United States Patent 12,624,385 (RIBOREGULATORS AND METHODS OF USE THEREOF) - sequence listing, part 3

SEQ ID NO: 32888 - DNA, 103 bp, Artificial Sequence
  Synthetic Polynucleotide
taatacgactcactatagggagattccaacaccaaggaaatacttaacacaacagaggagagtgttaatgatttccttgaacctggcggcagcgcaaaagatg

SEQ ID NO: 32889 - DNA, 103 bp, Artificial Sequence
  Synthetic Polynucleotide
taatacgactcactatagggtagagtgtgcgccaaatagcaggttccaacaacagaggagagttggaatgtgctatttgaacctggcggcagcgcaaaagatg

SEQ ID NO: 32890 - DNA, 103 bp, Artificial Sequence
  Synthetic Polynucleotide
taatacgactcactatagggttcatggccgtcgccgttccggcaactacaaacagaggagatgtagtatgcggaacggcaacctggcggcagcgcaaaagatg

SEQ ID NO: 32891 - DNA, 103 bp, Artificial Sequence
  Synthetic Polynucleotide
taatacgactcactataggggcgctaatgacctatatggtcaggtgaatgaacagaggagacattcaatggaccatataaacctggcggcagcgcaaaagatg

SEQ ID NO: 32892 - DNA, 103 bp, Artificial Sequence
  Synthetic Polynucleotide
taatacgactcactatagggacggtgacgaaagacagcgttagagtacataacagaggagaatgtacatgaacgctgtcaacctggcggcagcgcaaaagatg

SEQ ID NO: 32893 - DNA, 103 bp, Artificial Sequence
  Synthetic Polynucleotide
taatacgactcactataggggcgacttggtcgatcgtcccgtacctgaaaaacagaggagatttcagatgcgggacgataacctggcggcagcgcaaaagatg

SEQ ID NO: 32894 - DNA, 103 bp, Artificial Sequence
  Synthetic Polynucleotide
taatacgactcactataggggaacggctgttatgccttcaattctctcctaacagaggagaaggagaatgttgaaggcaaacctggcggcagcgcaaaagatg

SEQ ID NO: 32895 - DNA, 103 bp, Artificial Sequence
  Synthetic Polynucleotide
taatacgactcactatagggaagccctttaaccgttaatcgcgagttgccaacagaggagaggcaacatgcgattaacgaacctggcggcagcgcaaaagatg

SEQ ID NO: 32896 - DNA, 103 bp, Artificial Sequence
  Synthetic Polynucleotide
taatacgactcactatagggtagtagggcgagggttatgggaaggcgataaacagaggagatatcgcatgcccataaccaacctggcggcagcgcaaaagatg

SEQ ID NO: 32897 - DNA, 103 bp, Artificial Sequence
  Synthetic Polynucleotide
taatacgactcactatagggctgccaagatatgacagcctatagcacgggaacagaggagacccgtgatgtaggctgtcaacctggcggcagcgcaaaagatg

SEQ ID NO: 32898 - DNA, 103 bp, Artificial Sequence
  Synthetic Polynucleotide
taatacgactcactatagggcaattagggcacatgatcatgtaatgtgtaaacagaggagatacacaatgcatgatcataacctggcggcagcgcaaaagatg

SEQ ID NO: 32899 - DNA, 103 bp, Artificial Sequence
  Synthetic Polynucleotide
taatacgactcactatagggagtgagttactgattgttttcattgaatgaaacagaggagatcattcatggaaaacaataacctggcggcagcgcaaaagatg

SEQ ID NO: 32900 - DNA, 103 bp, Artificial Sequence
  Synthetic Polynucleotide
taatacgactcactatagggatagaatacgattaagctactatctcattcaacagaggagagaatgaatgagtagcttaaacctggcggcagcgcaaaagatg

SEQ ID NO: 32901 - DNA, 103 bp, Artificial Sequence
  Synthetic Polynucleotide
taatacgactcactatagggcctggatgactataaaagtcgcattctgtcaacagaggagagacagaatgcgacttttaaacctggcggcagcgcaaaagatg

SEQ ID NO: 32902 - DNA, 103 bp, Artificial Sequence
  Synthetic Polynucleotide
taatacgactcactatagggggataagctgagcagaaagaccgatcgtctaacagaggagaagacgaatggtctttctgaacctggcggcagcgcaaaagatg

SEQ ID NO: 32903 - DNA, 103 bp, Artificial Sequence
  Synthetic Polynucleotide
taatacgactcactataggggcgactgtacactacttcaagcctccgaaaaacagaggagatttcggatgcttgaagtaaacctggcggcagcgcaaaagatg

SEQ ID NO: 32904 - DNA, 103 bp, Artificial Sequence
  Synthetic Polynucleotide
taatacgactcactataggggttaaccagtgagggggagtatggaacctcaacagaggagagaggttatgtactcccccaacctggcggcagcgcaaaagatg

SEQ ID NO: 32905 - DNA, 103 bp, Artificial Sequence
  Synthetic Polynucleotide
taatacgactcactatagggccgtgacatcgggcattttcggtgagtcttaacagaggagaaagactatgcgaaaatgcaacctggcggcagcgcaaaagatg

SEQ ID NO: 32906 - DNA, 103 bp, Artificial Sequence
  Synthetic Polynucleotide
taatacgactcactatagggttaacgtcgggctggcacggccgttacagcaacagaggagagctgtaatggccgtgccaaacctggcggcagcgcaaaagatg

SEQ ID NO: 32907 - DNA, 103 bp, Artificial Sequence
  Synthetic Polynucleotide
taatacgactcactatagggcactcagactggaggcagtgcaatcgccgcaacagaggagagcggcgatggcactgcctaacctggcggcagcgcaaaagatg

SEQ ID NO: 32908 - DNA, 103 bp, Artificial Sequence
  Synthetic Polynucleotide
taatacgactcactatagggctctctgtggtaatgccagtcaggtatccaaacagaggagatggataatggactggcataacctggcggcagcgcaaaagatg

SEQ ID NO: 32909 - DNA, 103 bp, Artificial Sequence
  Synthetic Polynucleotide
taatacgactcactatagggtgttgctattgaaactatcacggctgccgaaacagaggagatcggcaatggtgatagttaacctggcggcagcgcaaaagatg

SEQ ID NO: 32910 - DNA, 103 bp, Artificial Sequence
  Synthetic Polynucleotide
taatacgactcactatagggatttcacccaaaaagcaatggtgagctacgaacagaggagacgtagcatgccattgcttaacctggcggcagcgcaaaagatg

SEQ ID NO: 32911 - DNA, 103 bp, Artificial Sequence
  Synthetic Polynucleotide
taatacgactcactatagggtatcgcttatgtgttcaggctgaagtggacaacagaggagagtccacatgagcctgaacaacctggcggcagcgcaaaagatg

SEQ ID NO: 32912 - DNA, 103 bp, Artificial Sequence
  Synthetic Polynucleotide
taatacgactcactataggggaggcggtttctccgtccaccgtgctatccaacagaggagaggatagatgggtggacggaacctggcggcagcgcaaaagatg

SEQ ID NO: 32913 - DNA, 103 bp, Artificial Sequence
  Synthetic Polynucleotide
taatacgactcactatagggtactatggctctgggactgcacctccggcgaacagaggagacgccggatgtgcagtcccaacctggcggcagcgcaaaagatg

SEQ ID NO: 32914 - DNA, 103 bp, Artificial Sequence
  Synthetic Polynucleotide
taatacgactcactatagggcacgtcaattcgattctctcgagtggaacgaacagaggagacgttccatgcgagagaataacctggcggcagcgcaaaagatg

SEQ ID NO: 32915 - DNA, 103 bp, Artificial Sequence
  Synthetic Polynucleotide
taatacgactcactatagggagctcatcgatagcagaaccaattacaccgaacagaggagacggtgtatgtggttctgcaacctggcggcagcgcaaaagatg

SEQ ID NO: 32916 - DNA, 103 bp, Artificial Sequence
  Synthetic Polynucleotide
taatacgactcactatagggcggctagcaaaggcggtagtcagccttttgaacagaggagacaaaagatggactaccgcaacctggcggcagcgcaaaagatg

SEQ ID NO: 32917 - DNA, 103 bp, Artificial Sequence
  Synthetic Polynucleotide
taatacgactcactatagggtaataggtggtgcaccgctgccctattagtaacagaggagaactaatatggcagcggtgaacctggcggcagcgcaaaagatg

SEQ ID NO: 32918 - DNA, 103 bp, Artificial Sequence
  Synthetic Polynucleotide
taatacgactcactataggggtagcgggtatacttcccgtatcgcactagaacagaggagactagtgatgtacgggaagaacctggcggcagcgcaaaagatg

SEQ ID NO: 32919 - DNA, 103 bp, Artificial Sequence
  Synthetic Polynucleotide
taatacgactcactataggggtcgggtgcttcgctaaacacatatcactaaacagaggagatagtgaatggtgtttagcaacctggcggcagcgcaaaagatg

SEQ ID NO: 32920 - DNA, 103 bp, Artificial Sequence
  Synthetic Polynucleotide
taatacgactcactataggggcatgagtcatcttcgtgatatgatcgaataacagaggagaattcgaatgtatcacgaaaacctggcggcagcgcaaaagatg

SEQ ID NO: 32921 - DNA, 103 bp, Artificial Sequence
  Synthetic Polynucleotide
taatacgactcactatagggggtacagtctaaacaatgtttcacctcataaacagaggagatatgagatgaaacattgtaacctggcggcagcgcaaaagatg

SEQ ID NO: 32922 - DNA, 103 bp, Artificial Sequence
  Synthetic Polynucleotide
taatacgactcactatagggacgctactcttaccctttactttgcgcttaaacagaggagataagcgatgagtaaagggaacctggcggcagcgcaaaagatg

SEQ ID NO: 32923 - DNA, 103 bp, Artificial Sequence
  Synthetic Polynucleotide
taatacgactcactatagggtaaattgcgtacgtgagaccgtttttactcaacagaggagagagtaaatgcggtctcacaacctggcggcagcgcaaaagatg

SEQ ID NO: 32924 - DNA, 103 bp, Artificial Sequence
  Synthetic Polynucleotide
taatacgactcactatagggtagaccccttccaggtatttcgggttggtcaacagaggagagaccaaatggaaatacctaacctggcggcagcgcaaaagatg

SEQ ID NO: 32925 - DNA, 103 bp, Artificial Sequence
  Synthetic Polynucleotide
taatacgactcactatagggattccagccattttaaagcgtgatgtgtgaaacagaggagatcacacatgacgctttaaaacctggcggcagcgcaaaagatg

SEQ ID NO: 32926 - DNA, 103 bp, Artificial Sequence
  Synthetic Polynucleotide
taatacgactcactatagggcccagctgctggagctgccatttaccccttaacagaggagaaaggggatgatggcagctaacctggcggcagcgcaaaagatg

SEQ ID NO: 32927 - DNA, 103 bp, Artificial Sequence
  Synthetic Polynucleotide
taatacgactcactatagggaagcgatatacaaatttggtgcacgctcagaacagaggagactgagcatgcaccaaattaacctggcggcagcgcaaaagatg

SEQ ID NO: 32928 - DNA, 103 bp, Artificial Sequence
  Synthetic Polynucleotide
taatacgactcactataggggtataaggcgccgcgtatccttgttcacaaaacagaggagattgtgaatgaggatacgcaacctggcggcagcgcaaaagatg

SEQ ID NO: 32929 - DNA, 103 bp, Artificial Sequence
  Synthetic Polynucleotide
taatacgactcactatagggccatcaagagaggcgcatagtttgcatggtaacagaggagaaccatgatgactatgcgcaacctggcggcagcgcaaaagatg

SEQ ID NO: 32930 - DNA, 103 bp, Artificial Sequence
  Synthetic Polynucleotide
taatacgactcactatagggattgccaatctcccactccgcgtctctgcaaacagaggagatgcagaatggcggagtggaacctggcggcagcgcaaaagatg

SEQ ID NO: 32931 - DNA, 103 bp, Artificial Sequence
  Synthetic Polynucleotide
taatacgactcactatagggggtcgacacctgtagagcccaggctgcgctaacagaggagaagcgcaatgtgggctctaaacctggcggcagcgcaaaagatg

SEQ ID NO: 32932 - DNA, 103 bp, Artificial Sequence
  Synthetic Polynucleotide
taatacgactcactatagggtgtttttccgagttacatgtagctcacatcaacagaggagagatgtgatgtacatgtaaaacctggcggcagcgcaaaagatg

SEQ ID NO: 32933 - DNA, 103 bp, Artificial Sequence
  Synthetic Polynucleotide
taatacgactcactatagggtaccccgacgccaggagcagctacaaatctaacagaggagaagatttatggctgctcctaacctggcggcagcgcaaaagatg

SEQ ID NO: 32934 - DNA, 103 bp, Artificial Sequence
  Synthetic Polynucleotide
taatacgactcactataggggaagtatagtcgttaggagctcgtggagacaacagaggagagtctccatgagctcctaaaacctggcggcagcgcaaaagatg

SEQ ID NO: 32935 - DNA, 103 bp, Artificial Sequence
  Synthetic Polynucleotide
taatacgactcactataggggtaacgctatcagggtggggacacctgaacaacagaggagagttcagatgtccccacccaacctggcggcagcgcaaaagatg

SEQ ID NO: 32936 - DNA, 103 bp, Artificial Sequence
  Synthetic Polynucleotide
taatacgactcactatagggaaagaacagccttaagtttaatttgattgcaacagaggagagcaatcatgttaaacttaaacctggcggcagcgcaaaagatg

SEQ ID NO: 32937 - DNA, 103 bp, Artificial Sequence
  Synthetic Polynucleotide
taatacgactcactataggggtatagctgtttttcgaaccaaatatgaaaaacagaggagatttcatatgtggttcgaaaacctggcggcagcgcaaaagatg

SEQ ID NO: 32938 - DNA, 103 bp, Artificial Sequence
  Synthetic Polynucleotide
taatacgactcactatagggatgctcatggtaggcatagtggggcaagctaacagaggagaagcttgatgcactatgccaacctggcggcagcgcaaaagatg

SEQ ID NO: 32939 - DNA, 103 bp, Artificial Sequence
  Synthetic Polynucleotide
taatacgactcactataggggatatcttcggcgacatgtggcctcccaggaacagaggagacctgggatgccacatgtcaacctggcggcagcgcaaaagatg

SEQ ID NO: 32940 - DNA, 103 bp, Artificial Sequence
  Synthetic Polynucleotide
taatacgactcactataggggaccctggcttgcgcgttggcgtaggcacaaacagaggagatgtgccatggccaacgcgaacctggcggcagcgcaaaagatg

SEQ ID NO: 32941 - DNA, 103 bp, Artificial Sequence
  Synthetic Polynucleotide
taatacgactcactataggggcacattgaatttgggttatataacaggctaacagaggagaagcctgatgtataacccaaacctggcggcagcgcaaaagatg

SEQ ID NO: 32942 - DNA, 103 bp, Artificial Sequence
  Synthetic Polynucleotide
taatacgactcactatagggcgtccagggttcattagatatatgacgcggaacagaggagaccgcgtatgatatctaataacctggcggcagcgcaaaagatg

SEQ ID NO: 32943 - DNA, 103 bp, Artificial Sequence
  Synthetic Polynucleotide
taatacgactcactatagggagggcgcatgtgggaacaaagtgcgtgcagaacagaggagactgcacatgctttgttccaacctggcggcagcgcaaaagatg

SEQ ID NO: 32944 - DNA, 103 bp, Artificial Sequence
  Synthetic Polynucleotide
taatacgactcactataggggtacgcggactacagagtcgtgaactaccgaacagaggagacggtagatgacgactctgaacctggcggcagcgcaaaagatg

SEQ ID NO: 32945 - DNA, 103 bp, Artificial Sequence
  Synthetic Polynucleotide
taatacgactcactatagggagctaaccacacacaaggcatcgaccgcgaaacagaggagatcgcggatgatgccttgtaacctggcggcagcgcaaaagatg

SEQ ID NO: 32946 - DNA, 103 bp, Artificial Sequence
  Synthetic Polynucleotide
taatacgactcactatagggcactggaattaaacaacatgcccccgcgataacagaggagaatcgcgatggcatgttgtaacctggcggcagcgcaaaagatg

SEQ ID NO: 32947 - DNA, 103 bp, Artificial Sequence
  Synthetic Polynucleotide
taatacgactcactataggggggcgcttgagcattgtagccccccctcaaaacagaggagattgaggatgggctacaataacctggcggcagcgcaaaagatg

SEQ ID NO: 32948 - DNA, 103 bp, Artificial Sequence
  Synthetic Polynucleotide
taatacgactcactatagggtcgagttcggcagttacgatggcttggcaaaacagaggagattgccaatgcatcgtaacaacctggcggcagcgcaaaagatg

SEQ ID NO: 32949 - DNA, 103 bp, Artificial Sequence
  Synthetic Polynucleotide
taatacgactcactatagggtgtgtgtttctccgtcaggtaactacagcaaacagaggagatgctgtatgtacctgacgaacctggcggcagcgcaaaagatg

SEQ ID NO: 32950 - DNA, 103 bp, Artificial Sequence
  Synthetic Polynucleotide
taatacgactcactatagggacagcaatatcaagcttcccgaccgtggacaacagaggagagtccacatgcgggaagctaacctggcggcagcgcaaaagatg

SEQ ID NO: 32951 - DNA, 103 bp, Artificial Sequence
  Synthetic Polynucleotide
taatacgactcactatagggccgtttggttagagcgggttggctaactgtaacagaggagaacagttatgcaacccgctaacctggcggcagcgcaaaagatg

SEQ ID NO: 32952 - DNA, 103 bp, Artificial Sequence
  Synthetic Polynucleotide
taatacgactcactatagggcacatgcagaaacttccctcatacaatcggaacagaggagaccgattatgtgagggaagaacctggcggcagcgcaaaagatg

SEQ ID NO: 32953 - DNA, 103 bp, Artificial Sequence
  Synthetic Polynucleotide
taatacgactcactatagggtctcaagggtccgttacctctcgaagtggcaacagaggagagccactatgagaggtaacaacctggcggcagcgcaaaagatg

SEQ ID NO: 32954 - DNA, 103 bp, Artificial Sequence
  Synthetic Polynucleotide
taatacgactcactatagggagcggccgttcaccacttcctcattacttaaacagaggagataagtaatgaggaagtggaacctggcggcagcgcaaaagatg

SEQ ID NO: 32955 - DNA, 103 bp, Artificial Sequence
  Synthetic Polynucleotide
taatacgactcactatagggccggctcacgttacggcgcagtactttaacaacagaggagagttaaaatgctgcgccgtaacctggcggcagcgcaaaagatg

SEQ ID NO: 32956 - DNA, 103 bp, Artificial Sequence
  Synthetic Polynucleotide
taatacgactcactatagggccaaaaggattctaccatggaatcttcggcaacagaggagagccgaaatgtccatggtaaacctggcggcagcgcaaaagatg

SEQ ID NO: 32957 - DNA, 103 bp, Artificial Sequence
  Synthetic Polynucleotide
taatacgactcactatagggctggaatcaaggcggtccaaatatggtgttaacagaggagaaacaccatgtttggaccgaacctggcggcagcgcaaaagatg

SEQ ID NO: 32958 - DNA, 103 bp, Artificial Sequence
  Synthetic Polynucleotide
taatacgactcactatagggttttaccgttttaaccggacacccggctgtaacagaggagaacagccatgtgtccggttaacctggcggcagcgcaaaagatg

SEQ ID NO: 32959 - DNA, 103 bp, Artificial Sequence
  Synthetic Polynucleotide
taatacgactcactatagggtcatttgaaaaagtcggccgtttactttgaaacagaggagatcaaagatgacggccgacaacctggcggcagcgcaaaagatg

SEQ ID NO: 32960 - DNA, 103 bp, Artificial Sequence
  Synthetic Polynucleotide
taatacgactcactatagggacaacttgggggtacttcattgcaaaaaacaacagaggagagtttttatgaatgaagtaaacctggcggcagcgcaaaagatg

SEQ ID NO: 32961 - DNA, 103 bp, Artificial Sequence
  Synthetic Polynucleotide
taatacgactcactatagggctaatcaggcaatcagtgcgtgtaaggaccaacagaggagaggtcctatgacgcactgaaacctggcggcagcgcaaaagatg

SEQ ID NO: 32962 - DNA, 103 bp, Artificial Sequence
  Synthetic Polynucleotide
taatacgactcactataggggtgcatatactggtcctggggggggactctaacagaggagaagagtcatgccccaggacaacctggcggcagcgcaaaagatg

SEQ ID NO: 32963 - DNA, 103 bp, Artificial Sequence
  Synthetic Polynucleotide
taatacgactcactatagggcaatatagacgataagtttgtcactgattcaacagaggagagaatcaatgacaaacttaaacctggcggcagcgcaaaagatg

SEQ ID NO: 32964 - DNA, 103 bp, Artificial Sequence
  Synthetic Polynucleotide
taatacgactcactatagggattagatcacgacacgaaattcttagtccgaacagaggagacggactatgaatttcgtgaacctggcggcagcgcaaaagatg

SEQ ID NO: 32965 - DNA, 103 bp, Artificial Sequence
  Synthetic Polynucleotide
taatacgactcactatagggtaaggccaccagacagatccagatccctagaacagaggagactagggatgtggatctgtaacctggcggcagcgcaaaagatg

SEQ ID NO: 32966 - DNA, 103 bp, Artificial Sequence
  Synthetic Polynucleotide
taatacgactcactatagggggatatggagagagtttatgaacgcatagaaacagaggagatctatgatgtcataaactaacctggcggcagcgcaaaagatg

SEQ ID NO: 32967 - DNA, 103 bp, Artificial Sequence
  Synthetic Polynucleotide
taatacgactcactatagggccgaatgtgttgtaattgtatgaatttcccaacagaggagagggaaaatgatacaattaaacctggcggcagcgcaaaagatg

SEQ ID NO: 32968 - DNA, 103 bp, Artificial Sequence
  Synthetic Polynucleotide
taatacgactcactatagggccgacgctaatgcttggctgggcattaaataacagaggagaatttaaatgccagccaagaacctggcggcagcgcaaaagatg

SEQ ID NO: 32969 - DNA, 103 bp, Artificial Sequence
  Synthetic Polynucleotide
taatacgactcactatagggcccaactggtggtttcattcgtcgtccgtgaacagaggagacacggaatgcgaatgaaaaacctggcggcagcgcaaaagatg

SEQ ID NO: 32970 - DNA, 103 bp, Artificial Sequence
  Synthetic Polynucleotide
taatacgactcactatagggcgaggcagcattgatccttcatggcagtagaacagaggagactactgatgtgaaggatcaacctggcggcagcgcaaaagatg

SEQ ID NO: 32971 - DNA, 103 bp, Artificial Sequence
  Synthetic Polynucleotide
taatacgactcactatagggggcaaagacttgcggatatgtcgatttacaaacagaggagatgtaaaatgacatatccgaacctggcggcagcgcaaaagatg

SEQ ID NO: 32972 - DNA, 103 bp, Artificial Sequence
  Synthetic Polynucleotide
taatacgactcactatagggggtttcatttcgtctaagcccatagaagaaaacagaggagattcttcatggggcttagaaacctggcggcagcgcaaaagatg

SEQ ID NO: 32973 - DNA, 103 bp, Artificial Sequence
  Synthetic Polynucleotide
taatacgactcactataggggatgattttccgtttgcgggacccagtgagaacagaggagactcactatgtcccgcaaaaacctggcggcagcgcaaaagatg

SEQ ID NO: 32974 - DNA, 103 bp, Artificial Sequence
  Synthetic Polynucleotide
taatacgactcactatagggacatgaccaattgggcgatgggacgtatgtaacagaggagaacatacatgccatcgcccaacctggcggcagcgcaaaagatg

SEQ ID NO: 32975 - DNA, 103 bp, Artificial Sequence
  Synthetic Polynucleotide
taatacgactcactataggggatcagacggcattctggtccggggctatgaacagaggagacatagcatgggaccagaaaacctggcggcagcgcaaaagatg

SEQ ID NO: 32976 - DNA, 103 bp, Artificial Sequence
  Synthetic Polynucleotide
taatacgactcactatagggcctatgacttccaaaatagtagtctcgaagaacagaggagacttcgaatgtactattttaacctggcggcagcgcaaaagatg

SEQ ID NO: 32977 - DNA, 103 bp, Artificial Sequence
  Synthetic Polynucleotide
taatacgactcactatagggggcgggtgagtaggaagacattgtccaggaaacagaggagatcctggatgatgtcttccaacctggcggcagcgcaaaagatg

SEQ ID NO: 32978 - DNA, 103 bp, Artificial Sequence
  Synthetic Polynucleotide
taatacgactcactatagggttcagagacgaccatagaaggtcactccgaaacagaggagatcggagatgccttctatgaacctggcggcagcgcaaaagatg

SEQ ID NO: 32979 - DNA, 103 bp, Artificial Sequence
  Synthetic Polynucleotide
taatacgactcactataggggtctcaccagcggagctcggggagaaatgaaacagaggagatcatttatgcccgagctcaacctggcggcagcgcaaaagatg

SEQ ID NO: 32980 - DNA, 103 bp, Artificial Sequence
  Synthetic Polynucleotide
taatacgactcactatagggtagcctgggtactcaaagcaatgcttgctgaacagaggagacagcaaatgttgctttgaaacctggcggcagcgcaaaagatg

SEQ ID NO: 32981 - DNA, 103 bp, Artificial Sequence
  Synthetic Polynucleotide
taatacgactcactatagggtatctgccattaccactgcacaatacgagaaacagaggagatctcgtatggtgcagtggaacctggcggcagcgcaaaagatg

SEQ ID NO: 32982 - DNA, 103 bp, Artificial Sequence
  Synthetic Polynucleotide
taatacgactcactatagggtcgaatacttacgaaaaggagtcgaggcttaacagaggagaaagcctatgctccttttcaacctggcggcagcgcaaaagatg

SEQ ID NO: 32983 - DNA, 103 bp, Artificial Sequence
  Synthetic Polynucleotide
taatacgactcactatagggctgtaaattttgcttcatgttcatgtagttaacagaggagaaactacatgaacatgaagaacctggcggcagcgcaaaagatg

SEQ ID NO: 32984 - DNA, 103 bp, Artificial Sequence
  Synthetic Polynucleotide
taatacgactcactatagggaatcaacagtggactttcctatttatccacaacagaggagagtggatatgtaggaaagtaacctggcggcagcgcaaaagatg

SEQ ID NO: 32985 - DNA, 103 bp, Artificial Sequence
  Synthetic Polynucleotide
taatacgactcactatagggcataagtccaccagatgcttactggccccaaacagaggagatggggcatgtaagcatctaacctggcggcagcgcaaaagatg

SEQ ID NO: 32986 - DNA, 103 bp, Artificial Sequence
  Synthetic Polynucleotide
taatacgactcactataggggcattacagaactaccccggaattattcccaacagaggagagggaatatgtccggggtaaacctggcggcagcgcaaaagatg

SEQ ID NO: 32987 - DNA, 103 bp, Artificial Sequence
  Synthetic Polynucleotide
taatacgactcactatagggtacattattaactagcgcctctgtagtaccaacagaggagaggtactatggaggcgctaaacctggcggcagcgcaaaagatg

SEQ ID NO: 32988 - DNA, 103 bp, Artificial Sequence
  Synthetic Polynucleotide
taatacgactcactatagggcgcattaccttcgcggaccatcttcatagtaacagaggagaactatgatgatggtccgcaacctggcggcagcgcaaaagatg

SEQ ID NO: 32989 - DNA, 103 bp, Artificial Sequence
  Synthetic Polynucleotide
taatacgactcactatagggacttaaaggtgattccaaggatgcatcggcaacagaggagagccgatatgtccttggaaaacctggcggcagcgcaaaagatg

SEQ ID NO: 32990 - DNA, 103 bp, Artificial Sequence
  Synthetic Polynucleotide
taatacgactcactatagggatgcttaaggtaagcctgggatcagtccttaacagaggagaaaggacatgtcccaggctaacctggcggcagcgcaaaagatg

SEQ ID NO: 32991 - DNA, 103 bp, Artificial Sequence
  Synthetic Polynucleotide
taatacgactcactataggggttttgcaataccgtatctttaatccttaaaacagaggagattaaggatgaaagatacgaacctggcggcagcgcaaaagatg

SEQ ID NO: 32992 - DNA, 103 bp, Artificial Sequence
  Synthetic Polynucleotide
taatacgactcactatagggaactccaactagctgtgattaaacgaaccaaacagaggagatggttcatgtaatcacagaacctggcggcagcgcaaaagatg

SEQ ID NO: 32993 - DNA, 103 bp, Artificial Sequence
  Synthetic Polynucleotide
taatacgactcactatagggataaatagctagtcagagtttactattcccaacagaggagagggaatatgaaactctgaaacctggcggcagcgcaaaagatg

SEQ ID NO: 32994 - DNA, 103 bp, Artificial Sequence
  Synthetic Polynucleotide
taatacgactcactatagggctgagtgttagtttggttaatttgcacttcaacagaggagagaagtgatgattaaccaaaacctggcggcagcgcaaaagatg

SEQ ID NO: 32995 - DNA, 103 bp, Artificial Sequence
  Synthetic Polynucleotide
taatacgactcactataggggaggtacgcataatgaaactcgcgtcagataacagaggagaatctgaatggagtttcataacctggcggcagcgcaaaagatg

SEQ ID NO: 32996 - DNA, 103 bp, Artificial Sequence
  Synthetic Polynucleotide
taatacgactcactataggggccttccgactacccggatggagccactcgaacagaggagacgagtgatgccatccgggaacctggcggcagcgcaaaagatg

SEQ ID NO: 32997 - DNA, 103 bp, Artificial Sequence
  Synthetic Polynucleotide
taatacgactcactatagggtactttacacgttttctgggccagtgcgcgaacagaggagacgcgcaatggcccagaaaaacctggcggcagcgcaaaagatg

SEQ ID NO: 32998 - DNA, 103 bp, Artificial Sequence
  Synthetic Polynucleotide
taatacgactcactatagggggctgccggagattactaactgttttcccgaacagaggagacgggaaatgagttagtaaaacctggcggcagcgcaaaagatg

SEQ ID NO: 32999 - DNA, 103 bp, Artificial Sequence
  Synthetic Polynucleotide
taatacgactcactatagggcttagcgctcccaaattcgtgaggtcaggtaacagaggagaacctgaatgcacgaatttaacctggcggcagcgcaaaagatg

SEQ ID NO: 33000 - DNA, 103 bp, Artificial Sequence
  Synthetic Polynucleotide
taatacgactcactataggggtgctatgttccgaataaatcagtttgtagaacagaggagactacaaatggatttattcaacctggcggcagcgcaaaagatg

SEQ ID NO: 33001 - DNA, 103 bp, Artificial Sequence
  Synthetic Polynucleotide
taatacgactcactatagggttcataaagatcgctttgcgaagcatacataacagaggagaatgtatatgtcgcaaagcaacctggcggcagcgcaaaagatg

SEQ ID NO: 33002 - DNA, 103 bp, Artificial Sequence
  Synthetic Polynucleotide
taatacgactcactatagggcagtgctctaattgttgccggcgcggggataacagaggagaatccccatgccggcaacaaacctggcggcagcgcaaaagatg

SEQ ID NO: 33003 - DNA, 103 bp, Artificial Sequence
  Synthetic Polynucleotide
taatacgactcactatagggcgcggctccaccttttcaacttgtgggtcaaacagaggagatgacccatgagttgaaaaaacctggcggcagcgcaaaagatg

SEQ ID NO: 33004 - DNA, 103 bp, Artificial Sequence
  Synthetic Polynucleotide
taatacgactcactataggggctaggttgcgctgtcgttgcggagttgggaacagaggagacccaacatggcaacgacaaacctggcggcagcgcaaaagatg

SEQ ID NO: 33005 - DNA, 103 bp, Artificial Sequence
  Synthetic Polynucleotide
taatacgactcactatagggatacaacatggtcccgggaaacgtgacgaaaacagaggagattcgtcatgtttcccgggaacctggcggcagcgcaaaagatg

SEQ ID NO: 33006 - DNA, 103 bp, Artificial Sequence
  Synthetic Polynucleotide
taatacgactcactataggggcgagcgagtcatgtaagagagaagaacataacagaggagaatgttcatgtctcttacaaacctggcggcagcgcaaaagatg

SEQ ID NO: 33007 - DNA, 103 bp, Artificial Sequence
  Synthetic Polynucleotide
taatacgactcactatagggttaagtaacatttgtctatggtaagtatccaacagaggagaggatacatgccatagacaaacctggcggcagcgcaaaagatg

SEQ ID NO: 33008 - DNA, 103 bp, Artificial Sequence
  Synthetic Polynucleotide
taatacgactcactataggggcacaaacttctcccgaagcatgtgagaagaacagaggagacttctcatgtgcttcgggaacctggcggcagcgcaaaagatg

SEQ ID NO: 33009 - DNA, 103 bp, Artificial Sequence
  Synthetic Polynucleotide
taatacgactcactatagggcaagagtcactcagcgattcgaaccagcataacagaggagaatgctgatgcgaatcgctaacctggcggcagcgcaaaagatg

SEQ ID NO: 33010 - DNA, 103 bp, Artificial Sequence
  Synthetic Polynucleotide
taatacgactcactatagggggcgtcgcggcgggcttgcaactcgtccagaacagaggagactggacatgttgcaagccaacctggcggcagcgcaaaagatg

SEQ ID NO: 33011 - DNA, 103 bp, Artificial Sequence
  Synthetic Polynucleotide
taatacgactcactatagggtcaacaaatcatagtggaggccaagactcaaacagaggagatgagtcatggcctccactaacctggcggcagcgcaaaagatg

SEQ ID NO: 33012 - DNA, 103 bp, Artificial Sequence
  Synthetic Polynucleotide
taatacgactcactatagggaaaggggggcaaaggtgcatccaggtgttcaacagaggagagaacacatggatgcacctaacctggcggcagcgcaaaagatg

SEQ ID NO: 33013 - DNA, 103 bp, Artificial Sequence
  Synthetic Polynucleotide
taatacgactcactatagggaagctgttttccgcggtgcactgaatgtccaacagaggagaggacatatggtgcaccgcaacctggcggcagcgcaaaagatg

SEQ ID NO: 33014 - DNA, 103 bp, Artificial Sequence
  Synthetic Polynucleotide
taatacgactcactatagggtccacggcttactcagggctttttcgaaccaacagaggagaggttcgatgaagccctgaaacctggcggcagcgcaaaagatg

SEQ ID NO: 33015 - DNA, 103 bp, Artificial Sequence
  Synthetic Polynucleotide
taatacgactcactatagggctgacctctggtgttcgaactccgtatcttaacagaggagaaagataatgagttcgaacaacctggcggcagcgcaaaagatg

SEQ ID NO: 33016 - DNA, 103 bp, Artificial Sequence
  Synthetic Polynucleotide
taatacgactcactataggggtgatctacatttgttgacaacgtgttttcaacagaggagagaaaacatgttgtcaacaaacctggcggcagcgcaaaagatg

SEQ ID NO: 33017 - DNA, 103 bp, Artificial Sequence
  Synthetic Polynucleotide
taatacgactcactatagggtcgcttcgcccttgacagatctgcccactgaacagaggagacagtggatggatctgtcaaacctggcggcagcgcaaaagatg

SEQ ID NO: 33018 - DNA, 103 bp, Artificial Sequence
  Synthetic Polynucleotide
taatacgactcactatagggcaccgacctagaaattgagcctgtacggccaacagaggagaggccgtatgggctcaattaacctggcggcagcgcaaaagatg

SEQ ID NO: 33019 - DNA, 103 bp, Artificial Sequence
  Synthetic Polynucleotide
taatacgactcactatagggccagcttacgcacaacatcaacgccgtcataacagaggagaatgacgatgttgatgttgaacctggcggcagcgcaaaagatg

SEQ ID NO: 33020 - DNA, 103 bp, Artificial Sequence
  Synthetic Polynucleotide
taatacgactcactatagggtaggtaatatcttaacctgtaatcacgtcgaacagaggagacgacgtatgtacaggttaaacctggcggcagcgcaaaagatg

SEQ ID NO: 33021 - DNA, 103 bp, Artificial Sequence
  Synthetic Polynucleotide
taatacgactcactatagggcgtttgcttgcatggagcaatcctaaatttaacagaggagaaaatttatgattgctccaaacctggcggcagcgcaaaagatg

SEQ ID NO: 33022 - DNA, 103 bp, Artificial Sequence
  Synthetic Polynucleotide
taatacgactcactataggggaaatgcccgcgggtagacgcagactggggaacagaggagaccccagatggcgtctaccaacctggcggcagcgcaaaagatg

SEQ ID NO: 33023 - DNA, 103 bp, Artificial Sequence
  Synthetic Polynucleotide
taatacgactcactatagggcccgaaaccgttggacccccaacgaagctaaacagaggagatagcttatgtgggggtccaacctggcggcagcgcaaaagatg

SEQ ID NO: 33024 - DNA, 103 bp, Artificial Sequence
  Synthetic Polynucleotide
taatacgactcactatagggagcagagtcagaagtctatacactcttcccaacagaggagagggaagatggtatagactaacctggcggcagcgcaaaagatg

SEQ ID NO: 33025 - DNA, 103 bp, Artificial Sequence
  Synthetic Polynucleotide
taatacgactcactataggggattcacctcttgaattccttgatcgcatcaacagaggagagatgcgatgaaggaattcaacctggcggcagcgcaaaagatg

SEQ ID NO: 33026 - DNA, 103 bp, Artificial Sequence
  Synthetic Polynucleotide
taatacgactcactatagggacgcggggcaaccgtgaatagaggccttcaaacagaggagatgaaggatgctattcacgaacctggcggcagcgcaaaagatg

SEQ ID NO: 33027 - DNA, 103 bp, Artificial Sequence
  Synthetic Polynucleotide
taatacgactcactatagggactagttgtacgattagatgttgccatatcaacagaggagagatatgatgacatctaataacctggcggcagcgcaaaagatg

SEQ ID NO: 33028 - DNA, 103 bp, Artificial Sequence
  Synthetic Polynucleotide
taatacgactcactatagggttggaagccgatttatagggggccgaccgcaacagaggagagcggtcatgcccctataaaacctggcggcagcgcaaaagatg

SEQ ID NO: 33029 - DNA, 103 bp, Artificial Sequence
  Synthetic Polynucleotide
taatacgactcactatagggctgcgttctaggcagtttagttcgctggagaacagaggagactccagatgactaaactgaacctggcggcagcgcaaaagatg

SEQ ID NO: 33030 - DNA, 103 bp, Artificial Sequence
  Synthetic Polynucleotide
taatacgactcactataggggattccgtgtgatgaattgcccgtgtgacaaacagaggagatgtcacatgggcaattcaaacctggcggcagcgcaaaagatg

SEQ ID NO: 33031 - DNA, 103 bp, Artificial Sequence
  Synthetic Polynucleotide
taatacgactcactatagggccccgaagtctgactcgctatggcattaccaacagaggagaggtaatatgatagcgagtaacctggcggcagcgcaaaagatg

SEQ ID NO: 33032 - DNA, 103 bp, Artificial Sequence
  Synthetic Polynucleotide
taatacgactcactataggggccccgtaccccgggacgatcgattcagtcaacagaggagagactgaatggatcgtcccaacctggcggcagcgcaaaagatg

SEQ ID NO: 33033 - DNA, 103 bp, Artificial Sequence
  Synthetic Polynucleotide
taatacgactcactatagggtttcacaaacagcgcccgtcacccagaggcaacagaggagagcctctatgtgacgggcgaacctggcggcagcgcaaaagatg

SEQ ID NO: 33034 - DNA, 103 bp, Artificial Sequence
  Synthetic Polynucleotide
taatacgactcactataggggaagctctccaacgccgccacgttgaattcaacagaggagagaattcatggtggcggcgaacctggcggcagcgcaaaagatg

SEQ ID NO: 33035 - DNA, 103 bp, Artificial Sequence
  Synthetic Polynucleotide
taatacgactcactatagggtgacaacaggcccgttcaattctaggtgataacagaggagaatcaccatgaattgaacgaacctggcggcagcgcaaaagatg

SEQ ID NO: 33036 - DNA, 103 bp, Artificial Sequence
  Synthetic Polynucleotide
taatacgactcactatagggaggcaggtcatttcgggcttacattctatcaacagaggagagatagaatgtaagcccgaaacctggcggcagcgcaaaagatg

SEQ ID NO: 33037 - DNA, 103 bp, Artificial Sequence
  Synthetic Polynucleotide
taatacgactcactatagggttgccactccctcgcggcctcaaccttaccaacagaggagaggtaagatggaggccgcgaacctggcggcagcgcaaaagatg

SEQ ID NO: 33038 - DNA, 103 bp, Artificial Sequence
  Synthetic Polynucleotide
taatacgactcactatagggcttagctaaatattgttgtgcaagtaactgaacagaggagacagttaatggcacaacaaaacctggcggcagcgcaaaagatg

SEQ ID NO: 33039 - DNA, 103 bp, Artificial Sequence
  Synthetic Polynucleotide
taatacgactcactatagggtgtaatcggcgttctgtgttcagtctagtaaacagaggagatactagatggaacacagaaacctggcggcagcgcaaaagatg

SEQ ID NO: 33040 - DNA, 103 bp, Artificial Sequence
  Synthetic Polynucleotide
taatacgactcactataggggctaatgcatcaggaaaacttacatgagtgaacagaggagacactcaatgaagttttccaacctggcggcagcgcaaaagatg

SEQ ID NO: 33041 - DNA, 103 bp, Artificial Sequence
  Synthetic Polynucleotide
taatacgactcactataggggagcatatttctaaagtacatcatatggctaacagaggagaagccatatgatgtactttaacctggcggcagcgcaaaagatg

SEQ ID NO: 33042 - DNA, 103 bp, Artificial Sequence
  Synthetic Polynucleotide
taatacgactcactatagggtaattttgcccgcctggcactctaccaacgaacagaggagacgttggatgagtgccaggaacctggcggcagcgcaaaagatg

SEQ ID NO: 33043 - DNA, 103 bp, Artificial Sequence
  Synthetic Polynucleotide
taatacgactcactataggggttacagcatcgtccaatggcaattttacaaacagaggagatgtaaaatggccattggaaacctggcggcagcgcaaaagatg

SEQ ID NO: 33044 - DNA, 103 bp, Artificial Sequence
  Synthetic Polynucleotide
taatacgactcactatagggggcggggtgtctgggcctataaactggccgaacagaggagacggccaatgtataggcccaacctggcggcagcgcaaaagatg

SEQ ID NO: 33045 - DNA, 103 bp, Artificial Sequence
  Synthetic Polynucleotide
taatacgactcactatagggcatgcagggcaaccggaacccatatctcccaacagaggagagggagaatggggttccggaacctggcggcagcgcaaaagatg

SEQ ID NO: 33046 - DNA, 103 bp, Artificial Sequence
  Synthetic Polynucleotide
taatacgactcactatagggcacgcccaacacagactgcctctgtcctgcaacagaggagagcaggaatgaggcagtctaacctggcggcagcgcaaaagatg

SEQ ID NO: 33047 - DNA, 103 bp, Artificial Sequence
  Synthetic Polynucleotide
taatacgactcactatagggcagcctttaccggctgagacttggagactgaacagaggagacagtctatgagtctcagcaacctggcggcagcgcaaaagatg

SEQ ID NO: 33048 - DNA, 103 bp, Artificial Sequence
  Synthetic Polynucleotide
taatacgactcactatagggacttacaaacctctctagcaccagcgttggaacagaggagaccaacgatggtgctagagaacctggcggcagcgcaaaagatg

SEQ ID NO: 33049 - DNA, 103 bp, Artificial Sequence
  Synthetic Polynucleotide
taatacgactcactatagggcttagcaggcccattgggctgagtcgtaagaacagaggagacttacgatgcagcccaataacctggcggcagcgcaaaagatg

SEQ ID NO: 33050 - DNA, 103 bp, Artificial Sequence
  Synthetic Polynucleotide
taatacgactcactatagggtgaatatcctaatcttccggaaagcgaccgaacagaggagacggtcgatgtccggaagaaacctggcggcagcgcaaaagatg

SEQ ID NO: 33051 - DNA, 103 bp, Artificial Sequence
  Synthetic Polynucleotide
taatacgactcactatagggcaacgaatcagaatcaggcccgttaatccgaacagaggagacggattatggggcctgataacctggcggcagcgcaaaagatg

SEQ ID NO: 33052 - DNA, 103 bp, Artificial Sequence
  Synthetic Polynucleotide
taatacgactcactatagggggcgcgattctcattcgagatgcgcagacaaacagaggagatgtctgatgatctcgaataacctggcggcagcgcaaaagatg

SEQ ID NO: 33053 - DNA, 103 bp, Artificial Sequence
  Synthetic Polynucleotide
taatacgactcactatagggtgagctataccccctgtacaatgacactacaacagaggagagtagtgatgttgtacaggaacctggcggcagcgcaaaagatg

SEQ ID NO: 33054 - DNA, 103 bp, Artificial Sequence
  Synthetic Polynucleotide
taatacgactcactatagggagagtctagccattggggccagggggatcaaacagaggagatgatccatgtggccccaaaacctggcggcagcgcaaaagatg

SEQ ID NO: 33055 - DNA, 103 bp, Artificial Sequence
  Synthetic Polynucleotide
taatacgactcactataggggtatcaaagacagttataaggaatgtcgcgaacagaggagacgcgacatgccttataacaacctggcggcagcgcaaaagatg

SEQ ID NO: 33056 - DNA, 103 bp, Artificial Sequence
  Synthetic Polynucleotide
taatacgactcactatagggtacacctaatccgtgacattgttatcaggcaacagaggagagcctgaatgcaatgtcacaacctggcggcagcgcaaaagatg

SEQ ID NO: 33057 - DNA, 103 bp, Artificial Sequence
  Synthetic Polynucleotide
taatacgactcactatagggtattcaagggttatgtatataggctctcctaacagaggagaaggagaatgtatatacataacctggcggcagcgcaaaagatg

SEQ ID NO: 33058 - DNA, 103 bp, Artificial Sequence
  Synthetic Polynucleotide
taatacgactcactatagggttcgtctaccatatccgatagccattctccaacagaggagaggagaaatgctatcggataacctggcggcagcgcaaaagatg

SEQ ID NO: 33059 - DNA, 103 bp, Artificial Sequence
  Synthetic Polynucleotide
taatacgactcactatagggctgaacgtatggctgatcgaaagttaggggaacagaggagacccctaatgttcgatcagaacctggcggcagcgcaaaagatg

SEQ ID NO: 33060 - DNA, 103 bp, Artificial Sequence
  Synthetic Polynucleotide
taatacgactcactataggggagctcggtctccaatcttaacctaccgtaaacagaggagatacggtatgttaagattgaacctggcggcagcgcaaaagatg

SEQ ID NO: 33061 - DNA, 103 bp, Artificial Sequence
  Synthetic Polynucleotide
taatacgactcactataggggtagccggttgcgtggtatatgccggcaggaacagaggagacctgccatgatataccacaacctggcggcagcgcaaaagatg

SEQ ID NO: 33062 - DNA, 103 bp, Artificial Sequence
  Synthetic Polynucleotide
taatacgactcactatagggtccaaattataggggcggtcgtcgggtaggaacagaggagacctaccatgcgaccgcccaacctggcggcagcgcaaaagatg

SEQ ID NO: 33063 - DNA, 103 bp, Artificial Sequence
  Synthetic Polynucleotide
taatacgactcactataggggaattgacacattcgctcttgcccacgggcaacagaggagagcccgtatgcaagagcgaaacctggcggcagcgcaaaagatg

SEQ ID NO: 33064 - DNA, 103 bp, Artificial Sequence
  Synthetic Polynucleotide
taatacgactcactatagggagttcgtaagaacactcctgcccaaatcgcaacagaggagagcgattatggcaggagtgaacctggcggcagcgcaaaagatg

SEQ ID NO: 33065 - DNA, 103 bp, Artificial Sequence
  Synthetic Polynucleotide
taatacgactcactatagggcgaagactattctcatactcgggcgattaaaacagaggagattaatcatgcgagtatgaaacctggcggcagcgcaaaagatg

SEQ ID NO: 33066 - DNA, 103 bp, Artificial Sequence
  Synthetic Polynucleotide
taatacgactcactatagggctatcagtcacagatcggtcgctctaatctaacagaggagaagattaatgcgaccgatcaacctggcggcagcgcaaaagatg

SEQ ID NO: 33067 - DNA, 103 bp, Artificial Sequence
  Synthetic Polynucleotide
taatacgactcactatagggattgcagattggtacctacttgtagcaggaaacagaggagatcctgcatgaagtaggtaaacctggcggcagcgcaaaagatg

SEQ ID NO: 33068 - DNA, 103 bp, Artificial Sequence
  Synthetic Polynucleotide
taatacgactcactatagggcgccgtcggtaagcgcactctatccctataaacagaggagatataggatgagagtgcgcaacctggcggcagcgcaaaagatg

SEQ ID NO: 33069 - DNA, 103 bp, Artificial Sequence
  Synthetic Polynucleotide
taatacgactcactatagggatcggtagcaccaatcatcagtagtctcgtaacagaggagaacgagaatgctgatgattaacctggcggcagcgcaaaagatg

SEQ ID NO: 33070 - DNA, 103 bp, Artificial Sequence
  Synthetic Polynucleotide
taatacgactcactatagggttaacgtaccaactttgtcgcagtcgaaagaacagaggagactttcgatggcgacaaagaacctggcggcagcgcaaaagatg

SEQ ID NO: 33071 - DNA, 103 bp, Artificial Sequence
  Synthetic Polynucleotide
taatacgactcactataggggtgcaccgctaaggttgtgtcgttttacctaacagaggagaaggtaaatggacacaaccaacctggcggcagcgcaaaagatg

SEQ ID NO: 33072 - DNA, 103 bp, Artificial Sequence
  Synthetic Polynucleotide
taatacgactcactatagggattgaggttgcacacttgatattccgagataacagaggagaatctcgatgtatcaagtgaacctggcggcagcgcaaaagatg

SEQ ID NO: 33073 - DNA, 103 bp, Artificial Sequence
  Synthetic Polynucleotide
taatacgactcactatagggatgagagcgaggccgcgtgatcacgggtacaacagaggagagtacccatgatcacgcggaacctggcggcagcgcaaaagatg

SEQ ID NO: 33074 - DNA, 103 bp, Artificial Sequence
  Synthetic Polynucleotide
taatacgactcactatagggcctaactgctctaagatagcgaatgtggcaaacagaggagatgccacatgcgctatcttaacctggcggcagcgcaaaagatg

SEQ ID NO: 33075 - DNA, 103 bp, Artificial Sequence
  Synthetic Polynucleotide
taatacgactcactatagggagaatactcggaaagccatagtgtaaacggaacagaggagaccgtttatgctatggcttaacctggcggcagcgcaaaagatg

SEQ ID NO: 33076 - DNA, 103 bp, Artificial Sequence
  Synthetic Polynucleotide
taatacgactcactataggggcctcattcctctagtctgtccgtgaatataacagaggagaatattcatggacagactaaacctggcggcagcgcaaaagatg

SEQ ID NO: 33077 - DNA, 103 bp, Artificial Sequence
  Synthetic Polynucleotide
taatacgactcactataggggctatgttatgtattatctatttaaaaccgaacagaggagacggtttatgatagataataacctggcggcagcgcaaaagatg

SEQ ID NO: 33078 - DNA, 103 bp, Artificial Sequence
  Synthetic Polynucleotide
taatacgactcactatagggacaagcctcatatcggttggctgtgggtagaacagaggagactacccatggccaaccgaaacctggcggcagcgcaaaagatg

SEQ ID NO: 33079 - DNA, 103 bp, Artificial Sequence
  Synthetic Polynucleotide
taatacgactcactatagggtatctacccgatctcgtctccgcttattcaaacagaggagatgaataatgggagacgagaacctggcggcagcgcaaaagatg

SEQ ID NO: 33080 - DNA, 103 bp, Artificial Sequence
  Synthetic Polynucleotide
taatacgactcactatagggactacctaaatgacagcccagcgtgtcgcaaacagaggagatgcgacatgctgggctgtaacctggcggcagcgcaaaagatg

SEQ ID NO: 33081 - DNA, 103 bp, Artificial Sequence
  Synthetic Polynucleotide
taatacgactcactatagggcattctttctctgcaccgtcaatccgctgaaacagaggagatcagcgatgtgacggtgcaacctggcggcagcgcaaaagatg

SEQ ID NO: 33082 - DNA, 103 bp, Artificial Sequence
  Synthetic Polynucleotide
taatacgactcactatagggagcaacccaaggttttagcaatacttgtcaaacagaggagatgacaaatgttgctaaaaaacctggcggcagcgcaaaagatg

SEQ ID NO: 33083 - DNA, 103 bp, Artificial Sequence
  Synthetic Polynucleotide
taatacgactcactatagggggcagcaaacgtccaggcctatctctggaaaacagaggagattccagatgtaggcctggaacctggcggcagcgcaaaagatg

SEQ ID NO: 33084 - DNA, 103 bp, Artificial Sequence
  Synthetic Polynucleotide
taatacgactcactatagggagacgccctctagtcgagctccttgtgtacaacagaggagagtacacatggagctcgacaacctggcggcagcgcaaaagatg

SEQ ID NO: 33085 - DNA, 103 bp, Artificial Sequence
  Synthetic Polynucleotide
taatacgactcactatagggatggcctatactcgggggtaggcggataagaacagaggagacttatcatgctacccccgaacctggcggcagcgcaaaagatg

SEQ ID NO: 33086 - DNA, 103 bp, Artificial Sequence
  Synthetic Polynucleotide
taatacgactcactatagggtggaacgaaacttatacaagataacgtctgaacagaggagacagacgatgtcttgtataaacctggcggcagcgcaaaagatg

SEQ ID NO: 33087 - DNA, 103 bp, Artificial Sequence
  Synthetic Polynucleotide
taatacgactcactatagggaggcgggtgtacggtaactgaaaaactttaaacagaggagataaagtatgtcagttaccaacctggcggcagcgcaaaagatg

SEQ ID NO: 33088 - DNA, 103 bp, Artificial Sequence
  Synthetic Polynucleotide
taatacgactcactatagggactctgacaaatcctcggtaggttctttggaacagaggagaccaaagatgctaccgaggaacctggcggcagcgcaaaagatg

SEQ ID NO: 33089 - DNA, 103 bp, Artificial Sequence
  Synthetic Polynucleotide
taatacgactcactatagggaacatcactttagcctgttatagggttaacaacagaggagagttaacatgataacaggcaacctggcggcagcgcaaaagatg

SEQ ID NO: 33090 - DNA, 103 bp, Artificial Sequence
  Synthetic Polynucleotide
taatacgactcactatagggcggtttctttccctggtttaggaaagtgagaacagaggagactcactatgctaaaccagaacctggcggcagcgcaaaagatg

SEQ ID NO: 33091 - DNA, 103 bp, Artificial Sequence
  Synthetic Polynucleotide
taatacgactcactatagggaaccatggtgcacaagattcgcttttgattaacagaggagaaatcaaatgcgaatcttgaacctggcggcagcgcaaaagatg

SEQ ID NO: 33092 - DNA, 103 bp, Artificial Sequence
  Synthetic Polynucleotide
taatacgactcactatagggagtggctttccctcggaagggcttgtaagcaacagaggagagcttacatgcccttccgaaacctggcggcagcgcaaaagatg

SEQ ID NO: 33093 - DNA, 103 bp, Artificial Sequence
  Synthetic Polynucleotide
taatacgactcactatagggccgcgcttagaaagcggaaaaggggatagcaacagaggagagctatcatgttttccgctaacctggcggcagcgcaaaagatg

SEQ ID NO: 33094 - DNA, 103 bp, Artificial Sequence
  Synthetic Polynucleotide
taatacgactcactatagggggcgcgtctacctatttcacgtcctcaccgaacagaggagacggtgaatgcgtgaaataaacctggcggcagcgcaaaagatg

SEQ ID NO: 33095 - DNA, 103 bp, Artificial Sequence
  Synthetic Polynucleotide
taatacgactcactataggggtttattacgccgttacgaggtgcggggggaacagaggagaccccccatgcctcgtaacaacctggcggcagcgcaaaagatg

SEQ ID NO: 33096 - DNA, 103 bp, Artificial Sequence
  Synthetic Polynucleotide
taatacgactcactatagggcgtggctaacatcgtatttggttgagtactaacagaggagaagtactatgccaaatacgaacctggcggcagcgcaaaagatg

SEQ ID NO: 33097 - DNA, 103 bp, Artificial Sequence
  Synthetic Polynucleotide
taatacgactcactatagggccacggacaacagtcctgtcatttcatggtaacagaggagaaccatgatgtgacaggacaacctggcggcagcgcaaaagatg

SEQ ID NO: 33098 - DNA, 103 bp, Artificial Sequence
  Synthetic Polynucleotide
taatacgactcactatagggctgctccagttctcaatcattagggatgcgaacagaggagacgcatcatgaatgattgaaacctggcggcagcgcaaaagatg

SEQ ID NO: 33099 - DNA, 103 bp, Artificial Sequence
  Synthetic Polynucleotide
taatacgactcactatagggtccagcctttagtatctgagaggaaaggagaacagaggagactccttatgtctcagataaacctggcggcagcgcaaaagatg

SEQ ID NO: 33100 - DNA, 103 bp, Artificial Sequence
  Synthetic Polynucleotide
taatacgactcactatagggttcattggacgtggttagactcctgggtagaacagaggagactacccatgagtctaaccaacctggcggcagcgcaaaagatg

SEQ ID NO: 33101 - DNA, 103 bp, Artificial Sequence
  Synthetic Polynucleotide
taatacgactcactatagggttgctcgttttatcacgccgatcatgctgcaacagaggagagcagcaatgtcggcgtgaaacctggcggcagcgcaaaagatg

SEQ ID NO: 33102 - DNA, 103 bp, Artificial Sequence
  Synthetic Polynucleotide
taatacgactcactatagggccgatgggtgttacctgaagtggaacgctcaacagaggagagagcgtatgacttcaggtaacctggcggcagcgcaaaagatg

SEQ ID NO: 33103 - DNA, 103 bp, Artificial Sequence
  Synthetic Polynucleotide
taatacgactcactatagggctaagaagcgttaagtcaccggcgtgattgaacagaggagacaatcaatgcggtgacttaacctggcggcagcgcaaaagatg

SEQ ID NO: 33104 - DNA, 103 bp, Artificial Sequence
  Synthetic Polynucleotide
taatacgactcactatagggggtgtactcgatcatagatcagaggggactaacagaggagaagtcccatgtgatctatgaacctggcggcagcgcaaaagatg

SEQ ID NO: 33105 - DNA, 103 bp, Artificial Sequence
  Synthetic Polynucleotide
taatacgactcactatagggaaggcaaaccgctcaatacggcccgttaccaacagaggagaggtaacatgccgtattgaaacctggcggcagcgcaaaagatg

SEQ ID NO: 33106 - DNA, 103 bp, Artificial Sequence
  Synthetic Polynucleotide
taatacgactcactatagggtgatagaaggtttagtgctaccagctacgtaacagaggagaacgtagatggtagcactaaacctggcggcagcgcaaaagatg

SEQ ID NO: 33107 - DNA, 103 bp, Artificial Sequence
  Synthetic Polynucleotide
taatacgactcactatagggcaaggcgaactggaccgatcctatttaaaaaacagaggagattttaaatgggatcggtcaacctggcggcagcgcaaaagatg

SEQ ID NO: 33108 - DNA, 103 bp, Artificial Sequence
  Synthetic Polynucleotide
taatacgactcactatagggtttcttgtcaaccttagtttccgtaagtataacagaggagaatacttatggaaactaagaacctggcggcagcgcaaaagatg

SEQ ID NO: 33109 - DNA, 103 bp, Artificial Sequence
  Synthetic Polynucleotide
taatacgactcactatagggtagctgcggaggctagtccttaagaacaggaacagaggagacctgttatgaaggactagaacctggcggcagcgcaaaagatg

SEQ ID NO: 33110 - DNA, 103 bp, Artificial Sequence
  Synthetic Polynucleotide
taatacgactcactatagggcccaacggtcctaaagcgacccataaagtgaacagaggagacactttatgggtcgctttaacctggcggcagcgcaaaagatg

SEQ ID NO: 33111 - DNA, 103 bp, Artificial Sequence
  Synthetic Polynucleotide
taatacgactcactataggggatcccgcttacctttcgcaacttcctatcaacagaggagagataggatgttgcgaaagaacctggcggcagcgcaaaagatg

SEQ ID NO: 33112 - DNA, 103 bp, Artificial Sequence
  Synthetic Polynucleotide
taatacgactcactatagggagtagcgttcatttaattcggatctcggacaacagaggagagtccgaatgccgaattaaaacctggcggcagcgcaaaagatg

SEQ ID NO: 33113 - DNA, 103 bp, Artificial Sequence
  Synthetic Polynucleotide
taatacgactcactatagggccccactacctgcgtgttcgtctcacgaacaacagaggagagttcgtatgacgaacacgaacctggcggcagcgcaaaagatg

SEQ ID NO: 33114 - DNA, 103 bp, Artificial Sequence
  Synthetic Polynucleotide
taatacgactcactatagggtccgatatttcgctaattgaccgtctgcgtaacagaggagaacgcagatggtcaattagaacctggcggcagcgcaaaagatg

SEQ ID NO: 33115 - DNA, 103 bp, Artificial Sequence
  Synthetic Polynucleotide
taatacgactcactataggggtgcgaccagaggtctcaagatggtgacggaacagaggagaccgtcaatgtcttgagacaacctggcggcagcgcaaaagatg

SEQ ID NO: 33116 - DNA, 103 bp, Artificial Sequence
  Synthetic Polynucleotide
taatacgactcactatagggccctcggagaaacttggacagcacgaccggaacagaggagaccggtcatgctgtccaagaacctggcggcagcgcaaaagatg

SEQ ID NO: 33117 - DNA, 103 bp, Artificial Sequence
  Synthetic Polynucleotide
taatacgactcactatagggatagtaaggtgaggacgggagagggcggctaacagaggagaagccgcatgctcccgtccaacctggcggcagcgcaaaagatg

SEQ ID NO: 33118 - DNA, 103 bp, Artificial Sequence
  Synthetic Polynucleotide
taatacgactcactatagggacaatcccgaggacgccggtcttgccgagtaacagaggagaactcggatggaccggcgtaacctggcggcagcgcaaaagatg

SEQ ID NO: 33119 - DNA, 103 bp, Artificial Sequence
  Synthetic Polynucleotide
taatacgactcactataggggtggtggccctcatttctagacttttctacaacagaggagagtagaaatgtctagaaataacctggcggcagcgcaaaagatg

SEQ ID NO: 33120 - DNA, 103 bp, Artificial Sequence
  Synthetic Polynucleotide
taatacgactcactatagggccatattaggactaagggatccttcacatgaacagaggagacatgtgatggatcccttaaacctggcggcagcgcaaaagatg

SEQ ID NO: 33121 - DNA, 103 bp, Artificial Sequence
  Synthetic Polynucleotide
taatacgactcactataggggcgaggcgttctgaggtccatcccattggaaacagaggagatccaatatgatggacctcaacctggcggcagcgcaaaagatg

SEQ ID NO: 33122 - DNA, 103 bp, Artificial Sequence
  Synthetic Polynucleotide
taatacgactcactatagggccctgtgataactgtaatcctcgcagggggaacagaggagaccccctatgaggattacaaacctggcggcagcgcaaaagatg

SEQ ID NO: 33123 - DNA, 103 bp, Artificial Sequence
  Synthetic Polynucleotide
taatacgactcactatagggtctcaagccgtgcgatacccttttgatcacaacagaggagagtgatcatgagggtatcgaacctggcggcagcgcaaaagatg

SEQ ID NO: 33124 - DNA, 103 bp, Artificial Sequence
  Synthetic Polynucleotide
taatacgactcactatagggtacacattcgatcggatctttgcaatcttaaacagaggagataagatatgaaagatccgaacctggcggcagcgcaaaagatg

SEQ ID NO: 33125 - DNA, 103 bp, Artificial Sequence
  Synthetic Polynucleotide
taatacgactcactatagggccttgcccgagcttggctgaacgcctcccaaacagaggagatgggagatgttcagccaaaacctggcggcagcgcaaaagatg

SEQ ID NO: 33126 - DNA, 103 bp, Artificial Sequence
  Synthetic Polynucleotide
taatacgactcactatagggacaagggtgccccgaatttgcactagtactaacagaggagaagtactatggcaaattcgaacctggcggcagcgcaaaagatg

SEQ ID NO: 33127 - DNA, 103 bp, Artificial Sequence
  Synthetic Polynucleotide
taatacgactcactatagggaggcttattttccttgcaccctccctagtaaacagaggagatactagatggggtgcaagaacctggcggcagcgcaaaagatg

SEQ ID NO: 33128 - DNA, 103 bp, Artificial Sequence
  Synthetic Polynucleotide
taatacgactcactatagggcgcaaatgttaatgctttgccgatagtggaaacagaggagatccactatgggcaaagcaaacctggcggcagcgcaaaagatg

SEQ ID NO: 33129 - DNA, 103 bp, Artificial Sequence
  Synthetic Polynucleotide
taatacgactcactataggggagtgggcttcgggtatattaaacttctgtaacagaggagaacagaaatgtaatataccaacctggcggcagcgcaaaagatg

SEQ ID NO: 33130 - DNA, 103 bp, Artificial Sequence
  Synthetic Polynucleotide
taatacgactcactatagggtttactttcctcagacctgcttcgcccaaaaacagaggagatttgggatgagcaggtctaacctggcggcagcgcaaaagatg

SEQ ID NO: 33131 - DNA, 103 bp, Artificial Sequence
  Synthetic Polynucleotide
taatacgactcactatagggacccacaagaattctggctgaaaacatggaaacagaggagatccatgatgtcagccagaaacctggcggcagcgcaaaagatg

SEQ ID NO: 33132 - DNA, 103 bp, Artificial Sequence
  Synthetic Polynucleotide
taatacgactcactataggggggttcaagggttagggccaggatgccgcgaacagaggagacgcggcatgctggccctaaacctggcggcagcgcaaaagatg

SEQ ID NO: 33133 - DNA, 103 bp, Artificial Sequence
  Synthetic Polynucleotide
taatacgactcactatagggtggaatccttctggcaatcgtggcccgcagaacagaggagactgcggatgacgattgccaacctggcggcagcgcaaaagatg

SEQ ID NO: 33134 - DNA, 103 bp, Artificial Sequence
  Synthetic Polynucleotide
taatacgactcactatagggggcgtatggtgcacggccctgtcccccggaaacagaggagatccgggatgcagggccgtaacctggcggcagcgcaaaagatg

SEQ ID NO: 33135 - DNA, 103 bp, Artificial Sequence
  Synthetic Polynucleotide
taatacgactcactatagggagtcgtaaggaatgactcgagacgcgtgtaaacagaggagatacacgatgctcgagtcaaacctggcggcagcgcaaaagatg

SEQ ID NO: 33136 - DNA, 103 bp, Artificial Sequence
  Synthetic Polynucleotide
taatacgactcactatagggatccgggcgagttcgcggagagaccacaaaaacagaggagatttgtgatgtctccgcgaaacctggcggcagcgcaaaagatg

SEQ ID NO: 33137 - DNA, 103 bp, Artificial Sequence
  Synthetic Polynucleotide
taatacgactcactataggggcttataacgcacccagtgaacgtctcgtgaacagaggagacacgagatgttcactgggaacctggcggcagcgcaaaagatg

SEQ ID NO: 33138 - DNA, 103 bp, Artificial Sequence
  Synthetic Polynucleotide
taatacgactcactatagggaataagctttctcggacactacccaagcataacagaggagaatgcttatgtagtgtccgaacctggcggcagcgcaaaagatg

SEQ ID NO: 33139 - DNA, 103 bp, Artificial Sequence
  Synthetic Polynucleotide
taatacgactcactatagggtcgacgcacctgaagcggcacagattaatcaacagaggagagattaaatggtgccgcttaacctggcggcagcgcaaaagatg

SEQ ID NO: 33140 - DNA, 103 bp, Artificial Sequence
  Synthetic Polynucleotide
taatacgactcactataggggaccactcgtaaagcactctttgttgatacaacagaggagagtatcaatgaagagtgctaacctggcggcagcgcaaaagatg

SEQ ID NO: 33141 - DNA, 103 bp, Artificial Sequence
  Synthetic Polynucleotide
taatacgactcactatagggagaccacgtcgtacgagatatccaacttgaaacagaggagatcaagtatgatatctcgtaacctggcggcagcgcaaaagatg

SEQ ID NO: 33142 - DNA, 103 bp, Artificial Sequence
  Synthetic Polynucleotide
taatacgactcactatagggtgaactgtgcagtatgtcaattagcggcccaacagaggagagggccgatgattgacataaacctggcggcagcgcaaaagatg

SEQ ID NO: 33143 - DNA, 103 bp, Artificial Sequence
  Synthetic Polynucleotide
taatacgactcactatagggagctgattgacgtaatacgatataactgttaacagaggagaaacagtatgatcgtattaaacctggcggcagcgcaaaagatg

SEQ ID NO: 33144 - DNA, 103 bp, Artificial Sequence
  Synthetic Polynucleotide
taatacgactcactatagggtgcagttccttccacgtatgactctctgataacagaggagaatcagaatgtcatacgtgaacctggcggcagcgcaaaagatg

SEQ ID NO: 33145 - DNA, 103 bp, Artificial Sequence
  Synthetic Polynucleotide
taatacgactcactatagggtcccctacatgtgcctagaggtctgcggttaacagaggagaaaccgcatgcctctaggcaacctggcggcagcgcaaaagatg

SEQ ID NO: 33146 - DNA, 103 bp, Artificial Sequence
  Synthetic Polynucleotide
taatacgactcactataggggattgggtagccgtcacgcactatttagcgaacagaggagacgctaaatggtgcgtgacaacctggcggcagcgcaaaagatg

SEQ ID NO: 33147 - DNA, 103 bp, Artificial Sequence
  Synthetic Polynucleotide
taatacgactcactatagggatctatgaaacgggtccggaaggtattttaaacagaggagataaaatatgttccggaccaacctggcggcagcgcaaaagatg

SEQ ID NO: 33148 - DNA, 103 bp, Artificial Sequence
  Synthetic Polynucleotide
taatacgactcactatagggccctgggctctacaatcaaatacattgtccaacagaggagaggacaaatgatttgattgaacctggcggcagcgcaaaagatg

SEQ ID NO: 33149 - DNA, 103 bp, Artificial Sequence
  Synthetic Polynucleotide
taatacgactcactatagggttctaacatgctgctcgatccagcagcaccaacagaggagaggtgctatgggatcgagcaacctggcggcagcgcaaaagatg

SEQ ID NO: 33150 - DNA, 103 bp, Artificial Sequence
  Synthetic Polynucleotide
taatacgactcactataggggatcagagtcatgtccacggaatctcatttaacagaggagaaaatgaatgtccgtggacaacctggcggcagcgcaaaagatg

SEQ ID NO: 33151 - DNA, 103 bp, Artificial Sequence
  Synthetic Polynucleotide
taatacgactcactatagggaacgcactgcagtccagcatcctcactctgaacagaggagacagagtatggatgctggaaacctggcggcagcgcaaaagatg

SEQ ID NO: 33152 - DNA, 103 bp, Artificial Sequence
  Synthetic Polynucleotide
taatacgactcactatagggggaatcacttcaatatgttagcgttgtggtaacagaggagaaccacaatgctaacatataacctggcggcagcgcaaaagatg

SEQ ID NO: 33153 - DNA, 103 bp, Artificial Sequence
  Synthetic Polynucleotide
taatacgactcactatagggtaggaagcccaaggaaacgtgtgtagacggaacagaggagaccgtctatgcacgtttccaacctggcggcagcgcaaaagatg

SEQ ID NO: 33154 - DNA, 103 bp, Artificial Sequence
  Synthetic Polynucleotide
taatacgactcactatagggtcgggacaagtgcctcgctagctctaacgtaacagaggagaacgttaatgctagcgaggaacctggcggcagcgcaaaagatg

SEQ ID NO: 33155 - DNA, 103 bp, Artificial Sequence
  Synthetic Polynucleotide
taatacgactcactatagggtgatttattagcgcgattccgaggtagtccaacagaggagaggactaatgcggaatcgcaacctggcggcagcgcaaaagatg

SEQ ID NO: 33156 - DNA, 103 bp, Artificial Sequence
  Synthetic Polynucleotide
taatacgactcactatagggtgctgctaaaccatggagccaagtcgcagtaacagaggagaactgcgatgtggctccataacctggcggcagcgcaaaagatg

SEQ ID NO: 33157 - DNA, 103 bp, Artificial Sequence
  Synthetic Polynucleotide
taatacgactcactatagggccccagtatagaccgcggaaaagaatgggcaacagaggagagcccatatgtttccgcggaacctggcggcagcgcaaaagatg

SEQ ID NO: 33158 - DNA, 103 bp, Artificial Sequence
  Synthetic Polynucleotide
taatacgactcactatagggcacacatcccgaacggcataacgcgtcataaacagaggagatatgacatgttatgccgtaacctggcggcagcgcaaaagatg

SEQ ID NO: 33159 - DNA, 103 bp, Artificial Sequence
  Synthetic Polynucleotide
taatacgactcactatagggcaccataacccccccagaaagactacatataacagaggagaatatgtatgctttctgggaacctggcggcagcgcaaaagatg

SEQ ID NO: 33160 - DNA, 103 bp, Artificial Sequence
  Synthetic Polynucleotide
taatacgactcactataggggagtatccacgctctcgcgaaatggaaaagaacagaggagacttttcatgttcgcgagaaacctggcggcagcgcaaaagatg

SEQ ID NO: 33161 - DNA, 103 bp, Artificial Sequence
  Synthetic Polynucleotide
taatacgactcactatagggaagctagggcgccactttcccctggcgaacaacagaggagagttcgcatggggaaagtgaacctggcggcagcgcaaaagatg

SEQ ID NO: 33162 - DNA, 103 bp, Artificial Sequence
  Synthetic Polynucleotide
taatacgactcactatagggtaaaaccaaatatgttccgaagccactcccaacagaggagagggagtatgttcggaacaaacctggcggcagcgcaaaagatg

SEQ ID NO: 33163 - DNA, 103 bp, Artificial Sequence
  Synthetic Polynucleotide
taatacgactcactatagggttggaccagtggctcgccaagcgcttattaaacagaggagataataaatgcttggcgagaacctggcggcagcgcaaaagatg

SEQ ID NO: 33164 - DNA, 103 bp, Artificial Sequence
  Synthetic Polynucleotide
taatacgactcactatagggccgaggacagctttccagactatacgaatgaacagaggagacattcgatgagtctggaaaacctggcggcagcgcaaaagatg

SEQ ID NO: 33165 - DNA, 103 bp, Artificial Sequence
  Synthetic Polynucleotide
taatacgactcactatagggcgtggacgtagaaatagagaagtctcaaccaacagaggagaggttgaatgttctctattaacctggcggcagcgcaaaagatg

SEQ ID NO: 33166 - DNA, 103 bp, Artificial Sequence
  Synthetic Polynucleotide
taatacgactcactatagggttggataactaagcgcgcgacaagaagtaaaacagaggagattacttatggtcgcgcgcaacctggcggcagcgcaaaagatg

SEQ ID NO: 33167 - DNA, 103 bp, Artificial Sequence
  Synthetic Polynucleotide
taatacgactcactatagggtagaaacttcgtgaactcctgaagacgttaaacagaggagataacgtatgcaggagttcaacctggcggcagcgcaaaagatg

SEQ ID NO: 33168 - DNA, 103 bp, Artificial Sequence
  Synthetic Polynucleotide
taatacgactcactataggggccaaacggcgaatttgacgtgctagataaaacagaggagattatctatgacgtcaaataacctggcggcagcgcaaaagatg

SEQ ID NO: 33169 - DNA, 103 bp, Artificial Sequence
  Synthetic Polynucleotide
taatacgactcactatagggccctgggcggtagtcgagtgactgcaacaaaacagaggagattgttgatgtcactcgacaacctggcggcagcgcaaaagatg

SEQ ID NO: 33170 - DNA, 103 bp, Artificial Sequence
  Synthetic Polynucleotide
taatacgactcactataggggtcagcccccagacgtcatccatttgcggaaacagaggagatccgcaatgggatgacgtaacctggcggcagcgcaaaagatg

SEQ ID NO: 33171 - DNA, 103 bp, Artificial Sequence
  Synthetic Polynucleotide
taatacgactcactatagggccggtagaggcatcagaggactatacgtaaaacagaggagattacgtatggtcctctgaaacctggcggcagcgcaaaagatg

SEQ ID NO: 33172 - DNA, 103 bp, Artificial Sequence
  Synthetic Polynucleotide
taatacgactcactataggggcagtagactgaccgtggtactaagggtaaaacagaggagattacccatggtaccacggaacctggcggcagcgcaaaagatg

SEQ ID NO: 33173 - DNA, 103 bp, Artificial Sequence
  Synthetic Polynucleotide
taatacgactcactatagggagtctttgcttcactgcttgccatgcgcggaacagaggagaccgcgcatggcaagcagtaacctggcggcagcgcaaaagatg

SEQ ID NO: 33174 - DNA, 103 bp, Artificial Sequence
  Synthetic Polynucleotide
taatacgactcactatagggccacaagaatcggttcttgtccgggacagtaacagaggagaactgtcatggacaagaacaacctggcggcagcgcaaaagatg

SEQ ID NO: 33175 - DNA, 103 bp, Artificial Sequence
  Synthetic Polynucleotide
taatacgactcactatagggagcattcacagactcacgtacaaactccggaacagaggagaccggagatggtacgtgagaacctggcggcagcgcaaaagatg

SEQ ID NO: 33176 - DNA, 103 bp, Artificial Sequence
  Synthetic Polynucleotide
taatacgactcactataggggggtagtttcaacgtaagatgccaagtacaaacagaggagatgtactatgcatcttacgaacctggcggcagcgcaaaagatg

SEQ ID NO: 33177 - DNA, 103 bp, Artificial Sequence
  Synthetic Polynucleotide
taatacgactcactatagggtactcaacaaaattttgttttggtcaggtaaacagaggagatacctgatgaaaacaaaaaacctggcggcagcgcaaaagatg

SEQ ID NO: 33178 - DNA, 103 bp, Artificial Sequence
  Synthetic Polynucleotide
taatacgactcactatagggttatcctgcgatagcggtggttgaggttgcaacagaggagagcaaccatgaccaccgctaacctggcggcagcgcaaaagatg

SEQ ID NO: 33179 - DNA, 103 bp, Artificial Sequence
  Synthetic Polynucleotide
taatacgactcactatagggcagtatccctagggggataatgaaaggtttaacagaggagaaaacctatgattatccccaacctggcggcagcgcaaaagatg

SEQ ID NO: 33180 - DNA, 103 bp, Artificial Sequence
  Synthetic Polynucleotide
taatacgactcactatagggcaatttcccctgctgaggccgtgaaatcccaacagaggagagggattatgcggcctcagaacctggcggcagcgcaaaagatg

SEQ ID NO: 33181 - DNA, 103 bp, Artificial Sequence
  Synthetic Polynucleotide
taatacgactcactatagggggggctgaagaatcctagttatatcgacgcaacagaggagagcgtcgatgtaactaggaaacctggcggcagcgcaaaagatg

SEQ ID NO: 33182 - DNA, 103 bp, Artificial Sequence
  Synthetic Polynucleotide
taatacgactcactatagggcgattttactcaatatcaaacacgttctctaacagaggagaagagaaatggtttgatataacctggcggcagcgcaaaagatg

SEQ ID NO: 33183 - DNA, 103 bp, Artificial Sequence
  Synthetic Polynucleotide
taatacgactcactatagggcgaggggctcaatcagtgtttggggcactgaacagaggagacagtgcatgaaacactgaaacctggcggcagcgcaaaagatg

SEQ ID NO: 33184 - DNA, 103 bp, Artificial Sequence
  Synthetic Polynucleotide
taatacgactcactatagggtaacctggcgcgcaagcaggtaagataataaacagaggagatattatatgacctgcttgaacctggcggcagcgcaaaagatg

SEQ ID NO: 33185 - DNA, 103 bp, Artificial Sequence
  Synthetic Polynucleotide
taatacgactcactataggggcctgctatccgagacagggtcgaaagaataacagaggagaattcttatgaccctgtctaacctggcggcagcgcaaaagatg

SEQ ID NO: 33186 - DNA, 103 bp, Artificial Sequence
  Synthetic Polynucleotide
taatacgactcactatagggtcctaaggtggcgatttgcaaatggcttaaaacagaggagattaagcatgttgcaaatcaacctggcggcagcgcaaaagatg

SEQ ID NO: 33187 - DNA, 103 bp, Artificial Sequence
  Synthetic Polynucleotide
taatacgactcactatagggtgaggttagccggcacccgagtcaagtttgaacagaggagacaaactatgctcgggtgcaacctggcggcagcgcaaaagatg

SEQ ID NO: 33188 - DNA, 103 bp, Artificial Sequence
  Synthetic Polynucleotide
taatacgactcactatagggcttcaggatttctgttattgcggagctcataacagaggagaatgagcatggcaataacaaacctggcggcagcgcaaaagatg

SEQ ID NO: 33189 - DNA, 103 bp, Artificial Sequence
  Synthetic Polynucleotide
taatacgactcactataggggggatctagtaaccgttaagtctgagggtaaacagaggagataccctatgacttaacggaacctggcggcagcgcaaaagatg

SEQ ID NO: 33190 - DNA, 103 bp, Artificial Sequence
  Synthetic Polynucleotide
taatacgactcactataggggattctggcgaaggtgtaggacttgcgccaaacagaggagatggcgcatgtcctacaccaacctggcggcagcgcaaaagatg

SEQ ID NO: 33191 - DNA, 103 bp, Artificial Sequence
  Synthetic Polynucleotide
taatacgactcactatagggatccgtttagtcacgcttgggtatttaataaacagaggagatattaaatgcccaagcgtaacctggcggcagcgcaaaagatg

SEQ ID NO: 33192 - DNA, 103 bp, Artificial Sequence
  Synthetic Polynucleotide
taatacgactcactatagggccctattgcgaatgcgcttgagtcggtataaacagaggagatataccatgtcaagcgcaaacctggcggcagcgcaaaagatg

SEQ ID NO: 33193 - DNA, 103 bp, Artificial Sequence
  Synthetic Polynucleotide
taatacgactcactatagggtgctgtaaagctgtgttgctggaggtcttgaacagaggagacaagacatgcagcaacacaacctggcggcagcgcaaaagatg

SEQ ID NO: 33194 - DNA, 103 bp, Artificial Sequence
  Synthetic Polynucleotide
taatacgactcactatagggggtactccttggctcgtggaacctccaaagaacagaggagactttggatgttccacgagaacctggcggcagcgcaaaagatg

SEQ ID NO: 33195 - DNA, 103 bp, Artificial Sequence
  Synthetic Polynucleotide
taatacgactcactatagggaacatggttgccttagcatgatccggactcaacagaggagagagtccatgtcatgctaaaacctggcggcagcgcaaaagatg

SEQ ID NO: 33196 - DNA, 103 bp, Artificial Sequence
  Synthetic Polynucleotide
taatacgactcactataggggtacactatcgtgctcatattcctcgccacaacagaggagagtggcgatgaatatgagcaacctggcggcagcgcaaaagatg

SEQ ID NO: 33197 - DNA, 103 bp, Artificial Sequence
  Synthetic Polynucleotide
taatacgactcactatagggttggcattaatcccctaaattgacgagtttaacagaggagaaaactcatgaatttagggaacctggcggcagcgcaaaagatg

SEQ ID NO: 33198 - DNA, 103 bp, Artificial Sequence
  Synthetic Polynucleotide
taatacgactcactatagggtccgcggtctatcccaggttccggggtactaacagaggagaagtaccatggaacctgggaacctggcggcagcgcaaaagatg

SEQ ID NO: 33199 - DNA, 103 bp, Artificial Sequence
  Synthetic Polynucleotide
taatacgactcactatagggtgcagcttcacaaattttgggggacctattaacagaggagaaataggatgcccaaaattaacctggcggcagcgcaaaagatg

SEQ ID NO: 33200 - DNA, 103 bp, Artificial Sequence
  Synthetic Polynucleotide
taatacgactcactataggggcataccccctcaatatatacttgcggtaaaacagaggagattaccgatggtatatattaacctggcggcagcgcaaaagatg

SEQ ID NO: 33201 - DNA, 103 bp, Artificial Sequence
  Synthetic Polynucleotide
taatacgactcactatagggaatagttatagctggttgatgaccaacttgaacagaggagacaagttatgcatcaaccaaacctggcggcagcgcaaaagatg

SEQ ID NO: 33202 - DNA, 103 bp, Artificial Sequence
  Synthetic Polynucleotide
taatacgactcactatagggattgggagcccttgaaatcggtttctcatgaacagaggagacatgagatgccgatttcaaacctggcggcagcgcaaaagatg

SEQ ID NO: 33203 - DNA, 103 bp, Artificial Sequence
  Synthetic Polynucleotide
taatacgactcactatagggttggcatgatgagcgtaaaagcataagcttaacagaggagaaagcttatgcttttacgcaacctggcggcagcgcaaaagatg

SEQ ID NO: 33204 - DNA, 103 bp, Artificial Sequence
  Synthetic Polynucleotide
taatacgactcactatagggttctctgcgtattggagagcggggtatgcaaacagaggagatgcataatgcgctctccaaacctggcggcagcgcaaaagatg

SEQ ID NO: 33205 - DNA, 103 bp, Artificial Sequence
  Synthetic Polynucleotide
taatacgactcactatagggatatgactaagttggaaatatcaagtccggaacagaggagaccggacatgatatttccaaacctggcggcagcgcaaaagatg

SEQ ID NO: 33206 - DNA, 103 bp, Artificial Sequence
  Synthetic Polynucleotide
taatacgactcactataggggccccttgggacccatcttccatgttgcaaaacagaggagattgcaaatgggaagatggaacctggcggcagcgcaaaagatg

SEQ ID NO: 33207 - DNA, 103 bp, Artificial Sequence
  Synthetic Polynucleotide
taatacgactcactatagggagttgtaggatcaaactctagcgatggcagaacagaggagactgccaatgctagagtttaacctggcggcagcgcaaaagatg

SEQ ID NO: 33208 - DNA, 103 bp, Artificial Sequence
  Synthetic Polynucleotide
taatacgactcactatagggtggaagcgctgtcccggtaagccggcagaaaacagaggagattctgcatgcttaccgggaacctggcggcagcgcaaaagatg

SEQ ID NO: 33209 - DNA, 103 bp, Artificial Sequence
  Synthetic Polynucleotide
taatacgactcactatagggagaagacaattgcgttgcgtctgggatggcaacagaggagagccatcatggacgcaacgaacctggcggcagcgcaaaagatg

SEQ ID NO: 33210 - DNA, 103 bp, Artificial Sequence
  Synthetic Polynucleotide
taatacgactcactatagggggagcaagcgttgggcgggtgacggcatgaaacagaggagatcatgcatgcacccgcccaacctggcggcagcgcaaaagatg

SEQ ID NO: 33211 - DNA, 103 bp, Artificial Sequence
  Synthetic Polynucleotide
taatacgactcactatagggtgcgacccgtgcctctcatgtcgtcttctgaacagaggagacagaagatgacatgagagaacctggcggcagcgcaaaagatg

SEQ ID NO: 33212 - DNA, 103 bp, Artificial Sequence
  Synthetic Polynucleotide
taatacgactcactataggggatcttctgggttcttgcggtgccctgtgtaacagaggagaacacagatgaccgcaagaaacctggcggcagcgcaaaagatg

SEQ ID NO: 33213 - DNA, 103 bp, Artificial Sequence
  Synthetic Polynucleotide
taatacgactcactatagggcccccgagacgttcacctttgggtgcccaaaacagaggagattgggcatgcaaaggtgaaacctggcggcagcgcaaaagatg

SEQ ID NO: 33214 - DNA, 103 bp, Artificial Sequence
  Synthetic Polynucleotide
taatacgactcactatagggagcatatttaggtactccgcttaaacactgaacagaggagacagtgtatgagcggagtaaacctggcggcagcgcaaaagatg

SEQ ID NO: 33215 - DNA, 103 bp, Artificial Sequence
  Synthetic Polynucleotide
taatacgactcactatagggttaacggaaatattatgtacaaaaactagtaacagaggagaactagtatgtgtacataaaacctggcggcagcgcaaaagatg

SEQ ID NO: 33216 - DNA, 103 bp, Artificial Sequence
  Synthetic Polynucleotide
taatacgactcactatagggcccgtccagcatggaaggcatgcgggcgctaacagaggagaagcgccatgatgccttccaacctggcggcagcgcaaaagatg

SEQ ID NO: 33217 - DNA, 103 bp, Artificial Sequence
  Synthetic Polynucleotide
taatacgactcactatagggatggttccgttttacagaaatcgaatggctaacagaggagaagccatatgatttctgtaaacctggcggcagcgcaaaagatg

SEQ ID NO: 33218 - DNA, 103 bp, Artificial Sequence
  Synthetic Polynucleotide
taatacgactcactataggggaccgcaatttgcccgcgtctcttcgccgaaacagaggagatcggcgatgagacgcgggaacctggcggcagcgcaaaagatg

SEQ ID NO: 33219 - DNA, 103 bp, Artificial Sequence
  Synthetic Polynucleotide
taatacgactcactatagggcgaagggcgccgatacaacgtctgctcgtaaacagaggagatacgagatgacgttgtataacctggcggcagcgcaaaagatg

SEQ ID NO: 33220 - DNA, 103 bp, Artificial Sequence
  Synthetic Polynucleotide
taatacgactcactatagggtctggtacaacattaacagtttatttctagaacagaggagactagaaatgaactgttaaaacctggcggcagcgcaaaagatg

SEQ ID NO: 33221 - DNA, 103 bp, Artificial Sequence
  Synthetic Polynucleotide
taatacgactcactatagggtttgttctcgtcaacaggggtacatccgcgaacagaggagacgcggaatgacccctgttaacctggcggcagcgcaaaagatg

SEQ ID NO: 33222 - DNA, 103 bp, Artificial Sequence
  Synthetic Polynucleotide
taatacgactcactatagggcattgctttttcggacgggtttgttacgccaacagaggagaggcgtaatgaacccgtccaacctggcggcagcgcaaaagatg

SEQ ID NO: 33223 - DNA, 103 bp, Artificial Sequence
  Synthetic Polynucleotide
taatacgactcactatagggcacgcactccttccgctctcgtacgaactcaacagaggagagagttcatgcgagagcggaacctggcggcagcgcaaaagatg

SEQ ID NO: 33224 - DNA, 103 bp, Artificial Sequence
  Synthetic Polynucleotide
taatacgactcactataggggtagaatagtctttgcggaacctaagccgaaacagaggagatcggctatggttccgcaaaacctggcggcagcgcaaaagatg

SEQ ID NO: 33225 - DNA, 103 bp, Artificial Sequence
  Synthetic Polynucleotide
taatacgactcactatagggtcacgggtatgatctaattttaactgagacaacagaggagagtctcaatgaaaattagaaacctggcggcagcgcaaaagatg

SEQ ID NO: 33226 - DNA, 103 bp, Artificial Sequence
  Synthetic Polynucleotide
taatacgactcactatagggaggacaaacgtgacctgtcctgattcctataacagaggagaataggaatgaggacaggtaacctggcggcagcgcaaaagatg

SEQ ID NO: 33227 - DNA, 103 bp, Artificial Sequence
  Synthetic Polynucleotide
taatacgactcactataggggcatgctcttcccttgacaactctattcgcaacagaggagagcgaatatggttgtcaagaacctggcggcagcgcaaaagatg

SEQ ID NO: 33228 - DNA, 103 bp, Artificial Sequence
  Synthetic Polynucleotide
taatacgactcactataggggtaatcattccgacctgccagtgctctaacaacagaggagagttagaatgctggcaggtaacctggcggcagcgcaaaagatg

SEQ ID NO: 33229 - DNA, 103 bp, Artificial Sequence
  Synthetic Polynucleotide
taatacgactcactatagggcgatcgccgtggcctgataacagccccccgaacagaggagacgggggatggttatcaggaacctggcggcagcgcaaaagatg

SEQ ID NO: 33230 - DNA, 103 bp, Artificial Sequence
  Synthetic Polynucleotide
taatacgactcactatagggtcttaaggtcgacgtggccttgcagttgacaacagaggagagtcaacatgaaggccacgaacctggcggcagcgcaaaagatg

SEQ ID NO: 33231 - DNA, 103 bp, Artificial Sequence
  Synthetic Polynucleotide
taatacgactcactatagggtttcaacctattgaaccgtcagaatcctagaacagaggagactaggaatgtgacggttcaacctggcggcagcgcaaaagatg

SEQ ID NO: 33232 - DNA, 103 bp, Artificial Sequence
  Synthetic Polynucleotide
taatacgactcactatagggctgcacatgccattacgcttttttaatgtgaacagaggagacacattatgaaagcgtaaaacctggcggcagcgcaaaagatg

SEQ ID NO: 33233 - DNA, 103 bp, Artificial Sequence
  Synthetic Polynucleotide
taatacgactcactataggggctacggtttctacgaagatagagatttataacagaggagaataaatatgtatcttcgtaacctggcggcagcgcaaaagatg

SEQ ID NO: 33234 - DNA, 103 bp, Artificial Sequence
  Synthetic Polynucleotide
taatacgactcactatagggccgcacagttcgcctctactctccgcagccaacagaggagaggctgcatggagtagaggaacctggcggcagcgcaaaagatg

SEQ ID NO: 33235 - DNA, 103 bp, Artificial Sequence
  Synthetic Polynucleotide
taatacgactcactatagggtggccccggccattgcagcaccgtttccctaacagaggagaagggaaatggtgctgcaaaacctggcggcagcgcaaaagatg

SEQ ID NO: 33236 - DNA, 103 bp, Artificial Sequence
  Synthetic Polynucleotide
taatacgactcactatagggtatgtaaagacgtggcctggacatagctcgaacagaggagacgagctatgtccaggccaaacctggcggcagcgcaaaagatg

SEQ ID NO: 33237 - DNA, 103 bp, Artificial Sequence
  Synthetic Polynucleotide
taatacgactcactatagggcgtaagcgtagcgtgatcttgcttcaagataacagaggagaatcttgatgcaagatcacaacctggcggcagcgcaaaagatg

SEQ ID NO: 33238 - DNA, 103 bp, Artificial Sequence
  Synthetic Polynucleotide
taatacgactcactatagggtctctgaggtgtctaaaaccctcctgtcgcaacagaggagagcgacaatggggttttagaacctggcggcagcgcaaaagatg

SEQ ID NO: 33239 - DNA, 103 bp, Artificial Sequence
  Synthetic Polynucleotide
taatacgactcactatagggcccacggactacactgggtcagaaataccaaacagaggagatggtatatgtgacccagtaacctggcggcagcgcaaaagatg

SEQ ID NO: 33240 - DNA, 103 bp, Artificial Sequence
  Synthetic Polynucleotide
taatacgactcactataggggagcgactccccgagacccgctctcgcgcaaacagaggagatgcgcgatggcgggtctcaacctggcggcagcgcaaaagatg

SEQ ID NO: 33241 - DNA, 103 bp, Artificial Sequence
  Synthetic Polynucleotide
taatacgactcactatagggcgttactatgttatatgctaggttattgataacagaggagaatcaatatgctagcatataacctggcggcagcgcaaaagatg

SEQ ID NO: 33242 - DNA, 103 bp, Artificial Sequence
  Synthetic Polynucleotide
taatacgactcactatagggtcaccgattagtggagcctaaggtggagagaacagaggagactctccatgttaggctccaacctggcggcagcgcaaaagatg

SEQ ID NO: 33243 - DNA, 103 bp, Artificial Sequence
  Synthetic Polynucleotide
taatacgactcactataggggtgagcccgccgtttggtctttctacacccaacagaggagagggtgtatgaagaccaaaaacctggcggcagcgcaaaagatg

SEQ ID NO: 33244 - DNA, 103 bp, Artificial Sequence
  Synthetic Polynucleotide
taatacgactcactatagggccgcatcgagtaccgtcaagcaactgacgtaacagaggagaacgtcaatggcttgacggaacctggcggcagcgcaaaagatg

SEQ ID NO: 33245 - DNA, 103 bp, Artificial Sequence
  Synthetic Polynucleotide
taatacgactcactatagggtggcacaggagcgtaatctataaccgctacaacagaggagagtagcgatgatagattacaacctggcggcagcgcaaaagatg

SEQ ID NO: 33246 - DNA, 103 bp, Artificial Sequence
  Synthetic Polynucleotide
taatacgactcactatagggtagacccaccacctacgagtcccgccgctgaacagaggagacagcggatggactcgtagaacctggcggcagcgcaaaagatg

SEQ ID NO: 33247 - DNA, 103 bp, Artificial Sequence
  Synthetic Polynucleotide
taatacgactcactatagggcttggtaggatattttgcttctcgcttcgcaacagaggagagcgaagatggaagcaaaaaacctggcggcagcgcaaaagatg

SEQ ID NO: 33248 - DNA, 103 bp, Artificial Sequence
  Synthetic Polynucleotide
taatacgactcactatagggagaacggagccgcagctgaaacggcgctcgaacagaggagacgagcgatgtttcagctgaacctggcggcagcgcaaaagatg

SEQ ID NO: 33249 - DNA, 103 bp, Artificial Sequence
  Synthetic Polynucleotide
taatacgactcactatagggaaccacagaaatatgcgcgccaccacaacaaacagaggagatgttgtatgggcgcgcataacctggcggcagcgcaaaagatg

SEQ ID NO: 33250 - DNA, 103 bp, Artificial Sequence
  Synthetic Polynucleotide
taatacgactcactataggggcgggctgtatggggtgttgctcagttacaaacagaggagatgtaacatggcaacacccaacctggcggcagcgcaaaagatg

SEQ ID NO: 33251 - DNA, 103 bp, Artificial Sequence
  Synthetic Polynucleotide
taatacgactcactatagggcctagaccttccatagattcgcaagagaataacagaggagaattctcatgcgaatctataacctggcggcagcgcaaaagatg

SEQ ID NO: 33252 - DNA, 103 bp, Artificial Sequence
  Synthetic Polynucleotide
taatacgactcactatagggtggggcctcacgataatgggtattgtccggaacagaggagaccggacatgacccattataacctggcggcagcgcaaaagatg

SEQ ID NO: 33253 - DNA, 103 bp, Artificial Sequence
  Synthetic Polynucleotide
taatacgactcactatagggaccttgccccgctgtgtcaaggcgccggcaaacagaggagatgccggatgcttgacacaaacctggcggcagcgcaaaagatg

SEQ ID NO: 33254 - DNA, 103 bp, Artificial Sequence
  Synthetic Polynucleotide
taatacgactcactatagggtggacaggctatagtattcaaaatgagtcgaacagaggagacgactcatgttgaatactaacctggcggcagcgcaaaagatg

SEQ ID NO: 33255 - DNA, 103 bp, Artificial Sequence
  Synthetic Polynucleotide
taatacgactcactatagggtacacccgttagcatctggctaccagaatcaacagaggagagattctatgagccagatgaacctggcggcagcgcaaaagatg

SEQ ID NO: 33256 - DNA, 103 bp, Artificial Sequence
  Synthetic Polynucleotide
taatacgactcactataggggttgcgtggagcattggttgataacaacttaacagaggagaaagttgatgtcaaccaataacctggcggcagcgcaaaagatg

SEQ ID NO: 33257 - DNA, 103 bp, Artificial Sequence
  Synthetic Polynucleotide
taatacgactcactatagggcttgggtctgcccgcacagtacaaagcccaaacagaggagatgggctatgtactgtgcgaacctggcggcagcgcaaaagatg

SEQ ID NO: 33258 - DNA, 103 bp, Artificial Sequence
  Synthetic Polynucleotide
taatacgactcactatagggtgaccccaaggggcgggcgcactatatgtgaacagaggagacacataatgtgcgcccgcaacctggcggcagcgcaaaagatg

SEQ ID NO: 33259 - DNA, 103 bp, Artificial Sequence
  Synthetic Polynucleotide
taatacgactcactatagggagaaggccccttatggtgtccggccgcttcaacagaggagagaagcgatgggacaccataacctggcggcagcgcaaaagatg

SEQ ID NO: 33260 - DNA, 103 bp, Artificial Sequence
  Synthetic Polynucleotide
taatacgactcactatagggccagaagagtttaagctgatcactatagcgaacagaggagacgctatatggatcagcttaacctggcggcagcgcaaaagatg

SEQ ID NO: 33261 - DNA, 103 bp, Artificial Sequence
  Synthetic Polynucleotide
taatacgactcactatagggcccacccgtatttttggccagcggcagggtaacagaggagaaccctgatgctggccaaaaacctggcggcagcgcaaaagatg

SEQ ID NO: 33262 - DNA, 103 bp, Artificial Sequence
  Synthetic Polynucleotide
taatacgactcactatagggcacgagccacttgttcacgcggccctgaagaacagaggagacttcagatgcgcgtgaacaacctggcggcagcgcaaaagatg

SEQ ID NO: 33263 - DNA, 103 bp, Artificial Sequence
  Synthetic Polynucleotide
taatacgactcactatagggcttcgtgggctactgcccaaccgactggtcaacagaggagagaccagatggttgggcagaacctggcggcagcgcaaaagatg

SEQ ID NO: 33264 - DNA, 103 bp, Artificial Sequence
  Synthetic Polynucleotide
taatacgactcactatagggtccatgtatggagaaattctccgaacttcgaacagaggagacgaagtatggagaatttcaacctggcggcagcgcaaaagatg

SEQ ID NO: 33265 - DNA, 103 bp, Artificial Sequence
  Synthetic Polynucleotide
taatacgactcactataggggtgtctgacatcatggcgcccagtggtgacaacagaggagagtcaccatggggcgccataacctggcggcagcgcaaaagatg

SEQ ID NO: 33266 - DNA, 103 bp, Artificial Sequence
  Synthetic Polynucleotide
taatacgactcactataggggtgttgcagttcgaacatgtaagaatatgtaacagaggagaacatatatgtacatgttcaacctggcggcagcgcaaaagatg

SEQ ID NO: 33267 - DNA, 103 bp, Artificial Sequence
  Synthetic Polynucleotide
taatacgactcactatagggtagctcttcattagtgtatcgacctgagttaacagaggagaaactcaatgcgatacactaacctggcggcagcgcaaaagatg

SEQ ID NO: 33268 - DNA, 103 bp, Artificial Sequence
  Synthetic Polynucleotide
taatacgactcactatagggcagataatgtggggagagggcgtagtagttaacagaggagaaactacatggccctctccaacctggcggcagcgcaaaagatg

SEQ ID NO: 33269 - DNA, 103 bp, Artificial Sequence
  Synthetic Polynucleotide
taatacgactcactatagggtgggaagtgtcttatttgaatgtaaatgtcaacagaggagagacattatgattcaaataaacctggcggcagcgcaaaagatg

SEQ ID NO: 33270 - DNA, 103 bp, Artificial Sequence
  Synthetic Polynucleotide
taatacgactcactatagggaatatctcataccttccagtgtgattccggaacagaggagaccggaaatgcactggaagaacctggcggcagcgcaaaagatg

SEQ ID NO: 33271 - DNA, 103 bp, Artificial Sequence
  Synthetic Polynucleotide
taatacgactcactataggggttgagctctttctgaggtgcctgggtcagaacagaggagactgaccatggcacctcagaacctggcggcagcgcaaaagatg

SEQ ID NO: 33272 - DNA, 103 bp, Artificial Sequence
  Synthetic Polynucleotide
taatacgactcactatagggataaagcacatgactcccaaggcttctggtaacagaggagaaccagaatgcttgggagtaacctggcggcagcgcaaaagatg

SEQ ID NO: 33273 - DNA, 103 bp, Artificial Sequence
  Synthetic Polynucleotide
taatacgactcactataggggaatctttgcggtatggctctaattagcctaacagaggagaaggctaatgagagccataaacctggcggcagcgcaaaagatg

SEQ ID NO: 33274 - DNA, 103 bp, Artificial Sequence
  Synthetic Polynucleotide
taatacgactcactatagggccataattttctgtaggaatattctccccaaacagaggagatggggaatgtattcctacaacctggcggcagcgcaaaagatg

SEQ ID NO: 33275 - DNA, 103 bp, Artificial Sequence
  Synthetic Polynucleotide
taatacgactcactatagggcttgagtcatttaaacatattctgaacgtgaacagaggagacacgttatgaatatgtttaacctggcggcagcgcaaaagatg

SEQ ID NO: 33276 - DNA, 103 bp, Artificial Sequence
  Synthetic Polynucleotide
taatacgactcactatagggagagtcaagagttgcgaccgttgtctatggaacagaggagaccatagatgacggtcgcaaacctggcggcagcgcaaaagatg

SEQ ID NO: 33277 - DNA, 103 bp, Artificial Sequence
  Synthetic Polynucleotide
taatacgactcactatagggaggtgctcggcgctctgtgtcaccccagccaacagaggagaggctggatggacacagagaacctggcggcagcgcaaaagatg

SEQ ID NO: 33278 - DNA, 103 bp, Artificial Sequence
  Synthetic Polynucleotide
taatacgactcactatagggcggaccagtgtgaccgtcagcttatgcatgaacagaggagacatgcaatggctgacggtaacctggcggcagcgcaaaagatg

SEQ ID NO: 33279 - DNA, 103 bp, Artificial Sequence
  Synthetic Polynucleotide
taatacgactcactatagggagccgtattcaaatagtcctcccggccactaacagaggagaagtggcatggaggactataacctggcggcagcgcaaaagatg

SEQ ID NO: 33280 - DNA, 103 bp, Artificial Sequence
  Synthetic Polynucleotide
taatacgactcactatagggcacgggagcaggttcgaacaacgagccagaaacagaggagatctggcatgttgttcgaaaacctggcggcagcgcaaaagatg

SEQ ID NO: 33281 - DNA, 103 bp, Artificial Sequence
  Synthetic Polynucleotide
taatacgactcactatagggccagctttcccgtacgcgacccacggccggaacagaggagaccggccatgggtcgcgtaaacctggcggcagcgcaaaagatg

SEQ ID NO: 33282 - DNA, 103 bp, Artificial Sequence
  Synthetic Polynucleotide
taatacgactcactatagggcccagccgccccgagacttactggattctgaacagaggagacagaatatggtaagtctcaacctggcggcagcgcaaaagatg

SEQ ID NO: 33283 - DNA, 103 bp, Artificial Sequence
  Synthetic Polynucleotide
taatacgactcactatagggacctgctgaccctaacctcagcgatcggaaaacagaggagattccgaatgctgaggttaaacctggcggcagcgcaaaagatg

SEQ ID NO: 33284 - DNA, 103 bp, Artificial Sequence
  Synthetic Polynucleotide
taatacgactcactatagggatctggattgctcggtttccgaggaggatcaacagaggagagatcctatgcggaaaccgaacctggcggcagcgcaaaagatg

SEQ ID NO: 33285 - DNA, 103 bp, Artificial Sequence
  Synthetic Polynucleotide
taatacgactcactatagggtgtgtacagtaaaactagggataaacggggaacagaggagaccccgtatgtccctagttaacctggcggcagcgcaaaagatg

SEQ ID NO: 33286 - DNA, 103 bp, Artificial Sequence
  Synthetic Polynucleotide
taatacgactcactatagggtgtgagccttctcccccgttctagacgccaaacagaggagatggcgtatggaacgggggaacctggcggcagcgcaaaagatg

SEQ ID NO: 33287 - DNA, 103 bp, Artificial Sequence
  Synthetic Polynucleotide
taatacgactcactatagggatactaagcacatcccaccacgtttcagttaacagaggagaaactgaatggtggtgggaaacctggcggcagcgcaaaagatg

SEQ ID NO: 33288 - DNA, 103 bp, Artificial Sequence
  Synthetic Polynucleotide
taatacgactcactatagggtgtccgcggtcattttgtatcgtcccccgcaacagaggagagcggggatggatacaaaaaacctggcggcagcgcaaaagatg

SEQ ID NO: 33289 - DNA, 103 bp, Artificial Sequence
  Synthetic Polynucleotide
taatacgactcactatagggtgccaacttcaccagctctaccggataggcaacagaggagagcctatatggtagagctgaacctggcggcagcgcaaaagatg

SEQ ID NO: 33290 - DNA, 103 bp, Artificial Sequence
  Synthetic Polynucleotide
taatacgactcactatagggtagatgcgattttagcaggctccttccccgaacagaggagacggggaatgagcctgctaaacctggcggcagcgcaaaagatg

SEQ ID NO: 33291 - DNA, 103 bp, Artificial Sequence
  Synthetic Polynucleotide
taatacgactcactatagggcaattgaacctgtcacgttgctatttgagaaacagaggagatctcaaatggcaacgtgaaacctggcggcagcgcaaaagatg

SEQ ID NO: 33292 - DNA, 103 bp, Artificial Sequence
  Synthetic Polynucleotide
taatacgactcactatagggactgcagcgtacccatcgcaccggtacgtcaacagaggagagacgtaatggtgcgatggaacctggcggcagcgcaaaagatg

SEQ ID NO: 33293 - DNA, 103 bp, Artificial Sequence
  Synthetic Polynucleotide
taatacgactcactatagggtcgatgactgcaactgcacataaatttcaaaacagaggagattgaaaatgatgtgcagtaacctggcggcagcgcaaaagatg

SEQ ID NO: 33294 - DNA, 103 bp, Artificial Sequence
  Synthetic Polynucleotide
taatacgactcactataggggattggtctttgacccacccccctgatgtcaacagaggagagacatcatgggggtgggtaacctggcggcagcgcaaaagatg

SEQ ID NO: 33295 - DNA, 103 bp, Artificial Sequence
  Synthetic Polynucleotide
taatacgactcactatagggcacactctattccctgtgcctagacccgtgaacagaggagacacgggatgaggcacaggaacctggcggcagcgcaaaagatg

SEQ ID NO: 33296 - DNA, 103 bp, Artificial Sequence
  Synthetic Polynucleotide
taatacgactcactatagggtatctacgtgtctatggttggggacgctcgaacagaggagacgagcgatgccaaccataaacctggcggcagcgcaaaagatg

SEQ ID NO: 33297 - DNA, 103 bp, Artificial Sequence
  Synthetic Polynucleotide
taatacgactcactatagggctaatagtacgcttctgcctctaaaagggaaacagaggagatcccttatggaggcagaaaacctggcggcagcgcaaaagatg

SEQ ID NO: 33298 - DNA, 103 bp, Artificial Sequence
  Synthetic Polynucleotide
taatacgactcactataggggtgatactttagtttcgtgttaacggcgtcaacagaggagagacgccatgaacacgaaaaacctggcggcagcgcaaaagatg

SEQ ID NO: 33299 - DNA, 103 bp, Artificial Sequence
  Synthetic Polynucleotide
taatacgactcactatagggcaagcgctatggagagcgggtcgttaattaaacagaggagataattaatgacccgctctaacctggcggcagcgcaaaagatg

SEQ ID NO: 33300 - DNA, 103 bp, Artificial Sequence
  Synthetic Polynucleotide
taatacgactcactatagggtgctcggaagtacccggccggagcgatagcaacagaggagagctatcatgccggccgggaacctggcggcagcgcaaaagatg

SEQ ID NO: 33301 - DNA, 103 bp, Artificial Sequence
  Synthetic Polynucleotide
taatacgactcactatagggactcggcctcaatgacacaaaagttgtgaaaacagaggagattcacaatgtttgtgtcaaacctggcggcagcgcaaaagatg

SEQ ID NO: 33302 - DNA, 103 bp, Artificial Sequence
  Synthetic Polynucleotide
taatacgactcactatagggttaaggcttgaacatattttaagccctaaaaacagaggagatttaggatgtaaaatatgaacctggcggcagcgcaaaagatg

SEQ ID NO: 33303 - DNA, 103 bp, Artificial Sequence
  Synthetic Polynucleotide
taatacgactcactatagggtccaatgctcacagttactatttctagtagaacagaggagactactaatgatagtaactaacctggcggcagcgcaaaagatg

SEQ ID NO: 33304 - DNA, 103 bp, Artificial Sequence
  Synthetic Polynucleotide
taatacgactcactataggggggcccgatctgcaatggaacgtggccgcaaacagaggagatgcggcatggttccattgaacctggcggcagcgcaaaagatg

SEQ ID NO: 33305 - DNA, 103 bp, Artificial Sequence
  Synthetic Polynucleotide
taatacgactcactatagggacccccgataggaataaaaataatctacgcaacagaggagagcgtagatgatttttattaacctggcggcagcgcaaaagatg

SEQ ID NO: 33306 - DNA, 103 bp, Artificial Sequence
  Synthetic Polynucleotide
taatacgactcactataggggtgcacggatttagtgggggtaacctttctaacagaggagaagaaagatgacccccactaacctggcggcagcgcaaaagatg

SEQ ID NO: 33307 - DNA, 103 bp, Artificial Sequence
  Synthetic Polynucleotide
taatacgactcactatagggaaattgtggtggctacggatcgccgaatgaaacagaggagatcattcatggatccgtagaacctggcggcagcgcaaaagatg

SEQ ID NO: 33308 - DNA, 103 bp, Artificial Sequence
  Synthetic Polynucleotide
taatacgactcactatagggcttcctgggtccctaaaccttgttgcatgcaacagaggagagcatgcatgaaggtttagaacctggcggcagcgcaaaagatg

SEQ ID NO: 33309 - DNA, 103 bp, Artificial Sequence
  Synthetic Polynucleotide
taatacgactcactataggggcgccagttacggcctgcgaaatgtaaagcaacagaggagagctttaatgttcgcaggcaacctggcggcagcgcaaaagatg

SEQ ID NO: 33310 - DNA, 103 bp, Artificial Sequence
  Synthetic Polynucleotide
taatacgactcactataggggatcgttcaggtattatgaattcatgccgtaacagaggagaacggcaatgattcataataacctggcggcagcgcaaaagatg

SEQ ID NO: 33311 - DNA, 103 bp, Artificial Sequence
  Synthetic Polynucleotide
taatacgactcactatagggtgagaaacctccgggacggccagatggcttaacagaggagaaagccaatgggccgtcccaacctggcggcagcgcaaaagatg

SEQ ID NO: 33312 - DNA, 103 bp, Artificial Sequence
  Synthetic Polynucleotide
taatacgactcactatagggaactacaccggggcttgtcgtcgccgaacaaacagaggagatgttcgatgacgacaagcaacctggcggcagcgcaaaagatg

SEQ ID NO: 33313 - DNA, 103 bp, Artificial Sequence
  Synthetic Polynucleotide
taatacgactcactatagggaaatagtccagcttgacaatggtcgattccaacagaggagaggaatcatgcattgtcaaaacctggcggcagcgcaaaagatg

SEQ ID NO: 33314 - DNA, 103 bp, Artificial Sequence
  Synthetic Polynucleotide
taatacgactcactatagggaccttgtataccaccaacctattgctccccaacagaggagaggggagatgtaggttggtaacctggcggcagcgcaaaagatg

SEQ ID NO: 33315 - DNA, 103 bp, Artificial Sequence
  Synthetic Polynucleotide
taatacgactcactatagggtgcagaaatagattgatgaatcccgcgctcaacagaggagagagcgcatgattcatcaaaacctggcggcagcgcaaaagatg

SEQ ID NO: 33316 - DNA, 103 bp, Artificial Sequence
  Synthetic Polynucleotide
taatacgactcactatagggacgcataaatgtgactccaaactatcttggaacagaggagaccaagaatgtttggagtcaacctggcggcagcgcaaaagatg

SEQ ID NO: 33317 - DNA, 103 bp, Artificial Sequence
  Synthetic Polynucleotide
taatacgactcactatagggagtggactgcggatgatcctttccctttgtaacagaggagaacaaagatgaaggatcataacctggcggcagcgcaaaagatg

SEQ ID NO: 33318 - DNA, 103 bp, Artificial Sequence
  Synthetic Polynucleotide
taatacgactcactataggggccgctgatcggcagatctaccctactagaaacagaggagatctagtatggtagatctgaacctggcggcagcgcaaaagatg

SEQ ID NO: 33319 - DNA, 103 bp, Artificial Sequence
  Synthetic Polynucleotide
taatacgactcactatagggatcgaataaatctggtaacaacgagtacggaacagaggagaccgtacatgttgttaccaaacctggcggcagcgcaaaagatg

SEQ ID NO: 33320 - DNA, 103 bp, Artificial Sequence
  Synthetic Polynucleotide
taatacgactcactatagggccgcacttagttttttacaacccattgtaaaacagaggagattacaaatggttgtaaaaaacctggcggcagcgcaaaagatg

SEQ ID NO: 33321 - DNA, 103 bp, Artificial Sequence
  Synthetic Polynucleotide
taatacgactcactatagggagttaccgtcagtggggaaacggtattgataacagaggagaatcaatatggtttccccaaacctggcggcagcgcaaaagatg

SEQ ID NO: 33322 - DNA, 103 bp, Artificial Sequence
  Synthetic Polynucleotide
taatacgactcactatagggaagggggaggacataaagaacaggagtttaaacagaggagataaactatggttctttataacctggcggcagcgcaaaagatg

SEQ ID NO: 33323 - DNA, 103 bp, Artificial Sequence
  Synthetic Polynucleotide
taatacgactcactataggggcgtccctctgatacgtagaaaccaaatcaaacagaggagatgatttatgttctacgtaaacctggcggcagcgcaaaagatg

SEQ ID NO: 33324 - DNA, 103 bp, Artificial Sequence
  Synthetic Polynucleotide
taatacgactcactatagggcttaccggtgtaccctaggccgcaaccattaacagaggagaaatggtatgggcctagggaacctggcggcagcgcaaaagatg

SEQ ID NO: 33325 - DNA, 103 bp, Artificial Sequence
  Synthetic Polynucleotide
taatacgactcactatagggcgggatgttattaccggcacctttagctcaaacagaggagatgagctatgggtgccggtaacctggcggcagcgcaaaagatg

SEQ ID NO: 33326 - DNA, 103 bp, Artificial Sequence
  Synthetic Polynucleotide
taatacgactcactatagggacacgctccgagtcagccccgccttggaccaacagaggagaggtccaatgcggggctgaaacctggcggcagcgcaaaagatg

SEQ ID NO: 33327 - DNA, 103 bp, Artificial Sequence
  Synthetic Polynucleotide
taatacgactcactataggggggttgtccatccactcgcgtggaaccaggaacagaggagacctggtatgacgcgagtgaacctggcggcagcgcaaaagatg

SEQ ID NO: 33328 - DNA, 103 bp, Artificial Sequence
  Synthetic Polynucleotide
taatacgactcactatagggataccctccacttgtaacaggtaacacccgaacagaggagacgggtgatgcctgttacaaacctggcggcagcgcaaaagatg

SEQ ID NO: 33329 - DNA, 103 bp, Artificial Sequence
  Synthetic Polynucleotide
taatacgactcactataggggccataatgatactagacccgtcctgtttcaacagaggagagaaacaatgcgggtctagaacctggcggcagcgcaaaagatg

SEQ ID NO: 33330 - DNA, 103 bp, Artificial Sequence
  Synthetic Polynucleotide
taatacgactcactatagggcgattagtagtgggcctactaaattgcgcaaacagaggagatgcgcaatgtagtaggccaacctggcggcagcgcaaaagatg

SEQ ID NO: 33331 - DNA, 103 bp, Artificial Sequence
  Synthetic Polynucleotide
taatacgactcactataggggaagggacacacaggctcatatgaaaatggaacagaggagaccatttatgtatgagcctaacctggcggcagcgcaaaagatg

SEQ ID NO: 33332 - DNA, 103 bp, Artificial Sequence
  Synthetic Polynucleotide
taatacgactcactatagggacccgtagcggtgcaccaagaacatttgtgaacagaggagacacaaaatgtcttggtgcaacctggcggcagcgcaaaagatg

SEQ ID NO: 33333 - DNA, 103 bp, Artificial Sequence
  Synthetic Polynucleotide
taatacgactcactatagggtcgcggaatgatgcacgtgttccccggtttaacagaggagaaaaccgatgaacacgtgcaacctggcggcagcgcaaaagatg

SEQ ID NO: 33334 - DNA, 103 bp, Artificial Sequence
  Synthetic Polynucleotide
taatacgactcactatagggctaagttggtaagtccgacatccataagaaaacagaggagattcttaatgatgtcggacaacctggcggcagcgcaaaagatg

SEQ ID NO: 33335 - DNA, 103 bp, Artificial Sequence
  Synthetic Polynucleotide
taatacgactcactatagggcgatggcgcagactatgtgagccatataaaaacagaggagatttataatgctcacatagaacctggcggcagcgcaaaagatg

SEQ ID NO: 33336 - DNA, 103 bp, Artificial Sequence
  Synthetic Polynucleotide
taatacgactcactatagggataacattgtgaggtgaccagcggagcgttaacagaggagaaacgctatgctggtcaccaacctggcggcagcgcaaaagatg

SEQ ID NO: 33337 - DNA, 103 bp, Artificial Sequence
  Synthetic Polynucleotide
taatacgactcactatagggtcacgtcgccgacaatgcaaccggccagagaacagaggagactctggatggttgcattgaacctggcggcagcgcaaaagatg

SEQ ID NO: 33338 - DNA, 103 bp, Artificial Sequence
  Synthetic Polynucleotide
taatacgactcactataggggatctagcagacgatcaagttatctcccagaacagaggagactgggaatgaacttgatcaacctggcggcagcgcaaaagatg

SEQ ID NO: 33339 - DNA, 103 bp, Artificial Sequence
  Synthetic Polynucleotide
taatacgactcactatagggcatagagttccagattatgataatctaccaaacagaggagatggtagatgatcataatcaacctggcggcagcgcaaaagatg

SEQ ID NO: 33340 - DNA, 103 bp, Artificial Sequence
  Synthetic Polynucleotide
taatacgactcactatagggcgactatctgtccccaatagaaaccagtacaacagaggagagtactgatgtctattgggaacctggcggcagcgcaaaagatg

SEQ ID NO: 33341 - DNA, 103 bp, Artificial Sequence
  Synthetic Polynucleotide
taatacgactcactatagggaatagtagcaagcgaaggcagtcatcccctaacagaggagaaggggaatgctgccttcgaacctggcggcagcgcaaaagatg

SEQ ID NO: 33342 - DNA, 103 bp, Artificial Sequence
  Synthetic Polynucleotide
taatacgactcactataggggcagccctgttacccccagccgctgacgaaaacagaggagattcgtcatgggctgggggaacctggcggcagcgcaaaagatg

SEQ ID NO: 33343 - DNA, 103 bp, Artificial Sequence
  Synthetic Polynucleotide
taatacgactcactataggggaaatttaggggggttataacccattacataacagaggagaatgtaaatggttataaccaacctggcggcagcgcaaaagatg

SEQ ID NO: 33344 - DNA, 103 bp, Artificial Sequence
  Synthetic Polynucleotide
taatacgactcactataggggggaggcttgcctgagcgtctgaacatgccaacagaggagaggcatgatgagacgctcaaacctggcggcagcgcaaaagatg

SEQ ID NO: 33345 - DNA, 103 bp, Artificial Sequence
  Synthetic Polynucleotide
taatacgactcactataggggcctttggtcgtacacgttgaggaaatatgaacagaggagacatattatgtcaacgtgtaacctggcggcagcgcaaaagatg

SEQ ID NO: 33346 - DNA, 103 bp, Artificial Sequence
  Synthetic Polynucleotide
taatacgactcactatagggctagatgcgaacaaatacacgtacggtgacaacagaggagagtcaccatgcgtgtatttaacctggcggcagcgcaaaagatg

SEQ ID NO: 33347 - DNA, 103 bp, Artificial Sequence
  Synthetic Polynucleotide
taatacgactcactatagggataacgggtggcgcaaacgtccgtgcgctcaacagaggagagagcgcatggacgtttgcaacctggcggcagcgcaaaagatg

SEQ ID NO: 33348 - DNA, 103 bp, Artificial Sequence
  Synthetic Polynucleotide
taatacgactcactatagggggtttaactggaatactaatcggaatgaccaacagaggagaggtcatatggattagtataacctggcggcagcgcaaaagatg

SEQ ID NO: 33349 - DNA, 103 bp, Artificial Sequence
  Synthetic Polynucleotide
taatacgactcactatagggaaagggacccccgaggcaatccgctctcgtaacagaggagaacgagaatggattgcctcaacctggcggcagcgcaaaagatg

SEQ ID NO: 33350 - DNA, 103 bp, Artificial Sequence
  Synthetic Polynucleotide
taatacgactcactatagggagacccgacaagcacagtcaaatccggagcaacagaggagagctccgatgttgactgtgaacctggcggcagcgcaaaagatg

SEQ ID NO: 33351 - DNA, 103 bp, Artificial Sequence
  Synthetic Polynucleotide
taatacgactcactatagggactgcgaggacacccctcattctgtaagataacagaggagaatcttaatgaatgaggggaacctggcggcagcgcaaaagatg

SEQ ID NO: 33352 - DNA, 103 bp, Artificial Sequence
  Synthetic Polynucleotide
taatacgactcactatagggtggcacggactagagcttcccaccccagcaaacagaggagatgctggatggggaagctcaacctggcggcagcgcaaaagatg

SEQ ID NO: 33353 - DNA, 103 bp, Artificial Sequence
  Synthetic Polynucleotide
taatacgactcactatagggaacgaatcgtaaaacagggggctaacgtctaacagaggagaagacgtatgccccctgttaacctggcggcagcgcaaaagatg

SEQ ID NO: 33354 - DNA, 103 bp, Artificial Sequence
  Synthetic Polynucleotide
taatacgactcactatagggccgactgagcgcgccgcagtattgccgtgtaacagaggagaacacggatgtactgcggcaacctggcggcagcgcaaaagatg

SEQ ID NO: 33355 - DNA, 103 bp, Artificial Sequence
  Synthetic Polynucleotide
taatacgactcactatagggcttagagcggttgcgagttagcaagtgtcaaacagaggagatgacacatgctaactcgcaacctggcggcagcgcaaaagatg

SEQ ID NO: 33356 - DNA, 103 bp, Artificial Sequence
  Synthetic Polynucleotide
taatacgactcactatagggcgttatctgcctaatatagcgtcacatctaaacagaggagatagatgatgcgctatattaacctggcggcagcgcaaaagatg

SEQ ID NO: 33357 - DNA, 103 bp, Artificial Sequence
  Synthetic Polynucleotide
taatacgactcactatagggcatgacgtgcaaagaccagagcagtttgcgaacagaggagacgcaaaatgctctggtctaacctggcggcagcgcaaaagatg

SEQ ID NO: 33358 - DNA, 103 bp, Artificial Sequence
  Synthetic Polynucleotide
taatacgactcactatagggagaattttaggttagggtccacttgtaccgaacagaggagacggtacatgtggaccctaaacctggcggcagcgcaaaagatg

SEQ ID NO: 33359 - DNA, 103 bp, Artificial Sequence
  Synthetic Polynucleotide
taatacgactcactatagggaacaggaattatgcaggggcgaaagtaaaaaacagaggagattttacatgcgcccctgcaacctggcggcagcgcaaaagatg

SEQ ID NO: 33360 - DNA, 103 bp, Artificial Sequence
  Synthetic Polynucleotide
taatacgactcactatagggtgacaacatatcggcgcggaccaaagtgttaacagaggagaaacactatggtccgcgccaacctggcggcagcgcaaaagatg

SEQ ID NO: 33361 - DNA, 103 bp, Artificial Sequence
  Synthetic Polynucleotide
taatacgactcactatagggaacttgctgcctcgaaatgaaacatcagccaacagaggagaggctgaatgttcatttcgaacctggcggcagcgcaaaagatg

SEQ ID NO: 33362 - DNA, 103 bp, Artificial Sequence
  Synthetic Polynucleotide
taatacgactcactatagggtcttaccaatggcccctcgactaaggcatcaacagaggagagatgccatggtcgaggggaacctggcggcagcgcaaaagatg

SEQ ID NO: 33363 - DNA, 103 bp, Artificial Sequence
  Synthetic Polynucleotide
taatacgactcactatagggcggccacgttattatcggagtggaccttgaaacagaggagatcaaggatgactccgataaacctggcggcagcgcaaaagatg

SEQ ID NO: 33364 - DNA, 103 bp, Artificial Sequence
  Synthetic Polynucleotide
taatacgactcactatagggaagtggtacttgggccagccccctcctccaaacagaggagatggaggatggggctggccaacctggcggcagcgcaaaagatg

SEQ ID NO: 33365 - DNA, 103 bp, Artificial Sequence
  Synthetic Polynucleotide
taatacgactcactatagggattaggcgtaattgtgtgcggctctacaagaacagaggagacttgtaatgccgcacacaaacctggcggcagcgcaaaagatg

SEQ ID NO: 33366 - DNA, 103 bp, Artificial Sequence
  Synthetic Polynucleotide
taatacgactcactatagggtggtggctgtttacagtaggaatgttctctaacagaggagaagagaaatgtcctactgtaacctggcggcagcgcaaaagatg

SEQ ID NO: 33367 - DNA, 103 bp, Artificial Sequence
  Synthetic Polynucleotide
taatacgactcactatagggacttttacgtactcttcatgttacctcagcaacagaggagagctgagatgacatgaagaaacctggcggcagcgcaaaagatg

SEQ ID NO: 33368 - DNA, 103 bp, Artificial Sequence
  Synthetic Polynucleotide
taatacgactcactataggggctcatgcgccgtccctggcccttatgattaacagaggagaaatcatatgggccagggaaacctggcggcagcgcaaaagatg

SEQ ID NO: 33369 - DNA, 103 bp, Artificial Sequence
  Synthetic Polynucleotide
taatacgactcactatagggctggttacaatgtatgtttagataaactaaaacagaggagattagttatgctaaacataaacctggcggcagcgcaaaagatg

SEQ ID NO: 33370 - DNA, 103 bp, Artificial Sequence
  Synthetic Polynucleotide
taatacgactcactatagggatgcaacccctgctcggaacgactcgccctaacagaggagaagggcgatgcgttccgagaacctggcggcagcgcaaaagatg

SEQ ID NO: 33371 - DNA, 103 bp, Artificial Sequence
  Synthetic Polynucleotide
taatacgactcactataggggcttgggaatcatgctaggttttagcgtccaacagaggagaggacgcatgaacctagcaaacctggcggcagcgcaaaagatg

SEQ ID NO: 33372 - DNA, 103 bp, Artificial Sequence
  Synthetic Polynucleotide
taatacgactcactatagggcaggcgttgggcctcatcgtcccgaaatgaaacagaggagatcatttatggacgatgagaacctggcggcagcgcaaaagatg

SEQ ID NO: 33373 - DNA, 103 bp, Artificial Sequence
  Synthetic Polynucleotide
taatacgactcactatagggatgatagatgctcaacgtacttaacgtggcaacagaggagagccacgatgagtacgttgaacctggcggcagcgcaaaagatg

SEQ ID NO: 33374 - DNA, 103 bp, Artificial Sequence
  Synthetic Polynucleotide
taatacgactcactatagggctaatctgggcaccgctccacaggagatacaacagaggagagtatctatggtggagcggaacctggcggcagcgcaaaagatg

SEQ ID NO: 33375 - DNA, 103 bp, Artificial Sequence
  Synthetic Polynucleotide
taatacgactcactatagggtcactcaaaactccaagttgactcattagtaacagaggagaactaatatgtcaacttggaacctggcggcagcgcaaaagatg

SEQ ID NO: 33376 - DNA, 103 bp, Artificial Sequence
  Synthetic Polynucleotide
taatacgactcactataggggcggagttgagtctcactgcggtgagccctaacagaggagaagggctatgcgcagtgagaacctggcggcagcgcaaaagatg

SEQ ID NO: 33377 - DNA, 103 bp, Artificial Sequence
  Synthetic Polynucleotide
taatacgactcactatagggtgtctaggactcgcaaactccggataaaataacagaggagaattttaatgggagtttgcaacctggcggcagcgcaaaagatg

SEQ ID NO: 33378 - DNA, 103 bp, Artificial Sequence
  Synthetic Polynucleotide
taatacgactcactatagggcacggcaggggatgcgccgacgtcactatcaacagaggagagatagtatggtcggcgcaaacctggcggcagcgcaaaagatg

SEQ ID NO: 33379 - DNA, 103 bp, Artificial Sequence
  Synthetic Polynucleotide
taatacgactcactatagggcactagtcagctgagtggtgcggatagcttaacagaggagaaagctaatggcaccactcaacctggcggcagcgcaaaagatg

SEQ ID NO: 33380 - DNA, 103 bp, Artificial Sequence
  Synthetic Polynucleotide
taatacgactcactatagggtggagttacggaccccagcacgggccccacaacagaggagagtggggatggtgctggggaacctggcggcagcgcaaaagatg

SEQ ID NO: 33381 - DNA, 103 bp, Artificial Sequence
  Synthetic Polynucleotide
taatacgactcactatagggaaactcgtacgcggcacactcgagagaagaaacagaggagatcttctatggagtgtgccaacctggcggcagcgcaaaagatg

SEQ ID NO: 33382 - DNA, 103 bp, Artificial Sequence
  Synthetic Polynucleotide
taatacgactcactatagggtgtcaaaaacattaccggaaacaggccttaaacagaggagataaggcatgtttccggtaaacctggcggcagcgcaaaagatg

SEQ ID NO: 33383 - DNA, 103 bp, Artificial Sequence
  Synthetic Polynucleotide
taatacgactcactatagggcttgtaccttaggtattacctactgataacaacagaggagagttatcatgaggtaatacaacctggcggcagcgcaaaagatg

SEQ ID NO: 33384 - DNA, 103 bp, Artificial Sequence
  Synthetic Polynucleotide
taatacgactcactatagggtacaaggctccgaacggacgggcagtaagtaacagaggagaacttacatgccgtccgttaacctggcggcagcgcaaaagatg

SEQ ID NO: 33385 - DNA, 103 bp, Artificial Sequence
  Synthetic Polynucleotide
taatacgactcactatagggtgggtgaggtgtacatttcgttctgctcttaacagaggagaaagagcatgacgaaatgtaacctggcggcagcgcaaaagatg

SEQ ID NO: 33386 - DNA, 103 bp, Artificial Sequence
  Synthetic Polynucleotide
taatacgactcactataggggggcagagccagagacgagcttcatctctcaacagaggagagagagaatgagctcgtctaacctggcggcagcgcaaaagatg

SEQ ID NO: 33387 - DNA, 103 bp, Artificial Sequence
  Synthetic Polynucleotide
taatacgactcactatagggaacctgtcgggtacattcgccatttgacttaacagaggagaaagtcaatgggcgaatgtaacctggcggcagcgcaaaagatg

SEQ ID NO: 33388 - DNA, 103 bp, Artificial Sequence
  Synthetic Polynucleotide
taatacgactcactatagggtaccctcgaaaacgaggaatacgcggtcgaaacagaggagatcgaccatgtattcctcgaacctggcggcagcgcaaaagatg

SEQ ID NO: 33389 - DNA, 103 bp, Artificial Sequence
  Synthetic Polynucleotide
taatacgactcactatagggtcctcatctcaggctgtggttgtatggttaaacagaggagataaccaatgaaccacagcaacctggcggcagcgcaaaagatg

SEQ ID NO: 33390 - DNA, 103 bp, Artificial Sequence
  Synthetic Polynucleotide
taatacgactcactatagggtgtgcccgctcctgcgactatgccttctataacagaggagaatagaaatgatagtcgcaaacctggcggcagcgcaaaagatg

SEQ ID NO: 33391 - DNA, 103 bp, Artificial Sequence
  Synthetic Polynucleotide
taatacgactcactatagggttgtcccgcggcccaaggaaatgtgtcgttaacagaggagaaacgacatgtttccttggaacctggcggcagcgcaaaagatg

SEQ ID NO: 33392 - DNA, 103 bp, Artificial Sequence
  Synthetic Polynucleotide
taatacgactcactatagggacgcgattgtatcatcagctgatttaagataacagaggagaatcttaatgcagctgatgaacctggcggcagcgcaaaagatg

SEQ ID NO: 33393 - DNA, 103 bp, Artificial Sequence
  Synthetic Polynucleotide
taatacgactcactataggggaggacatttaggttcagagcattaacattaacagaggagaaatgttatggctctgaacaacctggcggcagcgcaaaagatg

SEQ ID NO: 33394 - DNA, 103 bp, Artificial Sequence
  Synthetic Polynucleotide
taatacgactcactatagggtatgcgatggtgtgctccgacgacagcgtgaacagaggagacacgctatggtcggagcaaacctggcggcagcgcaaaagatg

SEQ ID NO: 33395 - DNA, 103 bp, Artificial Sequence
  Synthetic Polynucleotide
taatacgactcactatagggctcggtatcctccgggatcgttgtaagtcaaacagaggagatgacttatgacgatcccgaacctggcggcagcgcaaaagatg

SEQ ID NO: 33396 - DNA, 103 bp, Artificial Sequence
  Synthetic Polynucleotide
taatacgactcactatagggcctgacattccgtgatctcgggaagaaatgaacagaggagacatttcatgccgagatcaaacctggcggcagcgcaaaagatg

SEQ ID NO: 33397 - DNA, 103 bp, Artificial Sequence
  Synthetic Polynucleotide
taatacgactcactataggggataggtagacgggaggtgattccacccataacagaggagaatgggtatgatcacctccaacctggcggcagcgcaaaagatg

SEQ ID NO: 33398 - DNA, 103 bp, Artificial Sequence
  Synthetic Polynucleotide
taatacgactcactataggggattcgacatacctgtattcagtggccagcaacagaggagagctggcatgtgaatacagaacctggcggcagcgcaaaagatg

SEQ ID NO: 33399 - DNA, 103 bp, Artificial Sequence
  Synthetic Polynucleotide
taatacgactcactataggggtactaggataagctgtcgatagccaaactaacagaggagaagtttgatgatcgacagcaacctggcggcagcgcaaaagatg

SEQ ID NO: 33400 - DNA, 103 bp, Artificial Sequence
  Synthetic Polynucleotide
taatacgactcactatagggcccaaacttacggccatcggctaaaagaggaacagaggagacctcttatggccgatggcaacctggcggcagcgcaaaagatg

SEQ ID NO: 33401 - DNA, 103 bp, Artificial Sequence
  Synthetic Polynucleotide
taatacgactcactatagggcactgtcagccctcttttgctcagacgcataacagaggagaatgcgtatgagcaaaagaaacctggcggcagcgcaaaagatg

SEQ ID NO: 33402 - DNA, 103 bp, Artificial Sequence
  Synthetic Polynucleotide
taatacgactcactatagggtcatggggtacaagagaaagaatgggaacgaacagaggagacgttccatgtctttctctaacctggcggcagcgcaaaagatg

SEQ ID NO: 33403 - DNA, 103 bp, Artificial Sequence
  Synthetic Polynucleotide
taatacgactcactatagggacttcactggaaaggctgggaccccaggtaaacagaggagatacctgatgtcccagcctaacctggcggcagcgcaaaagatg

SEQ ID NO: 33404 - DNA, 103 bp, Artificial Sequence
  Synthetic Polynucleotide
taatacgactcactatagggggttcatagcaacatctggagttatagtcgaacagaggagacgactaatgctccagatgaacctggcggcagcgcaaaagatg

SEQ ID NO: 33405 - DNA, 103 bp, Artificial Sequence
  Synthetic Polynucleotide
taatacgactcactataggggacgcctcgcgggcgccgatagcgtagccgaacagaggagacggctaatgtatcggcgcaacctggcggcagcgcaaaagatg

SEQ ID NO: 33406 - DNA, 103 bp, Artificial Sequence
  Synthetic Polynucleotide
taatacgactcactatagggcgaatcctcctcggctatccaccaccgcgcaacagaggagagcgcggatgtggatagccaacctggcggcagcgcaaaagatg

SEQ ID NO: 33407 - DNA, 103 bp, Artificial Sequence
  Synthetic Polynucleotide
taatacgactcactatagggcgttcttcaaaaggatcccttcaaggcagcaacagaggagagctgccatgaagggatccaacctggcggcagcgcaaaagatg

SEQ ID NO: 33408 - DNA, 103 bp, Artificial Sequence
  Synthetic Polynucleotide
taatacgactcactatagggacgtaattgttttgcggcttctgatgccgtaacagaggagaacggcaatggaagccgcaaacctggcggcagcgcaaaagatg

SEQ ID NO: 33409 - DNA, 103 bp, Artificial Sequence
  Synthetic Polynucleotide
taatacgactcactatagggttgaaacgaattccatacatacgtcatgctaacagaggagaagcatgatgtatgtatggaacctggcggcagcgcaaaagatg

SEQ ID NO: 33410 - DNA, 103 bp, Artificial Sequence
  Synthetic Polynucleotide
taatacgactcactatagggggtgaactacccctggttccttgtcgggagaacagaggagactcccgatgaggaaccagaacctggcggcagcgcaaaagatg

SEQ ID NO: 33411 - DNA, 103 bp, Artificial Sequence
  Synthetic Polynucleotide
taatacgactcactatagggtaacctccatcatcttatcgtgtgctcaagaacagaggagacttgagatgacgataagaaacctggcggcagcgcaaaagatg

SEQ ID NO: 33412 - DNA, 103 bp, Artificial Sequence
  Synthetic Polynucleotide
taatacgactcactatagggcatgcgtgcgacaggctagggaaccagtgaaacagaggagatcactgatgccctagcctaacctggcggcagcgcaaaagatg

SEQ ID NO: 33413 - DNA, 103 bp, Artificial Sequence
  Synthetic Polynucleotide
taatacgactcactatagggtttacaaaataaacgagaatgcgcgatgccaacagaggagaggcatcatgcattctcgtaacctggcggcagcgcaaaagatg

SEQ ID NO: 33414 - DNA, 103 bp, Artificial Sequence
  Synthetic Polynucleotide
taatacgactcactatagggaggagcgctctctatatccggagtgcgccaaacagaggagatggcgcatgccggatataaacctggcggcagcgcaaaagatg

SEQ ID NO: 33415 - DNA, 103 bp, Artificial Sequence
  Synthetic Polynucleotide
taatacgactcactatagggaagtaactttattgcctgctccatttcgccaacagaggagaggcgaaatggagcaggcaaacctggcggcagcgcaaaagatg

SEQ ID NO: 33416 - DNA, 103 bp, Artificial Sequence
  Synthetic Polynucleotide
taatacgactcactatagggatccgacactagcaaccaccggttatcagaaacagaggagatctgatatgcggtggttgaacctggcggcagcgcaaaagatg

SEQ ID NO: 33417 - DNA, 103 bp, Artificial Sequence
  Synthetic Polynucleotide
taatacgactcactatagggcattcgtttatctacattcgggggaaaagaaacagaggagatcttttatgccgaatgtaaacctggcggcagcgcaaaagatg

SEQ ID NO: 33418 - DNA, 103 bp, Artificial Sequence
  Synthetic Polynucleotide
taatacgactcactataggggcgtactagctccggagcgcgattatatagaacagaggagactatatatgcgcgctccgaacctggcggcagcgcaaaagatg

SEQ ID NO: 33419 - DNA, 103 bp, Artificial Sequence
  Synthetic Polynucleotide
taatacgactcactatagggggaccggattctgtcgagggaccgccgtggaacagaggagaccacggatgtccctcgacaacctggcggcagcgcaaaagatg

SEQ ID NO: 33420 - DNA, 103 bp, Artificial Sequence
  Synthetic Polynucleotide
taatacgactcactatagggcattatcggtacgtccgaatcgtaaattctaacagaggagaagaattatggattcggacaacctggcggcagcgcaaaagatg

SEQ ID NO: 33421 - DNA, 103 bp, Artificial Sequence
  Synthetic Polynucleotide
taatacgactcactatagggacaccctaattagtgctagcggcacgttcaaacagaggagatgaacgatgcgctagcacaacctggcggcagcgcaaaagatg

SEQ ID NO: 33422 - DNA, 103 bp, Artificial Sequence
  Synthetic Polynucleotide
taatacgactcactataggggtcattgagcttgattatgtttacctaactaacagaggagaagttagatgaacataatcaacctggcggcagcgcaaaagatg

SEQ ID NO: 33423 - DNA, 103 bp, Artificial Sequence
  Synthetic Polynucleotide
taatacgactcactatagggctagttcatatctgcacttgcggcaagtacaacagaggagagtacttatggcaagtgcaaacctggcggcagcgcaaaagatg

SEQ ID NO: 33424 - DNA, 103 bp, Artificial Sequence
  Synthetic Polynucleotide
taatacgactcactataggggaaaatcaatctgaagcaatgaagtaggctaacagaggagaagcctaatgcattgcttcaacctggcggcagcgcaaaagatg

SEQ ID NO: 33425 - DNA, 103 bp, Artificial Sequence
  Synthetic Polynucleotide
taatacgactcactatagggagttacctccactaccttcagggcaaaacgaacagaggagacgttttatgctgaaggtaaacctggcggcagcgcaaaagatg

SEQ ID NO: 33426 - DNA, 103 bp, Artificial Sequence
  Synthetic Polynucleotide
taatacgactcactatagggtcacccaccacggcacgcctgagggcatataacagaggagaatatgcatgcaggcgtgcaacctggcggcagcgcaaaagatg

SEQ ID NO: 33427 - DNA, 103 bp, Artificial Sequence
  Synthetic Polynucleotide
taatacgactcactatagggagttaagtacagatctaactggctgaaactaacagaggagaagtttcatgcagttagataacctggcggcagcgcaaaagatg

SEQ ID NO: 33428 - DNA, 103 bp, Artificial Sequence
  Synthetic Polynucleotide
taatacgactcactataggggtggtgagagagactccctggtgggcgcccaacagaggagagggcgcatgccagggagtaacctggcggcagcgcaaaagatg

SEQ ID NO: 33429 - DNA, 103 bp, Artificial Sequence
  Synthetic Polynucleotide
taatacgactcactatagggccccgagagtagcggccagttctccccttaaacagaggagataagggatgaactggccgaacctggcggcagcgcaaaagatg

SEQ ID NO: 33430 - DNA, 103 bp, Artificial Sequence
  Synthetic Polynucleotide
taatacgactcactatagggctcgtggtgaaataatcacaaagggggagaaacagaggagatctcccatgttgtgattaaacctggcggcagcgcaaaagatg

SEQ ID NO: 33431 - DNA, 103 bp, Artificial Sequence
  Synthetic Polynucleotide
taatacgactcactatagggcattcaaacagcggcacggcaacaaaggggaacagaggagaccccttatgtgccgtgccaacctggcggcagcgcaaaagatg

SEQ ID NO: 33432 - DNA, 103 bp, Artificial Sequence
  Synthetic Polynucleotide
taatacgactcactatagggggtagacgtacgtacaagcagttgtcgataaacagaggagatatcgaatgctgcttgtaaacctggcggcagcgcaaaagatg

SEQ ID NO: 33433 - DNA, 103 bp, Artificial Sequence
  Synthetic Polynucleotide
taatacgactcactatagggagtccagctccgagctgtgttgagtcactgaacagaggagacagtgaatgaacacagctaacctggcggcagcgcaaaagatg

SEQ ID NO: 33434 - DNA, 103 bp, Artificial Sequence
  Synthetic Polynucleotide
taatacgactcactatagggcgacaatttcaaaataatatttctaaacaaaacagaggagattgtttatgaatattattaacctggcggcagcgcaaaagatg

SEQ ID NO: 33435 - DNA, 103 bp, Artificial Sequence
  Synthetic Polynucleotide
taatacgactcactatagggaatgctgaaacccacgaacgacacaacggaaacagaggagatccgttatgtcgttcgtgaacctggcggcagcgcaaaagatg

SEQ ID NO: 33436 - DNA, 103 bp, Artificial Sequence
  Synthetic Polynucleotide
taatacgactcactataggggttctatacctgctccagttagtatcagcgaacagaggagacgctgaatgtaactggagaacctggcggcagcgcaaaagatg

SEQ ID NO: 33437 - DNA, 103 bp, Artificial Sequence
  Synthetic Polynucleotide
taatacgactcactataggggatggcatgagtcttctcatgcgaactgagaacagaggagactcagtatgcatgagaagaacctggcggcagcgcaaaagatg

SEQ ID NO: 33438 - DNA, 103 bp, Artificial Sequence
  Synthetic Polynucleotide
taatacgactcactatagggattagattagtcataccgcgtattaggaagaacagaggagacttcctatgacgcggtataacctggcggcagcgcaaaagatg

SEQ ID NO: 33439 - DNA, 103 bp, Artificial Sequence
  Synthetic Polynucleotide
taatacgactcactatagggcctttaaacgcggcggcagagcgcgcctgcaacagaggagagcaggcatgctctgccgcaacctggcggcagcgcaaaagatg

SEQ ID NO: 33440 - DNA, 103 bp, Artificial Sequence
  Synthetic Polynucleotide
taatacgactcactatagggccggacaggagacctgctaccaaaacaagcaacagaggagagcttgtatgggtagcaggaacctggcggcagcgcaaaagatg

SEQ ID NO: 33441 - DNA, 103 bp, Artificial Sequence
  Synthetic Polynucleotide
taatacgactcactataggggctgtcgcctcccaacttgtagaaggcccaaacagaggagatgggccatgtacaagttgaacctggcggcagcgcaaaagatg

SEQ ID NO: 33442 - DNA, 103 bp, Artificial Sequence
  Synthetic Polynucleotide
taatacgactcactatagggctcatcaggctaaggcgcacgcctggtcccaacagaggagagggaccatgcgtgcgcctaacctggcggcagcgcaaaagatg

SEQ ID NO: 33443 - DNA, 103 bp, Artificial Sequence
  Synthetic Polynucleotide
taatacgactcactatagggtcgagatagaacgacgtggtgaattgctaaaacagaggagattagcaatgcaccacgtcaacctggcggcagcgcaaaagatg

SEQ ID NO: 33444 - DNA, 103 bp, Artificial Sequence
  Synthetic Polynucleotide
taatacgactcactataggggcacgtgtgtcggtgaggggagatccacataacagaggagaatgtggatgtcccctcacaacctggcggcagcgcaaaagatg

SEQ ID NO: 33445 - DNA, 103 bp, Artificial Sequence
  Synthetic Polynucleotide
taatacgactcactatagggcggcccctgatggaggattgttaacgcattaacagaggagaaatgcgatgacaatcctcaacctggcggcagcgcaaaagatg

SEQ ID NO: 33446 - DNA, 103 bp, Artificial Sequence
  Synthetic Polynucleotide
taatacgactcactatagggtgatgtcgcgacagcggcagcttgagttgcaacagaggagagcaactatggctgccgctaacctggcggcagcgcaaaagatg

SEQ ID NO: 33447 - DNA, 103 bp, Artificial Sequence
  Synthetic Polynucleotide
taatacgactcactataggggatataagttcggggcagtagccggtctaaaacagaggagattagacatgctactgcccaacctggcggcagcgcaaaagatg

SEQ ID NO: 33448 - DNA, 103 bp, Artificial Sequence
  Synthetic Polynucleotide
taatacgactcactataggggttaggagctgtaggaaacctagacgtcctaacagaggagaaggacgatgaggtttcctaacctggcggcagcgcaaaagatg

SEQ ID NO: 33449 - DNA, 103 bp, Artificial Sequence
  Synthetic Polynucleotide
taatacgactcactataggggctgagcacaaaggacggtcttccgggatgaacagaggagacatcccatgagaccgtccaacctggcggcagcgcaaaagatg

SEQ ID NO: 33450 - DNA, 103 bp, Artificial Sequence
  Synthetic Polynucleotide
taatacgactcactataggggtaaagtaccggctcacgaagagtttgcggaacagaggagaccgcaaatgcttcgtgagaacctggcggcagcgcaaaagatg

SEQ ID NO: 33451 - DNA, 103 bp, Artificial Sequence
  Synthetic Polynucleotide
taatacgactcactatagggtggacccgcgtttactacagacctatctggaacagaggagaccagatatgtctgtagtaaacctggcggcagcgcaaaagatg

SEQ ID NO: 33452 - DNA, 103 bp, Artificial Sequence
  Synthetic Polynucleotide
taatacgactcactatagggtaaatacagaccatactctattaggtcactaacagaggagaagtgacatgatagagtataacctggcggcagcgcaaaagatg

SEQ ID NO: 33453 - DNA, 103 bp, Artificial Sequence
  Synthetic Polynucleotide
taatacgactcactatagggttttggtagggatgcgtcacgagctgttagaacagaggagactaacaatgcgtgacgcaaacctggcggcagcgcaaaagatg

SEQ ID NO: 33454 - DNA, 103 bp, Artificial Sequence
  Synthetic Polynucleotide
taatacgactcactatagggtgcagaccccagaatcaatgctctagacacaacagaggagagtgtctatggcattgattaacctggcggcagcgcaaaagatg

SEQ ID NO: 33455 - DNA, 103 bp, Artificial Sequence
  Synthetic Polynucleotide
taatacgactcactatagggtgagcgagtccctatggttagtgaggtgccaacagaggagaggcaccatgctaaccataaacctggcggcagcgcaaaagatg

SEQ ID NO: 33456 - DNA, 103 bp, Artificial Sequence
  Synthetic Polynucleotide
taatacgactcactatagggcaaccggagcgatgagtcacaatcccccacaacagaggagagtggggatgtgtgactcaaacctggcggcagcgcaaaagatg

SEQ ID NO: 33457 - DNA, 103 bp, Artificial Sequence
  Synthetic Polynucleotide
taatacgactcactatagggcatccgagttccatgtgttgcctgcgcgagaacagaggagactcgcgatggcaacacataacctggcggcagcgcaaaagatg

SEQ ID NO: 33458 - DNA, 103 bp, Artificial Sequence
  Synthetic Polynucleotide
taatacgactcactataggggtggaaattttcctcactcctcagtcgtctaacagaggagaagacgaatgaggagtgagaacctggcggcagcgcaaaagatg

SEQ ID NO: 33459 - DNA, 103 bp, Artificial Sequence
  Synthetic Polynucleotide
taatacgactcactataggggaatgcgctgtttgggcctccgggtgaggcaacagaggagagcctcaatgggaggcccaaacctggcggcagcgcaaaagatg

SEQ ID NO: 33460 - DNA, 103 bp, Artificial Sequence
  Synthetic Polynucleotide
taatacgactcactataggggatcgcggaagacaatacgtgatacgatccaacagaggagaggatcgatgcacgtattgaacctggcggcagcgcaaaagatg

SEQ ID NO: 33461 - DNA, 103 bp, Artificial Sequence
  Synthetic Polynucleotide
taatacgactcactatagggccttacgaaaatgcattttgagagcaaaacaacagaggagagttttgatgtcaaaatgcaacctggcggcagcgcaaaagatg

SEQ ID NO: 33462 - DNA, 103 bp, Artificial Sequence
  Synthetic Polynucleotide
taatacgactcactatagggcgcacgctgcagtgtttattactgcaggataacagaggagaatcctgatgtaataaacaaacctggcggcagcgcaaaagatg

SEQ ID NO: 33463 - DNA, 103 bp, Artificial Sequence
  Synthetic Polynucleotide
taatacgactcactatagggctgctcgattctaactgatcagtagctggcaacagaggagagccagcatgtgatcagttaacctggcggcagcgcaaaagatg

SEQ ID NO: 33464 - DNA, 103 bp, Artificial Sequence
  Synthetic Polynucleotide
taatacgactcactatagggattgccgcaatgggatggcggcgcgcttggaacagaggagaccaagcatgccgccatccaacctggcggcagcgcaaaagatg

SEQ ID NO: 33465 - DNA, 103 bp, Artificial Sequence
  Synthetic Polynucleotide
taatacgactcactatagggagggtaccatgccgctcgtgtaatacatggaacagaggagaccatgtatgacacgagcgaacctggcggcagcgcaaaagatg

SEQ ID NO: 33466 - DNA, 103 bp, Artificial Sequence
  Synthetic Polynucleotide
taatacgactcactatagggcgcgacctggccgtagttccgttacgggataacagaggagaatcccgatgcggaactacaacctggcggcagcgcaaaagatg

SEQ ID NO: 33467 - DNA, 103 bp, Artificial Sequence
  Synthetic Polynucleotide
taatacgactcactatagggcggacgtttgatggttcacccagccattgtaacagaggagaacaatgatggggtgaaccaacctggcggcagcgcaaaagatg

SEQ ID NO: 33468 - DNA, 103 bp, Artificial Sequence
  Synthetic Polynucleotide
taatacgactcactatagggggcgctgtcgtccgtccagaacctagcagcaacagaggagagctgctatgttctggacgaacctggcggcagcgcaaaagatg

SEQ ID NO: 33469 - DNA, 103 bp, Artificial Sequence
  Synthetic Polynucleotide
taatacgactcactatagggcggcggttaaaccaaatacggcgagaggtgaacagaggagacacctcatgccgtatttgaacctggcggcagcgcaaaagatg

SEQ ID NO: 33470 - DNA, 103 bp, Artificial Sequence
  Synthetic Polynucleotide
taatacgactcactatagggctgggagcgcggcctacgatcatggtagtcaacagaggagagactacatggatcgtaggaacctggcggcagcgcaaaagatg

SEQ ID NO: 33471 - DNA, 103 bp, Artificial Sequence
  Synthetic Polynucleotide
taatacgactcactatagggtcggagccctggagatgggacgctctgtgcaacagaggagagcacagatggtcccatctaacctggcggcagcgcaaaagatg

SEQ ID NO: 33472 - DNA, 103 bp, Artificial Sequence
  Synthetic Polynucleotide
taatacgactcactatagggagcgctactcgacacaatttctgtgggattaacagaggagaaatcccatggaaattgtgaacctggcggcagcgcaaaagatg

SEQ ID NO: 33473 - DNA, 103 bp, Artificial Sequence
  Synthetic Polynucleotide
taatacgactcactatagggactatgaggcctggaaccccggtggactgaaacagaggagatcagtcatgcggggttccaacctggcggcagcgcaaaagatg

SEQ ID NO: 33474 - DNA, 103 bp, Artificial Sequence
  Synthetic Polynucleotide
taatacgactcactatagggagcttcgctttgttaggtatttcagagaacaacagaggagagttctcatgaatacctaaaacctggcggcagcgcaaaagatg

SEQ ID NO: 33475 - DNA, 103 bp, Artificial Sequence
  Synthetic Polynucleotide
taatacgactcactatagggtaactatccgctgcggccgtgtggcgaacaaacagaggagatgttcgatgcacggccgcaacctggcggcagcgcaaaagatg

SEQ ID NO: 33476 - DNA, 103 bp, Artificial Sequence
  Synthetic Polynucleotide
taatacgactcactataggggatgcaaatattcttacttggaacctgaagaacagaggagacttcagatgccaagtaagaacctggcggcagcgcaaaagatg

SEQ ID NO: 33477 - DNA, 103 bp, Artificial Sequence
  Synthetic Polynucleotide
taatacgactcactataggggacctcggatagcccgtgctgctcatcagcaacagaggagagctgatatgcagcacgggaacctggcggcagcgcaaaagatg

SEQ ID NO: 33478 - DNA, 103 bp, Artificial Sequence
  Synthetic Polynucleotide
taatacgactcactataggggtaacttgagacccatgtttcgcgagtttgaacagaggagacaaactatggaaacatggaacctggcggcagcgcaaaagatg

SEQ ID NO: 33479 - DNA, 103 bp, Artificial Sequence
  Synthetic Polynucleotide
taatacgactcactatagggagaaagttcttccagctatcgtccaaacacaacagaggagagtgtttatgcgatagctgaacctggcggcagcgcaaaagatg

SEQ ID NO: 33480 - DNA, 103 bp, Artificial Sequence
  Synthetic Polynucleotide
taatacgactcactatagggctacgttaaagtacgacccgacaactacggaacagaggagaccgtagatgtcgggtcgtaacctggcggcagcgcaaaagatg

SEQ ID NO: 33481 - DNA, 103 bp, Artificial Sequence
  Synthetic Polynucleotide
taatacgactcactatagggattaataaaccttcctctaagcgacgtaggaacagaggagacctacgatgcttagaggaaacctggcggcagcgcaaaagatg

SEQ ID NO: 33482 - DNA, 103 bp, Artificial Sequence
  Synthetic Polynucleotide
taatacgactcactataggggtttaacactcctacaactgtgatcgtggaaacagaggagatccacgatgacagttgtaaacctggcggcagcgcaaaagatg

SEQ ID NO: 33483 - DNA, 103 bp, Artificial Sequence
  Synthetic Polynucleotide
taatacgactcactataggggtccggacgcggccgggaatacgggtcgacaacagaggagagtcgacatgtattcccggaacctggcggcagcgcaaaagatg

SEQ ID NO: 33484 - DNA, 103 bp, Artificial Sequence
  Synthetic Polynucleotide
taatacgactcactatagggatatcggcacgcagcagttcgaatgactccaacagaggagaggagtcatgcgaactgctaacctggcggcagcgcaaaagatg

SEQ ID NO: 33485 - DNA, 103 bp, Artificial Sequence
  Synthetic Polynucleotide
taatacgactcactatagggtccaaagcccgcgtatgtacggcctgttaaaacagaggagattaacaatgcgtacatacaacctggcggcagcgcaaaagatg

SEQ ID NO: 33486 - DNA, 103 bp, Artificial Sequence
  Synthetic Polynucleotide
taatacgactcactatagggagagtcaacggttagaacatcgtcaaagttaacagaggagaaactttatggatgttctaaacctggcggcagcgcaaaagatg

SEQ ID NO: 33487 - DNA, 103 bp, Artificial Sequence
  Synthetic Polynucleotide
taatacgactcactatagggtctcgagaacctatcgtttattctgcggaaaacagaggagattccgcatgataaacgataacctggcggcagcgcaaaagatg

SEQ ID NO: 33488 - DNA, 103 bp, Artificial Sequence
  Synthetic Polynucleotide
taatacgactcactatagggtattaatatgttgcgccttcggtctctgataacagaggagaatcagaatgcgaaggcgcaacctggcggcagcgcaaaagatg

SEQ ID NO: 33489 - DNA, 103 bp, Artificial Sequence
  Synthetic Polynucleotide
taatacgactcactatagggcattcgtgctgatagcactgcggtatgtataacagaggagaatacatatggcagtgctaaacctggcggcagcgcaaaagatg

SEQ ID NO: 33490 - DNA, 103 bp, Artificial Sequence
  Synthetic Polynucleotide
taatacgactcactatagggagtgagcgttcccgacaccttatataccacaacagaggagagtggtaatgaaggtgtcgaacctggcggcagcgcaaaagatg

SEQ ID NO: 33491 - DNA, 103 bp, Artificial Sequence
  Synthetic Polynucleotide
taatacgactcactataggggagatgatttacacagcatatgcaaggttaaacagaggagataacctatgatatgctgtaacctggcggcagcgcaaaagatg

SEQ ID NO: 33492 - DNA, 103 bp, Artificial Sequence
  Synthetic Polynucleotide
taatacgactcactataggggttggatgagttagcttgcgtatcacctcaaacagaggagatgaggtatgacgcaagctaacctggcggcagcgcaaaagatg

SEQ ID NO: 33493 - DNA, 103 bp, Artificial Sequence
  Synthetic Polynucleotide
taatacgactcactatagggcttaaataacggtgccggctctggctatctaacagaggagaagatagatggagccggcaaacctggcggcagcgcaaaagatg

SEQ ID NO: 33494 - DNA, 103 bp, Artificial Sequence
  Synthetic Polynucleotide
taatacgactcactatagggaaaaacccgtacgagtcttaaggagataacaacagaggagagttatcatgttaagactcaacctggcggcagcgcaaaagatg

SEQ ID NO: 33495 - DNA, 103 bp, Artificial Sequence
  Synthetic Polynucleotide
taatacgactcactataggggaccatgcgttcattgaaatcggaaaaaagaacagaggagactttttatggatttcaataacctggcggcagcgcaaaagatg

SEQ ID NO: 33496 - DNA, 103 bp, Artificial Sequence
  Synthetic Polynucleotide
taatacgactcactatagggtgcgcgcgtgctgcgcgcagacaccccaataacagaggagaattgggatgtctgcgcgcaacctggcggcagcgcaaaagatg

SEQ ID NO: 33497 - DNA, 103 bp, Artificial Sequence
  Synthetic Polynucleotide
taatacgactcactatagggtcataggcaccgcttctgcagtacatacccaacagaggagagggtatatgctgcagaagaacctggcggcagcgcaaaagatg

SEQ ID NO: 33498 - DNA, 103 bp, Artificial Sequence
  Synthetic Polynucleotide
taatacgactcactatagggttcttctctgagtgcgatatcctcagactcaacagaggagagagtctatggatatcgcaaacctggcggcagcgcaaaagatg

SEQ ID NO: 33499 - DNA, 103 bp, Artificial Sequence
  Synthetic Polynucleotide
taatacgactcactatagggaagatacaacgcctaacactgggaaattgaaacagaggagatcaattatgcagtgttagaacctggcggcagcgcaaaagatg

SEQ ID NO: 33500 - DNA, 103 bp, Artificial Sequence
  Synthetic Polynucleotide
taatacgactcactatagggaccgtaccataatccgcccattggaggataaacagaggagatatcctatgatgggcggaaacctggcggcagcgcaaaagatg

SEQ ID NO: 33501 - DNA, 103 bp, Artificial Sequence
  Synthetic Polynucleotide
taatacgactcactatagggaatcattcgatctcgagtcataacactacaaacagaggagatgtagtatgatgactcgaaacctggcggcagcgcaaaagatg

SEQ ID NO: 33502 - DNA, 103 bp, Artificial Sequence
  Synthetic Polynucleotide
taatacgactcactataggggctatacggagcgattagtcaataagcacaaacagaggagatgtgctatgtgactaatcaacctggcggcagcgcaaaagatg

SEQ ID NO: 33503 - DNA, 103 bp, Artificial Sequence
  Synthetic Polynucleotide
taatacgactcactatagggcgagaccgatgctgagtcacaagataatgaaacagaggagatcattaatgtgtgactcaaacctggcggcagcgcaaaagatg

SEQ ID NO: 33504 - DNA, 103 bp, Artificial Sequence
  Synthetic Polynucleotide
taatacgactcactataggggtgcacgagcgagagtcatagcatggcgccaacagaggagaggcgccatgctatgactcaacctggcggcagcgcaaaagatg

SEQ ID NO: 33505 - DNA, 103 bp, Artificial Sequence
  Synthetic Polynucleotide
taatacgactcactatagggtagagagcccgttcgacacagtaagcgcacaacagaggagagtgcgcatgctgtgtcgaaacctggcggcagcgcaaaagatg

SEQ ID NO: 33506 - DNA, 103 bp, Artificial Sequence
  Synthetic Polynucleotide
taatacgactcactatagggaattggctagacctgtaagaagttttcaggaacagaggagacctgaaatgttcttacagaacctggcggcagcgcaaaagatg

SEQ ID NO: 33507 - DNA, 103 bp, Artificial Sequence
  Synthetic Polynucleotide
taatacgactcactatagggagatcgccatgtagcaggaggcaagattggaacagaggagaccaatcatgcctcctgctaacctggcggcagcgcaaaagatg

SEQ ID NO: 33508 - DNA, 103 bp, Artificial Sequence
  Synthetic Polynucleotide
taatacgactcactataggggaggggcaacgtcccggcggttgtatttgcaacagaggagagcaaatatgaccgccgggaacctggcggcagcgcaaaagatg

SEQ ID NO: 33509 - DNA, 103 bp, Artificial Sequence
  Synthetic Polynucleotide
taatacgactcactatagggggttaggcacttgggctatcggtcctattgaacagaggagacaatagatgcgatagcccaacctggcggcagcgcaaaagatg

SEQ ID NO: 33510 - DNA, 103 bp, Artificial Sequence
  Synthetic Polynucleotide
taatacgactcactatagggtacgcgcttgcctagcggggtaagctcttaaacagaggagataagagatgaccccgctaaacctggcggcagcgcaaaagatg

SEQ ID NO: 33511 - DNA, 103 bp, Artificial Sequence
  Synthetic Polynucleotide
taatacgactcactatagggtatccaggctgttgcacaccgaagtcgccaaacagaggagatggcgaatgcggtgtgcaaacctggcggcagcgcaaaagatg

SEQ ID NO: 33512 - DNA, 103 bp, Artificial Sequence
  Synthetic Polynucleotide
taatacgactcactatagggtcatcatcatgaccaattcgagtgttttagaacagaggagactaaaaatgtcgaattggaacctggcggcagcgcaaaagatg

SEQ ID NO: 33513 - DNA, 103 bp, Artificial Sequence
  Synthetic Polynucleotide
taatacgactcactataggggcctagaccgcaacttaggtgagtcacgaaaacagaggagattcgtgatgcacctaagtaacctggcggcagcgcaaaagatg

SEQ ID NO: 33514 - DNA, 103 bp, Artificial Sequence
  Synthetic Polynucleotide
taatacgactcactataggggaggcacgaaacacgtccctgctaccgcctaacagaggagaaggcggatgcagggacgtaacctggcggcagcgcaaaagatg

SEQ ID NO: 33515 - DNA, 103 bp, Artificial Sequence
  Synthetic Polynucleotide
taatacgactcactatagggaaaaactacctacccgcaaggttctgacagaacagaggagactgtcaatgccttgcgggaacctggcggcagcgcaaaagatg

SEQ ID NO: 33516 - DNA, 103 bp, Artificial Sequence
  Synthetic Polynucleotide
taatacgactcactatagggggtcgtataaaatatcattgacagtttagtaacagaggagaactaaaatgtcaatgataaacctggcggcagcgcaaaagatg

SEQ ID NO: 33517 - DNA, 103 bp, Artificial Sequence
  Synthetic Polynucleotide
taatacgactcactatagggtctgctttggacgactttcgtgccatcagaaacagaggagatctgatatgacgaaagtcaacctggcggcagcgcaaaagatg

SEQ ID NO: 33518 - DNA, 103 bp, Artificial Sequence
  Synthetic Polynucleotide
taatacgactcactatagggccggagaagaggagcgacgcatcatgttctaacagaggagaagaacaatgtgcgtcgctaacctggcggcagcgcaaaagatg

SEQ ID NO: 33519 - DNA, 103 bp, Artificial Sequence
  Synthetic Polynucleotide
taatacgactcactataggggcacggacttgggcattatctttcgcattgaacagaggagacaatgcatgagataatgcaacctggcggcagcgcaaaagatg

SEQ ID NO: 33520 - DNA, 103 bp, Artificial Sequence
  Synthetic Polynucleotide
taatacgactcactatagggagacctacagcttaataaggtccaaagtacaacagaggagagtacttatgaccttattaaacctggcggcagcgcaaaagatg

SEQ ID NO: 33521 - DNA, 103 bp, Artificial Sequence
  Synthetic Polynucleotide
taatacgactcactatagggtatgtcccgcggttcggactcaacttagtcaacagaggagagactaaatggagtccgaaaacctggcggcagcgcaaaagatg

SEQ ID NO: 33522 - DNA, 103 bp, Artificial Sequence
  Synthetic Polynucleotide
taatacgactcactatagggcgacctgcaaaagaaccccggttaagcaccaacagaggagaggtgctatgccggggttcaacctggcggcagcgcaaaagatg

SEQ ID NO: 33523 - DNA, 103 bp, Artificial Sequence
  Synthetic Polynucleotide
taatacgactcactatagggattggcccagtagggtcccttcatactcttaacagaggagaaagagtatgaagggacccaacctggcggcagcgcaaaagatg

SEQ ID NO: 33524 - DNA, 103 bp, Artificial Sequence
  Synthetic Polynucleotide
taatacgactcactataggggagaaaaggcccggttatccgatagtttcgaacagaggagacgaaacatgcggataaccaacctggcggcagcgcaaaagatg

SEQ ID NO: 33525 - DNA, 103 bp, Artificial Sequence
  Synthetic Polynucleotide
taatacgactcactataggggtcctggcatatttattaccgtcgttaaaaaacagaggagattttaaatgcggtaataaaacctggcggcagcgcaaaagatg

SEQ ID NO: 33526 - DNA, 103 bp, Artificial Sequence
  Synthetic Polynucleotide
taatacgactcactatagggtcgcctttttgcatgcggtcccagctaggcaacagaggagagcctagatgggaccgcataacctggcggcagcgcaaaagatg

SEQ ID NO: 33527 - DNA, 103 bp, Artificial Sequence
  Synthetic Polynucleotide
taatacgactcactatagggtgctttatagcccacaaattccgatttcaaaacagaggagattgaaaatggaatttgtgaacctggcggcagcgcaaaagatg

SEQ ID NO: 33528 - DNA, 103 bp, Artificial Sequence
  Synthetic Polynucleotide
taatacgactcactatagggtcgttgtatgaagttagcggcaacagctacaacagaggagagtagctatggccgctaacaacctggcggcagcgcaaaagatg

SEQ ID NO: 33529 - DNA, 103 bp, Artificial Sequence
  Synthetic Polynucleotide
taatacgactcactatagggaggaagctgtaaccacgccgctaaccttcaaacagaggagatgaaggatggcggcgtggaacctggcggcagcgcaaaagatg

SEQ ID NO: 33530 - DNA, 103 bp, Artificial Sequence
  Synthetic Polynucleotide
taatacgactcactataggggtcctcaaccctagtgagggaagcgggagcaacagaggagagctcccatgtccctcactaacctggcggcagcgcaaaagatg

SEQ ID NO: 33531 - DNA, 103 bp, Artificial Sequence
  Synthetic Polynucleotide
taatacgactcactatagggccatggtcgcttgcgagcgttagccaagggaacagaggagacccttgatgaacgctcgcaacctggcggcagcgcaaaagatg

SEQ ID NO: 33532 - DNA, 103 bp, Artificial Sequence
  Synthetic Polynucleotide
taatacgactcactatagggacctcgtgggcctacgctatcctccctcagaacagaggagactgaggatggatagcgtaaacctggcggcagcgcaaaagatg

SEQ ID NO: 33533 - DNA, 103 bp, Artificial Sequence
  Synthetic Polynucleotide
taatacgactcactataggggtctcttaagctgactttacctccatataaaacagaggagattatatatgggtaaagtcaacctggcggcagcgcaaaagatg

SEQ ID NO: 33534 - DNA, 103 bp, Artificial Sequence
  Synthetic Polynucleotide
taatacgactcactataggggctgtgccgcgagtagtctgttcagcaagtaacagaggagaacttgcatgacagactacaacctggcggcagcgcaaaagatg

SEQ ID NO: 33535 - DNA, 103 bp, Artificial Sequence
  Synthetic Polynucleotide
taatacgactcactatagggttgtgacccacgtagagaactttccgtgggaacagaggagacccacgatgagttctctaaacctggcggcagcgcaaaagatg

SEQ ID NO: 33536 - DNA, 103 bp, Artificial Sequence
  Synthetic Polynucleotide
taatacgactcactatagggccgtaactcacctactcaatatccaatgtcaacagaggagagacattatgtattgagtaaacctggcggcagcgcaaaagatg

SEQ ID NO: 33537 - DNA, 103 bp, Artificial Sequence
  Synthetic Polynucleotide
taatacgactcactatagggacaacacgtttcctcggctcagagacagcaaacagaggagatgctgtatgtgagccgagaacctggcggcagcgcaaaagatg

SEQ ID NO: 33538 - DNA, 103 bp, Artificial Sequence
  Synthetic Polynucleotide
taatacgactcactatagggggtaacactaaatggatactatgacggtcgaacagaggagacgaccgatgtagtatccaaacctggcggcagcgcaaaagatg

SEQ ID NO: 33539 - DNA, 103 bp, Artificial Sequence
  Synthetic Polynucleotide
taatacgactcactatagggcggcagtcatgcgcgggggtggcgtttctgaacagaggagacagaaaatgcacccccgcaacctggcggcagcgcaaaagatg

SEQ ID NO: 33540 - DNA, 103 bp, Artificial Sequence
  Synthetic Polynucleotide
taatacgactcactataggggcctcccagtccgacgtaggccgtgaggtaaacagaggagatacctcatggcctacgtcaacctggcggcagcgcaaaagatg

SEQ ID NO: 33541 - DNA, 103 bp, Artificial Sequence
  Synthetic Polynucleotide
taatacgactcactatagggacgtccttagtgaacgtggagtcctcagccaacagaggagaggctgaatgctccacgttaacctggcggcagcgcaaaagatg

SEQ ID NO: 33542 - DNA, 103 bp, Artificial Sequence
  Synthetic Polynucleotide
taatacgactcactatagggagagtcgagaagccctgaacatcgatagtgaacagaggagacactatatgtgttcagggaacctggcggcagcgcaaaagatg

SEQ ID NO: 33543 - DNA, 103 bp, Artificial Sequence
  Synthetic Polynucleotide
taatacgactcactatagggatacttgtcagcccacggtcgacacctacgaacagaggagacgtaggatgcgaccgtggaacctggcggcagcgcaaaagatg

SEQ ID NO: 33544 - DNA, 103 bp, Artificial Sequence
  Synthetic Polynucleotide
taatacgactcactatagggaacctaggttcttgaagtagtaacgggataaacagaggagatatcccatgactacttcaaacctggcggcagcgcaaaagatg

SEQ ID NO: 33545 - DNA, 103 bp, Artificial Sequence
  Synthetic Polynucleotide
taatacgactcactataggggttccgtggcatagtacggtgtcccgacctaacagaggagaaggtcgatgcaccgtactaacctggcggcagcgcaaaagatg

SEQ ID NO: 33546 - DNA, 103 bp, Artificial Sequence
  Synthetic Polynucleotide
taatacgactcactataggggacttgaaggtggaaaaatattgtctggacaacagaggagagtccagatgatatttttcaacctggcggcagcgcaaaagatg

SEQ ID NO: 33547 - DNA, 103 bp, Artificial Sequence
  Synthetic Polynucleotide
taatacgactcactatagggtggagcgggaactaaaaacctaaaagtgacaacagaggagagtcactatgaggtttttaaacctggcggcagcgcaaaagatg

SEQ ID NO: 33548 - DNA, 103 bp, Artificial Sequence
  Synthetic Polynucleotide
taatacgactcactatagggtccattcatacaaaatggtggtattcaagcaacagaggagagcttgaatgccaccatttaacctggcggcagcgcaaaagatg

SEQ ID NO: 33549 - DNA, 103 bp, Artificial Sequence
  Synthetic Polynucleotide
taatacgactcactatagggcataaaccgtttctttcagatagggagtccaacagaggagaggactcatgatctgaaagaacctggcggcagcgcaaaagatg

SEQ ID NO: 33550 - DNA, 103 bp, Artificial Sequence
  Synthetic Polynucleotide
taatacgactcactatagggtaattcaccctccgcccagaacggcgataaaacagaggagattatcgatgttctgggcgaacctggcggcagcgcaaaagatg

SEQ ID NO: 33551 - DNA, 103 bp, Artificial Sequence
  Synthetic Polynucleotide
taatacgactcactataggggattggagcagctcagatcattactgtcgcaacagaggagagcgacaatgatgatctgaaacctggcggcagcgcaaaagatg

SEQ ID NO: 33552 - DNA, 103 bp, Artificial Sequence
  Synthetic Polynucleotide
taatacgactcactatagggaggctacaatcgcgcggtgcggttgacccaaacagaggagatgggtcatgcgcaccgcgaacctggcggcagcgcaaaagatg

SEQ ID NO: 33553 - DNA, 103 bp, Artificial Sequence
  Synthetic Polynucleotide
taatacgactcactataggggaatctaccttcataaccccaagtatttgcaacagaggagagcaaatatgtggggttataacctggcggcagcgcaaaagatg

SEQ ID NO: 33554 - DNA, 103 bp, Artificial Sequence
  Synthetic Polynucleotide
taatacgactcactatagggcccgcgtgcacatttaacgcatggcattgcaacagaggagagcaatgatgtgcgttaaaaacctggcggcagcgcaaaagatg

SEQ ID NO: 33555 - DNA, 103 bp, Artificial Sequence
  Synthetic Polynucleotide
taatacgactcactataggggcctcgttgtcaatggtcaataacttatcaaacagaggagatgataaatgattgaccataacctggcggcagcgcaaaagatg

SEQ ID NO: 33556 - DNA, 103 bp, Artificial Sequence
  Synthetic Polynucleotide
taatacgactcactatagggctaccgctgtactaactgcacccggaaagcaacagaggagagctttcatggtgcagttaaacctggcggcagcgcaaaagatg

SEQ ID NO: 33557 - DNA, 103 bp, Artificial Sequence
  Synthetic Polynucleotide
taatacgactcactatagggtttgctgccacgactatctaccgaagtactaacagaggagaagtactatggtagatagtaacctggcggcagcgcaaaagatg

SEQ ID NO: 33558 - DNA, 103 bp, Artificial Sequence
  Synthetic Polynucleotide
taatacgactcactatagggggcagcctagtggtggtagggctttttagtaacagaggagaactaaaatgccctaccacaacctggcggcagcgcaaaagatg

SEQ ID NO: 33559 - DNA, 103 bp, Artificial Sequence
  Synthetic Polynucleotide
taatacgactcactatagggatccagaatgtttccttcaatttaaacctcaacagaggagagaggttatgattgaaggaaacctggcggcagcgcaaaagatg

SEQ ID NO: 33560 - DNA, 103 bp, Artificial Sequence
  Synthetic Polynucleotide
taatacgactcactatagggcaacaacactaccgtgcacgggtggagtcaaacagaggagatgactcatgccgtgcacgaacctggcggcagcgcaaaagatg

SEQ ID NO: 33561 - DNA, 103 bp, Artificial Sequence
  Synthetic Polynucleotide
taatacgactcactatagggccaaaaagtatatatctccgcgcgagtccgaacagaggagacggactatggcggagataaacctggcggcagcgcaaaagatg

SEQ ID NO: 33562 - DNA, 103 bp, Artificial Sequence
  Synthetic Polynucleotide
taatacgactcactatagggtaggcaagtacttgcacctgtctcatactgaacagaggagacagtatatgacaggtgcaaacctggcggcagcgcaaaagatg

SEQ ID NO: 33563 - DNA, 103 bp, Artificial Sequence
  Synthetic Polynucleotide
taatacgactcactataggggttgtcgtcggaggaaataaatgtaggcacaacagaggagagtgcctatgtttatttccaacctggcggcagcgcaaaagatg

SEQ ID NO: 33564 - DNA, 103 bp, Artificial Sequence
  Synthetic Polynucleotide
taatacgactcactatagggttcccggccaacgcccctgacctttctatcaacagaggagagatagaatggtcaggggcaacctggcggcagcgcaaaagatg

SEQ ID NO: 33565 - DNA, 103 bp, Artificial Sequence
  Synthetic Polynucleotide
taatacgactcactataggggcccttcccgtagtgcattagatcgagtgcaacagaggagagcactcatgctaatgcacaacctggcggcagcgcaaaagatg

SEQ ID NO: 33566 - DNA, 103 bp, Artificial Sequence
  Synthetic Polynucleotide
taatacgactcactatagggtcggctgtcgcgcttgtttagttctttttcaacagaggagagaaaaaatgctaaacaagaacctggcggcagcgcaaaagatg

SEQ ID NO: 33567 - DNA, 103 bp, Artificial Sequence
  Synthetic Polynucleotide
taatacgactcactatagggggggagggcgcctcaaagggttcccggcacaacagaggagagtgccgatgaccctttgaaacctggcggcagcgcaaaagatg

SEQ ID NO: 33568 - DNA, 103 bp, Artificial Sequence
  Synthetic Polynucleotide
taatacgactcactatagggccaaatggcgagtcgtcgtagcgaggagacaacagaggagagtctccatgctacgacgaaacctggcggcagcgcaaaagatg

SEQ ID NO: 33569 - DNA, 103 bp, Artificial Sequence
  Synthetic Polynucleotide
taatacgactcactatagggtacgcgccccgcgtacgacgcaggatacgcaacagaggagagcgtatatggcgtcgtacaacctggcggcagcgcaaaagatg

SEQ ID NO: 33570 - DNA, 103 bp, Artificial Sequence
  Synthetic Polynucleotide
taatacgactcactatagggttaagtctctgtgctgctcatgtatatatgaacagaggagacatataatgatgagcagcaacctggcggcagcgcaaaagatg

SEQ ID NO: 33571 - DNA, 103 bp, Artificial Sequence
  Synthetic Polynucleotide
taatacgactcactatagggacatgcaggggcatgcttcaacagataaaaaacagaggagattttatatgttgaagcataacctggcggcagcgcaaaagatg

SEQ ID NO: 33572 - DNA, 103 bp, Artificial Sequence
  Synthetic Polynucleotide
taatacgactcactatagggaatatccggtttaacgcgtcaatgacccctaacagaggagaaggggtatgtgacgcgttaacctggcggcagcgcaaaagatg

SEQ ID NO: 33573 - DNA, 103 bp, Artificial Sequence
  Synthetic Polynucleotide
taatacgactcactatagggccgtacgtccctccccttaggttgcgttataacagaggagaataacgatgcctaaggggaacctggcggcagcgcaaaagatg

SEQ ID NO: 33574 - DNA, 103 bp, Artificial Sequence
  Synthetic Polynucleotide
taatacgactcactatagggcatgggactgcgccagatatttctatgataaacagaggagatatcatatgaatatctggaacctggcggcagcgcaaaagatg

SEQ ID NO: 33575 - DNA, 103 bp, Artificial Sequence
  Synthetic Polynucleotide
taatacgactcactatagggacttgattcctcggcgactcactgtggcgcaacagaggagagcgccaatgtgagtcgccaacctggcggcagcgcaaaagatg

SEQ ID NO: 33576 - DNA, 103 bp, Artificial Sequence
  Synthetic Polynucleotide
taatacgactcactatagggcattgctggtgaaaccccgccgaaggcagaaacagaggagatctgccatgggcggggttaacctggcggcagcgcaaaagatg

SEQ ID NO: 33577 - DNA, 103 bp, Artificial Sequence
  Synthetic Polynucleotide
taatacgactcactatagggagccgtgattgaactcaatgtgggaaaatgaacagaggagacattttatgacattgagtaacctggcggcagcgcaaaagatg

SEQ ID NO: 33578 - DNA, 103 bp, Artificial Sequence
  Synthetic Polynucleotide
taatacgactcactatagggacgcactggcttattaacggcgtattgtataacagaggagaatacaaatggccgttaataacctggcggcagcgcaaaagatg

SEQ ID NO: 33579 - DNA, 103 bp, Artificial Sequence
  Synthetic Polynucleotide
taatacgactcactataggggtccaatatagtctgatacctagtaggccaaacagaggagatggcctatgaggtatcagaacctggcggcagcgcaaaagatg

SEQ ID NO: 33580 - DNA, 103 bp, Artificial Sequence
  Synthetic Polynucleotide
taatacgactcactatagggttcgtgttgcctgatgaattctgctggataaacagaggagatatccaatggaattcatcaacctggcggcagcgcaaaagatg

SEQ ID NO: 33581 - DNA, 103 bp, Artificial Sequence
  Synthetic Polynucleotide
taatacgactcactataggggtcagagcgcgaggtcggtggccggcctccaacagaggagaggaggcatgccaccgaccaacctggcggcagcgcaaaagatg

SEQ ID NO: 33582 - DNA, 103 bp, Artificial Sequence
  Synthetic Polynucleotide
taatacgactcactatagggcgttccttgcgaggtggctaacatgccggaaacagaggagatccggcatgttagccaccaacctggcggcagcgcaaaagatg

SEQ ID NO: 33583 - DNA, 103 bp, Artificial Sequence
  Synthetic Polynucleotide
taatacgactcactatagggttcattagaagtcacattagagagtcatagaacagaggagactatgaatgtctaatgtgaacctggcggcagcgcaaaagatg

SEQ ID NO: 33584 - DNA, 103 bp, Artificial Sequence
  Synthetic Polynucleotide
taatacgactcactataggggcatcggccgactgattgggccggtgttttaacagaggagaaaaacaatggcccaatcaaacctggcggcagcgcaaaagatg

SEQ ID NO: 33585 - DNA, 103 bp, Artificial Sequence
  Synthetic Polynucleotide
taatacgactcactatagggcagctattcaaactcatggccaaggcaagaaacagaggagatcttgcatgggccatgagaacctggcggcagcgcaaaagatg

SEQ ID NO: 33586 - DNA, 103 bp, Artificial Sequence
  Synthetic Polynucleotide
taatacgactcactatagggagacaacttcgtttgtgcagttgctgaccgaacagaggagacggtcaatgactgcacaaaacctggcggcagcgcaaaagatg

SEQ ID NO: 33587 - DNA, 103 bp, Artificial Sequence
  Synthetic Polynucleotide
taatacgactcactatagggaggaagggttggtaccacctacggaggtaaaacagaggagattacctatgtaggtggtaaacctggcggcagcgcaaaagatg

SEQ ID NO: 33588 - DNA, 103 bp, Artificial Sequence
  Synthetic Polynucleotide
taatacgactcactataggggtcactgtttagcgcgcagagcaagagcctaacagaggagaaggctcatgctctgcgcgaacctggcggcagcgcaaaagatg

SEQ ID NO: 33589 - DNA, 103 bp, Artificial Sequence
  Synthetic Polynucleotide
taatacgactcactatagggcgtgtctcactttctcatgcatcggcggtaaacagaggagataccgcatgtgcatgagaaacctggcggcagcgcaaaagatg

SEQ ID NO: 33590 - DNA, 103 bp, Artificial Sequence
  Synthetic Polynucleotide
taatacgactcactatagggatggtactgctgtgtacgtccgttttaccaaacagaggagatggtaaatgggacgtacaaacctggcggcagcgcaaaagatg

SEQ ID NO: 33591 - DNA, 103 bp, Artificial Sequence
  Synthetic Polynucleotide
taatacgactcactatagggtctttcccaacgccgtgagctgttaatcttaacagaggagaaagattatgagctcacggaacctggcggcagcgcaaaagatg

SEQ ID NO: 33592 - DNA, 103 bp, Artificial Sequence
  Synthetic Polynucleotide
taatacgactcactataggggacccttttactggtattaatgattcggcgaacagaggagacgccgaatgattaataccaacctggcggcagcgcaaaagatg

SEQ ID NO: 33593 - DNA, 103 bp, Artificial Sequence
  Synthetic Polynucleotide
taatacgactcactatagggcgttagttaatgctcgtagaaaagtaatgtaacagaggagaacattaatgttctacgagaacctggcggcagcgcaaaagatg

SEQ ID NO: 33594 - DNA, 103 bp, Artificial Sequence
  Synthetic Polynucleotide
taatacgactcactatagggtctttctgtttggcggaggctatgtcgaggaacagaggagacctcgaatgagcctccgcaacctggcggcagcgcaaaagatg

SEQ ID NO: 33595 - DNA, 103 bp, Artificial Sequence
  Synthetic Polynucleotide
taatacgactcactataggggccctgaaaagtcgacgacggtaataccctaacagaggagaagggtaatgccgtcgtcgaacctggcggcagcgcaaaagatg

SEQ ID NO: 33596 - DNA, 103 bp, Artificial Sequence
  Synthetic Polynucleotide
taatacgactcactatagggtctagcgactaggattcgacgggctgttgcaacagaggagagcaacaatgcgtcgaatcaacctggcggcagcgcaaaagatg

SEQ ID NO: 33597 - DNA, 103 bp, Artificial Sequence
  Synthetic Polynucleotide
taatacgactcactataggggacgagctgctcaatcgtccagaaacgcagaacagaggagactgcgtatgtggacgattaacctggcggcagcgcaaaagatg

SEQ ID NO: 33598 - DNA, 103 bp, Artificial Sequence
  Synthetic Polynucleotide
taatacgactcactatagggtggttatcatgagcctgacaacgttcgctgaacagaggagacagcgaatgttgtcaggcaacctggcggcagcgcaaaagatg

SEQ ID NO: 33599 - DNA, 103 bp, Artificial Sequence
  Synthetic Polynucleotide
taatacgactcactatagggacgggtaatcgtacgcttttcaggttagggaacagaggagaccctaaatggaaaagcgtaacctggcggcagcgcaaaagatg

SEQ ID NO: 33600 - DNA, 103 bp, Artificial Sequence
  Synthetic Polynucleotide
taatacgactcactatagggactgggccgagggctgatttaaggatccttaacagaggagaaaggatatgtaaatcagcaacctggcggcagcgcaaaagatg

SEQ ID NO: 33601 - DNA, 103 bp, Artificial Sequence
  Synthetic Polynucleotide
taatacgactcactatagggcgggaaatgaagctcccgggttgctggcctaacagaggagaaggccaatgacccgggagaacctggcggcagcgcaaaagatg

SEQ ID NO: 33602 - DNA, 103 bp, Artificial Sequence
  Synthetic Polynucleotide
taatacgactcactatagggagcctgcctattcttttcttaggttagatgaacagaggagacatctaatgtaagaaaagaacctggcggcagcgcaaaagatg

SEQ ID NO: 33603 - DNA, 103 bp, Artificial Sequence
  Synthetic Polynucleotide
taatacgactcactataggggggattaagacgtcttgaacaaacttgcttaacagaggagaaagcaaatgtgttcaagaaacctggcggcagcgcaaaagatg

SEQ ID NO: 33604 - DNA, 103 bp, Artificial Sequence
  Synthetic Polynucleotide
taatacgactcactatagggctttagacaagtatgcgcccatcagttctcaacagaggagagagaacatgtgggcgcataacctggcggcagcgcaaaagatg

SEQ ID NO: 33605 - DNA, 103 bp, Artificial Sequence
  Synthetic Polynucleotide
taatacgactcactataggggcaagcggatttaaaagcgggcgtcggatgaacagaggagacatccgatgcccgcttttaacctggcggcagcgcaaaagatg

SEQ ID NO: 33606 - DNA, 103 bp, Artificial Sequence
  Synthetic Polynucleotide
taatacgactcactatagggctggagaatgccaatccctacacacatggaaacagaggagatccatgatggtagggattaacctggcggcagcgcaaaagatg

SEQ ID NO: 33607 - DNA, 103 bp, Artificial Sequence
  Synthetic Polynucleotide
taatacgactcactatagggctttgcgacagtctgcgtcccaacgagggaaacagaggagatccctcatggggacgcagaacctggcggcagcgcaaaagatg

SEQ ID NO: 33608 - DNA, 103 bp, Artificial Sequence
  Synthetic Polynucleotide
taatacgactcactatagggttgtatgtcagatcccgcgattagaggtccaacagaggagaggacctatgatcgcgggaaacctggcggcagcgcaaaagatg

SEQ ID NO: 33609 - DNA, 103 bp, Artificial Sequence
  Synthetic Polynucleotide
taatacgactcactatagggactgcttacagttgtaacgaggttcccgttaacagaggagaaacgggatgctcgttacaaacctggcggcagcgcaaaagatg

SEQ ID NO: 33610 - DNA, 103 bp, Artificial Sequence
  Synthetic Polynucleotide
taatacgactcactatagggtttttcggatcggaatggaatctcggggtcaacagaggagagaccccatgattccattcaacctggcggcagcgcaaaagatg

SEQ ID NO: 33611 - DNA, 103 bp, Artificial Sequence
  Synthetic Polynucleotide
taatacgactcactataggggttgttacgagaccccttgacattagagagaacagaggagactctctatggtcaaggggaacctggcggcagcgcaaaagatg

SEQ ID NO: 33612 - DNA, 103 bp, Artificial Sequence
  Synthetic Polynucleotide
taatacgactcactatagggaggtaaccggttattgtaaccacctaaacgaacagaggagacgtttaatgggttacaataacctggcggcagcgcaaaagatg

SEQ ID NO: 33613 - DNA, 103 bp, Artificial Sequence
  Synthetic Polynucleotide
taatacgactcactataggggacaacatgcccccgttgccgccctacctcaacagaggagagaggtaatgcggcaacggaacctggcggcagcgcaaaagatg

SEQ ID NO: 33614 - DNA, 103 bp, Artificial Sequence
  Synthetic Polynucleotide
taatacgactcactataggggtagccgtcaatcgttttagagtattggctaacagaggagaagccaaatgtctaaaacgaacctggcggcagcgcaaaagatg

SEQ ID NO: 33615 - DNA, 103 bp, Artificial Sequence
  Synthetic Polynucleotide
taatacgactcactatagggatctcatcttgttactcagcgcataaggggaacagaggagaccccttatgcgctgagtaaacctggcggcagcgcaaaagatg

SEQ ID NO: 33616 - DNA, 103 bp, Artificial Sequence
  Synthetic Polynucleotide
taatacgactcactatagggcccattatcccccgaaagtgccgacgggggaacagaggagacccccgatggcactttcgaacctggcggcagcgcaaaagatg

SEQ ID NO: 33617 - DNA, 103 bp, Artificial Sequence
  Synthetic Polynucleotide
taatacgactcactatagggagggctcaattagtaggtgaatcgccctccaacagaggagaggagggatgttcacctacaacctggcggcagcgcaaaagatg

SEQ ID NO: 33618 - DNA, 103 bp, Artificial Sequence
  Synthetic Polynucleotide
taatacgactcactataggggcatccatgctgagcccaacaaacaaactgaacagaggagacagtttatgtgttgggctaacctggcggcagcgcaaaagatg

SEQ ID NO: 33619 - DNA, 103 bp, Artificial Sequence
  Synthetic Polynucleotide
taatacgactcactatagggggggacgatggaattttaggacaatattctaacagaggagaagaataatgtcctaaaataacctggcggcagcgcaaaagatg

SEQ ID NO: 33620 - DNA, 103 bp, Artificial Sequence
  Synthetic Polynucleotide
taatacgactcactatagggccgcgcatcaccccggcatgacagggtagtaacagaggagaactaccatgtcatgccggaacctggcggcagcgcaaaagatg

SEQ ID NO: 33621 - DNA, 103 bp, Artificial Sequence
  Synthetic Polynucleotide
taatacgactcactatagggacgggcggggctgtacactgcttggcccttaacagaggagaaagggcatggcagtgtacaacctggcggcagcgcaaaagatg

SEQ ID NO: 33622 - DNA, 103 bp, Artificial Sequence
  Synthetic Polynucleotide
taatacgactcactataggggtggtataggtcttggattctgccgcttataacagaggagaataagcatgagaatccaaaacctggcggcagcgcaaaagatg

SEQ ID NO: 33623 - DNA, 103 bp, Artificial Sequence
  Synthetic Polynucleotide
taatacgactcactatagggtgggtcttcgctggccatattgttttgccgaacagaggagacggcaaatgaatatggccaacctggcggcagcgcaaaagatg

SEQ ID NO: 33624 - DNA, 103 bp, Artificial Sequence
  Synthetic Polynucleotide
taatacgactcactataggggtccaatggtacatttaatatactccatgtaacagaggagaacatggatgatattaaataacctggcggcagcgcaaaagatg

SEQ ID NO: 33625 - DNA, 103 bp, Artificial Sequence
  Synthetic Polynucleotide
taatacgactcactatagggcgttagacaaaccgttgttccaggtttaacaacagaggagagttaaaatgggaacaacgaacctggcggcagcgcaaaagatg

SEQ ID NO: 33626 - DNA, 103 bp, Artificial Sequence
  Synthetic Polynucleotide
taatacgactcactataggggtgttaaccccaatatggaaccggattttgaacagaggagacaaaatatggttccatataacctggcggcagcgcaaaagatg

SEQ ID NO: 33627 - DNA, 103 bp, Artificial Sequence
  Synthetic Polynucleotide
taatacgactcactatagggcgaagggactattaaccaaacaaatataacaacagaggagagttataatggtttggttaaacctggcggcagcgcaaaagatg

SEQ ID NO: 33628 - DNA, 103 bp, Artificial Sequence
  Synthetic Polynucleotide
taatacgactcactataggggaaaatcgggcccgcggacagtctggtcctaacagaggagaaggaccatgctgtccgcgaacctggcggcagcgcaaaagatg

SEQ ID NO: 33629 - DNA, 103 bp, Artificial Sequence
  Synthetic Polynucleotide
taatacgactcactatagggtcctgtgcagctgacaatattccttcatataacagaggagaatatgaatgaatattgtcaacctggcggcagcgcaaaagatg

SEQ ID NO: 33630 - DNA, 103 bp, Artificial Sequence
  Synthetic Polynucleotide
taatacgactcactatagggtatttgtagtctcggaatttgtccatagaaaacagaggagattctatatgcaaattccgaacctggcggcagcgcaaaagatg

SEQ ID NO: 33631 - DNA, 103 bp, Artificial Sequence
  Synthetic Polynucleotide
taatacgactcactatagggtagtctaacggaacagcggatgtctccgtgaacagaggagacacggaatgatccgctgtaacctggcggcagcgcaaaagatg

SEQ ID NO: 33632 - DNA, 103 bp, Artificial Sequence
  Synthetic Polynucleotide
taatacgactcactatagggtgttcccccccttcgacgagtcttcgggggaacagaggagacccccgatgactcgtcgaaacctggcggcagcgcaaaagatg

SEQ ID NO: 33633 - DNA, 103 bp, Artificial Sequence
  Synthetic Polynucleotide
taatacgactcactataggggtctttgatggtcccccgcatctgcgcagaaacagaggagatctgcgatgatgcgggggaacctggcggcagcgcaaaagatg

SEQ ID NO: 33634 - DNA, 103 bp, Artificial Sequence
  Synthetic Polynucleotide
taatacgactcactatagggcactgttggtaagacatgcatcggtttttaaacagaggagataaaaaatgatgcatgtcaacctggcggcagcgcaaaagatg

SEQ ID NO: 33635 - DNA, 103 bp, Artificial Sequence
  Synthetic Polynucleotide
taatacgactcactataggggagatcagagctctattcaacatgcacctcaacagaggagagaggtgatggttgaatagaacctggcggcagcgcaaaagatg

SEQ ID NO: 33636 - DNA, 103 bp, Artificial Sequence
  Synthetic Polynucleotide
taatacgactcactatagggccagacgaaaccatcagtctcagcgaagtaaacagaggagatacttcatggagactgataacctggcggcagcgcaaaagatg

SEQ ID NO: 33637 - DNA, 103 bp, Artificial Sequence
  Synthetic Polynucleotide
taatacgactcactataggggggttagtgccaattgaaactgagcggctaaacagaggagatagccgatgagtttcaataacctggcggcagcgcaaaagatg

SEQ ID NO: 33638 - DNA, 103 bp, Artificial Sequence
  Synthetic Polynucleotide
taatacgactcactataggggttacgtgagactaacgcgggcgagcacataacagaggagaatgtgcatgcccgcgttaaacctggcggcagcgcaaaagatg

SEQ ID NO: 33639 - DNA, 103 bp, Artificial Sequence
  Synthetic Polynucleotide
taatacgactcactatagggtgtagcactctcaattatttgataaccattaacagaggagaaatggtatgcaaataattaacctggcggcagcgcaaaagatg

SEQ ID NO: 33640 - DNA, 103 bp, Artificial Sequence
  Synthetic Polynucleotide
taatacgactcactatagggggtaatggagcgccctacagcgtaactaagaacagaggagacttagtatggctgtagggaacctggcggcagcgcaaaagatg

SEQ ID NO: 33641 - DNA, 103 bp, Artificial Sequence
  Synthetic Polynucleotide
taatacgactcactatagggtaaaattctttggacataaagctctaaaacaacagaggagagttttaatgctttatgtcaacctggcggcagcgcaaaagatg

SEQ ID NO: 33642 - DNA, 103 bp, Artificial Sequence
  Synthetic Polynucleotide
taatacgactcactatagggtaacaagcaggaaatgcaacaataccacgtaacagaggagaacgtggatgtgttgcattaacctggcggcagcgcaaaagatg

SEQ ID NO: 33643 - DNA, 103 bp, Artificial Sequence
  Synthetic Polynucleotide
taatacgactcactataggggaattccgtaccggggcttttgaacgtcgaaacagaggagatcgacgatgaaaagccccaacctggcggcagcgcaaaagatg

SEQ ID NO: 33644 - DNA, 103 bp, Artificial Sequence
  Synthetic Polynucleotide
taatacgactcactataggggtcctgatgtccgagttcgtaccgtctacaaacagaggagatgtagaatgtacgaactcaacctggcggcagcgcaaaagatg

SEQ ID NO: 33645 - DNA, 103 bp, Artificial Sequence
  Synthetic Polynucleotide
taatacgactcactatagggtatctcagtattgtatgttccattatcacgaacagaggagacgtgatatgggaacatacaacctggcggcagcgcaaaagatg

SEQ ID NO: 33646 - DNA, 103 bp, Artificial Sequence
  Synthetic Polynucleotide
taatacgactcactatagggtggataaacgtagatgtaagaatcagaattaacagaggagaaattctatgtcttacatcaacctggcggcagcgcaaaagatg

SEQ ID NO: 33647 - DNA, 103 bp, Artificial Sequence
  Synthetic Polynucleotide
taatacgactcactatagggttctgcggtcaagacaatggataacgatttaacagaggagaaaatcgatgtccattgtcaacctggcggcagcgcaaaagatg

SEQ ID NO: 33648 - DNA, 103 bp, Artificial Sequence
  Synthetic Polynucleotide
taatacgactcactatagggcccctcgttatcccgggtctgtgtcagttgaacagaggagacaactgatgcagacccggaacctggcggcagcgcaaaagatg

SEQ ID NO: 33649 - DNA, 103 bp, Artificial Sequence
  Synthetic Polynucleotide
taatacgactcactatagggacgctgatgcgataaacgacccgaagtataaacagaggagatatactatgggtcgtttaaacctggcggcagcgcaaaagatg

SEQ ID NO: 33650 - DNA, 103 bp, Artificial Sequence
  Synthetic Polynucleotide
taatacgactcactataggggcactagaaaggttcatgaggacgccacggaacagaggagaccgtggatgcctcatgaaaacctggcggcagcgcaaaagatg

SEQ ID NO: 33651 - DNA, 103 bp, Artificial Sequence
  Synthetic Polynucleotide
taatacgactcactataggggtacagtaatgaccacaccgatttcgcacgaacagaggagacgtgcgatgtcggtgtggaacctggcggcagcgcaaaagatg

SEQ ID NO: 33652 - DNA, 103 bp, Artificial Sequence
  Synthetic Polynucleotide
taatacgactcactatagggggccggatagtttattccccctttacggggaacagaggagaccccgtatggggggaataaacctggcggcagcgcaaaagatg

SEQ ID NO: 33653 - DNA, 103 bp, Artificial Sequence
  Synthetic Polynucleotide
taatacgactcactatagggattggatgacgttggatttactacggactcaacagaggagagagtccatggtaaatccaaacctggcggcagcgcaaaagatg

SEQ ID NO: 33654 - DNA, 103 bp, Artificial Sequence
  Synthetic Polynucleotide
taatacgactcactatagggcaggtaggttctgcaggggagggatctagtaacagaggagaactagaatgctcccctgcaacctggcggcagcgcaaaagatg

SEQ ID NO: 33655 - DNA, 103 bp, Artificial Sequence
  Synthetic Polynucleotide
taatacgactcactatagggtggacccatgtatgtccgctgcgtggagctaacagaggagaagctccatgcagcggacaaacctggcggcagcgcaaaagatg

SEQ ID NO: 33656 - DNA, 103 bp, Artificial Sequence
  Synthetic Polynucleotide
taatacgactcactatagggcctacccggtgactgatcggatacatacaaaacagaggagattgtatatgtccgatcagaacctggcggcagcgcaaaagatg

SEQ ID NO: 33657 - DNA, 103 bp, Artificial Sequence
  Synthetic Polynucleotide
taatacgactcactatagggcagggcgttacttgtgtgtacatcaaatgcaacagaggagagcatttatggtacacacaaacctggcggcagcgcaaaagatg

SEQ ID NO: 33658 - DNA, 103 bp, Artificial Sequence
  Synthetic Polynucleotide
taatacgactcactatagggactactatctagttggtcgggccggcactgaacagaggagacagtgcatgcccgaccaaaacctggcggcagcgcaaaagatg

SEQ ID NO: 33659 - DNA, 103 bp, Artificial Sequence
  Synthetic Polynucleotide
taatacgactcactatagggcatagttgcctgtgtgactgaagacagaaaaacagaggagatttctgatgtcagtcacaaacctggcggcagcgcaaaagatg

SEQ ID NO: 33660 - DNA, 103 bp, Artificial Sequence
  Synthetic Polynucleotide
taatacgactcactatagggcatactctgtcctacgttgatagagagctaaacagaggagatagctcatgatcaacgtaaacctggcggcagcgcaaaagatg

SEQ ID NO: 33661 - DNA, 103 bp, Artificial Sequence
  Synthetic Polynucleotide
taatacgactcactatagggggccggtttcatagaacagggtcgcttgccaacagaggagaggcaagatgccctgttctaacctggcggcagcgcaaaagatg

SEQ ID NO: 33662 - DNA, 103 bp, Artificial Sequence
  Synthetic Polynucleotide
taatacgactcactataggggtgtactgtcacaaggtctattagaataagaacagaggagacttattatgatagaccttaacctggcggcagcgcaaaagatg

SEQ ID NO: 33663 - DNA, 103 bp, Artificial Sequence
  Synthetic Polynucleotide
taatacgactcactatagggccacggcgcatgtaagcaggcggtgctggcaacagaggagagccagcatggcctgcttaaacctggcggcagcgcaaaagatg

SEQ ID NO: 33664 - DNA, 103 bp, Artificial Sequence
  Synthetic Polynucleotide
taatacgactcactatagggggactactcccacgacctaagttaaaacctaacagaggagaaggtttatgcttaggtcgaacctggcggcagcgcaaaagatg

SEQ ID NO: 33665 - DNA, 103 bp, Artificial Sequence
  Synthetic Polynucleotide
taatacgactcactatagggggccgtgggagcaagatcttatacgaaaaaaacagaggagatttttcatgtaagatcttaacctggcggcagcgcaaaagatg

SEQ ID NO: 33666 - DNA, 103 bp, Artificial Sequence
  Synthetic Polynucleotide
taatacgactcactatagggtgtggagttctgaagaggctcgggttgtttaacagaggagaaaacaaatggagcctcttaacctggcggcagcgcaaaagatg

SEQ ID NO: 33667 - DNA, 103 bp, Artificial Sequence
  Synthetic Polynucleotide
taatacgactcactatagggtacaattattgtggcaggtatggccttctgaacagaggagacagaagatgatacctgccaacctggcggcagcgcaaaagatg

SEQ ID NO: 33668 - DNA, 103 bp, Artificial Sequence
  Synthetic Polynucleotide
taatacgactcactatagggcagtacttgagacgagtacccgcaggtgggaacagaggagacccaccatggggtactcgaacctggcggcagcgcaaaagatg

SEQ ID NO: 33669 - DNA, 103 bp, Artificial Sequence
  Synthetic Polynucleotide
taatacgactcactatagggggagcctccaggcctgatgactagggtagcaacagaggagagctaccatggtcatcaggaacctggcggcagcgcaaaagatg

SEQ ID NO: 33670 - DNA, 103 bp, Artificial Sequence
  Synthetic Polynucleotide
taatacgactcactatagggtgaataatgtagcggtcttagccctcccaaaacagaggagattgggaatgctaagaccgaacctggcggcagcgcaaaagatg

SEQ ID NO: 33671 - DNA, 103 bp, Artificial Sequence
  Synthetic Polynucleotide
taatacgactcactatagggttgacatttctcgtacatcagcttgtggcaaacagaggagatgccacatgctgatgtacaacctggcggcagcgcaaaagatg

SEQ ID NO: 33672 - DNA, 103 bp, Artificial Sequence
  Synthetic Polynucleotide
taatacgactcactatagggttgaacacgtgagtttcgttaggacggtttaacagaggagaaaaccgatgtaacgaaacaacctggcggcagcgcaaaagatg

SEQ ID NO: 33673 - DNA, 103 bp, Artificial Sequence
  Synthetic Polynucleotide
taatacgactcactatagggtccgtgtcgtgtcgacgcagacgacggaataacagaggagaattccgatgtctgcgtcgaacctggcggcagcgcaaaagatg

SEQ ID NO: 33674 - DNA, 103 bp, Artificial Sequence
  Synthetic Polynucleotide
taatacgactcactatagggtattacgtcacctcaacggcggcatcaaccaacagaggagaggttgaatgcgccgttgaaacctggcggcagcgcaaaagatg

SEQ ID NO: 33675 - DNA, 103 bp, Artificial Sequence
  Synthetic Polynucleotide
taatacgactcactatagggtgcagttcgaaaacccaacactggctttccaacagaggagaggaaagatggtgttgggtaacctggcggcagcgcaaaagatg

SEQ ID NO: 33676 - DNA, 103 bp, Artificial Sequence
  Synthetic Polynucleotide
taatacgactcactatagggtcttaggcactccgtttagagtgtcgacaaaacagaggagattgtcgatgctctaaacgaacctggcggcagcgcaaaagatg

SEQ ID NO: 33677 - DNA, 103 bp, Artificial Sequence
  Synthetic Polynucleotide
taatacgactcactataggggcctgatggtgtctcgaattgcgttatctgaacagaggagacagataatgcaattcgagaacctggcggcagcgcaaaagatg

SEQ ID NO: 33678 - DNA, 103 bp, Artificial Sequence
  Synthetic Polynucleotide
taatacgactcactatagggaaaaacgaagtcgccgcgggttcccaagataacagaggagaatcttgatgacccgcggcaacctggcggcagcgcaaaagatg

SEQ ID NO: 33679 - DNA, 103 bp, Artificial Sequence
  Synthetic Polynucleotide
taatacgactcactatagggtgtgcgcagcactatcttcagtcggtgtaaaacagaggagattacacatgctgaagataaacctggcggcagcgcaaaagatg

SEQ ID NO: 33680 - DNA, 103 bp, Artificial Sequence
  Synthetic Polynucleotide
taatacgactcactatagggctcgccacgtactttggtgctctcgcagccaacagaggagaggctgcatgagcaccaaaaacctggcggcagcgcaaaagatg

SEQ ID NO: 33681 - DNA, 103 bp, Artificial Sequence
  Synthetic Polynucleotide
taatacgactcactatagggtaagtgatgccgattcttccttcacctgataacagaggagaatcaggatgaggaagaataacctggcggcagcgcaaaagatg

SEQ ID NO: 33682 - DNA, 103 bp, Artificial Sequence
  Synthetic Polynucleotide
taatacgactcactatagggataaaacgtactctttgagcgtcctaccggaacagaggagaccggtaatgcgctcaaagaacctggcggcagcgcaaaagatg

SEQ ID NO: 33683 - DNA, 103 bp, Artificial Sequence
  Synthetic Polynucleotide
taatacgactcactatagggcattagtccgcactgttcaacacatcgcacaacagaggagagtgcgaatggttgaacagaacctggcggcagcgcaaaagatg

SEQ ID NO: 33684 - DNA, 103 bp, Artificial Sequence
  Synthetic Polynucleotide
taatacgactcactatagggtagatggctataccagtgtccgacgggtaaaacagaggagattacccatgggacactggaacctggcggcagcgcaaaagatg

SEQ ID NO: 33685 - DNA, 103 bp, Artificial Sequence
  Synthetic Polynucleotide
taatacgactcactatagggtatagaaaaacgtaaggtgcgctttgcctcaacagaggagagaggcaatgcgcaccttaaacctggcggcagcgcaaaagatg

SEQ ID NO: 33686 - DNA, 103 bp, Artificial Sequence
  Synthetic Polynucleotide
taatacgactcactataggggtctctaggcactcacaggagattcgacgtaacagaggagaacgtcgatgctcctgtgaaacctggcggcagcgcaaaagatg

SEQ ID NO: 33687 - DNA, 103 bp, Artificial Sequence
  Synthetic Polynucleotide
taatacgactcactatagggccaatcactctacttgcataagtcgctgtaaacagaggagatacagcatgttatgcaagaacctggcggcagcgcaaaagatg

SEQ ID NO: 33688 - DNA, 103 bp, Artificial Sequence
  Synthetic Polynucleotide
taatacgactcactataggggattaaagaggactcgtaatgcctcgcataaacagaggagatatgcgatgcattacgagaacctggcggcagcgcaaaagatg

SEQ ID NO: 33689 - DNA, 103 bp, Artificial Sequence
  Synthetic Polynucleotide
taatacgactcactataggggaccttccgtgtcggctcttctctcgggacaacagaggagagtcccgatggaagagccgaacctggcggcagcgcaaaagatg

SEQ ID NO: 33690 - DNA, 103 bp, Artificial Sequence
  Synthetic Polynucleotide
taatacgactcactatagggatacgcgctctaaataagcagggttaatctaacagaggagaagattaatgctgcttattaacctggcggcagcgcaaaagatg

SEQ ID NO: 33691 - DNA, 103 bp, Artificial Sequence
  Synthetic Polynucleotide
taatacgactcactatagggacctttgatcggcgggttggatgtcccactaacagaggagaagtgggatgtccaacccgaacctggcggcagcgcaaaagatg

SEQ ID NO: 33692 - DNA, 103 bp, Artificial Sequence
  Synthetic Polynucleotide
taatacgactcactatagggtgagcgagccgaacagttacataggggatgaacagaggagacatcccatgtgtaactgtaacctggcggcagcgcaaaagatg

SEQ ID NO: 33693 - DNA, 103 bp, Artificial Sequence
  Synthetic Polynucleotide
taatacgactcactatagggcgtgtacataatccaaccggattcatacataacagaggagaatgtatatgtccggttggaacctggcggcagcgcaaaagatg

SEQ ID NO: 33694 - DNA, 103 bp, Artificial Sequence
  Synthetic Polynucleotide
taatacgactcactataggggagaagcttcttgggttttgctcaccgtcaaacagaggagatgacggatggcaaaacccaacctggcggcagcgcaaaagatg

SEQ ID NO: 33695 - DNA, 103 bp, Artificial Sequence
  Synthetic Polynucleotide
taatacgactcactatagggtttcgaggctgaatgggcggagaccaatgaaacagaggagatcattgatgtccgcccataacctggcggcagcgcaaaagatg

SEQ ID NO: 33696 - DNA, 103 bp, Artificial Sequence
  Synthetic Polynucleotide
taatacgactcactataggggtgagtggctgccgggaccgaaagtcacgtaacagaggagaacgtgaatgtcggtcccgaacctggcggcagcgcaaaagatg

SEQ ID NO: 33697 - DNA, 103 bp, Artificial Sequence
  Synthetic Polynucleotide
taatacgactcactataggggtacttattagcagtactgcctacacctggaacagaggagaccaggtatgggcagtactaacctggcggcagcgcaaaagatg

SEQ ID NO: 33698 - DNA, 103 bp, Artificial Sequence
  Synthetic Polynucleotide
taatacgactcactataggggttgtggtcacgttcttttggttgaaatggaacagaggagaccatttatgccaaaagaaaacctggcggcagcgcaaaagatg

SEQ ID NO: 33699 - DNA, 103 bp, Artificial Sequence
  Synthetic Polynucleotide
taatacgactcactatagggcaggctccttccggcattgtctcccataataacagaggagaattatgatggacaatgccaacctggcggcagcgcaaaagatg

SEQ ID NO: 33700 - DNA, 103 bp, Artificial Sequence
  Synthetic Polynucleotide
taatacgactcactatagggaatctccaaatcacgcatcgtcctatcgacaacagaggagagtcgatatgacgatgcgtaacctggcggcagcgcaaaagatg

SEQ ID NO: 33701 - DNA, 103 bp, Artificial Sequence
  Synthetic Polynucleotide
taatacgactcactatagggttcttttaacattgctctctaatttggtgcaacagaggagagcaccaatgtagagagcaaacctggcggcagcgcaaaagatg

SEQ ID NO: 33702 - DNA, 103 bp, Artificial Sequence
  Synthetic Polynucleotide
taatacgactcactatagggtagggctggtttttaaccgtggctgttgagaacagaggagactcaacatgcacggttaaaacctggcggcagcgcaaaagatg

SEQ ID NO: 33703 - DNA, 103 bp, Artificial Sequence
  Synthetic Polynucleotide
taatacgactcactataggggtggtaacttctgagcacccaaggcccataaacagaggagatatgggatgtgggtgctcaacctggcggcagcgcaaaagatg

SEQ ID NO: 33704 - DNA, 103 bp, Artificial Sequence
  Synthetic Polynucleotide
taatacgactcactatagggatcgcgtgctgcctaccttcgcgcaaccaaaacagaggagattggttatgcgaaggtagaacctggcggcagcgcaaaagatg

SEQ ID NO: 33705 - DNA, 103 bp, Artificial Sequence
  Synthetic Polynucleotide
taatacgactcactatagggatagatataacgaacctcgatgccgtaagaaacagaggagatcttacatgatcgaggttaacctggcggcagcgcaaaagatg

SEQ ID NO: 33706 - DNA, 103 bp, Artificial Sequence
  Synthetic Polynucleotide
taatacgactcactatagggggtatcgcccgaggggccgaatcgcagtgcaacagaggagagcactgatgttcggccccaacctggcggcagcgcaaaagatg

SEQ ID NO: 33707 - DNA, 103 bp, Artificial Sequence
  Synthetic Polynucleotide
taatacgactcactatagggtgtgtcgattcgcacataccgctacgatgcaacagaggagagcatcgatgcggtatgtgaacctggcggcagcgcaaaagatg

SEQ ID NO: 33708 - DNA, 103 bp, Artificial Sequence
  Synthetic Polynucleotide
taatacgactcactatagggatcgatatagaagtaagggacgtgtcgttaaacagaggagataacgaatggtcccttacaacctggcggcagcgcaaaagatg

SEQ ID NO: 33709 - DNA, 103 bp, Artificial Sequence
  Synthetic Polynucleotide
taatacgactcactatagggggcctactacgggacgccccaggtcctaataacagaggagaattaggatgtggggcgtcaacctggcggcagcgcaaaagatg

SEQ ID NO: 33710 - DNA, 103 bp, Artificial Sequence
  Synthetic Polynucleotide
taatacgactcactatagggtgctggtcttccaagctacccgcgggcgttaacagaggagaaacgccatggggtagcttaacctggcggcagcgcaaaagatg

SEQ ID NO: 33711 - DNA, 103 bp, Artificial Sequence
  Synthetic Polynucleotide
taatacgactcactatagggtatgatgcaccgaatctatgtttcctccaaaacagaggagattggagatgacatagattaacctggcggcagcgcaaaagatg

SEQ ID NO: 33712 - DNA, 103 bp, Artificial Sequence
  Synthetic Polynucleotide
taatacgactcactatagggccaccatggttgtctgcggccctatgcgtaaacagaggagatacgcaatgggccgcagaaacctggcggcagcgcaaaagatg

SEQ ID NO: 33713 - DNA, 103 bp, Artificial Sequence
  Synthetic Polynucleotide
taatacgactcactatagggtgggatgggtgttcaatcgtcaccgaattaaacagaggagataattcatggacgattgaaacctggcggcagcgcaaaagatg

SEQ ID NO: 33714 - DNA, 103 bp, Artificial Sequence
  Synthetic Polynucleotide
taatacgactcactatagggatagcgattagaaataaagtcgtcatcctgaacagaggagacaggatatggactttattaacctggcggcagcgcaaaagatg

SEQ ID NO: 33715 - DNA, 103 bp, Artificial Sequence
  Synthetic Polynucleotide
taatacgactcactataggggaggcgacagcgccgtagcttgagactgataacagaggagaatcagtatgaagctacggaacctggcggcagcgcaaaagatg

SEQ ID NO: 33716 - DNA, 103 bp, Artificial Sequence
  Synthetic Polynucleotide
taatacgactcactatagggtgcggatgcgatgaggagaatcaaacgtccaacagaggagaggacgtatgattctcctcaacctggcggcagcgcaaaagatg

SEQ ID NO: 33717 - DNA, 103 bp, Artificial Sequence
  Synthetic Polynucleotide
taatacgactcactatagggccatgagacaccggtcacgcaactagatgcaacagaggagagcatctatgtgcgtgaccaacctggcggcagcgcaaaagatg

SEQ ID NO: 33718 - DNA, 103 bp, Artificial Sequence
  Synthetic Polynucleotide
taatacgactcactatagggtcatacgctgagtgcgtcgaatcacccaataacagaggagaattgggatgttcgacgcaaacctggcggcagcgcaaaagatg

SEQ ID NO: 33719 - DNA, 103 bp, Artificial Sequence
  Synthetic Polynucleotide
taatacgactcactatagggtatagacgttccccgcttggggatggatagaacagaggagactatccatgcccaagcggaacctggcggcagcgcaaaagatg

SEQ ID NO: 33720 - DNA, 103 bp, Artificial Sequence
  Synthetic Polynucleotide
taatacgactcactatagggcggcatgaatactgacagcaatgtaactgtaacagaggagaacagttatgttgctgtcaaacctggcggcagcgcaaaagatg

SEQ ID NO: 33721 - DNA, 103 bp, Artificial Sequence
  Synthetic Polynucleotide
taatacgactcactataggggaggcggcaatgggggggtctggctagcgaaacagaggagatcgctaatgagaccccccaacctggcggcagcgcaaaagatg

SEQ ID NO: 33722 - DNA, 103 bp, Artificial Sequence
  Synthetic Polynucleotide
taatacgactcactatagggagacagggacgcgaatctctactcgaggaaaacagaggagattcctcatgtagagattcaacctggcggcagcgcaaaagatg

SEQ ID NO: 33723 - DNA, 103 bp, Artificial Sequence
  Synthetic Polynucleotide
taatacgactcactatagggtcacgtgtttcgtcaagagctctatagtagaacagaggagactactaatgagctcttgaaacctggcggcagcgcaaaagatg

SEQ ID NO: 33724 - DNA, 103 bp, Artificial Sequence
  Synthetic Polynucleotide
taatacgactcactatagggcagcctgcgaccgacgacttaccctttctgaacagaggagacagaaaatgtaagtcgtcaacctggcggcagcgcaaaagatg

SEQ ID NO: 33725 - DNA, 103 bp, Artificial Sequence
  Synthetic Polynucleotide
taatacgactcactatagggtcgcacgaatatgttataaccgtccgatagaacagaggagactatcgatgggttataacaacctggcggcagcgcaaaagatg

SEQ ID NO: 33726 - DNA, 103 bp, Artificial Sequence
  Synthetic Polynucleotide
taatacgactcactatagggtgcttggtatcagtgtacatcgcggtgatgaacagaggagacatcacatggatgtacacaacctggcggcagcgcaaaagatg

SEQ ID NO: 33727 - DNA, 103 bp, Artificial Sequence
  Synthetic Polynucleotide
taatacgactcactataggggttcccatagacagtagctgtgggatgagtaacagaggagaactcatatgacagctactaacctggcggcagcgcaaaagatg

SEQ ID NO: 33728 - DNA, 103 bp, Artificial Sequence
  Synthetic Polynucleotide
taatacgactcactatagggcgacgtgacggagtcggtttgttttaagcaaacagaggagatgcttaatgcaaaccgacaacctggcggcagcgcaaaagatg

SEQ ID NO: 33729 - DNA, 103 bp, Artificial Sequence
  Synthetic Polynucleotide
taatacgactcactatagggtgtctaggcacggtatcctctctgcttcccaacagaggagagggaagatgagaggatacaacctggcggcagcgcaaaagatg

SEQ ID NO: 33730 - DNA, 103 bp, Artificial Sequence
  Synthetic Polynucleotide
taatacgactcactatagggcatccctattcgaatacaaacttctcgcgtaacagaggagaacgcgaatggtttgtattaacctggcggcagcgcaaaagatg

SEQ ID NO: 33731 - DNA, 103 bp, Artificial Sequence
  Synthetic Polynucleotide
taatacgactcactatagggggttcctttcaagcgctttgttagtcggcaaacagaggagatgccgaatgacaaagcgcaacctggcggcagcgcaaaagatg

SEQ ID NO: 33732 - DNA, 103 bp, Artificial Sequence
  Synthetic Polynucleotide
taatacgactcactatagggactaatgcaacggagggatacaatgttaataacagaggagaattaacatggtatccctcaacctggcggcagcgcaaaagatg

SEQ ID NO: 33733 - DNA, 103 bp, Artificial Sequence
  Synthetic Polynucleotide
taatacgactcactatagggaacatcgccgtgcacgaacacgcattgtggaacagaggagaccacaaatggtgttcgtgaacctggcggcagcgcaaaagatg

SEQ ID NO: 33734 - DNA, 103 bp, Artificial Sequence
  Synthetic Polynucleotide
taatacgactcactatagggtgcacaatgcttttggattacaaaggccttaacagaggagaaaggccatggtaatccaaaacctggcggcagcgcaaaagatg

SEQ ID NO: 33735 - DNA, 103 bp, Artificial Sequence
  Synthetic Polynucleotide
taatacgactcactatagggataaaacactgaggcaaccggtgaaaggtcaacagaggagagaccttatgccggttgccaacctggcggcagcgcaaaagatg

SEQ ID NO: 33736 - DNA, 103 bp, Artificial Sequence
  Synthetic Polynucleotide
taatacgactcactataggggcacgagggggtctgcccaattataaagtcaacagaggagagactttatgattgggcagaacctggcggcagcgcaaaagatg

SEQ ID NO: 33737 - DNA, 103 bp, Artificial Sequence
  Synthetic Polynucleotide
taatacgactcactatagggatcgctcgacgcattccctaaattaacgccaacagaggagaggcgttatgttagggaataacctggcggcagcgcaaaagatg

SEQ ID NO: 33738 - DNA, 103 bp, Artificial Sequence
  Synthetic Polynucleotide
taatacgactcactatagggttagcgtgaaagtgtgtgttcgcgcgtaggaacagaggagacctacgatggaacacacaaacctggcggcagcgcaaaagatg

SEQ ID NO: 33739 - DNA, 103 bp, Artificial Sequence
  Synthetic Polynucleotide
taatacgactcactatagggcccatactccccagtgggcgggtgctgaataacagaggagaattcagatgccgcccactaacctggcggcagcgcaaaagatg

SEQ ID NO: 33740 - DNA, 103 bp, Artificial Sequence
  Synthetic Polynucleotide
taatacgactcactatagggaaggggatatgcggtgcattccgaacggagaacagaggagactccgtatggaatgcaccaacctggcggcagcgcaaaagatg

SEQ ID NO: 33741 - DNA, 103 bp, Artificial Sequence
  Synthetic Polynucleotide
taatacgactcactatagggaactaatagaatttatacaagccagaggaaaacagaggagattcctcatgcttgtataaaacctggcggcagcgcaaaagatg

SEQ ID NO: 33742 - DNA, 103 bp, Artificial Sequence
  Synthetic Polynucleotide
taatacgactcactatagggctcagtggatcaccctgtggataggtttcgaacagaggagacgaaacatgtccacagggaacctggcggcagcgcaaaagatg

SEQ ID NO: 33743 - DNA, 103 bp, Artificial Sequence
  Synthetic Polynucleotide
taatacgactcactatagggtattgggtttcgggcatctgagctaatatcaacagaggagagatattatgtcagatgccaacctggcggcagcgcaaaagatg

SEQ ID NO: 33744 - DNA, 103 bp, Artificial Sequence
  Synthetic Polynucleotide
taatacgactcactatagggtcctgatctccaattgctaaagctaggcgtaacagaggagaacgcctatgtttagcaataacctggcggcagcgcaaaagatg

SEQ ID NO: 33745 - DNA, 103 bp, Artificial Sequence
  Synthetic Polynucleotide
taatacgactcactatagggagctctacgaaaatcccgggttagttgggtaacagaggagaacccaaatgacccgggataacctggcggcagcgcaaaagatg

SEQ ID NO: 33746 - DNA, 103 bp, Artificial Sequence
  Synthetic Polynucleotide
taatacgactcactatagggcatatcaagcaagctggcctacttactcccaacagaggagagggagtatgtaggccagcaacctggcggcagcgcaaaagatg

SEQ ID NO: 33747 - DNA, 103 bp, Artificial Sequence
  Synthetic Polynucleotide
taatacgactcactatagggaagtgtagtttcttttagatatgtcggaaaaacagaggagatttccgatgtatctaaaaaacctggcggcagcgcaaaagatg

SEQ ID NO: 33748 - DNA, 103 bp, Artificial Sequence
  Synthetic Polynucleotide
taatacgactcactataggggtacgatttgatgatactcaattttatgggaacagaggagacccataatgttgagtatcaacctggcggcagcgcaaaagatg

SEQ ID NO: 33749 - DNA, 103 bp, Artificial Sequence
  Synthetic Polynucleotide
taatacgactcactatagggttcggtggaggaggttgtaactgctacattaacagaggagaaatgtaatggttacaaccaacctggcggcagcgcaaaagatg

SEQ ID NO: 33750 - DNA, 103 bp, Artificial Sequence
  Synthetic Polynucleotide
taatacgactcactatagggtgctatctttttctctttatctttccccacaacagaggagagtggggatggataaagagaacctggcggcagcgcaaaagatg

SEQ ID NO: 33751 - DNA, 103 bp, Artificial Sequence
  Synthetic Polynucleotide
taatacgactcactataggggtgcgcatctagtctgtgtgacgagagcaaaacagaggagattgctcatgtcacacagaaacctggcggcagcgcaaaagatg

SEQ ID NO: 33752 - DNA, 103 bp, Artificial Sequence
  Synthetic Polynucleotide
taatacgactcactatagggccctcttcgatgacaggcattaacccacttaacagaggagaaagtggatgaatgcctgtaacctggcggcagcgcaaaagatg

SEQ ID NO: 33753 - DNA, 103 bp, Artificial Sequence
  Synthetic Polynucleotide
taatacgactcactataggggtgcgaactgcaagcacgatcattcgctccaacagaggagaggagcgatggatcgtgctaacctggcggcagcgcaaaagatg

SEQ ID NO: 33754 - DNA, 103 bp, Artificial Sequence
  Synthetic Polynucleotide
taatacgactcactatagggcttggagactccccaatgcccggcacctcgaacagaggagacgaggtatggggcattggaacctggcggcagcgcaaaagatg

SEQ ID NO: 33755 - DNA, 103 bp, Artificial Sequence
  Synthetic Polynucleotide
taatacgactcactataggggcttagtcaagaattacacgtgtagtcctgaacagaggagacaggacatgacgtgtaataacctggcggcagcgcaaaagatg

SEQ ID NO: 33756 - DNA, 103 bp, Artificial Sequence
  Synthetic Polynucleotide
taatacgactcactatagggttttaaaccgctactagcaataacaggaataacagaggagaattcctatgattgctagtaacctggcggcagcgcaaaagatg

SEQ ID NO: 33757 - DNA, 103 bp, Artificial Sequence
  Synthetic Polynucleotide
taatacgactcactataggggtagtgcgttaaaaaggcgggcccaccgataacagaggagaatcggtatgcccgcctttaacctggcggcagcgcaaaagatg

SEQ ID NO: 33758 - DNA, 103 bp, Artificial Sequence
  Synthetic Polynucleotide
taatacgactcactataggggcccatagccattaagggagtaattaaggaaacagaggagatccttaatgactcccttaaacctggcggcagcgcaaaagatg

SEQ ID NO: 33759 - DNA, 103 bp, Artificial Sequence
  Synthetic Polynucleotide
taatacgactcactatagggttcctaggctgcccttgcccagcctaggggaacagaggagacccctaatgtgggcaaggaacctggcggcagcgcaaaagatg

SEQ ID NO: 33760 - DNA, 103 bp, Artificial Sequence
  Synthetic Polynucleotide
taatacgactcactatagggattcgctgccaataataaatagaccggctaaacagaggagatagccgatgtatttattaaacctggcggcagcgcaaaagatg

SEQ ID NO: 33761 - DNA, 103 bp, Artificial Sequence
  Synthetic Polynucleotide
taatacgactcactatagggatgggcggaactataatctttggtgcgtcgaacagaggagacgacgcatgaaagattataacctggcggcagcgcaaaagatg

SEQ ID NO: 33762 - DNA, 103 bp, Artificial Sequence
  Synthetic Polynucleotide
taatacgactcactatagggggtaccgtatgccgagctcgactactttccaacagaggagaggaaagatgtcgagctcgaacctggcggcagcgcaaaagatg

SEQ ID NO: 33763 - DNA, 103 bp, Artificial Sequence
  Synthetic Polynucleotide
taatacgactcactataggggacttgtgaacgaatcgccatagctggtccaacagaggagaggaccaatgatggcgattaacctggcggcagcgcaaaagatg

SEQ ID NO: 33764 - DNA, 103 bp, Artificial Sequence
  Synthetic Polynucleotide
taatacgactcactatagggtctcccactttcgaggatccggaacactctaacagaggagaagagtgatgcggatcctcaacctggcggcagcgcaaaagatg

SEQ ID NO: 33765 - DNA, 103 bp, Artificial Sequence
  Synthetic Polynucleotide
taatacgactcactatagggcattcctactgcctcaatcgcactccattgaacagaggagacaatggatggcgattgagaacctggcggcagcgcaaaagatg

SEQ ID NO: 33766 - DNA, 103 bp, Artificial Sequence
  Synthetic Polynucleotide
taatacgactcactatagggtgctgtggggggtcatatgaaccaaacgtaaacagaggagatacgttatgttcatatgaaacctggcggcagcgcaaaagatg

SEQ ID NO: 33767 - DNA, 103 bp, Artificial Sequence
  Synthetic Polynucleotide
taatacgactcactatagggtagcaactgtgcaacgttgtgactaagaacaacagaggagagttcttatgcacaacgttaacctggcggcagcgcaaaagatg

SEQ ID NO: 33768 - DNA, 103 bp, Artificial Sequence
  Synthetic Polynucleotide
taatacgactcactataggggccgcttgttaataatgctactcagaaatcaacagaggagagatttcatggtagcattaaacctggcggcagcgcaaaagatg

SEQ ID NO: 33769 - DNA, 103 bp, Artificial Sequence
  Synthetic Polynucleotide
taatacgactcactatagggatagttgataaattggggttatgtaacttgaacagaggagacaagttatgtaaccccaaaacctggcggcagcgcaaaagatg

SEQ ID NO: 33770 - DNA, 103 bp, Artificial Sequence
  Synthetic Polynucleotide
taatacgactcactataggggggaaaattgaccggtgcgccggagacacgaacagaggagacgtgtcatgggcgcaccgaacctggcggcagcgcaaaagatg

SEQ ID NO: 33771 - DNA, 103 bp, Artificial Sequence
  Synthetic Polynucleotide
taatacgactcactatagggagccggatttcccctctattggtcggtggtaacagaggagaaccaccatgcaatagaggaacctggcggcagcgcaaaagatg

SEQ ID NO: 33772 - DNA, 103 bp, Artificial Sequence
  Synthetic Polynucleotide
taatacgactcactatagggcacgtgcctctacctcgtgcacctactggaaacagaggagatccagtatgtgcacgaggaacctggcggcagcgcaaaagatg

SEQ ID NO: 33773 - DNA, 103 bp, Artificial Sequence
  Synthetic Polynucleotide
taatacgactcactatagggtaactagttatggccaaaactgtgacaggcaacagaggagagcctgtatgagttttggcaacctggcggcagcgcaaaagatg

SEQ ID NO: 33774 - DNA, 103 bp, Artificial Sequence
  Synthetic Polynucleotide
taatacgactcactataggggtatgtcctccggcagcggagatctaaactaacagaggagaagtttaatgctccgctgcaacctggcggcagcgcaaaagatg

SEQ ID NO: 33775 - DNA, 103 bp, Artificial Sequence
  Synthetic Polynucleotide
taatacgactcactataggggtaaatcaacggagagaccgtagggataataacagaggagaattatcatgacggtctctaacctggcggcagcgcaaaagatg

SEQ ID NO: 33776 - DNA, 103 bp, Artificial Sequence
  Synthetic Polynucleotide
taatacgactcactatagggcccccgacttggacctggaacttgcactgcaacagaggagagcagtgatggttccaggtaacctggcggcagcgcaaaagatg

SEQ ID NO: 33777 - DNA, 103 bp, Artificial Sequence
  Synthetic Polynucleotide
taatacgactcactatagggatcggcgaaatctggctacggcgatgattaaacagaggagataatcaatgccgtagccaaacctggcggcagcgcaaaagatg

SEQ ID NO: 33778 - DNA, 103 bp, Artificial Sequence
  Synthetic Polynucleotide
taatacgactcactatagggagggcaaggcgatctgcgtgaagatggagaaacagaggagatctccaatgtcacgcagaaacctggcggcagcgcaaaagatg

SEQ ID NO: 33779 - DNA, 103 bp, Artificial Sequence
  Synthetic Polynucleotide
taatacgactcactatagggtggggcactactttgtatgggatataaccgaacagaggagacggttaatgcccatacaaaacctggcggcagcgcaaaagatg

SEQ ID NO: 33780 - DNA, 103 bp, Artificial Sequence
  Synthetic Polynucleotide
taatacgactcactatagggtacttcgtacgcacgcttgtcgcgtcctacaacagaggagagtaggaatggacaagcgtaacctggcggcagcgcaaaagatg

SEQ ID NO: 33781 - DNA, 103 bp, Artificial Sequence
  Synthetic Polynucleotide
taatacgactcactatagggatgaggaatttaatgtcaatgcttttggggaacagaggagaccccaaatgcattgacataacctggcggcagcgcaaaagatg

SEQ ID NO: 33782 - DNA, 103 bp, Artificial Sequence
  Synthetic Polynucleotide
taatacgactcactatagggggttaacgctgatcatgcctctctagcggcaacagaggagagccgctatggaggcatgaaacctggcggcagcgcaaaagatg

SEQ ID NO: 33783 - DNA, 103 bp, Artificial Sequence
  Synthetic Polynucleotide
taatacgactcactatagggtttcaggtgcctcgaagatagctagcccaaaacagaggagattgggcatgctatcttcgaacctggcggcagcgcaaaagatg

SEQ ID NO: 33784 - DNA, 103 bp, Artificial Sequence
  Synthetic Polynucleotide
taatacgactcactatagggcataaactcaggaagacgtggatcagaaataacagaggagaatttctatgccacgtcttaacctggcggcagcgcaaaagatg

SEQ ID NO: 33785 - DNA, 103 bp, Artificial Sequence
  Synthetic Polynucleotide
taatacgactcactatagggtaccagtctggttgaatcaccttggctcttaacagaggagaaagagcatgggtgattcaaacctggcggcagcgcaaaagatg

SEQ ID NO: 33786 - DNA, 103 bp, Artificial Sequence
  Synthetic Polynucleotide
taatacgactcactatagggagcttccgaatgtcacagtcctccactagcaacagaggagagctagtatgggactgtgaaacctggcggcagcgcaaaagatg

SEQ ID NO: 33787 - DNA, 103 bp, Artificial Sequence
  Synthetic Polynucleotide
taatacgactcactatagggtaatcagttaatacttggcttagggacgttaacagaggagaaacgtcatgaagccaagtaacctggcggcagcgcaaaagatg

SEQ ID NO: 33788 - DNA, 103 bp, Artificial Sequence
  Synthetic Polynucleotide
taatacgactcactataggggtcggatcccgcgtaatgctacatagattaaacagaggagataatctatgtagcattacaacctggcggcagcgcaaaagatg

SEQ ID NO: 33789 - DNA, 103 bp, Artificial Sequence
  Synthetic Polynucleotide
taatacgactcactatagggtgcacatcaagcacggcgccattcgcagggaacagaggagaccctgcatgtggcgccgtaacctggcggcagcgcaaaagatg

SEQ ID NO: 33790 - DNA, 103 bp, Artificial Sequence
  Synthetic Polynucleotide
taatacgactcactatagggtgttgagaagcgtgtagccgcaatgagcagaacagaggagactgctcatggcggctacaaacctggcggcagcgcaaaagatg

SEQ ID NO: 33791 - DNA, 103 bp, Artificial Sequence
  Synthetic Polynucleotide
taatacgactcactatagggagaaaacaggagtccgggcgttttgccaccaacagaggagaggtggcatgacgcccggaaacctggcggcagcgcaaaagatg

SEQ ID NO: 33792 - DNA, 103 bp, Artificial Sequence
  Synthetic Polynucleotide
taatacgactcactataggggatacccgagttagtctcttagttagcctaaacagaggagataggctatgtaagagactaacctggcggcagcgcaaaagatg

SEQ ID NO: 33793 - DNA, 103 bp, Artificial Sequence
  Synthetic Polynucleotide
taatacgactcactatagggtttataatgccattgttggacttcagaaggaacagaggagaccttctatggtccaacaaaacctggcggcagcgcaaaagatg

SEQ ID NO: 33794 - DNA, 103 bp, Artificial Sequence
  Synthetic Polynucleotide
taatacgactcactatagggagggtaggccgctcgaggggttttaacccgaacagaggagacgggttatgacccctcgaaacctggcggcagcgcaaaagatg

SEQ ID NO: 33795 - DNA, 103 bp, Artificial Sequence
  Synthetic Polynucleotide
taatacgactcactataggggttgcagaacttacattgataggccatctaaacagaggagatagatgatgtatcaatgtaacctggcggcagcgcaaaagatg

SEQ ID NO: 33796 - DNA, 103 bp, Artificial Sequence
  Synthetic Polynucleotide
taatacgactcactatagggtacggatggtgacggacggcacccgggtaaaacagaggagattacccatgtgccgtccgaacctggcggcagcgcaaaagatg

SEQ ID NO: 33797 - DNA, 103 bp, Artificial Sequence
  Synthetic Polynucleotide
taatacgactcactatagggcgtaaacaacctaatcgtggttccccttcgaacagaggagacgaaggatgaccacgattaacctggcggcagcgcaaaagatg

SEQ ID NO: 33798 - DNA, 103 bp, Artificial Sequence
  Synthetic Polynucleotide
taatacgactcactatagggtatatcggccatgagactctgcagggattaaacagaggagataatccatgcagagtctcaacctggcggcagcgcaaaagatg

SEQ ID NO: 33799 - DNA, 103 bp, Artificial Sequence
  Synthetic Polynucleotide
taatacgactcactataggggagagtaacggcgctccactcgcgctgatcaacagaggagagatcagatggagtggagcaacctggcggcagcgcaaaagatg

SEQ ID NO: 33800 - DNA, 103 bp, Artificial Sequence
  Synthetic Polynucleotide
taatacgactcactatagggatatagtcaagccgtcgcccaaactactcgaacagaggagacgagtaatgtgggcgacgaacctggcggcagcgcaaaagatg

SEQ ID NO: 33801 - DNA, 103 bp, Artificial Sequence
  Synthetic Polynucleotide
taatacgactcactatagggcaattagactcaagcaaaagctgccaccacaacagaggagagtggtgatggcttttgctaacctggcggcagcgcaaaagatg

SEQ ID NO: 33802 - DNA, 103 bp, Artificial Sequence
  Synthetic Polynucleotide
taatacgactcactatagggttccaaaatttagagtgatgcagttcgagcaacagaggagagctcgaatggcatcactcaacctggcggcagcgcaaaagatg

SEQ ID NO: 33803 - DNA, 103 bp, Artificial Sequence
  Synthetic Polynucleotide
taatacgactcactatagggtccccttctacaagctcgaagagagaagctaacagaggagaagcttcatgcttcgagctaacctggcggcagcgcaaaagatg

SEQ ID NO: 33804 - DNA, 103 bp, Artificial Sequence
  Synthetic Polynucleotide
taatacgactcactatagggcacttgcagggatcttgctctaagaaacggaacagaggagaccgtttatgagagcaagaaacctggcggcagcgcaaaagatg

SEQ ID NO: 33805 - DNA, 103 bp, Artificial Sequence
  Synthetic Polynucleotide
taatacgactcactatagggagagacagacatatcccctattttggtcctaacagaggagaaggaccatgataggggataacctggcggcagcgcaaaagatg

SEQ ID NO: 33806 - DNA, 103 bp, Artificial Sequence
  Synthetic Polynucleotide
taatacgactcactatagggttttgccaactttactgcagggatcgggtgaacagaggagacacccgatgcctgcagtaaacctggcggcagcgcaaaagatg

SEQ ID NO: 33807 - DNA, 103 bp, Artificial Sequence
  Synthetic Polynucleotide
taatacgactcactatagggacgccatctactaacgtgcataccttgacaaacagaggagatgtcaaatgatgcacgttaacctggcggcagcgcaaaagatg

SEQ ID NO: 33808 - DNA, 103 bp, Artificial Sequence
  Synthetic Polynucleotide
taatacgactcactatagggttagacgggccttgcgaattttgggatggaaacagaggagatccatcatgaaattcgcaaacctggcggcagcgcaaaagatg

SEQ ID NO: 33809 - DNA, 103 bp, Artificial Sequence
  Synthetic Polynucleotide
taatacgactcactatagggagccccgcccttaattaactatagtgagcaaacagaggagatgctcaatgtagttaattaacctggcggcagcgcaaaagatg

SEQ ID NO: 33810 - DNA, 103 bp, Artificial Sequence
  Synthetic Polynucleotide
taatacgactcactatagggccagctctagagcatgtcacccaaataataaacagaggagatattatatgggtgacatgaacctggcggcagcgcaaaagatg

SEQ ID NO: 33811 - DNA, 103 bp, Artificial Sequence
  Synthetic Polynucleotide
taatacgactcactatagggtatagttttccgcacacccgcatctggcgcaacagaggagagcgccaatggcgggtgtgaacctggcggcagcgcaaaagatg

SEQ ID NO: 33812 - DNA, 103 bp, Artificial Sequence
  Synthetic Polynucleotide
taatacgactcactatagggtttcggttccaacggtctcaatcatagcataacagaggagaatgctaatgttgagaccgaacctggcggcagcgcaaaagatg

SEQ ID NO: 33813 - DNA, 103 bp, Artificial Sequence
  Synthetic Polynucleotide
taatacgactcactataggggacttcagatgtcttgacgctggtagttcaaacagaggagatgaactatgagcgtcaagaacctggcggcagcgcaaaagatg

SEQ ID NO: 33814 - DNA, 103 bp, Artificial Sequence
  Synthetic Polynucleotide
taatacgactcactatagggcaaagtctggatggaaggcgattcaaaagtaacagaggagaacttttatgtcgccttccaacctggcggcagcgcaaaagatg

SEQ ID NO: 33815 - DNA, 103 bp, Artificial Sequence
  Synthetic Polynucleotide
taatacgactcactatagggctgccgactctcgattggtaaaaagaacgaaacagaggagatcgttcatgttaccaatcaacctggcggcagcgcaaaagatg

SEQ ID NO: 33816 - DNA, 103 bp, Artificial Sequence
  Synthetic Polynucleotide
taatacgactcactatagggccgaggcgagtcttaaggaaccttcttaataacagaggagaattaagatggttccttaaaacctggcggcagcgcaaaagatg

SEQ ID NO: 33817 - DNA, 103 bp, Artificial Sequence
  Synthetic Polynucleotide
taatacgactcactataggggttttaggtgtcttcaaccctccagtatacaacagaggagagtatacatgagggttgaaaacctggcggcagcgcaaaagatg

SEQ ID NO: 33818 - DNA, 103 bp, Artificial Sequence
  Synthetic Polynucleotide
taatacgactcactatagggtcatcctagatcggcgtataggggtccctgaacagaggagacagggaatgctatacgccaacctggcggcagcgcaaaagatg

SEQ ID NO: 33819 - DNA, 103 bp, Artificial Sequence
  Synthetic Polynucleotide
taatacgactcactatagggcgcgcgattcgcagaactcgctgcaggacaaacagaggagatgtcctatggcgagttctaacctggcggcagcgcaaaagatg

SEQ ID NO: 33820 - DNA, 103 bp, Artificial Sequence
  Synthetic Polynucleotide
taatacgactcactatagggacgttcctgattccctagtatcatacagggaacagaggagaccctgtatgatactagggaacctggcggcagcgcaaaagatg

SEQ ID NO: 33821 - DNA, 103 bp, Artificial Sequence
  Synthetic Polynucleotide
taatacgactcactatagggagtttagaagtaccgtcgatcacagggtagaacagaggagactacccatggatcgacggaacctggcggcagcgcaaaagatg

SEQ ID NO: 33822 - DNA, 103 bp, Artificial Sequence
  Synthetic Polynucleotide
taatacgactcactatagggaatcccacgtgtagaagttccaaaggccccaacagaggagaggggccatgggaacttctaacctggcggcagcgcaaaagatg

SEQ ID NO: 33823 - DNA, 103 bp, Artificial Sequence
  Synthetic Polynucleotide
taatacgactcactatagggcgatggctcaaggttgtcaattcgcccgcaaacagaggagatgcgggatgattgacaacaacctggcggcagcgcaaaagatg

SEQ ID NO: 33824 - DNA, 103 bp, Artificial Sequence
  Synthetic Polynucleotide
taatacgactcactataggggaaatacgtggtgaactatatagtttatctaacagaggagaagataaatgatatagttcaacctggcggcagcgcaaaagatg

SEQ ID NO: 33825 - DNA, 103 bp, Artificial Sequence
  Synthetic Polynucleotide
taatacgactcactatagggtaacggccctcgtgttgccagtatgagcccaacagaggagagggctcatgctggcaacaaacctggcggcagcgcaaaagatg

SEQ ID NO: 33826 - DNA, 103 bp, Artificial Sequence
  Synthetic Polynucleotide
taatacgactcactatagggacaaatcgccactacatattaagtaatagtaacagaggagaactattatgtaatatgtaaacctggcggcagcgcaaaagatg

SEQ ID NO: 33827 - DNA, 103 bp, Artificial Sequence
  Synthetic Polynucleotide
taatacgactcactatagggcttaactccgcagcgtgggctgttactgaaaacagaggagattcagtatgagcccacgcaacctggcggcagcgcaaaagatg

SEQ ID NO: 33828 - DNA, 103 bp, Artificial Sequence
  Synthetic Polynucleotide
taatacgactcactatagggcgtccgtaagctcatgccgttccaggctgtaacagaggagaacagccatgaacggcatgaacctggcggcagcgcaaaagatg

SEQ ID NO: 33829 - DNA, 103 bp, Artificial Sequence
  Synthetic Polynucleotide
taatacgactcactatagggtaatggagaggaactgttgagggatcacaaaacagaggagattgtgaatgctcaacagtaacctggcggcagcgcaaaagatg

SEQ ID NO: 33830 - DNA, 103 bp, Artificial Sequence
  Synthetic Polynucleotide
taatacgactcactatagggccgatatacggctcttgatcggcttccgggaacagaggagacccggaatgcgatcaagaaacctggcggcagcgcaaaagatg

SEQ ID NO: 33831 - DNA, 103 bp, Artificial Sequence
  Synthetic Polynucleotide
taatacgactcactatagggccttggtacttaccgcaattgactcaatccaacagaggagaggattgatgcaattgcggaacctggcggcagcgcaaaagatg

SEQ ID NO: 33832 - DNA, 103 bp, Artificial Sequence
  Synthetic Polynucleotide
taatacgactcactatagggagatgcaggaaacaccgagtaatgggaatcaacagaggagagattccatgtactcggtgaacctggcggcagcgcaaaagatg

SEQ ID NO: 33833 - DNA, 103 bp, Artificial Sequence
  Synthetic Polynucleotide
taatacgactcactataggggacccgtgtctcgaggaaagtggattagtgaacagaggagacactaaatgactttcctcaacctggcggcagcgcaaaagatg

SEQ ID NO: 33834 - DNA, 103 bp, Artificial Sequence
  Synthetic Polynucleotide
taatacgactcactatagggtcattggtgcacgacttgcatacattgcttaacagaggagaaagcaaatgatgcaagtcaacctggcggcagcgcaaaagatg

SEQ ID NO: 33835 - DNA, 103 bp, Artificial Sequence
  Synthetic Polynucleotide
taatacgactcactatagggggctagtctactgctccgtggtgctgtagaaacagaggagatctacaatgccacggagcaacctggcggcagcgcaaaagatg

SEQ ID NO: 33836 - DNA, 103 bp, Artificial Sequence
  Synthetic Polynucleotide
taatacgactcactatagggtttgtgtgtagtccagcacactacaatgataacagaggagaatcattatggtgtgctggaacctggcggcagcgcaaaagatg

SEQ ID NO: 33837 - DNA, 103 bp, Artificial Sequence
  Synthetic Polynucleotide
taatacgactcactatagggacgtctaaagaggagcaagagtggaagcttaacagaggagaaagcttatgctcttgctcaacctggcggcagcgcaaaagatg

SEQ ID NO: 33838 - DNA, 103 bp, Artificial Sequence
  Synthetic Polynucleotide
taatacgactcactataggggtctcgatgagctgggctgtatatataccgaacagaggagacggtatatgtacagcccaaacctggcggcagcgcaaaagatg

SEQ ID NO: 33839 - DNA, 103 bp, Artificial Sequence
  Synthetic Polynucleotide
taatacgactcactatagggtctgtctatcgttccaaggcttcgtgatccaacagaggagaggatcaatgagccttggaaacctggcggcagcgcaaaagatg

SEQ ID NO: 33840 - DNA, 103 bp, Artificial Sequence
  Synthetic Polynucleotide
taatacgactcactatagggccacgtggaagcaatgaatcgggtgccccgaacagaggagacggggcatgcgattcattaacctggcggcagcgcaaaagatg

SEQ ID NO: 33841 - DNA, 103 bp, Artificial Sequence
  Synthetic Polynucleotide
taatacgactcactatagggtacagaaaatgcaagtttctgcaggagaagaacagaggagacttctcatgcagaaacttaacctggcggcagcgcaaaagatg

SEQ ID NO: 33842 - DNA, 103 bp, Artificial Sequence
  Synthetic Polynucleotide
taatacgactcactatagggaaaccaatgaccctgaatctaggtagatgaaacagaggagatcatctatgtagattcagaacctggcggcagcgcaaaagatg

SEQ ID NO: 33843 - DNA, 103 bp, Artificial Sequence
  Synthetic Polynucleotide
taatacgactcactatagggcggaatcgagctattggactcgggctgctcaacagaggagagagcagatggagtccaataacctggcggcagcgcaaaagatg

SEQ ID NO: 33844 - DNA, 103 bp, Artificial Sequence
  Synthetic Polynucleotide
taatacgactcactatagggttgtactgttgagatgcccccgcaacctcaaacagaggagatgaggtatggggggcatcaacctggcggcagcgcaaaagatg

SEQ ID NO: 33845 - DNA, 103 bp, Artificial Sequence
  Synthetic Polynucleotide
taatacgactcactataggggcactccgccttgaaatggctgcatagccaaacagaggagatggctaatgagccatttcaacctggcggcagcgcaaaagatg

SEQ ID NO: 33846 - DNA, 103 bp, Artificial Sequence
  Synthetic Polynucleotide
taatacgactcactatagggtctttcgatctatacggattaggagccagaaacagaggagatctggcatgtaatccgtaaacctggcggcagcgcaaaagatg

SEQ ID NO: 33847 - DNA, 103 bp, Artificial Sequence
  Synthetic Polynucleotide
taatacgactcactatagggactgggcttgcagaaactactagcggcgtcaacagaggagagacgccatgagtagtttcaacctggcggcagcgcaaaagatg

SEQ ID NO: 33848 - DNA, 103 bp, Artificial Sequence
  Synthetic Polynucleotide
taatacgactcactatagggtgtttccccgctatgcggggatacccgtaaaacagaggagattacggatgtccccgcataacctggcggcagcgcaaaagatg

SEQ ID NO: 33849 - DNA, 103 bp, Artificial Sequence
  Synthetic Polynucleotide
taatacgactcactatagggccaccttaccgttccattatatcaggttttaacagaggagaaaaaccatgtataatggaaacctggcggcagcgcaaaagatg

SEQ ID NO: 33850 - DNA, 103 bp, Artificial Sequence
  Synthetic Polynucleotide
taatacgactcactatagggagagagctgacgttattgcacagccgaagcaacagaggagagcttcgatggtgcaataaaacctggcggcagcgcaaaagatg

SEQ ID NO: 33851 - DNA, 103 bp, Artificial Sequence
  Synthetic Polynucleotide
taatacgactcactatagggcccttcgtagactcgcgaattactagatataacagaggagaatatctatgaattcgcgaaacctggcggcagcgcaaaagatg

SEQ ID NO: 33852 - DNA, 103 bp, Artificial Sequence
  Synthetic Polynucleotide
taatacgactcactatagggcccgggccatccttacggtaggttccgactaacagaggagaagtcggatgctaccgtaaaacctggcggcagcgcaaaagatg

SEQ ID NO: 33853 - DNA, 103 bp, Artificial Sequence
  Synthetic Polynucleotide
taatacgactcactatagggctcgccaaaagtttctccgcgttcactaagaacagaggagacttagtatgcgcggagaaaacctggcggcagcgcaaaagatg

SEQ ID NO: 33854 - DNA, 103 bp, Artificial Sequence
  Synthetic Polynucleotide
taatacgactcactatagggtcaactacaaagtagtctctgttgtataggaacagaggagacctataatgcagagactaaacctggcggcagcgcaaaagatg

SEQ ID NO: 33855 - DNA, 103 bp, Artificial Sequence
  Synthetic Polynucleotide
taatacgactcactatagggggtgtgtcagctttgctgtaccgtggcatcaacagaggagagatgccatggtacagcaaaacctggcggcagcgcaaaagatg

SEQ ID NO: 33856 - DNA, 103 bp, Artificial Sequence
  Synthetic Polynucleotide
taatacgactcactatagggggagatgcttccttattcaacccacccgataacagaggagaatcgggatggttgaataaaacctggcggcagcgcaaaagatg

SEQ ID NO: 33857 - DNA, 103 bp, Artificial Sequence
  Synthetic Polynucleotide
taatacgactcactatagggggcatatgcgcggtgtactctagcccttgcaacagaggagagcaaggatgagagtacacaacctggcggcagcgcaaaagatg

SEQ ID NO: 33858 - DNA, 103 bp, Artificial Sequence
  Synthetic Polynucleotide
taatacgactcactataggggtagtacacagtaccggcacattgcttttgaacagaggagacaaaagatgtgtgccggtaacctggcggcagcgcaaaagatg

SEQ ID NO: 33859 - DNA, 103 bp, Artificial Sequence
  Synthetic Polynucleotide
taatacgactcactatagggttggtctgcctccatctctggaacgaggacaacagaggagagtcctcatgccagagatgaacctggcggcagcgcaaaagatg

SEQ ID NO: 33860 - DNA, 103 bp, Artificial Sequence
  Synthetic Polynucleotide
taatacgactcactatagggcactctccgcggagtatctgtgagctgtctaacagaggagaagacagatgacagatactaacctggcggcagcgcaaaagatg

SEQ ID NO: 33861 - DNA, 103 bp, Artificial Sequence
  Synthetic Polynucleotide
taatacgactcactatagggacaaaccgtcgatacgttagattgtgtcgcaacagaggagagcgacaatgtctaacgtaaacctggcggcagcgcaaaagatg

SEQ ID NO: 33862 - DNA, 103 bp, Artificial Sequence
  Synthetic Polynucleotide
taatacgactcactataggggtcatggagtaggcaggtggggggcctcaaaacagaggagattgaggatgcccacctgcaacctggcggcagcgcaaaagatg

SEQ ID NO: 33863 - DNA, 103 bp, Artificial Sequence
  Synthetic Polynucleotide
taatacgactcactatagggaatgtctactggccccgaaacacaacacgtaacagaggagaacgtgtatggtttcggggaacctggcggcagcgcaaaagatg

SEQ ID NO: 33864 - DNA, 103 bp, Artificial Sequence
  Synthetic Polynucleotide
taatacgactcactatagggatcccaaaaactggccgaagagcgtagagaaacagaggagatctctaatgtcttcggccaacctggcggcagcgcaaaagatg

SEQ ID NO: 33865 - DNA, 103 bp, Artificial Sequence
  Synthetic Polynucleotide
taatacgactcactatagggaatagcgcccggcgaaccgtcctacgtcagaacagaggagactgacgatggacggttcgaacctggcggcagcgcaaaagatg

SEQ ID NO: 33866 - DNA, 103 bp, Artificial Sequence
  Synthetic Polynucleotide
taatacgactcactatagggtaatagagcgggagcccagcctctggtttgaacagaggagacaaaccatgggctgggctaacctggcggcagcgcaaaagatg

SEQ ID NO: 33867 - DNA, 103 bp, Artificial Sequence
  Synthetic Polynucleotide
taatacgactcactatagggccttcagagacgggtgcataacggaacgttaacagaggagaaacgttatgttatgcaccaacctggcggcagcgcaaaagatg

SEQ ID NO: 33868 - DNA, 103 bp, Artificial Sequence
  Synthetic Polynucleotide
taatacgactcactatagggattacggcccgacaaaggtctctccctcagaacagaggagactgaggatgagacctttgaacctggcggcagcgcaaaagatg

SEQ ID NO: 33869 - DNA, 103 bp, Artificial Sequence
  Synthetic Polynucleotide
taatacgactcactatagggccagactaacgctcgcatctcacctcggcgaacagaggagacgccgaatggagatgcgaaacctggcggcagcgcaaaagatg

SEQ ID NO: 33870 - DNA, 103 bp, Artificial Sequence
  Synthetic Polynucleotide
taatacgactcactatagggccgagcaatacaatctcgccatatttggagaacagaggagactccaaatgtggcgagataacctggcggcagcgcaaaagatg

SEQ ID NO: 33871 - DNA, 103 bp, Artificial Sequence
  Synthetic Polynucleotide
taatacgactcactataggggacccaccaactttcaagaaggtcctaggtaacagaggagaacctagatgcttcttgaaaacctggcggcagcgcaaaagatg

SEQ ID NO: 33872 - DNA, 103 bp, Artificial Sequence
  Synthetic Polynucleotide
taatacgactcactatagggaatatattagattcctcggagggaagaaacaacagaggagagtttctatgctccgaggaaacctggcggcagcgcaaaagatg

SEQ ID NO: 33873 - DNA, 103 bp, Artificial Sequence
  Synthetic Polynucleotide
taatacgactcactatagggggtattgggacaaatgttaaatgagaaagtaacagaggagaactttcatgtttaacattaacctggcggcagcgcaaaagatg

SEQ ID NO: 33874 - DNA, 103 bp, Artificial Sequence
  Synthetic Polynucleotide
taatacgactcactataggggataaagtgcctctttagcataggtcgcccaacagaggagagggcgaatgatgctaaagaacctggcggcagcgcaaaagatg

SEQ ID NO: 33875 - DNA, 103 bp, Artificial Sequence
  Synthetic Polynucleotide
taatacgactcactataggggggtagccacccggtacgttagatttcactaacagaggagaagtgaaatgtaacgtaccaacctggcggcagcgcaaaagatg

SEQ ID NO: 33876 - DNA, 103 bp, Artificial Sequence
  Synthetic Polynucleotide
taatacgactcactatagggtggaagtaagaccattttgactttacacggaacagaggagaccgtgtatggtcaaaatgaacctggcggcagcgcaaaagatg

SEQ ID NO: 33877 - DNA, 103 bp, Artificial Sequence
  Synthetic Polynucleotide
taatacgactcactatagggtacgacaaaaccgcttgtgaccatgtcctaaacagaggagataggacatggtcacaagcaacctggcggcagcgcaaaagatg

SEQ ID NO: 33878 - DNA, 103 bp, Artificial Sequence
  Synthetic Polynucleotide
taatacgactcactatagggatcacatccgccttcagccacggtacatagaacagaggagactatgtatggtggctgaaaacctggcggcagcgcaaaagatg

SEQ ID NO: 33879 - DNA, 103 bp, Artificial Sequence
  Synthetic Polynucleotide
taatacgactcactataggggagcccggcaccgacgatgcgcgtccatctaacagaggagaagatggatgcgcatcgtcaacctggcggcagcgcaaaagatg

SEQ ID NO: 33880 - DNA, 103 bp, Artificial Sequence
  Synthetic Polynucleotide
taatacgactcactataggggtcgtttggcgcgttgtgttacggatcaaaaacagaggagatttgatatgtaacacaacaacctggcggcagcgcaaaagatg

SEQ ID NO: 33881 - DNA, 103 bp, Artificial Sequence
  Synthetic Polynucleotide
taatacgactcactatagggggaggcgaacatattccttacgtgggggggaacagaggagaccccccatggtaaggaataacctggcggcagcgcaaaagatg

SEQ ID NO: 33882 - DNA, 103 bp, Artificial Sequence
  Synthetic Polynucleotide
taatacgactcactatagggccacctgccctcgtcgcctatcacagtaagaacagaggagacttactatgataggcgacaacctggcggcagcgcaaaagatg

SEQ ID NO: 33883 - DNA, 103 bp, Artificial Sequence
  Synthetic Polynucleotide
taatacgactcactatagggctttctgaatatgtcctccgaaccatatgtaacagaggagaacatatatgtcggaggacaacctggcggcagcgcaaaagatg

SEQ ID NO: 33884 - DNA, 103 bp, Artificial Sequence
  Synthetic Polynucleotide
taatacgactcactatagggacaggtacgaagggcgtccgcggacatgcgaacagaggagacgcatgatggcggacgccaacctggcggcagcgcaaaagatg

SEQ ID NO: 33885 - DNA, 103 bp, Artificial Sequence
  Synthetic Polynucleotide
taatacgactcactatagggaattgactccgctgttggtggttccgttccaacagaggagaggaacgatgccaccaacaaacctggcggcagcgcaaaagatg

SEQ ID NO: 33886 - DNA, 103 bp, Artificial Sequence
  Synthetic Polynucleotide
taatacgactcactatagggcacaaatagcgcacgaaattcacctcatccaacagaggagaggatgaatggaatttcgtaacctggcggcagcgcaaaagatg

SEQ ID NO: 33887 - DNA, 103 bp, Artificial Sequence
  Synthetic Polynucleotide
taatacgactcactatagggtatgtacctgtccgtcagctgtagtactccaacagaggagaggagtaatgcagctgacgaacctggcggcagcgcaaaagatg

SEQ ID NO: 33888 - DNA, 103 bp, Artificial Sequence
  Synthetic Polynucleotide
taatacgactcactatagggaacggcccgcgtgttaagtacgttcgatggaacagaggagaccatcgatggtacttaacaacctggcggcagcgcaaaagatg

SEQ ID NO: 33889 - DNA, 103 bp, Artificial Sequence
  Synthetic Polynucleotide
taatacgactcactatagggagtgttcgtacgctcaactgaaagtccgcaaacagaggagatgcggaatgtcagttgagaacctggcggcagcgcaaaagatg

SEQ ID NO: 33890 - DNA, 103 bp, Artificial Sequence
  Synthetic Polynucleotide
taatacgactcactatagggatgcttttctcacagtctccacacggcagtaacagaggagaactgccatgtggagactgaacctggcggcagcgcaaaagatg

SEQ ID NO: 33891 - DNA, 103 bp, Artificial Sequence
  Synthetic Polynucleotide
taatacgactcactatagggcgcaaaagtcctaaaattccaatgcaccctaacagaggagaagggtgatgtggaattttaacctggcggcagcgcaaaagatg

SEQ ID NO: 33892 - DNA, 103 bp, Artificial Sequence
  Synthetic Polynucleotide
taatacgactcactatagggatgggagagtatcactttcgtatccatcgaaacagaggagatcgatgatgacgaaagtgaacctggcggcagcgcaaaagatg

SEQ ID NO: 33893 - DNA, 103 bp, Artificial Sequence
  Synthetic Polynucleotide
taatacgactcactatagggatgccgaaaagtaacagttagatttgggaaaacagaggagattcccaatgctaactgttaacctggcggcagcgcaaaagatg

SEQ ID NO: 33894 - DNA, 103 bp, Artificial Sequence
  Synthetic Polynucleotide
taatacgactcactataggggtcgatgtggccacatagtgtggcacgctcaacagaggagagagcgtatgacactatgtaacctggcggcagcgcaaaagatg

SEQ ID NO: 33895 - DNA, 103 bp, Artificial Sequence
  Synthetic Polynucleotide
taatacgactcactataggggacctaatgcaggacccggatcagaaagggaacagaggagaccctttatgatccgggtcaacctggcggcagcgcaaaagatg

SEQ ID NO: 33896 - DNA, 103 bp, Artificial Sequence
  Synthetic Polynucleotide
taatacgactcactatagggcgtggctgaaaggtttgaactgctccgaataacagaggagaattcggatgagttcaaacaacctggcggcagcgcaaaagatg

SEQ ID NO: 33897 - DNA, 103 bp, Artificial Sequence
  Synthetic Polynucleotide
taatacgactcactatagggcacgttccattcttggatgatctctaggctaacagaggagaagcctaatgatcatccaaaacctggcggcagcgcaaaagatg

SEQ ID NO: 33898 - DNA, 103 bp, Artificial Sequence
  Synthetic Polynucleotide
taatacgactcactatagggtaaaggccggccgatgatcacctggtactaaacagaggagatagtacatggtgatcatcaacctggcggcagcgcaaaagatg

SEQ ID NO: 33899 - DNA, 103 bp, Artificial Sequence
  Synthetic Polynucleotide
taatacgactcactatagggataatcgcgctgcgttcgccgctgcgttggaacagaggagaccaacgatgcggcgaacgaacctggcggcagcgcaaaagatg

SEQ ID NO: 33900 - DNA, 103 bp, Artificial Sequence
  Synthetic Polynucleotide
taatacgactcactatagggcgcataccgatctaactttgaggctcgctaaacagaggagatagcgaatgtcaaagttaaacctggcggcagcgcaaaagatg

SEQ ID NO: 33901 - DNA, 103 bp, Artificial Sequence
  Synthetic Polynucleotide
taatacgactcactatagggcggcgctgacagtccgtttaaacaacctggaacagaggagaccaggtatgttaaacggaaacctggcggcagcgcaaaagatg

SEQ ID NO: 33902 - DNA, 103 bp, Artificial Sequence
  Synthetic Polynucleotide
taatacgactcactatagggaggatgaggggtccaacggccccgggtagtaacagaggagaactaccatgggccgttggaacctggcggcagcgcaaaagatg

SEQ ID NO: 33903 - DNA, 103 bp, Artificial Sequence
  Synthetic Polynucleotide
taatacgactcactatagggtggaatcctggtccaataaatagaactaggaacagaggagacctagtatgatttattggaacctggcggcagcgcaaaagatg

SEQ ID NO: 33904 - DNA, 103 bp, Artificial Sequence
  Synthetic Polynucleotide
taatacgactcactatagggagagactgacagttacgcgtaattaaattaaacagaggagataatttatgtacgcgtaaaacctggcggcagcgcaaaagatg

SEQ ID NO: 33905 - DNA, 103 bp, Artificial Sequence
  Synthetic Polynucleotide
taatacgactcactataggggtatcgggaacggacgttgacttctccccaaacagaggagatggggaatggtcaacgtcaacctggcggcagcgcaaaagatg

SEQ ID NO: 33906 - DNA, 103 bp, Artificial Sequence
  Synthetic Polynucleotide
taatacgactcactatagggtattgcgcggttacgccactacaaatgtgtaacagaggagaacacatatgtagtggcgtaacctggcggcagcgcaaaagatg

SEQ ID NO: 33907 - DNA, 103 bp, Artificial Sequence
  Synthetic Polynucleotide
taatacgactcactataggggcctagaaggcatgtacagtattgctattcaacagaggagagaatagatgtactgtacaaacctggcggcagcgcaaaagatg

SEQ ID NO: 33908 - DNA, 103 bp, Artificial Sequence
  Synthetic Polynucleotide
taatacgactcactataggggcagtaacgtggcaatatatcagtagtaataacagaggagaattactatggatatattgaacctggcggcagcgcaaaagatg

SEQ ID NO: 33909 - DNA, 103 bp, Artificial Sequence
  Synthetic Polynucleotide
taatacgactcactatagggcagcacgctgtgatgaaccctatttgtgttaacagaggagaaacacaatgagggttcataacctggcggcagcgcaaaagatg

SEQ ID NO: 33910 - DNA, 103 bp, Artificial Sequence
  Synthetic Polynucleotide
taatacgactcactatagggtgcgagaagcacgtacgccagggcaaggaaaacagaggagattccttatgctggcgtacaacctggcggcagcgcaaaagatg

SEQ ID NO: 33911 - DNA, 103 bp, Artificial Sequence
  Synthetic Polynucleotide
taatacgactcactatagggctctgctattcaatagatttaatccaagcgaacagaggagacgcttgatgtaaatctataacctggcggcagcgcaaaagatg

SEQ ID NO: 33912 - DNA, 103 bp, Artificial Sequence
  Synthetic Polynucleotide
taatacgactcactatagggtttgataagtgtgctttgtcctatctattgaacagaggagacaatagatgggacaaagcaacctggcggcagcgcaaaagatg

SEQ ID NO: 33913 - DNA, 103 bp, Artificial Sequence
  Synthetic Polynucleotide
taatacgactcactatagggaaggcctcctcacccggctcgcagcactgaaacagaggagatcagtgatgcgagccgggaacctggcggcagcgcaaaagatg

SEQ ID NO: 33914 - DNA, 103 bp, Artificial Sequence
  Synthetic Polynucleotide
taatacgactcactatagggcagacctagttggggtaacgcaaattagcaaacagaggagatgctaaatggcgttacccaacctggcggcagcgcaaaagatg

SEQ ID NO: 33915 - DNA, 103 bp, Artificial Sequence
  Synthetic Polynucleotide
taatacgactcactatagggtacttagttaaccattctgttcacgcaaagaacagaggagactttgcatgaacagaatgaacctggcggcagcgcaaaagatg

SEQ ID NO: 33916 - DNA, 103 bp, Artificial Sequence
  Synthetic Polynucleotide
taatacgactcactataggggctggatacgcgccgataaagaagcgacgaaacagaggagatcgtcgatgctttatcggaacctggcggcagcgcaaaagatg

SEQ ID NO: 33917 - DNA, 103 bp, Artificial Sequence
  Synthetic Polynucleotide
taatacgactcactatagggagtctcttcacaagataataggagccccacaacagaggagagtggggatgctattatctaacctggcggcagcgcaaaagatg

SEQ ID NO: 33918 - DNA, 103 bp, Artificial Sequence
  Synthetic Polynucleotide
taatacgactcactatagggttcgtatatatgcctagcctactgtagtcaaacagaggagatgactaatgtaggctaggaacctggcggcagcgcaaaagatg

SEQ ID NO: 33919 - DNA, 103 bp, Artificial Sequence
  Synthetic Polynucleotide
taatacgactcactatagggtcgtctcggctgcacagtccaagacactcaaacagaggagatgagtgatgtggactgtgaacctggcggcagcgcaaaagatg

SEQ ID NO: 33920 - DNA, 103 bp, Artificial Sequence
  Synthetic Polynucleotide
taatacgactcactataggggcgtcgtctgtcggggagacttggaaagtgaacagaggagacactttatgagtctccccaacctggcggcagcgcaaaagatg

SEQ ID NO: 33921 - DNA, 103 bp, Artificial Sequence
  Synthetic Polynucleotide
taatacgactcactataggggcagccaactgtttgggaaagcgacgcgccaacagaggagaggcgcgatgctttcccaaaacctggcggcagcgcaaaagatg

SEQ ID NO: 33922 - DNA, 103 bp, Artificial Sequence
  Synthetic Polynucleotide
taatacgactcactatagggtcgctcacacccatggatattctagacggcaacagaggagagccgtcatgaatatccataacctggcggcagcgcaaaagatg

SEQ ID NO: 33923 - DNA, 103 bp, Artificial Sequence
  Synthetic Polynucleotide
taatacgactcactatagggctccgtgttacaggggtaggtgcgggccccaacagaggagaggggccatgacctaccccaacctggcggcagcgcaaaagatg

SEQ ID NO: 33924 - DNA, 103 bp, Artificial Sequence
  Synthetic Polynucleotide
taatacgactcactatagggcccggtgataaggccatagcacttcggaacaacagaggagagttccgatgtgctatggcaacctggcggcagcgcaaaagatg

SEQ ID NO: 33925 - DNA, 103 bp, Artificial Sequence
  Synthetic Polynucleotide
taatacgactcactatagggcgaccgttcctaagactataaccttttcacaacagaggagagtgaaaatgttatagtctaacctggcggcagcgcaaaagatg

SEQ ID NO: 33926 - DNA, 103 bp, Artificial Sequence
  Synthetic Polynucleotide
taatacgactcactatagggtcctagtggacagacccaccagggcacatcaacagaggagagatgtgatgtggtgggtcaacctggcggcagcgcaaaagatg

SEQ ID NO: 33927 - DNA, 103 bp, Artificial Sequence
  Synthetic Polynucleotide
taatacgactcactatagggagagcgaagttcgagaccggtaattcttggaacagaggagaccaagaatgaccggtctcaacctggcggcagcgcaaaagatg

SEQ ID NO: 33928 - DNA, 103 bp, Artificial Sequence
  Synthetic Polynucleotide
taatacgactcactatagggaactttgcgtcgtacatccgatttacacctaacagaggagaaggtgtatgtcggatgtaaacctggcggcagcgcaaaagatg

SEQ ID NO: 33929 - DNA, 103 bp, Artificial Sequence
  Synthetic Polynucleotide
taatacgactcactatagggaggacacgcgccgaaatacgcggggccttaaacagaggagataaggcatggcgtatttcaacctggcggcagcgcaaaagatg

SEQ ID NO: 33930 - DNA, 103 bp, Artificial Sequence
  Synthetic Polynucleotide
taatacgactcactatagggactatttacccaatcgcgtgaattaagcccaacagaggagagggcttatgtcacgcgataacctggcggcagcgcaaaagatg

SEQ ID NO: 33931 - DNA, 103 bp, Artificial Sequence
  Synthetic Polynucleotide
taatacgactcactatagggggttcgcactcttaattcggggtttctcgtaacagaggagaacgagaatgcccgaattaaacctggcggcagcgcaaaagatg

SEQ ID NO: 33932 - DNA, 103 bp, Artificial Sequence
  Synthetic Polynucleotide
taatacgactcactatagggtaccgaaccatgagtgttgccgtggtgcataacagaggagaatgcacatgggcaacactaacctggcggcagcgcaaaagatg

SEQ ID NO: 33933 - DNA, 103 bp, Artificial Sequence
  Synthetic Polynucleotide
taatacgactcactatagggctgccacgaacgggaaaaagggccgaaagtaacagaggagaactttcatgcctttttccaacctggcggcagcgcaaaagatg

SEQ ID NO: 33934 - DNA, 103 bp, Artificial Sequence
  Synthetic Polynucleotide
taatacgactcactataggggctccgcggagatattatcacggcctaacgaacagaggagacgttagatggtgataataaacctggcggcagcgcaaaagatg

SEQ ID NO: 33935 - DNA, 103 bp, Artificial Sequence
  Synthetic Polynucleotide
taatacgactcactatagggctaccacatcgtatagacgcacaacgaccgaacagaggagacggtcgatgtgcgtctataacctggcggcagcgcaaaagatg

SEQ ID NO: 33936 - DNA, 103 bp, Artificial Sequence
  Synthetic Polynucleotide
taatacgactcactatagggcatgttacttgagttgcggacgtcagccctaacagaggagaagggctatggtccgcaacaacctggcggcagcgcaaaagatg

SEQ ID NO: 33937 - DNA, 103 bp, Artificial Sequence
  Synthetic Polynucleotide
taatacgactcactataggggggcgtcaggctgagatgctaccttccgacaacagaggagagtcggaatgtagcatctcaacctggcggcagcgcaaaagatg

SEQ ID NO: 33938 - DNA, 103 bp, Artificial Sequence
  Synthetic Polynucleotide
taatacgactcactatagggcccctttgattagcacgaattctgcacatgaacagaggagacatgtgatgaattcgtgcaacctggcggcagcgcaaaagatg

SEQ ID NO: 33939 - DNA, 103 bp, Artificial Sequence
  Synthetic Polynucleotide
taatacgactcactatagggcatctagggagcgctgcccccgtgtgaccgaacagaggagacggtcaatggggggcagcaacctggcggcagcgcaaaagatg

SEQ ID NO: 33940 - DNA, 103 bp, Artificial Sequence
  Synthetic Polynucleotide
taatacgactcactatagggggcgtccgtaaatctgcgcaaacttcgctaaacagaggagatagcgaatgttgcgcagaaacctggcggcagcgcaaaagatg

SEQ ID NO: 33941 - DNA, 103 bp, Artificial Sequence
  Synthetic Polynucleotide
taatacgactcactataggggactcgtactcaggtatgttaaagagcactaacagaggagaagtgctatgtaacataccaacctggcggcagcgcaaaagatg

SEQ ID NO: 33942 - DNA, 103 bp, Artificial Sequence
  Synthetic Polynucleotide
taatacgactcactataggggttgcgaactacctcgggaggggtgcagagaacagaggagactctgcatgcctcccgagaacctggcggcagcgcaaaagatg

SEQ ID NO: 33943 - DNA, 103 bp, Artificial Sequence
  Synthetic Polynucleotide
taatacgactcactataggggtaatcagcgagagaacagacgctttggggaacagaggagaccccaaatggtctgttctaacctggcggcagcgcaaaagatg

SEQ ID NO: 33944 - DNA, 103 bp, Artificial Sequence
  Synthetic Polynucleotide
taatacgactcactatagggatggcaaagtcaggcgcagtaccaaggcaaaacagaggagattgcctatgtactgcgccaacctggcggcagcgcaaaagatg

SEQ ID NO: 33945 - DNA, 103 bp, Artificial Sequence
  Synthetic Polynucleotide
taatacgactcactatagggcgggcttacggaagaccacggtcgcggacaaacagaggagatgtccgatgccgtggtctaacctggcggcagcgcaaaagatg

SEQ ID NO: 33946 - DNA, 103 bp, Artificial Sequence
  Synthetic Polynucleotide
taatacgactcactatagggcagaactgctggtggctccctccctatggcaacagaggagagccataatgagggagccaaacctggcggcagcgcaaaagatg

SEQ ID NO: 33947 - DNA, 103 bp, Artificial Sequence
  Synthetic Polynucleotide
taatacgactcactatagggaagtgtacgtttgcagttgatggagggtgcaacagaggagagcacccatgatcaactgcaacctggcggcagcgcaaaagatg

SEQ ID NO: 33948 - DNA, 103 bp, Artificial Sequence
  Synthetic Polynucleotide
taatacgactcactatagggaggacgataagcgagtcaaattgccctgggaacagaggagacccaggatgatttgactcaacctggcggcagcgcaaaagatg

SEQ ID NO: 33949 - DNA, 103 bp, Artificial Sequence
  Synthetic Polynucleotide
taatacgactcactatagggccatccatgaccgcgtttcatgatgggcagaacagaggagactgcccatgatgaaacgcaacctggcggcagcgcaaaagatg

SEQ ID NO: 33950 - DNA, 103 bp, Artificial Sequence
  Synthetic Polynucleotide
taatacgactcactatagggtattggaaaagcatggggagtcgatatgagaacagaggagactcataatgactccccataacctggcggcagcgcaaaagatg

SEQ ID NO: 33951 - DNA, 103 bp, Artificial Sequence
  Synthetic Polynucleotide
taatacgactcactatagggtgtattcactaagatattacgtgtcctgacaacagaggagagtcaggatgcgtaatatcaacctggcggcagcgcaaaagatg

SEQ ID NO: 33952 - DNA, 103 bp, Artificial Sequence
  Synthetic Polynucleotide
taatacgactcactatagggtttaagtctagttattggcaagctctagttaacagaggagaaactagatgttgccaataaacctggcggcagcgcaaaagatg

SEQ ID NO: 33953 - DNA, 103 bp, Artificial Sequence
  Synthetic Polynucleotide
taatacgactcactataggggttgttagaggcttttattggtcgaatgaaaacagaggagattcattatgccaataaaaaacctggcggcagcgcaaaagatg

SEQ ID NO: 33954 - DNA, 103 bp, Artificial Sequence
  Synthetic Polynucleotide
taatacgactcactatagggtgcacgacggaagcggggtagcagcgcttgaacagaggagacaagcgatgctaccccgcaacctggcggcagcgcaaaagatg

SEQ ID NO: 33955 - DNA, 103 bp, Artificial Sequence
  Synthetic Polynucleotide
taatacgactcactatagggagctcgtagagtctttgtttcgttgctagcaacagaggagagctagcatggaaacaaagaacctggcggcagcgcaaaagatg

SEQ ID NO: 33956 - DNA, 103 bp, Artificial Sequence
  Synthetic Polynucleotide
taatacgactcactatagggcatccgcagaactattcaatagaaaaccgcaacagaggagagcggttatgtattgaataaacctggcggcagcgcaaaagatg

SEQ ID NO: 33957 - DNA, 103 bp, Artificial Sequence
  Synthetic Polynucleotide
taatacgactcactataggggtactcaagtaagcagagagaaatccaagaaacagaggagatcttggatgtctctctgcaacctggcggcagcgcaaaagatg

SEQ ID NO: 33958 - DNA, 103 bp, Artificial Sequence
  Synthetic Polynucleotide
taatacgactcactatagggacctctgttaagcagtcctccgaatttcgaaacagaggagatcgaaaatgggaggactgaacctggcggcagcgcaaaagatg

SEQ ID NO: 33959 - DNA, 103 bp, Artificial Sequence
  Synthetic Polynucleotide
taatacgactcactatagggcaccgaaatgacggactaattaaaaaccggaacagaggagaccggttatgaattagtccaacctggcggcagcgcaaaagatg

SEQ ID NO: 33960 - DNA, 103 bp, Artificial Sequence
  Synthetic Polynucleotide
taatacgactcactatagggatcggccagactaggaagtagtatctgactaacagaggagaagtcagatgctacttcctaacctggcggcagcgcaaaagatg

SEQ ID NO: 33961 - DNA, 103 bp, Artificial Sequence
  Synthetic Polynucleotide
taatacgactcactataggggattgcctggcaacatcgagccgggtgcaaaacagaggagattgcacatggctcgatgtaacctggcggcagcgcaaaagatg

SEQ ID NO: 33962 - DNA, 103 bp, Artificial Sequence
  Synthetic Polynucleotide
taatacgactcactatagggtgcggcaactagtttcatcagagggctcataacagaggagaatgagcatgctgatgaaaaacctggcggcagcgcaaaagatg

SEQ ID NO: 33963 - DNA, 103 bp, Artificial Sequence
  Synthetic Polynucleotide
taatacgactcactatagggcggacgttcggttgatccgaatggcaaaagaacagaggagacttttgatgttcggatcaaacctggcggcagcgcaaaagatg

SEQ ID NO: 33964 - DNA, 103 bp, Artificial Sequence
  Synthetic Polynucleotide
taatacgactcactatagggctggattgtactattgaataccaggcatgaaacagaggagatcatgcatggtattcaataacctggcggcagcgcaaaagatg

SEQ ID NO: 33965 - DNA, 103 bp, Artificial Sequence
  Synthetic Polynucleotide
taatacgactcactatagggatggtaactgaaggaagtaccaatagacggaacagaggagaccgtctatgggtacttccaacctggcggcagcgcaaaagatg

SEQ ID NO: 33966 - DNA, 103 bp, Artificial Sequence
  Synthetic Polynucleotide
taatacgactcactatagggacttgaggtcgggccgctgcagctacgcggaacagaggagaccgcgtatgtgcagcggcaacctggcggcagcgcaaaagatg

SEQ ID NO: 33967 - DNA, 103 bp, Artificial Sequence
  Synthetic Polynucleotide
taatacgactcactatagggtgtctcacggaaggattacataactttaataacagaggagaattaaaatgatgtaatccaacctggcggcagcgcaaaagatg

SEQ ID NO: 33968 - DNA, 103 bp, Artificial Sequence
  Synthetic Polynucleotide
taatacgactcactatagggagctgcgcgaagatccaaacaccctggccgaacagaggagacggccaatgtgtttggataacctggcggcagcgcaaaagatg

SEQ ID NO: 33969 - DNA, 103 bp, Artificial Sequence
  Synthetic Polynucleotide
taatacgactcactatagggacgcggagctaatctgctccttatagtttgaacagaggagacaaactatgaggagcagaaacctggcggcagcgcaaaagatg

SEQ ID NO: 33970 - DNA, 103 bp, Artificial Sequence
  Synthetic Polynucleotide
taatacgactcactatagggggttgggtgtggaacgccgaggcatattggaacagaggagaccaataatgctcggcgttaacctggcggcagcgcaaaagatg

SEQ ID NO: 33971 - DNA, 103 bp, Artificial Sequence
  Synthetic Polynucleotide
taatacgactcactatagggccagactgcgacctccgggacgcggaggcaaacagaggagatgcctcatggtcccggagaacctggcggcagcgcaaaagatg

SEQ ID NO: 33972 - DNA, 103 bp, Artificial Sequence
  Synthetic Polynucleotide
taatacgactcactatagggtaatatttgcccgttatgaacgtcgggtttaacagaggagaaaacccatggttcataacaacctggcggcagcgcaaaagatg

SEQ ID NO: 33973 - DNA, 103 bp, Artificial Sequence
  Synthetic Polynucleotide
taatacgactcactataggggggtcctcagcatcaagcctctgattcctgaacagaggagacaggaaatggaggcttgaaacctggcggcagcgcaaaagatg

SEQ ID NO: 33974 - DNA, 103 bp, Artificial Sequence
  Synthetic Polynucleotide
taatacgactcactatagggctcgtggacctaccgttccgctggggtaccaacagaggagaggtaccatggcggaacggaacctggcggcagcgcaaaagatg

SEQ ID NO: 33975 - DNA, 103 bp, Artificial Sequence
  Synthetic Polynucleotide
taatacgactcactataggggagaacatctagtcgagagtaagagcctgaaacagaggagatcaggcatgtactctcgaaacctggcggcagcgcaaaagatg

SEQ ID NO: 33976 - DNA, 103 bp, Artificial Sequence
  Synthetic Polynucleotide
taatacgactcactatagggtatatgcactgtaaacaacttttcgtcgacaacagaggagagtcgacatgaagttgtttaacctggcggcagcgcaaaagatg

SEQ ID NO: 33977 - DNA, 103 bp, Artificial Sequence
  Synthetic Polynucleotide
taatacgactcactatagggttttccgagctttagtccacgtgcagcctaaacagaggagataggctatgcgtggactaaacctggcggcagcgcaaaagatg

SEQ ID NO: 33978 - DNA, 103 bp, Artificial Sequence
  Synthetic Polynucleotide
taatacgactcactatagggcacggcggaatcgctgctgaatgagaaatgaacagaggagacatttcatgttcagcagcaacctggcggcagcgcaaaagatg

SEQ ID NO: 33979 - DNA, 103 bp, Artificial Sequence
  Synthetic Polynucleotide
taatacgactcactatagggatccagtctgccccttaaagagccttgtaaaacagaggagattacaaatgtctttaaggaacctggcggcagcgcaaaagatg

SEQ ID NO: 33980 - DNA, 103 bp, Artificial Sequence
  Synthetic Polynucleotide
taatacgactcactataggggagtacctgactggtgagcgtcgaaccgacaacagaggagagtcggtatgacgctcaccaacctggcggcagcgcaaaagatg

SEQ ID NO: 33981 - DNA, 103 bp, Artificial Sequence
  Synthetic Polynucleotide
taatacgactcactatagggacggaccggccgaggcgataacggtactcgaacagaggagacgagtaatgttatcgcctaacctggcggcagcgcaaaagatg

SEQ ID NO: 33982 - DNA, 103 bp, Artificial Sequence
  Synthetic Polynucleotide
taatacgactcactatagggtttgggtatgacgcctgacataaagacgttaacagaggagaaacgtcatgatgtcaggcaacctggcggcagcgcaaaagatg

SEQ ID NO: 33983 - DNA, 103 bp, Artificial Sequence
  Synthetic Polynucleotide
taatacgactcactatagggcttgcctccgcaattggtcgatttcattataacagaggagaataatgatgtcgaccaataacctggcggcagcgcaaaagatg

SEQ ID NO: 33984 - DNA, 103 bp, Artificial Sequence
  Synthetic Polynucleotide
taatacgactcactatagggggtaaataggctagcatcgtccgtcacagaaacagaggagatctgtgatggacgatgctaacctggcggcagcgcaaaagatg

SEQ ID NO: 33985 - DNA, 103 bp, Artificial Sequence
  Synthetic Polynucleotide
taatacgactcactataggggtcgacacgcattatgattgcccttaattaaacagaggagataattaatggcaatcataaacctggcggcagcgcaaaagatg

SEQ ID NO: 33986 - DNA, 103 bp, Artificial Sequence
  Synthetic Polynucleotide
taatacgactcactatagggcggaatctcgagccgtctgatgaggctgtcaacagaggagagacagcatgatcagacggaacctggcggcagcgcaaaagatg

SEQ ID NO: 33987 - DNA, 103 bp, Artificial Sequence
  Synthetic Polynucleotide
taatacgactcactatagggcgggttgcgagcctcatctctgtcaattaaaacagaggagattaattatgagagatgagaacctggcggcagcgcaaaagatg

SEQ ID NO: 33988 - DNA, 103 bp, Artificial Sequence
  Synthetic Polynucleotide
taatacgactcactataggggtcgccgtgtagtactgacggctgcaaagaaacagaggagatctttgatgccgtcagtaaacctggcggcagcgcaaaagatg

SEQ ID NO: 33989 - DNA, 103 bp, Artificial Sequence
  Synthetic Polynucleotide
taatacgactcactatagggcgcgccgtagacacggtctaggctaaatggaacagaggagaccatttatgctagaccgtaacctggcggcagcgcaaaagatg

SEQ ID NO: 33990 - DNA, 103 bp, Artificial Sequence
  Synthetic Polynucleotide
taatacgactcactatagggatctagctccgtctagccctcatattggccaacagaggagaggccaaatggagggctagaacctggcggcagcgcaaaagatg

SEQ ID NO: 33991 - DNA, 103 bp, Artificial Sequence
  Synthetic Polynucleotide
taatacgactcactatagggtaccgggattagggttaaatgacacagacaaacagaggagatgtctgatgcatttaaccaacctggcggcagcgcaaaagatg

SEQ ID NO: 33992 - DNA, 103 bp, Artificial Sequence
  Synthetic Polynucleotide
taatacgactcactatagggtcccccagattaacccgtagacgccgttttaacagaggagaaaaacgatgtctacgggtaacctggcggcagcgcaaaagatg

SEQ ID NO: 33993 - DNA, 103 bp, Artificial Sequence
  Synthetic Polynucleotide
taatacgactcactatagggtacattcaggacctgcctagccgaatctggaacagaggagaccagatatggctaggcagaacctggcggcagcgcaaaagatg

SEQ ID NO: 33994 - DNA, 103 bp, Artificial Sequence
  Synthetic Polynucleotide
taatacgactcactataggggcttaaggtaagttagggaccagcagctccaacagaggagaggagctatgggtccctaaaacctggcggcagcgcaaaagatg

SEQ ID NO: 33995 - DNA, 103 bp, Artificial Sequence
  Synthetic Polynucleotide
taatacgactcactataggggcacagcgatgggcatctcgttaatgaaataacagaggagaatttcaatgacgagatgcaacctggcggcagcgcaaaagatg

SEQ ID NO: 33996 - DNA, 103 bp, Artificial Sequence
  Synthetic Polynucleotide
taatacgactcactatagggcatctctattccactaacaatgccagtcaaaacagaggagattgactatgattgttagtaacctggcggcagcgcaaaagatg

SEQ ID NO: 33997 - DNA, 103 bp, Artificial Sequence
  Synthetic Polynucleotide
taatacgactcactataggggatgtaatgaagagtgctaatctccgaagaaacagaggagatcttcgatgattagcactaacctggcggcagcgcaaaagatg

SEQ ID NO: 33998 - DNA, 103 bp, Artificial Sequence
  Synthetic Polynucleotide
taatacgactcactataggggctgaagtaaaagacggctactgttctctgaacagaggagacagagaatggtagccgtcaacctggcggcagcgcaaaagatg

SEQ ID NO: 33999 - DNA, 103 bp, Artificial Sequence
  Synthetic Polynucleotide
taatacgactcactataggggtttagtgcggtgcgatggttcacgtctgtaacagaggagaacagacatgaaccatcgcaacctggcggcagcgcaaaagatg

SEQ ID NO: 34000 - DNA, 103 bp, Artificial Sequence
  Synthetic Polynucleotide
taatacgactcactatagggcccgtacttggtaatactacttacccgaaaaacagaggagatttcggatgagtagtattaacctggcggcagcgcaaaagatg

SEQ ID NO: 34001 - DNA, 103 bp, Artificial Sequence
  Synthetic Polynucleotide
taatacgactcactatagggggagcagtgcaacttatttttccgtttcgaaacagaggagatcgaaaatgaaaaataagaacctggcggcagcgcaaaagatg

SEQ ID NO: 34002 - DNA, 103 bp, Artificial Sequence
  Synthetic Polynucleotide
taatacgactcactatagggtgtcccggatcgttagccgccgcgcgcattaacagaggagaaatgcgatgggcggctaaaacctggcggcagcgcaaaagatg

SEQ ID NO: 34003 - DNA, 103 bp, Artificial Sequence
  Synthetic Polynucleotide
taatacgactcactatagggggtcgccgaacgtctcgtgcgacgtgtactaacagaggagaagtacaatgcgcacgagaaacctggcggcagcgcaaaagatg

SEQ ID NO: 34004 - DNA, 103 bp, Artificial Sequence
  Synthetic Polynucleotide
taatacgactcactatagggccgttatgcccttggtagccccatttaatcaacagaggagagattaaatggggctaccaaacctggcggcagcgcaaaagatg

SEQ ID NO: 34005 - DNA, 103 bp, Artificial Sequence
  Synthetic Polynucleotide
taatacgactcactatagggtgaccaacgagacagctattcgtgacgccgaacagaggagacggcgtatggaatagctgaacctggcggcagcgcaaaagatg

SEQ ID NO: 34006 - DNA, 103 bp, Artificial Sequence
  Synthetic Polynucleotide
taatacgactcactataggggcgtggcagcgctattacaatggttcactcaacagaggagagagtgaatgattgtaataaacctggcggcagcgcaaaagatg

SEQ ID NO: 34007 - DNA, 103 bp, Artificial Sequence
  Synthetic Polynucleotide
taatacgactcactatagggcatacgtctacggcctcacatgtgtaaggtaacagaggagaaccttaatgatgtgaggcaacctggcggcagcgcaaaagatg

SEQ ID NO: 34008 - DNA, 103 bp, Artificial Sequence
  Synthetic Polynucleotide
taatacgactcactatagggcttttgtgtcaagaaggtgattcggtggggaacagaggagaccccacatgatcaccttcaacctggcggcagcgcaaaagatg

SEQ ID NO: 34009 - DNA, 103 bp, Artificial Sequence
  Synthetic Polynucleotide
taatacgactcactataggggacaaagataccggctcctaaggctttagtaacagaggagaactaaaatgttaggagccaacctggcggcagcgcaaaagatg

SEQ ID NO: 34010 - DNA, 103 bp, Artificial Sequence
  Synthetic Polynucleotide
taatacgactcactataggggcatgcgatcaactcaaccatgcgcacccaaacagaggagatgggtgatgatggttgagaacctggcggcagcgcaaaagatg

SEQ ID NO: 34011 - DNA, 103 bp, Artificial Sequence
  Synthetic Polynucleotide
taatacgactcactatagggagtctgttggctcgcctaccgacgggagttaacagaggagaaactccatgcggtaggcgaacctggcggcagcgcaaaagatg

SEQ ID NO: 34012 - DNA, 103 bp, Artificial Sequence
  Synthetic Polynucleotide
taatacgactcactatagggggagggtttggaatggaatatcggggttataacagaggagaataaccatgatattccataacctggcggcagcgcaaaagatg

SEQ ID NO: 34013 - DNA, 103 bp, Artificial Sequence
  Synthetic Polynucleotide
taatacgactcactatagggagaattgattcaggaggtgggtctaatattaacagaggagaaatattatgcccacctccaacctggcggcagcgcaaaagatg

SEQ ID NO: 34014 - DNA, 103 bp, Artificial Sequence
  Synthetic Polynucleotide
taatacgactcactatagggccaggaggagccatcctcctagaggcagccaacagaggagaggctgcatgtaggaggataacctggcggcagcgcaaaagatg

SEQ ID NO: 34015 - DNA, 103 bp, Artificial Sequence
  Synthetic Polynucleotide
taatacgactcactatagggtccctgcgttcatgatagctgatcaaatcaaacagaggagatgatttatgcagctatcaaacctggcggcagcgcaaaagatg

SEQ ID NO: 34016 - DNA, 103 bp, Artificial Sequence
  Synthetic Polynucleotide
taatacgactcactatagggcggatgtttcacttcctgccggactctaacaacagaggagagttagaatgcggcaggaaaacctggcggcagcgcaaaagatg

SEQ ID NO: 34017 - DNA, 103 bp, Artificial Sequence
  Synthetic Polynucleotide
taatacgactcactataggggtagtgggtcacgttacatgttcaattcgaaacagaggagatcgaatatgacatgtaacaacctggcggcagcgcaaaagatg

SEQ ID NO: 34018 - DNA, 103 bp, Artificial Sequence
  Synthetic Polynucleotide
taatacgactcactatagggctcccatatcttaaagaactatagctatataacagaggagaatatagatgtagttctttaacctggcggcagcgcaaaagatg

SEQ ID NO: 34019 - DNA, 103 bp, Artificial Sequence
  Synthetic Polynucleotide
taatacgactcactatagggactcttatgaatgtacttataagtgcgacaaacagaggagatgtcgcatgtataagtacaacctggcggcagcgcaaaagatg

SEQ ID NO: 34020 - DNA, 103 bp, Artificial Sequence
  Synthetic Polynucleotide
taatacgactcactatagggttataatttcgtaaggacatcactgtcccgaacagaggagacgggacatggatgtccttaacctggcggcagcgcaaaagatg

SEQ ID NO: 34021 - DNA, 103 bp, Artificial Sequence
  Synthetic Polynucleotide
taatacgactcactatagggctgtgctcgttccacaggagcgtcgaacagaacagaggagactgttcatggctcctgtgaacctggcggcagcgcaaaagatg

SEQ ID NO: 34022 - DNA, 103 bp, Artificial Sequence
  Synthetic Polynucleotide
taatacgactcactataggggtgattacggaggtacgagccttactccgtaacagaggagaacggagatgggctcgtacaacctggcggcagcgcaaaagatg

SEQ ID NO: 34023 - DNA, 103 bp, Artificial Sequence
  Synthetic Polynucleotide
taatacgactcactataggggagcatagtggaggacagtggctccccccaaacagaggagatgggggatgccactgtccaacctggcggcagcgcaaaagatg

SEQ ID NO: 34024 - DNA, 103 bp, Artificial Sequence
  Synthetic Polynucleotide
taatacgactcactataggggtcccgaagcgtctctatagatgttaatctaacagaggagaagattaatgtctatagagaacctggcggcagcgcaaaagatg

SEQ ID NO: 34025 - DNA, 103 bp, Artificial Sequence
  Synthetic Polynucleotide
taatacgactcactatagggttcggttgggctaccggacgcagggttgtcaacagaggagagacaacatggcgtccggtaacctggcggcagcgcaaaagatg

SEQ ID NO: 34026 - DNA, 103 bp, Artificial Sequence
  Synthetic Polynucleotide
taatacgactcactataggggtccattgcatgtaaacatttcattctcttaacagaggagaaagagaatgaaatgtttaaacctggcggcagcgcaaaagatg

SEQ ID NO: 34027 - DNA, 103 bp, Artificial Sequence
  Synthetic Polynucleotide
taatacgactcactataggggtcaacagggcttcctctaattccggcgtaaacagaggagatacgccatgattagaggaaacctggcggcagcgcaaaagatg

SEQ ID NO: 34028 - DNA, 103 bp, Artificial Sequence
  Synthetic Polynucleotide
taatacgactcactatagggcaatcgttgcaacaactcatcgtcacgccgaacagaggagacggcgtatggatgagttgaacctggcggcagcgcaaaagatg

SEQ ID NO: 34029 - DNA, 103 bp, Artificial Sequence
  Synthetic Polynucleotide
taatacgactcactataggggacaatgtcgaaatttcagtctttttatgcaacagaggagagcataaatggactgaaataacctggcggcagcgcaaaagatg

SEQ ID NO: 34030 - DNA, 103 bp, Artificial Sequence
  Synthetic Polynucleotide
taatacgactcactatagggtcaaaccggttacggtaacgactctagggcaacagaggagagccctaatgtcgttaccgaacctggcggcagcgcaaaagatg

SEQ ID NO: 34031 - DNA, 103 bp, Artificial Sequence
  Synthetic Polynucleotide
taatacgactcactataggggatatcgaaaggcgaagcggacgggagcttaacagaggagaaagctcatgtccgcttcgaacctggcggcagcgcaaaagatg

SEQ ID NO: 34032 - DNA, 103 bp, Artificial Sequence
  Synthetic Polynucleotide
taatacgactcactatagggtcaccactcagctcgagctcaacgaattataacagaggagaataattatgtgagctcgaaacctggcggcagcgcaaaagatg

SEQ ID NO: 34033 - DNA, 103 bp, Artificial Sequence
  Synthetic Polynucleotide
taatacgactcactatagggattctcgcggacactcaggcactgggcactaacagaggagaagtgccatgtgcctgagtaacctggcggcagcgcaaaagatg

SEQ ID NO: 34034 - DNA, 103 bp, Artificial Sequence
  Synthetic Polynucleotide
taatacgactcactatagggaagccattggaattagttgggtatcggatcaacagaggagagatccgatgcccaactaaaacctggcggcagcgcaaaagatg

SEQ ID NO: 34035 - DNA, 103 bp, Artificial Sequence
  Synthetic Polynucleotide
taatacgactcactatagggcaaccagggcgaaggagacgcattcccgggaacagaggagacccgggatggcgtctcctaacctggcggcagcgcaaaagatg

SEQ ID NO: 34036 - DNA, 103 bp, Artificial Sequence
  Synthetic Polynucleotide
taatacgactcactatagggtgcactgccgtatcgggggatgaatgacccaacagaggagagggtcaatgatcccccgaaacctggcggcagcgcaaaagatg

SEQ ID NO: 34037 - DNA, 103 bp, Artificial Sequence
  Synthetic Polynucleotide
taatacgactcactatagggccataaaatggccatcatgagtttgtcactaacagaggagaagtgacatgctcatgatgaacctggcggcagcgcaaaagatg

SEQ ID NO: 34038 - DNA, 103 bp, Artificial Sequence
  Synthetic Polynucleotide
taatacgactcactataggggtttaagaagagacgtcatgagaggtccaaaacagaggagattggacatgtcatgacgtaacctggcggcagcgcaaaagatg

SEQ ID NO: 34039 - DNA, 103 bp, Artificial Sequence
  Synthetic Polynucleotide
taatacgactcactatagggagttgctggaaacgcggccacgtcgccaataacagaggagaattggcatggtggccgcgaacctggcggcagcgcaaaagatg

SEQ ID NO: 34040 - DNA, 103 bp, Artificial Sequence
  Synthetic Polynucleotide
taatacgactcactatagggagggtattgtaaaactagattgtcaacccaaacagaggagatgggttatgaatctagttaacctggcggcagcgcaaaagatg

SEQ ID NO: 34041 - DNA, 103 bp, Artificial Sequence
  Synthetic Polynucleotide
taatacgactcactatagggcttcggcggggggtgaaataaccagcccgcaacagaggagagcgggcatgttatttcacaacctggcggcagcgcaaaagatg

SEQ ID NO: 34042 - DNA, 103 bp, Artificial Sequence
  Synthetic Polynucleotide
taatacgactcactatagggtaggttcttgaggccttgttctggtgagagaacagaggagactctcaatggaacaaggcaacctggcggcagcgcaaaagatg

SEQ ID NO: 34043 - DNA, 103 bp, Artificial Sequence
  Synthetic Polynucleotide
taatacgactcactatagggttttccgagcattaaaaggcgtctcacattaacagaggagaaatgtgatgcgccttttaaacctggcggcagcgcaaaagatg

SEQ ID NO: 34044 - DNA, 103 bp, Artificial Sequence
  Synthetic Polynucleotide
taatacgactcactatagggctccgcagacaacttgatgaacttctccacaacagaggagagtggagatgttcatcaagaacctggcggcagcgcaaaagatg

SEQ ID NO: 34045 - DNA, 103 bp, Artificial Sequence
  Synthetic Polynucleotide
taatacgactcactatagggtcgctcatcatgtaactttgtccaacacataacagaggagaatgtgtatgacaaagttaaacctggcggcagcgcaaaagatg

SEQ ID NO: 34046 - DNA, 103 bp, Artificial Sequence
  Synthetic Polynucleotide
taatacgactcactatagggcatgataaatagttgcgtctatgctcgtggaacagaggagaccacgaatgtagacgcaaaacctggcggcagcgcaaaagatg

SEQ ID NO: 34047 - DNA, 103 bp, Artificial Sequence
  Synthetic Polynucleotide
taatacgactcactatagggatcaattcgattcacattcccggttaacagaacagaggagactgttaatggggaatgtgaacctggcggcagcgcaaaagatg

SEQ ID NO: 34048 - DNA, 103 bp, Artificial Sequence
  Synthetic Polynucleotide
taatacgactcactatagggccgggcagaagtgcacgcaacatcacctcaaacagaggagatgaggtatggttgcgtgcaacctggcggcagcgcaaaagatg

SEQ ID NO: 34049 - DNA, 103 bp, Artificial Sequence
  Synthetic Polynucleotide
taatacgactcactataggggacccgaggcctcgtctcactagtaaaggcaacagaggagagcctttatgagtgagacgaacctggcggcagcgcaaaagatg

SEQ ID NO: 34050 - DNA, 103 bp, Artificial Sequence
  Synthetic Polynucleotide
taatacgactcactatagggctatgggtacgatcatcgcgttaaattggtaacagaggagaaccaatatgacgcgatgaaacctggcggcagcgcaaaagatg

SEQ ID NO: 34051 - DNA, 103 bp, Artificial Sequence
  Synthetic Polynucleotide
taatacgactcactatagggtaggagtgccttgtacctgaataccctcggaacagaggagaccgaggatgttcaggtacaacctggcggcagcgcaaaagatg

SEQ ID NO: 34052 - DNA, 103 bp, Artificial Sequence
  Synthetic Polynucleotide
taatacgactcactatagggccatgtgctttctagcacgacggtcccgtcaacagaggagagacgggatggtcgtgctaaacctggcggcagcgcaaaagatg

SEQ ID NO: 34053 - DNA, 103 bp, Artificial Sequence
  Synthetic Polynucleotide
taatacgactcactatagggtactgagttgcacctctagtttagttgtacaacagaggagagtacaaatgaactagaggaacctggcggcagcgcaaaagatg

SEQ ID NO: 34054 - DNA, 103 bp, Artificial Sequence
  Synthetic Polynucleotide
taatacgactcactatagggcgcgcgctgagacagtaaggaccaccgagcaacagaggagagctcggatgtccttactgaacctggcggcagcgcaaaagatg

SEQ ID NO: 34055 - DNA, 103 bp, Artificial Sequence
  Synthetic Polynucleotide
taatacgactcactatagggttagtggaccggttacaatagttcacgttgaacagaggagacaacgtatgctattgtaaaacctggcggcagcgcaaaagatg

SEQ ID NO: 34056 - DNA, 103 bp, Artificial Sequence
  Synthetic Polynucleotide
taatacgactcactatagggactcctgcgtgtacgcttaggttctttcgaaacagaggagatcgaaaatgcctaagcgtaacctggcggcagcgcaaaagatg

SEQ ID NO: 34057 - DNA, 103 bp, Artificial Sequence
  Synthetic Polynucleotide
taatacgactcactatagggtccataggtgattaggcgaatggcaaggtgaacagaggagacaccttatgattcgcctaaacctggcggcagcgcaaaagatg

SEQ ID NO: 34058 - DNA, 103 bp, Artificial Sequence
  Synthetic Polynucleotide
taatacgactcactatagggtactaaccgatgacgtgtggtggtcctgccaacagaggagaggcaggatgaccacacgtaacctggcggcagcgcaaaagatg

SEQ ID NO: 34059 - DNA, 103 bp, Artificial Sequence
  Synthetic Polynucleotide
taatacgactcactatagggaatcagtattccaaagctgatagttgatttaacagaggagaaaatcaatgatcagctttaacctggcggcagcgcaaaagatg

SEQ ID NO: 34060 - DNA, 103 bp, Artificial Sequence
  Synthetic Polynucleotide
taatacgactcactataggggtaagctatgataacggcacgttagggatcaacagaggagagatcccatgcgtgccgttaacctggcggcagcgcaaaagatg

SEQ ID NO: 34061 - DNA, 103 bp, Artificial Sequence
  Synthetic Polynucleotide
taatacgactcactatagggtcgtcagtaaccctgcttttcctacgtgcaaacagaggagatgcacgatggaaaagcagaacctggcggcagcgcaaaagatg

SEQ ID NO: 34062 - DNA, 103 bp, Artificial Sequence
  Synthetic Polynucleotide
taatacgactcactatagggcctttacatagtactcaaggaggcttacgtaacagaggagaacgtaaatgtccttgagtaacctggcggcagcgcaaaagatg

SEQ ID NO: 34063 - DNA, 103 bp, Artificial Sequence
  Synthetic Polynucleotide
taatacgactcactatagggtaagttggagattgagagctcttaactgagaacagaggagactcagtatggagctctcaaacctggcggcagcgcaaaagatg

SEQ ID NO: 34064 - DNA, 103 bp, Artificial Sequence
  Synthetic Polynucleotide
taatacgactcactatagggagctagcggtatcagtgtggcgtgcttctgaacagaggagacagaagatggccacactgaacctggcggcagcgcaaaagatg

SEQ ID NO: 34065 - DNA, 103 bp, Artificial Sequence
  Synthetic Polynucleotide
taatacgactcactatagggtccccagaaccgatttggtagtgtgattctaacagaggagaagaatcatgctaccaaataacctggcggcagcgcaaaagatg

SEQ ID NO: 34066 - DNA, 103 bp, Artificial Sequence
  Synthetic Polynucleotide
taatacgactcactatagggatcaggtcaggccgaacttagaagaggacgaacagaggagacgtcctatgctaagttcgaacctggcggcagcgcaaaagatg

SEQ ID NO: 34067 - DNA, 103 bp, Artificial Sequence
  Synthetic Polynucleotide
taatacgactcactatagggggtacaagggcattcgcggctacttgtgataacagaggagaatcacaatgagccgcgaaaacctggcggcagcgcaaaagatg

SEQ ID NO: 34068 - DNA, 103 bp, Artificial Sequence
  Synthetic Polynucleotide
taatacgactcactatagggggccggctttcggagaagggctataaggccaacagaggagaggccttatggcccttctcaacctggcggcagcgcaaaagatg

SEQ ID NO: 34069 - DNA, 103 bp, Artificial Sequence
  Synthetic Polynucleotide
taatacgactcactatagggcgttaggactcacgtgatgacgtcgaagaaaacagaggagattcttcatggtcatcacgaacctggcggcagcgcaaaagatg

SEQ ID NO: 34070 - DNA, 103 bp, Artificial Sequence
  Synthetic Polynucleotide
taatacgactcactatagggaagcgcatgtaagctacaacacggttgtggaacagaggagaccacaaatgtgttgtagcaacctggcggcagcgcaaaagatg

SEQ ID NO: 34071 - DNA, 103 bp, Artificial Sequence
  Synthetic Polynucleotide
taatacgactcactataggggcgaccaacacgagtggcaaattactctaaaacagaggagattagagatgtttgccactaacctggcggcagcgcaaaagatg

SEQ ID NO: 34072 - DNA, 103 bp, Artificial Sequence
  Synthetic Polynucleotide
taatacgactcactatagggcagtcgacacgaagtctccctcgataaaaaaacagaggagatttttaatgagggagactaacctggcggcagcgcaaaagatg

SEQ ID NO: 34073 - DNA, 103 bp, Artificial Sequence
  Synthetic Polynucleotide
taatacgactcactatagggtgaggaggcgaacacattacggccggggataacagaggagaatccccatgcgtaatgtgaacctggcggcagcgcaaaagatg

SEQ ID NO: 34074 - DNA, 103 bp, Artificial Sequence
  Synthetic Polynucleotide
taatacgactcactatagggatccgctattagtttggcaccagcggagaaaacagaggagattctccatgggtgccaaaaacctggcggcagcgcaaaagatg

SEQ ID NO: 34075 - DNA, 103 bp, Artificial Sequence
  Synthetic Polynucleotide
taatacgactcactatagggctacgttgctcagaataagtcattcctcccaacagaggagagggaggatggacttattcaacctggcggcagcgcaaaagatg

SEQ ID NO: 34076 - DNA, 103 bp, Artificial Sequence
  Synthetic Polynucleotide
taatacgactcactataggggcatattcacgacccagccggccctaccgtaacagaggagaacggtaatgccggctgggaacctggcggcagcgcaaaagatg

SEQ ID NO: 34077 - DNA, 103 bp, Artificial Sequence
  Synthetic Polynucleotide
taatacgactcactataggggactatcccataagcaccgcctccccccggaacagaggagaccggggatgggcggtgctaacctggcggcagcgcaaaagatg

SEQ ID NO: 34078 - DNA, 103 bp, Artificial Sequence
  Synthetic Polynucleotide
taatacgactcactataggggtggaagaggtggaacgcccgccgcagagaaacagaggagatctctgatgcgggcgttcaacctggcggcagcgcaaaagatg

SEQ ID NO: 34079 - DNA, 103 bp, Artificial Sequence
  Synthetic Polynucleotide
taatacgactcactatagggtttgggacatacgttgagctgtataatttcaacagaggagagaaattatgcagctcaacaacctggcggcagcgcaaaagatg

SEQ ID NO: 34080 - DNA, 103 bp, Artificial Sequence
  Synthetic Polynucleotide
taatacgactcactataggggtatataagcttggatacttatgtagcagtaacagaggagaactgctatgtaagtatccaacctggcggcagcgcaaaagatg

SEQ ID NO: 34081 - DNA, 103 bp, Artificial Sequence
  Synthetic Polynucleotide
taatacgactcactataggggtgttttgcggcaatctagacagtcaggtgaacagaggagacacctgatggtctagattaacctggcggcagcgcaaaagatg

SEQ ID NO: 34082 - DNA, 103 bp, Artificial Sequence
  Synthetic Polynucleotide
taatacgactcactatagggctctttaccttcagtatttgtatttaagcaaacagaggagatgcttaatgacaaatactaacctggcggcagcgcaaaagatg

SEQ ID NO: 34083 - DNA, 103 bp, Artificial Sequence
  Synthetic Polynucleotide
taatacgactcactatagggaaacgtaggatacatgttcaaactggtccaaacagaggagatggaccatgttgaacatgaacctggcggcagcgcaaaagatg

SEQ ID NO: 34084 - DNA, 103 bp, Artificial Sequence
  Synthetic Polynucleotide
taatacgactcactataggggcttgtgacacaggctactggggggttccaaacagaggagatggaacatgccagtagccaacctggcggcagcgcaaaagatg

SEQ ID NO: 34085 - DNA, 103 bp, Artificial Sequence
  Synthetic Polynucleotide
taatacgactcactatagggtctgcatattgcaccctcggagcgagggtaaacagaggagataccctatgtccgagggtaacctggcggcagcgcaaaagatg

SEQ ID NO: 34086 - DNA, 103 bp, Artificial Sequence
  Synthetic Polynucleotide
taatacgactcactatagggaatgtttagattcagcgacgtatgactattaacagaggagaaatagtatgacgtcgctgaacctggcggcagcgcaaaagatg

SEQ ID NO: 34087 - DNA, 103 bp, Artificial Sequence
  Synthetic Polynucleotide
taatacgactcactatagggcggtcgaaggtctggcacgagggtttcactaacagaggagaagtgaaatgctcgtgccaaacctggcggcagcgcaaaagatg

SEQ ID NO: 34088 - DNA, 103 bp, Artificial Sequence
  Synthetic Polynucleotide
taatacgactcactataggggaaaacggtgatcgggaccacggcattccgaacagaggagacggaatatggtggtcccgaacctggcggcagcgcaaaagatg

SEQ ID NO: 34089 - DNA, 103 bp, Artificial Sequence
  Synthetic Polynucleotide
taatacgactcactatagggattgccttgtggccgggagctacgtatgccaacagaggagaggcataatgagctcccggaacctggcggcagcgcaaaagatg

SEQ ID NO: 34090 - DNA, 103 bp, Artificial Sequence
  Synthetic Polynucleotide
taatacgactcactatagggaaagcagagggattttgttgggagcggaccaacagaggagaggtccgatgccaacaaaaaacctggcggcagcgcaaaagatg

SEQ ID NO: 34091 - DNA, 103 bp, Artificial Sequence
  Synthetic Polynucleotide
taatacgactcactatagggaggtgtatgcgagtctcatccgagtcgccgaacagaggagacggcgaatgggatgagacaacctggcggcagcgcaaaagatg

SEQ ID NO: 34092 - DNA, 103 bp, Artificial Sequence
  Synthetic Polynucleotide
taatacgactcactatagggcttatttcttattaacagtggatcgtatgtaacagaggagaacatacatgccactgttaaacctggcggcagcgcaaaagatg

SEQ ID NO: 34093 - DNA, 103 bp, Artificial Sequence
  Synthetic Polynucleotide
taatacgactcactatagggcattgaaacacgtcgcatctcacgtccaccaacagaggagaggtggaatggagatgcgaaacctggcggcagcgcaaaagatg

SEQ ID NO: 34094 - DNA, 103 bp, Artificial Sequence
  Synthetic Polynucleotide
taatacgactcactatagggatgcatagtgggaccccaaacacatccggaaacagaggagatccggaatggtttggggtaacctggcggcagcgcaaaagatg

SEQ ID NO: 34095 - DNA, 103 bp, Artificial Sequence
  Synthetic Polynucleotide
taatacgactcactatagggtacgggtgaccactcggtgagtcgaggaaaaacagaggagatttcctatgctcaccgagaacctggcggcagcgcaaaagatg

SEQ ID NO: 34096 - DNA, 103 bp, Artificial Sequence
  Synthetic Polynucleotide
taatacgactcactatagggctgggtactgctacatatactcagttgaaaaacagaggagatttcaaatgagtatatgtaacctggcggcagcgcaaaagatg

SEQ ID NO: 34097 - DNA, 103 bp, Artificial Sequence
  Synthetic Polynucleotide
taatacgactcactataggggcgtgcgcggcctttttgtaaaattttattaacagaggagaaataaaatgttacaaaaaaacctggcggcagcgcaaaagatg

SEQ ID NO: 34098 - DNA, 103 bp, Artificial Sequence
  Synthetic Polynucleotide
taatacgactcactataggggtgcccgtcccagccaagccaccaattattaacagaggagaaataatatgtggcttggcaacctggcggcagcgcaaaagatg

SEQ ID NO: 34099 - DNA, 103 bp, Artificial Sequence
  Synthetic Polynucleotide
taatacgactcactatagggttgctcctagggcactccgtcacatggggaaacagaggagatccccaatggacggagtgaacctggcggcagcgcaaaagatg

SEQ ID NO: 34100 - DNA, 103 bp, Artificial Sequence
  Synthetic Polynucleotide
taatacgactcactatagggcttttactgggtggttatagattcgggtctaacagaggagaagacccatgtctataaccaacctggcggcagcgcaaaagatg

SEQ ID NO: 34101 - DNA, 103 bp, Artificial Sequence
  Synthetic Polynucleotide
taatacgactcactatagggtgtctggagggttcgtagcttaggatgcagaacagaggagactgcatatgaagctacgaaacctggcggcagcgcaaaagatg

SEQ ID NO: 34102 - DNA, 103 bp, Artificial Sequence
  Synthetic Polynucleotide
taatacgactcactatagggcgtgcaacgtctaactcccattgcgggagcaacagaggagagctcccatgatgggagttaacctggcggcagcgcaaaagatg

SEQ ID NO: 34103 - DNA, 103 bp, Artificial Sequence
  Synthetic Polynucleotide
taatacgactcactatagggcttcaatccaggcttgtgactctcgctttaaacagaggagataaagcatgagtcacaagaacctggcggcagcgcaaaagatg

SEQ ID NO: 34104 - DNA, 103 bp, Artificial Sequence
  Synthetic Polynucleotide
taatacgactcactatagggaaaggctacaactcgtcggcaacccgtgataacagaggagaatcacgatgtgccgacgaaacctggcggcagcgcaaaagatg

SEQ ID NO: 34105 - DNA, 103 bp, Artificial Sequence
  Synthetic Polynucleotide
taatacgactcactatagggaccagtctaacttcgtcctcagcttcccacaacagaggagagtgggaatgtgaggacgaaacctggcggcagcgcaaaagatg

SEQ ID NO: 34106 - DNA, 103 bp, Artificial Sequence
  Synthetic Polynucleotide
taatacgactcactatagggcggtggccactcttgcactagatactcactaacagaggagaagtgagatgctagtgcaaaacctggcggcagcgcaaaagatg

SEQ ID NO: 34107 - DNA, 103 bp, Artificial Sequence
  Synthetic Polynucleotide
taatacgactcactatagggataggctcaactagcgcctaagatgtgatcaacagaggagagatcacatgttaggcgctaacctggcggcagcgcaaaagatg

SEQ ID NO: 34108 - DNA, 103 bp, Artificial Sequence
  Synthetic Polynucleotide
taatacgactcactatagggcctatgaggaggtcgcagacagagggaggtaacagaggagaacctccatgtgtctgcgaaacctggcggcagcgcaaaagatg

SEQ ID NO: 34109 - DNA, 103 bp, Artificial Sequence
  Synthetic Polynucleotide
taatacgactcactatagggtccactctgactgcgcatgccatatctagcaacagaggagagctagaatgggcatgcgcaacctggcggcagcgcaaaagatg

SEQ ID NO: 34110 - DNA, 103 bp, Artificial Sequence
  Synthetic Polynucleotide
taatacgactcactatagggctggctgtcagattttcaaccgatatatccaacagaggagaggatatatgggttgaaaaaacctggcggcagcgcaaaagatg

SEQ ID NO: 34111 - DNA, 103 bp, Artificial Sequence
  Synthetic Polynucleotide
taatacgactcactatagggatcgtcattgggtgtagtttctcggagaaaaacagaggagatttctcatggaaactacaaacctggcggcagcgcaaaagatg

SEQ ID NO: 34112 - DNA, 103 bp, Artificial Sequence
  Synthetic Polynucleotide
taatacgactcactataggggtcagttccggtaatgaactcggggactggaacagaggagaccagtcatggagttcattaacctggcggcagcgcaaaagatg

SEQ ID NO: 34113 - DNA, 103 bp, Artificial Sequence
  Synthetic Polynucleotide
taatacgactcactatagggatccaggcctgatttgtcagtgttggtgccaacagaggagaggcaccatgactgacaaaaacctggcggcagcgcaaaagatg

SEQ ID NO: 34114 - DNA, 103 bp, Artificial Sequence
  Synthetic Polynucleotide
taatacgactcactatagggcaggtgcaatcccgctccgcttttgtatgcaacagaggagagcatacatgagcggagcgaacctggcggcagcgcaaaagatg

SEQ ID NO: 34115 - DNA, 103 bp, Artificial Sequence
  Synthetic Polynucleotide
taatacgactcactatagggatctggctccccccgatcctgggctaacgcaacagaggagagcgttaatgcaggatcggaacctggcggcagcgcaaaagatg

SEQ ID NO: 34116 - DNA, 103 bp, Artificial Sequence
  Synthetic Polynucleotide
taatacgactcactatagggtcctcaacaatatacattcggcgacgatccaacagaggagaggatcgatgccgaatgtaaacctggcggcagcgcaaaagatg

SEQ ID NO: 34117 - DNA, 103 bp, Artificial Sequence
  Synthetic Polynucleotide
taatacgactcactatagggcttactctgacgaagtcccttcatctacgaaacagaggagatcgtagatgaagggacttaacctggcggcagcgcaaaagatg

SEQ ID NO: 34118 - DNA, 103 bp, Artificial Sequence
  Synthetic Polynucleotide
taatacgactcactatagggcacatatagcggcccatacgtttatctaggaacagaggagacctagaatgacgtatgggaacctggcggcagcgcaaaagatg

SEQ ID NO: 34119 - DNA, 103 bp, Artificial Sequence
  Synthetic Polynucleotide
taatacgactcactatagggagagacgggtttagccgacgtggtgctttaaacagaggagataaagcatgacgtcggctaacctggcggcagcgcaaaagatg

SEQ ID NO: 34120 - DNA, 103 bp, Artificial Sequence
  Synthetic Polynucleotide
taatacgactcactatagggatcaggtcctagttcatatacttctccccaaacagaggagatggggaatggtatatgaaaacctggcggcagcgcaaaagatg

SEQ ID NO: 34121 - DNA, 103 bp, Artificial Sequence
  Synthetic Polynucleotide
taatacgactcactatagggacgtggtgcaaagtaaaaatgaaaggcaggaacagaggagacctgccatgcatttttacaacctggcggcagcgcaaaagatg

SEQ ID NO: 34122 - DNA, 103 bp, Artificial Sequence
  Synthetic Polynucleotide
taatacgactcactatagggcgtcgacccatcagtccgatagattaacccaacagaggagagggttaatgtatcggactaacctggcggcagcgcaaaagatg

SEQ ID NO: 34123 - DNA, 103 bp, Artificial Sequence
  Synthetic Polynucleotide
taatacgactcactatagggacttccactatcgcagtggggtcgtttaagaacagaggagacttaaaatgccccactgcaacctggcggcagcgcaaaagatg

SEQ ID NO: 34124 - DNA, 103 bp, Artificial Sequence
  Synthetic Polynucleotide
taatacgactcactatagggctccgttgcaacattagagttcagctatgaaacagaggagatcatagatgaactctaataacctggcggcagcgcaaaagatg

SEQ ID NO: 34125 - DNA, 103 bp, Artificial Sequence
  Synthetic Polynucleotide
taatacgactcactataggggctcatccggttaacgacctgggagttgtgaacagaggagacacaacatgcaggtcgttaacctggcggcagcgcaaaagatg

SEQ ID NO: 34126 - DNA, 103 bp, Artificial Sequence
  Synthetic Polynucleotide
taatacgactcactatagggggttgtttgtgcccgggcccatggcaaattaacagaggagaaatttgatgtgggcccggaacctggcggcagcgcaaaagatg

SEQ ID NO: 34127 - DNA, 103 bp, Artificial Sequence
  Synthetic Polynucleotide
taatacgactcactatagggactgctaagccgcatcttctagacatcaccaacagaggagaggtgatatgtagaagatgaacctggcggcagcgcaaaagatg

SEQ ID NO: 34128 - DNA, 103 bp, Artificial Sequence
  Synthetic Polynucleotide
taatacgactcactatagggtcttactcctcacttcgctgagttccaagtaacagaggagaacttggatgtcagcgaagaacctggcggcagcgcaaaagatg

SEQ ID NO: 34129 - DNA, 103 bp, Artificial Sequence
  Synthetic Polynucleotide
taatacgactcactatagggcctgattagattattccgtaggacaactagaacagaggagactagttatgctacggaataacctggcggcagcgcaaaagatg

SEQ ID NO: 34130 - DNA, 103 bp, Artificial Sequence
  Synthetic Polynucleotide
taatacgactcactatagggatattgattttctatgtacaccatgcaccaaacagaggagatggtgcatggtgtacataaacctggcggcagcgcaaaagatg

SEQ ID NO: 34131 - DNA, 103 bp, Artificial Sequence
  Synthetic Polynucleotide
taatacgactcactatagggcctatagggtccagccattagtacgaatcaaacagaggagatgattcatgctaatggctaacctggcggcagcgcaaaagatg

SEQ ID NO: 34132 - DNA, 103 bp, Artificial Sequence
  Synthetic Polynucleotide
taatacgactcactataggggatttcttcaggagaattcttatccacgagaacagaggagactcgtgatgaagaattctaacctggcggcagcgcaaaagatg

SEQ ID NO: 34133 - DNA, 103 bp, Artificial Sequence
  Synthetic Polynucleotide
taatacgactcactataggggattcgatgcaccgaactctctgaggtggaaacagaggagatccaccatggagagttcgaacctggcggcagcgcaaaagatg

SEQ ID NO: 34134 - DNA, 103 bp, Artificial Sequence
  Synthetic Polynucleotide
taatacgactcactatagggctaaaatatcgtaaacgagcaaccgagcataacagaggagaatgctcatgtgctcgtttaacctggcggcagcgcaaaagatg

SEQ ID NO: 34135 - DNA, 103 bp, Artificial Sequence
  Synthetic Polynucleotide
taatacgactcactatagggcttccacctatttagattcgattagcgcaaaacagaggagattgcgcatgtcgaatctaaacctggcggcagcgcaaaagatg

SEQ ID NO: 34136 - DNA, 103 bp, Artificial Sequence
  Synthetic Polynucleotide
taatacgactcactataggggtcaccgtggtcaaaattcgctccgcgcaaaacagaggagattgcgcatggcgaattttaacctggcggcagcgcaaaagatg

SEQ ID NO: 34137 - DNA, 103 bp, Artificial Sequence
  Synthetic Polynucleotide
taatacgactcactatagggaaagtggccagggtacgtgatttactatgaaacagaggagatcatagatgatcacgtacaacctggcggcagcgcaaaagatg

SEQ ID NO: 34138 - DNA, 103 bp, Artificial Sequence
  Synthetic Polynucleotide
taatacgactcactataggggtatacacctcttatttatgtttagcagcaaacagaggagatgctgcatgacataaataaacctggcggcagcgcaaaagatg

SEQ ID NO: 34139 - DNA, 103 bp, Artificial Sequence
  Synthetic Polynucleotide
taatacgactcactatagggagccgggtcgcccatacacaggttcttagtaacagaggagaactaagatgctgtgtatgaacctggcggcagcgcaaaagatg

SEQ ID NO: 34140 - DNA, 103 bp, Artificial Sequence
  Synthetic Polynucleotide
taatacgactcactatagggaatcaagccagattcgagactgtttatgaaaacagaggagattcataatgagtctcgaaaacctggcggcagcgcaaaagatg

SEQ ID NO: 34141 - DNA, 103 bp, Artificial Sequence
  Synthetic Polynucleotide
taatacgactcactataggggttatgtcgcccgggatgtattcatccgttaacagaggagaaacggaatgatacatcccaacctggcggcagcgcaaaagatg

SEQ ID NO: 34142 - DNA, 103 bp, Artificial Sequence
  Synthetic Polynucleotide
taatacgactcactatagggagctaatgccccttcgccatgtcgtggtccaacagaggagaggaccaatgcatggcgaaaacctggcggcagcgcaaaagatg

SEQ ID NO: 34143 - DNA, 103 bp, Artificial Sequence
  Synthetic Polynucleotide
taatacgactcactatagggccaggccagcggcaaactttcgccaatcataacagaggagaatgattatggaaagtttgaacctggcggcagcgcaaaagatg

SEQ ID NO: 34144 - DNA, 103 bp, Artificial Sequence
  Synthetic Polynucleotide
taatacgactcactatagggtaatacacacggtagaacacaacccagcccaacagaggagagggctgatgtgtgttctaaacctggcggcagcgcaaaagatg

SEQ ID NO: 34145 - DNA, 103 bp, Artificial Sequence
  Synthetic Polynucleotide
taatacgactcactatagggcgaaaaagccccgtcccttaattttaaatcaacagaggagagatttaatgttaagggacaacctggcggcagcgcaaaagatg

SEQ ID NO: 34146 - DNA, 103 bp, Artificial Sequence
  Synthetic Polynucleotide
taatacgactcactatagggaggcggtgccgtgttaaaattgctatgcaaaacagaggagattgcatatgaattttaacaacctggcggcagcgcaaaagatg

SEQ ID NO: 34147 - DNA, 103 bp, Artificial Sequence
  Synthetic Polynucleotide
taatacgactcactatagggtttccagtgcgctgctgaaccgccgggcaaaacagaggagattgcccatgggttcagcaaacctggcggcagcgcaaaagatg

SEQ ID NO: 34148 - DNA, 103 bp, Artificial Sequence
  Synthetic Polynucleotide
taatacgactcactatagggactggcacctttaggatgatacatggtagtaacagaggagaactaccatgtatcatcctaacctggcggcagcgcaaaagatg

SEQ ID NO: 34149 - DNA, 103 bp, Artificial Sequence
  Synthetic Polynucleotide
taatacgactcactatagggcggcttagaagtatgcgtagtcgaggcgtaaacagaggagatacgccatgactacgcataacctggcggcagcgcaaaagatg

SEQ ID NO: 34150 - DNA, 103 bp, Artificial Sequence
  Synthetic Polynucleotide
taatacgactcactatagggtccttatttgaggactacgactcatacggaaacagaggagatccgtaatggtcgtagtcaacctggcggcagcgcaaaagatg

SEQ ID NO: 34151 - DNA, 103 bp, Artificial Sequence
  Synthetic Polynucleotide
taatacgactcactatagggagagcttttccaaccgcatccatctgggtgaacagaggagacacccaatgggatgcggtaacctggcggcagcgcaaaagatg

SEQ ID NO: 34152 - DNA, 103 bp, Artificial Sequence
  Synthetic Polynucleotide
taatacgactcactatagggccttcgacggaattgggaaaactgcagaagaacagaggagacttctgatgttttcccaaaacctggcggcagcgcaaaagatg

SEQ ID NO: 34153 - DNA, 103 bp, Artificial Sequence
  Synthetic Polynucleotide
taatacgactcactataggggattctcggtgtgttcttcgagaacttcataacagaggagaatgaagatgtcgaagaacaacctggcggcagcgcaaaagatg

SEQ ID NO: 34154 - DNA, 103 bp, Artificial Sequence
  Synthetic Polynucleotide
taatacgactcactatagggtattcattgtcgtggctagaaaagtttcccaacagaggagagggaaaatgttctagccaaacctggcggcagcgcaaaagatg

SEQ ID NO: 34155 - DNA, 103 bp, Artificial Sequence
  Synthetic Polynucleotide
taatacgactcactatagggcgaaacagggagccgtaatgctggcttcccaacagaggagagggaagatggcattacggaacctggcggcagcgcaaaagatg

SEQ ID NO: 34156 - DNA, 103 bp, Artificial Sequence
  Synthetic Polynucleotide
taatacgactcactatagggaggcgcgacgctgttgacgtcgttgtccataacagaggagaatggacatggacgtcaacaacctggcggcagcgcaaaagatg

SEQ ID NO: 34157 - DNA, 103 bp, Artificial Sequence
  Synthetic Polynucleotide
taatacgactcactatagggacggaaatgaaatggtgatccaaattgcataacagaggagaatgcaaatgggatcaccaaacctggcggcagcgcaaaagatg

SEQ ID NO: 34158 - DNA, 103 bp, Artificial Sequence
  Synthetic Polynucleotide
taatacgactcactatagggtagaatagcgacggctaaaagtgatcacagaacagaggagactgtgaatgcttttagccaacctggcggcagcgcaaaagatg

SEQ ID NO: 34159 - DNA, 103 bp, Artificial Sequence
  Synthetic Polynucleotide
taatacgactcactatagggttaaacatgctgtgtctattgcgcgttgttaacagaggagaaacaacatgcaatagacaaacctggcggcagcgcaaaagatg

SEQ ID NO: 34160 - DNA, 103 bp, Artificial Sequence
  Synthetic Polynucleotide
taatacgactcactataggggagaaggcataacttactatcggcctttataacagaggagaataaagatggatagtaagaacctggcggcagcgcaaaagatg

SEQ ID NO: 34161 - DNA, 103 bp, Artificial Sequence
  Synthetic Polynucleotide
taatacgactcactatagggttaggtgaagctacgctaggttttgttgacaacagaggagagtcaacatgacctagcgtaacctggcggcagcgcaaaagatg

SEQ ID NO: 34162 - DNA, 103 bp, Artificial Sequence
  Synthetic Polynucleotide
taatacgactcactatagggatcgtacggatggcagaaaagcgagccataaacagaggagatatggcatgcttttctgcaacctggcggcagcgcaaaagatg

SEQ ID NO: 34163 - DNA, 103 bp, Artificial Sequence
  Synthetic Polynucleotide
taatacgactcactatagggcaagttagaccggccatcgcacacgcttgtaacagaggagaacaagcatgtgcgatggcaacctggcggcagcgcaaaagatg

SEQ ID NO: 34164 - DNA, 103 bp, Artificial Sequence
  Synthetic Polynucleotide
taatacgactcactatagggatggtgcgcgtactcgtttacgaactcgtcaacagaggagagacgagatggtaaacgagaacctggcggcagcgcaaaagatg

SEQ ID NO: 34165 - DNA, 103 bp, Artificial Sequence
  Synthetic Polynucleotide
taatacgactcactatagggatccttgtactgtcacacgaaatacggtgtaacagaggagaacaccgatgttcgtgtgaaacctggcggcagcgcaaaagatg

SEQ ID NO: 34166 - DNA, 103 bp, Artificial Sequence
  Synthetic Polynucleotide
taatacgactcactataggggagaggctgagggtttcggctctttttgctaacagaggagaagcaaaatgagccgaaacaacctggcggcagcgcaaaagatg

SEQ ID NO: 34167 - DNA, 103 bp, Artificial Sequence
  Synthetic Polynucleotide
taatacgactcactataggggtctgccccataaccatgattagagtgtataacagaggagaatacacatgaatcatggtaacctggcggcagcgcaaaagatg

SEQ ID NO: 34168 - DNA, 103 bp, Artificial Sequence
  Synthetic Polynucleotide
taatacgactcactatagggggagtagcgccgtaactagattattttcagaacagaggagactgaaaatgatctagttaaacctggcggcagcgcaaaagatg

SEQ ID NO: 34169 - DNA, 103 bp, Artificial Sequence
  Synthetic Polynucleotide
taatacgactcactatagggcaaatagaaggcacgtgagttaaaataataaacagaggagatattatatgaactcacgtaacctggcggcagcgcaaaagatg

SEQ ID NO: 34170 - DNA, 103 bp, Artificial Sequence
  Synthetic Polynucleotide
taatacgactcactatagggatggcaatctggtgatccggatcacataataacagaggagaattatgatgtccggatcaaacctggcggcagcgcaaaagatg

SEQ ID NO: 34171 - DNA, 103 bp, Artificial Sequence
  Synthetic Polynucleotide
taatacgactcactatagggcgacgcaaaaagtgcggtctgcctataactaacagaggagaagttatatgcagaccgcaaacctggcggcagcgcaaaagatg

SEQ ID NO: 34172 - DNA, 103 bp, Artificial Sequence
  Synthetic Polynucleotide
taatacgactcactatagggggcgttaattacgctgcgtgaagtcgttctaacagaggagaagaacgatgtcacgcagcaacctggcggcagcgcaaaagatg

SEQ ID NO: 34173 - DNA, 103 bp, Artificial Sequence
  Synthetic Polynucleotide
taatacgactcactatagggtgatgttgggtaggaatgacacgcacgccgaacagaggagacggcgtatgtgtcattccaacctggcggcagcgcaaaagatg

SEQ ID NO: 34174 - DNA, 103 bp, Artificial Sequence
  Synthetic Polynucleotide
taatacgactcactatagggaattctgtctattactttctccccggtttcaacagaggagagaaaccatggagaaagtaaacctggcggcagcgcaaaagatg

SEQ ID NO: 34175 - DNA, 103 bp, Artificial Sequence
  Synthetic Polynucleotide
taatacgactcactatagggtggctagcttaaagccgtctggcggcaaagaacagaggagactttgcatgcagacggctaacctggcggcagcgcaaaagatg

SEQ ID NO: 34176 - DNA, 103 bp, Artificial Sequence
  Synthetic Polynucleotide
taatacgactcactataggggtgcccgtatcttttccggttgacttcgggaacagaggagacccgaaatgaaccggaaaaacctggcggcagcgcaaaagatg

SEQ ID NO: 34177 - DNA, 103 bp, Artificial Sequence
  Synthetic Polynucleotide
taatacgactcactatagggaactggctcttgtgtatctgttgcctgtgcaacagaggagagcacagatgacagatacaaacctggcggcagcgcaaaagatg

SEQ ID NO: 34178 - DNA, 103 bp, Artificial Sequence
  Synthetic Polynucleotide
taatacgactcactatagggccagcgtaatggaggcccgggcgtctaccgaacagaggagacggtagatgcccgggcctaacctggcggcagcgcaaaagatg

SEQ ID NO: 34179 - DNA, 103 bp, Artificial Sequence
  Synthetic Polynucleotide
taatacgactcactatagggtgctcagagatagacttggctatctttagcaacagaggagagctaaaatgagccaagtcaacctggcggcagcgcaaaagatg

SEQ ID NO: 34180 - DNA, 103 bp, Artificial Sequence
  Synthetic Polynucleotide
taatacgactcactatagggtagctaatactatccggtttcggggcgataaacagaggagatatcgcatggaaaccggaaacctggcggcagcgcaaaagatg

SEQ ID NO: 34181 - DNA, 103 bp, Artificial Sequence
  Synthetic Polynucleotide
taatacgactcactatagggaagccgaggcatctcagataataacaatagaacagaggagactattgatgttatctgagaacctggcggcagcgcaaaagatg

SEQ ID NO: 34182 - DNA, 103 bp, Artificial Sequence
  Synthetic Polynucleotide
taatacgactcactataggggtgccaatcgcttgggctgtagttccgcttaacagaggagaaagcggatgtacagcccaaacctggcggcagcgcaaaagatg

SEQ ID NO: 34183 - DNA, 103 bp, Artificial Sequence
  Synthetic Polynucleotide
taatacgactcactatagggattttccggcttgatgctttccacactagcaacagaggagagctagtatggaaagcatcaacctggcggcagcgcaaaagatg

SEQ ID NO: 34184 - DNA, 103 bp, Artificial Sequence
  Synthetic Polynucleotide
taatacgactcactatagggcccacgacttgtgaaacttaccaactaaataacagaggagaatttagatggtaagtttcaacctggcggcagcgcaaaagatg

SEQ ID NO: 34185 - DNA, 103 bp, Artificial Sequence
  Synthetic Polynucleotide
taatacgactcactatagggcaatctcacgatgttccacgttaatcaaataacagaggagaatttgaatgacgtggaacaacctggcggcagcgcaaaagatg

SEQ ID NO: 34186 - DNA, 103 bp, Artificial Sequence
  Synthetic Polynucleotide
taatacgactcactatagggttgcgtggactgtgtgtgtcgatgtaatccaacagaggagaggattaatgcgacacacaaacctggcggcagcgcaaaagatg

SEQ ID NO: 34187 - DNA, 103 bp, Artificial Sequence
  Synthetic Polynucleotide
taatacgactcactatagggataatacgctggcaagggacaaccggccctaacagaggagaagggccatgtgtcccttgaacctggcggcagcgcaaaagatg

SEQ ID NO: 34188 - DNA, 103 bp, Artificial Sequence
  Synthetic Polynucleotide
taatacgactcactatagggatcccgcaggttcccacaaatgagcctgcaaacagaggagatgcaggatgatttgtgggaacctggcggcagcgcaaaagatg

SEQ ID NO: 34189 - DNA, 103 bp, Artificial Sequence
  Synthetic Polynucleotide
taatacgactcactatagggaaaaactgcccttacaatggaccgtattggaacagaggagaccaataatgtccattgtaaacctggcggcagcgcaaaagatg

SEQ ID NO: 34190 - DNA, 103 bp, Artificial Sequence
  Synthetic Polynucleotide
taatacgactcactataggggtggtttacgccgcgcttcaaggtttcagaaacagaggagatctgaaatgttgaagcgcaacctggcggcagcgcaaaagatg

SEQ ID NO: 34191 - DNA, 103 bp, Artificial Sequence
  Synthetic Polynucleotide
taatacgactcactatagggacgaatcatatcggatggtcgtctatcaaaaacagaggagatttgatatgcgaccatccaacctggcggcagcgcaaaagatg

SEQ ID NO: 34192 - DNA, 103 bp, Artificial Sequence
  Synthetic Polynucleotide
taatacgactcactatagggcaagactcttgaaatatcgacaccaacgagaacagaggagactcgttatggtcgatattaacctggcggcagcgcaaaagatg

SEQ ID NO: 34193 - DNA, 103 bp, Artificial Sequence
  Synthetic Polynucleotide
taatacgactcactatagggtctggccccgatggcgctgcaagtcggcctaacagaggagaaggccgatgtgcagcgccaacctggcggcagcgcaaaagatg

SEQ ID NO: 34194 - DNA, 103 bp, Artificial Sequence
  Synthetic Polynucleotide
taatacgactcactatagggcaagaaggcgaagtatgacttagggatcggaacagaggagaccgatcatgaagtcatacaacctggcggcagcgcaaaagatg

SEQ ID NO: 34195 - DNA, 103 bp, Artificial Sequence
  Synthetic Polynucleotide
taatacgactcactatagggacgctttaccccagaattgatatctgataaaacagaggagattatcaatgatcaattctaacctggcggcagcgcaaaagatg

SEQ ID NO: 34196 - DNA, 103 bp, Artificial Sequence
  Synthetic Polynucleotide
taatacgactcactatagggtcagtagatatcaggaataaatagccaattaacagaggagaaattggatgtttattcctaacctggcggcagcgcaaaagatg

SEQ ID NO: 34197 - DNA, 103 bp, Artificial Sequence
  Synthetic Polynucleotide
taatacgactcactataggggcatttggaaggcgaaagggcgtactaataaacagaggagatattagatggccctttcgaacctggcggcagcgcaaaagatg

SEQ ID NO: 34198 - DNA, 103 bp, Artificial Sequence
  Synthetic Polynucleotide
taatacgactcactataggggaaaagcactcaaacggcggtcgcttcaataacagaggagaattgaaatgaccgccgttaacctggcggcagcgcaaaagatg

SEQ ID NO: 34199 - DNA, 103 bp, Artificial Sequence
  Synthetic Polynucleotide
taatacgactcactatagggacgctcgattatcgctgatcgacagcctgcaacagaggagagcaggcatgcgatcagcgaacctggcggcagcgcaaaagatg

SEQ ID NO: 34200 - DNA, 103 bp, Artificial Sequence
  Synthetic Polynucleotide
taatacgactcactatagggtttccggccccgacagtgatggaatgcataaacagaggagatatgcaatgcatcactgtaacctggcggcagcgcaaaagatg

SEQ ID NO: 34201 - DNA, 103 bp, Artificial Sequence
  Synthetic Polynucleotide
taatacgactcactatagggaatgtgtcaacggctccgggaagtcccagcaacagaggagagctgggatgtcccggagcaacctggcggcagcgcaaaagatg

SEQ ID NO: 34202 - DNA, 103 bp, Artificial Sequence
  Synthetic Polynucleotide
taatacgactcactatagggtttaaaggattgctacgcaccaggttacgaaacagaggagatcgtaaatgggtgcgtagaacctggcggcagcgcaaaagatg

SEQ ID NO: 34203 - DNA, 103 bp, Artificial Sequence
  Synthetic Polynucleotide
taatacgactcactatagggcagcaatgggttcaaatgaggaagtgtaacaacagaggagagttacaatgcctcatttgaacctggcggcagcgcaaaagatg

SEQ ID NO: 34204 - DNA, 103 bp, Artificial Sequence
  Synthetic Polynucleotide
taatacgactcactataggggcggtacatgtcgacagcaagtgccgctcgaacagaggagacgagcgatgcttgctgtcaacctggcggcagcgcaaaagatg

SEQ ID NO: 34205 - DNA, 103 bp, Artificial Sequence
  Synthetic Polynucleotide
taatacgactcactatagggcaaacccagcgataggacagtgaactgtacaacagaggagagtacagatgactgtcctaaacctggcggcagcgcaaaagatg

SEQ ID NO: 34206 - DNA, 103 bp, Artificial Sequence
  Synthetic Polynucleotide
taatacgactcactatagggatgtggacggtcaggcagactcagggagggaacagaggagaccctccatgagtctgcctaacctggcggcagcgcaaaagatg

SEQ ID NO: 34207 - DNA, 103 bp, Artificial Sequence
  Synthetic Polynucleotide
taatacgactcactatagggctaatatctatcctattagtccgttctagcaacagaggagagctagaatggactaatagaacctggcggcagcgcaaaagatg

SEQ ID NO: 34208 - DNA, 103 bp, Artificial Sequence
  Synthetic Polynucleotide
taatacgactcactatagggcctccggcccataagaaatcttcatatttcaacagaggagagaaataatgagatttcttaacctggcggcagcgcaaaagatg

SEQ ID NO: 34209 - DNA, 103 bp, Artificial Sequence
  Synthetic Polynucleotide
taatacgactcactataggggatgaggaacgcgacgcatacaccccttgcaacagaggagagcaaggatggtatgcgtcaacctggcggcagcgcaaaagatg

SEQ ID NO: 34210 - DNA, 103 bp, Artificial Sequence
  Synthetic Polynucleotide
taatacgactcactatagggagccatagagtaagccggttcctctgtggtaacagaggagaaccacaatggaaccggctaacctggcggcagcgcaaaagatg

SEQ ID NO: 34211 - DNA, 103 bp, Artificial Sequence
  Synthetic Polynucleotide
taatacgactcactatagggaatacacctccggacaactcaggcgtcaccaacagaggagaggtgacatgtgagttgtcaacctggcggcagcgcaaaagatg

SEQ ID NO: 34212 - DNA, 103 bp, Artificial Sequence
  Synthetic Polynucleotide
taatacgactcactataggggcacgttacagttttaagcagactgatgggaacagaggagacccatcatgctgcttaaaaacctggcggcagcgcaaaagatg

SEQ ID NO: 34213 - DNA, 103 bp, Artificial Sequence
  Synthetic Polynucleotide
taatacgactcactatagggattaatattagttagatcaacgaacgttaaaacagaggagattaacgatggttgatctaaacctggcggcagcgcaaaagatg

SEQ ID NO: 34214 - DNA, 103 bp, Artificial Sequence
  Synthetic Polynucleotide
taatacgactcactatagggtctgttggtcgaagtggtcgcagaagtcctaacagaggagaaggactatggcgaccactaacctggcggcagcgcaaaagatg

SEQ ID NO: 34215 - DNA, 103 bp, Artificial Sequence
  Synthetic Polynucleotide
taatacgactcactataggggacaagctttgcttacatacggtctcccttaacagaggagaaagggaatgcgtatgtaaaacctggcggcagcgcaaaagatg

SEQ ID NO: 34216 - DNA, 103 bp, Artificial Sequence
  Synthetic Polynucleotide
taatacgactcactatagggacgatagactaacctccggatatcgcgggaaacagaggagatcccgcatgatccggaggaacctggcggcagcgcaaaagatg

SEQ ID NO: 34217 - DNA, 103 bp, Artificial Sequence
  Synthetic Polynucleotide
taatacgactcactatagggggcgcgacttcatcatgaacggatcctagaaacagaggagatctaggatgcgttcatgaaacctggcggcagcgcaaaagatg

SEQ ID NO: 34218 - DNA, 103 bp, Artificial Sequence
  Synthetic Polynucleotide
taatacgactcactatagggcaatgggcatctctgcatcgttaggcacctaacagaggagaaggtgcatgacgatgcagaacctggcggcagcgcaaaagatg

SEQ ID NO: 34219 - DNA, 103 bp, Artificial Sequence
  Synthetic Polynucleotide
taatacgactcactatagggctctggcatgcccccggtgttaggtggcttaacagaggagaaagccaatgaacaccgggaacctggcggcagcgcaaaagatg

SEQ ID NO: 34220 - DNA, 103 bp, Artificial Sequence
  Synthetic Polynucleotide
taatacgactcactatagggaggggcgctccaacctgacggcacccaccgaacagaggagacggtggatgccgtcaggtaacctggcggcagcgcaaaagatg

SEQ ID NO: 34221 - DNA, 103 bp, Artificial Sequence
  Synthetic Polynucleotide
taatacgactcactatagggcatttagtcgtcatcggacaaaatagctgaaacagaggagatcagctatgttgtccgataacctggcggcagcgcaaaagatg

SEQ ID NO: 34222 - DNA, 103 bp, Artificial Sequence
  Synthetic Polynucleotide
taatacgactcactatagggcctcgagaacaaaggcgtacaggcgtcaacaacagaggagagttgacatgtgtacgcctaacctggcggcagcgcaaaagatg

SEQ ID NO: 34223 - DNA, 103 bp, Artificial Sequence
  Synthetic Polynucleotide
taatacgactcactatagggggctctagtcgacaggggatctacgaagataacagaggagaatcttcatggatcccctgaacctggcggcagcgcaaaagatg

SEQ ID NO: 34224 - DNA, 103 bp, Artificial Sequence
  Synthetic Polynucleotide
taatacgactcactatagggactgtctcccagatcaaagcccgccgtgacaacagaggagagtcacgatgggctttgataacctggcggcagcgcaaaagatg

SEQ ID NO: 34225 - DNA, 103 bp, Artificial Sequence
  Synthetic Polynucleotide
taatacgactcactataggggcggcaccaagggaacgcccgccggccaagaacagaggagacttggcatgcgggcgttcaacctggcggcagcgcaaaagatg

SEQ ID NO: 34226 - DNA, 103 bp, Artificial Sequence
  Synthetic Polynucleotide
taatacgactcactatagggctcgaagtatgtagtaacatctccaatagaaacagaggagatctattatggatgttactaacctggcggcagcgcaaaagatg

SEQ ID NO: 34227 - DNA, 103 bp, Artificial Sequence
  Synthetic Polynucleotide
taatacgactcactatagggaggcgaaaatccaaaactcatcaagatcacaacagaggagagtgatcatgatgagttttaacctggcggcagcgcaaaagatg

SEQ ID NO: 34228 - DNA, 103 bp, Artificial Sequence
  Synthetic Polynucleotide
taatacgactcactatagggatcttcccgctcctattaactggcggacgtaacagaggagaacgtccatgagttaatagaacctggcggcagcgcaaaagatg

SEQ ID NO: 34229 - DNA, 103 bp, Artificial Sequence
  Synthetic Polynucleotide
taatacgactcactatagggctgaccttcgccgggtcgggttgtacgtcgaacagaggagacgacgtatgacccgacccaacctggcggcagcgcaaaagatg

SEQ ID NO: 34230 - DNA, 103 bp, Artificial Sequence
  Synthetic Polynucleotide
taatacgactcactatagggaggtaacagggatctgcggtccgatggcccaacagaggagagggccaatggaccgcagaaacctggcggcagcgcaaaagatg

SEQ ID NO: 34231 - DNA, 103 bp, Artificial Sequence
  Synthetic Polynucleotide
taatacgactcactatagggttttagttaaccggaaagtggcccaacttcaacagaggagagaagttatgccactttccaacctggcggcagcgcaaaagatg

SEQ ID NO: 34232 - DNA, 103 bp, Artificial Sequence
  Synthetic Polynucleotide
taatacgactcactatagggccggtcctgtaaaaacacttcgccacggccaacagaggagaggccgtatggaagtgtttaacctggcggcagcgcaaaagatg

SEQ ID NO: 34233 - DNA, 103 bp, Artificial Sequence
  Synthetic Polynucleotide
taatacgactcactatagggatccctgcggcaattctagacacgctccctaacagaggagaagggagatggtctagaataacctggcggcagcgcaaaagatg

SEQ ID NO: 34234 - DNA, 103 bp, Artificial Sequence
  Synthetic Polynucleotide
taatacgactcactatagggtctagatcttcacgttagtccacccactacaacagaggagagtagtgatgggactaacgaacctggcggcagcgcaaaagatg

SEQ ID NO: 34235 - DNA, 103 bp, Artificial Sequence
  Synthetic Polynucleotide
taatacgactcactatagggtacgccgcaggtaatgtctatacacacgttaacagaggagaaacgtgatgatagacattaacctggcggcagcgcaaaagatg

SEQ ID NO: 34236 - DNA, 103 bp, Artificial Sequence
  Synthetic Polynucleotide
taatacgactcactatagggtgtcgaggccggtcttgatctatcgttacaaacagaggagatgtaacatgagatcaagaaacctggcggcagcgcaaaagatg

SEQ ID NO: 34237 - DNA, 103 bp, Artificial Sequence
  Synthetic Polynucleotide
taatacgactcactatagggtcgccacatatgtatatctagcatcccccaaacagaggagatgggggatgctagatataaacctggcggcagcgcaaaagatg

SEQ ID NO: 34238 - DNA, 103 bp, Artificial Sequence
  Synthetic Polynucleotide
taatacgactcactatagggggtgttaccaccagagctttcaactttatcaacagaggagagataaaatggaaagctctaacctggcggcagcgcaaaagatg

SEQ ID NO: 34239 - DNA, 103 bp, Artificial Sequence
  Synthetic Polynucleotide
taatacgactcactatagggtcggtcaattcgagacgttatttgtcgggcaacagaggagagcccgaatgataacgtctaacctggcggcagcgcaaaagatg

SEQ ID NO: 34240 - DNA, 103 bp, Artificial Sequence
  Synthetic Polynucleotide
taatacgactcactatagggagtccagttgatcgaacggcagagcggtgtaacagaggagaacaccgatgtgccgttcgaacctggcggcagcgcaaaagatg

SEQ ID NO: 34241 - DNA, 103 bp, Artificial Sequence
  Synthetic Polynucleotide
taatacgactcactatagggggagtgcgtgggacactcaaagtaggtcgcaacagaggagagcgaccatgtttgagtgtaacctggcggcagcgcaaaagatg

SEQ ID NO: 34242 - DNA, 103 bp, Artificial Sequence
  Synthetic Polynucleotide
taatacgactcactatagggcgtcataacgggcgtagcgctaacttttacaacagaggagagtaaaaatgagcgctacgaacctggcggcagcgcaaaagatg

SEQ ID NO: 34243 - DNA, 103 bp, Artificial Sequence
  Synthetic Polynucleotide
taatacgactcactatagggcgcgggttgagtgtcacgattgtgtcatccaacagaggagaggatgaatgaatcgtgacaacctggcggcagcgcaaaagatg

SEQ ID NO: 34244 - DNA, 103 bp, Artificial Sequence
  Synthetic Polynucleotide
taatacgactcactatagggctggtaaaacagatacaggccgtgttaaggaacagaggagaccttaaatgggcctgtataacctggcggcagcgcaaaagatg

SEQ ID NO: 34245 - DNA, 103 bp, Artificial Sequence
  Synthetic Polynucleotide
taatacgactcactataggggtggcttgccgcgtggcaatatattggcgaaacagaggagatcgccaatgtattgccacaacctggcggcagcgcaaaagatg

SEQ ID NO: 34246 - DNA, 103 bp, Artificial Sequence
  Synthetic Polynucleotide
taatacgactcactatagggactcgatctagaggtggtgataggtataataacagaggagaattataatgatcaccaccaacctggcggcagcgcaaaagatg

SEQ ID NO: 34247 - DNA, 103 bp, Artificial Sequence
  Synthetic Polynucleotide
taatacgactcactatagggtgcgtaaccattacgattctctaacctaacaacagaggagagttaggatggagaatcgtaacctggcggcagcgcaaaagatg

SEQ ID NO: 34248 - DNA, 103 bp, Artificial Sequence
  Synthetic Polynucleotide
taatacgactcactatagggtctgagccagaactcaaccgtaacgcctggaacagaggagaccaggcatgacggttgagaacctggcggcagcgcaaaagatg

SEQ ID NO: 34249 - DNA, 103 bp, Artificial Sequence
  Synthetic Polynucleotide
taatacgactcactataggggtggccctctttgtaggcatgcaacatgtgaacagaggagacacatgatgcatgcctacaacctggcggcagcgcaaaagatg

SEQ ID NO: 34250 - DNA, 103 bp, Artificial Sequence
  Synthetic Polynucleotide
taatacgactcactatagggcagatctactaacgcgttaagcggaaccttaacagaggagaaaggttatgcttaacgcgaacctggcggcagcgcaaaagatg

SEQ ID NO: 34251 - DNA, 103 bp, Artificial Sequence
  Synthetic Polynucleotide
taatacgactcactataggggaacaggggacacggagtctcccgagattaaacagaggagataatctatggagactccgaacctggcggcagcgcaaaagatg

SEQ ID NO: 34252 - DNA, 103 bp, Artificial Sequence
  Synthetic Polynucleotide
taatacgactcactatagggtgccatcctcatcaacctgatctccttataaacagaggagatataagatgatcaggttgaacctggcggcagcgcaaaagatg

SEQ ID NO: 34253 - DNA, 103 bp, Artificial Sequence
  Synthetic Polynucleotide
taatacgactcactatagggccattactctctgcccgagtcggttagacaaacagaggagatgtctaatggactcgggcaacctggcggcagcgcaaaagatg

SEQ ID NO: 34254 - DNA, 103 bp, Artificial Sequence
  Synthetic Polynucleotide
taatacgactcactatagggccggcgcgcatcatacagatataaatccaaaacagaggagattggatatgtatctgtataacctggcggcagcgcaaaagatg

SEQ ID NO: 34255 - DNA, 103 bp, Artificial Sequence
  Synthetic Polynucleotide
taatacgactcactataggggacaaaacactggtgtgacggccgctgcggaacagaggagaccgcagatgccgtcacacaacctggcggcagcgcaaaagatg

SEQ ID NO: 34256 - DNA, 103 bp, Artificial Sequence
  Synthetic Polynucleotide
taatacgactcactatagggagctagctgaataggcgacattgtaacttcaacagaggagagaagttatgatgtcgcctaacctggcggcagcgcaaaagatg

SEQ ID NO: 34257 - DNA, 103 bp, Artificial Sequence
  Synthetic Polynucleotide
taatacgactcactataggggtgtcgtcttctctcatcgcaccccggcggaacagaggagaccgccgatgtgcgatgagaacctggcggcagcgcaaaagatg

SEQ ID NO: 34258 - DNA, 103 bp, Artificial Sequence
  Synthetic Polynucleotide
taatacgactcactatagggacgcataacaagtacgagcacgccctccccaacagaggagaggggagatggtgctcgtaaacctggcggcagcgcaaaagatg

SEQ ID NO: 34259 - DNA, 103 bp, Artificial Sequence
  Synthetic Polynucleotide
taatacgactcactatagggtacaactcctctatagtgctcgcgttaatcaacagaggagagattaaatggagcactataacctggcggcagcgcaaaagatg

SEQ ID NO: 34260 - DNA, 103 bp, Artificial Sequence
  Synthetic Polynucleotide
taatacgactcactatagggtcgccgggcgacgtcgtgaagggaaccaataacagaggagaattggtatgcttcacgacaacctggcggcagcgcaaaagatg

SEQ ID NO: 34261 - DNA, 103 bp, Artificial Sequence
  Synthetic Polynucleotide
taatacgactcactatagggttgagaagcctcgtagaggcgttgacggacaacagaggagagtccgtatgcgcctctacaacctggcggcagcgcaaaagatg

SEQ ID NO: 34262 - DNA, 103 bp, Artificial Sequence
  Synthetic Polynucleotide
taatacgactcactatagggctcagaagacggtgtgctacggccaaggtcaacagaggagagaccttatgcgtagcacaaacctggcggcagcgcaaaagatg

SEQ ID NO: 34263 - DNA, 103 bp, Artificial Sequence
  Synthetic Polynucleotide
taatacgactcactataggggcaacccgaggtctccttatctgctgcaccaacagaggagaggtgcaatggataaggagaacctggcggcagcgcaaaagatg

SEQ ID NO: 34264 - DNA, 103 bp, Artificial Sequence
  Synthetic Polynucleotide
taatacgactcactatagggggcacaacaacggaaagggcgaaagtactgaacagaggagacagtacatgcgccctttcaacctggcggcagcgcaaaagatg

SEQ ID NO: 34265 - DNA, 103 bp, Artificial Sequence
  Synthetic Polynucleotide
taatacgactcactatagggtttctgtttcgacggacgtaactcgaaatgaacagaggagacatttcatgttacgtccgaacctggcggcagcgcaaaagatg

SEQ ID NO: 34266 - DNA, 103 bp, Artificial Sequence
  Synthetic Polynucleotide
taatacgactcactatagggctggccactatgcaagaaacttggagccgcaacagaggagagcggctatgagtttcttgaacctggcggcagcgcaaaagatg

SEQ ID NO: 34267 - DNA, 103 bp, Artificial Sequence
  Synthetic Polynucleotide
taatacgactcactataggggaccctaatctctctagtggagttaaggataacagaggagaatccttatgtccactagaaacctggcggcagcgcaaaagatg

SEQ ID NO: 34268 - DNA, 103 bp, Artificial Sequence
  Synthetic Polynucleotide
taatacgactcactataggggactccggcggccggtgatctgttgtgtcaaacagaggagatgacacatgagatcaccgaacctggcggcagcgcaaaagatg

SEQ ID NO: 34269 - DNA, 103 bp, Artificial Sequence
  Synthetic Polynucleotide
taatacgactcactataggggcttcagtccgtcttcgtagcgactaataaaacagaggagattattaatggctacgaagaacctggcggcagcgcaaaagatg

SEQ ID NO: 34270 - DNA, 103 bp, Artificial Sequence
  Synthetic Polynucleotide
taatacgactcactatagggcatctcggggcgggctgaaggggttcaattaacagaggagaaattgaatgccttcagccaacctggcggcagcgcaaaagatg

SEQ ID NO: 34271 - DNA, 103 bp, Artificial Sequence
  Synthetic Polynucleotide
taatacgactcactatagggggaccggatggaggcaaatagcaactggcaaacagaggagatgccagatgctatttgccaacctggcggcagcgcaaaagatg

SEQ ID NO: 34272 - DNA, 103 bp, Artificial Sequence
  Synthetic Polynucleotide
taatacgactcactataggggtagtagacatccgagcttctaaggactgaaacagaggagatcagtcatgagaagctcgaacctggcggcagcgcaaaagatg

SEQ ID NO: 34273 - DNA, 103 bp, Artificial Sequence
  Synthetic Polynucleotide
taatacgactcactatagggtttcgccagtgccatgcccttatagagctcaacagaggagagagctcatgaagggcatgaacctggcggcagcgcaaaagatg

SEQ ID NO: 34274 - DNA, 103 bp, Artificial Sequence
  Synthetic Polynucleotide
taatacgactcactatagggtatatacatcggaaatgcgcaagcgtcaataacagaggagaattgacatgtgcgcatttaacctggcggcagcgcaaaagatg

SEQ ID NO: 34275 - DNA, 103 bp, Artificial Sequence
  Synthetic Polynucleotide
taatacgactcactatagggcttcggtaggcacgtttacctgctgctgggaacagaggagacccagcatgaggtaaacgaacctggcggcagcgcaaaagatg

SEQ ID NO: 34276 - DNA, 103 bp, Artificial Sequence
  Synthetic Polynucleotide
taatacgactcactatagggcctaacgcatcgtgaacaattgttggttgtaacagaggagaacaaccatgaattgttcaaacctggcggcagcgcaaaagatg

SEQ ID NO: 34277 - DNA, 103 bp, Artificial Sequence
  Synthetic Polynucleotide
taatacgactcactatagggtgccttccggaagtcgggacgtgtgaaagtaacagaggagaactttcatgcgtcccgacaacctggcggcagcgcaaaagatg

SEQ ID NO: 34278 - DNA, 103 bp, Artificial Sequence
  Synthetic Polynucleotide
taatacgactcactataggggataactgggtaataggtttctccacacaaaacagaggagattgtgtatggaaacctataacctggcggcagcgcaaaagatg

SEQ ID NO: 34279 - DNA, 103 bp, Artificial Sequence
  Synthetic Polynucleotide
taatacgactcactatagggtacagtgagacttctggaaattattagcggaacagaggagaccgctaatgatttccagaaacctggcggcagcgcaaaagatg

SEQ ID NO: 34280 - DNA, 103 bp, Artificial Sequence
  Synthetic Polynucleotide
taatacgactcactatagggtataccttaatatcgacagcgacctttagtaacagaggagaactaaaatgcgctgtcgaaacctggcggcagcgcaaaagatg

SEQ ID NO: 34281 - DNA, 103 bp, Artificial Sequence
  Synthetic Polynucleotide
taatacgactcactatagggtacctcgatgagatgagttttcgccccagcaacagaggagagctgggatgaaaactcataacctggcggcagcgcaaaagatg

SEQ ID NO: 34282 - DNA, 103 bp, Artificial Sequence
  Synthetic Polynucleotide
taatacgactcactatagggagactggacagcatttacacggaactcggcaacagaggagagccgagatgcgtgtaaataacctggcggcagcgcaaaagatg

SEQ ID NO: 34283 - DNA, 103 bp, Artificial Sequence
  Synthetic Polynucleotide
taatacgactcactatagggccccgcgtgggctttttgacgtaccaccctaacagaggagaagggtgatgcgtcaaaaaaacctggcggcagcgcaaaagatg

SEQ ID NO: 34284 - DNA, 103 bp, Artificial Sequence
  Synthetic Polynucleotide
taatacgactcactatagggagtcaggtgtggacggcccagctttagggaaacagaggagatccctaatgctgggccgtaacctggcggcagcgcaaaagatg

SEQ ID NO: 34285 - DNA, 103 bp, Artificial Sequence
  Synthetic Polynucleotide
taatacgactcactatagggttaatgagctatccggtatggggcgaccaaaacagaggagattggtcatgccataccggaacctggcggcagcgcaaaagatg

SEQ ID NO: 34286 - DNA, 103 bp, Artificial Sequence
  Synthetic Polynucleotide
taatacgactcactatagggtgtgtctgatcgcagtggatcaaggcccccaacagaggagagggggcatggatccactgaacctggcggcagcgcaaaagatg

SEQ ID NO: 34287 - DNA, 103 bp, Artificial Sequence
  Synthetic Polynucleotide
taatacgactcactatagggggaccttcagggcttatattttaacgacaaaacagaggagattgtcgatgaaatataagaacctggcggcagcgcaaaagatg

SEQ ID NO: 34288 - DNA, 103 bp, Artificial Sequence
  Synthetic Polynucleotide
taatacgactcactatagggagaaccacacttttcaataatgatgcgtgaaacagaggagatcacgcatgattattgaaaacctggcggcagcgcaaaagatg

SEQ ID NO: 34289 - DNA, 103 bp, Artificial Sequence
  Synthetic Polynucleotide
taatacgactcactatagggactccgcatcgatggtactggagaggtgacaacagaggagagtcaccatgccagtaccaaacctggcggcagcgcaaaagatg

SEQ ID NO: 34290 - DNA, 103 bp, Artificial Sequence
  Synthetic Polynucleotide
taatacgactcactataggggtaccagatcgcctctcgctttaggtgtagaacagaggagactacacatgaagcgagagaacctggcggcagcgcaaaagatg

SEQ ID NO: 34291 - DNA, 103 bp, Artificial Sequence
  Synthetic Polynucleotide
taatacgactcactatagggatgcgcgccgagtacagaagcgcgagtaacaacagaggagagttactatggcttctgtaaacctggcggcagcgcaaaagatg

SEQ ID NO: 34292 - DNA, 103 bp, Artificial Sequence
  Synthetic Polynucleotide
taatacgactcactatagggatttaaattccggcccctcacagccagactaacagaggagaagtctgatggtgaggggcaacctggcggcagcgcaaaagatg

SEQ ID NO: 34293 - DNA, 103 bp, Artificial Sequence
  Synthetic Polynucleotide
taatacgactcactataggggcacgcgcacccgaacagaggccatatataaacagaggagatatataatgcctctgttcaacctggcggcagcgcaaaagatg

SEQ ID NO: 34294 - DNA, 103 bp, Artificial Sequence
  Synthetic Polynucleotide
taatacgactcactatagggtaaaatgtgcctcacgagcggtaaatcatgaacagaggagacatgatatgccgctcgtgaacctggcggcagcgcaaaagatg

SEQ ID NO: 34295 - DNA, 103 bp, Artificial Sequence
  Synthetic Polynucleotide
taatacgactcactatagggagcatagccaaatgccaatcatcttccataaacagaggagatatggaatgtgattggcaaacctggcggcagcgcaaaagatg

SEQ ID NO: 34296 - DNA, 103 bp, Artificial Sequence
  Synthetic Polynucleotide
taatacgactcactatagggttccgccggcaacgctaaaaagtgggcaataacagaggagaattgccatgtttttagcgaacctggcggcagcgcaaaagatg

SEQ ID NO: 34297 - DNA, 103 bp, Artificial Sequence
  Synthetic Polynucleotide
taatacgactcactatagggatcgaaaagggcgaaggatcgtggtggaccaacagaggagaggtccaatgcgatccttcaacctggcggcagcgcaaaagatg

SEQ ID NO: 34298 - DNA, 103 bp, Artificial Sequence
  Synthetic Polynucleotide
taatacgactcactatagggacggcccggacgatagtaatacctagtcagaacagaggagactgactatgtattactataacctggcggcagcgcaaaagatg

SEQ ID NO: 34299 - DNA, 103 bp, Artificial Sequence
  Synthetic Polynucleotide
taatacgactcactatagggggactgactcttataccatgatcgttccggaacagaggagaccggaaatgtcatggtataacctggcggcagcgcaaaagatg

SEQ ID NO: 34300 - DNA, 103 bp, Artificial Sequence
  Synthetic Polynucleotide
taatacgactcactatagggcaacgaattaaggatagcggtttaactggcaacagaggagagccagtatgaccgctatcaacctggcggcagcgcaaaagatg

SEQ ID NO: 34301 - DNA, 103 bp, Artificial Sequence
  Synthetic Polynucleotide
taatacgactcactatagggcttatgtcgggagtaatgaaccccgcggcgaacagaggagacgccgcatggttcattacaacctggcggcagcgcaaaagatg

SEQ ID NO: 34302 - DNA, 103 bp, Artificial Sequence
  Synthetic Polynucleotide
taatacgactcactataggggtccctataagcggcttttcgtgagataacaacagaggagagttatcatgcgaaaagccaacctggcggcagcgcaaaagatg

SEQ ID NO: 34303 - DNA, 103 bp, Artificial Sequence
  Synthetic Polynucleotide
taatacgactcactataggggcgagctgggtcaaaaaaaaatgctgtcgcaacagaggagagcgacaatgtttttttttaacctggcggcagcgcaaaagatg

SEQ ID NO: 34304 - DNA, 103 bp, Artificial Sequence
  Synthetic Polynucleotide
taatacgactcactatagggcattaaggatcccgcagcttttccatacacaacagaggagagtgtatatgaaagctgcgaacctggcggcagcgcaaaagatg

SEQ ID NO: 34305 - DNA, 103 bp, Artificial Sequence
  Synthetic Polynucleotide
taatacgactcactatagggagctacggaaggtcagaagccctcgctgtcaacagaggagagacagcatgggcttctgaaacctggcggcagcgcaaaagatg

SEQ ID NO: 34306 - DNA, 103 bp, Artificial Sequence
  Synthetic Polynucleotide
taatacgactcactatagggaactgcaccttgacatatcgaccgtgaatgaacagaggagacattcaatgtcgatatgtaacctggcggcagcgcaaaagatg

SEQ ID NO: 34307 - DNA, 103 bp, Artificial Sequence
  Synthetic Polynucleotide
taatacgactcactatagggcacaatcgagattgtgaaagaacgacgtctaacagaggagaagacgtatgtctttcacaaacctggcggcagcgcaaaagatg

SEQ ID NO: 34308 - DNA, 103 bp, Artificial Sequence
  Synthetic Polynucleotide
taatacgactcactatagggcaccttagtcatcgccggcttatatgcagaaacagaggagatctgcaatgaagccggcgaacctggcggcagcgcaaaagatg

SEQ ID NO: 34309 - DNA, 103 bp, Artificial Sequence
  Synthetic Polynucleotide
taatacgactcactatagggtctagcggtagatagatcttggaatgtggtaacagaggagaaccacaatgcaagatctaaacctggcggcagcgcaaaagatg

SEQ ID NO: 34310 - DNA, 103 bp, Artificial Sequence
  Synthetic Polynucleotide
taatacgactcactataggggtaacgtagccaggcaggaccagactggctaacagaggagaagccagatgggtcctgccaacctggcggcagcgcaaaagatg

SEQ ID NO: 34311 - DNA, 103 bp, Artificial Sequence
  Synthetic Polynucleotide
taatacgactcactatagggaactttccagggtccaactacattctgttcaacagaggagagaacagatggtagttggaaacctggcggcagcgcaaaagatg

SEQ ID NO: 34312 - DNA, 103 bp, Artificial Sequence
  Synthetic Polynucleotide
taatacgactcactataggggcgtgacgcaagccaactatgatccgcgctaacagaggagaagcgcgatgcatagttggaacctggcggcagcgcaaaagatg

SEQ ID NO: 34313 - DNA, 103 bp, Artificial Sequence
  Synthetic Polynucleotide
taatacgactcactatagggaagtcagtaaattctgaaggcagtgtctgtaacagaggagaacagacatggccttcagaaacctggcggcagcgcaaaagatg

SEQ ID NO: 34314 - DNA, 103 bp, Artificial Sequence
  Synthetic Polynucleotide
taatacgactcactatagggcaagacgtcacgctttgtcggctgaggcctaacagaggagaaggcctatgccgacaaagaacctggcggcagcgcaaaagatg

SEQ ID NO: 34315 - DNA, 103 bp, Artificial Sequence
  Synthetic Polynucleotide
taatacgactcactatagggtctgaaacgccaaacttcgctggctggggcaacagaggagagccccaatgagcgaagttaacctggcggcagcgcaaaagatg

SEQ ID NO: 34316 - DNA, 103 bp, Artificial Sequence
  Synthetic Polynucleotide
taatacgactcactatagggtaagttcacacaatcccttcattgttatcgaacagaggagacgataaatgtgaagggataacctggcggcagcgcaaaagatg

SEQ ID NO: 34317 - DNA, 103 bp, Artificial Sequence
  Synthetic Polynucleotide
taatacgactcactatagggttaaaacgttcccaaagatacctgcgagataacagaggagaatctcgatggtatctttgaacctggcggcagcgcaaaagatg

SEQ ID NO: 34318 - DNA, 103 bp, Artificial Sequence
  Synthetic Polynucleotide
taatacgactcactatagggaaagtcagttctaatgtggggacctagattaacagaggagaaatctaatgccccacattaacctggcggcagcgcaaaagatg

SEQ ID NO: 34319 - DNA, 103 bp, Artificial Sequence
  Synthetic Polynucleotide
taatacgactcactatagggaagtagaggcacattagacgcggtcaagataacagaggagaatcttgatggcgtctaataacctggcggcagcgcaaaagatg

SEQ ID NO: 34320 - DNA, 103 bp, Artificial Sequence
  Synthetic Polynucleotide
taatacgactcactataggggatccagctcgaggggacgagacggccatcaacagaggagagatggcatgctcgtccccaacctggcggcagcgcaaaagatg

SEQ ID NO: 34321 - DNA, 103 bp, Artificial Sequence
  Synthetic Polynucleotide
taatacgactcactatagggcaacgacgggccaggataccgagggcacccaacagaggagagggtgcatgcggtatcctaacctggcggcagcgcaaaagatg

SEQ ID NO: 34322 - DNA, 103 bp, Artificial Sequence
  Synthetic Polynucleotide
taatacgactcactataggggacggtcaaactttaatcggcaagatgttgaacagaggagacaacatatggccgattaaaacctggcggcagcgcaaaagatg

SEQ ID NO: 34323 - DNA, 103 bp, Artificial Sequence
  Synthetic Polynucleotide
taatacgactcactatagggagactgtctggaagccattatgtccgctacaacagaggagagtagcgatgataatggctaacctggcggcagcgcaaaagatg

SEQ ID NO: 34324 - DNA, 103 bp, Artificial Sequence
  Synthetic Polynucleotide
taatacgactcactatagggttttcccacccgggttcatcctgttcaaacaacagaggagagtttgaatgggatgaaccaacctggcggcagcgcaaaagatg

SEQ ID NO: 34325 - DNA, 103 bp, Artificial Sequence
  Synthetic Polynucleotide
taatacgactcactatagggttgtcgcgacagtggcttcgacgccaaccaaacagaggagatggttgatgtcgaagccaaacctggcggcagcgcaaaagatg

SEQ ID NO: 34326 - DNA, 103 bp, Artificial Sequence
  Synthetic Polynucleotide
taatacgactcactatagggctccggagatgaagtgaatgaacgcgatccaacagaggagaggatcgatgtcattcactaacctggcggcagcgcaaaagatg

SEQ ID NO: 34327 - DNA, 103 bp, Artificial Sequence
  Synthetic Polynucleotide
taatacgactcactatagggttagcatcgtcctcggcaaattgcgtatgcaacagaggagagcatacatgatttgccgaaacctggcggcagcgcaaaagatg

SEQ ID NO: 34328 - DNA, 103 bp, Artificial Sequence
  Synthetic Polynucleotide
taatacgactcactatagggcgtttgtcgcagatctagatagttgaagcaaacagaggagatgcttcatgtatctagataacctggcggcagcgcaaaagatg

SEQ ID NO: 34329 - DNA, 103 bp, Artificial Sequence
  Synthetic Polynucleotide
taatacgactcactatagggtgggagctagattactaaaagttcgtgcctaacagaggagaaggcacatgcttttagtaaacctggcggcagcgcaaaagatg

SEQ ID NO: 34330 - DNA, 103 bp, Artificial Sequence
  Synthetic Polynucleotide
taatacgactcactatagggtccgcgagtggttgacatccggattacacaaacagaggagatgtgtaatgcggatgtcaaacctggcggcagcgcaaaagatg

SEQ ID NO: 34331 - DNA, 103 bp, Artificial Sequence
  Synthetic Polynucleotide
taatacgactcactatagggacttgttagcccggagtatagcgagtttcaaacagaggagatgaaacatgctatactccaacctggcggcagcgcaaaagatg

SEQ ID NO: 34332 - DNA, 103 bp, Artificial Sequence
  Synthetic Polynucleotide
taatacgactcactatagggtacacacagcgggggccgaatcatcttcgtaacagaggagaacgaagatgattcggcccaacctggcggcagcgcaaaagatg

SEQ ID NO: 34333 - DNA, 103 bp, Artificial Sequence
  Synthetic Polynucleotide
taatacgactcactatagggaaagccgctttcatctgcaactagtagatcaacagaggagagatctaatggttgcagataacctggcggcagcgcaaaagatg

SEQ ID NO: 34334 - DNA, 103 bp, Artificial Sequence
  Synthetic Polynucleotide
taatacgactcactataggggaggctttggacacacctaaagcccgttaaaacagaggagattaacgatgtttaggtgtaacctggcggcagcgcaaaagatg

SEQ ID NO: 34335 - DNA, 103 bp, Artificial Sequence
  Synthetic Polynucleotide
taatacgactcactatagggatctgagcttgataaatacattctgaaggaaacagaggagatccttcatgatgtatttaaacctggcggcagcgcaaaagatg

SEQ ID NO: 34336 - DNA, 103 bp, Artificial Sequence
  Synthetic Polynucleotide
taatacgactcactatagggcagtaccccccctagtttttaatttcgcacaacagaggagagtgcgaatgtaaaaactaaacctggcggcagcgcaaaagatg

SEQ ID NO: 34337 - DNA, 103 bp, Artificial Sequence
  Synthetic Polynucleotide
taatacgactcactataggggtggtcctgataaatcgtaacaattttcttaacagaggagaaagaaaatggttacgattaacctggcggcagcgcaaaagatg

SEQ ID NO: 34338 - DNA, 103 bp, Artificial Sequence
  Synthetic Polynucleotide
taatacgactcactatagggacacgtacctgcctcccctgcaaggccgtgaacagaggagacacggcatggcaggggagaacctggcggcagcgcaaaagatg

SEQ ID NO: 34339 - DNA, 103 bp, Artificial Sequence
  Synthetic Polynucleotide
taatacgactcactatagggactacattctagttgtagatgctatggataaacagaggagatatccaatgcatctacaaaacctggcggcagcgcaaaagatg

SEQ ID NO: 34340 - DNA, 103 bp, Artificial Sequence
  Synthetic Polynucleotide
taatacgactcactatagggaacctgcaaggcggtaacggctttgtacaaaacagaggagattgtacatggccgttaccaacctggcggcagcgcaaaagatg

SEQ ID NO: 34341 - DNA, 103 bp, Artificial Sequence
  Synthetic Polynucleotide
taatacgactcactatagggcggatcaaatagccatatagacggagggacaacagaggagagtccctatgtctatatggaacctggcggcagcgcaaaagatg

SEQ ID NO: 34342 - DNA, 103 bp, Artificial Sequence
  Synthetic Polynucleotide
taatacgactcactataggggatgctttggcaccctgacgagacggccataacagaggagaatggccatgtcgtcagggaacctggcggcagcgcaaaagatg

SEQ ID NO: 34343 - DNA, 103 bp, Artificial Sequence
  Synthetic Polynucleotide
taatacgactcactatagggttttagactcccagcttcttcagtcccaataacagaggagaattgggatggaagaagctaacctggcggcagcgcaaaagatg

SEQ ID NO: 34344 - DNA, 103 bp, Artificial Sequence
  Synthetic Polynucleotide
taatacgactcactatagggggggtcactggaaaagcgctcctggatttcaacagaggagagaaatcatggagcgctttaacctggcggcagcgcaaaagatg

SEQ ID NO: 34345 - DNA, 103 bp, Artificial Sequence
  Synthetic Polynucleotide
taatacgactcactatagggatctacgacggtttacaacatggacgcgccaacagaggagaggcgcgatgatgttgtaaaacctggcggcagcgcaaaagatg

SEQ ID NO: 34346 - DNA, 103 bp, Artificial Sequence
  Synthetic Polynucleotide
taatacgactcactataggggttaacgagggagaaacctcgtcggtgagtaacagaggagaactcacatgcgaggtttcaacctggcggcagcgcaaaagatg

SEQ ID NO: 34347 - DNA, 103 bp, Artificial Sequence
  Synthetic Polynucleotide
taatacgactcactatagggcttactagacagtcttcccccccttatgttaacagaggagaaacataatggggggaagaaacctggcggcagcgcaaaagatg

SEQ ID NO: 34348 - DNA, 103 bp, Artificial Sequence
  Synthetic Polynucleotide
taatacgactcactataggggcgccacaacagcctggagtcatgagacgaaacagaggagatcgtctatggactccaggaacctggcggcagcgcaaaagatg

SEQ ID NO: 34349 - DNA, 103 bp, Artificial Sequence
  Synthetic Polynucleotide
taatacgactcactatagggaatgtcaaacctggcgttctacttcccccaaacagaggagatgggggatgtagaacgccaacctggcggcagcgcaaaagatg

SEQ ID NO: 34350 - DNA, 103 bp, Artificial Sequence
  Synthetic Polynucleotide
taatacgactcactatagggcgtactatctggcggtatcggatattcccaaacagaggagatgggaaatgccgataccgaacctggcggcagcgcaaaagatg

SEQ ID NO: 34351 - DNA, 103 bp, Artificial Sequence
  Synthetic Polynucleotide
taatacgactcactatagggagtgatggcgtcagttcggcttgcagccgaaacagaggagatcggctatgagccgaactaacctggcggcagcgcaaaagatg

SEQ ID NO: 34352 - DNA, 103 bp, Artificial Sequence
  Synthetic Polynucleotide
taatacgactcactatagggacgtgtcctggtacacagtgccccgaccgaaacagaggagatcggtcatggcactgtgtaacctggcggcagcgcaaaagatg

SEQ ID NO: 34353 - DNA, 103 bp, Artificial Sequence
  Synthetic Polynucleotide
taatacgactcactatagggtccctgagatggagccctatctttgtggctaacagaggagaagccacatggatagggctaacctggcggcagcgcaaaagatg

SEQ ID NO: 34354 - DNA, 103 bp, Artificial Sequence
  Synthetic Polynucleotide
taatacgactcactatagggtaacccgacggaccggctaagctggtccgtaacagaggagaacggacatgcttagccggaacctggcggcagcgcaaaagatg

SEQ ID NO: 34355 - DNA, 103 bp, Artificial Sequence
  Synthetic Polynucleotide
taatacgactcactatagggacggtgtcagcgttgagggaactcaatacaaacagaggagatgtattatgttccctcaaaacctggcggcagcgcaaaagatg

SEQ ID NO: 34356 - DNA, 103 bp, Artificial Sequence
  Synthetic Polynucleotide
taatacgactcactatagggctacgagcggctgtgcatatgaatgagacgaacagaggagacgtctcatgcatatgcacaacctggcggcagcgcaaaagatg

SEQ ID NO: 34357 - DNA, 103 bp, Artificial Sequence
  Synthetic Polynucleotide
taatacgactcactataggggtatttaggttgatagccgtccagattaccaacagaggagaggtaatatggacggctataacctggcggcagcgcaaaagatg

SEQ ID NO: 34358 - DNA, 103 bp, Artificial Sequence
  Synthetic Polynucleotide
taatacgactcactatagggactaccataacagtagtacggcttggcagaaacagaggagatctgccatgccgtactacaacctggcggcagcgcaaaagatg

SEQ ID NO: 34359 - DNA, 103 bp, Artificial Sequence
  Synthetic Polynucleotide
taatacgactcactatagggagcatgaacgggcggagcgtgatccacctcaacagaggagagaggtgatgcacgctccgaacctggcggcagcgcaaaagatg

SEQ ID NO: 34360 - DNA, 103 bp, Artificial Sequence
  Synthetic Polynucleotide
taatacgactcactataggggacctccgactctgtcaatagatttgctgtaacagaggagaacagcaatgctattgacaaacctggcggcagcgcaaaagatg

SEQ ID NO: 34361 - DNA, 103 bp, Artificial Sequence
  Synthetic Polynucleotide
taatacgactcactatagggaacgaacgatgtcgactagtacactatcgaaacagaggagatcgataatgtactagtcgaacctggcggcagcgcaaaagatg

SEQ ID NO: 34362 - DNA, 103 bp, Artificial Sequence
  Synthetic Polynucleotide
taatacgactcactatagggctgtattgtgtgaacgaacacttcgaacctaacagaggagaaggttcatggtgttcgttaacctggcggcagcgcaaaagatg

SEQ ID NO: 34363 - DNA, 103 bp, Artificial Sequence
  Synthetic Polynucleotide
taatacgactcactatagggtgattgcctcgtcagtctgctaacgggactaacagaggagaagtcccatgagcagactgaacctggcggcagcgcaaaagatg

SEQ ID NO: 34364 - DNA, 103 bp, Artificial Sequence
  Synthetic Polynucleotide
taatacgactcactatagggcggcaccgaggaatcaaatgcaggaactataacagaggagaatagttatggcatttgataacctggcggcagcgcaaaagatg

SEQ ID NO: 34365 - DNA, 103 bp, Artificial Sequence
  Synthetic Polynucleotide
taatacgactcactatagggcccacccaccaacaataagcctgtaataacaacagaggagagttattatgggcttattgaacctggcggcagcgcaaaagatg

SEQ ID NO: 34366 - DNA, 103 bp, Artificial Sequence
  Synthetic Polynucleotide
taatacgactcactataggggcgcgatcgagtgaggctggcctaaagcaaaacagaggagattgcttatggccagcctcaacctggcggcagcgcaaaagatg

SEQ ID NO: 34367 - DNA, 103 bp, Artificial Sequence
  Synthetic Polynucleotide
taatacgactcactataggggaggacccgtcaaggcttcttatcgtctacaacagaggagagtagacatgaagaagcctaacctggcggcagcgcaaaagatg

SEQ ID NO: 34368 - DNA, 103 bp, Artificial Sequence
  Synthetic Polynucleotide
taatacgactcactataggggagaattttggttcggtcaagggccctagcaacagaggagagctaggatgcttgaccgaaacctggcggcagcgcaaaagatg

SEQ ID NO: 34369 - DNA, 103 bp, Artificial Sequence
  Synthetic Polynucleotide
taatacgactcactatagggcatatcgcagaattattaagattactgtccaacagaggagaggacagatgtcttaataaaacctggcggcagcgcaaaagatg

SEQ ID NO: 34370 - DNA, 103 bp, Artificial Sequence
  Synthetic Polynucleotide
taatacgactcactatagggatgaatggctaacttggtccgcgacgcggtaacagaggagaaccgcgatgcggaccaagaacctggcggcagcgcaaaagatg

SEQ ID NO: 34371 - DNA, 103 bp, Artificial Sequence
  Synthetic Polynucleotide
taatacgactcactatagggcctcttcttttgctatactcgacaatgaataacagaggagaattcatatgcgagtatagaacctggcggcagcgcaaaagatg

SEQ ID NO: 34372 - DNA, 103 bp, Artificial Sequence
  Synthetic Polynucleotide
taatacgactcactatagggggaccagaggtggtcatcatgatcttaccaaacagaggagatggtaaatgcatgatgacaacctggcggcagcgcaaaagatg

SEQ ID NO: 34373 - DNA, 103 bp, Artificial Sequence
  Synthetic Polynucleotide
taatacgactcactatagggctggggaagccgaagtcgatcgtcaccttcaacagaggagagaaggtatggatcgacttaacctggcggcagcgcaaaagatg

SEQ ID NO: 34374 - DNA, 103 bp, Artificial Sequence
  Synthetic Polynucleotide
taatacgactcactatagggaaacacgaaaaaatcaagttgacgacctgaaacagaggagatcaggtatgcaacttgataacctggcggcagcgcaaaagatg

SEQ ID NO: 34375 - DNA, 103 bp, Artificial Sequence
  Synthetic Polynucleotide
taatacgactcactataggggggggcttggtaattcaactactgtccggaaacagaggagatccggaatgtagttgaataacctggcggcagcgcaaaagatg

SEQ ID NO: 34376 - DNA, 103 bp, Artificial Sequence
  Synthetic Polynucleotide
taatacgactcactatagggcagaaataccgattgttcgcggcagcccaaaacagaggagattgggcatgcgcgaacaaaacctggcggcagcgcaaaagatg

SEQ ID NO: 34377 - DNA, 103 bp, Artificial Sequence
  Synthetic Polynucleotide
taatacgactcactatagggtgaacaatataatgaataagaacccattataacagaggagaataatgatgtcttattcaaacctggcggcagcgcaaaagatg

SEQ ID NO: 34378 - DNA, 103 bp, Artificial Sequence
  Synthetic Polynucleotide
taatacgactcactataggggattcgcggcacgataataacacatgttgtaacagaggagaacaacaatggttattatcaacctggcggcagcgcaaaagatg

SEQ ID NO: 34379 - DNA, 103 bp, Artificial Sequence
  Synthetic Polynucleotide
taatacgactcactataggggactgccatacgagcgcccaaaccgttaataacagaggagaattaacatgttgggcgctaacctggcggcagcgcaaaagatg

SEQ ID NO: 34380 - DNA, 103 bp, Artificial Sequence
  Synthetic Polynucleotide
taatacgactcactatagggtgcctgtcttacgctcggcaatcgtaaagtaacagaggagaactttaatgttgccgagcaacctggcggcagcgcaaaagatg

SEQ ID NO: 34381 - DNA, 103 bp, Artificial Sequence
  Synthetic Polynucleotide
taatacgactcactatagggtgtttgggggggtcgacctggatgcgaatgaacagaggagacattcgatgccaggtcgaaacctggcggcagcgcaaaagatg

SEQ ID NO: 34382 - DNA, 103 bp, Artificial Sequence
  Synthetic Polynucleotide
taatacgactcactatagggttagcggaatatagagccatcccgttaaacaacagaggagagtttaaatggatggctctaacctggcggcagcgcaaaagatg

SEQ ID NO: 34383 - DNA, 103 bp, Artificial Sequence
  Synthetic Polynucleotide
taatacgactcactataggggtcagacgagtaaatgctcttggggctccgaacagaggagacggagcatgaagagcattaacctggcggcagcgcaaaagatg

SEQ ID NO: 34384 - DNA, 103 bp, Artificial Sequence
  Synthetic Polynucleotide
taatacgactcactatagggtgtctatgggccttttgtttccgcaattttaacagaggagaaaaattatggaaacaaaaaacctggcggcagcgcaaaagatg

SEQ ID NO: 34385 - DNA, 103 bp, Artificial Sequence
  Synthetic Polynucleotide
taatacgactcactatagggaatcgacacgccatttcacattatggcaggaacagaggagacctgccatgatgtgaaataacctggcggcagcgcaaaagatg

SEQ ID NO: 34386 - DNA, 103 bp, Artificial Sequence
  Synthetic Polynucleotide
taatacgactcactatagggttaagaggatgaatacggggagtgcgcagtaacagaggagaactgcgatgtccccgtataacctggcggcagcgcaaaagatg

SEQ ID NO: 34387 - DNA, 103 bp, Artificial Sequence
  Synthetic Polynucleotide
taatacgactcactatagggcttcatggacgaagacaatctgcggcgcagaacagaggagactgcgcatgagattgtctaacctggcggcagcgcaaaagatg

SEQ ID NO: 34388 - DNA, 103 bp, Artificial Sequence
  Synthetic Polynucleotide
taatacgactcactataggggacgtgccaccctttggacgtctaattacaaacagaggagatgtaatatgacgtccaaaaacctggcggcagcgcaaaagatg

SEQ ID NO: 34389 - DNA, 103 bp, Artificial Sequence
  Synthetic Polynucleotide
taatacgactcactataggggccgagctttgcggtgcacggccctgttccaacagaggagaggaacaatgccgtgcaccaacctggcggcagcgcaaaagatg

SEQ ID NO: 34390 - DNA, 103 bp, Artificial Sequence
  Synthetic Polynucleotide
taatacgactcactatagggacccttacggcagaggtttgcgcgcccccgaacagaggagacgggggatggcaaacctcaacctggcggcagcgcaaaagatg

SEQ ID NO: 34391 - DNA, 103 bp, Artificial Sequence
  Synthetic Polynucleotide
taatacgactcactatagggactcgagttggcacggcatgatattatgcgaacagaggagacgcataatgtcatgccgtaacctggcggcagcgcaaaagatg

SEQ ID NO: 34392 - DNA, 103 bp, Artificial Sequence
  Synthetic Polynucleotide
taatacgactcactatagggcccgcgatcgggagtactcgaatccgccgtaacagaggagaacggcgatgtcgagtactaacctggcggcagcgcaaaagatg

SEQ ID NO: 34393 - DNA, 103 bp, Artificial Sequence
  Synthetic Polynucleotide
taatacgactcactatagggatgcaattcggcgagtagcgttcacgcgtgaacagaggagacacgcgatgacgctactcaacctggcggcagcgcaaaagatg

SEQ ID NO: 34394 - DNA, 103 bp, Artificial Sequence
  Synthetic Polynucleotide
taatacgactcactatagggccctcgtcatttaccgaagatgctcgcagtaacagaggagaactgcgatgatcttcggtaacctggcggcagcgcaaaagatg

SEQ ID NO: 34395 - DNA, 103 bp, Artificial Sequence
  Synthetic Polynucleotide
taatacgactcactatagggagaccaaagcaaggctcatattgccattaaaacagaggagattaatgatgatatgagccaacctggcggcagcgcaaaagatg

SEQ ID NO: 34396 - DNA, 103 bp, Artificial Sequence
  Synthetic Polynucleotide
taatacgactcactatagggtcgcgctgtggtgacagctgctcggcatctaacagaggagaagatgcatggcagctgtcaacctggcggcagcgcaaaagatg

SEQ ID NO: 34397 - DNA, 103 bp, Artificial Sequence
  Synthetic Polynucleotide
taatacgactcactataggggggggtctcgcgcacgtaccttagttcttgaacagaggagacaagaaatgaggtacgtgaacctggcggcagcgcaaaagatg

SEQ ID NO: 34398 - DNA, 103 bp, Artificial Sequence
  Synthetic Polynucleotide
taatacgactcactatagggcgctgatgctctatacggtgatagacgcctaacagaggagaaggcgtatgtcaccgtataacctggcggcagcgcaaaagatg

SEQ ID NO: 34399 - DNA, 103 bp, Artificial Sequence
  Synthetic Polynucleotide
taatacgactcactatagggctcggcgatctgtcaagatcgggtaaatctaacagaggagaagatttatgcgatcttgaaacctggcggcagcgcaaaagatg

SEQ ID NO: 34400 - DNA, 103 bp, Artificial Sequence
  Synthetic Polynucleotide
taatacgactcactataggggtttcacaggtatgccctacgttggattgtaacagaggagaacaatcatgcgtagggcaaacctggcggcagcgcaaaagatg

SEQ ID NO: 34401 - DNA, 103 bp, Artificial Sequence
  Synthetic Polynucleotide
taatacgactcactatagggcctatgctcggtctgactataaaatatggcaacagaggagagccataatgtatagtcagaacctggcggcagcgcaaaagatg

SEQ ID NO: 34402 - DNA, 103 bp, Artificial Sequence
  Synthetic Polynucleotide
taatacgactcactatagggaccgtgaggtccaggttgaggcgccctagtaacagaggagaactaggatgcctcaacctaacctggcggcagcgcaaaagatg

SEQ ID NO: 34403 - DNA, 103 bp, Artificial Sequence
  Synthetic Polynucleotide
taatacgactcactatagggttttgactcctgaaaggtctgcccactgagaacagaggagactcagtatgcagacctttaacctggcggcagcgcaaaagatg

SEQ ID NO: 34404 - DNA, 103 bp, Artificial Sequence
  Synthetic Polynucleotide
taatacgactcactatagggattgactctgctcgcctcgcggcatgatctaacagaggagaagatcaatgcgcgaggcgaacctggcggcagcgcaaaagatg

SEQ ID NO: 34405 - DNA, 103 bp, Artificial Sequence
  Synthetic Polynucleotide
taatacgactcactatagggggagacttgaggacaaagatctatgttaggaacagaggagacctaacatggatctttgtaacctggcggcagcgcaaaagatg

SEQ ID NO: 34406 - DNA, 103 bp, Artificial Sequence
  Synthetic Polynucleotide
taatacgactcactatagggtgtgctctaagtttagtcctctttaccgagaacagaggagactcggtatggaggactaaaacctggcggcagcgcaaaagatg

SEQ ID NO: 34407 - DNA, 103 bp, Artificial Sequence
  Synthetic Polynucleotide
taatacgactcactatagggtctcacaggcaatgtgagacatccgtgacgaacagaggagacgtcacatgtgtctcacaaacctggcggcagcgcaaaagatg

SEQ ID NO: 34408 - DNA, 103 bp, Artificial Sequence
  Synthetic Polynucleotide
taatacgactcactataggggtcgtgtctagctggctctgtggccagctcaacagaggagagagctgatgacagagccaaacctggcggcagcgcaaaagatg

SEQ ID NO: 34409 - DNA, 103 bp, Artificial Sequence
  Synthetic Polynucleotide
taatacgactcactatagggcgcaatcccatccttgcctgtcatagaattaacagaggagaaattctatgacaggcaagaacctggcggcagcgcaaaagatg

SEQ ID NO: 34410 - DNA, 103 bp, Artificial Sequence
  Synthetic Polynucleotide
taatacgactcactatagggctgggttatgagtctggagtggattagaggaacagaggagacctctaatgcactccagaaacctggcggcagcgcaaaagatg

SEQ ID NO: 34411 - DNA, 103 bp, Artificial Sequence
  Synthetic Polynucleotide
taatacgactcactatagggaaatcttattgctagacgtgtaggtcgcgtaacagaggagaacgcgaatgacacgtctaaacctggcggcagcgcaaaagatg

SEQ ID NO: 34412 - DNA, 103 bp, Artificial Sequence
  Synthetic Polynucleotide
taatacgactcactatagggcgcctgacactcggggttggtacggggtgtaacagaggagaacacccatgaccaaccccaacctggcggcagcgcaaaagatg

SEQ ID NO: 34413 - DNA, 103 bp, Artificial Sequence
  Synthetic Polynucleotide
taatacgactcactatagggtaagcacctcaacccgcatgtattcactgcaacagaggagagcagtgatgacatgcgggaacctggcggcagcgcaaaagatg

SEQ ID NO: 34414 - DNA, 103 bp, Artificial Sequence
  Synthetic Polynucleotide
taatacgactcactatagggttccaccatgttacgggtgaactttcaaagaacagaggagactttgaatgttcacccgtaacctggcggcagcgcaaaagatg

SEQ ID NO: 34415 - DNA, 103 bp, Artificial Sequence
  Synthetic Polynucleotide
taatacgactcactatagggctgctccggcgagacgaaacgatcgtttccaacagaggagaggaaacatgcgtttcgtcaacctggcggcagcgcaaaagatg

SEQ ID NO: 34416 - DNA, 103 bp, Artificial Sequence
  Synthetic Polynucleotide
taatacgactcactatagggtcgttcctgggccaaacagactgcaatgacaacagaggagagtcattatggtctgtttgaacctggcggcagcgcaaaagatg

SEQ ID NO: 34417 - DNA, 103 bp, Artificial Sequence
  Synthetic Polynucleotide
taatacgactcactataggggatccgcgtatcgtggtccaagccaaatataacagaggagaatatttatgttggaccacaacctggcggcagcgcaaaagatg

SEQ ID NO: 34418 - DNA, 103 bp, Artificial Sequence
  Synthetic Polynucleotide
taatacgactcactatagggcgatgcaaaagatgccacgctctctagcctaacagaggagaaggctaatgagcgtggcaaacctggcggcagcgcaaaagatg

SEQ ID NO: 34419 - DNA, 103 bp, Artificial Sequence
  Synthetic Polynucleotide
taatacgactcactatagggtttggtgtctaagttttctttacttgaccaaacagaggagatggtcaatgaaagaaaacaacctggcggcagcgcaaaagatg

SEQ ID NO: 34420 - DNA, 103 bp, Artificial Sequence
  Synthetic Polynucleotide
taatacgactcactatagggcatactcgacaatacagggaattggaaataaacagaggagatatttcatgttccctgtaaacctggcggcagcgcaaaagatg

SEQ ID NO: 34421 - DNA, 103 bp, Artificial Sequence
  Synthetic Polynucleotide
taatacgactcactatagggggccaagaactactccggcttcgggatgcgaacagaggagacgcatcatgaagccggagaacctggcggcagcgcaaaagatg

SEQ ID NO: 34422 - DNA, 103 bp, Artificial Sequence
  Synthetic Polynucleotide
taatacgactcactatagggtaatgcttcaggtatgggcagcggggcggtaacagaggagaaccgccatgctgcccataaacctggcggcagcgcaaaagatg

SEQ ID NO: 34423 - DNA, 103 bp, Artificial Sequence
  Synthetic Polynucleotide
taatacgactcactatagggagcggccccaacgaagtcaccctattgcgcaacagaggagagcgcaaatgggtgacttcaacctggcggcagcgcaaaagatg

SEQ ID NO: 34424 - DNA, 103 bp, Artificial Sequence
  Synthetic Polynucleotide
taatacgactcactatagggctcccctctggttggcgcgtacactccccaaacagaggagatggggaatgtacgcgccaaacctggcggcagcgcaaaagatg

SEQ ID NO: 34425 - DNA, 103 bp, Artificial Sequence
  Synthetic Polynucleotide
taatacgactcactatagggttcacctctttatcaactcccatgtcgcataacagaggagaatgcgaatggggagttgaaacctggcggcagcgcaaaagatg

SEQ ID NO: 34426 - DNA, 103 bp, Artificial Sequence
  Synthetic Polynucleotide
taatacgactcactatagggtttactatcgctaagattagattatgacagaacagaggagactgtcaatgtctaatcttaacctggcggcagcgcaaaagatg

SEQ ID NO: 34427 - DNA, 103 bp, Artificial Sequence
  Synthetic Polynucleotide
taatacgactcactatagggtacagcgtttgctcgaactactgtgatcggaacagaggagaccgatcatggtagttcgaaacctggcggcagcgcaaaagatg

SEQ ID NO: 34428 - DNA, 103 bp, Artificial Sequence
  Synthetic Polynucleotide
taatacgactcactatagggattcacgattaactgccatgtgactttacgaacagaggagacgtaaaatgacatggcagaacctggcggcagcgcaaaagatg

SEQ ID NO: 34429 - DNA, 103 bp, Artificial Sequence
  Synthetic Polynucleotide
taatacgactcactatagggtgaggttggcgatagacaattagtcatgagaacagaggagactcatgatgaattgtctaaacctggcggcagcgcaaaagatg

SEQ ID NO: 34430 - DNA, 103 bp, Artificial Sequence
  Synthetic Polynucleotide
taatacgactcactatagggcttttcggacactaagcagcacaggccttcaacagaggagagaaggcatgtgctgcttaaacctggcggcagcgcaaaagatg

SEQ ID NO: 34431 - DNA, 103 bp, Artificial Sequence
  Synthetic Polynucleotide
taatacgactcactatagggatcgccttgatctttagaactcttttgaaaaacagaggagatttcaaatgagttctaaaaacctggcggcagcgcaaaagatg

SEQ ID NO: 34432 - DNA, 103 bp, Artificial Sequence
  Synthetic Polynucleotide
taatacgactcactatagggccccggtcatatggcatacttcggatggtaaacagaggagataccatatgaagtatgccaacctggcggcagcgcaaaagatg

SEQ ID NO: 34433 - DNA, 103 bp, Artificial Sequence
  Synthetic Polynucleotide
taatacgactcactatagggggggcatactagacgtgaagtaacgtggagaacagaggagactccacatgacttcacgtaacctggcggcagcgcaaaagatg

SEQ ID NO: 34434 - DNA, 103 bp, Artificial Sequence
  Synthetic Polynucleotide
taatacgactcactatagggatccgtctggggattcgcgggagatacaagaacagaggagacttgtaatgcccgcgaataacctggcggcagcgcaaaagatg

SEQ ID NO: 34435 - DNA, 103 bp, Artificial Sequence
  Synthetic Polynucleotide
taatacgactcactatagggtcgcgccattgtcaatatctccgtacacttaacagaggagaaagtgtatggagatattgaacctggcggcagcgcaaaagatg

SEQ ID NO: 34436 - DNA, 103 bp, Artificial Sequence
  Synthetic Polynucleotide
taatacgactcactataggggccatgaacaagagtacacgactcaaaaacaacagaggagagtttttatgtcgtgtactaacctggcggcagcgcaaaagatg

SEQ ID NO: 34437 - DNA, 103 bp, Artificial Sequence
  Synthetic Polynucleotide
taatacgactcactatagggtcgaattcggatttcgaagggccagggcacaacagaggagagtgcccatgcccttcgaaaacctggcggcagcgcaaaagatg

SEQ ID NO: 34438 - DNA, 103 bp, Artificial Sequence
  Synthetic Polynucleotide
taatacgactcactatagggatcgcaaagagaccacgatgagtgtctaaaaacagaggagatttagaatgtcatcgtggaacctggcggcagcgcaaaagatg

SEQ ID NO: 34439 - DNA, 103 bp, Artificial Sequence
  Synthetic Polynucleotide
taatacgactcactatagggtcgttttccttatttcttcgcggacaggtgaacagaggagacacctgatggcgaagaaaaacctggcggcagcgcaaaagatg

SEQ ID NO: 34440 - DNA, 103 bp, Artificial Sequence
  Synthetic Polynucleotide
taatacgactcactataggggggcggcgccttcacaatgccgcgcccaggaacagaggagacctgggatgggcattgtgaacctggcggcagcgcaaaagatg

SEQ ID NO: 34441 - DNA, 103 bp, Artificial Sequence
  Synthetic Polynucleotide
taatacgactcactatagggctcgtacatgcgttaaatagccagtcggaaaacagaggagattccgaatggctatttaaaacctggcggcagcgcaaaagatg

SEQ ID NO: 34442 - DNA, 103 bp, Artificial Sequence
  Synthetic Polynucleotide
taatacgactcactatagggcgccaggtctcctgatggtcccctcgttccaacagaggagaggaacgatgggaccatcaaacctggcggcagcgcaaaagatg

SEQ ID NO: 34443 - DNA, 103 bp, Artificial Sequence
  Synthetic Polynucleotide
taatacgactcactatagggaatgatttaactcccaggagcctcaaattgaacagaggagacaatttatggctcctgggaacctggcggcagcgcaaaagatg

SEQ ID NO: 34444 - DNA, 103 bp, Artificial Sequence
  Synthetic Polynucleotide
taatacgactcactatagggttgttgcagcctgaactctcgacgaagcggaacagaggagaccgcttatgcgagagttcaacctggcggcagcgcaaaagatg

SEQ ID NO: 34445 - DNA, 103 bp, Artificial Sequence
  Synthetic Polynucleotide
taatacgactcactatagggttaagttgccgctgcccgccaccgtcacctaacagaggagaaggtgaatgtggcgggcaaacctggcggcagcgcaaaagatg

SEQ ID NO: 34446 - DNA, 103 bp, Artificial Sequence
  Synthetic Polynucleotide
taatacgactcactatagggcctcagtgaagcacaaggacatgcataaaaaacagaggagattttatatgtgtccttgtaacctggcggcagcgcaaaagatg

SEQ ID NO: 34447 - DNA, 103 bp, Artificial Sequence
  Synthetic Polynucleotide
taatacgactcactatagggtaggcctagtcctggcgatgcaccaaatagaacagaggagactatttatggcatcgccaaacctggcggcagcgcaaaagatg

SEQ ID NO: 34448 - DNA, 103 bp, Artificial Sequence
  Synthetic Polynucleotide
taatacgactcactatagggtcgccgaaatgccgggcacgcctactttacaacagaggagagtaaagatggcgtgcccgaacctggcggcagcgcaaaagatg

SEQ ID NO: 34449 - DNA, 103 bp, Artificial Sequence
  Synthetic Polynucleotide
taatacgactcactatagggaatggtccatcgaacacgtttatcatcgggaacagaggagacccgatatgaaacgtgttaacctggcggcagcgcaaaagatg

SEQ ID NO: 34450 - DNA, 103 bp, Artificial Sequence
  Synthetic Polynucleotide
taatacgactcactataggggcattccgttctggaatcttattttcttccaacagaggagaggaagaatgtaagattccaacctggcggcagcgcaaaagatg

SEQ ID NO: 34451 - DNA, 103 bp, Artificial Sequence
  Synthetic Polynucleotide
taatacgactcactatagggattcccaccccagggtcttatccggccggcaacagaggagagccggcatgataagacccaacctggcggcagcgcaaaagatg

SEQ ID NO: 34452 - DNA, 103 bp, Artificial Sequence
  Synthetic Polynucleotide
taatacgactcactatagggaaacggcaagtagtgggaaccactcttgtgaacagaggagacacaagatgggttcccacaacctggcggcagcgcaaaagatg

SEQ ID NO: 34453 - DNA, 103 bp, Artificial Sequence
  Synthetic Polynucleotide
taatacgactcactatagggctatcgcgtactatcgcctcgactccgaataacagaggagaattcggatgcgaggcgataacctggcggcagcgcaaaagatg

SEQ ID NO: 34454 - DNA, 103 bp, Artificial Sequence
  Synthetic Polynucleotide
taatacgactcactatagggtacaagacgaccctgacgatcattacgttcaacagaggagagaacgtatggatcgtcagaacctggcggcagcgcaaaagatg

SEQ ID NO: 34455 - DNA, 103 bp, Artificial Sequence
  Synthetic Polynucleotide
taatacgactcactatagggcaagggtgacctgaagcgaggtagctaactaacagaggagaagttagatgcctcgcttcaacctggcggcagcgcaaaagatg

SEQ ID NO: 34456 - DNA, 103 bp, Artificial Sequence
  Synthetic Polynucleotide
taatacgactcactatagggcacctggggctatgccttctccgccccactaacagaggagaagtgggatggagaaggcaaacctggcggcagcgcaaaagatg

SEQ ID NO: 34457 - DNA, 103 bp, Artificial Sequence
  Synthetic Polynucleotide
taatacgactcactatagggtagcaactggtgtctatgaggtttctccgaaacagaggagatcggagatgcctcatagaaacctggcggcagcgcaaaagatg

SEQ ID NO: 34458 - DNA, 103 bp, Artificial Sequence
  Synthetic Polynucleotide
taatacgactcactatagggttgtgatcttgccatgataaagcgtcagagaacagaggagactctgaatgtttatcatgaacctggcggcagcgcaaaagatg

SEQ ID NO: 34459 - DNA, 103 bp, Artificial Sequence
  Synthetic Polynucleotide
taatacgactcactatagggataggggcgatccatgtgataagcctccaaaacagaggagattggagatgtatcacatgaacctggcggcagcgcaaaagatg

SEQ ID NO: 34460 - DNA, 103 bp, Artificial Sequence
  Synthetic Polynucleotide
taatacgactcactatagggtgttgggacaagactctaattcgctttctgaacagaggagacagaaaatgaattagagtaacctggcggcagcgcaaaagatg

SEQ ID NO: 34461 - DNA, 103 bp, Artificial Sequence
  Synthetic Polynucleotide
taatacgactcactataggggtcgaacgtcagctccagacgagaaaatcaaacagaggagatgatttatgcgtctggagaacctggcggcagcgcaaaagatg

SEQ ID NO: 34462 - DNA, 103 bp, Artificial Sequence
  Synthetic Polynucleotide
taatacgactcactatagggacttaccagtcgaaggggagtgagtgtccaaacagaggagatggacaatgactccccttaacctggcggcagcgcaaaagatg

SEQ ID NO: 34463 - DNA, 103 bp, Artificial Sequence
  Synthetic Polynucleotide
taatacgactcactatagggacatgagctccacaacgcgtcaaagaaataaacagaggagatatttcatggacgcgttgaacctggcggcagcgcaaaagatg

SEQ ID NO: 34464 - DNA, 103 bp, Artificial Sequence
  Synthetic Polynucleotide
taatacgactcactatagggcagaccggcttaatgatacccaagttcgacaacagaggagagtcgaaatggggtatcataacctggcggcagcgcaaaagatg

SEQ ID NO: 34465 - DNA, 103 bp, Artificial Sequence
  Synthetic Polynucleotide
taatacgactcactatagggaccttgtgacgcgctgcaattacactgctaaacagaggagatagcagatgaattgcagcaacctggcggcagcgcaaaagatg

SEQ ID NO: 34466 - DNA, 103 bp, Artificial Sequence
  Synthetic Polynucleotide
taatacgactcactatagggtagtcttgactttactttacttgcgtccaaaacagaggagattggacatgagtaaagtaaacctggcggcagcgcaaaagatg

SEQ ID NO: 34467 - DNA, 103 bp, Artificial Sequence
  Synthetic Polynucleotide
taatacgactcactatagggtcgtgatggcgacgcgcactaagctacgaaaacagaggagattcgtaatgtagtgcgcgaacctggcggcagcgcaaaagatg

SEQ ID NO: 34468 - DNA, 103 bp, Artificial Sequence
  Synthetic Polynucleotide
taatacgactcactataggggctggttcgtgggagttacttaccatgataaacagaggagatatcatatgaagtaactcaacctggcggcagcgcaaaagatg

SEQ ID NO: 34469 - DNA, 103 bp, Artificial Sequence
  Synthetic Polynucleotide
taatacgactcactatagggtattaagaggatgactcttgtaccagagggaacagaggagaccctctatgacaagagtcaacctggcggcagcgcaaaagatg

SEQ ID NO: 34470 - DNA, 103 bp, Artificial Sequence
  Synthetic Polynucleotide
taatacgactcactataggggagagatctggtcgtacagaacacactcgtaacagaggagaacgagtatgttctgtacgaacctggcggcagcgcaaaagatg

SEQ ID NO: 34471 - DNA, 103 bp, Artificial Sequence
  Synthetic Polynucleotide
taatacgactcactataggggctcgtagggtaccgaacagtacctctgccaacagaggagaggcagaatgactgttcggaacctggcggcagcgcaaaagatg

SEQ ID NO: 34472 - DNA, 103 bp, Artificial Sequence
  Synthetic Polynucleotide
taatacgactcactatagggtttacccgaaggcgaaagtctgagttttgcaacagaggagagcaaaaatgagactttcgaacctggcggcagcgcaaaagatg

SEQ ID NO: 34473 - DNA, 103 bp, Artificial Sequence
  Synthetic Polynucleotide
taatacgactcactatagggttaagcggagtaacggagtcgtaatacggcaacagaggagagccgtaatgcgactccgtaacctggcggcagcgcaaaagatg

SEQ ID NO: 34474 - DNA, 103 bp, Artificial Sequence
  Synthetic Polynucleotide
taatacgactcactatagggagaactaaggtgcagtcgtatgagctgtacaacagaggagagtacagatgatacgactgaacctggcggcagcgcaaaagatg

SEQ ID NO: 34475 - DNA, 103 bp, Artificial Sequence
  Synthetic Polynucleotide
taatacgactcactatagggacattttgaaagcttgaacactgtagtacaaacagaggagatgtactatggtgttcaagaacctggcggcagcgcaaaagatg

SEQ ID NO: 34476 - DNA, 103 bp, Artificial Sequence
  Synthetic Polynucleotide
taatacgactcactatagggaggtatcagtgcattcttcggacggttatcaacagaggagagataacatgccgaagaataacctggcggcagcgcaaaagatg

SEQ ID NO: 34477 - DNA, 103 bp, Artificial Sequence
  Synthetic Polynucleotide
taatacgactcactatagggatttcaactggcttagtggcgctcagcattaacagaggagaaatgctatgcgccactaaaacctggcggcagcgcaaaagatg

SEQ ID NO: 34478 - DNA, 103 bp, Artificial Sequence
  Synthetic Polynucleotide
taatacgactcactatagggtatcatatcacgtgtgaggggaccatcagtaacagaggagaactgatatgcccctcacaaacctggcggcagcgcaaaagatg

SEQ ID NO: 34479 - DNA, 103 bp, Artificial Sequence
  Synthetic Polynucleotide
taatacgactcactatagggtgtagccccgaaccatcgaagtttgcaggaaacagaggagatcctgcatgcttcgatggaacctggcggcagcgcaaaagatg

SEQ ID NO: 34480 - DNA, 103 bp, Artificial Sequence
  Synthetic Polynucleotide
taatacgactcactatagggttgcagagcgaagaggacggaaccaatactaacagaggagaagtattatgtccgtcctcaacctggcggcagcgcaaaagatg

SEQ ID NO: 34481 - DNA, 103 bp, Artificial Sequence
  Synthetic Polynucleotide
taatacgactcactatagggcatacttatcactttgctacgagcttcagcaacagaggagagctgaaatgcgtagcaaaaacctggcggcagcgcaaaagatg

SEQ ID NO: 34482 - DNA, 103 bp, Artificial Sequence
  Synthetic Polynucleotide
taatacgactcactatagggcatttgtttttccttgagttcgcataacgtaacagaggagaacgttaatggaactcaagaacctggcggcagcgcaaaagatg

SEQ ID NO: 34483 - DNA, 103 bp, Artificial Sequence
  Synthetic Polynucleotide
taatacgactcactatagggggtatgaagctccgctgtagcacgactgccaacagaggagaggcagtatggctacagcgaacctggcggcagcgcaaaagatg

SEQ ID NO: 34484 - DNA, 103 bp, Artificial Sequence
  Synthetic Polynucleotide
taatacgactcactataggggaatttacttccgtcaccgtagcgccagacaacagaggagagtctggatgtacggtgacaacctggcggcagcgcaaaagatg

SEQ ID NO: 34485 - DNA, 103 bp, Artificial Sequence
  Synthetic Polynucleotide
taatacgactcactatagggagtggatattccaccgctgacatcggactaaacagaggagatagtccatggtcagcggtaacctggcggcagcgcaaaagatg

SEQ ID NO: 34486 - DNA, 103 bp, Artificial Sequence
  Synthetic Polynucleotide
taatacgactcactataggggttctgttccgtgacgaggcataatcacacaacagaggagagtgtgaatgtgcctcgtcaacctggcggcagcgcaaaagatg

SEQ ID NO: 34487 - DNA, 103 bp, Artificial Sequence
  Synthetic Polynucleotide
taatacgactcactatagggcgcaacaacccacgatcgatggcattaggcaacagaggagagcctaaatgcatcgatcgaacctggcggcagcgcaaaagatg

SEQ ID NO: 34488 - DNA, 103 bp, Artificial Sequence
  Synthetic Polynucleotide
taatacgactcactatagggatttacgtccctagtcaacttctccgttctaacagaggagaagaacgatgaagttgactaacctggcggcagcgcaaaagatg

SEQ ID NO: 34489 - DNA, 103 bp, Artificial Sequence
  Synthetic Polynucleotide
taatacgactcactatagggtaaggaagcagacaatactaacgaattttaaacagaggagataaaatatgttagtattgaacctggcggcagcgcaaaagatg

SEQ ID NO: 34490 - DNA, 103 bp, Artificial Sequence
  Synthetic Polynucleotide
taatacgactcactatagggtatttgagtctatacgaaacaacgccacccaacagaggagagggtggatgtgtttcgtaaacctggcggcagcgcaaaagatg

SEQ ID NO: 34491 - DNA, 103 bp, Artificial Sequence
  Synthetic Polynucleotide
taatacgactcactatagggaacgcatagtttttcgtagcctcggactaaaacagaggagattagtcatgggctacgaaaacctggcggcagcgcaaaagatg

SEQ ID NO: 34492 - DNA, 103 bp, Artificial Sequence
  Synthetic Polynucleotide
taatacgactcactatagggggtcatccatcttctggaaatgaacctaagaacagaggagacttaggatgatttccagaaacctggcggcagcgcaaaagatg

SEQ ID NO: 34493 - DNA, 103 bp, Artificial Sequence
  Synthetic Polynucleotide
taatacgactcactatagggtgcacacacagtaacgagtgcgctcttgttaacagaggagaaacaagatggcactcgttaacctggcggcagcgcaaaagatg

SEQ ID NO: 34494 - DNA, 103 bp, Artificial Sequence
  Synthetic Polynucleotide
taatacgactcactataggggaggccaatttatcgttcttgatcttgcccaacagaggagagggcaaatgcaagaacgaaacctggcggcagcgcaaaagatg

SEQ ID NO: 34495 - DNA, 103 bp, Artificial Sequence
  Synthetic Polynucleotide
taatacgactcactatagggcaagcagtacacgttctcacatccgcaccaaacagaggagatggtgcatgtgtgagaacaacctggcggcagcgcaaaagatg

SEQ ID NO: 34496 - DNA, 103 bp, Artificial Sequence
  Synthetic Polynucleotide
taatacgactcactatagggaacttcttgagacgctagatactacgaaagaacagaggagactttcgatgtatctagcgaacctggcggcagcgcaaaagatg

SEQ ID NO: 34497 - DNA, 103 bp, Artificial Sequence
  Synthetic Polynucleotide
taatacgactcactataggggtatcgtagctcggctgccgtaaattaagcaacagaggagagcttaaatgacggcagccaacctggcggcagcgcaaaagatg

SEQ ID NO: 34498 - DNA, 103 bp, Artificial Sequence
  Synthetic Polynucleotide
taatacgactcactataggggcgtggggcgcttggcaaagaactactcccaacagaggagagggagtatgtctttgccaaacctggcggcagcgcaaaagatg

SEQ ID NO: 34499 - DNA, 103 bp, Artificial Sequence
  Synthetic Polynucleotide
taatacgactcactatagggccgcggtcctagtgtcacaagctggtagtgaacagaggagacactacatgcttgtgacaaacctggcggcagcgcaaaagatg

SEQ ID NO: 34500 - DNA, 103 bp, Artificial Sequence
  Synthetic Polynucleotide
taatacgactcactatagggatagaacagaagatggtgctatctggccgaaacagaggagatcggccatgtagcaccataacctggcggcagcgcaaaagatg

SEQ ID NO: 34501 - DNA, 103 bp, Artificial Sequence
  Synthetic Polynucleotide
taatacgactcactatagggtcctgccgtacttaaaaaagctcatcggcgaacagaggagacgccgaatggcttttttaaacctggcggcagcgcaaaagatg

SEQ ID NO: 34502 - DNA, 103 bp, Artificial Sequence
  Synthetic Polynucleotide
taatacgactcactataggggcgtcgggaagaagggtggtagggtctcggaacagaggagaccgagaatgtaccaccctaacctggcggcagcgcaaaagatg

SEQ ID NO: 34503 - DNA, 103 bp, Artificial Sequence
  Synthetic Polynucleotide
taatacgactcactatagggctccacgacaacataagccaggccacggccaacagaggagaggccgtatgctggcttataacctggcggcagcgcaaaagatg

SEQ ID NO: 34504 - DNA, 103 bp, Artificial Sequence
  Synthetic Polynucleotide
taatacgactcactataggggctaaaaacttcctccagggtaaaccttctaacagaggagaagaaggatgaccctggagaacctggcggcagcgcaaaagatg

SEQ ID NO: 34505 - DNA, 103 bp, Artificial Sequence
  Synthetic Polynucleotide
taatacgactcactatagggtttgcagcaccaagcgcgctaagggctccgaacagaggagacggagcatgtagcgcgctaacctggcggcagcgcaaaagatg

SEQ ID NO: 34506 - DNA, 103 bp, Artificial Sequence
  Synthetic Polynucleotide
taatacgactcactataggggtctttccatattgccaataaaaatgcttaaacagaggagataagcaatgttattggcaaacctggcggcagcgcaaaagatg

SEQ ID NO: 34507 - DNA, 103 bp, Artificial Sequence
  Synthetic Polynucleotide
taatacgactcactatagggtagaccagttggggccttgttaggctctgtaacagaggagaacagagatgaacaaggccaacctggcggcagcgcaaaagatg

SEQ ID NO: 34508 - DNA, 103 bp, Artificial Sequence
  Synthetic Polynucleotide
taatacgactcactatagggaggttctactctgtgaaattgtggatcctaaacagaggagataggatatgcaatttcacaacctggcggcagcgcaaaagatg

SEQ ID NO: 34509 - DNA, 103 bp, Artificial Sequence
  Synthetic Polynucleotide
taatacgactcactataggggggtcagcggagagcaccttataaactttcaacagaggagagaaagtatgtaaggtgctaacctggcggcagcgcaaaagatg

SEQ ID NO: 34510 - DNA, 103 bp, Artificial Sequence
  Synthetic Polynucleotide
taatacgactcactatagggcaccgaatcaccccgtgaggcagggggcgaaacagaggagatcgcccatggcctcacggaacctggcggcagcgcaaaagatg

SEQ ID NO: 34511 - DNA, 103 bp, Artificial Sequence
  Synthetic Polynucleotide
taatacgactcactataggggtagctatcgatttatatcggcgagtggtcaacagaggagagaccacatgccgatataaaacctggcggcagcgcaaaagatg

SEQ ID NO: 34512 - DNA, 103 bp, Artificial Sequence
  Synthetic Polynucleotide
taatacgactcactatagggtgcagccgggaatttcttcgaacaagttaaaacagaggagattaactatgtcgaagaaaaacctggcggcagcgcaaaagatg

SEQ ID NO: 34513 - DNA, 103 bp, Artificial Sequence
  Synthetic Polynucleotide
taatacgactcactatagggacagtcgcgcggggtgttcgcgtgcgcaagaacagaggagacttgcgatggcgaacaccaacctggcggcagcgcaaaagatg

SEQ ID NO: 34514 - DNA, 103 bp, Artificial Sequence
  Synthetic Polynucleotide
taatacgactcactatagggggaagggttggacattatcccgaaccaatgaacagaggagacattggatggggataatgaacctggcggcagcgcaaaagatg

SEQ ID NO: 34515 - DNA, 103 bp, Artificial Sequence
  Synthetic Polynucleotide
taatacgactcactatagggtacaggtcgattggtcgtgtctaccgccctaacagaggagaagggcgatggacacgaccaacctggcggcagcgcaaaagatg

SEQ ID NO: 34516 - DNA, 103 bp, Artificial Sequence
  Synthetic Polynucleotide
taatacgactcactatagggcgccagatacggaactacttatgtttttcgaacagaggagacgaaaaatgtaagtagttaacctggcggcagcgcaaaagatg

SEQ ID NO: 34517 - DNA, 103 bp, Artificial Sequence
  Synthetic Polynucleotide
taatacgactcactatagggtctgtgctcaccggaacatacgttagttaaaacagaggagattaactatggtatgttccaacctggcggcagcgcaaaagatg

SEQ ID NO: 34518 - DNA, 103 bp, Artificial Sequence
  Synthetic Polynucleotide
taatacgactcactatagggtgcgtgcagggatccttcagttctcatcggaacagaggagaccgatgatgactgaaggaaacctggcggcagcgcaaaagatg

SEQ ID NO: 34519 - DNA, 103 bp, Artificial Sequence
  Synthetic Polynucleotide
taatacgactcactatagggattctctagggtggaacacgctgcaccttaaacagaggagataaggtatggcgtgttccaacctggcggcagcgcaaaagatg

SEQ ID NO: 34520 - DNA, 103 bp, Artificial Sequence
  Synthetic Polynucleotide
taatacgactcactatagggaacctacggcttgcgctaatggacctgcagaacagaggagactgcagatgcattagcgcaacctggcggcagcgcaaaagatg

SEQ ID NO: 34521 - DNA, 103 bp, Artificial Sequence
  Synthetic Polynucleotide
taatacgactcactatagggttcgcggtggaattgatctattgtaactgaaacagaggagatcagttatgatagatcaaaacctggcggcagcgcaaaagatg

SEQ ID NO: 34522 - DNA, 103 bp, Artificial Sequence
  Synthetic Polynucleotide
taatacgactcactatagggcgcgttgtagagggtactctcatgcggcttaacagaggagaaagccgatggagagtaccaacctggcggcagcgcaaaagatg

SEQ ID NO: 34523 - DNA, 103 bp, Artificial Sequence
  Synthetic Polynucleotide
taatacgactcactataggggagcggcacgatttacaatatcagtctggtaacagaggagaaccagaatgatattgtaaaacctggcggcagcgcaaaagatg

SEQ ID NO: 34524 - DNA, 103 bp, Artificial Sequence
  Synthetic Polynucleotide
taatacgactcactatagggacgaaacctatggcgtgagccctgaaatcaaacagaggagatgatttatgggctcacgcaacctggcggcagcgcaaaagatg

SEQ ID NO: 34525 - DNA, 103 bp, Artificial Sequence
  Synthetic Polynucleotide
taatacgactcactatagggaagtcctaacacattaaagataagcagatgaacagaggagacatctgatgatctttaataacctggcggcagcgcaaaagatg

SEQ ID NO: 34526 - DNA, 103 bp, Artificial Sequence
  Synthetic Polynucleotide
taatacgactcactatagggcggctgtcccccatctcccgaaacccgctcaacagaggagagagcggatgtcgggagataacctggcggcagcgcaaaagatg

SEQ ID NO: 34527 - DNA, 103 bp, Artificial Sequence
  Synthetic Polynucleotide
taatacgactcactatagggagtatctctcctaccccattctaagagaccaacagaggagaggtctcatggaatggggtaacctggcggcagcgcaaaagatg

SEQ ID NO: 34528 - DNA, 103 bp, Artificial Sequence
  Synthetic Polynucleotide
taatacgactcactatagggttggcgcgtctcatagctggttgctcagtaaacagaggagatactgaatgaccagctataacctggcggcagcgcaaaagatg

SEQ ID NO: 34529 - DNA, 103 bp, Artificial Sequence
  Synthetic Polynucleotide
taatacgactcactatagggccacggacccatacaataactattacgtcgaacagaggagacgacgtatgagttattgtaacctggcggcagcgcaaaagatg

SEQ ID NO: 34530 - DNA, 103 bp, Artificial Sequence
  Synthetic Polynucleotide
taatacgactcactatagggagggagacgtaatacttcaacgttctagcgaacagaggagacgctagatggttgaagtaaacctggcggcagcgcaaaagatg

SEQ ID NO: 34531 - DNA, 103 bp, Artificial Sequence
  Synthetic Polynucleotide
taatacgactcactatagggagaacaagcaggggcccgttgttattgtacaacagaggagagtacaaatgcaacgggccaacctggcggcagcgcaaaagatg

SEQ ID NO: 34532 - DNA, 103 bp, Artificial Sequence
  Synthetic Polynucleotide
taatacgactcactatagggttgcacttggagagtggggtgatgtctggcaacagaggagagccagaatgcaccccactaacctggcggcagcgcaaaagatg

SEQ ID NO: 34533 - DNA, 103 bp, Artificial Sequence
  Synthetic Polynucleotide
taatacgactcactatagggttcctctctcctccttagccaatcccctgtaacagaggagaacagggatgtggctaaggaacctggcggcagcgcaaaagatg

SEQ ID NO: 34534 - DNA, 103 bp, Artificial Sequence
  Synthetic Polynucleotide
taatacgactcactatagggccctgtgtgcacgggcggtacatggttcccaacagaggagagggaacatggtaccgcccaacctggcggcagcgcaaaagatg

SEQ ID NO: 34535 - DNA, 103 bp, Artificial Sequence
  Synthetic Polynucleotide
taatacgactcactatagggggagacctcaacgcaattactagatcgaagaacagaggagacttcgaatgagtaattgcaacctggcggcagcgcaaaagatg

SEQ ID NO: 34536 - DNA, 103 bp, Artificial Sequence
  Synthetic Polynucleotide
taatacgactcactataggggtgatttcgacagaagccacccgtctccgtaacagaggagaacggagatgggtggcttcaacctggcggcagcgcaaaagatg

SEQ ID NO: 34537 - DNA, 103 bp, Artificial Sequence
  Synthetic Polynucleotide
taatacgactcactatagggaagttccttcgctgcatccatagcgccttcaacagaggagagaaggcatgatggatgcaaacctggcggcagcgcaaaagatg

SEQ ID NO: 34538 - DNA, 103 bp, Artificial Sequence
  Synthetic Polynucleotide
taatacgactcactatagggcagtacgcttgctctgcaaggtaggagataaacagaggagatatctcatgccttgcagaaacctggcggcagcgcaaaagatg

SEQ ID NO: 34539 - DNA, 103 bp, Artificial Sequence
  Synthetic Polynucleotide
taatacgactcactatagggcgccactaagactgcacgacctcccacaagaacagaggagacttgtgatgggtcgtgcaaacctggcggcagcgcaaaagatg

SEQ ID NO: 34540 - DNA, 103 bp, Artificial Sequence
  Synthetic Polynucleotide
taatacgactcactatagggagcggcgcaactatgaccctaggggatctcaacagaggagagagatcatgtagggtcataacctggcggcagcgcaaaagatg

SEQ ID NO: 34541 - DNA, 103 bp, Artificial Sequence
  Synthetic Polynucleotide
taatacgactcactatagggcaccaccgttcataatgacccccagtaaacaacagaggagagtttacatggggtcattaaacctggcggcagcgcaaaagatg

SEQ ID NO: 34542 - DNA, 103 bp, Artificial Sequence
  Synthetic Polynucleotide
taatacgactcactatagggttcagtcgatcagtgacaaagatcatgacaaacagaggagatgtcatatgctttgtcacaacctggcggcagcgcaaaagatg

SEQ ID NO: 34543 - DNA, 103 bp, Artificial Sequence
  Synthetic Polynucleotide
taatacgactcactatagggcatggatccttggggcacttttgaaaagcgaacagaggagacgctttatgaaagtgcccaacctggcggcagcgcaaaagatg

SEQ ID NO: 34544 - DNA, 103 bp, Artificial Sequence
  Synthetic Polynucleotide
taatacgactcactatagggtaagagccattgtcgttgtaaaatcagcccaacagaggagagggctgatgttacaacgaaacctggcggcagcgcaaaagatg

SEQ ID NO: 34545 - DNA, 103 bp, Artificial Sequence
  Synthetic Polynucleotide
taatacgactcactatagggaatgagctcctgtcacggggatcaggcgggaacagaggagacccgccatgtccccgtgaaacctggcggcagcgcaaaagatg

SEQ ID NO: 34546 - DNA, 103 bp, Artificial Sequence
  Synthetic Polynucleotide
taatacgactcactataggggccacatctgtacgggcgaaactacagggaaacagaggagatccctgatgtttcgcccgaacctggcggcagcgcaaaagatg

SEQ ID NO: 34547 - DNA, 103 bp, Artificial Sequence
  Synthetic Polynucleotide
taatacgactcactataggggcgcggagaccttcgaaaagttgcgcgtcgaacagaggagacgacgcatgacttttcgaaacctggcggcagcgcaaaagatg

SEQ ID NO: 34548 - DNA, 103 bp, Artificial Sequence
  Synthetic Polynucleotide
taatacgactcactatagggccaattaaggaggtctacagatctaactgtaacagaggagaacagttatgtctgtagacaacctggcggcagcgcaaaagatg

SEQ ID NO: 34549 - DNA, 103 bp, Artificial Sequence
  Synthetic Polynucleotide
taatacgactcactataggggctatgccgatggcgcggattgttagttcaaacagaggagatgaactatgaatccgcgcaacctggcggcagcgcaaaagatg

SEQ ID NO: 34550 - DNA, 103 bp, Artificial Sequence
  Synthetic Polynucleotide
taatacgactcactataggggtgtccattgcaggcctgtggtattatacaaacagaggagatgtataatgccacaggccaacctggcggcagcgcaaaagatg

SEQ ID NO: 34551 - DNA, 103 bp, Artificial Sequence
  Synthetic Polynucleotide
taatacgactcactatagggggctccacccatatcgagtgtgtcagttgtaacagaggagaacaactatgacactcgataacctggcggcagcgcaaaagatg

SEQ ID NO: 34552 - DNA, 103 bp, Artificial Sequence
  Synthetic Polynucleotide
taatacgactcactatagggtcttcagttttttttcatatgagatcgctcaacagaggagagagcgaatgcatatgaaaaacctggcggcagcgcaaaagatg

SEQ ID NO: 34553 - DNA, 103 bp, Artificial Sequence
  Synthetic Polynucleotide
taatacgactcactataggggtatgatgaatgaggagcacctcaactacaaacagaggagatgtagtatgggtgctcctaacctggcggcagcgcaaaagatg

SEQ ID NO: 34554 - DNA, 103 bp, Artificial Sequence
  Synthetic Polynucleotide
taatacgactcactatagggttacctaacgctcggtgaccccctctaattaacagaggagaaattagatggggtcaccgaacctggcggcagcgcaaaagatg

SEQ ID NO: 34555 - DNA, 103 bp, Artificial Sequence
  Synthetic Polynucleotide
taatacgactcactatagggtagccgatccctaacacggaggtgcccgtcaacagaggagagacgggatgctccgtgttaacctggcggcagcgcaaaagatg

SEQ ID NO: 34556 - DNA, 103 bp, Artificial Sequence
  Synthetic Polynucleotide
taatacgactcactatagggatataatctttgaacagagcatcattctcgaacagaggagacgagaaatgtgctctgttaacctggcggcagcgcaaaagatg

SEQ ID NO: 34557 - DNA, 103 bp, Artificial Sequence
  Synthetic Polynucleotide
taatacgactcactataggggggttagtacggtaaaggttcaagagctctaacagaggagaagagctatggaacctttaaacctggcggcagcgcaaaagatg

SEQ ID NO: 34558 - DNA, 103 bp, Artificial Sequence
  Synthetic Polynucleotide
taatacgactcactatagggggggaacccgggctcgaggtttagacgcttaacagaggagaaagcgtatgaacctcgagaacctggcggcagcgcaaaagatg

SEQ ID NO: 34559 - DNA, 103 bp, Artificial Sequence
  Synthetic Polynucleotide
taatacgactcactataggggtgactctccaatggaaaacgcgctcactcaacagaggagagagtgaatgcgttttccaaacctggcggcagcgcaaaagatg

SEQ ID NO: 34560 - DNA, 103 bp, Artificial Sequence
  Synthetic Polynucleotide
taatacgactcactatagggatctcaatggattaatttatgtgccggtttaacagaggagaaaaccgatgcataaattaaacctggcggcagcgcaaaagatg

SEQ ID NO: 34561 - DNA, 103 bp, Artificial Sequence
  Synthetic Polynucleotide
taatacgactcactataggggaatcgaggagggtagtcgaccgatctacaaacagaggagatgtagaatggtcgactacaacctggcggcagcgcaaaagatg

SEQ ID NO: 34562 - DNA, 103 bp, Artificial Sequence
  Synthetic Polynucleotide
taatacgactcactatagggcagccagtgcaatttaggatcgttttattaaacagaggagataataaatggatcctaaaaacctggcggcagcgcaaaagatg

SEQ ID NO: 34563 - DNA, 103 bp, Artificial Sequence
  Synthetic Polynucleotide
taatacgactcactatagggaaatcctgtccaagtaggacaaccgtacaaaacagaggagattgtacatgtgtcctactaacctggcggcagcgcaaaagatg

SEQ ID NO: 34564 - DNA, 103 bp, Artificial Sequence
  Synthetic Polynucleotide
taatacgactcactataggggcaatgatccgcatgatcgccgcattgtacaacagaggagagtacaaatgggcgatcataacctggcggcagcgcaaaagatg

SEQ ID NO: 34565 - DNA, 103 bp, Artificial Sequence
  Synthetic Polynucleotide
taatacgactcactatagggtattgttgcaaggcgtgtactattatgaagaacagaggagacttcatatgagtacacgcaacctggcggcagcgcaaaagatg

SEQ ID NO: 34566 - DNA, 103 bp, Artificial Sequence
  Synthetic Polynucleotide
taatacgactcactatagggtcatccaggattctgggtttcgtgtgggataacagaggagaatcccaatggaaacccagaacctggcggcagcgcaaaagatg

SEQ ID NO: 34567 - DNA, 103 bp, Artificial Sequence
  Synthetic Polynucleotide
taatacgactcactatagggcacttgacgcggaaaatccagatggaggcgaacagaggagacgcctcatgctggattttaacctggcggcagcgcaaaagatg

SEQ ID NO: 34568 - DNA, 103 bp, Artificial Sequence
  Synthetic Polynucleotide
taatacgactcactatagggcggcggtcaactgttcaccttgtgagggaaaacagaggagattccctatgaaggtgaacaacctggcggcagcgcaaaagatg

SEQ ID NO: 34569 - DNA, 103 bp, Artificial Sequence
  Synthetic Polynucleotide
taatacgactcactatagggactctccgaggcgtaatcggtgccggtgttaacagaggagaaacaccatgaccgattacaacctggcggcagcgcaaaagatg

SEQ ID NO: 34570 - DNA, 103 bp, Artificial Sequence
  Synthetic Polynucleotide
taatacgactcactatagggtattgtagatcaccgtgtagggctggagtcaacagaggagagactccatgcctacacggaacctggcggcagcgcaaaagatg

SEQ ID NO: 34571 - DNA, 103 bp, Artificial Sequence
  Synthetic Polynucleotide
taatacgactcactataggggctgacagatcctggctccgggaattctaaaacagaggagattagaaatgccggagccaaacctggcggcagcgcaaaagatg

SEQ ID NO: 34572 - DNA, 103 bp, Artificial Sequence
  Synthetic Polynucleotide
taatacgactcactatagggtgtacaggtccttattacacgctaggggctaacagaggagaagccccatgcgtgtaataaacctggcggcagcgcaaaagatg

SEQ ID NO: 34573 - DNA, 103 bp, Artificial Sequence
  Synthetic Polynucleotide
taatacgactcactatagggcaggttattgtcttagtgctggcggcttgtaacagaggagaacaagcatgcagcactaaaacctggcggcagcgcaaaagatg

SEQ ID NO: 34574 - DNA, 103 bp, Artificial Sequence
  Synthetic Polynucleotide
taatacgactcactatagggaaatgataagggactgctctactactggcaaacagaggagatgccagatgtagagcagtaacctggcggcagcgcaaaagatg

SEQ ID NO: 34575 - DNA, 103 bp, Artificial Sequence
  Synthetic Polynucleotide
taatacgactcactatagggtccactagcctagtccacgctttgagatgtaacagaggagaacatctatgagcgtggacaacctggcggcagcgcaaaagatg

SEQ ID NO: 34576 - DNA, 103 bp, Artificial Sequence
  Synthetic Polynucleotide
taatacgactcactatagggattcgaagcttaactgatatgatctgagaaaacagaggagattctcaatgcatatcagtaacctggcggcagcgcaaaagatg

SEQ ID NO: 34577 - DNA, 103 bp, Artificial Sequence
  Synthetic Polynucleotide
taatacgactcactatagggataagggtatcggttttactgccccacagcaacagaggagagctgtgatgcagtaaaacaacctggcggcagcgcaaaagatg

SEQ ID NO: 34578 - DNA, 103 bp, Artificial Sequence
  Synthetic Polynucleotide
taatacgactcactatagggttgtcttcgacgaagttagacgacggattgaacagaggagacaatccatggtctaacttaacctggcggcagcgcaaaagatg

SEQ ID NO: 34579 - DNA, 103 bp, Artificial Sequence
  Synthetic Polynucleotide
taatacgactcactatagggcagcagtccgatgtagaatcgttcctaagcaacagaggagagcttagatgcgattctacaacctggcggcagcgcaaaagatg

SEQ ID NO: 34580 - DNA, 103 bp, Artificial Sequence
  Synthetic Polynucleotide
taatacgactcactatagggcacgagaattccttgttccggacggaagcgaacagaggagacgcttcatgccggaacaaaacctggcggcagcgcaaaagatg

SEQ ID NO: 34581 - DNA, 103 bp, Artificial Sequence
  Synthetic Polynucleotide
taatacgactcactatagggcgtactagatgagacttgtatagcaaactgaacagaggagacagtttatgatacaagtcaacctggcggcagcgcaaaagatg

SEQ ID NO: 34582 - DNA, 103 bp, Artificial Sequence
  Synthetic Polynucleotide
taatacgactcactatagggactaaataagtgcttgcgacgacgcaaaataacagaggagaattttgatgcgtcgcaagaacctggcggcagcgcaaaagatg

SEQ ID NO: 34583 - DNA, 103 bp, Artificial Sequence
  Synthetic Polynucleotide
taatacgactcactatagggcgacagaacgactctttcgtgggtacagataacagaggagaatctgtatgcacgaaagaaacctggcggcagcgcaaaagatg

SEQ ID NO: 34584 - DNA, 103 bp, Artificial Sequence
  Synthetic Polynucleotide
taatacgactcactatagggacaagatgtcacccgaaaggtgcgcttgacaacagaggagagtcaagatgacctttcggaacctggcggcagcgcaaaagatg

SEQ ID NO: 34585 - DNA, 103 bp, Artificial Sequence
  Synthetic Polynucleotide
taatacgactcactatagggctttgactccctctaccactttgcatgcgtaacagaggagaacgcatatgaagtggtagaacctggcggcagcgcaaaagatg

SEQ ID NO: 34586 - DNA, 103 bp, Artificial Sequence
  Synthetic Polynucleotide
taatacgactcactatagggcttataggcgtttaagctgtggtgggccttaacagaggagaaaggccatgcacagcttaaacctggcggcagcgcaaaagatg

SEQ ID NO: 34587 - DNA, 103 bp, Artificial Sequence
  Synthetic Polynucleotide
taatacgactcactatagggcaccgacatatagatcagacattacgtcacaacagaggagagtgacgatgtgtctgatcaacctggcggcagcgcaaaagatg

SEQ ID NO: 34588 - DNA, 103 bp, Artificial Sequence
  Synthetic Polynucleotide
taatacgactcactatagggagttgttgtcagcccgctacaatgtcgcgaaacagaggagatcgcgaatgtgtagcgggaacctggcggcagcgcaaaagatg

SEQ ID NO: 34589 - DNA, 103 bp, Artificial Sequence
  Synthetic Polynucleotide
taatacgactcactataggggcgtaatgttcaacccgcctttattgcagtaacagaggagaactgcaatgaaggcgggtaacctggcggcagcgcaaaagatg

SEQ ID NO: 34590 - DNA, 103 bp, Artificial Sequence
  Synthetic Polynucleotide
taatacgactcactatagggcgtgggagagttcaagggcctagtaggtccaacagaggagaggacctatgaggcccttgaacctggcggcagcgcaaaagatg

SEQ ID NO: 34591 - DNA, 103 bp, Artificial Sequence
  Synthetic Polynucleotide
taatacgactcactatagggaggccatgtacaactgagcggctgcctaataacagaggagaattaggatgccgctcagtaacctggcggcagcgcaaaagatg

SEQ ID NO: 34592 - DNA, 103 bp, Artificial Sequence
  Synthetic Polynucleotide
taatacgactcactatagggaactgatgaattgtactacaaacttgtgttaacagaggagaaacacaatgttgtagtacaacctggcggcagcgcaaaagatg

SEQ ID NO: 34593 - DNA, 103 bp, Artificial Sequence
  Synthetic Polynucleotide
taatacgactcactatagggctcccccgcgaccgagaagacaactggtcgaacagaggagacgaccaatggtcttctcgaacctggcggcagcgcaaaagatg

SEQ ID NO: 34594 - DNA, 103 bp, Artificial Sequence
  Synthetic Polynucleotide
taatacgactcactataggggaaacccatggactataactgtctattcggaacagaggagaccgaatatgcagttatagaacctggcggcagcgcaaaagatg

SEQ ID NO: 34595 - DNA, 103 bp, Artificial Sequence
  Synthetic Polynucleotide
taatacgactcactataggggtcaatagtctctctgagtctgcgaggggtaacagaggagaacccctatgagactcagaaacctggcggcagcgcaaaagatg

SEQ ID NO: 34596 - DNA, 103 bp, Artificial Sequence
  Synthetic Polynucleotide
taatacgactcactatagggaccattgaaaggagtttatcacggtgatctaacagaggagaagatcaatgtgataaactaacctggcggcagcgcaaaagatg

SEQ ID NO: 34597 - DNA, 103 bp, Artificial Sequence
  Synthetic Polynucleotide
taatacgactcactatagggcaaaccgagaggcaagattaaggaaccggaaacagaggagatccggtatgttaatcttgaacctggcggcagcgcaaaagatg

SEQ ID NO: 34598 - DNA, 103 bp, Artificial Sequence
  Synthetic Polynucleotide
taatacgactcactataggggagattaacgtctgacgcgcccccaatgacaacagaggagagtcattatgggcgcgtcaaacctggcggcagcgcaaaagatg

SEQ ID NO: 34599 - DNA, 103 bp, Artificial Sequence
  Synthetic Polynucleotide
taatacgactcactatagggctccactcgtctagtcgggtagcagggttcaacagaggagagaacccatgtacccgactaacctggcggcagcgcaaaagatg

SEQ ID NO: 34600 - DNA, 103 bp, Artificial Sequence
  Synthetic Polynucleotide
taatacgactcactatagggaagaggcggaagtcttctactgaagctgctaacagaggagaagcagcatgagtagaagaaacctggcggcagcgcaaaagatg

SEQ ID NO: 34601 - DNA, 103 bp, Artificial Sequence
  Synthetic Polynucleotide
taatacgactcactatagggatgccgttttgtgttcagaattctaagttaaacagaggagataacttatgattctgaacaacctggcggcagcgcaaaagatg

SEQ ID NO: 34602 - DNA, 103 bp, Artificial Sequence
  Synthetic Polynucleotide
taatacgactcactatagggaggtcgagaagaagtcgtcatgccgagcttaacagaggagaaagctcatgatgacgactaacctggcggcagcgcaaaagatg

SEQ ID NO: 34603 - DNA, 103 bp, Artificial Sequence
  Synthetic Polynucleotide
taatacgactcactatagggttgtttgaatccatcgtgagaactagcgagaacagaggagactcgctatgtctcacgataacctggcggcagcgcaaaagatg

SEQ ID NO: 34604 - DNA, 103 bp, Artificial Sequence
  Synthetic Polynucleotide
taatacgactcactataggggctatatgtcatggaagcgtaccctaaattaacagaggagaaatttaatgtacgcttccaacctggcggcagcgcaaaagatg

SEQ ID NO: 34605 - DNA, 103 bp, Artificial Sequence
  Synthetic Polynucleotide
taatacgactcactatagggcaaatgtgacccctatcggcgcatactttgaacagaggagacaaagtatgcgccgatagaacctggcggcagcgcaaaagatg

SEQ ID NO: 34606 - DNA, 103 bp, Artificial Sequence
  Synthetic Polynucleotide
taatacgactcactatagggcgagcaacccttggatcattacatagactcaacagaggagagagtctatgtaatgatccaacctggcggcagcgcaaaagatg

SEQ ID NO: 34607 - DNA, 103 bp, Artificial Sequence
  Synthetic Polynucleotide
taatacgactcactatagggatttacacatttttaacagaaggctatgttaacagaggagaaacataatgttctgttaaaacctggcggcagcgcaaaagatg

SEQ ID NO: 34608 - DNA, 103 bp, Artificial Sequence
  Synthetic Polynucleotide
taatacgactcactatagggctacggtatgtaaataatcaattcggaactaacagaggagaagttccatgttgattattaacctggcggcagcgcaaaagatg

SEQ ID NO: 34609 - DNA, 103 bp, Artificial Sequence
  Synthetic Polynucleotide
taatacgactcactatagggcatactctgtattagttgtagctttagcataacagaggagaatgctaatgctacaactaaacctggcggcagcgcaaaagatg

SEQ ID NO: 34610 - DNA, 103 bp, Artificial Sequence
  Synthetic Polynucleotide
taatacgactcactatagggcggtattcggtactgagggtagccacaagaaacagaggagatcttgtatgtaccctcagaacctggcggcagcgcaaaagatg

SEQ ID NO: 34611 - DNA, 103 bp, Artificial Sequence
  Synthetic Polynucleotide
taatacgactcactatagggtcgcaactaaattcatgcagtgatatacaaaacagaggagattgtatatgactgcatgaaacctggcggcagcgcaaaagatg

SEQ ID NO: 34612 - DNA, 103 bp, Artificial Sequence
  Synthetic Polynucleotide
taatacgactcactatagggagttgttttactataccgatatccaaggcgaacagaggagacgccttatgtatcggtataacctggcggcagcgcaaaagatg

SEQ ID NO: 34613 - DNA, 103 bp, Artificial Sequence
  Synthetic Polynucleotide
taatacgactcactatagggttcaggcacatagccctttgaggcgaattcaacagaggagagaattcatgtcaaagggcaacctggcggcagcgcaaaagatg

SEQ ID NO: 34614 - DNA, 103 bp, Artificial Sequence
  Synthetic Polynucleotide
taatacgactcactatagggcccggggtccttcgaaatggcgaccccggaaacagaggagatccgggatggccatttcgaacctggcggcagcgcaaaagatg

SEQ ID NO: 34615 - DNA, 103 bp, Artificial Sequence
  Synthetic Polynucleotide
taatacgactcactatagggccacgtttcggccggtagagtaagccggcaaacagaggagatgccggatgactctaccgaacctggcggcagcgcaaaagatg

SEQ ID NO: 34616 - DNA, 103 bp, Artificial Sequence
  Synthetic Polynucleotide
taatacgactcactatagggttcctcatatgcatggggcggttttaggggaacagaggagacccctaatgccgccccataacctggcggcagcgcaaaagatg

SEQ ID NO: 34617 - DNA, 103 bp, Artificial Sequence
  Synthetic Polynucleotide
taatacgactcactatagggagccaagggagatccttgtcataggagggaaacagaggagatccctcatgtgacaaggaaacctggcggcagcgcaaaagatg

SEQ ID NO: 34618 - DNA, 103 bp, Artificial Sequence
  Synthetic Polynucleotide
taatacgactcactataggggttggattaccattttgcattgacgcgtccaacagaggagaggacgcatgaatgcaaaaaacctggcggcagcgcaaaagatg

SEQ ID NO: 34619 - DNA, 103 bp, Artificial Sequence
  Synthetic Polynucleotide
taatacgactcactatagggtggtggtctagggctcgcacgtaggggcagaacagaggagactgcccatgcgtgcgagcaacctggcggcagcgcaaaagatg

SEQ ID NO: 34620 - DNA, 103 bp, Artificial Sequence
  Synthetic Polynucleotide
taatacgactcactatagggaacagagcgtggatgttggaatgaatcgctaacagaggagaagcgatatgttccaacataacctggcggcagcgcaaaagatg

SEQ ID NO: 34621 - DNA, 103 bp, Artificial Sequence
  Synthetic Polynucleotide
taatacgactcactatagggctaccgaggcgggccagacgcaccaaactcaacagaggagagagtttatggcgtctggcaacctggcggcagcgcaaaagatg

SEQ ID NO: 34622 - DNA, 103 bp, Artificial Sequence
  Synthetic Polynucleotide
taatacgactcactatagggaaatatgaatgggcgattggatcgcttctcaacagaggagagagaagatgtccaatcgcaacctggcggcagcgcaaaagatg

SEQ ID NO: 34623 - DNA, 103 bp, Artificial Sequence
  Synthetic Polynucleotide
taatacgactcactatagggactcagatcgagaaccgcttaccccgggcaaacagaggagatgcccgatgtaagcggttaacctggcggcagcgcaaaagatg

SEQ ID NO: 34624 - DNA, 103 bp, Artificial Sequence
  Synthetic Polynucleotide
taatacgactcactatagggagatgctagatatcacgggaacaccgcgacaacagaggagagtcgcgatgttcccgtgaaacctggcggcagcgcaaaagatg

SEQ ID NO: 34625 - DNA, 103 bp, Artificial Sequence
  Synthetic Polynucleotide
taatacgactcactatagggaatatgcgtcacaggaccgagctgaccgtaaacagaggagatacggtatgctcggtcctaacctggcggcagcgcaaaagatg

SEQ ID NO: 34626 - DNA, 103 bp, Artificial Sequence
  Synthetic Polynucleotide
taatacgactcactatagggctgcagggaatctccggaacaatactgctgaacagaggagacagcagatgtgttccggaaacctggcggcagcgcaaaagatg

SEQ ID NO: 34627 - DNA, 103 bp, Artificial Sequence
  Synthetic Polynucleotide
taatacgactcactatagggtacagatggtgaaaacaacctattacagcgaacagaggagacgctgtatgaggttgtttaacctggcggcagcgcaaaagatg

SEQ ID NO: 34628 - DNA, 103 bp, Artificial Sequence
  Synthetic Polynucleotide
taatacgactcactataggggctgttaccgttcggctttcttcgactcgtaacagaggagaacgagtatgagaaagccgaacctggcggcagcgcaaaagatg

SEQ ID NO: 34629 - DNA, 103 bp, Artificial Sequence
  Synthetic Polynucleotide
taatacgactcactataggggctgaagtatttatctagacgtcattgaataacagaggagaattcaaatgcgtctagataacctggcggcagcgcaaaagatg

SEQ ID NO: 34630 - DNA, 103 bp, Artificial Sequence
  Synthetic Polynucleotide
taatacgactcactatagggttgacgcgcgacggaatccgggtcggtgtcaacagaggagagacaccatgccggattccaacctggcggcagcgcaaaagatg

SEQ ID NO: 34631 - DNA, 103 bp, Artificial Sequence
  Synthetic Polynucleotide
taatacgactcactataggggttgcatggtcaaactcggtgctcttatacaacagaggagagtataaatgcaccgagttaacctggcggcagcgcaaaagatg

SEQ ID NO: 34632 - DNA, 103 bp, Artificial Sequence
  Synthetic Polynucleotide
taatacgactcactatagggggcatcaggtttcccctttcttcacccaacaacagaggagagttgggatgagaaaggggaacctggcggcagcgcaaaagatg

SEQ ID NO: 34633 - DNA, 103 bp, Artificial Sequence
  Synthetic Polynucleotide
taatacgactcactatagggttggacctacgcggatggacgtcgacatacaacagaggagagtatgtatgcgtccatccaacctggcggcagcgcaaaagatg

SEQ ID NO: 34634 - DNA, 103 bp, Artificial Sequence
  Synthetic Polynucleotide
taatacgactcactatagggcactagcctgagaaatactcacctaatagtaacagaggagaactattatgtgagtatttaacctggcggcagcgcaaaagatg

SEQ ID NO: 34635 - DNA, 103 bp, Artificial Sequence
  Synthetic Polynucleotide
taatacgactcactatagggttcgagggcgtggcagtgcctcttccccgcaacagaggagagcggggatgaggcactgcaacctggcggcagcgcaaaagatg

SEQ ID NO: 34636 - DNA, 103 bp, Artificial Sequence
  Synthetic Polynucleotide
taatacgactcactatagggaacatattctcgtatgtgcccgactgacgtaacagaggagaacgtcaatggggcacataaacctggcggcagcgcaaaagatg

SEQ ID NO: 34637 - DNA, 103 bp, Artificial Sequence
  Synthetic Polynucleotide
taatacgactcactatagggcctacgagggacctacgagcggagacaacaaacagaggagatgttgtatgcgctcgtagaacctggcggcagcgcaaaagatg

SEQ ID NO: 34638 - DNA, 103 bp, Artificial Sequence
  Synthetic Polynucleotide
taatacgactcactatagggatcttgatccgcacccaacgtcttgacgttaacagaggagaaacgtcatgacgttgggtaacctggcggcagcgcaaaagatg

SEQ ID NO: 34639 - DNA, 103 bp, Artificial Sequence
  Synthetic Polynucleotide
taatacgactcactatagggtcaaactgaactaccgttcaccagtagtccaacagaggagaggactaatggtgaacggtaacctggcggcagcgcaaaagatg

SEQ ID NO: 34640 - DNA, 103 bp, Artificial Sequence
  Synthetic Polynucleotide
taatacgactcactatagggcgagtgttgtggcgtcgcctttcacttgccaacagaggagaggcaagatgaaggcgacgaacctggcggcagcgcaaaagatg

SEQ ID NO: 34641 - DNA, 103 bp, Artificial Sequence
  Synthetic Polynucleotide
taatacgactcactatagggatgagtcctaggcccactaattagcacaacaacagaggagagttgtgatgattagtgggaacctggcggcagcgcaaaagatg

SEQ ID NO: 34642 - DNA, 103 bp, Artificial Sequence
  Synthetic Polynucleotide
taatacgactcactatagggtgcagggggctaattcagtagtccggcattaacagaggagaaatgccatgctactgaataacctggcggcagcgcaaaagatg

SEQ ID NO: 34643 - DNA, 103 bp, Artificial Sequence
  Synthetic Polynucleotide
taatacgactcactatagggcgaggtgctttggggggatccttcatcccgaacagaggagacgggatatgggatcccccaacctggcggcagcgcaaaagatg

SEQ ID NO: 34644 - DNA, 103 bp, Artificial Sequence
  Synthetic Polynucleotide
taatacgactcactatagggtgatcacgcgagaatgttacaccccccctcaacagaggagagaggggatgtgtaacattaacctggcggcagcgcaaaagatg

SEQ ID NO: 34645 - DNA, 103 bp, Artificial Sequence
  Synthetic Polynucleotide
taatacgactcactataggggggaccttatcgcacctaccggtcccgactaacagaggagaagtcggatgcggtaggtgaacctggcggcagcgcaaaagatg

SEQ ID NO: 34646 - DNA, 103 bp, Artificial Sequence
  Synthetic Polynucleotide
taatacgactcactatagggccctgcccggagagttcaggtagcggagataacagaggagaatctccatgacctgaactaacctggcggcagcgcaaaagatg

SEQ ID NO: 34647 - DNA, 103 bp, Artificial Sequence
  Synthetic Polynucleotide
taatacgactcactatagggcttcggttgaaggcgcgcataaatcatgcaaacagaggagatgcatgatgtatgcgcgcaacctggcggcagcgcaaaagatg

SEQ ID NO: 34648 - DNA, 103 bp, Artificial Sequence
  Synthetic Polynucleotide
taatacgactcactatagggggactcaaattacacagcctttatcgaggaaacagaggagatcctcgatgaaggctgtgaacctggcggcagcgcaaaagatg

SEQ ID NO: 34649 - DNA, 103 bp, Artificial Sequence
  Synthetic Polynucleotide
taatacgactcactataggggtcagtctcgcgaccaccgataaaacacttaacagaggagaaagtgtatgatcggtggtaacctggcggcagcgcaaaagatg

SEQ ID NO: 34650 - DNA, 103 bp, Artificial Sequence
  Synthetic Polynucleotide
taatacgactcactatagggctacgtgtaatgcaccctcagtgcgctaggaacagaggagacctagcatgctgagggtgaacctggcggcagcgcaaaagatg

SEQ ID NO: 34651 - DNA, 103 bp, Artificial Sequence
  Synthetic Polynucleotide
taatacgactcactatagggagtcaagactgctattcgactgccggctgtaacagaggagaacagccatgagtcgaataaacctggcggcagcgcaaaagatg

SEQ ID NO: 34652 - DNA, 103 bp, Artificial Sequence
  Synthetic Polynucleotide
taatacgactcactatagggacgctggggagcgtgcttaaatttcccgttaacagaggagaaacgggatgtttaagcacaacctggcggcagcgcaaaagatg

SEQ ID NO: 34653 - DNA, 103 bp, Artificial Sequence
  Synthetic Polynucleotide
taatacgactcactatagggtcgccaatgtgcccttctcgagcagctgagaacagaggagactcagcatgtcgagaaggaacctggcggcagcgcaaaagatg

SEQ ID NO: 34654 - DNA, 103 bp, Artificial Sequence
  Synthetic Polynucleotide
taatacgactcactatagggtgctatactgttctgaatgacgacaaagcaaacagaggagatgctttatggtcattcagaacctggcggcagcgcaaaagatg

SEQ ID NO: 34655 - DNA, 103 bp, Artificial Sequence
  Synthetic Polynucleotide
taatacgactcactatagggagggttttggacgaacggttatatatagctaacagaggagaagctatatgtaaccgttcaacctggcggcagcgcaaaagatg

SEQ ID NO: 34656 - DNA, 103 bp, Artificial Sequence
  Synthetic Polynucleotide
taatacgactcactatagggtttcatgcctgatgaatgatcctcaagacgaacagaggagacgtcttatggatcattcaaacctggcggcagcgcaaaagatg

SEQ ID NO: 34657 - DNA, 103 bp, Artificial Sequence
  Synthetic Polynucleotide
taatacgactcactatagggaatagccattatgctgagttccgccgcaggaacagaggagacctgcgatggaactcagcaacctggcggcagcgcaaaagatg

SEQ ID NO: 34658 - DNA, 103 bp, Artificial Sequence
  Synthetic Polynucleotide
taatacgactcactatagggcgatgccaattcgcctatgaacggcaattaaacagaggagataattgatgttcataggcaacctggcggcagcgcaaaagatg

SEQ ID NO: 34659 - DNA, 103 bp, Artificial Sequence
  Synthetic Polynucleotide
taatacgactcactatagggatcagcagcaaacgaaaataatccgaaactaacagaggagaagtttcatgttattttcgaacctggcggcagcgcaaaagatg

SEQ ID NO: 34660 - DNA, 103 bp, Artificial Sequence
  Synthetic Polynucleotide
taatacgactcactatagggtaaatcacctaaagttctcgaacggaccccaacagaggagaggggtcatgtcgagaactaacctggcggcagcgcaaaagatg

SEQ ID NO: 34661 - DNA, 103 bp, Artificial Sequence
  Synthetic Polynucleotide
taatacgactcactatagggtagttttcctttgccagagactaagcgggcaacagaggagagcccgcatggtctctggcaacctggcggcagcgcaaaagatg

SEQ ID NO: 34662 - DNA, 103 bp, Artificial Sequence
  Synthetic Polynucleotide
taatacgactcactatagggcgttcgaattctaactgttacgccaggtggaacagaggagaccacctatggtaacagttaacctggcggcagcgcaaaagatg

SEQ ID NO: 34663 - DNA, 103 bp, Artificial Sequence
  Synthetic Polynucleotide
taatacgactcactatagggttcttcctcgaagctgcgcgccaggtttcgaacagaggagacgaaacatggcgcgcagcaacctggcggcagcgcaaaagatg

SEQ ID NO: 34664 - DNA, 103 bp, Artificial Sequence
  Synthetic Polynucleotide
taatacgactcactatagggggcgggctatagtaacacggggaagctcgtaacagaggagaacgagcatgcccgtgttaaacctggcggcagcgcaaaagatg

SEQ ID NO: 34665 - DNA, 103 bp, Artificial Sequence
  Synthetic Polynucleotide
taatacgactcactatagggggcgccgagcatgtaagcgttataccctgcaacagaggagagcagggatgaacgcttacaacctggcggcagcgcaaaagatg

SEQ ID NO: 34666 - DNA, 103 bp, Artificial Sequence
  Synthetic Polynucleotide
taatacgactcactatagggcacggcccgcctcgcctgctctattcgaaaaacagaggagatttcgaatggagcaggcgaacctggcggcagcgcaaaagatg

SEQ ID NO: 34667 - DNA, 103 bp, Artificial Sequence
  Synthetic Polynucleotide
taatacgactcactatagggcccttggacgccgatcgccacgagcctcagaacagaggagactgaggatggtggcgatcaacctggcggcagcgcaaaagatg

SEQ ID NO: 34668 - DNA, 103 bp, Artificial Sequence
  Synthetic Polynucleotide
taatacgactcactatagggctccacgattcatttatccggtataccgctaacagaggagaagcggtatgccggataaaaacctggcggcagcgcaaaagatg

SEQ ID NO: 34669 - DNA, 103 bp, Artificial Sequence
  Synthetic Polynucleotide
taatacgactcactatagggaccctgataaccgagatgcgaggcctttgaaacagaggagatcaaagatgtcgcatctcaacctggcggcagcgcaaaagatg

SEQ ID NO: 34670 - DNA, 103 bp, Artificial Sequence
  Synthetic Polynucleotide
taatacgactcactatagggttaaagtcactgggttcttcttatctaatgaacagaggagacattagatgagaagaaccaacctggcggcagcgcaaaagatg

SEQ ID NO: 34671 - DNA, 103 bp, Artificial Sequence
  Synthetic Polynucleotide
taatacgactcactatagggttctcggaccaagcaaaacaggccatacacaacagaggagagtgtatatgctgttttgcaacctggcggcagcgcaaaagatg

SEQ ID NO: 34672 - DNA, 103 bp, Artificial Sequence
  Synthetic Polynucleotide
taatacgactcactatagggacgtatgcctgctccgcttgcgctagttgcaacagaggagagcaactatggcaagcggaaacctggcggcagcgcaaaagatg

SEQ ID NO: 34673 - DNA, 103 bp, Artificial Sequence
  Synthetic Polynucleotide
taatacgactcactatagggcttcagtggcctatcagatctgttgcacagaacagaggagactgtgcatgagatctgataacctggcggcagcgcaaaagatg

SEQ ID NO: 34674 - DNA, 103 bp, Artificial Sequence
  Synthetic Polynucleotide
taatacgactcactatagggagtcaaatctattataagctactcccagtaaacagaggagatactggatgtagcttataaacctggcggcagcgcaaaagatg

SEQ ID NO: 34675 - DNA, 103 bp, Artificial Sequence
  Synthetic Polynucleotide
taatacgactcactatagggaggggtatattcctagtttggggaatgcgcaacagaggagagcgcatatgccaaactagaacctggcggcagcgcaaaagatg

SEQ ID NO: 34676 - DNA, 103 bp, Artificial Sequence
  Synthetic Polynucleotide
taatacgactcactatagggtacataagcttcatacgcgagggcgggaataacagaggagaattcccatgctcgcgtataacctggcggcagcgcaaaagatg

SEQ ID NO: 34677 - DNA, 103 bp, Artificial Sequence
  Synthetic Polynucleotide
taatacgactcactatagggacgtaccacatgaaatgaaccgttgatgggaacagaggagacccatcatgggttcatttaacctggcggcagcgcaaaagatg

SEQ ID NO: 34678 - DNA, 103 bp, Artificial Sequence
  Synthetic Polynucleotide
taatacgactcactatagggtgccccaagttatttaccacattaactcaaaacagaggagattgagtatgtgtggtaaaaacctggcggcagcgcaaaagatg

SEQ ID NO: 34679 - DNA, 103 bp, Artificial Sequence
  Synthetic Polynucleotide
taatacgactcactatagggtttacgaaataatatgcaggagaagcaccgaacagaggagacggtgcatgtcctgcataaacctggcggcagcgcaaaagatg

SEQ ID NO: 34680 - DNA, 103 bp, Artificial Sequence
  Synthetic Polynucleotide
taatacgactcactatagggctgttcagcgatactcactattcgtgttcgaacagaggagacgaacaatgatagtgagtaacctggcggcagcgcaaaagatg

SEQ ID NO: 34681 - DNA, 103 bp, Artificial Sequence
  Synthetic Polynucleotide
taatacgactcactatagggtcattaaactagtctcacatgtaggcaagaaacagaggagatcttgcatgcatgtgagaaacctggcggcagcgcaaaagatg

SEQ ID NO: 34682 - DNA, 103 bp, Artificial Sequence
  Synthetic Polynucleotide
taatacgactcactatagggatatcctattgtagagggccggcgccaccgaacagaggagacggtggatgcggccctctaacctggcggcagcgcaaaagatg

SEQ ID NO: 34683 - DNA, 103 bp, Artificial Sequence
  Synthetic Polynucleotide
taatacgactcactatagggcgttcgatcatagcttcggacactaagacaaacagaggagatgtcttatggtccgaagcaacctggcggcagcgcaaaagatg

SEQ ID NO: 34684 - DNA, 103 bp, Artificial Sequence
  Synthetic Polynucleotide
taatacgactcactatagggcacaactagttaatcgccatgaataattccaacagaggagaggaattatgcatggcgataacctggcggcagcgcaaaagatg

SEQ ID NO: 34685 - DNA, 103 bp, Artificial Sequence
  Synthetic Polynucleotide
taatacgactcactatagggaaccatctgggttcggggtactgcaatctgaacagaggagacagattatggtaccccgaaacctggcggcagcgcaaaagatg

SEQ ID NO: 34686 - DNA, 103 bp, Artificial Sequence
  Synthetic Polynucleotide
taatacgactcactatagggaggtcggggcgagatcgagacactcggatgaacagaggagacatccgatggtctcgatcaacctggcggcagcgcaaaagatg

SEQ ID NO: 34687 - DNA, 103 bp, Artificial Sequence
  Synthetic Polynucleotide
taatacgactcactatagggtgagatgttttaatcgtgctggggcatcgaaacagaggagatcgatgatgcagcacgataacctggcggcagcgcaaaagatg

SEQ ID NO: 34688 - DNA, 103 bp, Artificial Sequence
  Synthetic Polynucleotide
taatacgactcactatagggggttcgggttctgcagaccttacatttaccaacagaggagaggtaaaatgaaggtctgcaacctggcggcagcgcaaaagatg

SEQ ID NO: 34689 - DNA, 103 bp, Artificial Sequence
  Synthetic Polynucleotide
taatacgactcactatagggtctatcatagctttcagactctatgtcaccaacagaggagaggtgacatggagtctgaaaacctggcggcagcgcaaaagatg

SEQ ID NO: 34690 - DNA, 103 bp, Artificial Sequence
  Synthetic Polynucleotide
taatacgactcactatagggctcggcatccgctcagccgtggggccaaacaacagaggagagtttggatgcacggctgaaacctggcggcagcgcaaaagatg

SEQ ID NO: 34691 - DNA, 103 bp, Artificial Sequence
  Synthetic Polynucleotide
taatacgactcactatagggtatctgtcatgaaattgggacagctaaagaaacagaggagatctttaatggtcccaattaacctggcggcagcgcaaaagatg

SEQ ID NO: 34692 - DNA, 103 bp, Artificial Sequence
  Synthetic Polynucleotide
taatacgactcactatagggttgtcggcagcgtatccgccgcgcgggctaaacagaggagatagcccatgcggcggataaacctggcggcagcgcaaaagatg

SEQ ID NO: 34693 - DNA, 103 bp, Artificial Sequence
  Synthetic Polynucleotide
taatacgactcactatagggcaagacattcgggtctggtgcttctgacacaacagaggagagtgtcaatggcaccagacaacctggcggcagcgcaaaagatg

SEQ ID NO: 34694 - DNA, 103 bp, Artificial Sequence
  Synthetic Polynucleotide
taatacgactcactatagggagacactactgcaggtcaccagttggcgacaacagaggagagtcgccatgtggtgacctaacctggcggcagcgcaaaagatg

SEQ ID NO: 34695 - DNA, 103 bp, Artificial Sequence
  Synthetic Polynucleotide
taatacgactcactatagggcgctctcggcggatgtgtctttatgggcgtaacagaggagaacgcccatgaagacacataacctggcggcagcgcaaaagatg

SEQ ID NO: 34696 - DNA, 103 bp, Artificial Sequence
  Synthetic Polynucleotide
taatacgactcactataggggaagtgcctcgtggggtgcgttctaaaagcaacagaggagagcttttatgacgcaccccaacctggcggcagcgcaaaagatg

SEQ ID NO: 34697 - DNA, 103 bp, Artificial Sequence
  Synthetic Polynucleotide
taatacgactcactataggggcgttatcgtggacggatcccaagcaatctaacagaggagaagattgatggggatccgtaacctggcggcagcgcaaaagatg

SEQ ID NO: 34698 - DNA, 103 bp, Artificial Sequence
  Synthetic Polynucleotide
taatacgactcactatagggcaatccaaaccgcgcacagggcacatcccaaacagaggagatgggatatgccctgtgcgaacctggcggcagcgcaaaagatg

SEQ ID NO: 34699 - DNA, 103 bp, Artificial Sequence
  Synthetic Polynucleotide
taatacgactcactatagggagataattgaccttctgacgagaaggttagaacagaggagactaaccatgtcgtcagaaaacctggcggcagcgcaaaagatg

SEQ ID NO: 34700 - DNA, 103 bp, Artificial Sequence
  Synthetic Polynucleotide
taatacgactcactatagggcttgtcagcacctggctttgtcagtcagaaaacagaggagattctgaatgacaaagccaaacctggcggcagcgcaaaagatg

SEQ ID NO: 34701 - DNA, 103 bp, Artificial Sequence
  Synthetic Polynucleotide
taatacgactcactatagggtaaacaaacacaggcataaaatcgtttcaaaacagaggagattgaaaatgttttatgccaacctggcggcagcgcaaaagatg

SEQ ID NO: 34702 - DNA, 103 bp, Artificial Sequence
  Synthetic Polynucleotide
taatacgactcactatagggccccccgcggaatgctagattgcagattgcaacagaggagagcaatcatgaatctagcaaacctggcggcagcgcaaaagatg

SEQ ID NO: 34703 - DNA, 103 bp, Artificial Sequence
  Synthetic Polynucleotide
taatacgactcactatagggttctgtctggcgtcaataaataaagaacgtaacagaggagaacgttcatgatttattgaaacctggcggcagcgcaaaagatg

SEQ ID NO: 34704 - DNA, 103 bp, Artificial Sequence
  Synthetic Polynucleotide
taatacgactcactatagggcgaggagttaataaagcatcaagctagatgaacagaggagacatctaatgtgatgctttaacctggcggcagcgcaaaagatg

SEQ ID NO: 34705 - DNA, 103 bp, Artificial Sequence
  Synthetic Polynucleotide
taatacgactcactatagggctgaacgtcatcgcccttacatggcacttaaacagaggagataagtgatgtgtaagggcaacctggcggcagcgcaaaagatg

SEQ ID NO: 34706 - DNA, 103 bp, Artificial Sequence
  Synthetic Polynucleotide
taatacgactcactatagggcgacagtcgtccaaccagcaaagcggtcgaaacagaggagatcgaccatgttgctggttaacctggcggcagcgcaaaagatg

SEQ ID NO: 34707 - DNA, 103 bp, Artificial Sequence
  Synthetic Polynucleotide
taatacgactcactatagggtacggtgttcctcaagggagacgcctatccaacagaggagaggatagatgtctcccttgaacctggcggcagcgcaaaagatg

SEQ ID NO: 34708 - DNA, 103 bp, Artificial Sequence
  Synthetic Polynucleotide
taatacgactcactatagggcaatgctatattgtctatagggaaatacaaaacagaggagattgtatatgcctatagacaacctggcggcagcgcaaaagatg

SEQ ID NO: 34709 - DNA, 103 bp, Artificial Sequence
  Synthetic Polynucleotide
taatacgactcactatagggaagcagtaaggtgtcccacgctccccgcgtaacagaggagaacgcggatggcgtgggacaacctggcggcagcgcaaaagatg

SEQ ID NO: 34710 - DNA, 103 bp, Artificial Sequence
  Synthetic Polynucleotide
taatacgactcactatagggacgtgcaaacctttagtgtatgacggcacgaacagaggagacgtgccatgatacactaaaacctggcggcagcgcaaaagatg

SEQ ID NO: 34711 - DNA, 103 bp, Artificial Sequence
  Synthetic Polynucleotide
taatacgactcactatagggaaatgcgttatacttgtggtgagctgttacaacagaggagagtaacaatgcaccacaagaacctggcggcagcgcaaaagatg

SEQ ID NO: 34712 - DNA, 103 bp, Artificial Sequence
  Synthetic Polynucleotide
taatacgactcactataggggttaaaagttccagaactccttagctaattaacagaggagaaattagatgaggagttctaacctggcggcagcgcaaaagatg

SEQ ID NO: 34713 - DNA, 103 bp, Artificial Sequence
  Synthetic Polynucleotide
taatacgactcactatagggttacgacccctttgactaaaggcctcattaaacagaggagataatgaatgctttagtcaaacctggcggcagcgcaaaagatg

SEQ ID NO: 34714 - DNA, 103 bp, Artificial Sequence
  Synthetic Polynucleotide
taatacgactcactataggggactttgaacgggtcgcgttgttaaacttaaacagaggagataagttatgcaacgcgacaacctggcggcagcgcaaaagatg

SEQ ID NO: 34715 - DNA, 103 bp, Artificial Sequence
  Synthetic Polynucleotide
taatacgactcactatagggtgtggcattctgtagcctgaacggaatcgaaacagaggagatcgattatgttcaggctaaacctggcggcagcgcaaaagatg

SEQ ID NO: 34716 - DNA, 103 bp, Artificial Sequence
  Synthetic Polynucleotide
taatacgactcactataggggtatacagtagtacaagacggcctcatagaaacagaggagatctatgatgccgtcttgtaacctggcggcagcgcaaaagatg

SEQ ID NO: 34717 - DNA, 103 bp, Artificial Sequence
  Synthetic Polynucleotide
taatacgactcactatagggtgccgtgacgctgattcccgagcaccaaagaacagaggagactttggatgtcgggaatcaacctggcggcagcgcaaaagatg

SEQ ID NO: 34718 - DNA, 103 bp, Artificial Sequence
  Synthetic Polynucleotide
taatacgactcactatagggaagtgatcagcgcctgcacttccggattataacagaggagaataatcatgaagtgcaggaacctggcggcagcgcaaaagatg

SEQ ID NO: 34719 - DNA, 103 bp, Artificial Sequence
  Synthetic Polynucleotide
taatacgactcactatagggagagttcggacgacttgcgagttattgctaaacagaggagatagcaaatgctcgcaagtaacctggcggcagcgcaaaagatg

SEQ ID NO: 34720 - DNA, 103 bp, Artificial Sequence
  Synthetic Polynucleotide
taatacgactcactatagggaaacgactagattcagctctgtgaattacgaacagaggagacgtaatatgcagagctgaaacctggcggcagcgcaaaagatg

SEQ ID NO: 34721 - DNA, 103 bp, Artificial Sequence
  Synthetic Polynucleotide
taatacgactcactataggggaagacactgcgaatcattttgatacgggcaacagaggagagcccgtatgaaaatgattaacctggcggcagcgcaaaagatg

SEQ ID NO: 34722 - DNA, 103 bp, Artificial Sequence
  Synthetic Polynucleotide
taatacgactcactataggggacagattaaggtgatctacgtggaccatgaacagaggagacatggtatgcgtagatcaaacctggcggcagcgcaaaagatg

SEQ ID NO: 34723 - DNA, 103 bp, Artificial Sequence
  Synthetic Polynucleotide
taatacgactcactataggggcgcatgcgttcaaatggatgcgacccacgaacagaggagacgtgggatgcatccatttaacctggcggcagcgcaaaagatg

SEQ ID NO: 34724 - DNA, 103 bp, Artificial Sequence
  Synthetic Polynucleotide
taatacgactcactatagggtagacaccgttagcaagcgataactacagtaacagaggagaactgtaatgatcgcttgcaacctggcggcagcgcaaaagatg

SEQ ID NO: 34725 - DNA, 103 bp, Artificial Sequence
  Synthetic Polynucleotide
taatacgactcactatagggaggggctccggctacctgacgtcaggatataacagaggagaatatccatgcgtcaggtaaacctggcggcagcgcaaaagatg

SEQ ID NO: 34726 - DNA, 103 bp, Artificial Sequence
  Synthetic Polynucleotide
taatacgactcactataggggtcttcgaggcgtcaccagttgcgctggggaacagaggagaccccagatgaactggtgaaacctggcggcagcgcaaaagatg

SEQ ID NO: 34727 - DNA, 103 bp, Artificial Sequence
  Synthetic Polynucleotide
taatacgactcactatagggcacactacgatgagtacccagtctataggaaacagaggagatcctatatgctgggtactaacctggcggcagcgcaaaagatg

SEQ ID NO: 34728 - DNA, 103 bp, Artificial Sequence
  Synthetic Polynucleotide
taatacgactcactatagggctgcgcagccggtgacctcacgtatagctaaacagaggagatagctaatggtgaggtcaaacctggcggcagcgcaaaagatg

SEQ ID NO: 34729 - DNA, 103 bp, Artificial Sequence
  Synthetic Polynucleotide
taatacgactcactataggggattagagccggagcacataaggggccgccaacagaggagaggcggcatgttatgtgctaacctggcggcagcgcaaaagatg

SEQ ID NO: 34730 - DNA, 103 bp, Artificial Sequence
  Synthetic Polynucleotide
taatacgactcactatagggccctgactatttgagcggttaatcagcgtaaacagaggagatacgctatgtaaccgctcaacctggcggcagcgcaaaagatg

SEQ ID NO: 34731 - DNA, 103 bp, Artificial Sequence
  Synthetic Polynucleotide
taatacgactcactatagggcatcgatgcggaagtatcaggcgtctttggaacagaggagaccaaagatgcctgatactaacctggcggcagcgcaaaagatg

SEQ ID NO: 34732 - DNA, 103 bp, Artificial Sequence
  Synthetic Polynucleotide
taatacgactcactatagggaaacccatcagtgccgctgaaatcattgtcaacagaggagagacaatatgttcagcggcaacctggcggcagcgcaaaagatg

SEQ ID NO: 34733 - DNA, 103 bp, Artificial Sequence
  Synthetic Polynucleotide
taatacgactcactatagggtagccagtaccgagtgtccataagcgcttgaacagaggagacaagcgatgatggacactaacctggcggcagcgcaaaagatg

SEQ ID NO: 34734 - DNA, 103 bp, Artificial Sequence
  Synthetic Polynucleotide
taatacgactcactatagggttcgagataaatggccggagtgtcctgcgaaacagaggagatcgcagatgactccggccaacctggcggcagcgcaaaagatg

SEQ ID NO: 34735 - DNA, 103 bp, Artificial Sequence
  Synthetic Polynucleotide
taatacgactcactatagggccgcggtcctaagtgctggcatgtctgcgaaacagaggagatcgcagatgtgccagcacaacctggcggcagcgcaaaagatg

SEQ ID NO: 34736 - DNA, 103 bp, Artificial Sequence
  Synthetic Polynucleotide
taatacgactcactatagggtcgtataaccaagcaaagacatggaatgggaacagaggagacccattatgtgtctttgcaacctggcggcagcgcaaaagatg

SEQ ID NO: 34737 - DNA, 103 bp, Artificial Sequence
  Synthetic Polynucleotide
taatacgactcactatagggaccggttaatccggggcaggtatgcgacggaacagaggagaccgtcgatgacctgccccaacctggcggcagcgcaaaagatg

SEQ ID NO: 34738 - DNA, 103 bp, Artificial Sequence
  Synthetic Polynucleotide
taatacgactcactatagggactaacaaataacactaggaaacaatcattaacagaggagaaatgatatgttcctagtgaacctggcggcagcgcaaaagatg

SEQ ID NO: 34739 - DNA, 103 bp, Artificial Sequence
  Synthetic Polynucleotide
taatacgactcactatagggcaacgccgggatagttcagcaaaaatgataaacagaggagatatcatatgtgctgaactaacctggcggcagcgcaaaagatg

SEQ ID NO: 34740 - DNA, 103 bp, Artificial Sequence
  Synthetic Polynucleotide
taatacgactcactatagggcccatgcggcgggcttcggtggggtcccgtaacagaggagaacgggaatgcaccgaagcaacctggcggcagcgcaaaagatg

SEQ ID NO: 34741 - DNA, 103 bp, Artificial Sequence
  Synthetic Polynucleotide
taatacgactcactatagggactttatgaggtgagtgtcttatagcgctcaacagaggagagagcgcatgaagacactcaacctggcggcagcgcaaaagatg

SEQ ID NO: 34742 - DNA, 103 bp, Artificial Sequence
  Synthetic Polynucleotide
taatacgactcactatagggactggctacttacgctaatctgagttggttaacagaggagaaaccaaatgagattagcgaacctggcggcagcgcaaaagatg

SEQ ID NO: 34743 - DNA, 103 bp, Artificial Sequence
  Synthetic Polynucleotide
taatacgactcactatagggcgatgtggagagcgagtgagtaggaaatttaacagaggagaaaatttatgactcactcgaacctggcggcagcgcaaaagatg

SEQ ID NO: 34744 - DNA, 103 bp, Artificial Sequence
  Synthetic Polynucleotide
taatacgactcactatagggttctcgcaagtgtcgtgaagggccaagaacaacagaggagagttcttatgccttcacgaaacctggcggcagcgcaaaagatg

SEQ ID NO: 34745 - DNA, 103 bp, Artificial Sequence
  Synthetic Polynucleotide
taatacgactcactataggggtgcttgtacaggagtaaccggatcggcgcaacagaggagagcgccgatgcggttactcaacctggcggcagcgcaaaagatg

SEQ ID NO: 34746 - DNA, 103 bp, Artificial Sequence
  Synthetic Polynucleotide
taatacgactcactatagggcctttatctgtaatctcgtgcagaatgcaaaacagaggagattgcatatggcacgagataacctggcggcagcgcaaaagatg

SEQ ID NO: 34747 - DNA, 103 bp, Artificial Sequence
  Synthetic Polynucleotide
taatacgactcactatagggcagggcagctcgcagtagatagtagccggaaacagaggagatccggcatgtatctactgaacctggcggcagcgcaaaagatg

SEQ ID NO: 34748 - DNA, 103 bp, Artificial Sequence
  Synthetic Polynucleotide
taatacgactcactatagggcagtgggattttcaactatgagtcacggttaacagaggagaaaccgtatgtcatagttgaacctggcggcagcgcaaaagatg

SEQ ID NO: 34749 - DNA, 103 bp, Artificial Sequence
  Synthetic Polynucleotide
taatacgactcactataggggctttcggtgcgtgcctaatcgggctccccaacagaggagaggggagatggattaggcaaacctggcggcagcgcaaaagatg

SEQ ID NO: 34750 - DNA, 103 bp, Artificial Sequence
  Synthetic Polynucleotide
taatacgactcactatagggtatcttgaaaaacgtggccccatgacctccaacagaggagaggaggtatgggggccacgaacctggcggcagcgcaaaagatg

SEQ ID NO: 34751 - DNA, 103 bp, Artificial Sequence
  Synthetic Polynucleotide
taatacgactcactatagggggagatttattataccgccgtgtcctgtaaaacagaggagattacagatgacggcggtaaacctggcggcagcgcaaaagatg

SEQ ID NO: 34752 - DNA, 103 bp, Artificial Sequence
  Synthetic Polynucleotide
taatacgactcactatagggcttagctatctacgggcaacagtctgcctcaacagaggagagaggcaatgtgttgcccgaacctggcggcagcgcaaaagatg

SEQ ID NO: 34753 - DNA, 103 bp, Artificial Sequence
  Synthetic Polynucleotide
taatacgactcactataggggcgattcgcacttgctgcctctgtcttacgaacagaggagacgtaagatggaggcagcaaacctggcggcagcgcaaaagatg

SEQ ID NO: 34754 - DNA, 103 bp, Artificial Sequence
  Synthetic Polynucleotide
taatacgactcactataggggcacaaatcggatgtgatccttaatcctcgaacagaggagacgaggaatgaggatcacaaacctggcggcagcgcaaaagatg

SEQ ID NO: 34755 - DNA, 103 bp, Artificial Sequence
  Synthetic Polynucleotide
taatacgactcactatagggttggacgagtcctgcgccgtgagctatttaaacagaggagataaataatgcacggcgcaaacctggcggcagcgcaaaagatg

SEQ ID NO: 34756 - DNA, 103 bp, Artificial Sequence
  Synthetic Polynucleotide
taatacgactcactatagggtggcacaggaggggcagaagtcgagccacgaacagaggagacgtggcatgacttctgccaacctggcggcagcgcaaaagatg

SEQ ID NO: 34757 - DNA, 103 bp, Artificial Sequence
  Synthetic Polynucleotide
taatacgactcactatagggggaggcgctagagcccgccacgacgcccagaacagaggagactgggcatggtggcgggcaacctggcggcagcgcaaaagatg

SEQ ID NO: 34758 - DNA, 103 bp, Artificial Sequence
  Synthetic Polynucleotide
taatacgactcactatagggcgcatccaagcttaccatacgataagctcaaacagaggagatgagctatgcgtatggtaaacctggcggcagcgcaaaagatg

SEQ ID NO: 34759 - DNA, 103 bp, Artificial Sequence
  Synthetic Polynucleotide
taatacgactcactataggggaaaaaggctaaccacaccatcaatgtctcaacagaggagagagacaatgatggtgtggaacctggcggcagcgcaaaagatg

SEQ ID NO: 34760 - DNA, 103 bp, Artificial Sequence
  Synthetic Polynucleotide
taatacgactcactatagggtagtcgaattagtcaagaaaacatgaaaaaaacagaggagatttttcatgttttcttgaaacctggcggcagcgcaaaagatg

SEQ ID NO: 34761 - DNA, 103 bp, Artificial Sequence
  Synthetic Polynucleotide
taatacgactcactatagggtggagcaagtccgtaggacgctacacggaaaacagaggagattccgtatggcgtcctacaacctggcggcagcgcaaaagatg

SEQ ID NO: 34762 - DNA, 103 bp, Artificial Sequence
  Synthetic Polynucleotide
taatacgactcactatagggccggcgtagacggagatatgtgcggaaactaacagaggagaagtttcatgacatatctcaacctggcggcagcgcaaaagatg

SEQ ID NO: 34763 - DNA, 103 bp, Artificial Sequence
  Synthetic Polynucleotide
taatacgactcactatagggcctcgaccccgtagtgtcgctagattacgcaacagaggagagcgtaaatgagcgacactaacctggcggcagcgcaaaagatg

SEQ ID NO: 34764 - DNA, 103 bp, Artificial Sequence
  Synthetic Polynucleotide
taatacgactcactataggggaggatctcgctgacttcggcgctttgttcaacagaggagagaacaaatggccgaagtcaacctggcggcagcgcaaaagatg

SEQ ID NO: 34765 - DNA, 103 bp, Artificial Sequence
  Synthetic Polynucleotide
taatacgactcactatagggcatggatttaacagatgcaattggctgcctaacagaggagaaggcagatgattgcatctaacctggcggcagcgcaaaagatg

SEQ ID NO: 34766 - DNA, 103 bp, Artificial Sequence
  Synthetic Polynucleotide
taatacgactcactatagggttggcatatcgcttgctaaacgcgccttataacagaggagaataaggatggtttagcaaaacctggcggcagcgcaaaagatg

SEQ ID NO: 34767 - DNA, 103 bp, Artificial Sequence
  Synthetic Polynucleotide
taatacgactcactatagggttcgcgatatctgcattttgggaacgaagtaacagaggagaacttcgatgccaaaatgcaacctggcggcagcgcaaaagatg

SEQ ID NO: 34768 - DNA, 103 bp, Artificial Sequence
  Synthetic Polynucleotide
taatacgactcactatagggaacctcggaatctcgccacgatgagcgtcaaacagaggagatgacgcatgtcgtggcgaaacctggcggcagcgcaaaagatg

SEQ ID NO: 34769 - DNA, 103 bp, Artificial Sequence
  Synthetic Polynucleotide
taatacgactcactatagggagcagcagtcgtcccctccctatcacaacaaacagaggagatgttgtatgagggaggggaacctggcggcagcgcaaaagatg

SEQ ID NO: 34770 - DNA, 103 bp, Artificial Sequence
  Synthetic Polynucleotide
taatacgactcactataggggtaatggatgtgtcttgaataatcactattaacagaggagaaatagtatgtattcaagaaacctggcggcagcgcaaaagatg

SEQ ID NO: 34771 - DNA, 103 bp, Artificial Sequence
  Synthetic Polynucleotide
taatacgactcactatagggaaggaacagtgtgaaaatcaactacaaaaaaacagaggagatttttgatgttgattttcaacctggcggcagcgcaaaagatg

SEQ ID NO: 34772 - DNA, 103 bp, Artificial Sequence
  Synthetic Polynucleotide
taatacgactcactataggggcagaggaatatgccttacttactctcgaaaacagaggagattcgagatgaagtaaggcaacctggcggcagcgcaaaagatg

SEQ ID NO: 34773 - DNA, 103 bp, Artificial Sequence
  Synthetic Polynucleotide
taatacgactcactataggggggttccctgtagatcttgccctaatgctaaacagaggagatagcatatgggcaagatcaacctggcggcagcgcaaaagatg

SEQ ID NO: 34774 - DNA, 103 bp, Artificial Sequence
  Synthetic Polynucleotide
taatacgactcactatagggctcctctcacgagcccgcaaatcaacactaaacagaggagatagtgtatgtttgcgggcaacctggcggcagcgcaaaagatg

SEQ ID NO: 34775 - DNA, 103 bp, Artificial Sequence
  Synthetic Polynucleotide
taatacgactcactatagggaaaccgcacgctctgtgaactgtagaagagaacagaggagactcttcatgagttcacagaacctggcggcagcgcaaaagatg

SEQ ID NO: 34776 - DNA, 103 bp, Artificial Sequence
  Synthetic Polynucleotide
taatacgactcactatagggccttggcaaggaggattgagcggtgcaataaacagaggagatattgcatggctcaatccaacctggcggcagcgcaaaagatg

SEQ ID NO: 34777 - DNA, 103 bp, Artificial Sequence
  Synthetic Polynucleotide
taatacgactcactataggggaatatattgagtcctcttaatcgacctagaacagaggagactaggtatgttaagaggaaacctggcggcagcgcaaaagatg

SEQ ID NO: 34778 - DNA, 103 bp, Artificial Sequence
  Synthetic Polynucleotide
taatacgactcactatagggtaatgcccgtaacccgttagcgagtttggtaacagaggagaaccaaaatggctaacgggaacctggcggcagcgcaaaagatg

SEQ ID NO: 34779 - DNA, 103 bp, Artificial Sequence
  Synthetic Polynucleotide
taatacgactcactataggggcggagtcttaactgtctcatagaagagataacagaggagaatctctatgatgagacagaacctggcggcagcgcaaaagatg

SEQ ID NO: 34780 - DNA, 103 bp, Artificial Sequence
  Synthetic Polynucleotide
taatacgactcactataggggactccccatcagcgtataatatccactgcaacagaggagagcagtgatgattatacgcaacctggcggcagcgcaaaagatg

SEQ ID NO: 34781 - DNA, 103 bp, Artificial Sequence
  Synthetic Polynucleotide
taatacgactcactatagggtacagcagcacacgaggcgacgacagagataacagaggagaatctctatggtcgcctcgaacctggcggcagcgcaaaagatg

SEQ ID NO: 34782 - DNA, 103 bp, Artificial Sequence
  Synthetic Polynucleotide
taatacgactcactatagggtgtaatccgtgatcatcagacagaaaacacaacagaggagagtgtttatggtctgatgaaacctggcggcagcgcaaaagatg

SEQ ID NO: 34783 - DNA, 103 bp, Artificial Sequence
  Synthetic Polynucleotide
taatacgactcactatagggtgttctccgggtcgaagtgccaagcccaggaacagaggagacctgggatgggcacttcgaacctggcggcagcgcaaaagatg

SEQ ID NO: 34784 - DNA, 103 bp, Artificial Sequence
  Synthetic Polynucleotide
taatacgactcactatagggctgctgaggagagctcacaatcttctaagaaacagaggagatcttagatgattgtgagcaacctggcggcagcgcaaaagatg

SEQ ID NO: 34785 - DNA, 103 bp, Artificial Sequence
  Synthetic Polynucleotide
taatacgactcactatagggaattaagtagtggggagtatgtaatggtctaacagaggagaagaccaatgcatactcccaacctggcggcagcgcaaaagatg

SEQ ID NO: 34786 - DNA, 103 bp, Artificial Sequence
  Synthetic Polynucleotide
taatacgactcactatagggctatttgttcgatcgggtgaggcctcccataacagaggagaatgggaatgctcacccgaaacctggcggcagcgcaaaagatg

SEQ ID NO: 34787 - DNA, 103 bp, Artificial Sequence
  Synthetic Polynucleotide
taatacgactcactatagggccgccacaaccggtactcaatactgcgctaaacagaggagatagcgcatgattgagtacaacctggcggcagcgcaaaagatg

SEQ ID NO: 34788 - DNA, 103 bp, Artificial Sequence
  Synthetic Polynucleotide
taatacgactcactatagggcgcgggcgtaatcgtcctcgtagcagcggtaacagaggagaaccgctatgacgaggacgaacctggcggcagcgcaaaagatg

SEQ ID NO: 34789 - DNA, 103 bp, Artificial Sequence
  Synthetic Polynucleotide
taatacgactcactatagggctgcgttggctaatcaccaggatttagcgcaacagaggagagcgctaatgcctggtgataacctggcggcagcgcaaaagatg

SEQ ID NO: 34790 - DNA, 103 bp, Artificial Sequence
  Synthetic Polynucleotide
taatacgactcactatagggtggtcacgcgacatctgctataggattcataacagaggagaatgaatatgatagcagataacctggcggcagcgcaaaagatg

SEQ ID NO: 34791 - DNA, 103 bp, Artificial Sequence
  Synthetic Polynucleotide
taatacgactcactatagggcccacattaacgctcaaaacgcgttactcaaacagaggagatgagtaatgcgttttgagaacctggcggcagcgcaaaagatg

SEQ ID NO: 34792 - DNA, 103 bp, Artificial Sequence
  Synthetic Polynucleotide
taatacgactcactatagggcaggaagatcggaggagattgtctccgcctaacagaggagaaggcggatgcaatctcctaacctggcggcagcgcaaaagatg

SEQ ID NO: 34793 - DNA, 103 bp, Artificial Sequence
  Synthetic Polynucleotide
taatacgactcactataggggacgtgtagataccctgagtatcctgtgtgaacagaggagacacacaatgtactcagggaacctggcggcagcgcaaaagatg

SEQ ID NO: 34794 - DNA, 103 bp, Artificial Sequence
  Synthetic Polynucleotide
taatacgactcactatagggatgggatataggcgatcagggtcacaaggtaacagaggagaaccttgatgccctgatcgaacctggcggcagcgcaaaagatg

SEQ ID NO: 34795 - DNA, 103 bp, Artificial Sequence
  Synthetic Polynucleotide
taatacgactcactataggggacactgatgtacggtgctagataaagaacaacagaggagagttcttatgctagcaccgaacctggcggcagcgcaaaagatg

SEQ ID NO: 34796 - DNA, 103 bp, Artificial Sequence
  Synthetic Polynucleotide
taatacgactcactataggggttccaagctgaggtggatatgccggtacgaacagaggagacgtaccatgatatccaccaacctggcggcagcgcaaaagatg

SEQ ID NO: 34797 - DNA, 103 bp, Artificial Sequence
  Synthetic Polynucleotide
taatacgactcactatagggtgcagcgggatacaactacaatggactgaaaacagaggagattcagtatgttgtagttgaacctggcggcagcgcaaaagatg

SEQ ID NO: 34798 - DNA, 103 bp, Artificial Sequence
  Synthetic Polynucleotide
taatacgactcactatagggtaattagtaacccgtacagggaggaggcataacagaggagaatgcctatgccctgtacgaacctggcggcagcgcaaaagatg

SEQ ID NO: 34799 - DNA, 103 bp, Artificial Sequence
  Synthetic Polynucleotide
taatacgactcactatagggataaaccgaacaacatgtagatcaccagctaacagaggagaagctggatgtctacatgtaacctggcggcagcgcaaaagatg

SEQ ID NO: 34800 - DNA, 103 bp, Artificial Sequence
  Synthetic Polynucleotide
taatacgactcactatagggcgctgatatagacaattcgtacttggcaataacagaggagaattgccatgtacgaattgaacctggcggcagcgcaaaagatg

SEQ ID NO: 34801 - DNA, 103 bp, Artificial Sequence
  Synthetic Polynucleotide
taatacgactcactatagggcgtttgggtagccttgccctgcggtgtgcgaacagaggagacgcacaatgcagggcaagaacctggcggcagcgcaaaagatg

SEQ ID NO: 34802 - DNA, 103 bp, Artificial Sequence
  Synthetic Polynucleotide
taatacgactcactatagggtctaggcctacatctagtcgaccttagaggaacagaggagacctctaatgtcgactagaaacctggcggcagcgcaaaagatg

SEQ ID NO: 34803 - DNA, 103 bp, Artificial Sequence
  Synthetic Polynucleotide
taatacgactcactataggggccggtccttaggatgacaaactccggcggaacagaggagaccgccgatgtttgtcatcaacctggcggcagcgcaaaagatg

SEQ ID NO: 34804 - DNA, 103 bp, Artificial Sequence
  Synthetic Polynucleotide
taatacgactcactatagggtcttgactactgcttagtctaattccgaccaacagaggagaggtcggatgtagactaagaacctggcggcagcgcaaaagatg

SEQ ID NO: 34805 - DNA, 103 bp, Artificial Sequence
  Synthetic Polynucleotide
taatacgactcactatagggcgacgcagcggcccacagatcccttgtcttaacagaggagaaagacaatggatctgtggaacctggcggcagcgcaaaagatg

SEQ ID NO: 34806 - DNA, 103 bp, Artificial Sequence
  Synthetic Polynucleotide
taatacgactcactatagggtgaccggtactcaatcccctcgctgcttcgaacagaggagacgaagcatggaggggattaacctggcggcagcgcaaaagatg

SEQ ID NO: 34807 - DNA, 103 bp, Artificial Sequence
  Synthetic Polynucleotide
taatacgactcactataggggaaggaggtgtggggccgttagtgatagtgaacagaggagacactatatgtaacggcccaacctggcggcagcgcaaaagatg

SEQ ID NO: 34808 - DNA, 103 bp, Artificial Sequence
  Synthetic Polynucleotide
taatacgactcactatagggcttctaaatagtttacaatagatgcagaggaacagaggagacctctgatgctattgtaaaacctggcggcagcgcaaaagatg

SEQ ID NO: 34809 - DNA, 103 bp, Artificial Sequence
  Synthetic Polynucleotide
taatacgactcactatagggcccggacgtacgtatcgccattccgacgttaacagaggagaaacgtcatgatggcgataaacctggcggcagcgcaaaagatg

SEQ ID NO: 34810 - DNA, 103 bp, Artificial Sequence
  Synthetic Polynucleotide
taatacgactcactatagggacgcaacatcgagcgatcgagtgaggactaaacagaggagatagtccatgctcgatcgcaacctggcggcagcgcaaaagatg

SEQ ID NO: 34811 - DNA, 103 bp, Artificial Sequence
  Synthetic Polynucleotide
taatacgactcactatagggtactcgccttaataaacgctaattgtgaccaacagaggagaggtcacatgtagcgtttaaacctggcggcagcgcaaaagatg

SEQ ID NO: 34812 - DNA, 103 bp, Artificial Sequence
  Synthetic Polynucleotide
taatacgactcactatagggtgacatcccactacgtatgaattagatttgaacagaggagacaaatcatgttcatacgtaacctggcggcagcgcaaaagatg

SEQ ID NO: 34813 - DNA, 103 bp, Artificial Sequence
  Synthetic Polynucleotide
taatacgactcactatagggagggacgcgctggagtatagtgccgagggtaacagaggagaaccctcatgactatactcaacctggcggcagcgcaaaagatg

SEQ ID NO: 34814 - DNA, 103 bp, Artificial Sequence
  Synthetic Polynucleotide
taatacgactcactataggggggcgcagaataatcggaagcacccattcgaacagaggagacgaatgatggcttccgataacctggcggcagcgcaaaagatg

SEQ ID NO: 34815 - DNA, 103 bp, Artificial Sequence
  Synthetic Polynucleotide
taatacgactcactatagggcgttgagcgagtcagcatcaaccgggaccaaacagaggagatggtccatgttgatgctgaacctggcggcagcgcaaaagatg

SEQ ID NO: 34816 - DNA, 103 bp, Artificial Sequence
  Synthetic Polynucleotide
taatacgactcactataggggaatcatagttgccccattttatcagttgtaacagaggagaacaactatgaaaatggggaacctggcggcagcgcaaaagatg

SEQ ID NO: 34817 - DNA, 103 bp, Artificial Sequence
  Synthetic Polynucleotide
taatacgactcactatagggtacctgtgttcgataccgcggcaacggaataacagaggagaattccgatgccgcggtataacctggcggcagcgcaaaagatg

SEQ ID NO: 34818 - DNA, 103 bp, Artificial Sequence
  Synthetic Polynucleotide
taatacgactcactatagggatgagaggttgaatcactacttcgcaagcaaacagaggagatgcttgatgagtagtgataacctggcggcagcgcaaaagatg

SEQ ID NO: 34819 - DNA, 103 bp, Artificial Sequence
  Synthetic Polynucleotide
taatacgactcactatagggagctgaattgctactgaattcggacagccgaacagaggagacggctgatggaattcagtaacctggcggcagcgcaaaagatg

SEQ ID NO: 34820 - DNA, 103 bp, Artificial Sequence
  Synthetic Polynucleotide
taatacgactcactatagggtgatattaactgggagtgagagaaaagtcaaacagaggagatgacttatgtctcactccaacctggcggcagcgcaaaagatg

SEQ ID NO: 34821 - DNA, 103 bp, Artificial Sequence
  Synthetic Polynucleotide
taatacgactcactatagggggatcctccagcagtcagtattaacaatataacagaggagaatattgatgatactgactaacctggcggcagcgcaaaagatg

SEQ ID NO: 34822 - DNA, 103 bp, Artificial Sequence
  Synthetic Polynucleotide
taatacgactcactatagggttatatattaccaaaccattgcatctagctaacagaggagaagctagatgcaatggtttaacctggcggcagcgcaaaagatg

SEQ ID NO: 34823 - DNA, 103 bp, Artificial Sequence
  Synthetic Polynucleotide
taatacgactcactatagggcgagcttcggccctacctggtctaaacgagaacagaggagactcgttatgaccaggtagaacctggcggcagcgcaaaagatg

SEQ ID NO: 34824 - DNA, 103 bp, Artificial Sequence
  Synthetic Polynucleotide
taatacgactcactatagggagttaaggaatggatcaagtaaggcagggcaacagaggagagccctgatgtacttgatcaacctggcggcagcgcaaaagatg

SEQ ID NO: 34825 - DNA, 103 bp, Artificial Sequence
  Synthetic Polynucleotide
taatacgactcactatagggcaaacccggtgggtagtttgttgcactgctaacagaggagaagcagtatgacaaactacaacctggcggcagcgcaaaagatg

SEQ ID NO: 34826 - DNA, 103 bp, Artificial Sequence
  Synthetic Polynucleotide
taatacgactcactataggggagtcggaatccgtccttctccgctagtggaacagaggagaccactaatggagaaggacaacctggcggcagcgcaaaagatg

SEQ ID NO: 34827 - DNA, 103 bp, Artificial Sequence
  Synthetic Polynucleotide
taatacgactcactatagggtgcgtggcctttatcctcacccagcgcggtaacagaggagaaccgcgatgggtgaggataacctggcggcagcgcaaaagatg

SEQ ID NO: 34828 - DNA, 103 bp, Artificial Sequence
  Synthetic Polynucleotide
taatacgactcactatagggtccaacatcagtgcgctcgtgccaaggttgaacagaggagacaacctatgcacgagcgcaacctggcggcagcgcaaaagatg

SEQ ID NO: 34829 - DNA, 103 bp, Artificial Sequence
  Synthetic Polynucleotide
taatacgactcactatagggattcaaatacctctttgctttcttacatctaacagaggagaagatgtatgaaagcaaagaacctggcggcagcgcaaaagatg

SEQ ID NO: 34830 - DNA, 103 bp, Artificial Sequence
  Synthetic Polynucleotide
taatacgactcactatagggcaacgtccttcgaaaagtttaaagtgtcgcaacagaggagagcgacaatgtaaacttttaacctggcggcagcgcaaaagatg

SEQ ID NO: 34831 - DNA, 103 bp, Artificial Sequence
  Synthetic Polynucleotide
taatacgactcactatagggtacagggggaaagcgccctaggcactgtacaacagaggagagtacagatgctagggcgcaacctggcggcagcgcaaaagatg

SEQ ID NO: 34832 - DNA, 103 bp, Artificial Sequence
  Synthetic Polynucleotide
taatacgactcactatagggatgacctaaccccacagggcgcagcgacgcaacagaggagagcgtcgatgcgccctgtgaacctggcggcagcgcaaaagatg

SEQ ID NO: 34833 - DNA, 103 bp, Artificial Sequence
  Synthetic Polynucleotide
taatacgactcactataggggatcacgcatcgactgtggtatacgtggcaaacagaggagatgccacatgtaccacagtaacctggcggcagcgcaaaagatg

SEQ ID NO: 34834 - DNA, 103 bp, Artificial Sequence
  Synthetic Polynucleotide
taatacgactcactatagggtgtgcctcacagggcgcgacacattagtagaacagaggagactactaatgtgtcgcgccaacctggcggcagcgcaaaagatg

SEQ ID NO: 34835 - DNA, 103 bp, Artificial Sequence
  Synthetic Polynucleotide
taatacgactcactatagggacatccaatagtcgcctcgctacacaatgcaacagaggagagcattgatgagcgaggcgaacctggcggcagcgcaaaagatg

SEQ ID NO: 34836 - DNA, 103 bp, Artificial Sequence
  Synthetic Polynucleotide
taatacgactcactatagggatcacctaccagagaatatgatatgccataaacagaggagatatggcatgtcatattctaacctggcggcagcgcaaaagatg

SEQ ID NO: 34837 - DNA, 103 bp, Artificial Sequence
  Synthetic Polynucleotide
taatacgactcactatagggatggggcaaccactcgtcctttctttatgcaacagaggagagcataaatgaaggacgagaacctggcggcagcgcaaaagatg

SEQ ID NO: 34838 - DNA, 103 bp, Artificial Sequence
  Synthetic Polynucleotide
taatacgactcactatagggcctcctttcttctttaagttagcaccatacaacagaggagagtatggatgtaacttaaaaacctggcggcagcgcaaaagatg

SEQ ID NO: 34839 - DNA, 103 bp, Artificial Sequence
  Synthetic Polynucleotide
taatacgactcactatagggacagataacacgcagttcgcattgagacggaacagaggagaccgtctatgtgcgaactgaacctggcggcagcgcaaaagatg

SEQ ID NO: 34840 - DNA, 103 bp, Artificial Sequence
  Synthetic Polynucleotide
taatacgactcactatagggactggatgaaattgatctggacacctcttaaacagaggagataagagatgtccagatcaaacctggcggcagcgcaaaagatg

SEQ ID NO: 34841 - DNA, 103 bp, Artificial Sequence
  Synthetic Polynucleotide
taatacgactcactatagggaaggcgattgtatcgctcccatcctgtcctaacagaggagaaggacaatgtgggagcgaaacctggcggcagcgcaaaagatg

SEQ ID NO: 34842 - DNA, 103 bp, Artificial Sequence
  Synthetic Polynucleotide
taatacgactcactataggggagggctcatcaagcgacacacgtcgcgacaacagaggagagtcgcgatgtgtgtcgctaacctggcggcagcgcaaaagatg

SEQ ID NO: 34843 - DNA, 103 bp, Artificial Sequence
  Synthetic Polynucleotide
taatacgactcactatagggcgaaagttggaatcggattttggcctgggcaacagaggagagcccagatgaaaatccgaaacctggcggcagcgcaaaagatg

SEQ ID NO: 34844 - DNA, 103 bp, Artificial Sequence
  Synthetic Polynucleotide
taatacgactcactataggggagctaaatgccttggccatcgggtgatgtaacagaggagaacatcaatggatggccaaaacctggcggcagcgcaaaagatg

SEQ ID NO: 34845 - DNA, 103 bp, Artificial Sequence
  Synthetic Polynucleotide
taatacgactcactatagggatttagggtcagagcctcaaaccattagggaacagaggagaccctaaatgtttgaggctaacctggcggcagcgcaaaagatg

SEQ ID NO: 34846 - DNA, 103 bp, Artificial Sequence
  Synthetic Polynucleotide
taatacgactcactatagggttcagtggcacccgcaggttctatctaataaacagaggagatattagatggaacctgcgaacctggcggcagcgcaaaagatg

SEQ ID NO: 34847 - DNA, 103 bp, Artificial Sequence
  Synthetic Polynucleotide
taatacgactcactataggggacataattgtcataattgatgtactgccgaacagaggagacggcagatgatcaattataacctggcggcagcgcaaaagatg

SEQ ID NO: 34848 - DNA, 103 bp, Artificial Sequence
  Synthetic Polynucleotide
taatacgactcactatagggggaaggaaaatcctatttcctggatgcctcaacagaggagagaggcaatgaggaaatagaacctggcggcagcgcaaaagatg

SEQ ID NO: 34849 - DNA, 103 bp, Artificial Sequence
  Synthetic Polynucleotide
taatacgactcactatagggtacatgaaagccacacggccttctcccaaaaacagaggagatttgggatgaggccgtgtaacctggcggcagcgcaaaagatg

SEQ ID NO: 34850 - DNA, 103 bp, Artificial Sequence
  Synthetic Polynucleotide
taatacgactcactatagggatcggcaatttcgccagtgagcacacacataacagaggagaatgtgtatgctcactggcaacctggcggcagcgcaaaagatg

SEQ ID NO: 34851 - DNA, 103 bp, Artificial Sequence
  Synthetic Polynucleotide
taatacgactcactatagggtttataataagacaaggactgagatcattgaacagaggagacaatgaatgcagtccttgaacctggcggcagcgcaaaagatg

SEQ ID NO: 34852 - DNA, 103 bp, Artificial Sequence
  Synthetic Polynucleotide
taatacgactcactatagggccctagagcgtagtgggggcacggttcaataacagaggagaattgaaatgtgcccccacaacctggcggcagcgcaaaagatg

SEQ ID NO: 34853 - DNA, 103 bp, Artificial Sequence
  Synthetic Polynucleotide
taatacgactcactatagggcagagctctggacagaaatccacactctgaaacagaggagatcagagatgggatttctgaacctggcggcagcgcaaaagatg

SEQ ID NO: 34854 - DNA, 103 bp, Artificial Sequence
  Synthetic Polynucleotide
taatacgactcactataggggaaccagcgatgtcgccaacgtggaatactaacagaggagaagtattatgcgttggcgaaacctggcggcagcgcaaaagatg

SEQ ID NO: 34855 - DNA, 103 bp, Artificial Sequence
  Synthetic Polynucleotide
taatacgactcactatagggtgtagtcgagtcttctccgccacgattggaaacagaggagatccaatatgggcggagaaaacctggcggcagcgcaaaagatg

SEQ ID NO: 34856 - DNA, 103 bp, Artificial Sequence
  Synthetic Polynucleotide
taatacgactcactatagggtgcaaacttatcggctctacatcccgccttaacagaggagaaaggcgatgtgtagagccaacctggcggcagcgcaaaagatg

SEQ ID NO: 34857 - DNA, 103 bp, Artificial Sequence
  Synthetic Polynucleotide
taatacgactcactatagggggtcgtacacaaaaaattccctcgaccgtcaacagaggagagacggtatggggaattttaacctggcggcagcgcaaaagatg

SEQ ID NO: 34858 - DNA, 103 bp, Artificial Sequence
  Synthetic Polynucleotide
taatacgactcactatagggagtggacgttgggtgataggtcgccaaataaacagaggagatatttgatgacctatcacaacctggcggcagcgcaaaagatg

SEQ ID NO: 34859 - DNA, 103 bp, Artificial Sequence
  Synthetic Polynucleotide
taatacgactcactatagggttcgctgttcacagtgcttgtggtgactctaacagaggagaagagtcatgacaagcactaacctggcggcagcgcaaaagatg

SEQ ID NO: 34860 - DNA, 103 bp, Artificial Sequence
  Synthetic Polynucleotide
taatacgactcactatagggacccctggcgtttcttccccaggttactgtaacagaggagaacagtaatgtggggaagaaacctggcggcagcgcaaaagatg

SEQ ID NO: 34861 - DNA, 103 bp, Artificial Sequence
  Synthetic Polynucleotide
taatacgactcactatagggcataccgcaaagatatgtttctaatttttgaacagaggagacaaaaaatggaaacatataacctggcggcagcgcaaaagatg

SEQ ID NO: 34862 - DNA, 103 bp, Artificial Sequence
  Synthetic Polynucleotide
taatacgactcactatagggctagctgcagtcgtccatggaattttagcgaacagaggagacgctaaatgtccatggacaacctggcggcagcgcaaaagatg

SEQ ID NO: 34863 - DNA, 103 bp, Artificial Sequence
  Synthetic Polynucleotide
taatacgactcactatagggtggataaatcccttcgcgtttagaccatgcaacagaggagagcatggatgaaacgcgaaaacctggcggcagcgcaaaagatg

SEQ ID NO: 34864 - DNA, 103 bp, Artificial Sequence
  Synthetic Polynucleotide
taatacgactcactatagggcttcatggacttacgacccgatacgattacaacagaggagagtaatcatgtcgggtcgtaacctggcggcagcgcaaaagatg

SEQ ID NO: 34865 - DNA, 103 bp, Artificial Sequence
  Synthetic Polynucleotide
taatacgactcactataggggtggttacgttttaagtacaagcctgcgtgaacagaggagacacgcaatgttgtacttaaacctggcggcagcgcaaaagatg

SEQ ID NO: 34866 - DNA, 103 bp, Artificial Sequence
  Synthetic Polynucleotide
taatacgactcactatagggtacgcaagacatagtcgagattacgaaacaaacagaggagatgtttcatgatctcgactaacctggcggcagcgcaaaagatg

SEQ ID NO: 34867 - DNA, 103 bp, Artificial Sequence
  Synthetic Polynucleotide
taatacgactcactatagggttcctgaggtaccgggatggatacggctacaacagaggagagtagccatgtccatcccgaacctggcggcagcgcaaaagatg

SEQ ID NO: 34868 - DNA, 103 bp, Artificial Sequence
  Synthetic Polynucleotide
taatacgactcactatagggagctgaataactgaagaattaaagctaccaaacagaggagatggtagatgtaattcttcaacctggcggcagcgcaaaagatg

SEQ ID NO: 34869 - DNA, 103 bp, Artificial Sequence
  Synthetic Polynucleotide
taatacgactcactatagggtaaagcaaagtgtaatccggaaaggctggaaacagaggagatccagcatgtccggattaaacctggcggcagcgcaaaagatg

SEQ ID NO: 34870 - DNA, 103 bp, Artificial Sequence
  Synthetic Polynucleotide
taatacgactcactatagggatatgacgcgtaatgacacatgagttgtataacagaggagaatacaaatgatgtgtcataacctggcggcagcgcaaaagatg

SEQ ID NO: 34871 - DNA, 103 bp, Artificial Sequence
  Synthetic Polynucleotide
taatacgactcactatagggcgaataaatggacgcaggccaagctctagaaacagaggagatctagaatgtggcctgcgaacctggcggcagcgcaaaagatg

SEQ ID NO: 34872 - DNA, 103 bp, Artificial Sequence
  Synthetic Polynucleotide
taatacgactcactatagggaattggtgtaccaagccaggatcaaggaggaacagaggagacctcctatgtcctggcttaacctggcggcagcgcaaaagatg

SEQ ID NO: 34873 - DNA, 103 bp, Artificial Sequence
  Synthetic Polynucleotide
taatacgactcactatagggtagtatactaagcatgcgcgaccatggaataacagaggagaattccaatgtcgcgcatgaacctggcggcagcgcaaaagatg

SEQ ID NO: 34874 - DNA, 103 bp, Artificial Sequence
  Synthetic Polynucleotide
taatacgactcactataggggagcagtcttggattggatgagggcgattcaacagaggagagaatcgatgtcatccaataacctggcggcagcgcaaaagatg

SEQ ID NO: 34875 - DNA, 103 bp, Artificial Sequence
  Synthetic Polynucleotide
taatacgactcactatagggtacatatcaatcccgtttgaagtcgggcgcaacagaggagagcgcccatgttcaaacggaacctggcggcagcgcaaaagatg

SEQ ID NO: 34876 - DNA, 103 bp, Artificial Sequence
  Synthetic Polynucleotide
taatacgactcactatagggatatgctaacgctcaaacggaggtagtcgaaacagaggagatcgactatgtccgtttgaaacctggcggcagcgcaaaagatg

SEQ ID NO: 34877 - DNA, 103 bp, Artificial Sequence
  Synthetic Polynucleotide
taatacgactcactataggggggaaaaagggctactttaacttccacctgaacagaggagacaggtgatggttaaagtaaacctggcggcagcgcaaaagatg

SEQ ID NO: 34878 - DNA, 103 bp, Artificial Sequence
  Synthetic Polynucleotide
taatacgactcactatagggtcctagatggatgcgcggaaactctacaccaacagaggagaggtgtaatgtttccgcgcaacctggcggcagcgcaaaagatg

SEQ ID NO: 34879 - DNA, 103 bp, Artificial Sequence
  Synthetic Polynucleotide
taatacgactcactatagggctgtcagctacgtaggaagagttatctttgaacagaggagacaaagaatgctcttcctaaacctggcggcagcgcaaaagatg

SEQ ID NO: 34880 - DNA, 103 bp, Artificial Sequence
  Synthetic Polynucleotide
taatacgactcactatagggcaactatcgctctgagccacgctaggcaagaacagaggagacttgccatgcgtggctcaaacctggcggcagcgcaaaagatg

SEQ ID NO: 34881 - DNA, 103 bp, Artificial Sequence
  Synthetic Polynucleotide
taatacgactcactataggggagagccctaccagcgagccatgttactctaacagaggagaagagtaatgtggctcgctaacctggcggcagcgcaaaagatg

SEQ ID NO: 34882 - DNA, 103 bp, Artificial Sequence
  Synthetic Polynucleotide
taatacgactcactatagggaccgatccgagggacaagtaaaaccagttcaacagaggagagaactgatgttacttgtcaacctggcggcagcgcaaaagatg

SEQ ID NO: 34883 - DNA, 103 bp, Artificial Sequence
  Synthetic Polynucleotide
taatacgactcactatagggagacggggccttacttcgtggttccgggcgaacagaggagacgcccgatgccacgaagtaacctggcggcagcgcaaaagatg

SEQ ID NO: 34884 - DNA, 103 bp, Artificial Sequence
  Synthetic Polynucleotide
taatacgactcactatagggcattagtgcgtttcgtgcaggtcgtgcgacaacagaggagagtcgcaatgcctgcacgaaacctggcggcagcgcaaaagatg

SEQ ID NO: 34885 - DNA, 103 bp, Artificial Sequence
  Synthetic Polynucleotide
taatacgactcactatagggtcatggggagtggcaaccgagtgtaccggaaacagaggagatccggtatgctcggttgcaacctggcggcagcgcaaaagatg

SEQ ID NO: 34886 - DNA, 103 bp, Artificial Sequence
  Synthetic Polynucleotide
taatacgactcactatagggtctttctactgtccctgaaaggtgtagcgtaacagaggagaacgctaatgctttcagggaacctggcggcagcgcaaaagatg

SEQ ID NO: 34887 - DNA, 103 bp, Artificial Sequence
  Synthetic Polynucleotide
taatacgactcactatagggcaaatcaataggaggaaacattatgcactaaacagaggagatagtgcatgatgtttcctaacctggcggcagcgcaaaagatg

SEQ ID NO: 34888 - DNA, 103 bp, Artificial Sequence
  Synthetic Polynucleotide
taatacgactcactatagggccaaagctcagtagcgactcctcttgcatcaacagaggagagatgcaatgggagtcgctaacctggcggcagcgcaaaagatg

SEQ ID NO: 34889 - DNA, 103 bp, Artificial Sequence
  Synthetic Polynucleotide
taatacgactcactatagggaacgacgcatgatcaaatccccttactgtcaacagaggagagacagtatggggatttgaaacctggcggcagcgcaaaagatg

SEQ ID NO: 34890 - DNA, 103 bp, Artificial Sequence
  Synthetic Polynucleotide
taatacgactcactatagggcgttggttgagtacatagacgatctctgagaacagaggagactcagaatgcgtctatgtaacctggcggcagcgcaaaagatg

SEQ ID NO: 34891 - DNA, 103 bp, Artificial Sequence
  Synthetic Polynucleotide
taatacgactcactatagggcggattttcgagatatcgtcctacctaaaaaacagaggagattttagatgggacgatataacctggcggcagcgcaaaagatg

SEQ ID NO: 34892 - DNA, 103 bp, Artificial Sequence
  Synthetic Polynucleotide
taatacgactcactatagggtactttcccaccggggcaagttgatctacaaacagaggagatgtagaatgacttgccccaacctggcggcagcgcaaaagatg

SEQ ID NO: 34893 - DNA, 103 bp, Artificial Sequence
  Synthetic Polynucleotide
taatacgactcactatagggcttatgtcccccgataggaagacggcctacaacagaggagagtaggcatgcttcctatcaacctggcggcagcgcaaaagatg

SEQ ID NO: 34894 - DNA, 103 bp, Artificial Sequence
  Synthetic Polynucleotide
taatacgactcactatagggtcaagaccgtgttgtcggccgcggaccaagaacagaggagacttggtatgcggccgacaaacctggcggcagcgcaaaagatg

SEQ ID NO: 34895 - DNA, 103 bp, Artificial Sequence
  Synthetic Polynucleotide
taatacgactcactatagggaaccagtagtggggcacgaggcatcggggtaacagaggagaaccccgatgcctcgtgccaacctggcggcagcgcaaaagatg

SEQ ID NO: 34896 - DNA, 103 bp, Artificial Sequence
  Synthetic Polynucleotide
taatacgactcactatagggtctcagtgtgctgtggactagaatcagcgaaacagaggagatcgctgatgctagtccacaacctggcggcagcgcaaaagatg

SEQ ID NO: 34897 - DNA, 103 bp, Artificial Sequence
  Synthetic Polynucleotide
taatacgactcactataggggaaagtcccttgcataggagggtaaacggaaacagaggagatccgttatgcctcctatgaacctggcggcagcgcaaaagatg

SEQ ID NO: 34898 - DNA, 103 bp, Artificial Sequence
  Synthetic Polynucleotide
taatacgactcactatagggtggctgagaccccgagcggtgcactagtttaacagaggagaaaactaatgcaccgctcgaacctggcggcagcgcaaaagatg

SEQ ID NO: 34899 - DNA, 103 bp, Artificial Sequence
  Synthetic Polynucleotide
taatacgactcactataggggcagccacgattaactatcagttcgccccgaacagaggagacggggcatgctgatagttaacctggcggcagcgcaaaagatg

SEQ ID NO: 34900 - DNA, 103 bp, Artificial Sequence
  Synthetic Polynucleotide
taatacgactcactataggggatgcttctcctagcaacgttgaatgtgagaacagaggagactcacaatgaacgttgctaacctggcggcagcgcaaaagatg

SEQ ID NO: 34901 - DNA, 103 bp, Artificial Sequence
  Synthetic Polynucleotide
taatacgactcactatagggggcaacggccttggtaatttgcactgcaggaacagaggagacctgcaatgcaaattaccaacctggcggcagcgcaaaagatg

SEQ ID NO: 34902 - DNA, 103 bp, Artificial Sequence
  Synthetic Polynucleotide
taatacgactcactatagggctctttgtaccccaacacgtcaagggaacaaacagaggagatgttccatggacgtgttgaacctggcggcagcgcaaaagatg

SEQ ID NO: 34903 - DNA, 103 bp, Artificial Sequence
  Synthetic Polynucleotide
taatacgactcactatagggagtaccgccgatacagatgcacgcgaagaaaacagaggagattcttcatgtgcatctgtaacctggcggcagcgcaaaagatg

SEQ ID NO: 34904 - DNA, 103 bp, Artificial Sequence
  Synthetic Polynucleotide
taatacgactcactatagggctgtcatgcctatatgttcgccaaaccgccaacagaggagaggcggtatggcgaacataaacctggcggcagcgcaaaagatg

SEQ ID NO: 34905 - DNA, 103 bp, Artificial Sequence
  Synthetic Polynucleotide
taatacgactcactatagggtgccaatggaagtcataagtttaggtccggaacagaggagaccggacatgaacttatgaaacctggcggcagcgcaaaagatg

SEQ ID NO: 34906 - DNA, 103 bp, Artificial Sequence
  Synthetic Polynucleotide
taatacgactcactatagggagactaagagtgacgggtaacaccttgcgaaacagaggagatcgcaaatggttacccgtaacctggcggcagcgcaaaagatg

SEQ ID NO: 34907 - DNA, 103 bp, Artificial Sequence
  Synthetic Polynucleotide
taatacgactcactatagggaatcaaagaataaggggaaccatgtcactcaacagaggagagagtgaatgggttcccctaacctggcggcagcgcaaaagatg

SEQ ID NO: 34908 - DNA, 103 bp, Artificial Sequence
  Synthetic Polynucleotide
taatacgactcactatagggaaagagcctactctctggcaacggacctacaacagaggagagtaggtatgttgccagagaacctggcggcagcgcaaaagatg

SEQ ID NO: 34909 - DNA, 103 bp, Artificial Sequence
  Synthetic Polynucleotide
taatacgactcactatagggcttttggtacgaaattgattgtctgtgcgaaacagaggagatcgcacatgcaatcaattaacctggcggcagcgcaaaagatg

SEQ ID NO: 34910 - DNA, 103 bp, Artificial Sequence
  Synthetic Polynucleotide
taatacgactcactatagggccgctagcaacttgcccgtacacctaaaggaacagaggagacctttaatggtacgggcaaacctggcggcagcgcaaaagatg

SEQ ID NO: 34911 - DNA, 103 bp, Artificial Sequence
  Synthetic Polynucleotide
taatacgactcactatagggaaggtctttcattactattgaccaagcagtaacagaggagaactgctatgtcaatagtaaacctggcggcagcgcaaaagatg

SEQ ID NO: 34912 - DNA, 103 bp, Artificial Sequence
  Synthetic Polynucleotide
taatacgactcactatagggaccctcatgtccccctcgagcgtattctacaacagaggagagtagaaatggctcgagggaacctggcggcagcgcaaaagatg

SEQ ID NO: 34913 - DNA, 103 bp, Artificial Sequence
  Synthetic Polynucleotide
taatacgactcactataggggcaattaaatggagaccgagttactgacagaacagaggagactgtcaatgactcggtctaacctggcggcagcgcaaaagatg

SEQ ID NO: 34914 - DNA, 103 bp, Artificial Sequence
  Synthetic Polynucleotide
taatacgactcactatagggtatgccgcgagttgtctaaaagaggatgataacagaggagaatcatcatgttttagacaaacctggcggcagcgcaaaagatg

SEQ ID NO: 34915 - DNA, 103 bp, Artificial Sequence
  Synthetic Polynucleotide
taatacgactcactataggggttgaccgtaatctttcgccttgcaagggaaacagaggagatcccttatgaggcgaaagaacctggcggcagcgcaaaagatg

SEQ ID NO: 34916 - DNA, 103 bp, Artificial Sequence
  Synthetic Polynucleotide
taatacgactcactataggggtcggcttgtcgtacttaacagtcataaaaaacagaggagattttatatgtgttaagtaaacctggcggcagcgcaaaagatg

SEQ ID NO: 34917 - DNA, 103 bp, Artificial Sequence
  Synthetic Polynucleotide
taatacgactcactatagggcgacaaggaatgtatggcttggccggggccaacagaggagaggccccatgcaagccataaacctggcggcagcgcaaaagatg

SEQ ID NO: 34918 - DNA, 103 bp, Artificial Sequence
  Synthetic Polynucleotide
taatacgactcactataggggcctcccatatgccacttccaacgattgataacagaggagaatcaatatgtggaagtggaacctggcggcagcgcaaaagatg

SEQ ID NO: 34919 - DNA, 103 bp, Artificial Sequence
  Synthetic Polynucleotide
taatacgactcactatagggtatatttgggtctatgatgaccgccgcccaaacagaggagatgggcgatggtcatcataaacctggcggcagcgcaaaagatg

SEQ ID NO: 34920 - DNA, 103 bp, Artificial Sequence
  Synthetic Polynucleotide
taatacgactcactatagggctcacggaacttaaagtgaggcgagcctagaacagaggagactaggcatgcctcactttaacctggcggcagcgcaaaagatg

SEQ ID NO: 34921 - DNA, 103 bp, Artificial Sequence
  Synthetic Polynucleotide
taatacgactcactatagggcctatatttatcgaatctaaaagattatctaacagaggagaagataaatgtttagattcaacctggcggcagcgcaaaagatg

SEQ ID NO: 34922 - DNA, 103 bp, Artificial Sequence
  Synthetic Polynucleotide
taatacgactcactatagggcgagactaccgcgggctgtacgcgagttgcaacagaggagagcaactatggtacagcccaacctggcggcagcgcaaaagatg

SEQ ID NO: 34923 - DNA, 103 bp, Artificial Sequence
  Synthetic Polynucleotide
taatacgactcactatagggcgtgatcgatttaatcgaggcaatcaaaaaaacagaggagatttttgatggcctcgattaacctggcggcagcgcaaaagatg

SEQ ID NO: 34924 - DNA, 103 bp, Artificial Sequence
  Synthetic Polynucleotide
taatacgactcactatagggtatcttcaatgaagtgacatgaattggtggaacagaggagaccaccaatgcatgtcactaacctggcggcagcgcaaaagatg

SEQ ID NO: 34925 - DNA, 103 bp, Artificial Sequence
  Synthetic Polynucleotide
taatacgactcactatagggcgagtaccttgctgtgaccatgtatctcagaacagaggagactgagaatgatggtcacaaacctggcggcagcgcaaaagatg

SEQ ID NO: 34926 - DNA, 103 bp, Artificial Sequence
  Synthetic Polynucleotide
taatacgactcactatagggatagacggagtaaactagcccgcgacgtttaacagaggagaaaacgtatggggctagttaacctggcggcagcgcaaaagatg

SEQ ID NO: 34927 - DNA, 103 bp, Artificial Sequence
  Synthetic Polynucleotide
taatacgactcactatagggcgtttatggctggccgcaggagtttaatcaaacagaggagatgattaatgtcctgcggcaacctggcggcagcgcaaaagatg

SEQ ID NO: 34928 - DNA, 103 bp, Artificial Sequence
  Synthetic Polynucleotide
taatacgactcactataggggccggttttacacttcgttggggcgtccagaacagaggagactggacatgccaacgaagaacctggcggcagcgcaaaagatg

SEQ ID NO: 34929 - DNA, 103 bp, Artificial Sequence
  Synthetic Polynucleotide
taatacgactcactatagggtaaaggaacaggggaatattctgcatgggaaacagaggagatcccatatggaatattccaacctggcggcagcgcaaaagatg

SEQ ID NO: 34930 - DNA, 103 bp, Artificial Sequence
  Synthetic Polynucleotide
taatacgactcactatagggtctacttcaaagaatccgagcaggccttggaacagaggagaccaaggatggctcggattaacctggcggcagcgcaaaagatg

SEQ ID NO: 34931 - DNA, 103 bp, Artificial Sequence
  Synthetic Polynucleotide
taatacgactcactatagggaacacgaacatagcgtttacgggtgagtaaaacagaggagattactcatgcgtaaacgcaacctggcggcagcgcaaaagatg

SEQ ID NO: 34932 - DNA, 103 bp, Artificial Sequence
  Synthetic Polynucleotide
taatacgactcactatagggcgtccgccactagttcggaaatcaccggataacagaggagaatccggatgtttccgaacaacctggcggcagcgcaaaagatg

SEQ ID NO: 34933 - DNA, 103 bp, Artificial Sequence
  Synthetic Polynucleotide
taatacgactcactataggggcgctggattagcgccacgcttatcagcgcaacagaggagagcgctgatgagcgtggcgaacctggcggcagcgcaaaagatg

SEQ ID NO: 34934 - DNA, 103 bp, Artificial Sequence
  Synthetic Polynucleotide
taatacgactcactatagggcagaggaagggtggtgtgtccatatcggttaacagaggagaaaccgaatgggacacaccaacctggcggcagcgcaaaagatg

SEQ ID NO: 34935 - DNA, 103 bp, Artificial Sequence
  Synthetic Polynucleotide
taatacgactcactatagggagatcggagaaaactgatcggctgagttagaacagaggagactaactatgccgatcagtaacctggcggcagcgcaaaagatg

SEQ ID NO: 34936 - DNA, 103 bp, Artificial Sequence
  Synthetic Polynucleotide
taatacgactcactataggggggatggacaggaaatgtctcctcttcattaacagaggagaaatgaaatggagacatttaacctggcggcagcgcaaaagatg

SEQ ID NO: 34937 - DNA, 103 bp, Artificial Sequence
  Synthetic Polynucleotide
taatacgactcactatagggagaacttcggctcgctaggactgccggtcaaacagaggagatgaccgatggtcctagcgaacctggcggcagcgcaaaagatg

SEQ ID NO: 34938 - DNA, 103 bp, Artificial Sequence
  Synthetic Polynucleotide
taatacgactcactatagggctaagttaccgctaaggagtgaaactgtacaacagaggagagtacagatgcactccttaaacctggcggcagcgcaaaagatg

SEQ ID NO: 34939 - DNA, 103 bp, Artificial Sequence
  Synthetic Polynucleotide
taatacgactcactatagggtcatgatcatcatgccgtcatcatgtctgcaacagaggagagcagacatgatgacggcaaacctggcggcagcgcaaaagatg

SEQ ID NO: 34940 - DNA, 103 bp, Artificial Sequence
  Synthetic Polynucleotide
taatacgactcactatagggtcatgcctctaatagcgcctctcagcacccaacagaggagagggtgcatggaggcgctaaacctggcggcagcgcaaaagatg

SEQ ID NO: 34941 - DNA, 103 bp, Artificial Sequence
  Synthetic Polynucleotide
taatacgactcactataggggaaaacaaacgtatctgggtctagggagtaaacagaggagatactccatggacccagataacctggcggcagcgcaaaagatg

SEQ ID NO: 34942 - DNA, 103 bp, Artificial Sequence
  Synthetic Polynucleotide
taatacgactcactatagggcagggcaacggcggggtattcgaaacatggaacagaggagaccatgtatggaataccccaacctggcggcagcgcaaaagatg

SEQ ID NO: 34943 - DNA, 103 bp, Artificial Sequence
  Synthetic Polynucleotide
taatacgactcactatagggacccagggcactccatgagcacagccacgaaacagaggagatcgtggatgtgctcatggaacctggcggcagcgcaaaagatg

SEQ ID NO: 34944 - DNA, 103 bp, Artificial Sequence
  Synthetic Polynucleotide
taatacgactcactatagggtagctgatacttaatacctcaatctaagagaacagaggagactcttaatgtgaggtattaacctggcggcagcgcaaaagatg

SEQ ID NO: 34945 - DNA, 103 bp, Artificial Sequence
  Synthetic Polynucleotide
taatacgactcactataggggttaacaccacctctgccggagcaggagctaacagaggagaagctccatgtccggcagaaacctggcggcagcgcaaaagatg

SEQ ID NO: 34946 - DNA, 103 bp, Artificial Sequence
  Synthetic Polynucleotide
taatacgactcactatagggcatcgacgccttagattagcccccacctcgaacagaggagacgaggtatgggctaatctaacctggcggcagcgcaaaagatg

SEQ ID NO: 34947 - DNA, 103 bp, Artificial Sequence
  Synthetic Polynucleotide
taatacgactcactatagggagcgagccgcgtccatcctggagcgcgttgaacagaggagacaacgcatgccaggatggaacctggcggcagcgcaaaagatg

SEQ ID NO: 34948 - DNA, 103 bp, Artificial Sequence
  Synthetic Polynucleotide
taatacgactcactataggggtgctccgctattacgtatacacggctataaacagaggagatatagcatggtatacgtaaacctggcggcagcgcaaaagatg

SEQ ID NO: 34949 - DNA, 103 bp, Artificial Sequence
  Synthetic Polynucleotide
taatacgactcactatagggtataaccataaaaatataagtatttgcacgaacagaggagacgtgcaatgacttatattaacctggcggcagcgcaaaagatg

SEQ ID NO: 34950 - DNA, 103 bp, Artificial Sequence
  Synthetic Polynucleotide
taatacgactcactataggggacagatagccctaacccctaacggggaagaacagaggagacttcccatgtaggggttaaacctggcggcagcgcaaaagatg

SEQ ID NO: 34951 - DNA, 103 bp, Artificial Sequence
  Synthetic Polynucleotide
taatacgactcactataggggatttactcactaaacatagggtgatttgaaacagaggagatcaaatatgcctatgtttaacctggcggcagcgcaaaagatg

SEQ ID NO: 34952 - DNA, 103 bp, Artificial Sequence
  Synthetic Polynucleotide
taatacgactcactatagggcacgtgttctcaagttgaccttacatccaaaacagaggagattggatatgaggtcaactaacctggcggcagcgcaaaagatg

SEQ ID NO: 34953 - DNA, 103 bp, Artificial Sequence
  Synthetic Polynucleotide
taatacgactcactatagggccgtcgcagtggcctcatatatcctggaccaacagaggagaggtccaatgtatatgaggaacctggcggcagcgcaaaagatg

SEQ ID NO: 34954 - DNA, 103 bp, Artificial Sequence
  Synthetic Polynucleotide
taatacgactcactataggggcaaggtctgtatcaagtactatcctccccaacagaggagaggggagatgagtacttgaaacctggcggcagcgcaaaagatg

SEQ ID NO: 34955 - DNA, 103 bp, Artificial Sequence
  Synthetic Polynucleotide
taatacgactcactatagggacagtgagcaaagagacacatcgtctcctaaacagaggagataggagatgatgtgtctcaacctggcggcagcgcaaaagatg

SEQ ID NO: 34956 - DNA, 103 bp, Artificial Sequence
  Synthetic Polynucleotide
taatacgactcactataggggtccgtttcatcagggacattgcgaaaggcaacagaggagagcctttatgaatgtccctaacctggcggcagcgcaaaagatg

SEQ ID NO: 34957 - DNA, 103 bp, Artificial Sequence
  Synthetic Polynucleotide
taatacgactcactatagggctatgagccgcagggcgtatagatatctctaacagaggagaagagatatgtatacgcccaacctggcggcagcgcaaaagatg

SEQ ID NO: 34958 - DNA, 103 bp, Artificial Sequence
  Synthetic Polynucleotide
taatacgactcactataggggatgcaatctaaacgccccgcgaaccattcaacagaggagagaatggatggcggggcgtaacctggcggcagcgcaaaagatg

SEQ ID NO: 34959 - DNA, 103 bp, Artificial Sequence
  Synthetic Polynucleotide
taatacgactcactatagggtcagtccacgatttcgctcatatatatgcgaacagaggagacgcataatgatgagcgaaaacctggcggcagcgcaaaagatg

SEQ ID NO: 34960 - DNA, 103 bp, Artificial Sequence
  Synthetic Polynucleotide
taatacgactcactatagggggaaacacggctggcgttagaaactctgaaaacagaggagattcagaatgtctaacgccaacctggcggcagcgcaaaagatg

SEQ ID NO: 34961 - DNA, 103 bp, Artificial Sequence
  Synthetic Polynucleotide
taatacgactcactatagggccagaagaaccacagcgttgtcgcctcgtaaacagaggagatacgagatgacaacgctgaacctggcggcagcgcaaaagatg

SEQ ID NO: 34962 - DNA, 103 bp, Artificial Sequence
  Synthetic Polynucleotide
taatacgactcactatagggcaaaccgaacctagccctccatggtcgcgcaacagaggagagcgcgaatgtggagggctaacctggcggcagcgcaaaagatg

SEQ ID NO: 34963 - DNA, 103 bp, Artificial Sequence
  Synthetic Polynucleotide
taatacgactcactataggggggcatacggtggaatggatactatgttgcaacagaggagagcaacaatgtatccattcaacctggcggcagcgcaaaagatg

SEQ ID NO: 34964 - DNA, 103 bp, Artificial Sequence
  Synthetic Polynucleotide
taatacgactcactatagggctcgctgcattctgtctgacttaatttcggaacagaggagaccgaaaatgagtcagacaaacctggcggcagcgcaaaagatg

SEQ ID NO: 34965 - DNA, 103 bp, Artificial Sequence
  Synthetic Polynucleotide
taatacgactcactatagggttgtgttcctcatattaatttcttgttgctaacagaggagaagcaacatgaaattaataaacctggcggcagcgcaaaagatg

SEQ ID NO: 34966 - DNA, 103 bp, Artificial Sequence
  Synthetic Polynucleotide
taatacgactcactatagggggtccctagggctaggagactcatctgctcaacagaggagagagcagatgagtctcctaaacctggcggcagcgcaaaagatg

SEQ ID NO: 34967 - DNA, 103 bp, Artificial Sequence
  Synthetic Polynucleotide
taatacgactcactatagggcgtttctgtcctggctagccgggcgcccttaacagaggagaaagggcatgcggctagccaacctggcggcagcgcaaaagatg

SEQ ID NO: 34968 - DNA, 103 bp, Artificial Sequence
  Synthetic Polynucleotide
taatacgactcactatagggtgtgccactcctaccttctcttgacagatgaacagaggagacatctgatgagagaaggtaacctggcggcagcgcaaaagatg

SEQ ID NO: 34969 - DNA, 103 bp, Artificial Sequence
  Synthetic Polynucleotide
taatacgactcactataggggccgcggcaccgatttgccaagcggccacaaacagaggagatgtggcatgttggcaaataacctggcggcagcgcaaaagatg

SEQ ID NO: 34970 - DNA, 103 bp, Artificial Sequence
  Synthetic Polynucleotide
taatacgactcactataggggtttgtccgatgcagcacgatattatgaataacagaggagaattcatatgatcgtgctgaacctggcggcagcgcaaaagatg

SEQ ID NO: 34971 - DNA, 103 bp, Artificial Sequence
  Synthetic Polynucleotide
taatacgactcactataggggtgtgggttaaacatagccggcgctgcaaaaacagaggagatttgcaatgccggctatgaacctggcggcagcgcaaaagatg

SEQ ID NO: 34972 - DNA, 103 bp, Artificial Sequence
  Synthetic Polynucleotide
taatacgactcactatagggtcttgcgctggaggtttgatgtgctctcagaacagaggagactgagaatgcatcaaaccaacctggcggcagcgcaaaagatg

SEQ ID NO: 34973 - DNA, 103 bp, Artificial Sequence
  Synthetic Polynucleotide
taatacgactcactatagggtcgtcctgggatccgattgtgtaatttcctaacagaggagaaggaaaatgcacaatcggaacctggcggcagcgcaaaagatg

SEQ ID NO: 34974 - DNA, 103 bp, Artificial Sequence
  Synthetic Polynucleotide
taatacgactcactatagggggccctcagaggcagcttctgtagccgcgaaacagaggagatcgcggatgcagaagctgaacctggcggcagcgcaaaagatg

SEQ ID NO: 34975 - DNA, 103 bp, Artificial Sequence
  Synthetic Polynucleotide
taatacgactcactatagggtgtaatatcatcggcgaatgggcgaagtccaacagaggagaggacttatgccattcgccaacctggcggcagcgcaaaagatg

SEQ ID NO: 34976 - DNA, 103 bp, Artificial Sequence
  Synthetic Polynucleotide
taatacgactcactatagggcctcagcccctatgccttcgtctaacgcctaacagaggagaaggcgtatgacgaaggcaaacctggcggcagcgcaaaagatg

SEQ ID NO: 34977 - DNA, 103 bp, Artificial Sequence
  Synthetic Polynucleotide
taatacgactcactatagggcggcaggccaagacgcaattctcagcccgcaacagaggagagcgggcatggaattgcgtaacctggcggcagcgcaaaagatg

SEQ ID NO: 34978 - DNA, 103 bp, Artificial Sequence
  Synthetic Polynucleotide
taatacgactcactatagggcaatattacctcccatcgtgggttggacataacagaggagaatgtccatgccacgatggaacctggcggcagcgcaaaagatg

SEQ ID NO: 34979 - DNA, 103 bp, Artificial Sequence
  Synthetic Polynucleotide
taatacgactcactatagggcacgacgcatgtgctggagactaaagggtcaacagaggagagaccctatggtctccagcaacctggcggcagcgcaaaagatg

SEQ ID NO: 34980 - DNA, 103 bp, Artificial Sequence
  Synthetic Polynucleotide
taatacgactcactatagggaaacttctgtactttctttttttgacctaaaacagaggagattaggtatgaaaaagaaaaacctggcggcagcgcaaaagatg

SEQ ID NO: 34981 - DNA, 103 bp, Artificial Sequence
  Synthetic Polynucleotide
taatacgactcactataggggaaggaaaatcagaattcagtagaagactaaacagaggagatagtctatgactgaattcaacctggcggcagcgcaaaagatg

SEQ ID NO: 34982 - DNA, 103 bp, Artificial Sequence
  Synthetic Polynucleotide
taatacgactcactatagggccgtcaaatcaacgtccttggaacggggttaacagaggagaaaccccatgccaaggacgaacctggcggcagcgcaaaagatg

SEQ ID NO: 34983 - DNA, 103 bp, Artificial Sequence
  Synthetic Polynucleotide
taatacgactcactatagggagacattcgcatgtgggacttttaatggttaacagaggagaaaccatatgaagtcccacaacctggcggcagcgcaaaagatg

SEQ ID NO: 34984 - DNA, 103 bp, Artificial Sequence
  Synthetic Polynucleotide
taatacgactcactatagggccagtgcctggttcaagtgtcgcgctcaacaacagaggagagttgagatggacacttgaaacctggcggcagcgcaaaagatg

SEQ ID NO: 34985 - DNA, 103 bp, Artificial Sequence
  Synthetic Polynucleotide
taatacgactcactatagggacctcgaccgactagggatctgtgtcgactaacagaggagaagtcgaatgagatccctaaacctggcggcagcgcaaaagatg

SEQ ID NO: 34986 - DNA, 103 bp, Artificial Sequence
  Synthetic Polynucleotide
taatacgactcactatagggtgagagatcgctgggtgtcgtaatgactaaaacagaggagattagtcatgacgacacccaacctggcggcagcgcaaaagatg

SEQ ID NO: 34987 - DNA, 103 bp, Artificial Sequence
  Synthetic Polynucleotide
taatacgactcactatagggcaaacggactctgttgaacgttttttacataacagaggagaatgtaaatgacgttcaacaacctggcggcagcgcaaaagatg

SEQ ID NO: 34988 - DNA, 103 bp, Artificial Sequence
  Synthetic Polynucleotide
taatacgactcactatagggctaaaattgcgggggatactggctcgaggtaacagaggagaacctcgatgcagtatcccaacctggcggcagcgcaaaagatg

SEQ ID NO: 34989 - DNA, 103 bp, Artificial Sequence
  Synthetic Polynucleotide
taatacgactcactatagggctgctgcatagcgtgcatcacttactaccgaacagaggagacggtagatggtgatgcacaacctggcggcagcgcaaaagatg

SEQ ID NO: 34990 - DNA, 103 bp, Artificial Sequence
  Synthetic Polynucleotide
taatacgactcactatagggggtcgtgggtttagcattagagatagtgtcaacagaggagagacactatgtctaatgctaacctggcggcagcgcaaaagatg

SEQ ID NO: 34991 - DNA, 103 bp, Artificial Sequence
  Synthetic Polynucleotide
taatacgactcactatagggtattcgagggttaacgcttgcagttttgtcaacagaggagagacaaaatggcaagcgttaacctggcggcagcgcaaaagatg

SEQ ID NO: 34992 - DNA, 103 bp, Artificial Sequence
  Synthetic Polynucleotide
taatacgactcactatagggcgcctacctagcgctaacctctaagaattaaacagaggagataattcatggaggttagcaacctggcggcagcgcaaaagatg

SEQ ID NO: 34993 - DNA, 103 bp, Artificial Sequence
  Synthetic Polynucleotide
taatacgactcactatagggtggtaccacaccaaacgaccgtacacttgaaacagaggagatcaagtatgcggtcgtttaacctggcggcagcgcaaaagatg

SEQ ID NO: 34994 - DNA, 103 bp, Artificial Sequence
  Synthetic Polynucleotide
taatacgactcactatagggacctacgactatcaaaactaaatgggaggtaacagaggagaacctccatgttagttttgaacctggcggcagcgcaaaagatg

SEQ ID NO: 34995 - DNA, 103 bp, Artificial Sequence
  Synthetic Polynucleotide
taatacgactcactatagggcgggagaaattaagccaagggctacccgtaaacagaggagatacgggatgcccttggctaacctggcggcagcgcaaaagatg

SEQ ID NO: 34996 - DNA, 103 bp, Artificial Sequence
  Synthetic Polynucleotide
taatacgactcactatagggaagactctagtgtccaacggatagcgtctaaacagaggagatagacgatgtccgttggaaacctggcggcagcgcaaaagatg

SEQ ID NO: 34997 - DNA, 103 bp, Artificial Sequence
  Synthetic Polynucleotide
taatacgactcactatagggtgtgctcagatcatctatagaaccgcttgtaacagaggagaacaagcatgtctatagataacctggcggcagcgcaaaagatg

SEQ ID NO: 34998 - DNA, 103 bp, Artificial Sequence
  Synthetic Polynucleotide
taatacgactcactatagggaaggtcccgcttaatacggctgtgggcaagaacagaggagacttgccatgagccgtattaacctggcggcagcgcaaaagatg

SEQ ID NO: 34999 - DNA, 103 bp, Artificial Sequence
  Synthetic Polynucleotide
taatacgactcactatagggagcaaagggagcagtgacaacgcatgacagaacagaggagactgtcaatggttgtcactaacctggcggcagcgcaaaagatg

SEQ ID NO: 35000 - DNA, 103 bp, Artificial Sequence
  Synthetic Polynucleotide
taatacgactcactatagggccacagttctcgaaagctgggtataaccgaaacagaggagatcggttatgcccagctttaacctggcggcagcgcaaaagatg

SEQ ID NO: 35001 - DNA, 103 bp, Artificial Sequence
  Synthetic Polynucleotide
taatacgactcactatagggtattccgtgtgtactttggagtaccccgcaaacagaggagatgcgggatgctccaaagtaacctggcggcagcgcaaaagatg

SEQ ID NO: 35002 - DNA, 103 bp, Artificial Sequence
  Synthetic Polynucleotide
taatacgactcactatagggtaaaccttgtggcaacgattagaccgtggtaacagaggagaaccacgatgtaatcgttgaacctggcggcagcgcaaaagatg

SEQ ID NO: 35003 - DNA, 103 bp, Artificial Sequence
  Synthetic Polynucleotide
taatacgactcactatagggactaagtgggcacataccgttttgatatttaacagaggagaaaatatatgaacggtatgaacctggcggcagcgcaaaagatg

SEQ ID NO: 35004 - DNA, 103 bp, Artificial Sequence
  Synthetic Polynucleotide
taatacgactcactatagggtagtcccggactaaggagtttaatgtgtggaacagaggagaccacacatgaaactccttaacctggcggcagcgcaaaagatg

SEQ ID NO: 35005 - DNA, 103 bp, Artificial Sequence
  Synthetic Polynucleotide
taatacgactcactatagggcttcggaagcgcattcccaacggtaactccaacagaggagaggagttatggttgggaataacctggcggcagcgcaaaagatg

SEQ ID NO: 35006 - DNA, 103 bp, Artificial Sequence
  Synthetic Polynucleotide
taatacgactcactatagggaatcagctatggcgcccgtgtccgaaacttaacagaggagaaagtttatgacacgggcgaacctggcggcagcgcaaaagatg

SEQ ID NO: 35007 - DNA, 103 bp, Artificial Sequence
  Synthetic Polynucleotide
taatacgactcactatagggtgggccgtcaatcagatcacggtgccgtccaacagaggagaggacggatgcgtgatctgaacctggcggcagcgcaaaagatg

SEQ ID NO: 35008 - DNA, 103 bp, Artificial Sequence
  Synthetic Polynucleotide
taatacgactcactatagggaaatattgaatcatcctcccggctagtaaaaacagaggagatttactatgcgggaggataacctggcggcagcgcaaaagatg

SEQ ID NO: 35009 - DNA, 103 bp, Artificial Sequence
  Synthetic Polynucleotide
taatacgactcactatagggtgcgataccggtcatcacatgacaactcaaaacagaggagattgagtatgcatgtgatgaacctggcggcagcgcaaaagatg

SEQ ID NO: 35010 - DNA, 103 bp, Artificial Sequence
  Synthetic Polynucleotide
taatacgactcactatagggtttagagcataatggaatcatgtcttgaggaacagaggagacctcaaatgatgattccaaacctggcggcagcgcaaaagatg

SEQ ID NO: 35011 - DNA, 103 bp, Artificial Sequence
  Synthetic Polynucleotide
taatacgactcactataggggcgaggaaacatgctgtcattgaacagaagaacagaggagacttctgatgaatgacagcaacctggcggcagcgcaaaagatg

SEQ ID NO: 35012 - DNA, 103 bp, Artificial Sequence
  Synthetic Polynucleotide
taatacgactcactataggggaggtttttacatcgcaccccgaacggcgaaacagaggagatcgccgatgggggtgcgaaacctggcggcagcgcaaaagatg

SEQ ID NO: 35013 - DNA, 103 bp, Artificial Sequence
  Synthetic Polynucleotide
taatacgactcactatagggcatccctatccgcggagtcaatcattcaaaaacagaggagatttgaaatgttgactccgaacctggcggcagcgcaaaagatg

SEQ ID NO: 35014 - DNA, 103 bp, Artificial Sequence
  Synthetic Polynucleotide
taatacgactcactatagggttactatctgacctctcttagcttcacaagaacagaggagacttgtgatgctaagagagaacctggcggcagcgcaaaagatg

SEQ ID NO: 35015 - DNA, 103 bp, Artificial Sequence
  Synthetic Polynucleotide
taatacgactcactatagggtgggaagcagctgcgatatgtccgatggataacagaggagaatccatatgacatatcgcaacctggcggcagcgcaaaagatg

SEQ ID NO: 35016 - DNA, 103 bp, Artificial Sequence
  Synthetic Polynucleotide
taatacgactcactatagggtttgatcatgcacacaagaggagcgtgccaaacagaggagatggcacatgcctcttgtgaacctggcggcagcgcaaaagatg

SEQ ID NO: 35017 - DNA, 103 bp, Artificial Sequence
  Synthetic Polynucleotide
taatacgactcactatagggtatattctaagcgggagatcgtgattatcaaacagaggagatgataaatgcgatctcccaacctggcggcagcgcaaaagatg

SEQ ID NO: 35018 - DNA, 103 bp, Artificial Sequence
  Synthetic Polynucleotide
taatacgactcactatagggatagtctcgtccgtacgggatctcatctcgaacagaggagacgagatatgatcccgtacaacctggcggcagcgcaaaagatg

SEQ ID NO: 35019 - DNA, 103 bp, Artificial Sequence
  Synthetic Polynucleotide
taatacgactcactatagggctggagaatacctaggcactttggcctcacaacagaggagagtgaggatgaagtgcctaaacctggcggcagcgcaaaagatg

SEQ ID NO: 35020 - DNA, 103 bp, Artificial Sequence
  Synthetic Polynucleotide
taatacgactcactatagggacgtttaatttccaacctgtgacccgagaaaacagaggagattctcgatgcacaggttgaacctggcggcagcgcaaaagatg

SEQ ID NO: 35021 - DNA, 103 bp, Artificial Sequence
  Synthetic Polynucleotide
taatacgactcactatagggttttgttcccatgagccaggagattcttgcaacagaggagagcaagaatgtcctggctcaacctggcggcagcgcaaaagatg

SEQ ID NO: 35022 - DNA, 103 bp, Artificial Sequence
  Synthetic Polynucleotide
taatacgactcactatagggttttcaatgacattcggtaagtaaggtttaaacagaggagataaaccatgcttaccgaaaacctggcggcagcgcaaaagatg

SEQ ID NO: 35023 - DNA, 103 bp, Artificial Sequence
  Synthetic Polynucleotide
taatacgactcactatagggtcttaaaatcctatgttcaccatcgtgaagaacagaggagacttcacatgggtgaacataacctggcggcagcgcaaaagatg

SEQ ID NO: 35024 - DNA, 103 bp, Artificial Sequence
  Synthetic Polynucleotide
taatacgactcactataggggagacttgagagactgacgtgagtctggaaaacagaggagattccagatgcacgtcagtaacctggcggcagcgcaaaagatg

SEQ ID NO: 35025 - DNA, 103 bp, Artificial Sequence
  Synthetic Polynucleotide
taatacgactcactatagggtgggcgtacagttccctgagattcgaaattaacagaggagaaatttcatgtctcagggaaacctggcggcagcgcaaaagatg

SEQ ID NO: 35026 - DNA, 103 bp, Artificial Sequence
  Synthetic Polynucleotide
taatacgactcactatagggtacttcagactctacggcctgcctgaacagaacagaggagactgttcatgcaggccgtaaacctggcggcagcgcaaaagatg

SEQ ID NO: 35027 - DNA, 103 bp, Artificial Sequence
  Synthetic Polynucleotide
taatacgactcactatagggtctcctgacataatcaagcgagtccaaaagaacagaggagacttttgatgtcgcttgataacctggcggcagcgcaaaagatg

SEQ ID NO: 35028 - DNA, 103 bp, Artificial Sequence
  Synthetic Polynucleotide
taatacgactcactatagggtacgactacgaaccgtagatctgtggacgtaacagaggagaacgtccatggatctacggaacctggcggcagcgcaaaagatg

SEQ ID NO: 35029 - DNA, 103 bp, Artificial Sequence
  Synthetic Polynucleotide
taatacgactcactataggggccgtaagcgcagtcggcagcccatgtggcaacagaggagagccacaatggctgccgacaacctggcggcagcgcaaaagatg

SEQ ID NO: 35030 - DNA, 103 bp, Artificial Sequence
  Synthetic Polynucleotide
taatacgactcactatagggtgccgctcagtgcttcatacagatgtaaggaacagaggagaccttacatgtgtatgaagaacctggcggcagcgcaaaagatg

SEQ ID NO: 35031 - DNA, 103 bp, Artificial Sequence
  Synthetic Polynucleotide
taatacgactcactatagggagtccgtaccctcatccgcgatgtaatctcaacagaggagagagattatgtcgcggatgaacctggcggcagcgcaaaagatg

SEQ ID NO: 35032 - DNA, 103 bp, Artificial Sequence
  Synthetic Polynucleotide
taatacgactcactataggggtcaatgaatattcagcgaatgcggatttgaacagaggagacaaatcatgattcgctgaaacctggcggcagcgcaaaagatg

SEQ ID NO: 35033 - DNA, 103 bp, Artificial Sequence
  Synthetic Polynucleotide
taatacgactcactatagggaaggtgaatgccacctttacttcgctcgctaacagaggagaagcgagatgagtaaaggtaacctggcggcagcgcaaaagatg

SEQ ID NO: 35034 - DNA, 103 bp, Artificial Sequence
  Synthetic Polynucleotide
taatacgactcactataggggcacctgatgctactgcccctcgtcgacgaaacagaggagatcgtcgatgaggggcagtaacctggcggcagcgcaaaagatg

SEQ ID NO: 35035 - DNA, 103 bp, Artificial Sequence
  Synthetic Polynucleotide
taatacgactcactatagggcgcttcaatcacttgcggtcccagacggaaaacagaggagattccgtatgggaccgcaaaacctggcggcagcgcaaaagatg

SEQ ID NO: 35036 - DNA, 103 bp, Artificial Sequence
  Synthetic Polynucleotide
taatacgactcactatagggtgccgagctgggtctacgtactgaacgagcaacagaggagagctcgtatggtacgtagaaacctggcggcagcgcaaaagatg

SEQ ID NO: 35037 - DNA, 103 bp, Artificial Sequence
  Synthetic Polynucleotide
taatacgactcactatagggggacgtatcctcttgacgactaccctgtcgaacagaggagacgacagatgagtcgtcaaaacctggcggcagcgcaaaagatg

SEQ ID NO: 35038 - DNA, 103 bp, Artificial Sequence
  Synthetic Polynucleotide
taatacgactcactataggggggtgcagagtcaaacgtctgcggatgggcaacagaggagagcccatatgcagacgtttaacctggcggcagcgcaaaagatg

SEQ ID NO: 35039 - DNA, 103 bp, Artificial Sequence
  Synthetic Polynucleotide
taatacgactcactataggggctataggacaagtagggtccggcctggttaacagaggagaaaccagatgggaccctacaacctggcggcagcgcaaaagatg

SEQ ID NO: 35040 - DNA, 103 bp, Artificial Sequence
  Synthetic Polynucleotide
taatacgactcactataggggaccgaacactggtgcatggattgaatagaaacagaggagatctattatgtccatgcacaacctggcggcagcgcaaaagatg

SEQ ID NO: 35041 - DNA, 103 bp, Artificial Sequence
  Synthetic Polynucleotide
taatacgactcactatagggggctaggcgcttgcccaggaaggactctcaaacagaggagatgagagatgttcctgggcaacctggcggcagcgcaaaagatg

SEQ ID NO: 35042 - DNA, 103 bp, Artificial Sequence
  Synthetic Polynucleotide
taatacgactcactatagggtttgcacgccaggggctaggtcggcccaacaacagaggagagttgggatgacctagcccaacctggcggcagcgcaaaagatg

SEQ ID NO: 35043 - DNA, 103 bp, Artificial Sequence
  Synthetic Polynucleotide
taatacgactcactataggggaccgccatgcttgcggttctccgctaactaacagaggagaagttagatgagaaccgcaaacctggcggcagcgcaaaagatg

SEQ ID NO: 35044 - DNA, 103 bp, Artificial Sequence
  Synthetic Polynucleotide
taatacgactcactatagggaagatgaagcagtcgcatgcagcattgcggaacagaggagaccgcaaatgtgcatgcgaaacctggcggcagcgcaaaagatg

SEQ ID NO: 35045 - DNA, 103 bp, Artificial Sequence
  Synthetic Polynucleotide
taatacgactcactatagggtagggtcctctaacatggccactttttcccaacagaggagagggaaaatgtggccatgtaacctggcggcagcgcaaaagatg

SEQ ID NO: 35046 - DNA, 103 bp, Artificial Sequence
  Synthetic Polynucleotide
taatacgactcactatagggaccgcggtgaaggccacgcgtggcttgtggaacagaggagaccacaaatgacgcgtggcaacctggcggcagcgcaaaagatg

SEQ ID NO: 35047 - DNA, 103 bp, Artificial Sequence
  Synthetic Polynucleotide
taatacgactcactatagggcgatcggcagatcgcacgttggcggaattaaacagaggagataattcatgcaacgtgcgaacctggcggcagcgcaaaagatg

SEQ ID NO: 35048 - DNA, 103 bp, Artificial Sequence
  Synthetic Polynucleotide
taatacgactcactatagggcccccatcaactatctaactttcagtggggaacagaggagaccccacatgaagttagataacctggcggcagcgcaaaagatg

SEQ ID NO: 35049 - DNA, 103 bp, Artificial Sequence
  Synthetic Polynucleotide
taatacgactcactatagggatgccaacgtactactgcagcatcatgctaaacagaggagatagcatatggctgcagtaaacctggcggcagcgcaaaagatg

SEQ ID NO: 35050 - DNA, 103 bp, Artificial Sequence
  Synthetic Polynucleotide
taatacgactcactataggggatatctagtagcgtagtgtcaatctctagaacagaggagactagagatggacactacgaacctggcggcagcgcaaaagatg

SEQ ID NO: 35051 - DNA, 103 bp, Artificial Sequence
  Synthetic Polynucleotide
taatacgactcactatagggtgggacccggtttagggagaaccgcgggacaacagaggagagtcccgatgttctccctaaacctggcggcagcgcaaaagatg

SEQ ID NO: 35052 - DNA, 103 bp, Artificial Sequence
  Synthetic Polynucleotide
taatacgactcactatagggtgggagtggttgctatcttacacctcagccaacagaggagaggctgaatggtaagatagaacctggcggcagcgcaaaagatg

SEQ ID NO: 35053 - DNA, 103 bp, Artificial Sequence
  Synthetic Polynucleotide
taatacgactcactataggggccgacaaccagtagatggacatggaacttaacagaggagaaagttcatggtccatctaaacctggcggcagcgcaaaagatg

SEQ ID NO: 35054 - DNA, 103 bp, Artificial Sequence
  Synthetic Polynucleotide
taatacgactcactataggggggttggactatcaaatcccccagctggacaacagaggagagtccagatgggggatttgaacctggcggcagcgcaaaagatg

SEQ ID NO: 35055 - DNA, 103 bp, Artificial Sequence
  Synthetic Polynucleotide
taatacgactcactatagggaaggtacgatatctatccagacgccaatccaacagaggagaggattgatgtctggatagaacctggcggcagcgcaaaagatg

SEQ ID NO: 35056 - DNA, 103 bp, Artificial Sequence
  Synthetic Polynucleotide
taatacgactcactatagggacttacaatgttttgtgggcgatttctaagaacagaggagacttagaatgcgcccacaaaacctggcggcagcgcaaaagatg

SEQ ID NO: 35057 - DNA, 103 bp, Artificial Sequence
  Synthetic Polynucleotide
taatacgactcactatagggttgtacttacctggaattcagcctcattcaaacagaggagatgaatgatgctgaattccaacctggcggcagcgcaaaagatg

SEQ ID NO: 35058 - DNA, 103 bp, Artificial Sequence
  Synthetic Polynucleotide
taatacgactcactatagggtgaatactggtaaacagtgatacccagcagaacagaggagactgctgatgatcactgttaacctggcggcagcgcaaaagatg

SEQ ID NO: 35059 - DNA, 103 bp, Artificial Sequence
  Synthetic Polynucleotide
taatacgactcactatagggacccgcaaactcacactgtagtcgctagttaacagaggagaaactagatgctacagtgtaacctggcggcagcgcaaaagatg

SEQ ID NO: 35060 - DNA, 103 bp, Artificial Sequence
  Synthetic Polynucleotide
taatacgactcactatagggaacaaagcgccaggaccccgcataaattgtaacagaggagaacaattatggcggggtccaacctggcggcagcgcaaaagatg

SEQ ID NO: 35061 - DNA, 103 bp, Artificial Sequence
  Synthetic Polynucleotide
taatacgactcactataggggagtaatcaaacatgacggactggaactccaacagaggagaggagttatggtccgtcataacctggcggcagcgcaaaagatg

SEQ ID NO: 35062 - DNA, 103 bp, Artificial Sequence
  Synthetic Polynucleotide
taatacgactcactataggggcaacaacttcgcgaactgcagagtacataaacagaggagatatgtaatgtgcagttcgaacctggcggcagcgcaaaagatg

SEQ ID NO: 35063 - DNA, 103 bp, Artificial Sequence
  Synthetic Polynucleotide
taatacgactcactataggggatggccagtgtcatcaccaaaccaagataaacagaggagatatcttatgttggtgatgaacctggcggcagcgcaaaagatg

SEQ ID NO: 35064 - DNA, 103 bp, Artificial Sequence
  Synthetic Polynucleotide
taatacgactcactatagggtctatcctttggcggttgcctagagcgcagaacagaggagactgcgcatgaggcaaccgaacctggcggcagcgcaaaagatg

SEQ ID NO: 35065 - DNA, 103 bp, Artificial Sequence
  Synthetic Polynucleotide
taatacgactcactatagggcacaagccatcctggttttataccccaccaaacagaggagatggtggatgataaaaccaaacctggcggcagcgcaaaagatg

SEQ ID NO: 35066 - DNA, 103 bp, Artificial Sequence
  Synthetic Polynucleotide
taatacgactcactatagggcacccagcgaggagtatgaatgatgccgggaacagaggagacccggcatgattcatactaacctggcggcagcgcaaaagatg

SEQ ID NO: 35067 - DNA, 103 bp, Artificial Sequence
  Synthetic Polynucleotide
taatacgactcactatagggaatgagccttgctcttcaaatacctgtcacaacagaggagagtgacaatgatttgaagaaacctggcggcagcgcaaaagatg

SEQ ID NO: 35068 - DNA, 103 bp, Artificial Sequence
  Synthetic Polynucleotide
taatacgactcactatagggtagctacaaaaggataagccgtaggctctgaacagaggagacagagcatgcggcttatcaacctggcggcagcgcaaaagatg

SEQ ID NO: 35069 - DNA, 103 bp, Artificial Sequence
  Synthetic Polynucleotide
taatacgactcactatagggacttaaattattcgtgctatcaccttcagcaacagaggagagctgaaatggatagcacgaacctggcggcagcgcaaaagatg

SEQ ID NO: 35070 - DNA, 103 bp, Artificial Sequence
  Synthetic Polynucleotide
taatacgactcactataggggcgccatacgctatccagaggcccagcgccaacagaggagaggcgctatgcctctggataacctggcggcagcgcaaaagatg

SEQ ID NO: 35071 - DNA, 103 bp, Artificial Sequence
  Synthetic Polynucleotide
taatacgactcactatagggcgtcctaattatccagtcgaactcttagataacagaggagaatctaaatgttcgactggaacctggcggcagcgcaaaagatg

SEQ ID NO: 35072 - DNA, 103 bp, Artificial Sequence
  Synthetic Polynucleotide
taatacgactcactataggggcacagatgaatgtcgagtatcgaattattaacagaggagaaataatatgatactcgacaacctggcggcagcgcaaaagatg

SEQ ID NO: 35073 - DNA, 103 bp, Artificial Sequence
  Synthetic Polynucleotide
taatacgactcactatagggggccttggcggtgtgcagccggggaacctaaacagaggagataggttatgcggctgcacaacctggcggcagcgcaaaagatg

SEQ ID NO: 35074 - DNA, 103 bp, Artificial Sequence
  Synthetic Polynucleotide
taatacgactcactatagggctattagtacaatcggggaagggacctccgaacagaggagacggaggatgcttccccgaaacctggcggcagcgcaaaagatg

SEQ ID NO: 35075 - DNA, 103 bp, Artificial Sequence
  Synthetic Polynucleotide
taatacgactcactataggggcccaggccgagagtacatactgcccgataaacagaggagatatcggatggtatgtactaacctggcggcagcgcaaaagatg

SEQ ID NO: 35076 - DNA, 103 bp, Artificial Sequence
  Synthetic Polynucleotide
taatacgactcactatagggcagcaatcgcgggtattcggaggcctaggaaacagaggagatcctagatgtccgaatacaacctggcggcagcgcaaaagatg

SEQ ID NO: 35077 - DNA, 103 bp, Artificial Sequence
  Synthetic Polynucleotide
taatacgactcactatagggattacggaacgcatgcatctacctatcgcaaacagaggagatgcgatatgtagatgcataacctggcggcagcgcaaaagatg

SEQ ID NO: 35078 - DNA, 103 bp, Artificial Sequence
  Synthetic Polynucleotide
taatacgactcactataggggatagaacaacccccatgttacttatcgccaacagaggagaggcgatatgtaacatgggaacctggcggcagcgcaaaagatg

SEQ ID NO: 35079 - DNA, 103 bp, Artificial Sequence
  Synthetic Polynucleotide
taatacgactcactatagggtcaggatcgtcatctcaaaccctgcagcgaaacagaggagatcgctgatgggtttgagaaacctggcggcagcgcaaaagatg

SEQ ID NO: 35080 - DNA, 103 bp, Artificial Sequence
  Synthetic Polynucleotide
taatacgactcactatagggatggatctctgcggtcaggtgattgcgcgcaacagaggagagcgcgcatgcacctgaccaacctggcggcagcgcaaaagatg

SEQ ID NO: 35081 - DNA, 103 bp, Artificial Sequence
  Synthetic Polynucleotide
taatacgactcactatagggcatgtatccgcacgtcaatcgttagactgcaacagaggagagcagtcatgcgattgacgaacctggcggcagcgcaaaagatg

SEQ ID NO: 35082 - DNA, 103 bp, Artificial Sequence
  Synthetic Polynucleotide
taatacgactcactatagggcgggcttagaaaagagtttcgcacgcactgaacagaggagacagtgcatgcgaaactctaacctggcggcagcgcaaaagatg

SEQ ID NO: 35083 - DNA, 103 bp, Artificial Sequence
  Synthetic Polynucleotide
taatacgactcactatagggacctgatgtgaggcgttcattccatctccgaacagaggagacggagaatgaatgaacgcaacctggcggcagcgcaaaagatg

SEQ ID NO: 35084 - DNA, 103 bp, Artificial Sequence
  Synthetic Polynucleotide
taatacgactcactatagggaggctgtccccggggatttccctgccccccaacagaggagaggggggatgggaaatcccaacctggcggcagcgcaaaagatg

SEQ ID NO: 35085 - DNA, 103 bp, Artificial Sequence
  Synthetic Polynucleotide
taatacgactcactatagggcagacgtaactaagcccattgaacaaattcaacagaggagagaatttatgcaatgggctaacctggcggcagcgcaaaagatg

SEQ ID NO: 35086 - DNA, 103 bp, Artificial Sequence
  Synthetic Polynucleotide
taatacgactcactataggggatcacagagtctcaggtacttaagcgcaaaacagaggagattgcgcatgagtacctgaaacctggcggcagcgcaaaagatg

SEQ ID NO: 35087 - DNA, 103 bp, Artificial Sequence
  Synthetic Polynucleotide
taatacgactcactatagggccatccggaactggcaagctctgcaagtggaacagaggagaccacttatggagcttgccaacctggcggcagcgcaaaagatg

SEQ ID NO: 35088 - DNA, 103 bp, Artificial Sequence
  Synthetic Polynucleotide
taatacgactcactatagggtagcacggaaggccaaataactcctaggtcaacagaggagagacctaatggttatttggaacctggcggcagcgcaaaagatg

SEQ ID NO: 35089 - DNA, 103 bp, Artificial Sequence
  Synthetic Polynucleotide
taatacgactcactatagggcctacctcccatgtttcctgaatatttagcaacagaggagagctaaaatgtcaggaaacaacctggcggcagcgcaaaagatg

SEQ ID NO: 35090 - DNA, 103 bp, Artificial Sequence
  Synthetic Polynucleotide
taatacgactcactatagggtgcgtctgatagcgcccagggtaaccgctaaacagaggagatagcggatgccctgggcgaacctggcggcagcgcaaaagatg

SEQ ID NO: 35091 - DNA, 103 bp, Artificial Sequence
  Synthetic Polynucleotide
taatacgactcactataggggattcacctacggaaggaagttggcgatgcaacagaggagagcatcgatgacttccttcaacctggcggcagcgcaaaagatg

SEQ ID NO: 35092 - DNA, 103 bp, Artificial Sequence
  Synthetic Polynucleotide
taatacgactcactataggggtgtcgtgaatctgtccgatttactctcgcaacagaggagagcgagaatgaatcggacaaacctggcggcagcgcaaaagatg

SEQ ID NO: 35093 - DNA, 103 bp, Artificial Sequence
  Synthetic Polynucleotide
taatacgactcactatagggtctccgcccgttactgtacaagtaataagaaacagaggagatcttatatgttgtacagtaacctggcggcagcgcaaaagatg

SEQ ID NO: 35094 - DNA, 103 bp, Artificial Sequence
  Synthetic Polynucleotide
taatacgactcactatagggagtgaagtgggacaattacttcagggacccaacagaggagagggtccatgaagtaattgaacctggcggcagcgcaaaagatg

SEQ ID NO: 35095 - DNA, 103 bp, Artificial Sequence
  Synthetic Polynucleotide
taatacgactcactatagggccgccgccgacaaggttcagtcagaagtacaacagaggagagtacttatgactgaacctaacctggcggcagcgcaaaagatg

SEQ ID NO: 35096 - DNA, 103 bp, Artificial Sequence
  Synthetic Polynucleotide
taatacgactcactatagggcctaggaaagtaaagcgtgtctaagggcataacagaggagaatgcccatggacacgcttaacctggcggcagcgcaaaagatg

SEQ ID NO: 35097 - DNA, 103 bp, Artificial Sequence
  Synthetic Polynucleotide
taatacgactcactatagggactgttaatgtatccggctggggtggcccgaacagaggagacgggccatgccagccggaaacctggcggcagcgcaaaagatg

SEQ ID NO: 35098 - DNA, 103 bp, Artificial Sequence
  Synthetic Polynucleotide
taatacgactcactatagggtactcgctatagtccttaaggttgggcggcaacagaggagagccgccatgccttaaggaaacctggcggcagcgcaaaagatg

SEQ ID NO: 35099 - DNA, 103 bp, Artificial Sequence
  Synthetic Polynucleotide
taatacgactcactatagggtccgaacgctaggtatgcgctaagaaaaggaacagaggagaccttttatgagcgcatacaacctggcggcagcgcaaaagatg

SEQ ID NO: 35100 - DNA, 103 bp, Artificial Sequence
  Synthetic Polynucleotide
taatacgactcactatagggtatggccagtctacagaaccattacgtctcaacagaggagagagacgatgtggttctgtaacctggcggcagcgcaaaagatg

SEQ ID NO: 35101 - DNA, 103 bp, Artificial Sequence
  Synthetic Polynucleotide
taatacgactcactatagggcagttctctaggtcgaatcaggttcttaataacagaggagaattaagatgctgattcgaaacctggcggcagcgcaaaagatg

SEQ ID NO: 35102 - DNA, 103 bp, Artificial Sequence
  Synthetic Polynucleotide
taatacgactcactatagggcactctaagagattataacttgcggaacggaacagaggagaccgttcatgaagttataaaacctggcggcagcgcaaaagatg

SEQ ID NO: 35103 - DNA, 103 bp, Artificial Sequence
  Synthetic Polynucleotide
taatacgactcactatagggcaccgatattccggagaggccggcagtgtcaacagaggagagacactatgggcctctccaacctggcggcagcgcaaaagatg

SEQ ID NO: 35104 - DNA, 103 bp, Artificial Sequence
  Synthetic Polynucleotide
taatacgactcactataggggcatgcgaaagcgcagtcgacctgcccgacaacagaggagagtcgggatggtcgactgcaacctggcggcagcgcaaaagatg

SEQ ID NO: 35105 - DNA, 103 bp, Artificial Sequence
  Synthetic Polynucleotide
taatacgactcactatagggcacctattaaacaagaagatgctggtcatgaacagaggagacatgacatgcatcttcttaacctggcggcagcgcaaaagatg

SEQ ID NO: 35106 - DNA, 103 bp, Artificial Sequence
  Synthetic Polynucleotide
taatacgactcactatagggacggatttcaactgacggtaaaagccacccaacagaggagagggtggatgttaccgtcaaacctggcggcagcgcaaaagatg

SEQ ID NO: 35107 - DNA, 103 bp, Artificial Sequence
  Synthetic Polynucleotide
taatacgactcactatagggcgtatcaagagtaactcagtttagccgattaacagaggagaaatcggatgaactgagttaacctggcggcagcgcaaaagatg

SEQ ID NO: 35108 - DNA, 103 bp, Artificial Sequence
  Synthetic Polynucleotide
taatacgactcactatagggtagctatcgataggacgcatcggcgtgggaaacagaggagatcccacatggatgcgtccaacctggcggcagcgcaaaagatg

SEQ ID NO: 35109 - DNA, 103 bp, Artificial Sequence
  Synthetic Polynucleotide
taatacgactcactatagggttagaagattcaaggctggaaatgatcatgaacagaggagacatgatatgttccagcctaacctggcggcagcgcaaaagatg

SEQ ID NO: 35110 - DNA, 103 bp, Artificial Sequence
  Synthetic Polynucleotide
taatacgactcactatagggcttattgcgtatagagccttcccagttaacaacagaggagagttaacatggaaggctctaacctggcggcagcgcaaaagatg

SEQ ID NO: 35111 - DNA, 103 bp, Artificial Sequence
  Synthetic Polynucleotide
taatacgactcactatagggcgagaatcatttttacagcgcactcccctcaacagaggagagaggggatggcgctgtaaaacctggcggcagcgcaaaagatg

SEQ ID NO: 35112 - DNA, 103 bp, Artificial Sequence
  Synthetic Polynucleotide
taatacgactcactatagggccaccaaacaaaatatatcagacaagcaggaacagaggagacctgctatgctgatatataacctggcggcagcgcaaaagatg

SEQ ID NO: 35113 - DNA, 103 bp, Artificial Sequence
  Synthetic Polynucleotide
taatacgactcactataggggtttctcgggaactccgtcatacgcgaccgaacagaggagacggtcgatgatgacggagaacctggcggcagcgcaaaagatg

SEQ ID NO: 35114 - DNA, 103 bp, Artificial Sequence
  Synthetic Polynucleotide
taatacgactcactatagggcactgcttgtacctcaaatgaataacgtcaaacagaggagatgacgtatgtcatttgagaacctggcggcagcgcaaaagatg

SEQ ID NO: 35115 - DNA, 103 bp, Artificial Sequence
  Synthetic Polynucleotide
taatacgactcactatagggtacatctatataacgtctagttattagcacaacagaggagagtgctaatgactagacgtaacctggcggcagcgcaaaagatg

SEQ ID NO: 35116 - DNA, 103 bp, Artificial Sequence
  Synthetic Polynucleotide
taatacgactcactatagggatactatcaggcaaggacttaggaaccgggaacagaggagacccggtatgtaagtccttaacctggcggcagcgcaaaagatg

SEQ ID NO: 35117 - DNA, 103 bp, Artificial Sequence
  Synthetic Polynucleotide
taatacgactcactataggggaggtataatgaaacggttcatgttcactgaacagaggagacagtgaatgtgaaccgttaacctggcggcagcgcaaaagatg

SEQ ID NO: 35118 - DNA, 103 bp, Artificial Sequence
  Synthetic Polynucleotide
taatacgactcactatagggataccgcacccagaacctaggatcaatcagaacagaggagactgattatgcctaggttcaacctggcggcagcgcaaaagatg

SEQ ID NO: 35119 - DNA, 103 bp, Artificial Sequence
  Synthetic Polynucleotide
taatacgactcactatagggatcaatacatatgcacagcttcttgaccgaaacagaggagatcggtcatgaagctgtgcaacctggcggcagcgcaaaagatg

SEQ ID NO: 35120 - DNA, 103 bp, Artificial Sequence
  Synthetic Polynucleotide
taatacgactcactatagggatagcccccacagaacactcgcaggccctgaacagaggagacagggcatgcgagtgttcaacctggcggcagcgcaaaagatg

SEQ ID NO: 35121 - DNA, 103 bp, Artificial Sequence
  Synthetic Polynucleotide
taatacgactcactatagggcctcagaaaccatagacctctgcccgtataaacagaggagatatacgatgagaggtctaaacctggcggcagcgcaaaagatg

SEQ ID NO: 35122 - DNA, 103 bp, Artificial Sequence
  Synthetic Polynucleotide
taatacgactcactataggggccatttcaccaacttaccccgggtgaagaaacagaggagatcttcaatgggggtaagtaacctggcggcagcgcaaaagatg

SEQ ID NO: 35123 - DNA, 103 bp, Artificial Sequence
  Synthetic Polynucleotide
taatacgactcactatagggggtgaaactgctccgaacagttgagttgggaacagaggagacccaacatgactgttcggaacctggcggcagcgcaaaagatg

SEQ ID NO: 35124 - DNA, 103 bp, Artificial Sequence
  Synthetic Polynucleotide
taatacgactcactataggggccgaaggcaatggcgtgatcaactagacaaacagaggagatgtctaatggatcacgccaacctggcggcagcgcaaaagatg

SEQ ID NO: 35125 - DNA, 103 bp, Artificial Sequence
  Synthetic Polynucleotide
taatacgactcactataggggctggccctctcgccatacacaagaggggaaacagaggagatcccctatggtgtatggcaacctggcggcagcgcaaaagatg

SEQ ID NO: 35126 - DNA, 103 bp, Artificial Sequence
  Synthetic Polynucleotide
taatacgactcactatagggtgtctagtttatgcgcgaaatcacagcgtgaacagaggagacacgctatgatttcgcgcaacctggcggcagcgcaaaagatg

SEQ ID NO: 35127 - DNA, 103 bp, Artificial Sequence
  Synthetic Polynucleotide
taatacgactcactatagggggatagctctgtttgcggctgtagcaagccaacagaggagaggcttgatgcagccgcaaaacctggcggcagcgcaaaagatg

SEQ ID NO: 35128 - DNA, 103 bp, Artificial Sequence
  Synthetic Polynucleotide
taatacgactcactatagggttgggactagaccgggctctctcgagtagtaacagaggagaactactatggagagcccgaacctggcggcagcgcaaaagatg

SEQ ID NO: 35129 - DNA, 103 bp, Artificial Sequence
  Synthetic Polynucleotide
taatacgactcactataggggctgctcccatacttccactaagagctcaaaacagaggagattgagcatgtagtggaagaacctggcggcagcgcaaaagatg

SEQ ID NO: 35130 - DNA, 103 bp, Artificial Sequence
  Synthetic Polynucleotide
taatacgactcactatagggtcctgctttttgtcgcgacgcatgcagctgaacagaggagacagctgatggcgtcgcgaaacctggcggcagcgcaaaagatg

SEQ ID NO: 35131 - DNA, 103 bp, Artificial Sequence
  Synthetic Polynucleotide
taatacgactcactatagggggttgccccgtacgtttccggtgggcccataacagaggagaatgggcatgccggaaacgaacctggcggcagcgcaaaagatg

SEQ ID NO: 35132 - DNA, 103 bp, Artificial Sequence
  Synthetic Polynucleotide
taatacgactcactatagggcccgctggttcagggatcggcgtgtcatgaaacagaggagatcatgaatggccgatcccaacctggcggcagcgcaaaagatg

SEQ ID NO: 35133 - DNA, 103 bp, Artificial Sequence
  Synthetic Polynucleotide
taatacgactcactataggggttcgttagttgcctacattcttggaatggaacagaggagaccattcatggaatgtaggaacctggcggcagcgcaaaagatg

SEQ ID NO: 35134 - DNA, 103 bp, Artificial Sequence
  Synthetic Polynucleotide
taatacgactcactatagggtcccctgtgggcgcagcaaagaagacctgcaacagaggagagcaggtatgctttgctgcaacctggcggcagcgcaaaagatg

SEQ ID NO: 35135 - DNA, 103 bp, Artificial Sequence
  Synthetic Polynucleotide
taatacgactcactatagggggccgtacttgtgtaattgaacacttgacgaacagaggagacgtcaaatgttcaattacaacctggcggcagcgcaaaagatg

SEQ ID NO: 35136 - DNA, 103 bp, Artificial Sequence
  Synthetic Polynucleotide
taatacgactcactatagggaactactattccgtcacagatttcggatagaacagaggagactatccatgatctgtgacaacctggcggcagcgcaaaagatg

SEQ ID NO: 35137 - DNA, 103 bp, Artificial Sequence
  Synthetic Polynucleotide
taatacgactcactatagggtcttctcggggttaaagacgtactcttgaaaacagaggagattcaagatgacgtctttaaacctggcggcagcgcaaaagatg

SEQ ID NO: 35138 - DNA, 103 bp, Artificial Sequence
  Synthetic Polynucleotide
taatacgactcactatagggtactccgccatcagctggcgtgattgtaacaacagaggagagttacaatgacgccagctaacctggcggcagcgcaaaagatg

SEQ ID NO: 35139 - DNA, 103 bp, Artificial Sequence
  Synthetic Polynucleotide
taatacgactcactataggggccgaagtgccgcaggaacgtacggaagataacagaggagaatcttcatgacgttcctgaacctggcggcagcgcaaaagatg

SEQ ID NO: 35140 - DNA, 103 bp, Artificial Sequence
  Synthetic Polynucleotide
taatacgactcactatagggcataactaaacgatgcgacgtcttcctaataacagaggagaattaggatgacgtcgcataacctggcggcagcgcaaaagatg

SEQ ID NO: 35141 - DNA, 103 bp, Artificial Sequence
  Synthetic Polynucleotide
taatacgactcactatagggaatttttcgtcagcagtaaccatagcatgcaacagaggagagcatgcatgggttactgcaacctggcggcagcgcaaaagatg

SEQ ID NO: 35142 - DNA, 103 bp, Artificial Sequence
  Synthetic Polynucleotide
taatacgactcactatagggcagcgtacgtgtccgaagtagaatataagaaacagaggagatcttatatgctacttcggaacctggcggcagcgcaaaagatg

SEQ ID NO: 35143 - DNA, 103 bp, Artificial Sequence
  Synthetic Polynucleotide
taatacgactcactatagggcctgtggccgccccccacccacgttccgttaacagaggagaaacggaatgtgggtggggaacctggcggcagcgcaaaagatg

SEQ ID NO: 35144 - DNA, 103 bp, Artificial Sequence
  Synthetic Polynucleotide
taatacgactcactatagggggcaaggacgatcaccacttgggatggttgaacagaggagacaaccaatgcaagtggtgaacctggcggcagcgcaaaagatg

SEQ ID NO: 35145 - DNA, 103 bp, Artificial Sequence
  Synthetic Polynucleotide
taatacgactcactataggggggcggctcccacgacgtctattgacatcgaacagaggagacgatgtatgtagacgtcgaacctggcggcagcgcaaaagatg

SEQ ID NO: 35146 - DNA, 103 bp, Artificial Sequence
  Synthetic Polynucleotide
taatacgactcactatagggtgagatattatgtagggctcatgaagtcagaacagaggagactgactatgtgagccctaaacctggcggcagcgcaaaagatg

SEQ ID NO: 35147 - DNA, 103 bp, Artificial Sequence
  Synthetic Polynucleotide
taatacgactcactatagggactaggataaccatagggagccatcccgtaaacagaggagatacgggatggctccctataacctggcggcagcgcaaaagatg

SEQ ID NO: 35148 - DNA, 103 bp, Artificial Sequence
  Synthetic Polynucleotide
taatacgactcactatagggcagcttgccatacagatagcaaatcgtgtcaacagaggagagacacgatgtgctatctgaacctggcggcagcgcaaaagatg

SEQ ID NO: 35149 - DNA, 103 bp, Artificial Sequence
  Synthetic Polynucleotide
taatacgactcactatagggcgaggactaggaacgcgatacggcaaaccaaacagaggagatggtttatggtatcgcgtaacctggcggcagcgcaaaagatg

SEQ ID NO: 35150 - DNA, 103 bp, Artificial Sequence
  Synthetic Polynucleotide
taatacgactcactatagggaggtgcgacataaaggattgatatcgctgaaacagaggagatcagcgatgtcaatccttaacctggcggcagcgcaaaagatg

SEQ ID NO: 35151 - DNA, 103 bp, Artificial Sequence
  Synthetic Polynucleotide
taatacgactcactatagggttaggttggcagtacagatgttcaggttacaacagaggagagtaaccatgacatctgtaaacctggcggcagcgcaaaagatg

SEQ ID NO: 35152 - DNA, 103 bp, Artificial Sequence
  Synthetic Polynucleotide
taatacgactcactatagggcaacgagaaatccaaaacaattcgcacaggaacagaggagacctgtgatgattgttttgaacctggcggcagcgcaaaagatg

SEQ ID NO: 35153 - DNA, 103 bp, Artificial Sequence
  Synthetic Polynucleotide
taatacgactcactatagggagtctgcaaaattcttttcggactcatcccaacagaggagagggatgatgccgaaaagaaacctggcggcagcgcaaaagatg

SEQ ID NO: 35154 - DNA, 103 bp, Artificial Sequence
  Synthetic Polynucleotide
taatacgactcactataggggttcgtggaagcaaaaggatcggggaagtcaacagaggagagacttcatggatccttttaacctggcggcagcgcaaaagatg

SEQ ID NO: 35155 - DNA, 103 bp, Artificial Sequence
  Synthetic Polynucleotide
taatacgactcactatagggggcgggaatgcgaagctctttttatagtagaacagaggagactactaatgaaagagcttaacctggcggcagcgcaaaagatg

SEQ ID NO: 35156 - DNA, 103 bp, Artificial Sequence
  Synthetic Polynucleotide
taatacgactcactatagggcgggacgtaaaggtttacccctgactagggaacagaggagaccctagatgggggtaaacaacctggcggcagcgcaaaagatg

SEQ ID NO: 35157 - DNA, 103 bp, Artificial Sequence
  Synthetic Polynucleotide
taatacgactcactatagggcctccgcactagaagttactgtcaaaaaaaaacagaggagattttttatgcagtaacttaacctggcggcagcgcaaaagatg

SEQ ID NO: 35158 - DNA, 103 bp, Artificial Sequence
  Synthetic Polynucleotide
taatacgactcactatagggaccgccctgacaacgaatagttgactctcgaacagaggagacgagagatgactattcgtaacctggcggcagcgcaaaagatg

SEQ ID NO: 35159 - DNA, 103 bp, Artificial Sequence
  Synthetic Polynucleotide
taatacgactcactataggggtaagtcgcagccatcgcgaatgggcgaccaacagaggagaggtcgcatgttcgcgatgaacctggcggcagcgcaaaagatg

SEQ ID NO: 35160 - DNA, 103 bp, Artificial Sequence
  Synthetic Polynucleotide
taatacgactcactatagggggggcgaatcgctgcgacgcatatagattaaacagaggagataatctatgtgcgtcgcaaacctggcggcagcgcaaaagatg

SEQ ID NO: 35161 - DNA, 103 bp, Artificial Sequence
  Synthetic Polynucleotide
taatacgactcactatagggattccagaaaagagccatacgagccgcgacaacagaggagagtcgcgatgcgtatggctaacctggcggcagcgcaaaagatg

SEQ ID NO: 35162 - DNA, 103 bp, Artificial Sequence
  Synthetic Polynucleotide
taatacgactcactatagggcaacacatctctgtctcgtcggatccgaggaacagaggagacctcggatgcgacgagacaacctggcggcagcgcaaaagatg

SEQ ID NO: 35163 - DNA, 103 bp, Artificial Sequence
  Synthetic Polynucleotide
taatacgactcactatagggtctcaagaccacaacaatctcttccgcggcaacagaggagagccgcgatggagattgttaacctggcggcagcgcaaaagatg

SEQ ID NO: 35164 - DNA, 103 bp, Artificial Sequence
  Synthetic Polynucleotide
taatacgactcactatagggatcttctcaatagcctcttcatttaaataaaacagaggagattatttatgtgaagaggcaacctggcggcagcgcaaaagatg

SEQ ID NO: 35165 - DNA, 103 bp, Artificial Sequence
  Synthetic Polynucleotide
taatacgactcactataggggcgaccgggaatacttttgtgccagaatagaacagaggagactattcatgcacaaaagtaacctggcggcagcgcaaaagatg

SEQ ID NO: 35166 - DNA, 103 bp, Artificial Sequence
  Synthetic Polynucleotide
taatacgactcactatagggatgcccacagccccgtcataaggtcactcgaacagaggagacgagtgatgttatgacggaacctggcggcagcgcaaaagatg

SEQ ID NO: 35167 - DNA, 103 bp, Artificial Sequence
  Synthetic Polynucleotide
taatacgactcactatagggaagcccaacaattatactgtgcgtagcatcaacagaggagagatgctatgcacagtataaacctggcggcagcgcaaaagatg

SEQ ID NO: 35168 - DNA, 103 bp, Artificial Sequence
  Synthetic Polynucleotide
taatacgactcactataggggctcgttgtgctcaaatccctgccaagtggaacagaggagaccacttatgagggatttgaacctggcggcagcgcaaaagatg

SEQ ID NO: 35169 - DNA, 103 bp, Artificial Sequence
  Synthetic Polynucleotide
taatacgactcactatagggtgatagattcattggaggggcttcattcctaacagaggagaaggaatatggcccctccaaacctggcggcagcgcaaaagatg

SEQ ID NO: 35170 - DNA, 103 bp, Artificial Sequence
  Synthetic Polynucleotide
taatacgactcactatagggcgctcctgcaaccatatgataccgaggaaaaacagaggagatttcctatgtatcatatgaacctggcggcagcgcaaaagatg

SEQ ID NO: 35171 - DNA, 103 bp, Artificial Sequence
  Synthetic Polynucleotide
taatacgactcactatagggaccgtgaagacaacttggatatgtcggttcaacagaggagagaaccgatgtatccaagtaacctggcggcagcgcaaaagatg

SEQ ID NO: 35172 - DNA, 103 bp, Artificial Sequence
  Synthetic Polynucleotide
taatacgactcactataggggtcaaccgtaacacacggccccattggagtaacagaggagaactccaatggggccgtgtaacctggcggcagcgcaaaagatg

SEQ ID NO: 35173 - DNA, 103 bp, Artificial Sequence
  Synthetic Polynucleotide
taatacgactcactatagggcaacggtagatcaggggtgcgccagggctgaacagaggagacagcccatgcgcacccctaacctggcggcagcgcaaaagatg

SEQ ID NO: 35174 - DNA, 103 bp, Artificial Sequence
  Synthetic Polynucleotide
taatacgactcactatagggtggtgatgcgaaaacactcttgtagggtataacagaggagaatacccatgaagagtgttaacctggcggcagcgcaaaagatg

SEQ ID NO: 35175 - DNA, 103 bp, Artificial Sequence
  Synthetic Polynucleotide
taatacgactcactatagggcctgccgactctctagcctcgtaaagatgtaacagaggagaacatctatgcgaggctagaacctggcggcagcgcaaaagatg

SEQ ID NO: 35176 - DNA, 103 bp, Artificial Sequence
  Synthetic Polynucleotide
taatacgactcactatagggcctggagaagaaggtcctttatctcaatacaacagaggagagtattgatgtaaaggaccaacctggcggcagcgcaaaagatg

SEQ ID NO: 35177 - DNA, 103 bp, Artificial Sequence
  Synthetic Polynucleotide
taatacgactcactatagggttgaaggcacgatcccatagaacccttgttaacagaggagaaacaagatgtctatgggaaacctggcggcagcgcaaaagatg

SEQ ID NO: 35178 - DNA, 103 bp, Artificial Sequence
  Synthetic Polynucleotide
taatacgactcactatagggtcggttttgagatgagtaatcccctcgaacaacagaggagagttcgaatggattactcaaacctggcggcagcgcaaaagatg

SEQ ID NO: 35179 - DNA, 103 bp, Artificial Sequence
  Synthetic Polynucleotide
taatacgactcactataggggttcacgggctgtagaccgttactgaagtcaacagaggagagacttcatgaacggtctaaacctggcggcagcgcaaaagatg

SEQ ID NO: 35180 - DNA, 103 bp, Artificial Sequence
  Synthetic Polynucleotide
taatacgactcactatagggatcactctaggcgttttacctctatagtgcaacagaggagagcactaatgaggtaaaacaacctggcggcagcgcaaaagatg

SEQ ID NO: 35181 - DNA, 103 bp, Artificial Sequence
  Synthetic Polynucleotide
taatacgactcactatagggctaattcgtctaagttgcaagggggggagcaacagaggagagctcccatgcttgcaactaacctggcggcagcgcaaaagatg

SEQ ID NO: 35182 - DNA, 103 bp, Artificial Sequence
  Synthetic Polynucleotide
taatacgactcactatagggttaggcccgaggatctactcgagacgaagtaacagaggagaacttcgatgcgagtagataacctggcggcagcgcaaaagatg

SEQ ID NO: 35183 - DNA, 103 bp, Artificial Sequence
  Synthetic Polynucleotide
taatacgactcactatagggttttacgctttctgtctgctactcatagttaacagaggagaaactatatgtagcagacaaacctggcggcagcgcaaaagatg

SEQ ID NO: 35184 - DNA, 103 bp, Artificial Sequence
  Synthetic Polynucleotide
taatacgactcactataggggtggtgcttgcctttgtgggactatacagcaacagaggagagctgtaatgtcccacaaaaacctggcggcagcgcaaaagatg

SEQ ID NO: 35185 - DNA, 103 bp, Artificial Sequence
  Synthetic Polynucleotide
taatacgactcactatagggggtataatgtaatatcggcgcaggattgacaacagaggagagtcaatatggcgccgataaacctggcggcagcgcaaaagatg

SEQ ID NO: 35186 - DNA, 103 bp, Artificial Sequence
  Synthetic Polynucleotide
taatacgactcactatagggtggtacctggccgacacgactcaaacccggaacagaggagaccgggtatgagtcgtgtcaacctggcggcagcgcaaaagatg

SEQ ID NO: 35187 - DNA, 103 bp, Artificial Sequence
  Synthetic Polynucleotide
taatacgactcactatagggccggttgtgcgtgctcgcggtcctcctttcaacagaggagagaaaggatgaccgcgagcaacctggcggcagcgcaaaagatg

SEQ ID NO: 35188 - DNA, 103 bp, Artificial Sequence
  Synthetic Polynucleotide
taatacgactcactatagggtgggtaaacctctcagactatattttaaacaacagaggagagtttaaatgatagtctgaaacctggcggcagcgcaaaagatg

SEQ ID NO: 35189 - DNA, 103 bp, Artificial Sequence
  Synthetic Polynucleotide
taatacgactcactatagggcagtatgcagtccctgtgtttgtcgttgttaacagaggagaaacaacatgaaacacaggaacctggcggcagcgcaaaagatg

SEQ ID NO: 35190 - DNA, 103 bp, Artificial Sequence
  Synthetic Polynucleotide
taatacgactcactatagggtagccaggtagtgatacatactgctttccaaacagaggagatggaaaatggtatgtatcaacctggcggcagcgcaaaagatg

SEQ ID NO: 35191 - DNA, 103 bp, Artificial Sequence
  Synthetic Polynucleotide
taatacgactcactatagggaccctcgggaaaagtaatcatttctggtctaacagaggagaagaccaatgatgattactaacctggcggcagcgcaaaagatg

SEQ ID NO: 35192 - DNA, 103 bp, Artificial Sequence
  Synthetic Polynucleotide
taatacgactcactataggggttacccctggggtgaaggcaagaggcggaaacagaggagatccgccatgtgccttcacaacctggcggcagcgcaaaagatg

SEQ ID NO: 35193 - DNA, 103 bp, Artificial Sequence
  Synthetic Polynucleotide
taatacgactcactatagggatcctactgatctccaacccgtcgtgctagaacagaggagactagcaatgcgggttggaaacctggcggcagcgcaaaagatg

SEQ ID NO: 35194 - DNA, 103 bp, Artificial Sequence
  Synthetic Polynucleotide
taatacgactcactatagggtatacatgaagttgatagtagttcaatcgtaacagaggagaacgattatgctactatcaaacctggcggcagcgcaaaagatg

SEQ ID NO: 35195 - DNA, 103 bp, Artificial Sequence
  Synthetic Polynucleotide
taatacgactcactatagggaggcatcaatatacatgaatgcccgaagctaacagaggagaagcttcatgcattcatgtaacctggcggcagcgcaaaagatg

SEQ ID NO: 35196 - DNA, 103 bp, Artificial Sequence
  Synthetic Polynucleotide
taatacgactcactatagggtgctcacatccgcgactaggaacggatgcaaacagaggagatgcatcatgtcctagtcgaacctggcggcagcgcaaaagatg

SEQ ID NO: 35197 - DNA, 103 bp, Artificial Sequence
  Synthetic Polynucleotide
taatacgactcactatagggaacgtctatcatgacttagtgaccgactggaacagaggagaccagtcatgcactaagtcaacctggcggcagcgcaaaagatg

SEQ ID NO: 35198 - DNA, 103 bp, Artificial Sequence
  Synthetic Polynucleotide
taatacgactcactatagggaagacgggtttaagatggcaatgcgctactaacagaggagaagtagcatgttgccatctaacctggcggcagcgcaaaagatg

SEQ ID NO: 35199 - DNA, 103 bp, Artificial Sequence
  Synthetic Polynucleotide
taatacgactcactatagggaacttgtaggtcacgctagcgcgaccagcaaacagaggagatgctggatgcgctagcgtaacctggcggcagcgcaaaagatg

SEQ ID NO: 35200 - DNA, 103 bp, Artificial Sequence
  Synthetic Polynucleotide
taatacgactcactatagggcgaacaataggcaacaggatcattgttttcaacagaggagagaaaacatggatcctgttaacctggcggcagcgcaaaagatg

SEQ ID NO: 35201 - DNA, 103 bp, Artificial Sequence
  Synthetic Polynucleotide
taatacgactcactatagggtgtaggcctgagacgcatggaaaaagacacaacagaggagagtgtctatgtccatgcgtaacctggcggcagcgcaaaagatg

SEQ ID NO: 35202 - DNA, 103 bp, Artificial Sequence
  Synthetic Polynucleotide
taatacgactcactatagggggaggctggggtgggcgacgcagaccggggaacagaggagaccccggatggcgtcgcccaacctggcggcagcgcaaaagatg

SEQ ID NO: 35203 - DNA, 103 bp, Artificial Sequence
  Synthetic Polynucleotide
taatacgactcactataggggcgcgccaacttgttggaggaacgaattataacagaggagaataattatgtcctccaacaacctggcggcagcgcaaaagatg

SEQ ID NO: 35204 - DNA, 103 bp, Artificial Sequence
  Synthetic Polynucleotide
taatacgactcactataggggcctagcgttctgttagacccccaccagccaacagaggagaggctggatggggtctaacaacctggcggcagcgcaaaagatg

SEQ ID NO: 35205 - DNA, 103 bp, Artificial Sequence
  Synthetic Polynucleotide
taatacgactcactatagggctcagtttaacgcgccgacgcattcgtctaaacagaggagatagacgatggcgtcggcgaacctggcggcagcgcaaaagatg

SEQ ID NO: 35206 - DNA, 103 bp, Artificial Sequence
  Synthetic Polynucleotide
taatacgactcactatagggtcggtaccgtacgtataaaccacaagatcgaacagaggagacgatctatgggtttatacaacctggcggcagcgcaaaagatg

SEQ ID NO: 35207 - DNA, 103 bp, Artificial Sequence
  Synthetic Polynucleotide
taatacgactcactataggggcagccagtgggtaaaccactcaagtatagaacagaggagactatacatgagtggtttaaacctggcggcagcgcaaaagatg

SEQ ID NO: 35208 - DNA, 103 bp, Artificial Sequence
  Synthetic Polynucleotide
taatacgactcactatagggggctcatagtgagcataagagaagttcctcaacagaggagagaggaaatgctcttatgcaacctggcggcagcgcaaaagatg

SEQ ID NO: 35209 - DNA, 103 bp, Artificial Sequence
  Synthetic Polynucleotide
taatacgactcactatagggttaacttggacatgaggaggcagccggtgaaacagaggagatcaccgatggcctcctcaaacctggcggcagcgcaaaagatg

SEQ ID NO: 35210 - DNA, 103 bp, Artificial Sequence
  Synthetic Polynucleotide
taatacgactcactatagggaagcatttctgcaactttcaaaacgcaggtaacagaggagaacctgcatgttgaaagttaacctggcggcagcgcaaaagatg

SEQ ID NO: 35211 - DNA, 103 bp, Artificial Sequence
  Synthetic Polynucleotide
taatacgactcactataggggatactttacctgaccggttcaaccgtagaaacagaggagatctacgatggaaccggtcaacctggcggcagcgcaaaagatg

SEQ ID NO: 35212 - DNA, 103 bp, Artificial Sequence
  Synthetic Polynucleotide
taatacgactcactatagggcctttgtttacggagcggtatcgcggacaaaacagaggagattgtccatgataccgctcaacctggcggcagcgcaaaagatg

SEQ ID NO: 35213 - DNA, 103 bp, Artificial Sequence
  Synthetic Polynucleotide
taatacgactcactatagggaatttgataacactttgctacgcggtggagaacagaggagactccacatggtagcaaagaacctggcggcagcgcaaaagatg

SEQ ID NO: 35214 - DNA, 103 bp, Artificial Sequence
  Synthetic Polynucleotide
taatacgactcactatagggatctgcgagacgactactgaggcaatgcagaacagaggagactgcatatgctcagtagtaacctggcggcagcgcaaaagatg

SEQ ID NO: 35215 - DNA, 103 bp, Artificial Sequence
  Synthetic Polynucleotide
taatacgactcactatagggacccgttccgcctgcgcgctgatgcaagaaaacagaggagattcttgatgcagcgcgcaaacctggcggcagcgcaaaagatg

SEQ ID NO: 35216 - DNA, 103 bp, Artificial Sequence
  Synthetic Polynucleotide
taatacgactcactatagggtcggctacagtcgaaaccggtcgactactaaacagaggagatagtagatgaccggtttcaacctggcggcagcgcaaaagatg

SEQ ID NO: 35217 - DNA, 103 bp, Artificial Sequence
  Synthetic Polynucleotide
taatacgactcactatagggctgcaggaacaactgctttcagtcctgactaacagaggagaagtcagatgtgaaagcagaacctggcggcagcgcaaaagatg

SEQ ID NO: 35218 - DNA, 103 bp, Artificial Sequence
  Synthetic Polynucleotide
taatacgactcactatagggcgagtatataggtccgcactctcactgagcaacagaggagagctcagatggagtgcggaaacctggcggcagcgcaaaagatg

SEQ ID NO: 35219 - DNA, 103 bp, Artificial Sequence
  Synthetic Polynucleotide
taatacgactcactatagggaaatccctgtgttatggtcacacgtacaggaacagaggagacctgtaatggtgaccataaacctggcggcagcgcaaaagatg

SEQ ID NO: 35220 - DNA, 103 bp, Artificial Sequence
  Synthetic Polynucleotide
taatacgactcactataggggctcgagcttgattttcggagaggcatggaaacagaggagatccatgatgctccgaaaaaacctggcggcagcgcaaaagatg

SEQ ID NO: 35221 - DNA, 103 bp, Artificial Sequence
  Synthetic Polynucleotide
taatacgactcactatagggggaaatccacaagccgcacagaacggcagtaacagaggagaactgccatgctgtgcggcaacctggcggcagcgcaaaagatg

SEQ ID NO: 35222 - DNA, 103 bp, Artificial Sequence
  Synthetic Polynucleotide
taatacgactcactataggggagcatcccctcacaggcgggaaccactacaacagaggagagtagtgatgcccgcctgtaacctggcggcagcgcaaaagatg

SEQ ID NO: 35223 - DNA, 103 bp, Artificial Sequence
  Synthetic Polynucleotide
taatacgactcactatagggttgccctttcagtaatataattgtggcggaaacagaggagatccgccatgattatattaaacctggcggcagcgcaaaagatg

SEQ ID NO: 35224 - DNA, 103 bp, Artificial Sequence
  Synthetic Polynucleotide
taatacgactcactatagggatctagagacgaccgcgtacggggttgcataacagaggagaatgcaaatgcgtacgcggaacctggcggcagcgcaaaagatg

SEQ ID NO: 35225 - DNA, 103 bp, Artificial Sequence
  Synthetic Polynucleotide
taatacgactcactatagggctgtccaaccgcgtctacacctgcgagtgcaacagaggagagcactcatgggtgtagacaacctggcggcagcgcaaaagatg

SEQ ID NO: 35226 - DNA, 103 bp, Artificial Sequence
  Synthetic Polynucleotide
taatacgactcactatagggcactgcagtgacactagttggttgatattgaacagaggagacaatatatgccaactagtaacctggcggcagcgcaaaagatg

SEQ ID NO: 35227 - DNA, 103 bp, Artificial Sequence
  Synthetic Polynucleotide
taatacgactcactatagggctagacaggcgaatacgctaccaattttctaacagaggagaagaaaaatggtagcgtataacctggcggcagcgcaaaagatg

SEQ ID NO: 35228 - DNA, 103 bp, Artificial Sequence
  Synthetic Polynucleotide
taatacgactcactatagggtctatgctacggcggtctccccactcaggtaacagaggagaacctgaatggggagaccgaacctggcggcagcgcaaaagatg

SEQ ID NO: 35229 - DNA, 103 bp, Artificial Sequence
  Synthetic Polynucleotide
taatacgactcactatagggcgaaggcggagcctgttacgaaaatagtgaaacagaggagatcactaatgtcgtaacagaacctggcggcagcgcaaaagatg

SEQ ID NO: 35230 - DNA, 103 bp, Artificial Sequence
  Synthetic Polynucleotide
taatacgactcactatagggacacggatgtactagcgatgcataaggttgaacagaggagacaacctatggcatcgctaaacctggcggcagcgcaaaagatg

SEQ ID NO: 35231 - DNA, 103 bp, Artificial Sequence
  Synthetic Polynucleotide
taatacgactcactatagggactgaccgctcgcagttcgtgccccagcgaaacagaggagatcgctgatgcacgaactgaacctggcggcagcgcaaaagatg

SEQ ID NO: 35232 - DNA, 103 bp, Artificial Sequence
  Synthetic Polynucleotide
taatacgactcactataggggaaaagccgtttcattgtagggcggagtcgaacagaggagacgactcatgcctacaatgaacctggcggcagcgcaaaagatg

SEQ ID NO: 35233 - DNA, 103 bp, Artificial Sequence
  Synthetic Polynucleotide
taatacgactcactatagggctcaacgtcatatcgcagaacagcgctcataacagaggagaatgagcatggttctgcgaaacctggcggcagcgcaaaagatg

SEQ ID NO: 35234 - DNA, 103 bp, Artificial Sequence
  Synthetic Polynucleotide
taatacgactcactataggggagaccagacgcgcgtagcggactaccagaaacagaggagatctggtatgccgctacgcaacctggcggcagcgcaaaagatg

SEQ ID NO: 35235 - DNA, 103 bp, Artificial Sequence
  Synthetic Polynucleotide
taatacgactcactatagggaagcgcctaagcccatcctaagttaaactaaacagaggagatagtttatgttaggatggaacctggcggcagcgcaaaagatg

SEQ ID NO: 35236 - DNA, 103 bp, Artificial Sequence
  Synthetic Polynucleotide
taatacgactcactatagggctatacgacaaaggtcatgaaacgacgtaaaacagaggagattacgtatgttcatgaccaacctggcggcagcgcaaaagatg

SEQ ID NO: 35237 - DNA, 103 bp, Artificial Sequence
  Synthetic Polynucleotide
taatacgactcactatagggctccggtagatacagcgcccacagcaacctaacagaggagaaggttgatgtgggcgctgaacctggcggcagcgcaaaagatg

SEQ ID NO: 35238 - DNA, 103 bp, Artificial Sequence
  Synthetic Polynucleotide
taatacgactcactatagggctcgctacctaagccggcgtgactcggtcgaacagaggagacgaccgatgcacgccggcaacctggcggcagcgcaaaagatg

SEQ ID NO: 35239 - DNA, 103 bp, Artificial Sequence
  Synthetic Polynucleotide
taatacgactcactatagggaactaaccacatctttaatattgctcagataacagaggagaatctgaatgatattaaagaacctggcggcagcgcaaaagatg

SEQ ID NO: 35240 - DNA, 103 bp, Artificial Sequence
  Synthetic Polynucleotide
taatacgactcactataggggcagtgtcactcatcgaaaagccctcccttaacagaggagaaagggaatgcttttcgataacctggcggcagcgcaaaagatg

SEQ ID NO: 35241 - DNA, 103 bp, Artificial Sequence
  Synthetic Polynucleotide
taatacgactcactatagggacccgatcgagaagtctggtaatggtcaagaacagaggagacttgacatgtaccagactaacctggcggcagcgcaaaagatg

SEQ ID NO: 35242 - DNA, 103 bp, Artificial Sequence
  Synthetic Polynucleotide
taatacgactcactataggggtagtagtcgccccatcataatttaatttcaacagaggagagaaattatgttatgatggaacctggcggcagcgcaaaagatg

SEQ ID NO: 35243 - DNA, 103 bp, Artificial Sequence
  Synthetic Polynucleotide
taatacgactcactatagggtgtacgggccaagcccagtccgggcctgctaacagaggagaagcaggatgggactgggcaacctggcggcagcgcaaaagatg

SEQ ID NO: 35244 - DNA, 103 bp, Artificial Sequence
  Synthetic Polynucleotide
taatacgactcactatagggcttacacaggaaagtaatgtagcgacccgcaacagaggagagcgggtatgtacattactaacctggcggcagcgcaaaagatg

SEQ ID NO: 35245 - DNA, 103 bp, Artificial Sequence
  Synthetic Polynucleotide
taatacgactcactatagggatagatgtcctattacataagctgaggcggaacagaggagaccgcctatgcttatgtaaaacctggcggcagcgcaaaagatg

SEQ ID NO: 35246 - DNA, 103 bp, Artificial Sequence
  Synthetic Polynucleotide
taatacgactcactatagggaagcgctgactttctattatattattcgccaacagaggagaggcgaaatgtataatagaaacctggcggcagcgcaaaagatg

SEQ ID NO: 35247 - DNA, 103 bp, Artificial Sequence
  Synthetic Polynucleotide
taatacgactcactatagggcctaaacggataatactcgccgcggatgccaacagaggagaggcatcatgggcgagtataacctggcggcagcgcaaaagatg

SEQ ID NO: 35248 - DNA, 103 bp, Artificial Sequence
  Synthetic Polynucleotide
taatacgactcactatagggtgccgcatgcttgtgagccagagaacagataacagaggagaatctgtatgctggctcacaacctggcggcagcgcaaaagatg

SEQ ID NO: 35249 - DNA, 103 bp, Artificial Sequence
  Synthetic Polynucleotide
taatacgactcactatagggatttaacatgtttccctccagacgcgtagcaacagaggagagctacgatgctggagggaaacctggcggcagcgcaaaagatg

SEQ ID NO: 35250 - DNA, 103 bp, Artificial Sequence
  Synthetic Polynucleotide
taatacgactcactataggggccgacccgtttggggttcgggtccactggaacagaggagaccagtgatgccgaaccccaacctggcggcagcgcaaaagatg

SEQ ID NO: 35251 - DNA, 103 bp, Artificial Sequence
  Synthetic Polynucleotide
taatacgactcactataggggccccgtaagcggtctagagttgtcgtcccaacagaggagagggacgatgactctagacaacctggcggcagcgcaaaagatg

SEQ ID NO: 35252 - DNA, 103 bp, Artificial Sequence
  Synthetic Polynucleotide
taatacgactcactatagggcagaattaacaacgagcgggtgcgctcgataacagaggagaatcgagatgacccgctcgaacctggcggcagcgcaaaagatg

SEQ ID NO: 35253 - DNA, 103 bp, Artificial Sequence
  Synthetic Polynucleotide
taatacgactcactataggggcggtccggagggatccgattcaggaaaataacagaggagaattttcatgaatcggatcaacctggcggcagcgcaaaagatg

SEQ ID NO: 35254 - DNA, 103 bp, Artificial Sequence
  Synthetic Polynucleotide
taatacgactcactatagggaatgcgccatgtgcttgttttcttcaccggaacagaggagaccggtgatgaaaacaagcaacctggcggcagcgcaaaagatg

SEQ ID NO: 35255 - DNA, 103 bp, Artificial Sequence
  Synthetic Polynucleotide
taatacgactcactatagggggaagattcgtccgtcgcacctacctcacaaacagaggagatgtgagatgggtgcgacgaacctggcggcagcgcaaaagatg

SEQ ID NO: 35256 - DNA, 103 bp, Artificial Sequence
  Synthetic Polynucleotide
taatacgactcactataggggccgaggtatgctgattcgagcttcaagctaacagaggagaagcttgatgctcgaatcaaacctggcggcagcgcaaaagatg

SEQ ID NO: 35257 - DNA, 103 bp, Artificial Sequence
  Synthetic Polynucleotide
taatacgactcactatagggatccaacgcagcgggaaagggtcaccacttaacagaggagaaagtggatgccctttcccaacctggcggcagcgcaaaagatg

SEQ ID NO: 35258 - DNA, 103 bp, Artificial Sequence
  Synthetic Polynucleotide
taatacgactcactataggggaaaccgcatctagctcatcaccctgtgagaacagaggagactcacaatgtgatgagctaacctggcggcagcgcaaaagatg

SEQ ID NO: 35259 - DNA, 103 bp, Artificial Sequence
  Synthetic Polynucleotide
taatacgactcactataggggactagactaaatgatcacagcccctgctcaacagaggagagagcagatgctgtgatcaaacctggcggcagcgcaaaagatg

SEQ ID NO: 35260 - DNA, 103 bp, Artificial Sequence
  Synthetic Polynucleotide
taatacgactcactatagggtgaagcccgatcgcctccagatcggaacttaacagaggagaaagttcatgtctggaggcaacctggcggcagcgcaaaagatg

SEQ ID NO: 35261 - DNA, 103 bp, Artificial Sequence
  Synthetic Polynucleotide
taatacgactcactatagggacctttctaaacctgatgctgctaacacgtaacagaggagaacgtgtatgcagcatcagaacctggcggcagcgcaaaagatg

SEQ ID NO: 35262 - DNA, 103 bp, Artificial Sequence
  Synthetic Polynucleotide
taatacgactcactatagggaattgtggacattacgggcgtaatccaatcaacagaggagagattggatgacgcccgtaaacctggcggcagcgcaaaagatg

SEQ ID NO: 35263 - DNA, 103 bp, Artificial Sequence
  Synthetic Polynucleotide
taatacgactcactatagggcggtacctaacggcgtaacaagagacgggtaacagaggagaacccgtatgttgttacgcaacctggcggcagcgcaaaagatg

SEQ ID NO: 35264 - DNA, 103 bp, Artificial Sequence
  Synthetic Polynucleotide
taatacgactcactatagggtacgccagccggcaagggaccaaaactcggaacagaggagaccgagtatgggtcccttgaacctggcggcagcgcaaaagatg

SEQ ID NO: 35265 - DNA, 103 bp, Artificial Sequence
  Synthetic Polynucleotide
taatacgactcactatagggatcccaaaaaaccccggcagtactgttagcaacagaggagagctaacatgactgccgggaacctggcggcagcgcaaaagatg

SEQ ID NO: 35266 - DNA, 103 bp, Artificial Sequence
  Synthetic Polynucleotide
taatacgactcactataggggcaccgccgtaaactgacggacgtctgaataacagaggagaattcagatgtccgtcagtaacctggcggcagcgcaaaagatg

SEQ ID NO: 35267 - DNA, 103 bp, Artificial Sequence
  Synthetic Polynucleotide
taatacgactcactatagggaagccctccggtttaaagtacggaaggtggaacagaggagaccacctatggtactttaaaacctggcggcagcgcaaaagatg

SEQ ID NO: 35268 - DNA, 103 bp, Artificial Sequence
  Synthetic Polynucleotide
taatacgactcactatagggggtgccttggactagattgtctatctgaaaaacagaggagatttcagatggacaatctaaacctggcggcagcgcaaaagatg

SEQ ID NO: 35269 - DNA, 103 bp, Artificial Sequence
  Synthetic Polynucleotide
taatacgactcactatagggtcgtgcaacgctgatggagacgagcggcggaacagaggagaccgccgatggtctccatcaacctggcggcagcgcaaaagatg

SEQ ID NO: 35270 - DNA, 103 bp, Artificial Sequence
  Synthetic Polynucleotide
taatacgactcactataggggaagctgagctttccactaggagaacataaaacagaggagattatgtatgcctagtggaaacctggcggcagcgcaaaagatg

SEQ ID NO: 35271 - DNA, 103 bp, Artificial Sequence
  Synthetic Polynucleotide
taatacgactcactatagggtgcgccactattcggggtgagagattcgagaacagaggagactcgaaatgctcaccccgaacctggcggcagcgcaaaagatg

SEQ ID NO: 35272 - DNA, 103 bp, Artificial Sequence
  Synthetic Polynucleotide
taatacgactcactatagggccagtaagttggcgactgtgcatacataataacagaggagaattatgatggcacagtcgaacctggcggcagcgcaaaagatg

SEQ ID NO: 35273 - DNA, 103 bp, Artificial Sequence
  Synthetic Polynucleotide
taatacgactcactataggggaacaataaatattggtcaattgacagccaaacagaggagatggctgatgattgaccaaaacctggcggcagcgcaaaagatg

SEQ ID NO: 35274 - DNA, 103 bp, Artificial Sequence
  Synthetic Polynucleotide
taatacgactcactatagggatgagttttgagttacacacagatttggaaaacagaggagattccaaatgtgtgtgtaaaacctggcggcagcgcaaaagatg

SEQ ID NO: 35275 - DNA, 103 bp, Artificial Sequence
  Synthetic Polynucleotide
taatacgactcactatagggcagcacaaacaaccgtatgttaatacagcgaacagaggagacgctgtatgaacatacggaacctggcggcagcgcaaaagatg

SEQ ID NO: 35276 - DNA, 103 bp, Artificial Sequence
  Synthetic Polynucleotide
taatacgactcactatagggtcctacaggcacactaagaacctaacgagaaacagaggagatctcgtatggttcttagtaacctggcggcagcgcaaaagatg

SEQ ID NO: 35277 - DNA, 103 bp, Artificial Sequence
  Synthetic Polynucleotide
taatacgactcactatagggcatggcatcctacggtacaaagatggttttaacagaggagaaaaaccatgtttgtaccgaacctggcggcagcgcaaaagatg

SEQ ID NO: 35278 - DNA, 103 bp, Artificial Sequence
  Synthetic Polynucleotide
taatacgactcactatagggacagagtggtatcgggtgtctcaaaaatgtaacagaggagaacatttatgagacacccgaacctggcggcagcgcaaaagatg

SEQ ID NO: 35279 - DNA, 103 bp, Artificial Sequence
  Synthetic Polynucleotide
taatacgactcactatagggctaccgatgtcttggcgctgtgcactgcgcaacagaggagagcgcagatgacagcgccaaacctggcggcagcgcaaaagatg

SEQ ID NO: 35280 - DNA, 103 bp, Artificial Sequence
  Synthetic Polynucleotide
taatacgactcactatagggaccgaataggcatctagtggtctgtccgataacagaggagaatcggaatgaccactagaaacctggcggcagcgcaaaagatg

SEQ ID NO: 35281 - DNA, 103 bp, Artificial Sequence
  Synthetic Polynucleotide
taatacgactcactatagggagtcaacagtgttagagacataatcgcttaaacagaggagataagcgatgatgtctctaaacctggcggcagcgcaaaagatg

SEQ ID NO: 35282 - DNA, 103 bp, Artificial Sequence
  Synthetic Polynucleotide
taatacgactcactataggggtaactccctcaccatatgggtcgtttctcaacagaggagagagaaaatgcccatatggaacctggcggcagcgcaaaagatg

SEQ ID NO: 35283 - DNA, 103 bp, Artificial Sequence
  Synthetic Polynucleotide
taatacgactcactataggggtgtgacagtgactatggagtaacacgatgaacagaggagacatcgtatgactccatagaacctggcggcagcgcaaaagatg

SEQ ID NO: 35284 - DNA, 103 bp, Artificial Sequence
  Synthetic Polynucleotide
taatacgactcactatagggcaacaagggagccacgcataatatcgacataacagaggagaatgtcgatgttatgcgtgaacctggcggcagcgcaaaagatg

SEQ ID NO: 35285 - DNA, 103 bp, Artificial Sequence
  Synthetic Polynucleotide
taatacgactcactatagggacggcggtcaccgaccgcgcgatatttatgaacagaggagacataaaatgcgcgcggtcaacctggcggcagcgcaaaagatg

SEQ ID NO: 35286 - DNA, 103 bp, Artificial Sequence
  Synthetic Polynucleotide
taatacgactcactataggggcatgtaccaaccgtctcatgtttcatccgaacagaggagacggatgatgcatgagacgaacctggcggcagcgcaaaagatg

SEQ ID NO: 35287 - DNA, 103 bp, Artificial Sequence
  Synthetic Polynucleotide
taatacgactcactatagggatacgtccactactgctgcaggcgaaatacaacagaggagagtatttatgctgcagcagaacctggcggcagcgcaaaagatg

SEQ ID NO: 35288 - DNA, 103 bp, Artificial Sequence
  Synthetic Polynucleotide
taatacgactcactatagggccttgcactagaggtgaagtatctggctataacagaggagaatagccatgtacttcaccaacctggcggcagcgcaaaagatg

SEQ ID NO: 35289 - DNA, 103 bp, Artificial Sequence
  Synthetic Polynucleotide
taatacgactcactatagggcctaattttcagttaacaagggtgcccagtaacagaggagaactgggatgccttgttaaaacctggcggcagcgcaaaagatg

SEQ ID NO: 35290 - DNA, 103 bp, Artificial Sequence
  Synthetic Polynucleotide
taatacgactcactataggggagtctccgctccgggtgctaggagcaaggaacagaggagaccttgcatgtagcacccgaacctggcggcagcgcaaaagatg

SEQ ID NO: 35291 - DNA, 103 bp, Artificial Sequence
  Synthetic Polynucleotide
taatacgactcactatagggggacaacgtgctgacccccgactttacgctaacagaggagaagcgtaatgtcgggggtcaacctggcggcagcgcaaaagatg

SEQ ID NO: 35292 - DNA, 103 bp, Artificial Sequence
  Synthetic Polynucleotide
taatacgactcactatagggtcaggggatccccagatttttcccttctggaacagaggagaccagaaatgaaaaatctgaacctggcggcagcgcaaaagatg

SEQ ID NO: 35293 - DNA, 103 bp, Artificial Sequence
  Synthetic Polynucleotide
taatacgactcactatagggatgactcatgcaaaggtaacgtgtgaattaaacagaggagataattcatgcgttaccttaacctggcggcagcgcaaaagatg

SEQ ID NO: 35294 - DNA, 103 bp, Artificial Sequence
  Synthetic Polynucleotide
taatacgactcactatagggaagtatactccagaatacgcattaccgagtaacagaggagaactcggatgtgcgtattcaacctggcggcagcgcaaaagatg

SEQ ID NO: 35295 - DNA, 103 bp, Artificial Sequence
  Synthetic Polynucleotide
taatacgactcactatagggaacatattgcttgggtgatatacaatcgccaacagaggagaggcgatatgatatcacccaacctggcggcagcgcaaaagatg

SEQ ID NO: 35296 - DNA, 103 bp, Artificial Sequence
  Synthetic Polynucleotide
taatacgactcactatagggattgggcggcaaccgttcgggcagtcttataacagaggagaataagaatgcccgaacggaacctggcggcagcgcaaaagatg

SEQ ID NO: 35297 - DNA, 103 bp, Artificial Sequence
  Synthetic Polynucleotide
taatacgactcactatagggctacagatttcccagaaactcatattgcaaaacagaggagattgcaaatggagtttctgaacctggcggcagcgcaaaagatg

SEQ ID NO: 35298 - DNA, 103 bp, Artificial Sequence
  Synthetic Polynucleotide
taatacgactcactatagggactaacaggtctccaggcatcatggtagcgaacagaggagacgctacatggatgcctggaacctggcggcagcgcaaaagatg

SEQ ID NO: 35299 - DNA, 103 bp, Artificial Sequence
  Synthetic Polynucleotide
taatacgactcactatagggtattttcgagcgccacccgcgcgaccgaccaacagaggagaggtcggatgcgcgggtggaacctggcggcagcgcaaaagatg

SEQ ID NO: 35300 - DNA, 103 bp, Artificial Sequence
  Synthetic Polynucleotide
taatacgactcactataggggcggccgcgtcgagaatttacgcctagcataacagaggagaatgctaatggtaaattctaacctggcggcagcgcaaaagatg

SEQ ID NO: 35301 - DNA, 103 bp, Artificial Sequence
  Synthetic Polynucleotide
taatacgactcactatagggcatctatatagttcacatgatccatcgcgtaacagaggagaacgcgaatgatcatgtgaaacctggcggcagcgcaaaagatg

SEQ ID NO: 35302 - DNA, 103 bp, Artificial Sequence
  Synthetic Polynucleotide
taatacgactcactataggggcgtgtttgttgcgcgatcgctgcgaggggaacagaggagacccctcatggcgatcgcgaacctggcggcagcgcaaaagatg

SEQ ID NO: 35303 - DNA, 103 bp, Artificial Sequence
  Synthetic Polynucleotide
taatacgactcactatagggactctgagtcatctattcactgtagacacgaacagaggagacgtgtcatgagtgaatagaacctggcggcagcgcaaaagatg

SEQ ID NO: 35304 - DNA, 103 bp, Artificial Sequence
  Synthetic Polynucleotide
taatacgactcactataggggttcccacctgcttagattgaggaaggcctaacagaggagaaggcctatgtcaatctaaaacctggcggcagcgcaaaagatg

SEQ ID NO: 35305 - DNA, 103 bp, Artificial Sequence
  Synthetic Polynucleotide
taatacgactcactataggggaccctgcgtcagtgggggcaataacgcagaacagaggagactgcgtatgtgcccccacaacctggcggcagcgcaaaagatg

SEQ ID NO: 35306 - DNA, 103 bp, Artificial Sequence
  Synthetic Polynucleotide
taatacgactcactataggggtatgacggaacagagatcgttaggcgaggaacagaggagacctcgcatgacgatctctaacctggcggcagcgcaaaagatg

SEQ ID NO: 35307 - DNA, 103 bp, Artificial Sequence
  Synthetic Polynucleotide
taatacgactcactatagggattgatcagctaacttactagtggcgcgataacagaggagaatcgcgatgctagtaagtaacctggcggcagcgcaaaagatg

SEQ ID NO: 35308 - DNA, 103 bp, Artificial Sequence
  Synthetic Polynucleotide
taatacgactcactatagggatcatgtgtctccttcatttgcacaggctcaacagaggagagagcctatgcaaatgaagaacctggcggcagcgcaaaagatg

SEQ ID NO: 35309 - DNA, 103 bp, Artificial Sequence
  Synthetic Polynucleotide
taatacgactcactatagggcggcgccttgatgccacatttttttctttcaacagaggagagaaagaatgaaatgtggcaacctggcggcagcgcaaaagatg

SEQ ID NO: 35310 - DNA, 103 bp, Artificial Sequence
  Synthetic Polynucleotide
taatacgactcactatagggcagagattatagtaaggcctgaatgctaccaacagaggagaggtagcatgcaggccttaaacctggcggcagcgcaaaagatg

SEQ ID NO: 35311 - DNA, 103 bp, Artificial Sequence
  Synthetic Polynucleotide
taatacgactcactatagggctctcatacagactgtcttgcgagtgcaggaacagaggagacctgcaatggcaagacagaacctggcggcagcgcaaaagatg

SEQ ID NO: 35312 - DNA, 103 bp, Artificial Sequence
  Synthetic Polynucleotide
taatacgactcactatagggcccaccgagctcgaagggaaccaaccgtgtaacagaggagaacacggatggttcccttcaacctggcggcagcgcaaaagatg

SEQ ID NO: 35313 - DNA, 103 bp, Artificial Sequence
  Synthetic Polynucleotide
taatacgactcactatagggatcagaatagaaaataaaacctattctcccaacagaggagagggagaatgggttttattaacctggcggcagcgcaaaagatg

SEQ ID NO: 35314 - DNA, 103 bp, Artificial Sequence
  Synthetic Polynucleotide
taatacgactcactatagggacataggatgggaagtagcaatatagtgcaaacagaggagatgcactatgttgctacttaacctggcggcagcgcaaaagatg

SEQ ID NO: 35315 - DNA, 103 bp, Artificial Sequence
  Synthetic Polynucleotide
taatacgactcactatagggcgttgttatattatcgtttctgtcgtaggtaacagaggagaacctacatgagaaacgataacctggcggcagcgcaaaagatg

SEQ ID NO: 35316 - DNA, 103 bp, Artificial Sequence
  Synthetic Polynucleotide
taatacgactcactataggggttcatcgtgactgtgattaatctggtactaacagaggagaagtaccatgttaatcacaaacctggcggcagcgcaaaagatg

SEQ ID NO: 35317 - DNA, 103 bp, Artificial Sequence
  Synthetic Polynucleotide
taatacgactcactataggggcttacgttcaaagccccatgtgcggaagtaacagaggagaacttccatgcatggggctaacctggcggcagcgcaaaagatg

SEQ ID NO: 35318 - DNA, 103 bp, Artificial Sequence
  Synthetic Polynucleotide
taatacgactcactatagggcgtccccgggagtcgcgtcactgaccaccaaacagaggagatggtggatggtgacgcgaaacctggcggcagcgcaaaagatg

SEQ ID NO: 35319 - DNA, 103 bp, Artificial Sequence
  Synthetic Polynucleotide
taatacgactcactatagggggatgaagccattcagccgttcggtaacgtaacagaggagaacgttaatgaacggctgaaacctggcggcagcgcaaaagatg

SEQ ID NO: 35320 - DNA, 103 bp, Artificial Sequence
  Synthetic Polynucleotide
taatacgactcactatagggcagtctaaagaccaaagcgtccgcctattaaacagaggagataatagatggacgctttgaacctggcggcagcgcaaaagatg

SEQ ID NO: 35321 - DNA, 103 bp, Artificial Sequence
  Synthetic Polynucleotide
taatacgactcactatagggaggcccgtcgtctgattcacgggcattgcgaacagaggagacgcaatatgcgtgaatcaaacctggcggcagcgcaaaagatg

SEQ ID NO: 35322 - DNA, 103 bp, Artificial Sequence
  Synthetic Polynucleotide
taatacgactcactataggggctggtttattagcaagaagaacttcttgaaacagaggagatcaagaatgtcttcttgcaacctggcggcagcgcaaaagatg

SEQ ID NO: 35323 - DNA, 103 bp, Artificial Sequence
  Synthetic Polynucleotide
taatacgactcactatagggcgcaattcgccccgttcttaatcatcgaccaacagaggagaggtcgaatgttaagaacgaacctggcggcagcgcaaaagatg

SEQ ID NO: 35324 - DNA, 103 bp, Artificial Sequence
  Synthetic Polynucleotide
taatacgactcactataggggaatacttcattatctgtcgatctggtagaaacagaggagatctaccatgtcgacagataacctggcggcagcgcaaaagatg

SEQ ID NO: 35325 - DNA, 103 bp, Artificial Sequence
  Synthetic Polynucleotide
taatacgactcactatagggtacgcgaacgattttataacctcgacgctgaacagaggagacagcgtatgggttataaaaacctggcggcagcgcaaaagatg

SEQ ID NO: 35326 - DNA, 103 bp, Artificial Sequence
  Synthetic Polynucleotide
taatacgactcactatagggcctggctacgtttaaaggcgtgatacggtcaacagaggagagaccgtatgacgcctttaaacctggcggcagcgcaaaagatg

SEQ ID NO: 35327 - DNA, 103 bp, Artificial Sequence
  Synthetic Polynucleotide
taatacgactcactatagggctacagacaccactcatggtttaaaacgcaaacagaggagatgcgttatgaaccatgagaacctggcggcagcgcaaaagatg

SEQ ID NO: 35328 - DNA, 103 bp, Artificial Sequence
  Synthetic Polynucleotide
taatacgactcactatagggtccgcatttcaagcacaccattccgacagaaacagaggagatctgtcatgatggtgtgcaacctggcggcagcgcaaaagatg

SEQ ID NO: 35329 - DNA, 103 bp, Artificial Sequence
  Synthetic Polynucleotide
taatacgactcactatagggtcggccctaacaagcgcttgaaatcaccataacagaggagaatggtgatgtcaagcgctaacctggcggcagcgcaaaagatg

SEQ ID NO: 35330 - DNA, 103 bp, Artificial Sequence
  Synthetic Polynucleotide
taatacgactcactatagggccaagtctctagcatctgcccgtgttccagaacagaggagactggaaatggggcagatgaacctggcggcagcgcaaaagatg

SEQ ID NO: 35331 - DNA, 103 bp, Artificial Sequence
  Synthetic Polynucleotide
taatacgactcactatagggtagcctcgataaccccatccaggtagtgataacagaggagaatcactatgtggatggggaacctggcggcagcgcaaaagatg

SEQ ID NO: 35332 - DNA, 103 bp, Artificial Sequence
  Synthetic Polynucleotide
taatacgactcactatagggatggctagggcgccgtgaaggtccgaccaaaacagaggagattggtcatgccttcacggaacctggcggcagcgcaaaagatg

SEQ ID NO: 35333 - DNA, 103 bp, Artificial Sequence
  Synthetic Polynucleotide
taatacgactcactatagggaaaggtcagttatgaaggtcgcaacagcacaacagaggagagtgctgatgcgaccttcaaacctggcggcagcgcaaaagatg

SEQ ID NO: 35334 - DNA, 103 bp, Artificial Sequence
  Synthetic Polynucleotide
taatacgactcactatagggccgcttctgagtctggtaaaaaaagagttgaacagaggagacaactcatgttttaccagaacctggcggcagcgcaaaagatg

SEQ ID NO: 35335 - DNA, 103 bp, Artificial Sequence
  Synthetic Polynucleotide
taatacgactcactataggggcgcgagcagtcctgtctcgagtattcgtaaacagaggagatacgaaatgtcgagacagaacctggcggcagcgcaaaagatg

SEQ ID NO: 35336 - DNA, 103 bp, Artificial Sequence
  Synthetic Polynucleotide
taatacgactcactatagggatctagtatccccccagtccacctcaagcgaacagaggagacgcttgatgtggactgggaacctggcggcagcgcaaaagatg

SEQ ID NO: 35337 - DNA, 103 bp, Artificial Sequence
  Synthetic Polynucleotide
taatacgactcactatagggaaatgaagcttgcaattcgcctattgacgtaacagaggagaacgtcaatgggcgaattgaacctggcggcagcgcaaaagatg

SEQ ID NO: 35338 - DNA, 103 bp, Artificial Sequence
  Synthetic Polynucleotide
taatacgactcactatagggtctatgcagtaccctagtgacacccaggtcaacagaggagagacctgatggtcactaggaacctggcggcagcgcaaaagatg

SEQ ID NO: 35339 - DNA, 103 bp, Artificial Sequence
  Synthetic Polynucleotide
taatacgactcactatagggtggtacgggctaagattacgtcgccgtctcaacagaggagagagacgatgacgtaatctaacctggcggcagcgcaaaagatg

SEQ ID NO: 35340 - DNA, 103 bp, Artificial Sequence
  Synthetic Polynucleotide
taatacgactcactatagggacgcgcctcactctgtgctagcaccgctgaaacagaggagatcagcgatgctagcacagaacctggcggcagcgcaaaagatg

SEQ ID NO: 35341 - DNA, 103 bp, Artificial Sequence
  Synthetic Polynucleotide
taatacgactcactatagggctagggcctccgcacacgagtggactgactaacagaggagaagtcagatgactcgtgtgaacctggcggcagcgcaaaagatg

SEQ ID NO: 35342 - DNA, 103 bp, Artificial Sequence
  Synthetic Polynucleotide
taatacgactcactatagggtggtgcgacgactatacccaccgaatgataaacagaggagatatcatatggtgggtataaacctggcggcagcgcaaaagatg

SEQ ID NO: 35343 - DNA, 103 bp, Artificial Sequence
  Synthetic Polynucleotide
taatacgactcactatagggaaatcataagagctatgccctccattaaagaacagaggagactttaaatgagggcatagaacctggcggcagcgcaaaagatg

SEQ ID NO: 35344 - DNA, 103 bp, Artificial Sequence
  Synthetic Polynucleotide
taatacgactcactatagggtcacctttgcctccaagcattatacaggtaaacagaggagatacctgatgaatgcttggaacctggcggcagcgcaaaagatg

SEQ ID NO: 35345 - DNA, 103 bp, Artificial Sequence
  Synthetic Polynucleotide
taatacgactcactataggggagggcctggcgatgttcgcatagtgcggcaacagaggagagccgcaatgtgcgaacataacctggcggcagcgcaaaagatg

SEQ ID NO: 35346 - DNA, 103 bp, Artificial Sequence
  Synthetic Polynucleotide
taatacgactcactataggggaaactctgcgccccgtgaccaaacgtcataacagaggagaatgacgatgggtcacgggaacctggcggcagcgcaaaagatg

SEQ ID NO: 35347 - DNA, 103 bp, Artificial Sequence
  Synthetic Polynucleotide
taatacgactcactatagggtagacgcatacgaactaagtgacaccagccaacagaggagaggctggatgcacttagttaacctggcggcagcgcaaaagatg

SEQ ID NO: 35348 - DNA, 103 bp, Artificial Sequence
  Synthetic Polynucleotide
taatacgactcactatagggggatcttgggtgcttctcgattaacgcttcaacagaggagagaagcgatgatcgagaagaacctggcggcagcgcaaaagatg

SEQ ID NO: 35349 - DNA, 103 bp, Artificial Sequence
  Synthetic Polynucleotide
taatacgactcactatagggcatcatcttcaattattatcaagtgaggagaacagaggagactcctcatgtgataataaaacctggcggcagcgcaaaagatg

SEQ ID NO: 35350 - DNA, 103 bp, Artificial Sequence
  Synthetic Polynucleotide
taatacgactcactatagggacaggaataactttgagttttgccttcggaaacagaggagatccgaaatgaaaactcaaaacctggcggcagcgcaaaagatg

SEQ ID NO: 35351 - DNA, 103 bp, Artificial Sequence
  Synthetic Polynucleotide
taatacgactcactatagggctgccaattcgtggcaggcgctacgttctaaacagaggagatagaacatggcgcctgccaacctggcggcagcgcaaaagatg

SEQ ID NO: 35352 - DNA, 103 bp, Artificial Sequence
  Synthetic Polynucleotide
taatacgactcactatagggacaaaatagctgagcctgtaatttccgggtaacagaggagaacccggatgttacaggctaacctggcggcagcgcaaaagatg

SEQ ID NO: 35353 - DNA, 103 bp, Artificial Sequence
  Synthetic Polynucleotide
taatacgactcactatagggtaatcatttctttcattagtgtatagtatcaacagaggagagatactatgcactaatgaaacctggcggcagcgcaaaagatg

SEQ ID NO: 35354 - DNA, 103 bp, Artificial Sequence
  Synthetic Polynucleotide
taatacgactcactatagggcattaagtaaccttgtatggcgtctaagccaacagaggagaggcttaatggccatacaaaacctggcggcagcgcaaaagatg

SEQ ID NO: 35355 - DNA, 103 bp, Artificial Sequence
  Synthetic Polynucleotide
taatacgactcactataggggaacctccacatatgtaagcgcagggaaataacagaggagaatttccatgcgcttacataacctggcggcagcgcaaaagatg

SEQ ID NO: 35356 - DNA, 103 bp, Artificial Sequence
  Synthetic Polynucleotide
taatacgactcactatagggatttacaaatgtagacgtcggcctgcgtgaaacagaggagatcacgcatgccgacgtctaacctggcggcagcgcaaaagatg

SEQ ID NO: 35357 - DNA, 103 bp, Artificial Sequence
  Synthetic Polynucleotide
taatacgactcactatagggagaacacggttcgagttatttgcgaagtggaacagaggagaccacttatgaaataactcaacctggcggcagcgcaaaagatg

SEQ ID NO: 35358 - DNA, 103 bp, Artificial Sequence
  Synthetic Polynucleotide
taatacgactcactatagggcataccgtaatagagcgcccgtaccaatgtaacagaggagaacattgatgcgggcgctcaacctggcggcagcgcaaaagatg

SEQ ID NO: 35359 - DNA, 103 bp, Artificial Sequence
  Synthetic Polynucleotide
taatacgactcactatagggctcaccacccgcgaggaatgtcatacaaaaaacagaggagattttgtatgacattcctcaacctggcggcagcgcaaaagatg

SEQ ID NO: 35360 - DNA, 103 bp, Artificial Sequence
  Synthetic Polynucleotide
taatacgactcactatagggtgtcgtcgtggtcttggtttgaccaataaaaacagaggagatttattatgcaaaccaagaacctggcggcagcgcaaaagatg

SEQ ID NO: 35361 - DNA, 103 bp, Artificial Sequence
  Synthetic Polynucleotide
taatacgactcactatagggatctgcgaaaaggcgttccgcttgccatacaacagaggagagtatggatggcggaacgcaacctggcggcagcgcaaaagatg

SEQ ID NO: 35362 - DNA, 103 bp, Artificial Sequence
  Synthetic Polynucleotide
taatacgactcactatagggtctgacatggagcgggagcgtgacttgaggaacagaggagacctcaaatgacgctcccgaacctggcggcagcgcaaaagatg

SEQ ID NO: 35363 - DNA, 103 bp, Artificial Sequence
  Synthetic Polynucleotide
taatacgactcactataggggcgtacagactaaagcggcatcattctgccaacagaggagaggcagaatgatgccgcttaacctggcggcagcgcaaaagatg

SEQ ID NO: 35364 - DNA, 103 bp, Artificial Sequence
  Synthetic Polynucleotide
taatacgactcactatagggatacggttacgctgttcatttcagcgtcacaacagaggagagtgacgatgaaatgaacaaacctggcggcagcgcaaaagatg

SEQ ID NO: 35365 - DNA, 103 bp, Artificial Sequence
  Synthetic Polynucleotide
taatacgactcactatagggcgtttaaacgctctaacctacacgtcacacaacagaggagagtgtgaatggtaggttagaacctggcggcagcgcaaaagatg

SEQ ID NO: 35366 - DNA, 103 bp, Artificial Sequence
  Synthetic Polynucleotide
taatacgactcactatagggtcggctttatggagaggtggacagcggtataacagaggagaataccgatgtccacctctaacctggcggcagcgcaaaagatg

SEQ ID NO: 35367 - DNA, 103 bp, Artificial Sequence
  Synthetic Polynucleotide
taatacgactcactataggggagcatgacgaccggagatgcacggggtcaaacagaggagatgacccatggcatctccgaacctggcggcagcgcaaaagatg

SEQ ID NO: 35368 - DNA, 103 bp, Artificial Sequence
  Synthetic Polynucleotide
taatacgactcactatagggactcagatacacctgagttgaaaggacctaaacagaggagataggtcatgtcaactcagaacctggcggcagcgcaaaagatg

SEQ ID NO: 35369 - DNA, 103 bp, Artificial Sequence
  Synthetic Polynucleotide
taatacgactcactatagggtacttagatcacacggaacgattgtaagcaaacagaggagatgcttaatgtcgttccgtaacctggcggcagcgcaaaagatg

SEQ ID NO: 35370 - DNA, 103 bp, Artificial Sequence
  Synthetic Polynucleotide
taatacgactcactatagggccaaagcccgccgccgacaggagaggacataacagaggagaatgtccatgcctgtcggcaacctggcggcagcgcaaaagatg

SEQ ID NO: 35371 - DNA, 103 bp, Artificial Sequence
  Synthetic Polynucleotide
taatacgactcactatagggaggcgcttaggggaatagtgtcgcaccgcgaacagaggagacgcggtatgacactattcaacctggcggcagcgcaaaagatg

SEQ ID NO: 35372 - DNA, 103 bp, Artificial Sequence
  Synthetic Polynucleotide
taatacgactcactatagggatttttgtcgctgcatcacgagtcatagtgaacagaggagacactatatgtcgtgatgcaacctggcggcagcgcaaaagatg

SEQ ID NO: 35373 - DNA, 103 bp, Artificial Sequence
  Synthetic Polynucleotide
taatacgactcactataggggcgaataattttgttaagggggtcaagcaaaacagaggagattgcttatgccccttaacaacctggcggcagcgcaaaagatg

SEQ ID NO: 35374 - DNA, 103 bp, Artificial Sequence
  Synthetic Polynucleotide
taatacgactcactatagggtcgatgtttgagataaagcttatagactccaacagaggagaggagtcatgaagctttataacctggcggcagcgcaaaagatg

SEQ ID NO: 35375 - DNA, 103 bp, Artificial Sequence
  Synthetic Polynucleotide
taatacgactcactataggggaaaacgtacaggcaagcgggcggtctctaaacagaggagatagagaatgcccgcttgcaacctggcggcagcgcaaaagatg

SEQ ID NO: 35376 - DNA, 103 bp, Artificial Sequence
  Synthetic Polynucleotide
taatacgactcactataggggtttaaggctcgtgcgattgctgtcaacaaaacagaggagattgttgatggcaatcgcaaacctggcggcagcgcaaaagatg

SEQ ID NO: 35377 - DNA, 103 bp, Artificial Sequence
  Synthetic Polynucleotide
taatacgactcactatagggagcactgtcccgcgccctccgtacttgggcaacagaggagagcccaaatgcggagggcgaacctggcggcagcgcaaaagatg

SEQ ID NO: 35378 - DNA, 103 bp, Artificial Sequence
  Synthetic Polynucleotide
taatacgactcactatagggcagtagcggcgcgagtgtatgggccatttaaacagaggagataaatgatgcatacactcaacctggcggcagcgcaaaagatg

SEQ ID NO: 35379 - DNA, 103 bp, Artificial Sequence
  Synthetic Polynucleotide
taatacgactcactatagggccacggaggtcgagattactacaatttagtaacagaggagaactaaaatgtagtaatctaacctggcggcagcgcaaaagatg

SEQ ID NO: 35380 - DNA, 103 bp, Artificial Sequence
  Synthetic Polynucleotide
taatacgactcactatagggctcaaactctcaatgacgaccggtatgagtaacagaggagaactcatatgggtcgtcataacctggcggcagcgcaaaagatg

SEQ ID NO: 35381 - DNA, 103 bp, Artificial Sequence
  Synthetic Polynucleotide
taatacgactcactatagggaactagaatgagggtgagagcgtcgtcacaaacagaggagatgtgacatggctctcaccaacctggcggcagcgcaaaagatg

SEQ ID NO: 35382 - DNA, 103 bp, Artificial Sequence
  Synthetic Polynucleotide
taatacgactcactatagggcctgctctgggatattactatgacgccaacaacagaggagagttggcatgatagtaataaacctggcggcagcgcaaaagatg

SEQ ID NO: 35383 - DNA, 103 bp, Artificial Sequence
  Synthetic Polynucleotide
taatacgactcactatagggccccgttatagctggtacctgtccatgagtaacagaggagaactcatatgcaggtaccaaacctggcggcagcgcaaaagatg

SEQ ID NO: 35384 - DNA, 103 bp, Artificial Sequence
  Synthetic Polynucleotide
taatacgactcactatagggtccgccggcacgtggaatccgtccctccgtaacagaggagaacggagatgcggattccaaacctggcggcagcgcaaaagatg

SEQ ID NO: 35385 - DNA, 103 bp, Artificial Sequence
  Synthetic Polynucleotide
taatacgactcactatagggcgcctctgcacatacgtgccttggtcaatgaacagaggagacattgaatgaggcacgtaaacctggcggcagcgcaaaagatg

SEQ ID NO: 35386 - DNA, 103 bp, Artificial Sequence
  Synthetic Polynucleotide
taatacgactcactatagggtagggtctacgttgcccatacgggcaatgtaacagaggagaacattgatggtatgggcaaacctggcggcagcgcaaaagatg

SEQ ID NO: 35387 - DNA, 103 bp, Artificial Sequence
  Synthetic Polynucleotide
taatacgactcactatagggtcccggctcgcgctcaagtaccgagttctgaacagaggagacagaacatggtacttgagaacctggcggcagcgcaaaagatg

SEQ ID NO: 35388 - DNA, 103 bp, Artificial Sequence
  Synthetic Polynucleotide
taatacgactcactatagggttgggaaaggtaccttacggtggggcgatgaacagaggagacatcgcatgaccgtaaggaacctggcggcagcgcaaaagatg

SEQ ID NO: 35389 - DNA, 103 bp, Artificial Sequence
  Synthetic Polynucleotide
taatacgactcactataggggactccattaaggcagtgtgagctctgcctaacagaggagaaggcagatgtcacactgcaacctggcggcagcgcaaaagatg

SEQ ID NO: 35390 - DNA, 103 bp, Artificial Sequence
  Synthetic Polynucleotide
taatacgactcactatagggtcttacgcaacagctatctcgagagcctctaacagaggagaagaggcatgcgagatagcaacctggcggcagcgcaaaagatg

SEQ ID NO: 35391 - DNA, 103 bp, Artificial Sequence
  Synthetic Polynucleotide
taatacgactcactatagggtctagtagtaaacttacagagctcgtacaaaacagaggagattgtacatgctctgtaagaacctggcggcagcgcaaaagatg

SEQ ID NO: 35392 - DNA, 103 bp, Artificial Sequence
  Synthetic Polynucleotide
taatacgactcactatagggtaaccactgcattttgttactcgcttgcttaacagaggagaaagcaaatgagtaacaaaaacctggcggcagcgcaaaagatg

SEQ ID NO: 35393 - DNA, 103 bp, Artificial Sequence
  Synthetic Polynucleotide
taatacgactcactatagggcgctgtgctggtctgggttgagcctcacaaaacagaggagattgtgaatgtcaacccagaacctggcggcagcgcaaaagatg

SEQ ID NO: 35394 - DNA, 103 bp, Artificial Sequence
  Synthetic Polynucleotide
taatacgactcactatagggcccctcaagtttatggtctttcacaccgccaacagaggagaggcggtatgaaagaccataacctggcggcagcgcaaaagatg

SEQ ID NO: 35395 - DNA, 103 bp, Artificial Sequence
  Synthetic Polynucleotide
taatacgactcactatagggtggtgtagcgtgacggagtaatgcctcccgaacagaggagacgggagatgttactccgtaacctggcggcagcgcaaaagatg

SEQ ID NO: 35396 - DNA, 103 bp, Artificial Sequence
  Synthetic Polynucleotide
taatacgactcactatagggtttacagagaataggcactgaagctgagaaaacagaggagattctcaatgtcagtgcctaacctggcggcagcgcaaaagatg

SEQ ID NO: 35397 - DNA, 103 bp, Artificial Sequence
  Synthetic Polynucleotide
taatacgactcactatagggcgtgttaataacgcaacccaacggctggaaaacagaggagattccagatgttgggttgcaacctggcggcagcgcaaaagatg

SEQ ID NO: 35398 - DNA, 103 bp, Artificial Sequence
  Synthetic Polynucleotide
taatacgactcactatagggagtgcctgatcatcggtgcttccgatatttaacagaggagaaaatatatgaagcaccgaaacctggcggcagcgcaaaagatg

SEQ ID NO: 35399 - DNA, 103 bp, Artificial Sequence
  Synthetic Polynucleotide
taatacgactcactatagggcaccctcgcctccgctggtcaatgggaaccaacagaggagaggttccatgtgaccagcgaacctggcggcagcgcaaaagatg

SEQ ID NO: 35400 - DNA, 103 bp, Artificial Sequence
  Synthetic Polynucleotide
taatacgactcactataggggctcctagaacccggacatgttcccctaagaacagaggagacttaggatgacatgtccgaacctggcggcagcgcaaaagatg

SEQ ID NO: 35401 - DNA, 103 bp, Artificial Sequence
  Synthetic Polynucleotide
taatacgactcactataggggtcggcgaacctcaggcttacgactggctcaacagaggagagagccaatggtaagcctgaacctggcggcagcgcaaaagatg

SEQ ID NO: 35402 - DNA, 103 bp, Artificial Sequence
  Synthetic Polynucleotide
taatacgactcactatagggaaaacttggcgacatgaactctgtgaaataaacagaggagatatttcatggagttcatgaacctggcggcagcgcaaaagatg

SEQ ID NO: 35403 - DNA, 103 bp, Artificial Sequence
  Synthetic Polynucleotide
taatacgactcactatagggaatcactacggataccaatgcgcgaatcggaacagaggagaccgattatggcattggtaaacctggcggcagcgcaaaagatg

SEQ ID NO: 35404 - DNA, 103 bp, Artificial Sequence
  Synthetic Polynucleotide
taatacgactcactatagggtcattctgagccagataaaatcgacataaaaacagaggagatttatgatgattttatctaacctggcggcagcgcaaaagatg

SEQ ID NO: 35405 - DNA, 103 bp, Artificial Sequence
  Synthetic Polynucleotide
taatacgactcactataggggacctcctaaatcttctcgactaactaggcaacagaggagagcctagatggtcgagaagaacctggcggcagcgcaaaagatg

SEQ ID NO: 35406 - DNA, 103 bp, Artificial Sequence
  Synthetic Polynucleotide
taatacgactcactatagggccgtgttagatcagaataccataatataacaacagaggagagttataatgtggtattctaacctggcggcagcgcaaaagatg

SEQ ID NO: 35407 - DNA, 103 bp, Artificial Sequence
  Synthetic Polynucleotide
taatacgactcactataggggggatgttgtccaaagacgtaccccgcgacaacagaggagagtcgcgatgtacgtctttaacctggcggcagcgcaaaagatg

SEQ ID NO: 35408 - DNA, 103 bp, Artificial Sequence
  Synthetic Polynucleotide
taatacgactcactatagggatagatgatcggcctagcgcgactcagttaaacagaggagataactgatgcgcgctaggaacctggcggcagcgcaaaagatg

SEQ ID NO: 35409 - DNA, 103 bp, Artificial Sequence
  Synthetic Polynucleotide
taatacgactcactataggggcatgactacgggtaactgctccgatgattaacagaggagaaatcatatgagcagttacaacctggcggcagcgcaaaagatg

SEQ ID NO: 35410 - DNA, 103 bp, Artificial Sequence
  Synthetic Polynucleotide
taatacgactcactatagggaaggaaggacccactagacatgagacgaacaacagaggagagttcgtatgatgtctagtaacctggcggcagcgcaaaagatg

SEQ ID NO: 35411 - DNA, 103 bp, Artificial Sequence
  Synthetic Polynucleotide
taatacgactcactataggggacgccagggtgtccgcgtatgacattggtaacagaggagaaccaatatgatacgcggaaacctggcggcagcgcaaaagatg

SEQ ID NO: 35412 - DNA, 103 bp, Artificial Sequence
  Synthetic Polynucleotide
taatacgactcactatagggagacgatcgatgaaggtcggctgcatccctaacagaggagaagggatatggccgaccttaacctggcggcagcgcaaaagatg

SEQ ID NO: 35413 - DNA, 103 bp, Artificial Sequence
  Synthetic Polynucleotide
taatacgactcactatagggctccgactcgaacttttgaattccattgtcaacagaggagagacaatatgattcaaaagaacctggcggcagcgcaaaagatg

SEQ ID NO: 35414 - DNA, 103 bp, Artificial Sequence
  Synthetic Polynucleotide
taatacgactcactatagggagtgcgttgcgctctccgactaaatcttctaacagaggagaagaagaatgagtcggagaaacctggcggcagcgcaaaagatg

SEQ ID NO: 35415 - DNA, 103 bp, Artificial Sequence
  Synthetic Polynucleotide
taatacgactcactatagggccaattgaaaggtcggacctgtatgcttgcaacagaggagagcaagcatgcaggtccgaaacctggcggcagcgcaaaagatg

SEQ ID NO: 35416 - DNA, 103 bp, Artificial Sequence
  Synthetic Polynucleotide
taatacgactcactatagggttggagtatacctattcaggaccgctagataacagaggagaatctagatgtcctgaataaacctggcggcagcgcaaaagatg

SEQ ID NO: 35417 - DNA, 103 bp, Artificial Sequence
  Synthetic Polynucleotide
taatacgactcactatagggtgctggcgatgggagtagggcaacccatggaacagaggagaccatggatggccctactcaacctggcggcagcgcaaaagatg

SEQ ID NO: 35418 - DNA, 103 bp, Artificial Sequence
  Synthetic Polynucleotide
taatacgactcactatagggttggagggaggtagacgcttaagaatgaaaaacagaggagatttcatatgtaagcgtctaacctggcggcagcgcaaaagatg

SEQ ID NO: 35419 - DNA, 103 bp, Artificial Sequence
  Synthetic Polynucleotide
taatacgactcactatagggttaaccaggcaggtatttgggatcctacttaacagaggagaaagtagatgcccaaatacaacctggcggcagcgcaaaagatg

SEQ ID NO: 35420 - DNA, 103 bp, Artificial Sequence
  Synthetic Polynucleotide
taatacgactcactatagggatagtgcggtactaatcattccaccctactaacagaggagaagtaggatggaatgattaaacctggcggcagcgcaaaagatg

SEQ ID NO: 35421 - DNA, 103 bp, Artificial Sequence
  Synthetic Polynucleotide
taatacgactcactataggggcaacgacctacatactccaaaaaaggattaacagaggagaaatcctatgttggagtataacctggcggcagcgcaaaagatg

SEQ ID NO: 35422 - DNA, 103 bp, Artificial Sequence
  Synthetic Polynucleotide
taatacgactcactataggggggctcatctcccgaaatgccgggcaaatcaacagaggagagatttgatgggcatttcgaacctggcggcagcgcaaaagatg

SEQ ID NO: 35423 - DNA, 103 bp, Artificial Sequence
  Synthetic Polynucleotide
taatacgactcactataggggtgttaactgcaggtatccctcaaattaaaaacagaggagatttaatatgagggataccaacctggcggcagcgcaaaagatg

SEQ ID NO: 35424 - DNA, 103 bp, Artificial Sequence
  Synthetic Polynucleotide
taatacgactcactatagggcaactcatgcatataagtacacacaccggcaacagaggagagccggtatgtgtacttataacctggcggcagcgcaaaagatg

SEQ ID NO: 35425 - DNA, 103 bp, Artificial Sequence
  Synthetic Polynucleotide
taatacgactcactatagggacaagctataggagcgcacagattcgcatgaacagaggagacatgcgatgctgtgcgctaacctggcggcagcgcaaaagatg

SEQ ID NO: 35426 - DNA, 103 bp, Artificial Sequence
  Synthetic Polynucleotide
taatacgactcactatagggtcggtagctgtccaaagaagatccccgactaacagaggagaagtcggatgtcttctttgaacctggcggcagcgcaaaagatg

SEQ ID NO: 35427 - DNA, 103 bp, Artificial Sequence
  Synthetic Polynucleotide
taatacgactcactatagggccagtgtcggccgggcaccattaaactactaacagaggagaagtagtatgatggtgcccaacctggcggcagcgcaaaagatg

SEQ ID NO: 35428 - DNA, 103 bp, Artificial Sequence
  Synthetic Polynucleotide
taatacgactcactataggggtgggctgtgctcggttgggcgattaggctaacagaggagaagcctaatggcccaaccgaacctggcggcagcgcaaaagatg

SEQ ID NO: 35429 - DNA, 103 bp, Artificial Sequence
  Synthetic Polynucleotide
taatacgactcactataggggaagcggagtccgtgggtatctccctgactaacagaggagaagtcagatggatacccacaacctggcggcagcgcaaaagatg

SEQ ID NO: 35430 - DNA, 103 bp, Artificial Sequence
  Synthetic Polynucleotide
taatacgactcactatagggccaaagtccagcctggcattgcggacttcgaacagaggagacgaagtatgcaatgccagaacctggcggcagcgcaaaagatg

SEQ ID NO: 35431 - DNA, 103 bp, Artificial Sequence
  Synthetic Polynucleotide
taatacgactcactatagggaaccgccttggattgatacccttaactcctaacagaggagaaggagtatggggtatcaaaacctggcggcagcgcaaaagatg

SEQ ID NO: 35432 - DNA, 103 bp, Artificial Sequence
  Synthetic Polynucleotide
taatacgactcactatagggcatccaatgccctcagaggtcacggggttcaacagaggagagaacccatggacctctgaaacctggcggcagcgcaaaagatg

SEQ ID NO: 35433 - DNA, 103 bp, Artificial Sequence
  Synthetic Polynucleotide
taatacgactcactatagggcgaagagcccacgtttagaatactggcggtaacagaggagaaccgccatgattctaaacaacctggcggcagcgcaaaagatg

SEQ ID NO: 35434 - DNA, 103 bp, Artificial Sequence
  Synthetic Polynucleotide
taatacgactcactatagggtacgtgttattccgcgtttacatcgaagtgaacagaggagacacttcatggtaaacgcgaacctggcggcagcgcaaaagatg

SEQ ID NO: 35435 - DNA, 103 bp, Artificial Sequence
  Synthetic Polynucleotide
taatacgactcactatagggacagcttgctagcgatagtacggagtccgcaacagaggagagcggacatggtactatcgaacctggcggcagcgcaaaagatg

SEQ ID NO: 35436 - DNA, 103 bp, Artificial Sequence
  Synthetic Polynucleotide
taatacgactcactatagggcagggggacacagtatcgctgaatgcgttgaacagaggagacaacgcatgcagcgatacaacctggcggcagcgcaaaagatg

SEQ ID NO: 35437 - DNA, 103 bp, Artificial Sequence
  Synthetic Polynucleotide
taatacgactcactatagggtctcgtgcggatggtaaccctcctgagagcaacagaggagagctctcatgagggttaccaacctggcggcagcgcaaaagatg

SEQ ID NO: 35438 - DNA, 103 bp, Artificial Sequence
  Synthetic Polynucleotide
taatacgactcactatagggcgagggcgctacatatatctgtttgcttataacagaggagaataagcatgcagatatataacctggcggcagcgcaaaagatg

SEQ ID NO: 35439 - DNA, 103 bp, Artificial Sequence
  Synthetic Polynucleotide
taatacgactcactataggggatgtatgtggagccataggatgtcaccccaacagaggagaggggtgatgtcctatggcaacctggcggcagcgcaaaagatg

SEQ ID NO: 35440 - DNA, 103 bp, Artificial Sequence
  Synthetic Polynucleotide
taatacgactcactataggggcgtgtaatcgctttgatgaacctattgtcaacagaggagagacaatatgttcatcaaaaacctggcggcagcgcaaaagatg

SEQ ID NO: 35441 - DNA, 103 bp, Artificial Sequence
  Synthetic Polynucleotide
taatacgactcactatagggacctcattcacgagattcagtgataaattaaacagaggagataatttatgactgaatctaacctggcggcagcgcaaaagatg

SEQ ID NO: 35442 - DNA, 103 bp, Artificial Sequence
  Synthetic Polynucleotide
taatacgactcactataggggggaccggcaagacctgaactatttcgctgaacagaggagacagcgaatgagttcaggtaacctggcggcagcgcaaaagatg

SEQ ID NO: 35443 - DNA, 103 bp, Artificial Sequence
  Synthetic Polynucleotide
taatacgactcactatagggtttccagattcccttttcgagtgcatttggaacagaggagaccaaatatgctcgaaaagaacctggcggcagcgcaaaagatg

SEQ ID NO: 35444 - DNA, 103 bp, Artificial Sequence
  Synthetic Polynucleotide
taatacgactcactatagggtatgactattcccggtagatccagagaaacaacagaggagagtttctatggatctaccgaacctggcggcagcgcaaaagatg

SEQ ID NO: 35445 - DNA, 103 bp, Artificial Sequence
  Synthetic Polynucleotide
taatacgactcactatagggaatacgaaccatctgtgagccagcgcacataacagaggagaatgtgcatgggctcacagaacctggcggcagcgcaaaagatg

SEQ ID NO: 35446 - DNA, 103 bp, Artificial Sequence
  Synthetic Polynucleotide
taatacgactcactatagggatgccgcggtttatatcacacctatgagctaacagaggagaagctcaatggtgtgatataacctggcggcagcgcaaaagatg

SEQ ID NO: 35447 - DNA, 103 bp, Artificial Sequence
  Synthetic Polynucleotide
taatacgactcactatagggctggcaagaatattagccgtccttcccgcgaacagaggagacgcgggatggacggctaaaacctggcggcagcgcaaaagatg

SEQ ID NO: 35448 - DNA, 103 bp, Artificial Sequence
  Synthetic Polynucleotide
taatacgactcactatagggtaactcatagggattcgattgcgcttatgtaacagaggagaacataaatgcaatcgaataacctggcggcagcgcaaaagatg

SEQ ID NO: 35449 - DNA, 103 bp, Artificial Sequence
  Synthetic Polynucleotide
taatacgactcactatagggctcattgagaggggaagaaagtcgatgatcaacagaggagagatcatatgctttcttccaacctggcggcagcgcaaaagatg

SEQ ID NO: 35450 - DNA, 103 bp, Artificial Sequence
  Synthetic Polynucleotide
taatacgactcactatagggcggtccctgtatggactgtcgtccaccatcaacagaggagagatggtatgcgacagtccaacctggcggcagcgcaaaagatg

SEQ ID NO: 35451 - DNA, 103 bp, Artificial Sequence
  Synthetic Polynucleotide
taatacgactcactataggggacagtctgcagtgacgaacacatggcaggaacagaggagacctgccatgtgttcgtcaaacctggcggcagcgcaaaagatg

SEQ ID NO: 35452 - DNA, 103 bp, Artificial Sequence
  Synthetic Polynucleotide
taatacgactcactatagggtccgagccatccaggaggacatccctgccgaacagaggagacggcagatgtgtcctcctaacctggcggcagcgcaaaagatg

SEQ ID NO: 35453 - DNA, 103 bp, Artificial Sequence
  Synthetic Polynucleotide
taatacgactcactatagggcctgccggttatctttatgcagccagaatgaacagaggagacattctatgtgcataaagaacctggcggcagcgcaaaagatg

SEQ ID NO: 35454 - DNA, 103 bp, Artificial Sequence
  Synthetic Polynucleotide
taatacgactcactatagggggacactagcgggtcctaaagcagaggggcaacagaggagagcccctatgctttaggacaacctggcggcagcgcaaaagatg

SEQ ID NO: 35455 - DNA, 103 bp, Artificial Sequence
  Synthetic Polynucleotide
taatacgactcactatagggagctgttggcctgttaggtaggaacgtgataacagaggagaatcacgatgctacctaacaacctggcggcagcgcaaaagatg

SEQ ID NO: 35456 - DNA, 103 bp, Artificial Sequence
  Synthetic Polynucleotide
taatacgactcactatagggggagtactccacggtctacagtacatgaataacagaggagaattcatatgctgtagaccaacctggcggcagcgcaaaagatg

SEQ ID NO: 35457 - DNA, 103 bp, Artificial Sequence
  Synthetic Polynucleotide
taatacgactcactatagggacggttaccgtcgacgccgactgtcatagtaacagaggagaactatgatggtcggcgtcaacctggcggcagcgcaaaagatg

SEQ ID NO: 35458 - DNA, 103 bp, Artificial Sequence
  Synthetic Polynucleotide
taatacgactcactatagggatgaggaggcacgggcgtcaatgatcgcagaacagaggagactgcgaatgttgacgcccaacctggcggcagcgcaaaagatg

SEQ ID NO: 35459 - DNA, 103 bp, Artificial Sequence
  Synthetic Polynucleotide
taatacgactcactatagggcaaaatagcgaaactgaagggctctctattaacagaggagaaatagaatgcccttcagtaacctggcggcagcgcaaaagatg

SEQ ID NO: 35460 - DNA, 103 bp, Artificial Sequence
  Synthetic Polynucleotide
taatacgactcactatagggtccagcagtcaatactccattatttgagtgaacagaggagacactcaatgaatggagtaaacctggcggcagcgcaaaagatg

SEQ ID NO: 35461 - DNA, 103 bp, Artificial Sequence
  Synthetic Polynucleotide
taatacgactcactatagggcatctcatgagtggcaaaaagaccaccttcaacagaggagagaaggtatgctttttgccaacctggcggcagcgcaaaagatg

SEQ ID NO: 35462 - DNA, 103 bp, Artificial Sequence
  Synthetic Polynucleotide
taatacgactcactatagggttctttcttatcgtagtttctgtgaatcaaaacagaggagattgattatgagaaactacaacctggcggcagcgcaaaagatg

SEQ ID NO: 35463 - DNA, 103 bp, Artificial Sequence
  Synthetic Polynucleotide
taatacgactcactatagggtctagtaattggccagtgagagtatcgcttaacagaggagaaagcgaatgtctcactggaacctggcggcagcgcaaaagatg

SEQ ID NO: 35464 - DNA, 103 bp, Artificial Sequence
  Synthetic Polynucleotide
taatacgactcactatagggcttaccggactattgatgttcgactcttggaacagaggagaccaagaatggaacatcaaaacctggcggcagcgcaaaagatg

SEQ ID NO: 35465 - DNA, 103 bp, Artificial Sequence
  Synthetic Polynucleotide
taatacgactcactatagggggctaaactttaaggactttattcggtataaacagaggagatataccatgtaaagtcctaacctggcggcagcgcaaaagatg

SEQ ID NO: 35466 - DNA, 103 bp, Artificial Sequence
  Synthetic Polynucleotide
taatacgactcactatagggcactcgcacgtgcatcggctaggcccgggtaacagaggagaacccggatgtagccgatgaacctggcggcagcgcaaaagatg

SEQ ID NO: 35467 - DNA, 103 bp, Artificial Sequence
  Synthetic Polynucleotide
taatacgactcactataggggcgtttctcgcagctgcactagatagacgaaacagaggagatcgtctatgtagtgcagcaacctggcggcagcgcaaaagatg

SEQ ID NO: 35468 - DNA, 103 bp, Artificial Sequence
  Synthetic Polynucleotide
taatacgactcactatagggttgatactaacaattagggatatgcctttaaacagaggagataaaggatgatccctaataacctggcggcagcgcaaaagatg

SEQ ID NO: 35469 - DNA, 103 bp, Artificial Sequence
  Synthetic Polynucleotide
taatacgactcactatagggccagccacccagaccgccacgatgagggctaacagaggagaagccctatgcgtggcggtaacctggcggcagcgcaaaagatg

SEQ ID NO: 35470 - DNA, 103 bp, Artificial Sequence
  Synthetic Polynucleotide
taatacgactcactataggggtcccaccttggcatgcgtcaaggggtctgaacagaggagacagaccatgtgacgcatgaacctggcggcagcgcaaaagatg

SEQ ID NO: 35471 - DNA, 103 bp, Artificial Sequence
  Synthetic Polynucleotide
taatacgactcactatagggatattcactgaccgtgggattcccagaggaaacagaggagatcctctatgaatcccacgaacctggcggcagcgcaaaagatg

SEQ ID NO: 35472 - DNA, 103 bp, Artificial Sequence
  Synthetic Polynucleotide
taatacgactcactataggggataaaaatgcgcgccctgaataatgtcagaacagaggagactgacaatgttcagggcgaacctggcggcagcgcaaaagatg

SEQ ID NO: 35473 - DNA, 103 bp, Artificial Sequence
  Synthetic Polynucleotide
taatacgactcactatagggttaactcggaagtcctcgaacggcgagggtaacagaggagaaccctcatggttcgaggaaacctggcggcagcgcaaaagatg

SEQ ID NO: 35474 - DNA, 103 bp, Artificial Sequence
  Synthetic Polynucleotide
taatacgactcactataggggcagggacacacctgtacgcgccccacagcaacagaggagagctgtgatgcgcgtacagaacctggcggcagcgcaaaagatg

SEQ ID NO: 35475 - DNA, 103 bp, Artificial Sequence
  Synthetic Polynucleotide
taatacgactcactataggggtattttctacagttcggtacagcacccggaacagaggagaccgggtatggtaccgaacaacctggcggcagcgcaaaagatg

SEQ ID NO: 35476 - DNA, 103 bp, Artificial Sequence
  Synthetic Polynucleotide
taatacgactcactatagggggcgcagccaatactgcaaatgacatctggaacagaggagaccagatatgatttgcagtaacctggcggcagcgcaaaagatg

SEQ ID NO: 35477 - DNA, 103 bp, Artificial Sequence
  Synthetic Polynucleotide
taatacgactcactataggggatgctcaccgccatcttggtctagcgcgcaacagaggagagcgcgcatgaccaagatgaacctggcggcagcgcaaaagatg

SEQ ID NO: 35478 - DNA, 103 bp, Artificial Sequence
  Synthetic Polynucleotide
taatacgactcactatagggtcgtgtacacgcttcacgtatcgcactctaaacagaggagatagagtatgatacgtgaaaacctggcggcagcgcaaaagatg

SEQ ID NO: 35479 - DNA, 103 bp, Artificial Sequence
  Synthetic Polynucleotide
taatacgactcactatagggctttgatcgagcggagtcgaacgaataattaacagaggagaaattatatgttcgactccaacctggcggcagcgcaaaagatg

SEQ ID NO: 35480 - DNA, 103 bp, Artificial Sequence
  Synthetic Polynucleotide
taatacgactcactatagggagaaaccaacgtcctgttgggctcgcaagaaacagaggagatcttgcatgcccaacaggaacctggcggcagcgcaaaagatg

SEQ ID NO: 35481 - DNA, 103 bp, Artificial Sequence
  Synthetic Polynucleotide
taatacgactcactatagggagagtgaattatctgcaattttggtggctcaacagaggagagagccaatgaaattgcagaacctggcggcagcgcaaaagatg

SEQ ID NO: 35482 - DNA, 103 bp, Artificial Sequence
  Synthetic Polynucleotide
taatacgactcactatagggcagtatgacaccgcacggacactatacacaaacagaggagatgtgtaatgtgtccgtgcaacctggcggcagcgcaaaagatg

SEQ ID NO: 35483 - DNA, 103 bp, Artificial Sequence
  Synthetic Polynucleotide
taatacgactcactatagggcatccatgttcataatcatatttgcatacaaacagaggagatgtatgatgatatgattaaacctggcggcagcgcaaaagatg

SEQ ID NO: 35484 - DNA, 103 bp, Artificial Sequence
  Synthetic Polynucleotide
taatacgactcactatagggaaagggagcgtaagaaccccgacacctagaaacagaggagatctaggatgcggggttctaacctggcggcagcgcaaaagatg

SEQ ID NO: 35485 - DNA, 103 bp, Artificial Sequence
  Synthetic Polynucleotide
taatacgactcactatagggtggtgtacctagctttgagtggctctaagcaacagaggagagcttagatgcactcaaagaacctggcggcagcgcaaaagatg

SEQ ID NO: 35486 - DNA, 103 bp, Artificial Sequence
  Synthetic Polynucleotide
taatacgactcactatagggcgcttcgatcagggaagccagcccagatttaacagaggagaaaatctatgctggcttccaacctggcggcagcgcaaaagatg

SEQ ID NO: 35487 - DNA, 103 bp, Artificial Sequence
  Synthetic Polynucleotide
taatacgactcactatagggcacgaatgttctacgccgcctccattagacaacagaggagagtctaaatgaggcggcgtaacctggcggcagcgcaaaagatg

SEQ ID NO: 35488 - DNA, 103 bp, Artificial Sequence
  Synthetic Polynucleotide
taatacgactcactatagggaatgatgaggagtttccaagctccgtatttaacagaggagaaaatacatggcttggaaaaacctggcggcagcgcaaaagatg

SEQ ID NO: 35489 - DNA, 103 bp, Artificial Sequence
  Synthetic Polynucleotide
taatacgactcactataggggtcatggtgcataaaacatttcatacgaccaacagaggagaggtcgtatgaaatgttttaacctggcggcagcgcaaaagatg

SEQ ID NO: 35490 - DNA, 103 bp, Artificial Sequence
  Synthetic Polynucleotide
taatacgactcactatagggatagaacttagctagccgtttcaatcgattaacagaggagaaatcgaatgaaacggctaaacctggcggcagcgcaaaagatg

SEQ ID NO: 35491 - DNA, 103 bp, Artificial Sequence
  Synthetic Polynucleotide
taatacgactcactatagggtgcaagcgagaattgcgtaccggcagatggaacagaggagaccatctatgggtacgcaaaacctggcggcagcgcaaaagatg

SEQ ID NO: 35492 - DNA, 103 bp, Artificial Sequence
  Synthetic Polynucleotide
taatacgactcactatagggatctatacgccagactgcggaatagatagtaacagaggagaactatcatgtccgcagtcaacctggcggcagcgcaaaagatg

SEQ ID NO: 35493 - DNA, 103 bp, Artificial Sequence
  Synthetic Polynucleotide
taatacgactcactatagggtggccataattctttctatacactcgccgcaacagaggagagcggcgatggtatagaaaaacctggcggcagcgcaaaagatg

SEQ ID NO: 35494 - DNA, 103 bp, Artificial Sequence
  Synthetic Polynucleotide
taatacgactcactatagggtcgcacgacggcggatacccccgattatacaacagaggagagtataaatgggggtatccaacctggcggcagcgcaaaagatg

SEQ ID NO: 35495 - DNA, 103 bp, Artificial Sequence
  Synthetic Polynucleotide
taatacgactcactatagggtacaggcttggcgccaaaacgaggcgcagcaacagaggagagctgcgatgcgttttggcaacctggcggcagcgcaaaagatg

SEQ ID NO: 35496 - DNA, 103 bp, Artificial Sequence
  Synthetic Polynucleotide
taatacgactcactataggggccggataatggatcagagaatttctgcctaacagaggagaaggcagatgttctctgataacctggcggcagcgcaaaagatg

SEQ ID NO: 35497 - DNA, 103 bp, Artificial Sequence
  Synthetic Polynucleotide
taatacgactcactatagggcttctactcgtacttctggtggcaagctacaacagaggagagtagctatgcaccagaagaacctggcggcagcgcaaaagatg

SEQ ID NO: 35498 - DNA, 103 bp, Artificial Sequence
  Synthetic Polynucleotide
taatacgactcactatagggcgtaagttcgtaaggctcaccattaatgataacagaggagaatcattatgggtgagcctaacctggcggcagcgcaaaagatg

SEQ ID NO: 35499 - DNA, 103 bp, Artificial Sequence
  Synthetic Polynucleotide
taatacgactcactatagggccatgagtctgtaccggcttaacgtaatgtaacagaggagaacattaatgtaagccggtaacctggcggcagcgcaaaagatg

SEQ ID NO: 35500 - DNA, 103 bp, Artificial Sequence
  Synthetic Polynucleotide
taatacgactcactatagggtttccttaaattctactaacaggcaacgtaaacagaggagatacgttatgtgttagtagaacctggcggcagcgcaaaagatg

SEQ ID NO: 35501 - DNA, 103 bp, Artificial Sequence
  Synthetic Polynucleotide
taatacgactcactatagggagacggttcaactctctcccctacttcgtaaacagaggagatacgaaatgggggagagaaacctggcggcagcgcaaaagatg

SEQ ID NO: 35502 - DNA, 103 bp, Artificial Sequence
  Synthetic Polynucleotide
taatacgactcactatagggcatggggctagttatgcccagaccggaaaaaacagaggagattttccatgctgggcataaacctggcggcagcgcaaaagatg

SEQ ID NO: 35503 - DNA, 103 bp, Artificial Sequence
  Synthetic Polynucleotide
taatacgactcactatagggcgctggtctacgcgcagtcttgattacgctaacagaggagaagcgtaatgaagactgcgaacctggcggcagcgcaaaagatg

SEQ ID NO: 35504 - DNA, 103 bp, Artificial Sequence
  Synthetic Polynucleotide
taatacgactcactataggggctggttatccgccttcaactcgaatcttgaacagaggagacaagatatgagttgaaggaacctggcggcagcgcaaaagatg

SEQ ID NO: 35505 - DNA, 103 bp, Artificial Sequence
  Synthetic Polynucleotide
taatacgactcactatagggagcgacctatgaatactttaccttctctgtaacagaggagaacagagatggtaaagtataacctggcggcagcgcaaaagatg

SEQ ID NO: 35506 - DNA, 103 bp, Artificial Sequence
  Synthetic Polynucleotide
taatacgactcactataggggagattgctccaggtagtgataagacgcttaacagaggagaaagcgtatgatcactaccaacctggcggcagcgcaaaagatg

SEQ ID NO: 35507 - DNA, 103 bp, Artificial Sequence
  Synthetic Polynucleotide
taatacgactcactataggggcacggttcccactcttcgacgacaaggcaaacagaggagatgccttatggtcgaagagaacctggcggcagcgcaaaagatg

SEQ ID NO: 35508 - DNA, 103 bp, Artificial Sequence
  Synthetic Polynucleotide
taatacgactcactatagggggaagctcaaaatgttgggttccgcgcaccaacagaggagaggtgcgatgaacccaacaaacctggcggcagcgcaaaagatg

SEQ ID NO: 35509 - DNA, 103 bp, Artificial Sequence
  Synthetic Polynucleotide
taatacgactcactatagggctgtgaatattcttggataacgtgactactaacagaggagaagtagtatggttatccaaaacctggcggcagcgcaaaagatg

SEQ ID NO: 35510 - DNA, 103 bp, Artificial Sequence
  Synthetic Polynucleotide
taatacgactcactatagggccatgcaacacatctccaggatcggcgggaaacagaggagatcccgcatgtcctggagaaacctggcggcagcgcaaaagatg

SEQ ID NO: 35511 - DNA, 103 bp, Artificial Sequence
  Synthetic Polynucleotide
taatacgactcactatagggacgagcgacctcgggcttgcacgagcaaacaacagaggagagtttgcatgtgcaagcccaacctggcggcagcgcaaaagatg

SEQ ID NO: 35512 - DNA, 103 bp, Artificial Sequence
  Synthetic Polynucleotide
taatacgactcactatagggaataagtaatcgagattgtgtaccacggagaacagaggagactccgtatgacacaatctaacctggcggcagcgcaaaagatg

SEQ ID NO: 35513 - DNA, 103 bp, Artificial Sequence
  Synthetic Polynucleotide
taatacgactcactataggggattggtagcttcagacttgcctaattgcgaacagaggagacgcaatatggcaagtctgaacctggcggcagcgcaaaagatg

SEQ ID NO: 35514 - DNA, 103 bp, Artificial Sequence
  Synthetic Polynucleotide
taatacgactcactataggggggccttggcgtggaaaagtctctgagaacaacagaggagagttctcatggacttttccaacctggcggcagcgcaaaagatg

SEQ ID NO: 35515 - DNA, 103 bp, Artificial Sequence
  Synthetic Polynucleotide
taatacgactcactatagggagggacgccaaggatagagtagtctctatgaacagaggagacatagaatgtactctatcaacctggcggcagcgcaaaagatg

SEQ ID NO: 35516 - DNA, 103 bp, Artificial Sequence
  Synthetic Polynucleotide
taatacgactcactatagggccggcggtgctcaaggggtgtgcgagcggcaacagaggagagccgctatgacaccccttaacctggcggcagcgcaaaagatg

SEQ ID NO: 35517 - DNA, 103 bp, Artificial Sequence
  Synthetic Polynucleotide
taatacgactcactatagggacaataggcatctaaaattcccaccgatcgaacagaggagacgatcgatgggaattttaaacctggcggcagcgcaaaagatg

SEQ ID NO: 35518 - DNA, 103 bp, Artificial Sequence
  Synthetic Polynucleotide
taatacgactcactatagggcttctgggcgttcagcccgcgccttatgctaacagaggagaagcataatgcgcgggctgaacctggcggcagcgcaaaagatg

SEQ ID NO: 35519 - DNA, 103 bp, Artificial Sequence
  Synthetic Polynucleotide
taatacgactcactatagggtttacaatccgtgaattagttcgcgtgattaacagaggagaaatcacatgaactaattcaacctggcggcagcgcaaaagatg

SEQ ID NO: 35520 - DNA, 103 bp, Artificial Sequence
  Synthetic Polynucleotide
taatacgactcactataggggtcaatataacacccataccttgtacctcgaacagaggagacgaggtatgaggtatgggaacctggcggcagcgcaaaagatg

SEQ ID NO: 35521 - DNA, 103 bp, Artificial Sequence
  Synthetic Polynucleotide
taatacgactcactatagggcagctgcggaagtgctccggtataatggctaacagaggagaagccatatgaccggagcaaacctggcggcagcgcaaaagatg

SEQ ID NO: 35522 - DNA, 103 bp, Artificial Sequence
  Synthetic Polynucleotide
taatacgactcactataggggggcaatgatacaccttgaggcgatttgagaacagaggagactcaaaatgcctcaaggtaacctggcggcagcgcaaaagatg

SEQ ID NO: 35523 - DNA, 103 bp, Artificial Sequence
  Synthetic Polynucleotide
taatacgactcactatagggaagagggtcgatgcaataaatcataaataaaacagaggagattatttatgatttattgcaacctggcggcagcgcaaaagatg

SEQ ID NO: 35524 - DNA, 103 bp, Artificial Sequence
  Synthetic Polynucleotide
taatacgactcactatagggccttaccgaattgcagcgtatggacaccgcaacagaggagagcggtgatgatacgctgcaacctggcggcagcgcaaaagatg

SEQ ID NO: 35525 - DNA, 103 bp, Artificial Sequence
  Synthetic Polynucleotide
taatacgactcactatagggtgtttatcgctttacaatgcgccatgaagcaacagaggagagcttcaatgcgcattgtaaacctggcggcagcgcaaaagatg

SEQ ID NO: 35526 - DNA, 103 bp, Artificial Sequence
  Synthetic Polynucleotide
taatacgactcactatagggtttgcgatccggggcgcttttaacgtacgaaacagaggagatcgtacatgaaaagcgccaacctggcggcagcgcaaaagatg

SEQ ID NO: 35527 - DNA, 103 bp, Artificial Sequence
  Synthetic Polynucleotide
taatacgactcactatagggcgtgtatttgtcaaccgcaacgatcttgacaacagaggagagtcaagatggttgcggttaacctggcggcagcgcaaaagatg

SEQ ID NO: 35528 - DNA, 103 bp, Artificial Sequence
  Synthetic Polynucleotide
taatacgactcactatagggaagtcacatgaggttagccaatccgggtataacagaggagaatacccatgttggctaacaacctggcggcagcgcaaaagatg

SEQ ID NO: 35529 - DNA, 103 bp, Artificial Sequence
  Synthetic Polynucleotide
taatacgactcactatagggtgcggccatctccacaaatcttaggagcccaacagaggagagggctcatgagatttgtgaacctggcggcagcgcaaaagatg

SEQ ID NO: 35530 - DNA, 103 bp, Artificial Sequence
  Synthetic Polynucleotide
taatacgactcactatagggttagaaatagaagttcctgcttgccttcctaacagaggagaaggaagatgagcaggaacaacctggcggcagcgcaaaagatg

SEQ ID NO: 35531 - DNA, 103 bp, Artificial Sequence
  Synthetic Polynucleotide
taatacgactcactatagggtttctagaacagcgggttggttggagtggtaacagaggagaaccactatgaccaacccgaacctggcggcagcgcaaaagatg

SEQ ID NO: 35532 - DNA, 103 bp, Artificial Sequence
  Synthetic Polynucleotide
taatacgactcactatagggtcgtggccccatacggaatgaggcatatcaaacagaggagatgatatatgtcattccgtaacctggcggcagcgcaaaagatg

SEQ ID NO: 35533 - DNA, 103 bp, Artificial Sequence
  Synthetic Polynucleotide
taatacgactcactataggggtaccgttggatctatgcctgcagccacagaacagaggagactgtggatgcaggcatagaacctggcggcagcgcaaaagatg

SEQ ID NO: 35534 - DNA, 103 bp, Artificial Sequence
  Synthetic Polynucleotide
taatacgactcactataggggcgaccccaattcgcccattcgggcccgtaaacagaggagatacgggatggaatgggcgaacctggcggcagcgcaaaagatg

SEQ ID NO: 35535 - DNA, 103 bp, Artificial Sequence
  Synthetic Polynucleotide
taatacgactcactataggggttccaggtattccccagctgttacaaataaacagaggagatatttgatgcagctggggaacctggcggcagcgcaaaagatg

SEQ ID NO: 35536 - DNA, 103 bp, Artificial Sequence
  Synthetic Polynucleotide
taatacgactcactatagggtagactaggagaacgcttgatagtaaacataacagaggagaatgtttatgatcaagcgtaacctggcggcagcgcaaaagatg

SEQ ID NO: 35537 - DNA, 103 bp, Artificial Sequence
  Synthetic Polynucleotide
taatacgactcactatagggcgttgacgtggagtacaatgctaaaagtcaaacagaggagatgacttatggcattgtacaacctggcggcagcgcaaaagatg

SEQ ID NO: 35538 - DNA, 103 bp, Artificial Sequence
  Synthetic Polynucleotide
taatacgactcactataggggatgcccatgagcatcgtgagatcgtaagcaacagaggagagcttacatgctcacgatgaacctggcggcagcgcaaaagatg

SEQ ID NO: 35539 - DNA, 103 bp, Artificial Sequence
  Synthetic Polynucleotide
taatacgactcactataggggatgtagtgcccccgcagttacatgtccacaacagaggagagtggacatgtaactgcggaacctggcggcagcgcaaaagatg

SEQ ID NO: 35540 - DNA, 103 bp, Artificial Sequence
  Synthetic Polynucleotide
taatacgactcactatagggagatgattattcatcgggtcgtctattaaaaacagaggagatttaatatgcgacccgataacctggcggcagcgcaaaagatg

SEQ ID NO: 35541 - DNA, 103 bp, Artificial Sequence
  Synthetic Polynucleotide
taatacgactcactatagggattagggccgaggtccgagcaccttggggcaacagaggagagccccaatgtgctcggacaacctggcggcagcgcaaaagatg

SEQ ID NO: 35542 - DNA, 103 bp, Artificial Sequence
  Synthetic Polynucleotide
taatacgactcactatagggactggaatgttgcgttccgcgcgacatctaaacagaggagatagatgatgcgcggaacgaacctggcggcagcgcaaaagatg

SEQ ID NO: 35543 - DNA, 103 bp, Artificial Sequence
  Synthetic Polynucleotide
taatacgactcactatagggttgccgagacggctatacgtgacataggctaacagaggagaagcctaatgcacgtatagaacctggcggcagcgcaaaagatg

SEQ ID NO: 35544 - DNA, 103 bp, Artificial Sequence
  Synthetic Polynucleotide
taatacgactcactatagggccagccagaccatcgcgagctggcatgggtaacagaggagaacccatatgagctcgcgaaacctggcggcagcgcaaaagatg

SEQ ID NO: 35545 - DNA, 103 bp, Artificial Sequence
  Synthetic Polynucleotide
taatacgactcactatagggtactactgtcagccagtgctagcgaagaagaacagaggagacttcttatgtagcactggaacctggcggcagcgcaaaagatg

SEQ ID NO: 35546 - DNA, 103 bp, Artificial Sequence
  Synthetic Polynucleotide
taatacgactcactataggggatcatctgtatctgcatgaatagatctctaacagaggagaagagatatgttcatgcagaacctggcggcagcgcaaaagatg

SEQ ID NO: 35547 - DNA, 103 bp, Artificial Sequence
  Synthetic Polynucleotide
taatacgactcactatagggaaggctaacctttctgcatttctatcgaccaacagaggagaggtcgaatgaaatgcagaaacctggcggcagcgcaaaagatg

SEQ ID NO: 35548 - DNA, 103 bp, Artificial Sequence
  Synthetic Polynucleotide
taatacgactcactatagggcattggtacgcgtcgaaggagttcccacataacagaggagaatgtggatgctccttcgaaacctggcggcagcgcaaaagatg

SEQ ID NO: 35549 - DNA, 103 bp, Artificial Sequence
  Synthetic Polynucleotide
taatacgactcactatagggttgtgtgaaggagtataggccccaaccgcaaacagaggagatgcggtatgggcctatacaacctggcggcagcgcaaaagatg

SEQ ID NO: 35550 - DNA, 103 bp, Artificial Sequence
  Synthetic Polynucleotide
taatacgactcactataggggagtccgacgttggatggcgtttaggaaagaacagaggagactttccatgacgccatccaacctggcggcagcgcaaaagatg

SEQ ID NO: 35551 - DNA, 103 bp, Artificial Sequence
  Synthetic Polynucleotide
taatacgactcactatagggcgtttctttccgatcggtcacgctcatgacaacagaggagagtcatgatggtgaccgataacctggcggcagcgcaaaagatg

SEQ ID NO: 35552 - DNA, 103 bp, Artificial Sequence
  Synthetic Polynucleotide
taatacgactcactataggggtctgcaatgctgctgttttttagggtgtaaacagaggagatacaccatgaaaaacagcaacctggcggcagcgcaaaagatg

SEQ ID NO: 35553 - DNA, 103 bp, Artificial Sequence
  Synthetic Polynucleotide
taatacgactcactatagggactcattgttgtctagaacagcataagcacaacagaggagagtgcttatgctgttctagaacctggcggcagcgcaaaagatg

SEQ ID NO: 35554 - DNA, 103 bp, Artificial Sequence
  Synthetic Polynucleotide
taatacgactcactataggggaactgaacccacaccagtacgattaacccaacagaggagagggttaatggtactggtgaacctggcggcagcgcaaaagatg

SEQ ID NO: 35555 - DNA, 103 bp, Artificial Sequence
  Synthetic Polynucleotide
taatacgactcactatagggcgttgtttccgcgttttgggaccattttctaacagaggagaagaaaaatgtcccaaaacaacctggcggcagcgcaaaagatg

SEQ ID NO: 35556 - DNA, 103 bp, Artificial Sequence
  Synthetic Polynucleotide
taatacgactcactatagggggaagtcccgggtaccatctaaaacgccgaaacagaggagatcggcgatgtagatggtaaacctggcggcagcgcaaaagatg

SEQ ID NO: 35557 - DNA, 103 bp, Artificial Sequence
  Synthetic Polynucleotide
taatacgactcactataggggggcaatggcgaagattgttgacgatactcaacagaggagagagtatatgcaacaatctaacctggcggcagcgcaaaagatg

SEQ ID NO: 35558 - DNA, 103 bp, Artificial Sequence
  Synthetic Polynucleotide
taatacgactcactatagggatagcatcttcccgtaacttctagcctcctaacagaggagaaggaggatggaagttacgaacctggcggcagcgcaaaagatg

SEQ ID NO: 35559 - DNA, 103 bp, Artificial Sequence
  Synthetic Polynucleotide
taatacgactcactatagggctagccaatataagtccgattgacttggggaacagaggagaccccaaatgaatcggactaacctggcggcagcgcaaaagatg

SEQ ID NO: 35560 - DNA, 103 bp, Artificial Sequence
  Synthetic Polynucleotide
taatacgactcactatagggataagcatcggaacacaccagacaactaataacagaggagaattagtatgctggtgtgtaacctggcggcagcgcaaaagatg

SEQ ID NO: 35561 - DNA, 103 bp, Artificial Sequence
  Synthetic Polynucleotide
taatacgactcactatagggcgatctgacgagcgttgtcgagcctcctctaacagaggagaagaggaatgtcgacaacgaacctggcggcagcgcaaaagatg

SEQ ID NO: 35562 - DNA, 103 bp, Artificial Sequence
  Synthetic Polynucleotide
taatacgactcactatagggtctgataggcaatataacacacatacacgtaacagaggagaacgtgtatgtgtgttataaacctggcggcagcgcaaaagatg

SEQ ID NO: 35563 - DNA, 103 bp, Artificial Sequence
  Synthetic Polynucleotide
taatacgactcactatagggatgtagctcaagcacatgctttcgctgtttaacagaggagaaaacagatgaagcatgtgaacctggcggcagcgcaaaagatg

SEQ ID NO: 35564 - DNA, 103 bp, Artificial Sequence
  Synthetic Polynucleotide
taatacgactcactatagggcgtgggtcgtagagacgaaactagagattgaacagaggagacaatctatggtttcgtctaacctggcggcagcgcaaaagatg

SEQ ID NO: 35565 - DNA, 103 bp, Artificial Sequence
  Synthetic Polynucleotide
taatacgactcactatagggtgtaacatcgcttaggttgctaaccactggaacagaggagaccagtgatgagcaacctaaacctggcggcagcgcaaaagatg

SEQ ID NO: 35566 - DNA, 103 bp, Artificial Sequence
  Synthetic Polynucleotide
taatacgactcactatagggttcggcctagacgcccttctatgctctgctaacagaggagaagcagaatgtagaagggcaacctggcggcagcgcaaaagatg

SEQ ID NO: 35567 - DNA, 103 bp, Artificial Sequence
  Synthetic Polynucleotide
taatacgactcactatagggatggcgtcgggcttgccgtattgttgctggaacagaggagaccagcaatgatacggcaaaacctggcggcagcgcaaaagatg

SEQ ID NO: 35568 - DNA, 103 bp, Artificial Sequence
  Synthetic Polynucleotide
taatacgactcactataggggactttaccgtttcctcgtccactgtgacaaacagaggagatgtcacatgggacgaggaaacctggcggcagcgcaaaagatg

SEQ ID NO: 35569 - DNA, 103 bp, Artificial Sequence
  Synthetic Polynucleotide
taatacgactcactatagggatgctaagctttacgcccagcgggagggttaacagaggagaaaccctatggctgggcgtaacctggcggcagcgcaaaagatg

SEQ ID NO: 35570 - DNA, 103 bp, Artificial Sequence
  Synthetic Polynucleotide
taatacgactcactatagggagatcaatatctctatctacacgatcgagcaacagaggagagctcgaatgtgtagatagaacctggcggcagcgcaaaagatg

SEQ ID NO: 35571 - DNA, 103 bp, Artificial Sequence
  Synthetic Polynucleotide
taatacgactcactataggggagggcctacaggagtccagactagctggcaacagaggagagccagcatgtctggactcaacctggcggcagcgcaaaagatg

SEQ ID NO: 35572 - DNA, 103 bp, Artificial Sequence
  Synthetic Polynucleotide
taatacgactcactatagggtatggtggtatcgcacctggactcataactaacagaggagaagttatatgtccaggtgcaacctggcggcagcgcaaaagatg

SEQ ID NO: 35573 - DNA, 103 bp, Artificial Sequence
  Synthetic Polynucleotide
taatacgactcactatagggtagctcttatgattctcacttcgaaatatgaacagaggagacatattatgaagtgagaaaacctggcggcagcgcaaaagatg

SEQ ID NO: 35574 - DNA, 103 bp, Artificial Sequence
  Synthetic Polynucleotide
taatacgactcactatagggcagtaagccccgaagtcacgcaggagtggaaacagaggagatccactatggcgtgacttaacctggcggcagcgcaaaagatg

SEQ ID NO: 35575 - DNA, 103 bp, Artificial Sequence
  Synthetic Polynucleotide
taatacgactcactatagggaaatccggacacacttggtttaggggtggtaacagaggagaaccaccatgaaaccaagtaacctggcggcagcgcaaaagatg

SEQ ID NO: 35576 - DNA, 103 bp, Artificial Sequence
  Synthetic Polynucleotide
taatacgactcactataggggttccatgtcacccacggggctatgatacgaacagaggagacgtatcatggccccgtggaacctggcggcagcgcaaaagatg

SEQ ID NO: 35577 - DNA, 103 bp, Artificial Sequence
  Synthetic Polynucleotide
taatacgactcactatagggcttgcatgagatagccataatctatgggagaacagaggagactcccaatgattatggctaacctggcggcagcgcaaaagatg

SEQ ID NO: 35578 - DNA, 103 bp, Artificial Sequence
  Synthetic Polynucleotide
taatacgactcactataggggcgtggatcgaattgcagacaaagttagggaacagaggagaccctaaatgtgtctgcaaaacctggcggcagcgcaaaagatg

SEQ ID NO: 35579 - DNA, 103 bp, Artificial Sequence
  Synthetic Polynucleotide
taatacgactcactatagggatacgcttatacgttggtgtcttatgtggtaacagaggagaaccacaatggacaccaacaacctggcggcagcgcaaaagatg

SEQ ID NO: 35580 - DNA, 103 bp, Artificial Sequence
  Synthetic Polynucleotide
taatacgactcactatagggccgtgcccgtcctcccgaggatgcatggacaacagaggagagtccatatgtcctcgggaaacctggcggcagcgcaaaagatg

SEQ ID NO: 35581 - DNA, 103 bp, Artificial Sequence
  Synthetic Polynucleotide
taatacgactcactatagggacatcagtaggatacatgcagtcattcacgaacagaggagacgtgaaatgctgcatgtaaacctggcggcagcgcaaaagatg

SEQ ID NO: 35582 - DNA, 103 bp, Artificial Sequence
  Synthetic Polynucleotide
taatacgactcactatagggcgcccccgttcgtgccgcgtggaactaggtaacagaggagaacctagatgcacgcggcaaacctggcggcagcgcaaaagatg

SEQ ID NO: 35583 - DNA, 103 bp, Artificial Sequence
  Synthetic Polynucleotide
taatacgactcactatagggccaccagagagtaaagaggactggcgcaacaacagaggagagttgcgatggtcctctttaacctggcggcagcgcaaaagatg

SEQ ID NO: 35584 - DNA, 103 bp, Artificial Sequence
  Synthetic Polynucleotide
taatacgactcactatagggatacatgtagatcatcccttgttttcgattaacagaggagaaatcgaatgcaagggatgaacctggcggcagcgcaaaagatg

SEQ ID NO: 35585 - DNA, 103 bp, Artificial Sequence
  Synthetic Polynucleotide
taatacgactcactatagggcggacaaacccttaccagagtgtccgatagaacagaggagactatcgatgactctggtaaacctggcggcagcgcaaaagatg

SEQ ID NO: 35586 - DNA, 103 bp, Artificial Sequence
  Synthetic Polynucleotide
taatacgactcactatagggtcttcggagtggcggagaaacagaacagtcaacagaggagagactgtatggtttctccgaacctggcggcagcgcaaaagatg

SEQ ID NO: 35587 - DNA, 103 bp, Artificial Sequence
  Synthetic Polynucleotide
taatacgactcactataggggcgtgcgacattgtactagcctctcaaatcaacagaggagagatttgatgggctagtacaacctggcggcagcgcaaaagatg

SEQ ID NO: 35588 - DNA, 103 bp, Artificial Sequence
  Synthetic Polynucleotide
taatacgactcactatagggcgattccgtcgtggtccgctatgtggccgcaacagaggagagcggccatgtagcggaccaacctggcggcagcgcaaaagatg

SEQ ID NO: 35589 - DNA, 103 bp, Artificial Sequence
  Synthetic Polynucleotide
taatacgactcactatagggcttatagcacttgacatggctttcgcaactaacagaggagaagttgcatgagccatgtcaacctggcggcagcgcaaaagatg

SEQ ID NO: 35590 - DNA, 103 bp, Artificial Sequence
  Synthetic Polynucleotide
taatacgactcactatagggtagtttatatgaaggggaaccaaaatcataaacagaggagatatgatatgggttcccctaacctggcggcagcgcaaaagatg

SEQ ID NO: 35591 - DNA, 103 bp, Artificial Sequence
  Synthetic Polynucleotide
taatacgactcactatagggtcgcatgtgtgctgagtaccggagtgaaataacagaggagaatttcaatgcggtactcaaacctggcggcagcgcaaaagatg

SEQ ID NO: 35592 - DNA, 103 bp, Artificial Sequence
  Synthetic Polynucleotide
taatacgactcactatagggccgcgatacgctaggtatatcaattatccgaacagaggagacggataatggatatacctaacctggcggcagcgcaaaagatg

SEQ ID NO: 35593 - DNA, 103 bp, Artificial Sequence
  Synthetic Polynucleotide
taatacgactcactatagggtgaatgtcatccggcctgagcagtgtcaagaacagaggagacttgacatggctcaggccaacctggcggcagcgcaaaagatg

SEQ ID NO: 35594 - DNA, 103 bp, Artificial Sequence
  Synthetic Polynucleotide
taatacgactcactatagggcgtcggaacactagtttcatatttcagcataacagaggagaatgctgatgtatgaaactaacctggcggcagcgcaaaagatg

SEQ ID NO: 35595 - DNA, 103 bp, Artificial Sequence
  Synthetic Polynucleotide
taatacgactcactatagggagtgtgaccatgtaccaatcgtcctatcccaacagaggagagggataatgcgattggtaaacctggcggcagcgcaaaagatg

SEQ ID NO: 35596 - DNA, 103 bp, Artificial Sequence
  Synthetic Polynucleotide
taatacgactcactatagggtttagtctgcctatgacagattaatgagggaacagaggagaccctcaatgatctgtcataacctggcggcagcgcaaaagatg

SEQ ID NO: 35597 - DNA, 103 bp, Artificial Sequence
  Synthetic Polynucleotide
taatacgactcactataggggcatgattacgaacatcacgattagttactaacagaggagaagtaacatgtcgtgatgtaacctggcggcagcgcaaaagatg

SEQ ID NO: 35598 - DNA, 103 bp, Artificial Sequence
  Synthetic Polynucleotide
taatacgactcactatagggtcggaccgccgcgtaacgcaagatctcgtaaacagaggagatacgagatgttgcgttacaacctggcggcagcgcaaaagatg

SEQ ID NO: 35599 - DNA, 103 bp, Artificial Sequence
  Synthetic Polynucleotide
taatacgactcactataggggtgcgatgacaactgcatggttgtgatcacaacagaggagagtgatcatgaccatgcagaacctggcggcagcgcaaaagatg

SEQ ID NO: 35600 - DNA, 103 bp, Artificial Sequence
  Synthetic Polynucleotide
taatacgactcactataggggtgcgggcgcgatcctccacgtttaccttaaacagaggagataaggtatgcgtggaggaaacctggcggcagcgcaaaagatg

SEQ ID NO: 35601 - DNA, 103 bp, Artificial Sequence
  Synthetic Polynucleotide
taatacgactcactatagggctcatggttaggcatcttgctagcatttataacagaggagaataaatatgagcaagatgaacctggcggcagcgcaaaagatg

SEQ ID NO: 35602 - DNA, 103 bp, Artificial Sequence
  Synthetic Polynucleotide
taatacgactcactatagggtagcgattatataggttctctaagactagcaacagaggagagctagtatgagagaacctaacctggcggcagcgcaaaagatg

SEQ ID NO: 35603 - DNA, 103 bp, Artificial Sequence
  Synthetic Polynucleotide
taatacgactcactatagggcaccccaaagtcctaatcgtaaatggatcaaacagaggagatgatccatgtacgattagaacctggcggcagcgcaaaagatg

SEQ ID NO: 35604 - DNA, 103 bp, Artificial Sequence
  Synthetic Polynucleotide
taatacgactcactatagggagagcaaagcgaagctaattgtccagcaagaacagaggagacttgctatgcaattagctaacctggcggcagcgcaaaagatg

SEQ ID NO: 35605 - DNA, 103 bp, Artificial Sequence
  Synthetic Polynucleotide
taatacgactcactatagggaaaagtgggaaagttcaacgcgagaagtcaaacagaggagatgacttatggcgttgaacaacctggcggcagcgcaaaagatg

SEQ ID NO: 35606 - DNA, 103 bp, Artificial Sequence
  Synthetic Polynucleotide
taatacgactcactatagggaattgttaaaagacgggacctatacagataaacagaggagatatctgatgaggtcccgtaacctggcggcagcgcaaaagatg

SEQ ID NO: 35607 - DNA, 103 bp, Artificial Sequence
  Synthetic Polynucleotide
taatacgactcactatagggtagttaccgttatcagcattcgaaagtcggaacagaggagaccgactatggaatgctgaaacctggcggcagcgcaaaagatg

SEQ ID NO: 35608 - DNA, 103 bp, Artificial Sequence
  Synthetic Polynucleotide
taatacgactcactatagggcgagcagcagtatattgtttaatttcgctaaacagaggagatagcgaatgtaaacaataaacctggcggcagcgcaaaagatg

SEQ ID NO: 35609 - DNA, 103 bp, Artificial Sequence
  Synthetic Polynucleotide
taatacgactcactatagggctaactgcctgtagtttgagcccgggccacaacagaggagagtggccatggctcaaactaacctggcggcagcgcaaaagatg

SEQ ID NO: 35610 - DNA, 103 bp, Artificial Sequence
  Synthetic Polynucleotide
taatacgactcactatagggtcacatatatcgtcgggacactgaaactccaacagaggagaggagttatggtgtcccgaaacctggcggcagcgcaaaagatg

SEQ ID NO: 35611 - DNA, 103 bp, Artificial Sequence
  Synthetic Polynucleotide
taatacgactcactatagggtccgaaatcgacgtcttatattacctcgaaaacagaggagattcgagatgatataagacaacctggcggcagcgcaaaagatg

SEQ ID NO: 35612 - DNA, 103 bp, Artificial Sequence
  Synthetic Polynucleotide
taatacgactcactatagggtggactggcggatcgaatgccgggctgctcaacagaggagagagcagatgggcattcgaaacctggcggcagcgcaaaagatg

SEQ ID NO: 35613 - DNA, 103 bp, Artificial Sequence
  Synthetic Polynucleotide
taatacgactcactataggggcctcaagaactgtacgcacttaagctgtaaacagaggagatacagcatgagtgcgtacaacctggcggcagcgcaaaagatg

SEQ ID NO: 35614 - DNA, 103 bp, Artificial Sequence
  Synthetic Polynucleotide
taatacgactcactatagggccggatttggagtacaacctatatatagtaaacagaggagatactatatgtaggttgtaaacctggcggcagcgcaaaagatg

SEQ ID NO: 35615 - DNA, 103 bp, Artificial Sequence
  Synthetic Polynucleotide
taatacgactcactataggggatcgaacttatttccgcccttgtattctaaacagaggagatagaatatgagggcggaaaacctggcggcagcgcaaaagatg

SEQ ID NO: 35616 - DNA, 103 bp, Artificial Sequence
  Synthetic Polynucleotide
taatacgactcactatagggggtggatttgagtacttggcttataggggaaacagaggagatcccctatgagccaagtaaacctggcggcagcgcaaaagatg

SEQ ID NO: 35617 - DNA, 103 bp, Artificial Sequence
  Synthetic Polynucleotide
taatacgactcactataggggactcttatcacggtacgagctggtgcagaaacagaggagatctgcaatggctcgtaccaacctggcggcagcgcaaaagatg

SEQ ID NO: 35618 - DNA, 103 bp, Artificial Sequence
  Synthetic Polynucleotide
taatacgactcactatagggctaaattgatcgatcatgagtccttttaggaacagaggagacctaaaatgactcatgataacctggcggcagcgcaaaagatg

SEQ ID NO: 35619 - DNA, 103 bp, Artificial Sequence
  Synthetic Polynucleotide
taatacgactcactatagggaggcgtgcaatgtctagttgagcctaccgaaacagaggagatcggtaatgtcaactagaaacctggcggcagcgcaaaagatg

SEQ ID NO: 35620 - DNA, 103 bp, Artificial Sequence
  Synthetic Polynucleotide
taatacgactcactatagggagtattgcgatagttaatgtcagtatggtcaacagaggagagaccatatggacattaacaacctggcggcagcgcaaaagatg

SEQ ID NO: 35621 - DNA, 103 bp, Artificial Sequence
  Synthetic Polynucleotide
taatacgactcactatagggtttttatctcattctcgtcagctgggtactaacagaggagaagtaccatgctgacgagaaacctggcggcagcgcaaaagatg

SEQ ID NO: 35622 - DNA, 103 bp, Artificial Sequence
  Synthetic Polynucleotide
taatacgactcactataggggctcgatttcgctattcccgggtgagaagaaacagaggagatcttctatgccgggaataaacctggcggcagcgcaaaagatg

SEQ ID NO: 35623 - DNA, 103 bp, Artificial Sequence
  Synthetic Polynucleotide
taatacgactcactatagggaaatgggtataccgtaggtgactgcagtagaacagaggagactactgatgtcacctacgaacctggcggcagcgcaaaagatg

SEQ ID NO: 35624 - DNA, 103 bp, Artificial Sequence
  Synthetic Polynucleotide
taatacgactcactatagggcacttaaaccccacctatcctgactctcgtaacagaggagaacgagaatgaggataggtaacctggcggcagcgcaaaagatg

SEQ ID NO: 35625 - DNA, 103 bp, Artificial Sequence
  Synthetic Polynucleotide
taatacgactcactatagggatagagcggaccgaatgataccaccctatcaacagaggagagataggatggtatcattcaacctggcggcagcgcaaaagatg

SEQ ID NO: 35626 - DNA, 103 bp, Artificial Sequence
  Synthetic Polynucleotide
taatacgactcactatagggtccctgaatgctgaccctcaagtgattaccaacagaggagaggtaatatgttgagggtcaacctggcggcagcgcaaaagatg

SEQ ID NO: 35627 - DNA, 103 bp, Artificial Sequence
  Synthetic Polynucleotide
taatacgactcactatagggtcgacgtgcggcatggacagataagaattcaacagaggagagaattcatgtctgtccataacctggcggcagcgcaaaagatg

SEQ ID NO: 35628 - DNA, 103 bp, Artificial Sequence
  Synthetic Polynucleotide
taatacgactcactatagggtcgtaccgtaagccgctgcacgtgtgattgaacagaggagacaatcaatggtgcagcggaacctggcggcagcgcaaaagatg

SEQ ID NO: 35629 - DNA, 103 bp, Artificial Sequence
  Synthetic Polynucleotide
taatacgactcactatagggcgtttctgaattgcagtcattgcttaccgtaacagaggagaacggtaatgaatgactgcaacctggcggcagcgcaaaagatg

SEQ ID NO: 35630 - DNA, 103 bp, Artificial Sequence
  Synthetic Polynucleotide
taatacgactcactatagggtggcacgacgaagccaccccaatccctttcaacagaggagagaaaggatgtggggtggcaacctggcggcagcgcaaaagatg

SEQ ID NO: 35631 - DNA, 103 bp, Artificial Sequence
  Synthetic Polynucleotide
taatacgactcactatagggacgtcgaacgcaaatttaggttagtccacaaacagaggagatgtggaatgacctaaattaacctggcggcagcgcaaaagatg

SEQ ID NO: 35632 - DNA, 103 bp, Artificial Sequence
  Synthetic Polynucleotide
taatacgactcactatagggctgggtttgttactgctctcttctgtaaacaacagaggagagtttacatgagagagcagaacctggcggcagcgcaaaagatg

SEQ ID NO: 35633 - DNA, 103 bp, Artificial Sequence
  Synthetic Polynucleotide
taatacgactcactatagggttcctgtcggaaacatctacatgtgaagtgaacagaggagacacttcatgtgtagatgtaacctggcggcagcgcaaaagatg

SEQ ID NO: 35634 - DNA, 103 bp, Artificial Sequence
  Synthetic Polynucleotide
taatacgactcactatagggatttcgttgccggaaatctacgcattgttcaacagaggagagaacaaatggtagatttcaacctggcggcagcgcaaaagatg

SEQ ID NO: 35635 - DNA, 103 bp, Artificial Sequence
  Synthetic Polynucleotide
taatacgactcactatagggtctgtcgtcactccagaggccgttcctgtaaacagaggagatacaggatgggcctctggaacctggcggcagcgcaaaagatg

SEQ ID NO: 35636 - DNA, 103 bp, Artificial Sequence
  Synthetic Polynucleotide
taatacgactcactatagggaagtggaatcattgtcgtaacaggcaagtcaacagaggagagacttgatggttacgacaaacctggcggcagcgcaaaagatg

SEQ ID NO: 35637 - DNA, 103 bp, Artificial Sequence
  Synthetic Polynucleotide
taatacgactcactataggggtcatgcgctcgtgctaaggccatacatctaacagaggagaagatgtatggccttagcaaacctggcggcagcgcaaaagatg

SEQ ID NO: 35638 - DNA, 103 bp, Artificial Sequence
  Synthetic Polynucleotide
taatacgactcactataggggccgaccacgcttagtgggaactctgtagtaacagaggagaactacaatgttcccactaaacctggcggcagcgcaaaagatg

SEQ ID NO: 35639 - DNA, 103 bp, Artificial Sequence
  Synthetic Polynucleotide
taatacgactcactatagggtcttcggacggactacgagccacgggtaacaacagaggagagttaccatgggctcgtagaacctggcggcagcgcaaaagatg

SEQ ID NO: 35640 - DNA, 103 bp, Artificial Sequence
  Synthetic Polynucleotide
taatacgactcactatagggctgagtatgctcggtattcccgagattaggaacagaggagacctaatatggggaataccaacctggcggcagcgcaaaagatg

SEQ ID NO: 35641 - DNA, 103 bp, Artificial Sequence
  Synthetic Polynucleotide
taatacgactcactatagggggattagggagggacctcgccgtcatagaaaacagaggagattctatatgggcgaggtcaacctggcggcagcgcaaaagatg

SEQ ID NO: 35642 - DNA, 103 bp, Artificial Sequence
  Synthetic Polynucleotide
taatacgactcactatagggttggtatccggtatacttccactataccggaacagaggagaccggtaatgtggaagtataacctggcggcagcgcaaaagatg

SEQ ID NO: 35643 - DNA, 103 bp, Artificial Sequence
  Synthetic Polynucleotide
taatacgactcactatagggccgactaggtcaagttaccgttgcggatctaacagaggagaagatccatgacggtaactaacctggcggcagcgcaaaagatg

SEQ ID NO: 35644 - DNA, 103 bp, Artificial Sequence
  Synthetic Polynucleotide
taatacgactcactatagggagccgacgccactagggtccgaaagacttgaacagaggagacaagtcatgcggaccctaaacctggcggcagcgcaaaagatg

SEQ ID NO: 35645 - DNA, 103 bp, Artificial Sequence
  Synthetic Polynucleotide
taatacgactcactatagggtgtcggatcgcctcgattatcatcagcatcaacagaggagagatgctatggataatcgaaacctggcggcagcgcaaaagatg

SEQ ID NO: 35646 - DNA, 103 bp, Artificial Sequence
  Synthetic Polynucleotide
taatacgactcactatagggggccggccatcaccacagtgaacaaaccataacagaggagaatggttatgtcactgtggaacctggcggcagcgcaaaagatg

SEQ ID NO: 35647 - DNA, 103 bp, Artificial Sequence
  Synthetic Polynucleotide
taatacgactcactatagggtctgtcgccttattgtataagcctcttgtaaacagaggagatacaagatgcttatacaaaacctggcggcagcgcaaaagatg

SEQ ID NO: 35648 - DNA, 103 bp, Artificial Sequence
  Synthetic Polynucleotide
taatacgactcactatagggaactgataagaagatctttagggtggtctaaacagaggagatagaccatgctaaagatcaacctggcggcagcgcaaaagatg

SEQ ID NO: 35649 - DNA, 103 bp, Artificial Sequence
  Synthetic Polynucleotide
taatacgactcactatagggtacgtggacgatgagagacgcgtgcgaaataacagaggagaatttcgatggcgtctctcaacctggcggcagcgcaaaagatg

SEQ ID NO: 35650 - DNA, 103 bp, Artificial Sequence
  Synthetic Polynucleotide
taatacgactcactatagggttaccgagcattgccgttcgggtctcatctaacagaggagaagatgaatgccgaacggcaacctggcggcagcgcaaaagatg

SEQ ID NO: 35651 - DNA, 103 bp, Artificial Sequence
  Synthetic Polynucleotide
taatacgactcactatagggctgcatttctccacgctattgcgacgcgtcaacagaggagagacgcgatgcaatagcgtaacctggcggcagcgcaaaagatg

SEQ ID NO: 35652 - DNA, 103 bp, Artificial Sequence
  Synthetic Polynucleotide
taatacgactcactatagggttctagtacgggtcgcagtattagactaataacagaggagaattagtatgatactgcgaaacctggcggcagcgcaaaagatg

SEQ ID NO: 35653 - DNA, 103 bp, Artificial Sequence
  Synthetic Polynucleotide
taatacgactcactatagggagaatggccgattataacgaggcggtctataacagaggagaatagacatgctcgttataaacctggcggcagcgcaaaagatg

SEQ ID NO: 35654 - DNA, 103 bp, Artificial Sequence
  Synthetic Polynucleotide
taatacgactcactatagggggtctgaggtgcatgtcgtcttgatcgttaaacagaggagataacgaatgagacgacataacctggcggcagcgcaaaagatg

SEQ ID NO: 35655 - DNA, 103 bp, Artificial Sequence
  Synthetic Polynucleotide
taatacgactcactataggggacaatctgcagtcatttgcctagtgtgggaacagaggagacccacaatgggcaaatgaaacctggcggcagcgcaaaagatg

SEQ ID NO: 35656 - DNA, 103 bp, Artificial Sequence
  Synthetic Polynucleotide
taatacgactcactatagggagcatcgtttcactagattcgaaggtcgcaaacagaggagatgcgacatgcgaatctagaacctggcggcagcgcaaaagatg

SEQ ID NO: 35657 - DNA, 103 bp, Artificial Sequence
  Synthetic Polynucleotide
taatacgactcactataggggagaccccaatattgagccgagtgtgatagaacagaggagactatcaatgtcggctcaaaacctggcggcagcgcaaaagatg

SEQ ID NO: 35658 - DNA, 103 bp, Artificial Sequence
  Synthetic Polynucleotide
taatacgactcactatagggctcatgatatccgtggggtccagtgtaatgaacagaggagacattacatgggaccccacaacctggcggcagcgcaaaagatg

SEQ ID NO: 35659 - DNA, 103 bp, Artificial Sequence
  Synthetic Polynucleotide
taatacgactcactataggggctccagcacctatggatacggcgctcccaaacagaggagatgggagatgcgtatccataacctggcggcagcgcaaaagatg

SEQ ID NO: 35660 - DNA, 103 bp, Artificial Sequence
  Synthetic Polynucleotide
taatacgactcactatagggtagttggaccacggggcacggcgcaataacaacagaggagagttattatgccgtgccccaacctggcggcagcgcaaaagatg

SEQ ID NO: 35661 - DNA, 103 bp, Artificial Sequence
  Synthetic Polynucleotide
taatacgactcactatagggtacccatccttcttctgataagcgggctagaacagaggagactagccatgttatcagaaaacctggcggcagcgcaaaagatg

SEQ ID NO: 35662 - DNA, 103 bp, Artificial Sequence
  Synthetic Polynucleotide
taatacgactcactatagggacgggtggtgcatctgggtgagggttcgataacagaggagaatcgaaatgtcacccagaaacctggcggcagcgcaaaagatg

SEQ ID NO: 35663 - DNA, 103 bp, Artificial Sequence
  Synthetic Polynucleotide
taatacgactcactatagggcaaataatcccgtcccaatagtatgaagtgaacagaggagacacttcatgctattgggaaacctggcggcagcgcaaaagatg

SEQ ID NO: 35664 - DNA, 103 bp, Artificial Sequence
  Synthetic Polynucleotide
taatacgactcactatagggttttcgggcataaatcactaatatcccacgaacagaggagacgtgggatgttagtgattaacctggcggcagcgcaaaagatg

SEQ ID NO: 35665 - DNA, 103 bp, Artificial Sequence
  Synthetic Polynucleotide
taatacgactcactatagggtcgtgtggtcagggcaacgtttactactttaacagaggagaaaagtaatgaacgttgccaacctggcggcagcgcaaaagatg

SEQ ID NO: 35666 - DNA, 103 bp, Artificial Sequence
  Synthetic Polynucleotide
taatacgactcactatagggagcacatcaactggggccgaaacatgttggaacagaggagaccaacaatgttcggccccaacctggcggcagcgcaaaagatg

SEQ ID NO: 35667 - DNA, 103 bp, Artificial Sequence
  Synthetic Polynucleotide
taatacgactcactatagggccgacggttcgtccaacgcaaggccgaccaaacagaggagatggtcgatgttgcgttggaacctggcggcagcgcaaaagatg

SEQ ID NO: 35668 - DNA, 103 bp, Artificial Sequence
  Synthetic Polynucleotide
taatacgactcactatagggcttaagcgacggtgaggatcgagggtcatcaacagaggagagatgacatgcgatcctcaaacctggcggcagcgcaaaagatg

SEQ ID NO: 35669 - DNA, 103 bp, Artificial Sequence
  Synthetic Polynucleotide
taatacgactcactataggggcccactggtacatctgcgaataatgattcaacagaggagagaatcaatgttcgcagataacctggcggcagcgcaaaagatg

SEQ ID NO: 35670 - DNA, 103 bp, Artificial Sequence
  Synthetic Polynucleotide
taatacgactcactatagggacgtacgactcccgtaactaccaatttcgcaacagaggagagcgaaaatggtagttacgaacctggcggcagcgcaaaagatg

SEQ ID NO: 35671 - DNA, 103 bp, Artificial Sequence
  Synthetic Polynucleotide
taatacgactcactatagggcaccatgggtagtgtctagacgcatgagccaacagaggagaggctcaatggtctagacaaacctggcggcagcgcaaaagatg

SEQ ID NO: 35672 - DNA, 103 bp, Artificial Sequence
  Synthetic Polynucleotide
taatacgactcactatagggccaactagccagcctgcgagtcgagagccaaacagaggagatggctcatgactcgcaggaacctggcggcagcgcaaaagatg

SEQ ID NO: 35673 - DNA, 103 bp, Artificial Sequence
  Synthetic Polynucleotide
taatacgactcactatagggcagttcgaactgcattaatgacagactaaaaacagaggagatttagtatgtcattaatgaacctggcggcagcgcaaaagatg

SEQ ID NO: 35674 - DNA, 103 bp, Artificial Sequence
  Synthetic Polynucleotide
taatacgactcactatagggagcgacagcgctcttatcgccctttctggtaacagaggagaaccagaatgggcgataagaacctggcggcagcgcaaaagatg

SEQ ID NO: 35675 - DNA, 103 bp, Artificial Sequence
  Synthetic Polynucleotide
taatacgactcactatagggaaagccatcgtgcaacgtgcttacttatttaacagaggagaaaataaatgagcacgttgaacctggcggcagcgcaaaagatg

SEQ ID NO: 35676 - DNA, 103 bp, Artificial Sequence
  Synthetic Polynucleotide
taatacgactcactataggggcctcggactccttgcaactgagaaggagaaacagaggagatctcctatgcagttgcaaaacctggcggcagcgcaaaagatg

SEQ ID NO: 35677 - DNA, 103 bp, Artificial Sequence
  Synthetic Polynucleotide
taatacgactcactatagggttaggtttcaacgctcgcgccggagccggaaacagaggagatccggcatgggcgcgagcaacctggcggcagcgcaaaagatg

SEQ ID NO: 35678 - DNA, 103 bp, Artificial Sequence
  Synthetic Polynucleotide
taatacgactcactatagggcataccgttaaggcctaccgtatcttgaagaacagaggagacttcaaatgacggtaggcaacctggcggcagcgcaaaagatg

SEQ ID NO: 35679 - DNA, 103 bp, Artificial Sequence
  Synthetic Polynucleotide
taatacgactcactataggggtgggaattcggagagcatgatttgtcaccaacagaggagaggtgacatgtcatgctctaacctggcggcagcgcaaaagatg

SEQ ID NO: 35680 - DNA, 103 bp, Artificial Sequence
  Synthetic Polynucleotide
taatacgactcactatagggtccgacggggtctcgatataccctcgtccgaacagaggagacggacgatggtatatcgaaacctggcggcagcgcaaaagatg

SEQ ID NO: 35681 - DNA, 103 bp, Artificial Sequence
  Synthetic Polynucleotide
taatacgactcactatagggcacaaggcccatgccatacgtagcgcacctaacagaggagaaggtgcatgacgtatggcaacctggcggcagcgcaaaagatg

SEQ ID NO: 35682 - DNA, 103 bp, Artificial Sequence
  Synthetic Polynucleotide
taatacgactcactatagggaagcccaacaatcgtaagacgcgggatggcaacagaggagagccatcatgcgtcttacgaacctggcggcagcgcaaaagatg

SEQ ID NO: 35683 - DNA, 103 bp, Artificial Sequence
  Synthetic Polynucleotide
taatacgactcactataggggatcggatgtatgggttatgactatggtgtaacagaggagaacaccaatgtcataacccaacctggcggcagcgcaaaagatg

SEQ ID NO: 35684 - DNA, 103 bp, Artificial Sequence
  Synthetic Polynucleotide
taatacgactcactataggggtatttttacgtaattcgatgtggctacataacagaggagaatgtagatgcatcgaattaacctggcggcagcgcaaaagatg

SEQ ID NO: 35685 - DNA, 103 bp, Artificial Sequence
  Synthetic Polynucleotide
taatacgactcactatagggggaagtgtatcgaactgctttagaagggtaaacagaggagataccctatgaaagcagttaacctggcggcagcgcaaaagatg

SEQ ID NO: 35686 - DNA, 103 bp, Artificial Sequence
  Synthetic Polynucleotide
taatacgactcactatagggaatcgcagatgtcgcatctgggaacttaggaacagaggagacctaagatgccagatgcgaacctggcggcagcgcaaaagatg

SEQ ID NO: 35687 - DNA, 103 bp, Artificial Sequence
  Synthetic Polynucleotide
taatacgactcactatagggcgaatcgctaacctccttgggaagcctctcaacagaggagagagaggatgcccaaggagaacctggcggcagcgcaaaagatg

SEQ ID NO: 35688 - DNA, 103 bp, Artificial Sequence
  Synthetic Polynucleotide
taatacgactcactatagggcagacgccacgtggcacatgtgcgtctcctaacagaggagaaggagaatgacatgtgccaacctggcggcagcgcaaaagatg

SEQ ID NO: 35689 - DNA, 103 bp, Artificial Sequence
  Synthetic Polynucleotide
taatacgactcactatagggtttcatttgagtctcccgctgtatgcagtgaacagaggagacactgcatgcagcgggagaacctggcggcagcgcaaaagatg

SEQ ID NO: 35690 - DNA, 103 bp, Artificial Sequence
  Synthetic Polynucleotide
taatacgactcactatagggaaaggtgtcatgcaaattacgcgggctgaaaacagaggagattcagcatgcgtaatttgaacctggcggcagcgcaaaagatg

SEQ ID NO: 35691 - DNA, 103 bp, Artificial Sequence
  Synthetic Polynucleotide
taatacgactcactatagggagtaggtccaattctagttgatggatctataacagaggagaatagatatgtcaactagaaacctggcggcagcgcaaaagatg

SEQ ID NO: 35692 - DNA, 103 bp, Artificial Sequence
  Synthetic Polynucleotide
taatacgactcactataggggcgatgaatgcaaacttattttcaaagcttaacagaggagaaagcttatgaaataagttaacctggcggcagcgcaaaagatg

SEQ ID NO: 35693 - DNA, 103 bp, Artificial Sequence
  Synthetic Polynucleotide
taatacgactcactataggggtgccgcaatcagtgaatagtagactcggcaacagaggagagccgagatgactattcacaacctggcggcagcgcaaaagatg

SEQ ID NO: 35694 - DNA, 103 bp, Artificial Sequence
  Synthetic Polynucleotide
taatacgactcactatagggcgtcctagtaaactctcccataggccttataacagaggagaataaggatgatgggagagaacctggcggcagcgcaaaagatg

SEQ ID NO: 35695 - DNA, 103 bp, Artificial Sequence
  Synthetic Polynucleotide
taatacgactcactataggggctaacggcctcatatgtcgccaacgccacaacagaggagagtggcgatggcgacatataacctggcggcagcgcaaaagatg

SEQ ID NO: 35696 - DNA, 103 bp, Artificial Sequence
  Synthetic Polynucleotide
taatacgactcactatagggggcccgagggcaatgagtataatcgaaggtaacagaggagaaccttcatgtatactcataacctggcggcagcgcaaaagatg

SEQ ID NO: 35697 - DNA, 103 bp, Artificial Sequence
  Synthetic Polynucleotide
taatacgactcactataggggactaaagacttaagataacaatgacaattaacagaggagaaattgtatgtgttatcttaacctggcggcagcgcaaaagatg

SEQ ID NO: 35698 - DNA, 103 bp, Artificial Sequence
  Synthetic Polynucleotide
taatacgactcactatagggtgctacgcatgcagcgcggagaacggcatcaacagaggagagatgccatgctccgcgctaacctggcggcagcgcaaaagatg

SEQ ID NO: 35699 - DNA, 103 bp, Artificial Sequence
  Synthetic Polynucleotide
taatacgactcactatagggaagtatatttgccgaccaaactggcgcgacaacagaggagagtcgcgatggtttggtcgaacctggcggcagcgcaaaagatg

SEQ ID NO: 35700 - DNA, 103 bp, Artificial Sequence
  Synthetic Polynucleotide
taatacgactcactatagggcggcgacgtattgacatatagaaggtgtcgaacagaggagacgacacatgctatatgtcaacctggcggcagcgcaaaagatg

SEQ ID NO: 35701 - DNA, 103 bp, Artificial Sequence
  Synthetic Polynucleotide
taatacgactcactataggggactacaccagcccttggatttaattcacaaacagaggagatgtgaaatgaatccaaggaacctggcggcagcgcaaaagatg

SEQ ID NO: 35702 - DNA, 103 bp, Artificial Sequence
  Synthetic Polynucleotide
taatacgactcactatagggctatttacagggcgcaccggggactattctaacagaggagaagaataatgcccggtgcgaacctggcggcagcgcaaaagatg

SEQ ID NO: 35703 - DNA, 103 bp, Artificial Sequence
  Synthetic Polynucleotide
taatacgactcactatagggctgttgagatccaccgtcgggaagacacccaacagaggagagggtgtatgcccgacggtaacctggcggcagcgcaaaagatg

SEQ ID NO: 35704 - DNA, 103 bp, Artificial Sequence
  Synthetic Polynucleotide
taatacgactcactatagggtgctaaagctacgcatcacatctcgtacgcaacagaggagagcgtacatgatgtgatgcaacctggcggcagcgcaaaagatg

SEQ ID NO: 35705 - DNA, 103 bp, Artificial Sequence
  Synthetic Polynucleotide
taatacgactcactatagggttacccggcaccttgaaacatgacagcttaaacagaggagataagctatgatgtttcaaaacctggcggcagcgcaaaagatg

SEQ ID NO: 35706 - DNA, 103 bp, Artificial Sequence
  Synthetic Polynucleotide
taatacgactcactatagggacgtctaactgatctgtgcacgggagtctaaacagaggagatagactatggtgcacagaaacctggcggcagcgcaaaagatg

SEQ ID NO: 35707 - DNA, 103 bp, Artificial Sequence
  Synthetic Polynucleotide
taatacgactcactatagggtcaacctgggacgcccataccttataattgaacagaggagacaattaatgggtatgggcaacctggcggcagcgcaaaagatg

SEQ ID NO: 35708 - DNA, 103 bp, Artificial Sequence
  Synthetic Polynucleotide
taatacgactcactatagggtgaaagcccggatgcccgaagctttcttcgaacagaggagacgaagaatgcttcgggcaaacctggcggcagcgcaaaagatg

SEQ ID NO: 35709 - DNA, 103 bp, Artificial Sequence
  Synthetic Polynucleotide
taatacgactcactatagggacccttcaaaggcgcccataaattttaaataacagaggagaatttaaatgttatgggcgaacctggcggcagcgcaaaagatg

SEQ ID NO: 35710 - DNA, 103 bp, Artificial Sequence
  Synthetic Polynucleotide
taatacgactcactataggggcatcgagaggaaatatagactacactaggaacagaggagacctagtatggtctatattaacctggcggcagcgcaaaagatg

SEQ ID NO: 35711 - DNA, 103 bp, Artificial Sequence
  Synthetic Polynucleotide
taatacgactcactatagggactagactgaaagtctctttctagcccaacaacagaggagagttgggatggaaagagacaacctggcggcagcgcaaaagatg

SEQ ID NO: 35712 - DNA, 103 bp, Artificial Sequence
  Synthetic Polynucleotide
taatacgactcactatagggttatacagctgcttcctctcggtggccggtaacagaggagaaccggcatgcgagaggaaaacctggcggcagcgcaaaagatg

SEQ ID NO: 35713 - DNA, 103 bp, Artificial Sequence
  Synthetic Polynucleotide
taatacgactcactatagggggtttggtatggattgcaggcgcgttcttcaacagaggagagaagaaatggcctgcaataacctggcggcagcgcaaaagatg

SEQ ID NO: 35714 - DNA, 103 bp, Artificial Sequence
  Synthetic Polynucleotide
taatacgactcactatagggcaaaatgcgaacccggcatcgtcggtagtcaacagaggagagactacatgcgatgccggaacctggcggcagcgcaaaagatg

SEQ ID NO: 35715 - DNA, 103 bp, Artificial Sequence
  Synthetic Polynucleotide
taatacgactcactatagggctgacgggaggagacaggtgagggtgtgtcaacagaggagagacacaatgtcacctgtcaacctggcggcagcgcaaaagatg

SEQ ID NO: 35716 - DNA, 103 bp, Artificial Sequence
  Synthetic Polynucleotide
taatacgactcactatagggttgctactcacagggtgtgataccgaagtaaacagaggagatacttcatgatcacacccaacctggcggcagcgcaaaagatg

SEQ ID NO: 35717 - DNA, 103 bp, Artificial Sequence
  Synthetic Polynucleotide
taatacgactcactatagggggtgcggattccgcatgttatataaggcggaacagaggagaccgcctatgataacatgcaacctggcggcagcgcaaaagatg

SEQ ID NO: 35718 - DNA, 103 bp, Artificial Sequence
  Synthetic Polynucleotide
taatacgactcactatagggctcattcgcaggcaatccagtttgcaaacaaacagaggagatgtttgatgactggattgaacctggcggcagcgcaaaagatg

SEQ ID NO: 35719 - DNA, 103 bp, Artificial Sequence
  Synthetic Polynucleotide
taatacgactcactatagggagctagacaacagtagagcggtgaccattgaacagaggagacaatggatgccgctctacaacctggcggcagcgcaaaagatg

SEQ ID NO: 35720 - DNA, 103 bp, Artificial Sequence
  Synthetic Polynucleotide
taatacgactcactatagggttgacagagctagattgtagcccagtccttaacagaggagaaaggacatggctacaatcaacctggcggcagcgcaaaagatg

SEQ ID NO: 35721 - DNA, 103 bp, Artificial Sequence
  Synthetic Polynucleotide
taatacgactcactatagggttacgcccgggaagttatttgtctaatgcgaacagaggagacgcattatgcaaataactaacctggcggcagcgcaaaagatg

SEQ ID NO: 35722 - DNA, 103 bp, Artificial Sequence
  Synthetic Polynucleotide
taatacgactcactatagggcgtacaattcgccggtacccgcacagccccaacagaggagaggggctatgcgggtaccgaacctggcggcagcgcaaaagatg

SEQ ID NO: 35723 - DNA, 103 bp, Artificial Sequence
  Synthetic Polynucleotide
taatacgactcactatagggggcgtctccgatcagagatgatacgagcacaacagaggagagtgctcatgtcatctctgaacctggcggcagcgcaaaagatg

SEQ ID NO: 35724 - DNA, 103 bp, Artificial Sequence
  Synthetic Polynucleotide
taatacgactcactatagggtatttgcatcgtggatttcagctccgccccaacagaggagaggggcgatgctgaaatccaacctggcggcagcgcaaaagatg

SEQ ID NO: 35725 - DNA, 103 bp, Artificial Sequence
  Synthetic Polynucleotide
taatacgactcactatagggctagctagacattgttcagcactccagcgaaacagaggagatcgctgatgtgctgaacaaacctggcggcagcgcaaaagatg

SEQ ID NO: 35726 - DNA, 103 bp, Artificial Sequence
  Synthetic Polynucleotide
taatacgactcactatagggagacgcggcactgaatacatctcattccagaacagaggagactggaaatggatgtattcaacctggcggcagcgcaaaagatg

SEQ ID NO: 35727 - DNA, 103 bp, Artificial Sequence
  Synthetic Polynucleotide
taatacgactcactatagggagcaatcactgtagcagggcttgttagcagaacagaggagactgctaatgagccctgctaacctggcggcagcgcaaaagatg

SEQ ID NO: 35728 - DNA, 103 bp, Artificial Sequence
  Synthetic Polynucleotide
taatacgactcactatagggcgtggttccgtatctcggttacgtctcgggaacagaggagacccgagatgtaaccgagaaacctggcggcagcgcaaaagatg

SEQ ID NO: 35729 - DNA, 103 bp, Artificial Sequence
  Synthetic Polynucleotide
taatacgactcactatagggaccatgccaagaatatccctgatcgcatgtaacagaggagaacatgcatgcagggatataacctggcggcagcgcaaaagatg

SEQ ID NO: 35730 - DNA, 103 bp, Artificial Sequence
  Synthetic Polynucleotide
taatacgactcactatagggggtcttcgcgaattatctcctggcttaagaaacagaggagatcttaaatgaggagataaaacctggcggcagcgcaaaagatg

SEQ ID NO: 35731 - DNA, 103 bp, Artificial Sequence
  Synthetic Polynucleotide
taatacgactcactatagggtacaggtggtgtttattcgtccctcttacgaacagaggagacgtaagatggacgaataaaacctggcggcagcgcaaaagatg

SEQ ID NO: 35732 - DNA, 103 bp, Artificial Sequence
  Synthetic Polynucleotide
taatacgactcactatagggcacgttattcggagatacgcgtccggggtgaacagaggagacaccccatgcgcgtatctaacctggcggcagcgcaaaagatg

SEQ ID NO: 35733 - DNA, 103 bp, Artificial Sequence
  Synthetic Polynucleotide
taatacgactcactatagggattgccaagcgattcgaggcgaagggacgcaacagaggagagcgtccatgcgcctcgaaaacctggcggcagcgcaaaagatg

SEQ ID NO: 35734 - DNA, 103 bp, Artificial Sequence
  Synthetic Polynucleotide
taatacgactcactatagggctacttgcggagggtacccgtggcgcatccaacagaggagaggatgcatgacgggtaccaacctggcggcagcgcaaaagatg

SEQ ID NO: 35735 - DNA, 103 bp, Artificial Sequence
  Synthetic Polynucleotide
taatacgactcactatagggctctttctccgcaacatgacagaagtaccgaacagaggagacggtacatgtgtcatgttaacctggcggcagcgcaaaagatg

SEQ ID NO: 35736 - DNA, 103 bp, Artificial Sequence
  Synthetic Polynucleotide
taatacgactcactatagggggaaatttggttcagataaacactaattaaaacagaggagattaattatggtttatctgaacctggcggcagcgcaaaagatg

SEQ ID NO: 35737 - DNA, 103 bp, Artificial Sequence
  Synthetic Polynucleotide
taatacgactcactataggggcactgagtgcagtcctgtaatcccgtaggaacagaggagacctacgatgttacaggacaacctggcggcagcgcaaaagatg

SEQ ID NO: 35738 - DNA, 103 bp, Artificial Sequence
  Synthetic Polynucleotide
taatacgactcactatagggggtccgcttcgtgcggtaaacctatataataacagaggagaattataatggtttaccgcaacctggcggcagcgcaaaagatg

SEQ ID NO: 35739 - DNA, 103 bp, Artificial Sequence
  Synthetic Polynucleotide
taatacgactcactatagggtaaaaaagatgcttcttggtaattgtccgaaacagaggagatcggacatgtaccaagaaaacctggcggcagcgcaaaagatg

SEQ ID NO: 35740 - DNA, 103 bp, Artificial Sequence
  Synthetic Polynucleotide
taatacgactcactatagggctcgtcagtacgtggtggggcaaagccaaaaacagaggagatttggcatggccccaccaaacctggcggcagcgcaaaagatg

SEQ ID NO: 35741 - DNA, 103 bp, Artificial Sequence
  Synthetic Polynucleotide
taatacgactcactatagggagaggcgatcgcaaggaacaatagaaacataacagaggagaatgtttatgttgttccttaacctggcggcagcgcaaaagatg

SEQ ID NO: 35742 - DNA, 103 bp, Artificial Sequence
  Synthetic Polynucleotide
taatacgactcactatagggggcgtggccgacgtcgttaaacgcttgtgtaacagaggagaacacaaatgtttaacgacaacctggcggcagcgcaaaagatg

SEQ ID NO: 35743 - DNA, 103 bp, Artificial Sequence
  Synthetic Polynucleotide
taatacgactcactatagggatccgaaaccgggagcatcgtgccgatacaaacagaggagatgtatcatgacgatgctcaacctggcggcagcgcaaaagatg

SEQ ID NO: 35744 - DNA, 103 bp, Artificial Sequence
  Synthetic Polynucleotide
taatacgactcactatagggtcaccggcacctaacgcctgctagacctgtaacagaggagaacaggtatggcaggcgttaacctggcggcagcgcaaaagatg

SEQ ID NO: 35745 - DNA, 103 bp, Artificial Sequence
  Synthetic Polynucleotide
taatacgactcactatagggtagagcctgtggaataggatgggcacccgtaacagaggagaacgggtatgcatcctattaacctggcggcagcgcaaaagatg

SEQ ID NO: 35746 - DNA, 103 bp, Artificial Sequence
  Synthetic Polynucleotide
taatacgactcactatagggtgttatacgttttccatctggtggggcttgaacagaggagacaagccatgccagatggaaacctggcggcagcgcaaaagatg

SEQ ID NO: 35747 - DNA, 103 bp, Artificial Sequence
  Synthetic Polynucleotide
taatacgactcactatagggtgacggaccttcttgcgaaatcagtctaataacagaggagaattagaatgatttcgcaaaacctggcggcagcgcaaaagatg

SEQ ID NO: 35748 - DNA, 103 bp, Artificial Sequence
  Synthetic Polynucleotide
taatacgactcactataggggcgcgacctagtcgagcagtagattaccataacagaggagaatggtaatgtactgctcgaacctggcggcagcgcaaaagatg

SEQ ID NO: 35749 - DNA, 103 bp, Artificial Sequence
  Synthetic Polynucleotide
taatacgactcactatagggagatgagtcagccctaggcctaaggtcagcaacagaggagagctgacatgaggcctaggaacctggcggcagcgcaaaagatg

SEQ ID NO: 35750 - DNA, 103 bp, Artificial Sequence
  Synthetic Polynucleotide
taatacgactcactatagggcaggcagaccaaggcactgactgcggacagaacagaggagactgtccatggtcagtgccaacctggcggcagcgcaaaagatg

SEQ ID NO: 35751 - DNA, 103 bp, Artificial Sequence
  Synthetic Polynucleotide
taatacgactcactatagggcagcgacactctgcgtcccggcctcggagcaacagaggagagctccgatgccgggacgcaacctggcggcagcgcaaaagatg

SEQ ID NO: 35752 - DNA, 103 bp, Artificial Sequence
  Synthetic Polynucleotide
taatacgactcactatagggcagattgagtgcaccgaaaacacattttcaaacagaggagatgaaaaatggttttcggtaacctggcggcagcgcaaaagatg

SEQ ID NO: 35753 - DNA, 103 bp, Artificial Sequence
  Synthetic Polynucleotide
taatacgactcactatagggagccatcctgaataaaagcttttcatagctaacagaggagaagctatatgaagcttttaaacctggcggcagcgcaaaagatg

SEQ ID NO: 35754 - DNA, 103 bp, Artificial Sequence
  Synthetic Polynucleotide
taatacgactcactatagggcgctaatcagcccccaatcgatacgatatcaacagaggagagatatcatgtcgattgggaacctggcggcagcgcaaaagatg

SEQ ID NO: 35755 - DNA, 103 bp, Artificial Sequence
  Synthetic Polynucleotide
taatacgactcactataggggagcagcgtaacaaagctaaggagctgtggaacagaggagaccacagatgcttagctttaacctggcggcagcgcaaaagatg

SEQ ID NO: 35756 - DNA, 103 bp, Artificial Sequence
  Synthetic Polynucleotide
taatacgactcactataggggtgaggtgttgatctgttgactcttcagggaacagaggagaccctgaatggtcaacagaaacctggcggcagcgcaaaagatg

SEQ ID NO: 35757 - DNA, 103 bp, Artificial Sequence
  Synthetic Polynucleotide
taatacgactcactatagggaataagaggtgtgctctctgatttttggggaacagaggagaccccaaatgtcagagagcaacctggcggcagcgcaaaagatg

SEQ ID NO: 35758 - DNA, 103 bp, Artificial Sequence
  Synthetic Polynucleotide
taatacgactcactatagggtcgaatacatagatccctgacgacaccgtaaacagaggagatacggtatggtcagggataacctggcggcagcgcaaaagatg

SEQ ID NO: 35759 - DNA, 103 bp, Artificial Sequence
  Synthetic Polynucleotide
taatacgactcactatagggagatccgtgcggctggcgcgttagggtgataacagaggagaatcaccatgacgcgccagaacctggcggcagcgcaaaagatg

SEQ ID NO: 35760 - DNA, 103 bp, Artificial Sequence
  Synthetic Polynucleotide
taatacgactcactatagggcatcaatgtgacgccgaaatccttcgaagaaacagaggagatcttcgatggatttcggcaacctggcggcagcgcaaaagatg

SEQ ID NO: 35761 - DNA, 103 bp, Artificial Sequence
  Synthetic Polynucleotide
taatacgactcactatagggatgtgtctctctctgccgcttaggcggattaacagaggagaaatccgatgaagcggcagaacctggcggcagcgcaaaagatg

SEQ ID NO: 35762 - DNA, 103 bp, Artificial Sequence
  Synthetic Polynucleotide
taatacgactcactatagggcttactgattttactgccatgctgctcagaaacagaggagatctgagatgcatggcagtaacctggcggcagcgcaaaagatg

SEQ ID NO: 35763 - DNA, 103 bp, Artificial Sequence
  Synthetic Polynucleotide
taatacgactcactataggggtcttgtttagcaacccacgttcccacttaaacagaggagataagtgatgacgtgggttaacctggcggcagcgcaaaagatg

SEQ ID NO: 35764 - DNA, 103 bp, Artificial Sequence
  Synthetic Polynucleotide
taatacgactcactatagggcggctatgtggctcttagccctcgacatataacagaggagaatatgtatggggctaagaaacctggcggcagcgcaaaagatg

SEQ ID NO: 35765 - DNA, 103 bp, Artificial Sequence
  Synthetic Polynucleotide
taatacgactcactatagggcgcatgtcagcggtgggtgtgtagtatcataacagaggagaatgataatgcacacccacaacctggcggcagcgcaaaagatg

SEQ ID NO: 35766 - DNA, 103 bp, Artificial Sequence
  Synthetic Polynucleotide
taatacgactcactataggggtagcttggatgggtttttaacgagaacgaaacagaggagatcgttcatgttaaaaaccaacctggcggcagcgcaaaagatg

SEQ ID NO: 35767 - DNA, 103 bp, Artificial Sequence
  Synthetic Polynucleotide
taatacgactcactatagggcactactagacggtaatgccgactttgggaaacagaggagatcccaaatgcggcattacaacctggcggcagcgcaaaagatg

SEQ ID NO: 35768 - DNA, 103 bp, Artificial Sequence
  Synthetic Polynucleotide
taatacgactcactatagggataggcgtctcacgacgggctgaggcaacaaacagaggagatgttgcatgagcccgtcgaacctggcggcagcgcaaaagatg

SEQ ID NO: 35769 - DNA, 103 bp, Artificial Sequence
  Synthetic Polynucleotide
taatacgactcactatagggggtcattgtaactggactagtagctaagaaaacagaggagattcttaatgactagtccaaacctggcggcagcgcaaaagatg

SEQ ID NO: 35770 - DNA, 103 bp, Artificial Sequence
  Synthetic Polynucleotide
taatacgactcactatagggggacagttttaggaaactcacgggcgatggaacagaggagaccatcgatggtgagtttcaacctggcggcagcgcaaaagatg

SEQ ID NO: 35771 - DNA, 103 bp, Artificial Sequence
  Synthetic Polynucleotide
taatacgactcactatagggggcgtcctatctcgacgagttgtccgggtaaacagaggagatacccgatgaactcgtcgaacctggcggcagcgcaaaagatg

SEQ ID NO: 35772 - DNA, 103 bp, Artificial Sequence
  Synthetic Polynucleotide
taatacgactcactataggggaacatcggatttttacgacccatacaggaaacagaggagatcctgtatgggtcgtaaaaacctggcggcagcgcaaaagatg

SEQ ID NO: 35773 - DNA, 103 bp, Artificial Sequence
  Synthetic Polynucleotide
taatacgactcactatagggtgtttgaagaaagtccactcagacccaagaaacagaggagatcttggatgtgagtggacaacctggcggcagcgcaaaagatg

SEQ ID NO: 35774 - DNA, 103 bp, Artificial Sequence
  Synthetic Polynucleotide
taatacgactcactatagggcactttagacgttgccgcggccgcaattttaacagaggagaaaaattatggccgcggcaaacctggcggcagcgcaaaagatg

SEQ ID NO: 35775 - DNA, 103 bp, Artificial Sequence
  Synthetic Polynucleotide
taatacgactcactatagggactcgattaatacacggcttggctgcacgcaacagaggagagcgtgcatgcaagccgtgaacctggcggcagcgcaaaagatg

SEQ ID NO: 35776 - DNA, 103 bp, Artificial Sequence
  Synthetic Polynucleotide
taatacgactcactataggggggactttcaacgctgatgtggacaacaccaacagaggagaggtgttatgcacatcagcaacctggcggcagcgcaaaagatg

SEQ ID NO: 35777 - DNA, 103 bp, Artificial Sequence
  Synthetic Polynucleotide
taatacgactcactatagggatatgttcgggtgtgaactggtagggcactaacagaggagaagtgccatgccagttcacaacctggcggcagcgcaaaagatg

SEQ ID NO: 35778 - DNA, 103 bp, Artificial Sequence
  Synthetic Polynucleotide
taatacgactcactataggggtcgtgggcatccgctttacgaaaatggcgaacagaggagacgccatatgcgtaaagcgaacctggcggcagcgcaaaagatg

SEQ ID NO: 35779 - DNA, 103 bp, Artificial Sequence
  Synthetic Polynucleotide
taatacgactcactataggggtaatttttccccgtgattggagtacacaaaacagaggagattgtgtatgccaatcacgaacctggcggcagcgcaaaagatg

SEQ ID NO: 35780 - DNA, 103 bp, Artificial Sequence
  Synthetic Polynucleotide
taatacgactcactatagggattgcctccacgtatttcaaatcgtgtagaaacagaggagatctacaatgtttgaaataaacctggcggcagcgcaaaagatg

SEQ ID NO: 35781 - DNA, 103 bp, Artificial Sequence
  Synthetic Polynucleotide
taatacgactcactatagggcgattctaaccaggcatatcatgatgacagaacagaggagactgtcaatgtgatatgccaacctggcggcagcgcaaaagatg

SEQ ID NO: 35782 - DNA, 103 bp, Artificial Sequence
  Synthetic Polynucleotide
taatacgactcactatagggctaattcttgattggggtattcttgacgcgaacagaggagacgcgtcatgaataccccaaacctggcggcagcgcaaaagatg

SEQ ID NO: 35783 - DNA, 103 bp, Artificial Sequence
  Synthetic Polynucleotide
taatacgactcactatagggacggcatatatttccccagtgaaagaccccaacagaggagaggggtcatgcactggggaaacctggcggcagcgcaaaagatg

SEQ ID NO: 35784 - DNA, 103 bp, Artificial Sequence
  Synthetic Polynucleotide
taatacgactcactataggggcgacttagcatagcagtcctttacaatgcaacagaggagagcattgatgaggactgctaacctggcggcagcgcaaaagatg

SEQ ID NO: 35785 - DNA, 103 bp, Artificial Sequence
  Synthetic Polynucleotide
taatacgactcactatagggtaaaaagcgtcttacttcattttggtaacgaacagaggagacgttacatgaatgaagtaaacctggcggcagcgcaaaagatg

SEQ ID NO: 35786 - DNA, 103 bp, Artificial Sequence
  Synthetic Polynucleotide
taatacgactcactatagggaatagttgcactggggtcgcccagattttgaacagaggagacaaaatatgggcgaccccaacctggcggcagcgcaaaagatg

SEQ ID NO: 35787 - DNA, 103 bp, Artificial Sequence
  Synthetic Polynucleotide
taatacgactcactatagggtccaaatggtagtgttcgagatggatcccaaacagaggagatgggatatgtctcgaacaaacctggcggcagcgcaaaagatg

SEQ ID NO: 35788 - DNA, 103 bp, Artificial Sequence
  Synthetic Polynucleotide
taatacgactcactatagggcagctgttgctcacagtgaatagcgcgctgaacagaggagacagcgcatgattcactgtaacctggcggcagcgcaaaagatg

SEQ ID NO: 35789 - DNA, 103 bp, Artificial Sequence
  Synthetic Polynucleotide
taatacgactcactataggggacgccatagaaggttcaagactcggaaaaaacagaggagattttccatgtcttgaaccaacctggcggcagcgcaaaagatg

SEQ ID NO: 35790 - DNA, 103 bp, Artificial Sequence
  Synthetic Polynucleotide
taatacgactcactatagggcaagagacggcccgctcatgctcgtaattcaacagaggagagaattaatggcatgagcgaacctggcggcagcgcaaaagatg

SEQ ID NO: 35791 - DNA, 103 bp, Artificial Sequence
  Synthetic Polynucleotide
taatacgactcactatagggaccgttccttccggaattttgactgccgacaacagaggagagtcggcatgcaaaattccaacctggcggcagcgcaaaagatg

SEQ ID NO: 35792 - DNA, 103 bp, Artificial Sequence
  Synthetic Polynucleotide
taatacgactcactatagggccaatttggctaatctttagaatgcgatcgaacagaggagacgatcgatgtctaaagataacctggcggcagcgcaaaagatg

SEQ ID NO: 35793 - DNA, 103 bp, Artificial Sequence
  Synthetic Polynucleotide
taatacgactcactataggggtcaggtacaccgtgcggggccgcccactgaacagaggagacagtggatggccccgcacaacctggcggcagcgcaaaagatg

SEQ ID NO: 35794 - DNA, 103 bp, Artificial Sequence
  Synthetic Polynucleotide
taatacgactcactatagggttgggggcgtcatgataggagccagttgcgaacagaggagacgcaacatgctcctatcaaacctggcggcagcgcaaaagatg

SEQ ID NO: 35795 - DNA, 103 bp, Artificial Sequence
  Synthetic Polynucleotide
taatacgactcactatagggagggaggaattgtgaaataaacgatatgataacagaggagaatcataatgtttatttcaaacctggcggcagcgcaaaagatg

SEQ ID NO: 35796 - DNA, 103 bp, Artificial Sequence
  Synthetic Polynucleotide
taatacgactcactatagggtcggggtcatctggctaaagcagggcaattaacagaggagaaattgcatggctttagccaacctggcggcagcgcaaaagatg

SEQ ID NO: 35797 - DNA, 103 bp, Artificial Sequence
  Synthetic Polynucleotide
taatacgactcactataggggaaacacagatcgcacgggcagctatcaagaacagaggagacttgatatgtgcccgtgcaacctggcggcagcgcaaaagatg

SEQ ID NO: 35798 - DNA, 103 bp, Artificial Sequence
  Synthetic Polynucleotide
taatacgactcactataggggagcggccggtaaagtttaactcgcgcatgaacagaggagacatgcgatggttaaacttaacctggcggcagcgcaaaagatg

SEQ ID NO: 35799 - DNA, 103 bp, Artificial Sequence
  Synthetic Polynucleotide
taatacgactcactatagggtatgtcgttttttgtgcacttgagggttacaacagaggagagtaaccatgaagtgcacaaacctggcggcagcgcaaaagatg

SEQ ID NO: 35800 - DNA, 103 bp, Artificial Sequence
  Synthetic Polynucleotide
taatacgactcactataggggccttgacaggatagcgccaacctaggtgaaacagaggagatcacctatgttggcgctaaacctggcggcagcgcaaaagatg

SEQ ID NO: 35801 - DNA, 103 bp, Artificial Sequence
  Synthetic Polynucleotide
taatacgactcactatagggcatgtcatgtcacctgatcaacgcgtcgacaacagaggagagtcgacatgttgatcaggaacctggcggcagcgcaaaagatg

SEQ ID NO: 35802 - DNA, 103 bp, Artificial Sequence
  Synthetic Polynucleotide
taatacgactcactatagggtacacatatcttatggcgaacaaatgaggaaacagaggagatcctcaatggttcgccataacctggcggcagcgcaaaagatg

SEQ ID NO: 35803 - DNA, 103 bp, Artificial Sequence
  Synthetic Polynucleotide
taatacgactcactataggggtcaagagttgaccaatacaggcctcaaggaacagaggagaccttgaatgctgtattggaacctggcggcagcgcaaaagatg

SEQ ID NO: 35804 - DNA, 103 bp, Artificial Sequence
  Synthetic Polynucleotide
taatacgactcactatagggtgagagcaggcccgaatttgttgtgtagaaaacagaggagattctacatgacaaattcgaacctggcggcagcgcaaaagatg

SEQ ID NO: 35805 - DNA, 103 bp, Artificial Sequence
  Synthetic Polynucleotide
taatacgactcactatagggtcccagagcaacgaggacattctgactataaacagaggagatatagtatgaatgtcctcaacctggcggcagcgcaaaagatg

SEQ ID NO: 35806 - DNA, 103 bp, Artificial Sequence
  Synthetic Polynucleotide
taatacgactcactatagggtcgggcgccttcggtgtatccgtaaggtaaaacagaggagattacctatgggatacaccaacctggcggcagcgcaaaagatg

SEQ ID NO: 35807 - DNA, 103 bp, Artificial Sequence
  Synthetic Polynucleotide
taatacgactcactataggggtctttatattgggggcgtcgctgtatggaaacagaggagatccataatgcgacgccccaacctggcggcagcgcaaaagatg

SEQ ID NO: 35808 - DNA, 103 bp, Artificial Sequence
  Synthetic Polynucleotide
taatacgactcactatagggatccatcagtctatgatagtaccgcacgccaacagaggagaggcgtgatgtactatcataacctggcggcagcgcaaaagatg

SEQ ID NO: 35809 - DNA, 103 bp, Artificial Sequence
  Synthetic Polynucleotide
taatacgactcactataggggtagcgggaaaacatagtccgcgtacagtgaacagaggagacactgtatgcggactatgaacctggcggcagcgcaaaagatg

SEQ ID NO: 35810 - DNA, 103 bp, Artificial Sequence
  Synthetic Polynucleotide
taatacgactcactatagggcaggatatcgtcaacctgtgcgaatttgcgaacagaggagacgcaaaatggcacaggttaacctggcggcagcgcaaaagatg

SEQ ID NO: 35811 - DNA, 103 bp, Artificial Sequence
  Synthetic Polynucleotide
taatacgactcactatagggagagcgcctctaagttcatcatcaagttaaaacagaggagattaactatgtgatgaactaacctggcggcagcgcaaaagatg

SEQ ID NO: 35812 - DNA, 103 bp, Artificial Sequence
  Synthetic Polynucleotide
taatacgactcactataggggcgctcccttactaatgtgtgactgccattaacagaggagaaatggcatgcacacattaaacctggcggcagcgcaaaagatg

SEQ ID NO: 35813 - DNA, 103 bp, Artificial Sequence
  Synthetic Polynucleotide
taatacgactcactatagggtaccctctcaccggcaaaggacctccagttaacagaggagaaactggatgtcctttgccaacctggcggcagcgcaaaagatg

SEQ ID NO: 35814 - DNA, 103 bp, Artificial Sequence
  Synthetic Polynucleotide
taatacgactcactataggggatcaaaaaaacgcacaagctaccagacacaacagaggagagtgtctatgagcttgtgcaacctggcggcagcgcaaaagatg

SEQ ID NO: 35815 - DNA, 103 bp, Artificial Sequence
  Synthetic Polynucleotide
taatacgactcactatagggcaccgcgaccacgcgcccgataatgctacaaacagaggagatgtagcatgatcgggcgcaacctggcggcagcgcaaaagatg

SEQ ID NO: 35816 - DNA, 103 bp, Artificial Sequence
  Synthetic Polynucleotide
taatacgactcactatagggtagagtgtggagacgtgaaggtaaacatgtaacagaggagaacatgtatgccttcacgtaacctggcggcagcgcaaaagatg

SEQ ID NO: 35817 - DNA, 103 bp, Artificial Sequence
  Synthetic Polynucleotide
taatacgactcactatagggtcgataaacggaacggagttacattctgtaaacagaggagatacagaatgtaactccgtaacctggcggcagcgcaaaagatg

SEQ ID NO: 35818 - DNA, 103 bp, Artificial Sequence
  Synthetic Polynucleotide
taatacgactcactatagggctatataccgcagttctacctataaggttaaacagaggagataacctatgaggtagaacaacctggcggcagcgcaaaagatg

SEQ ID NO: 35819 - DNA, 103 bp, Artificial Sequence
  Synthetic Polynucleotide
taatacgactcactataggggcggagcgatcaccctgtgccgcgtaggataacagaggagaatcctaatgggcacagggaacctggcggcagcgcaaaagatg

SEQ ID NO: 35820 - DNA, 103 bp, Artificial Sequence
  Synthetic Polynucleotide
taatacgactcactatagggcagtgtttttacctcctacgctcctagtttaacagaggagaaaactaatggcgtaggagaacctggcggcagcgcaaaagatg

SEQ ID NO: 35821 - DNA, 103 bp, Artificial Sequence
  Synthetic Polynucleotide
taatacgactcactataggggagccacttgtactccttcctggacaatagaacagaggagactattgatgaggaaggagaacctggcggcagcgcaaaagatg

SEQ ID NO: 35822 - DNA, 103 bp, Artificial Sequence
  Synthetic Polynucleotide
taatacgactcactatagggttggctaataggcgctcgaatcaccgccagaacagaggagactggcgatgattcgagcgaacctggcggcagcgcaaaagatg

SEQ ID NO: 35823 - DNA, 103 bp, Artificial Sequence
  Synthetic Polynucleotide
taatacgactcactatagggaccttaggcatacagagtctgttgggttgcaacagaggagagcaaccatgcagactctgaacctggcggcagcgcaaaagatg

SEQ ID NO: 35824 - DNA, 103 bp, Artificial Sequence
  Synthetic Polynucleotide
taatacgactcactatagggcgttagtcgcctatcgcatggacttctagtaacagaggagaactagaatgccatgcgataacctggcggcagcgcaaaagatg

SEQ ID NO: 35825 - DNA, 103 bp, Artificial Sequence
  Synthetic Polynucleotide
taatacgactcactatagggtgcgcgttccacgagttggtgcgggcgaggaacagaggagacctcgcatgcaccaactcaacctggcggcagcgcaaaagatg

SEQ ID NO: 35826 - DNA, 103 bp, Artificial Sequence
  Synthetic Polynucleotide
taatacgactcactatagggacgattcgccttcttataggggcacctgtgaacagaggagacacaggatgccctataagaacctggcggcagcgcaaaagatg

SEQ ID NO: 35827 - DNA, 103 bp, Artificial Sequence
  Synthetic Polynucleotide
taatacgactcactatagggcggtgtacgacggttatgtctatcggaccaaacagaggagatggtccatgagacataacaacctggcggcagcgcaaaagatg

SEQ ID NO: 35828 - DNA, 103 bp, Artificial Sequence
  Synthetic Polynucleotide
taatacgactcactatagggtgatgtgcccgcacactcgagttgggtacgaacagaggagacgtaccatgctcgagtgtaacctggcggcagcgcaaaagatg

SEQ ID NO: 35829 - DNA, 103 bp, Artificial Sequence
  Synthetic Polynucleotide
taatacgactcactatagggatagactccttcggccattagtgtctactaaacagaggagatagtagatgctaatggccaacctggcggcagcgcaaaagatg

SEQ ID NO: 35830 - DNA, 103 bp, Artificial Sequence
  Synthetic Polynucleotide
taatacgactcactatagggcgacatatcgtcaagcggggcccccacgcaaacagaggagatgcgtgatggccccgcttaacctggcggcagcgcaaaagatg

SEQ ID NO: 35831 - DNA, 103 bp, Artificial Sequence
  Synthetic Polynucleotide
taatacgactcactatagggcatggatgaagcaccctccaggctgccgccaacagaggagaggcggcatgctggagggtaacctggcggcagcgcaaaagatg

SEQ ID NO: 35832 - DNA, 103 bp, Artificial Sequence
  Synthetic Polynucleotide
taatacgactcactataggggggagttatatagttggtcaagcgttgcggaacagaggagaccgcaaatgttgaccaacaacctggcggcagcgcaaaagatg

SEQ ID NO: 35833 - DNA, 103 bp, Artificial Sequence
  Synthetic Polynucleotide
taatacgactcactatagggtgaacaaaagaaaccctcatttgccccagaaacagaggagatctgggatgaatgagggtaacctggcggcagcgcaaaagatg

SEQ ID NO: 35834 - DNA, 103 bp, Artificial Sequence
  Synthetic Polynucleotide
taatacgactcactatagggcatattggttctggtcaccgaaaggctattaacagaggagaaatagcatgtcggtgaccaacctggcggcagcgcaaaagatg

SEQ ID NO: 35835 - DNA, 103 bp, Artificial Sequence
  Synthetic Polynucleotide
taatacgactcactatagggtgataagttcaactactgtggaaagctggcaacagaggagagccagcatgccacagtagaacctggcggcagcgcaaaagatg

SEQ ID NO: 35836 - DNA, 103 bp, Artificial Sequence
  Synthetic Polynucleotide
taatacgactcactatagggccgagtctaccagcgttaacggtcttaagtaacagaggagaacttaaatgcgttaacgcaacctggcggcagcgcaaaagatg

SEQ ID NO: 35837 - DNA, 103 bp, Artificial Sequence
  Synthetic Polynucleotide
taatacgactcactatagggcgccattaatttatactgagaggggttgtcaacagaggagagacaacatgtctcagtataacctggcggcagcgcaaaagatg

SEQ ID NO: 35838 - DNA, 103 bp, Artificial Sequence
  Synthetic Polynucleotide
taatacgactcactatagggacagaaagtgtcaagcgaattctttctgataacagaggagaatcagaatgaattcgcttaacctggcggcagcgcaaaagatg

SEQ ID NO: 35839 - DNA, 103 bp, Artificial Sequence
  Synthetic Polynucleotide
taatacgactcactatagggccgaacgtctaatctttttgtatcagccagaacagaggagactggctatgacaaaaagaaacctggcggcagcgcaaaagatg

SEQ ID NO: 35840 - DNA, 103 bp, Artificial Sequence
  Synthetic Polynucleotide
taatacgactcactataggggccgctagagagtcgccagaccagcgcgataacagaggagaatcgcgatggtctggcgaaacctggcggcagcgcaaaagatg

SEQ ID NO: 35841 - DNA, 103 bp, Artificial Sequence
  Synthetic Polynucleotide
taatacgactcactataggggtatagatcatgggcaactgaggagccccaaacagaggagatggggcatgtcagttgccaacctggcggcagcgcaaaagatg

SEQ ID NO: 35842 - DNA, 103 bp, Artificial Sequence
  Synthetic Polynucleotide
taatacgactcactatagggtgataatctttcaaaaatcactgctctcacaacagaggagagtgagaatggtgatttttaacctggcggcagcgcaaaagatg

SEQ ID NO: 35843 - DNA, 103 bp, Artificial Sequence
  Synthetic Polynucleotide
taatacgactcactatagggtaatagccccacgagcgacgcatgaggcaaaacagaggagattgcctatggcgtcgctcaacctggcggcagcgcaaaagatg

SEQ ID NO: 35844 - DNA, 103 bp, Artificial Sequence
  Synthetic Polynucleotide
taatacgactcactatagggttgtggagaaagcgtaagcttaggtcgaccaacagaggagaggtcgaatgaagcttacgaacctggcggcagcgcaaaagatg

SEQ ID NO: 35845 - DNA, 103 bp, Artificial Sequence
  Synthetic Polynucleotide
taatacgactcactatagggcggaaaactcgattgacggaaacgctatcaaacagaggagatgatagatgttccgtcaaaacctggcggcagcgcaaaagatg

SEQ ID NO: 35846 - DNA, 103 bp, Artificial Sequence
  Synthetic Polynucleotide
taatacgactcactataggggtctatcgtttgtgttggagtgcttgctacaacagaggagagtagcaatgactccaacaaacctggcggcagcgcaaaagatg

SEQ ID NO: 35847 - DNA, 103 bp, Artificial Sequence
  Synthetic Polynucleotide
taatacgactcactatagggaggtatcaagagatatatctgtccctggtaaacagaggagataccagatgcagatatataacctggcggcagcgcaaaagatg

SEQ ID NO: 35848 - DNA, 103 bp, Artificial Sequence
  Synthetic Polynucleotide
taatacgactcactatagggctaaagttcagtcacaccgaccaccgccccaacagaggagaggggcgatggtcggtgtgaacctggcggcagcgcaaaagatg

SEQ ID NO: 35849 - DNA, 103 bp, Artificial Sequence
  Synthetic Polynucleotide
taatacgactcactatagggggtctaattggcatgtactcaaattggacaaacagaggagatgtccaatgtgagtacataacctggcggcagcgcaaaagatg

SEQ ID NO: 35850 - DNA, 103 bp, Artificial Sequence
  Synthetic Polynucleotide
taatacgactcactatagggtctatcgccagcgttgccatggagctccacaacagaggagagtggagatgcatggcaacaacctggcggcagcgcaaaagatg

SEQ ID NO: 35851 - DNA, 103 bp, Artificial Sequence
  Synthetic Polynucleotide
taatacgactcactatagggtgcgaaatattaacagcaaccatgagtaagaacagaggagacttactatgggttgctgtaacctggcggcagcgcaaaagatg

SEQ ID NO: 35852 - DNA, 103 bp, Artificial Sequence
  Synthetic Polynucleotide
taatacgactcactatagggcacaagcacaagtaatttaaagaatctctcaacagaggagagagagaatgtttaaattaaacctggcggcagcgcaaaagatg

SEQ ID NO: 35853 - DNA, 103 bp, Artificial Sequence
  Synthetic Polynucleotide
taatacgactcactataggggtacattacgttatgcccctagcccacggtaacagaggagaaccgtgatgtaggggcataacctggcggcagcgcaaaagatg

SEQ ID NO: 35854 - DNA, 103 bp, Artificial Sequence
  Synthetic Polynucleotide
taatacgactcactatagggtttaggcaccacccctacgacaagtcccagaacagaggagactgggaatggtcgtagggaacctggcggcagcgcaaaagatg

SEQ ID NO: 35855 - DNA, 103 bp, Artificial Sequence
  Synthetic Polynucleotide
taatacgactcactataggggtagaagggataagacggggcatgtcccccaacagaggagagggggaatggccccgtctaacctggcggcagcgcaaaagatg

SEQ ID NO: 35856 - DNA, 103 bp, Artificial Sequence
  Synthetic Polynucleotide
taatacgactcactatagggtggcaacgtagctggcctccttgcgatcagaacagaggagactgatcatgaggaggccaaacctggcggcagcgcaaaagatg

SEQ ID NO: 35857 - DNA, 103 bp, Artificial Sequence
  Synthetic Polynucleotide
taatacgactcactatagggtcaccatctttatggacacctagatatagtaacagaggagaactataatgaggtgtccaaacctggcggcagcgcaaaagatg

SEQ ID NO: 35858 - DNA, 103 bp, Artificial Sequence
  Synthetic Polynucleotide
taatacgactcactatagggtaggaggtcgtcccccaatacgcttggattaacagaggagaaatccaatggtattggggaacctggcggcagcgcaaaagatg

SEQ ID NO: 35859 - DNA, 103 bp, Artificial Sequence
  Synthetic Polynucleotide
taatacgactcactatagggtaagagagctaggcgtgcctgttgaaccgaaacagaggagatcggttatgcaggcacgcaacctggcggcagcgcaaaagatg

SEQ ID NO: 35860 - DNA, 103 bp, Artificial Sequence
  Synthetic Polynucleotide
taatacgactcactataggggggcgacttgtttgccgccggttcggcgaaaacagaggagattcgccatgccggcggcaaacctggcggcagcgcaaaagatg

SEQ ID NO: 35861 - DNA, 103 bp, Artificial Sequence
  Synthetic Polynucleotide
taatacgactcactatagggctctggcgacacggtacgctatgccttataaacagaggagatataagatgtagcgtaccaacctggcggcagcgcaaaagatg

SEQ ID NO: 35862 - DNA, 103 bp, Artificial Sequence
  Synthetic Polynucleotide
taatacgactcactatagggtaattaccatccgagtgctgccatcacggaaacagaggagatccgtgatggcagcactcaacctggcggcagcgcaaaagatg

SEQ ID NO: 35863 - DNA, 103 bp, Artificial Sequence
  Synthetic Polynucleotide
taatacgactcactatagggtagagggtctgcccgtggagcgtcagtgctaacagaggagaagcactatggctccacggaacctggcggcagcgcaaaagatg

SEQ ID NO: 35864 - DNA, 103 bp, Artificial Sequence
  Synthetic Polynucleotide
taatacgactcactatagggggtgccccctaactacgatagacttccagaaacagaggagatctggaatgctatcgtagaacctggcggcagcgcaaaagatg

SEQ ID NO: 35865 - DNA, 103 bp, Artificial Sequence
  Synthetic Polynucleotide
taatacgactcactatagggtattgataagtgggtgttgcaaacggcgccaacagaggagaggcgccatgtgcaacaccaacctggcggcagcgcaaaagatg

SEQ ID NO: 35866 - DNA, 103 bp, Artificial Sequence
  Synthetic Polynucleotide
taatacgactcactatagggatctggtaagaatctttgtctccgagccgaaacagaggagatcggctatgagacaaagaaacctggcggcagcgcaaaagatg

SEQ ID NO: 35867 - DNA, 103 bp, Artificial Sequence
  Synthetic Polynucleotide
taatacgactcactatagggctacctgtcctggcctcaaggctaccgagtaacagaggagaactcggatgccttgaggcaacctggcggcagcgcaaaagatg

SEQ ID NO: 35868 - DNA, 103 bp, Artificial Sequence
  Synthetic Polynucleotide
taatacgactcactataggggcatcctaggaccccggccctggtgcagccaacagaggagaggctgcatgagggccgggaacctggcggcagcgcaaaagatg

SEQ ID NO: 35869 - DNA, 103 bp, Artificial Sequence
  Synthetic Polynucleotide
taatacgactcactatagggctcaggcgttagcacacgaaacagcggccgaacagaggagacggccgatgtttcgtgtgaacctggcggcagcgcaaaagatg

SEQ ID NO: 35870 - DNA, 103 bp, Artificial Sequence
  Synthetic Polynucleotide
taatacgactcactatagggctccgttagcagccgaccccctttcgtataaacagaggagatatacgatggggggtcggaacctggcggcagcgcaaaagatg

SEQ ID NO: 35871 - DNA, 103 bp, Artificial Sequence
  Synthetic Polynucleotide
taatacgactcactataggggacaaagttggctttcccgcaattttcatgaacagaggagacatgaaatgtgcgggaaaaacctggcggcagcgcaaaagatg

SEQ ID NO: 35872 - DNA, 103 bp, Artificial Sequence
  Synthetic Polynucleotide
taatacgactcactatagggatgaacggactccaccactacgcgttgaggaacagaggagacctcaaatggtagtggtgaacctggcggcagcgcaaaagatg

SEQ ID NO: 35873 - DNA, 103 bp, Artificial Sequence
  Synthetic Polynucleotide
taatacgactcactatagggttctttcccactactagcatcgttccatcgaacagaggagacgatggatggatgctagtaacctggcggcagcgcaaaagatg

SEQ ID NO: 35874 - DNA, 103 bp, Artificial Sequence
  Synthetic Polynucleotide
taatacgactcactatagggcgaattttcagttagacgacatttcctgtaaacagaggagatacaggatgtgtcgtctaaacctggcggcagcgcaaaagatg

SEQ ID NO: 35875 - DNA, 103 bp, Artificial Sequence
  Synthetic Polynucleotide
taatacgactcactatagggcctagcttctcgagtggaaacggctttatcaacagaggagagataaaatggtttccactaacctggcggcagcgcaaaagatg

SEQ ID NO: 35876 - DNA, 103 bp, Artificial Sequence
  Synthetic Polynucleotide
taatacgactcactatagggcagcaggcggggggttcggaagcttttcataacagaggagaatgaaaatgttccgaaccaacctggcggcagcgcaaaagatg

SEQ ID NO: 35877 - DNA, 103 bp, Artificial Sequence
  Synthetic Polynucleotide
taatacgactcactatagggtttggaagacagcggacacagtatgatcgaaacagaggagatcgatcatgctgtgtccgaacctggcggcagcgcaaaagatg

SEQ ID NO: 35878 - DNA, 103 bp, Artificial Sequence
  Synthetic Polynucleotide
taatacgactcactataggggaactcatagctaagcttttctggatttttaacagaggagaaaaaatatggaaaagcttaacctggcggcagcgcaaaagatg

SEQ ID NO: 35879 - DNA, 103 bp, Artificial Sequence
  Synthetic Polynucleotide
taatacgactcactataggggcctaacgagatctccgagagctcttttagaacagaggagactaaaaatgctctcggagaacctggcggcagcgcaaaagatg

SEQ ID NO: 35880 - DNA, 103 bp, Artificial Sequence
  Synthetic Polynucleotide
taatacgactcactatagggtaagtgttcgagacgattcttggatcaaaaaacagaggagattttgaatgaagaatcgtaacctggcggcagcgcaaaagatg

SEQ ID NO: 35881 - DNA, 103 bp, Artificial Sequence
  Synthetic Polynucleotide
taatacgactcactatagggcagtgggacttttttgccatcgagtgccacaacagaggagagtggcaatggatggcaaaaacctggcggcagcgcaaaagatg

SEQ ID NO: 35882 - DNA, 103 bp, Artificial Sequence
  Synthetic Polynucleotide
taatacgactcactatagggtagggagtttacgtggcctcgttgttaacaaacagaggagatgttaaatgcgaggccacaacctggcggcagcgcaaaagatg

SEQ ID NO: 35883 - DNA, 103 bp, Artificial Sequence
  Synthetic Polynucleotide
taatacgactcactatagggacgttccttgtctggaccctgctacattgaaacagaggagatcaatgatgcagggtccaaacctggcggcagcgcaaaagatg

SEQ ID NO: 35884 - DNA, 103 bp, Artificial Sequence
  Synthetic Polynucleotide
taatacgactcactatagggttctaaacctctcaagactgcagccgactcaacagaggagagagtcgatggcagtcttgaacctggcggcagcgcaaaagatg

SEQ ID NO: 35885 - DNA, 103 bp, Artificial Sequence
  Synthetic Polynucleotide
taatacgactcactatagggcgtgccttggctaattctcgtttacaggagaacagaggagactcctgatgacgagaattaacctggcggcagcgcaaaagatg

SEQ ID NO: 35886 - DNA, 103 bp, Artificial Sequence
  Synthetic Polynucleotide
taatacgactcactatagggctacagcttactctaatcatagatggagtgaacagaggagacactccatgtatgattagaacctggcggcagcgcaaaagatg

SEQ ID NO: 35887 - DNA, 103 bp, Artificial Sequence
  Synthetic Polynucleotide
taatacgactcactatagggggctaggcattacggatcgcttccttccctaacagaggagaagggaaatgagcgatccgaacctggcggcagcgcaaaagatg

SEQ ID NO: 35888 - DNA, 103 bp, Artificial Sequence
  Synthetic Polynucleotide
taatacgactcactatagggctacactacacctgtcggagtccataacagaacagaggagactgttaatgactccgacaaacctggcggcagcgcaaaagatg

SEQ ID NO: 35889 - DNA, 103 bp, Artificial Sequence
  Synthetic Polynucleotide
taatacgactcactatagggctgtggagcccacacgaaggtaagatcaaaaacagaggagatttgatatgaccttcgtgaacctggcggcagcgcaaaagatg

SEQ ID NO: 35890 - DNA, 103 bp, Artificial Sequence
  Synthetic Polynucleotide
taatacgactcactatagggctttaaacagaagcattcggaattacaataaacagaggagatattgtatgtccgaatgcaacctggcggcagcgcaaaagatg

SEQ ID NO: 35891 - DNA, 103 bp, Artificial Sequence
  Synthetic Polynucleotide
taatacgactcactatagggtgacccacggcagaccacccatgttatccaaacagaggagatggataatgtgggtggtcaacctggcggcagcgcaaaagatg

SEQ ID NO: 35892 - DNA, 103 bp, Artificial Sequence
  Synthetic Polynucleotide
taatacgactcactatagggaagtgcggcgagagccgccaggcagaggccaacagaggagaggcctcatgctggcggctaacctggcggcagcgcaaaagatg

SEQ ID NO: 35893 - DNA, 103 bp, Artificial Sequence
  Synthetic Polynucleotide
taatacgactcactatagggttgacatagtaccgggcttcgcgcggatttaacagaggagaaaatccatgcgaagcccgaacctggcggcagcgcaaaagatg

SEQ ID NO: 35894 - DNA, 103 bp, Artificial Sequence
  Synthetic Polynucleotide
taatacgactcactatagggttgggggtagtgagacataagtgccgcccgaacagaggagacgggcgatgcttatgtctaacctggcggcagcgcaaaagatg

SEQ ID NO: 35895 - DNA, 103 bp, Artificial Sequence
  Synthetic Polynucleotide
taatacgactcactatagggccgtaaatacaaacaggacggagacatcctaacagaggagaaggatgatgccgtcctgtaacctggcggcagcgcaaaagatg

SEQ ID NO: 35896 - DNA, 103 bp, Artificial Sequence
  Synthetic Polynucleotide
taatacgactcactatagggaactgtctttctaagtagccgagaggaccgaacagaggagacggtccatgcggctacttaacctggcggcagcgcaaaagatg

SEQ ID NO: 35897 - DNA, 103 bp, Artificial Sequence
  Synthetic Polynucleotide
taatacgactcactatagggcaagcgaggatttgtccgtttctgggaaacaacagaggagagtttccatgaaacggacaaacctggcggcagcgcaaaagatg

SEQ ID NO: 35898 - DNA, 103 bp, Artificial Sequence
  Synthetic Polynucleotide
taatacgactcactatagggttagaacgttgaaaaagggaactacccataaacagaggagatatgggatgttcccttttaacctggcggcagcgcaaaagatg

SEQ ID NO: 35899 - DNA, 103 bp, Artificial Sequence
  Synthetic Polynucleotide
taatacgactcactatagggtcactcaagtccatttagggattccccatgaacagaggagacatgggatgtccctaaataacctggcggcagcgcaaaagatg

SEQ ID NO: 35900 - DNA, 103 bp, Artificial Sequence
  Synthetic Polynucleotide
taatacgactcactatagggattaacggttaatttaattacggtgggttgaacagaggagacaacccatggtaattaaaaacctggcggcagcgcaaaagatg

SEQ ID NO: 35901 - DNA, 103 bp, Artificial Sequence
  Synthetic Polynucleotide
taatacgactcactatagggctggtccattggctaactcactcgcaacctaacagaggagaaggttgatggtgagttagaacctggcggcagcgcaaaagatg

SEQ ID NO: 35902 - DNA, 103 bp, Artificial Sequence
  Synthetic Polynucleotide
taatacgactcactatagggattgttctgatcggaaccgatctaatataaaacagaggagattatatatgatcggttccaacctggcggcagcgcaaaagatg

SEQ ID NO: 35903 - DNA, 103 bp, Artificial Sequence
  Synthetic Polynucleotide
taatacgactcactatagggcttgaggatgcctcgtgcgccgggggttgaaacagaggagatcaaccatgggcgcacgaaacctggcggcagcgcaaaagatg

SEQ ID NO: 35904 - DNA, 103 bp, Artificial Sequence
  Synthetic Polynucleotide
taatacgactcactatagggaaacgagcccgatcaccagtggggagtgaaaacagaggagattcactatgcactggtgaaacctggcggcagcgcaaaagatg

SEQ ID NO: 35905 - DNA, 103 bp, Artificial Sequence
  Synthetic Polynucleotide
taatacgactcactatagggtaattcatcatggtgtggtacgtatctttcaacagaggagagaaagaatggtaccacacaacctggcggcagcgcaaaagatg

SEQ ID NO: 35906 - DNA, 103 bp, Artificial Sequence
  Synthetic Polynucleotide
taatacgactcactatagggttcgggaggcgcatctccgtgcgtagacggaacagaggagaccgtctatgcacggagataacctggcggcagcgcaaaagatg

SEQ ID NO: 35907 - DNA, 103 bp, Artificial Sequence
  Synthetic Polynucleotide
taatacgactcactatagggtaggctctgaagaatggtgtatctgcccagaacagaggagactgggcatgtacaccattaacctggcggcagcgcaaaagatg

SEQ ID NO: 35908 - DNA, 103 bp, Artificial Sequence
  Synthetic Polynucleotide
taatacgactcactatagggggtcgattggcagcttcgtatgcttggggcaacagaggagagccccaatgatacgaagcaacctggcggcagcgcaaaagatg

SEQ ID NO: 35909 - DNA, 103 bp, Artificial Sequence
  Synthetic Polynucleotide
taatacgactcactatagggaatgcacgagagacatagaccttgggattcaacagaggagagaatccatgggtctatgtaacctggcggcagcgcaaaagatg

SEQ ID NO: 35910 - DNA, 103 bp, Artificial Sequence
  Synthetic Polynucleotide
taatacgactcactatagggggcagtcagttatagggccgaccatcatccaacagaggagaggatgaatgtcggccctaaacctggcggcagcgcaaaagatg

SEQ ID NO: 35911 - DNA, 103 bp, Artificial Sequence
  Synthetic Polynucleotide
taatacgactcactatagggaatgagcagtcagcttaagtgacggttgagaacagaggagactcaacatgcacttaagcaacctggcggcagcgcaaaagatg

SEQ ID NO: 35912 - DNA, 103 bp, Artificial Sequence
  Synthetic Polynucleotide
taatacgactcactatagggcattgtgccgtaataactgcctactgatcaaacagaggagatgatcaatgggcagttataacctggcggcagcgcaaaagatg

SEQ ID NO: 35913 - DNA, 103 bp, Artificial Sequence
  Synthetic Polynucleotide
taatacgactcactataggggctctctaaggagcaaggttaaatactttgaacagaggagacaaagtatgtaaccttgcaacctggcggcagcgcaaaagatg

SEQ ID NO: 35914 - DNA, 103 bp, Artificial Sequence
  Synthetic Polynucleotide
taatacgactcactatagggcattaagacttccatcccatgttaaccccaaacagaggagatggggtatgcatgggatgaacctggcggcagcgcaaaagatg

SEQ ID NO: 35915 - DNA, 103 bp, Artificial Sequence
  Synthetic Polynucleotide
taatacgactcactatagggttcttctatgttaaaccgccttttaagttgaacagaggagacaacttatgaggcggtttaacctggcggcagcgcaaaagatg

SEQ ID NO: 35916 - DNA, 103 bp, Artificial Sequence
  Synthetic Polynucleotide
taatacgactcactatagggaggaatcgggtcagtctgcagctgcgtgccaacagaggagaggcacgatgctgcagactaacctggcggcagcgcaaaagatg

SEQ ID NO: 35917 - DNA, 103 bp, Artificial Sequence
  Synthetic Polynucleotide
taatacgactcactataggggactatcgttgacaatagccatcaaaggtaaacagaggagataccttatgtggctattgaacctggcggcagcgcaaaagatg

SEQ ID NO: 35918 - DNA, 103 bp, Artificial Sequence
  Synthetic Polynucleotide
taatacgactcactatagggatcaagcggcaactgagttccggtgtgttgaacagaggagacaacacatgggaactcagaacctggcggcagcgcaaaagatg

SEQ ID NO: 35919 - DNA, 103 bp, Artificial Sequence
  Synthetic Polynucleotide
taatacgactcactatagggtccccgaatcctaacgatatcaaggcaaagaacagaggagactttgcatggatatcgttaacctggcggcagcgcaaaagatg

SEQ ID NO: 35920 - DNA, 103 bp, Artificial Sequence
  Synthetic Polynucleotide
taatacgactcactatagggttagtcatctggtataggatccgcatcttaaacagaggagataagatatggatcctataaacctggcggcagcgcaaaagatg

SEQ ID NO: 35921 - DNA, 103 bp, Artificial Sequence
  Synthetic Polynucleotide
taatacgactcactatagggaaggaccgattcatgaagccttccctcagcaacagaggagagctgagatgaggcttcataacctggcggcagcgcaaaagatg

SEQ ID NO: 35922 - DNA, 103 bp, Artificial Sequence
  Synthetic Polynucleotide
taatacgactcactatagggtgtaaaatgtgaaggaacattgaaataattaacagaggagaaattatatgaatgttcctaacctggcggcagcgcaaaagatg

SEQ ID NO: 35923 - DNA, 103 bp, Artificial Sequence
  Synthetic Polynucleotide
taatacgactcactatagggttaggctgactcgtcgataacgtggcattgaacagaggagacaatgcatggttatcgacaacctggcggcagcgcaaaagatg

SEQ ID NO: 35924 - DNA, 103 bp, Artificial Sequence
  Synthetic Polynucleotide
taatacgactcactataggggggtcgggcactgggacgggttacagagtcaacagaggagagactctatgacccgtcccaacctggcggcagcgcaaaagatg

SEQ ID NO: 35925 - DNA, 103 bp, Artificial Sequence
  Synthetic Polynucleotide
taatacgactcactatagggcacaaaattggggagggctcaacccggactaacagaggagaagtccgatgtgagccctcaacctggcggcagcgcaaaagatg

SEQ ID NO: 35926 - DNA, 103 bp, Artificial Sequence
  Synthetic Polynucleotide
taatacgactcactatagggatcgtgccattagcagcaggatatggccccaacagaggagaggggccatgtcctgctgcaacctggcggcagcgcaaaagatg

SEQ ID NO: 35927 - DNA, 103 bp, Artificial Sequence
  Synthetic Polynucleotide
taatacgactcactatagggcactagcgttggagtaatagcatacactgcaacagaggagagcagtgatggctattactaacctggcggcagcgcaaaagatg

SEQ ID NO: 35928 - DNA, 103 bp, Artificial Sequence
  Synthetic Polynucleotide
taatacgactcactatagggcgactagactcatcgctgggatcaattggaaacagaggagatccaatatgtcccagcgaaacctggcggcagcgcaaaagatg

SEQ ID NO: 35929 - DNA, 103 bp, Artificial Sequence
  Synthetic Polynucleotide
taatacgactcactatagggttctacagggtatccactccgggaactctcaacagaggagagagagtatgcggagtggaaacctggcggcagcgcaaaagatg

SEQ ID NO: 35930 - DNA, 103 bp, Artificial Sequence
  Synthetic Polynucleotide
taatacgactcactataggggggctctattgttgttaagtcataactgcaaacagaggagatgcagtatggacttaacaaacctggcggcagcgcaaaagatg

SEQ ID NO: 35931 - DNA, 103 bp, Artificial Sequence
  Synthetic Polynucleotide
taatacgactcactatagggctatatatacctgtcacgttccgctcgtgaaacagaggagatcacgaatggaacgtgacaacctggcggcagcgcaaaagatg

SEQ ID NO: 35932 - DNA, 103 bp, Artificial Sequence
  Synthetic Polynucleotide
taatacgactcactatagggctgcacggtcgaaagatgtgtaacgacgtaaacagaggagatacgtcatgacacatcttaacctggcggcagcgcaaaagatg

SEQ ID NO: 35933 - DNA, 103 bp, Artificial Sequence
  Synthetic Polynucleotide
taatacgactcactatagggaagttgagtttaatcacatctccttaaagtaacagaggagaactttaatgagatgtgataacctggcggcagcgcaaaagatg

SEQ ID NO: 35934 - DNA, 103 bp, Artificial Sequence
  Synthetic Polynucleotide
taatacgactcactatagggtggggataattaggatgtttgatgctgttgaacagaggagacaacagatgcaaacatccaacctggcggcagcgcaaaagatg

SEQ ID NO: 35935 - DNA, 103 bp, Artificial Sequence
  Synthetic Polynucleotide
taatacgactcactatagggaattaaccaaacctgagcggattaacaacgaacagaggagacgttgtatgtccgctcagaacctggcggcagcgcaaaagatg

SEQ ID NO: 35936 - DNA, 103 bp, Artificial Sequence
  Synthetic Polynucleotide
taatacgactcactatagggtaacagtctcaagacgggggggtctggctcaacagaggagagagccaatgccccccgtcaacctggcggcagcgcaaaagatg

SEQ ID NO: 35937 - DNA, 103 bp, Artificial Sequence
  Synthetic Polynucleotide
taatacgactcactatagggctctcccaaggtctaagttagcccgtcgttaacagaggagaaacgacatgctaacttagaacctggcggcagcgcaaaagatg

SEQ ID NO: 35938 - DNA, 103 bp, Artificial Sequence
  Synthetic Polynucleotide
taatacgactcactatagggctgtaagacctcacgacccccgtgacgtctaacagaggagaagacgtatggggggtcgtaacctggcggcagcgcaaaagatg

SEQ ID NO: 35939 - DNA, 103 bp, Artificial Sequence
  Synthetic Polynucleotide
taatacgactcactatagggtatggccaccaaaaatgatattcatgttttaacagaggagaaaaacaatgatatcatttaacctggcggcagcgcaaaagatg

SEQ ID NO: 35940 - DNA, 103 bp, Artificial Sequence
  Synthetic Polynucleotide
taatacgactcactatagggggttagctttcgcttttgttacatggtggtaacagaggagaaccaccatgtaacaaaagaacctggcggcagcgcaaaagatg

SEQ ID NO: 35941 - DNA, 103 bp, Artificial Sequence
  Synthetic Polynucleotide
taatacgactcactatagggcggccagagagaacgcatactaccggtagaaacagaggagatctaccatgagtatgcgtaacctggcggcagcgcaaaagatg

SEQ ID NO: 35942 - DNA, 103 bp, Artificial Sequence
  Synthetic Polynucleotide
taatacgactcactatagggctacttttaggcgggaagagcctgggggccaacagaggagaggccccatggctcttcccaacctggcggcagcgcaaaagatg

SEQ ID NO: 35943 - DNA, 103 bp, Artificial Sequence
  Synthetic Polynucleotide
taatacgactcactatagggaagccagccttagtgcagtgaacacgcgctaacagaggagaagcgcgatgtcactgcacaacctggcggcagcgcaaaagatg

SEQ ID NO: 35944 - DNA, 103 bp, Artificial Sequence
  Synthetic Polynucleotide
taatacgactcactataggggggttaaggcatccgtggggtgtagctcgtaacagaggagaacgagcatgaccccacggaacctggcggcagcgcaaaagatg

SEQ ID NO: 35945 - DNA, 103 bp, Artificial Sequence
  Synthetic Polynucleotide
taatacgactcactatagggcccgaggatacggctcactgacggtgcacgaacagaggagacgtgcaatgtcagtgagcaacctggcggcagcgcaaaagatg

SEQ ID NO: 35946 - DNA, 103 bp, Artificial Sequence
  Synthetic Polynucleotide
taatacgactcactataggggtcataacatgttgtgttgtttggccgttaaacagaggagataacggatgaacaacacaaacctggcggcagcgcaaaagatg

SEQ ID NO: 35947 - DNA, 103 bp, Artificial Sequence
  Synthetic Polynucleotide
taatacgactcactataggggtctaacggaatgtaaagcgtgctcgtggcaacagaggagagccacgatgacgctttacaacctggcggcagcgcaaaagatg

SEQ ID NO: 35948 - DNA, 103 bp, Artificial Sequence
  Synthetic Polynucleotide
taatacgactcactatagggaattccagatctaagttgggatgttttgtaaacagaggagatacaaaatgtcccaacttaacctggcggcagcgcaaaagatg

SEQ ID NO: 35949 - DNA, 103 bp, Artificial Sequence
  Synthetic Polynucleotide
taatacgactcactatagggaggagagaacggagacgattcttaaagagaaacagaggagatctcttatggaatcgtctaacctggcggcagcgcaaaagatg

SEQ ID NO: 35950 - DNA, 103 bp, Artificial Sequence
  Synthetic Polynucleotide
taatacgactcactataggggcaggaacagtgtttctaacccctgccctaaacagaggagatagggcatgggttagaaaaacctggcggcagcgcaaaagatg

SEQ ID NO: 35951 - DNA, 103 bp, Artificial Sequence
  Synthetic Polynucleotide
taatacgactcactatagggctcgtggagtggcgcgccagcttgctcccaaacagaggagatgggagatggctggcgcgaacctggcggcagcgcaaaagatg

SEQ ID NO: 35952 - DNA, 103 bp, Artificial Sequence
  Synthetic Polynucleotide
taatacgactcactatagggaagccgccggggcggttaggaccccaaaggaacagaggagacctttgatgtcctaaccgaacctggcggcagcgcaaaagatg

SEQ ID NO: 35953 - DNA, 103 bp, Artificial Sequence
  Synthetic Polynucleotide
taatacgactcactatagggagacgtgctcgaggaaggccgcaccaaggtaacagaggagaaccttgatgcggccttccaacctggcggcagcgcaaaagatg

SEQ ID NO: 35954 - DNA, 103 bp, Artificial Sequence
  Synthetic Polynucleotide
taatacgactcactatagggattgtccactagcaggggagggacgagagaaacagaggagatctctcatgcctcccctgaacctggcggcagcgcaaaagatg

SEQ ID NO: 35955 - DNA, 103 bp, Artificial Sequence
  Synthetic Polynucleotide
taatacgactcactatagggtaaaggaaccattgtcagttaagaaattcgaacagaggagacgaattatgtaactgacaaacctggcggcagcgcaaaagatg

SEQ ID NO: 35956 - DNA, 103 bp, Artificial Sequence
  Synthetic Polynucleotide
taatacgactcactatagggggggttgagtattagagcggatacgctactaacagaggagaagtagcatgtccgctctaaacctggcggcagcgcaaaagatg

SEQ ID NO: 35957 - DNA, 103 bp, Artificial Sequence
  Synthetic Polynucleotide
taatacgactcactatagggagataagacctgggaaatgtggtcctagggaacagaggagaccctagatgcacatttccaacctggcggcagcgcaaaagatg

SEQ ID NO: 35958 - DNA, 103 bp, Artificial Sequence
  Synthetic Polynucleotide
taatacgactcactataggggttctagcaggtgccctccaatatgtttggaacagaggagaccaaacatgttggagggcaacctggcggcagcgcaaaagatg

SEQ ID NO: 35959 - DNA, 103 bp, Artificial Sequence
  Synthetic Polynucleotide
taatacgactcactatagggcttacaatgcgtagcgtgaatgttgtatccaacagaggagaggatacatgattcacgctaacctggcggcagcgcaaaagatg

SEQ ID NO: 35960 - DNA, 103 bp, Artificial Sequence
  Synthetic Polynucleotide
taatacgactcactataggggtaacatgtttgcgcagcacagcgcagttgaacagaggagacaactgatgtgtgctgcgaacctggcggcagcgcaaaagatg

SEQ ID NO: 35961 - DNA, 103 bp, Artificial Sequence
  Synthetic Polynucleotide
taatacgactcactataggggcaggaaaggcccattttagccactgggtaaacagaggagatacccaatggctaaaatgaacctggcggcagcgcaaaagatg

SEQ ID NO: 35962 - DNA, 103 bp, Artificial Sequence
  Synthetic Polynucleotide
taatacgactcactatagggactctttttcgtgatgtgccaatcatccataacagaggagaatggatatgtggcacatcaacctggcggcagcgcaaaagatg

SEQ ID NO: 35963 - DNA, 103 bp, Artificial Sequence
  Synthetic Polynucleotide
taatacgactcactataggggttcgacctcagcccgattggtctgagcttaacagaggagaaagctcatgccaatcgggaacctggcggcagcgcaaaagatg

SEQ ID NO: 35964 - DNA, 103 bp, Artificial Sequence
  Synthetic Polynucleotide
taatacgactcactatagggctggcgccatacatctgctaaataatgaacaacagaggagagttcatatgttagcagataacctggcggcagcgcaaaagatg

SEQ ID NO: 35965 - DNA, 103 bp, Artificial Sequence
  Synthetic Polynucleotide
taatacgactcactataggggggctactctcagggctcgcttaggtacgaaacagaggagatcgtacatgagcgagcccaacctggcggcagcgcaaaagatg

SEQ ID NO: 35966 - DNA, 103 bp, Artificial Sequence
  Synthetic Polynucleotide
taatacgactcactatagggccaccaagtccccatttcccaggcgatgggaacagaggagacccatcatgtgggaaatgaacctggcggcagcgcaaaagatg

SEQ ID NO: 35967 - DNA, 103 bp, Artificial Sequence
  Synthetic Polynucleotide
taatacgactcactatagggtttgtcaatcagtctcagggggtctccgttaacagaggagaaacggaatgcccctgagaaacctggcggcagcgcaaaagatg

SEQ ID NO: 35968 - DNA, 103 bp, Artificial Sequence
  Synthetic Polynucleotide
taatacgactcactataggggacgccgagtaatgtaactagagtgttactaacagaggagaagtaacatgctagttacaaacctggcggcagcgcaaaagatg

SEQ ID NO: 35969 - DNA, 103 bp, Artificial Sequence
  Synthetic Polynucleotide
taatacgactcactatagggcgatcacaccgacgggactgtgtctacccgaacagaggagacgggtaatgacagtcccgaacctggcggcagcgcaaaagatg

SEQ ID NO: 35970 - DNA, 103 bp, Artificial Sequence
  Synthetic Polynucleotide
taatacgactcactatagggttaggaaactagacaaatcttccgaagaaaaacagaggagatttcttatgaagatttgtaacctggcggcagcgcaaaagatg

SEQ ID NO: 35971 - DNA, 103 bp, Artificial Sequence
  Synthetic Polynucleotide
taatacgactcactataggggcattcagagcatgtcgctaactgccgttaaacagaggagataacggatgttagcgacaaacctggcggcagcgcaaaagatg

SEQ ID NO: 35972 - DNA, 103 bp, Artificial Sequence
  Synthetic Polynucleotide
taatacgactcactataggggcgaaaacagggcgtcacccgaaagctgtcaacagaggagagacagcatgcgggtgacgaacctggcggcagcgcaaaagatg

SEQ ID NO: 35973 - DNA, 103 bp, Artificial Sequence
  Synthetic Polynucleotide
taatacgactcactatagggggtagacgtggtcggtcagaacttcgacagaacagaggagactgtcgatgttctgaccgaacctggcggcagcgcaaaagatg

SEQ ID NO: 35974 - DNA, 103 bp, Artificial Sequence
  Synthetic Polynucleotide
taatacgactcactatagggtacacatggtaggacatctaaactatttgcaacagaggagagcaaatatgttagatgtcaacctggcggcagcgcaaaagatg

SEQ ID NO: 35975 - DNA, 103 bp, Artificial Sequence
  Synthetic Polynucleotide
taatacgactcactatagggactaaataaatattgatgaggagccatgttaacagaggagaaacatgatgcctcatcaaaacctggcggcagcgcaaaagatg

SEQ ID NO: 35976 - DNA, 103 bp, Artificial Sequence
  Synthetic Polynucleotide
taatacgactcactatagggttgcgattcttccgggtggacgcttgaagtaacagaggagaacttcaatggtccacccgaacctggcggcagcgcaaaagatg

SEQ ID NO: 35977 - DNA, 103 bp, Artificial Sequence
  Synthetic Polynucleotide
taatacgactcactatagggggcctccatttactttattcttcaggttgcaacagaggagagcaaccatgagaataaagaacctggcggcagcgcaaaagatg

SEQ ID NO: 35978 - DNA, 103 bp, Artificial Sequence
  Synthetic Polynucleotide
taatacgactcactatagggagatctataagagaaaattactatgtgtggaacagaggagaccacacatggtaattttcaacctggcggcagcgcaaaagatg

SEQ ID NO: 35979 - DNA, 103 bp, Artificial Sequence
  Synthetic Polynucleotide
taatacgactcactatagggaagtattaatcgtttcagacaggattggcaaacagaggagatgccaaatgtgtctgaaaaacctggcggcagcgcaaaagatg

SEQ ID NO: 35980 - DNA, 103 bp, Artificial Sequence
  Synthetic Polynucleotide
taatacgactcactatagggacacccacaatcttcagtgggctagataataacagaggagaattatcatgcccactgaaaacctggcggcagcgcaaaagatg

SEQ ID NO: 35981 - DNA, 103 bp, Artificial Sequence
  Synthetic Polynucleotide
taatacgactcactatagggcacgaaggccttacgtcttatttcggggccaacagaggagaggccccatgataagacgtaacctggcggcagcgcaaaagatg

SEQ ID NO: 35982 - DNA, 103 bp, Artificial Sequence
  Synthetic Polynucleotide
taatacgactcactatagggggtgattaagggtctgtccgataataggctaacagaggagaagcctaatgtcggacagaaacctggcggcagcgcaaaagatg

SEQ ID NO: 35983 - DNA, 103 bp, Artificial Sequence
  Synthetic Polynucleotide
taatacgactcactatagggatgatttccggatagtaaaattggtggatcaacagaggagagatccaatgattttactaaacctggcggcagcgcaaaagatg

SEQ ID NO: 35984 - DNA, 103 bp, Artificial Sequence
  Synthetic Polynucleotide
taatacgactcactatagggatcgattgcgcgtaggaaacaatgaacctaaacagaggagataggttatgtgtttcctaaacctggcggcagcgcaaaagatg

SEQ ID NO: 35985 - DNA, 103 bp, Artificial Sequence
  Synthetic Polynucleotide
taatacgactcactatagggcgcgctcctgtgtggtggactggactgcaaaacagaggagattgcagatgagtccaccaaacctggcggcagcgcaaaagatg

SEQ ID NO: 35986 - DNA, 103 bp, Artificial Sequence
  Synthetic Polynucleotide
taatacgactcactatagggttacgcccagttatgtgtaaaatcagcaacaacagaggagagttgctatgtttacacataacctggcggcagcgcaaaagatg

SEQ ID NO: 35987 - DNA, 103 bp, Artificial Sequence
  Synthetic Polynucleotide
taatacgactcactatagggagtagggtcaacattgtgctgaactctacgaacagaggagacgtagaatgcagcacaataacctggcggcagcgcaaaagatg

SEQ ID NO: 35988 - DNA, 103 bp, Artificial Sequence
  Synthetic Polynucleotide
taatacgactcactatagggtagccagtaacagcctcatcctattaaaataacagaggagaattttaatgggatgaggcaacctggcggcagcgcaaaagatg

SEQ ID NO: 35989 - DNA, 103 bp, Artificial Sequence
  Synthetic Polynucleotide
taatacgactcactataggggggaaactcgcggttatgcaaaacacttacaacagaggagagtaagtatgttgcataacaacctggcggcagcgcaaaagatg

SEQ ID NO: 35990 - DNA, 103 bp, Artificial Sequence
  Synthetic Polynucleotide
taatacgactcactataggggtgtccccgcacttacaagacggtcgcggtaacagaggagaaccgcgatggtcttgtaaaacctggcggcagcgcaaaagatg

SEQ ID NO: 35991 - DNA, 103 bp, Artificial Sequence
  Synthetic Polynucleotide
taatacgactcactatagggttgacttaagtgcgtcgtaccgtctttgggaacagaggagacccaaaatgggtacgacgaacctggcggcagcgcaaaagatg

SEQ ID NO: 35992 - DNA, 103 bp, Artificial Sequence
  Synthetic Polynucleotide
taatacgactcactatagggctgaggtagcggcacaacactacctaagctaacagaggagaagcttaatgagtgttgtgaacctggcggcagcgcaaaagatg

SEQ ID NO: 35993 - DNA, 103 bp, Artificial Sequence
  Synthetic Polynucleotide
taatacgactcactatagggccataccggactgatatctgaagaatccacaacagaggagagtggatatgtcagatatcaacctggcggcagcgcaaaagatg

SEQ ID NO: 35994 - DNA, 103 bp, Artificial Sequence
  Synthetic Polynucleotide
taatacgactcactatagggaaagtgccagcttcacaccaagagcagtataacagaggagaatactgatgttggtgtgaaacctggcggcagcgcaaaagatg

SEQ ID NO: 35995 - DNA, 103 bp, Artificial Sequence
  Synthetic Polynucleotide
taatacgactcactatagggggtgtgtcatagttggctggtaatgacgataacagaggagaatcgtcatgaccagccaaaacctggcggcagcgcaaaagatg

SEQ ID NO: 35996 - DNA, 103 bp, Artificial Sequence
  Synthetic Polynucleotide
taatacgactcactataggggggtccccagcgcaaggcgtaacactcagtaacagaggagaactgagatgtacgccttgaacctggcggcagcgcaaaagatg

SEQ ID NO: 35997 - DNA, 103 bp, Artificial Sequence
  Synthetic Polynucleotide
taatacgactcactatagggacggccctagaagcactgataaaatttcagaacagaggagactgaaaatgtatcagtgcaacctggcggcagcgcaaaagatg

SEQ ID NO: 35998 - DNA, 103 bp, Artificial Sequence
  Synthetic Polynucleotide
taatacgactcactatagggaggcctttacgaccaccgcaagagagaaccaacagaggagaggttctatgttgcggtggaacctggcggcagcgcaaaagatg

SEQ ID NO: 35999 - DNA, 103 bp, Artificial Sequence
  Synthetic Polynucleotide
taatacgactcactatagggtagcacgcctcttggtttcgtatgcaccagaacagaggagactggtgatgacgaaaccaaacctggcggcagcgcaaaagatg

SEQ ID NO: 36000 - DNA, 103 bp, Artificial Sequence
  Synthetic Polynucleotide
taatacgactcactatagggtagcggtagcgtttacttacggccaagcataacagaggagaatgcttatgcgtaagtaaaacctggcggcagcgcaaaagatg

SEQ ID NO: 36001 - DNA, 103 bp, Artificial Sequence
  Synthetic Polynucleotide
taatacgactcactatagggaggaccctatcttttcggtcccaatcagagaacagaggagactctgaatgggaccgaaaaacctggcggcagcgcaaaagatg

SEQ ID NO: 36002 - DNA, 103 bp, Artificial Sequence
  Synthetic Polynucleotide
taatacgactcactatagggattctgtagcgagagtattacaagggtcagaacagaggagactgaccatggtaatactcaacctggcggcagcgcaaaagatg

SEQ ID NO: 36003 - DNA, 103 bp, Artificial Sequence
  Synthetic Polynucleotide
taatacgactcactataggggttcctctacgaaaaagttgtgacaacagcaacagaggagagctgttatgacaacttttaacctggcggcagcgcaaaagatg

SEQ ID NO: 36004 - DNA, 103 bp, Artificial Sequence
  Synthetic Polynucleotide
taatacgactcactatagggctcggagtcgttgtgggaacctaaaaaatgaacagaggagacattttatgggttcccacaacctggcggcagcgcaaaagatg

SEQ ID NO: 36005 - DNA, 103 bp, Artificial Sequence
  Synthetic Polynucleotide
taatacgactcactataggggataaaataatttacaggcatacccttttcaacagaggagagaaaagatgatgcctgtaaacctggcggcagcgcaaaagatg

SEQ ID NO: 36006 - DNA, 103 bp, Artificial Sequence
  Synthetic Polynucleotide
taatacgactcactatagggcgtgaaacacactgacatttaactatcagcaacagaggagagctgatatgtaaatgtcaaacctggcggcagcgcaaaagatg

SEQ ID NO: 36007 - DNA, 103 bp, Artificial Sequence
  Synthetic Polynucleotide
taatacgactcactatagggtgcgtagaaaatcctggatctgtgagttctaacagaggagaagaactatgagatccaggaacctggcggcagcgcaaaagatg

SEQ ID NO: 36008 - DNA, 103 bp, Artificial Sequence
  Synthetic Polynucleotide
taatacgactcactatagggctccccgctgtatctactcacaataggcgcaacagaggagagcgcctatggtgagtagaaacctggcggcagcgcaaaagatg

SEQ ID NO: 36009 - DNA, 103 bp, Artificial Sequence
  Synthetic Polynucleotide
taatacgactcactatagggggagcggcccgttacccggaacgcctacgcaacagaggagagcgtagatgttccgggtaaacctggcggcagcgcaaaagatg

SEQ ID NO: 36010 - DNA, 103 bp, Artificial Sequence
  Synthetic Polynucleotide
taatacgactcactatagggggggtcgtaagaaacggttgaagaagccttaacagaggagaaaggctatgtcaaccgttaacctggcggcagcgcaaaagatg

SEQ ID NO: 36011 - DNA, 103 bp, Artificial Sequence
  Synthetic Polynucleotide
taatacgactcactatagggggaggtgagcaaccagaccagatatgcctgaacagaggagacaggcaatgctggtctggaacctggcggcagcgcaaaagatg

SEQ ID NO: 36012 - DNA, 103 bp, Artificial Sequence
  Synthetic Polynucleotide
taatacgactcactatagggccggcggctgggcggtgccgcggagggccgaacagaggagacggcccatggcggcaccgaacctggcggcagcgcaaaagatg

SEQ ID NO: 36013 - DNA, 103 bp, Artificial Sequence
  Synthetic Polynucleotide
taatacgactcactatagggtacagcatgtcttggtgaccccagtaggcgaacagaggagacgcctaatggggtcaccaaacctggcggcagcgcaaaagatg

SEQ ID NO: 36014 - DNA, 103 bp, Artificial Sequence
  Synthetic Polynucleotide
taatacgactcactataggggtgcagtagttgaaatggcccccagaaccgaacagaggagacggttcatggggccatttaacctggcggcagcgcaaaagatg

SEQ ID NO: 36015 - DNA, 103 bp, Artificial Sequence
  Synthetic Polynucleotide
taatacgactcactatagggtcccgaaccagaacgtggtgtacatcgtataacagaggagaatacgaatgacaccacgtaacctggcggcagcgcaaaagatg

SEQ ID NO: 36016 - DNA, 103 bp, Artificial Sequence
  Synthetic Polynucleotide
taatacgactcactatagggggcgactatgagcaccctctgacaacgctgaacagaggagacagcgtatgcagagggtgaacctggcggcagcgcaaaagatg

SEQ ID NO: 36017 - DNA, 103 bp, Artificial Sequence
  Synthetic Polynucleotide
taatacgactcactatagggtaaactgacttgacattgccaggtccttccaacagaggagaggaaggatgtggcaatgtaacctggcggcagcgcaaaagatg

SEQ ID NO: 36018 - DNA, 103 bp, Artificial Sequence
  Synthetic Polynucleotide
taatacgactcactatagggttggcgttcttgtactgtggtcacactaaaaacagaggagatttagtatgaccacagtaaacctggcggcagcgcaaaagatg

SEQ ID NO: 36019 - DNA, 103 bp, Artificial Sequence
  Synthetic Polynucleotide
taatacgactcactatagggataaacacggtctcataccgcaggggtttcaacagaggagagaaaccatggcggtatgaaacctggcggcagcgcaaaagatg

SEQ ID NO: 36020 - DNA, 103 bp, Artificial Sequence
  Synthetic Polynucleotide
taatacgactcactatagggggcggagttgcctctattttgataattccaaacagaggagatggaatatgcaaaatagaaacctggcggcagcgcaaaagatg

SEQ ID NO: 36021 - DNA, 103 bp, Artificial Sequence
  Synthetic Polynucleotide
taatacgactcactatagggtagagctcggctatattgctagccaaatcaaacagaggagatgatttatgtagcaatataacctggcggcagcgcaaaagatg

SEQ ID NO: 36022 - DNA, 103 bp, Artificial Sequence
  Synthetic Polynucleotide
taatacgactcactatagggtctaggtagctcaccgtcgttaaatctcagaacagaggagactgagaatgaacgacggtaacctggcggcagcgcaaaagatg

SEQ ID NO: 36023 - DNA, 103 bp, Artificial Sequence
  Synthetic Polynucleotide
taatacgactcactatagggtgcggtaactcagaactcagtagcctgcggaacagaggagaccgcagatgactgagttcaacctggcggcagcgcaaaagatg

SEQ ID NO: 36024 - DNA, 103 bp, Artificial Sequence
  Synthetic Polynucleotide
taatacgactcactatagggatttttggcttaacgaccctaccctggatgaacagaggagacatccaatgtagggtcgtaacctggcggcagcgcaaaagatg

SEQ ID NO: 36025 - DNA, 103 bp, Artificial Sequence
  Synthetic Polynucleotide
taatacgactcactatagggagtcaagatatcgaataaacccaatctgccaacagaggagaggcagaatgggtttattcaacctggcggcagcgcaaaagatg

SEQ ID NO: 36026 - DNA, 103 bp, Artificial Sequence
  Synthetic Polynucleotide
taatacgactcactatagggataccttgtagtttttatctgatgacgaataacagaggagaattcgtatgcagataaaaaacctggcggcagcgcaaaagatg

SEQ ID NO: 36027 - DNA, 103 bp, Artificial Sequence
  Synthetic Polynucleotide
taatacgactcactataggggcatcttctatgacatggtaatcactaaacaacagaggagagtttagatgttaccatgtaacctggcggcagcgcaaaagatg

SEQ ID NO: 36028 - DNA, 103 bp, Artificial Sequence
  Synthetic Polynucleotide
taatacgactcactatagggtgttttctgcttagcggctgctcactattaaacagaggagataatagatggcagccgctaacctggcggcagcgcaaaagatg

SEQ ID NO: 36029 - DNA, 103 bp, Artificial Sequence
  Synthetic Polynucleotide
taatacgactcactataggggcgcaatccttgtttcgtgaacgcacgagaaacagaggagatctcgtatgttcacgaaaaacctggcggcagcgcaaaagatg

SEQ ID NO: 36030 - DNA, 103 bp, Artificial Sequence
  Synthetic Polynucleotide
taatacgactcactatagggtgacgattgcggctggatggagacataaataacagaggagaatttatatgtccatccagaacctggcggcagcgcaaaagatg

SEQ ID NO: 36031 - DNA, 103 bp, Artificial Sequence
  Synthetic Polynucleotide
taatacgactcactatagggtaattcagtagagagaatcgaggtaataaaaacagaggagatttattatgtcgattctcaacctggcggcagcgcaaaagatg

SEQ ID NO: 36032 - DNA, 103 bp, Artificial Sequence
  Synthetic Polynucleotide
taatacgactcactatagggcatcggctccctaagactgagaggctattaaacagaggagataatagatgctcagtcttaacctggcggcagcgcaaaagatg

SEQ ID NO: 36033 - DNA, 103 bp, Artificial Sequence
  Synthetic Polynucleotide
taatacgactcactatagggggtatgtgccgcagctagcgataggagtcgaacagaggagacgactcatgtcgctagctaacctggcggcagcgcaaaagatg

SEQ ID NO: 36034 - DNA, 103 bp, Artificial Sequence
  Synthetic Polynucleotide
taatacgactcactatagggatcgcgtatagcggagccgacatctcgaataacagaggagaattcgaatggtcggctccaacctggcggcagcgcaaaagatg

SEQ ID NO: 36035 - DNA, 103 bp, Artificial Sequence
  Synthetic Polynucleotide
taatacgactcactataggggtccttaagcgcggtcttagcgtaggttagaacagaggagactaaccatggctaagaccaacctggcggcagcgcaaaagatg

SEQ ID NO: 36036 - DNA, 103 bp, Artificial Sequence
  Synthetic Polynucleotide
taatacgactcactatagggaatcagatatcaacgcgagcaatcgttatgaacagaggagacataacatgtgctcgcgtaacctggcggcagcgcaaaagatg

SEQ ID NO: 36037 - DNA, 103 bp, Artificial Sequence
  Synthetic Polynucleotide
taatacgactcactatagggcgcttgcagctcactcataagttatccaagaacagaggagacttggaatgcttatgagtaacctggcggcagcgcaaaagatg

SEQ ID NO: 36038 - DNA, 103 bp, Artificial Sequence
  Synthetic Polynucleotide
taatacgactcactatagggacgccaatcagctccccattgatagagcgcaacagaggagagcgctcatgcaatggggaaacctggcggcagcgcaaaagatg

SEQ ID NO: 36039 - DNA, 103 bp, Artificial Sequence
  Synthetic Polynucleotide
taatacgactcactataggggttgagaggtggcgacccgtagaactactcaacagaggagagagtagatgtacgggtcgaacctggcggcagcgcaaaagatg

SEQ ID NO: 36040 - DNA, 103 bp, Artificial Sequence
  Synthetic Polynucleotide
taatacgactcactatagggtggtctcagtgcgccactcctacaggttataacagaggagaataaccatgaggagtggcaacctggcggcagcgcaaaagatg

SEQ ID NO: 36041 - DNA, 103 bp, Artificial Sequence
  Synthetic Polynucleotide
taatacgactcactatagggaaatatcttgctacgcaccgttaagctatcaacagaggagagatagcatgacggtgcgtaacctggcggcagcgcaaaagatg

SEQ ID NO: 36042 - DNA, 103 bp, Artificial Sequence
  Synthetic Polynucleotide
taatacgactcactatagggctctccggtgctaatcgaatgctgcgatgcaacagaggagagcatcgatgcattcgattaacctggcggcagcgcaaaagatg

SEQ ID NO: 36043 - DNA, 103 bp, Artificial Sequence
  Synthetic Polynucleotide
taatacgactcactatagggccatatagtacaacccctcattccgtcgtgaacagaggagacacgacatgatgaggggtaacctggcggcagcgcaaaagatg

SEQ ID NO: 36044 - DNA, 103 bp, Artificial Sequence
  Synthetic Polynucleotide
taatacgactcactatagggtcaatcgttatagcccgtcgacttcgtacgaacagaggagacgtacgatgtcgacgggcaacctggcggcagcgcaaaagatg

SEQ ID NO: 36045 - DNA, 103 bp, Artificial Sequence
  Synthetic Polynucleotide
taatacgactcactataggggctgtcagtgattctcattaaagtctacggaacagaggagaccgtagatgttaatgagaaacctggcggcagcgcaaaagatg

SEQ ID NO: 36046 - DNA, 103 bp, Artificial Sequence
  Synthetic Polynucleotide
taatacgactcactataggggaacgcgccggtgagcgtgaaatagcaagaaacagaggagatcttgcatgttcacgctcaacctggcggcagcgcaaaagatg

SEQ ID NO: 36047 - DNA, 103 bp, Artificial Sequence
  Synthetic Polynucleotide
taatacgactcactatagggataaactaatggtattgtcatggactatcgaacagaggagacgatagatgatgacaataaacctggcggcagcgcaaaagatg

SEQ ID NO: 36048 - DNA, 103 bp, Artificial Sequence
  Synthetic Polynucleotide
taatacgactcactatagggttgttgcttacttaccggactataccttctaacagaggagaagaaggatgagtccggtaaacctggcggcagcgcaaaagatg

SEQ ID NO: 36049 - DNA, 103 bp, Artificial Sequence
  Synthetic Polynucleotide
taatacgactcactatagggtcaccgccctcgacttggggctcccagatcaacagaggagagatctgatggccccaagtaacctggcggcagcgcaaaagatg

SEQ ID NO: 36050 - DNA, 103 bp, Artificial Sequence
  Synthetic Polynucleotide
taatacgactcactatagggtacctgaccgtaaacgccggatttactattaacagaggagaaatagtatgtccggcgttaacctggcggcagcgcaaaagatg

SEQ ID NO: 36051 - DNA, 103 bp, Artificial Sequence
  Synthetic Polynucleotide
taatacgactcactatagggtatttcgcgcttgaagtagggggcaagcggaacagaggagaccgcttatgccctacttcaacctggcggcagcgcaaaagatg

SEQ ID NO: 36052 - DNA, 103 bp, Artificial Sequence
  Synthetic Polynucleotide
taatacgactcactatagggccgaaagcggtctaatttacacggcgcgcaaacagaggagatgcgcgatgtgtaaattaaacctggcggcagcgcaaaagatg

SEQ ID NO: 36053 - DNA, 103 bp, Artificial Sequence
  Synthetic Polynucleotide
taatacgactcactatagggagagacacatggaaaccccggcctctgagtaacagaggagaactcagatgccggggtttaacctggcggcagcgcaaaagatg

SEQ ID NO: 36054 - DNA, 103 bp, Artificial Sequence
  Synthetic Polynucleotide
taatacgactcactatagggtcgtacatcgggataatccattattgtacaaacagaggagatgtacaatgatggattataacctggcggcagcgcaaaagatg

SEQ ID NO: 36055 - DNA, 103 bp, Artificial Sequence
  Synthetic Polynucleotide
taatacgactcactatagggttatgaaagccatgaatttgattaaaatataacagaggagaatatttatgtcaaattcaaacctggcggcagcgcaaaagatg

SEQ ID NO: 36056 - DNA, 103 bp, Artificial Sequence
  Synthetic Polynucleotide
taatacgactcactataggggggagcataagagctgtgagtgaccactgaaacagaggagatcagtgatgactcacagcaacctggcggcagcgcaaaagatg

SEQ ID NO: 36057 - DNA, 103 bp, Artificial Sequence
  Synthetic Polynucleotide
taatacgactcactatagggacgtcgaagcaggacaacgaccgatcattaaacagaggagataatgaatggtcgttgtcaacctggcggcagcgcaaaagatg

SEQ ID NO: 36058 - DNA, 103 bp, Artificial Sequence
  Synthetic Polynucleotide
taatacgactcactatagggcgacgagagaataaccaggatgttttgatcaacagaggagagatcaaatgatcctggttaacctggcggcagcgcaaaagatg

SEQ ID NO: 36059 - DNA, 103 bp, Artificial Sequence
  Synthetic Polynucleotide
taatacgactcactataggggtcgatggcaggctcttacaccggcgacaaaacagaggagattgtcgatggtgtaagagaacctggcggcagcgcaaaagatg

SEQ ID NO: 36060 - DNA, 103 bp, Artificial Sequence
  Synthetic Polynucleotide
taatacgactcactatagggctatcttttttttatcgtcactgctcttgcaacagaggagagcaagaatggtgacgataaacctggcggcagcgcaaaagatg

SEQ ID NO: 36061 - DNA, 103 bp, Artificial Sequence
  Synthetic Polynucleotide
taatacgactcactatagggtacgtggtgccgagacctggacagaggtccaacagaggagaggacctatgtccaggtctaacctggcggcagcgcaaaagatg

SEQ ID NO: 36062 - DNA, 103 bp, Artificial Sequence
  Synthetic Polynucleotide
taatacgactcactatagggacccgtcttgtccgagctaacttctggaggaacagaggagacctccaatggttagctcgaacctggcggcagcgcaaaagatg

SEQ ID NO: 36063 - DNA, 103 bp, Artificial Sequence
  Synthetic Polynucleotide
taatacgactcactatagggagggggcacgatttggagcatacctcgcctaacagaggagaaggcgaatgatgctccaaaacctggcggcagcgcaaaagatg

SEQ ID NO: 36064 - DNA, 103 bp, Artificial Sequence
  Synthetic Polynucleotide
taatacgactcactatagggtatttacgcctagacgccaccatatcggtgaacagaggagacaccgaatgggtggcgtcaacctggcggcagcgcaaaagatg

SEQ ID NO: 36065 - DNA, 103 bp, Artificial Sequence
  Synthetic Polynucleotide
taatacgactcactatagggacaagcagccactaatcatgtgggtggctaaacagaggagatagccaatgacatgattaaacctggcggcagcgcaaaagatg

SEQ ID NO: 36066 - DNA, 103 bp, Artificial Sequence
  Synthetic Polynucleotide
taatacgactcactatagggatgccagaagtcggatcgatatgatagtcgaacagaggagacgactaatgtatcgatccaacctggcggcagcgcaaaagatg

SEQ ID NO: 36067 - DNA, 103 bp, Artificial Sequence
  Synthetic Polynucleotide
taatacgactcactatagggtaagaattccagcaaactcctcttcttgctaacagaggagaagcaagatgaggagtttgaacctggcggcagcgcaaaagatg

SEQ ID NO: 36068 - DNA, 103 bp, Artificial Sequence
  Synthetic Polynucleotide
taatacgactcactatagggcgttataactacgttaggtggaagtggcggaacagaggagaccgccaatgccacctaacaacctggcggcagcgcaaaagatg

SEQ ID NO: 36069 - DNA, 103 bp, Artificial Sequence
  Synthetic Polynucleotide
taatacgactcactatagggagaagacgcctggggtttaactccatacccaacagaggagagggtatatggttaaacccaacctggcggcagcgcaaaagatg

SEQ ID NO: 36070 - DNA, 103 bp, Artificial Sequence
  Synthetic Polynucleotide
taatacgactcactatagggcacaggcgacgcgtagatacgttgcgtaataacagaggagaattacgatgcgtatctacaacctggcggcagcgcaaaagatg

SEQ ID NO: 36071 - DNA, 103 bp, Artificial Sequence
  Synthetic Polynucleotide
taatacgactcactatagggcatgaggtcgacactattgccacactaagaaacagaggagatcttagatgggcaatagtaacctggcggcagcgcaaaagatg

SEQ ID NO: 36072 - DNA, 103 bp, Artificial Sequence
  Synthetic Polynucleotide
taatacgactcactatagggcggcaatttcccaagtggacaggagtttagaacagaggagactaaacatgtgtccacttaacctggcggcagcgcaaaagatg

SEQ ID NO: 36073 - DNA, 103 bp, Artificial Sequence
  Synthetic Polynucleotide
taatacgactcactataggggagccaccggtgggacgactaatgtactctaacagaggagaagagtaatgtagtcgtccaacctggcggcagcgcaaaagatg

SEQ ID NO: 36074 - DNA, 103 bp, Artificial Sequence
  Synthetic Polynucleotide
taatacgactcactatagggctaatcagtaccccatcgccagctcggtgtaacagaggagaacaccgatgtggcgatggaacctggcggcagcgcaaaagatg

SEQ ID NO: 36075 - DNA, 103 bp, Artificial Sequence
  Synthetic Polynucleotide
taatacgactcactatagggttgttcgtctcttggttaaggactaacaataacagaggagaattgttatgccttaaccaaacctggcggcagcgcaaaagatg

SEQ ID NO: 36076 - DNA, 103 bp, Artificial Sequence
  Synthetic Polynucleotide
taatacgactcactatagggaggaggagtgaggatgtagtctagatgtataacagaggagaatacatatggactacatcaacctggcggcagcgcaaaagatg

SEQ ID NO: 36077 - DNA, 103 bp, Artificial Sequence
  Synthetic Polynucleotide
taatacgactcactataggggtagccttcacgtattcgacggatggagtcaacagaggagagactccatgcgtcgaataaacctggcggcagcgcaaaagatg

SEQ ID NO: 36078 - DNA, 103 bp, Artificial Sequence
  Synthetic Polynucleotide
taatacgactcactataggggcaaacctcggcaagcttctccgggacggcaacagaggagagccgtcatggagaagcttaacctggcggcagcgcaaaagatg

SEQ ID NO: 36079 - DNA, 103 bp, Artificial Sequence
  Synthetic Polynucleotide
taatacgactcactatagggagccgtcaagacattgagctttcggttggaaacagaggagatccaacatgaagctcaataacctggcggcagcgcaaaagatg

SEQ ID NO: 36080 - DNA, 103 bp, Artificial Sequence
  Synthetic Polynucleotide
taatacgactcactatagggaaaatgtacaccgtcgttagccggtgacctaacagaggagaaggtcaatggctaacgacaacctggcggcagcgcaaaagatg

SEQ ID NO: 36081 - DNA, 103 bp, Artificial Sequence
  Synthetic Polynucleotide
taatacgactcactatagggaatgcagggtcataatttcataccaaatgtaacagaggagaacatttatgatgaaattaaacctggcggcagcgcaaaagatg

SEQ ID NO: 36082 - DNA, 103 bp, Artificial Sequence
  Synthetic Polynucleotide
taatacgactcactatagggatatccttccaatactcgcatccttatctcaacagaggagagagataatgatgcgagtaaacctggcggcagcgcaaaagatg

SEQ ID NO: 36083 - DNA, 103 bp, Artificial Sequence
  Synthetic Polynucleotide
taatacgactcactatagggggacgaagcccgctagatgagacacgggtaaacagaggagatacccgatgctcatctagaacctggcggcagcgcaaaagatg

SEQ ID NO: 36084 - DNA, 103 bp, Artificial Sequence
  Synthetic Polynucleotide
taatacgactcactatagggtccaaccgctcgaatatacacgcatactacaacagaggagagtagtaatggtgtatattaacctggcggcagcgcaaaagatg

SEQ ID NO: 36085 - DNA, 103 bp, Artificial Sequence
  Synthetic Polynucleotide
taatacgactcactataggggaactagaagccaccatctttaaatcagcaaacagaggagatgctgaatgaaagatggtaacctggcggcagcgcaaaagatg

SEQ ID NO: 36086 - DNA, 103 bp, Artificial Sequence
  Synthetic Polynucleotide
taatacgactcactatagggatacacgtcggcagtgtaaatgtatttggaaacagaggagatccaaaatgatttacactaacctggcggcagcgcaaaagatg

SEQ ID NO: 36087 - DNA, 103 bp, Artificial Sequence
  Synthetic Polynucleotide
taatacgactcactatagggtgggattcctgcgttcgccacgcgatatctaacagaggagaagatatatggtggcgaacaacctggcggcagcgcaaaagatg

SEQ ID NO: 36088 - DNA, 103 bp, Artificial Sequence
  Synthetic Polynucleotide
taatacgactcactataggggtccccagtgccacggctctcacccatgccaacagaggagaggcatgatggagagccgtaacctggcggcagcgcaaaagatg

SEQ ID NO: 36089 - DNA, 103 bp, Artificial Sequence
  Synthetic Polynucleotide
taatacgactcactatagggctgggacactcgtcatttaccaaacggagaaacagaggagatctccgatgggtaaatgaaacctggcggcagcgcaaaagatg

SEQ ID NO: 36090 - DNA, 103 bp, Artificial Sequence
  Synthetic Polynucleotide
taatacgactcactatagggccggcattggggattattcctgattttgggaacagaggagacccaaaatgaggaataataacctggcggcagcgcaaaagatg

SEQ ID NO: 36091 - DNA, 103 bp, Artificial Sequence
  Synthetic Polynucleotide
taatacgactcactatagggttgcaacaaggccgtcgtgtgggcgtctccaacagaggagaggagacatgcacacgacgaacctggcggcagcgcaaaagatg

SEQ ID NO: 36092 - DNA, 103 bp, Artificial Sequence
  Synthetic Polynucleotide
taatacgactcactataggggccagctcccggatcgttcgtagcctttgcaacagaggagagcaaagatgacgaacgataacctggcggcagcgcaaaagatg

SEQ ID NO: 36093 - DNA, 103 bp, Artificial Sequence
  Synthetic Polynucleotide
taatacgactcactatagggtactcgaggaaaaccggcactaaggcgagaaacagaggagatctcgcatgagtgccggtaacctggcggcagcgcaaaagatg

SEQ ID NO: 36094 - DNA, 103 bp, Artificial Sequence
  Synthetic Polynucleotide
taatacgactcactatagggtctctccacgttcccaatgcgagtgatctgaacagaggagacagatcatgcgcattgggaacctggcggcagcgcaaaagatg

SEQ ID NO: 36095 - DNA, 103 bp, Artificial Sequence
  Synthetic Polynucleotide
taatacgactcactataggggtgcgagtcggcaaccgtctccacagattgaacagaggagacaatctatggagacggttaacctggcggcagcgcaaaagatg

SEQ ID NO: 36096 - DNA, 103 bp, Artificial Sequence
  Synthetic Polynucleotide
taatacgactcactatagggtcccgataaagctcctagtttaccatctgtaacagaggagaacagatatgaaactaggaaacctggcggcagcgcaaaagatg

SEQ ID NO: 36097 - DNA, 103 bp, Artificial Sequence
  Synthetic Polynucleotide
taatacgactcactatagggattctactaggtgtatttctacgagaaataaacagaggagatatttcatgtagaaatacaacctggcggcagcgcaaaagatg

SEQ ID NO: 36098 - DNA, 103 bp, Artificial Sequence
  Synthetic Polynucleotide
taatacgactcactataggggacacgccatgtgccaatgacccactgggcaacagaggagagcccagatggtcattggcaacctggcggcagcgcaaaagatg

SEQ ID NO: 36099 - DNA, 103 bp, Artificial Sequence
  Synthetic Polynucleotide
taatacgactcactatagggtacggtcggcgtccctctaattcaacaaccaacagaggagaggttgtatgattagagggaacctggcggcagcgcaaaagatg

SEQ ID NO: 36100 - DNA, 103 bp, Artificial Sequence
  Synthetic Polynucleotide
taatacgactcactataggggacagtgcaaccaaggcatatgacacggctaacagaggagaagccgtatgatatgccttaacctggcggcagcgcaaaagatg

SEQ ID NO: 36101 - DNA, 103 bp, Artificial Sequence
  Synthetic Polynucleotide
taatacgactcactatagggggctgcgaagcgttcgcggcacgcaagtgaaacagaggagatcacttatgtgccgcgaaaacctggcggcagcgcaaaagatg

SEQ ID NO: 36102 - DNA, 103 bp, Artificial Sequence
  Synthetic Polynucleotide
taatacgactcactatagggacacgcccgcgcccgcagaaaacaattcccaacagaggagagggaatatgtttctgcggaacctggcggcagcgcaaaagatg

SEQ ID NO: 36103 - DNA, 103 bp, Artificial Sequence
  Synthetic Polynucleotide
taatacgactcactatagggacaatggctaaaactcaagaaactacaggaaacagaggagatcctgtatgttcttgagtaacctggcggcagcgcaaaagatg

SEQ ID NO: 36104 - DNA, 103 bp, Artificial Sequence
  Synthetic Polynucleotide
taatacgactcactatagggtgatccggagtttaataccaaactatccacaacagaggagagtggatatgttggtattaaacctggcggcagcgcaaaagatg

SEQ ID NO: 36105 - DNA, 103 bp, Artificial Sequence
  Synthetic Polynucleotide
taatacgactcactatagggctaccgtttctgcaagccgtagtattaaggaacagaggagaccttaaatgtacggcttgaacctggcggcagcgcaaaagatg

SEQ ID NO: 36106 - DNA, 103 bp, Artificial Sequence
  Synthetic Polynucleotide
taatacgactcactatagggtgtctagtatataagtccctagtatcgccgaacagaggagacggcgaatgtagggacttaacctggcggcagcgcaaaagatg

SEQ ID NO: 36107 - DNA, 103 bp, Artificial Sequence
  Synthetic Polynucleotide
taatacgactcactataggggctcactaagtaacattgaccacagaccacaacagaggagagtggtcatgggtcaatgtaacctggcggcagcgcaaaagatg

SEQ ID NO: 36108 - DNA, 103 bp, Artificial Sequence
  Synthetic Polynucleotide
taatacgactcactatagggtggtgcctggtactccacgagacactgatcaacagaggagagatcagatgctcgtggagaacctggcggcagcgcaaaagatg

SEQ ID NO: 36109 - DNA, 103 bp, Artificial Sequence
  Synthetic Polynucleotide
taatacgactcactatagggcgctcgaataattcctcatcccccctgctgaacagaggagacagcagatgggatgaggaaacctggcggcagcgcaaaagatg

SEQ ID NO: 36110 - DNA, 103 bp, Artificial Sequence
  Synthetic Polynucleotide
taatacgactcactataggggcgctcattcctcgggcagcgcgttggcccaacagaggagagggccaatgcgctgcccgaacctggcggcagcgcaaaagatg

SEQ ID NO: 36111 - DNA, 103 bp, Artificial Sequence
  Synthetic Polynucleotide
taatacgactcactatagggaccaggggcgctactggtggcggggtcggtaacagaggagaaccgacatggccaccagtaacctggcggcagcgcaaaagatg

SEQ ID NO: 36112 - DNA, 103 bp, Artificial Sequence
  Synthetic Polynucleotide
taatacgactcactatagggcctaaacgcatcctctggctaaaacttccaaacagaggagatggaagatgtagccagagaacctggcggcagcgcaaaagatg

SEQ ID NO: 36113 - DNA, 103 bp, Artificial Sequence
  Synthetic Polynucleotide
taatacgactcactataggggctgcattctcggttggcacagaaggtgagaacagaggagactcaccatgtgtgccaacaacctggcggcagcgcaaaagatg

SEQ ID NO: 36114 - DNA, 103 bp, Artificial Sequence
  Synthetic Polynucleotide
taatacgactcactatagggtatgtccctctactacgttatatgaaacttaacagaggagaaagtttatgataacgtagaacctggcggcagcgcaaaagatg

SEQ ID NO: 36115 - DNA, 103 bp, Artificial Sequence
  Synthetic Polynucleotide
taatacgactcactatagggctgtgtgttagctacgatctgatacgatgtaacagaggagaacatcgatgcagatcgtaaacctggcggcagcgcaaaagatg

SEQ ID NO: 36116 - DNA, 103 bp, Artificial Sequence
  Synthetic Polynucleotide
taatacgactcactatagggatttacccagcagctaggacacaataacctaacagaggagaaggttaatgtgtcctagcaacctggcggcagcgcaaaagatg

SEQ ID NO: 36117 - DNA, 103 bp, Artificial Sequence
  Synthetic Polynucleotide
taatacgactcactatagggcttgctgtagccggcgctagaggcaccaaaaacagaggagatttggtatgtctagcgccaacctggcggcagcgcaaaagatg

SEQ ID NO: 36118 - DNA, 103 bp, Artificial Sequence
  Synthetic Polynucleotide
taatacgactcactatagggtcagactagataaaagatgttgagccctacaacagaggagagtagggatgaacatctttaacctggcggcagcgcaaaagatg

SEQ ID NO: 36119 - DNA, 103 bp, Artificial Sequence
  Synthetic Polynucleotide
taatacgactcactataggggatatatccgcaatatactggagacatcaaaacagaggagattgatgatgccagtatataacctggcggcagcgcaaaagatg

SEQ ID NO: 36120 - DNA, 103 bp, Artificial Sequence
  Synthetic Polynucleotide
taatacgactcactatagggcatctgataccgctggtacgacctgggtacaacagaggagagtacccatgtcgtaccagaacctggcggcagcgcaaaagatg

SEQ ID NO: 36121 - DNA, 103 bp, Artificial Sequence
  Synthetic Polynucleotide
taatacgactcactatagggtcgcggggcagtttgtcaagaagacctgtaaacagaggagatacaggatgtcttgacaaaacctggcggcagcgcaaaagatg

SEQ ID NO: 36122 - DNA, 103 bp, Artificial Sequence
  Synthetic Polynucleotide
taatacgactcactatagggacgccgagatgtttacgggaactcttgcgtaacagaggagaacgcaaatgttcccgtaaaacctggcggcagcgcaaaagatg

SEQ ID NO: 36123 - DNA, 103 bp, Artificial Sequence
  Synthetic Polynucleotide
taatacgactcactatagggaaggcgtcaatcctatcgactagtagtagtaacagaggagaactactatgagtcgatagaacctggcggcagcgcaaaagatg

SEQ ID NO: 36124 - DNA, 103 bp, Artificial Sequence
  Synthetic Polynucleotide
taatacgactcactatagggcaacgactcaagctgacgaacccgagttcgaacagaggagacgaactatggttcgtcagaacctggcggcagcgcaaaagatg

SEQ ID NO: 36125 - DNA, 103 bp, Artificial Sequence
  Synthetic Polynucleotide
taatacgactcactatagggagtttatcaacgcgcgcttttcattctgtgaacagaggagacacagaatgaaaagcgcgaacctggcggcagcgcaaaagatg

SEQ ID NO: 36126 - DNA, 103 bp, Artificial Sequence
  Synthetic Polynucleotide
taatacgactcactataggggcctgcgaagataattcttgtgattccgttaacagaggagaaacggaatgacaagaattaacctggcggcagcgcaaaagatg

SEQ ID NO: 36127 - DNA, 103 bp, Artificial Sequence
  Synthetic Polynucleotide
taatacgactcactatagggccacccctcatcgctatccgagcgctcgaaaacagaggagattcgagatgtcggatagcaacctggcggcagcgcaaaagatg

SEQ ID NO: 36128 - DNA, 103 bp, Artificial Sequence
  Synthetic Polynucleotide
taatacgactcactatagggctcttagggaatagtcacgttacatctaaaaacagaggagatttagaatgaacgtgactaacctggcggcagcgcaaaagatg

SEQ ID NO: 36129 - DNA, 103 bp, Artificial Sequence
  Synthetic Polynucleotide
taatacgactcactatagggagatattggcgacaggggacttgcagctttaacagaggagaaaagctatgagtcccctgaacctggcggcagcgcaaaagatg

SEQ ID NO: 36130 - DNA, 103 bp, Artificial Sequence
  Synthetic Polynucleotide
taatacgactcactatagggagggaactgagcacgactggcgctatcgcaaacagaggagatgcgatatggccagtcgtaacctggcggcagcgcaaaagatg

SEQ ID NO: 36131 - DNA, 103 bp, Artificial Sequence
  Synthetic Polynucleotide
taatacgactcactatagggtgttttaaggtaagaattgcacacctgatcaacagaggagagatcagatgtgcaattctaacctggcggcagcgcaaaagatg

SEQ ID NO: 36132 - DNA, 103 bp, Artificial Sequence
  Synthetic Polynucleotide
taatacgactcactatagggccaggcccgaggatctgatccgttaacaagaacagaggagacttgttatgggatcagataacctggcggcagcgcaaaagatg

SEQ ID NO: 36133 - DNA, 103 bp, Artificial Sequence
  Synthetic Polynucleotide
taatacgactcactatagggttgcctctccggccaattcgcaagaaatggaacagaggagaccatttatggcgaattggaacctggcggcagcgcaaaagatg

SEQ ID NO: 36134 - DNA, 103 bp, Artificial Sequence
  Synthetic Polynucleotide
taatacgactcactatagggttcggggtgctaccactccatgcatctctgaacagaggagacagagaatgatggagtggaacctggcggcagcgcaaaagatg

SEQ ID NO: 36135 - DNA, 103 bp, Artificial Sequence
  Synthetic Polynucleotide
taatacgactcactatagggtcctcagaagaataatgacaaacattacgtaacagaggagaacgtaaatgttgtcattaaacctggcggcagcgcaaaagatg

SEQ ID NO: 36136 - DNA, 103 bp, Artificial Sequence
  Synthetic Polynucleotide
taatacgactcactatagggatttacgagtcttcacacagtcaggcgattaacagaggagaaatcgcatgactgtgtgaaacctggcggcagcgcaaaagatg

SEQ ID NO: 36137 - DNA, 103 bp, Artificial Sequence
  Synthetic Polynucleotide
taatacgactcactataggggtcctgaacacggggagttgttgactttagaacagaggagactaaagatgacaactcccaacctggcggcagcgcaaaagatg

SEQ ID NO: 36138 - DNA, 103 bp, Artificial Sequence
  Synthetic Polynucleotide
taatacgactcactatagggctgtgcctaaccgctctaaccttacgctgtaacagaggagaacagcgatgggttagagcaacctggcggcagcgcaaaagatg

SEQ ID NO: 36139 - DNA, 103 bp, Artificial Sequence
  Synthetic Polynucleotide
taatacgactcactataggggagcccagggttgtatgccaagaaagtgggaacagaggagacccactatgttggcatacaacctggcggcagcgcaaaagatg

SEQ ID NO: 36140 - DNA, 103 bp, Artificial Sequence
  Synthetic Polynucleotide
taatacgactcactatagggtgtatgggacacttcctgggctcagagtgcaacagaggagagcactcatggcccaggaaaacctggcggcagcgcaaaagatg

SEQ ID NO: 36141 - DNA, 103 bp, Artificial Sequence
  Synthetic Polynucleotide
taatacgactcactataggggccaggctcattattaacgccacatcagataacagaggagaatctgaatgggcgttaataacctggcggcagcgcaaaagatg

SEQ ID NO: 36142 - DNA, 103 bp, Artificial Sequence
  Synthetic Polynucleotide
taatacgactcactatagggagcaagccggattggagatcatgttggcgaaacagaggagatcgccaatgtgatctccaaacctggcggcagcgcaaaagatg

SEQ ID NO: 36143 - DNA, 103 bp, Artificial Sequence
  Synthetic Polynucleotide
taatacgactcactatagggtagtacctcaataactcaggcgccaacgtcaacagaggagagacgttatggcctgagttaacctggcggcagcgcaaaagatg

SEQ ID NO: 36144 - DNA, 103 bp, Artificial Sequence
  Synthetic Polynucleotide
taatacgactcactatagggttcgagcagttctaaataatagttagcttaaacagaggagataagctatgtattatttaaacctggcggcagcgcaaaagatg

SEQ ID NO: 36145 - DNA, 103 bp, Artificial Sequence
  Synthetic Polynucleotide
taatacgactcactataggggctcacagaacgtcttcatgtaaagacgttaacagaggagaaacgtcatgacatgaagaaacctggcggcagcgcaaaagatg

SEQ ID NO: 36146 - DNA, 103 bp, Artificial Sequence
  Synthetic Polynucleotide
taatacgactcactataggggggattcaagcgccttcgggtctaatctaaaacagaggagattagatatgacccgaaggaacctggcggcagcgcaaaagatg

SEQ ID NO: 36147 - DNA, 103 bp, Artificial Sequence
  Synthetic Polynucleotide
taatacgactcactatagggagtaacaacgcaggggtggtctggtggtggaacagaggagaccaccaatggaccaccccaacctggcggcagcgcaaaagatg

SEQ ID NO: 36148 - DNA, 103 bp, Artificial Sequence
  Synthetic Polynucleotide
taatacgactcactatagggattggtgttagctatggtggcaagagttttaacagaggagaaaaactatggccaccataaacctggcggcagcgcaaaagatg

SEQ ID NO: 36149 - DNA, 103 bp, Artificial Sequence
  Synthetic Polynucleotide
taatacgactcactatagggggagggcagcttatgtactctccacgtcataacagaggagaatgacgatgagagtacataacctggcggcagcgcaaaagatg

SEQ ID NO: 36150 - DNA, 103 bp, Artificial Sequence
  Synthetic Polynucleotide
taatacgactcactataggggcaagttgaagcagtaactgataacgatggaacagaggagaccatcgatgtcagttactaacctggcggcagcgcaaaagatg

SEQ ID NO: 36151 - DNA, 103 bp, Artificial Sequence
  Synthetic Polynucleotide
taatacgactcactatagggaagacttcaggtacctgtagcgtcctcacaaacagaggagatgtgagatggctacaggtaacctggcggcagcgcaaaagatg

SEQ ID NO: 36152 - DNA, 103 bp, Artificial Sequence
  Synthetic Polynucleotide
taatacgactcactatagggggtgtccctatcggcagggcatcttaagaaaacagaggagattcttaatgtgccctgccaacctggcggcagcgcaaaagatg

SEQ ID NO: 36153 - DNA, 103 bp, Artificial Sequence
  Synthetic Polynucleotide
taatacgactcactataggggaaggccaatgccaccgcgttccacttgacaacagaggagagtcaagatgaacgcggtgaacctggcggcagcgcaaaagatg

SEQ ID NO: 36154 - DNA, 103 bp, Artificial Sequence
  Synthetic Polynucleotide
taatacgactcactataggggtggttaacgaacctagctcttcccggctgaacagaggagacagccgatgagagctaggaacctggcggcagcgcaaaagatg

SEQ ID NO: 36155 - DNA, 103 bp, Artificial Sequence
  Synthetic Polynucleotide
taatacgactcactatagggaaagtacatccagctcgcgcgtatgtgaataacagaggagaattcacatgcgcgcgagcaacctggcggcagcgcaaaagatg

SEQ ID NO: 36156 - DNA, 103 bp, Artificial Sequence
  Synthetic Polynucleotide
taatacgactcactatagggcagtactcatagtgtatggggttaagtgctaacagaggagaagcactatgccccatacaaacctggcggcagcgcaaaagatg

SEQ ID NO: 36157 - DNA, 103 bp, Artificial Sequence
  Synthetic Polynucleotide
taatacgactcactataggggcgtccgtcgcccccccatgctcagtaccgaacagaggagacggtacatggcatgggggaacctggcggcagcgcaaaagatg

SEQ ID NO: 36158 - DNA, 103 bp, Artificial Sequence
  Synthetic Polynucleotide
taatacgactcactatagggttgggggtgtgatttcgcctggtaaagtgcaacagaggagagcacttatgcaggcgaaaaacctggcggcagcgcaaaagatg

SEQ ID NO: 36159 - DNA, 103 bp, Artificial Sequence
  Synthetic Polynucleotide
taatacgactcactatagggcctgcgcgtctacgataaagtataaatcagaacagaggagactgattatgactttatcgaacctggcggcagcgcaaaagatg

SEQ ID NO: 36160 - DNA, 103 bp, Artificial Sequence
  Synthetic Polynucleotide
taatacgactcactataggggaacgtaactgaagccttacacatatggtgaacagaggagacaccatatgtgtaaggctaacctggcggcagcgcaaaagatg

SEQ ID NO: 36161 - DNA, 103 bp, Artificial Sequence
  Synthetic Polynucleotide
taatacgactcactatagggcttataggtaggacagttgcagacgcgagtaacagaggagaactcgcatgtgcaactgtaacctggcggcagcgcaaaagatg

SEQ ID NO: 36162 - DNA, 103 bp, Artificial Sequence
  Synthetic Polynucleotide
taatacgactcactatagggaagagagcgacggtgcgatctgcagaaccgaacagaggagacggttcatgagatcgcacaacctggcggcagcgcaaaagatg

SEQ ID NO: 36163 - DNA, 103 bp, Artificial Sequence
  Synthetic Polynucleotide
taatacgactcactatagggataacgaacgtgccccaaactctttaccaaaacagaggagattggtaatgagtttggggaacctggcggcagcgcaaaagatg

SEQ ID NO: 36164 - DNA, 103 bp, Artificial Sequence
  Synthetic Polynucleotide
taatacgactcactatagggctatcaaccgcccgtcaggataaatggagcaacagaggagagctccaatgatcctgacgaacctggcggcagcgcaaaagatg

SEQ ID NO: 36165 - DNA, 103 bp, Artificial Sequence
  Synthetic Polynucleotide
taatacgactcactatagggacgtttacgctccccccgatagcgggcttcaacagaggagagaagccatgtatcgggggaacctggcggcagcgcaaaagatg

SEQ ID NO: 36166 - DNA, 103 bp, Artificial Sequence
  Synthetic Polynucleotide
taatacgactcactatagggggtatttcggtggtcgaggacagaaccgttaacagaggagaaacggtatggtcctcgacaacctggcggcagcgcaaaagatg

SEQ ID NO: 36167 - DNA, 103 bp, Artificial Sequence
  Synthetic Polynucleotide
taatacgactcactatagggctgtgttcgcaggagcttaaccgccgctcaaacagaggagatgagcgatggttaagctcaacctggcggcagcgcaaaagatg

SEQ ID NO: 36168 - DNA, 103 bp, Artificial Sequence
  Synthetic Polynucleotide
taatacgactcactataggggtcaagggaataagcgtctaagaggctttaaacagaggagataaagcatgttagacgctaacctggcggcagcgcaaaagatg

SEQ ID NO: 36169 - DNA, 103 bp, Artificial Sequence
  Synthetic Polynucleotide
taatacgactcactatagggcccagatcttgcaatgcgtaatataacggaaacagaggagatccgttatgttacgcattaacctggcggcagcgcaaaagatg

SEQ ID NO: 36170 - DNA, 103 bp, Artificial Sequence
  Synthetic Polynucleotide
taatacgactcactataggggcgtgctgatgtgagttagaaggcatgataaacagaggagatatcatatgttctaactcaacctggcggcagcgcaaaagatg

SEQ ID NO: 36171 - DNA, 103 bp, Artificial Sequence
  Synthetic Polynucleotide
taatacgactcactatagggttacgtggctgagtggtagacgcacgactgaacagaggagacagtcgatggtctaccacaacctggcggcagcgcaaaagatg

SEQ ID NO: 36172 - DNA, 103 bp, Artificial Sequence
  Synthetic Polynucleotide
taatacgactcactatagggatgtcttctcgcgagtttaccatggtctgtaacagaggagaacagacatgggtaaactcaacctggcggcagcgcaaaagatg

SEQ ID NO: 36173 - DNA, 103 bp, Artificial Sequence
  Synthetic Polynucleotide
taatacgactcactatagggtgctgacaccaatgggaagagacccccctcaacagaggagagaggggatgctcttcccaaacctggcggcagcgcaaaagatg

SEQ ID NO: 36174 - DNA, 103 bp, Artificial Sequence
  Synthetic Polynucleotide
taatacgactcactatagggtttagtaatacgtatcagttgggcaggctcaacagaggagagagcctatgcaactgataaacctggcggcagcgcaaaagatg

SEQ ID NO: 36175 - DNA, 103 bp, Artificial Sequence
  Synthetic Polynucleotide
taatacgactcactataggggtatgcgaaaagatttgagcgaggcgagagaacagaggagactctcgatgcgctcaaataacctggcggcagcgcaaaagatg

SEQ ID NO: 36176 - DNA, 103 bp, Artificial Sequence
  Synthetic Polynucleotide
taatacgactcactatagggcgaacactcgaatccaccactcctgatggaaacagaggagatccatcatgagtggtggaaacctggcggcagcgcaaaagatg

SEQ ID NO: 36177 - DNA, 103 bp, Artificial Sequence
  Synthetic Polynucleotide
taatacgactcactatagggtgggtagaccgcttccgggcgaaacgacttaacagaggagaaagtcgatgcgcccggaaaacctggcggcagcgcaaaagatg

SEQ ID NO: 36178 - DNA, 103 bp, Artificial Sequence
  Synthetic Polynucleotide
taatacgactcactatagggtacatgctttatcgtatcctcacactacttaacagaggagaaagtagatggaggatacgaacctggcggcagcgcaaaagatg

SEQ ID NO: 36179 - DNA, 103 bp, Artificial Sequence
  Synthetic Polynucleotide
taatacgactcactatagggaaaaccctagctcggtttcgatcagacgcaaacagaggagatgcgtcatgtcgaaaccgaacctggcggcagcgcaaaagatg

SEQ ID NO: 36180 - DNA, 103 bp, Artificial Sequence
  Synthetic Polynucleotide
taatacgactcactatagggcttcaatgtactcataagtcggggaggctgaacagaggagacagcctatgcgacttatgaacctggcggcagcgcaaaagatg

SEQ ID NO: 36181 - DNA, 103 bp, Artificial Sequence
  Synthetic Polynucleotide
taatacgactcactataggggatagctaatagagacgacgtatctaccgaaacagaggagatcggtaatgacgtcgtctaacctggcggcagcgcaaaagatg

SEQ ID NO: 36182 - DNA, 103 bp, Artificial Sequence
  Synthetic Polynucleotide
taatacgactcactatagggccacacatcatttggagagtaccgggttataacagaggagaataaccatgtactctccaaacctggcggcagcgcaaaagatg

SEQ ID NO: 36183 - DNA, 103 bp, Artificial Sequence
  Synthetic Polynucleotide
taatacgactcactatagggtggcatggcgcgggacagcgacgcaacgtgaacagaggagacacgttatgtcgctgtccaacctggcggcagcgcaaaagatg

SEQ ID NO: 36184 - DNA, 103 bp, Artificial Sequence
  Synthetic Polynucleotide
taatacgactcactatagggcggctcggagatacgtgtgcgcgtattttcaacagaggagagaaaatatgcgcacacgtaacctggcggcagcgcaaaagatg

SEQ ID NO: 36185 - DNA, 103 bp, Artificial Sequence
  Synthetic Polynucleotide
taatacgactcactataggggtggcatctagaagacgctgagactaaaggaacagaggagacctttaatgtcagcgtctaacctggcggcagcgcaaaagatg

SEQ ID NO: 36186 - DNA, 103 bp, Artificial Sequence
  Synthetic Polynucleotide
taatacgactcactatagggcggccttacttaagcctgttctgtattacgaacagaggagacgtaatatggaacaggctaacctggcggcagcgcaaaagatg

SEQ ID NO: 36187 - DNA, 103 bp, Artificial Sequence
  Synthetic Polynucleotide
taatacgactcactatagggccggggatagccatcgctatgggaaggtgaaacagaggagatcacctatgcatagcgataacctggcggcagcgcaaaagatg

SEQ ID NO: 36188 - DNA, 103 bp, Artificial Sequence
  Synthetic Polynucleotide
taatacgactcactatagggaccttggcagcggtaaggcagtgtgagtctaacagaggagaagactcatgctgccttacaacctggcggcagcgcaaaagatg

SEQ ID NO: 36189 - DNA, 103 bp, Artificial Sequence
  Synthetic Polynucleotide
taatacgactcactatagggcccctactatgtcctcggcgcccttcagctaacagaggagaagctgaatggcgccgaggaacctggcggcagcgcaaaagatg

SEQ ID NO: 36190 - DNA, 103 bp, Artificial Sequence
  Synthetic Polynucleotide
taatacgactcactatagggtgcagacagacccctcccaaacgggttacgaacagaggagacgtaacatgtttgggaggaacctggcggcagcgcaaaagatg

SEQ ID NO: 36191 - DNA, 103 bp, Artificial Sequence
  Synthetic Polynucleotide
taatacgactcactatagggcggacaatctgggagaacacgagctaccaaaacagaggagattggtaatgcgtgttctcaacctggcggcagcgcaaaagatg

SEQ ID NO: 36192 - DNA, 103 bp, Artificial Sequence
  Synthetic Polynucleotide
taatacgactcactatagggctggtgaataaacaccccagccctgcctcgaacagaggagacgaggcatggctggggtgaacctggcggcagcgcaaaagatg

SEQ ID NO: 36193 - DNA, 103 bp, Artificial Sequence
  Synthetic Polynucleotide
taatacgactcactatagggtacaccagatcgaagagtgcggagctccgaaacagaggagatcggagatgcgcactcttaacctggcggcagcgcaaaagatg

SEQ ID NO: 36194 - DNA, 103 bp, Artificial Sequence
  Synthetic Polynucleotide
taatacgactcactatagggcaactatcaagtttactcgtctattcgcacaacagaggagagtgcgaatggacgagtaaaacctggcggcagcgcaaaagatg

SEQ ID NO: 36195 - DNA, 103 bp, Artificial Sequence
  Synthetic Polynucleotide
taatacgactcactataggggcggttcgcggttaggaaattcggcctgacaacagaggagagtcaggatgaatttcctaaacctggcggcagcgcaaaagatg

SEQ ID NO: 36196 - DNA, 103 bp, Artificial Sequence
  Synthetic Polynucleotide
taatacgactcactatagggaatgcagcctattgcataacgcgctccgttaacagaggagaaacggaatgcgttatgcaaacctggcggcagcgcaaaagatg

SEQ ID NO: 36197 - DNA, 103 bp, Artificial Sequence
  Synthetic Polynucleotide
taatacgactcactatagggtgttaccgacgtccgaggatgcacgattacaacagaggagagtaatcatgcatcctcggaacctggcggcagcgcaaaagatg

SEQ ID NO: 36198 - DNA, 103 bp, Artificial Sequence
  Synthetic Polynucleotide
taatacgactcactatagggtcgcgtatttgtgatccacgccccttctgcaacagaggagagcagaaatggcgtggatcaacctggcggcagcgcaaaagatg

SEQ ID NO: 36199 - DNA, 103 bp, Artificial Sequence
  Synthetic Polynucleotide
taatacgactcactatagggtagtccgcgagagcggccccttcatggcctaacagaggagaaggccaatgaggggccgcaacctggcggcagcgcaaaagatg

SEQ ID NO: 36200 - DNA, 103 bp, Artificial Sequence
  Synthetic Polynucleotide
taatacgactcactatagggataaacaggtgcaatctcctccccgctggcaacagaggagagccagcatggaggagattaacctggcggcagcgcaaaagatg

SEQ ID NO: 36201 - DNA, 103 bp, Artificial Sequence
  Synthetic Polynucleotide
taatacgactcactataggggtgctatacactatctgccgaaagatatgcaacagaggagagcatatatgtcggcagataacctggcggcagcgcaaaagatg

SEQ ID NO: 36202 - DNA, 103 bp, Artificial Sequence
  Synthetic Polynucleotide
taatacgactcactatagggtgggtacagcctaatatgtttttcaccgctaacagaggagaagcggtatgaaacatattaacctggcggcagcgcaaaagatg

SEQ ID NO: 36203 - DNA, 103 bp, Artificial Sequence
  Synthetic Polynucleotide
taatacgactcactatagggaagccgtagacgtcatacccccatcgcaagaacagaggagacttgcgatgggggtatgaaacctggcggcagcgcaaaagatg

SEQ ID NO: 36204 - DNA, 103 bp, Artificial Sequence
  Synthetic Polynucleotide
taatacgactcactatagggcaagccatcccgcaacatgtggccgggccaaacagaggagatggcccatgcacatgttgaacctggcggcagcgcaaaagatg

SEQ ID NO: 36205 - DNA, 103 bp, Artificial Sequence
  Synthetic Polynucleotide
taatacgactcactatagggatcactttacatctgctacgacttgagatgaacagaggagacatctcatgtcgtagcagaacctggcggcagcgcaaaagatg

SEQ ID NO: 36206 - DNA, 103 bp, Artificial Sequence
  Synthetic Polynucleotide
taatacgactcactataggggctgccgggtggtaaaatgggagcggtccaaacagaggagatggaccatgcccattttaaacctggcggcagcgcaaaagatg

SEQ ID NO: 36207 - DNA, 103 bp, Artificial Sequence
  Synthetic Polynucleotide
taatacgactcactataggggtgtactatagttattatatcacgctcatgaacagaggagacatgagatggatataataaacctggcggcagcgcaaaagatg

SEQ ID NO: 36208 - DNA, 103 bp, Artificial Sequence
  Synthetic Polynucleotide
taatacgactcactatagggcttcgggctggatggcggcattaaactccgaacagaggagacggagtatgatgccgccaaacctggcggcagcgcaaaagatg

SEQ ID NO: 36209 - DNA, 103 bp, Artificial Sequence
  Synthetic Polynucleotide
taatacgactcactatagggtaaagcaggatctaccttgtcgacacataaaacagaggagattatgtatggacaaggtaaacctggcggcagcgcaaaagatg

SEQ ID NO: 36210 - DNA, 103 bp, Artificial Sequence
  Synthetic Polynucleotide
taatacgactcactatagggccggacaacgcgtcagagtgtgtctccgggaacagaggagacccggaatgacactctgaaacctggcggcagcgcaaaagatg

SEQ ID NO: 36211 - DNA, 103 bp, Artificial Sequence
  Synthetic Polynucleotide
taatacgactcactatagggctctctatgactgtggcctttggattcattaacagaggagaaatgaaatgaaaggccacaacctggcggcagcgcaaaagatg

SEQ ID NO: 36212 - DNA, 103 bp, Artificial Sequence
  Synthetic Polynucleotide
taatacgactcactatagggatagaacacttacgactcattcttcggtggaacagaggagaccaccgatgaatgagtcgaacctggcggcagcgcaaaagatg

SEQ ID NO: 36213 - DNA, 103 bp, Artificial Sequence
  Synthetic Polynucleotide
taatacgactcactatagggtttgccgtaacgtctaatgtgagcgtcggtaacagaggagaaccgacatgcacattagaaacctggcggcagcgcaaaagatg

SEQ ID NO: 36214 - DNA, 103 bp, Artificial Sequence
  Synthetic Polynucleotide
taatacgactcactatagggtgttctgcgctttctagctccggccggcataacagaggagaatgccgatgggagctagaaacctggcggcagcgcaaaagatg

SEQ ID NO: 36215 - DNA, 103 bp, Artificial Sequence
  Synthetic Polynucleotide
taatacgactcactataggggcctcattccactagaattgtaacgcttggaacagaggagaccaagcatgacaattctaaacctggcggcagcgcaaaagatg

SEQ ID NO: 36216 - DNA, 103 bp, Artificial Sequence
  Synthetic Polynucleotide
taatacgactcactatagggatcatgggactacgcgcgcgttcagaaggaaacagaggagatccttcatgacgcgcgcgaacctggcggcagcgcaaaagatg

SEQ ID NO: 36217 - DNA, 103 bp, Artificial Sequence
  Synthetic Polynucleotide
taatacgactcactatagggatcgcaaaatgggctttggttgccatgcagaacagaggagactgcatatgaaccaaagcaacctggcggcagcgcaaaagatg

SEQ ID NO: 36218 - DNA, 103 bp, Artificial Sequence
  Synthetic Polynucleotide
taatacgactcactatagggtttcgaagcggcgtattatcaatggtggagaacagaggagactccacatgtgataatacaacctggcggcagcgcaaaagatg

SEQ ID NO: 36219 - DNA, 103 bp, Artificial Sequence
  Synthetic Polynucleotide
taatacgactcactataggggccgatttcgtaccgcggacctacctgggaaacagaggagatcccagatgggtccgcggaacctggcggcagcgcaaaagatg

SEQ ID NO: 36220 - DNA, 103 bp, Artificial Sequence
  Synthetic Polynucleotide
taatacgactcactatagggtaacgccgcaaagcttgttaggaacaattgaacagaggagacaattgatgctaacaagcaacctggcggcagcgcaaaagatg

SEQ ID NO: 36221 - DNA, 103 bp, Artificial Sequence
  Synthetic Polynucleotide
taatacgactcactataggggtgtagcgaatacgcttccgcatgttcggtaacagaggagaaccgaaatggcggaagcgaacctggcggcagcgcaaaagatg

SEQ ID NO: 36222 - DNA, 103 bp, Artificial Sequence
  Synthetic Polynucleotide
taatacgactcactatagggagcaagcgaatgttagaaacgcaggggctcaacagaggagagagcccatgcgtttctaaaacctggcggcagcgcaaaagatg

SEQ ID NO: 36223 - DNA, 103 bp, Artificial Sequence
  Synthetic Polynucleotide
taatacgactcactatagggaagataccagtagcggctctagaaaggggtaacagaggagaacccctatgtagagccgcaacctggcggcagcgcaaaagatg

SEQ ID NO: 36224 - DNA, 103 bp, Artificial Sequence
  Synthetic Polynucleotide
taatacgactcactatagggtgcaaaagaacggggattagccaagtacgaaacagaggagatcgtacatggctaatcccaacctggcggcagcgcaaaagatg

SEQ ID NO: 36225 - DNA, 103 bp, Artificial Sequence
  Synthetic Polynucleotide
taatacgactcactatagggctgcttagagatgatgttacgggtggacttaacagaggagaaagtccatgcgtaacatcaacctggcggcagcgcaaaagatg

SEQ ID NO: 36226 - DNA, 103 bp, Artificial Sequence
  Synthetic Polynucleotide
taatacgactcactataggggtacaagaacgtgctttaactaaagcggcaaacagaggagatgccgcatgagttaaagcaacctggcggcagcgcaaaagatg

SEQ ID NO: 36227 - DNA, 103 bp, Artificial Sequence
  Synthetic Polynucleotide
taatacgactcactatagggccttagagcgctatgatgtcgtccggaataaacagaggagatattccatgcgacatcataacctggcggcagcgcaaaagatg

SEQ ID NO: 36228 - DNA, 103 bp, Artificial Sequence
  Synthetic Polynucleotide
taatacgactcactatagggtacgcgcggccagattacacttcagattacaacagaggagagtaatcatgagtgtaatcaacctggcggcagcgcaaaagatg

SEQ ID NO: 36229 - DNA, 103 bp, Artificial Sequence
  Synthetic Polynucleotide
taatacgactcactatagggtcgggcagttcccgctacatgctactgtataacagaggagaatacagatgcatgtagcgaacctggcggcagcgcaaaagatg

SEQ ID NO: 36230 - DNA, 103 bp, Artificial Sequence
  Synthetic Polynucleotide
taatacgactcactatagggttagcacggatcctaaggtcttcctttttcaacagaggagagaaaaaatgagaccttagaacctggcggcagcgcaaaagatg

SEQ ID NO: 36231 - DNA, 103 bp, Artificial Sequence
  Synthetic Polynucleotide
taatacgactcactataggggtacttcactgtaattctgttgtgctaaacaacagaggagagtttagatgaacagaattaacctggcggcagcgcaaaagatg

SEQ ID NO: 36232 - DNA, 103 bp, Artificial Sequence
  Synthetic Polynucleotide
taatacgactcactatagggagccgtccccaaattacttcctgccccacgaacagaggagacgtgggatgggaagtaataacctggcggcagcgcaaaagatg

SEQ ID NO: 36233 - DNA, 103 bp, Artificial Sequence
  Synthetic Polynucleotide
taatacgactcactatagggtacctgaaagctatctcaactccactgtcgaacagaggagacgacagatgagttgagataacctggcggcagcgcaaaagatg

SEQ ID NO: 36234 - DNA, 103 bp, Artificial Sequence
  Synthetic Polynucleotide
taatacgactcactatagggatcctgtgggtgcagtaccacggcctgagcaacagaggagagctcagatggtggtactgaacctggcggcagcgcaaaagatg

SEQ ID NO: 36235 - DNA, 103 bp, Artificial Sequence
  Synthetic Polynucleotide
taatacgactcactatagggggcacatctccctaacaggtatcagcaaataacagaggagaatttgcatgtacctgttaaacctggcggcagcgcaaaagatg

SEQ ID NO: 36236 - DNA, 103 bp, Artificial Sequence
  Synthetic Polynucleotide
taatacgactcactatagggccgtatgaaaggaaaatgcgtcggggattcaacagaggagagaatccatgacgcattttaacctggcggcagcgcaaaagatg

SEQ ID NO: 36237 - DNA, 103 bp, Artificial Sequence
  Synthetic Polynucleotide
taatacgactcactataggggtactcgtccagcaccctatctttgatattaacagaggagaaatatcatggatagggtgaacctggcggcagcgcaaaagatg

SEQ ID NO: 36238 - DNA, 103 bp, Artificial Sequence
  Synthetic Polynucleotide
taatacgactcactataggggagacagtgctatcttcactcggtcagaagaacagaggagacttctgatggagtgaagaaacctggcggcagcgcaaaagatg

SEQ ID NO: 36239 - DNA, 103 bp, Artificial Sequence
  Synthetic Polynucleotide
taatacgactcactataggggttaacttgacacatcgatggcgcaatcttaacagaggagaaagattatgccatcgatgaacctggcggcagcgcaaaagatg

SEQ ID NO: 36240 - DNA, 103 bp, Artificial Sequence
  Synthetic Polynucleotide
taatacgactcactataggggcgcatcccacgatagttcatcaagtagataacagaggagaatctacatgatgaactataacctggcggcagcgcaaaagatg

SEQ ID NO: 36241 - DNA, 103 bp, Artificial Sequence
  Synthetic Polynucleotide
taatacgactcactatagggccaagatagatttttatgcacgcgcccagcaacagaggagagctgggatggtgcataaaaacctggcggcagcgcaaaagatg

SEQ ID NO: 36242 - DNA, 103 bp, Artificial Sequence
  Synthetic Polynucleotide
taatacgactcactataggggttttgccctaggacatgtcatatacagcaaacagaggagatgctgtatgtgacatgtcaacctggcggcagcgcaaaagatg

SEQ ID NO: 36243 - DNA, 103 bp, Artificial Sequence
  Synthetic Polynucleotide
taatacgactcactatagggagtggactgttgttcgacccttgttcatagaacagaggagactatgaatgagggtcgaaaacctggcggcagcgcaaaagatg

SEQ ID NO: 36244 - DNA, 103 bp, Artificial Sequence
  Synthetic Polynucleotide
taatacgactcactataggggtggttcttatagtgatgctttggacttttaacagaggagaaaaagtatgaagcatcacaacctggcggcagcgcaaaagatg

SEQ ID NO: 36245 - DNA, 103 bp, Artificial Sequence
  Synthetic Polynucleotide
taatacgactcactatagggcgggcgcctcaccccgtcagtcgcacaggtaacagaggagaacctgtatgactgacgggaacctggcggcagcgcaaaagatg

SEQ ID NO: 36246 - DNA, 103 bp, Artificial Sequence
  Synthetic Polynucleotide
taatacgactcactatagggcgcccaacgcgcctttgccgggagcaggcaaacagaggagatgcctgatgccggcaaagaacctggcggcagcgcaaaagatg

SEQ ID NO: 36247 - DNA, 103 bp, Artificial Sequence
  Synthetic Polynucleotide
taatacgactcactatagggcccacgacctgttgcgtccaaataagttccaacagaggagaggaactatgttggacgcaaacctggcggcagcgcaaaagatg

SEQ ID NO: 36248 - DNA, 103 bp, Artificial Sequence
  Synthetic Polynucleotide
taatacgactcactataggggacgatcaattgatatcgcggcgagttccgaacagaggagacggaacatgccgcgatataacctggcggcagcgcaaaagatg

SEQ ID NO: 36249 - DNA, 103 bp, Artificial Sequence
  Synthetic Polynucleotide
taatacgactcactatagggtcctgtagaacaaagaaatccagcggtctaaacagaggagatagaccatgggatttcttaacctggcggcagcgcaaaagatg

SEQ ID NO: 36250 - DNA, 103 bp, Artificial Sequence
  Synthetic Polynucleotide
taatacgactcactataggggacctcgtaagagctgactgttgtgtgctaaacagaggagatagcacatgacagtcagcaacctggcggcagcgcaaaagatg

SEQ ID NO: 36251 - DNA, 103 bp, Artificial Sequence
  Synthetic Polynucleotide
taatacgactcactatagggtttagccaaaagagctaggggcggtggtagaacagaggagactaccaatgcccctagctaacctggcggcagcgcaaaagatg

SEQ ID NO: 36252 - DNA, 103 bp, Artificial Sequence
  Synthetic Polynucleotide
taatacgactcactatagggggttctgggcgacccctaccgagacgggaaaacagaggagattcccgatgcggtaggggaacctggcggcagcgcaaaagatg

SEQ ID NO: 36253 - DNA, 103 bp, Artificial Sequence
  Synthetic Polynucleotide
taatacgactcactataggggccagtactgtcgttaagtccaagacactgaacagaggagacagtgtatgggacttaacaacctggcggcagcgcaaaagatg

SEQ ID NO: 36254 - DNA, 103 bp, Artificial Sequence
  Synthetic Polynucleotide
taatacgactcactatagggtacggtacatgagacactcaagcgatagagaacagaggagactctatatgttgagtgtcaacctggcggcagcgcaaaagatg

SEQ ID NO: 36255 - DNA, 103 bp, Artificial Sequence
  Synthetic Polynucleotide
taatacgactcactatagggtcggtgactggtgattccacttcaacgttgaacagaggagacaacgtatgagtggaatcaacctggcggcagcgcaaaagatg

SEQ ID NO: 36256 - DNA, 103 bp, Artificial Sequence
  Synthetic Polynucleotide
taatacgactcactatagggtagcgatatgtccccaacaccgaggccttaaacagaggagataaggcatgggtgttgggaacctggcggcagcgcaaaagatg

SEQ ID NO: 36257 - DNA, 103 bp, Artificial Sequence
  Synthetic Polynucleotide
taatacgactcactatagggcaagacgcaagtgtgtgaggggcgtatataaacagaggagatatataatgccctcacacaacctggcggcagcgcaaaagatg

SEQ ID NO: 36258 - DNA, 103 bp, Artificial Sequence
  Synthetic Polynucleotide
taatacgactcactatagggttatgtgtccccatctatttgcgacatcacaacagaggagagtgatgatgcaaatagataacctggcggcagcgcaaaagatg

SEQ ID NO: 36259 - DNA, 103 bp, Artificial Sequence
  Synthetic Polynucleotide
taatacgactcactatagggggcgatgagtcacgagacaagacgaggagcaacagaggagagctcctatgcttgtctcgaacctggcggcagcgcaaaagatg

SEQ ID NO: 36260 - DNA, 103 bp, Artificial Sequence
  Synthetic Polynucleotide
taatacgactcactatagggggtctcaccgcagggccattaacacctacaaacagaggagatgtaggatgtaatggcccaacctggcggcagcgcaaaagatg

SEQ ID NO: 36261 - DNA, 103 bp, Artificial Sequence
  Synthetic Polynucleotide
taatacgactcactatagggagtcgaagctgcgcaacaacccactactacaacagaggagagtagtaatgggttgttgcaacctggcggcagcgcaaaagatg

SEQ ID NO: 36262 - DNA, 103 bp, Artificial Sequence
  Synthetic Polynucleotide
taatacgactcactatagggcttttcaccgagagtctaatttgtgcaaataacagaggagaatttgcatgaattagactaacctggcggcagcgcaaaagatg

SEQ ID NO: 36263 - DNA, 103 bp, Artificial Sequence
  Synthetic Polynucleotide
taatacgactcactataggggtggtattggtatgcccgtttacagaggagaacagaggagactcctcatgaaacgggcaaacctggcggcagcgcaaaagatg

SEQ ID NO: 36264 - DNA, 103 bp, Artificial Sequence
  Synthetic Polynucleotide
taatacgactcactatagggcgaccattgctcatagaggagcgttggtcaaacagaggagatgaccaatgctcctctataacctggcggcagcgcaaaagatg

SEQ ID NO: 36265 - DNA, 103 bp, Artificial Sequence
  Synthetic Polynucleotide
taatacgactcactatagggtcgtcctagataggttacccgtgctatgggaacagaggagacccataatgcgggtaaccaacctggcggcagcgcaaaagatg

SEQ ID NO: 36266 - DNA, 103 bp, Artificial Sequence
  Synthetic Polynucleotide
taatacgactcactatagggtaagcgatcggctaaatatctgttacatagaacagaggagactatgtatgagatatttaaacctggcggcagcgcaaaagatg

SEQ ID NO: 36267 - DNA, 103 bp, Artificial Sequence
  Synthetic Polynucleotide
taatacgactcactatagggtgtatcaaaccacgcgattccggccccttgaacagaggagacaagggatgggaatcgcgaacctggcggcagcgcaaaagatg

SEQ ID NO: 36268 - DNA, 103 bp, Artificial Sequence
  Synthetic Polynucleotide
taatacgactcactatagggagctggttgatgacaaccccgacgttcctaaacagaggagataggaaatgcggggttgtaacctggcggcagcgcaaaagatg

SEQ ID NO: 36269 - DNA, 103 bp, Artificial Sequence
  Synthetic Polynucleotide
taatacgactcactatagggccttcgagttcctaataaatacgtcgcaaaaacagaggagatttgcgatgtatttattaaacctggcggcagcgcaaaagatg

SEQ ID NO: 36270 - DNA, 103 bp, Artificial Sequence
  Synthetic Polynucleotide
taatacgactcactatagggtatgtcgtctggttgacgctttgagtaggcaacagaggagagcctacatgaagcgtcaaaacctggcggcagcgcaaaagatg

SEQ ID NO: 36271 - DNA, 103 bp, Artificial Sequence
  Synthetic Polynucleotide
taatacgactcactatagggtgcaagtaagtgaactaaccctcgtcaaaaaacagaggagattttgaatggggttagttaacctggcggcagcgcaaaagatg

SEQ ID NO: 36272 - DNA, 103 bp, Artificial Sequence
  Synthetic Polynucleotide
taatacgactcactataggggcctcttgcaatttttgcctattcctcgctaacagaggagaagcgagatgtaggcaaaaaacctggcggcagcgcaaaagatg

SEQ ID NO: 36273 - DNA, 103 bp, Artificial Sequence
  Synthetic Polynucleotide
taatacgactcactatagggtggcgaacaaccccgagtaaataggattacaacagaggagagtaatcatgtttactcggaacctggcggcagcgcaaaagatg

SEQ ID NO: 36274 - DNA, 103 bp, Artificial Sequence
  Synthetic Polynucleotide
taatacgactcactatagggtacagcgggtaatcatcacagaggctacataacagaggagaatgtagatgctgtgatgaaacctggcggcagcgcaaaagatg

SEQ ID NO: 36275 - DNA, 103 bp, Artificial Sequence
  Synthetic Polynucleotide
taatacgactcactataggggttcaaatcgcggcgaatccgagtgcaggcaacagaggagagcctgcatgcggattcgcaacctggcggcagcgcaaaagatg

SEQ ID NO: 36276 - DNA, 103 bp, Artificial Sequence
  Synthetic Polynucleotide
taatacgactcactatagggaatttcggagatagaggctattgtgtatacaacagaggagagtatacatgatagcctctaacctggcggcagcgcaaaagatg

SEQ ID NO: 36277 - DNA, 103 bp, Artificial Sequence
  Synthetic Polynucleotide
taatacgactcactataggggctgtgacctaagcaccttagtgcgacgtgaacagaggagacacgtcatgctaaggtgcaacctggcggcagcgcaaaagatg

SEQ ID NO: 36278 - DNA, 103 bp, Artificial Sequence
  Synthetic Polynucleotide
taatacgactcactatagggtcgtgtagattctgaaccctcgttatccgtaacagaggagaacggatatggagggttcaaacctggcggcagcgcaaaagatg

SEQ ID NO: 36279 - DNA, 103 bp, Artificial Sequence
  Synthetic Polynucleotide
taatacgactcactataggggcgtgtcctcgctgcctgactttcatcgagaacagaggagactcgatatgagtcaggcaaacctggcggcagcgcaaaagatg

SEQ ID NO: 36280 - DNA, 103 bp, Artificial Sequence
  Synthetic Polynucleotide
taatacgactcactatagggagcgaccaggacggcagtttcacggaatggaacagaggagaccattcatggaaactgccaacctggcggcagcgcaaaagatg

SEQ ID NO: 36281 - DNA, 103 bp, Artificial Sequence
  Synthetic Polynucleotide
taatacgactcactatagggaagagtcacttggtcgaactctaacccgggaacagaggagacccgggatggagttcgacaacctggcggcagcgcaaaagatg

SEQ ID NO: 36282 - DNA, 103 bp, Artificial Sequence
  Synthetic Polynucleotide
taatacgactcactatagggtcggatttagaaggttgtctagaggagcgcaacagaggagagcgctcatgtagacaaccaacctggcggcagcgcaaaagatg

SEQ ID NO: 36283 - DNA, 103 bp, Artificial Sequence
  Synthetic Polynucleotide
taatacgactcactatagggggtcgctagatccacccgggaatccagactaacagaggagaagtctgatgtcccgggtgaacctggcggcagcgcaaaagatg

SEQ ID NO: 36284 - DNA, 103 bp, Artificial Sequence
  Synthetic Polynucleotide
taatacgactcactatagggggaggcgaaaaccgaggactatttccgatgaacagaggagacatcggatgtagtcctcgaacctggcggcagcgcaaaagatg

SEQ ID NO: 36285 - DNA, 103 bp, Artificial Sequence
  Synthetic Polynucleotide
taatacgactcactatagggatttgtccattatccgagcgggctctatcgaacagaggagacgatagatgccgctcggaaacctggcggcagcgcaaaagatg

SEQ ID NO: 36286 - DNA, 103 bp, Artificial Sequence
  Synthetic Polynucleotide
taatacgactcactatagggcgagagttccacagcggagtataaaggtcgaacagaggagacgacctatgtactccgctaacctggcggcagcgcaaaagatg

SEQ ID NO: 36287 - DNA, 103 bp, Artificial Sequence
  Synthetic Polynucleotide
taatacgactcactataggggtataattatgaatgacgaggcgacggtcgaacagaggagacgaccgatgcctcgtcataacctggcggcagcgcaaaagatg

SEQ ID NO: 36288 - DNA, 103 bp, Artificial Sequence
  Synthetic Polynucleotide
taatacgactcactatagggctaggtcataaatcctgttatgttaataaaaacagaggagatttattatgataacaggaaacctggcggcagcgcaaaagatg

SEQ ID NO: 36289 - DNA, 103 bp, Artificial Sequence
  Synthetic Polynucleotide
taatacgactcactatagggaacgggaccgcgagcacgaggggatgtgctaacagaggagaagcacaatgcctcgtgctaacctggcggcagcgcaaaagatg

SEQ ID NO: 36290 - DNA, 103 bp, Artificial Sequence
  Synthetic Polynucleotide
taatacgactcactatagggcaagcccacgcttagaatgaaatggttaacaacagaggagagttaacatgttcattctaaacctggcggcagcgcaaaagatg

SEQ ID NO: 36291 - DNA, 103 bp, Artificial Sequence
  Synthetic Polynucleotide
taatacgactcactatagggccaatagagcctgtgtacgggtcggtgcaaaacagaggagattgcacatgcccgtacacaacctggcggcagcgcaaaagatg

SEQ ID NO: 36292 - DNA, 103 bp, Artificial Sequence
  Synthetic Polynucleotide
taatacgactcactatagggcgataacccccgccgtaaatctcccgcgtcaacagaggagagacgcgatggatttacggaacctggcggcagcgcaaaagatg

SEQ ID NO: 36293 - DNA, 103 bp, Artificial Sequence
  Synthetic Polynucleotide
taatacgactcactatagggacgcccgtatgagacaactaggcagtttagaacagaggagactaaacatgctagttgtcaacctggcggcagcgcaaaagatg

SEQ ID NO: 36294 - DNA, 103 bp, Artificial Sequence
  Synthetic Polynucleotide
taatacgactcactatagggctggatacaatcactcccaacgacaataacaacagaggagagttattatggttgggagtaacctggcggcagcgcaaaagatg

SEQ ID NO: 36295 - DNA, 103 bp, Artificial Sequence
  Synthetic Polynucleotide
taatacgactcactatagggccgtaccctccggtgtgtttgtgcaattcaaacagaggagatgaattatgcaaacacacaacctggcggcagcgcaaaagatg

SEQ ID NO: 36296 - DNA, 103 bp, Artificial Sequence
  Synthetic Polynucleotide
taatacgactcactatagggcgatacactattcgcagcccagcatggcagaacagaggagactgccaatgtgggctgcgaacctggcggcagcgcaaaagatg

SEQ ID NO: 36297 - DNA, 103 bp, Artificial Sequence
  Synthetic Polynucleotide
taatacgactcactatagggagacggagaagcatcagaccgtcaccccgtaacagaggagaacggggatgcggtctgataacctggcggcagcgcaaaagatg

SEQ ID NO: 36298 - DNA, 103 bp, Artificial Sequence
  Synthetic Polynucleotide
taatacgactcactatagggggtggaaatacagtgctctatatgtacgcaaacagaggagatgcgtaatgatagagcacaacctggcggcagcgcaaaagatg

SEQ ID NO: 36299 - DNA, 103 bp, Artificial Sequence
  Synthetic Polynucleotide
taatacgactcactatagggggcattgtcgacgaccaattttatccaatcaacagaggagagattggatgaaattggtcaacctggcggcagcgcaaaagatg

SEQ ID NO: 36300 - DNA, 103 bp, Artificial Sequence
  Synthetic Polynucleotide
taatacgactcactatagggttgtcgtaagagtcgtaacatcgaagctagaacagaggagactagctatgatgttacgaaacctggcggcagcgcaaaagatg

SEQ ID NO: 36301 - DNA, 103 bp, Artificial Sequence
  Synthetic Polynucleotide
taatacgactcactataggggtatacagcctttgtttctcggcacttcggaacagaggagaccgaagatgcgagaaacaaacctggcggcagcgcaaaagatg

SEQ ID NO: 36302 - DNA, 103 bp, Artificial Sequence
  Synthetic Polynucleotide
taatacgactcactatagggtcagaacatctaaacatagaagtcttgtaaaacagaggagattacaaatgttctatgttaacctggcggcagcgcaaaagatg

SEQ ID NO: 36303 - DNA, 103 bp, Artificial Sequence
  Synthetic Polynucleotide
taatacgactcactatagggcagcctgtgagtccgacgaaatgccattcgaacagaggagacgaatgatgtttcgtcggaacctggcggcagcgcaaaagatg

SEQ ID NO: 36304 - DNA, 103 bp, Artificial Sequence
  Synthetic Polynucleotide
taatacgactcactatagggttctggtatgtagttcttttatggaggagaaacagaggagatctcctatgtaaaagaacaacctggcggcagcgcaaaagatg

SEQ ID NO: 36305 - DNA, 103 bp, Artificial Sequence
  Synthetic Polynucleotide
taatacgactcactatagggtgcaacaaactagttgctacgtgagttataaacagaggagatataacatgcgtagcaacaacctggcggcagcgcaaaagatg

SEQ ID NO: 36306 - DNA, 103 bp, Artificial Sequence
  Synthetic Polynucleotide
taatacgactcactatagggctatgaaccacctaccttaagggaacggtaaacagaggagataccgtatgcttaaggtaaacctggcggcagcgcaaaagatg

SEQ ID NO: 36307 - DNA, 103 bp, Artificial Sequence
  Synthetic Polynucleotide
taatacgactcactatagggcaggtcttagacttccggttgtgaatgcttaacagaggagaaagcatatgcaaccggaaaacctggcggcagcgcaaaagatg

SEQ ID NO: 36308 - DNA, 103 bp, Artificial Sequence
  Synthetic Polynucleotide
taatacgactcactatagggacgggtccgctaccgaacctcacagcacgaaacagaggagatcgtgcatggaggttcggaacctggcggcagcgcaaaagatg

SEQ ID NO: 36309 - DNA, 103 bp, Artificial Sequence
  Synthetic Polynucleotide
taatacgactcactatagggagcagtgtaacggccgctaccccctcgggcaacagaggagagcccgaatgggtagcggcaacctggcggcagcgcaaaagatg

SEQ ID NO: 36310 - DNA, 103 bp, Artificial Sequence
  Synthetic Polynucleotide
taatacgactcactataggggacgtactataacaccggggttcccctaggaacagaggagacctaggatgaccccggtgaacctggcggcagcgcaaaagatg

SEQ ID NO: 36311 - DNA, 103 bp, Artificial Sequence
  Synthetic Polynucleotide
taatacgactcactataggggctgtgatagagccctccagatcttcgggaaacagaggagatcccgaatgtctggagggaacctggcggcagcgcaaaagatg

SEQ ID NO: 36312 - DNA, 103 bp, Artificial Sequence
  Synthetic Polynucleotide
taatacgactcactatagggcttccgtctgatccgaacgttgcgtggtacaacagaggagagtaccaatgaacgttcggaacctggcggcagcgcaaaagatg

SEQ ID NO: 36313 - DNA, 103 bp, Artificial Sequence
  Synthetic Polynucleotide
taatacgactcactatagggtaacgcatatggatcttagacttttagacaaacagaggagatgtctaatggtctaagataacctggcggcagcgcaaaagatg

SEQ ID NO: 36314 - DNA, 103 bp, Artificial Sequence
  Synthetic Polynucleotide
taatacgactcactatagggtagtgcaagcaggcgtagacgagaaccggcaacagaggagagccggtatgcgtctacgcaacctggcggcagcgcaaaagatg

SEQ ID NO: 36315 - DNA, 103 bp, Artificial Sequence
  Synthetic Polynucleotide
taatacgactcactatagggtcctgaacgttacctccacagtgcccgcataacagaggagaatgcggatgctgtggaggaacctggcggcagcgcaaaagatg

SEQ ID NO: 36316 - DNA, 103 bp, Artificial Sequence
  Synthetic Polynucleotide
taatacgactcactataggggagagtgcagaacctaatgtggttatttaaaacagaggagattaaatatgcacattaggaacctggcggcagcgcaaaagatg

SEQ ID NO: 36317 - DNA, 103 bp, Artificial Sequence
  Synthetic Polynucleotide
taatacgactcactatagggatctcctggaccctaagtgtacagcagcgaaacagaggagatcgctgatgtacacttagaacctggcggcagcgcaaaagatg

SEQ ID NO: 36318 - DNA, 103 bp, Artificial Sequence
  Synthetic Polynucleotide
taatacgactcactataggggaattcacatctcgggacaggtatttggaaaacagaggagattccaaatgcctgtcccgaacctggcggcagcgcaaaagatg

SEQ ID NO: 36319 - DNA, 103 bp, Artificial Sequence
  Synthetic Polynucleotide
taatacgactcactatagggagaaactaagtactacagataaatcgaactaacagaggagaagttcgatgtatctgtagaacctggcggcagcgcaaaagatg

SEQ ID NO: 36320 - DNA, 103 bp, Artificial Sequence
  Synthetic Polynucleotide
taatacgactcactataggggtagcaatccatcgtctcaggggcctgtcgaacagaggagacgacagatgcctgagacgaacctggcggcagcgcaaaagatg

SEQ ID NO: 36321 - DNA, 103 bp, Artificial Sequence
  Synthetic Polynucleotide
taatacgactcactatagggagacacgtattgcccttgaggcgagctatcaacagaggagagatagcatgcctcaagggaacctggcggcagcgcaaaagatg

SEQ ID NO: 36322 - DNA, 103 bp, Artificial Sequence
  Synthetic Polynucleotide
taatacgactcactataggggaatgtgacaatggtaatgtcaggcacacgaacagaggagacgtgtgatggacattaccaacctggcggcagcgcaaaagatg

SEQ ID NO: 36323 - DNA, 103 bp, Artificial Sequence
  Synthetic Polynucleotide
taatacgactcactatagggcctcaggcgcagtcgctgcactaagaatagaacagaggagactattcatggtgcagcgaaacctggcggcagcgcaaaagatg

SEQ ID NO: 36324 - DNA, 103 bp, Artificial Sequence
  Synthetic Polynucleotide
taatacgactcactatagggaggcggaggacgtgcttaaaaacaagtaataacagaggagaattactatgttttaagcaaacctggcggcagcgcaaaagatg

SEQ ID NO: 36325 - DNA, 103 bp, Artificial Sequence
  Synthetic Polynucleotide
taatacgactcactatagggggcggtcgcgtggagatattaatctgcctcaacagaggagagaggcaatgtaatatctcaacctggcggcagcgcaaaagatg

SEQ ID NO: 36326 - DNA, 103 bp, Artificial Sequence
  Synthetic Polynucleotide
taatacgactcactataggggcgcctataaatatcatacatgtccgccgtaacagaggagaacggcgatgatgtatgataacctggcggcagcgcaaaagatg

SEQ ID NO: 36327 - DNA, 103 bp, Artificial Sequence
  Synthetic Polynucleotide
taatacgactcactataggggaagacagaacgctgcaggcttcaaggtggaacagaggagaccacctatgagcctgcagaacctggcggcagcgcaaaagatg

SEQ ID NO: 36328 - DNA, 103 bp, Artificial Sequence
  Synthetic Polynucleotide
taatacgactcactatagggtcgcgctagggactttcccgcggggaagaaaacagaggagattcttcatggcgggaaagaacctggcggcagcgcaaaagatg

SEQ ID NO: 36329 - DNA, 103 bp, Artificial Sequence
  Synthetic Polynucleotide
taatacgactcactatagggctctattgaactctgtcaccctggttgataaacagaggagatatcaaatggggtgacagaacctggcggcagcgcaaaagatg

SEQ ID NO: 36330 - DNA, 103 bp, Artificial Sequence
  Synthetic Polynucleotide
taatacgactcactataggggctagagtgccggtactctcgaggatatccaacagaggagaggatatatgcgagagtacaacctggcggcagcgcaaaagatg

SEQ ID NO: 36331 - DNA, 103 bp, Artificial Sequence
  Synthetic Polynucleotide
taatacgactcactataggggattactgaacaaaccacgcgaagatatccaacagaggagaggatatatgcgcgtggttaacctggcggcagcgcaaaagatg

SEQ ID NO: 36332 - DNA, 103 bp, Artificial Sequence
  Synthetic Polynucleotide
taatacgactcactatagggcaaagaatgctagatgaaagacaaggctccaacagaggagaggagccatgtctttcatcaacctggcggcagcgcaaaagatg

SEQ ID NO: 36333 - DNA, 103 bp, Artificial Sequence
  Synthetic Polynucleotide
taatacgactcactatagggtgtgggtgctagccgcgacccgatatagtaaacagaggagatactatatggggtcgcggaacctggcggcagcgcaaaagatg

SEQ ID NO: 36334 - DNA, 103 bp, Artificial Sequence
  Synthetic Polynucleotide
taatacgactcactatagggaaatttaactaacgaggtttaggtactactaacagaggagaagtagtatgtaaacctcgaacctggcggcagcgcaaaagatg

SEQ ID NO: 36335 - DNA, 103 bp, Artificial Sequence
  Synthetic Polynucleotide
taatacgactcactatagggatcacgttacaatgcctattatgatgaatgaacagaggagacattcaatgtaataggcaaacctggcggcagcgcaaaagatg

SEQ ID NO: 36336 - DNA, 103 bp, Artificial Sequence
  Synthetic Polynucleotide
taatacgactcactatagggttctggatcctagcgccactcgaggaatctaacagaggagaagattcatggagtggcgcaacctggcggcagcgcaaaagatg

SEQ ID NO: 36337 - DNA, 103 bp, Artificial Sequence
  Synthetic Polynucleotide
taatacgactcactataggggatatcctaccagcaacttcggttgcaaccaacagaggagaggttgcatgcgaagttgcaacctggcggcagcgcaaaagatg

SEQ ID NO: 36338 - DNA, 103 bp, Artificial Sequence
  Synthetic Polynucleotide
taatacgactcactatagggacgagtttaagccgccaccttcagtccgggaacagaggagacccggaatgaaggtggcgaacctggcggcagcgcaaaagatg

SEQ ID NO: 36339 - DNA, 103 bp, Artificial Sequence
  Synthetic Polynucleotide
taatacgactcactatagggctacggcggcccgtatccttcatcaaactaaacagaggagatagtttatggaaggatacaacctggcggcagcgcaaaagatg

SEQ ID NO: 36340 - DNA, 103 bp, Artificial Sequence
  Synthetic Polynucleotide
taatacgactcactatagggtagagaactacgtgctgcccgttagcccacaacagaggagagtgggcatgcgggcagcaaacctggcggcagcgcaaaagatg

SEQ ID NO: 36341 - DNA, 103 bp, Artificial Sequence
  Synthetic Polynucleotide
taatacgactcactatagggttgcagtcagatgtgcatctggacccgctaaacagaggagatagcggatgcagatgcacaacctggcggcagcgcaaaagatg

SEQ ID NO: 36342 - DNA, 103 bp, Artificial Sequence
  Synthetic Polynucleotide
taatacgactcactataggggaatggagtcctgcagtgcgctttggactaaacagaggagatagtccatggcgcactgcaacctggcggcagcgcaaaagatg

SEQ ID NO: 36343 - DNA, 103 bp, Artificial Sequence
  Synthetic Polynucleotide
taatacgactcactatagggttgacgagatgcggacaggtattatgtaccaacagaggagaggtacaatgtacctgtccaacctggcggcagcgcaaaagatg

SEQ ID NO: 36344 - DNA, 103 bp, Artificial Sequence
  Synthetic Polynucleotide
taatacgactcactatagggtgttggcgtcaagcatcgagttccgtccgtaacagaggagaacggacatgactcgatgcaacctggcggcagcgcaaaagatg

SEQ ID NO: 36345 - DNA, 103 bp, Artificial Sequence
  Synthetic Polynucleotide
taatacgactcactataggggactagctttctcgtcgctcgagctgtaaaaacagaggagatttacaatgcgagcgacgaacctggcggcagcgcaaaagatg

SEQ ID NO: 36346 - DNA, 103 bp, Artificial Sequence
  Synthetic Polynucleotide
taatacgactcactataggggtaagggaaccaatactttttgctccgattaacagaggagaaatcggatgaaaaagtataacctggcggcagcgcaaaagatg

SEQ ID NO: 36347 - DNA, 103 bp, Artificial Sequence
  Synthetic Polynucleotide
taatacgactcactatagggtgcgcccgatatatatctcccttatgatagaacagaggagactatcaatggggagatataacctggcggcagcgcaaaagatg

SEQ ID NO: 36348 - DNA, 103 bp, Artificial Sequence
  Synthetic Polynucleotide
taatacgactcactatagggacttattacgatgcattcgggcattctaggaacagaggagacctagaatgcccgaatgcaacctggcggcagcgcaaaagatg

SEQ ID NO: 36349 - DNA, 103 bp, Artificial Sequence
  Synthetic Polynucleotide
taatacgactcactatagggctgttctgcgacaagcatctgctgcgttcaaacagaggagatgaacgatgcagatgcttaacctggcggcagcgcaaaagatg

SEQ ID NO: 36350 - DNA, 103 bp, Artificial Sequence
  Synthetic Polynucleotide
taatacgactcactatagggaccttccgacggtaggttcttaatgaattcaacagaggagagaattcatgaagaacctaaacctggcggcagcgcaaaagatg

SEQ ID NO: 36351 - DNA, 103 bp, Artificial Sequence
  Synthetic Polynucleotide
taatacgactcactatagggcctgggtcggaaagtctcagcacccgtgagaacagaggagactcacgatggctgagactaacctggcggcagcgcaaaagatg

SEQ ID NO: 36352 - DNA, 103 bp, Artificial Sequence
  Synthetic Polynucleotide
taatacgactcactataggggctataacctcttgttattggagaaacggtaacagaggagaaccgttatgccaataacaaacctggcggcagcgcaaaagatg

SEQ ID NO: 36353 - DNA, 103 bp, Artificial Sequence
  Synthetic Polynucleotide
taatacgactcactataggggccctttaagtgggttctgacatttcggataacagaggagaatccgaatggtcagaaccaacctggcggcagcgcaaaagatg

SEQ ID NO: 36354 - DNA, 103 bp, Artificial Sequence
  Synthetic Polynucleotide
taatacgactcactatagggcttttggctatacgatgctgcgatacataaaacagaggagattatgtatggcagcatcgaacctggcggcagcgcaaaagatg

SEQ ID NO: 36355 - DNA, 103 bp, Artificial Sequence
  Synthetic Polynucleotide
taatacgactcactatagggtgcagacgcgccgatttgcccccctcggctaacagaggagaagccgaatggggcaaatcaacctggcggcagcgcaaaagatg

SEQ ID NO: 36356 - DNA, 103 bp, Artificial Sequence
  Synthetic Polynucleotide
taatacgactcactatagggcccaagtaccgacccaatttgtctttgcataacagaggagaatgcaaatgcaaattgggaacctggcggcagcgcaaaagatg

SEQ ID NO: 36357 - DNA, 103 bp, Artificial Sequence
  Synthetic Polynucleotide
taatacgactcactataggggtggataaaactagtctgtcgaccccgggaaacagaggagatcccggatgcgacagactaacctggcggcagcgcaaaagatg

SEQ ID NO: 36358 - DNA, 103 bp, Artificial Sequence
  Synthetic Polynucleotide
taatacgactcactatagggccatatcaagcaacttcagaccctacacggaacagaggagaccgtgtatggtctgaagtaacctggcggcagcgcaaaagatg

SEQ ID NO: 36359 - DNA, 103 bp, Artificial Sequence
  Synthetic Polynucleotide
taatacgactcactatagggcatccaggcttacgaatcgtcttcgcaatgaacagaggagacattgcatggacgattcgaacctggcggcagcgcaaaagatg

SEQ ID NO: 36360 - DNA, 103 bp, Artificial Sequence
  Synthetic Polynucleotide
taatacgactcactatagggtgcctgccatcagtaatgtcctggcaggcaaacagaggagatgcctgatgggacattacaacctggcggcagcgcaaaagatg

SEQ ID NO: 36361 - DNA, 103 bp, Artificial Sequence
  Synthetic Polynucleotide
taatacgactcactataggggaccaataactattgaaactcgttaagtataacagaggagaatacttatggagtttcaaaacctggcggcagcgcaaaagatg

SEQ ID NO: 36362 - DNA, 103 bp, Artificial Sequence
  Synthetic Polynucleotide
taatacgactcactataggggtttggctgtcccacagaacacccggccttaacagaggagaaaggccatgtgttctgtgaacctggcggcagcgcaaaagatg

SEQ ID NO: 36363 - DNA, 103 bp, Artificial Sequence
  Synthetic Polynucleotide
taatacgactcactatagggtaagacggaaaccatgttccagttagtcgaaacagaggagatcgactatgtggaacatgaacctggcggcagcgcaaaagatg

SEQ ID NO: 36364 - DNA, 103 bp, Artificial Sequence
  Synthetic Polynucleotide
taatacgactcactatagggtcacgcgctgcttcctggggtcaagatgtgaacagaggagacacatcatgaccccaggaaacctggcggcagcgcaaaagatg

SEQ ID NO: 36365 - DNA, 103 bp, Artificial Sequence
  Synthetic Polynucleotide
taatacgactcactatagggaaccttaggtagtatgtctcgcatccaagcaacagaggagagcttggatgcgagacataaacctggcggcagcgcaaaagatg

SEQ ID NO: 36366 - DNA, 103 bp, Artificial Sequence
  Synthetic Polynucleotide
taatacgactcactatagggatgagaacgaaggcactcaggtagatacgcaacagaggagagcgtatatgcctgagtgcaacctggcggcagcgcaaaagatg

SEQ ID NO: 36367 - DNA, 103 bp, Artificial Sequence
  Synthetic Polynucleotide
taatacgactcactatagggggggggaatcgagaccagcctctaaataataacagaggagaattattatgaggctggtcaacctggcggcagcgcaaaagatg

SEQ ID NO: 36368 - DNA, 103 bp, Artificial Sequence
  Synthetic Polynucleotide
taatacgactcactatagggaccgacagtgattatgcagaatggtatggtaacagaggagaaccataatgttctgcataaacctggcggcagcgcaaaagatg

SEQ ID NO: 36369 - DNA, 103 bp, Artificial Sequence
  Synthetic Polynucleotide
taatacgactcactatagggggattcgtaatcggggcaaatttttattccaacagaggagaggaataatgatttgccccaacctggcggcagcgcaaaagatg

SEQ ID NO: 36370 - DNA, 103 bp, Artificial Sequence
  Synthetic Polynucleotide
taatacgactcactatagggaccgacctgagtatttctccgaatacatttaacagaggagaaaatgtatgcggagaaataacctggcggcagcgcaaaagatg

SEQ ID NO: 36371 - DNA, 103 bp, Artificial Sequence
  Synthetic Polynucleotide
taatacgactcactatagggatagaatttgccccgacttttttcaaaaggaacagaggagaccttttatgaaaagtcggaacctggcggcagcgcaaaagatg

SEQ ID NO: 36372 - DNA, 103 bp, Artificial Sequence
  Synthetic Polynucleotide
taatacgactcactataggggggaacacccgaaggtccccgggtcaagctaacagaggagaagcttgatgcggggacctaacctggcggcagcgcaaaagatg

SEQ ID NO: 36373 - DNA, 103 bp, Artificial Sequence
  Synthetic Polynucleotide
taatacgactcactatagggcaggtctcaaagccgtaggtccgagccgccaacagaggagaggcggcatggacctacggaacctggcggcagcgcaaaagatg

SEQ ID NO: 36374 - DNA, 103 bp, Artificial Sequence
  Synthetic Polynucleotide
taatacgactcactatagggagagtctaccggtacgaccagcactactccaacagaggagaggagtaatgctggtcgtaaacctggcggcagcgcaaaagatg

SEQ ID NO: 36375 - DNA, 103 bp, Artificial Sequence
  Synthetic Polynucleotide
taatacgactcactatagggcgcttggagatacttaagaatcattcatgtaacagaggagaacatgaatgattcttaagaacctggcggcagcgcaaaagatg

SEQ ID NO: 36376 - DNA, 103 bp, Artificial Sequence
  Synthetic Polynucleotide
taatacgactcactatagggtgctagtcactaacggcgtgagctaaattcaacagaggagagaatttatgtcacgccgtaacctggcggcagcgcaaaagatg

SEQ ID NO: 36377 - DNA, 103 bp, Artificial Sequence
  Synthetic Polynucleotide
taatacgactcactataggggcacgtgttctgttccttgtggcgtcgaaaaacagaggagatttcgaatgcacaaggaaaacctggcggcagcgcaaaagatg

SEQ ID NO: 36378 - DNA, 103 bp, Artificial Sequence
  Synthetic Polynucleotide
taatacgactcactatagggccgcctctagcaagaaggaataaggttaacaacagaggagagttaacatgattccttctaacctggcggcagcgcaaaagatg

SEQ ID NO: 36379 - DNA, 103 bp, Artificial Sequence
  Synthetic Polynucleotide
taatacgactcactatagggagacgcgcttatccccttctttttcgggtcaacagaggagagacccgatgaagaaggggaacctggcggcagcgcaaaagatg

SEQ ID NO: 36380 - DNA, 103 bp, Artificial Sequence
  Synthetic Polynucleotide
taatacgactcactatagggtgttgagaccgagggatgaccttaagagaaaacagaggagattctctatgggtcatcccaacctggcggcagcgcaaaagatg

SEQ ID NO: 36381 - DNA, 103 bp, Artificial Sequence
  Synthetic Polynucleotide
taatacgactcactatagggcgcgaaaagacctggctattagctggccgtaacagaggagaacggccatgtaatagccaaacctggcggcagcgcaaaagatg

SEQ ID NO: 36382 - DNA, 103 bp, Artificial Sequence
  Synthetic Polynucleotide
taatacgactcactataggggatatccaacgggacgactttcaaatcttcaacagaggagagaagatatgaaagtcgtcaacctggcggcagcgcaaaagatg

SEQ ID NO: 36383 - DNA, 103 bp, Artificial Sequence
  Synthetic Polynucleotide
taatacgactcactatagggacaccgaatgggcctaccacaggcgaaactaacagaggagaagtttcatgtgtggtaggaacctggcggcagcgcaaaagatg

SEQ ID NO: 36384 - DNA, 103 bp, Artificial Sequence
  Synthetic Polynucleotide
taatacgactcactatagggatcctatgctgcttctccccgaaaagagagaacagaggagactctctatgcggggagaaaacctggcggcagcgcaaaagatg

SEQ ID NO: 36385 - DNA, 103 bp, Artificial Sequence
  Synthetic Polynucleotide
taatacgactcactataggggctcccttttgtgcggatcctgtactagtcaacagaggagagactagatgaggatccgcaacctggcggcagcgcaaaagatg

SEQ ID NO: 36386 - DNA, 103 bp, Artificial Sequence
  Synthetic Polynucleotide
taatacgactcactatagggtgtatccgaatcgacttctgctagcttcttaacagaggagaaagaagatggcagaagtcaacctggcggcagcgcaaaagatg

SEQ ID NO: 36387 - DNA, 103 bp, Artificial Sequence
  Synthetic Polynucleotide
taatacgactcactatagggagatcgcttaaaccatttcgtttcttggtcaacagaggagagaccaaatgacgaaatggaacctggcggcagcgcaaaagatg

SEQ ID NO: 36388 - DNA, 103 bp, Artificial Sequence
  Synthetic Polynucleotide
taatacgactcactataggggatctcagtgcatgcatgatactcgatcataacagaggagaatgatcatgtatcatgcaaacctggcggcagcgcaaaagatg

SEQ ID NO: 36389 - DNA, 103 bp, Artificial Sequence
  Synthetic Polynucleotide
taatacgactcactatagggaataactcgacagttcaagctcactacgagaacagaggagactcgtaatgagcttgaacaacctggcggcagcgcaaaagatg

SEQ ID NO: 36390 - DNA, 103 bp, Artificial Sequence
  Synthetic Polynucleotide
taatacgactcactatagggcccctgcagcgccttgtttccacgcgcaagaacagaggagacttgcgatgggaaacaagaacctggcggcagcgcaaaagatg

SEQ ID NO: 36391 - DNA, 103 bp, Artificial Sequence
  Synthetic Polynucleotide
taatacgactcactataggggactgcccggaggccgtatggccacagttgaacagaggagacaactgatgccatacggcaacctggcggcagcgcaaaagatg

SEQ ID NO: 36392 - DNA, 103 bp, Artificial Sequence
  Synthetic Polynucleotide
taatacgactcactataggggccacgtatggaaataacctggcgacagcaaacagaggagatgctgtatgcaggttattaacctggcggcagcgcaaaagatg

SEQ ID NO: 36393 - DNA, 103 bp, Artificial Sequence
  Synthetic Polynucleotide
taatacgactcactataggggcaaaaggtgcactagatggcgttatctacaacagaggagagtagatatggccatctagaacctggcggcagcgcaaaagatg

SEQ ID NO: 36394 - DNA, 103 bp, Artificial Sequence
  Synthetic Polynucleotide
taatacgactcactataggggcctagggaatttgttgaaccgaagtcaaaaacagaggagatttgacatgggttcaacaaacctggcggcagcgcaaaagatg

SEQ ID NO: 36395 - DNA, 103 bp, Artificial Sequence
  Synthetic Polynucleotide
taatacgactcactatagggttctagagtgtatcatcctgccagaagtgtaacagaggagaacacttatggcaggatgaaacctggcggcagcgcaaaagatg

SEQ ID NO: 36396 - DNA, 103 bp, Artificial Sequence
  Synthetic Polynucleotide
taatacgactcactataggggtaggtggggtggactaaaagctgtagaggaacagaggagacctctaatgcttttagtcaacctggcggcagcgcaaaagatg

SEQ ID NO: 36397 - DNA, 103 bp, Artificial Sequence
  Synthetic Polynucleotide
taatacgactcactatagggctacgtaggccatactcagaggggctaaacaacagaggagagtttagatgctctgagtaaacctggcggcagcgcaaaagatg

SEQ ID NO: 36398 - DNA, 103 bp, Artificial Sequence
  Synthetic Polynucleotide
taatacgactcactatagggtatggctggtacctaacgcaattagtgaataacagaggagaattcacatgttgcgttagaacctggcggcagcgcaaaagatg

SEQ ID NO: 36399 - DNA, 103 bp, Artificial Sequence
  Synthetic Polynucleotide
taatacgactcactatagggaacgtccgcatgtcggattactcgccgccaaacagaggagatggcggatggtaatccgaaacctggcggcagcgcaaaagatg

SEQ ID NO: 36400 - DNA, 103 bp, Artificial Sequence
  Synthetic Polynucleotide
taatacgactcactataggggaggttccatgacgattctttgatacatggaacagaggagaccatgtatgaaagaatcgaacctggcggcagcgcaaaagatg

SEQ ID NO: 36401 - DNA, 103 bp, Artificial Sequence
  Synthetic Polynucleotide
taatacgactcactataggggtccaattttagatttgttaaggcgcgtcaaacagaggagatgacgcatgttaacaaataacctggcggcagcgcaaaagatg

SEQ ID NO: 36402 - DNA, 103 bp, Artificial Sequence
  Synthetic Polynucleotide
taatacgactcactatagggagcttcgaggattccatccaaatacctgacaacagaggagagtcaggatgttggatggaaacctggcggcagcgcaaaagatg

SEQ ID NO: 36403 - DNA, 103 bp, Artificial Sequence
  Synthetic Polynucleotide
taatacgactcactatagggtgatgtccggggagactgtgacctcgacgtaacagaggagaacgtcgatgtcacagtctaacctggcggcagcgcaaaagatg

SEQ ID NO: 36404 - DNA, 103 bp, Artificial Sequence
  Synthetic Polynucleotide
taatacgactcactatagggtctagcgggcgccccaatagtaggcggaggaacagaggagacctccgatgactattgggaacctggcggcagcgcaaaagatg

SEQ ID NO: 36405 - DNA, 103 bp, Artificial Sequence
  Synthetic Polynucleotide
taatacgactcactatagggagaacgtcgtctcactagtaatgtcatatcaacagaggagagatatgatgttactagtgaacctggcggcagcgcaaaagatg

SEQ ID NO: 36406 - DNA, 103 bp, Artificial Sequence
  Synthetic Polynucleotide
taatacgactcactatagggcatattgttaaaatgagccaagttgcccggaacagaggagaccgggcatgttggctcataacctggcggcagcgcaaaagatg

SEQ ID NO: 36407 - DNA, 103 bp, Artificial Sequence
  Synthetic Polynucleotide
taatacgactcactatagggttatccgatgcgtgcgttctcacgagtacaaacagaggagatgtactatggagaacgcaaacctggcggcagcgcaaaagatg

SEQ ID NO: 36408 - DNA, 103 bp, Artificial Sequence
  Synthetic Polynucleotide
taatacgactcactataggggcgtgccttgatcttgtaatgtacgcctgaaacagaggagatcaggcatgcattacaagaacctggcggcagcgcaaaagatg

SEQ ID NO: 36409 - DNA, 103 bp, Artificial Sequence
  Synthetic Polynucleotide
taatacgactcactatagggggccgatctcacccacgccctatttcggtgaacagaggagacaccgaatgagggcgtggaacctggcggcagcgcaaaagatg

SEQ ID NO: 36410 - DNA, 103 bp, Artificial Sequence
  Synthetic Polynucleotide
taatacgactcactataggggtcacctcctgctatgcaaaagggggtcctaacagaggagaaggaccatgttttgcataaacctggcggcagcgcaaaagatg

SEQ ID NO: 36411 - DNA, 103 bp, Artificial Sequence
  Synthetic Polynucleotide
taatacgactcactatagggtagcgcacttgtgcagtctccgagaatcataacagaggagaatgattatgggagactgcaacctggcggcagcgcaaaagatg

SEQ ID NO: 36412 - DNA, 103 bp, Artificial Sequence
  Synthetic Polynucleotide
taatacgactcactatagggtggaggagtcttgacgctatgtacactacaaacagaggagatgtagtatgcatagcgtcaacctggcggcagcgcaaaagatg

SEQ ID NO: 36413 - DNA, 103 bp, Artificial Sequence
  Synthetic Polynucleotide
taatacgactcactatagggagccaaggatgagactgatcgtactgccgaaacagaggagatcggcaatgcgatcagtcaacctggcggcagcgcaaaagatg

SEQ ID NO: 36414 - DNA, 103 bp, Artificial Sequence
  Synthetic Polynucleotide
taatacgactcactatagggagatctgaacgtaccgtagccatcgagagcaacagaggagagctctcatgggctacggtaacctggcggcagcgcaaaagatg

SEQ ID NO: 36415 - DNA, 103 bp, Artificial Sequence
  Synthetic Polynucleotide
taatacgactcactataggggatctgcagtataatacttggttccgtgaaaacagaggagattcacgatgccaagtattaacctggcggcagcgcaaaagatg

SEQ ID NO: 36416 - DNA, 103 bp, Artificial Sequence
  Synthetic Polynucleotide
taatacgactcactatagggcctctgacgtcctggagtaccgaatggcagaacagaggagactgccaatgggtactccaaacctggcggcagcgcaaaagatg

SEQ ID NO: 36417 - DNA, 103 bp, Artificial Sequence
  Synthetic Polynucleotide
taatacgactcactataggggcctccgaggggacccttaaactcatggtaaacagaggagataccatatgtttaagggtaacctggcggcagcgcaaaagatg

SEQ ID NO: 36418 - DNA, 103 bp, Artificial Sequence
  Synthetic Polynucleotide
taatacgactcactatagggtcgcacgctcctcagaggcacgggctgttgaacagaggagacaacagatggtgcctctgaacctggcggcagcgcaaaagatg

SEQ ID NO: 36419 - DNA, 103 bp, Artificial Sequence
  Synthetic Polynucleotide
taatacgactcactatagggggttggtatcagactgcatcaaacgttttgaacagaggagacaaaacatgtgatgcagtaacctggcggcagcgcaaaagatg

SEQ ID NO: 36420 - DNA, 103 bp, Artificial Sequence
  Synthetic Polynucleotide
taatacgactcactatagggataccacggcgaccatttatccagtgtccgaacagaggagacggacaatggataaatggaacctggcggcagcgcaaaagatg

SEQ ID NO: 36421 - DNA, 103 bp, Artificial Sequence
  Synthetic Polynucleotide
taatacgactcactatagggaacttatatcacatacgtagaacgagcaggaacagaggagacctgctatgtctacgtataacctggcggcagcgcaaaagatg

SEQ ID NO: 36422 - DNA, 103 bp, Artificial Sequence
  Synthetic Polynucleotide
taatacgactcactatagggcataaatttagaccagtctgattcgatgggaacagaggagacccatcatgtcagactggaacctggcggcagcgcaaaagatg

SEQ ID NO: 36423 - DNA, 103 bp, Artificial Sequence
  Synthetic Polynucleotide
taatacgactcactatagggtggagcttccgccttcaataagttttaatcaacagaggagagattaaatgttattgaagaacctggcggcagcgcaaaagatg

SEQ ID NO: 36424 - DNA, 103 bp, Artificial Sequence
  Synthetic Polynucleotide
taatacgactcactatagggccctggagagcctgctacgctgtggtctcaaacagaggagatgagacatgagcgtagcaaacctggcggcagcgcaaaagatg

SEQ ID NO: 36425 - DNA, 103 bp, Artificial Sequence
  Synthetic Polynucleotide
taatacgactcactatagggcgtattattcaccgcctggcttattgtagtaacagaggagaactacaatgagccaggcgaacctggcggcagcgcaaaagatg

SEQ ID NO: 36426 - DNA, 103 bp, Artificial Sequence
  Synthetic Polynucleotide
taatacgactcactatagggtggggcctggccaggaattggatccacaagaacagaggagacttgtgatgccaattcctaacctggcggcagcgcaaaagatg

SEQ ID NO: 36427 - DNA, 103 bp, Artificial Sequence
  Synthetic Polynucleotide
taatacgactcactatagggcttttgtaggcataacctatgtaagggcgtaacagaggagaacgcccatgcataggttaaacctggcggcagcgcaaaagatg

SEQ ID NO: 36428 - DNA, 103 bp, Artificial Sequence
  Synthetic Polynucleotide
taatacgactcactatagggaaactgatctctactgtatcctcaaaccccaacagaggagaggggttatgggatacagtaacctggcggcagcgcaaaagatg

SEQ ID NO: 36429 - DNA, 103 bp, Artificial Sequence
  Synthetic Polynucleotide
taatacgactcactatagggatagggcattgaagactcacatcgatctgtaacagaggagaacagatatgtgtgagtctaacctggcggcagcgcaaaagatg

SEQ ID NO: 36430 - DNA, 103 bp, Artificial Sequence
  Synthetic Polynucleotide
taatacgactcactatagggtgcagggttggccacgcccagtttagattcaacagaggagagaatctatgctgggcgtgaacctggcggcagcgcaaaagatg

SEQ ID NO: 36431 - DNA, 103 bp, Artificial Sequence
  Synthetic Polynucleotide
taatacgactcactatagggagggtgatgatcttgcaacagtcgttcggcaacagaggagagccgaaatgctgttgcaaaacctggcggcagcgcaaaagatg

SEQ ID NO: 36432 - DNA, 103 bp, Artificial Sequence
  Synthetic Polynucleotide
taatacgactcactatagggacgatgatcgtctctagtgaagttaagaaaaacagaggagatttcttatgttcactagaaacctggcggcagcgcaaaagatg

SEQ ID NO: 36433 - DNA, 103 bp, Artificial Sequence
  Synthetic Polynucleotide
taatacgactcactatagggtactattacgtttccgcaagcttgactgagaacagaggagactcagtatggcttgcggaaacctggcggcagcgcaaaagatg

SEQ ID NO: 36434 - DNA, 103 bp, Artificial Sequence
  Synthetic Polynucleotide
taatacgactcactatagggccagaggctacctatggctctatgtaccctaacagaggagaagggtaatgagagccataaacctggcggcagcgcaaaagatg

SEQ ID NO: 36435 - DNA, 103 bp, Artificial Sequence
  Synthetic Polynucleotide
taatacgactcactatagggagggagagggccgtggctaccgcgaccagtaacagaggagaactggtatgggtagccacaacctggcggcagcgcaaaagatg

SEQ ID NO: 36436 - DNA, 103 bp, Artificial Sequence
  Synthetic Polynucleotide
taatacgactcactataggggtctagtagcgcaagttttacacaatcacgaacagaggagacgtgatatggtaaaacttaacctggcggcagcgcaaaagatg

SEQ ID NO: 36437 - DNA, 103 bp, Artificial Sequence
  Synthetic Polynucleotide
taatacgactcactatagggtgcctatagaccacgttatgaacacgagtcaacagaggagagactcgatgtcataacgtaacctggcggcagcgcaaaagatg

SEQ ID NO: 36438 - DNA, 103 bp, Artificial Sequence
  Synthetic Polynucleotide
taatacgactcactataggggcgccagaaaaatactgccattccagtgggaacagaggagacccactatgatggcagtaaacctggcggcagcgcaaaagatg

SEQ ID NO: 36439 - DNA, 103 bp, Artificial Sequence
  Synthetic Polynucleotide
taatacgactcactataggggtacattctggtcccacattccgtctggtgaacagaggagacaccagatggaatgtgggaacctggcggcagcgcaaaagatg

SEQ ID NO: 36440 - DNA, 103 bp, Artificial Sequence
  Synthetic Polynucleotide
taatacgactcactatagggaatctggggcgctctttctattagcgagccaacagaggagaggctcgatgatagaaagaaacctggcggcagcgcaaaagatg

SEQ ID NO: 36441 - DNA, 103 bp, Artificial Sequence
  Synthetic Polynucleotide
taatacgactcactatagggctccgatggtgcacaggaggggtgtcgtctaacagaggagaagacgaatgccctcctgtaacctggcggcagcgcaaaagatg

SEQ ID NO: 36442 - DNA, 103 bp, Artificial Sequence
  Synthetic Polynucleotide
taatacgactcactatagggcgttcctaagagtcgcactaaaactactataacagaggagaatagtaatgttagtgcgaaacctggcggcagcgcaaaagatg

SEQ ID NO: 36443 - DNA, 103 bp, Artificial Sequence
  Synthetic Polynucleotide
taatacgactcactatagggttaaaatcgagggcgcccgagtttagtacaaacagaggagatgtactatgctcgggcgcaacctggcggcagcgcaaaagatg

SEQ ID NO: 36444 - DNA, 103 bp, Artificial Sequence
  Synthetic Polynucleotide
taatacgactcactatagggctggactctggttacaaaagtattgcgaccaacagaggagaggtcgcatgacttttgtaaacctggcggcagcgcaaaagatg

SEQ ID NO: 36445 - DNA, 103 bp, Artificial Sequence
  Synthetic Polynucleotide
taatacgactcactatagggccaaaactgattgggaggcgttccccgggtaacagaggagaacccggatgacgcctcccaacctggcggcagcgcaaaagatg

SEQ ID NO: 36446 - DNA, 103 bp, Artificial Sequence
  Synthetic Polynucleotide
taatacgactcactataggggagaaggggatgcgaacccaccgctttgcgaacagaggagacgcaaaatggtgggttcgaacctggcggcagcgcaaaagatg

SEQ ID NO: 36447 - DNA, 103 bp, Artificial Sequence
  Synthetic Polynucleotide
taatacgactcactatagggatttaagagggactgcgagcatctccgcagaacagaggagactgcggatgtgctcgcagaacctggcggcagcgcaaaagatg

SEQ ID NO: 36448 - DNA, 103 bp, Artificial Sequence
  Synthetic Polynucleotide
taatacgactcactataggggtgagagtcgtaatcggaggctcgaacaccaacagaggagaggtgttatggcctccgataacctggcggcagcgcaaaagatg

SEQ ID NO: 36449 - DNA, 103 bp, Artificial Sequence
  Synthetic Polynucleotide
taatacgactcactatagggtagtgatccgagaacaggtcgtgaatcttaaacagaggagataagatatgcgacctgttaacctggcggcagcgcaaaagatg

SEQ ID NO: 36450 - DNA, 103 bp, Artificial Sequence
  Synthetic Polynucleotide
taatacgactcactatagggagccgcgtggatcgggccacgaggattgctaacagaggagaagcaatatgcgtggcccgaacctggcggcagcgcaaaagatg

SEQ ID NO: 36451 - DNA, 103 bp, Artificial Sequence
  Synthetic Polynucleotide
taatacgactcactatagggtcaatcacgatggcgggctgcaggaccataaacagaggagatatggtatggcagcccgcaacctggcggcagcgcaaaagatg

SEQ ID NO: 36452 - DNA, 103 bp, Artificial Sequence
  Synthetic Polynucleotide
taatacgactcactatagggctcacccgcacgtatgcaagacgaatttggaacagaggagaccaaatatgtcttgcataaacctggcggcagcgcaaaagatg

SEQ ID NO: 36453 - DNA, 103 bp, Artificial Sequence
  Synthetic Polynucleotide
taatacgactcactatagggggagcgcggcttcttgcaccaagtcagacaaacagaggagatgtctgatgtggtgcaagaacctggcggcagcgcaaaagatg

SEQ ID NO: 36454 - DNA, 103 bp, Artificial Sequence
  Synthetic Polynucleotide
taatacgactcactatagggacggataaccagcaggtgtcgtagtcacaaaacagaggagattgtgaatgcgacacctgaacctggcggcagcgcaaaagatg

SEQ ID NO: 36455 - DNA, 103 bp, Artificial Sequence
  Synthetic Polynucleotide
taatacgactcactatagggagatctcaacgacataacgccgcctatgacaacagaggagagtcataatgggcgttatgaacctggcggcagcgcaaaagatg

SEQ ID NO: 36456 - DNA, 103 bp, Artificial Sequence
  Synthetic Polynucleotide
taatacgactcactatagggtccattagaacctgtctcgttctccccttgaacagaggagacaagggatgaacgagacaaacctggcggcagcgcaaaagatg

SEQ ID NO: 36457 - DNA, 103 bp, Artificial Sequence
  Synthetic Polynucleotide
taatacgactcactatagggccaagcgtaacgttgtaagccgcttgaggaaacagaggagatcctcaatgggcttacaaaacctggcggcagcgcaaaagatg

SEQ ID NO: 36458 - DNA, 103 bp, Artificial Sequence
  Synthetic Polynucleotide
taatacgactcactatagggaatatcaactattgactgcgcgagaccgtaaacagaggagatacggtatggcgcagtcaaacctggcggcagcgcaaaagatg

SEQ ID NO: 36459 - DNA, 103 bp, Artificial Sequence
  Synthetic Polynucleotide
taatacgactcactatagggccctgtgaatctcgcgggttagaactagcgaacagaggagacgctagatgtaacccgcgaacctggcggcagcgcaaaagatg

SEQ ID NO: 36460 - DNA, 103 bp, Artificial Sequence
  Synthetic Polynucleotide
taatacgactcactatagggaccttactcgaggcggtatgtgccgaacgaaacagaggagatcgttcatgacataccgcaacctggcggcagcgcaaaagatg

SEQ ID NO: 36461 - DNA, 103 bp, Artificial Sequence
  Synthetic Polynucleotide
taatacgactcactatagggttagcaccacctcaaggtatgcactgcctgaacagaggagacaggcaatgcataccttgaacctggcggcagcgcaaaagatg

SEQ ID NO: 36462 - DNA, 103 bp, Artificial Sequence
  Synthetic Polynucleotide
taatacgactcactatagggacctcaggcaacgacgttatttaacccagtaacagaggagaactgggatgaataacgtcaacctggcggcagcgcaaaagatg

SEQ ID NO: 36463 - DNA, 103 bp, Artificial Sequence
  Synthetic Polynucleotide
taatacgactcactatagggtttatctgtttgtaccttctattcccgagcaacagaggagagctcggatgtagaaggtaaacctggcggcagcgcaaaagatg

SEQ ID NO: 36464 - DNA, 103 bp, Artificial Sequence
  Synthetic Polynucleotide
taatacgactcactatagggagctgcactaacttcgagacccactacggtaacagaggagaaccgtaatgggtctcgaaaacctggcggcagcgcaaaagatg

SEQ ID NO: 36465 - DNA, 103 bp, Artificial Sequence
  Synthetic Polynucleotide
taatacgactcactatagggaacgcgcgttcgtgatgcaccactcaacgaaacagaggagatcgttgatgggtgcatcaaacctggcggcagcgcaaaagatg

SEQ ID NO: 36466 - DNA, 103 bp, Artificial Sequence
  Synthetic Polynucleotide
taatacgactcactatagggggcgacgactgtccgtggttacccacgaagaacagaggagacttcgtatgtaaccacggaacctggcggcagcgcaaaagatg

SEQ ID NO: 36467 - DNA, 103 bp, Artificial Sequence
  Synthetic Polynucleotide
taatacgactcactatagggacgatgattcgaagcaatttacaaagccgcaacagaggagagcggctatgtaaattgctaacctggcggcagcgcaaaagatg

SEQ ID NO: 36468 - DNA, 103 bp, Artificial Sequence
  Synthetic Polynucleotide
taatacgactcactatagggagccttcggacgtctcaattccaatccgtgaacagaggagacacggaatggaattgagaaacctggcggcagcgcaaaagatg

SEQ ID NO: 36469 - DNA, 103 bp, Artificial Sequence
  Synthetic Polynucleotide
taatacgactcactatagggacacaccaactgccttgttcccagttatgcaacagaggagagcataaatgggaacaaggaacctggcggcagcgcaaaagatg

SEQ ID NO: 36470 - DNA, 103 bp, Artificial Sequence
  Synthetic Polynucleotide
taatacgactcactatagggtcgcggtaagtatcagtcgagaaagctttgaacagaggagacaaagcatgctcgactgaaacctggcggcagcgcaaaagatg

SEQ ID NO: 36471 - DNA, 103 bp, Artificial Sequence
  Synthetic Polynucleotide
taatacgactcactatagggtcacgcccccaacctagtgtctcggtcaataacagaggagaattgacatggacactaggaacctggcggcagcgcaaaagatg

SEQ ID NO: 36472 - DNA, 103 bp, Artificial Sequence
  Synthetic Polynucleotide
taatacgactcactatagggggttgctattgataaaggtgcgctcggcataacagaggagaatgccgatggcacctttaaacctggcggcagcgcaaaagatg

SEQ ID NO: 36473 - DNA, 103 bp, Artificial Sequence
  Synthetic Polynucleotide
taatacgactcactatagggcttcgcctctcgtcggaagggcatacccagaacagaggagactgggtatgcccttccgaaacctggcggcagcgcaaaagatg

SEQ ID NO: 36474 - DNA, 103 bp, Artificial Sequence
  Synthetic Polynucleotide
taatacgactcactatagggctggtaggtggtgatcagaattttgcccaaaacagaggagattgggcatgattctgatcaacctggcggcagcgcaaaagatg

SEQ ID NO: 36475 - DNA, 103 bp, Artificial Sequence
  Synthetic Polynucleotide
taatacgactcactatagggcgggatgcgagtagacctgagattatctgtaacagaggagaacagatatgctcaggtctaacctggcggcagcgcaaaagatg

SEQ ID NO: 36476 - DNA, 103 bp, Artificial Sequence
  Synthetic Polynucleotide
taatacgactcactatagggttgcgggttagaagagaacgtcgcccaaagaacagaggagactttggatgacgttctctaacctggcggcagcgcaaaagatg

SEQ ID NO: 36477 - DNA, 103 bp, Artificial Sequence
  Synthetic Polynucleotide
taatacgactcactatagggtagtttacattctaacccggtgcatttggaaacagaggagatccaaaatgaccgggttaaacctggcggcagcgcaaaagatg

SEQ ID NO: 36478 - DNA, 103 bp, Artificial Sequence
  Synthetic Polynucleotide
taatacgactcactataggggtcgttggaagcgtgacgtcgtctttacataacagaggagaatgtaaatgcgacgtcacaacctggcggcagcgcaaaagatg

SEQ ID NO: 36479 - DNA, 103 bp, Artificial Sequence
  Synthetic Polynucleotide
taatacgactcactatagggagagttacgttttttgcggcgcgctaagcgaacagaggagacgcttaatgcgccgcaaaaacctggcggcagcgcaaaagatg

SEQ ID NO: 36480 - DNA, 103 bp, Artificial Sequence
  Synthetic Polynucleotide
taatacgactcactatagggatgcgaagcttaatagaaccagggtcactgaacagaggagacagtgaatgtggttctataacctggcggcagcgcaaaagatg

SEQ ID NO: 36481 - DNA, 103 bp, Artificial Sequence
  Synthetic Polynucleotide
taatacgactcactatagggtctgtgctaaacagcagttttaggtcgttgaacagaggagacaacgaatgaaaactgctaacctggcggcagcgcaaaagatg

SEQ ID NO: 36482 - DNA, 103 bp, Artificial Sequence
  Synthetic Polynucleotide
taatacgactcactataggggacctgaaccaaggtgcatttgtcggtggtaacagaggagaaccaccatgaaatgcaccaacctggcggcagcgcaaaagatg

SEQ ID NO: 36483 - DNA, 103 bp, Artificial Sequence
  Synthetic Polynucleotide
taatacgactcactatagggggaattcttccggaaatgaattagccctaaaacagaggagattagggatgattcatttcaacctggcggcagcgcaaaagatg

SEQ ID NO: 36484 - DNA, 103 bp, Artificial Sequence
  Synthetic Polynucleotide
taatacgactcactatagggccccgcattcgcaagcttgactgtcttgtgaacagaggagacacaagatggtcaagcttaacctggcggcagcgcaaaagatg

SEQ ID NO: 36485 - DNA, 103 bp, Artificial Sequence
  Synthetic Polynucleotide
taatacgactcactatagggttggacgctattatcgcacatagcgcggtgaacagaggagacaccgcatgatgtgcgataacctggcggcagcgcaaaagatg

SEQ ID NO: 36486 - DNA, 103 bp, Artificial Sequence
  Synthetic Polynucleotide
taatacgactcactatagggacccggttgctggtctgtagataatctaataacagaggagaattagaatgtctacagacaacctggcggcagcgcaaaagatg

SEQ ID NO: 36487 - DNA, 103 bp, Artificial Sequence
  Synthetic Polynucleotide
taatacgactcactatagggataagcggcgccacagaccgcagccgtactaacagaggagaagtacgatggcggtctgtaacctggcggcagcgcaaaagatg

SEQ ID NO: 36488 - DNA, 103 bp, Artificial Sequence
  Synthetic Polynucleotide
taatacgactcactatagggtaaataggtcagctgtcgcgagcgaattccaacagaggagaggaattatgtcgcgacagaacctggcggcagcgcaaaagatg

SEQ ID NO: 36489 - DNA, 103 bp, Artificial Sequence
  Synthetic Polynucleotide
taatacgactcactatagggcacttttcttacattataataaccggatttaacagaggagaaaatccatgtattataataacctggcggcagcgcaaaagatg

SEQ ID NO: 36490 - DNA, 103 bp, Artificial Sequence
  Synthetic Polynucleotide
taatacgactcactataggggatccagatgaaccagtgggcctcgccaccaacagaggagaggtggcatggcccactggaacctggcggcagcgcaaaagatg

SEQ ID NO: 36491 - DNA, 103 bp, Artificial Sequence
  Synthetic Polynucleotide
taatacgactcactatagggggtgaagggggataacacttttaacgacctaacagaggagaaggtcgatgaaagtgttaaacctggcggcagcgcaaaagatg

SEQ ID NO: 36492 - DNA, 103 bp, Artificial Sequence
  Synthetic Polynucleotide
taatacgactcactataggggtagctggtgtgttctcggagtctccagggaacagaggagaccctggatgctccgagaaaacctggcggcagcgcaaaagatg

SEQ ID NO: 36493 - DNA, 103 bp, Artificial Sequence
  Synthetic Polynucleotide
taatacgactcactatagggcgttagctcacttgccttcccgtccgacggaacagaggagaccgtcgatggggaaggcaaacctggcggcagcgcaaaagatg

SEQ ID NO: 36494 - DNA, 103 bp, Artificial Sequence
  Synthetic Polynucleotide
taatacgactcactatagggttcaccagggacgggcccacgagaatatgcaacagaggagagcatatatgcgtgggcccaacctggcggcagcgcaaaagatg

SEQ ID NO: 36495 - DNA, 103 bp, Artificial Sequence
  Synthetic Polynucleotide
taatacgactcactatagggtttgggtcaacttactcctgcgagggattaaacagaggagataatccatggcaggagtaaacctggcggcagcgcaaaagatg

SEQ ID NO: 36496 - DNA, 103 bp, Artificial Sequence
  Synthetic Polynucleotide
taatacgactcactatagggtggtcgatatgccggtcttcgtttcaagggaacagaggagacccttgatgcgaagaccgaacctggcggcagcgcaaaagatg

SEQ ID NO: 36497 - DNA, 103 bp, Artificial Sequence
  Synthetic Polynucleotide
taatacgactcactataggggccgaagttagttaaaacctcaaaaacgtgaacagaggagacacgttatggaggttttaaacctggcggcagcgcaaaagatg

SEQ ID NO: 36498 - DNA, 103 bp, Artificial Sequence
  Synthetic Polynucleotide
taatacgactcactatagggtaatggtaacgttgtgcaactccgtagtataacagaggagaatactaatgagttgcacaaacctggcggcagcgcaaaagatg

SEQ ID NO: 36499 - DNA, 103 bp, Artificial Sequence
  Synthetic Polynucleotide
taatacgactcactatagggtcgtgggagaatgcagtccataatgaattgaacagaggagacaattcatgatggactgcaacctggcggcagcgcaaaagatg

SEQ ID NO: 36500 - DNA, 103 bp, Artificial Sequence
  Synthetic Polynucleotide
taatacgactcactatagggcgctgccggcgcctacgcccagagctggtaaacagaggagataccagatgtgggcgtagaacctggcggcagcgcaaaagatg

SEQ ID NO: 36501 - DNA, 103 bp, Artificial Sequence
  Synthetic Polynucleotide
taatacgactcactatagggagcctaagctgctccccggttttgtcggtcaacagaggagagaccgaatgaaccggggaaacctggcggcagcgcaaaagatg

SEQ ID NO: 36502 - DNA, 103 bp, Artificial Sequence
  Synthetic Polynucleotide
taatacgactcactatagggcagtgataccgcggaataaaagctacataaaacagaggagattatgtatgttttattccaacctggcggcagcgcaaaagatg

SEQ ID NO: 36503 - DNA, 103 bp, Artificial Sequence
  Synthetic Polynucleotide
taatacgactcactatagggcctcatgatcaagccaattcgtatagtacaaacagaggagatgtactatgcgaattggcaacctggcggcagcgcaaaagatg

SEQ ID NO: 36504 - DNA, 103 bp, Artificial Sequence
  Synthetic Polynucleotide
taatacgactcactatagggcacttatcctgatagggttggctttcccctaacagaggagaaggggaatgccaaccctaaacctggcggcagcgcaaaagatg

SEQ ID NO: 36505 - DNA, 103 bp, Artificial Sequence
  Synthetic Polynucleotide
taatacgactcactatagggaacataagcttatatgtcgttcaaggctgaaacagaggagatcagccatgaacgacataaacctggcggcagcgcaaaagatg

SEQ ID NO: 36506 - DNA, 103 bp, Artificial Sequence
  Synthetic Polynucleotide
taatacgactcactatagggcagaaacaccgtagtgaaccttccggctgaaacagaggagatcagccatgaggttcactaacctggcggcagcgcaaaagatg

SEQ ID NO: 36507 - DNA, 103 bp, Artificial Sequence
  Synthetic Polynucleotide
taatacgactcactatagggtttcggaagttcttggattctgctccttgaaacagaggagatcaaggatgagaatccaaaacctggcggcagcgcaaaagatg

SEQ ID NO: 36508 - DNA, 103 bp, Artificial Sequence
  Synthetic Polynucleotide
taatacgactcactataggggttattagcttgggctcgatgcagtccgggaacagaggagacccggaatgcatcgagccaacctggcggcagcgcaaaagatg

SEQ ID NO: 36509 - DNA, 103 bp, Artificial Sequence
  Synthetic Polynucleotide
taatacgactcactatagggtctaaagcgagttgtgatagtgtgatcgcaaacagaggagatgcgatatgactatcacaaacctggcggcagcgcaaaagatg

SEQ ID NO: 36510 - DNA, 103 bp, Artificial Sequence
  Synthetic Polynucleotide
taatacgactcactatagggatacagtagagtgcttacgtttcgcatatgaacagaggagacatatgatgaacgtaagcaacctggcggcagcgcaaaagatg

SEQ ID NO: 36511 - DNA, 103 bp, Artificial Sequence
  Synthetic Polynucleotide
taatacgactcactatagggtctggctcacagaaggtggttacgagaccgaacagaggagacggtctatgaaccaccttaacctggcggcagcgcaaaagatg

SEQ ID NO: 36512 - DNA, 103 bp, Artificial Sequence
  Synthetic Polynucleotide
taatacgactcactatagggaagctgcgaaggccggagagcctagcttacaacagaggagagtaagcatggctctccggaacctggcggcagcgcaaaagatg

SEQ ID NO: 36513 - DNA, 103 bp, Artificial Sequence
  Synthetic Polynucleotide
taatacgactcactatagggggtactagcctacatgctgcctcgatatttaacagaggagaaaatatatgggcagcatgaacctggcggcagcgcaaaagatg

SEQ ID NO: 36514 - DNA, 103 bp, Artificial Sequence
  Synthetic Polynucleotide
taatacgactcactataggggagtcaactgcttgccattctatgtggagtaacagaggagaactccaatgagaatggcaaacctggcggcagcgcaaaagatg

SEQ ID NO: 36515 - DNA, 103 bp, Artificial Sequence
  Synthetic Polynucleotide
taatacgactcactatagggcccgtttatgtgtcacgccaccgatgggtaaacagaggagatacccaatggtggcgtgaaacctggcggcagcgcaaaagatg

SEQ ID NO: 36516 - DNA, 103 bp, Artificial Sequence
  Synthetic Polynucleotide
taatacgactcactatagggactggggtttaaccagatgccactgatagtaacagaggagaactatcatgggcatctggaacctggcggcagcgcaaaagatg

SEQ ID NO: 36517 - DNA, 103 bp, Artificial Sequence
  Synthetic Polynucleotide
taatacgactcactatagggccagtgggatcctacgtctcgtgctcttccaacagaggagaggaagaatgcgagacgtaaacctggcggcagcgcaaaagatg

SEQ ID NO: 36518 - DNA, 103 bp, Artificial Sequence
  Synthetic Polynucleotide
taatacgactcactatagggcggaaaagtgcagaatcggtctctgatactaacagaggagaagtatcatggaccgattcaacctggcggcagcgcaaaagatg

SEQ ID NO: 36519 - DNA, 103 bp, Artificial Sequence
  Synthetic Polynucleotide
taatacgactcactatagggtacttcagaactgcgcaagcctgcctccgcaacagaggagagcggagatgggcttgcgcaacctggcggcagcgcaaaagatg

SEQ ID NO: 36520 - DNA, 103 bp, Artificial Sequence
  Synthetic Polynucleotide
taatacgactcactatagggcatggtctatccgccttatgaagaggggccaacagaggagaggccccatgtcataaggcaacctggcggcagcgcaaaagatg

SEQ ID NO: 36521 - DNA, 103 bp, Artificial Sequence
  Synthetic Polynucleotide
taatacgactcactatagggatggacctctaacctccgtaaactagtgcgaacagaggagacgcactatgttacggaggaacctggcggcagcgcaaaagatg

SEQ ID NO: 36522 - DNA, 103 bp, Artificial Sequence
  Synthetic Polynucleotide
taatacgactcactatagggagaccgtaggtccactcaagggaccgagccaacagaggagaggctcgatgccttgagtgaacctggcggcagcgcaaaagatg

SEQ ID NO: 36523 - DNA, 103 bp, Artificial Sequence
  Synthetic Polynucleotide
taatacgactcactatagggaggtaaagcgctttgcctagaacagggggcaacagaggagagcccccatgtctaggcaaaacctggcggcagcgcaaaagatg

SEQ ID NO: 36524 - DNA, 103 bp, Artificial Sequence
  Synthetic Polynucleotide
taatacgactcactataggggacatgcaggagcggatggcatatttccgcaacagaggagagcggaaatgtgccatccgaacctggcggcagcgcaaaagatg

SEQ ID NO: 36525 - DNA, 103 bp, Artificial Sequence
  Synthetic Polynucleotide
taatacgactcactatagggatattagcatccacctaccttcgggatcaaaacagaggagattgatcatgaaggtaggtaacctggcggcagcgcaaaagatg

SEQ ID NO: 36526 - DNA, 103 bp, Artificial Sequence
  Synthetic Polynucleotide
taatacgactcactataggggggtgtgctaccaacattatcgtctgtctcaacagaggagagagacaatggataatgttaacctggcggcagcgcaaaagatg

SEQ ID NO: 36527 - DNA, 103 bp, Artificial Sequence
  Synthetic Polynucleotide
taatacgactcactatagggttgcgtctgattgctaagattctcaaccgaaacagaggagatcggttatgaatcttagcaacctggcggcagcgcaaaagatg

SEQ ID NO: 36528 - DNA, 103 bp, Artificial Sequence
  Synthetic Polynucleotide
taatacgactcactataggggagacaaggggcccagcagtactcagccagaacagaggagactggctatgtactgctggaacctggcggcagcgcaaaagatg

SEQ ID NO: 36529 - DNA, 103 bp, Artificial Sequence
  Synthetic Polynucleotide
taatacgactcactatagggcctaggaaggtgcaatttaccatagtttggaacagaggagaccaaacatgggtaaattgaacctggcggcagcgcaaaagatg

SEQ ID NO: 36530 - DNA, 103 bp, Artificial Sequence
  Synthetic Polynucleotide
taatacgactcactataggggcgctcgtgtcttaaattatccgatgagcaaacagaggagatgctcaatggataatttaaacctggcggcagcgcaaaagatg

SEQ ID NO: 36531 - DNA, 103 bp, Artificial Sequence
  Synthetic Polynucleotide
taatacgactcactatagggatactttctatgacgtggtttttgaaaggcaacagaggagagcctttatgaaaccacgtaacctggcggcagcgcaaaagatg

SEQ ID NO: 36532 - DNA, 103 bp, Artificial Sequence
  Synthetic Polynucleotide
taatacgactcactatagggcaccactagtacgatgaatgcccattgccgaacagaggagacggcaaatggcattcatcaacctggcggcagcgcaaaagatg

SEQ ID NO: 36533 - DNA, 103 bp, Artificial Sequence
  Synthetic Polynucleotide
taatacgactcactatagggggccacacgcccagtaccccatcagttactaacagaggagaagtaacatgtggggtactaacctggcggcagcgcaaaagatg

SEQ ID NO: 36534 - DNA, 103 bp, Artificial Sequence
  Synthetic Polynucleotide
taatacgactcactatagggatccgcgggagcaagctatcgtacttcaccaacagaggagaggtgaaatgcgatagcttaacctggcggcagcgcaaaagatg

SEQ ID NO: 36535 - DNA, 103 bp, Artificial Sequence
  Synthetic Polynucleotide
taatacgactcactataggggaccgacgctaaatgcccgcagactcgcttaacagaggagaaagcgaatgtgcgggcataacctggcggcagcgcaaaagatg

SEQ ID NO: 36536 - DNA, 103 bp, Artificial Sequence
  Synthetic Polynucleotide
taatacgactcactatagggccgttgctaagcatgtgcgattcgggcttcaacagaggagagaagccatgatcgcacataacctggcggcagcgcaaaagatg

SEQ ID NO: 36537 - DNA, 103 bp, Artificial Sequence
  Synthetic Polynucleotide
taatacgactcactatagggttggcggcgattcgctgctatgagtacgttaacagaggagaaacgtaatgatagcagcgaacctggcggcagcgcaaaagatg

SEQ ID NO: 36538 - DNA, 103 bp, Artificial Sequence
  Synthetic Polynucleotide
taatacgactcactatagggcatgacagatttctgctctgcgatgcatttaacagaggagaaaatgcatggcagagcagaacctggcggcagcgcaaaagatg

SEQ ID NO: 36539 - DNA, 103 bp, Artificial Sequence
  Synthetic Polynucleotide
taatacgactcactatagggcatagtgatcgctaggacgcattgtcgcacaacagaggagagtgcgaatgtgcgtcctaaacctggcggcagcgcaaaagatg

SEQ ID NO: 36540 - DNA, 103 bp, Artificial Sequence
  Synthetic Polynucleotide
taatacgactcactatagggccatggggcacatgtactagcttagctaagaacagaggagacttagcatggctagtacaaacctggcggcagcgcaaaagatg

SEQ ID NO: 36541 - DNA, 103 bp, Artificial Sequence
  Synthetic Polynucleotide
taatacgactcactataggggttcatgggcaattaagagccggagaagtcaacagaggagagacttcatgggctcttaaaacctggcggcagcgcaaaagatg

SEQ ID NO: 36542 - DNA, 103 bp, Artificial Sequence
  Synthetic Polynucleotide
taatacgactcactataggggtggttacgaacgcggagcggggggtggctaacagaggagaagccacatgccgctccgcaacctggcggcagcgcaaaagatg

SEQ ID NO: 36543 - DNA, 103 bp, Artificial Sequence
  Synthetic Polynucleotide
taatacgactcactatagggccagctaacgcgcggataactcgtgagcggaacagaggagaccgctcatgagttatccgaacctggcggcagcgcaaaagatg

SEQ ID NO: 36544 - DNA, 103 bp, Artificial Sequence
  Synthetic Polynucleotide
taatacgactcactatagggcatggagtcatgcttatgactacccagacgaacagaggagacgtctgatgagtcataagaacctggcggcagcgcaaaagatg

SEQ ID NO: 36545 - DNA, 103 bp, Artificial Sequence
  Synthetic Polynucleotide
taatacgactcactatagggagcaaactcgttgtcatgacaattaactgtaacagaggagaacagttatgtgtcatgacaacctggcggcagcgcaaaagatg

SEQ ID NO: 36546 - DNA, 103 bp, Artificial Sequence
  Synthetic Polynucleotide
taatacgactcactataggggaaaggatcggctgatctatctcagcgtccaacagaggagaggacgcatggatagatcaaacctggcggcagcgcaaaagatg

SEQ ID NO: 36547 - DNA, 103 bp, Artificial Sequence
  Synthetic Polynucleotide
taatacgactcactatagggctttacagggttatgcgattcaaaccgcgcaacagaggagagcgcggatggaatcgcataacctggcggcagcgcaaaagatg

SEQ ID NO: 36548 - DNA, 103 bp, Artificial Sequence
  Synthetic Polynucleotide
taatacgactcactatagggaaagtgcaatgatcggctctagatcccggaaacagaggagatccgggatgtagagccgaaacctggcggcagcgcaaaagatg

SEQ ID NO: 36549 - DNA, 103 bp, Artificial Sequence
  Synthetic Polynucleotide
taatacgactcactatagggtcactgggagtacgtaaatcatcgcttgtaaacagaggagatacaagatgtgatttacgaacctggcggcagcgcaaaagatg

SEQ ID NO: 36550 - DNA, 103 bp, Artificial Sequence
  Synthetic Polynucleotide
taatacgactcactatagggctgggaattgccctctgaaggactaacgctaacagaggagaagcgttatgccttcagagaacctggcggcagcgcaaaagatg

SEQ ID NO: 36551 - DNA, 103 bp, Artificial Sequence
  Synthetic Polynucleotide
taatacgactcactatagggaccggaagtaaaagctgtgtatcagccgtgaacagaggagacacggcatgtacacagctaacctggcggcagcgcaaaagatg

SEQ ID NO: 36552 - DNA, 103 bp, Artificial Sequence
  Synthetic Polynucleotide
taatacgactcactataggggtcaagtgtcaactagactatgagcaagttaacagaggagaaacttgatgatagtctagaacctggcggcagcgcaaaagatg

SEQ ID NO: 36553 - DNA, 103 bp, Artificial Sequence
  Synthetic Polynucleotide
taatacgactcactatagggacggagcaaattcaagtatggcgcacaatcaacagaggagagattgtatgccatacttgaacctggcggcagcgcaaaagatg

SEQ ID NO: 36554 - DNA, 103 bp, Artificial Sequence
  Synthetic Polynucleotide
taatacgactcactatagggcccgttctgattgtttccggtcgtcgaagcaacagaggagagcttcgatgaccggaaacaacctggcggcagcgcaaaagatg

SEQ ID NO: 36555 - DNA, 103 bp, Artificial Sequence
  Synthetic Polynucleotide
taatacgactcactatagggaacgggagggtcggtaggaaaatacccagcaacagaggagagctgggatgtttcctaccaacctggcggcagcgcaaaagatg

SEQ ID NO: 36556 - DNA, 103 bp, Artificial Sequence
  Synthetic Polynucleotide
taatacgactcactatagggtggtagagtaaggaggcgtagcccccttataacagaggagaataaggatgctacgcctcaacctggcggcagcgcaaaagatg

SEQ ID NO: 36557 - DNA, 103 bp, Artificial Sequence
  Synthetic Polynucleotide
taatacgactcactatagggtagtcattatttccaacgcggggacacggaaacagaggagatccgtgatgccgcgttggaacctggcggcagcgcaaaagatg

SEQ ID NO: 36558 - DNA, 103 bp, Artificial Sequence
  Synthetic Polynucleotide
taatacgactcactatagggaaattctgcggactaagcaatatctgatcgaacagaggagacgatcaatgattgcttagaacctggcggcagcgcaaaagatg

SEQ ID NO: 36559 - DNA, 103 bp, Artificial Sequence
  Synthetic Polynucleotide
taatacgactcactatagggagactatgtcctgcgcctactgaaaacggaaacagaggagatccgttatgagtaggcgcaacctggcggcagcgcaaaagatg

SEQ ID NO: 36560 - DNA, 103 bp, Artificial Sequence
  Synthetic Polynucleotide
taatacgactcactatagggatgcccgttgcgtttgacggtgaagacgggaacagaggagacccgtcatgaccgtcaaaaacctggcggcagcgcaaaagatg

SEQ ID NO: 36561 - DNA, 103 bp, Artificial Sequence
  Synthetic Polynucleotide
taatacgactcactatagggtgatgctaatttcgggcgtcgattctgttaaacagaggagataacagatgcgacgcccgaacctggcggcagcgcaaaagatg

SEQ ID NO: 36562 - DNA, 103 bp, Artificial Sequence
  Synthetic Polynucleotide
taatacgactcactataggggcgggattctgtcctacaggcggtcggataaacagaggagatatccgatggcctgtaggaacctggcggcagcgcaaaagatg

SEQ ID NO: 36563 - DNA, 103 bp, Artificial Sequence
  Synthetic Polynucleotide
taatacgactcactataggggcctcctctatcccgctgctgatggctattaacagaggagaaatagcatgcagcagcggaacctggcggcagcgcaaaagatg

SEQ ID NO: 36564 - DNA, 103 bp, Artificial Sequence
  Synthetic Polynucleotide
taatacgactcactatagggcgctagcgcatatatctcaaactggtagtaaacagaggagatactacatgtttgagataaacctggcggcagcgcaaaagatg

SEQ ID NO: 36565 - DNA, 103 bp, Artificial Sequence
  Synthetic Polynucleotide
taatacgactcactatagggagaacggctttcctggtgggcctaaacctcaacagaggagagaggttatggcccaccagaacctggcggcagcgcaaaagatg

SEQ ID NO: 36566 - DNA, 103 bp, Artificial Sequence
  Synthetic Polynucleotide
taatacgactcactatagggattcagactgtgccagtctaaggtccaagaaacagaggagatcttggatgttagactggaacctggcggcagcgcaaaagatg

SEQ ID NO: 36567 - DNA, 103 bp, Artificial Sequence
  Synthetic Polynucleotide
taatacgactcactatagggcatagttgtcaagcgtcccgatctatcgaaaacagaggagattcgatatgtcgggacgcaacctggcggcagcgcaaaagatg

SEQ ID NO: 36568 - DNA, 103 bp, Artificial Sequence
  Synthetic Polynucleotide
taatacgactcactataggggtggtgtaacgcaagtctgtcagctctccgaacagaggagacggagaatggacagacttaacctggcggcagcgcaaaagatg

SEQ ID NO: 36569 - DNA, 103 bp, Artificial Sequence
  Synthetic Polynucleotide
taatacgactcactatagggcatctggggcctatacagaccaccgctgcgaacagaggagacgcagcatgggtctgtataacctggcggcagcgcaaaagatg

SEQ ID NO: 36570 - DNA, 103 bp, Artificial Sequence
  Synthetic Polynucleotide
taatacgactcactatagggacgcggaacgtaatcgttttcaacattttgaacagaggagacaaaatatggaaaacgataacctggcggcagcgcaaaagatg

SEQ ID NO: 36571 - DNA, 103 bp, Artificial Sequence
  Synthetic Polynucleotide
taatacgactcactatagggccgttcttgtccatgagtactagctttgtaaacagaggagatacaaaatgagtactcataacctggcggcagcgcaaaagatg

SEQ ID NO: 36572 - DNA, 103 bp, Artificial Sequence
  Synthetic Polynucleotide
taatacgactcactatagggccgatgaacaatacgacgaattcgcttcagaacagaggagactgaagatgattcgtcgtaacctggcggcagcgcaaaagatg

SEQ ID NO: 36573 - DNA, 103 bp, Artificial Sequence
  Synthetic Polynucleotide
taatacgactcactatagggtgtccttcagattcctcagctagcggtgataacagaggagaatcaccatgagctgaggaaacctggcggcagcgcaaaagatg

SEQ ID NO: 36574 - DNA, 103 bp, Artificial Sequence
  Synthetic Polynucleotide
taatacgactcactataggggaggtgacgcccggcagcacttccgtaggcaacagaggagagcctacatgagtgctgccaacctggcggcagcgcaaaagatg

SEQ ID NO: 36575 - DNA, 103 bp, Artificial Sequence
  Synthetic Polynucleotide
taatacgactcactatagggggttccactaagtagatggaataatacccgaacagaggagacgggtaatgttccatctaaacctggcggcagcgcaaaagatg

SEQ ID NO: 36576 - DNA, 103 bp, Artificial Sequence
  Synthetic Polynucleotide
taatacgactcactatagggcttcccagctcacccgtgccattattctataacagaggagaatagaaatgtggcacgggaacctggcggcagcgcaaaagatg

SEQ ID NO: 36577 - DNA, 103 bp, Artificial Sequence
  Synthetic Polynucleotide
taatacgactcactatagggcgaaattatctcaaatgtaccaaaactaccaacagaggagaggtagtatgggtacatttaacctggcggcagcgcaaaagatg

SEQ ID NO: 36578 - DNA, 103 bp, Artificial Sequence
  Synthetic Polynucleotide
taatacgactcactatagggcgtcgtttctcgctagtcctcgtccgttccaacagaggagaggaacgatggaggactagaacctggcggcagcgcaaaagatg

SEQ ID NO: 36579 - DNA, 103 bp, Artificial Sequence
  Synthetic Polynucleotide
taatacgactcactatagggcgttctccaaagcacgcttcgaactttgacaacagaggagagtcaaaatgcgaagcgtgaacctggcggcagcgcaaaagatg

SEQ ID NO: 36580 - DNA, 103 bp, Artificial Sequence
  Synthetic Polynucleotide
taatacgactcactatagggccggttcctctgacagcccggacatctgggaacagaggagacccagaatgccgggctgtaacctggcggcagcgcaaaagatg

SEQ ID NO: 36581 - DNA, 103 bp, Artificial Sequence
  Synthetic Polynucleotide
taatacgactcactatagggtcaccagatgcgattagtgggttggccaacaacagaggagagttggcatgcccactaataacctggcggcagcgcaaaagatg

SEQ ID NO: 36582 - DNA, 103 bp, Artificial Sequence
  Synthetic Polynucleotide
taatacgactcactatagggacactatctcttatgggaaggtcgctatcgaacagaggagacgatagatgccttcccataacctggcggcagcgcaaaagatg

SEQ ID NO: 36583 - DNA, 103 bp, Artificial Sequence
  Synthetic Polynucleotide
taatacgactcactatagggtctgcttaagatcgcgggactcagtgcaataacagaggagaattgcaatgagtcccgcgaacctggcggcagcgcaaaagatg

SEQ ID NO: 36584 - DNA, 103 bp, Artificial Sequence
  Synthetic Polynucleotide
taatacgactcactatagggccgctgtttgtgaaccaccggtcatcaaaaaacagaggagattttgaatgccggtggttaacctggcggcagcgcaaaagatg

SEQ ID NO: 36585 - DNA, 103 bp, Artificial Sequence
  Synthetic Polynucleotide
taatacgactcactatagggccaacgtgacgcgtttctctattggaaaaaaacagaggagatttttcatgtagagaaacaacctggcggcagcgcaaaagatg

SEQ ID NO: 36586 - DNA, 103 bp, Artificial Sequence
  Synthetic Polynucleotide
taatacgactcactataggggccttcgactgggtagctcctgcctcctgcaacagaggagagcaggaatgaggagctacaacctggcggcagcgcaaaagatg

SEQ ID NO: 36587 - DNA, 103 bp, Artificial Sequence
  Synthetic Polynucleotide
taatacgactcactatagggcccgaataaactcctgccaaactatagggcaacagaggagagccctaatgtttggcaggaacctggcggcagcgcaaaagatg

SEQ ID NO: 36588 - DNA, 103 bp, Artificial Sequence
  Synthetic Polynucleotide
taatacgactcactatagggcgagactttcctgcatgggatcggagccgaaacagaggagatcggctatgatcccatgcaacctggcggcagcgcaaaagatg

SEQ ID NO: 36589 - DNA, 103 bp, Artificial Sequence
  Synthetic Polynucleotide
taatacgactcactatagggtttcgactcacgtttgctacgacacagtacaacagaggagagtactgatgcgtagcaaaaacctggcggcagcgcaaaagatg

SEQ ID NO: 36590 - DNA, 103 bp, Artificial Sequence
  Synthetic Polynucleotide
taatacgactcactatagggttcgaaattagctatgatctttccctactcaacagaggagagagtagatgaagatcataaacctggcggcagcgcaaaagatg

SEQ ID NO: 36591 - DNA, 103 bp, Artificial Sequence
  Synthetic Polynucleotide
taatacgactcactatagggacgctaggatcgcctgtgaatcgggtatccaacagaggagaggatacatgattcacaggaacctggcggcagcgcaaaagatg

SEQ ID NO: 36592 - DNA, 103 bp, Artificial Sequence
  Synthetic Polynucleotide
taatacgactcactatagggtcttacaccgatgggtgttagactaaatccaacagaggagaggatttatgctaacacccaacctggcggcagcgcaaaagatg

SEQ ID NO: 36593 - DNA, 103 bp, Artificial Sequence
  Synthetic Polynucleotide
taatacgactcactatagggggtgtgaatgacataaactagtaccccactaacagaggagaagtgggatgctagtttataacctggcggcagcgcaaaagatg

SEQ ID NO: 36594 - DNA, 103 bp, Artificial Sequence
  Synthetic Polynucleotide
taatacgactcactataggggctaaatcgcgtagagatgtattcgccccaaacagaggagatggggcatgtacatctctaacctggcggcagcgcaaaagatg

SEQ ID NO: 36595 - DNA, 103 bp, Artificial Sequence
  Synthetic Polynucleotide
taatacgactcactatagggaaagaacttctcgtcggcggtcgagctggtaacagaggagaaccagcatgaccgccgacaacctggcggcagcgcaaaagatg

SEQ ID NO: 36596 - DNA, 103 bp, Artificial Sequence
  Synthetic Polynucleotide
taatacgactcactatagggcaccttaaaaaggcaatgatccttccatcaaacagaggagatgatggatggatcattgcaacctggcggcagcgcaaaagatg

SEQ ID NO: 36597 - DNA, 103 bp, Artificial Sequence
  Synthetic Polynucleotide
taatacgactcactatagggagcagtattaacaaaatggcgcacgctgtcaacagaggagagacagcatgcgccattttaacctggcggcagcgcaaaagatg

SEQ ID NO: 36598 - DNA, 103 bp, Artificial Sequence
  Synthetic Polynucleotide
taatacgactcactatagggctttaccacgggaaaaggggcatagatgttaacagaggagaaacatcatggccccttttaacctggcggcagcgcaaaagatg

SEQ ID NO: 36599 - DNA, 103 bp, Artificial Sequence
  Synthetic Polynucleotide
taatacgactcactatagggtttcacagcagtcactcctgtacagctgcaaacagaggagatgcagcatgacaggagtgaacctggcggcagcgcaaaagatg

SEQ ID NO: 36600 - DNA, 103 bp, Artificial Sequence
  Synthetic Polynucleotide
taatacgactcactatagggttggtgggcgatgttgcgcacattgacagaaacagaggagatctgtcatggtgcgcaacaacctggcggcagcgcaaaagatg

SEQ ID NO: 36601 - DNA, 103 bp, Artificial Sequence
  Synthetic Polynucleotide
taatacgactcactataggggttcgggatggtacctcggcgaacatgcaaaacagaggagattgcatatgcgccgaggtaacctggcggcagcgcaaaagatg

SEQ ID NO: 36602 - DNA, 103 bp, Artificial Sequence
  Synthetic Polynucleotide
taatacgactcactataggggtcggccatgcatggcagcctcattgattcaacagaggagagaatcaatgaggctgccaaacctggcggcagcgcaaaagatg

SEQ ID NO: 36603 - DNA, 103 bp, Artificial Sequence
  Synthetic Polynucleotide
taatacgactcactatagggtcgatgagtgaaagggtagtgggtcgtcggaacagaggagaccgacgatgcactaccctaacctggcggcagcgcaaaagatg

SEQ ID NO: 36604 - DNA, 103 bp, Artificial Sequence
  Synthetic Polynucleotide
taatacgactcactataggggaacgaagaaagttgagttcatagccagtcaacagaggagagactggatgtgaactcaaaacctggcggcagcgcaaaagatg

SEQ ID NO: 36605 - DNA, 103 bp, Artificial Sequence
  Synthetic Polynucleotide
taatacgactcactatagggctaagttcactttaccgtcctgatttcgaaaacagaggagattcgaaatgaggacggtaaacctggcggcagcgcaaaagatg

SEQ ID NO: 36606 - DNA, 103 bp, Artificial Sequence
  Synthetic Polynucleotide
taatacgactcactatagggtacgtcgaaccgagtgccccggtggcccaaaacagaggagattgggcatgcggggcactaacctggcggcagcgcaaaagatg

SEQ ID NO: 36607 - DNA, 103 bp, Artificial Sequence
  Synthetic Polynucleotide
taatacgactcactatagggcgtatcgttacctcatcttatccttttactaacagaggagaagtaaaatgataagatgaaacctggcggcagcgcaaaagatg

SEQ ID NO: 36608 - DNA, 103 bp, Artificial Sequence
  Synthetic Polynucleotide
taatacgactcactatagggattaatcaggccggaaagatgtaaccgacaaacagaggagatgtcggatgcatctttccaacctggcggcagcgcaaaagatg

SEQ ID NO: 36609 - DNA, 103 bp, Artificial Sequence
  Synthetic Polynucleotide
taatacgactcactatagggaggttctgcacactagtgtaccggttcgacaacagaggagagtcgaaatggtacactagaacctggcggcagcgcaaaagatg

SEQ ID NO: 36610 - DNA, 103 bp, Artificial Sequence
  Synthetic Polynucleotide
taatacgactcactatagggaggaacgcagctgtgcagagagtctctataaacagaggagatatagaatgtctctgcacaacctggcggcagcgcaaaagatg

SEQ ID NO: 36611 - DNA, 103 bp, Artificial Sequence
  Synthetic Polynucleotide
taatacgactcactataggggcatatatcgttctggcaactcgattaaacaacagaggagagtttaaatgagttgccagaacctggcggcagcgcaaaagatg

SEQ ID NO: 36612 - DNA, 103 bp, Artificial Sequence
  Synthetic Polynucleotide
taatacgactcactatagggtctttatctttaattaggtagagagggaaaaacagaggagatttcccatgctacctaataacctggcggcagcgcaaaagatg

SEQ ID NO: 36613 - DNA, 103 bp, Artificial Sequence
  Synthetic Polynucleotide
taatacgactcactatagggtgttcgtccgacgtagacgtcgttttgaaaaacagaggagatttcaaatggacgtctacaacctggcggcagcgcaaaagatg

SEQ ID NO: 36614 - DNA, 103 bp, Artificial Sequence
  Synthetic Polynucleotide
taatacgactcactatagggtagtactttactccttaagaatcaaagagtaacagaggagaactcttatgttcttaaggaacctggcggcagcgcaaaagatg

SEQ ID NO: 36615 - DNA, 103 bp, Artificial Sequence
  Synthetic Polynucleotide
taatacgactcactatagggtaagtgaggtgctctgtttagcaagcaaaaaacagaggagattttgcatgctaaacagaaacctggcggcagcgcaaaagatg

SEQ ID NO: 36616 - DNA, 103 bp, Artificial Sequence
  Synthetic Polynucleotide
taatacgactcactatagggaatactaatgtgcctcccgccgcgtaataaaacagaggagattattaatgggcgggaggaacctggcggcagcgcaaaagatg

SEQ ID NO: 36617 - DNA, 103 bp, Artificial Sequence
  Synthetic Polynucleotide
taatacgactcactatagggaacggacagaccccctttacataaaaggtgaacagaggagacaccttatgtgtaaagggaacctggcggcagcgcaaaagatg

SEQ ID NO: 36618 - DNA, 103 bp, Artificial Sequence
  Synthetic Polynucleotide
taatacgactcactatagggatcgggaaccagccaatcaggcgggagtgcaacagaggagagcactcatgcctgattggaacctggcggcagcgcaaaagatg

SEQ ID NO: 36619 - DNA, 103 bp, Artificial Sequence
  Synthetic Polynucleotide
taatacgactcactatagggtcctggtgaagcttcgttctcggacggctcaacagaggagagagccgatggagaacgaaaacctggcggcagcgcaaaagatg

SEQ ID NO: 36620 - DNA, 103 bp, Artificial Sequence
  Synthetic Polynucleotide
taatacgactcactatagggtagggtaacgctgagatgtacgaatatcaaaacagaggagattgataatggtacatctcaacctggcggcagcgcaaaagatg

SEQ ID NO: 36621 - DNA, 103 bp, Artificial Sequence
  Synthetic Polynucleotide
taatacgactcactatagggcaatggccaagcgatgcagtgctcgcgaccaacagaggagaggtcgcatgcactgcatcaacctggcggcagcgcaaaagatg

SEQ ID NO: 36622 - DNA, 103 bp, Artificial Sequence
  Synthetic Polynucleotide
taatacgactcactatagggtacacgcgtgacagatggaggaagcgcgcaaacagaggagatgcgcgatgcctccatctaacctggcggcagcgcaaaagatg

SEQ ID NO: 36623 - DNA, 103 bp, Artificial Sequence
  Synthetic Polynucleotide
taatacgactcactatagggtctttgcctacaagatacagggccaagtccaacagaggagaggacttatgcctgtatctaacctggcggcagcgcaaaagatg

SEQ ID NO: 36624 - DNA, 103 bp, Artificial Sequence
  Synthetic Polynucleotide
taatacgactcactatagggcttccgggtagagcagccaattttccgcataacagaggagaatgcggatgattggctgcaacctggcggcagcgcaaaagatg

SEQ ID NO: 36625 - DNA, 103 bp, Artificial Sequence
  Synthetic Polynucleotide
taatacgactcactatagggacagcttcggatcggcgcgctcagcttgacaacagaggagagtcaagatgagcgcgccgaacctggcggcagcgcaaaagatg

SEQ ID NO: 36626 - DNA, 103 bp, Artificial Sequence
  Synthetic Polynucleotide
taatacgactcactataggggggactattgtttggttaatcaggtgtaggaacagaggagacctacaatggattaaccaaacctggcggcagcgcaaaagatg

SEQ ID NO: 36627 - DNA, 103 bp, Artificial Sequence
  Synthetic Polynucleotide
taatacgactcactatagggcaagtacccctcagcggcgtaacctagataaacagaggagatatctaatgtacgccgctaacctggcggcagcgcaaaagatg

SEQ ID NO: 36628 - DNA, 103 bp, Artificial Sequence
  Synthetic Polynucleotide
taatacgactcactatagggggagtgagggtgggagccaggaagttgattaacagaggagaaatcaaatgcctggctccaacctggcggcagcgcaaaagatg

SEQ ID NO: 36629 - DNA, 103 bp, Artificial Sequence
  Synthetic Polynucleotide
taatacgactcactatagggagatttgtttggggcttctacataccgtaaaacagaggagattacggatggtagaagccaacctggcggcagcgcaaaagatg

SEQ ID NO: 36630 - DNA, 103 bp, Artificial Sequence
  Synthetic Polynucleotide
taatacgactcactatagggatcacaggcgattcggcagcttgatggtctaacagaggagaagaccaatgagctgccgaaacctggcggcagcgcaaaagatg

SEQ ID NO: 36631 - DNA, 103 bp, Artificial Sequence
  Synthetic Polynucleotide
taatacgactcactataggggcccgtcggggtcaaaaggcgtggtgggataacagaggagaatcccaatgcgccttttgaacctggcggcagcgcaaaagatg

SEQ ID NO: 36632 - DNA, 103 bp, Artificial Sequence
  Synthetic Polynucleotide
taatacgactcactatagggccacgtgactgcccgcgcctccgcagcaggaacagaggagacctgctatggaggcgcggaacctggcggcagcgcaaaagatg

SEQ ID NO: 36633 - DNA, 103 bp, Artificial Sequence
  Synthetic Polynucleotide
taatacgactcactatagggccacattaaggaaccggggatttattcacgaacagaggagacgtgaaatgatccccggtaacctggcggcagcgcaaaagatg

SEQ ID NO: 36634 - DNA, 103 bp, Artificial Sequence
  Synthetic Polynucleotide
taatacgactcactatagggtcaaacggagtagcgacaggccactccgaaaacagaggagattcggaatggcctgtcgcaacctggcggcagcgcaaaagatg

SEQ ID NO: 36635 - DNA, 103 bp, Artificial Sequence
  Synthetic Polynucleotide
taatacgactcactatagggttgcctgggaacttgcgatatctgatgcgtaacagaggagaacgcatatgatatcgcaaaacctggcggcagcgcaaaagatg

SEQ ID NO: 36636 - DNA, 103 bp, Artificial Sequence
  Synthetic Polynucleotide
taatacgactcactatagggtctactgccaacacacccgcgcgcaactttaacagaggagaaaagttatgcgcgggtgtaacctggcggcagcgcaaaagatg

SEQ ID NO: 36637 - DNA, 103 bp, Artificial Sequence
  Synthetic Polynucleotide
taatacgactcactatagggaggtcagaagcggtctggtctaacgtcccaaacagaggagatgggacatgagaccagacaacctggcggcagcgcaaaagatg

SEQ ID NO: 36638 - DNA, 103 bp, Artificial Sequence
  Synthetic Polynucleotide
taatacgactcactatagggctaggacatcggttaaaggcccttgtggtaaacagaggagataccacatgggcctttaaaacctggcggcagcgcaaaagatg

SEQ ID NO: 36639 - DNA, 103 bp, Artificial Sequence
  Synthetic Polynucleotide
taatacgactcactatagggggggaacgtgcctacaggaccaaaggcgcaaacagaggagatgcgccatgggtcctgtaaacctggcggcagcgcaaaagatg

SEQ ID NO: 36640 - DNA, 103 bp, Artificial Sequence
  Synthetic Polynucleotide
taatacgactcactatagggtagcccgctagctccaccatcgtacacgggaacagaggagacccgtgatggatggtggaaacctggcggcagcgcaaaagatg

SEQ ID NO: 36641 - DNA, 103 bp, Artificial Sequence
  Synthetic Polynucleotide
taatacgactcactataggggaccctagattcaggtgcatatagtgcaccaacagaggagaggtgcaatgtatgcacctaacctggcggcagcgcaaaagatg

SEQ ID NO: 36642 - DNA, 103 bp, Artificial Sequence
  Synthetic Polynucleotide
taatacgactcactataggggatgatttgccgccgatcgagtttggtatcaacagaggagagataccatgctcgatcggaacctggcggcagcgcaaaagatg

SEQ ID NO: 36643 - DNA, 103 bp, Artificial Sequence
  Synthetic Polynucleotide
taatacgactcactataggggtttacggcacaagatcaaggacgccttcaaacagaggagatgaaggatgccttgatctaacctggcggcagcgcaaaagatg

SEQ ID NO: 36644 - DNA, 103 bp, Artificial Sequence
  Synthetic Polynucleotide
taatacgactcactatagggaaatttggcaaaatcgaatacgggtaattaaacagaggagataattaatggtattcgataacctggcggcagcgcaaaagatg

SEQ ID NO: 36645 - DNA, 103 bp, Artificial Sequence
  Synthetic Polynucleotide
taatacgactcactatagggtatataccgggcctcccgagctgctccgacaacagaggagagtcggaatggctcgggagaacctggcggcagcgcaaaagatg

SEQ ID NO: 36646 - DNA, 103 bp, Artificial Sequence
  Synthetic Polynucleotide
taatacgactcactatagggttcggaataccgcgtttcggttttctataaaacagaggagattatagatgaccgaaacgaacctggcggcagcgcaaaagatg

SEQ ID NO: 36647 - DNA, 103 bp, Artificial Sequence
  Synthetic Polynucleotide
taatacgactcactataggggacacctcttccatgtttattagagcaacgaacagaggagacgttgcatgaataaacataacctggcggcagcgcaaaagatg

SEQ ID NO: 36648 - DNA, 103 bp, Artificial Sequence
  Synthetic Polynucleotide
taatacgactcactatagggtgaacgtgagcggtagcatcatactctgtgaacagaggagacacagaatgtgatgctacaacctggcggcagcgcaaaagatg

SEQ ID NO: 36649 - DNA, 103 bp, Artificial Sequence
  Synthetic Polynucleotide
taatacgactcactatagggaggaagagtatcttatctctccctcgactgaacagaggagacagtcgatggagagataaaacctggcggcagcgcaaaagatg

SEQ ID NO: 36650 - DNA, 103 bp, Artificial Sequence
  Synthetic Polynucleotide
taatacgactcactatagggccacgagggcgctagttatcatagctatctaacagaggagaagatagatgtgataactaaacctggcggcagcgcaaaagatg

SEQ ID NO: 36651 - DNA, 103 bp, Artificial Sequence
  Synthetic Polynucleotide
taatacgactcactatagggtcgtgtcggtcggggacctccagtacatataacagaggagaatatgtatgggaggtcccaacctggcggcagcgcaaaagatg

SEQ ID NO: 36652 - DNA, 103 bp, Artificial Sequence
  Synthetic Polynucleotide
taatacgactcactatagggggtgactcgatttcctatcttacgatcttaaacagaggagataagatatgaagataggaaacctggcggcagcgcaaaagatg

SEQ ID NO: 36653 - DNA, 103 bp, Artificial Sequence
  Synthetic Polynucleotide
taatacgactcactataggggatggccaaattatttctctgatgtcgcctaacagaggagaaggcgaatgcagagaaataacctggcggcagcgcaaaagatg

SEQ ID NO: 36654 - DNA, 103 bp, Artificial Sequence
  Synthetic Polynucleotide
taatacgactcactataggggactaccagcctaaaaagctggcatcgaagaacagaggagacttcgaatgcagctttttaacctggcggcagcgcaaaagatg

SEQ ID NO: 36655 - DNA, 103 bp, Artificial Sequence
  Synthetic Polynucleotide
taatacgactcactatagggccgagcgacatacgtatagtacacgcgagaaacagaggagatctcgcatgtactatacgaacctggcggcagcgcaaaagatg

SEQ ID NO: 36656 - DNA, 103 bp, Artificial Sequence
  Synthetic Polynucleotide
taatacgactcactatagggtagctgcgtagctcttagcctgttgctcacaacagaggagagtgagcatgaggctaagaaacctggcggcagcgcaaaagatg

SEQ ID NO: 36657 - DNA, 103 bp, Artificial Sequence
  Synthetic Polynucleotide
taatacgactcactatagggctcaagcccacccgtatagacccggtacttaacagaggagaaagtacatggtctatacgaacctggcggcagcgcaaaagatg

SEQ ID NO: 36658 - DNA, 103 bp, Artificial Sequence
  Synthetic Polynucleotide
taatacgactcactataggggcgttattttgacgggagctttgaacctgtaacagaggagaacaggtatgaagctcccgaacctggcggcagcgcaaaagatg

SEQ ID NO: 36659 - DNA, 103 bp, Artificial Sequence
  Synthetic Polynucleotide
taatacgactcactatagggggcaccgttgctgattggtttccttgtgtaaacagaggagatacacaatgaaaccaatcaacctggcggcagcgcaaaagatg

SEQ ID NO: 36660 - DNA, 103 bp, Artificial Sequence
  Synthetic Polynucleotide
taatacgactcactatagggagaactcattggaggcctttagagccacttaacagaggagaaagtggatgtaaaggcctaacctggcggcagcgcaaaagatg

SEQ ID NO: 36661 - DNA, 103 bp, Artificial Sequence
  Synthetic Polynucleotide
taatacgactcactatagggagcactgactcctacgaggatatttattgtaacagaggagaacaataatgatcctcgtaaacctggcggcagcgcaaaagatg

SEQ ID NO: 36662 - DNA, 103 bp, Artificial Sequence
  Synthetic Polynucleotide
taatacgactcactatagggacagcggtttaaataccgcggccgtattcgaacagaggagacgaataatgccgcggtataacctggcggcagcgcaaaagatg

SEQ ID NO: 36663 - DNA, 103 bp, Artificial Sequence
  Synthetic Polynucleotide
taatacgactcactatagggtaacccgacagggcacttacgccggtatataacagaggagaatatacatgcgtaagtgcaacctggcggcagcgcaaaagatg

SEQ ID NO: 36664 - DNA, 103 bp, Artificial Sequence
  Synthetic Polynucleotide
taatacgactcactataggggctgtgatataacccagtccaggccctaaaaacagaggagatttaggatgtggactgggaacctggcggcagcgcaaaagatg

SEQ ID NO: 36665 - DNA, 103 bp, Artificial Sequence
  Synthetic Polynucleotide
taatacgactcactatagggcaaggtaccttcctaaactttatacttggtaacagaggagaaccaagatgaaagtttagaacctggcggcagcgcaaaagatg

SEQ ID NO: 36666 - DNA, 103 bp, Artificial Sequence
  Synthetic Polynucleotide
taatacgactcactatagggtttaacccaccgggaccgtgctagccaacaaacagaggagatgttggatggcacggtccaacctggcggcagcgcaaaagatg

SEQ ID NO: 36667 - DNA, 103 bp, Artificial Sequence
  Synthetic Polynucleotide
taatacgactcactatagggtcgagttcaacagttatgatggaccatctcaacagaggagagagatgatgcatcataacaacctggcggcagcgcaaaagatg

SEQ ID NO: 36668 - DNA, 103 bp, Artificial Sequence
  Synthetic Polynucleotide
taatacgactcactatagggccaatacgagggggacacgccccttgagataacagaggagaatctcaatgggcgtgtccaacctggcggcagcgcaaaagatg

SEQ ID NO: 36669 - DNA, 103 bp, Artificial Sequence
  Synthetic Polynucleotide
taatacgactcactataggggttactactcccttccgtacttagattgttaacagaggagaaacaatatgagtacggaaaacctggcggcagcgcaaaagatg

SEQ ID NO: 36670 - DNA, 103 bp, Artificial Sequence
  Synthetic Polynucleotide
taatacgactcactatagggtagagttttctactatcgacttaggaagtcaacagaggagagacttcatgagtcgatagaacctggcggcagcgcaaaagatg

SEQ ID NO: 36671 - DNA, 103 bp, Artificial Sequence
  Synthetic Polynucleotide
taatacgactcactatagggcgctatggtttcttcgccgcgcgaattggcaacagaggagagccaatatgcgcggcgaaaacctggcggcagcgcaaaagatg

SEQ ID NO: 36672 - DNA, 103 bp, Artificial Sequence
  Synthetic Polynucleotide
taatacgactcactatagggcggagacacgcgactgcccatcccctgaaaaacagaggagatttcagatgatgggcagtaacctggcggcagcgcaaaagatg

SEQ ID NO: 36673 - DNA, 103 bp, Artificial Sequence
  Synthetic Polynucleotide
taatacgactcactatagggcgagagccctggtgatggcatccgaggtcaaacagaggagatgacctatgatgccatcaaacctggcggcagcgcaaaagatg

SEQ ID NO: 36674 - DNA, 103 bp, Artificial Sequence
  Synthetic Polynucleotide
taatacgactcactatagggggagactcgatcaacatgaaggaatggactaacagaggagaagtccaatgcttcatgttaacctggcggcagcgcaaaagatg

SEQ ID NO: 36675 - DNA, 103 bp, Artificial Sequence
  Synthetic Polynucleotide
taatacgactcactatagggaagtgaatgcgctcagttcggtatcttctcaacagaggagagagaagatgccgaactgaaacctggcggcagcgcaaaagatg

SEQ ID NO: 36676 - DNA, 103 bp, Artificial Sequence
  Synthetic Polynucleotide
taatacgactcactatagggaccctttttctatcaaagagggtactattcaacagaggagagaatagatgcctctttgaaacctggcggcagcgcaaaagatg

SEQ ID NO: 36677 - DNA, 103 bp, Artificial Sequence
  Synthetic Polynucleotide
taatacgactcactataggggcgagagaaacctcatcagcggcaacttccaacagaggagaggaagtatgcgctgatgaaacctggcggcagcgcaaaagatg

SEQ ID NO: 36678 - DNA, 103 bp, Artificial Sequence
  Synthetic Polynucleotide
taatacgactcactataggggcgcagactcgttgtttttcagggtgtttcaacagaggagagaaacaatgtgaaaaacaaacctggcggcagcgcaaaagatg

SEQ ID NO: 36679 - DNA, 103 bp, Artificial Sequence
  Synthetic Polynucleotide
taatacgactcactatagggggcacgactccctttgccacttaaccattaaacagaggagataatggatgagtggcaaaaacctggcggcagcgcaaaagatg

SEQ ID NO: 36680 - DNA, 103 bp, Artificial Sequence
  Synthetic Polynucleotide
taatacgactcactatagggcgaatcctacacgactaggacgtaactacaaacagaggagatgtagtatggtcctagtcaacctggcggcagcgcaaaagatg

SEQ ID NO: 36681 - DNA, 103 bp, Artificial Sequence
  Synthetic Polynucleotide
taatacgactcactatagggggtgggtgacgctcgtaacatagatactcaaacagaggagatgagtaatgatgttacgaaacctggcggcagcgcaaaagatg

SEQ ID NO: 36682 - DNA, 103 bp, Artificial Sequence
  Synthetic Polynucleotide
taatacgactcactataggggggtcgccccttaggggcccgtcccgaggtaacagaggagaacctcgatgcgggcccctaacctggcggcagcgcaaaagatg

SEQ ID NO: 36683 - DNA, 103 bp, Artificial Sequence
  Synthetic Polynucleotide
taatacgactcactatagggttaacatgtattttcggtacgtcccagttgaacagaggagacaactgatgcgtaccgaaaacctggcggcagcgcaaaagatg

SEQ ID NO: 36684 - DNA, 103 bp, Artificial Sequence
  Synthetic Polynucleotide
taatacgactcactatagggggagccccttacggatactcacaaaaagcgaacagaggagacgctttatgtgagtatccaacctggcggcagcgcaaaagatg

SEQ ID NO: 36685 - DNA, 103 bp, Artificial Sequence
  Synthetic Polynucleotide
taatacgactcactatagggagaatttccgaccttatatcccgttcggtaaacagaggagataccgaatgggatataagaacctggcggcagcgcaaaagatg

SEQ ID NO: 36686 - DNA, 103 bp, Artificial Sequence
  Synthetic Polynucleotide
taatacgactcactatagggtaaggagtcgcttactaggcccttcgtacaaacagaggagatgtacgatgggcctagtaaacctggcggcagcgcaaaagatg

SEQ ID NO: 36687 - DNA, 103 bp, Artificial Sequence
  Synthetic Polynucleotide
taatacgactcactataggggcgttaattaggcagttggcaagtttgaccaacagaggagaggtcaaatgtgccaactgaacctggcggcagcgcaaaagatg

SEQ ID NO: 36688 - DNA, 103 bp, Artificial Sequence
  Synthetic Polynucleotide
taatacgactcactatagggttcgcgcaaattactgaataacttgcgcgcaacagaggagagcgcgcatgttattcagtaacctggcggcagcgcaaaagatg

SEQ ID NO: 36689 - DNA, 103 bp, Artificial Sequence
  Synthetic Polynucleotide
taatacgactcactatagggctttatagtgtccggctccgactgtaatctaacagaggagaagattaatgtcggagccgaacctggcggcagcgcaaaagatg

SEQ ID NO: 36690 - DNA, 103 bp, Artificial Sequence
  Synthetic Polynucleotide
taatacgactcactatagggctgcaaccgtgcagatacgatatcctgttcaacagaggagagaacagatgatcgtatctaacctggcggcagcgcaaaagatg

SEQ ID NO: 36691 - DNA, 103 bp, Artificial Sequence
  Synthetic Polynucleotide
taatacgactcactatagggcagtgtaactgctgaaggatatttggaccaaacagaggagatggtccatgtatccttcaaacctggcggcagcgcaaaagatg

SEQ ID NO: 36692 - DNA, 103 bp, Artificial Sequence
  Synthetic Polynucleotide
taatacgactcactatagggaccgctcgcgtaaagtaacaagtggcattcaacagaggagagaatgcatgttgttacttaacctggcggcagcgcaaaagatg

SEQ ID NO: 36693 - DNA, 103 bp, Artificial Sequence
  Synthetic Polynucleotide
taatacgactcactatagggagcttacattgttggcaccacgtggactttaacagaggagaaaagtcatggtggtgccaaacctggcggcagcgcaaaagatg

SEQ ID NO: 36694 - DNA, 103 bp, Artificial Sequence
  Synthetic Polynucleotide
taatacgactcactatagggatacattatcgcccggtgggggctagggtgaacagaggagacaccctatgccccaccggaacctggcggcagcgcaaaagatg

SEQ ID NO: 36695 - DNA, 103 bp, Artificial Sequence
  Synthetic Polynucleotide
taatacgactcactatagggtgacttctatatcgtgcggcggagcctaagaacagaggagacttaggatgcgccgcacgaacctggcggcagcgcaaaagatg

SEQ ID NO: 36696 - DNA, 103 bp, Artificial Sequence
  Synthetic Polynucleotide
taatacgactcactataggggaagacatcctccccaccgcggtcaataaaaacagaggagatttattatgcgcggtgggaacctggcggcagcgcaaaagatg

SEQ ID NO: 36697 - DNA, 103 bp, Artificial Sequence
  Synthetic Polynucleotide
taatacgactcactataggggataggctcattcgcactggacaattagtcaacagaggagagactaaatgtccagtgcgaacctggcggcagcgcaaaagatg

SEQ ID NO: 36698 - DNA, 103 bp, Artificial Sequence
  Synthetic Polynucleotide
taatacgactcactataggggcacatctaatttcctcttacttacataccaacagaggagaggtatgatggtaagaggaaacctggcggcagcgcaaaagatg

SEQ ID NO: 36699 - DNA, 103 bp, Artificial Sequence
  Synthetic Polynucleotide
taatacgactcactatagggttattattaccgtgcccaataaccgtggtcaacagaggagagaccacatgtattgggcaaacctggcggcagcgcaaaagatg

SEQ ID NO: 36700 - DNA, 103 bp, Artificial Sequence
  Synthetic Polynucleotide
taatacgactcactataggggcggtctctatgtcactaataccccgcggaaacagaggagatccgcgatgtattagtgaaacctggcggcagcgcaaaagatg

SEQ ID NO: 36701 - DNA, 103 bp, Artificial Sequence
  Synthetic Polynucleotide
taatacgactcactatagggttccttaacgccacgatctaccgtgctagcaacagaggagagctagcatggtagatcgtaacctggcggcagcgcaaaagatg

SEQ ID NO: 36702 - DNA, 103 bp, Artificial Sequence
  Synthetic Polynucleotide
taatacgactcactatagggggtcttattagaacctgtatgcaaacgcgcaacagaggagagcgcgtatgcatacaggtaacctggcggcagcgcaaaagatg

SEQ ID NO: 36703 - DNA, 103 bp, Artificial Sequence
  Synthetic Polynucleotide
taatacgactcactatagggctagttagagatttaccgtaaaggatctggaacagaggagaccagatatgttacggtaaaacctggcggcagcgcaaaagatg

SEQ ID NO: 36704 - DNA, 103 bp, Artificial Sequence
  Synthetic Polynucleotide
taatacgactcactatagggcgtggaatgagcacccgaagtatatgcactaacagaggagaagtgcaatgacttcgggtaacctggcggcagcgcaaaagatg

SEQ ID NO: 36705 - DNA, 103 bp, Artificial Sequence
  Synthetic Polynucleotide
taatacgactcactataggggggcagattctttccttaaacggtcggtcgaacagaggagacgaccgatggtttaaggaaacctggcggcagcgcaaaagatg

SEQ ID NO: 36706 - DNA, 103 bp, Artificial Sequence
  Synthetic Polynucleotide
taatacgactcactatagggggcagcgagctcagtagcgcacgatgacgaaacagaggagatcgtcaatgtgcgctactaacctggcggcagcgcaaaagatg

SEQ ID NO: 36707 - DNA, 103 bp, Artificial Sequence
  Synthetic Polynucleotide
taatacgactcactatagggataggactgtgagtatctagttgcacacataacagaggagaatgtgtatgactagatacaacctggcggcagcgcaaaagatg

SEQ ID NO: 36708 - DNA, 103 bp, Artificial Sequence
  Synthetic Polynucleotide
taatacgactcactatagggctttcgcccatcgacaagattatgtcaattaacagaggagaaattgaatgaatcttgtcaacctggcggcagcgcaaaagatg

SEQ ID NO: 36709 - DNA, 103 bp, Artificial Sequence
  Synthetic Polynucleotide
taatacgactcactatagggccattgggggacttccagagtgataattgcaacagaggagagcaattatgactctggaaaacctggcggcagcgcaaaagatg

SEQ ID NO: 36710 - DNA, 103 bp, Artificial Sequence
  Synthetic Polynucleotide
taatacgactcactataggggggcctttgaaaggtcggagagcagataaaaacagaggagatttatcatgtctccgaccaacctggcggcagcgcaaaagatg

SEQ ID NO: 36711 - DNA, 103 bp, Artificial Sequence
  Synthetic Polynucleotide
taatacgactcactatagggaatctgggaatcctatacgtggcgtccaataacagaggagaattggaatgcacgtatagaacctggcggcagcgcaaaagatg

SEQ ID NO: 36712 - DNA, 103 bp, Artificial Sequence
  Synthetic Polynucleotide
taatacgactcactatagggcgtgcgacggagtaccaggtctcgttgaaaaacagaggagatttcaaatggacctggtaaacctggcggcagcgcaaaagatg

SEQ ID NO: 36713 - DNA, 103 bp, Artificial Sequence
  Synthetic Polynucleotide
taatacgactcactatagggtggtcacggaacatgtccatcaggtcaaataacagaggagaatttgaatggatggacataacctggcggcagcgcaaaagatg

SEQ ID NO: 36714 - DNA, 103 bp, Artificial Sequence
  Synthetic Polynucleotide
taatacgactcactataggggatatctgccagtcgagtacaacgtggcttaacagaggagaaagccaatgtgtactcgaaacctggcggcagcgcaaaagatg

SEQ ID NO: 36715 - DNA, 103 bp, Artificial Sequence
  Synthetic Polynucleotide
taatacgactcactatagggccagctagattccacgactgagtcgttctgaacagaggagacagaacatgtcagtcgtgaacctggcggcagcgcaaaagatg

SEQ ID NO: 36716 - DNA, 103 bp, Artificial Sequence
  Synthetic Polynucleotide
taatacgactcactatagggctaagtgtacccatgtgcggagaatggaggaacagaggagacctccaatgtccgcacataacctggcggcagcgcaaaagatg

SEQ ID NO: 36717 - DNA, 103 bp, Artificial Sequence
  Synthetic Polynucleotide
taatacgactcactatagggaccagaccactgccttcatgtaactcgggtaacagaggagaacccgaatgacatgaaggaacctggcggcagcgcaaaagatg

SEQ ID NO: 36718 - DNA, 103 bp, Artificial Sequence
  Synthetic Polynucleotide
taatacgactcactatagggtccctactggtagcaccaaccgctctaagaaacagaggagatcttagatgggttggtgcaacctggcggcagcgcaaaagatg

SEQ ID NO: 36719 - DNA, 103 bp, Artificial Sequence
  Synthetic Polynucleotide
taatacgactcactataggggtgtttcgttgctcttgtctctttgccttgaacagaggagacaaggcatggagacaagaaacctggcggcagcgcaaaagatg

SEQ ID NO: 36720 - DNA, 103 bp, Artificial Sequence
  Synthetic Polynucleotide
taatacgactcactatagggatccgagctcgttgtcagtcgctagcggacaacagaggagagtccgcatgcgactgacaaacctggcggcagcgcaaaagatg

SEQ ID NO: 36721 - DNA, 103 bp, Artificial Sequence
  Synthetic Polynucleotide
taatacgactcactatagggtatagctactgacatttgggttatgagcagaacagaggagactgctcatgacccaaatgaacctggcggcagcgcaaaagatg

SEQ ID NO: 36722 - DNA, 103 bp, Artificial Sequence
  Synthetic Polynucleotide
taatacgactcactatagggctataatcgcaactgtccaatctaaacaccaacagaggagaggtgttatgattggacagaacctggcggcagcgcaaaagatg

SEQ ID NO: 36723 - DNA, 103 bp, Artificial Sequence
  Synthetic Polynucleotide
taatacgactcactatagggtatacacaatggaattctcgtgaataggtcaacagaggagagacctaatgacgagaattaacctggcggcagcgcaaaagatg

SEQ ID NO: 36724 - DNA, 103 bp, Artificial Sequence
  Synthetic Polynucleotide
taatacgactcactatagggaatgttggcgggtcgcactagggccaatataacagaggagaatattgatgctagtgcgaaacctggcggcagcgcaaaagatg

SEQ ID NO: 36725 - DNA, 103 bp, Artificial Sequence
  Synthetic Polynucleotide
taatacgactcactatagggacgatgcttcacatgtagccccggaaggtcaacagaggagagaccttatggggctacataacctggcggcagcgcaaaagatg

SEQ ID NO: 36726 - DNA, 103 bp, Artificial Sequence
  Synthetic Polynucleotide
taatacgactcactataggggcactctacgacggaaatgggtgtgttctgaacagaggagacagaacatgcccatttccaacctggcggcagcgcaaaagatg

SEQ ID NO: 36727 - DNA, 103 bp, Artificial Sequence
  Synthetic Polynucleotide
taatacgactcactatagggtcaaccacttaattatacaggaggcgtacgaacagaggagacgtacgatgcctgtataaaacctggcggcagcgcaaaagatg

SEQ ID NO: 36728 - DNA, 103 bp, Artificial Sequence
  Synthetic Polynucleotide
taatacgactcactatagggtttgagtcctatgtccacccgcttcttagtaacagaggagaactaagatgcgggtggacaacctggcggcagcgcaaaagatg

SEQ ID NO: 36729 - DNA, 103 bp, Artificial Sequence
  Synthetic Polynucleotide
taatacgactcactatagggtctaaccgaagaagatacttgaggagacagaacagaggagactgtctatgcaagtatctaacctggcggcagcgcaaaagatg

SEQ ID NO: 36730 - DNA, 103 bp, Artificial Sequence
  Synthetic Polynucleotide
taatacgactcactatagggtgcttagttgtgcgctcggacagcgaggataacagaggagaatcctcatggtccgagcgaacctggcggcagcgcaaaagatg

SEQ ID NO: 36731 - DNA, 103 bp, Artificial Sequence
  Synthetic Polynucleotide
taatacgactcactatagggatggcgagtttataccctgtcacttcgaggaacagaggagacctcgaatggacagggtaaacctggcggcagcgcaaaagatg

SEQ ID NO: 36732 - DNA, 103 bp, Artificial Sequence
  Synthetic Polynucleotide
taatacgactcactatagggatcgatcttcagccgagccacgaggagtgcaacagaggagagcactcatggtggctcggaacctggcggcagcgcaaaagatg

SEQ ID NO: 36733 - DNA, 103 bp, Artificial Sequence
  Synthetic Polynucleotide
taatacgactcactataggggagcaagtagacgtgtcaaaataggaattgaacagaggagacaattcatgttttgacacaacctggcggcagcgcaaaagatg

SEQ ID NO: 36734 - DNA, 103 bp, Artificial Sequence
  Synthetic Polynucleotide
taatacgactcactatagggggaggaatgcacggctacgaaccttagcgcaacagaggagagcgctaatgttcgtagccaacctggcggcagcgcaaaagatg

SEQ ID NO: 36735 - DNA, 103 bp, Artificial Sequence
  Synthetic Polynucleotide
taatacgactcactatagggaccagtggcggagtcggtcgcggtcgattaaacagaggagataatcgatggcgaccgacaacctggcggcagcgcaaaagatg

SEQ ID NO: 36736 - DNA, 103 bp, Artificial Sequence
  Synthetic Polynucleotide
taatacgactcactataggggaggaagcgcatttggtttttatgacgatgaacagaggagacatcgtatgaaaaaccaaaacctggcggcagcgcaaaagatg

SEQ ID NO: 36737 - DNA, 103 bp, Artificial Sequence
  Synthetic Polynucleotide
taatacgactcactatagggcagggtatcgggaactgagaggtttcgctcaacagaggagagagcgaatgctctcagttaacctggcggcagcgcaaaagatg

SEQ ID NO: 36738 - DNA, 103 bp, Artificial Sequence
  Synthetic Polynucleotide
taatacgactcactatagggtgcggcacgtcctcctcgagtgagagaaacaacagaggagagtttctatgactcgaggaaacctggcggcagcgcaaaagatg

SEQ ID NO: 36739 - DNA, 103 bp, Artificial Sequence
  Synthetic Polynucleotide
taatacgactcactataggggctccgctccgggcgttatagctttctaggaacagaggagacctagaatgctataacgcaacctggcggcagcgcaaaagatg

SEQ ID NO: 36740 - DNA, 103 bp, Artificial Sequence
  Synthetic Polynucleotide
taatacgactcactatagggattgtagtaagctgactggtactgctctgcaacagaggagagcagagatgtaccagtcaaacctggcggcagcgcaaaagatg

SEQ ID NO: 36741 - DNA, 103 bp, Artificial Sequence
  Synthetic Polynucleotide
taatacgactcactataggggtagcgaaactatctcctcagttttgggctaacagaggagaagcccaatgctgaggagaaacctggcggcagcgcaaaagatg

SEQ ID NO: 36742 - DNA, 103 bp, Artificial Sequence
  Synthetic Polynucleotide
taatacgactcactatagggttggtgcggtaggatcttggggcggtaggtaacagaggagaacctacatgcccaagatcaacctggcggcagcgcaaaagatg

SEQ ID NO: 36743 - DNA, 103 bp, Artificial Sequence
  Synthetic Polynucleotide
taatacgactcactatagggcttggtctcatgttgatgatcaatgaggcgaacagaggagacgcctcatggatcatcaaaacctggcggcagcgcaaaagatg

SEQ ID NO: 36744 - DNA, 103 bp, Artificial Sequence
  Synthetic Polynucleotide
taatacgactcactatagggattaccatttgccttctcacattacatgtaaacagaggagatacatgatgtgtgagaagaacctggcggcagcgcaaaagatg

SEQ ID NO: 36745 - DNA, 103 bp, Artificial Sequence
  Synthetic Polynucleotide
taatacgactcactatagggattcagcttgttctacgcgacgggggcatcaacagaggagagatgccatggtcgcgtagaacctggcggcagcgcaaaagatg

SEQ ID NO: 36746 - DNA, 103 bp, Artificial Sequence
  Synthetic Polynucleotide
taatacgactcactatagggactccactatgaattcgcatatcgatctccaacagaggagaggagatatgtatgcgaataacctggcggcagcgcaaaagatg

SEQ ID NO: 36747 - DNA, 103 bp, Artificial Sequence
  Synthetic Polynucleotide
taatacgactcactataggggcaggttcgggtatatctgtgccacggtgtaacagaggagaacaccgatgcacagatataacctggcggcagcgcaaaagatg

SEQ ID NO: 36748 - DNA, 103 bp, Artificial Sequence
  Synthetic Polynucleotide
taatacgactcactatagggagtacaccgctccacgcgggtctgatattaaacagaggagataatatatgacccgcgtgaacctggcggcagcgcaaaagatg

SEQ ID NO: 36749 - DNA, 103 bp, Artificial Sequence
  Synthetic Polynucleotide
taatacgactcactatagggggacgtgatctcggggacgccaacctactcaacagaggagagagtagatgggcgtccccaacctggcggcagcgcaaaagatg

SEQ ID NO: 36750 - DNA, 103 bp, Artificial Sequence
  Synthetic Polynucleotide
taatacgactcactatagggttcgagagcagcaacaaaaacagctcagccaacagaggagaggctgaatggtttttgttaacctggcggcagcgcaaaagatg

SEQ ID NO: 36751 - DNA, 103 bp, Artificial Sequence
  Synthetic Polynucleotide
taatacgactcactatagggttcatgaacatgttgcttcgtacgtaccccaacagaggagaggggtaatgacgaagcaaaacctggcggcagcgcaaaagatg

SEQ ID NO: 36752 - DNA, 103 bp, Artificial Sequence
  Synthetic Polynucleotide
taatacgactcactatagggagggggtgtacgctgctaccatgtaactctaacagaggagaagagttatgtggtagcagaacctggcggcagcgcaaaagatg

SEQ ID NO: 36753 - DNA, 103 bp, Artificial Sequence
  Synthetic Polynucleotide
taatacgactcactatagggttatacacatcaggtaatctaagacaataaaacagaggagattattgatgtagattaccaacctggcggcagcgcaaaagatg

SEQ ID NO: 36754 - DNA, 103 bp, Artificial Sequence
  Synthetic Polynucleotide
taatacgactcactatagggcaccctaacccacgcgctcgctgggactagaacagaggagactagtcatggcgagcgcgaacctggcggcagcgcaaaagatg

SEQ ID NO: 36755 - DNA, 103 bp, Artificial Sequence
  Synthetic Polynucleotide
taatacgactcactatagggtctgcaccccgtaacctgtaaagtgctgtaaacagaggagatacagcatgttacaggttaacctggcggcagcgcaaaagatg

SEQ ID NO: 36756 - DNA, 103 bp, Artificial Sequence
  Synthetic Polynucleotide
taatacgactcactatagggctacagtgggcccccggtacggagtttttgaacagaggagacaaaaaatgcgtaccgggaacctggcggcagcgcaaaagatg

SEQ ID NO: 36757 - DNA, 103 bp, Artificial Sequence
  Synthetic Polynucleotide
taatacgactcactatagggagcttgcaatgtctaaagctgaagggggctaacagaggagaagccccatgcagctttagaacctggcggcagcgcaaaagatg

SEQ ID NO: 36758 - DNA, 103 bp, Artificial Sequence
  Synthetic Polynucleotide
taatacgactcactatagggcatgaactacttaaacgcatgttcagatacaacagaggagagtatctatgcatgcgtttaacctggcggcagcgcaaaagatg

SEQ ID NO: 36759 - DNA, 103 bp, Artificial Sequence
  Synthetic Polynucleotide
taatacgactcactataggggttgggcatgtggtactgtcgaagtttattaacagaggagaaataaaatgcgacagtacaacctggcggcagcgcaaaagatg

SEQ ID NO: 36760 - DNA, 103 bp, Artificial Sequence
  Synthetic Polynucleotide
taatacgactcactataggggggcgactgggccgtcagataggcggactgaacagaggagacagtccatgtatctgacgaacctggcggcagcgcaaaagatg

SEQ ID NO: 36761 - DNA, 103 bp, Artificial Sequence
  Synthetic Polynucleotide
taatacgactcactatagggtataaactggcaaattcccacgcaattttcaacagaggagagaaaatatggtgggaattaacctggcggcagcgcaaaagatg

SEQ ID NO: 36762 - DNA, 103 bp, Artificial Sequence
  Synthetic Polynucleotide
taatacgactcactatagggcgtcaggatctttggatgatttttacgaataacagaggagaattcgtatgaatcatccaaacctggcggcagcgcaaaagatg

SEQ ID NO: 36763 - DNA, 103 bp, Artificial Sequence
  Synthetic Polynucleotide
taatacgactcactatagggtcctcactctctatcacattttttcctaacaacagaggagagttaggatgaaatgtgataacctggcggcagcgcaaaagatg

SEQ ID NO: 36764 - DNA, 103 bp, Artificial Sequence
  Synthetic Polynucleotide
taatacgactcactatagggaaccgatcttcttgtcaaatcgatgcacttaacagaggagaaagtgcatggatttgacaaacctggcggcagcgcaaaagatg

SEQ ID NO: 36765 - DNA, 103 bp, Artificial Sequence
  Synthetic Polynucleotide
taatacgactcactatagggatggctactggtcggccgagatctgaccacaacagaggagagtggtcatgtctcggccgaacctggcggcagcgcaaaagatg

SEQ ID NO: 36766 - DNA, 103 bp, Artificial Sequence
  Synthetic Polynucleotide
taatacgactcactatagggcgcacatgtcaccctggaatactcgcggtcaacagaggagagaccgcatgtattccaggaacctggcggcagcgcaaaagatg

SEQ ID NO: 36767 - DNA, 103 bp, Artificial Sequence
  Synthetic Polynucleotide
taatacgactcactataggggcgcatttaaatacaataggagcgggctataacagaggagaatagccatgtcctattgtaacctggcggcagcgcaaaagatg

SEQ ID NO: 36768 - DNA, 103 bp, Artificial Sequence
  Synthetic Polynucleotide
taatacgactcactatagggactgctaggaggcaactacaaagttggcagaacagaggagactgccaatgttgtagttgaacctggcggcagcgcaaaagatg

SEQ ID NO: 36769 - DNA, 103 bp, Artificial Sequence
  Synthetic Polynucleotide
taatacgactcactataggggatccacgcatactaaagctaaaataccgcaacagaggagagcggtaatgtagctttagaacctggcggcagcgcaaaagatg

SEQ ID NO: 36770 - DNA, 103 bp, Artificial Sequence
  Synthetic Polynucleotide
taatacgactcactatagggatgcttccggttctatcaatctttcgaatcaacagaggagagattcgatggattgatagaacctggcggcagcgcaaaagatg

SEQ ID NO: 36771 - DNA, 103 bp, Artificial Sequence
  Synthetic Polynucleotide
taatacgactcactatagggttagctaatcagggcgtttggtgtttaaggaacagaggagaccttaaatgccaaacgccaacctggcggcagcgcaaaagatg

SEQ ID NO: 36772 - DNA, 103 bp, Artificial Sequence
  Synthetic Polynucleotide
taatacgactcactatagggtacgtcgacgggtcatcatcgctgggcctaaacagaggagataggccatgcgatgatgaaacctggcggcagcgcaaaagatg

SEQ ID NO: 36773 - DNA, 103 bp, Artificial Sequence
  Synthetic Polynucleotide
taatacgactcactataggggcgatgccggcaacccccgggggaagaataaacagaggagatattctatgcccgggggtaacctggcggcagcgcaaaagatg

SEQ ID NO: 36774 - DNA, 103 bp, Artificial Sequence
  Synthetic Polynucleotide
taatacgactcactatagggataaatgccatctgccccagcaatagatataacagaggagaatatctatggctggggcaaacctggcggcagcgcaaaagatg

SEQ ID NO: 36775 - DNA, 103 bp, Artificial Sequence
  Synthetic Polynucleotide
taatacgactcactatagggtaggtacaacattcatgatatctgtccgagaacagaggagactcggaatgatatcatgaaacctggcggcagcgcaaaagatg

SEQ ID NO: 36776 - DNA, 103 bp, Artificial Sequence
  Synthetic Polynucleotide
taatacgactcactatagggtcacgggaggactgggttactaaaaatcaaaacagaggagattgattatgagtaacccaaacctggcggcagcgcaaaagatg

SEQ ID NO: 36777 - DNA, 103 bp, Artificial Sequence
  Synthetic Polynucleotide
taatacgactcactatagggcttcgagttgggctttctttgaaattagcaaacagaggagatgctaaatgcaaagaaagaacctggcggcagcgcaaaagatg

SEQ ID NO: 36778 - DNA, 103 bp, Artificial Sequence
  Synthetic Polynucleotide
taatacgactcactatagggaagataagagcccggtagccttgacacgtcaacagaggagagacgtgatgaggctaccgaacctggcggcagcgcaaaagatg

SEQ ID NO: 36779 - DNA, 103 bp, Artificial Sequence
  Synthetic Polynucleotide
taatacgactcactatagggtatctcatacaaagaggtggtattctctttaacagaggagaaaagagatgaccacctctaacctggcggcagcgcaaaagatg

SEQ ID NO: 36780 - DNA, 103 bp, Artificial Sequence
  Synthetic Polynucleotide
taatacgactcactatagggtcacagtccagccatgtatctgaaaccgcaaacagaggagatgcggtatgagatacatgaacctggcggcagcgcaaaagatg

SEQ ID NO: 36781 - DNA, 103 bp, Artificial Sequence
  Synthetic Polynucleotide
taatacgactcactatagggatactccataagataattcgtggcatcaccaacagaggagaggtgatatgacgaattataacctggcggcagcgcaaaagatg

SEQ ID NO: 36782 - DNA, 103 bp, Artificial Sequence
  Synthetic Polynucleotide
taatacgactcactatagggaccgtacaccttgagaggagcacgcggttaaacagaggagataaccgatggctcctctcaacctggcggcagcgcaaaagatg

SEQ ID NO: 36783 - DNA, 103 bp, Artificial Sequence
  Synthetic Polynucleotide
taatacgactcactatagggtacaggcctctatacttataggattcgccgaacagaggagacggcgaatgctataagtaaacctggcggcagcgcaaaagatg

SEQ ID NO: 36784 - DNA, 103 bp, Artificial Sequence
  Synthetic Polynucleotide
taatacgactcactatagggcctggttctggatagagtccatcaatatttaacagaggagaaaatatatgtggactctaaacctggcggcagcgcaaaagatg

SEQ ID NO: 36785 - DNA, 103 bp, Artificial Sequence
  Synthetic Polynucleotide
taatacgactcactatagggggactttcgaacataggtacgacatctgtcaacagaggagagacagaatgcgtacctataacctggcggcagcgcaaaagatg

SEQ ID NO: 36786 - DNA, 103 bp, Artificial Sequence
  Synthetic Polynucleotide
taatacgactcactatagggctcgttaaggctccagcgtagatgcgcagtaacagaggagaactgcgatgctacgctggaacctggcggcagcgcaaaagatg

SEQ ID NO: 36787 - DNA, 103 bp, Artificial Sequence
  Synthetic Polynucleotide
taatacgactcactatagggactcgatgagacttatgtcaaaggcacgccaacagaggagaggcgtgatgttgacataaaacctggcggcagcgcaaaagatg

SEQ ID NO: 36788 - DNA, 103 bp, Artificial Sequence
  Synthetic Polynucleotide
taatacgactcactatagggtccagcagcgccgggctgtcagtttcgagaaacagaggagatctcgaatgtgacagcccaacctggcggcagcgcaaaagatg

SEQ ID NO: 36789 - DNA, 103 bp, Artificial Sequence
  Synthetic Polynucleotide
taatacgactcactatagggagaatgggcctgtcattcagtctttatgcaaacagaggagatgcataatgactgaatgaaacctggcggcagcgcaaaagatg

SEQ ID NO: 36790 - DNA, 103 bp, Artificial Sequence
  Synthetic Polynucleotide
taatacgactcactatagggaacaacgcttaccactgttaccaaccgttaaacagaggagataacggatggtaacagtgaacctggcggcagcgcaaaagatg

SEQ ID NO: 36791 - DNA, 103 bp, Artificial Sequence
  Synthetic Polynucleotide
taatacgactcactatagggtttatataccaatgtggagtgaatcaccctaacagaggagaagggtgatgcactccacaaacctggcggcagcgcaaaagatg

SEQ ID NO: 36792 - DNA, 103 bp, Artificial Sequence
  Synthetic Polynucleotide
taatacgactcactatagggctgtagctataggtagtaggcctgatcactaacagaggagaagtgatatggcctactacaacctggcggcagcgcaaaagatg

SEQ ID NO: 36793 - DNA, 103 bp, Artificial Sequence
  Synthetic Polynucleotide
taatacgactcactatagggactaggttttggctccttcggcgtgtggcaaacagaggagatgccacatgccgaaggagaacctggcggcagcgcaaaagatg

SEQ ID NO: 36794 - DNA, 103 bp, Artificial Sequence
  Synthetic Polynucleotide
taatacgactcactatagggcacgaaggaaacgactcctagatggcgcggaacagaggagaccgcgcatgctaggagtcaacctggcggcagcgcaaaagatg

SEQ ID NO: 36795 - DNA, 103 bp, Artificial Sequence
  Synthetic Polynucleotide
taatacgactcactatagggctccggtcgcaggatgcgttcgatcaggtcaacagaggagagacctgatggaacgcatcaacctggcggcagcgcaaaagatg

SEQ ID NO: 36796 - DNA, 103 bp, Artificial Sequence
  Synthetic Polynucleotide
taatacgactcactatagggaagtttgaactcctagctttcgatcccgacaacagaggagagtcgggatggaaagctagaacctggcggcagcgcaaaagatg

SEQ ID NO: 36797 - DNA, 103 bp, Artificial Sequence
  Synthetic Polynucleotide
taatacgactcactatagggtgttgcgatggacactcggctctgtatgggaacagaggagacccataatgagccgagtgaacctggcggcagcgcaaaagatg

SEQ ID NO: 36798 - DNA, 103 bp, Artificial Sequence
  Synthetic Polynucleotide
taatacgactcactatagggcaccgatatgtattcgataatcgtgtgagtaacagaggagaactcacatgattatcgaaaacctggcggcagcgcaaaagatg

SEQ ID NO: 36799 - DNA, 103 bp, Artificial Sequence
  Synthetic Polynucleotide
taatacgactcactataggggactaccaggcgatgtaggatcaacggtctaacagaggagaagaccgatgatcctacataacctggcggcagcgcaaaagatg

SEQ ID NO: 36800 - DNA, 103 bp, Artificial Sequence
  Synthetic Polynucleotide
taatacgactcactatagggcccacattacggtgcctgtgatgcagcgtaaacagaggagatacgctatgtcacaggcaaacctggcggcagcgcaaaagatg

SEQ ID NO: 36801 - DNA, 103 bp, Artificial Sequence
  Synthetic Polynucleotide
taatacgactcactatagggacccccaacgttgaaaatgtcttaaccgataacagaggagaatcggtatggacattttcaacctggcggcagcgcaaaagatg

SEQ ID NO: 36802 - DNA, 103 bp, Artificial Sequence
  Synthetic Polynucleotide
taatacgactcactatagggcttatccgaccttcgtcctcggcatccctcaacagaggagagagggaatgcgaggacgaaacctggcggcagcgcaaaagatg

SEQ ID NO: 36803 - DNA, 103 bp, Artificial Sequence
  Synthetic Polynucleotide
taatacgactcactatagggtcccgggtggaataatggatgagttgcaggaacagaggagacctgcaatgcatccattaaacctggcggcagcgcaaaagatg

SEQ ID NO: 36804 - DNA, 103 bp, Artificial Sequence
  Synthetic Polynucleotide
taatacgactcactatagggagaaagggaatgtgtactggtatcagacggaacagaggagaccgtctatgaccagtacaaacctggcggcagcgcaaaagatg

SEQ ID NO: 36805 - DNA, 103 bp, Artificial Sequence
  Synthetic Polynucleotide
taatacgactcactatagggctggaccagtagcatccgggcgcgctacctaacagaggagaaggtagatggcccggatgaacctggcggcagcgcaaaagatg

SEQ ID NO: 36806 - DNA, 103 bp, Artificial Sequence
  Synthetic Polynucleotide
taatacgactcactatagggagcgctgtagtacgccccgttgactttcctaacagaggagaaggaaaatgaacggggcgaacctggcggcagcgcaaaagatg

SEQ ID NO: 36807 - DNA, 103 bp, Artificial Sequence
  Synthetic Polynucleotide
taatacgactcactatagggttcgcatattctaagtgccagtcactcagcaacagaggagagctgagatgctggcacttaacctggcggcagcgcaaaagatg

SEQ ID NO: 36808 - DNA, 103 bp, Artificial Sequence
  Synthetic Polynucleotide
taatacgactcactatagggttatatcgcgcgtttacatgctactatccgaacagaggagacggataatggcatgtaaaaacctggcggcagcgcaaaagatg

SEQ ID NO: 36809 - DNA, 103 bp, Artificial Sequence
  Synthetic Polynucleotide
taatacgactcactataggggagtcgggcatatgtctttggggccacgtaaacagaggagatacgtgatgccaaagacaaacctggcggcagcgcaaaagatg

SEQ ID NO: 36810 - DNA, 103 bp, Artificial Sequence
  Synthetic Polynucleotide
taatacgactcactatagggattagtgtaaattatccgcttacgcgtgccaacagaggagaggcacgatgaagcggataaacctggcggcagcgcaaaagatg

SEQ ID NO: 36811 - DNA, 103 bp, Artificial Sequence
  Synthetic Polynucleotide
taatacgactcactatagggatcagctccgtccaacctatgcggacgtcaaacagaggagatgacgtatgcataggttgaacctggcggcagcgcaaaagatg

SEQ ID NO: 36812 - DNA, 103 bp, Artificial Sequence
  Synthetic Polynucleotide
taatacgactcactatagggttcccggatctccgctcggccgtaaagctaaacagaggagatagcttatgggccgagcgaacctggcggcagcgcaaaagatg

SEQ ID NO: 36813 - DNA, 103 bp, Artificial Sequence
  Synthetic Polynucleotide
taatacgactcactatagggtcagatgttgtttctcgaaattatccccaaaacagaggagattggggatgatttcgagaaacctggcggcagcgcaaaagatg

SEQ ID NO: 36814 - DNA, 103 bp, Artificial Sequence
  Synthetic Polynucleotide
taatacgactcactatagggaacgtgcactggattgatacaaacacttaaaacagaggagattaagtatgtgtatcaataacctggcggcagcgcaaaagatg

SEQ ID NO: 36815 - DNA, 103 bp, Artificial Sequence
  Synthetic Polynucleotide
taatacgactcactatagggtcagcgccccctcatgcagcgggatactcaaacagaggagatgagtaatgcgctgcatgaacctggcggcagcgcaaaagatg

SEQ ID NO: 36816 - DNA, 103 bp, Artificial Sequence
  Synthetic Polynucleotide
taatacgactcactatagggccacgccggtggtagcagacgttttgatgcaacagaggagagcatcaatgcgtctgctaaacctggcggcagcgcaaaagatg

SEQ ID NO: 36817 - DNA, 103 bp, Artificial Sequence
  Synthetic Polynucleotide
taatacgactcactatagggcgagtaaattgagctattgcctgacaatagaacagaggagactattgatgggcaatagcaacctggcggcagcgcaaaagatg

SEQ ID NO: 36818 - DNA, 103 bp, Artificial Sequence
  Synthetic Polynucleotide
taatacgactcactatagggccatgtaaagaaaacactcctctaccatcgaacagaggagacgatggatgaggagtgttaacctggcggcagcgcaaaagatg

SEQ ID NO: 36819 - DNA, 103 bp, Artificial Sequence
  Synthetic Polynucleotide
taatacgactcactatagggctgcgcactttgaaggagatgctattgcaaaacagaggagattgcaaatgcatctccttaacctggcggcagcgcaaaagatg

SEQ ID NO: 36820 - DNA, 103 bp, Artificial Sequence
  Synthetic Polynucleotide
taatacgactcactatagggcaggctttgacagtacttctttctataaacaacagaggagagtttatatgaagaagtacaacctggcggcagcgcaaaagatg

SEQ ID NO: 36821 - DNA, 103 bp, Artificial Sequence
  Synthetic Polynucleotide
taatacgactcactatagggccgcagcagcgtcgagaccgccagttatctaacagaggagaagataaatggcggtctcgaacctggcggcagcgcaaaagatg

SEQ ID NO: 36822 - DNA, 103 bp, Artificial Sequence
  Synthetic Polynucleotide
taatacgactcactatagggatagatgcagctaaccctcttatcctccagaacagaggagactggagatgaagagggttaacctggcggcagcgcaaaagatg

SEQ ID NO: 36823 - DNA, 103 bp, Artificial Sequence
  Synthetic Polynucleotide
taatacgactcactatagggcacgagagtggccccgcacatggattagagaacagaggagactctaaatgatgtgcgggaacctggcggcagcgcaaaagatg

SEQ ID NO: 36824 - DNA, 103 bp, Artificial Sequence
  Synthetic Polynucleotide
taatacgactcactataggggccttctggccctaaatccaccgcttaataaacagaggagatattaaatggtggatttaaacctggcggcagcgcaaaagatg

SEQ ID NO: 36825 - DNA, 103 bp, Artificial Sequence
  Synthetic Polynucleotide
taatacgactcactatagggcaagagacatgccaatttgatcggcagagaaacagaggagatctctgatgatcaaattgaacctggcggcagcgcaaaagatg

SEQ ID NO: 36826 - DNA, 103 bp, Artificial Sequence
  Synthetic Polynucleotide
taatacgactcactatagggcgaccacatggcctggaatacgtagcacgcaacagaggagagcgtgcatggtattccagaacctggcggcagcgcaaaagatg

SEQ ID NO: 36827 - DNA, 103 bp, Artificial Sequence
  Synthetic Polynucleotide
taatacgactcactataggggctagttcggtcacacatacgggacttgataacagaggagaatcaagatgcgtatgtgtaacctggcggcagcgcaaaagatg

SEQ ID NO: 36828 - DNA, 103 bp, Artificial Sequence
  Synthetic Polynucleotide
taatacgactcactatagggggtcctcacgccatgacgaattgctgaattaacagaggagaaattcaatgattcgtcataacctggcggcagcgcaaaagatg

SEQ ID NO: 36829 - DNA, 103 bp, Artificial Sequence
  Synthetic Polynucleotide
taatacgactcactatagggcagcaatgacagagtgcatccggccgcattaacagaggagaaatgcgatgggatgcactaacctggcggcagcgcaaaagatg

SEQ ID NO: 36830 - DNA, 103 bp, Artificial Sequence
  Synthetic Polynucleotide
taatacgactcactatagggatggtcgtcgaatagcttctaaccattaaaaacagaggagatttaatatgtagaagctaaacctggcggcagcgcaaaagatg

SEQ ID NO: 36831 - DNA, 103 bp, Artificial Sequence
  Synthetic Polynucleotide
taatacgactcactatagggaaattccctttagttatgcacaagatccccaacagaggagaggggatatggtgcataacaacctggcggcagcgcaaaagatg

SEQ ID NO: 36832 - DNA, 103 bp, Artificial Sequence
  Synthetic Polynucleotide
taatacgactcactatagggaggcgcccgactaggctctaggcttcggtcaacagaggagagaccgaatgctagagcctaacctggcggcagcgcaaaagatg

SEQ ID NO: 36833 - DNA, 103 bp, Artificial Sequence
  Synthetic Polynucleotide
taatacgactcactatagggaaatccttggtctaagatgagaatcgcctcaacagaggagagaggcgatgctcatcttaaacctggcggcagcgcaaaagatg

SEQ ID NO: 36834 - DNA, 103 bp, Artificial Sequence
  Synthetic Polynucleotide
taatacgactcactatagggtacgcttagttccaagcactggtaacccagaacagaggagactgggtatgcagtgcttgaacctggcggcagcgcaaaagatg

SEQ ID NO: 36835 - DNA, 103 bp, Artificial Sequence
  Synthetic Polynucleotide
taatacgactcactataggggctgacgctaaaaactgtcttcggcccaagaacagaggagacttgggatgaagacagttaacctggcggcagcgcaaaagatg

SEQ ID NO: 36836 - DNA, 103 bp, Artificial Sequence
  Synthetic Polynucleotide
taatacgactcactatagggcaagagagttctagttaggctggactcattaacagaggagaaatgagatgagcctaactaacctggcggcagcgcaaaagatg

SEQ ID NO: 36837 - DNA, 103 bp, Artificial Sequence
  Synthetic Polynucleotide
taatacgactcactatagggatcccgaaacggtggacgggaagtacctgaaacagaggagatcaggtatgtcccgtccaaacctggcggcagcgcaaaagatg

SEQ ID NO: 36838 - DNA, 103 bp, Artificial Sequence
  Synthetic Polynucleotide
taatacgactcactatagggggaaataacagattcatacgttctcaaaacaacagaggagagttttgatgacgtatgaaaacctggcggcagcgcaaaagatg

SEQ ID NO: 36839 - DNA, 103 bp, Artificial Sequence
  Synthetic Polynucleotide
taatacgactcactatagggattgaccacggtaccctctctagccgtatcaacagaggagagatacgatgagagagggtaacctggcggcagcgcaaaagatg

SEQ ID NO: 36840 - DNA, 103 bp, Artificial Sequence
  Synthetic Polynucleotide
taatacgactcactataggggttggaggcgatcgacattgcgactcattgaacagaggagacaatgaatggcaatgtcgaacctggcggcagcgcaaaagatg

SEQ ID NO: 36841 - DNA, 103 bp, Artificial Sequence
  Synthetic Polynucleotide
taatacgactcactatagggcactctcgctgactttcggatgtaggatggaacagaggagaccatccatgatccgaaagaacctggcggcagcgcaaaagatg

SEQ ID NO: 36842 - DNA, 103 bp, Artificial Sequence
  Synthetic Polynucleotide
taatacgactcactatagggccagtaccgagatttttggcgaccggaattaacagaggagaaattccatgcgccaaaaaaacctggcggcagcgcaaaagatg

SEQ ID NO: 36843 - DNA, 103 bp, Artificial Sequence
  Synthetic Polynucleotide
taatacgactcactatagggttggtctttctggttaatatcaagcgatacaacagaggagagtatcgatggatattaacaacctggcggcagcgcaaaagatg

SEQ ID NO: 36844 - DNA, 103 bp, Artificial Sequence
  Synthetic Polynucleotide
taatacgactcactatagggtaattcggctgggtaccagcactttctaacaacagaggagagttagaatgtgctggtacaacctggcggcagcgcaaaagatg

SEQ ID NO: 36845 - DNA, 103 bp, Artificial Sequence
  Synthetic Polynucleotide
taatacgactcactatagggtaggggcccatgaggtgatctcacaattaaaacagaggagattaattatgagatcacctaacctggcggcagcgcaaaagatg

SEQ ID NO: 36846 - DNA, 103 bp, Artificial Sequence
  Synthetic Polynucleotide
taatacgactcactatagggtctggcgaataccggcgctccgaaaaagggaacagaggagaccctttatgggagcgccgaacctggcggcagcgcaaaagatg

SEQ ID NO: 36847 - DNA, 103 bp, Artificial Sequence
  Synthetic Polynucleotide
taatacgactcactataggggttgggcacggacagtaatgaaatagaggtaacagaggagaacctctatgtcattactgaacctggcggcagcgcaaaagatg

SEQ ID NO: 36848 - DNA, 103 bp, Artificial Sequence
  Synthetic Polynucleotide
taatacgactcactataggggttgagcagttcgcgcgtgatcatcttacaaacagaggagatgtaagatgatcacgcgcaacctggcggcagcgcaaaagatg

SEQ ID NO: 36849 - DNA, 103 bp, Artificial Sequence
  Synthetic Polynucleotide
taatacgactcactatagggtcgaatttcgccagtattcgatagctacttaacagaggagaaagtagatgtcgaatactaacctggcggcagcgcaaaagatg

SEQ ID NO: 36850 - DNA, 103 bp, Artificial Sequence
  Synthetic Polynucleotide
taatacgactcactatagggccaatatgtccttaactctgcattcgctataacagaggagaatagcgatggcagagttaaacctggcggcagcgcaaaagatg

SEQ ID NO: 36851 - DNA, 103 bp, Artificial Sequence
  Synthetic Polynucleotide
taatacgactcactatagggggtgactaaataagcatgcaaagtaggtcgaacagaggagacgacctatgttgcatgctaacctggcggcagcgcaaaagatg

SEQ ID NO: 36852 - DNA, 103 bp, Artificial Sequence
  Synthetic Polynucleotide
taatacgactcactatagggtattttctcgataccgtgttgttcttttcgaacagaggagacgaaaaatgcaacacggtaacctggcggcagcgcaaaagatg

SEQ ID NO: 36853 - DNA, 103 bp, Artificial Sequence
  Synthetic Polynucleotide
taatacgactcactatagggccccactcgatcgttttaagatatattcgcaacagaggagagcgaatatgtcttaaaacaacctggcggcagcgcaaaagatg

SEQ ID NO: 36854 - DNA, 103 bp, Artificial Sequence
  Synthetic Polynucleotide
taatacgactcactatagggcatatgcccaaagattattacataccgcgaaacagaggagatcgcggatggtaataatcaacctggcggcagcgcaaaagatg

SEQ ID NO: 36855 - DNA, 103 bp, Artificial Sequence
  Synthetic Polynucleotide
taatacgactcactatagggtcacagattccaacgattattctacattttaacagaggagaaaaatgatgaataatcgtaacctggcggcagcgcaaaagatg

SEQ ID NO: 36856 - DNA, 103 bp, Artificial Sequence
  Synthetic Polynucleotide
taatacgactcactatagggaatgtatttgcacctgtaccgaagtggcacaacagaggagagtgccaatgcggtacaggaacctggcggcagcgcaaaagatg

SEQ ID NO: 36857 - DNA, 103 bp, Artificial Sequence
  Synthetic Polynucleotide
taatacgactcactatagggtctttgacccacgtaaacgatctgtggtggaacagaggagaccaccaatgatcgtttacaacctggcggcagcgcaaaagatg

SEQ ID NO: 36858 - DNA, 103 bp, Artificial Sequence
  Synthetic Polynucleotide
taatacgactcactataggggaaggttcgccattggcgcagccactttctaacagaggagaagaaagatgctgcgccaaaacctggcggcagcgcaaaagatg

SEQ ID NO: 36859 - DNA, 103 bp, Artificial Sequence
  Synthetic Polynucleotide
taatacgactcactatagggcataatcggggaggctggtcggtgtgctacaacagaggagagtagcaatgcgaccagccaacctggcggcagcgcaaaagatg

SEQ ID NO: 36860 - DNA, 103 bp, Artificial Sequence
  Synthetic Polynucleotide
taatacgactcactataggggcgctgatgctgtgttacagaggtctctacaacagaggagagtagagatgtctgtaacaaacctggcggcagcgcaaaagatg

SEQ ID NO: 36861 - DNA, 103 bp, Artificial Sequence
  Synthetic Polynucleotide
taatacgactcactataggggcttcaacctgcctacaacgacggtgcggtaacagaggagaaccgcaatgtcgttgtagaacctggcggcagcgcaaaagatg

SEQ ID NO: 36862 - DNA, 103 bp, Artificial Sequence
  Synthetic Polynucleotide
taatacgactcactatagggtctcggaaaaagtgctacactgctaggtgcaacagaggagagcacctatgagtgtagcaaacctggcggcagcgcaaaagatg

SEQ ID NO: 36863 - DNA, 103 bp, Artificial Sequence
  Synthetic Polynucleotide
taatacgactcactatagggaccttgagttgcaggaagatgtctcacatcaacagaggagagatgtgatgcatcttcctaacctggcggcagcgcaaaagatg

SEQ ID NO: 36864 - DNA, 103 bp, Artificial Sequence
  Synthetic Polynucleotide
taatacgactcactatagggctgacacacacatatgacaggggactgggcaacagaggagagcccagatgcctgtcataaacctggcggcagcgcaaaagatg

SEQ ID NO: 36865 - DNA, 103 bp, Artificial Sequence
  Synthetic Polynucleotide
taatacgactcactatagggggcatagaagagcggtaatgcaaatgccggaacagaggagaccggcaatggcattaccgaacctggcggcagcgcaaaagatg

SEQ ID NO: 36866 - DNA, 103 bp, Artificial Sequence
  Synthetic Polynucleotide
taatacgactcactatagggtactttaacgggagcgatttatggaggggcaacagaggagagcccctatgtaaatcgctaacctggcggcagcgcaaaagatg

SEQ ID NO: 36867 - DNA, 103 bp, Artificial Sequence
  Synthetic Polynucleotide
taatacgactcactatagggggagcttgggttacactaacggtccaccataacagaggagaatggtgatgcgttagtgtaacctggcggcagcgcaaaagatg

SEQ ID NO: 36868 - DNA, 103 bp, Artificial Sequence
  Synthetic Polynucleotide
taatacgactcactatagggcatccaatacattaatacaatagccaccacaacagaggagagtggtgatgattgtattaaacctggcggcagcgcaaaagatg

SEQ ID NO: 36869 - DNA, 103 bp, Artificial Sequence
  Synthetic Polynucleotide
taatacgactcactatagggcatcgaaaagacggtggcgtagcacgcctgaacagaggagacaggcgatgtacgccaccaacctggcggcagcgcaaaagatg

SEQ ID NO: 36870 - DNA, 103 bp, Artificial Sequence
  Synthetic Polynucleotide
taatacgactcactataggggtagatgccctacgtgttattgccccgttaaacagaggagataacggatgaataacacgaacctggcggcagcgcaaaagatg

SEQ ID NO: 36871 - DNA, 103 bp, Artificial Sequence
  Synthetic Polynucleotide
taatacgactcactatagggagttagcgtcaagacactcactgggctcgcaacagaggagagcgagcatggtgagtgtcaacctggcggcagcgcaaaagatg

SEQ ID NO: 36872 - DNA, 103 bp, Artificial Sequence
  Synthetic Polynucleotide
taatacgactcactataggggcgcttctccggtagacagaatcaagcgcaaacagaggagatgcgctatgttctgtctaaacctggcggcagcgcaaaagatg

SEQ ID NO: 36873 - DNA, 103 bp, Artificial Sequence
  Synthetic Polynucleotide
taatacgactcactatagggttaaaggcaatggcgagacattcttaatcgaacagaggagacgattaatgatgtctcgcaacctggcggcagcgcaaaagatg

SEQ ID NO: 36874 - DNA, 103 bp, Artificial Sequence
  Synthetic Polynucleotide
taatacgactcactataggggttaggattgcagtatccttcatccgcctaaacagaggagataggcgatggaaggatacaacctggcggcagcgcaaaagatg

SEQ ID NO: 36875 - DNA, 103 bp, Artificial Sequence
  Synthetic Polynucleotide
taatacgactcactatagggccggtccactatggtcgttctattgcttcaaacagaggagatgaagcatgagaacgaccaacctggcggcagcgcaaaagatg

SEQ ID NO: 36876 - DNA, 103 bp, Artificial Sequence
  Synthetic Polynucleotide
taatacgactcactatagggttgttattgcttgtcgccggcacgggcaaaaacagaggagatttgccatggccggcgacaacctggcggcagcgcaaaagatg

SEQ ID NO: 36877 - DNA, 103 bp, Artificial Sequence
  Synthetic Polynucleotide
taatacgactcactataggggcatgacgcaggcgtgctggggccgcgttcaacagaggagagaacgcatgcccagcacgaacctggcggcagcgcaaaagatg

SEQ ID NO: 36878 - DNA, 103 bp, Artificial Sequence
  Synthetic Polynucleotide
taatacgactcactatagggttgtctgtcgggcgaacttcacgtaactgcaacagaggagagcagttatgtgaagttcgaacctggcggcagcgcaaaagatg

SEQ ID NO: 36879 - DNA, 103 bp, Artificial Sequence
  Synthetic Polynucleotide
taatacgactcactatagggactggctgggcaagggcgcgtggtgtcaaaaacagaggagatttgacatgacgcgccctaacctggcggcagcgcaaaagatg

SEQ ID NO: 36880 - DNA, 103 bp, Artificial Sequence
  Synthetic Polynucleotide
taatacgactcactataggggaagtagcggcggcggagtataaagcaacgaacagaggagacgttgcatgatactccgcaacctggcggcagcgcaaaagatg

SEQ ID NO: 36881 - DNA, 103 bp, Artificial Sequence
  Synthetic Polynucleotide
taatacgactcactatagggagttgactacgcttcgccctctttctgtgaaacagaggagatcacagatggagggcgaaaacctggcggcagcgcaaaagatg

SEQ ID NO: 36882 - DNA, 103 bp, Artificial Sequence
  Synthetic Polynucleotide
taatacgactcactatagggtcggatgtactcccgtgtgaacccaatcgaaacagaggagatcgattatgttcacacggaacctggcggcagcgcaaaagatg

SEQ ID NO: 36883 - DNA, 103 bp, Artificial Sequence
  Synthetic Polynucleotide
taatacgactcactataggggccacgactagtgggcttgtgagaatccacaacagaggagagtggatatgcacaagcccaacctggcggcagcgcaaaagatg

SEQ ID NO: 36884 - DNA, 103 bp, Artificial Sequence
  Synthetic Polynucleotide
taatacgactcactatagggaatcgcgcgaaggcccaatctagcgcaggaaacagaggagatcctgcatgagattgggcaacctggcggcagcgcaaaagatg

SEQ ID NO: 36885 - DNA, 103 bp, Artificial Sequence
  Synthetic Polynucleotide
taatacgactcactatagggtatcgctaaataggttttcaactcaagcgtaacagaggagaacgcttatgttgaaaaccaacctggcggcagcgcaaaagatg

SEQ ID NO: 36886 - DNA, 103 bp, Artificial Sequence
  Synthetic Polynucleotide
taatacgactcactatagggtcaccagctccaaagacggtacggtgaactaacagaggagaagttcaatgtaccgtcttaacctggcggcagcgcaaaagatg

SEQ ID NO: 36887 - DNA, 103 bp, Artificial Sequence
  Synthetic Polynucleotide
taatacgactcactatagggaacaagcactacagaactctatagttaacgaacagaggagacgttaaatgtagagttctaacctggcggcagcgcaaaagatg

SEQ ID NO: 36888 - DNA, 103 bp, Artificial Sequence
  Synthetic Polynucleotide
taatacgactcactatagggatgcccgtaagtgccgtagatcctcccgtgaacagaggagacacgggatgatctacggcaacctggcggcagcgcaaaagatg

SEQ ID NO: 36889 - DNA, 103 bp, Artificial Sequence
  Synthetic Polynucleotide
taatacgactcactatagggttgcttagacaagcccttccatcttgtaataacagaggagaattacaatgtggaagggcaacctggcggcagcgcaaaagatg

SEQ ID NO: 36890 - DNA, 103 bp, Artificial Sequence
  Synthetic Polynucleotide
taatacgactcactatagggcctccgttctacgtgcgtttgggtagaaagaacagaggagactttctatgcaaacgcacaacctggcggcagcgcaaaagatg

SEQ ID NO: 36891 - DNA, 103 bp, Artificial Sequence
  Synthetic Polynucleotide
taatacgactcactatagggccttaccgtgccgttccttgaacgctacgcaacagaggagagcgtagatgtcaaggaacaacctggcggcagcgcaaaagatg

SEQ ID NO: 36892 - DNA, 103 bp, Artificial Sequence
  Synthetic Polynucleotide
taatacgactcactatagggtgtgctttctcgaagggtgggagctgacctaacagaggagaaggtcaatgcccacccttaacctggcggcagcgcaaaagatg

SEQ ID NO: 36893 - DNA, 103 bp, Artificial Sequence
  Synthetic Polynucleotide
taatacgactcactataggggcaccggcgagacatggcgcgcttctccttaacagaggagaaaggagatgcgcgccatgaacctggcggcagcgcaaaagatg

SEQ ID NO: 36894 - DNA, 103 bp, Artificial Sequence
  Synthetic Polynucleotide
taatacgactcactatagggctttttggttttgtccacttccacaataagaacagaggagacttattatggaagtggacaacctggcggcagcgcaaaagatg

SEQ ID NO: 36895 - DNA, 103 bp, Artificial Sequence
  Synthetic Polynucleotide
taatacgactcactataggggtatgttcggtgtcgaaggattatcggagaaacagaggagatctccgatgatccttcgaaacctggcggcagcgcaaaagatg

SEQ ID NO: 36896 - DNA, 103 bp, Artificial Sequence
  Synthetic Polynucleotide
taatacgactcactatagggttatgccgacgagaccttcatgtgctttttaacagaggagaaaaaagatgatgaaggtcaacctggcggcagcgcaaaagatg

SEQ ID NO: 36897 - DNA, 103 bp, Artificial Sequence
  Synthetic Polynucleotide
taatacgactcactatagggtaatgaggggcgtgcattggcggcatccagaacagaggagactggatatggccaatgcaaacctggcggcagcgcaaaagatg

SEQ ID NO: 36898 - DNA, 103 bp, Artificial Sequence
  Synthetic Polynucleotide
taatacgactcactatagggcatacgctgcacagggtctccacgggtttgaacagaggagacaaaccatgggagaccctaacctggcggcagcgcaaaagatg

SEQ ID NO: 36899 - DNA, 103 bp, Artificial Sequence
  Synthetic Polynucleotide
taatacgactcactatagggtagcttgaaggtagcccgtccaccgatggcaacagaggagagccatcatgggacgggctaacctggcggcagcgcaaaagatg

SEQ ID NO: 36900 - DNA, 103 bp, Artificial Sequence
  Synthetic Polynucleotide
taatacgactcactatagggatgaagtagctggtcgtattttctacctggaacagaggagaccaggtatgaaatacgacaacctggcggcagcgcaaaagatg

SEQ ID NO: 36901 - DNA, 103 bp, Artificial Sequence
  Synthetic Polynucleotide
taatacgactcactatagggataacatgagatgtacggttttacttaacaaacagaggagatgttaaatgaaaccgtacaacctggcggcagcgcaaaagatg

SEQ ID NO: 36902 - DNA, 103 bp, Artificial Sequence
  Synthetic Polynucleotide
taatacgactcactatagggcctaagagggactactattccggatcggcaaacagaggagatgccgaatgggaatagtaaacctggcggcagcgcaaaagatg

SEQ ID NO: 36903 - DNA, 103 bp, Artificial Sequence
  Synthetic Polynucleotide
taatacgactcactataggggacaacttcccgagtttacccaaagagtacaacagaggagagtactcatggggtaaactaacctggcggcagcgcaaaagatg

SEQ ID NO: 36904 - DNA, 103 bp, Artificial Sequence
  Synthetic Polynucleotide
taatacgactcactatagggttgatacaaaaagctgggtgagggaatcttaacagaggagaaagattatgtcacccagcaacctggcggcagcgcaaaagatg

SEQ ID NO: 36905 - DNA, 103 bp, Artificial Sequence
  Synthetic Polynucleotide
taatacgactcactatagggtatggttgttgggctagcaggacattgtcaaacagaggagatgacaaatgcctgctagcaacctggcggcagcgcaaaagatg

SEQ ID NO: 36906 - DNA, 103 bp, Artificial Sequence
  Synthetic Polynucleotide
taatacgactcactataggggaactttcccctagctgtttccgcccggagaacagaggagactccggatggaaacagctaacctggcggcagcgcaaaagatg

SEQ ID NO: 36907 - DNA, 103 bp, Artificial Sequence
  Synthetic Polynucleotide
taatacgactcactatagggaagtcatgcaaactgtcgtagataggctctaacagaggagaagagccatgctacgacagaacctggcggcagcgcaaaagatg

SEQ ID NO: 36908 - DNA, 103 bp, Artificial Sequence
  Synthetic Polynucleotide
taatacgactcactatagggcgggcgcttggaagacatcgcactgacgttaacagaggagaaacgtcatggcgatgtctaacctggcggcagcgcaaaagatg

SEQ ID NO: 36909 - DNA, 103 bp, Artificial Sequence
  Synthetic Polynucleotide
taatacgactcactatagggtgcagtctccagggcggtatgtatagagaaaacagaggagattctctatgcataccgccaacctggcggcagcgcaaaagatg

SEQ ID NO: 36910 - DNA, 103 bp, Artificial Sequence
  Synthetic Polynucleotide
taatacgactcactatagggtcagagagcgaatcggaatgccagttgaaaaacagaggagatttcaaatggcattccgaaacctggcggcagcgcaaaagatg

SEQ ID NO: 36911 - DNA, 103 bp, Artificial Sequence
  Synthetic Polynucleotide
taatacgactcactatagggctaatcgctcgtccagaatcttgaatagcaaacagaggagatgctatatgagattctggaacctggcggcagcgcaaaagatg

SEQ ID NO: 36912 - DNA, 103 bp, Artificial Sequence
  Synthetic Polynucleotide
taatacgactcactatagggagtttcatcctaccatccgtcacaacaatgaacagaggagacattgtatggacggatggaacctggcggcagcgcaaaagatg

SEQ ID NO: 36913 - DNA, 103 bp, Artificial Sequence
  Synthetic Polynucleotide
taatacgactcactataggggcttaactatgtaggggcttggtttaggcaaacagaggagatgcctaatgcaagcccctaacctggcggcagcgcaaaagatg

SEQ ID NO: 36914 - DNA, 103 bp, Artificial Sequence
  Synthetic Polynucleotide
taatacgactcactatagggtgacgagcggtatgtttctcagacctgtaaaacagaggagattacagatgtgagaaacaaacctggcggcagcgcaaaagatg

SEQ ID NO: 36915 - DNA, 103 bp, Artificial Sequence
  Synthetic Polynucleotide
taatacgactcactatagggtgtctagtgtggaacgcctagtcctaggtgaacagaggagacacctaatgctaggcgttaacctggcggcagcgcaaaagatg

SEQ ID NO: 36916 - DNA, 103 bp, Artificial Sequence
  Synthetic Polynucleotide
taatacgactcactataggggacactagcgctggaaaggtcgggggttataacagaggagaataaccatggacctttccaacctggcggcagcgcaaaagatg

SEQ ID NO: 36917 - DNA, 103 bp, Artificial Sequence
  Synthetic Polynucleotide
taatacgactcactatagggccgcagtacacatctcattttccccaaagaaacagaggagatctttgatgaaaatgagaaacctggcggcagcgcaaaagatg

SEQ ID NO: 36918 - DNA, 103 bp, Artificial Sequence
  Synthetic Polynucleotide
taatacgactcactatagggtgcaaaacagtatgactctggcgcgactagaacagaggagactagtcatgccagagtcaaacctggcggcagcgcaaaagatg

SEQ ID NO: 36919 - DNA, 103 bp, Artificial Sequence
  Synthetic Polynucleotide
taatacgactcactataggggaaaatatatagatcagctgctatttctccaacagaggagaggagaaatggcagctgataacctggcggcagcgcaaaagatg

SEQ ID NO: 36920 - DNA, 103 bp, Artificial Sequence
  Synthetic Polynucleotide
taatacgactcactatagggcgtcaggggggtattgtgactgtgcagcagaacagaggagactgctgatgagtcacaataacctggcggcagcgcaaaagatg

SEQ ID NO: 36921 - DNA, 103 bp, Artificial Sequence
  Synthetic Polynucleotide
taatacgactcactatagggcattggatattagtccaggtaaacgtgtgcaacagaggagagcacacatgtacctggacaacctggcggcagcgcaaaagatg

SEQ ID NO: 36922 - DNA, 103 bp, Artificial Sequence
  Synthetic Polynucleotide
taatacgactcactatagggtgctacggctatctacggtgcgtatgagttaacagaggagaaactcaatggcaccgtagaacctggcggcagcgcaaaagatg

SEQ ID NO: 36923 - DNA, 103 bp, Artificial Sequence
  Synthetic Polynucleotide
taatacgactcactatagggacagatcctgtcgcttccggccgtcagacaaacagaggagatgtctgatggccggaagcaacctggcggcagcgcaaaagatg

SEQ ID NO: 36924 - DNA, 103 bp, Artificial Sequence
  Synthetic Polynucleotide
taatacgactcactatagggacattaggtgaccaagaagaccacactccaaacagaggagatggagtatggtcttcttgaacctggcggcagcgcaaaagatg

SEQ ID NO: 36925 - DNA, 103 bp, Artificial Sequence
  Synthetic Polynucleotide
taatacgactcactatagggattgagcaatacagccacaaacaagaaaggaacagaggagacctttcatgtttgtggctaacctggcggcagcgcaaaagatg

SEQ ID NO: 36926 - DNA, 103 bp, Artificial Sequence
  Synthetic Polynucleotide
taatacgactcactatagggcgtcctcgatagtgcggcacgcatgtcccgaacagaggagacgggacatgcgtgccgcaaacctggcggcagcgcaaaagatg

SEQ ID NO: 36927 - DNA, 103 bp, Artificial Sequence
  Synthetic Polynucleotide
taatacgactcactataggggtactcgagcgggacgcacaggtaacgggtaacagaggagaacccgtatgctgtgcgtcaacctggcggcagcgcaaaagatg

SEQ ID NO: 36928 - DNA, 103 bp, Artificial Sequence
  Synthetic Polynucleotide
taatacgactcactatagggagttcaagttactcttacgatcgggcccccaacagaggagagggggcatgatcgtaagaaacctggcggcagcgcaaaagatg

SEQ ID NO: 36929 - DNA, 103 bp, Artificial Sequence
  Synthetic Polynucleotide
taatacgactcactatagggacatagggagactgcaagatacttgtgtgtaacagaggagaacacacatgtatcttgcaaacctggcggcagcgcaaaagatg

SEQ ID NO: 36930 - DNA, 103 bp, Artificial Sequence
  Synthetic Polynucleotide
taatacgactcactatagggctagaaggtgtgggtactcggacctttgcaaacagaggagatgcaaaatgccgagtaccaacctggcggcagcgcaaaagatg

SEQ ID NO: 36931 - DNA, 103 bp, Artificial Sequence
  Synthetic Polynucleotide
taatacgactcactatagggtcagggtcgtagttcgaagaccgcgggacaaacagaggagatgtcccatggtcttcgaaaacctggcggcagcgcaaaagatg

SEQ ID NO: 36932 - DNA, 103 bp, Artificial Sequence
  Synthetic Polynucleotide
taatacgactcactatagggcatacaggtactcttccctgcgtttacgttaacagaggagaaacgtaatggcagggaagaacctggcggcagcgcaaaagatg

SEQ ID NO: 36933 - DNA, 103 bp, Artificial Sequence
  Synthetic Polynucleotide
taatacgactcactatagggcatacattactgccagcattgggcggtattaacagaggagaaataccatgcaatgctggaacctggcggcagcgcaaaagatg

SEQ ID NO: 36934 - DNA, 103 bp, Artificial Sequence
  Synthetic Polynucleotide
taatacgactcactatagggaagagaagcacacgttgagaggtgccatccaacagaggagaggatggatgctctcaacgaacctggcggcagcgcaaaagatg

SEQ ID NO: 36935 - DNA, 103 bp, Artificial Sequence
  Synthetic Polynucleotide
taatacgactcactatagggaaaattcgggggtgatgtctcctaccgaaaaacagaggagatttcggatggagacatcaaacctggcggcagcgcaaaagatg

SEQ ID NO: 36936 - DNA, 103 bp, Artificial Sequence
  Synthetic Polynucleotide
taatacgactcactatagggtgtggctgtgattctatggcctgtcgctgcaacagaggagagcagcgatgggccatagaaacctggcggcagcgcaaaagatg

SEQ ID NO: 36937 - DNA, 103 bp, Artificial Sequence
  Synthetic Polynucleotide
taatacgactcactatagggcagctggttgcctgtgaacacttcatttccaacagaggagaggaaatatggtgttcacaaacctggcggcagcgcaaaagatg

SEQ ID NO: 36938 - DNA, 103 bp, Artificial Sequence
  Synthetic Polynucleotide
taatacgactcactataggggtttgaatccgggcatggggattgttcagaaacagaggagatctgaaatgtccccatgcaacctggcggcagcgcaaaagatg

SEQ ID NO: 36939 - DNA, 103 bp, Artificial Sequence
  Synthetic Polynucleotide
taatacgactcactatagggctctaacctcctaccggaatgaaagtggtaaacagaggagataccacatgcattccggtaacctggcggcagcgcaaaagatg

SEQ ID NO: 36940 - DNA, 103 bp, Artificial Sequence
  Synthetic Polynucleotide
taatacgactcactatagggggcgatgagtcgtggggcaccatagttcaaaacagaggagattgaacatgggtgccccaaacctggcggcagcgcaaaagatg

SEQ ID NO: 36941 - DNA, 103 bp, Artificial Sequence
  Synthetic Polynucleotide
taatacgactcactatagggtggttgcacagaaggatggatctggtgtgaaacagaggagatcacacatgatccatcctaacctggcggcagcgcaaaagatg

SEQ ID NO: 36942 - DNA, 103 bp, Artificial Sequence
  Synthetic Polynucleotide
taatacgactcactatagggtaaagggagggctaatagtcctctgtacaaaacagaggagattgtacatgggactattaaacctggcggcagcgcaaaagatg

SEQ ID NO: 36943 - DNA, 103 bp, Artificial Sequence
  Synthetic Polynucleotide
taatacgactcactatagggatagcgcggcagggatttgagctgaccgttaacagaggagaaacggtatgctcaaatccaacctggcggcagcgcaaaagatg

SEQ ID NO: 36944 - DNA, 103 bp, Artificial Sequence
  Synthetic Polynucleotide
taatacgactcactatagggtatttcttaccttgccatatagtcatagataacagaggagaatctatatgtatatggcaaacctggcggcagcgcaaaagatg

SEQ ID NO: 36945 - DNA, 103 bp, Artificial Sequence
  Synthetic Polynucleotide
taatacgactcactatagggatattagaagctatattgcccaagggaagaaacagaggagatcttccatggggcaatataacctggcggcagcgcaaaagatg

SEQ ID NO: 36946 - DNA, 103 bp, Artificial Sequence
  Synthetic Polynucleotide
taatacgactcactatagggttttatttacttggtccggtacaatgccaaaacagaggagattggcaatgtaccggaccaacctggcggcagcgcaaaagatg

SEQ ID NO: 36947 - DNA, 103 bp, Artificial Sequence
  Synthetic Polynucleotide
taatacgactcactatagggctcaacgtgcggttaaaactttatgaacaaaacagaggagattgttcatgaagttttaaaacctggcggcagcgcaaaagatg

SEQ ID NO: 36948 - DNA, 103 bp, Artificial Sequence
  Synthetic Polynucleotide
taatacgactcactatagggagcataagtctattctatcaccatcacgtcaacagaggagagacgtgatggtgatagaaaacctggcggcagcgcaaaagatg

SEQ ID NO: 36949 - DNA, 103 bp, Artificial Sequence
  Synthetic Polynucleotide
taatacgactcactataggggcttcgtttgtcacaggaccaactaaattaaacagaggagataatttatgtggtcctgtaacctggcggcagcgcaaaagatg

SEQ ID NO: 36950 - DNA, 103 bp, Artificial Sequence
  Synthetic Polynucleotide
taatacgactcactatagggctgccctaccttggtcttggagagaaattgaacagaggagacaatttatgtccaagaccaacctggcggcagcgcaaaagatg

SEQ ID NO: 36951 - DNA, 103 bp, Artificial Sequence
  Synthetic Polynucleotide
taatacgactcactatagggaacttgggaccctgccgccgattagatctgaacagaggagacagatcatgtcggcggcaaacctggcggcagcgcaaaagatg

SEQ ID NO: 36952 - DNA, 103 bp, Artificial Sequence
  Synthetic Polynucleotide
taatacgactcactatagggcgttagagtccaagctctccaccccatccaaacagaggagatggatgatgtggagagctaacctggcggcagcgcaaaagatg

SEQ ID NO: 36953 - DNA, 103 bp, Artificial Sequence
  Synthetic Polynucleotide
taatacgactcactatagggggggcagataaaggacggcagctggttcataacagaggagaatgaacatgctgccgtccaacctggcggcagcgcaaaagatg

SEQ ID NO: 36954 - DNA, 103 bp, Artificial Sequence
  Synthetic Polynucleotide
taatacgactcactataggggcagaaactagttgtgatttgcacgggtgtaacagaggagaacacccatgcaaatcacaaacctggcggcagcgcaaaagatg

SEQ ID NO: 36955 - DNA, 103 bp, Artificial Sequence
  Synthetic Polynucleotide
taatacgactcactatagggagatgtcgaaattggagcacatgttagctaaacagaggagatagctaatgtgtgctccaaacctggcggcagcgcaaaagatg

SEQ ID NO: 36956 - DNA, 103 bp, Artificial Sequence
  Synthetic Polynucleotide
taatacgactcactatagggtcatcgaaacgggagcacgctgatgtcgataacagaggagaatcgacatgagcgtgctcaacctggcggcagcgcaaaagatg

SEQ ID NO: 36957 - DNA, 103 bp, Artificial Sequence
  Synthetic Polynucleotide
taatacgactcactatagggaggacaatgatctagagcctcaatccaagaaacagaggagatcttggatggaggctctaaacctggcggcagcgcaaaagatg

SEQ ID NO: 36958 - DNA, 103 bp, Artificial Sequence
  Synthetic Polynucleotide
taatacgactcactatagggctacgacttggttgtcaccctcggtcttccaacagaggagaggaagaatgagggtgacaaacctggcggcagcgcaaaagatg

SEQ ID NO: 36959 - DNA, 103 bp, Artificial Sequence
  Synthetic Polynucleotide
taatacgactcactatagggaagtgattagcataaactacgtcaccgcccaacagaggagagggcggatgcgtagtttaaacctggcggcagcgcaaaagatg

SEQ ID NO: 36960 - DNA, 103 bp, Artificial Sequence
  Synthetic Polynucleotide
taatacgactcactatagggatattaacataggaatgagtactctgacttaacagaggagaaagtcaatgtactcattcaacctggcggcagcgcaaaagatg

SEQ ID NO: 36961 - DNA, 103 bp, Artificial Sequence
  Synthetic Polynucleotide
taatacgactcactatagggaggccatctggcgccaagaccccctgagggaacagaggagaccctcaatgggtcttggcaacctggcggcagcgcaaaagatg

SEQ ID NO: 36962 - DNA, 103 bp, Artificial Sequence
  Synthetic Polynucleotide
taatacgactcactataggggtgcggtcaaacacagaatccacagaaagtaacagaggagaactttcatgggattctgtaacctggcggcagcgcaaaagatg

SEQ ID NO: 36963 - DNA, 103 bp, Artificial Sequence
  Synthetic Polynucleotide
taatacgactcactatagggcagattacgagggtatcggttgccaactgaaacagaggagatcagttatgaaccgatacaacctggcggcagcgcaaaagatg

SEQ ID NO: 36964 - DNA, 103 bp, Artificial Sequence
  Synthetic Polynucleotide
taatacgactcactatagggagcgcataagtttaggcattagaatgggctaacagaggagaagcccaatgtaatgcctaaacctggcggcagcgcaaaagatg

SEQ ID NO: 36965 - DNA, 103 bp, Artificial Sequence
  Synthetic Polynucleotide
taatacgactcactatagggggacaaagaatgaatgggtggaacgatctcaacagaggagagagatcatgccacccattaacctggcggcagcgcaaaagatg

SEQ ID NO: 36966 - DNA, 103 bp, Artificial Sequence
  Synthetic Polynucleotide
taatacgactcactatagggttgaagacagctcagagaggcatagaaattaacagaggagaaatttcatggcctctctgaacctggcggcagcgcaaaagatg

SEQ ID NO: 36967 - DNA, 103 bp, Artificial Sequence
  Synthetic Polynucleotide
taatacgactcactatagggagcctcatgttccccccgtcttgtgctctgaacagaggagacagagcatgagacgggggaacctggcggcagcgcaaaagatg

SEQ ID NO: 36968 - DNA, 103 bp, Artificial Sequence
  Synthetic Polynucleotide
taatacgactcactatagggttcgaatggcttcgtagcgttttcatagctaacagaggagaagctatatgaacgctacgaacctggcggcagcgcaaaagatg

SEQ ID NO: 36969 - DNA, 103 bp, Artificial Sequence
  Synthetic Polynucleotide
taatacgactcactatagggttaatcccgcgtggataagtggcggctcgtaacagaggagaacgagcatgcacttatccaacctggcggcagcgcaaaagatg

SEQ ID NO: 36970 - DNA, 103 bp, Artificial Sequence
  Synthetic Polynucleotide
taatacgactcactatagggtgacgaaacactagaagtcccaccaaactaaacagaggagatagtttatggggacttctaacctggcggcagcgcaaaagatg

SEQ ID NO: 36971 - DNA, 103 bp, Artificial Sequence
  Synthetic Polynucleotide
taatacgactcactatagggtgctactctgtgacgaaaaacaccccgataaacagaggagatatcggatggtttttcgtaacctggcggcagcgcaaaagatg

SEQ ID NO: 36972 - DNA, 103 bp, Artificial Sequence
  Synthetic Polynucleotide
taatacgactcactatagggttaggtaaagaaaccgtggatgtgctgcctaacagaggagaaggcagatgatccacggtaacctggcggcagcgcaaaagatg

SEQ ID NO: 36973 - DNA, 103 bp, Artificial Sequence
  Synthetic Polynucleotide
taatacgactcactatagggtttaagtcttccactagctatactaaagataacagaggagaatctttatgatagctagtaacctggcggcagcgcaaaagatg

SEQ ID NO: 36974 - DNA, 103 bp, Artificial Sequence
  Synthetic Polynucleotide
taatacgactcactatagggatactggtggataccaaacactctctccataacagaggagaatggagatggtgtttggtaacctggcggcagcgcaaaagatg

SEQ ID NO: 36975 - DNA, 103 bp, Artificial Sequence
  Synthetic Polynucleotide
taatacgactcactatagggagcgcaagtgtccttgagggttagcaatcgaacagaggagacgattgatgaccctcaagaacctggcggcagcgcaaaagatg

SEQ ID NO: 36976 - DNA, 103 bp, Artificial Sequence
  Synthetic Polynucleotide
taatacgactcactatagggcattgattgttacactatggaccagatgacaacagaggagagtcatcatgtccatagtgaacctggcggcagcgcaaaagatg

SEQ ID NO: 36977 - DNA, 103 bp, Artificial Sequence
  Synthetic Polynucleotide
taatacgactcactatagggtattatctggttagccttatgtacgcacctaacagaggagaaggtgcatgcataaggctaacctggcggcagcgcaaaagatg

SEQ ID NO: 36978 - DNA, 103 bp, Artificial Sequence
  Synthetic Polynucleotide
taatacgactcactataggggtgcgacttcactactagactaaccgccttaacagaggagaaaggcgatgagtctagtaaacctggcggcagcgcaaaagatg

SEQ ID NO: 36979 - DNA, 103 bp, Artificial Sequence
  Synthetic Polynucleotide
taatacgactcactatagggcgctcgttataggtatttatagtcggttaaaacagaggagattaaccatgtataaatacaacctggcggcagcgcaaaagatg

SEQ ID NO: 36980 - DNA, 103 bp, Artificial Sequence
  Synthetic Polynucleotide
taatacgactcactatagggttctcgtaaattctctagaggcatagacgtaacagaggagaacgtctatgcctctagagaacctggcggcagcgcaaaagatg

SEQ ID NO: 36981 - DNA, 103 bp, Artificial Sequence
  Synthetic Polynucleotide
taatacgactcactataggggttcgcgtgcatgggcgtacgggtgcatgcaacagaggagagcatgcatgcgtacgcccaacctggcggcagcgcaaaagatg

SEQ ID NO: 36982 - DNA, 103 bp, Artificial Sequence
  Synthetic Polynucleotide
taatacgactcactatagggggtacgagccgtcagcgagcaccatggttaaacagaggagataaccaatgtgctcgctgaacctggcggcagcgcaaaagatg

SEQ ID NO: 36983 - DNA, 103 bp, Artificial Sequence
  Synthetic Polynucleotide
taatacgactcactatagggacagagctcaactcagaggaacaggtgcacaacagaggagagtgcacatgttcctctgaaacctggcggcagcgcaaaagatg

SEQ ID NO: 36984 - DNA, 103 bp, Artificial Sequence
  Synthetic Polynucleotide
taatacgactcactatagggaccatctatataggttagtgacacacatcgaacagaggagacgatgtatgtcactaaccaacctggcggcagcgcaaaagatg

SEQ ID NO: 36985 - DNA, 103 bp, Artificial Sequence
  Synthetic Polynucleotide
taatacgactcactatagggaaaactgcgcaggatcatggaccctctgacaacagaggagagtcagaatgtccatgatcaacctggcggcagcgcaaaagatg

SEQ ID NO: 36986 - DNA, 103 bp, Artificial Sequence
  Synthetic Polynucleotide
taatacgactcactataggggccggagcagaatgccgtattaactgactgaacagaggagacagtcaatgaatacggcaaacctggcggcagcgcaaaagatg

SEQ ID NO: 36987 - DNA, 103 bp, Artificial Sequence
  Synthetic Polynucleotide
taatacgactcactatagggctcgtattaaggaacccgcgggtttgtagaaacagaggagatctacaatgccgcgggttaacctggcggcagcgcaaaagatg

SEQ ID NO: 36988 - DNA, 103 bp, Artificial Sequence
  Synthetic Polynucleotide
taatacgactcactataggggtaagggcaacctccctgggcggtatgcgcaacagaggagagcgcatatggcccagggaaacctggcggcagcgcaaaagatg

SEQ ID NO: 36989 - DNA, 103 bp, Artificial Sequence
  Synthetic Polynucleotide
taatacgactcactatagggtacccagacgggatctacaagcccttctggaacagaggagaccagaaatgcttgtagataacctggcggcagcgcaaaagatg

SEQ ID NO: 36990 - DNA, 103 bp, Artificial Sequence
  Synthetic Polynucleotide
taatacgactcactatagggtcacgcgcggcgacagagagttacgggtgaaacagaggagatcacccatgactctctgtaacctggcggcagcgcaaaagatg

SEQ ID NO: 36991 - DNA, 103 bp, Artificial Sequence
  Synthetic Polynucleotide
taatacgactcactatagggcgtcgttcgcttaatccctctcatcacagcaacagaggagagctgtgatgagagggattaacctggcggcagcgcaaaagatg

SEQ ID NO: 36992 - DNA, 103 bp, Artificial Sequence
  Synthetic Polynucleotide
taatacgactcactatagggcttacggcagagtaaacaatccagcggcacaacagaggagagtgccgatggattgtttaaacctggcggcagcgcaaaagatg

SEQ ID NO: 36993 - DNA, 103 bp, Artificial Sequence
  Synthetic Polynucleotide
taatacgactcactatagggagcgtgtgaattgacgccttcgacgaacataacagaggagaatgttcatggaaggcgtcaacctggcggcagcgcaaaagatg

SEQ ID NO: 36994 - DNA, 103 bp, Artificial Sequence
  Synthetic Polynucleotide
taatacgactcactatagggtctcaatacacgcgccgctgacagagagtaaacagaggagatactctatgtcagcggcgaacctggcggcagcgcaaaagatg

SEQ ID NO: 36995 - DNA, 103 bp, Artificial Sequence
  Synthetic Polynucleotide
taatacgactcactatagggggaggtgtgccttcactcaataaggatttaaacagaggagataaatcatgattgagtgaaacctggcggcagcgcaaaagatg

SEQ ID NO: 36996 - DNA, 103 bp, Artificial Sequence
  Synthetic Polynucleotide
taatacgactcactatagggaattctgtgttggactttatctcagccagtaacagaggagaactggcatggataaagtcaacctggcggcagcgcaaaagatg

SEQ ID NO: 36997 - DNA, 103 bp, Artificial Sequence
  Synthetic Polynucleotide
taatacgactcactatagggtaactgatcaacccgtttgcgaggggtccgaacagaggagacggaccatgcgcaaacggaacctggcggcagcgcaaaagatg

SEQ ID NO: 36998 - DNA, 103 bp, Artificial Sequence
  Synthetic Polynucleotide
taatacgactcactataggggctcatacacggagtattatttattacaggaacagaggagacctgtaatgaataatactaacctggcggcagcgcaaaagatg

SEQ ID NO: 36999 - DNA, 103 bp, Artificial Sequence
  Synthetic Polynucleotide
taatacgactcactatagggcggcggttcgttccgggtttatgacgagataacagaggagaatctcgatgtaaacccggaacctggcggcagcgcaaaagatg

SEQ ID NO: 37000 - DNA, 103 bp, Artificial Sequence
  Synthetic Polynucleotide
taatacgactcactatagggtcatccaggggctgagcgtggcccggctataacagaggagaatagccatgccacgctcaaacctggcggcagcgcaaaagatg

SEQ ID NO: 37001 - DNA, 103 bp, Artificial Sequence
  Synthetic Polynucleotide
taatacgactcactatagggacaatcctaggtccccactctcctgggtcaaacagaggagatgacccatgagagtggggaacctggcggcagcgcaaaagatg

SEQ ID NO: 37002 - DNA, 103 bp, Artificial Sequence
  Synthetic Polynucleotide
taatacgactcactatagggaccgaacttggcatgattacaacgccgcccaacagaggagagggcggatgtgtaatcataacctggcggcagcgcaaaagatg

SEQ ID NO: 37003 - DNA, 103 bp, Artificial Sequence
  Synthetic Polynucleotide
taatacgactcactatagggggcatcatcggtgggtacgcttcgttaaataacagaggagaatttaaatgagcgtacccaacctggcggcagcgcaaaagatg

SEQ ID NO: 37004 - DNA, 103 bp, Artificial Sequence
  Synthetic Polynucleotide
taatacgactcactatagggccttaatggtctgagattcctagtgcccggaacagaggagaccgggcatgaggaatctcaacctggcggcagcgcaaaagatg

SEQ ID NO: 37005 - DNA, 103 bp, Artificial Sequence
  Synthetic Polynucleotide
taatacgactcactatagggtcaattaagccgccgtctcgcttggctagtaacagaggagaactagcatggcgagacggaacctggcggcagcgcaaaagatg

SEQ ID NO: 37006 - DNA, 103 bp, Artificial Sequence
  Synthetic Polynucleotide
taatacgactcactatagggaacacgaatgatcgaacaactcctgcaccgaacagaggagacggtgcatgagttgttcgaacctggcggcagcgcaaaagatg

SEQ ID NO: 37007 - DNA, 103 bp, Artificial Sequence
  Synthetic Polynucleotide
taatacgactcactatagggctactcttcgaactggcctcgcagtgatgtaacagaggagaacatcaatgcgaggccagaacctggcggcagcgcaaaagatg

SEQ ID NO: 37008 - DNA, 103 bp, Artificial Sequence
  Synthetic Polynucleotide
taatacgactcactatagggcaagggttccacgttgtcaatgcgatctcgaacagaggagacgagatatgattgacaacaacctggcggcagcgcaaaagatg

SEQ ID NO: 37009 - DNA, 103 bp, Artificial Sequence
  Synthetic Polynucleotide
taatacgactcactatagggcggccgcactatttaggattaggcagagctaacagaggagaagctctatgtaatcctaaaacctggcggcagcgcaaaagatg

SEQ ID NO: 37010 - DNA, 103 bp, Artificial Sequence
  Synthetic Polynucleotide
taatacgactcactatagggtccggaacagtctcgggcacttagttattcaacagaggagagaataaatgagtgcccgaaacctggcggcagcgcaaaagatg

SEQ ID NO: 37011 - DNA, 103 bp, Artificial Sequence
  Synthetic Polynucleotide
taatacgactcactatagggacttattcccactcggatagtccccgacacaacagaggagagtgtcgatgactatccgaaacctggcggcagcgcaaaagatg

SEQ ID NO: 37012 - DNA, 103 bp, Artificial Sequence
  Synthetic Polynucleotide
taatacgactcactatagggtacctgtgcgcgcgcacaaacgtgactcttaacagaggagaaagagtatggtttgtgcgaacctggcggcagcgcaaaagatg

SEQ ID NO: 37013 - DNA, 103 bp, Artificial Sequence
  Synthetic Polynucleotide
taatacgactcactatagggaaaaccgtgtgggcaaacccgccctctcacaacagaggagagtgagaatgcgggtttgcaacctggcggcagcgcaaaagatg

SEQ ID NO: 37014 - DNA, 103 bp, Artificial Sequence
  Synthetic Polynucleotide
taatacgactcactatagggagtctcgacaggcggtaaaccacgaaccccaacagaggagaggggttatgggtttaccgaacctggcggcagcgcaaaagatg

SEQ ID NO: 37015 - DNA, 103 bp, Artificial Sequence
  Synthetic Polynucleotide
taatacgactcactatagggactctccaacggattattctgacgattccaaacagaggagatggaatatgcagaataataacctggcggcagcgcaaaagatg

SEQ ID NO: 37016 - DNA, 103 bp, Artificial Sequence
  Synthetic Polynucleotide
taatacgactcactatagggaaccctacggtgattgcacgtatagactcaaacagaggagatgagtcatgacgtgcaataacctggcggcagcgcaaaagatg

SEQ ID NO: 37017 - DNA, 103 bp, Artificial Sequence
  Synthetic Polynucleotide
taatacgactcactatagggtaccgcggtagctcagtgtaggtacaccacaacagaggagagtggtgatgctacactgaaacctggcggcagcgcaaaagatg

SEQ ID NO: 37018 - DNA, 103 bp, Artificial Sequence
  Synthetic Polynucleotide
taatacgactcactatagggcagagttgccgtgttgctcacggcttttagaacagaggagactaaaaatggtgagcaacaacctggcggcagcgcaaaagatg

SEQ ID NO: 37019 - DNA, 103 bp, Artificial Sequence
  Synthetic Polynucleotide
taatacgactcactatagggttatcgcgagcgctcagtcatcgtaggactaacagaggagaagtcctatgatgactgagaacctggcggcagcgcaaaagatg

SEQ ID NO: 37020 - DNA, 103 bp, Artificial Sequence
  Synthetic Polynucleotide
taatacgactcactatagggagggctgtgtcttaaatcaatcactcggataacagaggagaatccgaatgattgatttaaacctggcggcagcgcaaaagatg

SEQ ID NO: 37021 - DNA, 103 bp, Artificial Sequence
  Synthetic Polynucleotide
taatacgactcactatagggagatgctaatggtcgcagctttctgcttgcaacagaggagagcaagcatgaagctgcgaaacctggcggcagcgcaaaagatg

SEQ ID NO: 37022 - DNA, 103 bp, Artificial Sequence
  Synthetic Polynucleotide
taatacgactcactatagggtagcagaccagtccacaattgttaacgtaaaacagaggagattacgtatgcaattgtggaacctggcggcagcgcaaaagatg

SEQ ID NO: 37023 - DNA, 103 bp, Artificial Sequence
  Synthetic Polynucleotide
taatacgactcactatagggactcgaagtttttgattagtttaatccgttaacagaggagaaacggaatgaactaatcaaacctggcggcagcgcaaaagatg

SEQ ID NO: 37024 - DNA, 103 bp, Artificial Sequence
  Synthetic Polynucleotide
taatacgactcactatagggtcacggaagagcacctatctaagttaaaataacagaggagaattttaatgtagataggtaacctggcggcagcgcaaaagatg

SEQ ID NO: 37025 - DNA, 103 bp, Artificial Sequence
  Synthetic Polynucleotide
taatacgactcactatagggaattaaaccgccactgattttacccggtagaacagaggagactaccgatgaaaatcagtaacctggcggcagcgcaaaagatg

SEQ ID NO: 37026 - DNA, 103 bp, Artificial Sequence
  Synthetic Polynucleotide
taatacgactcactatagggcgtcatcaccaaagcaagcagggggatactaacagaggagaagtatcatgctgcttgctaacctggcggcagcgcaaaagatg

SEQ ID NO: 37027 - DNA, 103 bp, Artificial Sequence
  Synthetic Polynucleotide
taatacgactcactataggggatcccttcggcttaatgctatgcgcttaaaacagaggagattaagcatgtagcattaaaacctggcggcagcgcaaaagatg

SEQ ID NO: 37028 - DNA, 103 bp, Artificial Sequence
  Synthetic Polynucleotide
taatacgactcactatagggtgtagccgttaaagaggttggaatcgaaacaacagaggagagtttcgatgccaacctctaacctggcggcagcgcaaaagatg

SEQ ID NO: 37029 - DNA, 103 bp, Artificial Sequence
  Synthetic Polynucleotide
taatacgactcactataggggctagtatgattccagctcggccggtaggaaacagaggagatcctacatgccgagctggaacctggcggcagcgcaaaagatg

SEQ ID NO: 37030 - DNA, 103 bp, Artificial Sequence
  Synthetic Polynucleotide
taatacgactcactatagggggcatcttggttgaacatcctcgactcgtaaacagaggagatacgagatgaggatgttcaacctggcggcagcgcaaaagatg

SEQ ID NO: 37031 - DNA, 103 bp, Artificial Sequence
  Synthetic Polynucleotide
taatacgactcactatagggccctgcgcatccgttcttgtacggagaccaaacagaggagatggtctatgtacaagaacaacctggcggcagcgcaaaagatg

SEQ ID NO: 37032 - DNA, 103 bp, Artificial Sequence
  Synthetic Polynucleotide
taatacgactcactatagggcggatcgacataagtaagggttccttgttcaacagaggagagaacaaatgacccttactaacctggcggcagcgcaaaagatg

SEQ ID NO: 37033 - DNA, 103 bp, Artificial Sequence
  Synthetic Polynucleotide
taatacgactcactatagggtcctcgctgatggagcatcaggttgtatgaaacagaggagatcatacatgctgatgctcaacctggcggcagcgcaaaagatg

SEQ ID NO: 37034 - DNA, 103 bp, Artificial Sequence
  Synthetic Polynucleotide
taatacgactcactataggggcccccagtcggcctaagtacaaacattcgaacagaggagacgaatgatggtacttaggaacctggcggcagcgcaaaagatg

SEQ ID NO: 37035 - DNA, 103 bp, Artificial Sequence
  Synthetic Polynucleotide
taatacgactcactatagggattgagggccaggagtatcgtagaaacgctaacagaggagaagcgttatgacgatactcaacctggcggcagcgcaaaagatg

SEQ ID NO: 37036 - DNA, 103 bp, Artificial Sequence
  Synthetic Polynucleotide
taatacgactcactatagggcttccgggccttctgctggctcgctagcgcaacagaggagagcgctaatgagccagcagaacctggcggcagcgcaaaagatg

SEQ ID NO: 37037 - DNA, 103 bp, Artificial Sequence
  Synthetic Polynucleotide
taatacgactcactatagggttaatgttgtcggtatgtcccccaatatgtaacagaggagaacatatatggggacatacaacctggcggcagcgcaaaagatg

SEQ ID NO: 37038 - DNA, 103 bp, Artificial Sequence
  Synthetic Polynucleotide
taatacgactcactatagggtgagttgattgcggcatagtgtgccgcccgaacagaggagacgggcgatgcactatgccaacctggcggcagcgcaaaagatg

SEQ ID NO: 37039 - DNA, 103 bp, Artificial Sequence
  Synthetic Polynucleotide
taatacgactcactatagggggaacggagctttatagcccttgccgataaaacagaggagattatcgatgagggctataaacctggcggcagcgcaaaagatg

SEQ ID NO: 37040 - DNA, 103 bp, Artificial Sequence
  Synthetic Polynucleotide
taatacgactcactatagggcgacgctaatggatccgcgcctcccattggaacagaggagaccaatgatgggcgcggataacctggcggcagcgcaaaagatg

SEQ ID NO: 37041 - DNA, 103 bp, Artificial Sequence
  Synthetic Polynucleotide
taatacgactcactatagggctacaataaacttcaccaaacggcgtcggaaacagaggagatccgacatggtttggtgaaacctggcggcagcgcaaaagatg

SEQ ID NO: 37042 - DNA, 103 bp, Artificial Sequence
  Synthetic Polynucleotide
taatacgactcactatagggagtttcccggcaatacactgttgtctagagaacagaggagactctagatgacagtgtataacctggcggcagcgcaaaagatg

SEQ ID NO: 37043 - DNA, 103 bp, Artificial Sequence
  Synthetic Polynucleotide
taatacgactcactataggggagggaggcaggcccctatgaagagccagcaacagaggagagctggcatgtcataggggaacctggcggcagcgcaaaagatg

SEQ ID NO: 37044 - DNA, 103 bp, Artificial Sequence
  Synthetic Polynucleotide
taatacgactcactatagggccacatttaaatcacatgtccatcctaagtaacagaggagaacttagatgggacatgtgaacctggcggcagcgcaaaagatg

SEQ ID NO: 37045 - DNA, 103 bp, Artificial Sequence
  Synthetic Polynucleotide
taatacgactcactataggggacgaggacgtgggacacggcgtattaccaaacagaggagatggtaaatggccgtgtccaacctggcggcagcgcaaaagatg

SEQ ID NO: 37046 - DNA, 103 bp, Artificial Sequence
  Synthetic Polynucleotide
taatacgactcactatagggctctgcctccggtctccctgcactgaggtgaacagaggagacacctcatggcagggagaaacctggcggcagcgcaaaagatg

SEQ ID NO: 37047 - DNA, 103 bp, Artificial Sequence
  Synthetic Polynucleotide
taatacgactcactatagggtggtgtcaaatcagtggtgtcctcccgacgaacagaggagacgtcggatggacaccactaacctggcggcagcgcaaaagatg

SEQ ID NO: 37048 - DNA, 103 bp, Artificial Sequence
  Synthetic Polynucleotide
taatacgactcactataggggcttcatgaagctcggttggccagataggtaacagaggagaacctatatggccaaccgaaacctggcggcagcgcaaaagatg

SEQ ID NO: 37049 - DNA, 103 bp, Artificial Sequence
  Synthetic Polynucleotide
taatacgactcactataggggagcgtcaatctgatccaagtcgatacgtgaacagaggagacacgtaatgacttggatcaacctggcggcagcgcaaaagatg

SEQ ID NO: 37050 - DNA, 103 bp, Artificial Sequence
  Synthetic Polynucleotide
taatacgactcactataggggtaacgggctgtgagtagaacagtgagagaaacagaggagatctctcatggttctactcaacctggcggcagcgcaaaagatg

SEQ ID NO: 37051 - DNA, 103 bp, Artificial Sequence
  Synthetic Polynucleotide
taatacgactcactatagggcgcgttaccgaaggcgctaaatctaatttaaacagaggagataaattatgtttagcgccaacctggcggcagcgcaaaagatg

SEQ ID NO: 37052 - DNA, 103 bp, Artificial Sequence
  Synthetic Polynucleotide
taatacgactcactatagggtcttatacgggtcacgccatggctagggacaacagaggagagtccctatgcatggcgtgaacctggcggcagcgcaaaagatg

SEQ ID NO: 37053 - DNA, 103 bp, Artificial Sequence
  Synthetic Polynucleotide
taatacgactcactatagggaggatcagctcattagagcctctcttccgaaacagaggagatcggaaatgaggctctaaaacctggcggcagcgcaaaagatg

SEQ ID NO: 37054 - DNA, 103 bp, Artificial Sequence
  Synthetic Polynucleotide
taatacgactcactatagggtcaatctaacactccgaagcaaactgggtcaacagaggagagacccaatgtgcttcggaaacctggcggcagcgcaaaagatg

SEQ ID NO: 37055 - DNA, 103 bp, Artificial Sequence
  Synthetic Polynucleotide
taatacgactcactatagggataggcctctgacttatgtgatagtcagtcaacagaggagagactgaatgtcacataagaacctggcggcagcgcaaaagatg

SEQ ID NO: 37056 - DNA, 103 bp, Artificial Sequence
  Synthetic Polynucleotide
taatacgactcactatagggtgagctaaattcgtcggcgccttatctcttaacagaggagaaagagaatgggcgccgacaacctggcggcagcgcaaaagatg

SEQ ID NO: 37057 - DNA, 103 bp, Artificial Sequence
  Synthetic Polynucleotide
taatacgactcactatagggaaattcacgactgtggagtgtgcgctgccaaacagaggagatggcagatgacactccacaacctggcggcagcgcaaaagatg

SEQ ID NO: 37058 - DNA, 103 bp, Artificial Sequence
  Synthetic Polynucleotide
taatacgactcactataggggcaggagcgctacgttaactctaatttatgaacagaggagacataaaatggagttaacgaacctggcggcagcgcaaaagatg

SEQ ID NO: 37059 - DNA, 103 bp, Artificial Sequence
  Synthetic Polynucleotide
taatacgactcactatagggagggccctccgcaactaaacttgttctgagaacagaggagactcagaatgagtttagttaacctggcggcagcgcaaaagatg

SEQ ID NO: 37060 - DNA, 103 bp, Artificial Sequence
  Synthetic Polynucleotide
taatacgactcactatagggtcgcacacttgttgactcgggaaaaggtataacagaggagaatacctatgcccgagtcaaacctggcggcagcgcaaaagatg

SEQ ID NO: 37061 - DNA, 103 bp, Artificial Sequence
  Synthetic Polynucleotide
taatacgactcactataggggctagattccggccttgcacgttgcgtcgcaacagaggagagcgacgatgcgtgcaaggaacctggcggcagcgcaaaagatg

SEQ ID NO: 37062 - DNA, 103 bp, Artificial Sequence
  Synthetic Polynucleotide
taatacgactcactatagggttgatcaaccgcgaatacgtctcgcttaagaacagaggagacttaagatggacgtattcaacctggcggcagcgcaaaagatg

SEQ ID NO: 37063 - DNA, 103 bp, Artificial Sequence
  Synthetic Polynucleotide
taatacgactcactatagggcggcgtgcgtagagagtaggttgtatgcagaacagaggagactgcatatgacctactctaacctggcggcagcgcaaaagatg

SEQ ID NO: 37064 - DNA, 103 bp, Artificial Sequence
  Synthetic Polynucleotide
taatacgactcactatagggtttttgtcctccatggtattgcgcatgccaaacagaggagatggcatatgcaataccataacctggcggcagcgcaaaagatg

SEQ ID NO: 37065 - DNA, 103 bp, Artificial Sequence
  Synthetic Polynucleotide
taatacgactcactatagggcggcgtgtaagctcatcgcctcaagtggataacagaggagaatccacatgaggcgatgaaacctggcggcagcgcaaaagatg

SEQ ID NO: 37066 - DNA, 103 bp, Artificial Sequence
  Synthetic Polynucleotide
taatacgactcactatagggcggtcgaaccccgaaagatcttagggattgaacagaggagacaatccatgagatctttcaacctggcggcagcgcaaaagatg

SEQ ID NO: 37067 - DNA, 103 bp, Artificial Sequence
  Synthetic Polynucleotide
taatacgactcactataggggcgccgcacaaatattagtctcaaacctacaacagaggagagtaggtatgagactaataaacctggcggcagcgcaaaagatg

SEQ ID NO: 37068 - DNA, 103 bp, Artificial Sequence
  Synthetic Polynucleotide
taatacgactcactataggggctcagaggtgattcgacaggccagactataacagaggagaatagtcatgcctgtcgaaaacctggcggcagcgcaaaagatg

SEQ ID NO: 37069 - DNA, 103 bp, Artificial Sequence
  Synthetic Polynucleotide
taatacgactcactatagggattgagggtattcgcgcgtttgtttgggagaacagaggagactcccaatgaaacgcgcgaacctggcggcagcgcaaaagatg

SEQ ID NO: 37070 - DNA, 103 bp, Artificial Sequence
  Synthetic Polynucleotide
taatacgactcactatagggggggcctacgaacagtaattcgtcttctgcaacagaggagagcagaaatggaattactgaacctggcggcagcgcaaaagatg

SEQ ID NO: 37071 - DNA, 103 bp, Artificial Sequence
  Synthetic Polynucleotide
taatacgactcactatagggcgtaggcacaatcacacatgtagaagcgtaaacagaggagatacgctatgacatgtgtgaacctggcggcagcgcaaaagatg

SEQ ID NO: 37072 - DNA, 103 bp, Artificial Sequence
  Synthetic Polynucleotide
taatacgactcactatagggagtcgttcaaggagtgacgtcgtaccactcaacagaggagagagtggatggacgtcactaacctggcggcagcgcaaaagatg

SEQ ID NO: 37073 - DNA, 103 bp, Artificial Sequence
  Synthetic Polynucleotide
taatacgactcactatagggtctaattatggcaggctacacaattactgaaacagaggagatcagtaatggtgtagcctaacctggcggcagcgcaaaagatg

SEQ ID NO: 37074 - DNA, 103 bp, Artificial Sequence
  Synthetic Polynucleotide
taatacgactcactatagggatgaatttgtcattatgggtcattagtacaaacagaggagatgtactatggacccataaaacctggcggcagcgcaaaagatg

SEQ ID NO: 37075 - DNA, 103 bp, Artificial Sequence
  Synthetic Polynucleotide
taatacgactcactatagggaggcgtcgacgcaacataagtttgcagaataacagaggagaattctgatgacttatgttaacctggcggcagcgcaaaagatg

SEQ ID NO: 37076 - DNA, 103 bp, Artificial Sequence
  Synthetic Polynucleotide
taatacgactcactatagggaatataacaaggacgcagatctattactataacagaggagaatagtaatggatctgcgtaacctggcggcagcgcaaaagatg

SEQ ID NO: 37077 - DNA, 103 bp, Artificial Sequence
  Synthetic Polynucleotide
taatacgactcactatagggtcgctttacggagatggtgtcgattccgggaacagaggagacccggaatggacaccatcaacctggcggcagcgcaaaagatg

SEQ ID NO: 37078 - DNA, 103 bp, Artificial Sequence
  Synthetic Polynucleotide
taatacgactcactatagggccagctacgcatgtttctcttcgtatgctaaacagaggagatagcatatgaagagaaacaacctggcggcagcgcaaaagatg

SEQ ID NO: 37079 - DNA, 103 bp, Artificial Sequence
  Synthetic Polynucleotide
taatacgactcactatagggttactacccgttgacttcccctccaagtcgaacagaggagacgacttatgggggaagtcaacctggcggcagcgcaaaagatg

SEQ ID NO: 37080 - DNA, 103 bp, Artificial Sequence
  Synthetic Polynucleotide
taatacgactcactatagggctactacgtggtgcaccgagcattgcagacaacagaggagagtctgcatggctcggtgcaacctggcggcagcgcaaaagatg

SEQ ID NO: 37081 - DNA, 103 bp, Artificial Sequence
  Synthetic Polynucleotide
taatacgactcactataggggggcatcagtctgtcacacaggggcgttccaacagaggagaggaacgatgctgtgtgacaacctggcggcagcgcaaaagatg

SEQ ID NO: 37082 - DNA, 103 bp, Artificial Sequence
  Synthetic Polynucleotide
taatacgactcactatagggtttctgcgggatacccgggaagcatagatgaacagaggagacatctaatgttcccgggtaacctggcggcagcgcaaaagatg

SEQ ID NO: 37083 - DNA, 103 bp, Artificial Sequence
  Synthetic Polynucleotide
taatacgactcactatagggctcaggttagaataagagtacctctttcccaacagaggagagggaaaatggtactcttaaacctggcggcagcgcaaaagatg

SEQ ID NO: 37084 - DNA, 103 bp, Artificial Sequence
  Synthetic Polynucleotide
taatacgactcactataggggtagatgctgggtcgggtatcaatgaggacaacagaggagagtcctcatggatacccgaaacctggcggcagcgcaaaagatg

SEQ ID NO: 37085 - DNA, 103 bp, Artificial Sequence
  Synthetic Polynucleotide
taatacgactcactatagggaatactataccctcgaggagttaccgttaaaacagaggagattaacgatgactcctcgaaacctggcggcagcgcaaaagatg

SEQ ID NO: 37086 - DNA, 103 bp, Artificial Sequence
  Synthetic Polynucleotide
taatacgactcactatagggtcgctgagtgaatgggtgtaagaagcattaaacagaggagataatgcatgttacacccaaacctggcggcagcgcaaaagatg

SEQ ID NO: 37087 - DNA, 103 bp, Artificial Sequence
  Synthetic Polynucleotide
taatacgactcactatagggcttaaaaatccgcctccaaatgtcactagaaacagaggagatctagtatgatttggaggaacctggcggcagcgcaaaagatg

SEQ ID NO: 37088 - DNA, 103 bp, Artificial Sequence
  Synthetic Polynucleotide
taatacgactcactatagggttggcttacataagtccatcacgtcgagcgaacagaggagacgctcgatgtgatggactaacctggcggcagcgcaaaagatg

SEQ ID NO: 37089 - DNA, 103 bp, Artificial Sequence
  Synthetic Polynucleotide
taatacgactcactataggggtgagcgggagtcacgcggctgattccagtaacagaggagaactggaatgagccgcgtgaacctggcggcagcgcaaaagatg

SEQ ID NO: 37090 - DNA, 103 bp, Artificial Sequence
  Synthetic Polynucleotide
taatacgactcactataggggaaacggctattgagaaacggaccccggtaaacagaggagataccggatgccgtttctcaacctggcggcagcgcaaaagatg

SEQ ID NO: 37091 - DNA, 103 bp, Artificial Sequence
  Synthetic Polynucleotide
taatacgactcactatagggcttagcggtgtcgactcggcgagatcgaagaacagaggagacttcgaatgcgccgagtcaacctggcggcagcgcaaaagatg

SEQ ID NO: 37092 - DNA, 103 bp, Artificial Sequence
  Synthetic Polynucleotide
taatacgactcactatagggcacaagaatctgggtctcctgatctacaagaacagaggagacttgtaatgcaggagaccaacctggcggcagcgcaaaagatg

SEQ ID NO: 37093 - DNA, 103 bp, Artificial Sequence
  Synthetic Polynucleotide
taatacgactcactataggggatagggctcacaggcgcacggatacgatgaacagaggagacatcgtatgcgtgcgcctaacctggcggcagcgcaaaagatg

SEQ ID NO: 37094 - DNA, 103 bp, Artificial Sequence
  Synthetic Polynucleotide
taatacgactcactatagggtactcatctacagatagtggtaggaaacataacagaggagaatgtttatgaccactatcaacctggcggcagcgcaaaagatg

SEQ ID NO: 37095 - DNA, 103 bp, Artificial Sequence
  Synthetic Polynucleotide
taatacgactcactatagggcagtgcgtctgatctctgcgagcactctccaacagaggagaggagagatgtcgcagagaaacctggcggcagcgcaaaagatg

SEQ ID NO: 37096 - DNA, 103 bp, Artificial Sequence
  Synthetic Polynucleotide
taatacgactcactataggggcggcctaggtccagttaagttagatcgccaacagaggagaggcgatatgacttaactgaacctggcggcagcgcaaaagatg

SEQ ID NO: 37097 - DNA, 103 bp, Artificial Sequence
  Synthetic Polynucleotide
taatacgactcactatagggctccggcacgagtacctgctgcccccccccaacagaggagaggggggatgcagcaggtaaacctggcggcagcgcaaaagatg

SEQ ID NO: 37098 - DNA, 103 bp, Artificial Sequence
  Synthetic Polynucleotide
taatacgactcactatagggttgcggtgtgacgcggtgattgaacgacccaacagaggagagggtcgatgaatcaccgcaacctggcggcagcgcaaaagatg

SEQ ID NO: 37099 - DNA, 103 bp, Artificial Sequence
  Synthetic Polynucleotide
taatacgactcactatagggtcgtagctctaaacgcaaacgtaacataataacagaggagaattatgatgcgtttgcgtaacctggcggcagcgcaaaagatg

SEQ ID NO: 37100 - DNA, 103 bp, Artificial Sequence
  Synthetic Polynucleotide
taatacgactcactatagggaaatcattcacattgtgtgatgattcccataacagaggagaatgggaatgatcacacaaaacctggcggcagcgcaaaagatg

SEQ ID NO: 37101 - DNA, 103 bp, Artificial Sequence
  Synthetic Polynucleotide
taatacgactcactatagggcaataatgatgtgtaaagaatcactgttcaaacagaggagatgaacaatgattctttacaacctggcggcagcgcaaaagatg

SEQ ID NO: 37102 - DNA, 103 bp, Artificial Sequence
  Synthetic Polynucleotide
taatacgactcactatagggcctggtggccaagacgttcgggtgtactcaaacagaggagatgagtaatgccgaacgtcaacctggcggcagcgcaaaagatg

SEQ ID NO: 37103 - DNA, 103 bp, Artificial Sequence
  Synthetic Polynucleotide
taatacgactcactatagggcaaacacagagggggaatgactccctggccaacagaggagaggccagatggtcattcccaacctggcggcagcgcaaaagatg

SEQ ID NO: 37104 - DNA, 103 bp, Artificial Sequence
  Synthetic Polynucleotide
taatacgactcactatagggcatggcccaggtcccttagtcttttccttaaacagaggagataaggaatggactaagggaacctggcggcagcgcaaaagatg

SEQ ID NO: 37105 - DNA, 103 bp, Artificial Sequence
  Synthetic Polynucleotide
taatacgactcactatagggacccataatgtgcggaaagagtaatcgaaaaacagaggagatttcgaatgctctttccgaacctggcggcagcgcaaaagatg

SEQ ID NO: 37106 - DNA, 103 bp, Artificial Sequence
  Synthetic Polynucleotide
taatacgactcactatagggcccttccgcaatggtatgaaggtgaggacgaacagaggagacgtcctatgcttcataccaacctggcggcagcgcaaaagatg

SEQ ID NO: 37107 - DNA, 103 bp, Artificial Sequence
  Synthetic Polynucleotide
taatacgactcactatagggatgtgataacaacgatcatagtcgatgctaaacagaggagatagcatatgctatgatcgaacctggcggcagcgcaaaagatg

SEQ ID NO: 37108 - DNA, 103 bp, Artificial Sequence
  Synthetic Polynucleotide
taatacgactcactatagggtccaaatctactacaggctccgtgcagcggaacagaggagaccgctgatgggagcctgtaacctggcggcagcgcaaaagatg

SEQ ID NO: 37109 - DNA, 103 bp, Artificial Sequence
  Synthetic Polynucleotide
taatacgactcactatagggcaaggttgtacatgaagacgggtaatcattaacagaggagaaatgatatgccgtcttcaaacctggcggcagcgcaaaagatg

SEQ ID NO: 37110 - DNA, 103 bp, Artificial Sequence
  Synthetic Polynucleotide
taatacgactcactatagggcttgtttgtcttctaagtaattgtgtagggaacagaggagaccctacatgattacttagaacctggcggcagcgcaaaagatg

SEQ ID NO: 37111 - DNA, 103 bp, Artificial Sequence
  Synthetic Polynucleotide
taatacgactcactatagggtatggagcatcaacgctgatgcataacgctaacagaggagaagcgttatgcatcagcgtaacctggcggcagcgcaaaagatg

SEQ ID NO: 37112 - DNA, 103 bp, Artificial Sequence
  Synthetic Polynucleotide
taatacgactcactatagggaacttttgccgtagacggtagtatatttggaacagaggagaccaaatatgctaccgtctaacctggcggcagcgcaaaagatg

SEQ ID NO: 37113 - DNA, 103 bp, Artificial Sequence
  Synthetic Polynucleotide
taatacgactcactatagggatttgctgttcagtaggaatcccttaagagaacagaggagactcttaatggattcctacaacctggcggcagcgcaaaagatg

SEQ ID NO: 37114 - DNA, 103 bp, Artificial Sequence
  Synthetic Polynucleotide
taatacgactcactatagggaaagtggatgtaagatcactgtagaaacttaacagaggagaaagtttatgcagtgatctaacctggcggcagcgcaaaagatg

SEQ ID NO: 37115 - DNA, 103 bp, Artificial Sequence
  Synthetic Polynucleotide
taatacgactcactatagggaaccataataaaggggcgactgggatcgtgaacagaggagacacgatatgagtcgccccaacctggcggcagcgcaaaagatg

SEQ ID NO: 37116 - DNA, 103 bp, Artificial Sequence
  Synthetic Polynucleotide
taatacgactcactatagggaagcatcacaaaatatttgctcgtaccttgaacagaggagacaaggtatgagcaaatataacctggcggcagcgcaaaagatg

SEQ ID NO: 37117 - DNA, 103 bp, Artificial Sequence
  Synthetic Polynucleotide
taatacgactcactatagggagctagagtcggcgctcatgggcggtttcaaacagaggagatgaaacatgccatgagcgaacctggcggcagcgcaaaagatg

SEQ ID NO: 37118 - DNA, 103 bp, Artificial Sequence
  Synthetic Polynucleotide
taatacgactcactatagggatagagctcaaagattgcgtcaaaatagcaaacagaggagatgctatatggacgcaatcaacctggcggcagcgcaaaagatg

SEQ ID NO: 37119 - DNA, 103 bp, Artificial Sequence
  Synthetic Polynucleotide
taatacgactcactataggggtgatcggcctagtacgttgagtgtatgcaaacagaggagatgcataatgtcaacgtacaacctggcggcagcgcaaaagatg

SEQ ID NO: 37120 - DNA, 103 bp, Artificial Sequence
  Synthetic Polynucleotide
taatacgactcactataggggtcacaaccggtgaccccgcgggcgaacgtaacagaggagaacgttcatgcgcggggtcaacctggcggcagcgcaaaagatg

SEQ ID NO: 37121 - DNA, 103 bp, Artificial Sequence
  Synthetic Polynucleotide
taatacgactcactatagggggaaacgctcgatagacgtaattagaattgaacagaggagacaattcatgttacgtctaaacctggcggcagcgcaaaagatg

SEQ ID NO: 37122 - DNA, 103 bp, Artificial Sequence
  Synthetic Polynucleotide
taatacgactcactatagggctaggggttggtctgcaggctgcttcctgaaacagaggagatcaggaatgagcctgcagaacctggcggcagcgcaaaagatg

SEQ ID NO: 37123 - DNA, 103 bp, Artificial Sequence
  Synthetic Polynucleotide
taatacgactcactatagggaaaccgtctctcacatggccgaggagtccgaacagaggagacggactatgcggccatgtaacctggcggcagcgcaaaagatg

SEQ ID NO: 37124 - DNA, 103 bp, Artificial Sequence
  Synthetic Polynucleotide
taatacgactcactatagggtatgggaacggcaatgccttactggggtttaacagaggagaaaacccatgtaaggcattaacctggcggcagcgcaaaagatg

SEQ ID NO: 37125 - DNA, 103 bp, Artificial Sequence
  Synthetic Polynucleotide
taatacgactcactatagggtactcgcgccatcgcggtgcagacacttcaaacagaggagatgaagtatgtgcaccgcgaacctggcggcagcgcaaaagatg

SEQ ID NO: 37126 - DNA, 103 bp, Artificial Sequence
  Synthetic Polynucleotide
taatacgactcactatagggtgtctcaggggttccctctgtgagtcattcaacagaggagagaatgaatgacagagggaaacctggcggcagcgcaaaagatg

SEQ ID NO: 37127 - DNA, 103 bp, Artificial Sequence
  Synthetic Polynucleotide
taatacgactcactatagggagatggcgcaattcggcactatgtgcgtcgaacagaggagacgacgcatgtagtgccgaaacctggcggcagcgcaaaagatg

SEQ ID NO: 37128 - DNA, 103 bp, Artificial Sequence
  Synthetic Polynucleotide
taatacgactcactatagggtggtgtaaccctcgaaactaccatctctttaacagaggagaaaagagatggtagtttcgaacctggcggcagcgcaaaagatg

SEQ ID NO: 37129 - DNA, 103 bp, Artificial Sequence
  Synthetic Polynucleotide
taatacgactcactatagggatgtaagcctagcgatgggtaataccagacaacagaggagagtctggatgtacccatcgaacctggcggcagcgcaaaagatg

SEQ ID NO: 37130 - DNA, 103 bp, Artificial Sequence
  Synthetic Polynucleotide
taatacgactcactatagggacggccccattgatcgctatgcatccggttaacagaggagaaaccggatgcatagcgataacctggcggcagcgcaaaagatg

SEQ ID NO: 37131 - DNA, 103 bp, Artificial Sequence
  Synthetic Polynucleotide
taatacgactcactatagggatctcgagaaaaccttacgaacggcggcccaacagaggagagggccgatgttcgtaaggaacctggcggcagcgcaaaagatg

SEQ ID NO: 37132 - DNA, 103 bp, Artificial Sequence
  Synthetic Polynucleotide
taatacgactcactatagggaggagggatacctatttcatcggaggcaggaacagaggagacctgccatggatgaaataaacctggcggcagcgcaaaagatg

SEQ ID NO: 37133 - DNA, 103 bp, Artificial Sequence
  Synthetic Polynucleotide
taatacgactcactataggggagctcgttccgagcgtcacggaacagcccaacagaggagagggctgatgcgtgacgctaacctggcggcagcgcaaaagatg

SEQ ID NO: 37134 - DNA, 103 bp, Artificial Sequence
  Synthetic Polynucleotide
taatacgactcactatagggcaacttgatcaagaacttaattcggatcaaaacagaggagattgatcatgattaagttcaacctggcggcagcgcaaaagatg

SEQ ID NO: 37135 - DNA, 103 bp, Artificial Sequence
  Synthetic Polynucleotide
taatacgactcactatagggtaaggtgcacatctactcaaatagactaaaaacagaggagatttagtatgtttgagtagaacctggcggcagcgcaaaagatg

SEQ ID NO: 37136 - DNA, 103 bp, Artificial Sequence
  Synthetic Polynucleotide
taatacgactcactatagggagtccaatcatatctaggaaaaaccaagataacagaggagaatcttgatgtttcctagaaacctggcggcagcgcaaaagatg

SEQ ID NO: 37137 - DNA, 103 bp, Artificial Sequence
  Synthetic Polynucleotide
taatacgactcactatagggaattccgtgaatagctctgcatgtggttataacagaggagaataaccatgtgcagagctaacctggcggcagcgcaaaagatg

SEQ ID NO: 37138 - DNA, 103 bp, Artificial Sequence
  Synthetic Polynucleotide
taatacgactcactatagggtaagtatcgagcctaacccgagacgaacgaaacagaggagatcgttcatgtcgggttagaacctggcggcagcgcaaaagatg

SEQ ID NO: 37139 - DNA, 103 bp, Artificial Sequence
  Synthetic Polynucleotide
taatacgactcactatagggcctaatcgacctctggagtactgttcaaataacagaggagaatttgaatggtactccagaacctggcggcagcgcaaaagatg

SEQ ID NO: 37140 - DNA, 103 bp, Artificial Sequence
  Synthetic Polynucleotide
taatacgactcactatagggcgctcgactctaaatgacggatgtttacgcaacagaggagagcgtaaatgtccgtcattaacctggcggcagcgcaaaagatg

SEQ ID NO: 37141 - DNA, 103 bp, Artificial Sequence
  Synthetic Polynucleotide
taatacgactcactataggggccctcgcggtcgttcagcgaggactcctaaacagaggagataggagatgtcgctgaacaacctggcggcagcgcaaaagatg

SEQ ID NO: 37142 - DNA, 103 bp, Artificial Sequence
  Synthetic Polynucleotide
taatacgactcactatagggcgtggccgcggaaagtagtgagctgcggtcaacagaggagagaccgcatgtcactacttaacctggcggcagcgcaaaagatg

SEQ ID NO: 37143 - DNA, 103 bp, Artificial Sequence
  Synthetic Polynucleotide
taatacgactcactatagggttatctacccaacctattattactctcatgaacagaggagacatgagatgaataataggaacctggcggcagcgcaaaagatg

SEQ ID NO: 37144 - DNA, 103 bp, Artificial Sequence
  Synthetic Polynucleotide
taatacgactcactatagggaccggcagactagtcctcgcggcatgttgtaacagaggagaacaacaatgcgcgaggacaacctggcggcagcgcaaaagatg

SEQ ID NO: 37145 - DNA, 103 bp, Artificial Sequence
  Synthetic Polynucleotide
taatacgactcactatagggaaacggtggggattgcagagtagtgaattaaacagaggagataattcatgactctgcaaaacctggcggcagcgcaaaagatg

SEQ ID NO: 37146 - DNA, 103 bp, Artificial Sequence
  Synthetic Polynucleotide
taatacgactcactatagggctatctaaggctaggttgcacattcggaagaacagaggagacttccgatggtgcaacctaacctggcggcagcgcaaaagatg

SEQ ID NO: 37147 - DNA, 103 bp, Artificial Sequence
  Synthetic Polynucleotide
taatacgactcactatagggaacctagtgtaagtgtataacggcgcttagaacagaggagactaagcatggttatacacaacctggcggcagcgcaaaagatg

SEQ ID NO: 37148 - DNA, 103 bp, Artificial Sequence
  Synthetic Polynucleotide
taatacgactcactataggggatttatcacgacgcatcccacaggcgacgaacagaggagacgtcgcatgtgggatgcgaacctggcggcagcgcaaaagatg

SEQ ID NO: 37149 - DNA, 103 bp, Artificial Sequence
  Synthetic Polynucleotide
taatacgactcactatagggatacggaattacaattcagccgagtcagcgaacagaggagacgctgaatgggctgaattaacctggcggcagcgcaaaagatg

SEQ ID NO: 37150 - DNA, 103 bp, Artificial Sequence
  Synthetic Polynucleotide
taatacgactcactatagggtaaacatattcaactctagaggacagtcccaacagaggagagggactatgctctagagtaacctggcggcagcgcaaaagatg

SEQ ID NO: 37151 - DNA, 103 bp, Artificial Sequence
  Synthetic Polynucleotide
taatacgactcactatagggtgcgtaagaaaccaagagtcagcactttgaaacagaggagatcaaagatgtgactcttgaacctggcggcagcgcaaaagatg

SEQ ID NO: 37152 - DNA, 103 bp, Artificial Sequence
  Synthetic Polynucleotide
taatacgactcactataggggagagcaatggttcaagcaaataaatctccaacagaggagaggagatatgtttgcttgaaacctggcggcagcgcaaaagatg

SEQ ID NO: 37153 - DNA, 103 bp, Artificial Sequence
  Synthetic Polynucleotide
taatacgactcactataggggaccagctgttaatctgttacatgtatagtaacagaggagaactataatggtaacagataacctggcggcagcgcaaaagatg

SEQ ID NO: 37154 - DNA, 103 bp, Artificial Sequence
  Synthetic Polynucleotide
taatacgactcactataggggtcccagtcctctagtgaatagcgccatgcaacagaggagagcatggatgtattcactaaacctggcggcagcgcaaaagatg

SEQ ID NO: 37155 - DNA, 103 bp, Artificial Sequence
  Synthetic Polynucleotide
taatacgactcactatagggtcgcggctgaattcggtgcacggcccctggaacagaggagaccagggatggtgcaccgaaacctggcggcagcgcaaaagatg

SEQ ID NO: 37156 - DNA, 103 bp, Artificial Sequence
  Synthetic Polynucleotide
taatacgactcactatagggagtgggaattcgcagcggtgtactgccagaaacagaggagatctggcatgacaccgctgaacctggcggcagcgcaaaagatg

SEQ ID NO: 37157 - DNA, 103 bp, Artificial Sequence
  Synthetic Polynucleotide
taatacgactcactataggggtagggagcgtttgcctgccgtagacctgaaacagaggagatcaggtatgcggcaggcaaacctggcggcagcgcaaaagatg

SEQ ID NO: 37158 - DNA, 103 bp, Artificial Sequence
  Synthetic Polynucleotide
taatacgactcactatagggcacttacacgatttaggaccttcgctttcgaacagaggagacgaaagatgaggtcctaaaacctggcggcagcgcaaaagatg

SEQ ID NO: 37159 - DNA, 103 bp, Artificial Sequence
  Synthetic Polynucleotide
taatacgactcactatagggctgggtctgccgggcgtaaggcaggtaattaacagaggagaaattacatgccttacgccaacctggcggcagcgcaaaagatg

SEQ ID NO: 37160 - DNA, 103 bp, Artificial Sequence
  Synthetic Polynucleotide
taatacgactcactatagggtacaagtccctgtccacgtaacggctacataacagaggagaatgtagatgttacgtggaaacctggcggcagcgcaaaagatg

SEQ ID NO: 37161 - DNA, 103 bp, Artificial Sequence
  Synthetic Polynucleotide
taatacgactcactatagggtttctgttcgtctcacatccgcattcttacaacagaggagagtaagaatgcggatgtgaaacctggcggcagcgcaaaagatg

SEQ ID NO: 37162 - DNA, 103 bp, Artificial Sequence
  Synthetic Polynucleotide
taatacgactcactataggggaaccctatcagcctagtcgtgatcgctctaacagaggagaagagcgatgacgactaggaacctggcggcagcgcaaaagatg

SEQ ID NO: 37163 - DNA, 103 bp, Artificial Sequence
  Synthetic Polynucleotide
taatacgactcactatagggcatcacccaggcatttcatccataggcaataacagaggagaattgccatgggatgaaataacctggcggcagcgcaaaagatg

SEQ ID NO: 37164 - DNA, 103 bp, Artificial Sequence
  Synthetic Polynucleotide
taatacgactcactatagggccctaactccaatgagcacctttgtgcgataacagaggagaatcgcaatgaggtgctcaaacctggcggcagcgcaaaagatg

SEQ ID NO: 37165 - DNA, 103 bp, Artificial Sequence
  Synthetic Polynucleotide
taatacgactcactataggggtatctggtgtgaagaacaagtggggcaccaacagaggagaggtgccatgcttgttcttaacctggcggcagcgcaaaagatg

SEQ ID NO: 37166 - DNA, 103 bp, Artificial Sequence
  Synthetic Polynucleotide
taatacgactcactatagggttcacatgatgatgccgaaagagccgacgtaacagaggagaacgtcgatgctttcggcaaacctggcggcagcgcaaaagatg

SEQ ID NO: 37167 - DNA, 103 bp, Artificial Sequence
  Synthetic Polynucleotide
taatacgactcactatagggaatggatggcgcgagcaggccggtcgtggaaacagaggagatccacgatgggcctgctcaacctggcggcagcgcaaaagatg

SEQ ID NO: 37168 - DNA, 103 bp, Artificial Sequence
  Synthetic Polynucleotide
taatacgactcactataggggtcacatgtacgctatgaattcattgctcgaacagaggagacgagcaatgaattcatagaacctggcggcagcgcaaaagatg

SEQ ID NO: 37169 - DNA, 103 bp, Artificial Sequence
  Synthetic Polynucleotide
taatacgactcactatagggcgtgccggcgtcactccggaataggctaggaacagaggagacctagcatgttccggagtaacctggcggcagcgcaaaagatg

SEQ ID NO: 37170 - DNA, 103 bp, Artificial Sequence
  Synthetic Polynucleotide
taatacgactcactatagggccagcaaggaggcatggccgggtttcaattaacagaggagaaattgaatgccggccatgaacctggcggcagcgcaaaagatg

SEQ ID NO: 37171 - DNA, 103 bp, Artificial Sequence
  Synthetic Polynucleotide
taatacgactcactatagggtctggctattactcagtatcgtctgtcaataacagaggagaattgacatgcgatactgaaacctggcggcagcgcaaaagatg

SEQ ID NO: 37172 - DNA, 103 bp, Artificial Sequence
  Synthetic Polynucleotide
taatacgactcactatagggagttgcagccacgccgccctcaacaccagcaacagaggagagctggtatggagggcggcaacctggcggcagcgcaaaagatg

SEQ ID NO: 37173 - DNA, 103 bp, Artificial Sequence
  Synthetic Polynucleotide
taatacgactcactataggggtggttgcatctatacgtatgctgtgcaagaacagaggagacttgcaatgcatacgtataacctggcggcagcgcaaaagatg

SEQ ID NO: 37174 - DNA, 103 bp, Artificial Sequence
  Synthetic Polynucleotide
taatacgactcactatagggcctcggaacgaggcggtgcctagattgggaaacagaggagatcccaaatgaggcaccgcaacctggcggcagcgcaaaagatg

SEQ ID NO: 37175 - DNA, 103 bp, Artificial Sequence
  Synthetic Polynucleotide
taatacgactcactatagggcccaggccttccaatgtcagaggcacgttgaacagaggagacaacgtatgtctgacattaacctggcggcagcgcaaaagatg

SEQ ID NO: 37176 - DNA, 103 bp, Artificial Sequence
  Synthetic Polynucleotide
taatacgactcactatagggacgtcgcccgcactgcgaactggctatttcaacagaggagagaaataatgagttcgcagaacctggcggcagcgcaaaagatg

SEQ ID NO: 37177 - DNA, 103 bp, Artificial Sequence
  Synthetic Polynucleotide
taatacgactcactatagggaaccctttgccgctaacaattctacgttataacagaggagaataacgatgaattgttagaacctggcggcagcgcaaaagatg

SEQ ID NO: 37178 - DNA, 103 bp, Artificial Sequence
  Synthetic Polynucleotide
taatacgactcactataggggaattaggcatacggtatattctcgctgcaaacagaggagatgcagcatgaatataccgaacctggcggcagcgcaaaagatg

SEQ ID NO: 37179 - DNA, 103 bp, Artificial Sequence
  Synthetic Polynucleotide
taatacgactcactatagggcctatacgcaatctcgagtccataatctgaaacagaggagatcagatatgggactcgagaacctggcggcagcgcaaaagatg

SEQ ID NO: 37180 - DNA, 103 bp, Artificial Sequence
  Synthetic Polynucleotide
taatacgactcactataggggccggccaattctccaatatgtacctccacaacagaggagagtggagatgcatattggaaacctggcggcagcgcaaaagatg

SEQ ID NO: 37181 - DNA, 103 bp, Artificial Sequence
  Synthetic Polynucleotide
taatacgactcactatagggcgattagcaagggttgttgcctcgctggataacagaggagaatccagatgggcaacaacaacctggcggcagcgcaaaagatg

SEQ ID NO: 37182 - DNA, 103 bp, Artificial Sequence
  Synthetic Polynucleotide
taatacgactcactatagggttttaggcgcatctcttgaacacgttatacaacagaggagagtataaatggttcaagagaacctggcggcagcgcaaaagatg

SEQ ID NO: 37183 - DNA, 103 bp, Artificial Sequence
  Synthetic Polynucleotide
taatacgactcactatagggttaattacggtggatcttacatgaacttcaaacagaggagatgaagtatgtgtaagatcaacctggcggcagcgcaaaagatg

SEQ ID NO: 37184 - DNA, 103 bp, Artificial Sequence
  Synthetic Polynucleotide
taatacgactcactatagggttgtcacacagacgaatcgtcccctacgtcaacagaggagagacgtaatggacgattcgaacctggcggcagcgcaaaagatg

SEQ ID NO: 37185 - DNA, 103 bp, Artificial Sequence
  Synthetic Polynucleotide
taatacgactcactatagggcgccacgaaggcggcttcggagttgttgacaacagaggagagtcaacatgtccgaagccaacctggcggcagcgcaaaagatg

SEQ ID NO: 37186 - DNA, 103 bp, Artificial Sequence
  Synthetic Polynucleotide
taatacgactcactatagggtcgagcagcggacttgatggcttcggccctaacagaggagaagggccatggccatcaagaacctggcggcagcgcaaaagatg

SEQ ID NO: 37187 - DNA, 103 bp, Artificial Sequence
  Synthetic Polynucleotide
taatacgactcactatagggtgacctttttcttttatagcttggtgctataacagaggagaatagcaatgagctataaaaacctggcggcagcgcaaaagatg

SEQ ID NO: 37188 - DNA, 103 bp, Artificial Sequence
  Synthetic Polynucleotide
taatacgactcactataggggcaaccaaatctgctgacccccaaacggacaacagaggagagtccgtatgggggtcagcaacctggcggcagcgcaaaagatg

SEQ ID NO: 37189 - DNA, 103 bp, Artificial Sequence
  Synthetic Polynucleotide
taatacgactcactataggggctaggagaaacaccccttagaaccatcaaaacagaggagattgatgatgctaaggggtaacctggcggcagcgcaaaagatg

SEQ ID NO: 37190 - DNA, 103 bp, Artificial Sequence
  Synthetic Polynucleotide
taatacgactcactatagggccagccgtaccgtcccgaaggacctcctcaaacagaggagatgaggaatgccttcgggaaacctggcggcagcgcaaaagatg

SEQ ID NO: 37191 - DNA, 103 bp, Artificial Sequence
  Synthetic Polynucleotide
taatacgactcactatagggttcaccgcgcgctcgtttgttaagcgttttaacagaggagaaaaacgatgaacaaacgaaacctggcggcagcgcaaaagatg

SEQ ID NO: 37192 - DNA, 103 bp, Artificial Sequence
  Synthetic Polynucleotide
taatacgactcactataggggaaccattcgtactagcgtctaacacctagaacagaggagactaggtatgagacgctagaacctggcggcagcgcaaaagatg

SEQ ID NO: 37193 - DNA, 103 bp, Artificial Sequence
  Synthetic Polynucleotide
taatacgactcactataggggttagcattgaaccaaagatatggggcgaaaacagaggagattcgccatgtatctttggaacctggcggcagcgcaaaagatg

SEQ ID NO: 37194 - DNA, 103 bp, Artificial Sequence
  Synthetic Polynucleotide
taatacgactcactatagggggtggtcctctgacagtgaagagtctaccaaacagaggagatggtagatgcttcactgtaacctggcggcagcgcaaaagatg

SEQ ID NO: 37195 - DNA, 103 bp, Artificial Sequence
  Synthetic Polynucleotide
taatacgactcactatagggcggcgtactcccccattcgcgtctagtcgcaacagaggagagcgactatgcgcgaatggaacctggcggcagcgcaaaagatg

SEQ ID NO: 37196 - DNA, 103 bp, Artificial Sequence
  Synthetic Polynucleotide
taatacgactcactatagggaagaggaggatcagcgtaacgtccactaacaacagaggagagttagtatgcgttacgctaacctggcggcagcgcaaaagatg

SEQ ID NO: 37197 - DNA, 103 bp, Artificial Sequence
  Synthetic Polynucleotide
taatacgactcactatagggcccgataccgggtcagcacggcctcataaaaacagaggagatttatgatgccgtgctgaaacctggcggcagcgcaaaagatg

SEQ ID NO: 37198 - DNA, 103 bp, Artificial Sequence
  Synthetic Polynucleotide
taatacgactcactatagggctcagaatttaccatcaggtagacacctgcaacagaggagagcaggtatgtacctgatgaacctggcggcagcgcaaaagatg

SEQ ID NO: 37199 - DNA, 103 bp, Artificial Sequence
  Synthetic Polynucleotide
taatacgactcactataggggatcgtaagtgagaaaggacaagacaataaaacagaggagattattgatgtgtcctttcaacctggcggcagcgcaaaagatg

SEQ ID NO: 37200 - DNA, 103 bp, Artificial Sequence
  Synthetic Polynucleotide
taatacgactcactataggggcctgttatagcccgacaatccccggcgcaaacagaggagatgcgccatggattgtcggaacctggcggcagcgcaaaagatg

SEQ ID NO: 37201 - DNA, 103 bp, Artificial Sequence
  Synthetic Polynucleotide
taatacgactcactatagggaaagcgatactttatttggcgatttctcccaacagaggagagggagaatgcgccaaataaacctggcggcagcgcaaaagatg

SEQ ID NO: 37202 - DNA, 103 bp, Artificial Sequence
  Synthetic Polynucleotide
taatacgactcactatagggctgggtcgcagaatatgcgttcctaaaacaaacagaggagatgttttatgaacgcatataacctggcggcagcgcaaaagatg

SEQ ID NO: 37203 - DNA, 103 bp, Artificial Sequence
  Synthetic Polynucleotide
taatacgactcactatagggctgtgcttacccataattagcttgggactcaacagaggagagagtccatggctaattataacctggcggcagcgcaaaagatg

SEQ ID NO: 37204 - DNA, 103 bp, Artificial Sequence
  Synthetic Polynucleotide
taatacgactcactatagggccggcaacgcctcgtatcgataatccgcataacagaggagaatgcggatgatcgatacgaacctggcggcagcgcaaaagatg

SEQ ID NO: 37205 - DNA, 103 bp, Artificial Sequence
  Synthetic Polynucleotide
taatacgactcactatagggcgggaatccaaaatagatatccaggccaataacagaggagaattggcatggatatctataacctggcggcagcgcaaaagatg

SEQ ID NO: 37206 - DNA, 103 bp, Artificial Sequence
  Synthetic Polynucleotide
taatacgactcactatagggacgacaaagaggatgctcgtatgtcgatacaacagaggagagtatcgatgtacgagcataacctggcggcagcgcaaaagatg

SEQ ID NO: 37207 - DNA, 103 bp, Artificial Sequence
  Synthetic Polynucleotide
taatacgactcactatagggtccgttcagaagagcgaaaactttactgtaaacagaggagatacagtatggttttcgctaacctggcggcagcgcaaaagatg

SEQ ID NO: 37208 - DNA, 103 bp, Artificial Sequence
  Synthetic Polynucleotide
taatacgactcactatagggggatatcgcccgccgtcgacactacgctttaacagaggagaaaagcgatgtgtcgacggaacctggcggcagcgcaaaagatg

SEQ ID NO: 37209 - DNA, 103 bp, Artificial Sequence
  Synthetic Polynucleotide
taatacgactcactatagggacaggtaagaatgactaagggaagactcccaacagaggagagggagtatgcccttagtcaacctggcggcagcgcaaaagatg

SEQ ID NO: 37210 - DNA, 103 bp, Artificial Sequence
  Synthetic Polynucleotide
taatacgactcactataggggatactgataaagtaacgtattaggccgttaacagaggagaaacggcatgatacgttacaacctggcggcagcgcaaaagatg

SEQ ID NO: 37211 - DNA, 103 bp, Artificial Sequence
  Synthetic Polynucleotide
taatacgactcactatagggcggcgctgactagccctgttcctaactcgtaacagaggagaacgagtatggaacagggcaacctggcggcagcgcaaaagatg

SEQ ID NO: 37212 - DNA, 103 bp, Artificial Sequence
  Synthetic Polynucleotide
taatacgactcactatagggttaccgggtatgagttataacgcggtacaaaacagaggagattgtacatggttataactaacctggcggcagcgcaaaagatg

SEQ ID NO: 37213 - DNA, 103 bp, Artificial Sequence
  Synthetic Polynucleotide
taatacgactcactatagggtgagcctcttaggtttgcgattggaggaacaacagaggagagttcctatgatcgcaaacaacctggcggcagcgcaaaagatg

SEQ ID NO: 37214 - DNA, 103 bp, Artificial Sequence
  Synthetic Polynucleotide
taatacgactcactatagggatgtctaagtctgtgctcggaacccaagacaacagaggagagtcttgatgtccgagcacaacctggcggcagcgcaaaagatg

SEQ ID NO: 37215 - DNA, 103 bp, Artificial Sequence
  Synthetic Polynucleotide
taatacgactcactatagggcgtgaccctaaaatattgtgattctaaaggaacagaggagacctttaatgtcacaatataacctggcggcagcgcaaaagatg

SEQ ID NO: 37216 - DNA, 103 bp, Artificial Sequence
  Synthetic Polynucleotide
taatacgactcactataggggtagttcgacagatgagaacccgtaggcaaaacagaggagattgcctatgggttctcataacctggcggcagcgcaaaagatg

SEQ ID NO: 37217 - DNA, 103 bp, Artificial Sequence
  Synthetic Polynucleotide
taatacgactcactatagggatccattcgggcgagcgcatgccacgcaataacagaggagaattgcgatgcatgcgctcaacctggcggcagcgcaaaagatg

SEQ ID NO: 37218 - DNA, 103 bp, Artificial Sequence
  Synthetic Polynucleotide
taatacgactcactataggggaattcctccctagcaggccgctatgctcgaacagaggagacgagcaatgcggcctgctaacctggcggcagcgcaaaagatg

SEQ ID NO: 37219 - DNA, 103 bp, Artificial Sequence
  Synthetic Polynucleotide
taatacgactcactatagggacccaacaacatacgttggactgacccaataacagaggagaattgggatggtccaacgtaacctggcggcagcgcaaaagatg

SEQ ID NO: 37220 - DNA, 103 bp, Artificial Sequence
  Synthetic Polynucleotide
taatacgactcactatagggcggcgtgacgatggcgatcaagtcgggtgaaacagaggagatcacccatgttgatcgccaacctggcggcagcgcaaaagatg

SEQ ID NO: 37221 - DNA, 103 bp, Artificial Sequence
  Synthetic Polynucleotide
taatacgactcactatagggcccattagagtcgtttccgccagataagttaacagaggagaaacttaatgggcggaaacaacctggcggcagcgcaaaagatg

SEQ ID NO: 37222 - DNA, 103 bp, Artificial Sequence
  Synthetic Polynucleotide
taatacgactcactatagggagttgccgctgtgatgttcaaacaccgtagaacagaggagactacggatgttgaacatcaacctggcggcagcgcaaaagatg

SEQ ID NO: 37223 - DNA, 103 bp, Artificial Sequence
  Synthetic Polynucleotide
taatacgactcactatagggagatggctccgtgcgggccgtcaacaacccaacagaggagagggttgatgacggcccgcaacctggcggcagcgcaaaagatg

SEQ ID NO: 37224 - DNA, 103 bp, Artificial Sequence
  Synthetic Polynucleotide
taatacgactcactatagggcgactattgggcctcccaagatatggtaggaacagaggagacctaccatgtcttgggagaacctggcggcagcgcaaaagatg

SEQ ID NO: 37225 - DNA, 103 bp, Artificial Sequence
  Synthetic Polynucleotide
taatacgactcactataggggaacaccatctcataagcatgtagagtgataacagaggagaatcactatgcatgcttataacctggcggcagcgcaaaagatg

SEQ ID NO: 37226 - DNA, 103 bp, Artificial Sequence
  Synthetic Polynucleotide
taatacgactcactataggggtttactctaggcagggctccaacgagccaaacagaggagatggctcatgggagccctgaacctggcggcagcgcaaaagatg

SEQ ID NO: 37227 - DNA, 103 bp, Artificial Sequence
  Synthetic Polynucleotide
taatacgactcactataggggatcctaaaatacggaagaccttctggacaaacagaggagatgtccaatgggtcttccgaacctggcggcagcgcaaaagatg

SEQ ID NO: 37228 - DNA, 103 bp, Artificial Sequence
  Synthetic Polynucleotide
taatacgactcactatagggccggtgaggggggagatttgatagataacgaacagaggagacgttatatgtcaaatctcaacctggcggcagcgcaaaagatg

SEQ ID NO: 37229 - DNA, 103 bp, Artificial Sequence
  Synthetic Polynucleotide
taatacgactcactatagggtcaagggcgcggctgatgtgagcggcgtataacagaggagaatacgcatgtcacatcagaacctggcggcagcgcaaaagatg

SEQ ID NO: 37230 - DNA, 103 bp, Artificial Sequence
  Synthetic Polynucleotide
taatacgactcactatagggcacagcttcctaaacgccctcgtatgtttaaacagaggagataaacaatggagggcgttaacctggcggcagcgcaaaagatg

SEQ ID NO: 37231 - DNA, 103 bp, Artificial Sequence
  Synthetic Polynucleotide
taatacgactcactatagggtgttagacggtgagcaggggggtgagtagaaacagaggagatctactatgccccctgctaacctggcggcagcgcaaaagatg

SEQ ID NO: 37232 - DNA, 103 bp, Artificial Sequence
  Synthetic Polynucleotide
taatacgactcactataggggaaagactggagtctcattaaacaggcctcaacagaggagagaggccatgttaatgagaaacctggcggcagcgcaaaagatg

SEQ ID NO: 37233 - DNA, 103 bp, Artificial Sequence
  Synthetic Polynucleotide
taatacgactcactatagggaggcgcatccgtaaaatgaaaagctagacaaacagaggagatgtctaatgtttcattttaacctggcggcagcgcaaaagatg

SEQ ID NO: 37234 - DNA, 103 bp, Artificial Sequence
  Synthetic Polynucleotide
taatacgactcactatagggtccactgttgggtccaactcggatcgacttaacagaggagaaagtcgatgcgagttggaaacctggcggcagcgcaaaagatg

SEQ ID NO: 37235 - DNA, 103 bp, Artificial Sequence
  Synthetic Polynucleotide
taatacgactcactatagggtccacgtagaatagtggtccggtccggcctaacagaggagaaggccgatgcggaccactaacctggcggcagcgcaaaagatg

SEQ ID NO: 37236 - DNA, 103 bp, Artificial Sequence
  Synthetic Polynucleotide
taatacgactcactatagggttgccccctaacaacttccttgcgaggcccaacagaggagagggcctatgaaggaagttaacctggcggcagcgcaaaagatg

SEQ ID NO: 37237 - DNA, 103 bp, Artificial Sequence
  Synthetic Polynucleotide
taatacgactcactatagggcatatgtatcttaagggcactgctttatttaacagaggagaaaataaatgagtgcccttaacctggcggcagcgcaaaagatg

SEQ ID NO: 37238 - DNA, 103 bp, Artificial Sequence
  Synthetic Polynucleotide
taatacgactcactatagggggagccgtgaagctggcgtcatagtaacgaaacagaggagatcgttaatgtgacgccagaacctggcggcagcgcaaaagatg

SEQ ID NO: 37239 - DNA, 103 bp, Artificial Sequence
  Synthetic Polynucleotide
taatacgactcactataggggcgtgcaataacctaactgggtgttgcgtcaacagaggagagacgcaatgcccagttagaacctggcggcagcgcaaaagatg

SEQ ID NO: 37240 - DNA, 103 bp, Artificial Sequence
  Synthetic Polynucleotide
taatacgactcactatagggcgtaaattgccgctcctagaggggaaacgaaacagaggagatcgtttatgctctaggagaacctggcggcagcgcaaaagatg

SEQ ID NO: 37241 - DNA, 103 bp, Artificial Sequence
  Synthetic Polynucleotide
taatacgactcactatagggtgccgtcttactgaaaacgcgtcggacaacaacagaggagagttgtcatgcgcgttttcaacctggcggcagcgcaaaagatg

SEQ ID NO: 37242 - DNA, 103 bp, Artificial Sequence
  Synthetic Polynucleotide
taatacgactcactatagggggtcgtggtaggactcatcgtcccgtgagaaacagaggagatctcacatgacgatgagtaacctggcggcagcgcaaaagatg

SEQ ID NO: 37243 - DNA, 103 bp, Artificial Sequence
  Synthetic Polynucleotide
taatacgactcactataggggacacgcggtacgtactatgtgcggtatttaacagaggagaaaatacatgacatagtacaacctggcggcagcgcaaaagatg

SEQ ID NO: 37244 - DNA, 103 bp, Artificial Sequence
  Synthetic Polynucleotide
taatacgactcactatagggaacctggacgcgccccgacccaatcttaacaacagaggagagttaagatggggtcggggaacctggcggcagcgcaaaagatg

SEQ ID NO: 37245 - DNA, 103 bp, Artificial Sequence
  Synthetic Polynucleotide
taatacgactcactatagggctacaatcgaactctgatgtcctatactacaacagaggagagtagtaatggacatcagaaacctggcggcagcgcaaaagatg

SEQ ID NO: 37246 - DNA, 103 bp, Artificial Sequence
  Synthetic Polynucleotide
taatacgactcactatagggtggagcgttgtgacgtatgtgggtcttggaaacagaggagatccaagatgcacatacgtaacctggcggcagcgcaaaagatg

SEQ ID NO: 37247 - DNA, 103 bp, Artificial Sequence
  Synthetic Polynucleotide
taatacgactcactatagggccattgagggcggtaatcagagtcccttcaaacagaggagatgaaggatgtctgattacaacctggcggcagcgcaaaagatg

SEQ ID NO: 37248 - DNA, 103 bp, Artificial Sequence
  Synthetic Polynucleotide
taatacgactcactatagggtatagtgagcgacgtattctcggcaggtgcaacagaggagagcacctatggagaatacgaacctggcggcagcgcaaaagatg

SEQ ID NO: 37249 - DNA, 103 bp, Artificial Sequence
  Synthetic Polynucleotide
taatacgactcactatagggttaagataattcacggacattagcgtcgacaacagaggagagtcgacatgaatgtccgtaacctggcggcagcgcaaaagatg

SEQ ID NO: 37250 - DNA, 103 bp, Artificial Sequence
  Synthetic Polynucleotide
taatacgactcactatagggcatatgggtgattggttgctccacccaagcaacagaggagagcttggatggagcaaccaaacctggcggcagcgcaaaagatg

SEQ ID NO: 37251 - DNA, 103 bp, Artificial Sequence
  Synthetic Polynucleotide
taatacgactcactatagggtcctcggtggagcgatagatcacgttacggaacagaggagaccgtaaatggatctatcgaacctggcggcagcgcaaaagatg

SEQ ID NO: 37252 - DNA, 103 bp, Artificial Sequence
  Synthetic Polynucleotide
taatacgactcactatagggcaacaatacgttgacgctgtctttcgcgtaaacagaggagatacgcgatggacagcgtcaacctggcggcagcgcaaaagatg

SEQ ID NO: 37253 - DNA, 103 bp, Artificial Sequence
  Synthetic Polynucleotide
taatacgactcactataggggtaaagaccgcacataaatccgccccgactaacagaggagaagtcggatgggatttatgaacctggcggcagcgcaaaagatg

SEQ ID NO: 37254 - DNA, 103 bp, Artificial Sequence
  Synthetic Polynucleotide
taatacgactcactataggggaacattaaatctaaatgttaatactttaaaacagaggagattaaagatgtaacatttaaacctggcggcagcgcaaaagatg

SEQ ID NO: 37255 - DNA, 103 bp, Artificial Sequence
  Synthetic Polynucleotide
taatacgactcactatagggatgttagacaagattgtgatcgtcgactgtaacagaggagaacagtcatggatcacaataacctggcggcagcgcaaaagatg

SEQ ID NO: 37256 - DNA, 103 bp, Artificial Sequence
  Synthetic Polynucleotide
taatacgactcactatagggaaagacgtgatggaaacgcttgacggacggaacagaggagaccgtccatgaagcgtttcaacctggcggcagcgcaaaagatg

SEQ ID NO: 37257 - DNA, 103 bp, Artificial Sequence
  Synthetic Polynucleotide
taatacgactcactatagggtgttgttgcatggggtgtgtccaagccagaaacagaggagatctggcatggacacacccaacctggcggcagcgcaaaagatg

SEQ ID NO: 37258 - DNA, 103 bp, Artificial Sequence
  Synthetic Polynucleotide
taatacgactcactatagggctcaacagatgttttcagagttcgaatgcgaacagaggagacgcattatgactctgaaaaacctggcggcagcgcaaaagatg

SEQ ID NO: 37259 - DNA, 103 bp, Artificial Sequence
  Synthetic Polynucleotide
taatacgactcactataggggactatcgcgaatgccaattaatacggagcaacagaggagagctccgatgtaattggcaaacctggcggcagcgcaaaagatg

SEQ ID NO: 37260 - DNA, 103 bp, Artificial Sequence
  Synthetic Polynucleotide
taatacgactcactatagggaaattgttgcgacgacaccgctatttgtacaacagaggagagtacaaatggcggtgtcgaacctggcggcagcgcaaaagatg

SEQ ID NO: 37261 - DNA, 103 bp, Artificial Sequence
  Synthetic Polynucleotide
taatacgactcactatagggaacttgagtagtaaaccttttcctcacgcaaacagaggagatgcgtgatgaaaaggtttaacctggcggcagcgcaaaagatg

SEQ ID NO: 37262 - DNA, 103 bp, Artificial Sequence
  Synthetic Polynucleotide
taatacgactcactatagggcgtatattgaggctagaataaccgtgcgtgaacagaggagacacgcaatgttattctagaacctggcggcagcgcaaaagatg

SEQ ID NO: 37263 - DNA, 103 bp, Artificial Sequence
  Synthetic Polynucleotide
taatacgactcactatagggggtgctatatacgtatattgattttgcgctaacagaggagaagcgcaatgtcaatatacaacctggcggcagcgcaaaagatg

SEQ ID NO: 37264 - DNA, 103 bp, Artificial Sequence
  Synthetic Polynucleotide
taatacgactcactataggggtagtacttttctcagctctgctcggcgccaacagaggagaggcgccatgcagagctgaaacctggcggcagcgcaaaagatg

SEQ ID NO: 37265 - DNA, 103 bp, Artificial Sequence
  Synthetic Polynucleotide
taatacgactcactatagggcccttcccacagattaccagctcaggttcgaacagaggagacgaaccatggctggtaataacctggcggcagcgcaaaagatg

SEQ ID NO: 37266 - DNA, 103 bp, Artificial Sequence
  Synthetic Polynucleotide
taatacgactcactatagggttcagaaagggaccgtatcagctttgtggaaacagaggagatccacaatgctgatacggaacctggcggcagcgcaaaagatg

SEQ ID NO: 37267 - DNA, 103 bp, Artificial Sequence
  Synthetic Polynucleotide
taatacgactcactatagggccacgacaaagatcgtgcttgcttatacgtaacagaggagaacgtatatgcaagcacgaaacctggcggcagcgcaaaagatg

SEQ ID NO: 37268 - DNA, 103 bp, Artificial Sequence
  Synthetic Polynucleotide
taatacgactcactatagggtgacagggggatcccgaaagcaggaatcagaacagaggagactgattatggctttcgggaacctggcggcagcgcaaaagatg

SEQ ID NO: 37269 - DNA, 103 bp, Artificial Sequence
  Synthetic Polynucleotide
taatacgactcactatagggaactgcgaaggctatggtcagtgacgtatgaacagaggagacatacgatgctgaccataaacctggcggcagcgcaaaagatg

SEQ ID NO: 37270 - DNA, 103 bp, Artificial Sequence
  Synthetic Polynucleotide
taatacgactcactatagggaccagaccttctctccatttaaatggccgtaacagaggagaacggccatgtaaatggagaacctggcggcagcgcaaaagatg

SEQ ID NO: 37271 - DNA, 103 bp, Artificial Sequence
  Synthetic Polynucleotide
taatacgactcactatagggtcatcgccacccaaaagtcagacgcggtcaaacagaggagatgaccgatgctgacttttaacctggcggcagcgcaaaagatg

SEQ ID NO: 37272 - DNA, 103 bp, Artificial Sequence
  Synthetic Polynucleotide
taatacgactcactatagggctcacctataagcccttttcggaaataaagaacagaggagactttatatgcgaaaagggaacctggcggcagcgcaaaagatg

SEQ ID NO: 37273 - DNA, 103 bp, Artificial Sequence
  Synthetic Polynucleotide
taatacgactcactatagggtagtctgccccctgcagcaatgggagcgccaacagaggagaggcgctatgattgctgcaaacctggcggcagcgcaaaagatg

SEQ ID NO: 37274 - DNA, 103 bp, Artificial Sequence
  Synthetic Polynucleotide
taatacgactcactatagggcggtgatagtaccgcaacgaatctaggacaaacagaggagatgtcctatgttcgttgcgaacctggcggcagcgcaaaagatg

SEQ ID NO: 37275 - DNA, 103 bp, Artificial Sequence
  Synthetic Polynucleotide
taatacgactcactatagggccgtttccattaattaaggtcgttgcgtagaacagaggagactacgcatggaccttaataacctggcggcagcgcaaaagatg

SEQ ID NO: 37276 - DNA, 103 bp, Artificial Sequence
  Synthetic Polynucleotide
taatacgactcactatagggccattcacctcagagcttcgcatactgataaacagaggagatatcagatggcgaagctcaacctggcggcagcgcaaaagatg

SEQ ID NO: 37277 - DNA, 103 bp, Artificial Sequence
  Synthetic Polynucleotide
taatacgactcactataggggtatgcgcttaccctgccggactgggttcaaacagaggagatgaaccatgtccggcaggaacctggcggcagcgcaaaagatg

SEQ ID NO: 37278 - DNA, 103 bp, Artificial Sequence
  Synthetic Polynucleotide
taatacgactcactatagggatactcgttgccgactagattgctatcggtaacagaggagaaccgatatgaatctagtcaacctggcggcagcgcaaaagatg

SEQ ID NO: 37279 - DNA, 103 bp, Artificial Sequence
  Synthetic Polynucleotide
taatacgactcactataggggctgtagcggcagtgagtattcaatgaacgaacagaggagacgttcaatgaatactcacaacctggcggcagcgcaaaagatg

SEQ ID NO: 37280 - DNA, 103 bp, Artificial Sequence
  Synthetic Polynucleotide
taatacgactcactatagggcgctagctttcccgcatttcggatgctcttaacagaggagaaagagcatgcgaaatgcgaacctggcggcagcgcaaaagatg

SEQ ID NO: 37281 - DNA, 103 bp, Artificial Sequence
  Synthetic Polynucleotide
taatacgactcactatagggcccgacgagcgaaacgtgggttccttggtgaacagaggagacaccaaatgacccacgttaacctggcggcagcgcaaaagatg

SEQ ID NO: 37282 - DNA, 103 bp, Artificial Sequence
  Synthetic Polynucleotide
taatacgactcactatagggaaaactgagtagcagcaaataatggaacaaaacagaggagattgttcatgtatttgctgaacctggcggcagcgcaaaagatg

SEQ ID NO: 37283 - DNA, 103 bp, Artificial Sequence
  Synthetic Polynucleotide
taatacgactcactatagggaatctaatggtaaggacggtctgaccgggcaacagaggagagcccggatggaccgtcctaacctggcggcagcgcaaaagatg

SEQ ID NO: 37284 - DNA, 103 bp, Artificial Sequence
  Synthetic Polynucleotide
taatacgactcactatagggtcatgtatgtctcatcttgtaaggaactgcaacagaggagagcagttatgtacaagatgaacctggcggcagcgcaaaagatg

SEQ ID NO: 37285 - DNA, 103 bp, Artificial Sequence
  Synthetic Polynucleotide
taatacgactcactatagggggccgagccagacgagatcacaaaggtcgaaacagaggagatcgaccatggtgatctcgaacctggcggcagcgcaaaagatg

SEQ ID NO: 37286 - DNA, 103 bp, Artificial Sequence
  Synthetic Polynucleotide
taatacgactcactatagggcgtttgtaggagggcagccggattaataacaacagaggagagttattatgccggctgccaacctggcggcagcgcaaaagatg

SEQ ID NO: 37287 - DNA, 103 bp, Artificial Sequence
  Synthetic Polynucleotide
taatacgactcactatagggtgtatcctgcttccgaaacaaagcagaatgaacagaggagacattctatgttgtttcggaacctggcggcagcgcaaaagatg

SEQ ID NO: 37288 - DNA, 103 bp, Artificial Sequence
  Synthetic Polynucleotide
taatacgactcactatagggcagatgcgatctggctcgggaggcgtctgaaacagaggagatcagacatgtcccgagccaacctggcggcagcgcaaaagatg

SEQ ID NO: 37289 - DNA, 103 bp, Artificial Sequence
  Synthetic Polynucleotide
taatacgactcactataggggccatagtgagtaaagaatagaatgtctccaacagaggagaggagacatgctattctttaacctggcggcagcgcaaaagatg

SEQ ID NO: 37290 - DNA, 103 bp, Artificial Sequence
  Synthetic Polynucleotide
taatacgactcactataggggggggcgtctacgtgggctggagtgtcggcaacagaggagagccgacatgccagcccacaacctggcggcagcgcaaaagatg

SEQ ID NO: 37291 - DNA, 103 bp, Artificial Sequence
  Synthetic Polynucleotide
taatacgactcactataggggaccccgtggaatgtggttatggcgattgtaacagaggagaacaatcatgataaccacaaacctggcggcagcgcaaaagatg

SEQ ID NO: 37292 - DNA, 103 bp, Artificial Sequence
  Synthetic Polynucleotide
taatacgactcactatagggcgctttatgaatatctcagggcgtccccgtaacagaggagaacggggatgccctgagataacctggcggcagcgcaaaagatg

SEQ ID NO: 37293 - DNA, 103 bp, Artificial Sequence
  Synthetic Polynucleotide
taatacgactcactatagggacacagggcggctgcaaatcgccgattccgaacagaggagacggaatatgcgatttgcaaacctggcggcagcgcaaaagatg

SEQ ID NO: 37294 - DNA, 103 bp, Artificial Sequence
  Synthetic Polynucleotide
taatacgactcactatagggtacggcggggctagcgagcaagccccgcacaacagaggagagtgcggatgttgctcgctaacctggcggcagcgcaaaagatg

SEQ ID NO: 37295 - DNA, 103 bp, Artificial Sequence
  Synthetic Polynucleotide
taatacgactcactataggggctataggcattggcgtgtcaaccgtgctaaacagaggagatagcacatgtgacacgccaacctggcggcagcgcaaaagatg

SEQ ID NO: 37296 - DNA, 103 bp, Artificial Sequence
  Synthetic Polynucleotide
taatacgactcactatagggcttaagtaacaccgattggtaaatcgcttaaacagaggagataagcgatgtaccaatcgaacctggcggcagcgcaaaagatg

SEQ ID NO: 37297 - DNA, 103 bp, Artificial Sequence
  Synthetic Polynucleotide
taatacgactcactatagggcccgtcaaagcgccggggtggaccgataataacagaggagaattatcatgccaccccggaacctggcggcagcgcaaaagatg

SEQ ID NO: 37298 - DNA, 103 bp, Artificial Sequence
  Synthetic Polynucleotide
taatacgactcactatagggtgccacactagttccccaatgtcgaggtaaaacagaggagattacctatgcattggggaaacctggcggcagcgcaaaagatg

SEQ ID NO: 37299 - DNA, 103 bp, Artificial Sequence
  Synthetic Polynucleotide
taatacgactcactatagggatgtgatgccccctgtgtgcatggccgatgaacagaggagacatcggatgtgcacacagaacctggcggcagcgcaaaagatg

SEQ ID NO: 37300 - DNA, 103 bp, Artificial Sequence
  Synthetic Polynucleotide
taatacgactcactatagggtaacgttagcaccttattacagccttggaaaacagaggagattccaaatgtgtaataagaacctggcggcagcgcaaaagatg

SEQ ID NO: 37301 - DNA, 103 bp, Artificial Sequence
  Synthetic Polynucleotide
taatacgactcactatagggtaagcttccaaattagacatgaaacgcttaaacagaggagataagcgatgcatgtctaaaacctggcggcagcgcaaaagatg

SEQ ID NO: 37302 - DNA, 103 bp, Artificial Sequence
  Synthetic Polynucleotide
taatacgactcactatagggtaagccgttacacaatgtctatgattttgaaacagaggagatcaaaaatgtagacattgaacctggcggcagcgcaaaagatg

SEQ ID NO: 37303 - DNA, 103 bp, Artificial Sequence
  Synthetic Polynucleotide
taatacgactcactatagggcaactacatcccgtgatccgcggggggacaaacagaggagatgtcccatggcggatcacaacctggcggcagcgcaaaagatg

SEQ ID NO: 37304 - DNA, 103 bp, Artificial Sequence
  Synthetic Polynucleotide
taatacgactcactataggggccaacccccggttgctcacacagcaaagcaacagaggagagctttgatgtgtgagcaaaacctggcggcagcgcaaaagatg

SEQ ID NO: 37305 - DNA, 103 bp, Artificial Sequence
  Synthetic Polynucleotide
taatacgactcactatagggtcggagaccacccttcctccccccacggataacagaggagaatccgtatggggaggaagaacctggcggcagcgcaaaagatg

SEQ ID NO: 37306 - DNA, 103 bp, Artificial Sequence
  Synthetic Polynucleotide
taatacgactcactatagggcggggaccaaagttcacgacagcttgtaataacagaggagaattacaatgtgtcgtgaaaacctggcggcagcgcaaaagatg

SEQ ID NO: 37307 - DNA, 103 bp, Artificial Sequence
  Synthetic Polynucleotide
taatacgactcactatagggtaggtccgcagggtgcaaaaagactcgtcgaacagaggagacgacgaatgtttttgcacaacctggcggcagcgcaaaagatg

SEQ ID NO: 37308 - DNA, 103 bp, Artificial Sequence
  Synthetic Polynucleotide
taatacgactcactatagggtgaaccaatcacgctacaactagctcgctcaacagaggagagagcgaatgagttgtagcaacctggcggcagcgcaaaagatg

SEQ ID NO: 37309 - DNA, 103 bp, Artificial Sequence
  Synthetic Polynucleotide
taatacgactcactatagggagtcgttagacagcccgtagaagagactagaacagaggagactagtcatgtctacgggcaacctggcggcagcgcaaaagatg

SEQ ID NO: 37310 - DNA, 103 bp, Artificial Sequence
  Synthetic Polynucleotide
taatacgactcactatagggttgcggaggatcatttaaatttggtgtcggaacagaggagaccgacaatgaatttaaataacctggcggcagcgcaaaagatg

SEQ ID NO: 37311 - DNA, 103 bp, Artificial Sequence
  Synthetic Polynucleotide
taatacgactcactatagggaaaagggtctaccggaaagaagctgcggaaaacagaggagattccgcatgttctttccgaacctggcggcagcgcaaaagatg

SEQ ID NO: 37312 - DNA, 103 bp, Artificial Sequence
  Synthetic Polynucleotide
taatacgactcactatagggcatcagccctgtgcacgaacgataaacgttaacagaggagaaacgttatgcgttcgtgcaacctggcggcagcgcaaaagatg

SEQ ID NO: 37313 - DNA, 103 bp, Artificial Sequence
  Synthetic Polynucleotide
taatacgactcactatagggtgaattgtggacattggcgagcgccgtcgtaacagaggagaacgacgatgctcgccaataacctggcggcagcgcaaaagatg

SEQ ID NO: 37314 - DNA, 103 bp, Artificial Sequence
  Synthetic Polynucleotide
taatacgactcactatagggctaggtgggcttagcagagatggtacattaaacagaggagataatgtatgatctctgctaacctggcggcagcgcaaaagatg

SEQ ID NO: 37315 - DNA, 103 bp, Artificial Sequence
  Synthetic Polynucleotide
taatacgactcactataggggtagttagaagcaattcagcagttagaactaacagaggagaagttctatgtgctgaattaacctggcggcagcgcaaaagatg

SEQ ID NO: 37316 - DNA, 103 bp, Artificial Sequence
  Synthetic Polynucleotide
taatacgactcactatagggtcggatcacgagcaactccacagccgttaaaacagaggagattaacgatggtggagttgaacctggcggcagcgcaaaagatg

SEQ ID NO: 37317 - DNA, 103 bp, Artificial Sequence
  Synthetic Polynucleotide
taatacgactcactatagggacgagagagggacttgatgccgtaggctacaacagaggagagtagccatgggcatcaagaacctggcggcagcgcaaaagatg

SEQ ID NO: 37318 - DNA, 103 bp, Artificial Sequence
  Synthetic Polynucleotide
taatacgactcactataggggaggattgggacaacatttattcggggagtaacagaggagaactcccatgataaatgttaacctggcggcagcgcaaaagatg

SEQ ID NO: 37319 - DNA, 103 bp, Artificial Sequence
  Synthetic Polynucleotide
taatacgactcactatagggctcgctctaaattgcggcgtatcatgggagaacagaggagactcccaatgtacgccgcaaacctggcggcagcgcaaaagatg

SEQ ID NO: 37320 - DNA, 103 bp, Artificial Sequence
  Synthetic Polynucleotide
taatacgactcactatagggcctcaaccgggaatatgaccgttactcaggaacagaggagacctgagatgcggtcatataacctggcggcagcgcaaaagatg

SEQ ID NO: 37321 - DNA, 103 bp, Artificial Sequence
  Synthetic Polynucleotide
taatacgactcactataggggtcatgtcactaatctcaattcgatttacaaacagaggagatgtaaaatgaattgagataacctggcggcagcgcaaaagatg

SEQ ID NO: 37322 - DNA, 103 bp, Artificial Sequence
  Synthetic Polynucleotide
taatacgactcactatagggtggttcagtaagctacagaggttagctgctaacagaggagaagcagcatgcctctgtagaacctggcggcagcgcaaaagatg

SEQ ID NO: 37323 - DNA, 103 bp, Artificial Sequence
  Synthetic Polynucleotide
taatacgactcactatagggtgggaggtaaatgggcccacctccccttctaacagaggagaagaaggatgggtgggcccaacctggcggcagcgcaaaagatg

SEQ ID NO: 37324 - DNA, 103 bp, Artificial Sequence
  Synthetic Polynucleotide
taatacgactcactatagggctttccaagtccatattactgagaccgagtaacagaggagaactcggatgcagtaatataacctggcggcagcgcaaaagatg

SEQ ID NO: 37325 - DNA, 103 bp, Artificial Sequence
  Synthetic Polynucleotide
taatacgactcactataggggtcattgcgcacattagacgcgatcaatgaaacagaggagatcattgatggcgtctaataacctggcggcagcgcaaaagatg

SEQ ID NO: 37326 - DNA, 103 bp, Artificial Sequence
  Synthetic Polynucleotide
taatacgactcactatagggaatgcagttggtcacgtcctggttcgaactaacagaggagaagttcgatgcaggacgtgaacctggcggcagcgcaaaagatg

SEQ ID NO: 37327 - DNA, 103 bp, Artificial Sequence
  Synthetic Polynucleotide
taatacgactcactatagggaggctctcgggaatcggaatctgccggcaaaacagaggagattgccgatggattccgataacctggcggcagcgcaaaagatg

SEQ ID NO: 37328 - DNA, 103 bp, Artificial Sequence
  Synthetic Polynucleotide
taatacgactcactatagggaagcggagagctcttatagaatggcatctgaacagaggagacagatgatgttctataagaacctggcggcagcgcaaaagatg

SEQ ID NO: 37329 - DNA, 103 bp, Artificial Sequence
  Synthetic Polynucleotide
taatacgactcactatagggagtggtccttcacacactctgatcttttaaaacagaggagattaaaaatgcagagtgtgaacctggcggcagcgcaaaagatg

SEQ ID NO: 37330 - DNA, 103 bp, Artificial Sequence
  Synthetic Polynucleotide
taatacgactcactatagggacactgaaacccctagtctttacctcaagtaacagaggagaacttgaatgaaagactagaacctggcggcagcgcaaaagatg

SEQ ID NO: 37331 - DNA, 103 bp, Artificial Sequence
  Synthetic Polynucleotide
taatacgactcactatagggcgtgttcaaaatcgcgttggtgatcccctgaacagaggagacaggggatgaccaacgcgaacctggcggcagcgcaaaagatg

SEQ ID NO: 37332 - DNA, 103 bp, Artificial Sequence
  Synthetic Polynucleotide
taatacgactcactataggggtttttctgcgaattcgagcactgagatcgaacagaggagacgatctatgtgctcgaataacctggcggcagcgcaaaagatg

SEQ ID NO: 37333 - DNA, 103 bp, Artificial Sequence
  Synthetic Polynucleotide
taatacgactcactatagggtgttagcaccaaagcccctgtggccttaataacagaggagaattaagatgacaggggctaacctggcggcagcgcaaaagatg

SEQ ID NO: 37334 - DNA, 103 bp, Artificial Sequence
  Synthetic Polynucleotide
taatacgactcactatagggcacttcgaagggtcctaatcagcggtgaataacagaggagaattcacatgtgattaggaaacctggcggcagcgcaaaagatg

SEQ ID NO: 37335 - DNA, 103 bp, Artificial Sequence
  Synthetic Polynucleotide
taatacgactcactataggggggggctggtgggataagagcggtgtactgaacagaggagacagtacatggctcttatcaacctggcggcagcgcaaaagatg

SEQ ID NO: 37336 - DNA, 103 bp, Artificial Sequence
  Synthetic Polynucleotide
taatacgactcactatagggacgatttcgtccaccggaaataggctggtgaacagaggagacaccagatgatttccggtaacctggcggcagcgcaaaagatg

SEQ ID NO: 37337 - DNA, 103 bp, Artificial Sequence
  Synthetic Polynucleotide
taatacgactcactataggggctctatcagcgaaattcctcctccgatccaacagaggagaggatcgatggaggaatttaacctggcggcagcgcaaaagatg

SEQ ID NO: 37338 - DNA, 103 bp, Artificial Sequence
  Synthetic Polynucleotide
taatacgactcactatagggttctcaatacaatgtttgaaaagctccgaaaacagaggagattcggaatgtttcaaacaaacctggcggcagcgcaaaagatg

SEQ ID NO: 37339 - DNA, 103 bp, Artificial Sequence
  Synthetic Polynucleotide
taatacgactcactatagggtagggtcatttcgaagctatggctaacaggaacagaggagacctgttatgcatagcttcaacctggcggcagcgcaaaagatg

SEQ ID NO: 37340 - DNA, 103 bp, Artificial Sequence
  Synthetic Polynucleotide
taatacgactcactataggggagcacgcgaaagcaacatcagccaaggccaacagaggagaggccttatgtgatgttgcaacctggcggcagcgcaaaagatg

SEQ ID NO: 37341 - DNA, 103 bp, Artificial Sequence
  Synthetic Polynucleotide
taatacgactcactatagggttactgtcgagaccggcgttccactgcgtgaacagaggagacacgcaatggaacgccggaacctggcggcagcgcaaaagatg

SEQ ID NO: 37342 - DNA, 103 bp, Artificial Sequence
  Synthetic Polynucleotide
taatacgactcactatagggatcgagttctatcaggctgctgtgcttctgaacagaggagacagaagatgagcagcctgaacctggcggcagcgcaaaagatg

SEQ ID NO: 37343 - DNA, 103 bp, Artificial Sequence
  Synthetic Polynucleotide
taatacgactcactatagggtcacgatggtcgcacttgtgcgcaagtgagaacagaggagactcactatggcacaagtgaacctggcggcagcgcaaaagatg

SEQ ID NO: 37344 - DNA, 103 bp, Artificial Sequence
  Synthetic Polynucleotide
taatacgactcactatagggggttagatggatcgcctagcgggagtgggaaacagaggagatcccacatgcgctaggcgaacctggcggcagcgcaaaagatg

SEQ ID NO: 37345 - DNA, 103 bp, Artificial Sequence
  Synthetic Polynucleotide
taatacgactcactatagggtgctcgcccagttaccccaaatgcgtgggaaacagaggagatcccacatgtttggggtaaacctggcggcagcgcaaaagatg

SEQ ID NO: 37346 - DNA, 103 bp, Artificial Sequence
  Synthetic Polynucleotide
taatacgactcactatagggccgcctggccctttcagatccgcatccgttaacagaggagaaacggaatgggatctgaaaacctggcggcagcgcaaaagatg

SEQ ID NO: 37347 - DNA, 103 bp, Artificial Sequence
  Synthetic Polynucleotide
taatacgactcactatagggtacatatgagaaagttggcatcgtaaacccaacagaggagagggtttatgatgccaactaacctggcggcagcgcaaaagatg

SEQ ID NO: 37348 - DNA, 103 bp, Artificial Sequence
  Synthetic Polynucleotide
taatacgactcactataggggaattttatcgacccttatttcgcggtcagaacagaggagactgaccatgaaataagggaacctggcggcagcgcaaaagatg

SEQ ID NO: 37349 - DNA, 103 bp, Artificial Sequence
  Synthetic Polynucleotide
taatacgactcactatagggttcgcgctgcagactcgttataagcatgttaacagaggagaaacatgatgataacgagtaacctggcggcagcgcaaaagatg

SEQ ID NO: 37350 - DNA, 103 bp, Artificial Sequence
  Synthetic Polynucleotide
taatacgactcactatagggagaccccatcctcaagctatgtcagagcagaacagaggagactgctcatgcatagcttgaacctggcggcagcgcaaaagatg

SEQ ID NO: 37351 - DNA, 103 bp, Artificial Sequence
  Synthetic Polynucleotide
taatacgactcactatagggcttgtcgacggatgtacccaccccttaataaacagaggagatattaaatggtgggtacaaacctggcggcagcgcaaaagatg

SEQ ID NO: 37352 - DNA, 103 bp, Artificial Sequence
  Synthetic Polynucleotide
taatacgactcactatagggtgatacggaacgacgtgttcccacttggcgaacagaggagacgccaaatgggaacacgtaacctggcggcagcgcaaaagatg

SEQ ID NO: 37353 - DNA, 103 bp, Artificial Sequence
  Synthetic Polynucleotide
taatacgactcactatagggtcggtgctaggacaataggagaacatgggcaacagaggagagcccatatgctcctattgaacctggcggcagcgcaaaagatg

SEQ ID NO: 37354 - DNA, 103 bp, Artificial Sequence
  Synthetic Polynucleotide
taatacgactcactatagggtttttggcccccggcaagatggagctcccgaacagaggagacgggagatgcatcttgccaacctggcggcagcgcaaaagatg

SEQ ID NO: 37355 - DNA, 103 bp, Artificial Sequence
  Synthetic Polynucleotide
taatacgactcactatagggggcgggtgtacttcggacgagcatggaacaaacagaggagatgttccatgctcgtccgaaacctggcggcagcgcaaaagatg

SEQ ID NO: 37356 - DNA, 103 bp, Artificial Sequence
  Synthetic Polynucleotide
taatacgactcactatagggctgtctggtgatcagatggggggatgctgtaacagaggagaacagcaatgccccatctgaacctggcggcagcgcaaaagatg

SEQ ID NO: 37357 - DNA, 103 bp, Artificial Sequence
  Synthetic Polynucleotide
taatacgactcactatagggaaaagttgttagtatcctgtatcaccgatcaacagaggagagatcggatgtacaggataaacctggcggcagcgcaaaagatg

SEQ ID NO: 37358 - DNA, 103 bp, Artificial Sequence
  Synthetic Polynucleotide
taatacgactcactatagggcttccgtcagctcatccgatgcgctgccacaacagaggagagtggcaatgcatcggatgaacctggcggcagcgcaaaagatg

SEQ ID NO: 37359 - DNA, 103 bp, Artificial Sequence
  Synthetic Polynucleotide
taatacgactcactatagggccggactcgcatcagtcggagaatactgaaaacagaggagattcagtatgctccgactgaacctggcggcagcgcaaaagatg

SEQ ID NO: 37360 - DNA, 103 bp, Artificial Sequence
  Synthetic Polynucleotide
taatacgactcactataggggggccttgcgcagctggtgatttcccgcccaacagaggagagggcggatgatcaccagcaacctggcggcagcgcaaaagatg

SEQ ID NO: 37361 - DNA, 103 bp, Artificial Sequence
  Synthetic Polynucleotide
taatacgactcactatagggacgtgaaatgatactggcgatatcattgggaacagaggagacccaatatgatcgccagtaacctggcggcagcgcaaaagatg

SEQ ID NO: 37362 - DNA, 103 bp, Artificial Sequence
  Synthetic Polynucleotide
taatacgactcactatagggtggagcacccggaagactcagattctgggaaacagaggagatcccagatgctgagtcttaacctggcggcagcgcaaaagatg

SEQ ID NO: 37363 - DNA, 103 bp, Artificial Sequence
  Synthetic Polynucleotide
taatacgactcactatagggggcgaaggatacttttagttctaggggaataacagaggagaattcccatggaactaaaaaacctggcggcagcgcaaaagatg

SEQ ID NO: 37364 - DNA, 103 bp, Artificial Sequence
  Synthetic Polynucleotide
taatacgactcactatagggcgcgacatggagggctgtcgtgtgaagtcgaacagaggagacgacttatgacgacagccaacctggcggcagcgcaaaagatg

SEQ ID NO: 37365 - DNA, 103 bp, Artificial Sequence
  Synthetic Polynucleotide
taatacgactcactatagggaggtaatacctcgcaaattgatgacggagcaacagaggagagctccgatgtcaatttgcaacctggcggcagcgcaaaagatg

SEQ ID NO: 37366 - DNA, 103 bp, Artificial Sequence
  Synthetic Polynucleotide
taatacgactcactataggggtcgaactacgaaagcccctctagtttaacaacagaggagagttaaaatggaggggcttaacctggcggcagcgcaaaagatg

SEQ ID NO: 37367 - DNA, 103 bp, Artificial Sequence
  Synthetic Polynucleotide
taatacgactcactatagggtagttttaagttcatcacacaagtggtacgaacagaggagacgtaccatgtgtgtgatgaacctggcggcagcgcaaaagatg

SEQ ID NO: 37368 - DNA, 103 bp, Artificial Sequence
  Synthetic Polynucleotide
taatacgactcactatagggtgccgtctcacggtttatgcgctctggtacaacagaggagagtaccaatgcgcataaacaacctggcggcagcgcaaaagatg

SEQ ID NO: 37369 - DNA, 103 bp, Artificial Sequence
  Synthetic Polynucleotide
taatacgactcactatagggtcgggggcaatcgggggatatgcaacagggaacagaggagaccctgtatgatatcccccaacctggcggcagcgcaaaagatg

SEQ ID NO: 37370 - DNA, 103 bp, Artificial Sequence
  Synthetic Polynucleotide
taatacgactcactatagggagcggagctcatggaacgattagcccgttgaacagaggagacaacggatgaatcgttccaacctggcggcagcgcaaaagatg

SEQ ID NO: 37371 - DNA, 103 bp, Artificial Sequence
  Synthetic Polynucleotide
taatacgactcactataggggggatccgcatcaaagcattgacgtagggcaacagaggagagccctaatgcaatgctttaacctggcggcagcgcaaaagatg

SEQ ID NO: 37372 - DNA, 103 bp, Artificial Sequence
  Synthetic Polynucleotide
taatacgactcactatagggcacgtttaggtccatgtacgataccatttaaacagaggagataaatgatgtcgtacatgaacctggcggcagcgcaaaagatg

SEQ ID NO: 37373 - DNA, 103 bp, Artificial Sequence
  Synthetic Polynucleotide
taatacgactcactatagggacgtctgtagctggtcacatgagggttagaaacagaggagatctaacatgcatgtgaccaacctggcggcagcgcaaaagatg

SEQ ID NO: 37374 - DNA, 103 bp, Artificial Sequence
  Synthetic Polynucleotide
taatacgactcactataggggtaaaaaagatccttcgaaggcttataccaaacagaggagatggtatatgccttcgaagaacctggcggcagcgcaaaagatg

SEQ ID NO: 37375 - DNA, 103 bp, Artificial Sequence
  Synthetic Polynucleotide
taatacgactcactatagggcctcgctgccaattcgttcgtaagcggactaacagaggagaagtccgatgacgaacgaaaacctggcggcagcgcaaaagatg

SEQ ID NO: 37376 - DNA, 103 bp, Artificial Sequence
  Synthetic Polynucleotide
taatacgactcactatagggcaggctagccggtctttacggtaatacctgaacagaggagacaggtaatgccgtaaagaaacctggcggcagcgcaaaagatg

SEQ ID NO: 37377 - DNA, 103 bp, Artificial Sequence
  Synthetic Polynucleotide
taatacgactcactatagggttgacttaagctgcgcctgcacatgatcttaacagaggagaaagatcatgtgcaggcgcaacctggcggcagcgcaaaagatg

SEQ ID NO: 37378 - DNA, 103 bp, Artificial Sequence
  Synthetic Polynucleotide
taatacgactcactatagggcttaacacagtccttgctatcaggtgactaaacagaggagatagtcaatggatagcaagaacctggcggcagcgcaaaagatg

SEQ ID NO: 37379 - DNA, 103 bp, Artificial Sequence
  Synthetic Polynucleotide
taatacgactcactataggggcaacaaaccacctaggtcctaaattggtaaacagaggagataccaaatgaggacctagaacctggcggcagcgcaaaagatg

SEQ ID NO: 37380 - DNA, 103 bp, Artificial Sequence
  Synthetic Polynucleotide
taatacgactcactatagggatggtccttttcggtagacctgagtaagataacagaggagaatcttaatgaggtctaccaacctggcggcagcgcaaaagatg

SEQ ID NO: 37381 - DNA, 103 bp, Artificial Sequence
  Synthetic Polynucleotide
taatacgactcactatagggggcctctgccttcgccgtacagtgtttaagaacagaggagacttaaaatgtgtacggcgaacctggcggcagcgcaaaagatg

SEQ ID NO: 37382 - DNA, 103 bp, Artificial Sequence
  Synthetic Polynucleotide
taatacgactcactatagggcactagaggccactgccgacctgggggtctaacagaggagaagacccatgggtcggcagaacctggcggcagcgcaaaagatg

SEQ ID NO: 37383 - DNA, 103 bp, Artificial Sequence
  Synthetic Polynucleotide
taatacgactcactataggggtagaacctgagagcctcgcctgaatttgcaacagaggagagcaaatatgggcgaggctaacctggcggcagcgcaaaagatg

SEQ ID NO: 37384 - DNA, 103 bp, Artificial Sequence
  Synthetic Polynucleotide
taatacgactcactatagggattccccacgcgagcatcgtaaggcccgccaacagaggagaggcgggatgtacgatgctaacctggcggcagcgcaaaagatg

SEQ ID NO: 37385 - DNA, 103 bp, Artificial Sequence
  Synthetic Polynucleotide
taatacgactcactatagggaaactcgctaattctcgcgtggtagaacaaaacagaggagattgttcatgcacgcgagaaacctggcggcagcgcaaaagatg

SEQ ID NO: 37386 - DNA, 103 bp, Artificial Sequence
  Synthetic Polynucleotide
taatacgactcactataggggtcgttatagtacagtagtttgaaaagttcaacagaggagagaacttatgaaactactgaacctggcggcagcgcaaaagatg

SEQ ID NO: 37387 - DNA, 103 bp, Artificial Sequence
  Synthetic Polynucleotide
taatacgactcactatagggattgttcgtgcaataacaggggacatctagaacagaggagactagatatgccctgttataacctggcggcagcgcaaaagatg

SEQ ID NO: 37388 - DNA, 103 bp, Artificial Sequence
  Synthetic Polynucleotide
taatacgactcactatagggtggacgacggaacaaggatctaacgttaggaacagaggagacctaacatgagatccttgaacctggcggcagcgcaaaagatg

SEQ ID NO: 37389 - DNA, 103 bp, Artificial Sequence
  Synthetic Polynucleotide
taatacgactcactataggggatccttcagtggcgtatctacgacccgagaacagaggagactcgggatgtagatacgcaacctggcggcagcgcaaaagatg

SEQ ID NO: 37390 - DNA, 103 bp, Artificial Sequence
  Synthetic Polynucleotide
taatacgactcactatagggtatccgcatatatgtgtgctaacagtctcgaacagaggagacgagacatgtagcacacaaacctggcggcagcgcaaaagatg

SEQ ID NO: 37391 - DNA, 103 bp, Artificial Sequence
  Synthetic Polynucleotide
taatacgactcactatagggtgtaaagtgttaaccgcttgaaatcaactaaacagaggagatagttgatgtcaagcggtaacctggcggcagcgcaaaagatg

SEQ ID NO: 37392 - DNA, 103 bp, Artificial Sequence
  Synthetic Polynucleotide
taatacgactcactatagggacacgcccggtgacaagggaaggaatttccaacagaggagaggaaatatgttcccttgtaacctggcggcagcgcaaaagatg

SEQ ID NO: 37393 - DNA, 103 bp, Artificial Sequence
  Synthetic Polynucleotide
taatacgactcactatagggacgcctaggttataacgttaatttaccaataacagaggagaattggtatgttaacgttaaacctggcggcagcgcaaaagatg

SEQ ID NO: 37394 - DNA, 103 bp, Artificial Sequence
  Synthetic Polynucleotide
taatacgactcactatagggaactcatacatacagggtagctcaccagtaaacagaggagatactggatggctaccctgaacctggcggcagcgcaaaagatg

SEQ ID NO: 37395 - DNA, 103 bp, Artificial Sequence
  Synthetic Polynucleotide
taatacgactcactataggggggacgtttccatttatggacgagtcatacaacagaggagagtatgaatggtccataaaaacctggcggcagcgcaaaagatg

SEQ ID NO: 37396 - DNA, 103 bp, Artificial Sequence
  Synthetic Polynucleotide
taatacgactcactatagggaagcacgaaaatgcctcaacccaatgtgtgaacagaggagacacacaatgggttgaggcaacctggcggcagcgcaaaagatg

SEQ ID NO: 37397 - DNA, 103 bp, Artificial Sequence
  Synthetic Polynucleotide
taatacgactcactatagggttgtcggccattgcaatattatagtacacgaacagaggagacgtgtaatgtaatattgcaacctggcggcagcgcaaaagatg

SEQ ID NO: 37398 - DNA, 103 bp, Artificial Sequence
  Synthetic Polynucleotide
taatacgactcactatagggaatctgatcgcacatcctaatgcctccacaaacagaggagatgtggaatgattaggatgaacctggcggcagcgcaaaagatg

SEQ ID NO: 37399 - DNA, 103 bp, Artificial Sequence
  Synthetic Polynucleotide
taatacgactcactatagggaatttggcgcacgctgctttgaccagacttaacagaggagaaagtctatgcaaagcagcaacctggcggcagcgcaaaagatg

SEQ ID NO: 37400 - DNA, 103 bp, Artificial Sequence
  Synthetic Polynucleotide
taatacgactcactatagggcttagtttccgaactgcgatgcggagtgcgaacagaggagacgcactatgcatcgcagtaacctggcggcagcgcaaaagatg

SEQ ID NO: 37401 - DNA, 103 bp, Artificial Sequence
  Synthetic Polynucleotide
taatacgactcactatagggcaaagtcccaatactccctggctctaacacaacagaggagagtgttaatgccagggagtaacctggcggcagcgcaaaagatg

SEQ ID NO: 37402 - DNA, 103 bp, Artificial Sequence
  Synthetic Polynucleotide
taatacgactcactatagggaacctacgataccagacctgattgacagtcaacagaggagagactgtatgtcaggtctgaacctggcggcagcgcaaaagatg

SEQ ID NO: 37403 - DNA, 103 bp, Artificial Sequence
  Synthetic Polynucleotide
taatacgactcactatagggtagaataataggtatgcagaatctgtggtcaacagaggagagaccacatgttctgcataaacctggcggcagcgcaaaagatg

SEQ ID NO: 37404 - DNA, 103 bp, Artificial Sequence
  Synthetic Polynucleotide
taatacgactcactatagggcaggcgggagttatgatgcgaggtagaggaaacagaggagatcctctatgtcgcatcataacctggcggcagcgcaaaagatg

SEQ ID NO: 37405 - DNA, 103 bp, Artificial Sequence
  Synthetic Polynucleotide
taatacgactcactatagggcctagtcaccgcatagggattcagatattaaacagaggagataatatatgaatccctataacctggcggcagcgcaaaagatg

SEQ ID NO: 37406 - DNA, 103 bp, Artificial Sequence
  Synthetic Polynucleotide
taatacgactcactataggggcgggttaccgcgagatcctggaggcgcaaaacagaggagattgcgcatgcaggatctcaacctggcggcagcgcaaaagatg

SEQ ID NO: 37407 - DNA, 103 bp, Artificial Sequence
  Synthetic Polynucleotide
taatacgactcactatagggcaaataggagcgtgccatatacatccggacaacagaggagagtccggatgtatatggcaaacctggcggcagcgcaaaagatg

SEQ ID NO: 37408 - DNA, 103 bp, Artificial Sequence
  Synthetic Polynucleotide
taatacgactcactatagggtctcctaatgcgattaccgctttactcccaaacagaggagatgggagatgagcggtaataacctggcggcagcgcaaaagatg

SEQ ID NO: 37409 - DNA, 103 bp, Artificial Sequence
  Synthetic Polynucleotide
taatacgactcactatagggaagcgccccacgtgtggcagtaacgccaaaaacagaggagatttggcatgactgccacaaacctggcggcagcgcaaaagatg

SEQ ID NO: 37410 - DNA, 103 bp, Artificial Sequence
  Synthetic Polynucleotide
taatacgactcactataggggcgaccaatttgttctcctgttgtagtcagaacagaggagactgactatgacaggagaaaacctggcggcagcgcaaaagatg

SEQ ID NO: 37411 - DNA, 103 bp, Artificial Sequence
  Synthetic Polynucleotide
taatacgactcactataggggtgtccatacggctacatcagagtcaggataacagaggagaatcctgatgctgatgtagaacctggcggcagcgcaaaagatg

SEQ ID NO: 37412 - DNA, 103 bp, Artificial Sequence
  Synthetic Polynucleotide
taatacgactcactatagggcccaagcggggccgaggaggactggacataaacagaggagatatgtcatgtcctcctcgaacctggcggcagcgcaaaagatg

SEQ ID NO: 37413 - DNA, 103 bp, Artificial Sequence
  Synthetic Polynucleotide
taatacgactcactatagggtcgtatactaggattggtccccggcaacgcaacagaggagagcgttgatggggaccaataacctggcggcagcgcaaaagatg

SEQ ID NO: 37414 - DNA, 103 bp, Artificial Sequence
  Synthetic Polynucleotide
taatacgactcactataggggttggttcatacaagcaagatcccttcgctaacagaggagaagcgaaatgatcttgcttaacctggcggcagcgcaaaagatg

SEQ ID NO: 37415 - DNA, 103 bp, Artificial Sequence
  Synthetic Polynucleotide
taatacgactcactatagggcgggtaaccgagtgccgtatgcctgccccaaacagaggagatggggcatgcatacggcaaacctggcggcagcgcaaaagatg

SEQ ID NO: 37416 - DNA, 103 bp, Artificial Sequence
  Synthetic Polynucleotide
taatacgactcactatagggcaagccgattttatcagctgacgccgaacaaacagaggagatgttcgatgtcagctgataacctggcggcagcgcaaaagatg

SEQ ID NO: 37417 - DNA, 103 bp, Artificial Sequence
  Synthetic Polynucleotide
taatacgactcactatagggtgcccctcattttcccccggacagtcgagcaacagaggagagctcgaatgtccgggggaaacctggcggcagcgcaaaagatg

SEQ ID NO: 37418 - DNA, 103 bp, Artificial Sequence
  Synthetic Polynucleotide
taatacgactcactataggggctgcgtttattgaagctctgcaccaagtcaacagaggagagacttgatgcagagcttcaacctggcggcagcgcaaaagatg

SEQ ID NO: 37419 - DNA, 103 bp, Artificial Sequence
  Synthetic Polynucleotide
taatacgactcactatagggatgcctgacctaaaataagcatccattgctaacagaggagaagcaatatgtgcttatttaacctggcggcagcgcaaaagatg

SEQ ID NO: 37420 - DNA, 103 bp, Artificial Sequence
  Synthetic Polynucleotide
taatacgactcactatagggggtcggcgtctgtgtccatcagaaagtaggaacagaggagacctactatgtgatggacaaacctggcggcagcgcaaaagatg

SEQ ID NO: 37421 - DNA, 103 bp, Artificial Sequence
  Synthetic Polynucleotide
taatacgactcactatagggggaataacctgtcatgttagatatcgggctaacagaggagaagcccgatgtctaacatgaacctggcggcagcgcaaaagatg

SEQ ID NO: 37422 - DNA, 103 bp, Artificial Sequence
  Synthetic Polynucleotide
taatacgactcactatagggaagcaggacgcgatgtcggccgatgaaaagaacagaggagacttttcatgggccgacataacctggcggcagcgcaaaagatg

SEQ ID NO: 37423 - DNA, 103 bp, Artificial Sequence
  Synthetic Polynucleotide
taatacgactcactatagggagcggtgagccctgaaccgcacccaggaggaacagaggagacctcctatgtgcggttcaaacctggcggcagcgcaaaagatg

SEQ ID NO: 37424 - DNA, 103 bp, Artificial Sequence
  Synthetic Polynucleotide
taatacgactcactatagggggatgcatagcagttagcaacataattgcaaacagaggagatgcaatatggttgctaacaacctggcggcagcgcaaaagatg

SEQ ID NO: 37425 - DNA, 103 bp, Artificial Sequence
  Synthetic Polynucleotide
taatacgactcactataggggagacgtgccatccgctcggttgcagcaagaacagaggagacttgctatgaccgagcggaacctggcggcagcgcaaaagatg

SEQ ID NO: 37426 - DNA, 103 bp, Artificial Sequence
  Synthetic Polynucleotide
taatacgactcactatagggctctttcttcttattataggaggtcctatcaacagaggagagataggatgtcctataataacctggcggcagcgcaaaagatg

SEQ ID NO: 37427 - DNA, 103 bp, Artificial Sequence
  Synthetic Polynucleotide
taatacgactcactatagggaacacccagactgtagatgtgactgccgacaacagaggagagtcggcatgcacatctacaacctggcggcagcgcaaaagatg

SEQ ID NO: 37428 - DNA, 103 bp, Artificial Sequence
  Synthetic Polynucleotide
taatacgactcactatagggatgattcccaggcgagccgccccgataacgaacagaggagacgttatatgggcggctcgaacctggcggcagcgcaaaagatg

SEQ ID NO: 37429 - DNA, 103 bp, Artificial Sequence
  Synthetic Polynucleotide
taatacgactcactatagggtgcgcactttcgcgcaaacatctggacggtaacagaggagaaccgtcatgatgtttgcgaacctggcggcagcgcaaaagatg

SEQ ID NO: 37430 - DNA, 103 bp, Artificial Sequence
  Synthetic Polynucleotide
taatacgactcactatagggtgcaccgcggtaattacgcaggccggtgtaaacagaggagatacaccatgctgcgtaataacctggcggcagcgcaaaagatg

SEQ ID NO: 37431 - DNA, 103 bp, Artificial Sequence
  Synthetic Polynucleotide
taatacgactcactatagggcgggtcctcgcaggccatggttctttcaccaacagaggagaggtgaaatgaccatggccaacctggcggcagcgcaaaagatg

SEQ ID NO: 37432 - DNA, 103 bp, Artificial Sequence
  Synthetic Polynucleotide
taatacgactcactatagggtgctcctcattagggctagccggataaagtaacagaggagaactttaatgggctagcccaacctggcggcagcgcaaaagatg

SEQ ID NO: 37433 - DNA, 103 bp, Artificial Sequence
  Synthetic Polynucleotide
taatacgactcactatagggttaatatttacctctaacatgctcggcatgaacagaggagacatgccatgcatgttagaaacctggcggcagcgcaaaagatg

SEQ ID NO: 37434 - DNA, 103 bp, Artificial Sequence
  Synthetic Polynucleotide
taatacgactcactatagggctattagccaaattatcacctcatgatgccaacagaggagaggcatcatgaggtgataaaacctggcggcagcgcaaaagatg

SEQ ID NO: 37435 - DNA, 103 bp, Artificial Sequence
  Synthetic Polynucleotide
taatacgactcactatagggcgcgtggaccgggcgtttcggaaaaagtaaaacagaggagattacttatgccgaaacgcaacctggcggcagcgcaaaagatg

SEQ ID NO: 37436 - DNA, 103 bp, Artificial Sequence
  Synthetic Polynucleotide
taatacgactcactatagggcgtcagcggtcctaccgtcttttacatggtaacagaggagaaccatgatgaagacggtaaacctggcggcagcgcaaaagatg

SEQ ID NO: 37437 - DNA, 103 bp, Artificial Sequence
  Synthetic Polynucleotide
taatacgactcactatagggcgtcgtgtctacctcatcgcttcgcaacgcaacagaggagagcgttgatgagcgatgagaacctggcggcagcgcaaaagatg

SEQ ID NO: 37438 - DNA, 103 bp, Artificial Sequence
  Synthetic Polynucleotide
taatacgactcactatagggatcccacaggattgtaggctggaaggcagaaacagaggagatctgccatgcagcctacaaacctggcggcagcgcaaaagatg

SEQ ID NO: 37439 - DNA, 103 bp, Artificial Sequence
  Synthetic Polynucleotide
taatacgactcactatagggatcaccaggtctgcagagccgcatcaccgaaacagaggagatcggtgatgcggctctgcaacctggcggcagcgcaaaagatg

SEQ ID NO: 37440 - DNA, 103 bp, Artificial Sequence
  Synthetic Polynucleotide
taatacgactcactatagggtttgaggggcggtgatcatcgggagaactcaacagaggagagagttcatgcgatgatcaaacctggcggcagcgcaaaagatg

SEQ ID NO: 37441 - DNA, 103 bp, Artificial Sequence
  Synthetic Polynucleotide
taatacgactcactatagggggtggtggttggtcatcaggaattagggttaacagaggagaaaccctatgtcctgatgaaacctggcggcagcgcaaaagatg

SEQ ID NO: 37442 - DNA, 103 bp, Artificial Sequence
  Synthetic Polynucleotide
taatacgactcactatagggacactctaagcgactgcaaactcaagttcgaacagaggagacgaactatggtttgcagtaacctggcggcagcgcaaaagatg

SEQ ID NO: 37443 - DNA, 103 bp, Artificial Sequence
  Synthetic Polynucleotide
taatacgactcactatagggaggaagcggtttccgcgggagccgttgtttaacagaggagaaaacaaatgctcccgcggaacctggcggcagcgcaaaagatg

SEQ ID NO: 37444 - DNA, 103 bp, Artificial Sequence
  Synthetic Polynucleotide
taatacgactcactatagggccgaggccgggcgcaaacgtacaattaaccaacagaggagaggttaaatgtacgtttgcaacctggcggcagcgcaaaagatg

SEQ ID NO: 37445 - DNA, 103 bp, Artificial Sequence
  Synthetic Polynucleotide
taatacgactcactatagggggatgactcgttccgccgatttttggccataacagaggagaatggccatgaatcggcggaacctggcggcagcgcaaaagatg

SEQ ID NO: 37446 - DNA, 103 bp, Artificial Sequence
  Synthetic Polynucleotide
taatacgactcactatagggtaggagacgcgcattgcgccgaccaagtaaaacagaggagattacttatgcggcgcaataacctggcggcagcgcaaaagatg

SEQ ID NO: 37447 - DNA, 103 bp, Artificial Sequence
  Synthetic Polynucleotide
taatacgactcactatagggctcgtacgacacacaatgagttcagatctaaacagaggagatagatcatgactcattgtaacctggcggcagcgcaaaagatg

SEQ ID NO: 37448 - DNA, 103 bp, Artificial Sequence
  Synthetic Polynucleotide
taatacgactcactatagggcttgcccctacttccccggacattcggattaacagaggagaaatccgatggtccggggaaacctggcggcagcgcaaaagatg

SEQ ID NO: 37449 - DNA, 103 bp, Artificial Sequence
  Synthetic Polynucleotide
taatacgactcactatagggccatggaaagggtgcaatttccatgtacctaacagaggagaaggtacatggaaattgcaaacctggcggcagcgcaaaagatg

SEQ ID NO: 37450 - DNA, 103 bp, Artificial Sequence
  Synthetic Polynucleotide
taatacgactcactataggggtcaccgtcacctgacattgattgtcaaggaacagaggagaccttgaatgtcaatgtcaaacctggcggcagcgcaaaagatg

SEQ ID NO: 37451 - DNA, 103 bp, Artificial Sequence
  Synthetic Polynucleotide
taatacgactcactatagggggaagagctctcaatttctcccctgctgtcaacagaggagagacagcatgggagaaattaacctggcggcagcgcaaaagatg

SEQ ID NO: 37452 - DNA, 103 bp, Artificial Sequence
  Synthetic Polynucleotide
taatacgactcactatagggaacataacactcgactcgtccattcccagcaacagaggagagctgggatgggacgagtcaacctggcggcagcgcaaaagatg

SEQ ID NO: 37453 - DNA, 103 bp, Artificial Sequence
  Synthetic Polynucleotide
taatacgactcactatagggcgaatcatcagcggaacgggtttaaaagttaacagaggagaaactttatgacccgttccaacctggcggcagcgcaaaagatg

SEQ ID NO: 37454 - DNA, 103 bp, Artificial Sequence
  Synthetic Polynucleotide
taatacgactcactatagggggccgggcatgggctgggactatgacggggaacagaggagaccccgtatgagtcccagcaacctggcggcagcgcaaaagatg

SEQ ID NO: 37455 - DNA, 103 bp, Artificial Sequence
  Synthetic Polynucleotide
taatacgactcactatagggaacaaggaaggcgtccggtagctgtgacaaaacagaggagattgtcaatgctaccggacaacctggcggcagcgcaaaagatg

SEQ ID NO: 37456 - DNA, 103 bp, Artificial Sequence
  Synthetic Polynucleotide
taatacgactcactatagggcatgggtcgcgagttcaaacgagtaagaagaacagaggagacttcttatgcgtttgaacaacctggcggcagcgcaaaagatg

SEQ ID NO: 37457 - DNA, 103 bp, Artificial Sequence
  Synthetic Polynucleotide
taatacgactcactatagggacaattctaactaggtgtcaggaacccggtaacagaggagaaccgggatgctgacacctaacctggcggcagcgcaaaagatg

SEQ ID NO: 37458 - DNA, 103 bp, Artificial Sequence
  Synthetic Polynucleotide
taatacgactcactatagggaccgacgattgaacaatgcgaggtgatttcaacagaggagagaaatcatgtcgcattgtaacctggcggcagcgcaaaagatg

SEQ ID NO: 37459 - DNA, 103 bp, Artificial Sequence
  Synthetic Polynucleotide
taatacgactcactatagggcacgggcgtcttaaatgcgtcgattcacagaacagaggagactgtgaatggacgcatttaacctggcggcagcgcaaaagatg

SEQ ID NO: 37460 - DNA, 103 bp, Artificial Sequence
  Synthetic Polynucleotide
taatacgactcactatagggccttgaaggccgcgggggagtctacccgttaacagaggagaaacgggatgactcccccgaacctggcggcagcgcaaaagatg

SEQ ID NO: 37461 - DNA, 103 bp, Artificial Sequence
  Synthetic Polynucleotide
taatacgactcactatagggcggggttggcatttaagtctccagtgcaacaacagaggagagttgcaatggagacttaaaacctggcggcagcgcaaaagatg

SEQ ID NO: 37462 - DNA, 103 bp, Artificial Sequence
  Synthetic Polynucleotide
taatacgactcactataggggacaaggagacggcccaagtttccactcgaaacagaggagatcgagtatgaacttgggcaacctggcggcagcgcaaaagatg

SEQ ID NO: 37463 - DNA, 103 bp, Artificial Sequence
  Synthetic Polynucleotide
taatacgactcactatagggcaatccagttcagctcgcacgggtgataggaacagaggagacctatcatgcgtgcgagcaacctggcggcagcgcaaaagatg

SEQ ID NO: 37464 - DNA, 103 bp, Artificial Sequence
  Synthetic Polynucleotide
taatacgactcactatagggcaaagggccgttcgggccgattgcatctgtaacagaggagaacagatatgatcggcccgaacctggcggcagcgcaaaagatg

SEQ ID NO: 37465 - DNA, 103 bp, Artificial Sequence
  Synthetic Polynucleotide
taatacgactcactataggggatgccaggaagttagactcacattcttgtaacagaggagaacaagaatgtgagtctaaaacctggcggcagcgcaaaagatg

SEQ ID NO: 37466 - DNA, 103 bp, Artificial Sequence
  Synthetic Polynucleotide
taatacgactcactatagggtatggagggaatcggtgctaacaattctagaacagaggagactagaaatgttagcaccgaacctggcggcagcgcaaaagatg

SEQ ID NO: 37467 - DNA, 103 bp, Artificial Sequence
  Synthetic Polynucleotide
taatacgactcactatagggggcctagacgtcagcgtcactacaagaaggaacagaggagaccttctatgagtgacgctaacctggcggcagcgcaaaagatg

SEQ ID NO: 37468 - DNA, 103 bp, Artificial Sequence
  Synthetic Polynucleotide
taatacgactcactatagggctgtgtgggacccaccctaatcagtgtcttaacagaggagaaagacaatgattagggtgaacctggcggcagcgcaaaagatg

SEQ ID NO: 37469 - DNA, 103 bp, Artificial Sequence
  Synthetic Polynucleotide
taatacgactcactatagggcgttttgcctcacatggggggataaccataaacagaggagatatggtatgccccccatgaacctggcggcagcgcaaaagatg

SEQ ID NO: 37470 - DNA, 103 bp, Artificial Sequence
  Synthetic Polynucleotide
taatacgactcactataggggggagcaagaccgtgtcctgaggtaaacgaaacagaggagatcgtttatgtcaggacacaacctggcggcagcgcaaaagatg

SEQ ID NO: 37471 - DNA, 103 bp, Artificial Sequence
  Synthetic Polynucleotide
taatacgactcactatagggcgttttgtgtccggattaacgtacattttgaacagaggagacaaaatatgcgttaatccaacctggcggcagcgcaaaagatg

SEQ ID NO: 37472 - DNA, 103 bp, Artificial Sequence
  Synthetic Polynucleotide
taatacgactcactataggggaccctaataggtcacaagaccggcgcttcaacagaggagagaagcgatggtcttgtgaaacctggcggcagcgcaaaagatg

SEQ ID NO: 37473 - DNA, 103 bp, Artificial Sequence
  Synthetic Polynucleotide
taatacgactcactatagggccgtgatgtctatgcggcgcacctggagagaacagaggagactctccatgtgcgccgcaaacctggcggcagcgcaaaagatg

SEQ ID NO: 37474 - DNA, 103 bp, Artificial Sequence
  Synthetic Polynucleotide
taatacgactcactatagggtgctggtgggctgctccgcttgttgttcaaaacagaggagattgaacatgaagcggagcaacctggcggcagcgcaaaagatg

SEQ ID NO: 37475 - DNA, 103 bp, Artificial Sequence
  Synthetic Polynucleotide
taatacgactcactatagggaattacctagcctcccgttcaccggcataaaacagaggagattatgcatgtgaacgggaaacctggcggcagcgcaaaagatg

SEQ ID NO: 37476 - DNA, 103 bp, Artificial Sequence
  Synthetic Polynucleotide
taatacgactcactatagggtagacgaatgaagactcccccaataccagtaacagaggagaactggtatggggggagtcaacctggcggcagcgcaaaagatg

SEQ ID NO: 37477 - DNA, 103 bp, Artificial Sequence
  Synthetic Polynucleotide
taatacgactcactataggggcagagttttccgtagtaaggtttataccgaacagaggagacggtatatgccttactacaacctggcggcagcgcaaaagatg

SEQ ID NO: 37478 - DNA, 103 bp, Artificial Sequence
  Synthetic Polynucleotide
taatacgactcactatagggaggcgcacagccccgtccccttgaaggcacaacagaggagagtgcctatgaggggacggaacctggcggcagcgcaaaagatg

SEQ ID NO: 37479 - DNA, 103 bp, Artificial Sequence
  Synthetic Polynucleotide
taatacgactcactataggggggaccggtaatgacgctttagtttaagcaaacagaggagatgcttaatgtaaagcgtcaacctggcggcagcgcaaaagatg

SEQ ID NO: 37480 - DNA, 103 bp, Artificial Sequence
  Synthetic Polynucleotide
taatacgactcactatagggactgtagggagttagctgatggtgagcatgaacagaggagacatgctatgcatcagctaaacctggcggcagcgcaaaagatg

SEQ ID NO: 37481 - DNA, 103 bp, Artificial Sequence
  Synthetic Polynucleotide
taatacgactcactatagggagtgggttcaatatgggttgctcgcgccttaacagaggagaaaggcgatggcaacccataacctggcggcagcgcaaaagatg

SEQ ID NO: 37482 - DNA, 103 bp, Artificial Sequence
  Synthetic Polynucleotide
taatacgactcactatagggaccggggggtaatccggctctgaatccctcaacagaggagagagggaatgagagccggaaacctggcggcagcgcaaaagatg

SEQ ID NO: 37483 - DNA, 103 bp, Artificial Sequence
  Synthetic Polynucleotide
taatacgactcactatagggacgccgtggagatagaacagcatgggtcgtaacagaggagaacgaccatggctgttctaaacctggcggcagcgcaaaagatg

SEQ ID NO: 37484 - DNA, 103 bp, Artificial Sequence
  Synthetic Polynucleotide
taatacgactcactataggggcgagagcacccaaggggccgcagaccaacaacagaggagagttggtatgcggccccttaacctggcggcagcgcaaaagatg

SEQ ID NO: 37485 - DNA, 103 bp, Artificial Sequence
  Synthetic Polynucleotide
taatacgactcactatagggaagctgacaggcatatggatgaagccatgtaacagaggagaacatggatgcatccatataacctggcggcagcgcaaaagatg

SEQ ID NO: 37486 - DNA, 103 bp, Artificial Sequence
  Synthetic Polynucleotide
taatacgactcactatagggtcatcgcgggttatgttacgaaaacagagcaacagaggagagctctgatgtcgtaacataacctggcggcagcgcaaaagatg

SEQ ID NO: 37487 - DNA, 103 bp, Artificial Sequence
  Synthetic Polynucleotide
taatacgactcactatagggctcctaagccgtgatcagctgggaggtccaaacagaggagatggaccatgcagctgatcaacctggcggcagcgcaaaagatg

SEQ ID NO: 37488 - DNA, 103 bp, Artificial Sequence
  Synthetic Polynucleotide
taatacgactcactatagggctggtaatgtgtccttatgcttacttccgcaacagaggagagcggaaatgagcataaggaacctggcggcagcgcaaaagatg

SEQ ID NO: 37489 - DNA, 103 bp, Artificial Sequence
  Synthetic Polynucleotide
taatacgactcactatagggtctgtggtcgcctgtactggtgctcttctaaacagaggagatagaagatgaccagtacaaacctggcggcagcgcaaaagatg

SEQ ID NO: 37490 - DNA, 103 bp, Artificial Sequence
  Synthetic Polynucleotide
taatacgactcactatagggacttgacatggaacccaccgtcgggtacctaacagaggagaaggtacatgacggtgggtaacctggcggcagcgcaaaagatg

SEQ ID NO: 37491 - DNA, 103 bp, Artificial Sequence
  Synthetic Polynucleotide
taatacgactcactatagggagaccttgtgctctaaatactaatcttcggaacagaggagaccgaagatgagtatttagaacctggcggcagcgcaaaagatg

SEQ ID NO: 37492 - DNA, 103 bp, Artificial Sequence
  Synthetic Polynucleotide
taatacgactcactatagggaccgtaaatggaggtcacgtcaagctataaaacagaggagattatagatggacgtgaccaacctggcggcagcgcaaaagatg

SEQ ID NO: 37493 - DNA, 103 bp, Artificial Sequence
  Synthetic Polynucleotide
taatacgactcactatagggttatcatgccagccgctacggaccgggcccaacagaggagagggcccatgccgtagcggaacctggcggcagcgcaaaagatg

SEQ ID NO: 37494 - DNA, 103 bp, Artificial Sequence
  Synthetic Polynucleotide
taatacgactcactatagggccttcgttagatcgggtgaagtaaagagtgaacagaggagacactctatgcttcacccgaacctggcggcagcgcaaaagatg

SEQ ID NO: 37495 - DNA, 103 bp, Artificial Sequence
  Synthetic Polynucleotide
taatacgactcactatagggatcactggaggcgcgagttttcaaggatccaacagaggagaggatccatgaaaactcgcaacctggcggcagcgcaaaagatg

SEQ ID NO: 37496 - DNA, 103 bp, Artificial Sequence
  Synthetic Polynucleotide
taatacgactcactatagggatactaggagtctttcccacccgtcgaggtaacagaggagaacctcgatgggtgggaaaaacctggcggcagcgcaaaagatg

SEQ ID NO: 37497 - DNA, 103 bp, Artificial Sequence
  Synthetic Polynucleotide
taatacgactcactataggggtctgaccctgccataatgcgagtaggggaaacagaggagatcccctatgcgcattatgaacctggcggcagcgcaaaagatg

SEQ ID NO: 37498 - DNA, 103 bp, Artificial Sequence
  Synthetic Polynucleotide
taatacgactcactatagggtggcactgcgccccctgaccctaaaagcggaacagaggagaccgcttatggggtcagggaacctggcggcagcgcaaaagatg

SEQ ID NO: 37499 - DNA, 103 bp, Artificial Sequence
  Synthetic Polynucleotide
taatacgactcactatagggtcacggtcaccttgccatggttttggttggaacagaggagaccaaccatgaccatggcaaacctggcggcagcgcaaaagatg

SEQ ID NO: 37500 - DNA, 103 bp, Artificial Sequence
  Synthetic Polynucleotide
taatacgactcactatagggtctccgtccatcattggtgggacaaaatagaacagaggagactatttatgcccaccaataacctggcggcagcgcaaaagatg

SEQ ID NO: 37501 - DNA, 103 bp, Artificial Sequence
  Synthetic Polynucleotide
taatacgactcactataggggactaggtattcaatgaaaatatgcgggccaacagaggagaggcccgatgattttcattaacctggcggcagcgcaaaagatg

SEQ ID NO: 37502 - DNA, 103 bp, Artificial Sequence
  Synthetic Polynucleotide
taatacgactcactatagggattacgttaatagcgcgagattgttccaacaacagaggagagttggaatgatctcgcgcaacctggcggcagcgcaaaagatg

SEQ ID NO: 37503 - DNA, 103 bp, Artificial Sequence
  Synthetic Polynucleotide
taatacgactcactatagggtaaatgaccacgttatttaaaacgctcctaaacagaggagataggagatgtttaaataaaacctggcggcagcgcaaaagatg

SEQ ID NO: 37504 - DNA, 103 bp, Artificial Sequence
  Synthetic Polynucleotide
taatacgactcactataggggaccaccctcgcgaaggaaagaccgtacggaacagaggagaccgtacatgctttccttcaacctggcggcagcgcaaaagatg

SEQ ID NO: 37505 - DNA, 103 bp, Artificial Sequence
  Synthetic Polynucleotide
taatacgactcactatagggaagcgtttgtggtttaccttctgttctaataacagaggagaattagaatggaaggtaaaaacctggcggcagcgcaaaagatg

SEQ ID NO: 37506 - DNA, 103 bp, Artificial Sequence
  Synthetic Polynucleotide
taatacgactcactatagggggggatccatgacagacgggctagacgtgcaacagaggagagcacgtatggcccgtctgaacctggcggcagcgcaaaagatg

SEQ ID NO: 37507 - DNA, 103 bp, Artificial Sequence
  Synthetic Polynucleotide
taatacgactcactatagggacaccagcgtatcaccgcgctgtagcagttaacagaggagaaactgcatgagcgcggtgaacctggcggcagcgcaaaagatg

SEQ ID NO: 37508 - DNA, 103 bp, Artificial Sequence
  Synthetic Polynucleotide
taatacgactcactatagggaaattctccccagattgtcacccattcgataacagaggagaatcgaaatggtgacaatcaacctggcggcagcgcaaaagatg

SEQ ID NO: 37509 - DNA, 103 bp, Artificial Sequence
  Synthetic Polynucleotide
taatacgactcactatagggaaatagtttgaatcgccagcgcataatcaaaacagaggagattgattatgcgctggcgaaacctggcggcagcgcaaaagatg

SEQ ID NO: 37510 - DNA, 103 bp, Artificial Sequence
  Synthetic Polynucleotide
taatacgactcactataggggtcagcctagggcaccactagagggttggtaacagaggagaaccaacatgctagtggtgaacctggcggcagcgcaaaagatg

SEQ ID NO: 37511 - DNA, 103 bp, Artificial Sequence
  Synthetic Polynucleotide
taatacgactcactatagggaaataaattacctgtgcctggacaagactcaacagaggagagagtctatgccaggcacaaacctggcggcagcgcaaaagatg

SEQ ID NO: 37512 - DNA, 103 bp, Artificial Sequence
  Synthetic Polynucleotide
taatacgactcactatagggttttaaagcgacttattcacccaaccggttaacagaggagaaaccggatgggtgaataaaacctggcggcagcgcaaaagatg

SEQ ID NO: 37513 - DNA, 103 bp, Artificial Sequence
  Synthetic Polynucleotide
taatacgactcactatagggccgtagacattttgtcatgagcccagggttaacagaggagaaaccctatgctcatgacaaacctggcggcagcgcaaaagatg

SEQ ID NO: 37514 - DNA, 103 bp, Artificial Sequence
  Synthetic Polynucleotide
taatacgactcactataggggtttgaggtgacacgcagagacctgccgaaaacagaggagattcggcatgtctctgcgtaacctggcggcagcgcaaaagatg

SEQ ID NO: 37515 - DNA, 103 bp, Artificial Sequence
  Synthetic Polynucleotide
taatacgactcactataggggagtccgcatcccagcgggagcagttccccaacagaggagaggggaaatgctcccgctgaacctggcggcagcgcaaaagatg

SEQ ID NO: 37516 - DNA, 103 bp, Artificial Sequence
  Synthetic Polynucleotide
taatacgactcactatagggcggggtcctgggtctgaacgcgtcctttgaaacagaggagatcaaagatggcgttcagaaacctggcggcagcgcaaaagatg

SEQ ID NO: 37517 - DNA, 103 bp, Artificial Sequence
  Synthetic Polynucleotide
taatacgactcactatagggggtatactagcgcttatagaagctgactttaacagaggagaaaagtcatgttctataagaacctggcggcagcgcaaaagatg

SEQ ID NO: 37518 - DNA, 103 bp, Artificial Sequence
  Synthetic Polynucleotide
taatacgactcactatagggagaaaccttccccgatggagtacatacggaaacagaggagatccgtaatgactccatcgaacctggcggcagcgcaaaagatg

SEQ ID NO: 37519 - DNA, 103 bp, Artificial Sequence
  Synthetic Polynucleotide
taatacgactcactatagggaaaataatttaataggtaaaaataagaaagaacagaggagactttctatgttttacctaaacctggcggcagcgcaaaagatg

SEQ ID NO: 37520 - DNA, 103 bp, Artificial Sequence
  Synthetic Polynucleotide
taatacgactcactatagggctcttcgaagatgttcggtcgatgttgccgaacagaggagacggcaaatgcgaccgaacaacctggcggcagcgcaaaagatg

SEQ ID NO: 37521 - DNA, 103 bp, Artificial Sequence
  Synthetic Polynucleotide
taatacgactcactataggggtgatgtgaccgattgcacagcgatacgctaacagaggagaagcgtaatgctgtgcaataacctggcggcagcgcaaaagatg

SEQ ID NO: 37522 - DNA, 103 bp, Artificial Sequence
  Synthetic Polynucleotide
taatacgactcactatagggtttagcccgatcatgtacttggtcacatccaacagaggagaggatgtatgcaagtacataacctggcggcagcgcaaaagatg

SEQ ID NO: 37523 - DNA, 103 bp, Artificial Sequence
  Synthetic Polynucleotide
taatacgactcactataggggctaaacctaagccatgttgaacggacgcaaacagaggagatgcgtcatgtcaacatggaacctggcggcagcgcaaaagatg

SEQ ID NO: 37524 - DNA, 103 bp, Artificial Sequence
  Synthetic Polynucleotide
taatacgactcactatagggagtctggcgtacagaaccattcatgaggcaaacagaggagatgcctcatgaatggttctaacctggcggcagcgcaaaagatg

SEQ ID NO: 37525 - DNA, 103 bp, Artificial Sequence
  Synthetic Polynucleotide
taatacgactcactatagggcattcaaacaccgccctatccacacgaccgaacagaggagacggtcgatgggatagggcaacctggcggcagcgcaaaagatg

SEQ ID NO: 37526 - DNA, 103 bp, Artificial Sequence
  Synthetic Polynucleotide
taatacgactcactatagggcactgatcgcagcgactagcagccttcgtaaacagaggagatacgaaatgtgctagtcgaacctggcggcagcgcaaaagatg

SEQ ID NO: 37527 - DNA, 103 bp, Artificial Sequence
  Synthetic Polynucleotide
taatacgactcactatagggactacgtgagttgaagagaaacatgcaggcaacagaggagagcctgcatgtttctcttcaacctggcggcagcgcaaaagatg

SEQ ID NO: 37528 - DNA, 103 bp, Artificial Sequence
  Synthetic Polynucleotide
taatacgactcactatagggtggcccctatatgaccgtcagattttcatcaacagaggagagatgaaatgctgacggtcaacctggcggcagcgcaaaagatg

SEQ ID NO: 37529 - DNA, 103 bp, Artificial Sequence
  Synthetic Polynucleotide
taatacgactcactataggggaggccataaccctgtctgttcatgactgtaacagaggagaacagtcatgaacagacagaacctggcggcagcgcaaaagatg

SEQ ID NO: 37530 - DNA, 103 bp, Artificial Sequence
  Synthetic Polynucleotide
taatacgactcactatagggactgagcgtacatgacttcccctagccctcaacagaggagagagggcatggggaagtcaaacctggcggcagcgcaaaagatg

SEQ ID NO: 37531 - DNA, 103 bp, Artificial Sequence
  Synthetic Polynucleotide
taatacgactcactatagggaggctcccgtgtttgctgaatgccctagacaacagaggagagtctagatgattcagcaaaacctggcggcagcgcaaaagatg

SEQ ID NO: 37532 - DNA, 103 bp, Artificial Sequence
  Synthetic Polynucleotide
taatacgactcactataggggtccatcttacagagggtttttcgaggcgcaacagaggagagcgcctatgaaaaccctcaacctggcggcagcgcaaaagatg

SEQ ID NO: 37533 - DNA, 103 bp, Artificial Sequence
  Synthetic Polynucleotide
taatacgactcactatagggagcagtacctaggtaggagaactttcaaagaacagaggagactttgaatgttctcctacaacctggcggcagcgcaaaagatg

SEQ ID NO: 37534 - DNA, 103 bp, Artificial Sequence
  Synthetic Polynucleotide
taatacgactcactataggggcggcccacactgggcatagccgaataaggaacagaggagaccttatatggctatgcccaacctggcggcagcgcaaaagatg

SEQ ID NO: 37535 - DNA, 103 bp, Artificial Sequence
  Synthetic Polynucleotide
taatacgactcactatagggtattacgccgtacgggtgggtaccgagatgaacagaggagacatctcatgacccacccgaacctggcggcagcgcaaaagatg

SEQ ID NO: 37536 - DNA, 103 bp, Artificial Sequence
  Synthetic Polynucleotide
taatacgactcactatagggaccggcattagcatgatgagacgctggattaacagaggagaaatccaatgtctcatcataacctggcggcagcgcaaaagatg

SEQ ID NO: 37537 - DNA, 103 bp, Artificial Sequence
  Synthetic Polynucleotide
taatacgactcactatagggtccactataaggagcaccgagcgcgcgcaaaacagaggagattgcgcatgctcggtgctaacctggcggcagcgcaaaagatg

SEQ ID NO: 37538 - DNA, 103 bp, Artificial Sequence
  Synthetic Polynucleotide
taatacgactcactatagggccaaatgctccataggcctcttcgtctgcgaacagaggagacgcagaatgagaggcctaaacctggcggcagcgcaaaagatg

SEQ ID NO: 37539 - DNA, 103 bp, Artificial Sequence
  Synthetic Polynucleotide
taatacgactcactatagggagccgaagttaatggactcgacagtaacagaacagaggagactgttaatgtcgagtccaaacctggcggcagcgcaaaagatg

SEQ ID NO: 37540 - DNA, 103 bp, Artificial Sequence
  Synthetic Polynucleotide
taatacgactcactatagggggaggaactagagagctgcacagccgaatgaacagaggagacattcgatggtgcagctcaacctggcggcagcgcaaaagatg

SEQ ID NO: 37541 - DNA, 103 bp, Artificial Sequence
  Synthetic Polynucleotide
taatacgactcactatagggcaatgatgcgacctttgggcaatttaatgcaacagaggagagcattaatgtgcccaaagaacctggcggcagcgcaaaagatg

SEQ ID NO: 37542 - DNA, 103 bp, Artificial Sequence
  Synthetic Polynucleotide
taatacgactcactatagggtcaccttgggaaatgatactgtatagttttaacagaggagaaaaactatgcagtatcataacctggcggcagcgcaaaagatg

SEQ ID NO: 37543 - DNA, 103 bp, Artificial Sequence
  Synthetic Polynucleotide
taatacgactcactatagggtgacttacacaccgggacatagtcgtacgcaacagaggagagcgtacatgtatgtcccgaacctggcggcagcgcaaaagatg

SEQ ID NO: 37544 - DNA, 103 bp, Artificial Sequence
  Synthetic Polynucleotide
taatacgactcactatagggggtacttgcgccgctcgttttgatgcggcaaacagaggagatgccgcatgaaaacgagcaacctggcggcagcgcaaaagatg

SEQ ID NO: 37545 - DNA, 103 bp, Artificial Sequence
  Synthetic Polynucleotide
taatacgactcactatagggggtattggcccggttgatcatacgaggcataacagaggagaatgcctatgatgatcaacaacctggcggcagcgcaaaagatg

SEQ ID NO: 37546 - DNA, 103 bp, Artificial Sequence
  Synthetic Polynucleotide
taatacgactcactatagggaatcggtctacctgagttgatgttcaacgcaacagaggagagcgttgatgatcaactcaaacctggcggcagcgcaaaagatg

SEQ ID NO: 37547 - DNA, 103 bp, Artificial Sequence
  Synthetic Polynucleotide
taatacgactcactataggggttctgaggcgctggaaatatataaattgaaacagaggagatcaattatgatatttccaaacctggcggcagcgcaaaagatg

SEQ ID NO: 37548 - DNA, 103 bp, Artificial Sequence
  Synthetic Polynucleotide
taatacgactcactatagggaggacacctgatgattctagagtggccattaacagaggagaaatggcatgtctagaatcaacctggcggcagcgcaaaagatg

SEQ ID NO: 37549 - DNA, 103 bp, Artificial Sequence
  Synthetic Polynucleotide
taatacgactcactataggggcttaagccgccccggtcgaacgattagataacagaggagaatctaaatgttcgaccggaacctggcggcagcgcaaaagatg

SEQ ID NO: 37550 - DNA, 103 bp, Artificial Sequence
  Synthetic Polynucleotide
taatacgactcactatagggagcccttgggaagcatggtaatgacggtctaacagaggagaagaccgatgttaccatgcaacctggcggcagcgcaaaagatg

SEQ ID NO: 37551 - DNA, 103 bp, Artificial Sequence
  Synthetic Polynucleotide
taatacgactcactatagggcgccggccctgcatcaccacgccgaggtaaaacagaggagattacctatgcgtggtgataacctggcggcagcgcaaaagatg

SEQ ID NO: 37552 - DNA, 103 bp, Artificial Sequence
  Synthetic Polynucleotide
taatacgactcactataggggatgcaggttagctgaatattggtcacattaacagaggagaaatgtgatgaatattcagaacctggcggcagcgcaaaagatg

SEQ ID NO: 37553 - DNA, 103 bp, Artificial Sequence
  Synthetic Polynucleotide
taatacgactcactataggggtcagcagattgatttcctagtgggacgagaacagaggagactcgtcatgctaggaaataacctggcggcagcgcaaaagatg

SEQ ID NO: 37554 - DNA, 103 bp, Artificial Sequence
  Synthetic Polynucleotide
taatacgactcactataggggaattagattagcgcctttaatcgtattacaacagaggagagtaataatgttaaaggcgaacctggcggcagcgcaaaagatg

SEQ ID NO: 37555 - DNA, 103 bp, Artificial Sequence
  Synthetic Polynucleotide
taatacgactcactatagggccaatgcgtcatcgaagcccgtccctggtaaacagaggagataccagatgcgggcttcgaacctggcggcagcgcaaaagatg

SEQ ID NO: 37556 - DNA, 103 bp, Artificial Sequence
  Synthetic Polynucleotide
taatacgactcactataggggggtagggcttttcagcagtccgcgggtttaacagaggagaaaacccatggactgctgaaacctggcggcagcgcaaaagatg

SEQ ID NO: 37557 - DNA, 103 bp, Artificial Sequence
  Synthetic Polynucleotide
taatacgactcactataggggaatggtggactcatagactggcgggcatgaacagaggagacatgccatgcagtctatgaacctggcggcagcgcaaaagatg

SEQ ID NO: 37558 - DNA, 103 bp, Artificial Sequence
  Synthetic Polynucleotide
taatacgactcactatagggcttgaatgtgagcgacggttgaatatagtcaacagaggagagactatatgcaaccgtcgaacctggcggcagcgcaaaagatg

SEQ ID NO: 37559 - DNA, 103 bp, Artificial Sequence
  Synthetic Polynucleotide
taatacgactcactatagggcgggcagaacgatgcccatatacagctgcaaacagaggagatgcagcatgatatgggcaaacctggcggcagcgcaaaagatg

SEQ ID NO: 37560 - DNA, 103 bp, Artificial Sequence
  Synthetic Polynucleotide
taatacgactcactatagggtacagaagttgtaacgcgtcacccttcaaaaacagaggagatttgaaatgtgacgcgttaacctggcggcagcgcaaaagatg

SEQ ID NO: 37561 - DNA, 103 bp, Artificial Sequence
  Synthetic Polynucleotide
taatacgactcactatagggttcaactgacatcgagcccgtccgaccctgaacagaggagacagggtatgacgggctcgaacctggcggcagcgcaaaagatg

SEQ ID NO: 37562 - DNA, 103 bp, Artificial Sequence
  Synthetic Polynucleotide
taatacgactcactatagggcgcctgcctgatcatcactatcgttaggcaaacagaggagatgcctaatgatagtgatgaacctggcggcagcgcaaaagatg

SEQ ID NO: 37563 - DNA, 103 bp, Artificial Sequence
  Synthetic Polynucleotide
taatacgactcactatagggcactaacgatcccggacatacttgtgcctgaacagaggagacaggcaatggtatgtccgaacctggcggcagcgcaaaagatg

SEQ ID NO: 37564 - DNA, 103 bp, Artificial Sequence
  Synthetic Polynucleotide
taatacgactcactataggggtcacttctgcccgcctttgtttagttaacaacagaggagagttaacatgacaaaggcgaacctggcggcagcgcaaaagatg

SEQ ID NO: 37565 - DNA, 103 bp, Artificial Sequence
  Synthetic Polynucleotide
taatacgactcactatagggacggcgggcaagaagcttcccgtcgtcatgaacagaggagacatgacatggggaagcttaacctggcggcagcgcaaaagatg

SEQ ID NO: 37566 - DNA, 103 bp, Artificial Sequence
  Synthetic Polynucleotide
taatacgactcactatagggagcttccgaatgttcctccctcgtttgacaaacagaggagatgtcaaatgagggaggaaaacctggcggcagcgcaaaagatg

SEQ ID NO: 37567 - DNA, 103 bp, Artificial Sequence
  Synthetic Polynucleotide
taatacgactcactatagggtaactcgatgagatatgctagttatcctgcaacagaggagagcaggaatgctagcatataacctggcggcagcgcaaaagatg

SEQ ID NO: 37568 - DNA, 103 bp, Artificial Sequence
  Synthetic Polynucleotide
taatacgactcactatagggggttgcgagtcgcgatccaagggatatcccaacagaggagagggataatgcttggatcgaacctggcggcagcgcaaaagatg

SEQ ID NO: 37569 - DNA, 103 bp, Artificial Sequence
  Synthetic Polynucleotide
taatacgactcactataggggcttcatgtttacgaattgataacctaggcaacagaggagagcctagatgatcaattcgaacctggcggcagcgcaaaagatg

SEQ ID NO: 37570 - DNA, 103 bp, Artificial Sequence
  Synthetic Polynucleotide
taatacgactcactatagggtcggaactttgtttttgtcgttctatgcaaaacagaggagattgcatatgacgacaaaaaacctggcggcagcgcaaaagatg

SEQ ID NO: 37571 - DNA, 103 bp, Artificial Sequence
  Synthetic Polynucleotide
taatacgactcactatagggaaggattggggtgctgggttatgcggttaaaacagaggagattaaccatgtaacccagcaacctggcggcagcgcaaaagatg

SEQ ID NO: 37572 - DNA, 103 bp, Artificial Sequence
  Synthetic Polynucleotide
taatacgactcactataggggagtcggactttctttggatgcttcttagcaacagaggagagctaagatgcatccaaagaacctggcggcagcgcaaaagatg

SEQ ID NO: 37573 - DNA, 103 bp, Artificial Sequence
  Synthetic Polynucleotide
taatacgactcactataggggagggttgtatattaacggacgtcacccagaacagaggagactgggtatggtccgttaaaacctggcggcagcgcaaaagatg

SEQ ID NO: 37574 - DNA, 103 bp, Artificial Sequence
  Synthetic Polynucleotide
taatacgactcactataggggccccacattggcgatatggctaatttgccaacagaggagaggcaaaatggccatatcgaacctggcggcagcgcaaaagatg

SEQ ID NO: 37575 - DNA, 103 bp, Artificial Sequence
  Synthetic Polynucleotide
taatacgactcactatagggcacatgactatcggcaggcaaaattaatctaacagaggagaagattaatgttgcctgccaacctggcggcagcgcaaaagatg

SEQ ID NO: 37576 - DNA, 103 bp, Artificial Sequence
  Synthetic Polynucleotide
taatacgactcactatagggggcttcttctttgctgcttcaacgacttttaacagaggagaaaaagtatgtgaagcagcaacctggcggcagcgcaaaagatg

SEQ ID NO: 37577 - DNA, 103 bp, Artificial Sequence
  Synthetic Polynucleotide
taatacgactcactatagggagattcgcaccagccggattggcctcccataacagaggagaatgggaatgcaatccggcaacctggcggcagcgcaaaagatg

SEQ ID NO: 37578 - DNA, 103 bp, Artificial Sequence
  Synthetic Polynucleotide
taatacgactcactataggggagctccaataacaaactggcgatgaccataacagaggagaatggtcatggccagtttgaacctggcggcagcgcaaaagatg

SEQ ID NO: 37579 - DNA, 103 bp, Artificial Sequence
  Synthetic Polynucleotide
taatacgactcactatagggtttgctacaggtggtagcacggtgcgaaagaacagaggagactttcgatgcgtgctaccaacctggcggcagcgcaaaagatg

SEQ ID NO: 37580 - DNA, 103 bp, Artificial Sequence
  Synthetic Polynucleotide
taatacgactcactatagggtcaatacggtacttcagacgttgaatccttaacagaggagaaaggatatgacgtctgaaaacctggcggcagcgcaaaagatg

SEQ ID NO: 37581 - DNA, 103 bp, Artificial Sequence
  Synthetic Polynucleotide
taatacgactcactatagggtcgtctccgagggtaacgacggggatcgcgaacagaggagacgcgatatgcgtcgttacaacctggcggcagcgcaaaagatg

SEQ ID NO: 37582 - DNA, 103 bp, Artificial Sequence
  Synthetic Polynucleotide
taatacgactcactatagggtatctgctgcggactaattgcccactctccaacagaggagaggagagatggcaattagtaacctggcggcagcgcaaaagatg

SEQ ID NO: 37583 - DNA, 103 bp, Artificial Sequence
  Synthetic Polynucleotide
taatacgactcactatagggctaccttgattacaccgttagagcctacggaacagaggagaccgtagatgctaacggtgaacctggcggcagcgcaaaagatg

SEQ ID NO: 37584 - DNA, 103 bp, Artificial Sequence
  Synthetic Polynucleotide
taatacgactcactatagggttcagagctacatacctagagaaggtaccgaacagaggagacggtacatgctctaggtaaacctggcggcagcgcaaaagatg

SEQ ID NO: 37585 - DNA, 103 bp, Artificial Sequence
  Synthetic Polynucleotide
taatacgactcactatagggtacccggtgggtccgcggtcacacttccacaacagaggagagtggaaatgtgaccgcggaacctggcggcagcgcaaaagatg

SEQ ID NO: 37586 - DNA, 103 bp, Artificial Sequence
  Synthetic Polynucleotide
taatacgactcactatagggccgtctaagtcgtcaaccccgtcgtcaaataacagaggagaatttgaatgcggggttgaaacctggcggcagcgcaaaagatg

SEQ ID NO: 37587 - DNA, 103 bp, Artificial Sequence
  Synthetic Polynucleotide
taatacgactcactataggggttagcccactcctgggtattataacaagtaacagaggagaacttgtatgaatacccagaacctggcggcagcgcaaaagatg

SEQ ID NO: 37588 - DNA, 103 bp, Artificial Sequence
  Synthetic Polynucleotide
taatacgactcactatagggaatctctaagtagtaagtatatgtatccagaacagaggagactggatatgtatacttacaacctggcggcagcgcaaaagatg

SEQ ID NO: 37589 - DNA, 103 bp, Artificial Sequence
  Synthetic Polynucleotide
taatacgactcactatagggctatgtatagatggtcgaccgcgtaaagagaacagaggagactctttatgcggtcgaccaacctggcggcagcgcaaaagatg

SEQ ID NO: 37590 - DNA, 103 bp, Artificial Sequence
  Synthetic Polynucleotide
taatacgactcactatagggatggcagtaagtgtgatggtatcagccaataacagaggagaattggcatgtaccatcacaacctggcggcagcgcaaaagatg

SEQ ID NO: 37591 - DNA, 103 bp, Artificial Sequence
  Synthetic Polynucleotide
taatacgactcactatagggatcggttattacagtccttagcgtccgtagaacagaggagactacggatgctaaggactaacctggcggcagcgcaaaagatg

SEQ ID NO: 37592 - DNA, 103 bp, Artificial Sequence
  Synthetic Polynucleotide
taatacgactcactataggggcgaaaggcgagaatttcatggtaatgcagaacagaggagactgcatatgcatgaaattaacctggcggcagcgcaaaagatg

SEQ ID NO: 37593 - DNA, 103 bp, Artificial Sequence
  Synthetic Polynucleotide
taatacgactcactatagggtaggtgggccgcgaacaaaaaagtaggtgaaacagaggagatcacctatgtttttgttcaacctggcggcagcgcaaaagatg

SEQ ID NO: 37594 - DNA, 103 bp, Artificial Sequence
  Synthetic Polynucleotide
taatacgactcactatagggaccggagcagtgacttattgtgacgtttttaacagaggagaaaaaacatgacaataagtaacctggcggcagcgcaaaagatg

SEQ ID NO: 37595 - DNA, 103 bp, Artificial Sequence
  Synthetic Polynucleotide
taatacgactcactatagggagaggagaaatcggtctactaacgaacacgaacagaggagacgtgttatgtagtagaccaacctggcggcagcgcaaaagatg

SEQ ID NO: 37596 - DNA, 103 bp, Artificial Sequence
  Synthetic Polynucleotide
taatacgactcactataggggtaaagatagacgcccggctagaggtctgcaacagaggagagcagacatgtagccgggcaacctggcggcagcgcaaaagatg

SEQ ID NO: 37597 - DNA, 103 bp, Artificial Sequence
  Synthetic Polynucleotide
taatacgactcactatagggttagatttccccgccccgacacgaaaaccgaacagaggagacggtttatgtgtcggggcaacctggcggcagcgcaaaagatg

SEQ ID NO: 37598 - DNA, 103 bp, Artificial Sequence
  Synthetic Polynucleotide
taatacgactcactatagggaacatgagatgtattgtgcgcaatctctgtaacagaggagaacagagatggcgcacaataacctggcggcagcgcaaaagatg

SEQ ID NO: 37599 - DNA, 103 bp, Artificial Sequence
  Synthetic Polynucleotide
taatacgactcactatagggacagaagatgacaatattcccataactcttaacagaggagaaagagtatggggaatattaacctggcggcagcgcaaaagatg

SEQ ID NO: 37600 - DNA, 103 bp, Artificial Sequence
  Synthetic Polynucleotide
taatacgactcactataggggcccacgtgagcgtaccgaggactaagtggaacagaggagaccacttatgcctcggtacaacctggcggcagcgcaaaagatg

SEQ ID NO: 37601 - DNA, 103 bp, Artificial Sequence
  Synthetic Polynucleotide
taatacgactcactatagggatgttgagatggtcgaaaatggtccgctgaaacagaggagatcagcgatgcattttcgaaacctggcggcagcgcaaaagatg

SEQ ID NO: 37602 - DNA, 103 bp, Artificial Sequence
  Synthetic Polynucleotide
taatacgactcactataggggtattccttggtcggagctcgctcaaaggcaacagaggagagcctttatgcgagctccgaacctggcggcagcgcaaaagatg

SEQ ID NO: 37603 - DNA, 103 bp, Artificial Sequence
  Synthetic Polynucleotide
taatacgactcactatagggaatagcacggtcctacgccatttaaggtataacagaggagaatacctatgatggcgtagaacctggcggcagcgcaaaagatg

SEQ ID NO: 37604 - DNA, 103 bp, Artificial Sequence
  Synthetic Polynucleotide
taatacgactcactatagggattgctggagtatcggatctgtctttagggaacagaggagaccctaaatgcagatccgaaacctggcggcagcgcaaaagatg

SEQ ID NO: 37605 - DNA, 103 bp, Artificial Sequence
  Synthetic Polynucleotide
taatacgactcactatagggtcatagaatcgcagatattgaacgttttgcaacagaggagagcaaaaatgtcaatatctaacctggcggcagcgcaaaagatg

SEQ ID NO: 37606 - DNA, 103 bp, Artificial Sequence
  Synthetic Polynucleotide
taatacgactcactatagggatagctctttttgatctgcaaaagaggcagaacagaggagactgcctatgttgcagatcaacctggcggcagcgcaaaagatg

SEQ ID NO: 37607 - DNA, 103 bp, Artificial Sequence
  Synthetic Polynucleotide
taatacgactcactatagggccgggaagttgtaggcctcacggtatggcaaacagaggagatgccatatggtgaggcctaacctggcggcagcgcaaaagatg

SEQ ID NO: 37608 - DNA, 103 bp, Artificial Sequence
  Synthetic Polynucleotide
taatacgactcactatagggccgcagcagctgggagagaaaccttatactaacagaggagaagtataatgtttctctccaacctggcggcagcgcaaaagatg

SEQ ID NO: 37609 - DNA, 103 bp, Artificial Sequence
  Synthetic Polynucleotide
taatacgactcactatagggttccaatcatagggatctggcggggcagcaaacagaggagatgctgcatggccagatccaacctggcggcagcgcaaaagatg

SEQ ID NO: 37610 - DNA, 103 bp, Artificial Sequence
  Synthetic Polynucleotide
taatacgactcactatagggtcagcactcgtcgcgcaacccggcactttcaacagaggagagaaagtatggggttgcgcaacctggcggcagcgcaaaagatg

SEQ ID NO: 37611 - DNA, 103 bp, Artificial Sequence
  Synthetic Polynucleotide
taatacgactcactatagggctagctttgtagctttaacgattcaaagcaaacagaggagatgctttatgtcgttaaagaacctggcggcagcgcaaaagatg

SEQ ID NO: 37612 - DNA, 103 bp, Artificial Sequence
  Synthetic Polynucleotide
taatacgactcactataggggcctatgaaacaggctgcatgtggaacttgaacagaggagacaagttatgcatgcagccaacctggcggcagcgcaaaagatg

SEQ ID NO: 37613 - DNA, 103 bp, Artificial Sequence
  Synthetic Polynucleotide
taatacgactcactataggggtatgaacaaaactaaaaattgaattatctaacagaggagaagataaatgaatttttagaacctggcggcagcgcaaaagatg

SEQ ID NO: 37614 - DNA, 103 bp, Artificial Sequence
  Synthetic Polynucleotide
taatacgactcactatagggttggtttatcgagcccttacgactgataacaacagaggagagttatcatgcgtaagggcaacctggcggcagcgcaaaagatg

SEQ ID NO: 37615 - DNA, 103 bp, Artificial Sequence
  Synthetic Polynucleotide
taatacgactcactatagggatatcctgctaatcgcttaggtagtttcaaaacagaggagattgaaaatgcctaagcgaaacctggcggcagcgcaaaagatg

SEQ ID NO: 37616 - DNA, 103 bp, Artificial Sequence
  Synthetic Polynucleotide
taatacgactcactatagggcgatgcactgaacattggttgatactcaacaacagaggagagttgagatgcaaccaatgaacctggcggcagcgcaaaagatg

SEQ ID NO: 37617 - DNA, 103 bp, Artificial Sequence
  Synthetic Polynucleotide
taatacgactcactatagggaattgttcgtagctccttcatcatgcccctaacagaggagaaggggcatgatgaaggagaacctggcggcagcgcaaaagatg

SEQ ID NO: 37618 - DNA, 103 bp, Artificial Sequence
  Synthetic Polynucleotide
taatacgactcactatagggtaacagcagtctacgcccgtgcgtctagtaaacagaggagatactagatgcacgggcgtaacctggcggcagcgcaaaagatg

SEQ ID NO: 37619 - DNA, 103 bp, Artificial Sequence
  Synthetic Polynucleotide
taatacgactcactatagggggaagtaactcttacaattagtatcgctaaaacagaggagattagcgatgctaattgtaaacctggcggcagcgcaaaagatg

SEQ ID NO: 37620 - DNA, 103 bp, Artificial Sequence
  Synthetic Polynucleotide
taatacgactcactatagggcgtctccagcgatgagtcacggatgaccataacagaggagaatggtcatgcgtgactcaaacctggcggcagcgcaaaagatg

SEQ ID NO: 37621 - DNA, 103 bp, Artificial Sequence
  Synthetic Polynucleotide
taatacgactcactatagggccaactgctcgccgatcagggcgacgccgcaacagaggagagcggcgatgccctgatcgaacctggcggcagcgcaaaagatg

SEQ ID NO: 37622 - DNA, 103 bp, Artificial Sequence
  Synthetic Polynucleotide
taatacgactcactataggggtcttaattcaaccagtttgctgaattatgaacagaggagacataatatggcaaactggaacctggcggcagcgcaaaagatg

SEQ ID NO: 37623 - DNA, 103 bp, Artificial Sequence
  Synthetic Polynucleotide
taatacgactcactatagggcttgttggaggggttggcagggactgttcaaacagaggagatgaacaatgcctgccaacaacctggcggcagcgcaaaagatg

SEQ ID NO: 37624 - DNA, 103 bp, Artificial Sequence
  Synthetic Polynucleotide
taatacgactcactatagggtagtgcctgagtaaacccattacgatgtcaaacagaggagatgacatatgaatgggtttaacctggcggcagcgcaaaagatg

SEQ ID NO: 37625 - DNA, 103 bp, Artificial Sequence
  Synthetic Polynucleotide
taatacgactcactatagggtcgagggagtgtaaacttcgaggtcgccggaacagaggagaccggcgatgtcgaagtttaacctggcggcagcgcaaaagatg

SEQ ID NO: 37626 - DNA, 103 bp, Artificial Sequence
  Synthetic Polynucleotide
taatacgactcactatagggactgacataacacgatcatctcggtgatgtaacagaggagaacatcaatgagatgatcgaacctggcggcagcgcaaaagatg

SEQ ID NO: 37627 - DNA, 103 bp, Artificial Sequence
  Synthetic Polynucleotide
taatacgactcactataggggcgcgcgcaaatatatacaaggttaggacgaacagaggagacgtcctatgcttgtatataacctggcggcagcgcaaaagatg

SEQ ID NO: 37628 - DNA, 103 bp, Artificial Sequence
  Synthetic Polynucleotide
taatacgactcactataggggttccgtaagaatgatcgatgtcttagtagaacagaggagactactaatgcatcgatcaaacctggcggcagcgcaaaagatg

SEQ ID NO: 37629 - DNA, 103 bp, Artificial Sequence
  Synthetic Polynucleotide
taatacgactcactatagggcgctgctaacgccgggggtcggccaacggaaacagaggagatccgttatgcgacccccgaacctggcggcagcgcaaaagatg

SEQ ID NO: 37630 - DNA, 103 bp, Artificial Sequence
  Synthetic Polynucleotide
taatacgactcactatagggaatggtccgggacagcgcattgttacttggaacagaggagaccaagtatgaatgcgctgaacctggcggcagcgcaaaagatg

SEQ ID NO: 37631 - DNA, 103 bp, Artificial Sequence
  Synthetic Polynucleotide
taatacgactcactataggggcgttactacaacacggtaagtgagcattgaacagaggagacaatgcatgcttaccgtgaacctggcggcagcgcaaaagatg

SEQ ID NO: 37632 - DNA, 103 bp, Artificial Sequence
  Synthetic Polynucleotide
taatacgactcactatagggattttatttcaccggggagagtagccttgaaacagaggagatcaaggatgctctccccgaacctggcggcagcgcaaaagatg

SEQ ID NO: 37633 - DNA, 103 bp, Artificial Sequence
  Synthetic Polynucleotide
taatacgactcactatagggtcttacgttaaggcaagaaggagaagttgtaacagaggagaacaactatgccttcttgcaacctggcggcagcgcaaaagatg

SEQ ID NO: 37634 - DNA, 103 bp, Artificial Sequence
  Synthetic Polynucleotide
taatacgactcactatagggcaaatctcttattaaccgggcctacatcagaacagaggagactgatgatggcccggttaaacctggcggcagcgcaaaagatg

SEQ ID NO: 37635 - DNA, 103 bp, Artificial Sequence
  Synthetic Polynucleotide
taatacgactcactatagggcctttgcgtacgttcccgttaagtaatttcaacagaggagagaaattatgtaacgggaaaacctggcggcagcgcaaaagatg

SEQ ID NO: 37636 - DNA, 103 bp, Artificial Sequence
  Synthetic Polynucleotide
taatacgactcactatagggccccaggcccctctttaggtcctgaaacgcaacagaggagagcgtttatggacctaaagaacctggcggcagcgcaaaagatg

SEQ ID NO: 37637 - DNA, 103 bp, Artificial Sequence
  Synthetic Polynucleotide
taatacgactcactatagggaggctaaccgtccacacggtctattggccgaacagaggagacggccaatggaccgtgtgaacctggcggcagcgcaaaagatg

SEQ ID NO: 37638 - DNA, 103 bp, Artificial Sequence
  Synthetic Polynucleotide
taatacgactcactatagggttgataataggtcctggctccctgtacgttaacagaggagaaacgtaatgggagccaggaacctggcggcagcgcaaaagatg

SEQ ID NO: 37639 - DNA, 103 bp, Artificial Sequence
  Synthetic Polynucleotide
taatacgactcactatagggcttaagtaccggacctcgccctcgaaccgtaacagaggagaacggttatggggcgaggtaacctggcggcagcgcaaaagatg

SEQ ID NO: 37640 - DNA, 103 bp, Artificial Sequence
  Synthetic Polynucleotide
taatacgactcactatagggctgacctggcgggtccctagtccggagcataacagaggagaatgctcatgactagggacaacctggcggcagcgcaaaagatg

SEQ ID NO: 37641 - DNA, 103 bp, Artificial Sequence
  Synthetic Polynucleotide
taatacgactcactatagggaagttacccggacagtactcacaagggcttaacagaggagaaagcccatgtgagtactgaacctggcggcagcgcaaaagatg

SEQ ID NO: 37642 - DNA, 103 bp, Artificial Sequence
  Synthetic Polynucleotide
taatacgactcactatagggaagaattcaactaggtatagcacggcagcgaacagaggagacgctgcatggctatacctaacctggcggcagcgcaaaagatg

SEQ ID NO: 37643 - DNA, 103 bp, Artificial Sequence
  Synthetic Polynucleotide
taatacgactcactataggggtatgacgcgcaatccaaaataggtggcgcaacagaggagagcgccaatgattttggataacctggcggcagcgcaaaagatg

SEQ ID NO: 37644 - DNA, 103 bp, Artificial Sequence
  Synthetic Polynucleotide
taatacgactcactatagggtgtccaaatgtaataagcatacgtcagctgaacagaggagacagctgatgtatgcttataacctggcggcagcgcaaaagatg

SEQ ID NO: 37645 - DNA, 103 bp, Artificial Sequence
  Synthetic Polynucleotide
taatacgactcactatagggcttgggtgactgctgtaggggagagccccaaacagaggagatggggcatgcccctacagaacctggcggcagcgcaaaagatg

SEQ ID NO: 37646 - DNA, 103 bp, Artificial Sequence
  Synthetic Polynucleotide
taatacgactcactatagggcctgcgagggctcccacctagcgcatacataacagaggagaatgtatatgctaggtgggaacctggcggcagcgcaaaagatg

SEQ ID NO: 37647 - DNA, 103 bp, Artificial Sequence
  Synthetic Polynucleotide
taatacgactcactatagggcacaatacctccgtgcacttagagtaaccaaacagaggagatggttaatgtaagtgcacaacctggcggcagcgcaaaagatg

SEQ ID NO: 37648 - DNA, 103 bp, Artificial Sequence
  Synthetic Polynucleotide
taatacgactcactatagggctttgagatagccgctcgggcaacggccggaacagaggagaccggccatggcccgagcgaacctggcggcagcgcaaaagatg

SEQ ID NO: 37649 - DNA, 103 bp, Artificial Sequence
  Synthetic Polynucleotide
taatacgactcactatagggtttggtcgcccatagattcataattcttttaacagaggagaaaaagaatgatgaatctaaacctggcggcagcgcaaaagatg

SEQ ID NO: 37650 - DNA, 103 bp, Artificial Sequence
  Synthetic Polynucleotide
taatacgactcactatagggtgttaaccaagatcatagaaacgtagctctaacagaggagaagagctatgtttctatgaaacctggcggcagcgcaaaagatg

SEQ ID NO: 37651 - DNA, 103 bp, Artificial Sequence
  Synthetic Polynucleotide
taatacgactcactatagggtgtgtccgacagtgatatgataggggaaaaaacagaggagattttccatgatcatatcaaacctggcggcagcgcaaaagatg

SEQ ID NO: 37652 - DNA, 103 bp, Artificial Sequence
  Synthetic Polynucleotide
taatacgactcactataggggtcaccacggcggacttgcgccaatatcaaaacagaggagattgataatggcgcaagtcaacctggcggcagcgcaaaagatg

SEQ ID NO: 37653 - DNA, 103 bp, Artificial Sequence
  Synthetic Polynucleotide
taatacgactcactatagggcggctttgtaggattagtgaacatgacttgaacagaggagacaagtcatgttcactaataacctggcggcagcgcaaaagatg

SEQ ID NO: 37654 - DNA, 103 bp, Artificial Sequence
  Synthetic Polynucleotide
taatacgactcactatagggtagagtcccctaaccgggcgagaaggaagaaacagaggagatcttccatgtcgcccggtaacctggcggcagcgcaaaagatg

SEQ ID NO: 37655 - DNA, 103 bp, Artificial Sequence
  Synthetic Polynucleotide
taatacgactcactatagggtctaacggaggtgtcgcagggttagcgggcaacagaggagagcccgcatgccctgcgacaacctggcggcagcgcaaaagatg

SEQ ID NO: 37656 - DNA, 103 bp, Artificial Sequence
  Synthetic Polynucleotide
taatacgactcactataggggcgttcttccggactgcgagcgctcaccagaacagaggagactggtgatggctcgcagtaacctggcggcagcgcaaaagatg

SEQ ID NO: 37657 - DNA, 103 bp, Artificial Sequence
  Synthetic Polynucleotide
taatacgactcactatagggaattttcagccagcagctcaacttaagtccaacagaggagaggacttatgttgagctgcaacctggcggcagcgcaaaagatg

SEQ ID NO: 37658 - DNA, 103 bp, Artificial Sequence
  Synthetic Polynucleotide
taatacgactcactatagggccggaaggtgacagacaggtgtgttgtacgaacagaggagacgtacaatgcacctgtctaacctggcggcagcgcaaaagatg

SEQ ID NO: 37659 - DNA, 103 bp, Artificial Sequence
  Synthetic Polynucleotide
taatacgactcactatagggtgcattagcattattcattttgaatccgcaaacagaggagatgcggaatgaaaatgaataacctggcggcagcgcaaaagatg

SEQ ID NO: 37660 - DNA, 103 bp, Artificial Sequence
  Synthetic Polynucleotide
taatacgactcactatagggaacagccgtaacaccgacaaagcctgaaacaacagaggagagtttcaatgtttgtcggtaacctggcggcagcgcaaaagatg

SEQ ID NO: 37661 - DNA, 103 bp, Artificial Sequence
  Synthetic Polynucleotide
taatacgactcactataggggatgttggttcgaaatcaacactaactgagaacagaggagactcagtatgtgttgatttaacctggcggcagcgcaaaagatg

SEQ ID NO: 37662 - DNA, 103 bp, Artificial Sequence
  Synthetic Polynucleotide
taatacgactcactatagggccagggattacacaacgcccacgatccagcaacagaggagagctggaatgtgggcgttgaacctggcggcagcgcaaaagatg

SEQ ID NO: 37663 - DNA, 103 bp, Artificial Sequence
  Synthetic Polynucleotide
taatacgactcactatagggtcgtaccccaccacacaaaggtagccacccaacagaggagagggtggatgcctttgtgtaacctggcggcagcgcaaaagatg

SEQ ID NO: 37664 - DNA, 103 bp, Artificial Sequence
  Synthetic Polynucleotide
taatacgactcactatagggttatttcagtcaatgcaaatattgagcaccaacagaggagaggtgctatgtatttgcataacctggcggcagcgcaaaagatg

SEQ ID NO: 37665 - DNA, 103 bp, Artificial Sequence
  Synthetic Polynucleotide
taatacgactcactatagggttacactatatgaaccgtcaacgccggctcaacagaggagagagccgatgttgacggttaacctggcggcagcgcaaaagatg

SEQ ID NO: 37666 - DNA, 103 bp, Artificial Sequence
  Synthetic Polynucleotide
taatacgactcactatagggtgtgcacctctcacgtttatagactgcagcaacagaggagagctgcaatgtataaacgtaacctggcggcagcgcaaaagatg

SEQ ID NO: 37667 - DNA, 103 bp, Artificial Sequence
  Synthetic Polynucleotide
taatacgactcactatagggatgaaaaaacctcagagatcttcgtggtagaacagaggagactaccaatgagatctctgaacctggcggcagcgcaaaagatg

SEQ ID NO: 37668 - DNA, 103 bp, Artificial Sequence
  Synthetic Polynucleotide
taatacgactcactatagggcgacaagagtgagttaacaggtcagcgagtaacagaggagaactcgcatgcctgttaacaacctggcggcagcgcaaaagatg

SEQ ID NO: 37669 - DNA, 103 bp, Artificial Sequence
  Synthetic Polynucleotide
taatacgactcactataggggccttaagtctttggtaggagccccgcgggaacagaggagacccgcgatgctcctaccaaacctggcggcagcgcaaaagatg

SEQ ID NO: 37670 - DNA, 103 bp, Artificial Sequence
  Synthetic Polynucleotide
taatacgactcactatagggtccaagggtgggctttgcgtagctgacccgaacagaggagacgggtcatgtacgcaaagaacctggcggcagcgcaaaagatg

SEQ ID NO: 37671 - DNA, 103 bp, Artificial Sequence
  Synthetic Polynucleotide
taatacgactcactatagggtgatggggcgcttgagagatgttatacacaaacagaggagatgtgtaatgcatctctcaaacctggcggcagcgcaaaagatg

SEQ ID NO: 37672 - DNA, 103 bp, Artificial Sequence
  Synthetic Polynucleotide
taatacgactcactatagggagactgtgctaccccatcacacgccgggcaaacagaggagatgcccgatgtgtgatgggaacctggcggcagcgcaaaagatg

SEQ ID NO: 37673 - DNA, 103 bp, Artificial Sequence
  Synthetic Polynucleotide
taatacgactcactatagggaggggggttaatccgatctatgcctgcgataacagaggagaatcgcaatgatagatcggaacctggcggcagcgcaaaagatg

SEQ ID NO: 37674 - DNA, 103 bp, Artificial Sequence
  Synthetic Polynucleotide
taatacgactcactatagggtatgccgataacaaggagctcgagcgtagtaacagaggagaactacgatggagctccttaacctggcggcagcgcaaaagatg

SEQ ID NO: 37675 - DNA, 103 bp, Artificial Sequence
  Synthetic Polynucleotide
taatacgactcactatagggcgcctcaccccagaagacgcgggccttgagaacagaggagactcaagatgcgcgtcttcaacctggcggcagcgcaaaagatg

SEQ ID NO: 37676 - DNA, 103 bp, Artificial Sequence
  Synthetic Polynucleotide
taatacgactcactatagggtgaaagatttgacctagcctcctacatgttaacagaggagaaacatgatggaggctaggaacctggcggcagcgcaaaagatg

SEQ ID NO: 37677 - DNA, 103 bp, Artificial Sequence
  Synthetic Polynucleotide
taatacgactcactatagggaaatggtaaggtacgctaggctttgtgtaaaacagaggagattacacatggcctagcgtaacctggcggcagcgcaaaagatg

SEQ ID NO: 37678 - DNA, 103 bp, Artificial Sequence
  Synthetic Polynucleotide
taatacgactcactatagggtttatgtataggttgagtgacctcaaacccaacagaggagagggtttatggtcactcaaaacctggcggcagcgcaaaagatg

SEQ ID NO: 37679 - DNA, 103 bp, Artificial Sequence
  Synthetic Polynucleotide
taatacgactcactatagggatctggacgaatatgtatttcctaagcttcaacagaggagagaagctatggaaatacataacctggcggcagcgcaaaagatg

SEQ ID NO: 37680 - DNA, 103 bp, Artificial Sequence
  Synthetic Polynucleotide
taatacgactcactatagggttcatccatcaggggtattggattcggggtaacagaggagaaccccgatgccaatacccaacctggcggcagcgcaaaagatg

SEQ ID NO: 37681 - DNA, 103 bp, Artificial Sequence
  Synthetic Polynucleotide
taatacgactcactatagggggccaaacttgactctcttcggagtcgcgtaacagaggagaacgcgaatgcgaagagagaacctggcggcagcgcaaaagatg

SEQ ID NO: 37682 - DNA, 103 bp, Artificial Sequence
  Synthetic Polynucleotide
taatacgactcactatagggctttagcgccgctcagatattattcagcgcaacagaggagagcgctgatgaatatctgaaacctggcggcagcgcaaaagatg

SEQ ID NO: 37683 - DNA, 103 bp, Artificial Sequence
  Synthetic Polynucleotide
taatacgactcactatagggcgagatgagcggcgtaaccctttctctgacaacagaggagagtcagaatgagggttacgaacctggcggcagcgcaaaagatg

SEQ ID NO: 37684 - DNA, 103 bp, Artificial Sequence
  Synthetic Polynucleotide
taatacgactcactatagggaacagccctctgctgcctccaatgaccatcaacagaggagagatggtatgtggaggcagaacctggcggcagcgcaaaagatg

SEQ ID NO: 37685 - DNA, 103 bp, Artificial Sequence
  Synthetic Polynucleotide
taatacgactcactatagggctccttctcgtataagcaatattgctgctcaacagaggagagagcagatgtattgcttaaacctggcggcagcgcaaaagatg

SEQ ID NO: 37686 - DNA, 103 bp, Artificial Sequence
  Synthetic Polynucleotide
taatacgactcactatagggagagattggcatctactgaacgccggagtaaacagaggagatactccatggttcagtagaacctggcggcagcgcaaaagatg

SEQ ID NO: 37687 - DNA, 103 bp, Artificial Sequence
  Synthetic Polynucleotide
taatacgactcactatagggtccggtcaggcaggctgtgccctgagaacaaacagaggagatgttctatgggcacagccaacctggcggcagcgcaaaagatg

SEQ ID NO: 37688 - DNA, 103 bp, Artificial Sequence
  Synthetic Polynucleotide
taatacgactcactatagggctctcgtctctcggcctacatcaaacgcttaacagaggagaaagcgtatgatgtaggccaacctggcggcagcgcaaaagatg

SEQ ID NO: 37689 - DNA, 103 bp, Artificial Sequence
  Synthetic Polynucleotide
taatacgactcactatagggctttttgtttaataattggctgcagacttaaacagaggagataagtcatgagccaattaaacctggcggcagcgcaaaagatg

SEQ ID NO: 37690 - DNA, 103 bp, Artificial Sequence
  Synthetic Polynucleotide
taatacgactcactatagggacggatccgcatatcaaagtgctcgttactaacagaggagaagtaacatgcactttgataacctggcggcagcgcaaaagatg

SEQ ID NO: 37691 - DNA, 103 bp, Artificial Sequence
  Synthetic Polynucleotide
taatacgactcactatagggtcgtctcaggctctaaaattacttcggtccaacagaggagaggaccgatgtaattttagaacctggcggcagcgcaaaagatg

SEQ ID NO: 37692 - DNA, 103 bp, Artificial Sequence
  Synthetic Polynucleotide
taatacgactcactatagggacgctgggatacgggtagcgtcctaacatgaacagaggagacatgttatgacgctacccaacctggcggcagcgcaaaagatg

SEQ ID NO: 37693 - DNA, 103 bp, Artificial Sequence
  Synthetic Polynucleotide
taatacgactcactataggggagctggcggcaccaggtggccgatcgcgtaacagaggagaacgcgaatggccacctggaacctggcggcagcgcaaaagatg

SEQ ID NO: 37694 - DNA, 103 bp, Artificial Sequence
  Synthetic Polynucleotide
taatacgactcactatagggttatgatctatgagacccctctttgtttacaacagaggagagtaaacatggaggggtctaacctggcggcagcgcaaaagatg

SEQ ID NO: 37695 - DNA, 103 bp, Artificial Sequence
  Synthetic Polynucleotide
taatacgactcactatagggtttgcgactctcggaagtaggatccaaaacaacagaggagagttttgatgcctacttccaacctggcggcagcgcaaaagatg

SEQ ID NO: 37696 - DNA, 103 bp, Artificial Sequence
  Synthetic Polynucleotide
taatacgactcactatagggttacccgtagcggggcaacgggtttgatcgaacagaggagacgatcaatgccgttgcccaacctggcggcagcgcaaaagatg

SEQ ID NO: 37697 - DNA, 103 bp, Artificial Sequence
  Synthetic Polynucleotide
taatacgactcactatagggtatatcacatatcggataatccgggaaccgaacagaggagacggttcatggattatccgaacctggcggcagcgcaaaagatg

SEQ ID NO: 37698 - DNA, 103 bp, Artificial Sequence
  Synthetic Polynucleotide
taatacgactcactatagggcctatgaagtccgtccttgttatgcagcgcaacagaggagagcgctgatgaacaaggacaacctggcggcagcgcaaaagatg

SEQ ID NO: 37699 - DNA, 103 bp, Artificial Sequence
  Synthetic Polynucleotide
taatacgactcactatagggacggcggggcgtgaactgtgtaagtgattgaacagaggagacaatcaatgacacagttcaacctggcggcagcgcaaaagatg

SEQ ID NO: 37700 - DNA, 103 bp, Artificial Sequence
  Synthetic Polynucleotide
taatacgactcactatagggtccacggtgcgctcgggtaaaactagtttaaacagaggagataaactatgtttacccgaaacctggcggcagcgcaaaagatg

SEQ ID NO: 37701 - DNA, 103 bp, Artificial Sequence
  Synthetic Polynucleotide
taatacgactcactataggggcgagtaacacgctgtagggaagagctccgaacagaggagacggagcatgtccctacagaacctggcggcagcgcaaaagatg

SEQ ID NO: 37702 - DNA, 103 bp, Artificial Sequence
  Synthetic Polynucleotide
taatacgactcactatagggaagagacatcgaagttaatgtagagcgaataacagaggagaattcgcatgacattaactaacctggcggcagcgcaaaagatg

SEQ ID NO: 37703 - DNA, 103 bp, Artificial Sequence
  Synthetic Polynucleotide
taatacgactcactatagggaaaagagtattttagtactcttgaatatttaacagaggagaaaatatatgagagtactaaacctggcggcagcgcaaaagatg

SEQ ID NO: 37704 - DNA, 103 bp, Artificial Sequence
  Synthetic Polynucleotide
taatacgactcactatagggtaacatttgatagactcgtaaaggtgtacaaacagaggagatgtacaatgttacgagtcaacctggcggcagcgcaaaagatg

SEQ ID NO: 37705 - DNA, 103 bp, Artificial Sequence
  Synthetic Polynucleotide
taatacgactcactataggggtgggtcgaagtaacgctggcgtgataagtaacagaggagaacttatatggccagcgttaacctggcggcagcgcaaaagatg

SEQ ID NO: 37706 - DNA, 103 bp, Artificial Sequence
  Synthetic Polynucleotide
taatacgactcactatagggtgtgatgttcgtacgtcgccagcaccggtgaacagaggagacaccggatgtggcgacgtaacctggcggcagcgcaaaagatg

SEQ ID NO: 37707 - DNA, 103 bp, Artificial Sequence
  Synthetic Polynucleotide
taatacgactcactatagggacgggcggtggccgtttttcgagggtcgctaacagaggagaagcgacatgcgaaaaacgaacctggcggcagcgcaaaagatg

SEQ ID NO: 37708 - DNA, 103 bp, Artificial Sequence
  Synthetic Polynucleotide
taatacgactcactatagggctcggacaagcaggtcatctgtagttgtctaacagaggagaagacaaatgcagatgaccaacctggcggcagcgcaaaagatg

SEQ ID NO: 37709 - DNA, 103 bp, Artificial Sequence
  Synthetic Polynucleotide
taatacgactcactatagggtaaaggggagcggctggaagagtcctggggaacagaggagaccccagatgtcttccagcaacctggcggcagcgcaaaagatg

SEQ ID NO: 37710 - DNA, 103 bp, Artificial Sequence
  Synthetic Polynucleotide
taatacgactcactatagggatctcgaactcaccggctccgactgaagcgaacagaggagacgcttcatgcggagccggaacctggcggcagcgcaaaagatg

SEQ ID NO: 37711 - DNA, 103 bp, Artificial Sequence
  Synthetic Polynucleotide
taatacgactcactataggggttgactctcgtcaaatgtgatctccgcccaacagaggagagggcggatgtcacatttgaacctggcggcagcgcaaaagatg

SEQ ID NO: 37712 - DNA, 103 bp, Artificial Sequence
  Synthetic Polynucleotide
taatacgactcactataggggcagattctacagggttaattataatatacaacagaggagagtatatatgaattaacccaacctggcggcagcgcaaaagatg

SEQ ID NO: 37713 - DNA, 103 bp, Artificial Sequence
  Synthetic Polynucleotide
taatacgactcactatagggccatagtgtttgggagtcccagaagccgctaacagaggagaagcggcatgtgggactccaacctggcggcagcgcaaaagatg

SEQ ID NO: 37714 - DNA, 103 bp, Artificial Sequence
  Synthetic Polynucleotide
taatacgactcactatagggttccagcgaagttccgaaatattcattttaaacagaggagataaaatatgtatttcggaaacctggcggcagcgcaaaagatg

SEQ ID NO: 37715 - DNA, 103 bp, Artificial Sequence
  Synthetic Polynucleotide
taatacgactcactataggggacgtggggcatacgcgtaatttaatctagaacagaggagactagatatgattacgcgtaacctggcggcagcgcaaaagatg

SEQ ID NO: 37716 - DNA, 103 bp, Artificial Sequence
  Synthetic Polynucleotide
taatacgactcactatagggaaagcaagcaataaggacgcatcaagatgaaacagaggagatcatctatgtgcgtccttaacctggcggcagcgcaaaagatg

SEQ ID NO: 37717 - DNA, 103 bp, Artificial Sequence
  Synthetic Polynucleotide
taatacgactcactatagggcgcggtacacgcctggcgtacaccgagggtaacagaggagaaccctcatggtacgccagaacctggcggcagcgcaaaagatg

SEQ ID NO: 37718 - DNA, 103 bp, Artificial Sequence
  Synthetic Polynucleotide
taatacgactcactatagggatcaattgtcctgttccttcgggctgtcagaacagaggagactgacaatgcgaaggaacaacctggcggcagcgcaaaagatg

SEQ ID NO: 37719 - DNA, 103 bp, Artificial Sequence
  Synthetic Polynucleotide
taatacgactcactatagggtctatcgcatgacctctaacggaggtagtgaacagaggagacactacatgcgttagaggaacctggcggcagcgcaaaagatg

SEQ ID NO: 37720 - DNA, 103 bp, Artificial Sequence
  Synthetic Polynucleotide
taatacgactcactatagggtgaacgcggatgacgcttgctaagagaggaaacagaggagatcctctatgagcaagcgtaacctggcggcagcgcaaaagatg

SEQ ID NO: 37721 - DNA, 103 bp, Artificial Sequence
  Synthetic Polynucleotide
taatacgactcactataggggccttattacacccttctcccgtagaggtaaacagaggagatacctcatggggagaaggaacctggcggcagcgcaaaagatg

SEQ ID NO: 37722 - DNA, 103 bp, Artificial Sequence
  Synthetic Polynucleotide
taatacgactcactatagggtcccttctatcggacatacgtataagcaagaacagaggagacttgctatgacgtatgtcaacctggcggcagcgcaaaagatg

SEQ ID NO: 37723 - DNA, 103 bp, Artificial Sequence
  Synthetic Polynucleotide
taatacgactcactatagggggccaaagttacgcgtttcggaattcagtgaacagaggagacactgaatgccgaaacgcaacctggcggcagcgcaaaagatg

SEQ ID NO: 37724 - DNA, 103 bp, Artificial Sequence
  Synthetic Polynucleotide
taatacgactcactatagggattctctctaagcccacagtagtagctcgcaacagaggagagcgagcatgtactgtgggaacctggcggcagcgcaaaagatg

SEQ ID NO: 37725 - DNA, 103 bp, Artificial Sequence
  Synthetic Polynucleotide
taatacgactcactatagggaaggaacgtcggagataaaaatacctcggcaacagaggagagccgagatgtttttatctaacctggcggcagcgcaaaagatg

SEQ ID NO: 37726 - DNA, 103 bp, Artificial Sequence
  Synthetic Polynucleotide
taatacgactcactataggggggaggctgcgcctttattcttgctcacacaacagaggagagtgtgaatgagaataaagaacctggcggcagcgcaaaagatg

SEQ ID NO: 37727 - DNA, 103 bp, Artificial Sequence
  Synthetic Polynucleotide
taatacgactcactataggggcaattgagagacagcacgacacaatcagaaacagaggagatctgatatggtcgtgctgaacctggcggcagcgcaaaagatg

SEQ ID NO: 37728 - DNA, 103 bp, Artificial Sequence
  Synthetic Polynucleotide
taatacgactcactataggggtgcagccggctccaagcaagctgttcaataacagaggagaattgaaatgcttgcttggaacctggcggcagcgcaaaagatg

SEQ ID NO: 37729 - DNA, 103 bp, Artificial Sequence
  Synthetic Polynucleotide
taatacgactcactataggggcgaatccgcggttgcaaactcaaatactgaacagaggagacagtatatgagtttgcaaaacctggcggcagcgcaaaagatg

SEQ ID NO: 37730 - DNA, 103 bp, Artificial Sequence
  Synthetic Polynucleotide
taatacgactcactatagggaaggtactggataccacgcacgtcgactcgaacagaggagacgagtcatggtgcgtggtaacctggcggcagcgcaaaagatg

SEQ ID NO: 37731 - DNA, 103 bp, Artificial Sequence
  Synthetic Polynucleotide
taatacgactcactatagggcactctgagttgcaggcgtgcgtagcggccaacagaggagaggccgcatggcacgcctgaacctggcggcagcgcaaaagatg

SEQ ID NO: 37732 - DNA, 103 bp, Artificial Sequence
  Synthetic Polynucleotide
taatacgactcactatagggctgacataccaggcaggggaggaccgttttaacagaggagaaaaacgatgctcccctgcaacctggcggcagcgcaaaagatg

SEQ ID NO: 37733 - DNA, 103 bp, Artificial Sequence
  Synthetic Polynucleotide
taatacgactcactataggggtggtacattttatgtcgaggactagcaacaacagaggagagttgctatgcctcgacataacctggcggcagcgcaaaagatg

SEQ ID NO: 37734 - DNA, 103 bp, Artificial Sequence
  Synthetic Polynucleotide
taatacgactcactataggggttcttgccgtactgacgcagcgtcctgtcaacagaggagagacaggatgctgcgtcagaacctggcggcagcgcaaaagatg

SEQ ID NO: 37735 - DNA, 103 bp, Artificial Sequence
  Synthetic Polynucleotide
taatacgactcactatagggtccacagagttgagcaggtgggtgatagataacagaggagaatctatatgccacctgctaacctggcggcagcgcaaaagatg

SEQ ID NO: 37736 - DNA, 103 bp, Artificial Sequence
  Synthetic Polynucleotide
taatacgactcactatagggccttaaagtcttttatccgcctatccctgcaacagaggagagcagggatgggcggataaaacctggcggcagcgcaaaagatg

SEQ ID NO: 37737 - DNA, 103 bp, Artificial Sequence
  Synthetic Polynucleotide
taatacgactcactatagggggcacgccagaagtttgtcggatacgttgcaacagaggagagcaacgatgccgacaaacaacctggcggcagcgcaaaagatg

SEQ ID NO: 37738 - DNA, 103 bp, Artificial Sequence
  Synthetic Polynucleotide
taatacgactcactatagggcaccttttactggctaagcggtcctccgccaacagaggagaggcggaatgccgcttagcaacctggcggcagcgcaaaagatg

SEQ ID NO: 37739 - DNA, 103 bp, Artificial Sequence
  Synthetic Polynucleotide
taatacgactcactataggggacgccgtctcgttacttgtccagggatacaacagaggagagtatccatggacaagtaaaacctggcggcagcgcaaaagatg

SEQ ID NO: 37740 - DNA, 103 bp, Artificial Sequence
  Synthetic Polynucleotide
taatacgactcactatagggtttaataaagtgtgccactaccttatcactaacagaggagaagtgatatggtagtggcaaacctggcggcagcgcaaaagatg

SEQ ID NO: 37741 - DNA, 103 bp, Artificial Sequence
  Synthetic Polynucleotide
taatacgactcactatagggagagtaggattaaagtccagaatgaagataaacagaggagatatcttatgtctggacttaacctggcggcagcgcaaaagatg

SEQ ID NO: 37742 - DNA, 103 bp, Artificial Sequence
  Synthetic Polynucleotide
taatacgactcactataggggtggcagaagcgtcgacttggctcgcctgtaacagaggagaacaggcatgccaagtcgaaacctggcggcagcgcaaaagatg

SEQ ID NO: 37743 - DNA, 103 bp, Artificial Sequence
  Synthetic Polynucleotide
taatacgactcactatagggcgtctgagtacacgttgcgcgcgttaggacaacagaggagagtcctaatgcgcgcaacgaacctggcggcagcgcaaaagatg

SEQ ID NO: 37744 - DNA, 103 bp, Artificial Sequence
  Synthetic Polynucleotide
taatacgactcactataggggttacctcctaaatggggtctacggctaccaacagaggagaggtagcatgagaccccataacctggcggcagcgcaaaagatg

SEQ ID NO: 37745 - DNA, 103 bp, Artificial Sequence
  Synthetic Polynucleotide
taatacgactcactatagggggcgactttatgggtagccattcttgagacaacagaggagagtctcaatgatggctaccaacctggcggcagcgcaaaagatg

SEQ ID NO: 37746 - DNA, 103 bp, Artificial Sequence
  Synthetic Polynucleotide
taatacgactcactatagggtgggactgagaaagaacctgtgtggaatcaaacagaggagatgattcatgacaggttctaacctggcggcagcgcaaaagatg

SEQ ID NO: 37747 - DNA, 103 bp, Artificial Sequence
  Synthetic Polynucleotide
taatacgactcactataggggtacttgacagcgtctggtggtcgtgtcgaaacagaggagatcgacaatgccaccagacaacctggcggcagcgcaaaagatg

SEQ ID NO: 37748 - DNA, 103 bp, Artificial Sequence
  Synthetic Polynucleotide
taatacgactcactatagggacgcctttagtaaacttcgggcatcctctgaacagaggagacagaggatgcccgaagttaacctggcggcagcgcaaaagatg

SEQ ID NO: 37749 - DNA, 103 bp, Artificial Sequence
  Synthetic Polynucleotide
taatacgactcactatagggtccagcccagtcaagtagaacccgaatggtaacagaggagaaccattatggttctacttaacctggcggcagcgcaaaagatg

SEQ ID NO: 37750 - DNA, 103 bp, Artificial Sequence
  Synthetic Polynucleotide
taatacgactcactatagggtattgaatagtggtggatcgatgtaaggggaacagaggagaccccttatgtcgatccacaacctggcggcagcgcaaaagatg

SEQ ID NO: 37751 - DNA, 103 bp, Artificial Sequence
  Synthetic Polynucleotide
taatacgactcactatagggtacctggacacagtacatgagggtcgacgaaacagaggagatcgtcgatgctcatgtacaacctggcggcagcgcaaaagatg

SEQ ID NO: 37752 - DNA, 103 bp, Artificial Sequence
  Synthetic Polynucleotide
taatacgactcactatagggcgcacaggaccggtatgtgctcatattgcaaacagaggagatgcaatatgagcacatacaacctggcggcagcgcaaaagatg

SEQ ID NO: 37753 - DNA, 103 bp, Artificial Sequence
  Synthetic Polynucleotide
taatacgactcactatagggaagactacaaatatactggcgtatcatctaaacagaggagatagatgatgcgccagtataacctggcggcagcgcaaaagatg

SEQ ID NO: 37754 - DNA, 103 bp, Artificial Sequence
  Synthetic Polynucleotide
taatacgactcactatagggtacgtgtctacggccgcaccagtccgtatcaacagaggagagatacgatgtggtgcggcaacctggcggcagcgcaaaagatg

SEQ ID NO: 37755 - DNA, 103 bp, Artificial Sequence
  Synthetic Polynucleotide
taatacgactcactatagggaccggtaaacccacatagagactaactttaaacagaggagataaagtatgtctctatgtaacctggcggcagcgcaaaagatg

SEQ ID NO: 37756 - DNA, 103 bp, Artificial Sequence
  Synthetic Polynucleotide
taatacgactcactatagggagccagtgaattccgaaaaaaagaatcacaaacagaggagatgtgatatgttttttcggaacctggcggcagcgcaaaagatg

SEQ ID NO: 37757 - DNA, 103 bp, Artificial Sequence
  Synthetic Polynucleotide
taatacgactcactataggggttagcgtctagtgcactgcgaatacatacaacagaggagagtatgtatgcgcagtgcaaacctggcggcagcgcaaaagatg

SEQ ID NO: 37758 - DNA, 103 bp, Artificial Sequence
  Synthetic Polynucleotide
taatacgactcactatagggtcacagactctcgagtctttacagctcttgaacagaggagacaagagatgtaaagactcaacctggcggcagcgcaaaagatg

SEQ ID NO: 37759 - DNA, 103 bp, Artificial Sequence
  Synthetic Polynucleotide
taatacgactcactatagggcatcaactatgtccgagggacctagtcatgaacagaggagacatgacatggtccctcggaacctggcggcagcgcaaaagatg

SEQ ID NO: 37760 - DNA, 103 bp, Artificial Sequence
  Synthetic Polynucleotide
taatacgactcactataggggttcactgtccatggcgcagcgctgttcaaaacagaggagattgaacatggctgcgccaaacctggcggcagcgcaaaagatg

SEQ ID NO: 37761 - DNA, 103 bp, Artificial Sequence
  Synthetic Polynucleotide
taatacgactcactatagggagcagctggaattgtatcgcacaacattttaacagaggagaaaaatgatgtgcgatacaaacctggcggcagcgcaaaagatg

SEQ ID NO: 37762 - DNA, 103 bp, Artificial Sequence
  Synthetic Polynucleotide
taatacgactcactatagggataatagaaacgttaaaaattgttcacacgaacagaggagacgtgtgatgaatttttaaaacctggcggcagcgcaaaagatg

SEQ ID NO: 37763 - DNA, 103 bp, Artificial Sequence
  Synthetic Polynucleotide
taatacgactcactatagggccagatgtctcgcaggtcattgattgtagaaacagaggagatctacaatgaatgacctgaacctggcggcagcgcaaaagatg

SEQ ID NO: 37764 - DNA, 103 bp, Artificial Sequence
  Synthetic Polynucleotide
taatacgactcactatagggcccaggggcgattgagatgtgccaatttcgaacagaggagacgaaatatgcacatctcaaacctggcggcagcgcaaaagatg

SEQ ID NO: 37765 - DNA, 103 bp, Artificial Sequence
  Synthetic Polynucleotide
taatacgactcactatagggcgatataaaacgagtttttaaaaatggctcaacagaggagagagccaatgttaaaaactaacctggcggcagcgcaaaagatg

SEQ ID NO: 37766 - DNA, 103 bp, Artificial Sequence
  Synthetic Polynucleotide
taatacgactcactatagggggagccagaccagtatatcgctacaaacgcaacagaggagagcgtttatggcgatatacaacctggcggcagcgcaaaagatg

SEQ ID NO: 37767 - DNA, 103 bp, Artificial Sequence
  Synthetic Polynucleotide
taatacgactcactatagggacttccaagattccgggacgttgtatctcaaacagaggagatgagatatgacgtcccggaacctggcggcagcgcaaaagatg

SEQ ID NO: 37768 - DNA, 103 bp, Artificial Sequence
  Synthetic Polynucleotide
taatacgactcactatagggactgatcaaggtaggcatctttttagggataacagaggagaatccctatgaagatgcctaacctggcggcagcgcaaaagatg

SEQ ID NO: 37769 - DNA, 103 bp, Artificial Sequence
  Synthetic Polynucleotide
taatacgactcactatagggctagaaccatgatgtcacggaatgctcgagaacagaggagactcgagatgtccgtgacaaacctggcggcagcgcaaaagatg

SEQ ID NO: 37770 - DNA, 103 bp, Artificial Sequence
  Synthetic Polynucleotide
taatacgactcactataggggcgaacgataatacccgcgttgtgggtatgaacagaggagacataccatgaacgcgggtaacctggcggcagcgcaaaagatg

SEQ ID NO: 37771 - DNA, 103 bp, Artificial Sequence
  Synthetic Polynucleotide
taatacgactcactataggggcgggattcattgtctcactcctgcgtgataacagaggagaatcacgatggagtgagacaacctggcggcagcgcaaaagatg

SEQ ID NO: 37772 - DNA, 103 bp, Artificial Sequence
  Synthetic Polynucleotide
taatacgactcactatagggccaacccggtgagagtaaactcttgtttataacagaggagaataaacatgagtttactcaacctggcggcagcgcaaaagatg

SEQ ID NO: 37773 - DNA, 103 bp, Artificial Sequence
  Synthetic Polynucleotide
taatacgactcactatagggcttctccaaatccttgcattgaaacctcttaacagaggagaaagaggatgcaatgcaagaacctggcggcagcgcaaaagatg

SEQ ID NO: 37774 - DNA, 103 bp, Artificial Sequence
  Synthetic Polynucleotide
taatacgactcactatagggttttttagtctgagtggatctgcgacaggtaacagaggagaacctgtatgagatccactaacctggcggcagcgcaaaagatg

SEQ ID NO: 37775 - DNA, 103 bp, Artificial Sequence
  Synthetic Polynucleotide
taatacgactcactatagggaagtcaactcgcgagcgctacttaagggacaacagaggagagtccctatggtagcgctcaacctggcggcagcgcaaaagatg

SEQ ID NO: 37776 - DNA, 103 bp, Artificial Sequence
  Synthetic Polynucleotide
taatacgactcactatagggatactatgtcgcctctcctgacgacttcggaacagaggagaccgaagatgtcaggagagaacctggcggcagcgcaaaagatg

SEQ ID NO: 37777 - DNA, 103 bp, Artificial Sequence
  Synthetic Polynucleotide
taatacgactcactatagggagtgttggctcaggagtaggactggttcagaacagaggagactgaacatgtcctactccaacctggcggcagcgcaaaagatg

SEQ ID NO: 37778 - DNA, 103 bp, Artificial Sequence
  Synthetic Polynucleotide
taatacgactcactatagggacaggggtgaaaatgccataagcatacaacaacagaggagagttgtaatgttatggcataacctggcggcagcgcaaaagatg

SEQ ID NO: 37779 - DNA, 103 bp, Artificial Sequence
  Synthetic Polynucleotide
taatacgactcactatagggtggcatcgacgaaattataggtatgtttctaacagaggagaagaaacatgcctataattaacctggcggcagcgcaaaagatg

SEQ ID NO: 37780 - DNA, 103 bp, Artificial Sequence
  Synthetic Polynucleotide
taatacgactcactatagggactgttactcgtgttcaccggtccgaacgaaacagaggagatcgttcatgccggtgaacaacctggcggcagcgcaaaagatg

SEQ ID NO: 37781 - DNA, 103 bp, Artificial Sequence
  Synthetic Polynucleotide
taatacgactcactataggggggagtcgtggtcgggcggaaacagaggacaacagaggagagtcctcatgttccgcccgaacctggcggcagcgcaaaagatg

SEQ ID NO: 37782 - DNA, 103 bp, Artificial Sequence
  Synthetic Polynucleotide
taatacgactcactatagggccccgacgctatccggcttaaacttagcacaacagaggagagtgctaatgttaagccggaacctggcggcagcgcaaaagatg

SEQ ID NO: 37783 - DNA, 103 bp, Artificial Sequence
  Synthetic Polynucleotide
taatacgactcactataggggagtaagctggggaccgagtctagttgcataacagaggagaatgcaaatggactcggtcaacctggcggcagcgcaaaagatg

SEQ ID NO: 37784 - DNA, 103 bp, Artificial Sequence
  Synthetic Polynucleotide
taatacgactcactatagggaacgagtgaccccggcatcctccgttgcaaaacagaggagattgcaaatgaggatgccgaacctggcggcagcgcaaaagatg

SEQ ID NO: 37785 - DNA, 103 bp, Artificial Sequence
  Synthetic Polynucleotide
taatacgactcactatagggctgtttgcgcggaagcggaccaactctaccaacagaggagaggtagaatgggtccgcttaacctggcggcagcgcaaaagatg

SEQ ID NO: 37786 - DNA, 103 bp, Artificial Sequence
  Synthetic Polynucleotide
taatacgactcactatagggcctcttgaagttcaaatgggctgtcactgaaacagaggagatcagtgatggcccatttgaacctggcggcagcgcaaaagatg

SEQ ID NO: 37787 - DNA, 103 bp, Artificial Sequence
  Synthetic Polynucleotide
taatacgactcactatagggagtctagcccaaccccatttcagtcgtgataacagaggagaatcacgatggaaatggggaacctggcggcagcgcaaaagatg

SEQ ID NO: 37788 - DNA, 103 bp, Artificial Sequence
  Synthetic Polynucleotide
taatacgactcactatagggtagaagcccatgccttgggaggccttcgcgaacagaggagacgcgaaatgctcccaaggaacctggcggcagcgcaaaagatg

SEQ ID NO: 37789 - DNA, 103 bp, Artificial Sequence
  Synthetic Polynucleotide
taatacgactcactatagggcaatcctaagtgttggggatgtgacacgtcaacagaggagagacgtgatgcatccccaaaacctggcggcagcgcaaaagatg

SEQ ID NO: 37790 - DNA, 103 bp, Artificial Sequence
  Synthetic Polynucleotide
taatacgactcactatagggtcgcgtttgtaatcgggttacagcatcaggaacagaggagacctgatatggtaacccgaaacctggcggcagcgcaaaagatg

SEQ ID NO: 37791 - DNA, 103 bp, Artificial Sequence
  Synthetic Polynucleotide
taatacgactcactatagggacgagaacgattcatgtattgttagctttaaacagaggagataaagcatgcaatacatgaacctggcggcagcgcaaaagatg

SEQ ID NO: 37792 - DNA, 103 bp, Artificial Sequence
  Synthetic Polynucleotide
taatacgactcactatagggagaccaaagtcctttcgcactgtgatctgcaacagaggagagcagatatgagtgcgaaaaacctggcggcagcgcaaaagatg

SEQ ID NO: 37793 - DNA, 103 bp, Artificial Sequence
  Synthetic Polynucleotide
taatacgactcactatagggccttaagcgctgggccaaactttgacacttaacagaggagaaagtgtatgagtttggccaacctggcggcagcgcaaaagatg

SEQ ID NO: 37794 - DNA, 103 bp, Artificial Sequence
  Synthetic Polynucleotide
taatacgactcactatagggggattacctactaccccacgtaggatcacaaacagaggagatgtgatatgacgtggggtaacctggcggcagcgcaaaagatg

SEQ ID NO: 37795 - DNA, 103 bp, Artificial Sequence
  Synthetic Polynucleotide
taatacgactcactatagggggggacaagccaccaatctcctcacccgcaaacagaggagatgcgggatgggagattggaacctggcggcagcgcaaaagatg

SEQ ID NO: 37796 - DNA, 103 bp, Artificial Sequence
  Synthetic Polynucleotide
taatacgactcactatagggtgtgatctaagcaccatccctgagtcgtgcaacagaggagagcacgaatgagggatggtaacctggcggcagcgcaaaagatg

SEQ ID NO: 37797 - DNA, 103 bp, Artificial Sequence
  Synthetic Polynucleotide
taatacgactcactatagggaaataatgtcacttggttggtgcgcctgaaaacagaggagattcaggatgaccaaccaaaacctggcggcagcgcaaaagatg

SEQ ID NO: 37798 - DNA, 103 bp, Artificial Sequence
  Synthetic Polynucleotide
taatacgactcactatagggatcgccttatctccctccaagagttagcggaacagaggagaccgctaatgcttggagggaacctggcggcagcgcaaaagatg

SEQ ID NO: 37799 - DNA, 103 bp, Artificial Sequence
  Synthetic Polynucleotide
taatacgactcactatagggacctatactgcttatgttgcatgtcttgggaacagaggagacccaagatgtgcaacataaacctggcggcagcgcaaaagatg

SEQ ID NO: 37800 - DNA, 103 bp, Artificial Sequence
  Synthetic Polynucleotide
taatacgactcactataggggacgatagacttttctgaacacggcctgtgaacagaggagacacaggatgtgttcagaaaacctggcggcagcgcaaaagatg

SEQ ID NO: 37801 - DNA, 103 bp, Artificial Sequence
  Synthetic Polynucleotide
taatacgactcactataggggaactgacgtaccctacccttctcgttccaaacagaggagatggaacatgaagggtaggaacctggcggcagcgcaaaagatg

SEQ ID NO: 37802 - DNA, 103 bp, Artificial Sequence
  Synthetic Polynucleotide
taatacgactcactatagggtcaccgccccgagaattttcatttctatagaacagaggagactatagatgtgaaaattcaacctggcggcagcgcaaaagatg

SEQ ID NO: 37803 - DNA, 103 bp, Artificial Sequence
  Synthetic Polynucleotide
taatacgactcactatagggggtgggtacccatttccttacactatccgcaacagaggagagcggatatggtaaggaaaaacctggcggcagcgcaaaagatg

SEQ ID NO: 37804 - DNA, 103 bp, Artificial Sequence
  Synthetic Polynucleotide
taatacgactcactatagggcgagcaggggacaactagccaggtgaagagaacagaggagactcttcatgtggctagttaacctggcggcagcgcaaaagatg

SEQ ID NO: 37805 - DNA, 103 bp, Artificial Sequence
  Synthetic Polynucleotide
taatacgactcactatagggtttttttctccgaccgcttgataggtccttaacagaggagaaaggacatgtcaagcggtaacctggcggcagcgcaaaagatg

SEQ ID NO: 37806 - DNA, 103 bp, Artificial Sequence
  Synthetic Polynucleotide
taatacgactcactatagggcgaagaatagatccctcggtctggtgggaaaacagaggagattcccaatggaccgagggaacctggcggcagcgcaaaagatg

SEQ ID NO: 37807 - DNA, 103 bp, Artificial Sequence
  Synthetic Polynucleotide
taatacgactcactatagggcgccctactaagttcatcattgctgctcttaacagaggagaaagagcatgaatgatgaaaacctggcggcagcgcaaaagatg

SEQ ID NO: 37808 - DNA, 103 bp, Artificial Sequence
  Synthetic Polynucleotide
taatacgactcactatagggcataatatgaaaacgccgctttacaagcgcaacagaggagagcgcttatgaagcggcgtaacctggcggcagcgcaaaagatg

SEQ ID NO: 37809 - DNA, 103 bp, Artificial Sequence
  Synthetic Polynucleotide
taatacgactcactataggggtcctcgattgaagtgggcctaaaacaaccaacagaggagaggttgtatgaggcccactaacctggcggcagcgcaaaagatg

SEQ ID NO: 37810 - DNA, 103 bp, Artificial Sequence
  Synthetic Polynucleotide
taatacgactcactatagggtgcctgtcacacttctgcagcaatagttcgaacagaggagacgaactatggctgcagaaaacctggcggcagcgcaaaagatg

SEQ ID NO: 37811 - DNA, 103 bp, Artificial Sequence
  Synthetic Polynucleotide
taatacgactcactatagggtatagtagctgatagttatgtcagagtagcaacagaggagagctactatgacataactaaacctggcggcagcgcaaaagatg

SEQ ID NO: 37812 - DNA, 103 bp, Artificial Sequence
  Synthetic Polynucleotide
taatacgactcactatagggcaagacgttgatcgcacagtgctaaaaaccaacagaggagaggttttatgcactgtgcgaacctggcggcagcgcaaaagatg

SEQ ID NO: 37813 - DNA, 103 bp, Artificial Sequence
  Synthetic Polynucleotide
taatacgactcactatagggcgcccttgaaccggacaaataccggaaacaaacagaggagatgtttcatgtatttgtccaacctggcggcagcgcaaaagatg

SEQ ID NO: 37814 - DNA, 103 bp, Artificial Sequence
  Synthetic Polynucleotide
taatacgactcactataggggctttttcgcacttataaaatcagtcgtagaacagaggagactacgaatgattttataaaacctggcggcagcgcaaaagatg

SEQ ID NO: 37815 - DNA, 103 bp, Artificial Sequence
  Synthetic Polynucleotide
taatacgactcactataggggtacgattacctaatcccgcaatgcgggtaaacagaggagatacccgatgtgcgggattaacctggcggcagcgcaaaagatg

SEQ ID NO: 37816 - DNA, 103 bp, Artificial Sequence
  Synthetic Polynucleotide
taatacgactcactataggggcgaatttggtcatcgcctcaattagtgcaaacagaggagatgcactatgtgaggcgataacctggcggcagcgcaaaagatg

SEQ ID NO: 37817 - DNA, 103 bp, Artificial Sequence
  Synthetic Polynucleotide
taatacgactcactatagggtagctcgctgcagccgcggatcgctcgtgaaacagaggagatcacgaatgatccgcggcaacctggcggcagcgcaaaagatg

SEQ ID NO: 37818 - DNA, 103 bp, Artificial Sequence
  Synthetic Polynucleotide
taatacgactcactatagggttgataagtgagatagcgcttaatcacacgaacagaggagacgtgtgatgaagcgctataacctggcggcagcgcaaaagatg

SEQ ID NO: 37819 - DNA, 103 bp, Artificial Sequence
  Synthetic Polynucleotide
taatacgactcactatagggccctggagacttaaatctccgtgtgcaccgaacagaggagacggtgcatgcggagatttaacctggcggcagcgcaaaagatg

SEQ ID NO: 37820 - DNA, 103 bp, Artificial Sequence
  Synthetic Polynucleotide
taatacgactcactatagggtagagacgaccgccagtgacgccgcctaacaacagaggagagttaggatgcgtcactggaacctggcggcagcgcaaaagatg

SEQ ID NO: 37821 - DNA, 103 bp, Artificial Sequence
  Synthetic Polynucleotide
taatacgactcactataggggtacggcccgttctgcttggttagccatgcaacagaggagagcatggatgaccaagcagaacctggcggcagcgcaaaagatg

SEQ ID NO: 37822 - DNA, 103 bp, Artificial Sequence
  Synthetic Polynucleotide
taatacgactcactatagggtatacgctccatttgggcgcacaagaggtgaacagaggagacacctcatgtgcgcccaaaacctggcggcagcgcaaaagatg

SEQ ID NO: 37823 - DNA, 103 bp, Artificial Sequence
  Synthetic Polynucleotide
taatacgactcactatagggtagagacgactcattagtgaaacggggttgaacagaggagacaacccatgttcactaataacctggcggcagcgcaaaagatg

SEQ ID NO: 37824 - DNA, 103 bp, Artificial Sequence
  Synthetic Polynucleotide
taatacgactcactatagggttctcccattgggggaacgccacctgggccaacagaggagaggcccaatgggcgttcccaacctggcggcagcgcaaaagatg

SEQ ID NO: 37825 - DNA, 103 bp, Artificial Sequence
  Synthetic Polynucleotide
taatacgactcactatagggggtgacagtcaccaaacaaatattacatccaacagaggagaggatgtatgatttgtttgaacctggcggcagcgcaaaagatg

SEQ ID NO: 37826 - DNA, 103 bp, Artificial Sequence
  Synthetic Polynucleotide
taatacgactcactatagggtagcgtttgactgtcttgacatcttgcgtgaacagaggagacacgcaatgtgtcaagacaacctggcggcagcgcaaaagatg

SEQ ID NO: 37827 - DNA, 103 bp, Artificial Sequence
  Synthetic Polynucleotide
taatacgactcactatagggcctatacgaaatgccagcgggtcaccatctaacagaggagaagatggatgcccgctggcaacctggcggcagcgcaaaagatg

SEQ ID NO: 37828 - DNA, 103 bp, Artificial Sequence
  Synthetic Polynucleotide
taatacgactcactatagggtaagggagttcggttgtattcgatgtcgtcaacagaggagagacgacatggaatacaacaacctggcggcagcgcaaaagatg

SEQ ID NO: 37829 - DNA, 103 bp, Artificial Sequence
  Synthetic Polynucleotide
taatacgactcactatagggcttgccaaccccaactctgaagtgatcagaaacagaggagatctgatatgttcagagttaacctggcggcagcgcaaaagatg

SEQ ID NO: 37830 - DNA, 103 bp, Artificial Sequence
  Synthetic Polynucleotide
taatacgactcactatagggctggctaattaagggtttagcacccgcgtgaacagaggagacacgcgatggctaaacccaacctggcggcagcgcaaaagatg

SEQ ID NO: 37831 - DNA, 103 bp, Artificial Sequence
  Synthetic Polynucleotide
taatacgactcactatagggagatgagttccaacggcggaccctgattcaaacagaggagatgaatcatggtccgccgtaacctggcggcagcgcaaaagatg

SEQ ID NO: 37832 - DNA, 103 bp, Artificial Sequence
  Synthetic Polynucleotide
taatacgactcactatagggcactttcgctccgtaaacggcggaactaacaacagaggagagttagtatggccgtttacaacctggcggcagcgcaaaagatg

SEQ ID NO: 37833 - DNA, 103 bp, Artificial Sequence
  Synthetic Polynucleotide
taatacgactcactatagggcctgatccagctagacgatgcatcttgctcaacagaggagagagcaaatggcatcgtctaacctggcggcagcgcaaaagatg

SEQ ID NO: 37834 - DNA, 103 bp, Artificial Sequence
  Synthetic Polynucleotide
taatacgactcactatagggctgcatactgccactgtcgtaccgggccacaacagaggagagtggccatgtacgacagtaacctggcggcagcgcaaaagatg

SEQ ID NO: 37835 - DNA, 103 bp, Artificial Sequence
  Synthetic Polynucleotide
taatacgactcactataggggggaaaagccagtagctagtcttagttccgaacagaggagacggaacatggactagctaaacctggcggcagcgcaaaagatg

SEQ ID NO: 37836 - DNA, 103 bp, Artificial Sequence
  Synthetic Polynucleotide
taatacgactcactatagggatctgcttctgacattctttcgtactaaacaacagaggagagtttagatggaaagaatgaacctggcggcagcgcaaaagatg

SEQ ID NO: 37837 - DNA, 103 bp, Artificial Sequence
  Synthetic Polynucleotide
taatacgactcactatagggtacgctatttcagctcgtcaatgcgttaagaacagaggagacttaacatgttgacgagcaacctggcggcagcgcaaaagatg

SEQ ID NO: 37838 - DNA, 103 bp, Artificial Sequence
  Synthetic Polynucleotide
taatacgactcactataggggacctgcactagtcataagcatgcaatagcaacagaggagagctattatgtgcttatgaaacctggcggcagcgcaaaagatg

SEQ ID NO: 37839 - DNA, 103 bp, Artificial Sequence
  Synthetic Polynucleotide
taatacgactcactatagggggggtataccggcatgatgatacatttcgaaacagaggagatcgaaaatgatcatcatgaacctggcggcagcgcaaaagatg

SEQ ID NO: 37840 - DNA, 103 bp, Artificial Sequence
  Synthetic Polynucleotide
taatacgactcactatagggttcagcgcgctagtcagcgcgtgtagcgcaaacagaggagatgcgctatgcgcgctgacaacctggcggcagcgcaaaagatg

SEQ ID NO: 37841 - DNA, 103 bp, Artificial Sequence
  Synthetic Polynucleotide
taatacgactcactatagggtttaaaactctcccaccagtaccgctcggcaacagaggagagccgagatgtactggtggaacctggcggcagcgcaaaagatg

SEQ ID NO: 37842 - DNA, 103 bp, Artificial Sequence
  Synthetic Polynucleotide
taatacgactcactatagggctggggcaagtagcgtacactgcaagcctcaacagaggagagaggctatgagtgtacgcaacctggcggcagcgcaaaagatg

SEQ ID NO: 37843 - DNA, 103 bp, Artificial Sequence
  Synthetic Polynucleotide
taatacgactcactatagggggatttcttagctgacccagagtttgcaggaacagaggagacctgcaatgtctgggtcaaacctggcggcagcgcaaaagatg

SEQ ID NO: 37844 - DNA, 103 bp, Artificial Sequence
  Synthetic Polynucleotide
taatacgactcactatagggagcgcggttcagcgttaattcgactccagaaacagaggagatctggaatggaattaacgaacctggcggcagcgcaaaagatg

SEQ ID NO: 37845 - DNA, 103 bp, Artificial Sequence
  Synthetic Polynucleotide
taatacgactcactatagggcggcagggtttgcaggacaaggtcagtcccaacagaggagagggactatgcttgtcctgaacctggcggcagcgcaaaagatg

SEQ ID NO: 37846 - DNA, 103 bp, Artificial Sequence
  Synthetic Polynucleotide
taatacgactcactatagggtcgtatatgaggaattagatgtgatggatcaacagaggagagatccaatgcatctaattaacctggcggcagcgcaaaagatg

SEQ ID NO: 37847 - DNA, 103 bp, Artificial Sequence
  Synthetic Polynucleotide
taatacgactcactataggggaccagtaccacctggtaaatagtagacagaacagaggagactgtctatgatttaccagaacctggcggcagcgcaaaagatg

SEQ ID NO: 37848 - DNA, 103 bp, Artificial Sequence
  Synthetic Polynucleotide
taatacgactcactatagggctttgcgttgggaggggggacctacctcttaacagaggagaaagaggatggtcccccctaacctggcggcagcgcaaaagatg

SEQ ID NO: 37849 - DNA, 103 bp, Artificial Sequence
  Synthetic Polynucleotide
taatacgactcactatagggaacaccgcactggttatcccctttaagagcaacagaggagagctcttatgggggataacaacctggcggcagcgcaaaagatg

SEQ ID NO: 37850 - DNA, 103 bp, Artificial Sequence
  Synthetic Polynucleotide
taatacgactcactatagggtgcatcgtgagtctagacagcggccaacgaaacagaggagatcgttgatggctgtctagaacctggcggcagcgcaaaagatg

SEQ ID NO: 37851 - DNA, 103 bp, Artificial Sequence
  Synthetic Polynucleotide
taatacgactcactataggggccataagaaacccgacgccgtgagcccacaacagaggagagtgggcatgcggcgtcggaacctggcggcagcgcaaaagatg

SEQ ID NO: 37852 - DNA, 103 bp, Artificial Sequence
  Synthetic Polynucleotide
taatacgactcactataggggatgtagcaggtcgtcgaatcgagtatagcaacagaggagagctataatggattcgacgaacctggcggcagcgcaaaagatg

SEQ ID NO: 37853 - DNA, 103 bp, Artificial Sequence
  Synthetic Polynucleotide
taatacgactcactatagggtctatctgtgatatttctaacgttctattaaacagaggagataatagatggttagaaataacctggcggcagcgcaaaagatg

SEQ ID NO: 37854 - DNA, 103 bp, Artificial Sequence
  Synthetic Polynucleotide
taatacgactcactatagggcttgcacccccttgccactcctctcgaaagaacagaggagactttcgatgggagtggcaaacctggcggcagcgcaaaagatg

SEQ ID NO: 37855 - DNA, 103 bp, Artificial Sequence
  Synthetic Polynucleotide
taatacgactcactatagggatagtctcggcggcaacgttgtaaccgggaaacagaggagatcccggatgcaacgttgcaacctggcggcagcgcaaaagatg

SEQ ID NO: 37856 - DNA, 103 bp, Artificial Sequence
  Synthetic Polynucleotide
taatacgactcactatagggctcgcgcggcagaaactgtgaaagggaacgaacagaggagacgttccatgtcacagtttaacctggcggcagcgcaaaagatg

SEQ ID NO: 37857 - DNA, 103 bp, Artificial Sequence
  Synthetic Polynucleotide
taatacgactcactatagggagctaaccgctaaactcgctgaacgctacgaacagaggagacgtagcatgcagcgagttaacctggcggcagcgcaaaagatg

SEQ ID NO: 37858 - DNA, 103 bp, Artificial Sequence
  Synthetic Polynucleotide
taatacgactcactatagggggaatgactcggacttgtggcctcggtacaaacagaggagatgtaccatggccacaagtaacctggcggcagcgcaaaagatg

SEQ ID NO: 37859 - DNA, 103 bp, Artificial Sequence
  Synthetic Polynucleotide
taatacgactcactatagggggacccttatgcaagtagttccacggctagaacagaggagactagccatggaactacttaacctggcggcagcgcaaaagatg

SEQ ID NO: 37860 - DNA, 103 bp, Artificial Sequence
  Synthetic Polynucleotide
taatacgactcactatagggccccctactatgtccccgacataccccggcaacagaggagagccgggatgtgtcggggaaacctggcggcagcgcaaaagatg

SEQ ID NO: 37861 - DNA, 103 bp, Artificial Sequence
  Synthetic Polynucleotide
taatacgactcactatagggcttacttaacgaatttagagtgtggggccaaacagaggagatggcccatgactctaaataacctggcggcagcgcaaaagatg

SEQ ID NO: 37862 - DNA, 103 bp, Artificial Sequence
  Synthetic Polynucleotide
taatacgactcactatagggagcattatgttggtgacccgagtggccgcgaacagaggagacgcggcatgtcgggtcacaacctggcggcagcgcaaaagatg

SEQ ID NO: 37863 - DNA, 103 bp, Artificial Sequence
  Synthetic Polynucleotide
taatacgactcactataggggtagacccatatggaaggggtgcagacggtaacagaggagaaccgtcatgaccccttccaacctggcggcagcgcaaaagatg

SEQ ID NO: 37864 - DNA, 103 bp, Artificial Sequence
  Synthetic Polynucleotide
taatacgactcactatagggtatctattcagcgttgtaacttatgtgcataacagaggagaatgcacatgagttacaacaacctggcggcagcgcaaaagatg

SEQ ID NO: 37865 - DNA, 103 bp, Artificial Sequence
  Synthetic Polynucleotide
taatacgactcactatagggagcacgattcccaacgataagaatacacagaacagaggagactgtgtatgcttatcgttaacctggcggcagcgcaaaagatg

SEQ ID NO: 37866 - DNA, 103 bp, Artificial Sequence
  Synthetic Polynucleotide
taatacgactcactatagggaccaccactacttaactgcgttgtttatcaaacagaggagatgataaatgacgcagttaaacctggcggcagcgcaaaagatg

SEQ ID NO: 37867 - DNA, 103 bp, Artificial Sequence
  Synthetic Polynucleotide
taatacgactcactatagggtcatacaatttatctgcgagcacttggtgaaacagaggagatcaccaatggctcgcagaaacctggcggcagcgcaaaagatg

SEQ ID NO: 37868 - DNA, 103 bp, Artificial Sequence
  Synthetic Polynucleotide
taatacgactcactataggggcttagctgacccagggaagcgcctgttacaacagaggagagtaacaatggcttccctgaacctggcggcagcgcaaaagatg

SEQ ID NO: 37869 - DNA, 103 bp, Artificial Sequence
  Synthetic Polynucleotide
taatacgactcactataggggtcataggtgcaccgataaagtcaggatccaacagaggagaggatccatgctttatcggaacctggcggcagcgcaaaagatg

SEQ ID NO: 37870 - DNA, 103 bp, Artificial Sequence
  Synthetic Polynucleotide
taatacgactcactatagggcagtaaccgccctagtaggccaggaggtgcaacagaggagagcacctatgggcctactaaacctggcggcagcgcaaaagatg

SEQ ID NO: 37871 - DNA, 103 bp, Artificial Sequence
  Synthetic Polynucleotide
taatacgactcactatagggaggctatgcacgcgttgatattccgtcaggaacagaggagacctgacatgatatcaacgaacctggcggcagcgcaaaagatg

SEQ ID NO: 37872 - DNA, 103 bp, Artificial Sequence
  Synthetic Polynucleotide
taatacgactcactataggggtcgacgagcgggggcgctcgagcggccgcaacagaggagagcggccatgcgagcgcccaacctggcggcagcgcaaaagatg

SEQ ID NO: 37873 - DNA, 103 bp, Artificial Sequence
  Synthetic Polynucleotide
taatacgactcactatagggaggcacgggcagttgtcagctccatgcctgaacagaggagacaggcaatgagctgacaaaacctggcggcagcgcaaaagatg

SEQ ID NO: 37874 - DNA, 103 bp, Artificial Sequence
  Synthetic Polynucleotide
taatacgactcactataggggaagttgcgctctccccaacgagatgaataaacagaggagatattcaatgcgttggggaaacctggcggcagcgcaaaagatg

SEQ ID NO: 37875 - DNA, 103 bp, Artificial Sequence
  Synthetic Polynucleotide
taatacgactcactataggggagctaatggttagttttttctagtccggcaacagaggagagccggaatggaaaaaactaacctggcggcagcgcaaaagatg

SEQ ID NO: 37876 - DNA, 103 bp, Artificial Sequence
  Synthetic Polynucleotide
taatacgactcactatagggtccagtggcttgcagatttgacccaaacaaaacagaggagattgtttatgtcaaatctgaacctggcggcagcgcaaaagatg

SEQ ID NO: 37877 - DNA, 103 bp, Artificial Sequence
  Synthetic Polynucleotide
taatacgactcactatagggaatcccttttacaccgcggggattcaggcgaacagaggagacgcctgatgccccgcggtaacctggcggcagcgcaaaagatg

SEQ ID NO: 37878 - DNA, 103 bp, Artificial Sequence
  Synthetic Polynucleotide
taatacgactcactatagggttcttggaccggcggccccatttgcataagaacagaggagacttatgatgatggggccgaacctggcggcagcgcaaaagatg

SEQ ID NO: 37879 - DNA, 103 bp, Artificial Sequence
  Synthetic Polynucleotide
taatacgactcactatagggcggagcttttgccgtcatcgctccggtacaaacagaggagatgtaccatggcgatgacgaacctggcggcagcgcaaaagatg

SEQ ID NO: 37880 - DNA, 103 bp, Artificial Sequence
  Synthetic Polynucleotide
taatacgactcactataggggtacaggacgatcgacgccgagataaagaaaacagaggagattctttatgtcggcgtcgaacctggcggcagcgcaaaagatg

SEQ ID NO: 37881 - DNA, 103 bp, Artificial Sequence
  Synthetic Polynucleotide
taatacgactcactatagggatttcgctatcaacatgtgtcttcccgatcaacagaggagagatcggatggacacatgtaacctggcggcagcgcaaaagatg

SEQ ID NO: 37882 - DNA, 103 bp, Artificial Sequence
  Synthetic Polynucleotide
taatacgactcactatagggtttgtccacgacatctgatcggttggcataaacagaggagatatgccatgcgatcagataacctggcggcagcgcaaaagatg

SEQ ID NO: 37883 - DNA, 103 bp, Artificial Sequence
  Synthetic Polynucleotide
taatacgactcactatagggaacatgccgctcgctctcttcccgcaatccaacagaggagaggattgatggaagagagcaacctggcggcagcgcaaaagatg

SEQ ID NO: 37884 - DNA, 103 bp, Artificial Sequence
  Synthetic Polynucleotide
taatacgactcactatagggcctaggggagtctgccattgaggggctcaaaacagaggagattgagcatgtcaatggcaaacctggcggcagcgcaaaagatg

SEQ ID NO: 37885 - DNA, 103 bp, Artificial Sequence
  Synthetic Polynucleotide
taatacgactcactataggggacacttgcgtagtaccggacgagaaaatgaacagaggagacattttatggtccggtacaacctggcggcagcgcaaaagatg

SEQ ID NO: 37886 - DNA, 103 bp, Artificial Sequence
  Synthetic Polynucleotide
taatacgactcactataggggacggatcagaaagccctctgtcttcctgaaacagaggagatcaggaatgcagagggctaacctggcggcagcgcaaaagatg

SEQ ID NO: 37887 - DNA, 103 bp, Artificial Sequence
  Synthetic Polynucleotide
taatacgactcactatagggaccctcgttgacaggctactctgagttagaaacagaggagatctaacatggagtagcctaacctggcggcagcgcaaaagatg

SEQ ID NO: 37888 - DNA, 103 bp, Artificial Sequence
  Synthetic Polynucleotide
taatacgactcactatagggtagcctagaaccggccttgtactggctattaacagaggagaaatagcatgtacaaggccaacctggcggcagcgcaaaagatg

SEQ ID NO: 37889 - DNA, 103 bp, Artificial Sequence
  Synthetic Polynucleotide
taatacgactcactatagggacgcgtggggggccgtgctgaggaatcagtaacagaggagaactgatatgtcagcacggaacctggcggcagcgcaaaagatg

SEQ ID NO: 37890 - DNA, 103 bp, Artificial Sequence
  Synthetic Polynucleotide
taatacgactcactataggggcgatctatgacactcgtgccatcgacaacaacagaggagagttgtcatgggcacgagtaacctggcggcagcgcaaaagatg

SEQ ID NO: 37891 - DNA, 103 bp, Artificial Sequence
  Synthetic Polynucleotide
taatacgactcactatagggttatatgtgatttgatgggcctgagatttaaacagaggagataaatcatgggcccatcaaacctggcggcagcgcaaaagatg

SEQ ID NO: 37892 - DNA, 103 bp, Artificial Sequence
  Synthetic Polynucleotide
taatacgactcactatagggctagaagcatacgtcgacgcgccagatactaacagaggagaagtatcatgcgcgtcgacaacctggcggcagcgcaaaagatg

SEQ ID NO: 37893 - DNA, 103 bp, Artificial Sequence
  Synthetic Polynucleotide
taatacgactcactatagggcattgatcctgagggcaacggtacttctgaaacagaggagatcagaaatgccgttgcccaacctggcggcagcgcaaaagatg

SEQ ID NO: 37894 - DNA, 103 bp, Artificial Sequence
  Synthetic Polynucleotide
taatacgactcactatagggggtactctcatccttcaggctctgccgatcaacagaggagagatcggatgagcctgaagaacctggcggcagcgcaaaagatg

SEQ ID NO: 37895 - DNA, 103 bp, Artificial Sequence
  Synthetic Polynucleotide
taatacgactcactatagggcgctgggtagtggaggcatcataagcagctaacagaggagaagctgcatgtgatgcctcaacctggcggcagcgcaaaagatg

SEQ ID NO: 37896 - DNA, 103 bp, Artificial Sequence
  Synthetic Polynucleotide
taatacgactcactatagggtaaagttggccaggcgtagagagcacctcaaacagaggagatgaggtatgctctacgccaacctggcggcagcgcaaaagatg

SEQ ID NO: 37897 - DNA, 103 bp, Artificial Sequence
  Synthetic Polynucleotide
taatacgactcactataggggtggctatcgacacagcgtcatgatgcgttaacagaggagaaacgcaatgtgacgctgtaacctggcggcagcgcaaaagatg

SEQ ID NO: 37898 - DNA, 103 bp, Artificial Sequence
  Synthetic Polynucleotide
taatacgactcactatagggtgctgctaagccctgacagtctaggaactaaacagaggagatagttcatggactgtcagaacctggcggcagcgcaaaagatg

SEQ ID NO: 37899 - DNA, 103 bp, Artificial Sequence
  Synthetic Polynucleotide
taatacgactcactatagggacctgccatctaagccatcattaccaccttaacagaggagaaaggtgatgatgatggctaacctggcggcagcgcaaaagatg

SEQ ID NO: 37900 - DNA, 103 bp, Artificial Sequence
  Synthetic Polynucleotide
taatacgactcactatagggactctctagccgtcccccgcgaccagtcctaacagaggagaaggactatgcgcgggggaaacctggcggcagcgcaaaagatg

SEQ ID NO: 37901 - DNA, 103 bp, Artificial Sequence
  Synthetic Polynucleotide
taatacgactcactatagggtatgtccaattcacacacgtaatcaattgcaacagaggagagcaattatgtacgtgtgtaacctggcggcagcgcaaaagatg

SEQ ID NO: 37902 - DNA, 103 bp, Artificial Sequence
  Synthetic Polynucleotide
taatacgactcactatagggtctaggatcgcgtacgccccggaacatcttaacagaggagaaagatgatgcggggcgtaaacctggcggcagcgcaaaagatg

SEQ ID NO: 37903 - DNA, 103 bp, Artificial Sequence
  Synthetic Polynucleotide
taatacgactcactatagggctacccttcaacagcgtcagacgtggggttaacagaggagaaaccccatgtctgacgctaacctggcggcagcgcaaaagatg

SEQ ID NO: 37904 - DNA, 103 bp, Artificial Sequence
  Synthetic Polynucleotide
taatacgactcactatagggtgcccccattgaacactacactccccaggtaacagaggagaacctggatggtgtagtgtaacctggcggcagcgcaaaagatg

SEQ ID NO: 37905 - DNA, 103 bp, Artificial Sequence
  Synthetic Polynucleotide
taatacgactcactataggggctacggcgggagtgaattcgcaatatcgtaacagaggagaacgataatgcgaattcacaacctggcggcagcgcaaaagatg

SEQ ID NO: 37906 - DNA, 103 bp, Artificial Sequence
  Synthetic Polynucleotide
taatacgactcactataggggattaaggttttttctgcagggttaaatccaacagaggagaggatttatgcctgcagaaaacctggcggcagcgcaaaagatg

SEQ ID NO: 37907 - DNA, 103 bp, Artificial Sequence
  Synthetic Polynucleotide
taatacgactcactatagggacataaaaaaaataccgtttctaaacgcagaacagaggagactgcgtatggaaacggtaaacctggcggcagcgcaaaagatg

SEQ ID NO: 37908 - DNA, 103 bp, Artificial Sequence
  Synthetic Polynucleotide
taatacgactcactatagggaatcattagtgcagcccacgcaagcggctaaacagaggagatagccgatggcgtgggctaacctggcggcagcgcaaaagatg

SEQ ID NO: 37909 - DNA, 103 bp, Artificial Sequence
  Synthetic Polynucleotide
taatacgactcactatagggtgctagaactatttgatgacacgatgaatgaacagaggagacattcaatgtgtcatcaaaacctggcggcagcgcaaaagatg

SEQ ID NO: 37910 - DNA, 103 bp, Artificial Sequence
  Synthetic Polynucleotide
taatacgactcactatagggtgtcgcgggaacatactcctgtcagctgataacagaggagaatcagcatgcaggagtataacctggcggcagcgcaaaagatg

SEQ ID NO: 37911 - DNA, 103 bp, Artificial Sequence
  Synthetic Polynucleotide
taatacgactcactatagggcgccttggaacaacgaacacccgccaaggcaacagaggagagccttgatgggtgttcgtaacctggcggcagcgcaaaagatg

SEQ ID NO: 37912 - DNA, 103 bp, Artificial Sequence
  Synthetic Polynucleotide
taatacgactcactataggggttgtggttaatgccaccgctaaaaatgttaacagaggagaaacattatgagcggtggcaacctggcggcagcgcaaaagatg

SEQ ID NO: 37913 - DNA, 103 bp, Artificial Sequence
  Synthetic Polynucleotide
taatacgactcactatagggacctaaagtaactgttccttatgggccggcaacagaggagagccggcatgtaaggaacaaacctggcggcagcgcaaaagatg

SEQ ID NO: 37914 - DNA, 103 bp, Artificial Sequence
  Synthetic Polynucleotide
taatacgactcactatagggatatgcgccgcttgctagattaatgtcatgaacagaggagacatgacatgaatctagcaaacctggcggcagcgcaaaagatg

SEQ ID NO: 37915 - DNA, 103 bp, Artificial Sequence
  Synthetic Polynucleotide
taatacgactcactataggggctacccctccaaacctccagcgctggttgaacagaggagacaaccaatgctggaggttaacctggcggcagcgcaaaagatg

SEQ ID NO: 37916 - DNA, 103 bp, Artificial Sequence
  Synthetic Polynucleotide
taatacgactcactatagggtgctctggcggcacgcacggcgctagcaacaacagaggagagttgctatggccgtgcgtaacctggcggcagcgcaaaagatg

SEQ ID NO: 37917 - DNA, 103 bp, Artificial Sequence
  Synthetic Polynucleotide
taatacgactcactataggggtagtggacggtactacaaatcactgaggtaacagaggagaacctcaatgatttgtagtaacctggcggcagcgcaaaagatg

SEQ ID NO: 37918 - DNA, 103 bp, Artificial Sequence
  Synthetic Polynucleotide
taatacgactcactatagggaccaaacaagtgaatgcgtcagttagcactaacagaggagaagtgctatgtgacgcattaacctggcggcagcgcaaaagatg

SEQ ID NO: 37919 - DNA, 103 bp, Artificial Sequence
  Synthetic Polynucleotide
taatacgactcactatagggcgtacgagccccggtgtatcgctgggttataacagaggagaataaccatgcgatacaccaacctggcggcagcgcaaaagatg

SEQ ID NO: 37920 - DNA, 103 bp, Artificial Sequence
  Synthetic Polynucleotide
taatacgactcactataggggacaaaaaaagcatgggcagcctaatttagaacagaggagactaaatatggctgcccataacctggcggcagcgcaaaagatg

SEQ ID NO: 37921 - DNA, 103 bp, Artificial Sequence
  Synthetic Polynucleotide
taatacgactcactatagggattgggtgtacgatgtttctaaattgtgttaacagaggagaaacacaatgtagaaacataacctggcggcagcgcaaaagatg

SEQ ID NO: 37922 - DNA, 103 bp, Artificial Sequence
  Synthetic Polynucleotide
taatacgactcactatagggtgagtgatacaaggccttatcaaataccgtaacagaggagaacggtaatggataaggccaacctggcggcagcgcaaaagatg

SEQ ID NO: 37923 - DNA, 103 bp, Artificial Sequence
  Synthetic Polynucleotide
taatacgactcactatagggtgcaggtctatcactgcccttccggaaggcaacagaggagagccttcatgaagggcagtaacctggcggcagcgcaaaagatg

SEQ ID NO: 37924 - DNA, 103 bp, Artificial Sequence
  Synthetic Polynucleotide
taatacgactcactatagggtagcatttctcatgtcatctaattttctgtaacagaggagaacagaaatgtagatgacaaacctggcggcagcgcaaaagatg

SEQ ID NO: 37925 - DNA, 103 bp, Artificial Sequence
  Synthetic Polynucleotide
taatacgactcactatagggcccgctccttaacagagctccgtcaggtgaaacagaggagatcacctatgggagctctgaacctggcggcagcgcaaaagatg

SEQ ID NO: 37926 - DNA, 103 bp, Artificial Sequence
  Synthetic Polynucleotide
taatacgactcactatagggcgcctagattacttcgcggatcatggagagaacagaggagactctccatgatccgcgaaaacctggcggcagcgcaaaagatg

SEQ ID NO: 37927 - DNA, 103 bp, Artificial Sequence
  Synthetic Polynucleotide
taatacgactcactataggggacgcgtcccgctgggccacctaattcatgaacagaggagacatgaaatgggtggcccaaacctggcggcagcgcaaaagatg

SEQ ID NO: 37928 - DNA, 103 bp, Artificial Sequence
  Synthetic Polynucleotide
taatacgactcactatagggtcgaaaacacgatcagcaaaagtcaaggctaacagaggagaagccttatgttttgctgaaacctggcggcagcgcaaaagatg

SEQ ID NO: 37929 - DNA, 103 bp, Artificial Sequence
  Synthetic Polynucleotide
taatacgactcactatagggcaggtcccagtcccgcgatgataaagctttaacagaggagaaaagctatgtcatcgcggaacctggcggcagcgcaaaagatg

SEQ ID NO: 37930 - DNA, 103 bp, Artificial Sequence
  Synthetic Polynucleotide
taatacgactcactataggggtaaaatctgcattgcttttgcttctctttaacagaggagaaaagagatgcaaaagcaaaacctggcggcagcgcaaaagatg

SEQ ID NO: 37931 - DNA, 103 bp, Artificial Sequence
  Synthetic Polynucleotide
taatacgactcactatagggttgtatagatccggcggctgcctggtggacaacagaggagagtccacatggcagccgccaacctggcggcagcgcaaaagatg

SEQ ID NO: 37932 - DNA, 103 bp, Artificial Sequence
  Synthetic Polynucleotide
taatacgactcactatagggtagcggcttactcatttggcgtttcttcggaacagaggagaccgaagatgcgccaaatgaacctggcggcagcgcaaaagatg

SEQ ID NO: 37933 - DNA, 103 bp, Artificial Sequence
  Synthetic Polynucleotide
taatacgactcactataggggacagagcaaccggcttatcgacttcggcgaacagaggagacgccgaatgcgataagccaacctggcggcagcgcaaaagatg

SEQ ID NO: 37934 - DNA, 103 bp, Artificial Sequence
  Synthetic Polynucleotide
taatacgactcactatagggccggaggggccagcaaaggtctaaagttgaaacagaggagatcaactatggacctttgcaacctggcggcagcgcaaaagatg

SEQ ID NO: 37935 - DNA, 103 bp, Artificial Sequence
  Synthetic Polynucleotide
taatacgactcactatagggaactaggtaggatggatgatagcatactataacagaggagaatagtaatgtatcatccaaacctggcggcagcgcaaaagatg

SEQ ID NO: 37936 - DNA, 103 bp, Artificial Sequence
  Synthetic Polynucleotide
taatacgactcactatagggtcgacgtaaaagtaaccaacgtatggattaaacagaggagataatccatgcgttggttaaacctggcggcagcgcaaaagatg

SEQ ID NO: 37937 - DNA, 103 bp, Artificial Sequence
  Synthetic Polynucleotide
taatacgactcactataggggtgctgcctaggcgccccaataagagcctcaacagaggagagaggctatgattggggcgaacctggcggcagcgcaaaagatg

SEQ ID NO: 37938 - DNA, 103 bp, Artificial Sequence
  Synthetic Polynucleotide
taatacgactcactataggggaaatagtagcagatcagagagatggacataacagaggagaatgtccatgtctctgatcaacctggcggcagcgcaaaagatg

SEQ ID NO: 37939 - DNA, 103 bp, Artificial Sequence
  Synthetic Polynucleotide
taatacgactcactatagggcgtaattagccatgtctatctcgtgtgtttaacagaggagaaaacacatgagatagacaaacctggcggcagcgcaaaagatg

SEQ ID NO: 37940 - DNA, 103 bp, Artificial Sequence
  Synthetic Polynucleotide
taatacgactcactatagggtcaaggtaacgagaccactgtgctgcgactaacagaggagaagtcgcatgacagtggtcaacctggcggcagcgcaaaagatg

SEQ ID NO: 37941 - DNA, 103 bp, Artificial Sequence
  Synthetic Polynucleotide
taatacgactcactataggggacccagacatactccattctagcagccttaacagaggagaaaggctatgagaatggagaacctggcggcagcgcaaaagatg

SEQ ID NO: 37942 - DNA, 103 bp, Artificial Sequence
  Synthetic Polynucleotide
taatacgactcactataggggaatggggctatctcgcgcttggatcaccaaacagaggagatggtgaatgaagcgcgagaacctggcggcagcgcaaaagatg

SEQ ID NO: 37943 - DNA, 103 bp, Artificial Sequence
  Synthetic Polynucleotide
taatacgactcactatagggcaggtggacaagatgtccgaccagccgagtaacagaggagaactcggatggtcggacataacctggcggcagcgcaaaagatg

SEQ ID NO: 37944 - DNA, 103 bp, Artificial Sequence
  Synthetic Polynucleotide
taatacgactcactatagggagagccagtccggccaggggtactcctctgaacagaggagacagaggatgacccctggcaacctggcggcagcgcaaaagatg

SEQ ID NO: 37945 - DNA, 103 bp, Artificial Sequence
  Synthetic Polynucleotide
taatacgactcactatagggactattcgatacaaaacgtcggctctatccaacagaggagaggatagatgcgacgttttaacctggcggcagcgcaaaagatg

SEQ ID NO: 37946 - DNA, 103 bp, Artificial Sequence
  Synthetic Polynucleotide
taatacgactcactatagggccggaaagcggggccaactgcggcaacgcgaacagaggagacgcgttatggcagttggcaacctggcggcagcgcaaaagatg

SEQ ID NO: 37947 - DNA, 103 bp, Artificial Sequence
  Synthetic Polynucleotide
taatacgactcactataggggagtaaatcaggattcgggtctaattcgccaacagaggagaggcgaaatggacccgaataacctggcggcagcgcaaaagatg

SEQ ID NO: 37948 - DNA, 103 bp, Artificial Sequence
  Synthetic Polynucleotide
taatacgactcactatagggcaggccatccattttagacccagttctccaaacagaggagatggagaatggggtctaaaaacctggcggcagcgcaaaagatg

SEQ ID NO: 37949 - DNA, 103 bp, Artificial Sequence
  Synthetic Polynucleotide
taatacgactcactatagggcagagtggatgctaccatggatatcattttaacagaggagaaaaatgatgtccatggtaaacctggcggcagcgcaaaagatg

SEQ ID NO: 37950 - DNA, 103 bp, Artificial Sequence
  Synthetic Polynucleotide
taatacgactcactataggggagcggcggagtcttccgtagtcgccctataacagaggagaatagggatgctacggaagaacctggcggcagcgcaaaagatg

SEQ ID NO: 37951 - DNA, 103 bp, Artificial Sequence
  Synthetic Polynucleotide
taatacgactcactatagggagtggtaagataggacctacaaggggtggtaacagaggagaaccaccatgtgtaggtccaacctggcggcagcgcaaaagatg

SEQ ID NO: 37952 - DNA, 103 bp, Artificial Sequence
  Synthetic Polynucleotide
taatacgactcactatagggctcggttcctggtggtcgtggatgggaggcaacagaggagagcctccatgccacgaccaaacctggcggcagcgcaaaagatg

SEQ ID NO: 37953 - DNA, 103 bp, Artificial Sequence
  Synthetic Polynucleotide
taatacgactcactatagggcgcgtgcctgagaagcagcgtaagaatgttaacagaggagaaacattatgacgctgcttaacctggcggcagcgcaaaagatg

SEQ ID NO: 37954 - DNA, 103 bp, Artificial Sequence
  Synthetic Polynucleotide
taatacgactcactatagggagagatgaatttactcgtaacgtggatatgaacagaggagacatatcatggttacgagtaacctggcggcagcgcaaaagatg

SEQ ID NO: 37955 - DNA, 103 bp, Artificial Sequence
  Synthetic Polynucleotide
taatacgactcactataggggggcagagcggcaatatgaccgatgtcaccaacagaggagaggtgacatgggtcatattaacctggcggcagcgcaaaagatg

SEQ ID NO: 37956 - DNA, 103 bp, Artificial Sequence
  Synthetic Polynucleotide
taatacgactcactatagggtcccgacttggaccgaacagatatggcgcaaacagaggagatgcgccatgtctgttcggaacctggcggcagcgcaaaagatg

SEQ ID NO: 37957 - DNA, 103 bp, Artificial Sequence
  Synthetic Polynucleotide
taatacgactcactatagggaatagaaatccccacagagcccgactgttcaacagaggagagaacagatgggctctgtgaacctggcggcagcgcaaaagatg

SEQ ID NO: 37958 - DNA, 103 bp, Artificial Sequence
  Synthetic Polynucleotide
taatacgactcactatagggtggttagcacacgggttaaggtgtgcggtaaacagaggagataccgcatgccttaacccaacctggcggcagcgcaaaagatg

SEQ ID NO: 37959 - DNA, 103 bp, Artificial Sequence
  Synthetic Polynucleotide
taatacgactcactatagggtcggtcgaatatgcttccactaatcccaggaacagaggagacctgggatgagtggaagcaacctggcggcagcgcaaaagatg

SEQ ID NO: 37960 - DNA, 103 bp, Artificial Sequence
  Synthetic Polynucleotide
taatacgactcactatagggtaaactcattcaccgcttttgttaacgtagaacagaggagactacgtatgcaaaagcggaacctggcggcagcgcaaaagatg

SEQ ID NO: 37961 - DNA, 103 bp, Artificial Sequence
  Synthetic Polynucleotide
taatacgactcactatagggctaattctcacgcgccgacgcaccgccaataacagaggagaattggcatggcgtcggcgaacctggcggcagcgcaaaagatg

SEQ ID NO: 37962 - DNA, 103 bp, Artificial Sequence
  Synthetic Polynucleotide
taatacgactcactatagggcattcgggctataaaagatacgctgcgatgaacagaggagacatcgcatggtatcttttaacctggcggcagcgcaaaagatg

SEQ ID NO: 37963 - DNA, 103 bp, Artificial Sequence
  Synthetic Polynucleotide
taatacgactcactatagggccgtcttcaacacaatccataataatagttaacagaggagaaactatatgtatggattgaacctggcggcagcgcaaaagatg

SEQ ID NO: 37964 - DNA, 103 bp, Artificial Sequence
  Synthetic Polynucleotide
taatacgactcactatagggcagtgcaggccgtaccaagctggcgggtctaacagaggagaagacccatgagcttggtaaacctggcggcagcgcaaaagatg

SEQ ID NO: 37965 - DNA, 103 bp, Artificial Sequence
  Synthetic Polynucleotide
taatacgactcactatagggatctccgacgctcggaacatgaagccgggcaacagaggagagcccggatgcatgttccgaacctggcggcagcgcaaaagatg

SEQ ID NO: 37966 - DNA, 103 bp, Artificial Sequence
  Synthetic Polynucleotide
taatacgactcactatagggcctaggtgagcaagcgggtagaaggtgcggaacagaggagaccgcacatgctacccgctaacctggcggcagcgcaaaagatg

SEQ ID NO: 37967 - DNA, 103 bp, Artificial Sequence
  Synthetic Polynucleotide
taatacgactcactatagggttaacgcgtcccatcccatagtacgatgggaacagaggagacccatcatgctatgggataacctggcggcagcgcaaaagatg

SEQ ID NO: 37968 - DNA, 103 bp, Artificial Sequence
  Synthetic Polynucleotide
taatacgactcactatagggtcagctgtactacaacacagtctttgaagcaacagaggagagcttcaatgactgtgttgaacctggcggcagcgcaaaagatg

SEQ ID NO: 37969 - DNA, 103 bp, Artificial Sequence
  Synthetic Polynucleotide
taatacgactcactatagggaagcggcgggcgattccaagtctcactgctaacagaggagaagcagtatgacttggaataacctggcggcagcgcaaaagatg

SEQ ID NO: 37970 - DNA, 103 bp, Artificial Sequence
  Synthetic Polynucleotide
taatacgactcactatagggcttgcagacggcactcccccttcacatagcaacagaggagagctatgatgagggggagtaacctggcggcagcgcaaaagatg

SEQ ID NO: 37971 - DNA, 103 bp, Artificial Sequence
  Synthetic Polynucleotide
taatacgactcactatagggcggagtcaacgtgggtggcttccacagcgtaacagaggagaacgctgatgaagccacccaacctggcggcagcgcaaaagatg

SEQ ID NO: 37972 - DNA, 103 bp, Artificial Sequence
  Synthetic Polynucleotide
taatacgactcactatagggactaaccggggtccctatattcaatccctcaacagaggagagagggaatgaatatagggaacctggcggcagcgcaaaagatg

SEQ ID NO: 37973 - DNA, 103 bp, Artificial Sequence
  Synthetic Polynucleotide
taatacgactcactatagggcgggccgattacattgcggaggtttcatccaacagaggagaggatgaatgctccgcaataacctggcggcagcgcaaaagatg

SEQ ID NO: 37974 - DNA, 103 bp, Artificial Sequence
  Synthetic Polynucleotide
taatacgactcactatagggtggtccatagctaacaggtctatagcttttaacagaggagaaaaagcatgagacctgttaacctggcggcagcgcaaaagatg

SEQ ID NO: 37975 - DNA, 103 bp, Artificial Sequence
  Synthetic Polynucleotide
taatacgactcactatagggtccgaccggaggcgacgataagtaaggtgtaacagaggagaacacctatgttatcgtcgaacctggcggcagcgcaaaagatg

SEQ ID NO: 37976 - DNA, 103 bp, Artificial Sequence
  Synthetic Polynucleotide
taatacgactcactataggggtctggcggcccacctattcacagaggtataacagaggagaatacctatgtgaataggtaacctggcggcagcgcaaaagatg

SEQ ID NO: 37977 - DNA, 103 bp, Artificial Sequence
  Synthetic Polynucleotide
taatacgactcactatagggggttcagcttttggctatactgacttttaaaacagaggagattaaaaatgagtatagccaacctggcggcagcgcaaaagatg

SEQ ID NO: 37978 - DNA, 103 bp, Artificial Sequence
  Synthetic Polynucleotide
taatacgactcactatagggaggcggtggacgcggagctagatcgctcataacagaggagaatgagcatgctagctccgaacctggcggcagcgcaaaagatg

SEQ ID NO: 37979 - DNA, 103 bp, Artificial Sequence
  Synthetic Polynucleotide
taatacgactcactataggggaaaccgccccatcaatcgctcagattccaaacagaggagatggaatatgagcgattgaaacctggcggcagcgcaaaagatg

SEQ ID NO: 37980 - DNA, 103 bp, Artificial Sequence
  Synthetic Polynucleotide
taatacgactcactatagggcacttgggtgttggttaggagaagatgatgaacagaggagacatcatatgctcctaaccaacctggcggcagcgcaaaagatg

SEQ ID NO: 37981 - DNA, 103 bp, Artificial Sequence
  Synthetic Polynucleotide
taatacgactcactatagggtataccgggttgcataattctgtggggcgcaacagaggagagcgcccatgagaattatgaacctggcggcagcgcaaaagatg

SEQ ID NO: 37982 - DNA, 103 bp, Artificial Sequence
  Synthetic Polynucleotide
taatacgactcactatagggatttcctaaggaatttggcttcgtagcacaaacagaggagatgtgctatgaagccaaataacctggcggcagcgcaaaagatg

SEQ ID NO: 37983 - DNA, 103 bp, Artificial Sequence
  Synthetic Polynucleotide
taatacgactcactataggggtaggatagggctaaacttttagtatcgacaacagaggagagtcgatatgaaaagtttaaacctggcggcagcgcaaaagatg

SEQ ID NO: 37984 - DNA, 103 bp, Artificial Sequence
  Synthetic Polynucleotide
taatacgactcactataggggtgttcattagtctagtgcaggtacggataaacagaggagatatccgatgctgcactagaacctggcggcagcgcaaaagatg

SEQ ID NO: 37985 - DNA, 103 bp, Artificial Sequence
  Synthetic Polynucleotide
taatacgactcactatagggaatagcggcgctgtattgagcaacctctccaacagaggagaggagagatggctcaatacaacctggcggcagcgcaaaagatg

SEQ ID NO: 37986 - DNA, 103 bp, Artificial Sequence
  Synthetic Polynucleotide
taatacgactcactatagggaacattcacgacttcggtatatttcgagtcaacagaggagagactcgatgtataccgaaaacctggcggcagcgcaaaagatg

SEQ ID NO: 37987 - DNA, 103 bp, Artificial Sequence
  Synthetic Polynucleotide
taatacgactcactatagggtgctcagaacacctataaaactggttgctgaacagaggagacagcaaatggttttatagaacctggcggcagcgcaaaagatg

SEQ ID NO: 37988 - DNA, 103 bp, Artificial Sequence
  Synthetic Polynucleotide
taatacgactcactatagggatccccgcgttacacttttgttcggagtacaacagaggagagtactcatgacaaaagtgaacctggcggcagcgcaaaagatg

SEQ ID NO: 37989 - DNA, 103 bp, Artificial Sequence
  Synthetic Polynucleotide
taatacgactcactatagggaggatggagcagactctggagaccacccgcaacagaggagagcgggtatgctccagagtaacctggcggcagcgcaaaagatg

SEQ ID NO: 37990 - DNA, 103 bp, Artificial Sequence
  Synthetic Polynucleotide
taatacgactcactatagggaatatagcggacggaagtttagccgtcgcgaacagaggagacgcgacatgtaaacttccaacctggcggcagcgcaaaagatg

SEQ ID NO: 37991 - DNA, 103 bp, Artificial Sequence
  Synthetic Polynucleotide
taatacgactcactatagggttattggggggacttttgagtatcgtccgtaacagaggagaacggacatgactcaaaagaacctggcggcagcgcaaaagatg

SEQ ID NO: 37992 - DNA, 103 bp, Artificial Sequence
  Synthetic Polynucleotide
taatacgactcactataggggccagcacaagactgattttccccgtgttaaacagaggagataacacatggaaaatcagaacctggcggcagcgcaaaagatg

SEQ ID NO: 37993 - DNA, 103 bp, Artificial Sequence
  Synthetic Polynucleotide
taatacgactcactatagggaccctcggtacgacctgaccagagcgagtgaacagaggagacactcgatgtggtcaggtaacctggcggcagcgcaaaagatg

SEQ ID NO: 37994 - DNA, 103 bp, Artificial Sequence
  Synthetic Polynucleotide
taatacgactcactatagggtcggcgattcttccggtcccaatcgggaacaacagaggagagttcccatgtgggaccggaacctggcggcagcgcaaaagatg

SEQ ID NO: 37995 - DNA, 103 bp, Artificial Sequence
  Synthetic Polynucleotide
taatacgactcactatagggtttgagactgatagggacttgacctagcagaacagaggagactgctaatgcaagtccctaacctggcggcagcgcaaaagatg

SEQ ID NO: 37996 - DNA, 103 bp, Artificial Sequence
  Synthetic Polynucleotide
taatacgactcactatagggtctagtaatccaagggaacctcgtgtaccgaacagaggagacggtacatgaggttccctaacctggcggcagcgcaaaagatg

SEQ ID NO: 37997 - DNA, 103 bp, Artificial Sequence
  Synthetic Polynucleotide
taatacgactcactatagggaagtggctaaattgtggagagcttcggggtaacagaggagaaccccgatgctctccacaaacctggcggcagcgcaaaagatg

SEQ ID NO: 37998 - DNA, 103 bp, Artificial Sequence
  Synthetic Polynucleotide
taatacgactcactatagggaatctagaacagtgcccacaggctctgcgcaacagaggagagcgcagatgctgtgggcaaacctggcggcagcgcaaaagatg

SEQ ID NO: 37999 - DNA, 103 bp, Artificial Sequence
  Synthetic Polynucleotide
taatacgactcactataggggttacagcacctttcagctctcttagcgctaacagaggagaagcgctatgagagctgaaaacctggcggcagcgcaaaagatg

SEQ ID NO: 38000 - DNA, 103 bp, Artificial Sequence
  Synthetic Polynucleotide
taatacgactcactataggggcgggagaattgtttgtgacccaatcctgtaacagaggagaacaggaatgggtcacaaaaacctggcggcagcgcaaaagatg

SEQ ID NO: 38001 - DNA, 103 bp, Artificial Sequence
  Synthetic Polynucleotide
taatacgactcactatagggtatttcgtttaacacgccactggttacctgaacagaggagacaggtaatgagtggcgtgaacctggcggcagcgcaaaagatg

SEQ ID NO: 38002 - DNA, 103 bp, Artificial Sequence
  Synthetic Polynucleotide
taatacgactcactatagggcatggccagtgtctcggggagtcacactacaacagaggagagtagtgatgctccccgagaacctggcggcagcgcaaaagatg

SEQ ID NO: 38003 - DNA, 103 bp, Artificial Sequence
  Synthetic Polynucleotide
taatacgactcactataggggcacgacgcaagcctagattgattgcggtaaacagaggagataccgcatgcaatctaggaacctggcggcagcgcaaaagatg

SEQ ID NO: 38004 - DNA, 103 bp, Artificial Sequence
  Synthetic Polynucleotide
taatacgactcactatagggatctaccatacttccacctaaagagattcaaacagaggagatgaatcatgttaggtggaaacctggcggcagcgcaaaagatg

SEQ ID NO: 38005 - DNA, 103 bp, Artificial Sequence
  Synthetic Polynucleotide
taatacgactcactataggggtcaggatggttggtaagtcggcgggcttgaacagaggagacaagccatgcgacttaccaacctggcggcagcgcaaaagatg

SEQ ID NO: 38006 - DNA, 103 bp, Artificial Sequence
  Synthetic Polynucleotide
taatacgactcactataggggcagtcactcgcacgagacgtagcattatgaacagaggagacataatatgacgtctcgtaacctggcggcagcgcaaaagatg

SEQ ID NO: 38007 - DNA, 103 bp, Artificial Sequence
  Synthetic Polynucleotide
taatacgactcactatagggcttagacaggtaccagacctgcctcgtttcaacagaggagagaaacgatgcaggtctggaacctggcggcagcgcaaaagatg

SEQ ID NO: 38008 - DNA, 103 bp, Artificial Sequence
  Synthetic Polynucleotide
taatacgactcactatagggcattatgggcgctgcggacctaataaacacaacagaggagagtgtttatgaggtccgcaaacctggcggcagcgcaaaagatg

SEQ ID NO: 38009 - DNA, 103 bp, Artificial Sequence
  Synthetic Polynucleotide
taatacgactcactatagggggtaggatgccgggtcacagacgctcaaacaacagaggagagtttgaatgtctgtgaccaacctggcggcagcgcaaaagatg

SEQ ID NO: 38010 - DNA, 103 bp, Artificial Sequence
  Synthetic Polynucleotide
taatacgactcactatagggctggcggaaagcttgacggattgtggcaggaacagaggagacctgccatgatccgtcaaaacctggcggcagcgcaaaagatg

SEQ ID NO: 38011 - DNA, 103 bp, Artificial Sequence
  Synthetic Polynucleotide
taatacgactcactatagggttactggaaagtgtattcgttaagatgataaacagaggagatatcatatgaacgaatacaacctggcggcagcgcaaaagatg

SEQ ID NO: 38012 - DNA, 103 bp, Artificial Sequence
  Synthetic Polynucleotide
taatacgactcactatagggcatccaactcccactagatggaactttataaacagaggagatataaaatgccatctagtaacctggcggcagcgcaaaagatg

SEQ ID NO: 38013 - DNA, 103 bp, Artificial Sequence
  Synthetic Polynucleotide
taatacgactcactatagggaggggcctgggcagctgcacaagttatggaaacagaggagatccataatgtgtgcagctaacctggcggcagcgcaaaagatg

SEQ ID NO: 38014 - DNA, 103 bp, Artificial Sequence
  Synthetic Polynucleotide
taatacgactcactatagggggtccacactgtcctgttactctaacaccaaacagaggagatggtgtatgagtaacaggaacctggcggcagcgcaaaagatg

SEQ ID NO: 38015 - DNA, 103 bp, Artificial Sequence
  Synthetic Polynucleotide
taatacgactcactataggggatgtcttccctcctgcgcgcgcggcagtaaacagaggagatactgcatggcgcgcaggaacctggcggcagcgcaaaagatg

SEQ ID NO: 38016 - DNA, 103 bp, Artificial Sequence
  Synthetic Polynucleotide
taatacgactcactatagggtatatacctacgtaatggaaatacgcactaaacagaggagatagtgcatgtttccattaaacctggcggcagcgcaaaagatg

SEQ ID NO: 38017 - DNA, 103 bp, Artificial Sequence
  Synthetic Polynucleotide
taatacgactcactataggggcactgggagcatgtgacgagtttagtgctaacagaggagaagcactatgctcgtcacaaacctggcggcagcgcaaaagatg

SEQ ID NO: 38018 - DNA, 103 bp, Artificial Sequence
  Synthetic Polynucleotide
taatacgactcactatagggcgtaaggacaaatggtgttataaagtagtaaacagaggagatactacatgataacaccaaacctggcggcagcgcaaaagatg

SEQ ID NO: 38019 - DNA, 103 bp, Artificial Sequence
  Synthetic Polynucleotide
taatacgactcactatagggtccctgagatgagggctgtatgcgggcctaaacagaggagataggccatgatacagcccaacctggcggcagcgcaaaagatg

SEQ ID NO: 38020 - DNA, 103 bp, Artificial Sequence
  Synthetic Polynucleotide
taatacgactcactatagggttaccgcttctagattgacgaatcggattgaacagaggagacaatccatgtcgtcaatcaacctggcggcagcgcaaaagatg

SEQ ID NO: 38021 - DNA, 103 bp, Artificial Sequence
  Synthetic Polynucleotide
taatacgactcactatagggcgtcacgctggggaagcggtcggctcaactaacagaggagaagttgaatggaccgcttcaacctggcggcagcgcaaaagatg

SEQ ID NO: 38022 - DNA, 103 bp, Artificial Sequence
  Synthetic Polynucleotide
taatacgactcactatagggggtgactaatcgtcgaaatcctgtagaaggaacagaggagaccttctatgggatttcgaaacctggcggcagcgcaaaagatg

SEQ ID NO: 38023 - DNA, 103 bp, Artificial Sequence
  Synthetic Polynucleotide
taatacgactcactatagggtttcctccgcatagaatggattggtcgtagaacagaggagactacgaatgatccattctaacctggcggcagcgcaaaagatg

SEQ ID NO: 38024 - DNA, 103 bp, Artificial Sequence
  Synthetic Polynucleotide
taatacgactcactatagggaaacccatgcttttgcttaactcatggtgtaacagaggagaacaccaatggttaagcaaaacctggcggcagcgcaaaagatg

SEQ ID NO: 38025 - DNA, 103 bp, Artificial Sequence
  Synthetic Polynucleotide
taatacgactcactatagggggaagcgacgacaagaagtctgatacttgcaacagaggagagcaagtatgagacttcttaacctggcggcagcgcaaaagatg

SEQ ID NO: 38026 - DNA, 103 bp, Artificial Sequence
  Synthetic Polynucleotide
taatacgactcactatagggcctagggcacaaggctactgaatagtcaacaacagaggagagttgacatgtcagtagccaacctggcggcagcgcaaaagatg

SEQ ID NO: 38027 - DNA, 103 bp, Artificial Sequence
  Synthetic Polynucleotide
taatacgactcactatagggtgggaatccttgagagccaagcagcctattaacagaggagaaataggatgcttggctctaacctggcggcagcgcaaaagatg

SEQ ID NO: 38028 - DNA, 103 bp, Artificial Sequence
  Synthetic Polynucleotide
taatacgactcactatagggagcccaccattcgtgaatctacgcccagagaacagaggagactctggatgtagattcacaacctggcggcagcgcaaaagatg

SEQ ID NO: 38029 - DNA, 103 bp, Artificial Sequence
  Synthetic Polynucleotide
taatacgactcactatagggatgctccttgaggactaaatcagtccccataacagaggagaatggggatggatttagtcaacctggcggcagcgcaaaagatg

SEQ ID NO: 38030 - DNA, 103 bp, Artificial Sequence
  Synthetic Polynucleotide
taatacgactcactataggggagtgagcccatagacaggtcctgcacaagaacagaggagacttgtgatggacctgtctaacctggcggcagcgcaaaagatg

SEQ ID NO: 38031 - DNA, 103 bp, Artificial Sequence
  Synthetic Polynucleotide
taatacgactcactatagggtacgccacgggttgacccggcggttcggagaacagaggagactccgaatggccgggtcaaacctggcggcagcgcaaaagatg

SEQ ID NO: 38032 - DNA, 103 bp, Artificial Sequence
  Synthetic Polynucleotide
taatacgactcactataggggtgtctatagagagtccttagagaggtcgaaacagaggagatcgaccatgctaaggactaacctggcggcagcgcaaaagatg

SEQ ID NO: 38033 - DNA, 103 bp, Artificial Sequence
  Synthetic Polynucleotide
taatacgactcactatagggggccggcatttggacctgctgatctaaattaacagaggagaaatttaatgcagcaggtcaacctggcggcagcgcaaaagatg

SEQ ID NO: 38034 - DNA, 103 bp, Artificial Sequence
  Synthetic Polynucleotide
taatacgactcactatagggtgacttcgcgcgcgagttagtcaccgtatcaacagaggagagatacgatgactaactcgaacctggcggcagcgcaaaagatg

SEQ ID NO: 38035 - DNA, 103 bp, Artificial Sequence
  Synthetic Polynucleotide
taatacgactcactatagggccgtgtggactgcgggcgtgtcactggcgtaacagaggagaacgccaatgacacgcccgaacctggcggcagcgcaaaagatg

SEQ ID NO: 38036 - DNA, 103 bp, Artificial Sequence
  Synthetic Polynucleotide
taatacgactcactatagggatgttccactgtgcaggcctacctgaattgaacagaggagacaattcatgtaggcctgcaacctggcggcagcgcaaaagatg

SEQ ID NO: 38037 - DNA, 103 bp, Artificial Sequence
  Synthetic Polynucleotide
taatacgactcactataggggactaccaggggtggtatatcgcccctgccaacagaggagaggcaggatggatataccaaacctggcggcagcgcaaaagatg

SEQ ID NO: 38038 - DNA, 103 bp, Artificial Sequence
  Synthetic Polynucleotide
taatacgactcactatagggtggggtgtggctctgcactcgctctctacaaacagaggagatgtagaatgcgagtgcagaacctggcggcagcgcaaaagatg

SEQ ID NO: 38039 - DNA, 103 bp, Artificial Sequence
  Synthetic Polynucleotide
taatacgactcactatagggtcctcgctccggtttctagtgcgcaggttcaacagaggagagaacctatgcactagaaaaacctggcggcagcgcaaaagatg

SEQ ID NO: 38040 - DNA, 103 bp, Artificial Sequence
  Synthetic Polynucleotide
taatacgactcactatagggattttgaacgacttcattcaacaactatagaacagaggagactatagatgttgaatgaaaacctggcggcagcgcaaaagatg

SEQ ID NO: 38041 - DNA, 103 bp, Artificial Sequence
  Synthetic Polynucleotide
taatacgactcactataggggcatggcatacctcttgaaagaggctggggaacagaggagaccccagatgctttcaagaaacctggcggcagcgcaaaagatg

SEQ ID NO: 38042 - DNA, 103 bp, Artificial Sequence
  Synthetic Polynucleotide
taatacgactcactatagggaagttcagaccatcaacagttgctagcaaaaacagaggagatttgctatgaactgttgaaacctggcggcagcgcaaaagatg

SEQ ID NO: 38043 - DNA, 103 bp, Artificial Sequence
  Synthetic Polynucleotide
taatacgactcactatagggacttctggtctcccggcgttaaccacccgaaacagaggagatcgggtatgtaacgccggaacctggcggcagcgcaaaagatg

SEQ ID NO: 38044 - DNA, 103 bp, Artificial Sequence
  Synthetic Polynucleotide
taatacgactcactatagggccttctccgtttttaaactgtcatacattaaacagaggagataatgtatgacagtttaaaacctggcggcagcgcaaaagatg

SEQ ID NO: 38045 - DNA, 103 bp, Artificial Sequence
  Synthetic Polynucleotide
taatacgactcactatagggtagttgattatctagtatgtcgattaccgcaacagaggagagcggtaatggacatactaaacctggcggcagcgcaaaagatg

SEQ ID NO: 38046 - DNA, 103 bp, Artificial Sequence
  Synthetic Polynucleotide
taatacgactcactatagggtaaaatagtagaagctgttcggcgcgaagtaacagaggagaacttcgatgcgaacagctaacctggcggcagcgcaaaagatg

SEQ ID NO: 38047 - DNA, 103 bp, Artificial Sequence
  Synthetic Polynucleotide
taatacgactcactataggggggtagtaatatactaagtgttggtgtcgcaacagaggagagcgacaatgacacttagtaacctggcggcagcgcaaaagatg

SEQ ID NO: 38048 - DNA, 103 bp, Artificial Sequence
  Synthetic Polynucleotide
taatacgactcactatagggtacgtcagaggtaactgaatttctggctctaacagaggagaagagccatgaattcagttaacctggcggcagcgcaaaagatg

SEQ ID NO: 38049 - DNA, 103 bp, Artificial Sequence
  Synthetic Polynucleotide
taatacgactcactatagggttacactaccgtgtgtccctacttgtttgaaacagaggagatcaaacatgtagggacacaacctggcggcagcgcaaaagatg

SEQ ID NO: 38050 - DNA, 103 bp, Artificial Sequence
  Synthetic Polynucleotide
taatacgactcactatagggagggacccttcaaggtctgcagacctaatgaacagaggagacattagatgtgcagacctaacctggcggcagcgcaaaagatg

SEQ ID NO: 38051 - DNA, 103 bp, Artificial Sequence
  Synthetic Polynucleotide
taatacgactcactatagggttctcgcgtgaaatctcttagcacaaatgcaacagaggagagcatttatgctaagagataacctggcggcagcgcaaaagatg

SEQ ID NO: 38052 - DNA, 103 bp, Artificial Sequence
  Synthetic Polynucleotide
taatacgactcactatagggttgggtcaaccttgtctatagggaagctcaaacagaggagatgagctatgctatagacaaacctggcggcagcgcaaaagatg

SEQ ID NO: 38053 - DNA, 103 bp, Artificial Sequence
  Synthetic Polynucleotide
taatacgactcactatagggctcttgctgaacttgaccgtttagcaaaggaacagaggagacctttgatgaacggtcaaaacctggcggcagcgcaaaagatg

SEQ ID NO: 38054 - DNA, 103 bp, Artificial Sequence
  Synthetic Polynucleotide
taatacgactcactatagggctgccacctcaccaggggcttcggataattaacagaggagaaattatatgaagcccctgaacctggcggcagcgcaaaagatg

SEQ ID NO: 38055 - DNA, 103 bp, Artificial Sequence
  Synthetic Polynucleotide
taatacgactcactatagggtaaatttaaggttcgatcatatgtcctcccaacagaggagagggaggatgtatgatcgaaacctggcggcagcgcaaaagatg

SEQ ID NO: 38056 - DNA, 103 bp, Artificial Sequence
  Synthetic Polynucleotide
taatacgactcactataggggttttgtattagcagtgttgcctatcttccaacagaggagaggaagaatggcaacactgaacctggcggcagcgcaaaagatg

SEQ ID NO: 38057 - DNA, 103 bp, Artificial Sequence
  Synthetic Polynucleotide
taatacgactcactatagggtgccgtcaggacgctttcaggccatgttctaacagaggagaagaacaatgcctgaaagcaacctggcggcagcgcaaaagatg

SEQ ID NO: 38058 - DNA, 103 bp, Artificial Sequence
  Synthetic Polynucleotide
taatacgactcactatagggttgtatttagtagatgcacttacagggtgcaacagaggagagcacccatgaagtgcatcaacctggcggcagcgcaaaagatg

SEQ ID NO: 38059 - DNA, 103 bp, Artificial Sequence
  Synthetic Polynucleotide
taatacgactcactatagggacgctcgtcgggttccggcctactgaaggcaacagaggagagccttcatgaggccggaaaacctggcggcagcgcaaaagatg

SEQ ID NO: 38060 - DNA, 103 bp, Artificial Sequence
  Synthetic Polynucleotide
taatacgactcactatagggttgcataatacgcgacgtcacgacgggcagaacagaggagactgcccatggtgacgtcgaacctggcggcagcgcaaaagatg

SEQ ID NO: 38061 - DNA, 103 bp, Artificial Sequence
  Synthetic Polynucleotide
taatacgactcactatagggtgtttcgatgcaggggtccacaagaattggaacagaggagaccaattatggtggaccccaacctggcggcagcgcaaaagatg

SEQ ID NO: 38062 - DNA, 103 bp, Artificial Sequence
  Synthetic Polynucleotide
taatacgactcactatagggggggtcagttcttattagttcataaccaacaacagaggagagttggtatggaactaataaacctggcggcagcgcaaaagatg

SEQ ID NO: 38063 - DNA, 103 bp, Artificial Sequence
  Synthetic Polynucleotide
taatacgactcactatagggaagccgaccccagacacgttcatcccggggaacagaggagaccccggatggaacgtgtcaacctggcggcagcgcaaaagatg

SEQ ID NO: 38064 - DNA, 103 bp, Artificial Sequence
  Synthetic Polynucleotide
taatacgactcactataggggaaaaaaagtaaagtcaacggttgggttagaacagaggagactaaccatgccgttgactaacctggcggcagcgcaaaagatg

SEQ ID NO: 38065 - DNA, 103 bp, Artificial Sequence
  Synthetic Polynucleotide
taatacgactcactatagggtttagtagatacaccctgttaatacaactcaacagaggagagagttgatgtaacagggtaacctggcggcagcgcaaaagatg

SEQ ID NO: 38066 - DNA, 103 bp, Artificial Sequence
  Synthetic Polynucleotide
taatacgactcactatagggccaaactattctatattccaattcccaattaacagaggagaaattggatgttggaatataacctggcggcagcgcaaaagatg

SEQ ID NO: 38067 - DNA, 103 bp, Artificial Sequence
  Synthetic Polynucleotide
taatacgactcactatagggttaactggttaatgttcgttatacgtctgaaacagaggagatcagacatgtaacgaacaaacctggcggcagcgcaaaagatg

SEQ ID NO: 38068 - DNA, 103 bp, Artificial Sequence
  Synthetic Polynucleotide
taatacgactcactatagggccatagtgcgatcccataaagctcagagataacagaggagaatctctatgctttatgggaacctggcggcagcgcaaaagatg

SEQ ID NO: 38069 - DNA, 103 bp, Artificial Sequence
  Synthetic Polynucleotide
taatacgactcactatagggatctcgttacagctttttagatcagacagtaacagaggagaactgtcatgtctaaaaagaacctggcggcagcgcaaaagatg

SEQ ID NO: 38070 - DNA, 103 bp, Artificial Sequence
  Synthetic Polynucleotide
taatacgactcactatagggtgggggtaaaccaaaggtagtccccgccgaaacagaggagatcggcgatgactacctttaacctggcggcagcgcaaaagatg

SEQ ID NO: 38071 - DNA, 103 bp, Artificial Sequence
  Synthetic Polynucleotide
taatacgactcactatagggagagcctgcattatctcaacgaacgctcgaaacagaggagatcgagcatgcgttgagataacctggcggcagcgcaaaagatg

SEQ ID NO: 38072 - DNA, 103 bp, Artificial Sequence
  Synthetic Polynucleotide
taatacgactcactatagggtgagctaaacgacggtctagggagcttggcaacagaggagagccaagatgcctagaccgaacctggcggcagcgcaaaagatg

SEQ ID NO: 38073 - DNA, 103 bp, Artificial Sequence
  Synthetic Polynucleotide
taatacgactcactatagggcgaacgctaactagcgctgcagatgcgcgaaacagaggagatcgcgcatgtgcagcgctaacctggcggcagcgcaaaagatg

SEQ ID NO: 38074 - DNA, 103 bp, Artificial Sequence
  Synthetic Polynucleotide
taatacgactcactatagggccaagacagtgagccacatcgtgcttaacaaacagaggagatgttaaatgcgatgtggcaacctggcggcagcgcaaaagatg

SEQ ID NO: 38075 - DNA, 103 bp, Artificial Sequence
  Synthetic Polynucleotide
taatacgactcactatagggtacggctggcaccctgccggtgtccgaaccaacagaggagaggttcgatgaccggcaggaacctggcggcagcgcaaaagatg

SEQ ID NO: 38076 - DNA, 103 bp, Artificial Sequence
  Synthetic Polynucleotide
taatacgactcactatagggcacagtttggaaccgggtgataccgtaggaaacagaggagatcctacatgatcacccggaacctggcggcagcgcaaaagatg

SEQ ID NO: 38077 - DNA, 103 bp, Artificial Sequence
  Synthetic Polynucleotide
taatacgactcactatagggagcgcagtagtcaggttggacataagcgcaaacagaggagatgcgctatggtccaacctaacctggcggcagcgcaaaagatg

SEQ ID NO: 38078 - DNA, 103 bp, Artificial Sequence
  Synthetic Polynucleotide
taatacgactcactatagggctaatatataacgccattgagtctccggaaaacagaggagattccggatgctcaatggcaacctggcggcagcgcaaaagatg

SEQ ID NO: 38079 - DNA, 103 bp, Artificial Sequence
  Synthetic Polynucleotide
taatacgactcactatagggaccacactcccccacagtatccgaccggggaacagaggagaccccggatggatactgtgaacctggcggcagcgcaaaagatg

SEQ ID NO: 38080 - DNA, 103 bp, Artificial Sequence
  Synthetic Polynucleotide
taatacgactcactatagggtctctgtaacgaaacgcgctgcaattgcagaacagaggagactgcaaatgcagcgcgttaacctggcggcagcgcaaaagatg

SEQ ID NO: 38081 - DNA, 103 bp, Artificial Sequence
  Synthetic Polynucleotide
taatacgactcactatagggcgagtcgtggcgcattaatgaccatcgttcaacagaggagagaacgaatgtcattaatgaacctggcggcagcgcaaaagatg

SEQ ID NO: 38082 - DNA, 103 bp, Artificial Sequence
  Synthetic Polynucleotide
taatacgactcactatagggccatgcaactgttacctacagccgacagataacagaggagaatctgtatgctgtaggtaaacctggcggcagcgcaaaagatg

SEQ ID NO: 38083 - DNA, 103 bp, Artificial Sequence
  Synthetic Polynucleotide
taatacgactcactatagggcctcagcggcccgtggtgaaaccaaagcttaacagaggagaaagcttatgtttcaccacaacctggcggcagcgcaaaagatg

SEQ ID NO: 38084 - DNA, 103 bp, Artificial Sequence
  Synthetic Polynucleotide
taatacgactcactatagggatgcgggatgccccgagggtgtaaggccataacagaggagaatggccatgcaccctcggaacctggcggcagcgcaaaagatg

SEQ ID NO: 38085 - DNA, 103 bp, Artificial Sequence
  Synthetic Polynucleotide
taatacgactcactatagggccgtcgtaataaagacgcgggacttgtggcaacagaggagagccacaatgcccgcgtctaacctggcggcagcgcaaaagatg

SEQ ID NO: 38086 - DNA, 103 bp, Artificial Sequence
  Synthetic Polynucleotide
taatacgactcactatagggtcgagtctaacggcacggctttgcccctcaaacagaggagatgagggatgaagccgtgcaacctggcggcagcgcaaaagatg

SEQ ID NO: 38087 - DNA, 103 bp, Artificial Sequence
  Synthetic Polynucleotide
taatacgactcactatagggacgcagtgcggtccgttaatcatgtagtacaacagaggagagtactaatggattaacggaacctggcggcagcgcaaaagatg

SEQ ID NO: 38088 - DNA, 103 bp, Artificial Sequence
  Synthetic Polynucleotide
taatacgactcactataggggatcggacatgtggagtcgtaaagaggataaacagaggagatatcctatgtacgactccaacctggcggcagcgcaaaagatg

SEQ ID NO: 38089 - DNA, 103 bp, Artificial Sequence
  Synthetic Polynucleotide
taatacgactcactatagggtgccttacaaggggacgtgatacattatgtaacagaggagaacataaatgatcacgtccaacctggcggcagcgcaaaagatg

SEQ ID NO: 38090 - DNA, 103 bp, Artificial Sequence
  Synthetic Polynucleotide
taatacgactcactatagggatagctatgagtgatttttgttcggtacctaacagaggagaaggtacatgacaaaaatcaacctggcggcagcgcaaaagatg

SEQ ID NO: 38091 - DNA, 103 bp, Artificial Sequence
  Synthetic Polynucleotide
taatacgactcactatagggtgattgactgtacttgggttcaaagtgttaaacagaggagataacacatggaacccaagaacctggcggcagcgcaaaagatg

SEQ ID NO: 38092 - DNA, 103 bp, Artificial Sequence
  Synthetic Polynucleotide
taatacgactcactatagggcactccataaagagcggacgaaggggggctaacagaggagaagccccatgtcgtccgctaacctggcggcagcgcaaaagatg

SEQ ID NO: 38093 - DNA, 103 bp, Artificial Sequence
  Synthetic Polynucleotide
taatacgactcactatagggaggcctacgatatgtctattacgccgaggtaacagaggagaacctcgatgtaatagacaaacctggcggcagcgcaaaagatg

SEQ ID NO: 38094 - DNA, 103 bp, Artificial Sequence
  Synthetic Polynucleotide
taatacgactcactatagggcgcgttcccaccttttactattggccatagaacagaggagactatggatgatagtaaaaaacctggcggcagcgcaaaagatg

SEQ ID NO: 38095 - DNA, 103 bp, Artificial Sequence
  Synthetic Polynucleotide
taatacgactcactatagggcgcaagccggtgcgatattagaactcaagcaacagaggagagcttgaatgctaatatcgaacctggcggcagcgcaaaagatg

SEQ ID NO: 38096 - DNA, 103 bp, Artificial Sequence
  Synthetic Polynucleotide
taatacgactcactatagggatcaaagtagccctatgtaccgtagcctgtaacagaggagaacaggcatgggtacatagaacctggcggcagcgcaaaagatg

SEQ ID NO: 38097 - DNA, 103 bp, Artificial Sequence
  Synthetic Polynucleotide
taatacgactcactataggggccatcgggacttacatttctaacgcttcaaacagaggagatgaagcatgagaaatgtaaacctggcggcagcgcaaaagatg

SEQ ID NO: 38098 - DNA, 103 bp, Artificial Sequence
  Synthetic Polynucleotide
taatacgactcactataggggcggccgacgtatcacatcgctgcttaggtaacagaggagaacctaaatggcgatgtgaaacctggcggcagcgcaaaagatg

SEQ ID NO: 38099 - DNA, 103 bp, Artificial Sequence
  Synthetic Polynucleotide
taatacgactcactatagggtgactaaaagtctgcataggtagaaatctgaacagaggagacagattatgacctatgcaaacctggcggcagcgcaaaagatg

SEQ ID NO: 38100 - DNA, 103 bp, Artificial Sequence
  Synthetic Polynucleotide
taatacgactcactataggggatgggaccgggcttacgttggacttgcgcaacagaggagagcgcaaatgcaacgtaagaacctggcggcagcgcaaaagatg

SEQ ID NO: 38101 - DNA, 103 bp, Artificial Sequence
  Synthetic Polynucleotide
taatacgactcactatagggacgtagcaaataccgtcatcggttctctataacagaggagaatagagatgcgatgacggaacctggcggcagcgcaaaagatg

SEQ ID NO: 38102 - DNA, 103 bp, Artificial Sequence
  Synthetic Polynucleotide
taatacgactcactataggggcatccctattatgtggtgctgaagtatgtaacagaggagaacatacatgagcaccacaaacctggcggcagcgcaaaagatg

SEQ ID NO: 38103 - DNA, 103 bp, Artificial Sequence
  Synthetic Polynucleotide
taatacgactcactatagggtagctcgcttaccagggccgtacttaggggaacagaggagacccctaatgacggccctgaacctggcggcagcgcaaaagatg

SEQ ID NO: 38104 - DNA, 103 bp, Artificial Sequence
  Synthetic Polynucleotide
taatacgactcactatagggccctgcccgacgccttcgtttgtgcgttccaacagaggagaggaacgatgaaacgaaggaacctggcggcagcgcaaaagatg

SEQ ID NO: 38105 - DNA, 103 bp, Artificial Sequence
  Synthetic Polynucleotide
taatacgactcactatagggttaggagacgccggacgcctaggtcttccaaacagaggagatggaagatgtaggcgtccaacctggcggcagcgcaaaagatg

SEQ ID NO: 38106 - DNA, 103 bp, Artificial Sequence
  Synthetic Polynucleotide
taatacgactcactatagggttcgcgtacatggttccatccatccgtggaaacagaggagatccacgatgggatggaacaacctggcggcagcgcaaaagatg

SEQ ID NO: 38107 - DNA, 103 bp, Artificial Sequence
  Synthetic Polynucleotide
taatacgactcactatagggatcttatctacgtacggattaatcactgtgaacagaggagacacagtatgtaatccgtaaacctggcggcagcgcaaaagatg

SEQ ID NO: 38108 - DNA, 103 bp, Artificial Sequence
  Synthetic Polynucleotide
taatacgactcactatagggtcgcgtcagccaagggctcgtccctaggtgaacagaggagacacctaatgacgagccctaacctggcggcagcgcaaaagatg

SEQ ID NO: 38109 - DNA, 103 bp, Artificial Sequence
  Synthetic Polynucleotide
taatacgactcactatagggacgtgcgaacggggtaaaacattctccaacaacagaggagagttggaatgtgttttaccaacctggcggcagcgcaaaagatg

SEQ ID NO: 38110 - DNA, 103 bp, Artificial Sequence
  Synthetic Polynucleotide
taatacgactcactatagggactttgtcccgtcgtgcgaggaatgatattaacagaggagaaatatcatgcctcgcacgaacctggcggcagcgcaaaagatg

SEQ ID NO: 38111 - DNA, 103 bp, Artificial Sequence
  Synthetic Polynucleotide
taatacgactcactatagggctaactgtagtaccgtctgccgtataaatgaacagaggagacatttaatgggcagacggaacctggcggcagcgcaaaagatg

SEQ ID NO: 38112 - DNA, 103 bp, Artificial Sequence
  Synthetic Polynucleotide
taatacgactcactataggggtgtatatataccgttcattgcactttcgcaacagaggagagcgaaaatgcaatgaacgaacctggcggcagcgcaaaagatg

SEQ ID NO: 38113 - DNA, 103 bp, Artificial Sequence
  Synthetic Polynucleotide
taatacgactcactatagggagtcgattactgacgatgacaaaaaaccggaacagaggagaccggttatgtgtcatcgtaacctggcggcagcgcaaaagatg

SEQ ID NO: 38114 - DNA, 103 bp, Artificial Sequence
  Synthetic Polynucleotide
taatacgactcactataggggctgttggatctgtcccagtcacttgcctaaacagaggagataggcaatggactgggacaacctggcggcagcgcaaaagatg

SEQ ID NO: 38115 - DNA, 103 bp, Artificial Sequence
  Synthetic Polynucleotide
taatacgactcactataggggcgcatgatggtggcgatcgatttcgctggaacagaggagaccagcgatgtcgatcgccaacctggcggcagcgcaaaagatg

SEQ ID NO: 38116 - DNA, 103 bp, Artificial Sequence
  Synthetic Polynucleotide
taatacgactcactatagggggcaaacaggaatgcgagcacatgctgataaacagaggagatatcagatggtgctcgcaaacctggcggcagcgcaaaagatg

SEQ ID NO: 38117 - DNA, 103 bp, Artificial Sequence
  Synthetic Polynucleotide
taatacgactcactatagggctagatacaatttattcggaaggttagcgaaacagaggagatcgctaatgttccgaataaacctggcggcagcgcaaaagatg

SEQ ID NO: 38118 - DNA, 103 bp, Artificial Sequence
  Synthetic Polynucleotide
taatacgactcactatagggtactccaggggtgagcagcgtggaggtgccaacagaggagaggcaccatgacgctgctcaacctggcggcagcgcaaaagatg

SEQ ID NO: 38119 - DNA, 103 bp, Artificial Sequence
  Synthetic Polynucleotide
taatacgactcactataggggagtggtgcaggcatacctcgaggatcatcaacagaggagagatgatatgcgaggtatgaacctggcggcagcgcaaaagatg

SEQ ID NO: 38120 - DNA, 103 bp, Artificial Sequence
  Synthetic Polynucleotide
taatacgactcactatagggggacccaattcgcatttctgtaatatgaggaacagaggagacctcatatgacagaaatgaacctggcggcagcgcaaaagatg

SEQ ID NO: 38121 - DNA, 103 bp, Artificial Sequence
  Synthetic Polynucleotide
taatacgactcactatagggacaataaagtgccgaccggggcatgataagaacagaggagacttatcatgccccggtcgaacctggcggcagcgcaaaagatg

SEQ ID NO: 38122 - DNA, 103 bp, Artificial Sequence
  Synthetic Polynucleotide
taatacgactcactatagggcatcaaatcacgttcattattatgggcggcaacagaggagagccgccatgaataatgaaaacctggcggcagcgcaaaagatg

SEQ ID NO: 38123 - DNA, 103 bp, Artificial Sequence
  Synthetic Polynucleotide
taatacgactcactatagggttgacgggaaatgggtgtcaattgagcgccaacagaggagaggcgctatgttgacacccaacctggcggcagcgcaaaagatg

SEQ ID NO: 38124 - DNA, 103 bp, Artificial Sequence
  Synthetic Polynucleotide
taatacgactcactatagggttagataagtaacgacagtcgtagctccgaaacagaggagatcggagatgcgactgtcgaacctggcggcagcgcaaaagatg

SEQ ID NO: 38125 - DNA, 103 bp, Artificial Sequence
  Synthetic Polynucleotide
taatacgactcactatagggcccaacagcgtcaataaacgatcatcgcacaacagaggagagtgcgaatgtcgtttattaacctggcggcagcgcaaaagatg

SEQ ID NO: 38126 - DNA, 103 bp, Artificial Sequence
  Synthetic Polynucleotide
taatacgactcactatagggccgcccgtggttcggagatttcggataactaacagaggagaagttatatgaaatctccgaacctggcggcagcgcaaaagatg

SEQ ID NO: 38127 - DNA, 103 bp, Artificial Sequence
  Synthetic Polynucleotide
taatacgactcactatagggaatgctccagccttcaggtgagctgttcaaaacagaggagattgaacatgtcacctgaaaacctggcggcagcgcaaaagatg

SEQ ID NO: 38128 - DNA, 103 bp, Artificial Sequence
  Synthetic Polynucleotide
taatacgactcactatagggcactacaaagtacaatattaattgaaagcgaacagaggagacgctttatgttaatattgaacctggcggcagcgcaaaagatg

SEQ ID NO: 38129 - DNA, 103 bp, Artificial Sequence
  Synthetic Polynucleotide
taatacgactcactatagggtaacaccgtcacgttagtgtcaaagtcgtgaacagaggagacacgacatggacactaacaacctggcggcagcgcaaaagatg

SEQ ID NO: 38130 - DNA, 103 bp, Artificial Sequence
  Synthetic Polynucleotide
taatacgactcactataggggttttcaggtagcgtcatgaatggaagaacaacagaggagagttcttatgttcatgacgaacctggcggcagcgcaaaagatg

SEQ ID NO: 38131 - DNA, 103 bp, Artificial Sequence
  Synthetic Polynucleotide
taatacgactcactataggggtaaatcctccaatgtgcattgaactcgctaacagaggagaagcgagatgaatgcacataacctggcggcagcgcaaaagatg

SEQ ID NO: 38132 - DNA, 103 bp, Artificial Sequence
  Synthetic Polynucleotide
taatacgactcactatagggtcgtgggtttctgtacggaggtcctagtctaacagaggagaagactaatgcctccgtacaacctggcggcagcgcaaaagatg

SEQ ID NO: 38133 - DNA, 103 bp, Artificial Sequence
  Synthetic Polynucleotide
taatacgactcactataggggttacagacgaaccgaatatcaacatattaaacagaggagataatatatggatattcggaacctggcggcagcgcaaaagatg

SEQ ID NO: 38134 - DNA, 103 bp, Artificial Sequence
  Synthetic Polynucleotide
taatacgactcactataggggttttttgctttcgccgggaacgctgttaaaacagaggagattaacaatgttcccggcgaacctggcggcagcgcaaaagatg

SEQ ID NO: 38135 - DNA, 103 bp, Artificial Sequence
  Synthetic Polynucleotide
taatacgactcactataggggcgaagatgtggggcttacaatggttactcaacagaggagagagtaaatgttgtaagccaacctggcggcagcgcaaaagatg

SEQ ID NO: 38136 - DNA, 103 bp, Artificial Sequence
  Synthetic Polynucleotide
taatacgactcactatagggcgggtagcgcgaagaacgtagatatgtataaacagaggagatatacaatgctacgttctaacctggcggcagcgcaaaagatg

SEQ ID NO: 38137 - DNA, 103 bp, Artificial Sequence
  Synthetic Polynucleotide
taatacgactcactatagggagttagacctgacctatgatcagggaacgtaacagaggagaacgttcatggatcataggaacctggcggcagcgcaaaagatg

SEQ ID NO: 38138 - DNA, 103 bp, Artificial Sequence
  Synthetic Polynucleotide
taatacgactcactatagggatgtgatagaaaattaaccacattcgcgcgaacagaggagacgcgcgatggtggttaataacctggcggcagcgcaaaagatg

SEQ ID NO: 38139 - DNA, 103 bp, Artificial Sequence
  Synthetic Polynucleotide
taatacgactcactatagggtgtattccggatattgtagtttacttcacaaacagaggagatgtgaaatgaactacaataacctggcggcagcgcaaaagatg

SEQ ID NO: 38140 - DNA, 103 bp, Artificial Sequence
  Synthetic Polynucleotide
taatacgactcactatagggacatatagcacgcacccgtaaatgcaatgtaacagaggagaacattgatgttacgggtgaacctggcggcagcgcaaaagatg

SEQ ID NO: 38141 - DNA, 103 bp, Artificial Sequence
  Synthetic Polynucleotide
taatacgactcactatagggctcggttggctcgcgactcgagaccggggtaacagaggagaaccccgatgtcgagtcgcaacctggcggcagcgcaaaagatg

SEQ ID NO: 38142 - DNA, 103 bp, Artificial Sequence
  Synthetic Polynucleotide
taatacgactcactataggggcaaagagcagtgttctcatgtccaaggggaacagaggagaccccttatgcatgagaacaacctggcggcagcgcaaaagatg

SEQ ID NO: 38143 - DNA, 103 bp, Artificial Sequence
  Synthetic Polynucleotide
taatacgactcactatagggtgctgtacgaagttcacgtcggcggtgactaacagaggagaagtcacatgcgacgtgaaaacctggcggcagcgcaaaagatg

SEQ ID NO: 38144 - DNA, 103 bp, Artificial Sequence
  Synthetic Polynucleotide
taatacgactcactatagggtcgaggaagaggggaacgagccagtgcgcaaacagaggagatgcgcaatggctcgttccaacctggcggcagcgcaaaagatg

SEQ ID NO: 38145 - DNA, 103 bp, Artificial Sequence
  Synthetic Polynucleotide
taatacgactcactatagggatgaatattgcgtctgtctgtgctttaattaacagaggagaaattaaatgacagacagaaacctggcggcagcgcaaaagatg

SEQ ID NO: 38146 - DNA, 103 bp, Artificial Sequence
  Synthetic Polynucleotide
taatacgactcactatagggaagagactgtcgtatcaccccgataccccgaacagaggagacggggtatgggggtgataaacctggcggcagcgcaaaagatg

SEQ ID NO: 38147 - DNA, 103 bp, Artificial Sequence
  Synthetic Polynucleotide
taatacgactcactatagggcgtacatcgggccattcgctttattcgccgaacagaggagacggcgaatgaagcgaatgaacctggcggcagcgcaaaagatg

SEQ ID NO: 38148 - DNA, 103 bp, Artificial Sequence
  Synthetic Polynucleotide
taatacgactcactatagggcggacttgctttgtaaagtctgttacgtcgaacagaggagacgacgtatgagactttacaacctggcggcagcgcaaaagatg

SEQ ID NO: 38149 - DNA, 103 bp, Artificial Sequence
  Synthetic Polynucleotide
taatacgactcactataggggttacaaccctcatagagctatctgatagaaacagaggagatctatcatgtagctctataacctggcggcagcgcaaaagatg

SEQ ID NO: 38150 - DNA, 103 bp, Artificial Sequence
  Synthetic Polynucleotide
taatacgactcactataggggtgtttggtagcacattccagtagtcccccaacagaggagagggggaatgctggaatgtaacctggcggcagcgcaaaagatg

SEQ ID NO: 38151 - DNA, 103 bp, Artificial Sequence
  Synthetic Polynucleotide
taatacgactcactatagggaggcgaccggaagtgaccttcgggctcgtaaacagaggagatacgagatggaaggtcacaacctggcggcagcgcaaaagatg

SEQ ID NO: 38152 - DNA, 103 bp, Artificial Sequence
  Synthetic Polynucleotide
taatacgactcactataggggagttttcgctgtctctcggtgtaggcgggaacagaggagacccgccatgaccgagagaaacctggcggcagcgcaaaagatg

SEQ ID NO: 38153 - DNA, 103 bp, Artificial Sequence
  Synthetic Polynucleotide
taatacgactcactatagggaagaggctccagcacggtgcttgcccgtggaacagaggagaccacggatgagcaccgtgaacctggcggcagcgcaaaagatg

SEQ ID NO: 38154 - DNA, 103 bp, Artificial Sequence
  Synthetic Polynucleotide
taatacgactcactatagggatgtgttgccgaagtacatagccgtcgataaacagaggagatatcgaatgctatgtactaacctggcggcagcgcaaaagatg

SEQ ID NO: 38155 - DNA, 103 bp, Artificial Sequence
  Synthetic Polynucleotide
taatacgactcactatagggctgacaacagttattttgcaaacctatgttaacagaggagaaacataatgttgcaaaataacctggcggcagcgcaaaagatg

SEQ ID NO: 38156 - DNA, 103 bp, Artificial Sequence
  Synthetic Polynucleotide
taatacgactcactatagggtgcatcagagcattccccttctgtatcgggaacagaggagacccgatatggaaggggaaaacctggcggcagcgcaaaagatg

SEQ ID NO: 38157 - DNA, 103 bp, Artificial Sequence
  Synthetic Polynucleotide
taatacgactcactatagggttttttcggactagagtacgcgaagtgtttaacagaggagaaaacacatggcgtactctaacctggcggcagcgcaaaagatg

SEQ ID NO: 38158 - DNA, 103 bp, Artificial Sequence
  Synthetic Polynucleotide
taatacgactcactatagggctgtgagccacggagcttattcgtgtcgataacagaggagaatcgacatgaataagctcaacctggcggcagcgcaaaagatg

SEQ ID NO: 38159 - DNA, 103 bp, Artificial Sequence
  Synthetic Polynucleotide
taatacgactcactatagggtcccgttcttggtcttaattgtggtgttcgaacagaggagacgaacaatgcaattaagaaacctggcggcagcgcaaaagatg

SEQ ID NO: 38160 - DNA, 103 bp, Artificial Sequence
  Synthetic Polynucleotide
taatacgactcactatagggaacacttcatcgctgcctaagaggagtcgcaacagaggagagcgactatgcttaggcagaacctggcggcagcgcaaaagatg

SEQ ID NO: 38161 - DNA, 103 bp, Artificial Sequence
  Synthetic Polynucleotide
taatacgactcactatagggctctgtgagagccctaagcagattcatttgaacagaggagacaaatgatgctgcttaggaacctggcggcagcgcaaaagatg

SEQ ID NO: 38162 - DNA, 103 bp, Artificial Sequence
  Synthetic Polynucleotide
taatacgactcactatagggcagctcatcgtcttgaaccgctcatttgctaacagaggagaagcaaaatggcggttcaaaacctggcggcagcgcaaaagatg

SEQ ID NO: 38163 - DNA, 103 bp, Artificial Sequence
  Synthetic Polynucleotide
taatacgactcactatagggcactcgtgtcggcgtttcagtgcaggctccaacagaggagaggagccatgactgaaacgaacctggcggcagcgcaaaagatg

SEQ ID NO: 38164 - DNA, 103 bp, Artificial Sequence
  Synthetic Polynucleotide
taatacgactcactataggggagaccaacttcatggtaacgggtgtccctaacagaggagaagggacatgcgttaccataacctggcggcagcgcaaaagatg

SEQ ID NO: 38165 - DNA, 103 bp, Artificial Sequence
  Synthetic Polynucleotide
taatacgactcactataggggagcaaactgcatcctagcgaactcactataacagaggagaatagtgatgtcgctaggaaacctggcggcagcgcaaaagatg

SEQ ID NO: 38166 - DNA, 103 bp, Artificial Sequence
  Synthetic Polynucleotide
taatacgactcactatagggtcagagtgaagcccacatttgtcttcaccgaacagaggagacggtgaatgcaaatgtggaacctggcggcagcgcaaaagatg

SEQ ID NO: 38167 - DNA, 103 bp, Artificial Sequence
  Synthetic Polynucleotide
taatacgactcactataggggtcaacggagggcaagacgtacattgagcgaacagaggagacgctcaatgtacgtcttgaacctggcggcagcgcaaaagatg

SEQ ID NO: 38168 - DNA, 103 bp, Artificial Sequence
  Synthetic Polynucleotide
taatacgactcactataggggttatatgcgtccccttattctggcatctgaacagaggagacagatgatggaataagggaacctggcggcagcgcaaaagatg

SEQ ID NO: 38169 - DNA, 103 bp, Artificial Sequence
  Synthetic Polynucleotide
taatacgactcactatagggcttccccgctatatggatcgcgcgggggggaacagaggagaccccccatggcgatccataacctggcggcagcgcaaaagatg

SEQ ID NO: 38170 - DNA, 103 bp, Artificial Sequence
  Synthetic Polynucleotide
taatacgactcactatagggagagttaaacaatgtcttatccagctgggtaacagaggagaacccagatggataagacaaacctggcggcagcgcaaaagatg

SEQ ID NO: 38171 - DNA, 103 bp, Artificial Sequence
  Synthetic Polynucleotide
taatacgactcactatagggtctcgcataaggaagtggattaggatgctaaacagaggagatagcatatgaatccacttaacctggcggcagcgcaaaagatg

SEQ ID NO: 38172 - DNA, 103 bp, Artificial Sequence
  Synthetic Polynucleotide
taatacgactcactatagggataccgccccggaggctagtggacgtggcgaacagaggagacgccacatgcactagcctaacctggcggcagcgcaaaagatg

SEQ ID NO: 38173 - DNA, 103 bp, Artificial Sequence
  Synthetic Polynucleotide
taatacgactcactatagggtatcaatgagcttccagagcagacctctcgaacagaggagacgagagatgtgctctggaaacctggcggcagcgcaaaagatg

SEQ ID NO: 38174 - DNA, 103 bp, Artificial Sequence
  Synthetic Polynucleotide
taatacgactcactatagggttgccgggaagtgtcttccgcaatttgcctaacagaggagaaggcaaatggcggaagacaacctggcggcagcgcaaaagatg

SEQ ID NO: 38175 - DNA, 103 bp, Artificial Sequence
  Synthetic Polynucleotide
taatacgactcactatagggagtcctgagtggggctcagagcaagccgccaacagaggagaggcggcatgctctgagccaacctggcggcagcgcaaaagatg

SEQ ID NO: 38176 - DNA, 103 bp, Artificial Sequence
  Synthetic Polynucleotide
taatacgactcactatagggtgcaatctccgttgattgttgtatacctgaaacagaggagatcaggtatgcaacaatcaaacctggcggcagcgcaaaagatg

SEQ ID NO: 38177 - DNA, 103 bp, Artificial Sequence
  Synthetic Polynucleotide
taatacgactcactatagggcacataagtcgaccgccgtatggaccgccgaacagaggagacggcggatgatacggcggaacctggcggcagcgcaaaagatg

SEQ ID NO: 38178 - DNA, 103 bp, Artificial Sequence
  Synthetic Polynucleotide
taatacgactcactatagggtaggcgcttgcaaatgtatcgtcatttctaaacagaggagatagaaaatgcgatacattaacctggcggcagcgcaaaagatg

SEQ ID NO: 38179 - DNA, 103 bp, Artificial Sequence
  Synthetic Polynucleotide
taatacgactcactatagggaggtggacacccttgcatatttcccaggttaacagaggagaaacctgatgaatatgcaaaacctggcggcagcgcaaaagatg

SEQ ID NO: 38180 - DNA, 103 bp, Artificial Sequence
  Synthetic Polynucleotide
taatacgactcactatagggctatcactcttacgggctaggcgcagatccaacagaggagaggatctatgcctagcccgaacctggcggcagcgcaaaagatg

SEQ ID NO: 38181 - DNA, 103 bp, Artificial Sequence
  Synthetic Polynucleotide
taatacgactcactatagggtcattgggcggagcagcaccgtaaaatctgaacagaggagacagattatgcggtgctgcaacctggcggcagcgcaaaagatg

SEQ ID NO: 38182 - DNA, 103 bp, Artificial Sequence
  Synthetic Polynucleotide
taatacgactcactatagggtgcgtcagaggccgacggtcattttttgggaacagaggagacccaaaatgtgaccgtcgaacctggcggcagcgcaaaagatg

SEQ ID NO: 38183 - DNA, 103 bp, Artificial Sequence
  Synthetic Polynucleotide
taatacgactcactataggggccggcacatccaggcctatttactactagaacagaggagactagtaatgaataggcctaacctggcggcagcgcaaaagatg

SEQ ID NO: 38184 - DNA, 103 bp, Artificial Sequence
  Synthetic Polynucleotide
taatacgactcactatagggcctagcgataacactcccggcatgcaggctaacagaggagaagcctgatggccgggagtaacctggcggcagcgcaaaagatg

SEQ ID NO: 38185 - DNA, 103 bp, Artificial Sequence
  Synthetic Polynucleotide
taatacgactcactatagggtggtccgcgactagcccgcataatcaggttaacagaggagaaacctgatgatgcgggctaacctggcggcagcgcaaaagatg

SEQ ID NO: 38186 - DNA, 103 bp, Artificial Sequence
  Synthetic Polynucleotide
taatacgactcactatagggcaccgtccgccttgtcctatttttggaatgaacagaggagacattccatgaataggacaaacctggcggcagcgcaaaagatg

SEQ ID NO: 38187 - DNA, 103 bp, Artificial Sequence
  Synthetic Polynucleotide
taatacgactcactatagggctacggtgacaatctcaaccgtaaccggctaacagaggagaagccggatgcggttgagaaacctggcggcagcgcaaaagatg

SEQ ID NO: 38188 - DNA, 103 bp, Artificial Sequence
  Synthetic Polynucleotide
taatacgactcactatagggcggcattttatttgtcatgagtagacaaaaaacagaggagattttgtatgctcatgacaaacctggcggcagcgcaaaagatg

SEQ ID NO: 38189 - DNA, 103 bp, Artificial Sequence
  Synthetic Polynucleotide
taatacgactcactatagggcgttatggctcaagaagctcgcttcttaataacagaggagaattaagatgcgagcttctaacctggcggcagcgcaaaagatg

SEQ ID NO: 38190 - DNA, 103 bp, Artificial Sequence
  Synthetic Polynucleotide
taatacgactcactatagggctgcataccaacctaaaaaggatcctcatgaacagaggagacatgagatgcctttttagaacctggcggcagcgcaaaagatg

SEQ ID NO: 38191 - DNA, 103 bp, Artificial Sequence
  Synthetic Polynucleotide
taatacgactcactatagggcgcgacgttatgacgcaccgcgttaccggaaacagaggagatccggtatggcggtgcgtaacctggcggcagcgcaaaagatg

SEQ ID NO: 38192 - DNA, 103 bp, Artificial Sequence
  Synthetic Polynucleotide
taatacgactcactatagggagaaaggggtgccttttaagtggtgtcaataacagaggagaattgacatgacttaaaagaacctggcggcagcgcaaaagatg

SEQ ID NO: 38193 - DNA, 103 bp, Artificial Sequence
  Synthetic Polynucleotide
taatacgactcactatagggagtattgagcataaatcgcccaaacgaagtaacagaggagaacttcgatggggcgatttaacctggcggcagcgcaaaagatg

SEQ ID NO: 38194 - DNA, 103 bp, Artificial Sequence
  Synthetic Polynucleotide
taatacgactcactatagggaccacaacagaaaaagtgtcgggtgccgaaaacagaggagattcggcatgcgacactttaacctggcggcagcgcaaaagatg

SEQ ID NO: 38195 - DNA, 103 bp, Artificial Sequence
  Synthetic Polynucleotide
taatacgactcactatagggtgccgactgcgacccgaggtttgttagactaacagaggagaagtctaatgaacctcgggaacctggcggcagcgcaaaagatg

SEQ ID NO: 38196 - DNA, 103 bp, Artificial Sequence
  Synthetic Polynucleotide
taatacgactcactataggggtactgaagcccgagtggtaagcaagtgggaacagaggagacccactatgttaccactcaacctggcggcagcgcaaaagatg

SEQ ID NO: 38197 - DNA, 103 bp, Artificial Sequence
  Synthetic Polynucleotide
taatacgactcactatagggccggcctccagtacaactacgcaccttttaaacagaggagataaaagatgcgtagttgtaacctggcggcagcgcaaaagatg

SEQ ID NO: 38198 - DNA, 103 bp, Artificial Sequence
  Synthetic Polynucleotide
taatacgactcactatagggggtacctaattccgtaggtaacaagttctaaacagaggagatagaacatgttacctacgaacctggcggcagcgcaaaagatg

SEQ ID NO: 38199 - DNA, 103 bp, Artificial Sequence
  Synthetic Polynucleotide
taatacgactcactatagggcaattatacaactgcaccgacgtcttccgtaacagaggagaacggaaatggtcggtgcaaacctggcggcagcgcaaaagatg

SEQ ID NO: 38200 - DNA, 103 bp, Artificial Sequence
  Synthetic Polynucleotide
taatacgactcactatagggccacgaatagggagaggtcaatcgcgttaaaacagaggagattaacgatgttgacctctaacctggcggcagcgcaaaagatg

SEQ ID NO: 38201 - DNA, 103 bp, Artificial Sequence
  Synthetic Polynucleotide
taatacgactcactatagggtggaggtaagagccgaaggggggcgctggcaacagaggagagccagcatgccccttcggaacctggcggcagcgcaaaagatg

SEQ ID NO: 38202 - DNA, 103 bp, Artificial Sequence
  Synthetic Polynucleotide
taatacgactcactataggggctgcggggatcaccacatgatctcacaggaacagaggagacctgtgatgtcatgtggtaacctggcggcagcgcaaaagatg

SEQ ID NO: 38203 - DNA, 103 bp, Artificial Sequence
  Synthetic Polynucleotide
taatacgactcactatagggaccctcaccagtggttcttctgcatccactaacagaggagaagtggaatgagaagaaccaacctggcggcagcgcaaaagatg

SEQ ID NO: 38204 - DNA, 103 bp, Artificial Sequence
  Synthetic Polynucleotide
taatacgactcactatagggagatatctgtcatatgaagcgcagggccggaacagaggagaccggccatgcgcttcataaacctggcggcagcgcaaaagatg

SEQ ID NO: 38205 - DNA, 103 bp, Artificial Sequence
  Synthetic Polynucleotide
taatacgactcactatagggtcgccccatcatagagtattaagatttaccaacagaggagaggtaaaatgtaatactctaacctggcggcagcgcaaaagatg

SEQ ID NO: 38206 - DNA, 103 bp, Artificial Sequence
  Synthetic Polynucleotide
taatacgactcactatagggattcggaatgccaatgacacaatcgacggcaacagaggagagccgtcatgtgtgtcattaacctggcggcagcgcaaaagatg

SEQ ID NO: 38207 - DNA, 103 bp, Artificial Sequence
  Synthetic Polynucleotide
taatacgactcactataggggatccggttccgagcttactacaaaatgggaacagaggagacccattatgtagtaagctaacctggcggcagcgcaaaagatg

SEQ ID NO: 38208 - DNA, 103 bp, Artificial Sequence
  Synthetic Polynucleotide
taatacgactcactatagggagcggctcgcgacggcaaaagccttggagtaacagaggagaactccaatgcttttgccgaacctggcggcagcgcaaaagatg

SEQ ID NO: 38209 - DNA, 103 bp, Artificial Sequence
  Synthetic Polynucleotide
taatacgactcactatagggtcgtaagtcgtttaaacctaggccgtgtctaacagaggagaagacacatgctaggtttaaacctggcggcagcgcaaaagatg

SEQ ID NO: 38210 - DNA, 103 bp, Artificial Sequence
  Synthetic Polynucleotide
taatacgactcactatagggtgtgctaagaaacaaatggcccggtggatgaacagaggagacatccaatgggccatttgaacctggcggcagcgcaaaagatg

SEQ ID NO: 38211 - DNA, 103 bp, Artificial Sequence
  Synthetic Polynucleotide
taatacgactcactatagggggggacatgcgatacggccctcctgagtgaaacagaggagatcactcatgagggccgtaaacctggcggcagcgcaaaagatg

SEQ ID NO: 38212 - DNA, 103 bp, Artificial Sequence
  Synthetic Polynucleotide
taatacgactcactatagggaaaagtagcagtcttaggcggtcaccgaataacagaggagaattcggatgccgcctaagaacctggcggcagcgcaaaagatg

SEQ ID NO: 38213 - DNA, 103 bp, Artificial Sequence
  Synthetic Polynucleotide
taatacgactcactatagggttggcgctcgacactcaccggattttcattaacagaggagaaatgaaatgccggtgagtaacctggcggcagcgcaaaagatg

SEQ ID NO: 38214 - DNA, 103 bp, Artificial Sequence
  Synthetic Polynucleotide
taatacgactcactatagggattcgcttaaaggacatcccgcttgtttccaacagaggagaggaaacatgcgggatgtcaacctggcggcagcgcaaaagatg

SEQ ID NO: 38215 - DNA, 103 bp, Artificial Sequence
  Synthetic Polynucleotide
taatacgactcactataggggtgttcgtacacacgtctccatgccacttcaacagaggagagaagtgatgtggagacgtaacctggcggcagcgcaaaagatg

SEQ ID NO: 38216 - DNA, 103 bp, Artificial Sequence
  Synthetic Polynucleotide
taatacgactcactatagggtcgtgtaagcggagtttaatacctgcgcacaacagaggagagtgcgcatgtattaaactaacctggcggcagcgcaaaagatg

SEQ ID NO: 38217 - DNA, 103 bp, Artificial Sequence
  Synthetic Polynucleotide
taatacgactcactatagggctcattcggcagacataaacgcgaattgccaacagaggagaggcaatatgcgtttatgtaacctggcggcagcgcaaaagatg

SEQ ID NO: 38218 - DNA, 103 bp, Artificial Sequence
  Synthetic Polynucleotide
taatacgactcactatagggcgctgaaatgctaaaagtacaaagtgttgcaacagaggagagcaacaatgtgtacttttaacctggcggcagcgcaaaagatg

SEQ ID NO: 38219 - DNA, 103 bp, Artificial Sequence
  Synthetic Polynucleotide
taatacgactcactatagggggagacctagacgacatccgacgcgaaacgaacagaggagacgtttcatgtcggatgtcaacctggcggcagcgcaaaagatg

SEQ ID NO: 38220 - DNA, 103 bp, Artificial Sequence
  Synthetic Polynucleotide
taatacgactcactatagggtgcatttatgtccgcaactggttcagactaaacagaggagatagtctatgccagttgcgaacctggcggcagcgcaaaagatg

SEQ ID NO: 38221 - DNA, 103 bp, Artificial Sequence
  Synthetic Polynucleotide
taatacgactcactatagggataacatggcacgcaatgcaaggcagggacaacagaggagagtccctatgttgcattgcaacctggcggcagcgcaaaagatg

SEQ ID NO: 38222 - DNA, 103 bp, Artificial Sequence
  Synthetic Polynucleotide
taatacgactcactatagggaatgtaacgtttgagtatcaagcccgcaacaacagaggagagttgcgatgttgatactcaacctggcggcagcgcaaaagatg

SEQ ID NO: 38223 - DNA, 103 bp, Artificial Sequence
  Synthetic Polynucleotide
taatacgactcactataggggatgcgacgtgaaactatacgggaactatgaacagaggagacatagtatgcgtatagttaacctggcggcagcgcaaaagatg

SEQ ID NO: 38224 - DNA, 103 bp, Artificial Sequence
  Synthetic Polynucleotide
taatacgactcactataggggttctggggctgccactcggggccacttataacagaggagaataagtatgcccgagtggaacctggcggcagcgcaaaagatg

SEQ ID NO: 38225 - DNA, 103 bp, Artificial Sequence
  Synthetic Polynucleotide
taatacgactcactatagggcgcgactcggttgcactaacctgcccccgtaacagaggagaacggggatgggttagtgcaacctggcggcagcgcaaaagatg

SEQ ID NO: 38226 - DNA, 103 bp, Artificial Sequence
  Synthetic Polynucleotide
taatacgactcactataggggcgtcgaaatcgttcggccacatggctggtaacagaggagaaccagcatggtggccgaaaacctggcggcagcgcaaaagatg

SEQ ID NO: 38227 - DNA, 103 bp, Artificial Sequence
  Synthetic Polynucleotide
taatacgactcactatagggaactagatctgagcattgtccgctatctccaacagaggagaggagatatgggacaatgcaacctggcggcagcgcaaaagatg

SEQ ID NO: 38228 - DNA, 103 bp, Artificial Sequence
  Synthetic Polynucleotide
taatacgactcactatagggaggtgacaatgtcacttacgcaaattccgcaacagaggagagcggaaatggcgtaagtgaacctggcggcagcgcaaaagatg

SEQ ID NO: 38229 - DNA, 103 bp, Artificial Sequence
  Synthetic Polynucleotide
taatacgactcactatagggccatggttacctctttggtacgaggttgtcaacagaggagagacaacatggtaccaaagaacctggcggcagcgcaaaagatg

SEQ ID NO: 38230 - DNA, 103 bp, Artificial Sequence
  Synthetic Polynucleotide
taatacgactcactatagggaggcaggcacgacacgaccaacggtcagcaaacagaggagatgctgaatgttggtcgtgaacctggcggcagcgcaaaagatg

SEQ ID NO: 38231 - DNA, 103 bp, Artificial Sequence
  Synthetic Polynucleotide
taatacgactcactatagggagcaccatgaggccataccacgcacctcggaacagaggagaccgaggatggtggtatggaacctggcggcagcgcaaaagatg

SEQ ID NO: 38232 - DNA, 103 bp, Artificial Sequence
  Synthetic Polynucleotide
taatacgactcactatagggcccgcgggaagactcacttcaaggatttggaacagaggagaccaaatatgtgaagtgagaacctggcggcagcgcaaaagatg

SEQ ID NO: 38233 - DNA, 103 bp, Artificial Sequence
  Synthetic Polynucleotide
taatacgactcactatagggttagttaatcagtttggggactcgaggcgtaacagaggagaacgcctatggtccccaaaaacctggcggcagcgcaaaagatg

SEQ ID NO: 38234 - DNA, 103 bp, Artificial Sequence
  Synthetic Polynucleotide
taatacgactcactatagggcatcccacattgagccgaggtgcggcgcgcaacagaggagagcgcgcatgacctcggctaacctggcggcagcgcaaaagatg

SEQ ID NO: 38235 - DNA, 103 bp, Artificial Sequence
  Synthetic Polynucleotide
taatacgactcactatagggcgccagtctcgtgtattattgtgagcttggaacagaggagaccaagcatgcaataatacaacctggcggcagcgcaaaagatg

SEQ ID NO: 38236 - DNA, 103 bp, Artificial Sequence
  Synthetic Polynucleotide
taatacgactcactatagggttcaagctacgcggtcatatggatgcagtgaacagaggagacactgcatgcatatgaccaacctggcggcagcgcaaaagatg

SEQ ID NO: 38237 - DNA, 103 bp, Artificial Sequence
  Synthetic Polynucleotide
taatacgactcactatagggacaatatttgcgcttccgtcaaaaaaagtaaacagaggagatactttatgtgacggaagaacctggcggcagcgcaaaagatg

SEQ ID NO: 38238 - DNA, 103 bp, Artificial Sequence
  Synthetic Polynucleotide
taatacgactcactataggggctgagatacgtataatgggcgtttccgggaacagaggagacccggaatggcccattataacctggcggcagcgcaaaagatg

SEQ ID NO: 38239 - DNA, 103 bp, Artificial Sequence
  Synthetic Polynucleotide
taatacgactcactatagggccattcgcaacacacgtccaaaacaggaggaacagaggagacctcctatgttggacgtgaacctggcggcagcgcaaaagatg

SEQ ID NO: 38240 - DNA, 103 bp, Artificial Sequence
  Synthetic Polynucleotide
taatacgactcactatagggatccggctcgcttagctggctataactagtaacagaggagaactagtatgagccagctaaacctggcggcagcgcaaaagatg

SEQ ID NO: 38241 - DNA, 103 bp, Artificial Sequence
  Synthetic Polynucleotide
taatacgactcactatagggggaacaaccgccggaccgggtaggttattcaacagaggagagaataaatgacccggtccaacctggcggcagcgcaaaagatg

SEQ ID NO: 38242 - DNA, 103 bp, Artificial Sequence
  Synthetic Polynucleotide
taatacgactcactatagggtgcatcacattatgacctgtccgaacagagaacagaggagactctgtatggacaggtcaaacctggcggcagcgcaaaagatg

SEQ ID NO: 38243 - DNA, 103 bp, Artificial Sequence
  Synthetic Polynucleotide
taatacgactcactataggggcacaggacaggagtccagcagtagccatgaacagaggagacatggcatgtgctggactaacctggcggcagcgcaaaagatg

SEQ ID NO: 38244 - DNA, 103 bp, Artificial Sequence
  Synthetic Polynucleotide
taatacgactcactataggggttgcgttaaagagcacgacccctcatggcaacagaggagagccatgatgggtcgtgctaacctggcggcagcgcaaaagatg

SEQ ID NO: 38245 - DNA, 103 bp, Artificial Sequence
  Synthetic Polynucleotide
taatacgactcactatagggaatcgaactcgcctcttccttgatcaccgcaacagaggagagcggtgatgaaggaagagaacctggcggcagcgcaaaagatg

SEQ ID NO: 38246 - DNA, 103 bp, Artificial Sequence
  Synthetic Polynucleotide
taatacgactcactatagggctcaatactcggtggttagcctgattgaggaacagaggagacctcaaatgggctaaccaaacctggcggcagcgcaaaagatg

SEQ ID NO: 38247 - DNA, 103 bp, Artificial Sequence
  Synthetic Polynucleotide
taatacgactcactataggggcttgatctacataaggcgtcgtgtcatgaaacagaggagatcatgaatggacgccttaaacctggcggcagcgcaaaagatg

SEQ ID NO: 38248 - DNA, 103 bp, Artificial Sequence
  Synthetic Polynucleotide
taatacgactcactatagggacggaaagctgatcaacagcactgagtcgaaacagaggagatcgactatgtgctgttgaaacctggcggcagcgcaaaagatg

SEQ ID NO: 38249 - DNA, 103 bp, Artificial Sequence
  Synthetic Polynucleotide
taatacgactcactatagggaagtcagtagttgatctagtgaatacagagaacagaggagactctgtatgcactagatcaacctggcggcagcgcaaaagatg

SEQ ID NO: 38250 - DNA, 103 bp, Artificial Sequence
  Synthetic Polynucleotide
taatacgactcactatagggcggtatcgacaggattagttttgtcatagtaacagaggagaactatgatgaaactaatcaacctggcggcagcgcaaaagatg

SEQ ID NO: 38251 - DNA, 103 bp, Artificial Sequence
  Synthetic Polynucleotide
taatacgactcactatagggtagatgggaactaggactacgatgttaagcaacagaggagagcttaaatgcgtagtcctaacctggcggcagcgcaaaagatg

SEQ ID NO: 38252 - DNA, 103 bp, Artificial Sequence
  Synthetic Polynucleotide
taatacgactcactatagggcaaatgtgttctccaaggtaatcggcgttaaacagaggagataacgcatgttaccttggaacctggcggcagcgcaaaagatg

SEQ ID NO: 38253 - DNA, 103 bp, Artificial Sequence
  Synthetic Polynucleotide
taatacgactcactatagggggggtaatatcgaggcgtataaaggaatttaacagaggagaaaattcatgtatacgcctaacctggcggcagcgcaaaagatg

SEQ ID NO: 38254 - DNA, 103 bp, Artificial Sequence
  Synthetic Polynucleotide
taatacgactcactatagggataacaacggattacggcgccataaaaacaaacagaggagatgttttatgggcgccgtaaacctggcggcagcgcaaaagatg

SEQ ID NO: 38255 - DNA, 103 bp, Artificial Sequence
  Synthetic Polynucleotide
taatacgactcactataggggataaataattccgcgtacgcacctctcgaaacagaggagatcgagaatggcgtacgcgaacctggcggcagcgcaaaagatg

SEQ ID NO: 38256 - DNA, 103 bp, Artificial Sequence
  Synthetic Polynucleotide
taatacgactcactataggggtaggagaaaccttcgtaaatcagtcggccaacagaggagaggccgaatgatttacgaaaacctggcggcagcgcaaaagatg

SEQ ID NO: 38257 - DNA, 103 bp, Artificial Sequence
  Synthetic Polynucleotide
taatacgactcactatagggtgaactccgtgatctggcgcagctaagcgaaacagaggagatcgcttatgtgcgccagaaacctggcggcagcgcaaaagatg

SEQ ID NO: 38258 - DNA, 103 bp, Artificial Sequence
  Synthetic Polynucleotide
taatacgactcactatagggttatatgaaaccccggccccccgagccccaaacagaggagatggggcatggggggccggaacctggcggcagcgcaaaagatg

SEQ ID NO: 38259 - DNA, 103 bp, Artificial Sequence
  Synthetic Polynucleotide
taatacgactcactataggggtgtttccatttttccagtaaaccatatagaacagaggagactatatatgttactggaaaacctggcggcagcgcaaaagatg

SEQ ID NO: 38260 - DNA, 103 bp, Artificial Sequence
  Synthetic Polynucleotide
taatacgactcactatagggtctgtgaggctgcgcgcgtctgcaacccataacagaggagaatgggtatgagacgcgcgaacctggcggcagcgcaaaagatg

SEQ ID NO: 38261 - DNA, 103 bp, Artificial Sequence
  Synthetic Polynucleotide
taatacgactcactatagggcagagatactttttgagggcagccggtttgaacagaggagacaaaccatgtgccctcaaaacctggcggcagcgcaaaagatg

SEQ ID NO: 38262 - DNA, 103 bp, Artificial Sequence
  Synthetic Polynucleotide
taatacgactcactatagggtaggtgcatgcttacttgactctatgttgaaacagaggagatcaacaatgagtcaagtaaacctggcggcagcgcaaaagatg

SEQ ID NO: 38263 - DNA, 103 bp, Artificial Sequence
  Synthetic Polynucleotide
taatacgactcactatagggactcggttacgagtgttgtgatttgacggaaacagaggagatccgtcatgtcacaacacaacctggcggcagcgcaaaagatg

SEQ ID NO: 38264 - DNA, 103 bp, Artificial Sequence
  Synthetic Polynucleotide
taatacgactcactatagggactgtcgtatgaagcgagtttgtgtccgtaaacagaggagatacggaatgaaactcgctaacctggcggcagcgcaaaagatg

SEQ ID NO: 38265 - DNA, 103 bp, Artificial Sequence
  Synthetic Polynucleotide
taatacgactcactatagggagtctctcaaaagagttgcatgccgcgaacaacagaggagagttcgcatgatgcaactcaacctggcggcagcgcaaaagatg

SEQ ID NO: 38266 - DNA, 103 bp, Artificial Sequence
  Synthetic Polynucleotide
taatacgactcactataggggcttcatagtgctttagtaaataccagttcaacagaggagagaactgatgtttactaaaaacctggcggcagcgcaaaagatg

SEQ ID NO: 38267 - DNA, 103 bp, Artificial Sequence
  Synthetic Polynucleotide
taatacgactcactatagggacgctcgcggttagtgaatgtgaggctcgtaacagaggagaacgagcatgacattcactaacctggcggcagcgcaaaagatg

SEQ ID NO: 38268 - DNA, 103 bp, Artificial Sequence
  Synthetic Polynucleotide
taatacgactcactataggggtgacgtccaaacgtcaaacttgctgttttaacagaggagaaaaacaatgagtttgacgaacctggcggcagcgcaaaagatg

SEQ ID NO: 38269 - DNA, 103 bp, Artificial Sequence
  Synthetic Polynucleotide
taatacgactcactatagggacaattgtgtacattaaagagaaggtctaaaacagaggagattagacatgctctttaataacctggcggcagcgcaaaagatg

SEQ ID NO: 38270 - DNA, 103 bp, Artificial Sequence
  Synthetic Polynucleotide
taatacgactcactatagggagtatatcgcagggtggcataaagttcgaaaacagaggagattcgaaatgtatgccaccaacctggcggcagcgcaaaagatg

SEQ ID NO: 38271 - DNA, 103 bp, Artificial Sequence
  Synthetic Polynucleotide
taatacgactcactatagggtcggcgcgcataaacgagcacctcccgggcaacagaggagagcccggatggtgctcgttaacctggcggcagcgcaaaagatg

SEQ ID NO: 38272 - DNA, 103 bp, Artificial Sequence
  Synthetic Polynucleotide
taatacgactcactatagggaaaacagtgcctgtgtaagaaatactggttaacagaggagaaaccagatgttcttacacaacctggcggcagcgcaaaagatg

SEQ ID NO: 38273 - DNA, 103 bp, Artificial Sequence
  Synthetic Polynucleotide
taatacgactcactatagggttggcaccctgtgctacggtaagcaatgctaacagaggagaagcattatgtaccgtagcaacctggcggcagcgcaaaagatg

SEQ ID NO: 38274 - DNA, 103 bp, Artificial Sequence
  Synthetic Polynucleotide
taatacgactcactatagggcccatcccgcactgatgtccgtttttggacaacagaggagagtccaaatgcggacatcaaacctggcggcagcgcaaaagatg

SEQ ID NO: 38275 - DNA, 103 bp, Artificial Sequence
  Synthetic Polynucleotide
taatacgactcactataggggcccattgatcgctctttcagggacggccgaacagaggagacggccgatgctgaaagagaacctggcggcagcgcaaaagatg

SEQ ID NO: 38276 - DNA, 103 bp, Artificial Sequence
  Synthetic Polynucleotide
taatacgactcactatagggtatctagggacgtgacatcacggtttctgaaacagaggagatcagaaatggtgatgtcaaacctggcggcagcgcaaaagatg

SEQ ID NO: 38277 - DNA, 103 bp, Artificial Sequence
  Synthetic Polynucleotide
taatacgactcactatagggtagtttctcggagttcgtggtaaaacatcgaacagaggagacgatgtatgaccacgaacaacctggcggcagcgcaaaagatg

SEQ ID NO: 38278 - DNA, 103 bp, Artificial Sequence
  Synthetic Polynucleotide
taatacgactcactatagggaatcgtcgctcccctcacacttgacagcagaacagaggagactgctgatgagtgtgaggaacctggcggcagcgcaaaagatg

SEQ ID NO: 38279 - DNA, 103 bp, Artificial Sequence
  Synthetic Polynucleotide
taatacgactcactatagggactcgcgattgacttcgttggggccatagaaacagaggagatctatgatgccaacgaagaacctggcggcagcgcaaaagatg

SEQ ID NO: 38280 - DNA, 103 bp, Artificial Sequence
  Synthetic Polynucleotide
taatacgactcactatagggtagggacgcaatagggggtgtgggtccgcaaacagaggagatgcggaatgacaccccctaacctggcggcagcgcaaaagatg

SEQ ID NO: 38281 - DNA, 103 bp, Artificial Sequence
  Synthetic Polynucleotide
taatacgactcactataggggtcagcgtatggggcacgttaaatttatttaacagaggagaaaataaatgtaacgtgccaacctggcggcagcgcaaaagatg

SEQ ID NO: 38282 - DNA, 103 bp, Artificial Sequence
  Synthetic Polynucleotide
taatacgactcactatagggagaaactttatcttttaacttccattgaccaacagaggagaggtcaaatgaagttaaaaaacctggcggcagcgcaaaagatg

SEQ ID NO: 38283 - DNA, 103 bp, Artificial Sequence
  Synthetic Polynucleotide
taatacgactcactatagggagtcgtttccgcggccggaatctagcttttaacagaggagaaaaagcatgattccggccaacctggcggcagcgcaaaagatg

SEQ ID NO: 38284 - DNA, 103 bp, Artificial Sequence
  Synthetic Polynucleotide
taatacgactcactatagggtttggggaggaactttgagcgtaaaacgtgaacagaggagacacgttatgcgctcaaagaacctggcggcagcgcaaaagatg

SEQ ID NO: 38285 - DNA, 103 bp, Artificial Sequence
  Synthetic Polynucleotide
taatacgactcactatagggcccgaatggtgtgtcgattcgtagatatgtaacagaggagaacatatatgcgaatcgacaacctggcggcagcgcaaaagatg

SEQ ID NO: 38286 - DNA, 103 bp, Artificial Sequence
  Synthetic Polynucleotide
taatacgactcactataggggggataatcgtgtctacgacggcttaaattaacagaggagaaatttaatgcgtcgtagaaacctggcggcagcgcaaaagatg

SEQ ID NO: 38287 - DNA, 103 bp, Artificial Sequence
  Synthetic Polynucleotide
taatacgactcactatagggatgtttgtaaggcatctctcaagatcgtgtaacagaggagaacacgaatgtgagagatgaacctggcggcagcgcaaaagatg

SEQ ID NO: 38288 - DNA, 103 bp, Artificial Sequence
  Synthetic Polynucleotide
taatacgactcactataggggtccagaaagtataagggcatatagcatcgaacagaggagacgatgcatgatgcccttaaacctggcggcagcgcaaaagatg

SEQ ID NO: 38289 - DNA, 103 bp, Artificial Sequence
  Synthetic Polynucleotide
taatacgactcactatagggacaagccgatctgcttaagcaggcgtgcagaacagaggagactgcacatgtgcttaagcaacctggcggcagcgcaaaagatg

SEQ ID NO: 38290 - DNA, 103 bp, Artificial Sequence
  Synthetic Polynucleotide
taatacgactcactatagggcttcgcttctgctatagaggaaatgagtgtaacagaggagaacactcatgtcctctataaacctggcggcagcgcaaaagatg

SEQ ID NO: 38291 - DNA, 103 bp, Artificial Sequence
  Synthetic Polynucleotide
taatacgactcactatagggacgaaaagcccccgagcatcatagtcgaagaacagaggagacttcgaatgtgatgctcgaacctggcggcagcgcaaaagatg

SEQ ID NO: 38292 - DNA, 103 bp, Artificial Sequence
  Synthetic Polynucleotide
taatacgactcactatagggaattactattggcattaacgaggggcgtggaacagaggagaccacgcatgtcgttaatgaacctggcggcagcgcaaaagatg

SEQ ID NO: 38293 - DNA, 103 bp, Artificial Sequence
  Synthetic Polynucleotide
taatacgactcactatagggagggtcaaacccacgccatcttaatatgctaacagaggagaagcataatgagatggcgtaacctggcggcagcgcaaaagatg

SEQ ID NO: 38294 - DNA, 103 bp, Artificial Sequence
  Synthetic Polynucleotide
taatacgactcactatagggatatgttccaatccatcttcaatggatcacaacagaggagagtgatcatgtgaagatggaacctggcggcagcgcaaaagatg

SEQ ID NO: 38295 - DNA, 103 bp, Artificial Sequence
  Synthetic Polynucleotide
taatacgactcactatagggtatagactaagcgattcgttgccttttcgtaacagaggagaacgaaaatgcaacgaatcaacctggcggcagcgcaaaagatg

SEQ ID NO: 38296 - DNA, 103 bp, Artificial Sequence
  Synthetic Polynucleotide
taatacgactcactatagggaccctggtagatcccggtacaacagagggtaacagaggagaaccctcatgtgtaccgggaacctggcggcagcgcaaaagatg

SEQ ID NO: 38297 - DNA, 103 bp, Artificial Sequence
  Synthetic Polynucleotide
taatacgactcactatagggccaacgcaacctgggtccgcaggggtagggaacagaggagaccctacatgtgcggacccaacctggcggcagcgcaaaagatg

SEQ ID NO: 38298 - DNA, 103 bp, Artificial Sequence
  Synthetic Polynucleotide
taatacgactcactatagggtagtcataatatttcactaccagactcaacaacagaggagagttgagatgggtagtgaaaacctggcggcagcgcaaaagatg

SEQ ID NO: 38299 - DNA, 103 bp, Artificial Sequence
  Synthetic Polynucleotide
taatacgactcactatagggtcgccgggaagtctctctcctccaacaacaaacagaggagatgttgtatgaggagagagaacctggcggcagcgcaaaagatg

SEQ ID NO: 38300 - DNA, 103 bp, Artificial Sequence
  Synthetic Polynucleotide
taatacgactcactatagggatcggcattactcgcccccgtcgcctgttcaacagaggagagaacagatgacgggggcgaacctggcggcagcgcaaaagatg

SEQ ID NO: 38301 - DNA, 103 bp, Artificial Sequence
  Synthetic Polynucleotide
taatacgactcactatagggcgaagatcaaacttagcccgtatatgcagaaacagaggagatctgcaatgacgggctaaaacctggcggcagcgcaaaagatg

SEQ ID NO: 38302 - DNA, 103 bp, Artificial Sequence
  Synthetic Polynucleotide
taatacgactcactatagggcctcatctcgtctacccagcctttgttacgaacagaggagacgtaacatgggctgggtaaacctggcggcagcgcaaaagatg

SEQ ID NO: 38303 - DNA, 103 bp, Artificial Sequence
  Synthetic Polynucleotide
taatacgactcactatagggctggatcccatgagccaaacgtatgctattaacagaggagaaatagcatgcgtttggctaacctggcggcagcgcaaaagatg

SEQ ID NO: 38304 - DNA, 103 bp, Artificial Sequence
  Synthetic Polynucleotide
taatacgactcactataggggtcttgtcctgcccgttacccccagagggaaacagaggagatccctcatggggtaacggaacctggcggcagcgcaaaagatg

SEQ ID NO: 38305 - DNA, 103 bp, Artificial Sequence
  Synthetic Polynucleotide
taatacgactcactataggggcgttatatagaccgctgggaggctcgcccaacagaggagagggcgaatgtcccagcggaacctggcggcagcgcaaaagatg

SEQ ID NO: 38306 - DNA, 103 bp, Artificial Sequence
  Synthetic Polynucleotide
taatacgactcactataggggcaaagcgttaatgcttcactttagcaataaacagaggagatattgcatgagtgaagcaaacctggcggcagcgcaaaagatg

SEQ ID NO: 38307 - DNA, 103 bp, Artificial Sequence
  Synthetic Polynucleotide
taatacgactcactatagggttcatgcactactttgcaacccgccctcccaacagaggagagggaggatgggttgcaaaaacctggcggcagcgcaaaagatg

SEQ ID NO: 38308 - DNA, 103 bp, Artificial Sequence
  Synthetic Polynucleotide
taatacgactcactatagggatagggtcaacctgacgagaaggtttataaaacagaggagattataaatgttctcgtcaaacctggcggcagcgcaaaagatg

SEQ ID NO: 38309 - DNA, 103 bp, Artificial Sequence
  Synthetic Polynucleotide
taatacgactcactataggggctatagcattaattgctcgagaacgtcgtaacagaggagaacgacgatgtcgagcaataacctggcggcagcgcaaaagatg

SEQ ID NO: 38310 - DNA, 103 bp, Artificial Sequence
  Synthetic Polynucleotide
taatacgactcactatagggcgggcccatttctgtgcacggcaagggttaaacagaggagataacccatgccgtgcacaaacctggcggcagcgcaaaagatg

SEQ ID NO: 38311 - DNA, 103 bp, Artificial Sequence
  Synthetic Polynucleotide
taatacgactcactatagggttgagacccgtcaccctatatccgcaacgtaacagaggagaacgttgatgatatagggtaacctggcggcagcgcaaaagatg

SEQ ID NO: 38312 - DNA, 103 bp, Artificial Sequence
  Synthetic Polynucleotide
taatacgactcactatagggctatttccctggagcagcgcatactctcctaacagaggagaaggagaatgtgcgctgctaacctggcggcagcgcaaaagatg

SEQ ID NO: 38313 - DNA, 103 bp, Artificial Sequence
  Synthetic Polynucleotide
taatacgactcactatagggatagctgctttgcttgatatagtataacacaacagaggagagtgttaatgtatatcaagaacctggcggcagcgcaaaagatg

SEQ ID NO: 38314 - DNA, 103 bp, Artificial Sequence
  Synthetic Polynucleotide
taatacgactcactatagggtaaggcgggatcctggagtgacgtcgatgcaacagaggagagcatcgatgtcactccagaacctggcggcagcgcaaaagatg

SEQ ID NO: 38315 - DNA, 103 bp, Artificial Sequence
  Synthetic Polynucleotide
taatacgactcactatagggcgttaagtacattccaaaatgcagctttggaacagaggagaccaaagatgcattttggaaacctggcggcagcgcaaaagatg

SEQ ID NO: 38316 - DNA, 103 bp, Artificial Sequence
  Synthetic Polynucleotide
taatacgactcactatagggcccggcgtaagttcgaggtatgatcggcaaaacagaggagattgccgatgatacctcgaaacctggcggcagcgcaaaagatg

SEQ ID NO: 38317 - DNA, 103 bp, Artificial Sequence
  Synthetic Polynucleotide
taatacgactcactataggggttcgccgtggcgggcctcaaagggaggcaaacagaggagatgcctcatgttgaggcccaacctggcggcagcgcaaaagatg

SEQ ID NO: 38318 - DNA, 103 bp, Artificial Sequence
  Synthetic Polynucleotide
taatacgactcactatagggtgagaggctcaaacgcacacgcgcgtgaagaacagaggagacttcacatgcgtgtgcgtaacctggcggcagcgcaaaagatg

SEQ ID NO: 38319 - DNA, 103 bp, Artificial Sequence
  Synthetic Polynucleotide
taatacgactcactatagggaactacataccaatgtgggcgcacaaagtcaacagaggagagactttatgcgcccacataacctggcggcagcgcaaaagatg

SEQ ID NO: 38320 - DNA, 103 bp, Artificial Sequence
  Synthetic Polynucleotide
taatacgactcactatagggaagaagtgaccccaggcgtgtagctagtgaaacagaggagatcactaatgacacgcctgaacctggcggcagcgcaaaagatg

SEQ ID NO: 38321 - DNA, 103 bp, Artificial Sequence
  Synthetic Polynucleotide
taatacgactcactatagggattcaaaagccccgagtaggagaacaagctaacagaggagaagcttgatgtcctactcgaacctggcggcagcgcaaaagatg

SEQ ID NO: 38322 - DNA, 103 bp, Artificial Sequence
  Synthetic Polynucleotide
taatacgactcactatagggtaagttgggcgaatcttgccattgcgggtcaacagaggagagacccgatgtggcaagataacctggcggcagcgcaaaagatg

SEQ ID NO: 38323 - DNA, 103 bp, Artificial Sequence
  Synthetic Polynucleotide
taatacgactcactatagggtagttccctaccccatgattatagtacggtaacagaggagaaccgtaatgtaatcatggaacctggcggcagcgcaaaagatg

SEQ ID NO: 38324 - DNA, 103 bp, Artificial Sequence
  Synthetic Polynucleotide
taatacgactcactatagggcagtaacgggcagccccagaagggggcggtaacagaggagaaccgccatgttctggggcaacctggcggcagcgcaaaagatg

SEQ ID NO: 38325 - DNA, 103 bp, Artificial Sequence
  Synthetic Polynucleotide
taatacgactcactatagggcaatccaccttcgtcaaaggccaacgattaaacagaggagataatcgatggcctttgacaacctggcggcagcgcaaaagatg

SEQ ID NO: 38326 - DNA, 103 bp, Artificial Sequence
  Synthetic Polynucleotide
taatacgactcactatagggttgctagttaactgatcattgcacaactgtaacagaggagaacagttatgcaatgatcaaacctggcggcagcgcaaaagatg

SEQ ID NO: 38327 - DNA, 103 bp, Artificial Sequence
  Synthetic Polynucleotide
taatacgactcactatagggatacatctgagtattaacaatagcgaccgcaacagaggagagcggtcatgattgttaataacctggcggcagcgcaaaagatg

SEQ ID NO: 38328 - DNA, 103 bp, Artificial Sequence
  Synthetic Polynucleotide
taatacgactcactatagggcgccgctaggttgactcttcggcaacgtctaacagaggagaagacgtatgcgaagagtcaacctggcggcagcgcaaaagatg

SEQ ID NO: 38329 - DNA, 103 bp, Artificial Sequence
  Synthetic Polynucleotide
taatacgactcactatagggctcgaaagagctcatcgctgcctccgccttaacagaggagaaaggcgatggcagcgatgaacctggcggcagcgcaaaagatg

SEQ ID NO: 38330 - DNA, 103 bp, Artificial Sequence
  Synthetic Polynucleotide
taatacgactcactatagggcccatttgttgcgcacgtatgagcaggtaaaacagaggagattacctatgcatacgtgcaacctggcggcagcgcaaaagatg

SEQ ID NO: 38331 - DNA, 103 bp, Artificial Sequence
  Synthetic Polynucleotide
taatacgactcactatagggtgaaaccttcagccggaaagtagttaagccaacagaggagaggcttaatgactttccggaacctggcggcagcgcaaaagatg

SEQ ID NO: 38332 - DNA, 103 bp, Artificial Sequence
  Synthetic Polynucleotide
taatacgactcactatagggtctagaaagatcacagccctgtggcgattcaacagaggagagaatcgatgcagggctgtaacctggcggcagcgcaaaagatg

SEQ ID NO: 38333 - DNA, 103 bp, Artificial Sequence
  Synthetic Polynucleotide
taatacgactcactataggggcacgcggaacatttgacgcttacgacgaaaacagaggagattcgtcatgagcgtcaaaaacctggcggcagcgcaaaagatg

SEQ ID NO: 38334 - DNA, 103 bp, Artificial Sequence
  Synthetic Polynucleotide
taatacgactcactataggggtgtcagtcgctacaaactactgggcatacaacagaggagagtatgcatggtagtttgtaacctggcggcagcgcaaaagatg

SEQ ID NO: 38335 - DNA, 103 bp, Artificial Sequence
  Synthetic Polynucleotide
taatacgactcactatagggcaggccgcgtcgtaaaaggaaggagctaacaacagaggagagttagcatgttccttttaaacctggcggcagcgcaaaagatg

SEQ ID NO: 38336 - DNA, 103 bp, Artificial Sequence
  Synthetic Polynucleotide
taatacgactcactatagggcttgcctatacggtctttatgtatccacgtaacagaggagaacgtggatgcataaagacaacctggcggcagcgcaaaagatg

SEQ ID NO: 38337 - DNA, 103 bp, Artificial Sequence
  Synthetic Polynucleotide
taatacgactcactatagggcccgacccgcagggccggctcttttgttcgaacagaggagacgaacaatggagccggccaacctggcggcagcgcaaaagatg

SEQ ID NO: 38338 - DNA, 103 bp, Artificial Sequence
  Synthetic Polynucleotide
taatacgactcactataggggatacaacgtcgctctagtttgattcatgtaacagaggagaacatgaatgaaactagagaacctggcggcagcgcaaaagatg

SEQ ID NO: 38339 - DNA, 103 bp, Artificial Sequence
  Synthetic Polynucleotide
taatacgactcactatagggtcctcttacgcagagctagtccccctctctaacagaggagaagagagatggactagctcaacctggcggcagcgcaaaagatg

SEQ ID NO: 38340 - DNA, 103 bp, Artificial Sequence
  Synthetic Polynucleotide
taatacgactcactatagggtaagaagacatggcgtaaatggccatgtacaacagaggagagtacatatgcatttacgcaacctggcggcagcgcaaaagatg

SEQ ID NO: 38341 - DNA, 103 bp, Artificial Sequence
  Synthetic Polynucleotide
taatacgactcactatagggtgtcaccgggtatcgacgttaggctaggacaacagaggagagtcctaatgtaacgtcgaaacctggcggcagcgcaaaagatg

SEQ ID NO: 38342 - DNA, 103 bp, Artificial Sequence
  Synthetic Polynucleotide
taatacgactcactatagggtgtgtatctatgtggttcttttagctagctaacagaggagaagctagatgaaagaaccaaacctggcggcagcgcaaaagatg

SEQ ID NO: 38343 - DNA, 103 bp, Artificial Sequence
  Synthetic Polynucleotide
taatacgactcactatagggggtattggatgaccatgctgaggtaagcggaacagaggagaccgcttatgtcagcatggaacctggcggcagcgcaaaagatg

SEQ ID NO: 38344 - DNA, 103 bp, Artificial Sequence
  Synthetic Polynucleotide
taatacgactcactatagggcctcgagtcacacgacccgtgagtaccacgaacagaggagacgtggtatgcacgggtcgaacctggcggcagcgcaaaagatg

SEQ ID NO: 38345 - DNA, 103 bp, Artificial Sequence
  Synthetic Polynucleotide
taatacgactcactatagggctgtgccggtcaatattatccagttttataaacagaggagatataaaatgggataatataacctggcggcagcgcaaaagatg

SEQ ID NO: 38346 - DNA, 103 bp, Artificial Sequence
  Synthetic Polynucleotide
taatacgactcactatagggtagtagtcacgttgcggtttacgttatacaaacagaggagatgtataatgtaaaccgcaaacctggcggcagcgcaaaagatg

SEQ ID NO: 38347 - DNA, 103 bp, Artificial Sequence
  Synthetic Polynucleotide
taatacgactcactatagggggaggaagggataattcgcacgtttatgagaacagaggagactcataatggtgcgaattaacctggcggcagcgcaaaagatg

SEQ ID NO: 38348 - DNA, 103 bp, Artificial Sequence
  Synthetic Polynucleotide
taatacgactcactatagggcacgtacaacggtacgttctaaggtcaaagaacagaggagactttgaatgtagaacgtaaacctggcggcagcgcaaaagatg

SEQ ID NO: 38349 - DNA, 103 bp, Artificial Sequence
  Synthetic Polynucleotide
taatacgactcactatagggaaaaactaacccttttttacaggagataccaacagaggagaggtatcatgtgtaaaaaaaacctggcggcagcgcaaaagatg

SEQ ID NO: 38350 - DNA, 103 bp, Artificial Sequence
  Synthetic Polynucleotide
taatacgactcactatagggaacactgtaaccaccactgttgttgagcctaacagaggagaaggctcatgaacagtggtaacctggcggcagcgcaaaagatg

SEQ ID NO: 38351 - DNA, 103 bp, Artificial Sequence
  Synthetic Polynucleotide
taatacgactcactatagggacttggcttagttatacgacgctcccgatcaacagaggagagatcggatgcgtcgtataaacctggcggcagcgcaaaagatg

SEQ ID NO: 38352 - DNA, 103 bp, Artificial Sequence
  Synthetic Polynucleotide
taatacgactcactatagggcttcgctattaagagagcgccgtaacgaggaacagaggagacctcgtatgggcgctctcaacctggcggcagcgcaaaagatg

SEQ ID NO: 38353 - DNA, 103 bp, Artificial Sequence
  Synthetic Polynucleotide
taatacgactcactataggggacgactcgcgttgccgtcatattccaagcaacagaggagagcttggatgatgacggcaaacctggcggcagcgcaaaagatg

SEQ ID NO: 38354 - DNA, 103 bp, Artificial Sequence
  Synthetic Polynucleotide
taatacgactcactataggggacacatgaaaatagatttggccaacctctaacagaggagaagaggtatgccaaatctaaacctggcggcagcgcaaaagatg

SEQ ID NO: 38355 - DNA, 103 bp, Artificial Sequence
  Synthetic Polynucleotide
taatacgactcactataggggtgcacgcttgtttaacagcatctacggcaaacagaggagatgccgtatgtgctgttaaaacctggcggcagcgcaaaagatg

SEQ ID NO: 38356 - DNA, 103 bp, Artificial Sequence
  Synthetic Polynucleotide
taatacgactcactataggggcgccccgggtagtgttcgagatacttgggaacagaggagacccaagatgctcgaacacaacctggcggcagcgcaaaagatg

SEQ ID NO: 38357 - DNA, 103 bp, Artificial Sequence
  Synthetic Polynucleotide
taatacgactcactatagggtgaatatgtctctttattaaaccaccgaaaaacagaggagatttcggatgtttaataaaaacctggcggcagcgcaaaagatg

SEQ ID NO: 38358 - DNA, 103 bp, Artificial Sequence
  Synthetic Polynucleotide
taatacgactcactatagggcttcactatacttgcgctactgaacattctaacagaggagaagaatgatgagtagcgcaaacctggcggcagcgcaaaagatg

SEQ ID NO: 38359 - DNA, 103 bp, Artificial Sequence
  Synthetic Polynucleotide
taatacgactcactatagggtttcccaataggagcctacgcagtcttcgaaacagaggagatcgaagatggcgtaggctaacctggcggcagcgcaaaagatg

SEQ ID NO: 38360 - DNA, 103 bp, Artificial Sequence
  Synthetic Polynucleotide
taatacgactcactatagggattatctgcagtgttagtgatgtagagttgaacagaggagacaactcatgatcactaacaacctggcggcagcgcaaaagatg

SEQ ID NO: 38361 - DNA, 103 bp, Artificial Sequence
  Synthetic Polynucleotide
taatacgactcactatagggtcacatactggtaccgatgcgttttctactaacagaggagaagtagaatgcgcatcggtaacctggcggcagcgcaaaagatg

SEQ ID NO: 38362 - DNA, 103 bp, Artificial Sequence
  Synthetic Polynucleotide
taatacgactcactatagggagctacagtaatgcaatcgcagccgtgttgaacagaggagacaacacatgtgcgattgcaacctggcggcagcgcaaaagatg

SEQ ID NO: 38363 - DNA, 103 bp, Artificial Sequence
  Synthetic Polynucleotide
taatacgactcactataggggatgattgatagtatccgcgataagcccggaacagaggagaccgggcatgtcgcggataaacctggcggcagcgcaaaagatg

SEQ ID NO: 38364 - DNA, 103 bp, Artificial Sequence
  Synthetic Polynucleotide
taatacgactcactataggggcggggttgtagccgtcaaaatacgctaggaacagaggagacctagcatgttttgacggaacctggcggcagcgcaaaagatg

SEQ ID NO: 38365 - DNA, 103 bp, Artificial Sequence
  Synthetic Polynucleotide
taatacgactcactatagggctagatgtgaactcgagacccttgtcttcgaacagaggagacgaagaatggggtctcgaaacctggcggcagcgcaaaagatg

SEQ ID NO: 38366 - DNA, 103 bp, Artificial Sequence
  Synthetic Polynucleotide
taatacgactcactataggggagagggtccggaacggcgcgcgtgtatgaaacagaggagatcatacatgcgcgccgttaacctggcggcagcgcaaaagatg

SEQ ID NO: 38367 - DNA, 103 bp, Artificial Sequence
  Synthetic Polynucleotide
taatacgactcactatagggcagctgaggtcgataaacgtagggtgctcaaacagaggagatgagcaatgtacgtttataacctggcggcagcgcaaaagatg

SEQ ID NO: 38368 - DNA, 103 bp, Artificial Sequence
  Synthetic Polynucleotide
taatacgactcactatagggctcggaacgtatttccgatgtgtggttcctaacagaggagaaggaacatgacatcggaaaacctggcggcagcgcaaaagatg

SEQ ID NO: 38369 - DNA, 103 bp, Artificial Sequence
  Synthetic Polynucleotide
taatacgactcactatagggcaatgtttttgatcggctgcataccccgccaacagaggagaggcgggatgtgcagccgaaacctggcggcagcgcaaaagatg

SEQ ID NO: 38370 - DNA, 103 bp, Artificial Sequence
  Synthetic Polynucleotide
taatacgactcactatagggaagcgcttgctatgactagccggtcgatgtaacagaggagaacatcgatgggctagtcaaacctggcggcagcgcaaaagatg

SEQ ID NO: 38371 - DNA, 103 bp, Artificial Sequence
  Synthetic Polynucleotide
taatacgactcactatagggtggtatgagacagacttgccccgggccgtcaacagaggagagacggcatggggcaagtcaacctggcggcagcgcaaaagatg

SEQ ID NO: 38372 - DNA, 103 bp, Artificial Sequence
  Synthetic Polynucleotide
taatacgactcactataggggattattctgcttggagacgaaaccggggaaacagaggagatccccgatgtcgtctccaaacctggcggcagcgcaaaagatg

SEQ ID NO: 38373 - DNA, 103 bp, Artificial Sequence
  Synthetic Polynucleotide
taatacgactcactatagggcgtttctgctgggcgagagagccacagaccaacagaggagaggtctgatgctctctcgcaacctggcggcagcgcaaaagatg

SEQ ID NO: 38374 - DNA, 103 bp, Artificial Sequence
  Synthetic Polynucleotide
taatacgactcactatagggtggattaactcgttattaagctctcaatataacagaggagaatattgatggcttaataaaacctggcggcagcgcaaaagatg

SEQ ID NO: 38375 - DNA, 103 bp, Artificial Sequence
  Synthetic Polynucleotide
taatacgactcactatagggctaatgtgcgggccgtttgggcttaccactaacagaggagaagtggtatgcccaaacggaacctggcggcagcgcaaaagatg

SEQ ID NO: 38376 - DNA, 103 bp, Artificial Sequence
  Synthetic Polynucleotide
taatacgactcactatagggactgcacgaagaggtggagtaacatcacgaaacagaggagatcgtgaatgtactccaccaacctggcggcagcgcaaaagatg

SEQ ID NO: 38377 - DNA, 103 bp, Artificial Sequence
  Synthetic Polynucleotide
taatacgactcactataggggaacatagccgagcggggtccgggatcataaacagaggagatatgatatgggaccccgcaacctggcggcagcgcaaaagatg

SEQ ID NO: 38378 - DNA, 103 bp, Artificial Sequence
  Synthetic Polynucleotide
taatacgactcactataggggactctaaaatctcacctgagactattctgaacagaggagacagaatatgctcaggtgaaacctggcggcagcgcaaaagatg

SEQ ID NO: 38379 - DNA, 103 bp, Artificial Sequence
  Synthetic Polynucleotide
taatacgactcactatagggagctttagccctgctttaatccctaccgtgaacagaggagacacggtatggattaaagcaacctggcggcagcgcaaaagatg

SEQ ID NO: 38380 - DNA, 103 bp, Artificial Sequence
  Synthetic Polynucleotide
taatacgactcactatagggtgggagcaagtagtaaggggtccagactctaacagaggagaagagtcatgaccccttacaacctggcggcagcgcaaaagatg

SEQ ID NO: 38381 - DNA, 103 bp, Artificial Sequence
  Synthetic Polynucleotide
taatacgactcactatagggacattgtctcaggcgaccatactccgtcgcaacagaggagagcgacgatgtatggtcgcaacctggcggcagcgcaaaagatg

SEQ ID NO: 38382 - DNA, 103 bp, Artificial Sequence
  Synthetic Polynucleotide
taatacgactcactataggggggagaaagcggaccatttggggtgtcgtcaacagaggagagacgacatgccaaatggtaacctggcggcagcgcaaaagatg

SEQ ID NO: 38383 - DNA, 103 bp, Artificial Sequence
  Synthetic Polynucleotide
taatacgactcactataggggcagccagggatgttcactctgagcgattgaacagaggagacaatcgatgagagtgaacaacctggcggcagcgcaaaagatg

SEQ ID NO: 38384 - DNA, 103 bp, Artificial Sequence
  Synthetic Polynucleotide
taatacgactcactatagggtttaggaatcacttcagggattgtcaggacaacagaggagagtcctgatgatccctgaaaacctggcggcagcgcaaaagatg

SEQ ID NO: 38385 - DNA, 103 bp, Artificial Sequence
  Synthetic Polynucleotide
taatacgactcactatagggtgtgctgtacactgtgccacgtctcgcagtaacagaggagaactgcgatgcgtggcacaaacctggcggcagcgcaaaagatg

SEQ ID NO: 38386 - DNA, 103 bp, Artificial Sequence
  Synthetic Polynucleotide
taatacgactcactatagggttgggttgctcgtttcaatgggagttcgtaaacagaggagatacgaaatgccattgaaaaacctggcggcagcgcaaaagatg

SEQ ID NO: 38387 - DNA, 103 bp, Artificial Sequence
  Synthetic Polynucleotide
taatacgactcactatagggcatagtcagtttgctataaaaatcgcggtcaacagaggagagaccgcatgttttatagcaacctggcggcagcgcaaaagatg

SEQ ID NO: 38388 - DNA, 103 bp, Artificial Sequence
  Synthetic Polynucleotide
taatacgactcactatagggctgtgggttcatgcaccgagtcgaagcagcaacagaggagagctgctatgactcggtgcaacctggcggcagcgcaaaagatg

SEQ ID NO: 38389 - DNA, 103 bp, Artificial Sequence
  Synthetic Polynucleotide
taatacgactcactataggggtactttacgccggagcaagatcacttcgaaacagaggagatcgaagatgtcttgctccaacctggcggcagcgcaaaagatg

SEQ ID NO: 38390 - DNA, 103 bp, Artificial Sequence
  Synthetic Polynucleotide
taatacgactcactatagggtagacgctcgatatgcaatccgtcatgtttaacagaggagaaaacatatgggattgcataacctggcggcagcgcaaaagatg

SEQ ID NO: 38391 - DNA, 103 bp, Artificial Sequence
  Synthetic Polynucleotide
taatacgactcactatagggaacaaacatgtgataggaggttgactatttaacagaggagaaaatagatgacctcctataacctggcggcagcgcaaaagatg

SEQ ID NO: 38392 - DNA, 103 bp, Artificial Sequence
  Synthetic Polynucleotide
taatacgactcactatagggttctctctgggacgcggaactaccgctgcgaacagaggagacgcagcatgagttccgcgaacctggcggcagcgcaaaagatg

SEQ ID NO: 38393 - DNA, 103 bp, Artificial Sequence
  Synthetic Polynucleotide
taatacgactcactatagggctgcaaaccagagattaccatactaatagcaacagaggagagctattatgatggtaatcaacctggcggcagcgcaaaagatg

SEQ ID NO: 38394 - DNA, 103 bp, Artificial Sequence
  Synthetic Polynucleotide
taatacgactcactatagggatgatttggcaaagtgcacagcgccgttggaacagaggagaccaacgatgctgtgcactaacctggcggcagcgcaaaagatg

SEQ ID NO: 38395 - DNA, 103 bp, Artificial Sequence
  Synthetic Polynucleotide
taatacgactcactatagggtaagcgaaggcgtgtagcgcgtccccacctaacagaggagaaggtggatgcgcgctacaaacctggcggcagcgcaaaagatg

SEQ ID NO: 38396 - DNA, 103 bp, Artificial Sequence
  Synthetic Polynucleotide
taatacgactcactatagggtgacgcgacgtaaaggggtgacaagctgataacagaggagaatcagcatgtcaccccttaacctggcggcagcgcaaaagatg

SEQ ID NO: 38397 - DNA, 103 bp, Artificial Sequence
  Synthetic Polynucleotide
taatacgactcactatagggatgcgtaactcttagataagttccgtccaaaacagaggagattggacatgacttatctaaacctggcggcagcgcaaaagatg

SEQ ID NO: 38398 - DNA, 103 bp, Artificial Sequence
  Synthetic Polynucleotide
taatacgactcactatagggcccatcgctccgttactcgagctggcgagaaacagaggagatctcgcatgctcgagtaaaacctggcggcagcgcaaaagatg

SEQ ID NO: 38399 - DNA, 103 bp, Artificial Sequence
  Synthetic Polynucleotide
taatacgactcactatagggcagatgacgcgccattcccctccagagcagaacagaggagactgctcatgaggggaatgaacctggcggcagcgcaaaagatg

SEQ ID NO: 38400 - DNA, 103 bp, Artificial Sequence
  Synthetic Polynucleotide
taatacgactcactatagggatgcacgaggatggttgtccctgacatacaaacagaggagatgtatgatggggacaaccaacctggcggcagcgcaaaagatg

SEQ ID NO: 38401 - DNA, 103 bp, Artificial Sequence
  Synthetic Polynucleotide
taatacgactcactatagggctcactcctatgaagaacaaaaaacgttctaacagaggagaagaacgatgtttgttcttaacctggcggcagcgcaaaagatg

SEQ ID NO: 38402 - DNA, 103 bp, Artificial Sequence
  Synthetic Polynucleotide
taatacgactcactatagggagcgcaaaagagccccagttgtacggagggaacagaggagaccctccatgcaactggggaacctggcggcagcgcaaaagatg

SEQ ID NO: 38403 - DNA, 103 bp, Artificial Sequence
  Synthetic Polynucleotide
taatacgactcactataggggattgctccgtgtctcgcatatgcaccgcgaacagaggagacgcggtatgtatgcgagaaacctggcggcagcgcaaaagatg

SEQ ID NO: 38404 - DNA, 103 bp, Artificial Sequence
  Synthetic Polynucleotide
taatacgactcactataggggctacaacgcccctcccaaacggatcctttaacagaggagaaaaggaatggtttgggagaacctggcggcagcgcaaaagatg

SEQ ID NO: 38405 - DNA, 103 bp, Artificial Sequence
  Synthetic Polynucleotide
taatacgactcactataggggggagcaccgttggacgcggaggagacatgaacagaggagacatgtcatgtccgcgtccaacctggcggcagcgcaaaagatg

SEQ ID NO: 38406 - DNA, 103 bp, Artificial Sequence
  Synthetic Polynucleotide
taatacgactcactatagggaagctgcgatgtaatgggcgtcgagtgtgaaacagaggagatcacacatgacgcccattaacctggcggcagcgcaaaagatg

SEQ ID NO: 38407 - DNA, 103 bp, Artificial Sequence
  Synthetic Polynucleotide
taatacgactcactatagggatccatccccttgtgccaagtccgcaacgcaacagaggagagcgttgatgacttggcacaacctggcggcagcgcaaaagatg

SEQ ID NO: 38408 - DNA, 103 bp, Artificial Sequence
  Synthetic Polynucleotide
taatacgactcactatagggttgctgttaagtgatcttaagcgtcataccaacagaggagaggtatgatgcttaagatcaacctggcggcagcgcaaaagatg

SEQ ID NO: 38409 - DNA, 103 bp, Artificial Sequence
  Synthetic Polynucleotide
taatacgactcactatagggggcatgcatccctggattctaacacggtccaacagaggagaggaccgatgtagaatccaaacctggcggcagcgcaaaagatg

SEQ ID NO: 38410 - DNA, 103 bp, Artificial Sequence
  Synthetic Polynucleotide
taatacgactcactatagggcctgtgtactgtacatagcgccggagtggaaacagaggagatccactatggcgctatgtaacctggcggcagcgcaaaagatg

SEQ ID NO: 38411 - DNA, 103 bp, Artificial Sequence
  Synthetic Polynucleotide
taatacgactcactatagggcccaaattctctgacagggtctgatgttttaacagaggagaaaaacaatggaccctgtcaacctggcggcagcgcaaaagatg

SEQ ID NO: 38412 - DNA, 103 bp, Artificial Sequence
  Synthetic Polynucleotide
taatacgactcactataggggtcagattcacgtcagagctaatcttccttaacagaggagaaaggaaatgtagctctgaaacctggcggcagcgcaaaagatg

SEQ ID NO: 38413 - DNA, 103 bp, Artificial Sequence
  Synthetic Polynucleotide
taatacgactcactataggggcatacgccttcaatgaagtgtgcgccagcaacagaggagagctggcatgcacttcattaacctggcggcagcgcaaaagatg

SEQ ID NO: 38414 - DNA, 103 bp, Artificial Sequence
  Synthetic Polynucleotide
taatacgactcactatagggtgtcggtgtagcatcgttctcggtgttcataacagaggagaatgaacatggagaacgataacctggcggcagcgcaaaagatg

SEQ ID NO: 38415 - DNA, 103 bp, Artificial Sequence
  Synthetic Polynucleotide
taatacgactcactatagggtcgatctattgaatttacggtactccgtccaacagaggagaggacggatgaccgtaaataacctggcggcagcgcaaaagatg

SEQ ID NO: 38416 - DNA, 103 bp, Artificial Sequence
  Synthetic Polynucleotide
taatacgactcactatagggtaaatttcagatagaatgttactccgtaataacagaggagaattacgatgtaacattctaacctggcggcagcgcaaaagatg

SEQ ID NO: 38417 - DNA, 103 bp, Artificial Sequence
  Synthetic Polynucleotide
taatacgactcactatagggctacaaaacgagtagtgcgttggcccattaaacagaggagataatggatgaacgcactaaacctggcggcagcgcaaaagatg

SEQ ID NO: 38418 - DNA, 103 bp, Artificial Sequence
  Synthetic Polynucleotide
taatacgactcactataggggtaacgcatgcgagagttttagaacgctgaaacagaggagatcagcgatgtaaaactctaacctggcggcagcgcaaaagatg

SEQ ID NO: 38419 - DNA, 103 bp, Artificial Sequence
  Synthetic Polynucleotide
taatacgactcactatagggttcacaaagaggacgagctggtaggcacgaaacagaggagatcgtgcatgccagctcgtaacctggcggcagcgcaaaagatg

SEQ ID NO: 38420 - DNA, 103 bp, Artificial Sequence
  Synthetic Polynucleotide
taatacgactcactatagggcaccaactctaaaatagtacaaggacattcaacagaggagagaatgtatgtgtactattaacctggcggcagcgcaaaagatg

SEQ ID NO: 38421 - DNA, 103 bp, Artificial Sequence
  Synthetic Polynucleotide
taatacgactcactatagggccattgactctaccaaaggagatctttagaaacagaggagatctaaaatgctcctttggaacctggcggcagcgcaaaagatg

SEQ ID NO: 38422 - DNA, 103 bp, Artificial Sequence
  Synthetic Polynucleotide
taatacgactcactataggggataagaacgttggccagtcgttcgggtcaaacagaggagatgacccatgcgactggccaacctggcggcagcgcaaaagatg

SEQ ID NO: 38423 - DNA, 103 bp, Artificial Sequence
  Synthetic Polynucleotide
taatacgactcactatagggtggaatatgaatccagccgccatatatgataacagaggagaatcataatgggcggctggaacctggcggcagcgcaaaagatg

SEQ ID NO: 38424 - DNA, 103 bp, Artificial Sequence
  Synthetic Polynucleotide
taatacgactcactatagggaagggctacgtgcctgccagatgccgctctaacagaggagaagagcgatgtctggcaggaacctggcggcagcgcaaaagatg

SEQ ID NO: 38425 - DNA, 103 bp, Artificial Sequence
  Synthetic Polynucleotide
taatacgactcactatagggcggtggtttggtcggcgctcgttcctacttaacagaggagaaagtagatgcgagcgccgaacctggcggcagcgcaaaagatg

SEQ ID NO: 38426 - DNA, 103 bp, Artificial Sequence
  Synthetic Polynucleotide
taatacgactcactatagggtaggcgcagttaatagggggtgctaactagaacagaggagactagttatgaccccctataacctggcggcagcgcaaaagatg

SEQ ID NO: 38427 - DNA, 103 bp, Artificial Sequence
  Synthetic Polynucleotide
taatacgactcactatagggtccgtacgcggcaggctacttaaccagtaaaacagaggagattactgatgaagtagcctaacctggcggcagcgcaaaagatg

SEQ ID NO: 38428 - DNA, 103 bp, Artificial Sequence
  Synthetic Polynucleotide
taatacgactcactatagggatagaggattcattcaccggcacgtgcctcaacagaggagagaggcaatggccggtgaaaacctggcggcagcgcaaaagatg

SEQ ID NO: 38429 - DNA, 103 bp, Artificial Sequence
  Synthetic Polynucleotide
taatacgactcactatagggtgtatcgagatcgagagggtcgcgggtgagaacagaggagactcaccatggaccctctcaacctggcggcagcgcaaaagatg

SEQ ID NO: 38430 - DNA, 103 bp, Artificial Sequence
  Synthetic Polynucleotide
taatacgactcactataggggcttacctcgggccgagtgtatatctggggaacagaggagaccccagatgtacactcggaacctggcggcagcgcaaaagatg

SEQ ID NO: 38431 - DNA, 103 bp, Artificial Sequence
  Synthetic Polynucleotide
taatacgactcactatagggaccggtggccagattgcactgagggagaacaacagaggagagttctcatgcagtgcaataacctggcggcagcgcaaaagatg

SEQ ID NO: 38432 - DNA, 103 bp, Artificial Sequence
  Synthetic Polynucleotide
taatacgactcactatagggtcacatatacccaatcttattggattaccaaacagaggagatggtaaatgaataagattaacctggcggcagcgcaaaagatg

SEQ ID NO: 38433 - DNA, 103 bp, Artificial Sequence
  Synthetic Polynucleotide
taatacgactcactataggggtgccactctagataaaccaggctccctacaacagaggagagtagggatgctggtttataacctggcggcagcgcaaaagatg

SEQ ID NO: 38434 - DNA, 103 bp, Artificial Sequence
  Synthetic Polynucleotide
taatacgactcactataggggctccattctgctttcgattccagggttgaaacagaggagatcaaccatggaatcgaaaaacctggcggcagcgcaaaagatg

SEQ ID NO: 38435 - DNA, 103 bp, Artificial Sequence
  Synthetic Polynucleotide
taatacgactcactatagggtacggcatattacttcccaggcatttcgcgaacagaggagacgcgaaatgcctgggaagaacctggcggcagcgcaaaagatg

SEQ ID NO: 38436 - DNA, 103 bp, Artificial Sequence
  Synthetic Polynucleotide
taatacgactcactataggggctggatatatttacgatggacggttctcgaacagaggagacgagaaatgtccatcgtaaacctggcggcagcgcaaaagatg

SEQ ID NO: 38437 - DNA, 103 bp, Artificial Sequence
  Synthetic Polynucleotide
taatacgactcactataggggggacataacgtaactctagtggcaacgctaacagaggagaagcgttatgactagagttaacctggcggcagcgcaaaagatg

SEQ ID NO: 38438 - DNA, 103 bp, Artificial Sequence
  Synthetic Polynucleotide
taatacgactcactatagggcgattcaggtaagccgagctttttcgttccaacagaggagaggaacgatgaagctcggcaacctggcggcagcgcaaaagatg

SEQ ID NO: 38439 - DNA, 103 bp, Artificial Sequence
  Synthetic Polynucleotide
taatacgactcactatagggcttagcgcggtacccggtagctcgtgaaggaacagaggagaccttcaatggctaccgggaacctggcggcagcgcaaaagatg

SEQ ID NO: 38440 - DNA, 103 bp, Artificial Sequence
  Synthetic Polynucleotide
taatacgactcactatagggaactcgtgttagtaagctaggtcaagaccaaacagaggagatggtctatgcctagcttaaacctggcggcagcgcaaaagatg

SEQ ID NO: 38441 - DNA, 103 bp, Artificial Sequence
  Synthetic Polynucleotide
taatacgactcactatagggtacattggctcctctgagttgtcactactgaacagaggagacagtagatgcaactcagaaacctggcggcagcgcaaaagatg

SEQ ID NO: 38442 - DNA, 103 bp, Artificial Sequence
  Synthetic Polynucleotide
taatacgactcactatagggcatactctcgcaagtacagcgttccggcgaaacagaggagatcgccgatgcgctgtactaacctggcggcagcgcaaaagatg

SEQ ID NO: 38443 - DNA, 103 bp, Artificial Sequence
  Synthetic Polynucleotide
taatacgactcactatagggctaatcgtaagtgttgtactgtcgctggctaacagaggagaagccagatgcagtacaacaacctggcggcagcgcaaaagatg

SEQ ID NO: 38444 - DNA, 103 bp, Artificial Sequence
  Synthetic Polynucleotide
taatacgactcactatagggactattctacttgcggagatatcggtccttaacagaggagaaaggacatgtatctccgcaacctggcggcagcgcaaaagatg

SEQ ID NO: 38445 - DNA, 103 bp, Artificial Sequence
  Synthetic Polynucleotide
taatacgactcactatagggcctcataacggaaagattggaaagaaatagaacagaggagactatttatgtccaatcttaacctggcggcagcgcaaaagatg

SEQ ID NO: 38446 - DNA, 103 bp, Artificial Sequence
  Synthetic Polynucleotide
taatacgactcactatagggcagggagggtagcgactcagtcagtgtattaacagaggagaaatacaatgactgagtcgaacctggcggcagcgcaaaagatg

SEQ ID NO: 38447 - DNA, 103 bp, Artificial Sequence
  Synthetic Polynucleotide
taatacgactcactatagggcgtatacctgggtctgatattcgatatgcaaacagaggagatgcataatgaatatcagaaacctggcggcagcgcaaaagatg

SEQ ID NO: 38448 - DNA, 103 bp, Artificial Sequence
  Synthetic Polynucleotide
taatacgactcactatagggttgcctaagccacgggatagctctaggcggaacagaggagaccgcctatggctatcccgaacctggcggcagcgcaaaagatg

SEQ ID NO: 38449 - DNA, 103 bp, Artificial Sequence
  Synthetic Polynucleotide
taatacgactcactatagggttccttcctaatttagagagatttactaggaacagaggagacctagtatgtctctctaaaacctggcggcagcgcaaaagatg

SEQ ID NO: 38450 - DNA, 103 bp, Artificial Sequence
  Synthetic Polynucleotide
taatacgactcactataggggagtcgttaaattgctgacatcaaagagccaacagaggagaggctctatgatgtcagcaaacctggcggcagcgcaaaagatg

SEQ ID NO: 38451 - DNA, 103 bp, Artificial Sequence
  Synthetic Polynucleotide
taatacgactcactatagggaatacttaaaaggccataacgcggctcggtaacagaggagaaccgagatgcgttatggcaacctggcggcagcgcaaaagatg

SEQ ID NO: 38452 - DNA, 103 bp, Artificial Sequence
  Synthetic Polynucleotide
taatacgactcactataggggaggtggaatttccttctctgaccccaattaacagaggagaaattggatgcagagaaggaacctggcggcagcgcaaaagatg

SEQ ID NO: 38453 - DNA, 103 bp, Artificial Sequence
  Synthetic Polynucleotide
taatacgactcactataggggtttgcattctccggtcaagagatttgtacaacagaggagagtacaaatgtcttgaccgaacctggcggcagcgcaaaagatg

SEQ ID NO: 38454 - DNA, 103 bp, Artificial Sequence
  Synthetic Polynucleotide
taatacgactcactatagggcacttgctggcgcgcttcaggcctggtgataacagaggagaatcaccatgcctgaagcgaacctggcggcagcgcaaaagatg

SEQ ID NO: 38455 - DNA, 103 bp, Artificial Sequence
  Synthetic Polynucleotide
taatacgactcactatagggcaatctgccgatgagggacgtaaagtttaaaacagaggagattaaacatgacgtccctcaacctggcggcagcgcaaaagatg

SEQ ID NO: 38456 - DNA, 103 bp, Artificial Sequence
  Synthetic Polynucleotide
taatacgactcactataggggtagcctgtggtgtagactatgcactcagtaacagaggagaactgagatgatagtctacaacctggcggcagcgcaaaagatg

SEQ ID NO: 38457 - DNA, 103 bp, Artificial Sequence
  Synthetic Polynucleotide
taatacgactcactatagggagcagttccagcgcggcggatctttcgtccaacagaggagaggacgaatgatccgccgcaacctggcggcagcgcaaaagatg

SEQ ID NO: 38458 - DNA, 103 bp, Artificial Sequence
  Synthetic Polynucleotide
taatacgactcactatagggattcatggggatgagtgacccggcaaactgaacagaggagacagtttatggggtcactcaacctggcggcagcgcaaaagatg

SEQ ID NO: 38459 - DNA, 103 bp, Artificial Sequence
  Synthetic Polynucleotide
taatacgactcactatagggggagctattcacagagacagcaaaagaagaaacagaggagatcttctatggctgtctctaacctggcggcagcgcaaaagatg

SEQ ID NO: 38460 - DNA, 103 bp, Artificial Sequence
  Synthetic Polynucleotide
taatacgactcactatagggttggggttagactggctaattagttatccaaacagaggagatggataatgaattagccaaacctggcggcagcgcaaaagatg

SEQ ID NO: 38461 - DNA, 103 bp, Artificial Sequence
  Synthetic Polynucleotide
taatacgactcactatagggctccgtgctacgacattcactaaagatggtaacagaggagaaccatcatgagtgaatgtaacctggcggcagcgcaaaagatg

SEQ ID NO: 38462 - DNA, 103 bp, Artificial Sequence
  Synthetic Polynucleotide
taatacgactcactatagggatgaaacctatagtttaaagctgttttcacaacagaggagagtgaaaatggctttaaacaacctggcggcagcgcaaaagatg

SEQ ID NO: 38463 - DNA, 103 bp, Artificial Sequence
  Synthetic Polynucleotide
taatacgactcactatagggagaattccggacatcacatgctcgccccgcaacagaggagagcggggatggcatgtgataacctggcggcagcgcaaaagatg

SEQ ID NO: 38464 - DNA, 103 bp, Artificial Sequence
  Synthetic Polynucleotide
taatacgactcactataggggtggacccatcactcgcgacgggctcgtttaacagaggagaaaacgaatgcgtcgcgagaacctggcggcagcgcaaaagatg

SEQ ID NO: 38465 - DNA, 103 bp, Artificial Sequence
  Synthetic Polynucleotide
taatacgactcactatagggaaaacaaacgtaaaataagtcaagctcgcaaacagaggagatgcgagatggacttatttaacctggcggcagcgcaaaagatg

SEQ ID NO: 38466 - DNA, 103 bp, Artificial Sequence
  Synthetic Polynucleotide
taatacgactcactatagggatcacgacgagatactacttacagtgcattaacagaggagaaatgcaatgtaagtagtaaacctggcggcagcgcaaaagatg

SEQ ID NO: 38467 - DNA, 103 bp, Artificial Sequence
  Synthetic Polynucleotide
taatacgactcactatagggcctttcctacctagtacagaggcagttccgaacagaggagacggaacatgctctgtactaacctggcggcagcgcaaaagatg

SEQ ID NO: 38468 - DNA, 103 bp, Artificial Sequence
  Synthetic Polynucleotide
taatacgactcactatagggtattgggttcgtagcaggagtgtctattcgaacagaggagacgaataatgactcctgctaacctggcggcagcgcaaaagatg

SEQ ID NO: 38469 - DNA, 103 bp, Artificial Sequence
  Synthetic Polynucleotide
taatacgactcactatagggtgtcagccagacaaaagtgcatagagtcagaacagaggagactgactatgtgcacttttaacctggcggcagcgcaaaagatg

SEQ ID NO: 38470 - DNA, 103 bp, Artificial Sequence
  Synthetic Polynucleotide
taatacgactcactatagggttcacgcccgttaagattcggcgcccgaccaacagaggagaggtcggatgccgaatcttaacctggcggcagcgcaaaagatg

SEQ ID NO: 38471 - DNA, 103 bp, Artificial Sequence
  Synthetic Polynucleotide
taatacgactcactataggggactgtcccgtcgtcatatcacaagccgccaacagaggagaggcggcatgtgatatgacaacctggcggcagcgcaaaagatg

SEQ ID NO: 38472 - DNA, 103 bp, Artificial Sequence
  Synthetic Polynucleotide
taatacgactcactataggggtcacttatacggcaaggaaacccgtttctaacagaggagaagaaacatgtttccttgcaacctggcggcagcgcaaaagatg

SEQ ID NO: 38473 - DNA, 103 bp, Artificial Sequence
  Synthetic Polynucleotide
taatacgactcactatagggacagctatattggatggccttcgagccccaaacagaggagatggggcatgaaggccatcaacctggcggcagcgcaaaagatg

SEQ ID NO: 38474 - DNA, 103 bp, Artificial Sequence
  Synthetic Polynucleotide
taatacgactcactatagggagatctccatttgcagtgatcgagtacacaaacagaggagatgtgtaatggatcactgcaacctggcggcagcgcaaaagatg

SEQ ID NO: 38475 - DNA, 103 bp, Artificial Sequence
  Synthetic Polynucleotide
taatacgactcactatagggaagttttcacatcgcctgctatgatgtgttaacagaggagaaacacaatgtagcaggcgaacctggcggcagcgcaaaagatg

SEQ ID NO: 38476 - DNA, 103 bp, Artificial Sequence
  Synthetic Polynucleotide
taatacgactcactatagggcttagctgtacgctgaacggatgtagttataacagaggagaataactatgtccgttcagaacctggcggcagcgcaaaagatg

SEQ ID NO: 38477 - DNA, 103 bp, Artificial Sequence
  Synthetic Polynucleotide
taatacgactcactatagggaaggcggtcctcagtacgacttcctatacgaacagaggagacgtataatgagtcgtactaacctggcggcagcgcaaaagatg

SEQ ID NO: 38478 - DNA, 103 bp, Artificial Sequence
  Synthetic Polynucleotide
taatacgactcactatagggttaaagtacatcagcagtacgtgaaagagaaacagaggagatctcttatgcgtactgctaacctggcggcagcgcaaaagatg

SEQ ID NO: 38479 - DNA, 103 bp, Artificial Sequence
  Synthetic Polynucleotide
taatacgactcactatagggtccggcgggggaagagccatctgttctcaaaacagaggagattgagaatggatggctctaacctggcggcagcgcaaaagatg

SEQ ID NO: 38480 - DNA, 103 bp, Artificial Sequence
  Synthetic Polynucleotide
taatacgactcactatagggatttagatgtccggcgactgagaatggagaaacagaggagatctccaatgtcagtcgccaacctggcggcagcgcaaaagatg

SEQ ID NO: 38481 - DNA, 103 bp, Artificial Sequence
  Synthetic Polynucleotide
taatacgactcactataggggtaggaaggaaggcccgttaaagtggatccaacagaggagaggatccatgttaacgggcaacctggcggcagcgcaaaagatg

SEQ ID NO: 38482 - DNA, 103 bp, Artificial Sequence
  Synthetic Polynucleotide
taatacgactcactataggggcaccgttgcagggacgtgtccatttagcgaacagaggagacgctaaatggacacgtccaacctggcggcagcgcaaaagatg

SEQ ID NO: 38483 - DNA, 103 bp, Artificial Sequence
  Synthetic Polynucleotide
taatacgactcactatagggaccccagagccgacccacaagcgatactgaaacagaggagatcagtaatgcttgtgggtaacctggcggcagcgcaaaagatg

SEQ ID NO: 38484 - DNA, 103 bp, Artificial Sequence
  Synthetic Polynucleotide
taatacgactcactataggggcagccccaacgactttcataagatttcataacagaggagaatgaaaatgtatgaaagtaacctggcggcagcgcaaaagatg

SEQ ID NO: 38485 - DNA, 103 bp, Artificial Sequence
  Synthetic Polynucleotide
taatacgactcactatagggattgctatctatgacatacttaacgcacttaacagaggagaaagtgcatgaagtatgtcaacctggcggcagcgcaaaagatg

SEQ ID NO: 38486 - DNA, 103 bp, Artificial Sequence
  Synthetic Polynucleotide
taatacgactcactatagggtaatagtcgaggcgcgttgatcgctctgcgaacagaggagacgcagaatgatcaacgcgaacctggcggcagcgcaaaagatg

SEQ ID NO: 38487 - DNA, 103 bp, Artificial Sequence
  Synthetic Polynucleotide
taatacgactcactataggggggaggagtgagacatttgagaggtttaaaaacagaggagatttaaaatgctcaaatgtaacctggcggcagcgcaaaagatg

SEQ ID NO: 38488 - DNA, 103 bp, Artificial Sequence
  Synthetic Polynucleotide
taatacgactcactataggggattcaggacgacggaccgtaggagaagtgaacagaggagacacttcatgtacggtccgaacctggcggcagcgcaaaagatg

SEQ ID NO: 38489 - DNA, 103 bp, Artificial Sequence
  Synthetic Polynucleotide
taatacgactcactataggggatgttgacttatgccattcaacgacacgaaacagaggagatcgtgtatgtgaatggcaaacctggcggcagcgcaaaagatg

SEQ ID NO: 38490 - DNA, 103 bp, Artificial Sequence
  Synthetic Polynucleotide
taatacgactcactataggggaacgatcactacgccgtcctccagcttacaacagaggagagtaagcatgaggacggcgaacctggcggcagcgcaaaagatg

SEQ ID NO: 38491 - DNA, 103 bp, Artificial Sequence
  Synthetic Polynucleotide
taatacgactcactataggggtcgcgtaggactaagtcctctgccccctgaacagaggagacaggggatggaggacttaaacctggcggcagcgcaaaagatg

SEQ ID NO: 38492 - DNA, 103 bp, Artificial Sequence
  Synthetic Polynucleotide
taatacgactcactatagggaatcaagagctgcttacaactgcctatttcaacagaggagagaaataatgagttgtaagaacctggcggcagcgcaaaagatg

SEQ ID NO: 38493 - DNA, 103 bp, Artificial Sequence
  Synthetic Polynucleotide
taatacgactcactatagggtctttaatgagattcggctgcggccaggcaaacagaggagatgcctgatggcagccgaaaacctggcggcagcgcaaaagatg

SEQ ID NO: 38494 - DNA, 103 bp, Artificial Sequence
  Synthetic Polynucleotide
taatacgactcactatagggaatcctgctggggacttccgcacacgaatgaacagaggagacattcgatggcggaagtcaacctggcggcagcgcaaaagatg

SEQ ID NO: 38495 - DNA, 103 bp, Artificial Sequence
  Synthetic Polynucleotide
taatacgactcactatagggcggcctagagaatagtggtgggtcttccctaacagaggagaagggaaatgccaccactaaacctggcggcagcgcaaaagatg

SEQ ID NO: 38496 - DNA, 103 bp, Artificial Sequence
  Synthetic Polynucleotide
taatacgactcactatagggccttttgcccgtacacccacgatggaggccaacagaggagaggcctcatgcgtgggtgtaacctggcggcagcgcaaaagatg

SEQ ID NO: 38497 - DNA, 103 bp, Artificial Sequence
  Synthetic Polynucleotide
taatacgactcactataggggtgtcccgttctgatggtaacatatccaataacagaggagaattggaatggttaccatcaacctggcggcagcgcaaaagatg

SEQ ID NO: 38498 - DNA, 103 bp, Artificial Sequence
  Synthetic Polynucleotide
taatacgactcactatagggcatgtggtatgacccgaaatcagttccgtaaacagaggagatacggaatggatttcgggaacctggcggcagcgcaaaagatg

SEQ ID NO: 38499 - DNA, 103 bp, Artificial Sequence
  Synthetic Polynucleotide
taatacgactcactatagggcattagacgccacagactccgccgcgattcaacagaggagagaatcgatgcggagtctgaacctggcggcagcgcaaaagatg

SEQ ID NO: 38500 - DNA, 103 bp, Artificial Sequence
  Synthetic Polynucleotide
taatacgactcactatagggtctcaaagtggacactttgcggtcgctactaacagaggagaagtagcatgcgcaaagtgaacctggcggcagcgcaaaagatg

SEQ ID NO: 38501 - DNA, 103 bp, Artificial Sequence
  Synthetic Polynucleotide
taatacgactcactatagggtccatttttggattgaggccgcggatagaaaacagaggagattctatatgcggcctcaaaacctggcggcagcgcaaaagatg

SEQ ID NO: 38502 - DNA, 103 bp, Artificial Sequence
  Synthetic Polynucleotide
taatacgactcactatagggtggacagaggggatgaattccgcttaagtaaacagaggagatacttaatgggaattcataacctggcggcagcgcaaaagatg

SEQ ID NO: 38503 - DNA, 103 bp, Artificial Sequence
  Synthetic Polynucleotide
taatacgactcactataggggccctgtccccgcgaatcaatggtaccggaaacagaggagatccggtatgattgattcgaacctggcggcagcgcaaaagatg

SEQ ID NO: 38504 - DNA, 103 bp, Artificial Sequence
  Synthetic Polynucleotide
taatacgactcactatagggaggcgggagctacttagcgttagtcacaggaacagaggagacctgtgatgaacgctaagaacctggcggcagcgcaaaagatg

SEQ ID NO: 38505 - DNA, 103 bp, Artificial Sequence
  Synthetic Polynucleotide
taatacgactcactatagggctcctctcacatcacggaaggggctagtgtaacagaggagaacactaatgccttccgtgaacctggcggcagcgcaaaagatg

SEQ ID NO: 38506 - DNA, 103 bp, Artificial Sequence
  Synthetic Polynucleotide
taatacgactcactataggggagctcgcccgatcgcttactcttaataacaacagaggagagttattatgagtaagcgaaacctggcggcagcgcaaaagatg

SEQ ID NO: 38507 - DNA, 103 bp, Artificial Sequence
  Synthetic Polynucleotide
taatacgactcactatagggcggccacgatagaccgcattatgtatcgtcaacagaggagagacgatatgtaatgcggtaacctggcggcagcgcaaaagatg

SEQ ID NO: 38508 - DNA, 103 bp, Artificial Sequence
  Synthetic Polynucleotide
taatacgactcactatagggggtgctacagggcaccatcgctctgaaaaaaacagaggagatttttcatggcgatggtgaacctggcggcagcgcaaaagatg

SEQ ID NO: 38509 - DNA, 103 bp, Artificial Sequence
  Synthetic Polynucleotide
taatacgactcactataggggtgagggtaatgacagctactgtcgatactaacagaggagaagtatcatgagtagctgtaacctggcggcagcgcaaaagatg

SEQ ID NO: 38510 - DNA, 103 bp, Artificial Sequence
  Synthetic Polynucleotide
taatacgactcactatagggggtctgctgtccaacaaggcaagtaaacggaacagaggagaccgtttatgtgccttgttaacctggcggcagcgcaaaagatg

SEQ ID NO: 38511 - DNA, 103 bp, Artificial Sequence
  Synthetic Polynucleotide
taatacgactcactataggggttcttgcacagaacgagacagccttgcccaacagaggagagggcaaatgtgtctcgttaacctggcggcagcgcaaaagatg

SEQ ID NO: 38512 - DNA, 103 bp, Artificial Sequence
  Synthetic Polynucleotide
taatacgactcactatagggaattggtcggtggcggtgacaatcacttataacagaggagaataagtatgtgtcaccgcaacctggcggcagcgcaaaagatg

SEQ ID NO: 38513 - DNA, 103 bp, Artificial Sequence
  Synthetic Polynucleotide
taatacgactcactatagggccgtcaccacttagcataaacttacgtggtaacagaggagaaccacgatggtttatgctaacctggcggcagcgcaaaagatg

SEQ ID NO: 38514 - DNA, 103 bp, Artificial Sequence
  Synthetic Polynucleotide
taatacgactcactataggggaacgtaggatccctcacaggggctacgccaacagaggagaggcgtaatgcctgtgaggaacctggcggcagcgcaaaagatg

SEQ ID NO: 38515 - DNA, 103 bp, Artificial Sequence
  Synthetic Polynucleotide
taatacgactcactatagggacatgaactaggccctgtcccacgcgtgagaacagaggagactcacgatggggacagggaacctggcggcagcgcaaaagatg

SEQ ID NO: 38516 - DNA, 103 bp, Artificial Sequence
  Synthetic Polynucleotide
taatacgactcactataggggaggtacaaagctcggtgagtgcgctcctcaacagaggagagaggagatgactcaccgaaacctggcggcagcgcaaaagatg

SEQ ID NO: 38517 - DNA, 103 bp, Artificial Sequence
  Synthetic Polynucleotide
taatacgactcactatagggccatgctcccacggcttcctgtttaaaaggaacagaggagaccttttatgcaggaagccaacctggcggcagcgcaaaagatg

SEQ ID NO: 38518 - DNA, 103 bp, Artificial Sequence
  Synthetic Polynucleotide
taatacgactcactatagggcaaaatgcgacctgatttttcatttcgctgaacagaggagacagcgaatggaaaaatcaaacctggcggcagcgcaaaagatg

SEQ ID NO: 38519 - DNA, 103 bp, Artificial Sequence
  Synthetic Polynucleotide
taatacgactcactatagggagctgtcgcgaggtttatcttagggccgcgaacagaggagacgcggcatgaagataaacaacctggcggcagcgcaaaagatg

SEQ ID NO: 38520 - DNA, 103 bp, Artificial Sequence
  Synthetic Polynucleotide
taatacgactcactatagggaatgcgtgactctaccaccatacttcttggaacagaggagaccaagaatgatggtggtaaacctggcggcagcgcaaaagatg

SEQ ID NO: 38521 - DNA, 103 bp, Artificial Sequence
  Synthetic Polynucleotide
taatacgactcactatagggcaggactctacacggtatctcaccccgctcaacagaggagagagcggatggagataccgaacctggcggcagcgcaaaagatg

SEQ ID NO: 38522 - DNA, 103 bp, Artificial Sequence
  Synthetic Polynucleotide
taatacgactcactatagggatgcgcgtcctcgcccaggacttcgcgcgtaacagaggagaacgcgcatggtcctgggcaacctggcggcagcgcaaaagatg

SEQ ID NO: 38523 - DNA, 103 bp, Artificial Sequence
  Synthetic Polynucleotide
taatacgactcactatagggttctccatcgccccatacagcgtctttgttaacagaggagaaacaaaatggctgtatggaacctggcggcagcgcaaaagatg

SEQ ID NO: 38524 - DNA, 103 bp, Artificial Sequence
  Synthetic Polynucleotide
taatacgactcactataggggctggccgaacggagtgtagatggtctcctaacagaggagaaggagaatgtctacactcaacctggcggcagcgcaaaagatg

SEQ ID NO: 38525 - DNA, 103 bp, Artificial Sequence
  Synthetic Polynucleotide
taatacgactcactatagggctggctgctcccgcgcaccgaacccccggaaacagaggagatccgggatgtcggtgcgcaacctggcggcagcgcaaaagatg

SEQ ID NO: 38526 - DNA, 103 bp, Artificial Sequence
  Synthetic Polynucleotide
taatacgactcactatagggctcgaacgagagaggatcggacctcgagtaaacagaggagatactcgatgtccgatcctaacctggcggcagcgcaaaagatg

SEQ ID NO: 38527 - DNA, 103 bp, Artificial Sequence
  Synthetic Polynucleotide
taatacgactcactataggggtgacgttaacaacacttctagccggcgccaacagaggagaggcgccatgtagaagtgtaacctggcggcagcgcaaaagatg

SEQ ID NO: 38528 - DNA, 103 bp, Artificial Sequence
  Synthetic Polynucleotide
taatacgactcactataggggtgaccatacccgcccggggacctgggtgcaacagaggagagcacccatgtccccgggcaacctggcggcagcgcaaaagatg

SEQ ID NO: 38529 - DNA, 103 bp, Artificial Sequence
  Synthetic Polynucleotide
taatacgactcactatagggtgcaacggcaaattcacacaaggaaatcataacagaggagaatgattatgttgtgtgaaaacctggcggcagcgcaaaagatg

SEQ ID NO: 38530 - DNA, 103 bp, Artificial Sequence
  Synthetic Polynucleotide
taatacgactcactatagggtgtatacagattaactgctttgggaagccgaacagaggagacggcttatgaaagcagttaacctggcggcagcgcaaaagatg

SEQ ID NO: 38531 - DNA, 103 bp, Artificial Sequence
  Synthetic Polynucleotide
taatacgactcactatagggtctcgaaatagtatgccctaggatatggataacagaggagaatccatatgctagggcataacctggcggcagcgcaaaagatg

SEQ ID NO: 38532 - DNA, 103 bp, Artificial Sequence
  Synthetic Polynucleotide
taatacgactcactatagggttacagcaagaatgtgcactactcacgacaaacagaggagatgtcgtatgtagtgcacaaacctggcggcagcgcaaaagatg

SEQ ID NO: 38533 - DNA, 103 bp, Artificial Sequence
  Synthetic Polynucleotide
taatacgactcactatagggcggggcgtaatccaacattgcagaggactaaacagaggagatagtccatggcaatgttgaacctggcggcagcgcaaaagatg

SEQ ID NO: 38534 - DNA, 103 bp, Artificial Sequence
  Synthetic Polynucleotide
taatacgactcactatagggtcatccgttggagtttgaggtactcatcgcaacagaggagagcgatgatgacctcaaacaacctggcggcagcgcaaaagatg

SEQ ID NO: 38535 - DNA, 103 bp, Artificial Sequence
  Synthetic Polynucleotide
taatacgactcactataggggacgtatctctgacaattctctcatgttctaacagaggagaagaacaatggagaattgtaacctggcggcagcgcaaaagatg

SEQ ID NO: 38536 - DNA, 103 bp, Artificial Sequence
  Synthetic Polynucleotide
taatacgactcactatagggagtcacatcatgatttagtgttgactctagaacagaggagactagagatgacactaaataacctggcggcagcgcaaaagatg

SEQ ID NO: 38537 - DNA, 103 bp, Artificial Sequence
  Synthetic Polynucleotide
taatacgactcactatagggtatcgacaggttcgcgctaaggggaccccaaacagaggagatggggtatgcttagcgcgaacctggcggcagcgcaaaagatg

SEQ ID NO: 38538 - DNA, 103 bp, Artificial Sequence
  Synthetic Polynucleotide
taatacgactcactataggggagtgtctgtggcgcgccatgattcacctaaacagaggagataggtgatgcatggcgcgaacctggcggcagcgcaaaagatg

SEQ ID NO: 38539 - DNA, 103 bp, Artificial Sequence
  Synthetic Polynucleotide
taatacgactcactataggggcgaaggtcagacaagcaagcagtactcgtaacagaggagaacgagtatggcttgcttgaacctggcggcagcgcaaaagatg

SEQ ID NO: 38540 - DNA, 103 bp, Artificial Sequence
  Synthetic Polynucleotide
taatacgactcactataggggctcctgcctagttagtaatgtcataaggcaacagaggagagccttaatgcattactaaaacctggcggcagcgcaaaagatg

SEQ ID NO: 38541 - DNA, 103 bp, Artificial Sequence
  Synthetic Polynucleotide
taatacgactcactatagggcgacaagtagggtgagggttgacgagaccgaacagaggagacggtctatgcaaccctcaaacctggcggcagcgcaaaagatg

SEQ ID NO: 38542 - DNA, 103 bp, Artificial Sequence
  Synthetic Polynucleotide
taatacgactcactatagggcgtgaagcacatagctctatagcgacctgcaacagaggagagcaggtatgtatagagctaacctggcggcagcgcaaaagatg

SEQ ID NO: 38543 - DNA, 103 bp, Artificial Sequence
  Synthetic Polynucleotide
taatacgactcactatagggaatgtaccgacgatgagagctcgaattaaaaacagaggagatttaatatgagctctcataacctggcggcagcgcaaaagatg

SEQ ID NO: 38544 - DNA, 103 bp, Artificial Sequence
  Synthetic Polynucleotide
taatacgactcactatagggacgctggccagtttatacatttatttgatgaacagaggagacatcaaatgaatgtataaaacctggcggcagcgcaaaagatg

SEQ ID NO: 38545 - DNA, 103 bp, Artificial Sequence
  Synthetic Polynucleotide
taatacgactcactataggggtggatagtataagttgcgctgtcgtctagaacagaggagactagacatgagcgcaactaacctggcggcagcgcaaaagatg

SEQ ID NO: 38546 - DNA, 103 bp, Artificial Sequence
  Synthetic Polynucleotide
taatacgactcactataggggccgctcgtaacgacgctatgcccttctacaacagaggagagtagaaatgcatagcgtcaacctggcggcagcgcaaaagatg

SEQ ID NO: 38547 - DNA, 103 bp, Artificial Sequence
  Synthetic Polynucleotide
taatacgactcactatagggcccgcgcgtccaggacaccaacgtttctataacagaggagaatagaaatgttggtgtccaacctggcggcagcgcaaaagatg

SEQ ID NO: 38548 - DNA, 103 bp, Artificial Sequence
  Synthetic Polynucleotide
taatacgactcactatagggcgtctggccacaattccggaccgtttgaaaaacagaggagatttcaaatggtccggaataacctggcggcagcgcaaaagatg

SEQ ID NO: 38549 - DNA, 103 bp, Artificial Sequence
  Synthetic Polynucleotide
taatacgactcactataggggagaagacggaatcagctatattagaacaaaacagaggagattgttcatgtatagctgaaacctggcggcagcgcaaaagatg

SEQ ID NO: 38550 - DNA, 103 bp, Artificial Sequence
  Synthetic Polynucleotide
taatacgactcactatagggctggaggtccagacaacccacggccccgccaacagaggagaggcgggatggtgggttgtaacctggcggcagcgcaaaagatg

SEQ ID NO: 38551 - DNA, 103 bp, Artificial Sequence
  Synthetic Polynucleotide
taatacgactcactataggggcgattatcaccacccgtcggtgcattagaaacagaggagatctaatatgccgacgggtaacctggcggcagcgcaaaagatg

SEQ ID NO: 38552 - DNA, 103 bp, Artificial Sequence
  Synthetic Polynucleotide
taatacgactcactataggggcatcgttgtggacgggtataatgcccctaaacagaggagataggggatgtatacccgtaacctggcggcagcgcaaaagatg

SEQ ID NO: 38553 - DNA, 103 bp, Artificial Sequence
  Synthetic Polynucleotide
taatacgactcactatagggatctgggccgctggcaactccccccacctaaacagaggagataggtgatgggagttgccaacctggcggcagcgcaaaagatg

SEQ ID NO: 38554 - DNA, 103 bp, Artificial Sequence
  Synthetic Polynucleotide
taatacgactcactatagggaacactactcctggtgggaatcgatatggcaacagaggagagccataatgattcccaccaacctggcggcagcgcaaaagatg

SEQ ID NO: 38555 - DNA, 103 bp, Artificial Sequence
  Synthetic Polynucleotide
taatacgactcactatagggcacgttactaaaatctaacgcaatgtcaaaaacagaggagatttgacatggcgttagataacctggcggcagcgcaaaagatg

SEQ ID NO: 38556 - DNA, 103 bp, Artificial Sequence
  Synthetic Polynucleotide
taatacgactcactatagggggctatgacgttcgacccggggtgcgtgagaacagaggagactcacgatgcccgggtcgaacctggcggcagcgcaaaagatg

SEQ ID NO: 38557 - DNA, 103 bp, Artificial Sequence
  Synthetic Polynucleotide
taatacgactcactatagggttttcctagcgaagcagatgcttgtcaagaaacagaggagatcttgaatggcatctgctaacctggcggcagcgcaaaagatg

SEQ ID NO: 38558 - DNA, 103 bp, Artificial Sequence
  Synthetic Polynucleotide
taatacgactcactatagggggcggctctgcatcggacgtcagttcctacaacagaggagagtaggaatggacgtccgaaacctggcggcagcgcaaaagatg

SEQ ID NO: 38559 - DNA, 103 bp, Artificial Sequence
  Synthetic Polynucleotide
taatacgactcactataggggggagccccccaaatggtcaccaggatataaacagaggagatatatcatggtgaccattaacctggcggcagcgcaaaagatg

SEQ ID NO: 38560 - DNA, 103 bp, Artificial Sequence
  Synthetic Polynucleotide
taatacgactcactatagggcgtgcttacagcggagatgccggaaacgcgaacagaggagacgcgttatgggcatctccaacctggcggcagcgcaaaagatg

SEQ ID NO: 38561 - DNA, 103 bp, Artificial Sequence
  Synthetic Polynucleotide
taatacgactcactatagggtgctacctgcagcaacgaaccgcataagacaacagaggagagtcttaatgggttcgttgaacctggcggcagcgcaaaagatg

SEQ ID NO: 38562 - DNA, 103 bp, Artificial Sequence
  Synthetic Polynucleotide
taatacgactcactatagggacgcaacttaagtgagactgggcgcaagggaacagaggagacccttgatgccagtctcaaacctggcggcagcgcaaaagatg

SEQ ID NO: 38563 - DNA, 103 bp, Artificial Sequence
  Synthetic Polynucleotide
taatacgactcactatagggaattgctcggccaggtctgtttgccaccagaacagaggagactggtgatgaacagacctaacctggcggcagcgcaaaagatg

SEQ ID NO: 38564 - DNA, 103 bp, Artificial Sequence
  Synthetic Polynucleotide
taatacgactcactatagggggcggtaataggtacatgccggagctgtaaaacagaggagattacagatgcggcatgtaaacctggcggcagcgcaaaagatg

SEQ ID NO: 38565 - DNA, 103 bp, Artificial Sequence
  Synthetic Polynucleotide
taatacgactcactatagggactcaaaaggcgacatgattgcgtcagccaaacagaggagatggctgatgcaatcatgtaacctggcggcagcgcaaaagatg

SEQ ID NO: 38566 - DNA, 103 bp, Artificial Sequence
  Synthetic Polynucleotide
taatacgactcactatagggctatcttttattattttgagcatatctagcaacagaggagagctagaatggctcaaaataacctggcggcagcgcaaaagatg

SEQ ID NO: 38567 - DNA, 103 bp, Artificial Sequence
  Synthetic Polynucleotide
taatacgactcactatagggggtgcaaggctgtagaccgactgcggcgcgaacagaggagacgcgccatggtcggtctaaacctggcggcagcgcaaaagatg

SEQ ID NO: 38568 - DNA, 103 bp, Artificial Sequence
  Synthetic Polynucleotide
taatacgactcactataggggcacgtgcggattcgttacgtacttgtcagaacagaggagactgacaatgacgtaacgaaacctggcggcagcgcaaaagatg

SEQ ID NO: 38569 - DNA, 103 bp, Artificial Sequence
  Synthetic Polynucleotide
taatacgactcactatagggagagagctgaagccgacatgctatctgcaaaacagaggagattgcagatggcatgtcggaacctggcggcagcgcaaaagatg

SEQ ID NO: 38570 - DNA, 103 bp, Artificial Sequence
  Synthetic Polynucleotide
taatacgactcactataggggaaattgagtggcttcagatcgtagtcgtaaacagaggagatacgacatggatctgaagaacctggcggcagcgcaaaagatg

SEQ ID NO: 38571 - DNA, 103 bp, Artificial Sequence
  Synthetic Polynucleotide
taatacgactcactataggggaacaaaccagcgattctacgtaatagggcaacagaggagagccctaatgcgtagaatcaacctggcggcagcgcaaaagatg

SEQ ID NO: 38572 - DNA, 103 bp, Artificial Sequence
  Synthetic Polynucleotide
taatacgactcactataggggacgatgagcgaagatagctgagtctctcaaacagaggagatgagagatgcagctatctaacctggcggcagcgcaaaagatg

SEQ ID NO: 38573 - DNA, 103 bp, Artificial Sequence
  Synthetic Polynucleotide
taatacgactcactatagggaccctctgagtacaagtccaggttgctcggaacagaggagaccgagcatgctggacttgaacctggcggcagcgcaaaagatg

SEQ ID NO: 38574 - DNA, 103 bp, Artificial Sequence
  Synthetic Polynucleotide
taatacgactcactatagggtgatttacttaaacagctccaactggtagtaacagaggagaactaccatgtggagctgtaacctggcggcagcgcaaaagatg

SEQ ID NO: 38575 - DNA, 103 bp, Artificial Sequence
  Synthetic Polynucleotide
taatacgactcactatagggtcagtatccctcttaggttataatttcgacaacagaggagagtcgaaatgataacctaaaacctggcggcagcgcaaaagatg

SEQ ID NO: 38576 - DNA, 103 bp, Artificial Sequence
  Synthetic Polynucleotide
taatacgactcactatagggctcaaaggcgcaaggtatccaaggcttcctaacagaggagaaggaagatgtggatacctaacctggcggcagcgcaaaagatg

SEQ ID NO: 38577 - DNA, 103 bp, Artificial Sequence
  Synthetic Polynucleotide
taatacgactcactatagggccaggatttacgtacgaaatctgccctattaacagaggagaaataggatggatttcgtaaacctggcggcagcgcaaaagatg

SEQ ID NO: 38578 - DNA, 103 bp, Artificial Sequence
  Synthetic Polynucleotide
taatacgactcactatagggtgtttttggtgacggtattagatcagcagaaacagaggagatctgctatgctaataccgaacctggcggcagcgcaaaagatg

SEQ ID NO: 38579 - DNA, 103 bp, Artificial Sequence
  Synthetic Polynucleotide
taatacgactcactatagggctgacttttagtacctcacgagtgacgcgtaacagaggagaacgcgtatgtcgtgaggtaacctggcggcagcgcaaaagatg

SEQ ID NO: 38580 - DNA, 103 bp, Artificial Sequence
  Synthetic Polynucleotide
taatacgactcactataggggttgtcagctcgcacccgattaaactttttaacagaggagaaaaaagatgaatcgggtgaacctggcggcagcgcaaaagatg

SEQ ID NO: 38581 - DNA, 103 bp, Artificial Sequence
  Synthetic Polynucleotide
taatacgactcactatagggggcgtcgtatggcgccagatctctatcctcaacagaggagagaggatatggatctggcgaacctggcggcagcgcaaaagatg

SEQ ID NO: 38582 - DNA, 103 bp, Artificial Sequence
  Synthetic Polynucleotide
taatacgactcactataggggcgtctagcggcgcgctttgtaaatacattaacagaggagaaatgtaatgacaaagcgcaacctggcggcagcgcaaaagatg

SEQ ID NO: 38583 - DNA, 103 bp, Artificial Sequence
  Synthetic Polynucleotide
taatacgactcactataggggaagctacgactttgcttttcacattctcaaacagaggagatgagaaatggaaaagcaaaacctggcggcagcgcaaaagatg

SEQ ID NO: 38584 - DNA, 103 bp, Artificial Sequence
  Synthetic Polynucleotide
taatacgactcactatagggcacgtcagtgttcttatccttttcatgaacaacagaggagagttcatatgaaggataagaacctggcggcagcgcaaaagatg

SEQ ID NO: 38585 - DNA, 103 bp, Artificial Sequence
  Synthetic Polynucleotide
taatacgactcactataggggtgaggcacgacctcagtcgaaatactgtcaacagaggagagacagtatgtcgactgagaacctggcggcagcgcaaaagatg

SEQ ID NO: 38586 - DNA, 103 bp, Artificial Sequence
  Synthetic Polynucleotide
taatacgactcactatagggtctaagaataacctcgtcagcgcgtatggtaacagaggagaaccataatggctgacgagaacctggcggcagcgcaaaagatg

SEQ ID NO: 38587 - DNA, 103 bp, Artificial Sequence
  Synthetic Polynucleotide
taatacgactcactatagggacgtcgaactcttattgcccatcacacgggaacagaggagacccgtgatgtgggcaataaacctggcggcagcgcaaaagatg

SEQ ID NO: 38588 - DNA, 103 bp, Artificial Sequence
  Synthetic Polynucleotide
taatacgactcactatagggggtgaataacctagccttttcacactcaccaacagaggagaggtgagatggaaaaggctaacctggcggcagcgcaaaagatg

SEQ ID NO: 38589 - DNA, 103 bp, Artificial Sequence
  Synthetic Polynucleotide
taatacgactcactataggggaaacctttgagcctcacgaacataaagcgaacagaggagacgctttatgttcgtgaggaacctggcggcagcgcaaaagatg

SEQ ID NO: 38590 - DNA, 103 bp, Artificial Sequence
  Synthetic Polynucleotide
taatacgactcactatagggcttcaccctgtcgacacagcgggggcagagaacagaggagactctgcatgcgctgtgtcaacctggcggcagcgcaaaagatg

SEQ ID NO: 38591 - DNA, 103 bp, Artificial Sequence
  Synthetic Polynucleotide
taatacgactcactatagggagtactttttgggatcggatcgacatcgacaacagaggagagtcgatatggatccgatcaacctggcggcagcgcaaaagatg

SEQ ID NO: 38592 - DNA, 103 bp, Artificial Sequence
  Synthetic Polynucleotide
taatacgactcactatagggcactacatgaattctcgcccgagctcgagcaacagaggagagctcgaatgcgggcgagaaacctggcggcagcgcaaaagatg

SEQ ID NO: 38593 - DNA, 103 bp, Artificial Sequence
  Synthetic Polynucleotide
taatacgactcactataggggtagtctccactggaaggaacttctcctctaacagaggagaagaggaatggttccttccaacctggcggcagcgcaaaagatg

SEQ ID NO: 38594 - DNA, 103 bp, Artificial Sequence
  Synthetic Polynucleotide
taatacgactcactatagggtcgcaccttgggatcgtacataaatcggtcaacagaggagagaccgaatgatgtacgataacctggcggcagcgcaaaagatg

SEQ ID NO: 38595 - DNA, 103 bp, Artificial Sequence
  Synthetic Polynucleotide
taatacgactcactatagggctgtgatcctgacagtgccaaggctagcgtaacagaggagaacgctaatgttggcactgaacctggcggcagcgcaaaagatg

SEQ ID NO: 38596 - DNA, 103 bp, Artificial Sequence
  Synthetic Polynucleotide
taatacgactcactataggggaagtcagctcgcgacgtcgggcacgaagcaacagaggagagcttcgatgccgacgtcgaacctggcggcagcgcaaaagatg

SEQ ID NO: 38597 - DNA, 103 bp, Artificial Sequence
  Synthetic Polynucleotide
taatacgactcactatagggcgtgcacatgtggtacgcgtctttaacggaaacagaggagatccgttatggacgcgtacaacctggcggcagcgcaaaagatg

SEQ ID NO: 38598 - DNA, 103 bp, Artificial Sequence
  Synthetic Polynucleotide
taatacgactcactataggggcatccggaccagaaatcagatcaaatagaaacagaggagatctattatgtctgatttcaacctggcggcagcgcaaaagatg

SEQ ID NO: 38599 - DNA, 103 bp, Artificial Sequence
  Synthetic Polynucleotide
taatacgactcactatagggaaaagtacagcgtcttgtcttctgtgctggaacagaggagaccagcaatgaagacaagaaacctggcggcagcgcaaaagatg

SEQ ID NO: 38600 - DNA, 103 bp, Artificial Sequence
  Synthetic Polynucleotide
taatacgactcactatagggttttaactgactattaccaatcatgtgttaaacagaggagataacacatgattggtaataacctggcggcagcgcaaaagatg

SEQ ID NO: 38601 - DNA, 103 bp, Artificial Sequence
  Synthetic Polynucleotide
taatacgactcactataggggagcaatcatggggacagtctcttcggtcaaacagaggagatgaccgatgagactgtccaacctggcggcagcgcaaaagatg

SEQ ID NO: 38602 - DNA, 103 bp, Artificial Sequence
  Synthetic Polynucleotide
taatacgactcactatagggctcgttcacgcctacgactaagtataaaagaacagaggagacttttaatgttagtcgtaaacctggcggcagcgcaaaagatg

SEQ ID NO: 38603 - DNA, 103 bp, Artificial Sequence
  Synthetic Polynucleotide
taatacgactcactatagggaagctgcggaacggcgaatagacagggcggaacagaggagaccgcccatgctattcgccaacctggcggcagcgcaaaagatg

SEQ ID NO: 38604 - DNA, 103 bp, Artificial Sequence
  Synthetic Polynucleotide
taatacgactcactatagggcatgacggataagatactggaaaactacctaacagaggagaaggtagatgtccagtatcaacctggcggcagcgcaaaagatg

SEQ ID NO: 38605 - DNA, 103 bp, Artificial Sequence
  Synthetic Polynucleotide
taatacgactcactatagggagaattccactttcaaacccggtaacctacaacagaggagagtaggtatgcgggtttgaaacctggcggcagcgcaaaagatg

SEQ ID NO: 38606 - DNA, 103 bp, Artificial Sequence
  Synthetic Polynucleotide
taatacgactcactatagggcgagtttaacgtcactgccctgacccgcggaacagaggagaccgcggatgagggcagtgaacctggcggcagcgcaaaagatg

SEQ ID NO: 38607 - DNA, 103 bp, Artificial Sequence
  Synthetic Polynucleotide
taatacgactcactatagggtgtgtcaattgtaaccagctgcgtaggatgaacagaggagacatcctatgcagctggttaacctggcggcagcgcaaaagatg

SEQ ID NO: 38608 - DNA, 103 bp, Artificial Sequence
  Synthetic Polynucleotide
taatacgactcactatagggaccccgtagtacgggtccgtggattagaagaacagaggagacttctaatgcacggacccaacctggcggcagcgcaaaagatg

SEQ ID NO: 38609 - DNA, 103 bp, Artificial Sequence
  Synthetic Polynucleotide
taatacgactcactataggggaccgctatgttgacggcggccggtattgtaacagaggagaacaataatggccgccgtcaacctggcggcagcgcaaaagatg

SEQ ID NO: 38610 - DNA, 103 bp, Artificial Sequence
  Synthetic Polynucleotide
taatacgactcactatagggcaattgggactggttttcgcgtcctagtgtaacagaggagaacactaatgcgcgaaaacaacctggcggcagcgcaaaagatg

SEQ ID NO: 38611 - DNA, 103 bp, Artificial Sequence
  Synthetic Polynucleotide
taatacgactcactatagggattaggtgacatagccatcgagaggccttcaacagaggagagaaggcatgtcgatggctaacctggcggcagcgcaaaagatg

SEQ ID NO: 38612 - DNA, 103 bp, Artificial Sequence
  Synthetic Polynucleotide
taatacgactcactataggggcccgatgcacataaaatcgcgcctgctttaacagaggagaaaagcaatggcgattttaaacctggcggcagcgcaaaagatg

SEQ ID NO: 38613 - DNA, 103 bp, Artificial Sequence
  Synthetic Polynucleotide
taatacgactcactataggggtacaggaaggacatacggtcgtgtcagtgaacagaggagacactgaatggaccgtatgaacctggcggcagcgcaaaagatg

SEQ ID NO: 38614 - DNA, 103 bp, Artificial Sequence
  Synthetic Polynucleotide
taatacgactcactataggggggacctgagcgtcattagtgtctagggtcaacagaggagagaccctatgcactaatgaaacctggcggcagcgcaaaagatg

SEQ ID NO: 38615 - DNA, 103 bp, Artificial Sequence
  Synthetic Polynucleotide
taatacgactcactatagggagaatttaagtaatgaaagaaccaggacagaacagaggagactgtccatgttctttcataacctggcggcagcgcaaaagatg

SEQ ID NO: 38616 - DNA, 103 bp, Artificial Sequence
  Synthetic Polynucleotide
taatacgactcactatagggattcaatacgtcaacactcgttggttacaaaacagaggagattgtaaatgacgagtgttaacctggcggcagcgcaaaagatg

SEQ ID NO: 38617 - DNA, 103 bp, Artificial Sequence
  Synthetic Polynucleotide
taatacgactcactataggggagagataaacttgtagcttcatcaccgtgaacagaggagacacggtatggaagctacaaacctggcggcagcgcaaaagatg

SEQ ID NO: 38618 - DNA, 103 bp, Artificial Sequence
  Synthetic Polynucleotide
taatacgactcactatagggttgccgtcaccgtctacggtgtagttatttaacagaggagaaaataaatgcaccgtagaaacctggcggcagcgcaaaagatg

SEQ ID NO: 38619 - DNA, 103 bp, Artificial Sequence
  Synthetic Polynucleotide
taatacgactcactatagggccccaacgggcgttggccttccacaagaagaacagaggagacttcttatggaaggccaaaacctggcggcagcgcaaaagatg

SEQ ID NO: 38620 - DNA, 103 bp, Artificial Sequence
  Synthetic Polynucleotide
taatacgactcactataggggtacatgattcgtaagacgctcagagtgtaaacagaggagatacactatgagcgtcttaaacctggcggcagcgcaaaagatg

SEQ ID NO: 38621 - DNA, 103 bp, Artificial Sequence
  Synthetic Polynucleotide
taatacgactcactataggggttttaacttgttcatctgcttgggccagaaacagaggagatctggcatgagcagatgaaacctggcggcagcgcaaaagatg

SEQ ID NO: 38622 - DNA, 103 bp, Artificial Sequence
  Synthetic Polynucleotide
taatacgactcactataggggccgagaacgtgtcttagcaattttcgataaacagaggagatatcgaatgttgctaagaaacctggcggcagcgcaaaagatg

SEQ ID NO: 38623 - DNA, 103 bp, Artificial Sequence
  Synthetic Polynucleotide
taatacgactcactatagggggggtagcccttctgcgtgcgctagagtacaacagaggagagtactcatgcgcacgcagaacctggcggcagcgcaaaagatg

SEQ ID NO: 38624 - DNA, 103 bp, Artificial Sequence
  Synthetic Polynucleotide
taatacgactcactatagggccggcggtaagccgggtccttggccatcgaaacagaggagatcgatgatgaaggacccgaacctggcggcagcgcaaaagatg

SEQ ID NO: 38625 - DNA, 103 bp, Artificial Sequence
  Synthetic Polynucleotide
taatacgactcactatagggattgcaccaagggaaggctggtgtttccagaacagaggagactggaaatgccagccttcaacctggcggcagcgcaaaagatg

SEQ ID NO: 38626 - DNA, 103 bp, Artificial Sequence
  Synthetic Polynucleotide
taatacgactcactataggggaaactgaactctgagatggctgctaaccaaacagaggagatggttaatggccatctcaaacctggcggcagcgcaaaagatg

SEQ ID NO: 38627 - DNA, 103 bp, Artificial Sequence
  Synthetic Polynucleotide
taatacgactcactatagggctgtgatggaacaacacgaggataatacctaacagaggagaaggtatatgcctcgtgttaacctggcggcagcgcaaaagatg

SEQ ID NO: 38628 - DNA, 103 bp, Artificial Sequence
  Synthetic Polynucleotide
taatacgactcactatagggtgtcagttggcgcggagtcttatgatggtcaacagaggagagaccatatgaagactccgaacctggcggcagcgcaaaagatg

SEQ ID NO: 38629 - DNA, 103 bp, Artificial Sequence
  Synthetic Polynucleotide
taatacgactcactatagggagatgattatcaagtaccaaggaccaaacgaacagaggagacgtttgatgcttggtactaacctggcggcagcgcaaaagatg

SEQ ID NO: 38630 - DNA, 103 bp, Artificial Sequence
  Synthetic Polynucleotide
taatacgactcactatagggtatcacataccggtcacaagtatggtggtaaacagaggagataccacatgacttgtgacaacctggcggcagcgcaaaagatg

SEQ ID NO: 38631 - DNA, 103 bp, Artificial Sequence
  Synthetic Polynucleotide
taatacgactcactataggggaatgcgtgcgcctcctggttcagggccagaacagaggagactggccatgaaccaggagaacctggcggcagcgcaaaagatg

SEQ ID NO: 38632 - DNA, 103 bp, Artificial Sequence
  Synthetic Polynucleotide
taatacgactcactatagggttgccggaaccaacgccacacatagtcatcaacagaggagagatgacatggtgtggcgtaacctggcggcagcgcaaaagatg

SEQ ID NO: 38633 - DNA, 103 bp, Artificial Sequence
  Synthetic Polynucleotide
taatacgactcactatagggttgagcactttcgtacgccttgggttgcgaaacagaggagatcgcaaatgaaggcgtacaacctggcggcagcgcaaaagatg

SEQ ID NO: 38634 - DNA, 103 bp, Artificial Sequence
  Synthetic Polynucleotide
taatacgactcactatagggtttccccaacgctgcctgacacgcgcacttaacagaggagaaagtgcatgtgtcaggcaaacctggcggcagcgcaaaagatg

SEQ ID NO: 38635 - DNA, 103 bp, Artificial Sequence
  Synthetic Polynucleotide
taatacgactcactatagggcagtacagacactcgtaacatgttatcgataacagaggagaatcgatatgatgttacgaaacctggcggcagcgcaaaagatg

SEQ ID NO: 38636 - DNA, 103 bp, Artificial Sequence
  Synthetic Polynucleotide
taatacgactcactatagggtcccgagccgttcatgtcgagcgtgcgagtaacagaggagaactcgcatgctcgacatgaacctggcggcagcgcaaaagatg

SEQ ID NO: 38637 - DNA, 103 bp, Artificial Sequence
  Synthetic Polynucleotide
taatacgactcactataggggccgcaaaagccttctttggctcgctggataacagaggagaatccagatggccaaagaaaacctggcggcagcgcaaaagatg

SEQ ID NO: 38638 - DNA, 103 bp, Artificial Sequence
  Synthetic Polynucleotide
taatacgactcactataggggttgatcaagagcgtctctgactggacctcaacagaggagagaggtcatgtcagagacgaacctggcggcagcgcaaaagatg

SEQ ID NO: 38639 - DNA, 103 bp, Artificial Sequence
  Synthetic Polynucleotide
taatacgactcactatagggcctagtgaatgttacgcatataacttagttaacagaggagaaactaaatgatatgcgtaaacctggcggcagcgcaaaagatg

SEQ ID NO: 38640 - DNA, 103 bp, Artificial Sequence
  Synthetic Polynucleotide
taatacgactcactatagggtttgcgtgaattctcgactcggatgaattcaacagaggagagaattcatgcgagtcgagaacctggcggcagcgcaaaagatg

SEQ ID NO: 38641 - DNA, 103 bp, Artificial Sequence
  Synthetic Polynucleotide
taatacgactcactatagggcgccccactcaggggttgggcagcccggagaacagaggagactccggatggcccaacccaacctggcggcagcgcaaaagatg

SEQ ID NO: 38642 - DNA, 103 bp, Artificial Sequence
  Synthetic Polynucleotide
taatacgactcactatagggcaaaaatcgggctcttacctctatctgggcaacagaggagagcccagatggaggtaagaaacctggcggcagcgcaaaagatg

SEQ ID NO: 38643 - DNA, 103 bp, Artificial Sequence
  Synthetic Polynucleotide
taatacgactcactatagggcgtatgcggaaaacaagttcaggtagtttcaacagaggagagaaactatgtgaacttgtaacctggcggcagcgcaaaagatg

SEQ ID NO: 38644 - DNA, 103 bp, Artificial Sequence
  Synthetic Polynucleotide
taatacgactcactatagggatatccgtggcaaagcgataaaacccgttgaacagaggagacaacggatgttatcgcttaacctggcggcagcgcaaaagatg

SEQ ID NO: 38645 - DNA, 103 bp, Artificial Sequence
  Synthetic Polynucleotide
taatacgactcactatagggagcggtatcgtcggctctgaagcggtcgccaacagaggagaggcgacatgttcagagccaacctggcggcagcgcaaaagatg

SEQ ID NO: 38646 - DNA, 103 bp, Artificial Sequence
  Synthetic Polynucleotide
taatacgactcactatagggacatctgcttaaagcctcttctggaagactaacagaggagaagtcttatggaagaggctaacctggcggcagcgcaaaagatg

SEQ ID NO: 38647 - DNA, 103 bp, Artificial Sequence
  Synthetic Polynucleotide
taatacgactcactatagggcatccggcgagcgagcggccatttcgcgttaacagaggagaaacgcgatgtggccgctcaacctggcggcagcgcaaaagatg

SEQ ID NO: 38648 - DNA, 103 bp, Artificial Sequence
  Synthetic Polynucleotide
taatacgactcactatagggccaggccatgcaatggccagaccatcagggaacagaggagaccctgaatgtctggccataacctggcggcagcgcaaaagatg

SEQ ID NO: 38649 - DNA, 103 bp, Artificial Sequence
  Synthetic Polynucleotide
taatacgactcactatagggggttcgtttctctcgggtctgaaagcgagaaacagaggagatctcgcatgcagacccgaaacctggcggcagcgcaaaagatg

SEQ ID NO: 38650 - DNA, 103 bp, Artificial Sequence
  Synthetic Polynucleotide
taatacgactcactatagggggtgtctccactttaaagaacttcttattaaacagaggagataataaatggttctttaaaacctggcggcagcgcaaaagatg

SEQ ID NO: 38651 - DNA, 103 bp, Artificial Sequence
  Synthetic Polynucleotide
taatacgactcactatagggggatttgcaagctaacggcggtacgccacaaacagaggagatgtggcatgccgccgttaaacctggcggcagcgcaaaagatg

SEQ ID NO: 38652 - DNA, 103 bp, Artificial Sequence
  Synthetic Polynucleotide
taatacgactcactatagggagagcccgcatcctctaaggctcaacgcggaacagaggagaccgcgtatggccttagagaacctggcggcagcgcaaaagatg

SEQ ID NO: 38653 - DNA, 103 bp, Artificial Sequence
  Synthetic Polynucleotide
taatacgactcactatagggtacccgcgacacttccgtccacatctgtataacagaggagaatacagatgtggacggaaaacctggcggcagcgcaaaagatg

SEQ ID NO: 38654 - DNA, 103 bp, Artificial Sequence
  Synthetic Polynucleotide
taatacgactcactataggggtgtcgtcaccagcttcatacagaaagcgcaacagaggagagcgcttatggtatgaagcaacctggcggcagcgcaaaagatg

SEQ ID NO: 38655 - DNA, 103 bp, Artificial Sequence
  Synthetic Polynucleotide
taatacgactcactatagggttgatagcagacggggctaacctgcaccataacagaggagaatggtgatggttagccccaacctggcggcagcgcaaaagatg

SEQ ID NO: 38656 - DNA, 103 bp, Artificial Sequence
  Synthetic Polynucleotide
taatacgactcactatagggaacttttttttgcctaaggcagtctcgacgaacagaggagacgtcgaatgtgccttaggaacctggcggcagcgcaaaagatg

SEQ ID NO: 38657 - DNA, 103 bp, Artificial Sequence
  Synthetic Polynucleotide
taatacgactcactatagggagtcgtttcagactcgagttccatggcgataacagaggagaatcgccatggaactcgagaacctggcggcagcgcaaaagatg

SEQ ID NO: 38658 - DNA, 103 bp, Artificial Sequence
  Synthetic Polynucleotide
taatacgactcactatagggccgatatcggtgccatctgccatgaccgcgaacagaggagacgcggtatgggcagatggaacctggcggcagcgcaaaagatg

SEQ ID NO: 38659 - DNA, 103 bp, Artificial Sequence
  Synthetic Polynucleotide
taatacgactcactatagggccggaatattaatagcgtgtaggagggatcaacagaggagagatcccatgtacacgctaaacctggcggcagcgcaaaagatg

SEQ ID NO: 38660 - DNA, 103 bp, Artificial Sequence
  Synthetic Polynucleotide
taatacgactcactatagggagatggtagcccaacagccaccctacgagtaacagaggagaactcgtatggtggctgttaacctggcggcagcgcaaaagatg

SEQ ID NO: 38661 - DNA, 103 bp, Artificial Sequence
  Synthetic Polynucleotide
taatacgactcactatagggattgactataaaaagcgagttaatttcgttaacagaggagaaacgaaatgaactcgcttaacctggcggcagcgcaaaagatg

SEQ ID NO: 38662 - DNA, 103 bp, Artificial Sequence
  Synthetic Polynucleotide
taatacgactcactataggggtcgagccccgtcgcggtcgccgtccttgcaacagaggagagcaaggatggcgaccgcgaacctggcggcagcgcaaaagatg

SEQ ID NO: 38663 - DNA, 103 bp, Artificial Sequence
  Synthetic Polynucleotide
taatacgactcactatagggcaatcaagaccccggcccggccgaatagtcaacagaggagagactatatggccgggccgaacctggcggcagcgcaaaagatg

SEQ ID NO: 38664 - DNA, 103 bp, Artificial Sequence
  Synthetic Polynucleotide
taatacgactcactatagggttttacagcgagtaggaccatatcaactagaacagaggagactagttatgatggtcctaaacctggcggcagcgcaaaagatg

SEQ ID NO: 38665 - DNA, 103 bp, Artificial Sequence
  Synthetic Polynucleotide
taatacgactcactataggggaaaacgagacgatcgaccagattgcgtctaacagaggagaagacgcatgctggtcgataacctggcggcagcgcaaaagatg

SEQ ID NO: 38666 - DNA, 103 bp, Artificial Sequence
  Synthetic Polynucleotide
taatacgactcactatagggttcaggcccaatccactttcgcgagccagtaacagaggagaactggcatgcgaaagtggaacctggcggcagcgcaaaagatg

SEQ ID NO: 38667 - DNA, 103 bp, Artificial Sequence
  Synthetic Polynucleotide
taatacgactcactatagggctttactatactaccaaggccccaggtgccaacagaggagaggcaccatgggccttggtaacctggcggcagcgcaaaagatg

SEQ ID NO: 38668 - DNA, 103 bp, Artificial Sequence
  Synthetic Polynucleotide
taatacgactcactatagggcccctagtcgaccttcacgtttcgaaccttaacagaggagaaaggttatgaacgtgaagaacctggcggcagcgcaaaagatg

SEQ ID NO: 38669 - DNA, 103 bp, Artificial Sequence
  Synthetic Polynucleotide
taatacgactcactatagggcattggttatacatggcataaacgaccactaacagaggagaagtggtatgttatgccataacctggcggcagcgcaaaagatg

SEQ ID NO: 38670 - DNA, 103 bp, Artificial Sequence
  Synthetic Polynucleotide
taatacgactcactatagggcacaggcaatgtcttaaaatgcgcttcctaaacagaggagataggaaatgcattttaagaacctggcggcagcgcaaaagatg

SEQ ID NO: 38671 - DNA, 103 bp, Artificial Sequence
  Synthetic Polynucleotide
taatacgactcactatagggggtaccgtaacatactctcgagacaaacccaacagaggagagggtttatgtcgagagtaaacctggcggcagcgcaaaagatg

SEQ ID NO: 38672 - DNA, 103 bp, Artificial Sequence
  Synthetic Polynucleotide
taatacgactcactatagggtcatatgactttctgagaacgggagcttctaacagaggagaagaagcatgcgttctcagaacctggcggcagcgcaaaagatg

SEQ ID NO: 38673 - DNA, 103 bp, Artificial Sequence
  Synthetic Polynucleotide
taatacgactcactataggggcgtaaaacacaaaccagtatatttggccgaacagaggagacggccaatgatactggttaacctggcggcagcgcaaaagatg

SEQ ID NO: 38674 - DNA, 103 bp, Artificial Sequence
  Synthetic Polynucleotide
taatacgactcactatagggacagaactccggaatagcgaattcgatgacaacagaggagagtcatcatgttcgctattaacctggcggcagcgcaaaagatg

SEQ ID NO: 38675 - DNA, 103 bp, Artificial Sequence
  Synthetic Polynucleotide
taatacgactcactataggggccggatccggtgccctatacggggtaaaaaacagaggagattttacatggtatagggcaacctggcggcagcgcaaaagatg

SEQ ID NO: 38676 - DNA, 103 bp, Artificial Sequence
  Synthetic Polynucleotide
taatacgactcactatagggctgcctgtatatcctatagaaatctgagtaaacagaggagatactcaatgttctataggaacctggcggcagcgcaaaagatg

SEQ ID NO: 38677 - DNA, 103 bp, Artificial Sequence
  Synthetic Polynucleotide
taatacgactcactatagggttcgggttcggctgggtacggtgcgaacttaacagaggagaaagttcatgccgtacccaaacctggcggcagcgcaaaagatg

SEQ ID NO: 38678 - DNA, 103 bp, Artificial Sequence
  Synthetic Polynucleotide
taatacgactcactataggggccgtacctcatgggcagagacaaagcgttaacagaggagaaacgctatgtctctgcccaacctggcggcagcgcaaaagatg

SEQ ID NO: 38679 - DNA, 103 bp, Artificial Sequence
  Synthetic Polynucleotide
taatacgactcactatagggttaaatgtaaaaacgttgggcccttactcgaacagaggagacgagtaatggcccaacgtaacctggcggcagcgcaaaagatg

SEQ ID NO: 38680 - DNA, 103 bp, Artificial Sequence
  Synthetic Polynucleotide
taatacgactcactatagggtcaaccaactctacgtactttttacgcctcaacagaggagagaggcgatgaaagtacgtaacctggcggcagcgcaaaagatg

SEQ ID NO: 38681 - DNA, 103 bp, Artificial Sequence
  Synthetic Polynucleotide
taatacgactcactatagggagaacgatgcatcagtcttttggaactgccaacagaggagaggcagtatgaaaagactgaacctggcggcagcgcaaaagatg

SEQ ID NO: 38682 - DNA, 103 bp, Artificial Sequence
  Synthetic Polynucleotide
taatacgactcactatagggtggattttaccaaacagaaccatgaacttcaacagaggagagaagttatgggttctgttaacctggcggcagcgcaaaagatg

SEQ ID NO: 38683 - DNA, 103 bp, Artificial Sequence
  Synthetic Polynucleotide
taatacgactcactatagggcccggtgctctaggttaaggatggcataagaacagaggagacttatgatgtccttaaccaacctggcggcagcgcaaaagatg

SEQ ID NO: 38684 - DNA, 103 bp, Artificial Sequence
  Synthetic Polynucleotide
taatacgactcactataggggccgcggcgaaccaacgcggcgtataacacaacagaggagagtgttaatggccgcgttgaacctggcggcagcgcaaaagatg

SEQ ID NO: 38685 - DNA, 103 bp, Artificial Sequence
  Synthetic Polynucleotide
taatacgactcactatagggaaacttaacctgttagtagtgagaccaggcaacagaggagagcctggatgcactactaaaacctggcggcagcgcaaaagatg

SEQ ID NO: 38686 - DNA, 103 bp, Artificial Sequence
  Synthetic Polynucleotide
taatacgactcactataggggatgagtatcgcaaaaaggttatggcatggaacagaggagaccatgcatgaacctttttaacctggcggcagcgcaaaagatg

SEQ ID NO: 38687 - DNA, 103 bp, Artificial Sequence
  Synthetic Polynucleotide
taatacgactcactatagggcgaaaataatagataatctttggtatagtaaacagaggagatactatatgaaagattataacctggcggcagcgcaaaagatg

SEQ ID NO: 38688 - DNA, 103 bp, Artificial Sequence
  Synthetic Polynucleotide
taatacgactcactatagggatatatgttcctacaatgggcaaaaagtttaacagaggagaaaacttatggcccattgtaacctggcggcagcgcaaaagatg

SEQ ID NO: 38689 - DNA, 103 bp, Artificial Sequence
  Synthetic Polynucleotide
taatacgactcactatagggaaacaatgttcgcccatatcgtgccgtttcaacagaggagagaaacgatgcgatatgggaacctggcggcagcgcaaaagatg

SEQ ID NO: 38690 - DNA, 103 bp, Artificial Sequence
  Synthetic Polynucleotide
taatacgactcactatagggtcgtaacgagttaactcatgactttttgagaacagaggagactcaaaatgtcatgagttaacctggcggcagcgcaaaagatg

SEQ ID NO: 38691 - DNA, 103 bp, Artificial Sequence
  Synthetic Polynucleotide
taatacgactcactatagggcggaatcatttgcctctaagatggcgacataacagaggagaatgtcgatgtcttagaggaacctggcggcagcgcaaaagatg

SEQ ID NO: 38692 - DNA, 103 bp, Artificial Sequence
  Synthetic Polynucleotide
taatacgactcactatagggggttctttccataactaaacccagaccgctaacagaggagaagcggtatgggtttagttaacctggcggcagcgcaaaagatg

SEQ ID NO: 38693 - DNA, 103 bp, Artificial Sequence
  Synthetic Polynucleotide
taatacgactcactatagggataacgggagaccactgcgggtgtccagaaaacagaggagattctggatgcccgcagtgaacctggcggcagcgcaaaagatg

SEQ ID NO: 38694 - DNA, 103 bp, Artificial Sequence
  Synthetic Polynucleotide
taatacgactcactatagggataacaacgatagtacgatccagcccaatgaacagaggagacattggatgggatcgtacaacctggcggcagcgcaaaagatg

SEQ ID NO: 38695 - DNA, 103 bp, Artificial Sequence
  Synthetic Polynucleotide
taatacgactcactatagggtcacgataacattcaaggagcactcatcataacagaggagaatgatgatggctccttgaaacctggcggcagcgcaaaagatg

SEQ ID NO: 38696 - DNA, 103 bp, Artificial Sequence
  Synthetic Polynucleotide
taatacgactcactatagggtttttccagttgttgccgcaaccaacgttcaacagaggagagaacgtatgttgcggcaaaacctggcggcagcgcaaaagatg

SEQ ID NO: 38697 - DNA, 103 bp, Artificial Sequence
  Synthetic Polynucleotide
taatacgactcactatagggcgggctttatccttctcgaccactggtgtcaacagaggagagacaccatgggtcgagaaaacctggcggcagcgcaaaagatg

SEQ ID NO: 38698 - DNA, 103 bp, Artificial Sequence
  Synthetic Polynucleotide
taatacgactcactatagggtctggaccaccacgatacaagaatctcgataacagaggagaatcgagatgcttgtatcgaacctggcggcagcgcaaaagatg

SEQ ID NO: 38699 - DNA, 103 bp, Artificial Sequence
  Synthetic Polynucleotide
taatacgactcactatagggtcagcctcttgccttcgagcccctctttccaacagaggagaggaaagatgggctcgaagaacctggcggcagcgcaaaagatg

SEQ ID NO: 38700 - DNA, 103 bp, Artificial Sequence
  Synthetic Polynucleotide
taatacgactcactatagggcaaagaatgaattttacggtactcctactgaacagaggagacagtagatgtaccgtaaaaacctggcggcagcgcaaaagatg

SEQ ID NO: 38701 - DNA, 103 bp, Artificial Sequence
  Synthetic Polynucleotide
taatacgactcactatagggacacgttagatgagacccctgacagccgttaacagaggagaaacggcatgcaggggtctaacctggcggcagcgcaaaagatg

SEQ ID NO: 38702 - DNA, 103 bp, Artificial Sequence
  Synthetic Polynucleotide
taatacgactcactatagggtctaataggtatcgcagaagtgtttcgtcaaacagaggagatgacgaatgacttctgcgaacctggcggcagcgcaaaagatg

SEQ ID NO: 38703 - DNA, 103 bp, Artificial Sequence
  Synthetic Polynucleotide
taatacgactcactatagggcgtatcattaatcggcttttggggatcattaacagaggagaaatgatatgcaaaagccgaacctggcggcagcgcaaaagatg

SEQ ID NO: 38704 - DNA, 103 bp, Artificial Sequence
  Synthetic Polynucleotide
taatacgactcactatagggtgtcccgcactcgggctaaacgtttggtacaacagaggagagtaccaatggtttagcccaacctggcggcagcgcaaaagatg

SEQ ID NO: 38705 - DNA, 103 bp, Artificial Sequence
  Synthetic Polynucleotide
taatacgactcactataggggttttaccgtacggccgggttatgagttgcaacagaggagagcaactatgaacccggccaacctggcggcagcgcaaaagatg

SEQ ID NO: 38706 - DNA, 103 bp, Artificial Sequence
  Synthetic Polynucleotide
taatacgactcactatagggtccaggcgtactgtagagcgcagaagaactaacagaggagaagttctatggcgctctacaacctggcggcagcgcaaaagatg

SEQ ID NO: 38707 - DNA, 103 bp, Artificial Sequence
  Synthetic Polynucleotide
taatacgactcactataggggcatcatagatggctcggagagtcagttctaacagaggagaagaactatgtctccgagcaacctggcggcagcgcaaaagatg

SEQ ID NO: 38708 - DNA, 103 bp, Artificial Sequence
  Synthetic Polynucleotide
taatacgactcactatagggcttccttaggatctagctagcggtaatataaacagaggagatatattatggctagctagaacctggcggcagcgcaaaagatg

SEQ ID NO: 38709 - DNA, 103 bp, Artificial Sequence
  Synthetic Polynucleotide
taatacgactcactatagggtccaaagacttgttcctttctacactggggaacagaggagaccccagatgagaaaggaaaacctggcggcagcgcaaaagatg

SEQ ID NO: 38710 - DNA, 103 bp, Artificial Sequence
  Synthetic Polynucleotide
taatacgactcactatagggagttctacccaaggtacgcgggctttacggaacagaggagaccgtaaatgccgcgtaccaacctggcggcagcgcaaaagatg

SEQ ID NO: 38711 - DNA, 103 bp, Artificial Sequence
  Synthetic Polynucleotide
taatacgactcactatagggaatatcaacgtgagggtacgtcatgactagaacagaggagactagtcatgacgtaccctaacctggcggcagcgcaaaagatg

SEQ ID NO: 38712 - DNA, 103 bp, Artificial Sequence
  Synthetic Polynucleotide
taatacgactcactatagggctcttagtcaagtgcgttagagtaaggaagaacagaggagacttcctatgtctaacgcaaacctggcggcagcgcaaaagatg

SEQ ID NO: 38713 - DNA, 103 bp, Artificial Sequence
  Synthetic Polynucleotide
taatacgactcactatagggtcgcccttagagctgaagatcatctctctgaacagaggagacagagaatggatcttcagaacctggcggcagcgcaaaagatg

SEQ ID NO: 38714 - DNA, 103 bp, Artificial Sequence
  Synthetic Polynucleotide
taatacgactcactataggggttggctgcatttcaattctgcatgctcgtaacagaggagaacgagcatgcagaattgaaacctggcggcagcgcaaaagatg

SEQ ID NO: 38715 - DNA, 103 bp, Artificial Sequence
  Synthetic Polynucleotide
taatacgactcactataggggtgatcttaattggtatggcaccgaaaaataacagaggagaatttttatgtgccataccaacctggcggcagcgcaaaagatg

SEQ ID NO: 38716 - DNA, 103 bp, Artificial Sequence
  Synthetic Polynucleotide
taatacgactcactatagggttctcgttcgcagatagggccaaccatcgtaacagaggagaacgatgatgggccctatcaacctggcggcagcgcaaaagatg

SEQ ID NO: 38717 - DNA, 103 bp, Artificial Sequence
  Synthetic Polynucleotide
taatacgactcactatagggtaatgtcgtttggttagtgacaggggaaccaacagaggagaggttccatggtcactaacaacctggcggcagcgcaaaagatg

SEQ ID NO: 38718 - DNA, 103 bp, Artificial Sequence
  Synthetic Polynucleotide
taatacgactcactatagggagtaaacacttaagcgttggagatcctacgaacagaggagacgtaggatgtccaacgctaacctggcggcagcgcaaaagatg

SEQ ID NO: 38719 - DNA, 103 bp, Artificial Sequence
  Synthetic Polynucleotide
taatacgactcactatagggtcgttgtagcggtgataatggacgaaaaaaaacagaggagattttttatgccattatcaaacctggcggcagcgcaaaagatg

SEQ ID NO: 38720 - DNA, 103 bp, Artificial Sequence
  Synthetic Polynucleotide
taatacgactcactataggggacggccactgtagagccggtccgacggccaacagaggagaggccgtatgaccggctctaacctggcggcagcgcaaaagatg

SEQ ID NO: 38721 - DNA, 103 bp, Artificial Sequence
  Synthetic Polynucleotide
taatacgactcactatagggtagtcgggacgggatcggagggtaaaaaataacagaggagaatttttatgcctccgatcaacctggcggcagcgcaaaagatg

SEQ ID NO: 38722 - DNA, 103 bp, Artificial Sequence
  Synthetic Polynucleotide
taatacgactcactatagggtctacctcgacatccctctgacgcccggccaacagaggagaggccggatgtcagagggaaacctggcggcagcgcaaaagatg

SEQ ID NO: 38723 - DNA, 103 bp, Artificial Sequence
  Synthetic Polynucleotide
taatacgactcactatagggcgacttctgaggacgtgggctagctccaggaacagaggagacctggaatgagcccacgtaacctggcggcagcgcaaaagatg

SEQ ID NO: 38724 - DNA, 103 bp, Artificial Sequence
  Synthetic Polynucleotide
taatacgactcactatagggcttttgaatcggtagatcgttagcagctcgaacagaggagacgagctatgaacgatctaaacctggcggcagcgcaaaagatg

SEQ ID NO: 38725 - DNA, 103 bp, Artificial Sequence
  Synthetic Polynucleotide
taatacgactcactatagggagtgttgcccattaacacccagcctaatcaaacagaggagatgattaatgtgggtgttaaacctggcggcagcgcaaaagatg

SEQ ID NO: 38726 - DNA, 103 bp, Artificial Sequence
  Synthetic Polynucleotide
taatacgactcactataggggcgtgaagccatgacctcccagttcagtttaacagaggagaaaactgatgtgggaggtcaacctggcggcagcgcaaaagatg

SEQ ID NO: 38727 - DNA, 103 bp, Artificial Sequence
  Synthetic Polynucleotide
taatacgactcactatagggcaattcgtttcgggagtgcgaaaatctgttaacagaggagaaacagaatgtcgcactccaacctggcggcagcgcaaaagatg

SEQ ID NO: 38728 - DNA, 103 bp, Artificial Sequence
  Synthetic Polynucleotide
taatacgactcactatagggtttaccaatcaacacctaaatcattcttcgaacagaggagacgaagaatgatttaggtgaacctggcggcagcgcaaaagatg

SEQ ID NO: 38729 - DNA, 103 bp, Artificial Sequence
  Synthetic Polynucleotide
taatacgactcactatagggactgtacggatcgcgaaatatgttctgtataacagaggagaatacagatgatatttcgcaacctggcggcagcgcaaaagatg

SEQ ID NO: 38730 - DNA, 103 bp, Artificial Sequence
  Synthetic Polynucleotide
taatacgactcactataggggctccatggttccgggggtagatgcatgagaacagaggagactcatgatgctacccccgaacctggcggcagcgcaaaagatg

SEQ ID NO: 38731 - DNA, 103 bp, Artificial Sequence
  Synthetic Polynucleotide
taatacgactcactatagggactacagtaaggggggagatgtgcctagtcaacagaggagagactagatgcatctccccaacctggcggcagcgcaaaagatg

SEQ ID NO: 38732 - DNA, 103 bp, Artificial Sequence
  Synthetic Polynucleotide
taatacgactcactatagggggctactccgaggcagacagcgtctacgcgaacagaggagacgcgtaatggctgtctgcaacctggcggcagcgcaaaagatg

SEQ ID NO: 38733 - DNA, 103 bp, Artificial Sequence
  Synthetic Polynucleotide
taatacgactcactatagggcccgacgcagggggttatggccaccagcggaacagaggagaccgctgatggccataaccaacctggcggcagcgcaaaagatg

SEQ ID NO: 38734 - DNA, 103 bp, Artificial Sequence
  Synthetic Polynucleotide
taatacgactcactatagggacgatacggtctatactgactcactgcactaacagaggagaagtgcaatgagtcagtataacctggcggcagcgcaaaagatg

SEQ ID NO: 38735 - DNA, 103 bp, Artificial Sequence
  Synthetic Polynucleotide
taatacgactcactatagggatacgtctaattgtcggaacactgccaagcaacagaggagagcttggatgtgttccgacaacctggcggcagcgcaaaagatg

SEQ ID NO: 38736 - DNA, 103 bp, Artificial Sequence
  Synthetic Polynucleotide
taatacgactcactatagggggtcggcccggtcaaacatcactgcgggggaacagaggagacccccgatgtgatgtttgaacctggcggcagcgcaaaagatg

SEQ ID NO: 38737 - DNA, 103 bp, Artificial Sequence
  Synthetic Polynucleotide
taatacgactcactatagggtaattataatgactttgggtgtagttcggtaacagaggagaaccgaaatgcacccaaagaacctggcggcagcgcaaaagatg

SEQ ID NO: 38738 - DNA, 103 bp, Artificial Sequence
  Synthetic Polynucleotide
taatacgactcactatagggagcaaccgactcttcactttggcgtctcgtaacagaggagaacgagaatgcaaagtgaaaacctggcggcagcgcaaaagatg

SEQ ID NO: 38739 - DNA, 103 bp, Artificial Sequence
  Synthetic Polynucleotide
taatacgactcactatagggcggcccctcgcgacgctgcccttggggccaaacagaggagatggcccatggggcagcgtaacctggcggcagcgcaaaagatg

SEQ ID NO: 38740 - DNA, 103 bp, Artificial Sequence
  Synthetic Polynucleotide
taatacgactcactatagggcgcccgtagccctcttttaacaaagcgcggaacagaggagaccgcgcatggttaaaagaaacctggcggcagcgcaaaagatg

SEQ ID NO: 38741 - DNA, 103 bp, Artificial Sequence
  Synthetic Polynucleotide
taatacgactcactatagggccgcgcttcctacgtgtataaagagccgctaacagaggagaagcggcatgttatacacgaacctggcggcagcgcaaaagatg

SEQ ID NO: 38742 - DNA, 103 bp, Artificial Sequence
  Synthetic Polynucleotide
taatacgactcactataggggaagtccagcagtctactatagtgaaactgaacagaggagacagtttatgtatagtagaaacctggcggcagcgcaaaagatg

SEQ ID NO: 38743 - DNA, 103 bp, Artificial Sequence
  Synthetic Polynucleotide
taatacgactcactatagggtctgctagctgtcttaggaggtgtctttccaacagaggagaggaaagatgcctcctaagaacctggcggcagcgcaaaagatg

SEQ ID NO: 38744 - DNA, 103 bp, Artificial Sequence
  Synthetic Polynucleotide
taatacgactcactatagggcatatgccattgccctagggtatcgtgcgcaacagaggagagcgcacatgaccctagggaacctggcggcagcgcaaaagatg

SEQ ID NO: 38745 - DNA, 103 bp, Artificial Sequence
  Synthetic Polynucleotide
taatacgactcactataggggcttatggcagaaatgtataggcgagttgtaacagaggagaacaactatgctatacattaacctggcggcagcgcaaaagatg

SEQ ID NO: 38746 - DNA, 103 bp, Artificial Sequence
  Synthetic Polynucleotide
taatacgactcactataggggttccgggctagaatgatgttttagtaataaacagaggagatattacatgaacatcattaacctggcggcagcgcaaaagatg

SEQ ID NO: 38747 - DNA, 103 bp, Artificial Sequence
  Synthetic Polynucleotide
taatacgactcactatagggtctggtcgtagacgaccaaagcgacgtaggaacagaggagacctacgatgctttggtcgaacctggcggcagcgcaaaagatg

SEQ ID NO: 38748 - DNA, 103 bp, Artificial Sequence
  Synthetic Polynucleotide
taatacgactcactatagggggaactaacgtggaccccggcccccgaattaacagaggagaaattcgatggccggggtcaacctggcggcagcgcaaaagatg

SEQ ID NO: 38749 - DNA, 103 bp, Artificial Sequence
  Synthetic Polynucleotide
taatacgactcactataggggggcctgctgcatgctggtacctccgacacaacagaggagagtgtcgatggtaccagcaaacctggcggcagcgcaaaagatg

SEQ ID NO: 38750 - DNA, 103 bp, Artificial Sequence
  Synthetic Polynucleotide
taatacgactcactataggggcaggaggtacccgtatctaacacgttcggaacagaggagaccgaacatgttagatacgaacctggcggcagcgcaaaagatg

SEQ ID NO: 38751 - DNA, 103 bp, Artificial Sequence
  Synthetic Polynucleotide
taatacgactcactataggggtcaatccacgatcgtgccgcgtccgtactaacagaggagaagtacgatggcggcacgaaacctggcggcagcgcaaaagatg

SEQ ID NO: 38752 - DNA, 103 bp, Artificial Sequence
  Synthetic Polynucleotide
taatacgactcactatagggccgaaactcgaaaattataggtcgtgataaaacagaggagattatcaatgcctataattaacctggcggcagcgcaaaagatg

SEQ ID NO: 38753 - DNA, 103 bp, Artificial Sequence
  Synthetic Polynucleotide
taatacgactcactatagggtcttgtaccgagcgcgcggccctaggagataacagaggagaatctccatgggccgcgcgaacctggcggcagcgcaaaagatg

SEQ ID NO: 38754 - DNA, 103 bp, Artificial Sequence
  Synthetic Polynucleotide
taatacgactcactatagggttccccgccaaacggttcggccaagagagtaacagaggagaactctcatggccgaaccgaacctggcggcagcgcaaaagatg

SEQ ID NO: 38755 - DNA, 103 bp, Artificial Sequence
  Synthetic Polynucleotide
taatacgactcactatagggatatcgcttccatccacatggataggcacaaacagaggagatgtgccatgccatgtggaaacctggcggcagcgcaaaagatg

SEQ ID NO: 38756 - DNA, 103 bp, Artificial Sequence
  Synthetic Polynucleotide
taatacgactcactatagggcctgaagtcctttgccaagacaccatccgtaacagaggagaacggatatggtcttggcaaacctggcggcagcgcaaaagatg

SEQ ID NO: 38757 - DNA, 103 bp, Artificial Sequence
  Synthetic Polynucleotide
taatacgactcactataggggacaccttgcttgtctgtcgcttaagatgaaacagaggagatcatctatggcgacagacaacctggcggcagcgcaaaagatg

SEQ ID NO: 38758 - DNA, 103 bp, Artificial Sequence
  Synthetic Polynucleotide
taatacgactcactatagggcgaagtatagaacgggcacatcttagtacgaacagaggagacgtactatgatgtgcccgaacctggcggcagcgcaaaagatg

SEQ ID NO: 38759 - DNA, 103 bp, Artificial Sequence
  Synthetic Polynucleotide
taatacgactcactatagggtttggagtctgggatatgttggatcgcacaaacagaggagatgtgcgatgcaacatatcaacctggcggcagcgcaaaagatg

SEQ ID NO: 38760 - DNA, 103 bp, Artificial Sequence
  Synthetic Polynucleotide
taatacgactcactataggggggactggcggtctcctgtggggcatcattaacagaggagaaatgatatgccacaggagaacctggcggcagcgcaaaagatg

SEQ ID NO: 38761 - DNA, 103 bp, Artificial Sequence
  Synthetic Polynucleotide
taatacgactcactatagggtacgttgcgtgatgaaatactagccagtcaaacagaggagatgactgatgagtatttcaaacctggcggcagcgcaaaagatg

SEQ ID NO: 38762 - DNA, 103 bp, Artificial Sequence
  Synthetic Polynucleotide
taatacgactcactatagggccacagcaatccaccttataacaatgtaagaacagaggagacttacaatgttataaggtaacctggcggcagcgcaaaagatg

SEQ ID NO: 38763 - DNA, 103 bp, Artificial Sequence
  Synthetic Polynucleotide
taatacgactcactatagggtggaattgctacaatacgaccctggtagtcaacagaggagagactacatgggtcgtattaacctggcggcagcgcaaaagatg

SEQ ID NO: 38764 - DNA, 103 bp, Artificial Sequence
  Synthetic Polynucleotide
taatacgactcactatagggagtggcacacaggtataccacgtaatccggaacagaggagaccggatatggtggtatacaacctggcggcagcgcaaaagatg

SEQ ID NO: 38765 - DNA, 103 bp, Artificial Sequence
  Synthetic Polynucleotide
taatacgactcactatagggtcggtggttaaaatagcacggctcgcttagaacagaggagactaagcatgccgtgctataacctggcggcagcgcaaaagatg

SEQ ID NO: 38766 - DNA, 103 bp, Artificial Sequence
  Synthetic Polynucleotide
taatacgactcactatagggtggccgattctaggtatgcgctgattctgcaacagaggagagcagaaatggcgcataccaacctggcggcagcgcaaaagatg

SEQ ID NO: 38767 - DNA, 103 bp, Artificial Sequence
  Synthetic Polynucleotide
taatacgactcactatagggcctgtactagccgcatgcttttgcggtggaaacagaggagatccaccatgaaagcatgcaacctggcggcagcgcaaaagatg

SEQ ID NO: 38768 - DNA, 103 bp, Artificial Sequence
  Synthetic Polynucleotide
taatacgactcactataggggttggacgacatgctgctgaactcccttcaaacagaggagatgaaggatgttcagcagcaacctggcggcagcgcaaaagatg

SEQ ID NO: 38769 - DNA, 103 bp, Artificial Sequence
  Synthetic Polynucleotide
taatacgactcactatagggtctgcggattaaaactagcgccgcaacttaaacagaggagataagttatggcgctagttaacctggcggcagcgcaaaagatg

SEQ ID NO: 38770 - DNA, 103 bp, Artificial Sequence
  Synthetic Polynucleotide
taatacgactcactatagggaataacagaccgttcttcctgatcgactgcaacagaggagagcagtcatgcaggaagaaaacctggcggcagcgcaaaagatg

SEQ ID NO: 38771 - DNA, 103 bp, Artificial Sequence
  Synthetic Polynucleotide
taatacgactcactatagggcggcgatcgagcgacaagatgagggtccccaacagaggagaggggacatgcatcttgtcaacctggcggcagcgcaaaagatg

SEQ ID NO: 38772 - DNA, 103 bp, Artificial Sequence
  Synthetic Polynucleotide
taatacgactcactatagggttgcaggagtatacaagagctacgtctactaacagaggagaagtagaatgagctcttgtaacctggcggcagcgcaaaagatg

SEQ ID NO: 38773 - DNA, 103 bp, Artificial Sequence
  Synthetic Polynucleotide
taatacgactcactatagggagtgtataactttggtgacgtcgaaagccaaacagaggagatggcttatgacgtcaccaaacctggcggcagcgcaaaagatg

SEQ ID NO: 38774 - DNA, 103 bp, Artificial Sequence
  Synthetic Polynucleotide
taatacgactcactatagggcgatgggactgccaactgggagggacacagaacagaggagactgtgtatgtcccagttgaacctggcggcagcgcaaaagatg

SEQ ID NO: 38775 - DNA, 103 bp, Artificial Sequence
  Synthetic Polynucleotide
taatacgactcactatagggacgcgctacacagtgagcgatgttattaataacagaggagaattaatatgatcgctcacaacctggcggcagcgcaaaagatg

SEQ ID NO: 38776 - DNA, 103 bp, Artificial Sequence
  Synthetic Polynucleotide
taatacgactcactataggggggctattacggacagctaaatatccggcaaacagaggagatgccggatgtttagctgtaacctggcggcagcgcaaaagatg

SEQ ID NO: 38777 - DNA, 103 bp, Artificial Sequence
  Synthetic Polynucleotide
taatacgactcactatagggaatgtccattcaacatctccgagcggaaagaacagaggagactttccatgcggagatgtaacctggcggcagcgcaaaagatg

SEQ ID NO: 38778 - DNA, 103 bp, Artificial Sequence
  Synthetic Polynucleotide
taatacgactcactatagggactcgatattcactcttaggataatgtgtgaacagaggagacacacaatgtcctaagagaacctggcggcagcgcaaaagatg

SEQ ID NO: 38779 - DNA, 103 bp, Artificial Sequence
  Synthetic Polynucleotide
taatacgactcactatagggcctcctgcgtcggaaacttctttgatggcaaacagaggagatgccatatgagaagtttcaacctggcggcagcgcaaaagatg

SEQ ID NO: 38780 - DNA, 103 bp, Artificial Sequence
  Synthetic Polynucleotide
taatacgactcactatagggtcgggtacgccatgtgacctctccaagaggaacagaggagacctcttatggaggtcacaaacctggcggcagcgcaaaagatg

SEQ ID NO: 38781 - DNA, 103 bp, Artificial Sequence
  Synthetic Polynucleotide
taatacgactcactatagggctacatatcggtggcgatacttcgttgtgtaacagaggagaacacaaatgagtatcgccaacctggcggcagcgcaaaagatg

SEQ ID NO: 38782 - DNA, 103 bp, Artificial Sequence
  Synthetic Polynucleotide
taatacgactcactatagggtccctggtggacttcatatgccttggttggaacagaggagaccaaccatggcatatgaaaacctggcggcagcgcaaaagatg

SEQ ID NO: 38783 - DNA, 103 bp, Artificial Sequence
  Synthetic Polynucleotide
taatacgactcactatagggggatacatgggcgtcatgtgcccttcctccaacagaggagaggaggaatggcacatgacaacctggcggcagcgcaaaagatg

SEQ ID NO: 38784 - DNA, 103 bp, Artificial Sequence
  Synthetic Polynucleotide
taatacgactcactatagggcccattaaaaggtgagcagacatgtccattaacagaggagaaatggaatggtctgctcaaacctggcggcagcgcaaaagatg

SEQ ID NO: 38785 - DNA, 103 bp, Artificial Sequence
  Synthetic Polynucleotide
taatacgactcactatagggggcaaagaagtgcaatgagttgcctaagcgaacagaggagacgcttaatgaactcattgaacctggcggcagcgcaaaagatg

SEQ ID NO: 38786 - DNA, 103 bp, Artificial Sequence
  Synthetic Polynucleotide
taatacgactcactatagggccatggacgctccacgattcagcggccaacaacagaggagagttggcatgtgaatcgtgaacctggcggcagcgcaaaagatg

SEQ ID NO: 38787 - DNA, 103 bp, Artificial Sequence
  Synthetic Polynucleotide
taatacgactcactatagggaagcatcacttataccattaacccacgggtaacagaggagaacccgtatgttaatggtaaacctggcggcagcgcaaaagatg

SEQ ID NO: 38788 - DNA, 103 bp, Artificial Sequence
  Synthetic Polynucleotide
taatacgactcactatagggcccctcgcgcggatgagctgatctcctcaaaacagaggagattgaggatgtcagctcataacctggcggcagcgcaaaagatg

SEQ ID NO: 38789 - DNA, 103 bp, Artificial Sequence
  Synthetic Polynucleotide
taatacgactcactataggggtgaatttgcacaaggatcaccaaattggaaacagaggagatccaatatggtgatccttaacctggcggcagcgcaaaagatg

SEQ ID NO: 38790 - DNA, 103 bp, Artificial Sequence
  Synthetic Polynucleotide
taatacgactcactatagggctccgtcgattatgattagcgtgactgaaaaacagaggagatttcagatgcgctaatcaaacctggcggcagcgcaaaagatg

SEQ ID NO: 38791 - DNA, 103 bp, Artificial Sequence
  Synthetic Polynucleotide
taatacgactcactatagggggtccgaaaaggcgattaaaaggccattcgaacagaggagacgaatgatgttttaatcgaacctggcggcagcgcaaaagatg

SEQ ID NO: 38792 - DNA, 103 bp, Artificial Sequence
  Synthetic Polynucleotide
taatacgactcactatagggaggatcgcatgtatcggttaccgggatctgaacagaggagacagatcatggtaaccgataacctggcggcagcgcaaaagatg

SEQ ID NO: 38793 - DNA, 103 bp, Artificial Sequence
  Synthetic Polynucleotide
taatacgactcactatagggcggaggactgagatctacccagcatactctaacagaggagaagagtaatgtgggtagataacctggcggcagcgcaaaagatg

SEQ ID NO: 38794 - DNA, 103 bp, Artificial Sequence
  Synthetic Polynucleotide
taatacgactcactatagggtagtccgtgcagatggacgtatacctgaagaacagaggagacttcagatgtacgtccataacctggcggcagcgcaaaagatg

SEQ ID NO: 38795 - DNA, 103 bp, Artificial Sequence
  Synthetic Polynucleotide
taatacgactcactatagggcgaggctcgtcgaaacgccgtcttcataggaacagaggagacctatgatgacggcgtttaacctggcggcagcgcaaaagatg

SEQ ID NO: 38796 - DNA, 103 bp, Artificial Sequence
  Synthetic Polynucleotide
taatacgactcactatagggggtacagtgattagtcacgggcaggtgggaaacagaggagatcccacatgcccgtgactaacctggcggcagcgcaaaagatg

SEQ ID NO: 38797 - DNA, 103 bp, Artificial Sequence
  Synthetic Polynucleotide
taatacgactcactatagggccagaacggtcgcatacttgttcttggttaaacagaggagataaccaatgacaagtatgaacctggcggcagcgcaaaagatg

SEQ ID NO: 38798 - DNA, 103 bp, Artificial Sequence
  Synthetic Polynucleotide
taatacgactcactatagggcgccccggatattctgcttagggattgaataacagaggagaattcaaatgctaagcagaaacctggcggcagcgcaaaagatg

SEQ ID NO: 38799 - DNA, 103 bp, Artificial Sequence
  Synthetic Polynucleotide
taatacgactcactatagggtgtgcaaaattcattccagccggacttcacaacagaggagagtgaagatgggctggaataacctggcggcagcgcaaaagatg

SEQ ID NO: 38800 - DNA, 103 bp, Artificial Sequence
  Synthetic Polynucleotide
taatacgactcactatagggagatgcgtccgcatagttatcgttggctgcaacagaggagagcagccatggataactataacctggcggcagcgcaaaagatg

SEQ ID NO: 38801 - DNA, 103 bp, Artificial Sequence
  Synthetic Polynucleotide
taatacgactcactatagggctgacatactgcgacagatggtgcctaagcaacagaggagagcttagatgccatctgtcaacctggcggcagcgcaaaagatg

SEQ ID NO: 38802 - DNA, 103 bp, Artificial Sequence
  Synthetic Polynucleotide
taatacgactcactatagggcaccagtggacacatcaggaggccccccttaacagaggagaaaggggatgctcctgatgaacctggcggcagcgcaaaagatg

SEQ ID NO: 38803 - DNA, 103 bp, Artificial Sequence
  Synthetic Polynucleotide
taatacgactcactataggggatacttgccgtaagcgacgggtaggccagaacagaggagactggccatgccgtcgcttaacctggcggcagcgcaaaagatg

SEQ ID NO: 38804 - DNA, 103 bp, Artificial Sequence
  Synthetic Polynucleotide
taatacgactcactatagggctaagttcgatctagacagatatgcctcaaaacagaggagattgaggatgatctgtctaaacctggcggcagcgcaaaagatg

SEQ ID NO: 38805 - DNA, 103 bp, Artificial Sequence
  Synthetic Polynucleotide
taatacgactcactatagggccaaaaaatacttctagcatgatgttttcaaacagaggagatgaaaaatgcatgctagaaacctggcggcagcgcaaaagatg

SEQ ID NO: 38806 - DNA, 103 bp, Artificial Sequence
  Synthetic Polynucleotide
taatacgactcactatagggttatattagctcaaccttccttaagatcgtaacagaggagaacgatcatgaggaaggttaacctggcggcagcgcaaaagatg

SEQ ID NO: 38807 - DNA, 103 bp, Artificial Sequence
  Synthetic Polynucleotide
taatacgactcactatagggctttcgtatcgagccgccccctttaatataaacagaggagatatattatggggggcggcaacctggcggcagcgcaaaagatg

SEQ ID NO: 38808 - DNA, 103 bp, Artificial Sequence
  Synthetic Polynucleotide
taatacgactcactataggggttattataggaaggacacgctctcggattaacagaggagaaatccgatggcgtgtcctaacctggcggcagcgcaaaagatg

SEQ ID NO: 38809 - DNA, 103 bp, Artificial Sequence
  Synthetic Polynucleotide
taatacgactcactatagggataaccgtcgctgacgatccgagatgttgtaacagaggagaacaacaatgcggatcgtcaacctggcggcagcgcaaaagatg

SEQ ID NO: 38810 - DNA, 103 bp, Artificial Sequence
  Synthetic Polynucleotide
taatacgactcactatagggggtaaggaggtgttagctggccggattgtgaacagaggagacacaatatggccagctaaaacctggcggcagcgcaaaagatg

SEQ ID NO: 38811 - DNA, 103 bp, Artificial Sequence
  Synthetic Polynucleotide
taatacgactcactatagggttgggttagccgcgccccattatcctccctaacagaggagaagggagatgaatggggcgaacctggcggcagcgcaaaagatg

SEQ ID NO: 38812 - DNA, 103 bp, Artificial Sequence
  Synthetic Polynucleotide
taatacgactcactatagggcctacccgccactacttcctcgtacggtcgaacagaggagacgaccgatggaggaagtaaacctggcggcagcgcaaaagatg

SEQ ID NO: 38813 - DNA, 103 bp, Artificial Sequence
  Synthetic Polynucleotide
taatacgactcactatagggtttcgatgcataggagcgttccggtctacaaacagaggagatgtagaatggaacgctccaacctggcggcagcgcaaaagatg

SEQ ID NO: 38814 - DNA, 103 bp, Artificial Sequence
  Synthetic Polynucleotide
taatacgactcactatagggcaggccatgctggatgcatatagccgcgagaacagaggagactcgcgatgatatgcatcaacctggcggcagcgcaaaagatg

SEQ ID NO: 38815 - DNA, 103 bp, Artificial Sequence
  Synthetic Polynucleotide
taatacgactcactatagggcgcccggcagggaaatgtccctcgatttggaacagaggagaccaaatatggggacatttaacctggcggcagcgcaaaagatg

SEQ ID NO: 38816 - DNA, 103 bp, Artificial Sequence
  Synthetic Polynucleotide
taatacgactcactatagggcaactcgggctcccgtgtccgtatcagctcaacagaggagagagctgatgcggacacggaacctggcggcagcgcaaaagatg

SEQ ID NO: 38817 - DNA, 103 bp, Artificial Sequence
  Synthetic Polynucleotide
taatacgactcactataggggaactagcggggttgcagattttaagtgctaacagaggagaagcactatgaatctgcaaaacctggcggcagcgcaaaagatg

SEQ ID NO: 38818 - DNA, 103 bp, Artificial Sequence
  Synthetic Polynucleotide
taatacgactcactatagggactgggctcctctttcatatagtgaggcccaacagaggagagggcctatgtatatgaaaaacctggcggcagcgcaaaagatg

SEQ ID NO: 38819 - DNA, 103 bp, Artificial Sequence
  Synthetic Polynucleotide
taatacgactcactatagggctgcactaacctgtcccccagcatgtttttaacagaggagaaaaaacatgctgggggacaacctggcggcagcgcaaaagatg

SEQ ID NO: 38820 - DNA, 103 bp, Artificial Sequence
  Synthetic Polynucleotide
taatacgactcactatagggggtctataagctctcagacaatccccgagtaacagaggagaactcggatgttgtctgagaacctggcggcagcgcaaaagatg

SEQ ID NO: 38821 - DNA, 103 bp, Artificial Sequence
  Synthetic Polynucleotide
taatacgactcactatagggagggcatactttgttaaagctaagcagtagaacagaggagactactgatgagctttaacaacctggcggcagcgcaaaagatg

SEQ ID NO: 38822 - DNA, 103 bp, Artificial Sequence
  Synthetic Polynucleotide
taatacgactcactatagggatgtcagatcgatagtttggcgagatatagaacagaggagactatatatggccaaactaaacctggcggcagcgcaaaagatg

SEQ ID NO: 38823 - DNA, 103 bp, Artificial Sequence
  Synthetic Polynucleotide
taatacgactcactatagggccctagtactgtgtaggcctggaactgcataacagaggagaatgcagatgcaggcctacaacctggcggcagcgcaaaagatg

SEQ ID NO: 38824 - DNA, 103 bp, Artificial Sequence
  Synthetic Polynucleotide
taatacgactcactataggggtaggcctcgggccttcagttaaatggttgaacagaggagacaaccaatgaactgaaggaacctggcggcagcgcaaaagatg

SEQ ID NO: 38825 - DNA, 103 bp, Artificial Sequence
  Synthetic Polynucleotide
taatacgactcactataggggactccggggaagccggcttcctggtctccaacagaggagaggagacatggaagccggcaacctggcggcagcgcaaaagatg

SEQ ID NO: 38826 - DNA, 103 bp, Artificial Sequence
  Synthetic Polynucleotide
taatacgactcactataggggagttctttccatgaggttatcttgggcctaacagaggagaaggcccatgataacctcaaacctggcggcagcgcaaaagatg

SEQ ID NO: 38827 - DNA, 103 bp, Artificial Sequence
  Synthetic Polynucleotide
taatacgactcactatagggctgcacacaccgactactcttgacgcaataaacagaggagatattgcatgaagagtagtaacctggcggcagcgcaaaagatg

SEQ ID NO: 38828 - DNA, 103 bp, Artificial Sequence
  Synthetic Polynucleotide
taatacgactcactatagggagtgaaatacagagagtgcggtgctagaagaacagaggagacttctaatgccgcactctaacctggcggcagcgcaaaagatg

SEQ ID NO: 38829 - DNA, 103 bp, Artificial Sequence
  Synthetic Polynucleotide
taatacgactcactatagggacaacgtacacatggctaatacctggcaggaacagaggagacctgccatgtattagccaaacctggcggcagcgcaaaagatg

SEQ ID NO: 38830 - DNA, 103 bp, Artificial Sequence
  Synthetic Polynucleotide
taatacgactcactatagggccgtcgcagaagcaaagagcagattcagagaacagaggagactctgaatgtgctctttgaacctggcggcagcgcaaaagatg

SEQ ID NO: 38831 - DNA, 103 bp, Artificial Sequence
  Synthetic Polynucleotide
taatacgactcactatagggtcaacgtataggaccactttatagttggggaacagaggagaccccaaatgtaaagtggtaacctggcggcagcgcaaaagatg

SEQ ID NO: 38832 - DNA, 103 bp, Artificial Sequence
  Synthetic Polynucleotide
taatacgactcactataggggtcctatcgccgggaagattgaaatcatcgaacagaggagacgatgaatgcaatcttccaacctggcggcagcgcaaaagatg

SEQ ID NO: 38833 - DNA, 103 bp, Artificial Sequence
  Synthetic Polynucleotide
taatacgactcactatagggtcggagcaggggtaccgaggccagtactgtaacagaggagaacagtaatggcctcggtaaacctggcggcagcgcaaaagatg

SEQ ID NO: 38834 - DNA, 103 bp, Artificial Sequence
  Synthetic Polynucleotide
taatacgactcactatagggcaatctgtaactaccgcacggaacagtaataacagaggagaattactatgccgtgcggtaacctggcggcagcgcaaaagatg

SEQ ID NO: 38835 - DNA, 103 bp, Artificial Sequence
  Synthetic Polynucleotide
taatacgactcactatagggccctgtgatagttgcaacctgagcattaccaacagaggagaggtaatatgcaggttgcaaacctggcggcagcgcaaaagatg

SEQ ID NO: 38836 - DNA, 103 bp, Artificial Sequence
  Synthetic Polynucleotide
taatacgactcactatagggggcggctcaagtagatcgatcgctgtatgtaacagaggagaacatacatggatcgatctaacctggcggcagcgcaaaagatg

SEQ ID NO: 38837 - DNA, 103 bp, Artificial Sequence
  Synthetic Polynucleotide
taatacgactcactatagggccagccctgcgcgtccaaagaggacttcgtaacagaggagaacgaagatgtctttggacaacctggcggcagcgcaaaagatg

SEQ ID NO: 38838 - DNA, 103 bp, Artificial Sequence
  Synthetic Polynucleotide
taatacgactcactatagggactgggagggcctcatatcggtacttatggaacagaggagaccataaatgccgatatgaaacctggcggcagcgcaaaagatg

SEQ ID NO: 38839 - DNA, 103 bp, Artificial Sequence
  Synthetic Polynucleotide
taatacgactcactatagggtagactcataaggagtacccgcaataccttaacagaggagaaaggtaatgcgggtactcaacctggcggcagcgcaaaagatg

SEQ ID NO: 38840 - DNA, 103 bp, Artificial Sequence
  Synthetic Polynucleotide
taatacgactcactataggggatagtaatccatctagtttacgttctagcaacagaggagagctagaatgtaaactagaaacctggcggcagcgcaaaagatg

SEQ ID NO: 38841 - DNA, 103 bp, Artificial Sequence
  Synthetic Polynucleotide
taatacgactcactatagggaaaggacaagctaagttatgagagtgaatgaacagaggagacattcaatgtcataacttaacctggcggcagcgcaaaagatg

SEQ ID NO: 38842 - DNA, 103 bp, Artificial Sequence
  Synthetic Polynucleotide
taatacgactcactatagggtgtttttgtcacactgactggagacggttgaacagaggagacaaccgatgccagtcagtaacctggcggcagcgcaaaagatg

SEQ ID NO: 38843 - DNA, 103 bp, Artificial Sequence
  Synthetic Polynucleotide
taatacgactcactatagggtaccttttgtcaaaccttgttctcaacattaacagaggagaaatgttatgaacaaggttaacctggcggcagcgcaaaagatg

SEQ ID NO: 38844 - DNA, 103 bp, Artificial Sequence
  Synthetic Polynucleotide
taatacgactcactatagggaagttggctaggcacttagcccggagtactaacagaggagaagtactatgggctaagtgaacctggcggcagcgcaaaagatg

SEQ ID NO: 38845 - DNA, 103 bp, Artificial Sequence
  Synthetic Polynucleotide
taatacgactcactatagggtatatccttatcctccctgcaggtgctcctaacagaggagaaggagcatgtgcagggagaacctggcggcagcgcaaaagatg

SEQ ID NO: 38846 - DNA, 103 bp, Artificial Sequence
  Synthetic Polynucleotide
taatacgactcactatagggcgaggacatgagtccctggatggaagtagtaacagaggagaactactatgatccagggaaacctggcggcagcgcaaaagatg

SEQ ID NO: 38847 - DNA, 103 bp, Artificial Sequence
  Synthetic Polynucleotide
taatacgactcactatagggatttaggaacattacacttcgtgtatagggaacagaggagaccctatatgcgaagtgtaaacctggcggcagcgcaaaagatg

SEQ ID NO: 38848 - DNA, 103 bp, Artificial Sequence
  Synthetic Polynucleotide
taatacgactcactataggggttgacgtgtcgccgtttcaactaggaatcaacagaggagagattccatgttgaaacggaacctggcggcagcgcaaaagatg

SEQ ID NO: 38849 - DNA, 103 bp, Artificial Sequence
  Synthetic Polynucleotide
taatacgactcactatagggcgccagggaccagtgtctaacagaggaccaaacagaggagatggtccatggttagacacaacctggcggcagcgcaaaagatg

SEQ ID NO: 38850 - DNA, 103 bp, Artificial Sequence
  Synthetic Polynucleotide
taatacgactcactataggggttcgtagaagggatccacgccatgacaaaaacagaggagatttgtcatggcgtggatcaacctggcggcagcgcaaaagatg

SEQ ID NO: 38851 - DNA, 103 bp, Artificial Sequence
  Synthetic Polynucleotide
taatacgactcactataggggtagcaagtatcggacatgtcactggctagaacagaggagactagccatggacatgtccaacctggcggcagcgcaaaagatg

SEQ ID NO: 38852 - DNA, 103 bp, Artificial Sequence
  Synthetic Polynucleotide
taatacgactcactataggggcgaagccacgacccatctcagttgtcagcaacagaggagagctgacatgtgagatgggaacctggcggcagcgcaaaagatg

SEQ ID NO: 38853 - DNA, 103 bp, Artificial Sequence
  Synthetic Polynucleotide
taatacgactcactatagggaacaatgcgaatcacatggtattgcaggaaaacagaggagattcctgatgtaccatgtgaacctggcggcagcgcaaaagatg

SEQ ID NO: 38854 - DNA, 103 bp, Artificial Sequence
  Synthetic Polynucleotide
taatacgactcactatagggttgccactattggtaactagagattgggagaacagaggagactcccaatgtctagttacaacctggcggcagcgcaaaagatg

SEQ ID NO: 38855 - DNA, 103 bp, Artificial Sequence
  Synthetic Polynucleotide
taatacgactcactatagggcttctgtataacggccgctcggaccgacgcaacagaggagagcgtcgatgcgagcggccaacctggcggcagcgcaaaagatg

SEQ ID NO: 38856 - DNA, 103 bp, Artificial Sequence
  Synthetic Polynucleotide
taatacgactcactatagggcgagtctgaatgcagtactttagaggccaaaacagaggagattggccatgaaagtactgaacctggcggcagcgcaaaagatg

SEQ ID NO: 38857 - DNA, 103 bp, Artificial Sequence
  Synthetic Polynucleotide
taatacgactcactatagggttgggcacctttcgagcttttcaaaaagtcaacagaggagagactttatgaaaagctcgaacctggcggcagcgcaaaagatg

SEQ ID NO: 38858 - DNA, 103 bp, Artificial Sequence
  Synthetic Polynucleotide
taatacgactcactatagggaagcacggccctgtccaggtatggaccgcgaacagaggagacgcggtatgtacctggacaacctggcggcagcgcaaaagatg

SEQ ID NO: 38859 - DNA, 103 bp, Artificial Sequence
  Synthetic Polynucleotide
taatacgactcactatagggattagtgaggggagctagagtccacgcagtaacagaggagaactgcgatgactctagctaacctggcggcagcgcaaaagatg

SEQ ID NO: 38860 - DNA, 103 bp, Artificial Sequence
  Synthetic Polynucleotide
taatacgactcactatagggtcactcgccacttgtgtcagattacggtcaaacagaggagatgaccgatgtctgacacaaacctggcggcagcgcaaaagatg

SEQ ID NO: 38861 - DNA, 103 bp, Artificial Sequence
  Synthetic Polynucleotide
taatacgactcactatagggcaatggaacgacttttgccgccccagcaggaacagaggagacctgctatggcggcaaaaaacctggcggcagcgcaaaagatg

SEQ ID NO: 38862 - DNA, 103 bp, Artificial Sequence
  Synthetic Polynucleotide
taatacgactcactatagggatatgtgactagcctatatcacgctcaataaacagaggagatattgaatgtgatataggaacctggcggcagcgcaaaagatg

SEQ ID NO: 38863 - DNA, 103 bp, Artificial Sequence
  Synthetic Polynucleotide
taatacgactcactatagggcaaaagtaggctgcgtactaaatggacttgaacagaggagacaagtcatgttagtacgcaacctggcggcagcgcaaaagatg

SEQ ID NO: 38864 - DNA, 103 bp, Artificial Sequence
  Synthetic Polynucleotide
taatacgactcactataggggagtccaagctgtcagaacaagaacggcccaacagaggagagggccgatgttgttctgaaacctggcggcagcgcaaaagatg

SEQ ID NO: 38865 - DNA, 103 bp, Artificial Sequence
  Synthetic Polynucleotide
taatacgactcactatagggcacgagacgttgccagtcccgtatttacacaacagaggagagtgtaaatgcgggactggaacctggcggcagcgcaaaagatg

SEQ ID NO: 38866 - DNA, 103 bp, Artificial Sequence
  Synthetic Polynucleotide
taatacgactcactatagggcgttgcatatgacacttctgtgccctttctaacagaggagaagaaagatgacagaagtgaacctggcggcagcgcaaaagatg

SEQ ID NO: 38867 - DNA, 103 bp, Artificial Sequence
  Synthetic Polynucleotide
taatacgactcactatagggggaactatgggcgtccactggcacattgtaaacagaggagatacaatatgccagtggacaacctggcggcagcgcaaaagatg

SEQ ID NO: 38868 - DNA, 103 bp, Artificial Sequence
  Synthetic Polynucleotide
taatacgactcactatagggcagacctcgcactgcccaaacctaggaattaacagaggagaaattccatggtttgggcaaacctggcggcagcgcaaaagatg

SEQ ID NO: 38869 - DNA, 103 bp, Artificial Sequence
  Synthetic Polynucleotide
taatacgactcactatagggcgtgggcgcgcaggggccggagttagagaaaacagaggagattctctatgtccggccccaacctggcggcagcgcaaaagatg

SEQ ID NO: 38870 - DNA, 103 bp, Artificial Sequence
  Synthetic Polynucleotide
taatacgactcactataggggtgtcaataccagcatttactcgacccatcaacagaggagagatgggatgagtaaatgcaacctggcggcagcgcaaaagatg

SEQ ID NO: 38871 - DNA, 103 bp, Artificial Sequence
  Synthetic Polynucleotide
taatacgactcactatagggacctaccctgaccgtttcggaccctcaactaacagaggagaagttgaatgtccgaaacgaacctggcggcagcgcaaaagatg

SEQ ID NO: 38872 - DNA, 103 bp, Artificial Sequence
  Synthetic Polynucleotide
taatacgactcactatagggtggagtgctaagtgggacgtatgcagcatcaacagaggagagatgctatgtacgtcccaaacctggcggcagcgcaaaagatg

SEQ ID NO: 38873 - DNA, 103 bp, Artificial Sequence
  Synthetic Polynucleotide
taatacgactcactatagggaaaattgaggcaaaattggttcctcggagcaacagaggagagctccgatgaaccaatttaacctggcggcagcgcaaaagatg

SEQ ID NO: 38874 - DNA, 103 bp, Artificial Sequence
  Synthetic Polynucleotide
taatacgactcactatagggttacgaccaggtgtgtcttcaaacgcatagaacagaggagactatgcatgtgaagacacaacctggcggcagcgcaaaagatg

SEQ ID NO: 38875 - DNA, 103 bp, Artificial Sequence
  Synthetic Polynucleotide
taatacgactcactataggggattgtgtcatgccagctataaggttacttaacagaggagaaagtaaatgtatagctggaacctggcggcagcgcaaaagatg

SEQ ID NO: 38876 - DNA, 103 bp, Artificial Sequence
  Synthetic Polynucleotide
taatacgactcactatagggacaacgtccctctagtatttactggattacaacagaggagagtaatcatgtaaatactaaacctggcggcagcgcaaaagatg

SEQ ID NO: 38877 - DNA, 103 bp, Artificial Sequence
  Synthetic Polynucleotide
taatacgactcactatagggctagttgcttggccagccaatacgtagtgtaacagaggagaacactaatgattggctggaacctggcggcagcgcaaaagatg

SEQ ID NO: 38878 - DNA, 103 bp, Artificial Sequence
  Synthetic Polynucleotide
taatacgactcactatagggtccctattaaagtctttctatgaggttgccaacagaggagaggcaacatgatagaaagaaacctggcggcagcgcaaaagatg

SEQ ID NO: 38879 - DNA, 103 bp, Artificial Sequence
  Synthetic Polynucleotide
taatacgactcactataggggcaatagtgatcgaaggctagaaaaagaacaacagaggagagttcttatgctagccttcaacctggcggcagcgcaaaagatg

SEQ ID NO: 38880 - DNA, 103 bp, Artificial Sequence
  Synthetic Polynucleotide
taatacgactcactatagggtcgtttagctctccccagcagtgtgtccgaaacagaggagatcggacatgctgctggggaacctggcggcagcgcaaaagatg

SEQ ID NO: 38881 - DNA, 103 bp, Artificial Sequence
  Synthetic Polynucleotide
taatacgactcactatagggagataggcgtgacgtctacatatgtctcaaaacagaggagattgagaatgatgtagacgaacctggcggcagcgcaaaagatg

SEQ ID NO: 38882 - DNA, 103 bp, Artificial Sequence
  Synthetic Polynucleotide
taatacgactcactatagggaatgttgattagactgggatgtacacgttgaacagaggagacaacgtatgcatcccagtaacctggcggcagcgcaaaagatg

SEQ ID NO: 38883 - DNA, 103 bp, Artificial Sequence
  Synthetic Polynucleotide
taatacgactcactatagggtatctgatcgaaaattctgtagtaaatgtgaacagaggagacacattatgtacagaattaacctggcggcagcgcaaaagatg

SEQ ID NO: 38884 - DNA, 103 bp, Artificial Sequence
  Synthetic Polynucleotide
taatacgactcactatagggtgtggcagcagtggcccccagagctcagtgaacagaggagacactgaatgctgggggccaacctggcggcagcgcaaaagatg

SEQ ID NO: 38885 - DNA, 103 bp, Artificial Sequence
  Synthetic Polynucleotide
taatacgactcactatagggaggctggctgccttctctagcttcaacacaaacagaggagatgtgttatggctagagaaaacctggcggcagcgcaaaagatg

SEQ ID NO: 38886 - DNA, 103 bp, Artificial Sequence
  Synthetic Polynucleotide
taatacgactcactataggggtccagagtacagatacgtatgggaccgaaaacagaggagattcggtatgatacgtatcaacctggcggcagcgcaaaagatg

SEQ ID NO: 38887 - DNA, 103 bp, Artificial Sequence
  Synthetic Polynucleotide
taatacgactcactataggggtccatcggagcttatcgggtcgttgacttaacagaggagaaagtcaatgacccgataaaacctggcggcagcgcaaaagatg

SEQ ID NO: 38888 - DNA, 103 bp, Artificial Sequence
  Synthetic Polynucleotide
taatacgactcactatagggtcgggcgcacttgaaagaatctacgtttgtaacagaggagaacaaacatggattctttcaacctggcggcagcgcaaaagatg

SEQ ID NO: 38889 - DNA, 103 bp, Artificial Sequence
  Synthetic Polynucleotide
taatacgactcactatagggctggatgaaggacctttcatatggggaggtaacagaggagaacctccatgtatgaaaggaacctggcggcagcgcaaaagatg

SEQ ID NO: 38890 - DNA, 103 bp, Artificial Sequence
  Synthetic Polynucleotide
taatacgactcactatagggaacaacagtgttgcagccatttcaccaaaaaacagaggagattttggatgaatggctgcaacctggcggcagcgcaaaagatg

SEQ ID NO: 38891 - DNA, 103 bp, Artificial Sequence
  Synthetic Polynucleotide
taatacgactcactatagggacggtttctaaaggagggaaagccacctggaacagaggagaccaggtatgtttccctccaacctggcggcagcgcaaaagatg

SEQ ID NO: 38892 - DNA, 103 bp, Artificial Sequence
  Synthetic Polynucleotide
taatacgactcactatagggaatctacgaaaacgctcaagccacacgtagaacagaggagactacgtatggcttgagcgaacctggcggcagcgcaaaagatg

SEQ ID NO: 38893 - DNA, 103 bp, Artificial Sequence
  Synthetic Polynucleotide
taatacgactcactatagggttggacttacaacttcggccctattcagagaacagaggagactctgaatggggccgaagaacctggcggcagcgcaaaagatg

SEQ ID NO: 38894 - DNA, 103 bp, Artificial Sequence
  Synthetic Polynucleotide
taatacgactcactatagggaaggagagagggaagatgttgacccatactaacagaggagaagtatgatgcaacatcttaacctggcggcagcgcaaaagatg

SEQ ID NO: 38895 - DNA, 103 bp, Artificial Sequence
  Synthetic Polynucleotide
taatacgactcactataggggtttgaccccagcctatcacctagctacgaaacagaggagatcgtagatgggtgataggaacctggcggcagcgcaaaagatg

SEQ ID NO: 38896 - DNA, 103 bp, Artificial Sequence
  Synthetic Polynucleotide
taatacgactcactatagggtcgaagttgggcacttaaaccgggttcaccaacagaggagaggtgaaatgggtttaagtaacctggcggcagcgcaaaagatg

SEQ ID NO: 38897 - DNA, 103 bp, Artificial Sequence
  Synthetic Polynucleotide
taatacgactcactatagggaatagcattttcggttctttaacagactccaacagaggagaggagtcatgtaaagaaccaacctggcggcagcgcaaaagatg

SEQ ID NO: 38898 - DNA, 103 bp, Artificial Sequence
  Synthetic Polynucleotide
taatacgactcactatagggtaccgatattccgctcgtatctgatgttacaacagaggagagtaacaatggatacgagcaacctggcggcagcgcaaaagatg

SEQ ID NO: 38899 - DNA, 103 bp, Artificial Sequence
  Synthetic Polynucleotide
taatacgactcactataggggttggaggacgcatgcgtaaccccgtgcctaacagaggagaaggcacatggttacgcataacctggcggcagcgcaaaagatg

SEQ ID NO: 38900 - DNA, 103 bp, Artificial Sequence
  Synthetic Polynucleotide
taatacgactcactatagggtctgcgtaatgctgcaagcggtacgtgtagaacagaggagactacacatgccgcttgcaaacctggcggcagcgcaaaagatg

SEQ ID NO: 38901 - DNA, 103 bp, Artificial Sequence
  Synthetic Polynucleotide
taatacgactcactataggggactcctgtccaggttatctaaagacctccaacagaggagaggaggtatgtagataaccaacctggcggcagcgcaaaagatg

SEQ ID NO: 38902 - DNA, 103 bp, Artificial Sequence
  Synthetic Polynucleotide
taatacgactcactatagggcgccccatagggcgcggcagttcttgggaaaacagaggagattcccaatgactgccgcgaacctggcggcagcgcaaaagatg

SEQ ID NO: 38903 - DNA, 103 bp, Artificial Sequence
  Synthetic Polynucleotide
taatacgactcactataggggtcggcgactagccatacaaactagtccagaacagaggagactggacatgtttgtatggaacctggcggcagcgcaaaagatg

SEQ ID NO: 38904 - DNA, 103 bp, Artificial Sequence
  Synthetic Polynucleotide
taatacgactcactataggggactgaccttgatattgcgtcttgaccatcaacagaggagagatggtatggacgcaataaacctggcggcagcgcaaaagatg

SEQ ID NO: 38905 - DNA, 103 bp, Artificial Sequence
  Synthetic Polynucleotide
taatacgactcactatagggccaccctgtaacagcaattaggacaggaccaacagaggagaggtcctatgctaattgctaacctggcggcagcgcaaaagatg

SEQ ID NO: 38906 - DNA, 103 bp, Artificial Sequence
  Synthetic Polynucleotide
taatacgactcactatagggtattgaatctgagtaccttccgactagaaaaacagaggagatttctaatgggaaggtacaacctggcggcagcgcaaaagatg

SEQ ID NO: 38907 - DNA, 103 bp, Artificial Sequence
  Synthetic Polynucleotide
taatacgactcactataggggtttccttcaaaagtgcaactccactccctaacagaggagaagggagatgagttgcactaacctggcggcagcgcaaaagatg

SEQ ID NO: 38908 - DNA, 103 bp, Artificial Sequence
  Synthetic Polynucleotide
taatacgactcactataggggtggcctaacttagaagtggcctaactaataacagaggagaattagtatggccacttctaacctggcggcagcgcaaaagatg

SEQ ID NO: 38909 - DNA, 103 bp, Artificial Sequence
  Synthetic Polynucleotide
taatacgactcactatagggttgcggaacaatgctcatgatcgcagcacaaacagaggagatgtgctatgatcatgagcaacctggcggcagcgcaaaagatg

SEQ ID NO: 38910 - DNA, 103 bp, Artificial Sequence
  Synthetic Polynucleotide
taatacgactcactatagggtcagcgtatagagaatctagcttgtgctcgaacagaggagacgagcaatggctagattcaacctggcggcagcgcaaaagatg

SEQ ID NO: 38911 - DNA, 103 bp, Artificial Sequence
  Synthetic Polynucleotide
taatacgactcactatagggttttcttatctcctgtaattacggcagcggaacagaggagaccgctgatgtaattacagaacctggcggcagcgcaaaagatg

SEQ ID NO: 38912 - DNA, 103 bp, Artificial Sequence
  Synthetic Polynucleotide
taatacgactcactatagggttggtgaacttgccctcgcccctggatcgaaacagaggagatcgatcatggggcgagggaacctggcggcagcgcaaaagatg

SEQ ID NO: 38913 - DNA, 103 bp, Artificial Sequence
  Synthetic Polynucleotide
taatacgactcactataggggctcgggttcttaggcgagtaatgtgtaccaacagaggagaggtacaatgtactcgcctaacctggcggcagcgcaaaagatg

SEQ ID NO: 38914 - DNA, 103 bp, Artificial Sequence
  Synthetic Polynucleotide
taatacgactcactataggggtattttggcctgttggagatgtcgcaaacaacagaggagagtttgcatgatctccaacaacctggcggcagcgcaaaagatg

SEQ ID NO: 38915 - DNA, 103 bp, Artificial Sequence
  Synthetic Polynucleotide
taatacgactcactatagggaaacaacgaaatggtcgctgcgcacacatcaacagaggagagatgtgatggcagcgaccaacctggcggcagcgcaaaagatg

SEQ ID NO: 38916 - DNA, 103 bp, Artificial Sequence
  Synthetic Polynucleotide
taatacgactcactatagggatagtggtcattcttgccgtgcacagacgaaacagaggagatcgtctatgcacggcaagaacctggcggcagcgcaaaagatg

SEQ ID NO: 38917 - DNA, 103 bp, Artificial Sequence
  Synthetic Polynucleotide
taatacgactcactataggggaagtgtctccgtaatgattgcattccttgaacagaggagacaaggaatgcaatcattaaacctggcggcagcgcaaaagatg

SEQ ID NO: 38918 - DNA, 103 bp, Artificial Sequence
  Synthetic Polynucleotide
taatacgactcactataggggcgccgatctcgtgcttaaggagcaagcggaacagaggagaccgcttatgccttaagcaaacctggcggcagcgcaaaagatg

SEQ ID NO: 38919 - DNA, 103 bp, Artificial Sequence
  Synthetic Polynucleotide
taatacgactcactatagggtatgagggaacgtgatcgacccgaaccgggaacagaggagacccggtatgggtcgatcaaacctggcggcagcgcaaaagatg

SEQ ID NO: 38920 - DNA, 103 bp, Artificial Sequence
  Synthetic Polynucleotide
taatacgactcactatagggctaagctccaccatcgctattaagctttgtaacagaggagaacaaagatgaatagcgataacctggcggcagcgcaaaagatg

SEQ ID NO: 38921 - DNA, 103 bp, Artificial Sequence
  Synthetic Polynucleotide
taatacgactcactatagggtaactctggatataacacgtcgagggccgaaacagaggagatcggccatggacgtgttaaacctggcggcagcgcaaaagatg

SEQ ID NO: 38922 - DNA, 103 bp, Artificial Sequence
  Synthetic Polynucleotide
taatacgactcactatagggtttaattataaagagatagccaataaatggaacagaggagaccatttatgggctatctcaacctggcggcagcgcaaaagatg

SEQ ID NO: 38923 - DNA, 103 bp, Artificial Sequence
  Synthetic Polynucleotide
taatacgactcactatagggcgtttgctgatacttcacaaaaattaccgcaacagaggagagcggtaatgtttgtgaagaacctggcggcagcgcaaaagatg

SEQ ID NO: 38924 - DNA, 103 bp, Artificial Sequence
  Synthetic Polynucleotide
taatacgactcactatagggggaacaacgtaagttgaacagggcctcctgaacagaggagacaggagatgctgttcaacaacctggcggcagcgcaaaagatg

SEQ ID NO: 38925 - DNA, 103 bp, Artificial Sequence
  Synthetic Polynucleotide
taatacgactcactatagggcctgccctgcgacacgaacatcacattgcgaacagaggagacgcaatatgatgttcgtgaacctggcggcagcgcaaaagatg

SEQ ID NO: 38926 - DNA, 103 bp, Artificial Sequence
  Synthetic Polynucleotide
taatacgactcactatagggtgtacactcttgacccctatgttgccaggaaacagaggagatcctggatgcataggggtaacctggcggcagcgcaaaagatg

SEQ ID NO: 38927 - DNA, 103 bp, Artificial Sequence
  Synthetic Polynucleotide
taatacgactcactataggggtgggggcggcctataaaaatcgttcgcccaacagaggagagggcgaatgatttttataaacctggcggcagcgcaaaagatg

SEQ ID NO: 38928 - DNA, 103 bp, Artificial Sequence
  Synthetic Polynucleotide
taatacgactcactatagggggcggcaggccgggtgactaacagctggcaaacagaggagatgccagatgttagtcaccaacctggcggcagcgcaaaagatg

SEQ ID NO: 38929 - DNA, 103 bp, Artificial Sequence
  Synthetic Polynucleotide
taatacgactcactatagggtcgtagcagcctggtgttcttccggagcagaacagaggagactgctcatgaagaacaccaacctggcggcagcgcaaaagatg

SEQ ID NO: 38930 - DNA, 103 bp, Artificial Sequence
  Synthetic Polynucleotide
taatacgactcactatagggcattataatccacttgagcaccgttcattcaacagaggagagaatgaatggtgctcaagaacctggcggcagcgcaaaagatg

SEQ ID NO: 38931 - DNA, 103 bp, Artificial Sequence
  Synthetic Polynucleotide
taatacgactcactatagggtgatctaggagggcgccaaattggctgcataacagaggagaatgcagatgatttggcgcaacctggcggcagcgcaaaagatg

SEQ ID NO: 38932 - DNA, 103 bp, Artificial Sequence
  Synthetic Polynucleotide
taatacgactcactatagggatcattcggcgctatcgaagcccccaggtgaacagaggagacacctgatggcttcgataaacctggcggcagcgcaaaagatg

SEQ ID NO: 38933 - DNA, 103 bp, Artificial Sequence
  Synthetic Polynucleotide
taatacgactcactatagggtgcgaatctgatcatatccatcagagggagaacagaggagactccctatgatggatatgaacctggcggcagcgcaaaagatg

SEQ ID NO: 38934 - DNA, 103 bp, Artificial Sequence
  Synthetic Polynucleotide
taatacgactcactatagggcgagtatcgcaaccaccaattgtgactactaacagaggagaagtagtatgaattggtggaacctggcggcagcgcaaaagatg

SEQ ID NO: 38935 - DNA, 103 bp, Artificial Sequence
  Synthetic Polynucleotide
taatacgactcactatagggaaatatgtttaaagggtttgggtcccagctaacagaggagaagctggatgccaaaccctaacctggcggcagcgcaaaagatg

SEQ ID NO: 38936 - DNA, 103 bp, Artificial Sequence
  Synthetic Polynucleotide
taatacgactcactatagggtcgtcccctctcttcttccccggactaattaacagaggagaaattagatgggggaagaaaacctggcggcagcgcaaaagatg

SEQ ID NO: 38937 - DNA, 103 bp, Artificial Sequence
  Synthetic Polynucleotide
taatacgactcactataggggaccatgggtaacatggccaaaatatgggaaacagaggagatcccatatgttggccatgaacctggcggcagcgcaaaagatg

SEQ ID NO: 38938 - DNA, 103 bp, Artificial Sequence
  Synthetic Polynucleotide
taatacgactcactatagggttgattaccctagccggcgcacaagtccgcaacagaggagagcggacatgtgcgccggcaacctggcggcagcgcaaaagatg

SEQ ID NO: 38939 - DNA, 103 bp, Artificial Sequence
  Synthetic Polynucleotide
taatacgactcactatagggtctgtggtttgttcatatctggtgatgggaaacagaggagatcccatatgcagatatgaaacctggcggcagcgcaaaagatg

SEQ ID NO: 38940 - DNA, 103 bp, Artificial Sequence
  Synthetic Polynucleotide
taatacgactcactatagggcgtccgatatactgttaaacgccctcatgcaacagaggagagcatgaatgcgtttaacaaacctggcggcagcgcaaaagatg

SEQ ID NO: 38941 - DNA, 103 bp, Artificial Sequence
  Synthetic Polynucleotide
taatacgactcactatagggcaaagtgccgcactaaagctaaactcttccaacagaggagaggaagaatgtagctttagaacctggcggcagcgcaaaagatg

SEQ ID NO: 38942 - DNA, 103 bp, Artificial Sequence
  Synthetic Polynucleotide
taatacgactcactatagggagaggcctagtcgtggcctagaagacccgaaacagaggagatcgggtatgctaggccacaacctggcggcagcgcaaaagatg

SEQ ID NO: 38943 - DNA, 103 bp, Artificial Sequence
  Synthetic Polynucleotide
taatacgactcactatagggaacttggtggaaggaattgctaggctagagaacagaggagactctagatgagcaattccaacctggcggcagcgcaaaagatg

SEQ ID NO: 38944 - DNA, 103 bp, Artificial Sequence
  Synthetic Polynucleotide
taatacgactcactatagggcgggctcctacccgaagttgccatcaatcgaacagaggagacgattgatggcaacttcgaacctggcggcagcgcaaaagatg

SEQ ID NO: 38945 - DNA, 103 bp, Artificial Sequence
  Synthetic Polynucleotide
taatacgactcactataggggacaacaggtcttcctctcttcagtgggaaaacagaggagattcccaatgaagagaggaaacctggcggcagcgcaaaagatg

SEQ ID NO: 38946 - DNA, 103 bp, Artificial Sequence
  Synthetic Polynucleotide
taatacgactcactatagggtaacagacaagaaataagaatcaggatagtaacagaggagaactatcatgattcttattaacctggcggcagcgcaaaagatg

SEQ ID NO: 38947 - DNA, 103 bp, Artificial Sequence
  Synthetic Polynucleotide
taatacgactcactatagggtttcattaaaggctccacgacaacgaatacaacagaggagagtattcatggtcgtggagaacctggcggcagcgcaaaagatg

SEQ ID NO: 38948 - DNA, 103 bp, Artificial Sequence
  Synthetic Polynucleotide
taatacgactcactatagggtccttggagaggtacgagtgtactctccagaacagaggagactggagatgacactcgtaaacctggcggcagcgcaaaagatg

SEQ ID NO: 38949 - DNA, 103 bp, Artificial Sequence
  Synthetic Polynucleotide
taatacgactcactatagggatacagcaaatccgtcataacatagcagctaacagaggagaagctgcatggttatgacgaacctggcggcagcgcaaaagatg

SEQ ID NO: 38950 - DNA, 103 bp, Artificial Sequence
  Synthetic Polynucleotide
taatacgactcactataggggacttaaaaataaggggtcctactatccataacagaggagaatggatatgaggacccctaacctggcggcagcgcaaaagatg

SEQ ID NO: 38951 - DNA, 103 bp, Artificial Sequence
  Synthetic Polynucleotide
taatacgactcactatagggcttgatgtcttatagaaccgctccgcctcgaacagaggagacgaggcatggcggttctaaacctggcggcagcgcaaaagatg

SEQ ID NO: 38952 - DNA, 103 bp, Artificial Sequence
  Synthetic Polynucleotide
taatacgactcactatagggattcaagcgcatgtccagaacatcggatataacagaggagaatatccatggttctggacaacctggcggcagcgcaaaagatg

SEQ ID NO: 38953 - DNA, 103 bp, Artificial Sequence
  Synthetic Polynucleotide
taatacgactcactatagggatggccggataggggggcagtttcagtgccaacagaggagaggcactatgactgcccccaacctggcggcagcgcaaaagatg

SEQ ID NO: 38954 - DNA, 103 bp, Artificial Sequence
  Synthetic Polynucleotide
taatacgactcactatagggaggcagtgcctctcatgccgggtgcaggggaacagaggagacccctgatgccggcatgaaacctggcggcagcgcaaaagatg

SEQ ID NO: 38955 - DNA, 103 bp, Artificial Sequence
  Synthetic Polynucleotide
taatacgactcactatagggtcgtcctaataacgacgtagcaaaccttctaacagaggagaagaaggatggctacgtcgaacctggcggcagcgcaaaagatg

SEQ ID NO: 38956 - DNA, 103 bp, Artificial Sequence
  Synthetic Polynucleotide
taatacgactcactatagggaatagttacggtagcgggccagtattggccaacagaggagaggccaaatgtggcccgctaacctggcggcagcgcaaaagatg

SEQ ID NO: 38957 - DNA, 103 bp, Artificial Sequence
  Synthetic Polynucleotide
taatacgactcactataggggcgcggcagcacgcgagtgggcttcggttaaacagaggagataaccgatgcccactcgcaacctggcggcagcgcaaaagatg

SEQ ID NO: 38958 - DNA, 103 bp, Artificial Sequence
  Synthetic Polynucleotide
taatacgactcactatagggggtatagttgatgtggacgcgtgcacgcgtaacagaggagaacgcgtatgcgcgtccacaacctggcggcagcgcaaaagatg

SEQ ID NO: 38959 - DNA, 103 bp, Artificial Sequence
  Synthetic Polynucleotide
taatacgactcactataggggaaagagtgactatcgtgatgttcaggaaaaacagaggagatttcctatgcatcacgataacctggcggcagcgcaaaagatg

SEQ ID NO: 38960 - DNA, 103 bp, Artificial Sequence
  Synthetic Polynucleotide
taatacgactcactatagggggggtaaacgcgaatatagaagcaaaatataacagaggagaatatttatgttctatattaacctggcggcagcgcaaaagatg

SEQ ID NO: 38961 - DNA, 103 bp, Artificial Sequence
  Synthetic Polynucleotide
taatacgactcactatagggtccttatttccttgcaggaacaaacgagataacagaggagaatctcgatggttcctgcaaacctggcggcagcgcaaaagatg

SEQ ID NO: 38962 - DNA, 103 bp, Artificial Sequence
  Synthetic Polynucleotide
taatacgactcactatagggcgctgatacgcctttaaccgtttatttgcaaacagaggagatgcaaaatgacggttaaaaacctggcggcagcgcaaaagatg

SEQ ID NO: 38963 - DNA, 103 bp, Artificial Sequence
  Synthetic Polynucleotide
taatacgactcactatagggcattgttctgcacgagttactgttgacggcaacagaggagagccgtcatgagtaactcgaacctggcggcagcgcaaaagatg

SEQ ID NO: 38964 - DNA, 103 bp, Artificial Sequence
  Synthetic Polynucleotide
taatacgactcactatagggagtgccggttagtagcggtcgctcaggataaacagaggagatatcctatgcgaccgctaaacctggcggcagcgcaaaagatg

SEQ ID NO: 38965 - DNA, 103 bp, Artificial Sequence
  Synthetic Polynucleotide
taatacgactcactataggggaagtctgacctgttttggtaaaccgacaaaacagaggagattgtcgatgtaccaaaacaacctggcggcagcgcaaaagatg

SEQ ID NO: 38966 - DNA, 103 bp, Artificial Sequence
  Synthetic Polynucleotide
taatacgactcactatagggacattcacgtgaaaagtgcgctcagtaagcaacagaggagagcttacatggcgcactttaacctggcggcagcgcaaaagatg

SEQ ID NO: 38967 - DNA, 103 bp, Artificial Sequence
  Synthetic Polynucleotide
taatacgactcactatagggaggccctccccggtcagcgtatacctacataacagaggagaatgtagatgtacgctgacaacctggcggcagcgcaaaagatg

SEQ ID NO: 38968 - DNA, 103 bp, Artificial Sequence
  Synthetic Polynucleotide
taatacgactcactataggggacataacttggtcgcctccggtacagtacaacagaggagagtactgatgcggaggcgaaacctggcggcagcgcaaaagatg

SEQ ID NO: 38969 - DNA, 103 bp, Artificial Sequence
  Synthetic Polynucleotide
taatacgactcactatagggctcccatctctaaaacagtcaagattttagaacagaggagactaaaaatgtgactgtttaacctggcggcagcgcaaaagatg

SEQ ID NO: 38970 - DNA, 103 bp, Artificial Sequence
  Synthetic Polynucleotide
taatacgactcactatagggccaaaaccgatcccctgggcgccggctttaaacagaggagataaagcatgcgcccagggaacctggcggcagcgcaaaagatg

SEQ ID NO: 38971 - DNA, 103 bp, Artificial Sequence
  Synthetic Polynucleotide
taatacgactcactatagggtcgctgatgtgtgggacattatcgattgcgaacagaggagacgcaatatgtaatgtcccaacctggcggcagcgcaaaagatg

SEQ ID NO: 38972 - DNA, 103 bp, Artificial Sequence
  Synthetic Polynucleotide
taatacgactcactataggggcgctaatgcagtggggacaagaggatccaaacagaggagatggatcatgttgtccccaaacctggcggcagcgcaaaagatg

SEQ ID NO: 38973 - DNA, 103 bp, Artificial Sequence
  Synthetic Polynucleotide
taatacgactcactatagggacaacctgcgaggcccgcggatcttgccagaacagaggagactggcaatgtccgcgggcaacctggcggcagcgcaaaagatg

SEQ ID NO: 38974 - DNA, 103 bp, Artificial Sequence
  Synthetic Polynucleotide
taatacgactcactatagggataccctcgcacagactatacatctgtaggaacagaggagacctacaatggtatagtctaacctggcggcagcgcaaaagatg

SEQ ID NO: 38975 - DNA, 103 bp, Artificial Sequence
  Synthetic Polynucleotide
taatacgactcactatagggcatgtatttcacataaatgattgcgatcggaacagaggagaccgatcatgatcatttataacctggcggcagcgcaaaagatg

SEQ ID NO: 38976 - DNA, 103 bp, Artificial Sequence
  Synthetic Polynucleotide
taatacgactcactatagggaagcgagtaccgtgtccgcacaggtgatataacagaggagaatatcaatggtgcggacaaacctggcggcagcgcaaaagatg

SEQ ID NO: 38977 - DNA, 103 bp, Artificial Sequence
  Synthetic Polynucleotide
taatacgactcactatagggggcgtagtaaatacctcgaggatttgcataaacagaggagatatgcaatgcctcgaggtaacctggcggcagcgcaaaagatg

SEQ ID NO: 38978 - DNA, 103 bp, Artificial Sequence
  Synthetic Polynucleotide
taatacgactcactatagggtcgactgaacacagttgtaacgccggggaaaacagaggagattccccatggttacaactaacctggcggcagcgcaaaagatg

SEQ ID NO: 38979 - DNA, 103 bp, Artificial Sequence
  Synthetic Polynucleotide
taatacgactcactatagggtaaaagtgaaccgtcgttagcggttaccgtaacagaggagaacggtaatggctaacgacaacctggcggcagcgcaaaagatg

SEQ ID NO: 38980 - DNA, 103 bp, Artificial Sequence
  Synthetic Polynucleotide
taatacgactcactataggggttcgtacacacccctttgaggcaaagctcaacagaggagagagcttatgctcaaagggaacctggcggcagcgcaaaagatg

SEQ ID NO: 38981 - DNA, 103 bp, Artificial Sequence
  Synthetic Polynucleotide
taatacgactcactatagggtcggcctagatggatcttgcacctcgagcaaacagaggagatgctcgatgtgcaagatcaacctggcggcagcgcaaaagatg

SEQ ID NO: 38982 - DNA, 103 bp, Artificial Sequence
  Synthetic Polynucleotide
taatacgactcactatagggcatctttaggctaacgaatactgagaaggtaacagaggagaaccttcatggtattcgttaacctggcggcagcgcaaaagatg

SEQ ID NO: 38983 - DNA, 103 bp, Artificial Sequence
  Synthetic Polynucleotide
taatacgactcactatagggccgtcatgccgagaactcaaaagagcacggaacagaggagaccgtgcatgtttgagttcaacctggcggcagcgcaaaagatg

SEQ ID NO: 38984 - DNA, 103 bp, Artificial Sequence
  Synthetic Polynucleotide
taatacgactcactatagggcgagattatagcaaggaagccacggcagtgaacagaggagacactgcatgggcttccttaacctggcggcagcgcaaaagatg

SEQ ID NO: 38985 - DNA, 103 bp, Artificial Sequence
  Synthetic Polynucleotide
taatacgactcactatagggcgacagatgataaaaatgtcatgtaggagcaacagaggagagctcctatgtgacattttaacctggcggcagcgcaaaagatg

SEQ ID NO: 38986 - DNA, 103 bp, Artificial Sequence
  Synthetic Polynucleotide
taatacgactcactataggggtcagtcttctaggcctagtgccctttgagaacagaggagactcaaaatgcactaggccaacctggcggcagcgcaaaagatg

SEQ ID NO: 38987 - DNA, 103 bp, Artificial Sequence
  Synthetic Polynucleotide
taatacgactcactatagggggtggagccatgggtaatactgatgtgcgaaacagaggagatcgcacatgagtattaccaacctggcggcagcgcaaaagatg

SEQ ID NO: 38988 - DNA, 103 bp, Artificial Sequence
  Synthetic Polynucleotide
taatacgactcactatagggtgggcccatttacaagaaataggtttatcgaacagaggagacgataaatgtatttcttgaacctggcggcagcgcaaaagatg

SEQ ID NO: 38989 - DNA, 103 bp, Artificial Sequence
  Synthetic Polynucleotide
taatacgactcactatagggagggtttgcaaaagtcggagagaaccttgaaacagaggagatcaaggatgtctccgactaacctggcggcagcgcaaaagatg

SEQ ID NO: 38990 - DNA, 103 bp, Artificial Sequence
  Synthetic Polynucleotide
taatacgactcactatagggtagagcgtctcgattccaggtcgtggctggaacagaggagaccagccatgacctggaataacctggcggcagcgcaaaagatg

SEQ ID NO: 38991 - DNA, 103 bp, Artificial Sequence
  Synthetic Polynucleotide
taatacgactcactatagggcgatctagaagaagcatgacacaacgccacaacagaggagagtggcgatgtgtcatgctaacctggcggcagcgcaaaagatg

SEQ ID NO: 38992 - DNA, 103 bp, Artificial Sequence
  Synthetic Polynucleotide
taatacgactcactatagggtggcctccgttctacttggcacggtaatttaacagaggagaaaattaatgtgccaagtaaacctggcggcagcgcaaaagatg

SEQ ID NO: 38993 - DNA, 103 bp, Artificial Sequence
  Synthetic Polynucleotide
taatacgactcactatagggggttagctctttcccgagcagggaactggcaacagaggagagccagtatgctgctcgggaacctggcggcagcgcaaaagatg

SEQ ID NO: 38994 - DNA, 103 bp, Artificial Sequence
  Synthetic Polynucleotide
taatacgactcactataggggatcgtagagtaactttgagccctacttttaacagaggagaaaaagtatggctcaaagtaacctggcggcagcgcaaaagatg

SEQ ID NO: 38995 - DNA, 103 bp, Artificial Sequence
  Synthetic Polynucleotide
taatacgactcactatagggatcgagcttcggaccgaggttggcaatccaaacagaggagatggattatgaacctcggtaacctggcggcagcgcaaaagatg

SEQ ID NO: 38996 - DNA, 103 bp, Artificial Sequence
  Synthetic Polynucleotide
taatacgactcactatagggacttcttactcagcgattacctagcctggtaacagaggagaaccaggatgggtaatcgcaacctggcggcagcgcaaaagatg

SEQ ID NO: 38997 - DNA, 103 bp, Artificial Sequence
  Synthetic Polynucleotide
taatacgactcactatagggcagcacgtcaccacctgacaaacctgcggcaacagaggagagccgcaatgttgtcaggtaacctggcggcagcgcaaaagatg

SEQ ID NO: 38998 - DNA, 103 bp, Artificial Sequence
  Synthetic Polynucleotide
taatacgactcactatagggagatggggctgcattgttatgttggctagaaacagaggagatctagcatgcataacaataacctggcggcagcgcaaaagatg

SEQ ID NO: 38999 - DNA, 103 bp, Artificial Sequence
  Synthetic Polynucleotide
taatacgactcactataggggctataaaggaatggaagacatcctttataaacagaggagatataaaatgtgtcttccaaacctggcggcagcgcaaaagatg

SEQ ID NO: 39000 - DNA, 103 bp, Artificial Sequence
  Synthetic Polynucleotide
taatacgactcactatagggcagacgctctgctgtcgcacgctaaaataaaacagaggagattatttatgcgtgcgacaaacctggcggcagcgcaaaagatg

SEQ ID NO: 39001 - DNA, 103 bp, Artificial Sequence
  Synthetic Polynucleotide
taatacgactcactatagggcccacgtcacctgcttcctgagtcagatcgaacagaggagacgatctatgtcaggaagcaacctggcggcagcgcaaaagatg

SEQ ID NO: 39002 - DNA, 103 bp, Artificial Sequence
  Synthetic Polynucleotide
taatacgactcactatagggtcgaccaatcagtcaggtcgcgtcttaaataacagaggagaatttaaatggcgacctgaaacctggcggcagcgcaaaagatg

SEQ ID NO: 39003 - DNA, 103 bp, Artificial Sequence
  Synthetic Polynucleotide
taatacgactcactataggggcttggcagggaccgatagtagcggccaacaacagaggagagttggcatgtactatcggaacctggcggcagcgcaaaagatg

SEQ ID NO: 39004 - DNA, 103 bp, Artificial Sequence
  Synthetic Polynucleotide
taatacgactcactataggggggtaatccggcgacaccgaaattatatcgaacagaggagacgatatatgttcggtgtcaacctggcggcagcgcaaaagatg

SEQ ID NO: 39005 - DNA, 103 bp, Artificial Sequence
  Synthetic Polynucleotide
taatacgactcactataggggaatttagtagcttgtgccaaactctagggaacagaggagaccctagatgttggcacaaaacctggcggcagcgcaaaagatg

SEQ ID NO: 39006 - DNA, 103 bp, Artificial Sequence
  Synthetic Polynucleotide
taatacgactcactatagggaaccttggactatcctgaatggctaaaaacaacagaggagagtttttatgcattcaggaaacctggcggcagcgcaaaagatg

SEQ ID NO: 39007 - DNA, 103 bp, Artificial Sequence
  Synthetic Polynucleotide
taatacgactcactatagggctccacccgtcggaggcaacaataataccaaacagaggagatggtatatgtgttgcctcaacctggcggcagcgcaaaagatg

SEQ ID NO: 39008 - DNA, 103 bp, Artificial Sequence
  Synthetic Polynucleotide
taatacgactcactataggggagcagttcagcacaaagctatcgggtgggaacagaggagacccaccatgtagctttgtaacctggcggcagcgcaaaagatg

SEQ ID NO: 39009 - DNA, 103 bp, Artificial Sequence
  Synthetic Polynucleotide
taatacgactcactatagggttgatctaaggttaacacaggctgacaagcaacagaggagagcttgtatgcctgtgttaaacctggcggcagcgcaaaagatg

SEQ ID NO: 39010 - DNA, 103 bp, Artificial Sequence
  Synthetic Polynucleotide
taatacgactcactataggggttggaccattctgaactaattacgacctaaacagaggagataggtcatgattagttcaaacctggcggcagcgcaaaagatg

SEQ ID NO: 39011 - DNA, 103 bp, Artificial Sequence
  Synthetic Polynucleotide
taatacgactcactatagggcaagctctgaaaccagaattgcacgtacgaaacagaggagatcgtacatgcaattctggaacctggcggcagcgcaaaagatg

SEQ ID NO: 39012 - DNA, 103 bp, Artificial Sequence
  Synthetic Polynucleotide
taatacgactcactatagggagccagagggatatattacgggatatgaaaaacagaggagatttcatatgccgtaatataacctggcggcagcgcaaaagatg

SEQ ID NO: 39013 - DNA, 103 bp, Artificial Sequence
  Synthetic Polynucleotide
taatacgactcactatagggaaaattcttcactaggctttgtgtatagaaaacagaggagattctatatgcaaagcctaaacctggcggcagcgcaaaagatg

SEQ ID NO: 39014 - DNA, 103 bp, Artificial Sequence
  Synthetic Polynucleotide
taatacgactcactatagggattggttattaacctcgaggcgtggaggccaacagaggagaggcctcatggcctcgaggaacctggcggcagcgcaaaagatg

SEQ ID NO: 39015 - DNA, 103 bp, Artificial Sequence
  Synthetic Polynucleotide
taatacgactcactataggggtacatgtaggtttctcagttaagccgataaacagaggagatatcggatgaactgagaaaacctggcggcagcgcaaaagatg

SEQ ID NO: 39016 - DNA, 103 bp, Artificial Sequence
  Synthetic Polynucleotide
taatacgactcactatagggcagtgggagctgcctcgtatatcgactcccaacagaggagagggagtatgtatacgaggaacctggcggcagcgcaaaagatg

SEQ ID NO: 39017 - DNA, 103 bp, Artificial Sequence
  Synthetic Polynucleotide
taatacgactcactataggggagggggtcttcacttgtagctcagaaggaaacagaggagatccttcatggctacaagtaacctggcggcagcgcaaaagatg

SEQ ID NO: 39018 - DNA, 103 bp, Artificial Sequence
  Synthetic Polynucleotide
taatacgactcactataggggttcctttagaatagccccctgtccatagcaacagaggagagctatgatgagggggctaaacctggcggcagcgcaaaagatg

SEQ ID NO: 39019 - DNA, 103 bp, Artificial Sequence
  Synthetic Polynucleotide
taatacgactcactatagggtggcatccggtgggtgttccgatcagtttaaacagaggagataaactatgcggaacaccaacctggcggcagcgcaaaagatg

SEQ ID NO: 39020 - DNA, 103 bp, Artificial Sequence
  Synthetic Polynucleotide
taatacgactcactatagggggcggcccgtccaacgcttgctccgtccagaacagaggagactggacatggcaagcgttaacctggcggcagcgcaaaagatg

SEQ ID NO: 39021 - DNA, 103 bp, Artificial Sequence
  Synthetic Polynucleotide
taatacgactcactatagggatgacaatcagagataattccaaatgcattaacagaggagaaatgcaatgggaattatcaacctggcggcagcgcaaaagatg

SEQ ID NO: 39022 - DNA, 103 bp, Artificial Sequence
  Synthetic Polynucleotide
taatacgactcactatagggtttccagattaggagtctggaggaaagaacaacagaggagagttcttatgtccagactcaacctggcggcagcgcaaaagatg

SEQ ID NO: 39023 - DNA, 103 bp, Artificial Sequence
  Synthetic Polynucleotide
taatacgactcactatagggtacccagttagggggccacagacgcatgtgaacagaggagacacatgatgctgtggcccaacctggcggcagcgcaaaagatg

SEQ ID NO: 39024 - DNA, 103 bp, Artificial Sequence
  Synthetic Polynucleotide
taatacgactcactatagggcatgtactgtgagagcattgaaatggacgaaacagaggagatcgtccatgtcaatgctcaacctggcggcagcgcaaaagatg

SEQ ID NO: 39025 - DNA, 103 bp, Artificial Sequence
  Synthetic Polynucleotide
taatacgactcactatagggagacagggcttctaaaacaacctgctttgtaacagaggagaacaaagatggttgttttaaacctggcggcagcgcaaaagatg

SEQ ID NO: 39026 - DNA, 103 bp, Artificial Sequence
  Synthetic Polynucleotide
taatacgactcactatagggatcgctacgtgtagctcaccttctgcatcgaacagaggagacgatgcatgaggtgagctaacctggcggcagcgcaaaagatg

SEQ ID NO: 39027 - DNA, 103 bp, Artificial Sequence
  Synthetic Polynucleotide
taatacgactcactatagggacatggcacctcaagcatgggggtcagatcaacagaggagagatctgatgcccatgcttaacctggcggcagcgcaaaagatg

SEQ ID NO: 39028 - DNA, 103 bp, Artificial Sequence
  Synthetic Polynucleotide
taatacgactcactatagggcatgatgaattacaaagctcgccgcgttataacagaggagaataacgatgcgagctttgaacctggcggcagcgcaaaagatg

SEQ ID NO: 39029 - DNA, 103 bp, Artificial Sequence
  Synthetic Polynucleotide
taatacgactcactatagggcgtagtgattgaactggtatcgatgtttgtaacagaggagaacaaacatggataccagtaacctggcggcagcgcaaaagatg

SEQ ID NO: 39030 - DNA, 103 bp, Artificial Sequence
  Synthetic Polynucleotide
taatacgactcactatagggcgtgtcggggcacggggagagccgctaagtaacagaggagaacttagatgctctccccgaacctggcggcagcgcaaaagatg

SEQ ID NO: 39031 - DNA, 103 bp, Artificial Sequence
  Synthetic Polynucleotide
taatacgactcactataggggctcctgaagtactggactcgcgtgagcacaacagaggagagtgctcatgcgagtccagaacctggcggcagcgcaaaagatg

SEQ ID NO: 39032 - DNA, 103 bp, Artificial Sequence
  Synthetic Polynucleotide
taatacgactcactatagggcactgtgtattttctacatttcggccaatcaacagaggagagattggatgaaatgtagaaacctggcggcagcgcaaaagatg

SEQ ID NO: 39033 - DNA, 103 bp, Artificial Sequence
  Synthetic Polynucleotide
taatacgactcactatagggagtaaaaaagcgcgaggatccgggcccaaaaacagaggagatttgggatgggatcctcgaacctggcggcagcgcaaaagatg

SEQ ID NO: 39034 - DNA, 103 bp, Artificial Sequence
  Synthetic Polynucleotide
taatacgactcactataggggttgatcctccacgataggaaaaggagtctaacagaggagaagactcatgttcctatcgaacctggcggcagcgcaaaagatg

SEQ ID NO: 39035 - DNA, 103 bp, Artificial Sequence
  Synthetic Polynucleotide
taatacgactcactatagggttcagcctactagcattggtattccttcttaacagaggagaaagaagatgtaccaatgcaacctggcggcagcgcaaaagatg

SEQ ID NO: 39036 - DNA, 103 bp, Artificial Sequence
  Synthetic Polynucleotide
taatacgactcactatagggcctccctaaaggcaaaaaacaaaccggaaaaacagaggagatttccgatgtgttttttgaacctggcggcagcgcaaaagatg

SEQ ID NO: 39037 - DNA, 103 bp, Artificial Sequence
  Synthetic Polynucleotide
taatacgactcactatagggctcgctttcgaaccgcacatgcaacgtggcaacagaggagagccacgatgcatgtgcggaacctggcggcagcgcaaaagatg

SEQ ID NO: 39038 - DNA, 103 bp, Artificial Sequence
  Synthetic Polynucleotide
taatacgactcactatagggctttgcacgctttacaacagcccgtggttcaacagaggagagaaccaatggctgttgtaaacctggcggcagcgcaaaagatg

SEQ ID NO: 39039 - DNA, 103 bp, Artificial Sequence
  Synthetic Polynucleotide
taatacgactcactatagggatgcgactccaagaccgtcatggatgcttcaacagaggagagaagcaatgatgacggtcaacctggcggcagcgcaaaagatg

SEQ ID NO: 39040 - DNA, 103 bp, Artificial Sequence
  Synthetic Polynucleotide
taatacgactcactatagggccctcctccgctaccattgtggtcgaggggaacagaggagacccctcatgcacaatggtaacctggcggcagcgcaaaagatg

SEQ ID NO: 39041 - DNA, 103 bp, Artificial Sequence
  Synthetic Polynucleotide
taatacgactcactatagggtatgaccggactcgcctcgacgcgacccgaaacagaggagatcgggtatggtcgaggcgaacctggcggcagcgcaaaagatg

SEQ ID NO: 39042 - DNA, 103 bp, Artificial Sequence
  Synthetic Polynucleotide
taatacgactcactatagggagtccttgggcgaggacagcgactggccctaacagaggagaagggccatgcgctgtcctaacctggcggcagcgcaaaagatg

SEQ ID NO: 39043 - DNA, 103 bp, Artificial Sequence
  Synthetic Polynucleotide
taatacgactcactatagggggctttgttgttcaggttgcgcgtggatacaacagaggagagtatccatgcgcaacctgaacctggcggcagcgcaaaagatg

SEQ ID NO: 39044 - DNA, 103 bp, Artificial Sequence
  Synthetic Polynucleotide
taatacgactcactataggggacggttccaaccttttgggctgttgccccaacagaggagaggggcaatggcccaaaagaacctggcggcagcgcaaaagatg

SEQ ID NO: 39045 - DNA, 103 bp, Artificial Sequence
  Synthetic Polynucleotide
taatacgactcactataggggggccagacaatgtcagaggttatgattgcaacagaggagagcaatcatgacctctgacaacctggcggcagcgcaaaagatg

SEQ ID NO: 39046 - DNA, 103 bp, Artificial Sequence
  Synthetic Polynucleotide
taatacgactcactatagggctcgtaaaaaggcctctgctctcaacggagaacagaggagactccgtatggagcagaggaacctggcggcagcgcaaaagatg

SEQ ID NO: 39047 - DNA, 103 bp, Artificial Sequence
  Synthetic Polynucleotide
taatacgactcactataggggtagtaggtcagcgacgctgttctgaatataacagaggagaatattcatgacagcgtcgaacctggcggcagcgcaaaagatg

SEQ ID NO: 39048 - DNA, 103 bp, Artificial Sequence
  Synthetic Polynucleotide
taatacgactcactataggggggattgagtttgtgtttttgagagactcaaacagaggagatgagtcatgcaaaaacacaacctggcggcagcgcaaaagatg

SEQ ID NO: 39049 - DNA, 103 bp, Artificial Sequence
  Synthetic Polynucleotide
taatacgactcactatagggagggcgattctttcagtaaatggcgacccgaacagaggagacgggtcatgatttactgaaacctggcggcagcgcaaaagatg

SEQ ID NO: 39050 - DNA, 103 bp, Artificial Sequence
  Synthetic Polynucleotide
taatacgactcactatagggctgtaagggcgctaggggattataacaataaacagaggagatattgtatgaatcccctaaacctggcggcagcgcaaaagatg

SEQ ID NO: 39051 - DNA, 103 bp, Artificial Sequence
  Synthetic Polynucleotide
taatacgactcactatagggaccctgccccgcgacgtttcctcggtcgaaaacagaggagattcgacatgggaaacgtcaacctggcggcagcgcaaaagatg

SEQ ID NO: 39052 - DNA, 103 bp, Artificial Sequence
  Synthetic Polynucleotide
taatacgactcactatagggggctagctagacccgtacggcaggctcacaaacagaggagatgtgagatggccgtacggaacctggcggcagcgcaaaagatg

SEQ ID NO: 39053 - DNA, 103 bp, Artificial Sequence
  Synthetic Polynucleotide
taatacgactcactatagggtaaggttgcacgctatattagtaagccaagaacagaggagacttggcatgctaatatagaacctggcggcagcgcaaaagatg

SEQ ID NO: 39054 - DNA, 103 bp, Artificial Sequence
  Synthetic Polynucleotide
taatacgactcactatagggttacaccttgttcacgccgctatttggctaaacagaggagatagccaatgagcggcgtgaacctggcggcagcgcaaaagatg

SEQ ID NO: 39055 - DNA, 103 bp, Artificial Sequence
  Synthetic Polynucleotide
taatacgactcactataggggggcaggcgtgatcatcgtgcgcatcgggtaacagaggagaacccgaatggcacgatgaaacctggcggcagcgcaaaagatg

SEQ ID NO: 39056 - DNA, 103 bp, Artificial Sequence
  Synthetic Polynucleotide
taatacgactcactatagggtgtgagagacaatgggattcacgctagcggaacagaggagaccgctaatgtgaatcccaaacctggcggcagcgcaaaagatg

SEQ ID NO: 39057 - DNA, 103 bp, Artificial Sequence
  Synthetic Polynucleotide
taatacgactcactataggggtcctctctggtctgcaacacatcctggagaacagaggagactccagatggtgttgcagaacctggcggcagcgcaaaagatg

SEQ ID NO: 39058 - DNA, 103 bp, Artificial Sequence
  Synthetic Polynucleotide
taatacgactcactataggggcagagatagttgcctctgcaggtcacagaaacagaggagatctgtgatgtgcagaggcaacctggcggcagcgcaaaagatg

SEQ ID NO: 39059 - DNA, 103 bp, Artificial Sequence
  Synthetic Polynucleotide
taatacgactcactatagggcttaactcaagcgacgtagaatactggtctaacagaggagaagaccaatgttctacgtcaacctggcggcagcgcaaaagatg

SEQ ID NO: 39060 - DNA, 103 bp, Artificial Sequence
  Synthetic Polynucleotide
taatacgactcactatagggacgacttggccacggcttactacgaggtccaacagaggagaggacctatgagtaagccgaacctggcggcagcgcaaaagatg

SEQ ID NO: 39061 - DNA, 103 bp, Artificial Sequence
  Synthetic Polynucleotide
taatacgactcactatagggggctgaagttgagtatttgaatggccacagaacagaggagactgtggatgttcaaatacaacctggcggcagcgcaaaagatg

SEQ ID NO: 39062 - DNA, 103 bp, Artificial Sequence
  Synthetic Polynucleotide
taatacgactcactatagggtgccaccaatagccaagtttgagtagctccaacagaggagaggagctatgcaaacttggaacctggcggcagcgcaaaagatg

SEQ ID NO: 39063 - DNA, 103 bp, Artificial Sequence
  Synthetic Polynucleotide
taatacgactcactatagggagtttggacggtaactcaattcgcaactgtaacagaggagaacagttatgaattgagttaacctggcggcagcgcaaaagatg

SEQ ID NO: 39064 - DNA, 103 bp, Artificial Sequence
  Synthetic Polynucleotide
taatacgactcactataggggtgcgcaagaatatatagaaccgttcaaacaacagaggagagtttgaatggttctatataacctggcggcagcgcaaaagatg

SEQ ID NO: 39065 - DNA, 103 bp, Artificial Sequence
  Synthetic Polynucleotide
taatacgactcactataggggggttacgtctaacatgtccgagaaccctaaacagaggagatagggtatgcggacatgtaacctggcggcagcgcaaaagatg

SEQ ID NO: 39066 - DNA, 103 bp, Artificial Sequence
  Synthetic Polynucleotide
taatacgactcactatagggtcctctcgacaacctctttagtccgctaacaacagaggagagttagcatgctaaagaggaacctggcggcagcgcaaaagatg

SEQ ID NO: 39067 - DNA, 103 bp, Artificial Sequence
  Synthetic Polynucleotide
taatacgactcactatagggacataataggagagacattctcatccatacaacagaggagagtatggatgagaatgtctaacctggcggcagcgcaaaagatg

SEQ ID NO: 39068 - DNA, 103 bp, Artificial Sequence
  Synthetic Polynucleotide
taatacgactcactataggggtttcaccaaccggcctgactcacaatcccaacagaggagagggattatgagtcaggccaacctggcggcagcgcaaaagatg

SEQ ID NO: 39069 - DNA, 103 bp, Artificial Sequence
  Synthetic Polynucleotide
taatacgactcactatagggaacattggcgtgtcttttaatccgtgcactaacagaggagaagtgcaatgattaaaagaaacctggcggcagcgcaaaagatg

SEQ ID NO: 39070 - DNA, 103 bp, Artificial Sequence
  Synthetic Polynucleotide
taatacgactcactatagggcgtatgtagacatattagtaaccgtcgctcaacagaggagagagcgaatgttactaataaacctggcggcagcgcaaaagatg

SEQ ID NO: 39071 - DNA, 103 bp, Artificial Sequence
  Synthetic Polynucleotide
taatacgactcactatagggaatacgggtgcctcgcccgcccccgagagtaacagaggagaactctcatgggcgggcgaaacctggcggcagcgcaaaagatg

SEQ ID NO: 39072 - DNA, 103 bp, Artificial Sequence
  Synthetic Polynucleotide
taatacgactcactatagggttctaccatacttctactgatcggctcacgaacagaggagacgtgagatgatcagtagaaacctggcggcagcgcaaaagatg

SEQ ID NO: 39073 - DNA, 103 bp, Artificial Sequence
  Synthetic Polynucleotide
taatacgactcactataggggattaagacaggctcaaggagggaagcggcaacagaggagagccgctatgctccttgagaacctggcggcagcgcaaaagatg

SEQ ID NO: 39074 - DNA, 103 bp, Artificial Sequence
  Synthetic Polynucleotide
taatacgactcactataggggtgtccgatccagacagtcacgggcgtcctaacagaggagaaggacgatggtgactgtcaacctggcggcagcgcaaaagatg

SEQ ID NO: 39075 - DNA, 103 bp, Artificial Sequence
  Synthetic Polynucleotide
taatacgactcactatagggagcttacgaggttctctcacaggtcggttcaacagaggagagaaccgatgtgtgagagaaacctggcggcagcgcaaaagatg

SEQ ID NO: 39076 - DNA, 103 bp, Artificial Sequence
  Synthetic Polynucleotide
taatacgactcactatagggtgcgctacttagtggtgcctgcgcggcttgaacagaggagacaagccatgcaggcaccaaacctggcggcagcgcaaaagatg

SEQ ID NO: 39077 - DNA, 103 bp, Artificial Sequence
  Synthetic Polynucleotide
taatacgactcactatagggagaccgcacttcattgtagacacattctgcaacagaggagagcagaaatggtctacaataacctggcggcagcgcaaaagatg

SEQ ID NO: 39078 - DNA, 103 bp, Artificial Sequence
  Synthetic Polynucleotide
taatacgactcactataggggtttcgtagaagccggccaggtagatgctgaacagaggagacagcatatgcctggccggaacctggcggcagcgcaaaagatg

SEQ ID NO: 39079 - DNA, 103 bp, Artificial Sequence
  Synthetic Polynucleotide
taatacgactcactatagggtggaagggaagtggatagggatgcatccaaaacagaggagattggatatgtccctatccaacctggcggcagcgcaaaagatg

SEQ ID NO: 39080 - DNA, 103 bp, Artificial Sequence
  Synthetic Polynucleotide
taatacgactcactatagggttaatgaaggagcgtgctgtgaggcctcgtaacagaggagaacgaggatgcacagcacgaacctggcggcagcgcaaaagatg

SEQ ID NO: 39081 - DNA, 103 bp, Artificial Sequence
  Synthetic Polynucleotide
taatacgactcactatagggttcggacgtaaaatttagtgcggcctccacaacagaggagagtggagatggcactaaataacctggcggcagcgcaaaagatg

SEQ ID NO: 39082 - DNA, 103 bp, Artificial Sequence
  Synthetic Polynucleotide
taatacgactcactatagggaagttcgtgcactttgtgaagactctctagaacagaggagactagagatgcttcacaaaaacctggcggcagcgcaaaagatg

SEQ ID NO: 39083 - DNA, 103 bp, Artificial Sequence
  Synthetic Polynucleotide
taatacgactcactatagggccctatgggtgcaatcgccggaatacatggaacagaggagaccatgtatgccggcgattaacctggcggcagcgcaaaagatg

SEQ ID NO: 39084 - DNA, 103 bp, Artificial Sequence
  Synthetic Polynucleotide
taatacgactcactatagggacttttgaaccatgctggggccatcattagaacagaggagactaatgatggccccagcaaacctggcggcagcgcaaaagatg

SEQ ID NO: 39085 - DNA, 103 bp, Artificial Sequence
  Synthetic Polynucleotide
taatacgactcactatagggtaccgtacctacaggcttaaattcctgtggaacagaggagaccacagatgtttaagcctaacctggcggcagcgcaaaagatg

SEQ ID NO: 39086 - DNA, 103 bp, Artificial Sequence
  Synthetic Polynucleotide
taatacgactcactatagggaacctctaatgcacgggcgccagctgctagaacagaggagactagcaatgggcgcccgtaacctggcggcagcgcaaaagatg

SEQ ID NO: 39087 - DNA, 103 bp, Artificial Sequence
  Synthetic Polynucleotide
taatacgactcactatagggatacactcctatttgaccattctgtcagctaacagaggagaagctgaatgaatggtcaaaacctggcggcagcgcaaaagatg

SEQ ID NO: 39088 - DNA, 103 bp, Artificial Sequence
  Synthetic Polynucleotide
taatacgactcactatagggcctatgcgtctcacaccgtcctagattttaaacagaggagataaaatatgggacggtgtaacctggcggcagcgcaaaagatg

SEQ ID NO: 39089 - DNA, 103 bp, Artificial Sequence
  Synthetic Polynucleotide
taatacgactcactatagggtcagtgcaattggtaagcaagagatctactaacagaggagaagtagaatgcttgcttacaacctggcggcagcgcaaaagatg

SEQ ID NO: 39090 - DNA, 103 bp, Artificial Sequence
  Synthetic Polynucleotide
taatacgactcactatagggtggcaagagtatataggatcatgagagttaaacagaggagataactcatgtgatcctataacctggcggcagcgcaaaagatg

SEQ ID NO: 39091 - DNA, 103 bp, Artificial Sequence
  Synthetic Polynucleotide
taatacgactcactatagggccaacccttctagtaatgggctcttcgcggaacagaggagaccgcgaatggcccattacaacctggcggcagcgcaaaagatg

SEQ ID NO: 39092 - DNA, 103 bp, Artificial Sequence
  Synthetic Polynucleotide
taatacgactcactatagggaagtactgacggggtgcgattagcgttcgaaacagaggagatcgaacatgaatcgcaccaacctggcggcagcgcaaaagatg

SEQ ID NO: 39093 - DNA, 103 bp, Artificial Sequence
  Synthetic Polynucleotide
taatacgactcactatagggctggatccagcccactggtaagtatggcctaacagaggagaaggccaatgttaccagtgaacctggcggcagcgcaaaagatg

SEQ ID NO: 39094 - DNA, 103 bp, Artificial Sequence
  Synthetic Polynucleotide
taatacgactcactataggggtacacgtacagtggtaaccgggtagtcggaacagaggagaccgactatgcggttaccaaacctggcggcagcgcaaaagatg

SEQ ID NO: 39095 - DNA, 103 bp, Artificial Sequence
  Synthetic Polynucleotide
taatacgactcactataggggagcctacctcggtgtggatagatacattaaacagaggagataatgtatgtatccacacaacctggcggcagcgcaaaagatg

SEQ ID NO: 39096 - DNA, 103 bp, Artificial Sequence
  Synthetic Polynucleotide
taatacgactcactatagggggtcccgcaaagggcggtaagcatgaccataacagaggagaatggtcatgcttaccgccaacctggcggcagcgcaaaagatg

SEQ ID NO: 39097 - DNA, 103 bp, Artificial Sequence
  Synthetic Polynucleotide
taatacgactcactatagggaacttgatctccggacactcgcttttacgaaacagaggagatcgtaaatgcgagtgtccaacctggcggcagcgcaaaagatg

SEQ ID NO: 39098 - DNA, 103 bp, Artificial Sequence
  Synthetic Polynucleotide
taatacgactcactatagggaacagctattagtctaagcccaccgacccgaacagaggagacgggtcatggggcttagaaacctggcggcagcgcaaaagatg

SEQ ID NO: 39099 - DNA, 103 bp, Artificial Sequence
  Synthetic Polynucleotide
taatacgactcactatagggtatagactacaacgactgcatctcggtactaacagaggagaagtaccatgatgcagtcgaacctggcggcagcgcaaaagatg

SEQ ID NO: 39100 - DNA, 103 bp, Artificial Sequence
  Synthetic Polynucleotide
taatacgactcactatagggaaccctacgacgtcggtcgtcatctcgcataacagaggagaatgcgaatggacgaccgaaacctggcggcagcgcaaaagatg

SEQ ID NO: 39101 - DNA, 103 bp, Artificial Sequence
  Synthetic Polynucleotide
taatacgactcactatagggcagtccgaccgagctcgcacaaagactataaacagaggagatatagtatgtgtgcgagcaacctggcggcagcgcaaaagatg

SEQ ID NO: 39102 - DNA, 103 bp, Artificial Sequence
  Synthetic Polynucleotide
taatacgactcactatagggttggcggttgaggagatagcggggtgcccgaacagaggagacgggcaatgcgctatctcaacctggcggcagcgcaaaagatg

SEQ ID NO: 39103 - DNA, 103 bp, Artificial Sequence
  Synthetic Polynucleotide
taatacgactcactataggggtaatgagcgccgtcgcaggaacaggtaccaacagaggagaggtaccatgtcctgcgacaacctggcggcagcgcaaaagatg

SEQ ID NO: 39104 - DNA, 103 bp, Artificial Sequence
  Synthetic Polynucleotide
taatacgactcactatagggaaagtttggcgcctcctgaaactaatactcaacagaggagagagtatatgtttcaggagaacctggcggcagcgcaaaagatg

SEQ ID NO: 39105 - DNA, 103 bp, Artificial Sequence
  Synthetic Polynucleotide
taatacgactcactatagggaggtgcaggtcccatcaatcagcgcctggtaacagaggagaaccaggatgtgattgatgaacctggcggcagcgcaaaagatg

SEQ ID NO: 39106 - DNA, 103 bp, Artificial Sequence
  Synthetic Polynucleotide
taatacgactcactatagggtcggctttggatacgcgcgatagtttccgcaacagaggagagcggaaatgatcgcgcgtaacctggcggcagcgcaaaagatg

SEQ ID NO: 39107 - DNA, 103 bp, Artificial Sequence
  Synthetic Polynucleotide
taatacgactcactatagggagctggtttttgtagggacgcccccatccaaacagaggagatggatgatggcgtccctaaacctggcggcagcgcaaaagatg

SEQ ID NO: 39108 - DNA, 103 bp, Artificial Sequence
  Synthetic Polynucleotide
taatacgactcactatagggcttcatatgatccccttgtgaagtttgtgcaacagaggagagcacaaatgtcacaagggaacctggcggcagcgcaaaagatg

SEQ ID NO: 39109 - DNA, 103 bp, Artificial Sequence
  Synthetic Polynucleotide
taatacgactcactatagggcaagcccagtgtggatgggagcttcccaataacagaggagaattgggatgctcccatccaacctggcggcagcgcaaaagatg

SEQ ID NO: 39110 - DNA, 103 bp, Artificial Sequence
  Synthetic Polynucleotide
taatacgactcactatagggggaatactagatgtgctacgggcctaataaaacagaggagattattaatgccgtagcacaacctggcggcagcgcaaaagatg

SEQ ID NO: 39111 - DNA, 103 bp, Artificial Sequence
  Synthetic Polynucleotide
taatacgactcactatagggcccactcattacctgggggccattcaactaaacagaggagatagttgatgggcccccagaacctggcggcagcgcaaaagatg

SEQ ID NO: 39112 - DNA, 103 bp, Artificial Sequence
  Synthetic Polynucleotide
taatacgactcactatagggtatcgtcgttgtgcattcggaaccctataaaacagaggagattatagatgtccgaatgcaacctggcggcagcgcaaaagatg

SEQ ID NO: 39113 - DNA, 103 bp, Artificial Sequence
  Synthetic Polynucleotide
taatacgactcactatagggcctcgtgctcggttcaccttcaaacagaccaacagaggagaggtctgatggaaggtgaaaacctggcggcagcgcaaaagatg

SEQ ID NO: 39114 - DNA, 103 bp, Artificial Sequence
  Synthetic Polynucleotide
taatacgactcactatagggagacatagcgaacccggtccgcgtacgtataacagaggagaatacgtatgcggaccgggaacctggcggcagcgcaaaagatg

SEQ ID NO: 39115 - DNA, 103 bp, Artificial Sequence
  Synthetic Polynucleotide
taatacgactcactatagggggattttacgctcggatcactacaaagttaaacagaggagataacttatgagtgatccgaacctggcggcagcgcaaaagatg

SEQ ID NO: 39116 - DNA, 103 bp, Artificial Sequence
  Synthetic Polynucleotide
taatacgactcactatagggcacttgctacaatggtcagtgttcgaccttaacagaggagaaaggtcatgcactgaccaaacctggcggcagcgcaaaagatg

SEQ ID NO: 39117 - DNA, 103 bp, Artificial Sequence
  Synthetic Polynucleotide
taatacgactcactatagggcagattgcaaacacggttcgtcgccgtgggaacagaggagacccacgatgacgaaccgtaacctggcggcagcgcaaaagatg

SEQ ID NO: 39118 - DNA, 103 bp, Artificial Sequence
  Synthetic Polynucleotide
taatacgactcactatagggaagtaatggtccaagctaaccgagccgcaaaacagaggagattgcggatgggttagcttaacctggcggcagcgcaaaagatg

SEQ ID NO: 39119 - DNA, 103 bp, Artificial Sequence
  Synthetic Polynucleotide
taatacgactcactatagggatatgggaacacttccaacgcgtggacgtgaacagaggagacacgtcatggcgttggaaaacctggcggcagcgcaaaagatg

SEQ ID NO: 39120 - DNA, 103 bp, Artificial Sequence
  Synthetic Polynucleotide
taatacgactcactatagggggttcctggggcatagttctcgtgtgatacaacagaggagagtatcaatggagaactataacctggcggcagcgcaaaagatg

SEQ ID NO: 39121 - DNA, 103 bp, Artificial Sequence
  Synthetic Polynucleotide
taatacgactcactatagggtcgtccctgcactctctagctttcgtctccaacagaggagaggagacatgagctagagaaacctggcggcagcgcaaaagatg

SEQ ID NO: 39122 - DNA, 103 bp, Artificial Sequence
  Synthetic Polynucleotide
taatacgactcactatagggtcattctaatgaaaagcgcacggcccgccgaacagaggagacggcggatggtgcgctttaacctggcggcagcgcaaaagatg

SEQ ID NO: 39123 - DNA, 103 bp, Artificial Sequence
  Synthetic Polynucleotide
taatacgactcactatagggattgtccggatttggccgacatctccagaaaacagaggagattctggatgtgtcggccaaacctggcggcagcgcaaaagatg

SEQ ID NO: 39124 - DNA, 103 bp, Artificial Sequence
  Synthetic Polynucleotide
taatacgactcactataggggatgagtacctgcctatacgtctagcatgtaacagaggagaacatgcatgacgtataggaacctggcggcagcgcaaaagatg

SEQ ID NO: 39125 - DNA, 103 bp, Artificial Sequence
  Synthetic Polynucleotide
taatacgactcactataggggccatagcctggtagccggcggcgttaaataacagaggagaatttaaatgcgccggctaaacctggcggcagcgcaaaagatg

SEQ ID NO: 39126 - DNA, 103 bp, Artificial Sequence
  Synthetic Polynucleotide
taatacgactcactataggggcctagattcataggatcagaggaactcaaaacagaggagattgagtatgtctgatcctaacctggcggcagcgcaaaagatg

SEQ ID NO: 39127 - DNA, 103 bp, Artificial Sequence
  Synthetic Polynucleotide
taatacgactcactatagggtgtatttgtgtaaaaaagaccaccggtgaaaacagaggagattcaccatgggtctttttaacctggcggcagcgcaaaagatg

SEQ ID NO: 39128 - DNA, 103 bp, Artificial Sequence
  Synthetic Polynucleotide
taatacgactcactatagggtaatccctgtagatatactacgggcgcgtaaacagaggagatacgcgatggtagtatataacctggcggcagcgcaaaagatg

SEQ ID NO: 39129 - DNA, 103 bp, Artificial Sequence
  Synthetic Polynucleotide
taatacgactcactataggggatccagagaccgcattccagttggcacttaacagaggagaaagtgcatgctggaatgcaacctggcggcagcgcaaaagatg

SEQ ID NO: 39130 - DNA, 103 bp, Artificial Sequence
  Synthetic Polynucleotide
taatacgactcactatagggtagggaccgttcgcgcctctacgaataagaaacagaggagatcttatatgtagaggcgcaacctggcggcagcgcaaaagatg

SEQ ID NO: 39131 - DNA, 103 bp, Artificial Sequence
  Synthetic Polynucleotide
taatacgactcactataggggcaccgaggccactttcgttctgtctcttaaacagaggagataagagatggaacgaaagaacctggcggcagcgcaaaagatg

SEQ ID NO: 39132 - DNA, 103 bp, Artificial Sequence
  Synthetic Polynucleotide
taatacgactcactatagggacccctttacaatgttgggtttccgttaacaacagaggagagttaacatgaacccaacaaacctggcggcagcgcaaaagatg

SEQ ID NO: 39133 - DNA, 103 bp, Artificial Sequence
  Synthetic Polynucleotide
taatacgactcactatagggcggagataagtcaggcctcaagcaagataaaacagaggagattatctatgttgaggcctaacctggcggcagcgcaaaagatg

SEQ ID NO: 39134 - DNA, 103 bp, Artificial Sequence
  Synthetic Polynucleotide
taatacgactcactatagggggaagcgaatctacgagaacctgccgaggtaacagaggagaacctcgatgggttctcgtaacctggcggcagcgcaaaagatg

SEQ ID NO: 39135 - DNA, 103 bp, Artificial Sequence
  Synthetic Polynucleotide
taatacgactcactatagggtccgcgccacggccgcagctgatatttctgaacagaggagacagaaaatgcagctgcggaacctggcggcagcgcaaaagatg

SEQ ID NO: 39136 - DNA, 103 bp, Artificial Sequence
  Synthetic Polynucleotide
taatacgactcactataggggtacgtcccccccgcgatacgaagtaggtaaacagaggagatacctaatgcgtatcgcgaacctggcggcagcgcaaaagatg

SEQ ID NO: 39137 - DNA, 103 bp, Artificial Sequence
  Synthetic Polynucleotide
taatacgactcactatagggcacgttggatgacaattttattttgtcgtaaacagaggagatacgacatgataaaattgaacctggcggcagcgcaaaagatg

SEQ ID NO: 39138 - DNA, 103 bp, Artificial Sequence
  Synthetic Polynucleotide
taatacgactcactatagggtgcctggcagagcgtctccctctcgaccctaacagaggagaagggtcatgagggagacgaacctggcggcagcgcaaaagatg

SEQ ID NO: 39139 - DNA, 103 bp, Artificial Sequence
  Synthetic Polynucleotide
taatacgactcactataggggctaatcgggcggaccaaagtgtgggatacaacagaggagagtatccatgactttggtcaacctggcggcagcgcaaaagatg

SEQ ID NO: 39140 - DNA, 103 bp, Artificial Sequence
  Synthetic Polynucleotide
taatacgactcactatagggcggccgccgggaggactctattcgttcgcgaacagaggagacgcgaaatgatagagtccaacctggcggcagcgcaaaagatg

SEQ ID NO: 39141 - DNA, 103 bp, Artificial Sequence
  Synthetic Polynucleotide
taatacgactcactatagggttccgaatgaaaactcgttcaatggataacaacagaggagagttatcatgtgaacgagtaacctggcggcagcgcaaaagatg

SEQ ID NO: 39142 - DNA, 103 bp, Artificial Sequence
  Synthetic Polynucleotide
taatacgactcactatagggaattagtcatctaagcgcggacagataatgaacagaggagacattatatgtccgcgcttaacctggcggcagcgcaaaagatg

SEQ ID NO: 39143 - DNA, 103 bp, Artificial Sequence
  Synthetic Polynucleotide
taatacgactcactatagggctttcactaccttacgagccaggccatgataacagaggagaatcatgatgtggctcgtaaacctggcggcagcgcaaaagatg

SEQ ID NO: 39144 - DNA, 103 bp, Artificial Sequence
  Synthetic Polynucleotide
taatacgactcactatagggagcgactgacagctactatacacttccggcaacagaggagagccggaatggtatagtagaacctggcggcagcgcaaaagatg

SEQ ID NO: 39145 - DNA, 103 bp, Artificial Sequence
  Synthetic Polynucleotide
taatacgactcactataggggctattaactatggagaacataggcgaaccaacagaggagaggttcgatgatgttctccaacctggcggcagcgcaaaagatg

SEQ ID NO: 39146 - DNA, 103 bp, Artificial Sequence
  Synthetic Polynucleotide
taatacgactcactataggggcagactcgcttgaacgttttgtttgtacaaacagaggagatgtacaatgaaaacgttcaacctggcggcagcgcaaaagatg

SEQ ID NO: 39147 - DNA, 103 bp, Artificial Sequence
  Synthetic Polynucleotide
taatacgactcactatagggacgtgaaaattaccattaggtagtcagctaaacagaggagatagctgatgacctaatggaacctggcggcagcgcaaaagatg

SEQ ID NO: 39148 - DNA, 103 bp, Artificial Sequence
  Synthetic Polynucleotide
taatacgactcactatagggcagagtacgaggtgcagttttgaatagttcaacagaggagagaactaatgaaaactgcaaacctggcggcagcgcaaaagatg

SEQ ID NO: 39149 - DNA, 103 bp, Artificial Sequence
  Synthetic Polynucleotide
taatacgactcactatagggattcggcacgttgatgggagaacggtaccgaacagaggagacggtacatgtctcccatcaacctggcggcagcgcaaaagatg

SEQ ID NO: 39150 - DNA, 103 bp, Artificial Sequence
  Synthetic Polynucleotide
taatacgactcactataggggcgagacgaatcgctatctaccctagtcataacagaggagaatgactatggtagatagcaacctggcggcagcgcaaaagatg

SEQ ID NO: 39151 - DNA, 103 bp, Artificial Sequence
  Synthetic Polynucleotide
taatacgactcactatagggtatgcgtgtgatactcaagtcgccccttcaaacagaggagatgaaggatggacttgagtaacctggcggcagcgcaaaagatg

SEQ ID NO: 39152 - DNA, 103 bp, Artificial Sequence
  Synthetic Polynucleotide
taatacgactcactatagggctaattcgatgttctcggctcctacgatgaaacagaggagatcatcgatggagccgagaaacctggcggcagcgcaaaagatg

SEQ ID NO: 39153 - DNA, 103 bp, Artificial Sequence
  Synthetic Polynucleotide
taatacgactcactatagggccaatgaccagagcccgaaaagaagctagcaacagaggagagctagcatgttttcgggcaacctggcggcagcgcaaaagatg

SEQ ID NO: 39154 - DNA, 103 bp, Artificial Sequence
  Synthetic Polynucleotide
taatacgactcactatagggatggcccattcactcaatctcgactagacgaacagaggagacgtctaatggagattgagaacctggcggcagcgcaaaagatg

SEQ ID NO: 39155 - DNA, 103 bp, Artificial Sequence
  Synthetic Polynucleotide
taatacgactcactatagggtcggaaggtagtttgtgacatacaggcttgaacagaggagacaagccatgatgtcacaaaacctggcggcagcgcaaaagatg

SEQ ID NO: 39156 - DNA, 103 bp, Artificial Sequence
  Synthetic Polynucleotide
taatacgactcactatagggataggtccagacctggttgctcaagggcgtaacagaggagaacgcccatgagcaaccagaacctggcggcagcgcaaaagatg

SEQ ID NO: 39157 - DNA, 103 bp, Artificial Sequence
  Synthetic Polynucleotide
taatacgactcactataggggatttcaagttttaccaacctcggttggcaaacagaggagatgccaaatgaggttggtaaacctggcggcagcgcaaaagatg

SEQ ID NO: 39158 - DNA, 103 bp, Artificial Sequence
  Synthetic Polynucleotide
taatacgactcactatagggtcgagataactttagcatagaatcgcctttaacagaggagaaaaggcatgtctatgctaaacctggcggcagcgcaaaagatg

SEQ ID NO: 39159 - DNA, 103 bp, Artificial Sequence
  Synthetic Polynucleotide
taatacgactcactatagggaacgtggttgcgctcaaagattgcactcgtaacagaggagaacgagtatgatctttgagaacctggcggcagcgcaaaagatg

SEQ ID NO: 39160 - DNA, 103 bp, Artificial Sequence
  Synthetic Polynucleotide
taatacgactcactatagggtcttgccgcggatgaatatcaagtgtggataacagaggagaatccacatgtgatattcaaacctggcggcagcgcaaaagatg

SEQ ID NO: 39161 - DNA, 103 bp, Artificial Sequence
  Synthetic Polynucleotide
taatacgactcactatagggacggataactctggcctccgagacatgctgaacagaggagacagcatatgtcggaggccaacctggcggcagcgcaaaagatg

SEQ ID NO: 39162 - DNA, 103 bp, Artificial Sequence
  Synthetic Polynucleotide
taatacgactcactatagggggaggtggaaatggggccaagtttcaagaaaacagaggagattcttgatgcttggccccaacctggcggcagcgcaaaagatg

SEQ ID NO: 39163 - DNA, 103 bp, Artificial Sequence
  Synthetic Polynucleotide
taatacgactcactatagggctttggtgttgtccagagcctatttctagtaacagaggagaactagaatgaggctctggaacctggcggcagcgcaaaagatg

SEQ ID NO: 39164 - DNA, 103 bp, Artificial Sequence
  Synthetic Polynucleotide
taatacgactcactataggggggtcgagctagacgcatcttcgacgaagcaacagaggagagcttcgatgaagatgcgtaacctggcggcagcgcaaaagatg

SEQ ID NO: 39165 - DNA, 103 bp, Artificial Sequence
  Synthetic Polynucleotide
taatacgactcactataggggttggcgaattgagaatacaccaacagttcaacagaggagagaactgatggtgtattctaacctggcggcagcgcaaaagatg

SEQ ID NO: 39166 - DNA, 103 bp, Artificial Sequence
  Synthetic Polynucleotide
taatacgactcactatagggatttgtactggccgcccggcggccgaaacgaacagaggagacgtttcatgcgccgggcgaacctggcggcagcgcaaaagatg

SEQ ID NO: 39167 - DNA, 103 bp, Artificial Sequence
  Synthetic Polynucleotide
taatacgactcactatagggtgaattaaccgaagtgccgtttgaagccttaacagaggagaaaggctatgaacggcactaacctggcggcagcgcaaaagatg

SEQ ID NO: 39168 - DNA, 103 bp, Artificial Sequence
  Synthetic Polynucleotide
taatacgactcactatagggtgtgcgagacttaaaacttcactagtgcacaacagaggagagtgcacatgtgaagttttaacctggcggcagcgcaaaagatg

SEQ ID NO: 39169 - DNA, 103 bp, Artificial Sequence
  Synthetic Polynucleotide
taatacgactcactatagggtgtacctccaaaatgttgatagccggcgtaaacagaggagatacgccatgtatcaacataacctggcggcagcgcaaaagatg

SEQ ID NO: 39170 - DNA, 103 bp, Artificial Sequence
  Synthetic Polynucleotide
taatacgactcactatagggcgttacgagatcagcagcgataccataccaaacagaggagatggtatatgatcgctgctaacctggcggcagcgcaaaagatg

SEQ ID NO: 39171 - DNA, 103 bp, Artificial Sequence
  Synthetic Polynucleotide
taatacgactcactatagggtataagtacaacctacccgcgtacacaagaaacagaggagatcttgtatgcgcgggtagaacctggcggcagcgcaaaagatg

SEQ ID NO: 39172 - DNA, 103 bp, Artificial Sequence
  Synthetic Polynucleotide
taatacgactcactatagggactatcatcccgaacaagttggaccgttttaacagaggagaaaaacgatgcaacttgttaacctggcggcagcgcaaaagatg

SEQ ID NO: 39173 - DNA, 103 bp, Artificial Sequence
  Synthetic Polynucleotide
taatacgactcactatagggaccacccagcgcaaggagcatattccgaggaacagaggagacctcggatgatgctccttaacctggcggcagcgcaaaagatg

SEQ ID NO: 39174 - DNA, 103 bp, Artificial Sequence
  Synthetic Polynucleotide
taatacgactcactatagggccacgcctgccagcgactaggctaattgtaaacagaggagatacaatatgcctagtcgcaacctggcggcagcgcaaaagatg

SEQ ID NO: 39175 - DNA, 103 bp, Artificial Sequence
  Synthetic Polynucleotide
taatacgactcactatagggcgcaggcaatggcttcacccttcggcgtgcaacagaggagagcacgcatgagggtgaagaacctggcggcagcgcaaaagatg

SEQ ID NO: 39176 - DNA, 103 bp, Artificial Sequence
  Synthetic Polynucleotide
taatacgactcactatagggaagcctaattccgtatatttttggcaccataacagaggagaatggtgatgaaaatatacaacctggcggcagcgcaaaagatg

SEQ ID NO: 39177 - DNA, 103 bp, Artificial Sequence
  Synthetic Polynucleotide
taatacgactcactatagggtatcgcacgggacctggtatagccaccaggaacagaggagacctggtatgtataccaggaacctggcggcagcgcaaaagatg

SEQ ID NO: 39178 - DNA, 103 bp, Artificial Sequence
  Synthetic Polynucleotide
taatacgactcactatagggacgaagggcgatgagcgggtgagaggttccaacagaggagaggaaccatgcacccgctcaacctggcggcagcgcaaaagatg

SEQ ID NO: 39179 - DNA, 103 bp, Artificial Sequence
  Synthetic Polynucleotide
taatacgactcactatagggtccgctctgggttctataataccagcggttaacagaggagaaaccgcatgtattatagaaacctggcggcagcgcaaaagatg

SEQ ID NO: 39180 - DNA, 103 bp, Artificial Sequence
  Synthetic Polynucleotide
taatacgactcactatagggctgagttccttagtgtcgtggagatcacaaaacagaggagattgtgaatgccacgacacaacctggcggcagcgcaaaagatg

SEQ ID NO: 39181 - DNA, 103 bp, Artificial Sequence
  Synthetic Polynucleotide
taatacgactcactatagggtggtataaattatattactggcgacgcgaaaacagaggagattcgcgatgccagtaataaacctggcggcagcgcaaaagatg

SEQ ID NO: 39182 - DNA, 103 bp, Artificial Sequence
  Synthetic Polynucleotide
taatacgactcactatagggggcattagggaaacactgaaagaggggtgcaacagaggagagcacccatgtttcagtgtaacctggcggcagcgcaaaagatg

SEQ ID NO: 39183 - DNA, 103 bp, Artificial Sequence
  Synthetic Polynucleotide
taatacgactcactataggggggggacgattgcatcccaccgtgactgtaaacagaggagatacagtatgggtgggatgaacctggcggcagcgcaaaagatg

SEQ ID NO: 39184 - DNA, 103 bp, Artificial Sequence
  Synthetic Polynucleotide
taatacgactcactataggggcgtaactgatatgtctcagcttcaccttcaacagaggagagaaggtatggctgagacaaacctggcggcagcgcaaaagatg

SEQ ID NO: 39185 - DNA, 103 bp, Artificial Sequence
  Synthetic Polynucleotide
taatacgactcactatagggttctcgtagtcgattgccggcccatcaaagaacagaggagactttgaatggccggcaataacctggcggcagcgcaaaagatg

SEQ ID NO: 39186 - DNA, 103 bp, Artificial Sequence
  Synthetic Polynucleotide
taatacgactcactatagggacgggctacccttagccccctttcaaagcgaacagaggagacgctttatgagggggctaaacctggcggcagcgcaaaagatg

SEQ ID NO: 39187 - DNA, 103 bp, Artificial Sequence
  Synthetic Polynucleotide
taatacgactcactatagggttttagtgtagtccgaggaaccgactgcccaacagaggagagggcagatggttcctcggaacctggcggcagcgcaaaagatg

SEQ ID NO: 39188 - DNA, 103 bp, Artificial Sequence
  Synthetic Polynucleotide
taatacgactcactatagggttatatcttagagggtcaatcggagcacgcaacagaggagagcgtgcatggattgacccaacctggcggcagcgcaaaagatg

SEQ ID NO: 39189 - DNA, 103 bp, Artificial Sequence
  Synthetic Polynucleotide
taatacgactcactatagggatatcaggctgttgaactacccaatcaaataacagaggagaatttgaatgggtagttcaaacctggcggcagcgcaaaagatg

SEQ ID NO: 39190 - DNA, 103 bp, Artificial Sequence
  Synthetic Polynucleotide
taatacgactcactatagggcatgtcagagaatgaagcgctataattcggaacagaggagaccgaatatgagcgcttcaaacctggcggcagcgcaaaagatg

SEQ ID NO: 39191 - DNA, 103 bp, Artificial Sequence
  Synthetic Polynucleotide
taatacgactcactatagggatcggtcatcgtttagaacgcgggacggaaaacagaggagattccgtatggcgttctaaaacctggcggcagcgcaaaagatg

SEQ ID NO: 39192 - DNA, 103 bp, Artificial Sequence
  Synthetic Polynucleotide
taatacgactcactatagggtatcggatcggcaacacgcgcaagccaactaacagaggagaagttggatggcgcgtgttaacctggcggcagcgcaaaagatg

SEQ ID NO: 39193 - DNA, 103 bp, Artificial Sequence
  Synthetic Polynucleotide
taatacgactcactatagggacttcaaatccggtggtcacgtccatcctaaacagaggagataggatatgcgtgaccacaacctggcggcagcgcaaaagatg

SEQ ID NO: 39194 - DNA, 103 bp, Artificial Sequence
  Synthetic Polynucleotide
taatacgactcactatagggtagcactccggtaaaaagtgggtgaattggaacagaggagaccaattatgccactttttaacctggcggcagcgcaaaagatg

SEQ ID NO: 39195 - DNA, 103 bp, Artificial Sequence
  Synthetic Polynucleotide
taatacgactcactataggggtttatgtcatttaaattagagccacccccaacagaggagagggggtatgtctaatttaaacctggcggcagcgcaaaagatg

SEQ ID NO: 39196 - DNA, 103 bp, Artificial Sequence
  Synthetic Polynucleotide
taatacgactcactatagggacggtttaggggtgaataaatgcaaaacttaacagaggagaaagtttatgatttattcaaacctggcggcagcgcaaaagatg

SEQ ID NO: 39197 - DNA, 103 bp, Artificial Sequence
  Synthetic Polynucleotide
taatacgactcactatagggggatgacgcaatggtggcccagtacgaacgaacagaggagacgttcgatgtgggccaccaacctggcggcagcgcaaaagatg

SEQ ID NO: 39198 - DNA, 103 bp, Artificial Sequence
  Synthetic Polynucleotide
taatacgactcactataggggacgcagtgagtgggaacacggtcggtattaacagaggagaaataccatgcgtgttcccaacctggcggcagcgcaaaagatg

SEQ ID NO: 39199 - DNA, 103 bp, Artificial Sequence
  Synthetic Polynucleotide
taatacgactcactatagggggtcgtacagagggccgatccccaagagtaaacagaggagatactctatgggatcggccaacctggcggcagcgcaaaagatg

SEQ ID NO: 39200 - DNA, 103 bp, Artificial Sequence
  Synthetic Polynucleotide
taatacgactcactatagggaacaagcgacaacaactcatatctaagacgaacagaggagacgtcttatgtatgagttgaacctggcggcagcgcaaaagatg

SEQ ID NO: 39201 - DNA, 103 bp, Artificial Sequence
  Synthetic Polynucleotide
taatacgactcactataggggtgagtgatctcggtggctaatctttgaaaaacagaggagatttcaaatgttagccaccaacctggcggcagcgcaaaagatg

SEQ ID NO: 39202 - DNA, 103 bp, Artificial Sequence
  Synthetic Polynucleotide
taatacgactcactatagggttctacatgcggagcgagttaccgatgtcgaacagaggagacgacatatgtaactcgctaacctggcggcagcgcaaaagatg

SEQ ID NO: 39203 - DNA, 103 bp, Artificial Sequence
  Synthetic Polynucleotide
taatacgactcactatagggccgggtatgacacagggtgtacgtcgccgaaacagaggagatcggcgatgtacaccctgaacctggcggcagcgcaaaagatg

SEQ ID NO: 39204 - DNA, 103 bp, Artificial Sequence
  Synthetic Polynucleotide
taatacgactcactatagggtctccgactgaaccttcgcgtcggctgcacaacagaggagagtgcagatgacgcgaaggaacctggcggcagcgcaaaagatg

SEQ ID NO: 39205 - DNA, 103 bp, Artificial Sequence
  Synthetic Polynucleotide
taatacgactcactatagggagggtcagttacgttcgtgaaaaagagggcaacagaggagagccctcatgttcacgaacaacctggcggcagcgcaaaagatg

SEQ ID NO: 39206 - DNA, 103 bp, Artificial Sequence
  Synthetic Polynucleotide
taatacgactcactatagggttatcgaccggctatacccgccccggtttaaacagaggagataaaccatggcgggtataaacctggcggcagcgcaaaagatg

SEQ ID NO: 39207 - DNA, 103 bp, Artificial Sequence
  Synthetic Polynucleotide
taatacgactcactatagggagaggtaggacatttacacatcctcaccccaacagaggagaggggtgatgatgtgtaaaaacctggcggcagcgcaaaagatg

SEQ ID NO: 39208 - DNA, 103 bp, Artificial Sequence
  Synthetic Polynucleotide
taatacgactcactatagggcgaatcccaccccgggcaataataccatttaacagaggagaaaatggatgtattgcccgaacctggcggcagcgcaaaagatg

SEQ ID NO: 39209 - DNA, 103 bp, Artificial Sequence
  Synthetic Polynucleotide
taatacgactcactatagggtttcgtctgagacagaggtgtggacctcagaacagaggagactgaggatgacacctctgaacctggcggcagcgcaaaagatg

SEQ ID NO: 39210 - DNA, 103 bp, Artificial Sequence
  Synthetic Polynucleotide
taatacgactcactatagggatcttatatacactatcagtccccgtgtgaaacagaggagatcacacatggactgatagaacctggcggcagcgcaaaagatg

SEQ ID NO: 39211 - DNA, 103 bp, Artificial Sequence
  Synthetic Polynucleotide
taatacgactcactatagggcctggcggtcttcgcctccctcacgtcggaaacagaggagatccgacatgagggaggcgaacctggcggcagcgcaaaagatg

SEQ ID NO: 39212 - DNA, 103 bp, Artificial Sequence
  Synthetic Polynucleotide
taatacgactcactatagggcggtcctctcgctgggccgcgcaagctcgtaacagaggagaacgagcatgcgcggcccaaacctggcggcagcgcaaaagatg

SEQ ID NO: 39213 - DNA, 103 bp, Artificial Sequence
  Synthetic Polynucleotide
taatacgactcactatagggcttgcttatcttacttgtatagaggaccgaaacagaggagatcggtcatgtatacaagtaacctggcggcagcgcaaaagatg

SEQ ID NO: 39214 - DNA, 103 bp, Artificial Sequence
  Synthetic Polynucleotide
taatacgactcactataggggtagtaggattaaaccccggagagtaacttaacagaggagaaagttaatgtccggggttaacctggcggcagcgcaaaagatg

SEQ ID NO: 39215 - DNA, 103 bp, Artificial Sequence
  Synthetic Polynucleotide
taatacgactcactatagggcctgtggtgtttctaactctgtagtaaccgaacagaggagacggttaatgcagagttagaacctggcggcagcgcaaaagatg

SEQ ID NO: 39216 - DNA, 103 bp, Artificial Sequence
  Synthetic Polynucleotide
taatacgactcactataggggcctcgggttaattatttcaagcgcggcttaacagaggagaaagccgatgttgaaataaaacctggcggcagcgcaaaagatg

SEQ ID NO: 39217 - DNA, 103 bp, Artificial Sequence
  Synthetic Polynucleotide
taatacgactcactataggggtccactgttactcttaaacaggcctgcacaacagaggagagtgcagatgtgtttaagaaacctggcggcagcgcaaaagatg

SEQ ID NO: 39218 - DNA, 103 bp, Artificial Sequence
  Synthetic Polynucleotide
taatacgactcactatagggaagtccgacccccgttccgcggattgggataacagaggagaatcccaatgcgcggaacgaacctggcggcagcgcaaaagatg

SEQ ID NO: 39219 - DNA, 103 bp, Artificial Sequence
  Synthetic Polynucleotide
taatacgactcactatagggtggatcatataactattaccagtaaaactgaacagaggagacagtttatgtggtaatagaacctggcggcagcgcaaaagatg

SEQ ID NO: 39220 - DNA, 103 bp, Artificial Sequence
  Synthetic Polynucleotide
taatacgactcactatagggcggaagaatgccatcggtattagaagattaaacagaggagataatctatgaataccgataacctggcggcagcgcaaaagatg

SEQ ID NO: 39221 - DNA, 103 bp, Artificial Sequence
  Synthetic Polynucleotide
taatacgactcactatagggcggggtagcgaggattgactctactattggaacagaggagaccaataatggagtcaatcaacctggcggcagcgcaaaagatg

SEQ ID NO: 39222 - DNA, 103 bp, Artificial Sequence
  Synthetic Polynucleotide
taatacgactcactatagggttctagagaaaggaactggcgcaattgtgtaacagaggagaacacaaatgcgccagttcaacctggcggcagcgcaaaagatg

SEQ ID NO: 39223 - DNA, 103 bp, Artificial Sequence
  Synthetic Polynucleotide
taatacgactcactatagggaattcgactcgattctctaattgtccacacaacagaggagagtgtggatgattagagaaaacctggcggcagcgcaaaagatg

SEQ ID NO: 39224 - DNA, 103 bp, Artificial Sequence
  Synthetic Polynucleotide
taatacgactcactatagggagtccgatctacttaggagaacatcggtgcaacagaggagagcaccgatgttctcctaaaacctggcggcagcgcaaaagatg

SEQ ID NO: 39225 - DNA, 103 bp, Artificial Sequence
  Synthetic Polynucleotide
taatacgactcactatagggcgaatatgtatggaacactagcaaagctctaacagaggagaagagctatgctagtgttcaacctggcggcagcgcaaaagatg

SEQ ID NO: 39226 - DNA, 103 bp, Artificial Sequence
  Synthetic Polynucleotide
taatacgactcactatagggaattgttattgttatggtataactagttcaaacagaggagatgaactatgtataccataaacctggcggcagcgcaaaagatg

SEQ ID NO: 39227 - DNA, 103 bp, Artificial Sequence
  Synthetic Polynucleotide
taatacgactcactatagggcttggatcctgtcgcaggtgctgctgactgaacagaggagacagtcaatggcacctgcgaacctggcggcagcgcaaaagatg

SEQ ID NO: 39228 - DNA, 103 bp, Artificial Sequence
  Synthetic Polynucleotide
taatacgactcactatagggtgatgcccccatccacctataccggttgggaacagaggagacccaacatgtataggtggaacctggcggcagcgcaaaagatg

SEQ ID NO: 39229 - DNA, 103 bp, Artificial Sequence
  Synthetic Polynucleotide
taatacgactcactatagggtatacgctcgatcacccggtgtctcacgggaacagaggagacccgtgatgcaccgggtgaacctggcggcagcgcaaaagatg

SEQ ID NO: 39230 - DNA, 103 bp, Artificial Sequence
  Synthetic Polynucleotide
taatacgactcactatagggaatgtagcggtacagaagatcgtgaagggcaacagaggagagcccttatggatcttctgaacctggcggcagcgcaaaagatg

SEQ ID NO: 39231 - DNA, 103 bp, Artificial Sequence
  Synthetic Polynucleotide
taatacgactcactataggggtatgaagcaagtaccgtatagtgggatacaacagaggagagtatccatgtatacggtaaacctggcggcagcgcaaaagatg

SEQ ID NO: 39232 - DNA, 103 bp, Artificial Sequence
  Synthetic Polynucleotide
taatacgactcactataggggtcggtgagccgtagccaaaaccgaatgcaaacagaggagatgcattatgttttggctaaacctggcggcagcgcaaaagatg

SEQ ID NO: 39233 - DNA, 103 bp, Artificial Sequence
  Synthetic Polynucleotide
taatacgactcactatagggtaatatcttcccatacactctaaattacggaacagaggagaccgtaaatgagagtgtataacctggcggcagcgcaaaagatg

SEQ ID NO: 39234 - DNA, 103 bp, Artificial Sequence
  Synthetic Polynucleotide
taatacgactcactatagggccctcccagaccggtgaaagcgttcctgttaacagaggagaaacaggatggctttcaccaacctggcggcagcgcaaaagatg

SEQ ID NO: 39235 - DNA, 103 bp, Artificial Sequence
  Synthetic Polynucleotide
taatacgactcactatagggtctgtgagattaggtatagaccatgacaggaacagaggagacctgtcatggtctataccaacctggcggcagcgcaaaagatg

SEQ ID NO: 39236 - DNA, 103 bp, Artificial Sequence
  Synthetic Polynucleotide
taatacgactcactataggggcgggtgtcgcctgctctccgcaaaaatctaacagaggagaagatttatgcggagagcaaacctggcggcagcgcaaaagatg

SEQ ID NO: 39237 - DNA, 103 bp, Artificial Sequence
  Synthetic Polynucleotide
taatacgactcactatagggtccgtaattgagttttgataacacgcggaaaacagaggagattccgcatgttatcaaaaaacctggcggcagcgcaaaagatg

SEQ ID NO: 39238 - DNA, 103 bp, Artificial Sequence
  Synthetic Polynucleotide
taatacgactcactatagggtcgaacaccctcccctctttgacagtcatgaacagaggagacatgacatgcaaagagggaacctggcggcagcgcaaaagatg

SEQ ID NO: 39239 - DNA, 103 bp, Artificial Sequence
  Synthetic Polynucleotide
taatacgactcactatagggctttcgtcccaatagaatattcgggtccgaaacagaggagatcggacatgaatattctaaacctggcggcagcgcaaaagatg

SEQ ID NO: 39240 - DNA, 103 bp, Artificial Sequence
  Synthetic Polynucleotide
taatacgactcactatagggacgtaagttggccatgcaggttactataataacagaggagaattataatgacctgcatgaacctggcggcagcgcaaaagatg

SEQ ID NO: 39241 - DNA, 103 bp, Artificial Sequence
  Synthetic Polynucleotide
taatacgactcactataggggcgccggtaatgctagacgcttcgcttatcaacagaggagagataagatgagcgtctagaacctggcggcagcgcaaaagatg

SEQ ID NO: 39242 - DNA, 103 bp, Artificial Sequence
  Synthetic Polynucleotide
taatacgactcactatagggtcgtatgtcaagggggtatttcccatgtcaaacagaggagatgacatatgaaataccccaacctggcggcagcgcaaaagatg

SEQ ID NO: 39243 - DNA, 103 bp, Artificial Sequence
  Synthetic Polynucleotide
taatacgactcactatagggatctgcgttaatagtaatccggagatgatgaacagaggagacatcatatgcggattactaacctggcggcagcgcaaaagatg

SEQ ID NO: 39244 - DNA, 103 bp, Artificial Sequence
  Synthetic Polynucleotide
taatacgactcactatagggtgatagacacggccacgataatattagaccaacagaggagaggtctaatgttatcgtggaacctggcggcagcgcaaaagatg

SEQ ID NO: 39245 - DNA, 103 bp, Artificial Sequence
  Synthetic Polynucleotide
taatacgactcactatagggcaggatgcgatacacgcgtctgggacatctaacagaggagaagatgtatgagacgcgtgaacctggcggcagcgcaaaagatg

SEQ ID NO: 39246 - DNA, 103 bp, Artificial Sequence
  Synthetic Polynucleotide
taatacgactcactatagggcgaaacacatctttgggagcaagtcttaccaacagaggagaggtaagatgtgctcccaaaacctggcggcagcgcaaaagatg

SEQ ID NO: 39247 - DNA, 103 bp, Artificial Sequence
  Synthetic Polynucleotide
taatacgactcactataggggcagtggaatgcaaggtcgggaagggcgtgaacagaggagacacgccatgcccgaccttaacctggcggcagcgcaaaagatg

SEQ ID NO: 39248 - DNA, 103 bp, Artificial Sequence
  Synthetic Polynucleotide
taatacgactcactatagggtcatcgactgtcaacttatacccctttcctaacagaggagaaggaaaatggtataagttaacctggcggcagcgcaaaagatg

SEQ ID NO: 39249 - DNA, 103 bp, Artificial Sequence
  Synthetic Polynucleotide
taatacgactcactatagggacgtagaagtaaaatgagacgccgtaacggaacagaggagaccgttaatgcgtctcattaacctggcggcagcgcaaaagatg

SEQ ID NO: 39250 - DNA, 103 bp, Artificial Sequence
  Synthetic Polynucleotide
taatacgactcactatagggatacagtcagtatccatgatccatgcgacgaacagaggagacgtcgcatggatcatggaaacctggcggcagcgcaaaagatg

SEQ ID NO: 39251 - DNA, 103 bp, Artificial Sequence
  Synthetic Polynucleotide
taatacgactcactatagggccgtttgggtggccttgtcgtaggaattgcaacagaggagagcaattatgacgacaaggaacctggcggcagcgcaaaagatg

SEQ ID NO: 39252 - DNA, 103 bp, Artificial Sequence
  Synthetic Polynucleotide
taatacgactcactatagggacaaaccaatttagttaggtgagccgaggaaacagaggagatcctcgatgcacctaactaacctggcggcagcgcaaaagatg

SEQ ID NO: 39253 - DNA, 103 bp, Artificial Sequence
  Synthetic Polynucleotide
taatacgactcactataggggatcaggatcagaacctgggagtaccaaccaacagaggagaggttggatgtcccaggttaacctggcggcagcgcaaaagatg

SEQ ID NO: 39254 - DNA, 103 bp, Artificial Sequence
  Synthetic Polynucleotide
taatacgactcactatagggaaccggccatacccgactccaccaagcgacaacagaggagagtcgctatgtggagtcggaacctggcggcagcgcaaaagatg

SEQ ID NO: 39255 - DNA, 103 bp, Artificial Sequence
  Synthetic Polynucleotide
taatacgactcactatagggggacggtgaacgtggctttaattttagcacaacagaggagagtgctaatgttaaagccaaacctggcggcagcgcaaaagatg

SEQ ID NO: 39256 - DNA, 103 bp, Artificial Sequence
  Synthetic Polynucleotide
taatacgactcactatagggataccccctacgggggtgcaatatccttctaacagaggagaagaaggatgttgcaccccaacctggcggcagcgcaaaagatg

SEQ ID NO: 39257 - DNA, 103 bp, Artificial Sequence
  Synthetic Polynucleotide
taatacgactcactataggggggttattattcgtggtcgaggtcacatggaacagaggagaccatgtatgctcgaccacaacctggcggcagcgcaaaagatg

SEQ ID NO: 39258 - DNA, 103 bp, Artificial Sequence
  Synthetic Polynucleotide
taatacgactcactatagggttgaattgggccgttaatatcccgaaagagaacagaggagactctttatggatattaacaacctggcggcagcgcaaaagatg

SEQ ID NO: 39259 - DNA, 103 bp, Artificial Sequence
  Synthetic Polynucleotide
taatacgactcactatagggaaaatgacaagggttgcaaaattacaacttaacagaggagaaagttgatgttttgcaacaacctggcggcagcgcaaaagatg

SEQ ID NO: 39260 - DNA, 103 bp, Artificial Sequence
  Synthetic Polynucleotide
taatacgactcactatagggcccccacgattgatataattggtcgtttctaacagaggagaagaaacatgcaattatataacctggcggcagcgcaaaagatg

SEQ ID NO: 39261 - DNA, 103 bp, Artificial Sequence
  Synthetic Polynucleotide
taatacgactcactataggggagactcgcatcctcgtggctctccgaattaacagaggagaaattcgatgagccacgagaacctggcggcagcgcaaaagatg

SEQ ID NO: 39262 - DNA, 103 bp, Artificial Sequence
  Synthetic Polynucleotide
taatacgactcactatagggcgacgtgcttgtagtatatggcccgcgctgaacagaggagacagcgcatgccatatactaacctggcggcagcgcaaaagatg

SEQ ID NO: 39263 - DNA, 103 bp, Artificial Sequence
  Synthetic Polynucleotide
taatacgactcactatagggagaagtgaacgtagcatcactagaacgctgaacagaggagacagcgtatgagtgatgctaacctggcggcagcgcaaaagatg

SEQ ID NO: 39264 - DNA, 103 bp, Artificial Sequence
  Synthetic Polynucleotide
taatacgactcactatagggaggtaacggtttcaagctgctggtaactagaacagaggagactagttatgagcagcttgaacctggcggcagcgcaaaagatg

SEQ ID NO: 39265 - DNA, 103 bp, Artificial Sequence
  Synthetic Polynucleotide
taatacgactcactatagggtttcccttcccgtaacaactattttcaggcaacagaggagagcctgaatgtagttgttaaacctggcggcagcgcaaaagatg

SEQ ID NO: 39266 - DNA, 103 bp, Artificial Sequence
  Synthetic Polynucleotide
taatacgactcactatagggtcattccagaattaatgatgaaaatgcctgaacagaggagacaggcaatgtcatcattaaacctggcggcagcgcaaaagatg

SEQ ID NO: 39267 - DNA, 103 bp, Artificial Sequence
  Synthetic Polynucleotide
taatacgactcactatagggggccatttaggcgcaatcgcactggcatggaacagaggagaccatgcatgtgcgattgcaacctggcggcagcgcaaaagatg

SEQ ID NO: 39268 - DNA, 103 bp, Artificial Sequence
  Synthetic Polynucleotide
taatacgactcactataggggataagttacccccggattgaccttttgcgaacagaggagacgcaaaatgtcaatccggaacctggcggcagcgcaaaagatg

SEQ ID NO: 39269 - DNA, 103 bp, Artificial Sequence
  Synthetic Polynucleotide
taatacgactcactatagggagtacatgttttaagctctgtgtcccgactaacagaggagaagtcggatgacagagcttaacctggcggcagcgcaaaagatg

SEQ ID NO: 39270 - DNA, 103 bp, Artificial Sequence
  Synthetic Polynucleotide
taatacgactcactataggggatcgctccggtggagccccctcatgacgcaacagaggagagcgtcaatggggggctccaacctggcggcagcgcaaaagatg

SEQ ID NO: 39271 - DNA, 103 bp, Artificial Sequence
  Synthetic Polynucleotide
taatacgactcactatagggttaggttagccgcattaaaagctgtttgcaaacagaggagatgcaaaatgcttttaatgaacctggcggcagcgcaaaagatg

SEQ ID NO: 39272 - DNA, 103 bp, Artificial Sequence
  Synthetic Polynucleotide
taatacgactcactatagggcgctttatgtctccttcgtgttagctaaataacagaggagaatttagatgacacgaaggaacctggcggcagcgcaaaagatg

SEQ ID NO: 39273 - DNA, 103 bp, Artificial Sequence
  Synthetic Polynucleotide
taatacgactcactatagggtcgcgcgctgcttagctattccattcatcgaacagaggagacgatgaatggaatagctaaacctggcggcagcgcaaaagatg

SEQ ID NO: 39274 - DNA, 103 bp, Artificial Sequence
  Synthetic Polynucleotide
taatacgactcactataggggttataagcaaatgttctgggtgtgaggacaacagaggagagtcctcatgcccagaacaaacctggcggcagcgcaaaagatg

SEQ ID NO: 39275 - DNA, 103 bp, Artificial Sequence
  Synthetic Polynucleotide
taatacgactcactatagggacgtacgaggatgaatcccatatctgcaagaacagaggagacttgcaatgatgggattcaacctggcggcagcgcaaaagatg

SEQ ID NO: 39276 - DNA, 103 bp, Artificial Sequence
  Synthetic Polynucleotide
taatacgactcactataggggatgactgtccgtaggacatacgtacccacaacagaggagagtgggtatgtatgtcctaaacctggcggcagcgcaaaagatg

SEQ ID NO: 39277 - DNA, 103 bp, Artificial Sequence
  Synthetic Polynucleotide
taatacgactcactatagggatacacaaacaaattagactgacttaaaacaacagaggagagttttaatgcagtctaataacctggcggcagcgcaaaagatg

SEQ ID NO: 39278 - DNA, 103 bp, Artificial Sequence
  Synthetic Polynucleotide
taatacgactcactatagggaattaagatgtaaccacgtatcttaatactaacagaggagaagtattatgatacgtggtaacctggcggcagcgcaaaagatg

SEQ ID NO: 39279 - DNA, 103 bp, Artificial Sequence
  Synthetic Polynucleotide
taatacgactcactatagggcactttatcatccttgtcattccggtgtaaaacagaggagattacacatgaatgacaagaacctggcggcagcgcaaaagatg

SEQ ID NO: 39280 - DNA, 103 bp, Artificial Sequence
  Synthetic Polynucleotide
taatacgactcactatagggcttgacgcacctaattgtgactcaaggcacaacagaggagagtgcctatggtcacaattaacctggcggcagcgcaaaagatg

SEQ ID NO: 39281 - DNA, 103 bp, Artificial Sequence
  Synthetic Polynucleotide
taatacgactcactataggggagtgacgcgaaacggtaagtgaagctcataacagaggagaatgagcatgacttaccgtaacctggcggcagcgcaaaagatg

SEQ ID NO: 39282 - DNA, 103 bp, Artificial Sequence
  Synthetic Polynucleotide
taatacgactcactatagggtattaaagaggagtgtggtttctgggcatgaacagaggagacatgccatgaaaccacacaacctggcggcagcgcaaaagatg

SEQ ID NO: 39283 - DNA, 103 bp, Artificial Sequence
  Synthetic Polynucleotide
taatacgactcactatagggccgggggtacaaatatcgggtcgcaccgccaacagaggagaggcggtatgacccgatataacctggcggcagcgcaaaagatg

SEQ ID NO: 39284 - DNA, 103 bp, Artificial Sequence
  Synthetic Polynucleotide
taatacgactcactatagggtccaacaaaccgcttcacgtgacccttctcaacagaggagagagaagatgcacgtgaagaacctggcggcagcgcaaaagatg

SEQ ID NO: 39285 - DNA, 103 bp, Artificial Sequence
  Synthetic Polynucleotide
taatacgactcactatagggtctggcggcccgtttgaccacccatggcctaacagaggagaaggccaatggtggtcaaaaacctggcggcagcgcaaaagatg

SEQ ID NO: 39286 - DNA, 103 bp, Artificial Sequence
  Synthetic Polynucleotide
taatacgactcactataggggaggctctcgccagtcggctgtcgagcagcaacagaggagagctgctatgcagccgactaacctggcggcagcgcaaaagatg

SEQ ID NO: 39287 - DNA, 103 bp, Artificial Sequence
  Synthetic Polynucleotide
taatacgactcactatagggtaattcatgacccgatgactttttgaattgaacagaggagacaattcatgaagtcatcgaacctggcggcagcgcaaaagatg

SEQ ID NO: 39288 - DNA, 103 bp, Artificial Sequence
  Synthetic Polynucleotide
taatacgactcactataggggttactcggattgttcccaagttgaaacctaacagaggagaaggtttatgcttgggaacaacctggcggcagcgcaaaagatg

SEQ ID NO: 39289 - DNA, 103 bp, Artificial Sequence
  Synthetic Polynucleotide
taatacgactcactatagggacagccgaccttggcggcaatatcacaatcaacagaggagagattgtatgattgccgccaacctggcggcagcgcaaaagatg

SEQ ID NO: 39290 - DNA, 103 bp, Artificial Sequence
  Synthetic Polynucleotide
taatacgactcactatagggtttgcgccggagtccctgtcccgccccttcaacagaggagagaagggatgggacagggaaacctggcggcagcgcaaaagatg

SEQ ID NO: 39291 - DNA, 103 bp, Artificial Sequence
  Synthetic Polynucleotide
taatacgactcactataggggatgctctagctaagtgcaggaatgactgcaacagaggagagcagtcatgcctgcacttaacctggcggcagcgcaaaagatg

SEQ ID NO: 39292 - DNA, 103 bp, Artificial Sequence
  Synthetic Polynucleotide
taatacgactcactatagggcgataataggaagggttaagattgtccaggaacagaggagacctggaatgtcttaacccaacctggcggcagcgcaaaagatg

SEQ ID NO: 39293 - DNA, 103 bp, Artificial Sequence
  Synthetic Polynucleotide
taatacgactcactatagggtctctagaacgattgcgcacttaatgatacaacagaggagagtatcaatgagtgcgcaaaacctggcggcagcgcaaaagatg

SEQ ID NO: 39294 - DNA, 103 bp, Artificial Sequence
  Synthetic Polynucleotide
taatacgactcactatagggcaattataaacttttccatatgtgacaggtaacagaggagaacctgtatgatatggaaaaacctggcggcagcgcaaaagatg

SEQ ID NO: 39295 - DNA, 103 bp, Artificial Sequence
  Synthetic Polynucleotide
taatacgactcactatagggttatgggctatacgctcccatcagaaccgcaacagaggagagcggttatgatgggagcgaacctggcggcagcgcaaaagatg

SEQ ID NO: 39296 - DNA, 103 bp, Artificial Sequence
  Synthetic Polynucleotide
taatacgactcactatagggtcaaccaggctgtaacctgcgcagcggtgtaacagaggagaacaccgatgcgcaggttaaacctggcggcagcgcaaaagatg

SEQ ID NO: 39297 - DNA, 103 bp, Artificial Sequence
  Synthetic Polynucleotide
taatacgactcactatagggcaatacccggaccaccatgaaagaccgtcaaacagaggagatgacggatgttcatggtgaacctggcggcagcgcaaaagatg

SEQ ID NO: 39298 - DNA, 103 bp, Artificial Sequence
  Synthetic Polynucleotide
taatacgactcactatagggctcagccgattggcgatggtgtggtcactaaacagaggagatagtgaatgcaccatcgcaacctggcggcagcgcaaaagatg

SEQ ID NO: 39299 - DNA, 103 bp, Artificial Sequence
  Synthetic Polynucleotide
taatacgactcactataggggcctcatgccaccgagcatatgactaatggaacagaggagaccattaatgatatgctcgaacctggcggcagcgcaaaagatg

SEQ ID NO: 39300 - DNA, 103 bp, Artificial Sequence
  Synthetic Polynucleotide
taatacgactcactatagggaaaaatcgcccctcgagatcgcaatccgctaacagaggagaagcggaatgcgatctcgaaacctggcggcagcgcaaaagatg

SEQ ID NO: 39301 - DNA, 103 bp, Artificial Sequence
  Synthetic Polynucleotide
taatacgactcactatagggtggtcgcttgaagatacggacagctagaataacagaggagaattctaatggtccgtatcaacctggcggcagcgcaaaagatg

SEQ ID NO: 39302 - DNA, 103 bp, Artificial Sequence
  Synthetic Polynucleotide
taatacgactcactatagggacgaaacacgcgcgttctattgccaacgctaacagaggagaagcgttatgaatagaacgaacctggcggcagcgcaaaagatg

SEQ ID NO: 39303 - DNA, 103 bp, Artificial Sequence
  Synthetic Polynucleotide
taatacgactcactatagggtgctcgatccgatgcccgctgttaacttaaaacagaggagattaagtatgcagcgggcaaacctggcggcagcgcaaaagatg

SEQ ID NO: 39304 - DNA, 103 bp, Artificial Sequence
  Synthetic Polynucleotide
taatacgactcactatagggagttttcctacgcaactaccacgctataagaacagaggagacttataatgtggtagttgaacctggcggcagcgcaaaagatg

SEQ ID NO: 39305 - DNA, 103 bp, Artificial Sequence
  Synthetic Polynucleotide
taatacgactcactatagggatagtctcttgagacgtaacttcctcgcgaaacagaggagatcgcgaatgagttacgtcaacctggcggcagcgcaaaagatg

SEQ ID NO: 39306 - DNA, 103 bp, Artificial Sequence
  Synthetic Polynucleotide
taatacgactcactataggggtggatgaagttcatactcacccaatagcaaacagaggagatgctatatggtgagtatgaacctggcggcagcgcaaaagatg

SEQ ID NO: 39307 - DNA, 103 bp, Artificial Sequence
  Synthetic Polynucleotide
taatacgactcactatagggaacacgggaactgtaggcgaattgcaagctaacagaggagaagcttgatgttcgcctacaacctggcggcagcgcaaaagatg

SEQ ID NO: 39308 - DNA, 103 bp, Artificial Sequence
  Synthetic Polynucleotide
taatacgactcactatagggtactactacatcttccgacgcgtttgtgataacagaggagaatcacaatggcgtcggaaaacctggcggcagcgcaaaagatg

SEQ ID NO: 39309 - DNA, 103 bp, Artificial Sequence
  Synthetic Polynucleotide
taatacgactcactataggggataagcattaatcaggctgtgtgtggcacaacagaggagagtgccaatgacagcctgaaacctggcggcagcgcaaaagatg

SEQ ID NO: 39310 - DNA, 103 bp, Artificial Sequence
  Synthetic Polynucleotide
taatacgactcactatagggtgttgaggccgacgcgcgcccggaatccagaacagaggagactggatatggggcgcgcgaacctggcggcagcgcaaaagatg

SEQ ID NO: 39311 - DNA, 103 bp, Artificial Sequence
  Synthetic Polynucleotide
taatacgactcactatagggatgtcccataatatgaaccgataggagatcaacagaggagagatctcatgtcggttcataacctggcggcagcgcaaaagatg

SEQ ID NO: 39312 - DNA, 103 bp, Artificial Sequence
  Synthetic Polynucleotide
taatacgactcactataggggagttgctgatgctagtacgtcggtcttgcaacagaggagagcaagaatgacgtactagaacctggcggcagcgcaaaagatg

SEQ ID NO: 39313 - DNA, 103 bp, Artificial Sequence
  Synthetic Polynucleotide
taatacgactcactatagggccacgcactgacggggccatgacgcgaattaacagaggagaaattcgatgcatggccccaacctggcggcagcgcaaaagatg

SEQ ID NO: 39314 - DNA, 103 bp, Artificial Sequence
  Synthetic Polynucleotide
taatacgactcactataggggacaggattgtgtacgggtgtcgcaattacaacagaggagagtaattatgacacccgtaaacctggcggcagcgcaaaagatg

SEQ ID NO: 39315 - DNA, 103 bp, Artificial Sequence
  Synthetic Polynucleotide
taatacgactcactatagggtcggagacccccaaaacgcgcatgctgtttaacagaggagaaaacagatggcgcgttttaacctggcggcagcgcaaaagatg

SEQ ID NO: 39316 - DNA, 103 bp, Artificial Sequence
  Synthetic Polynucleotide
taatacgactcactataggggcgacaagagttgatcatcggtatctataaaacagaggagattatagatgccgatgatcaacctggcggcagcgcaaaagatg

SEQ ID NO: 39317 - DNA, 103 bp, Artificial Sequence
  Synthetic Polynucleotide
taatacgactcactatagggcggactttatttcacacctgtccacattagaacagaggagactaatgatgacaggtgtgaacctggcggcagcgcaaaagatg

SEQ ID NO: 39318 - DNA, 103 bp, Artificial Sequence
  Synthetic Polynucleotide
taatacgactcactatagggccagagattttgtttagaaaggaatgcaataacagaggagaattgcaatgctttctaaaaacctggcggcagcgcaaaagatg

SEQ ID NO: 39319 - DNA, 103 bp, Artificial Sequence
  Synthetic Polynucleotide
taatacgactcactatagggcagaagcatggggccgatattcatagcaagaacagaggagacttgctatgaatatcggcaacctggcggcagcgcaaaagatg

SEQ ID NO: 39320 - DNA, 103 bp, Artificial Sequence
  Synthetic Polynucleotide
taatacgactcactatagggcgcgaagctacgtgccgctggttaatatcaaacagaggagatgatatatgccagcggcaaacctggcggcagcgcaaaagatg

SEQ ID NO: 39321 - DNA, 103 bp, Artificial Sequence
  Synthetic Polynucleotide
taatacgactcactatagggaataccatcgatcctcgtgcactctacgctaacagaggagaagcgtaatgtgcacgaggaacctggcggcagcgcaaaagatg

SEQ ID NO: 39322 - DNA, 103 bp, Artificial Sequence
  Synthetic Polynucleotide
taatacgactcactataggggagatttccccttcgactttctgttagtataacagaggagaatactaatggaaagtcgaaacctggcggcagcgcaaaagatg

SEQ ID NO: 39323 - DNA, 103 bp, Artificial Sequence
  Synthetic Polynucleotide
taatacgactcactataggggataaagcagagagatacttagtagatcctaacagaggagaaggatcatgtaagtatctaacctggcggcagcgcaaaagatg

SEQ ID NO: 39324 - DNA, 103 bp, Artificial Sequence
  Synthetic Polynucleotide
taatacgactcactatagggtttaaactaggggagccccaatctagaggaaacagaggagatcctctatgttggggctcaacctggcggcagcgcaaaagatg

SEQ ID NO: 39325 - DNA, 103 bp, Artificial Sequence
  Synthetic Polynucleotide
taatacgactcactataggggctggagctcccgtttcctaccatgtatcaaacagaggagatgatacatggtaggaaacaacctggcggcagcgcaaaagatg

SEQ ID NO: 39326 - DNA, 103 bp, Artificial Sequence
  Synthetic Polynucleotide
taatacgactcactataggggtagattacggttagagaatgaggttttggaacagaggagaccaaaaatgcattctctaaacctggcggcagcgcaaaagatg

SEQ ID NO: 39327 - DNA, 103 bp, Artificial Sequence
  Synthetic Polynucleotide
taatacgactcactatagggcgcaggaatactctataccaagcattctcgaacagaggagacgagaaatgttggtatagaacctggcggcagcgcaaaagatg

SEQ ID NO: 39328 - DNA, 103 bp, Artificial Sequence
  Synthetic Polynucleotide
taatacgactcactatagggcggctgccagacgagcaattgagctccgagaacagaggagactcggaatgcaattgctcaacctggcggcagcgcaaaagatg

SEQ ID NO: 39329 - DNA, 103 bp, Artificial Sequence
  Synthetic Polynucleotide
taatacgactcactatagggtgtcgaactgatcgactctcgcagattataaacagaggagatataatatgcgagagtcgaacctggcggcagcgcaaaagatg

SEQ ID NO: 39330 - DNA, 103 bp, Artificial Sequence
  Synthetic Polynucleotide
taatacgactcactatagggagaaattgccagtcccctcgccgggaaaggaacagaggagacctttcatggcgaggggaaacctggcggcagcgcaaaagatg

SEQ ID NO: 39331 - DNA, 103 bp, Artificial Sequence
  Synthetic Polynucleotide
taatacgactcactatagggacggactcttatggtcacttccaaagccccaacagaggagaggggctatggaagtgaccaacctggcggcagcgcaaaagatg

SEQ ID NO: 39332 - DNA, 103 bp, Artificial Sequence
  Synthetic Polynucleotide
taatacgactcactataggggtcgcaagggaacactgggtatatcgctgtaacagaggagaacagcgatgtacccagtgaacctggcggcagcgcaaaagatg

SEQ ID NO: 39333 - DNA, 103 bp, Artificial Sequence
  Synthetic Polynucleotide
taatacgactcactatagggtaggttagtagagggtctgtcgagttgcagaacagaggagactgcaaatggacagacccaacctggcggcagcgcaaaagatg

SEQ ID NO: 39334 - DNA, 103 bp, Artificial Sequence
  Synthetic Polynucleotide
taatacgactcactatagggccacttgtctaccaacgaagtcttcgccgaaacagaggagatcggcgatgacttcgttgaacctggcggcagcgcaaaagatg

SEQ ID NO: 39335 - DNA, 103 bp, Artificial Sequence
  Synthetic Polynucleotide
taatacgactcactatagggatcccttgaagatatactcgcaggaatggtaacagaggagaaccattatggcgagtataaacctggcggcagcgcaaaagatg

SEQ ID NO: 39336 - DNA, 103 bp, Artificial Sequence
  Synthetic Polynucleotide
taatacgactcactatagggcactaatccacactgcataaggccccgcgcaacagaggagagcgcggatgcttatgcagaacctggcggcagcgcaaaagatg

SEQ ID NO: 39337 - DNA, 103 bp, Artificial Sequence
  Synthetic Polynucleotide
taatacgactcactatagggcaacggtaggtagcgcgaccccttataggtaacagaggagaacctatatggggtcgcgcaacctggcggcagcgcaaaagatg

SEQ ID NO: 39338 - DNA, 103 bp, Artificial Sequence
  Synthetic Polynucleotide
taatacgactcactatagggatgggcaacgacccgagctatcaggcatttaacagaggagaaaatgcatgatagctcggaacctggcggcagcgcaaaagatg

SEQ ID NO: 39339 - DNA, 103 bp, Artificial Sequence
  Synthetic Polynucleotide
taatacgactcactatagggccgagccgcatgccagtaagcaagcgccggaacagaggagaccggcgatggcttactggaacctggcggcagcgcaaaagatg

SEQ ID NO: 39340 - DNA, 103 bp, Artificial Sequence
  Synthetic Polynucleotide
taatacgactcactatagggagtggatcgaaacggccggctagtgggaataacagaggagaattcccatgagccggccgaacctggcggcagcgcaaaagatg

SEQ ID NO: 39341 - DNA, 103 bp, Artificial Sequence
  Synthetic Polynucleotide
taatacgactcactatagggatattgttgtcttccgaggtgatcctgcgaaacagaggagatcgcagatgcacctcggaaacctggcggcagcgcaaaagatg

SEQ ID NO: 39342 - DNA, 103 bp, Artificial Sequence
  Synthetic Polynucleotide
taatacgactcactatagggcgatctgggagtaggcgttaacgtatgtgtaacagaggagaacacatatgttaacgcctaacctggcggcagcgcaaaagatg

SEQ ID NO: 39343 - DNA, 103 bp, Artificial Sequence
  Synthetic Polynucleotide
taatacgactcactataggggaactggtcaccactaacggcacgtgagataacagaggagaatctcaatggccgttagtaacctggcggcagcgcaaaagatg

SEQ ID NO: 39344 - DNA, 103 bp, Artificial Sequence
  Synthetic Polynucleotide
taatacgactcactatagggcgggatgggggttgatcctattatgaaaaaaacagaggagatttttcatgataggatcaaacctggcggcagcgcaaaagatg

SEQ ID NO: 39345 - DNA, 103 bp, Artificial Sequence
  Synthetic Polynucleotide
taatacgactcactatagggttccggtctcgtacggggtaagtagtactaaacagaggagatagtacatgttaccccgtaacctggcggcagcgcaaaagatg

SEQ ID NO: 39346 - DNA, 103 bp, Artificial Sequence
  Synthetic Polynucleotide
taatacgactcactatagggcctaggacctaagaatgacgcactaagttaaacagaggagataacttatggcgtcattcaacctggcggcagcgcaaaagatg

SEQ ID NO: 39347 - DNA, 103 bp, Artificial Sequence
  Synthetic Polynucleotide
taatacgactcactataggggagtccacaatagaaatacagctgcgtgaaaacagaggagattcacgatgctgtatttcaacctggcggcagcgcaaaagatg

SEQ ID NO: 39348 - DNA, 103 bp, Artificial Sequence
  Synthetic Polynucleotide
taatacgactcactatagggaagccccatcgcgcatgcccgcaaaacggcaacagaggagagccgttatgcgggcatgcaacctggcggcagcgcaaaagatg

SEQ ID NO: 39349 - DNA, 103 bp, Artificial Sequence
  Synthetic Polynucleotide
taatacgactcactatagggccgagtttggccgcaaagcaggacacaaggaacagaggagaccttgtatgctgctttgcaacctggcggcagcgcaaaagatg

SEQ ID NO: 39350 - DNA, 103 bp, Artificial Sequence
  Synthetic Polynucleotide
taatacgactcactatagggcgcgagatttatggctcgcaatgcacgagcaacagaggagagctcgtatgttgcgagccaacctggcggcagcgcaaaagatg

SEQ ID NO: 39351 - DNA, 103 bp, Artificial Sequence
  Synthetic Polynucleotide
taatacgactcactataggggagacctcccacggcgttaaccgcttgtcgaacagaggagacgacaaatggttaacgccaacctggcggcagcgcaaaagatg

SEQ ID NO: 39352 - DNA, 103 bp, Artificial Sequence
  Synthetic Polynucleotide
taatacgactcactatagggatcgatattaccacgcttcgaattggtgccaacagaggagaggcaccatgtcgaagcgtaacctggcggcagcgcaaaagatg

SEQ ID NO: 39353 - DNA, 103 bp, Artificial Sequence
  Synthetic Polynucleotide
taatacgactcactatagggtaccactatcaaatttggacattaaatcagaacagaggagactgattatgtgtccaaataacctggcggcagcgcaaaagatg

SEQ ID NO: 39354 - DNA, 103 bp, Artificial Sequence
  Synthetic Polynucleotide
taatacgactcactatagggaatagtctcgccggttatggaaggttcggtaacagaggagaaccgaaatgtccataaccaacctggcggcagcgcaaaagatg

SEQ ID NO: 39355 - DNA, 103 bp, Artificial Sequence
  Synthetic Polynucleotide
taatacgactcactatagggcactgtaatgagcacaaaagagccatgcgcaacagaggagagcgcatatgtcttttgtgaacctggcggcagcgcaaaagatg

SEQ ID NO: 39356 - DNA, 103 bp, Artificial Sequence
  Synthetic Polynucleotide
taatacgactcactataggggctgtcaacagctacatagaggttctcggcaacagaggagagccgagatgctctatgtaaacctggcggcagcgcaaaagatg

SEQ ID NO: 39357 - DNA, 103 bp, Artificial Sequence
  Synthetic Polynucleotide
taatacgactcactatagggatacttttttccgattcgataaccgacaacaacagaggagagttgtcatgtatcgaatcaacctggcggcagcgcaaaagatg

SEQ ID NO: 39358 - DNA, 103 bp, Artificial Sequence
  Synthetic Polynucleotide
taatacgactcactatagggcagctctgaagactccctcgtgcgatatgtaacagaggagaacatatatgacgagggagaacctggcggcagcgcaaaagatg

SEQ ID NO: 39359 - DNA, 103 bp, Artificial Sequence
  Synthetic Polynucleotide
taatacgactcactatagggttgtgtctgctttggcagactagcccggtgaacagaggagacaccggatgagtctgccaaacctggcggcagcgcaaaagatg

SEQ ID NO: 39360 - DNA, 103 bp, Artificial Sequence
  Synthetic Polynucleotide
taatacgactcactataggggtaagctgacggtcccggggctcttcgaccaacagaggagaggtcgaatggccccgggaaacctggcggcagcgcaaaagatg

SEQ ID NO: 39361 - DNA, 103 bp, Artificial Sequence
  Synthetic Polynucleotide
taatacgactcactatagggttcgtctaaaggtaggtaaggccagggggcaacagaggagagcccccatgccttacctaaacctggcggcagcgcaaaagatg

SEQ ID NO: 39362 - DNA, 103 bp, Artificial Sequence
  Synthetic Polynucleotide
taatacgactcactataggggagccgggggaatattcacgagctaggaaaaacagaggagatttcctatgtcgtgaataaacctggcggcagcgcaaaagatg

SEQ ID NO: 39363 - DNA, 103 bp, Artificial Sequence
  Synthetic Polynucleotide
taatacgactcactatagggcggttacgaccactttatgcattagtacgtaacagaggagaacgtacatgtgcataaagaacctggcggcagcgcaaaagatg

SEQ ID NO: 39364 - DNA, 103 bp, Artificial Sequence
  Synthetic Polynucleotide
taatacgactcactatagggtacacacttcttctgctgagactagtgccgaacagaggagacggcacatgtctcagcagaacctggcggcagcgcaaaagatg

SEQ ID NO: 39365 - DNA, 103 bp, Artificial Sequence
  Synthetic Polynucleotide
taatacgactcactatagggtctaggaccgcagttctgaacgaggtagcgaacagaggagacgctacatggttcagaacaacctggcggcagcgcaaaagatg

SEQ ID NO: 39366 - DNA, 103 bp, Artificial Sequence
  Synthetic Polynucleotide
taatacgactcactatagggaacctagctgtgttacaatagaatctacagaacagaggagactgtagatgctattgtaaaacctggcggcagcgcaaaagatg

SEQ ID NO: 39367 - DNA, 103 bp, Artificial Sequence
  Synthetic Polynucleotide
taatacgactcactatagggttccttgaggacttacgcgttagtttatagaacagaggagactataaatgaacgcgtaaaacctggcggcagcgcaaaagatg

SEQ ID NO: 39368 - DNA, 103 bp, Artificial Sequence
  Synthetic Polynucleotide
taatacgactcactatagggagcgttccccccacttctccattgtacgaaaacagaggagattcgtaatgtggagaagtaacctggcggcagcgcaaaagatg

SEQ ID NO: 39369 - DNA, 103 bp, Artificial Sequence
  Synthetic Polynucleotide
taatacgactcactatagggacgccaagcagtgccgcgctgggcagtgtcaacagaggagagacactatgcagcgcggcaacctggcggcagcgcaaaagatg

SEQ ID NO: 39370 - DNA, 103 bp, Artificial Sequence
  Synthetic Polynucleotide
taatacgactcactataggggcaggtagggccttttctacttctttaataaacagaggagatattaaatgagtagaaaaaacctggcggcagcgcaaaagatg

SEQ ID NO: 39371 - DNA, 103 bp, Artificial Sequence
  Synthetic Polynucleotide
taatacgactcactatagggcaacaaggactcacaccccgccctacataaaacagaggagattatgtatggcggggtgtaacctggcggcagcgcaaaagatg

SEQ ID NO: 39372 - DNA, 103 bp, Artificial Sequence
  Synthetic Polynucleotide
taatacgactcactatagggagattataggccaggggcgcaaacatgtgtaacagaggagaacacatatgtgcgcccctaacctggcggcagcgcaaaagatg

SEQ ID NO: 39373 - DNA, 103 bp, Artificial Sequence
  Synthetic Polynucleotide
taatacgactcactataggggcggttccacattgtgcacgaggatcaccaaacagaggagatggtgaatgtcgtgcacaaacctggcggcagcgcaaaagatg

SEQ ID NO: 39374 - DNA, 103 bp, Artificial Sequence
  Synthetic Polynucleotide
taatacgactcactatagggaggctactttcgacgctgggcgccgaagtgaacagaggagacacttcatggcccagcgtaacctggcggcagcgcaaaagatg

SEQ ID NO: 39375 - DNA, 103 bp, Artificial Sequence
  Synthetic Polynucleotide
taatacgactcactatagggccatagtgggtgttactctgcataaaatgcaacagaggagagcatttatggcagagtaaaacctggcggcagcgcaaaagatg

SEQ ID NO: 39376 - DNA, 103 bp, Artificial Sequence
  Synthetic Polynucleotide
taatacgactcactataggggaagaacggcgcccatttcttatgcccgggaacagaggagacccgggatgaagaaatggaacctggcggcagcgcaaaagatg

SEQ ID NO: 39377 - DNA, 103 bp, Artificial Sequence
  Synthetic Polynucleotide
taatacgactcactatagggaacccggtattgtaacattgccggcaggtgaacagaggagacacctgatggcaatgttaaacctggcggcagcgcaaaagatg

SEQ ID NO: 39378 - DNA, 103 bp, Artificial Sequence
  Synthetic Polynucleotide
taatacgactcactatagggccatagactactggtcatcgcagttcagacaacagaggagagtctgaatggcgatgaccaacctggcggcagcgcaaaagatg

SEQ ID NO: 39379 - DNA, 103 bp, Artificial Sequence
  Synthetic Polynucleotide
taatacgactcactatagggctatgcaaataccagcatctcgccagtatcaacagaggagagatactatggagatgctgaacctggcggcagcgcaaaagatg

SEQ ID NO: 39380 - DNA, 103 bp, Artificial Sequence
  Synthetic Polynucleotide
taatacgactcactataggggcttcgccgtctacggttgcacgatgcagcaacagaggagagctgcaatgtgcaaccgtaacctggcggcagcgcaaaagatg

SEQ ID NO: 39381 - DNA, 103 bp, Artificial Sequence
  Synthetic Polynucleotide
taatacgactcactatagggcgagagcgccggtagaggagaagctaaaagaacagaggagacttttaatgtctcctctaaacctggcggcagcgcaaaagatg

SEQ ID NO: 39382 - DNA, 103 bp, Artificial Sequence
  Synthetic Polynucleotide
taatacgactcactatagggtcagcatctaggcaccttaagatctgaaacaacagaggagagtttcaatgcttaaggtgaacctggcggcagcgcaaaagatg

SEQ ID NO: 39383 - DNA, 103 bp, Artificial Sequence
  Synthetic Polynucleotide
taatacgactcactatagggccgatgtacacgcttttgtatgtaatccggaacagaggagaccggatatgatacaaaagaacctggcggcagcgcaaaagatg

SEQ ID NO: 39384 - DNA, 103 bp, Artificial Sequence
  Synthetic Polynucleotide
taatacgactcactataggggtatctgtaggagcgagaagtctttaccccaacagaggagaggggtaatgacttctcgcaacctggcggcagcgcaaaagatg

SEQ ID NO: 39385 - DNA, 103 bp, Artificial Sequence
  Synthetic Polynucleotide
taatacgactcactatagggcgtcatttataaagaatgcattccactggtaacagaggagaaccagtatgatgcattctaacctggcggcagcgcaaaagatg

SEQ ID NO: 39386 - DNA, 103 bp, Artificial Sequence
  Synthetic Polynucleotide
taatacgactcactataggggcgtttgccagataacctcttttgtagaacaacagaggagagttctaatgaagaggttaaacctggcggcagcgcaaaagatg

SEQ ID NO: 39387 - DNA, 103 bp, Artificial Sequence
  Synthetic Polynucleotide
taatacgactcactatagggttcaaacatttagacagctatttccaagtgaacagaggagacacttgatgatagctgtcaacctggcggcagcgcaaaagatg

SEQ ID NO: 39388 - DNA, 103 bp, Artificial Sequence
  Synthetic Polynucleotide
taatacgactcactatagggtaaagattatgggttaagggtcgtgcaaccaacagaggagaggttgcatgacccttaacaacctggcggcagcgcaaaagatg

SEQ ID NO: 39389 - DNA, 103 bp, Artificial Sequence
  Synthetic Polynucleotide
taatacgactcactatagggggcgactcccaccactgagactacgtaaataacagaggagaatttacatggtctcagtgaacctggcggcagcgcaaaagatg

SEQ ID NO: 39390 - DNA, 103 bp, Artificial Sequence
  Synthetic Polynucleotide
taatacgactcactatagggccctttgagtaaggtgcccgtaacctccgcaacagaggagagcggagatgacgggcaccaacctggcggcagcgcaaaagatg

SEQ ID NO: 39391 - DNA, 103 bp, Artificial Sequence
  Synthetic Polynucleotide
taatacgactcactatagggttggtcagaagcaccgtaacgtaatttcttaacagaggagaaagaaaatgcgttacggtaacctggcggcagcgcaaaagatg

SEQ ID NO: 39392 - DNA, 103 bp, Artificial Sequence
  Synthetic Polynucleotide
taatacgactcactatagggaaccgtgggtcgaattcacgcgaagaggacaacagaggagagtcctcatggcgtgaattaacctggcggcagcgcaaaagatg

SEQ ID NO: 39393 - DNA, 103 bp, Artificial Sequence
  Synthetic Polynucleotide
taatacgactcactataggggcatcgagttacccaatacccattctttccaacagaggagaggaaagatggggtattggaacctggcggcagcgcaaaagatg

SEQ ID NO: 39394 - DNA, 103 bp, Artificial Sequence
  Synthetic Polynucleotide
taatacgactcactatagggtaatcagtcggtattgacgtgtcttatcggaacagaggagaccgataatgcacgtcaataacctggcggcagcgcaaaagatg

SEQ ID NO: 39395 - DNA, 103 bp, Artificial Sequence
  Synthetic Polynucleotide
taatacgactcactatagggattggaagggtagggatgcacgccattgataacagaggagaatcaatatggtgcatcccaacctggcggcagcgcaaaagatg

SEQ ID NO: 39396 - DNA, 103 bp, Artificial Sequence
  Synthetic Polynucleotide
taatacgactcactatagggttacagatataaattcatagttctaccgcgaacagaggagacgcggtatgactatgaataacctggcggcagcgcaaaagatg

SEQ ID NO: 39397 - DNA, 103 bp, Artificial Sequence
  Synthetic Polynucleotide
taatacgactcactatagggcgcatccattttcaggtgtgactgcttaggaacagaggagacctaagatgtcacacctgaacctggcggcagcgcaaaagatg

SEQ ID NO: 39398 - DNA, 103 bp, Artificial Sequence
  Synthetic Polynucleotide
taatacgactcactataggggactgggccgaacggtcgccattaattcgcaacagaggagagcgaatatgtggcgaccgaacctggcggcagcgcaaaagatg

SEQ ID NO: 39399 - DNA, 103 bp, Artificial Sequence
  Synthetic Polynucleotide
taatacgactcactataggggtattacttgcgttcctgcatcccacgaaaaacagaggagatttcgtatgatgcaggaaaacctggcggcagcgcaaaagatg

SEQ ID NO: 39400 - DNA, 103 bp, Artificial Sequence
  Synthetic Polynucleotide
taatacgactcactatagggacgtgcccaagaatgtatgcgcaagtatgaaacagaggagatcatacatgcgcatacataacctggcggcagcgcaaaagatg

SEQ ID NO: 39401 - DNA, 103 bp, Artificial Sequence
  Synthetic Polynucleotide
taatacgactcactataggggtgcttgctataccgcgagacaagtggcttaacagaggagaaagccaatggtctcgcggaacctggcggcagcgcaaaagatg

SEQ ID NO: 39402 - DNA, 103 bp, Artificial Sequence
  Synthetic Polynucleotide
taatacgactcactatagggggttcagagccccccactgttaaacctgccaacagaggagaggcaggatgaacagtgggaacctggcggcagcgcaaaagatg

SEQ ID NO: 39403 - DNA, 103 bp, Artificial Sequence
  Synthetic Polynucleotide
taatacgactcactatagggctacgacgcgagagctagcataggagccacaacagaggagagtggctatgatgctagctaacctggcggcagcgcaaaagatg

SEQ ID NO: 39404 - DNA, 103 bp, Artificial Sequence
  Synthetic Polynucleotide
taatacgactcactataggggattctcctatgatctttgatagacgccgcaacagaggagagcggcgatgatcaaagataacctggcggcagcgcaaaagatg

SEQ ID NO: 39405 - DNA, 103 bp, Artificial Sequence
  Synthetic Polynucleotide
taatacgactcactataggggttaaagtcaacattggacctcgcgctttaaacagaggagataaagcatgaggtccaataacctggcggcagcgcaaaagatg

SEQ ID NO: 39406 - DNA, 103 bp, Artificial Sequence
  Synthetic Polynucleotide
taatacgactcactatagggggacacatcagtggaaccattgttttgccgaacagaggagacggcaaatgaatggttccaacctggcggcagcgcaaaagatg

SEQ ID NO: 39407 - DNA, 103 bp, Artificial Sequence
  Synthetic Polynucleotide
taatacgactcactataggggtgagtttcactagtaattttgccgtcctaaacagaggagataggacatgaaaattactaacctggcggcagcgcaaaagatg

SEQ ID NO: 39408 - DNA, 103 bp, Artificial Sequence
  Synthetic Polynucleotide
taatacgactcactataggggaagtccggtacgtacctggtaaccttgttaacagaggagaaacaagatgaccaggtacaacctggcggcagcgcaaaagatg

SEQ ID NO: 39409 - DNA, 103 bp, Artificial Sequence
  Synthetic Polynucleotide
taatacgactcactatagggctcgaaccgcgtaacctccgtagcccaaaaaacagaggagattttggatgacggaggttaacctggcggcagcgcaaaagatg

SEQ ID NO: 39410 - DNA, 103 bp, Artificial Sequence
  Synthetic Polynucleotide
taatacgactcactatagggattgcagaaaggcgatacagggggagtcctaacagaggagaaggactatgcctgtatcgaacctggcggcagcgcaaaagatg

SEQ ID NO: 39411 - DNA, 103 bp, Artificial Sequence
  Synthetic Polynucleotide
taatacgactcactatagggggatcacccctagactggtttagatcgtaaaacagaggagattacgaatgaaaccagtcaacctggcggcagcgcaaaagatg

SEQ ID NO: 39412 - DNA, 103 bp, Artificial Sequence
  Synthetic Polynucleotide
taatacgactcactatagggctattttacgcgagaaagtttgggattgctaacagaggagaagcaatatgaaactttctaacctggcggcagcgcaaaagatg

SEQ ID NO: 39413 - DNA, 103 bp, Artificial Sequence
  Synthetic Polynucleotide
taatacgactcactatagggatgagggatagcacgcataaatttaccgttaacagaggagaaacggtatgtttatgcgtaacctggcggcagcgcaaaagatg

SEQ ID NO: 39414 - DNA, 103 bp, Artificial Sequence
  Synthetic Polynucleotide
taatacgactcactatagggccagctaagtggatccgggtacacgcccgtaacagaggagaacgggcatgtacccggataacctggcggcagcgcaaaagatg

SEQ ID NO: 39415 - DNA, 103 bp, Artificial Sequence
  Synthetic Polynucleotide
taatacgactcactataggggctgctgcagctcaggcgtggccaccacgaaacagaggagatcgtggatgccacgcctgaacctggcggcagcgcaaaagatg

SEQ ID NO: 39416 - DNA, 103 bp, Artificial Sequence
  Synthetic Polynucleotide
taatacgactcactatagggctggccatgctctgcactgttgcacgaaccaacagaggagaggttcgatgaacagtgcaaacctggcggcagcgcaaaagatg

SEQ ID NO: 39417 - DNA, 103 bp, Artificial Sequence
  Synthetic Polynucleotide
taatacgactcactatagggcgctcgcaaacggcaccgcgtgtcaatgcaaacagaggagatgcattatgacgcggtgcaacctggcggcagcgcaaaagatg

SEQ ID NO: 39418 - DNA, 103 bp, Artificial Sequence
  Synthetic Polynucleotide
taatacgactcactatagggctacggtccgcttccccgaagaggcggggaaacagaggagatccccgatgcttcggggaaacctggcggcagcgcaaaagatg

SEQ ID NO: 39419 - DNA, 103 bp, Artificial Sequence
  Synthetic Polynucleotide
taatacgactcactataggggacgtggatagatgacggcgctgatcgaacaacagaggagagttcgaatggcgccgtcaaacctggcggcagcgcaaaagatg

SEQ ID NO: 39420 - DNA, 103 bp, Artificial Sequence
  Synthetic Polynucleotide
taatacgactcactataggggtcaaacggtcaatccggaggaccattcacaacagaggagagtgaatatgcctccggataacctggcggcagcgcaaaagatg

SEQ ID NO: 39421 - DNA, 103 bp, Artificial Sequence
  Synthetic Polynucleotide
taatacgactcactatagggaacgatttccgggcgattcattctacttgaaacagaggagatcaagtatgatgaatcgcaacctggcggcagcgcaaaagatg

SEQ ID NO: 39422 - DNA, 103 bp, Artificial Sequence
  Synthetic Polynucleotide
taatacgactcactatagggtacggaagggccggctgggggtgtagcacaaacagaggagatgtgctatgcccccagccaacctggcggcagcgcaaaagatg

SEQ ID NO: 39423 - DNA, 103 bp, Artificial Sequence
  Synthetic Polynucleotide
taatacgactcactatagggattcacaccattacgcaggtataagctcctaacagaggagaaggagcatgtacctgcgtaacctggcggcagcgcaaaagatg

SEQ ID NO: 39424 - DNA, 103 bp, Artificial Sequence
  Synthetic Polynucleotide
taatacgactcactatagggttttatgcggaggggccgtttccggtcacaaacagaggagatgtgacatgaaacggcccaacctggcggcagcgcaaaagatg

SEQ ID NO: 39425 - DNA, 103 bp, Artificial Sequence
  Synthetic Polynucleotide
taatacgactcactatagggatatcatttgccgctgtattatcttgtagcaacagaggagagctacaatgtaatacagcaacctggcggcagcgcaaaagatg

SEQ ID NO: 39426 - DNA, 103 bp, Artificial Sequence
  Synthetic Polynucleotide
taatacgactcactatagggtgccgcccgtaggtacagggttaaggatagaacagaggagactatccatgaccctgtacaacctggcggcagcgcaaaagatg

SEQ ID NO: 39427 - DNA, 103 bp, Artificial Sequence
  Synthetic Polynucleotide
taatacgactcactatagggcggcgacccttaatgtgagtagggagccctaacagaggagaagggctatgtactcacataacctggcggcagcgcaaaagatg

SEQ ID NO: 39428 - DNA, 103 bp, Artificial Sequence
  Synthetic Polynucleotide
taatacgactcactatagggatggtgttcaggtcgggctcgagccacagaaacagaggagatctgtgatgcgagcccgaaacctggcggcagcgcaaaagatg

SEQ ID NO: 39429 - DNA, 103 bp, Artificial Sequence
  Synthetic Polynucleotide
taatacgactcactatagggccgacaagaggcctaggtaagcagcccagtaacagaggagaactgggatgcttacctagaacctggcggcagcgcaaaagatg

SEQ ID NO: 39430 - DNA, 103 bp, Artificial Sequence
  Synthetic Polynucleotide
taatacgactcactatagggaggatagggtgtaagtcatgaacattgggtaacagaggagaacccaaatgtcatgacttaacctggcggcagcgcaaaagatg

SEQ ID NO: 39431 - DNA, 103 bp, Artificial Sequence
  Synthetic Polynucleotide
taatacgactcactatagggcgcaattaacggcggagtgatccgccgtttaacagaggagaaaacggatgatcactccgaacctggcggcagcgcaaaagatg

SEQ ID NO: 39432 - DNA, 103 bp, Artificial Sequence
  Synthetic Polynucleotide
taatacgactcactatagggcactgggaggctggacttgatacgcgcaccaacagaggagaggtgcgatgatcaagtccaacctggcggcagcgcaaaagatg

SEQ ID NO: 39433 - DNA, 103 bp, Artificial Sequence
  Synthetic Polynucleotide
taatacgactcactatagggccggcgcaggggtgcctaacgaggattcgaaacagaggagatcgaatatgcgttaggcaaacctggcggcagcgcaaaagatg

SEQ ID NO: 39434 - DNA, 103 bp, Artificial Sequence
  Synthetic Polynucleotide
taatacgactcactatagggacctctatagtacggagattctagggacaaaacagaggagattgtccatggaatctccgaacctggcggcagcgcaaaagatg

SEQ ID NO: 39435 - DNA, 103 bp, Artificial Sequence
  Synthetic Polynucleotide
taatacgactcactatagggagctaaaccccgcggatgctagctgttatcaacagaggagagataacatgtagcatccgaacctggcggcagcgcaaaagatg

SEQ ID NO: 39436 - DNA, 103 bp, Artificial Sequence
  Synthetic Polynucleotide
taatacgactcactatagggacgctactcccggcgtgactcaacatctgaaacagaggagatcagatatggagtcacgcaacctggcggcagcgcaaaagatg

SEQ ID NO: 39437 - DNA, 103 bp, Artificial Sequence
  Synthetic Polynucleotide
taatacgactcactatagggtgtttcgttgagctcacttgcggacacattaacagaggagaaatgtgatggcaagtgagaacctggcggcagcgcaaaagatg

SEQ ID NO: 39438 - DNA, 103 bp, Artificial Sequence
  Synthetic Polynucleotide
taatacgactcactatagggcgtttcgagaaatgagtaggagagtaacgtaacagaggagaacgttaatgtcctactcaaacctggcggcagcgcaaaagatg

SEQ ID NO: 39439 - DNA, 103 bp, Artificial Sequence
  Synthetic Polynucleotide
taatacgactcactatagggtcgttgtctcgatttgatcctgtatagtcaaacagaggagatgactaatgaggatcaaaaacctggcggcagcgcaaaagatg

SEQ ID NO: 39440 - DNA, 103 bp, Artificial Sequence
  Synthetic Polynucleotide
taatacgactcactatagggtaaggtctgtatccgcttatagctttagcaaacagaggagatgctaaatgtataagcggaacctggcggcagcgcaaaagatg

SEQ ID NO: 39441 - DNA, 103 bp, Artificial Sequence
  Synthetic Polynucleotide
taatacgactcactatagggcaaccacctaccggcgaggccaagtattacaacagaggagagtaataatgggcctcgccaacctggcggcagcgcaaaagatg

SEQ ID NO: 39442 - DNA, 103 bp, Artificial Sequence
  Synthetic Polynucleotide
taatacgactcactatagggcagtacaaaaagtatgaccactggttagtcaacagaggagagactaaatggtggtcataaacctggcggcagcgcaaaagatg

SEQ ID NO: 39443 - DNA, 103 bp, Artificial Sequence
  Synthetic Polynucleotide
taatacgactcactatagggtggaagcatgatttcgaaaagccagtatcaaacagaggagatgatacatgcttttcgaaaacctggcggcagcgcaaaagatg

SEQ ID NO: 39444 - DNA, 103 bp, Artificial Sequence
  Synthetic Polynucleotide
taatacgactcactataggggtggagcaccgattgggtcaagacttcgataacagaggagaatcgaaatgttgacccaaaacctggcggcagcgcaaaagatg

SEQ ID NO: 39445 - DNA, 103 bp, Artificial Sequence
  Synthetic Polynucleotide
taatacgactcactatagggcatcgacggccgccttcgcctgagggcgtaaacagaggagatacgccatgaggcgaaggaacctggcggcagcgcaaaagatg

SEQ ID NO: 39446 - DNA, 103 bp, Artificial Sequence
  Synthetic Polynucleotide
taatacgactcactatagggcgatgtacatcttagatttcgggagtatcaaacagaggagatgatacatgcgaaatctaaacctggcggcagcgcaaaagatg

SEQ ID NO: 39447 - DNA, 103 bp, Artificial Sequence
  Synthetic Polynucleotide
taatacgactcactatagggtaggattttggtctctcatattaaactggtaacagaggagaaccagtatgatatgagagaacctggcggcagcgcaaaagatg

SEQ ID NO: 39448 - DNA, 103 bp, Artificial Sequence
  Synthetic Polynucleotide
taatacgactcactatagggagtcatcagttggcagactacatacggaccaacagaggagaggtccgatggtagtctgcaacctggcggcagcgcaaaagatg

SEQ ID NO: 39449 - DNA, 103 bp, Artificial Sequence
  Synthetic Polynucleotide
taatacgactcactataggggataggcgtactatgcgccgcctacatcttaacagaggagaaagatgatggcggcgcataacctggcggcagcgcaaaagatg

SEQ ID NO: 39450 - DNA, 103 bp, Artificial Sequence
  Synthetic Polynucleotide
taatacgactcactatagggcactgcgggaaggaatcggacacactggttaacagaggagaaaccagatggtccgattcaacctggcggcagcgcaaaagatg

SEQ ID NO: 39451 - DNA, 103 bp, Artificial Sequence
  Synthetic Polynucleotide
taatacgactcactatagggcagatcattcagatccctagcgatctccggaacagaggagaccggagatggctagggataacctggcggcagcgcaaaagatg

SEQ ID NO: 39452 - DNA, 103 bp, Artificial Sequence
  Synthetic Polynucleotide
taatacgactcactataggggtaccgggccgtaagccccttaagatacggaacagaggagaccgtatatgaaggggcttaacctggcggcagcgcaaaagatg

SEQ ID NO: 39453 - DNA, 103 bp, Artificial Sequence
  Synthetic Polynucleotide
taatacgactcactataggggtagcgacgcctcttataccgtgaggagcaaacagaggagatgctccatgcggtataagaacctggcggcagcgcaaaagatg

SEQ ID NO: 39454 - DNA, 103 bp, Artificial Sequence
  Synthetic Polynucleotide
taatacgactcactatagggggcccttcagctgagcctaagcagcccgttaacagaggagaaacgggatgcttaggctcaacctggcggcagcgcaaaagatg

SEQ ID NO: 39455 - DNA, 103 bp, Artificial Sequence
  Synthetic Polynucleotide
taatacgactcactatagggggccatcagacgcatagtaccttgacttgaaacagaggagatcaagtatgggtactatgaacctggcggcagcgcaaaagatg

SEQ ID NO: 39456 - DNA, 103 bp, Artificial Sequence
  Synthetic Polynucleotide
taatacgactcactatagggtgtcgaaataagctggggccgaatgtcatgaacagaggagacatgacatgcggccccagaacctggcggcagcgcaaaagatg

SEQ ID NO: 39457 - DNA, 103 bp, Artificial Sequence
  Synthetic Polynucleotide
taatacgactcactatagggttccgttgagccgacataaagtgccggtcgaacagaggagacgaccgatgctttatgtcaacctggcggcagcgcaaaagatg

SEQ ID NO: 39458 - DNA, 103 bp, Artificial Sequence
  Synthetic Polynucleotide
taatacgactcactatagggggtcctcgagctcgaaattaggaaggccgcaacagaggagagcggccatgctaatttcgaacctggcggcagcgcaaaagatg

SEQ ID NO: 39459 - DNA, 103 bp, Artificial Sequence
  Synthetic Polynucleotide
taatacgactcactatagggatcaaactcctgcatgttgactgacaacctaacagaggagaaggttgatggtcaacatgaacctggcggcagcgcaaaagatg

SEQ ID NO: 39460 - DNA, 103 bp, Artificial Sequence
  Synthetic Polynucleotide
taatacgactcactatagggtcctcttcatgtcgtcggtgggagacgcgcaacagaggagagcgcgtatgccaccgacgaacctggcggcagcgcaaaagatg

SEQ ID NO: 39461 - DNA, 103 bp, Artificial Sequence
  Synthetic Polynucleotide
taatacgactcactatagggtggcgacgatgcaatcctacgtacaaactgaacagaggagacagtttatgcgtaggattaacctggcggcagcgcaaaagatg

SEQ ID NO: 39462 - DNA, 103 bp, Artificial Sequence
  Synthetic Polynucleotide
taatacgactcactatagggtacatggtctagctccataaagtccggagtaacagaggagaactccgatgtttatggagaacctggcggcagcgcaaaagatg

SEQ ID NO: 39463 - DNA, 103 bp, Artificial Sequence
  Synthetic Polynucleotide
taatacgactcactatagggcgaattaccacgctaccccattgtgtagcaaacagaggagatgctacatgatggggtagaacctggcggcagcgcaaaagatg

SEQ ID NO: 39464 - DNA, 103 bp, Artificial Sequence
  Synthetic Polynucleotide
taatacgactcactatagggtaaccacgccgttgtcacagtcatggcttaaacagaggagataagccatgactgtgacaaacctggcggcagcgcaaaagatg

SEQ ID NO: 39465 - DNA, 103 bp, Artificial Sequence
  Synthetic Polynucleotide
taatacgactcactatagggcctcctggactttctggatttttagatggaaacagaggagatccatcatgaaatccagaaacctggcggcagcgcaaaagatg

SEQ ID NO: 39466 - DNA, 103 bp, Artificial Sequence
  Synthetic Polynucleotide
taatacgactcactataggggcctgtctgtgacggatatacgtaaggttaaacagaggagataacctatggtatatccgaacctggcggcagcgcaaaagatg

SEQ ID NO: 39467 - DNA, 103 bp, Artificial Sequence
  Synthetic Polynucleotide
taatacgactcactatagggggagctatatgaacttacgaatcctcgtagaacagaggagactacgaatgttcgtaagtaacctggcggcagcgcaaaagatg

SEQ ID NO: 39468 - DNA, 103 bp, Artificial Sequence
  Synthetic Polynucleotide
taatacgactcactatagggtttccaccctctcaagctttaatagcgacgaacagaggagacgtcgcatgtaaagcttgaacctggcggcagcgcaaaagatg

SEQ ID NO: 39469 - DNA, 103 bp, Artificial Sequence
  Synthetic Polynucleotide
taatacgactcactatagggtcgctatcccgacggagttcccactagactaacagaggagaagtctaatgggaactccgaacctggcggcagcgcaaaagatg

SEQ ID NO: 39470 - DNA, 103 bp, Artificial Sequence
  Synthetic Polynucleotide
taatacgactcactatagggtctcttgattcctcattctttctattcacaaacagaggagatgtgaaatgaaagaatgaaacctggcggcagcgcaaaagatg

SEQ ID NO: 39471 - DNA, 103 bp, Artificial Sequence
  Synthetic Polynucleotide
taatacgactcactatagggataccactttcccagagacgcttcactccaaacagaggagatggagtatggcgtctctgaacctggcggcagcgcaaaagatg

SEQ ID NO: 39472 - DNA, 103 bp, Artificial Sequence
  Synthetic Polynucleotide
taatacgactcactatagggatccgaggaaggccgtgtaaaccgcagctaaacagaggagatagctgatgtttacacggaacctggcggcagcgcaaaagatg

SEQ ID NO: 39473 - DNA, 103 bp, Artificial Sequence
  Synthetic Polynucleotide
taatacgactcactataggggtcacgatacaacaatatgcccgccttccgaacagaggagacggaagatgggcatattgaacctggcggcagcgcaaaagatg

SEQ ID NO: 39474 - DNA, 103 bp, Artificial Sequence
  Synthetic Polynucleotide
taatacgactcactatagggctcacgtcggggagtgcgacttagtgttacaacagaggagagtaacaatgagtcgcactaacctggcggcagcgcaaaagatg

SEQ ID NO: 39475 - DNA, 103 bp, Artificial Sequence
  Synthetic Polynucleotide
taatacgactcactatagggtgccgcggaagggattaaccggatcaataaaacagaggagattattgatgcggttaatcaacctggcggcagcgcaaaagatg

SEQ ID NO: 39476 - DNA, 103 bp, Artificial Sequence
  Synthetic Polynucleotide
taatacgactcactatagggctgaagaatagacgtagtcctctaacggtaaacagaggagataccgtatgaggactacgaacctggcggcagcgcaaaagatg

SEQ ID NO: 39477 - DNA, 103 bp, Artificial Sequence
  Synthetic Polynucleotide
taatacgactcactatagggaatgggtgcgatatgggttatgagaaccacaacagaggagagtggttatgataacccataacctggcggcagcgcaaaagatg

SEQ ID NO: 39478 - DNA, 103 bp, Artificial Sequence
  Synthetic Polynucleotide
taatacgactcactatagggacaccacaacggactgtagttcgaatgaacaacagaggagagttcatatgaactacagtaacctggcggcagcgcaaaagatg

SEQ ID NO: 39479 - DNA, 103 bp, Artificial Sequence
  Synthetic Polynucleotide
taatacgactcactataggggctcgtcgggaagactggcaagtaatatgaaacagaggagatcatatatgttgccagtcaacctggcggcagcgcaaaagatg

SEQ ID NO: 39480 - DNA, 103 bp, Artificial Sequence
  Synthetic Polynucleotide
taatacgactcactatagggcaacgagaccaccctcacgtataggccggaaacagaggagatccggcatgtacgtgaggaacctggcggcagcgcaaaagatg

SEQ ID NO: 39481 - DNA, 103 bp, Artificial Sequence
  Synthetic Polynucleotide
taatacgactcactatagggacacacacgctcacctagtcctgataaagaaacagaggagatctttaatgggactaggtaacctggcggcagcgcaaaagatg

SEQ ID NO: 39482 - DNA, 103 bp, Artificial Sequence
  Synthetic Polynucleotide
taatacgactcactatagggaattaaactggagcaaagcgacaaccagcaaacagaggagatgctggatgtcgctttgcaacctggcggcagcgcaaaagatg

SEQ ID NO: 39483 - DNA, 103 bp, Artificial Sequence
  Synthetic Polynucleotide
taatacgactcactatagggcattgaacaagagttcccatgaacatgctaaacagaggagatagcatatgcatgggaacaacctggcggcagcgcaaaagatg

SEQ ID NO: 39484 - DNA, 103 bp, Artificial Sequence
  Synthetic Polynucleotide
taatacgactcactatagggtggtattccatcggaagcgaaagccacatcaacagaggagagatgtgatgttcgcttccaacctggcggcagcgcaaaagatg

SEQ ID NO: 39485 - DNA, 103 bp, Artificial Sequence
  Synthetic Polynucleotide
taatacgactcactatagggagccggttcgcttgagaacgtttagtcaaaaacagaggagatttgacatgacgttctcaaacctggcggcagcgcaaaagatg

SEQ ID NO: 39486 - DNA, 103 bp, Artificial Sequence
  Synthetic Polynucleotide
taatacgactcactatagggcgaccccctgaaacggtagtcggatccgccaacagaggagaggcggaatggactaccgtaacctggcggcagcgcaaaagatg

SEQ ID NO: 39487 - DNA, 103 bp, Artificial Sequence
  Synthetic Polynucleotide
taatacgactcactatagggcatctctcgctcaacagaattaaacgcagcaacagaggagagctgcgatgaattctgttaacctggcggcagcgcaaaagatg

SEQ ID NO: 39488 - DNA, 103 bp, Artificial Sequence
  Synthetic Polynucleotide
taatacgactcactatagggcagcttggacacggctgttgcctaaacgacaacagaggagagtcgttatggcaacagccaacctggcggcagcgcaaaagatg

SEQ ID NO: 39489 - DNA, 103 bp, Artificial Sequence
  Synthetic Polynucleotide
taatacgactcactatagggtgcagtacgacatcaaaagccgtttcgtagaacagaggagactacgaatgggcttttgaaacctggcggcagcgcaaaagatg

SEQ ID NO: 39490 - DNA, 103 bp, Artificial Sequence
  Synthetic Polynucleotide
taatacgactcactatagggtctgtgttagaatcaaaaaaacttagagccaacagaggagaggctctatgtttttttgaaacctggcggcagcgcaaaagatg

SEQ ID NO: 39491 - DNA, 103 bp, Artificial Sequence
  Synthetic Polynucleotide
taatacgactcactatagggccgcatcaactaagatgtaggctctcaaataacagaggagaatttgaatgcctacatctaacctggcggcagcgcaaaagatg

SEQ ID NO: 39492 - DNA, 103 bp, Artificial Sequence
  Synthetic Polynucleotide
taatacgactcactatagggagcaactacgcggcgtgagaactccatagtaacagaggagaactatgatgttctcacgcaacctggcggcagcgcaaaagatg

SEQ ID NO: 39493 - DNA, 103 bp, Artificial Sequence
  Synthetic Polynucleotide
taatacgactcactatagggaaagctgaatgggtgagtgaggtctgtgcaaacagaggagatgcacaatgctcactcacaacctggcggcagcgcaaaagatg

SEQ ID NO: 39494 - DNA, 103 bp, Artificial Sequence
  Synthetic Polynucleotide
taatacgactcactatagggagtaggagatagtctttccccaaacgtattaacagaggagaaatacgatgggggaaagaaacctggcggcagcgcaaaagatg

SEQ ID NO: 39495 - DNA, 103 bp, Artificial Sequence
  Synthetic Polynucleotide
taatacgactcactatagggcgctgtcattcagacttgggctgatattacaacagaggagagtaataatggcccaagtcaacctggcggcagcgcaaaagatg

SEQ ID NO: 39496 - DNA, 103 bp, Artificial Sequence
  Synthetic Polynucleotide
taatacgactcactatagggtaccaaccgtcgggaaggatagcttcgctaaacagaggagatagcgaatgtatccttccaacctggcggcagcgcaaaagatg

SEQ ID NO: 39497 - DNA, 103 bp, Artificial Sequence
  Synthetic Polynucleotide
taatacgactcactatagggagtttgaaaaaaggtggtagacctttctctaacagaggagaagagaaatgtctaccaccaacctggcggcagcgcaaaagatg

SEQ ID NO: 39498 - DNA, 103 bp, Artificial Sequence
  Synthetic Polynucleotide
taatacgactcactatagggtgcgattggacgacattaggtctcagtttgaacagaggagacaaactatgacctaatgtaacctggcggcagcgcaaaagatg

SEQ ID NO: 39499 - DNA, 103 bp, Artificial Sequence
  Synthetic Polynucleotide
taatacgactcactatagggaagatcaaacagcccaactcattcgacagaaacagaggagatctgtcatgtgagttgggaacctggcggcagcgcaaaagatg

SEQ ID NO: 39500 - DNA, 103 bp, Artificial Sequence
  Synthetic Polynucleotide
taatacgactcactataggggctgcgttagagagtcggcgatatgcaaggaacagaggagaccttgcatgtcgccgactaacctggcggcagcgcaaaagatg

SEQ ID NO: 39501 - DNA, 103 bp, Artificial Sequence
  Synthetic Polynucleotide
taatacgactcactatagggcggaccctattaggccacgttggatagaacaacagaggagagttctaatgaacgtggccaacctggcggcagcgcaaaagatg

SEQ ID NO: 39502 - DNA, 103 bp, Artificial Sequence
  Synthetic Polynucleotide
taatacgactcactatagggcttctgaaacgcggggaaaattacatgctaaacagaggagatagcatatgattttccccaacctggcggcagcgcaaaagatg

SEQ ID NO: 39503 - DNA, 103 bp, Artificial Sequence
  Synthetic Polynucleotide
taatacgactcactatagggccagttggcatacgagatagcacgctccataacagaggagaatggagatggctatctcgaacctggcggcagcgcaaaagatg

SEQ ID NO: 39504 - DNA, 103 bp, Artificial Sequence
  Synthetic Polynucleotide
taatacgactcactatagggaagctgcaatcgccttattatatggtaccaaacagaggagatggtacatgataataaggaacctggcggcagcgcaaaagatg

SEQ ID NO: 39505 - DNA, 103 bp, Artificial Sequence
  Synthetic Polynucleotide
taatacgactcactataggggaacggctcatcgtatcccctctcccgcagaacagaggagactgcggatgaggggatacaacctggcggcagcgcaaaagatg

SEQ ID NO: 39506 - DNA, 103 bp, Artificial Sequence
  Synthetic Polynucleotide
taatacgactcactatagggtcacagcgacttgtatttaggctagctgcaaacagaggagatgcagcatgcctaaatacaacctggcggcagcgcaaaagatg

SEQ ID NO: 39507 - DNA, 103 bp, Artificial Sequence
  Synthetic Polynucleotide
taatacgactcactataggggtgaaactgagcattcgcagtcacctcgataacagaggagaatcgagatgactgcgaataacctggcggcagcgcaaaagatg

SEQ ID NO: 39508 - DNA, 103 bp, Artificial Sequence
  Synthetic Polynucleotide
taatacgactcactataggggtttatggtacatggtccggtccatacccaaacagaggagatgggtaatgaccggaccaaacctggcggcagcgcaaaagatg

SEQ ID NO: 39509 - DNA, 103 bp, Artificial Sequence
  Synthetic Polynucleotide
taatacgactcactatagggttatttctgcagacacggagcgttgtgtagaacagaggagactacacatggctccgtgtaacctggcggcagcgcaaaagatg

SEQ ID NO: 39510 - DNA, 103 bp, Artificial Sequence
  Synthetic Polynucleotide
taatacgactcactatagggtcacgtagacgggtcaatacggtcaggttaaacagaggagataacctatgcgtattgacaacctggcggcagcgcaaaagatg

SEQ ID NO: 39511 - DNA, 103 bp, Artificial Sequence
  Synthetic Polynucleotide
taatacgactcactatagggccataccaggtaaaaatacctagttcgcccaacagaggagagggcgaatgaggtattttaacctggcggcagcgcaaaagatg

SEQ ID NO: 39512 - DNA, 103 bp, Artificial Sequence
  Synthetic Polynucleotide
taatacgactcactatagggttctcggcaataacccgtaaggagcgagaaaacagaggagattctcgatgcttacgggtaacctggcggcagcgcaaaagatg

SEQ ID NO: 39513 - DNA, 103 bp, Artificial Sequence
  Synthetic Polynucleotide
taatacgactcactatagggaaatgcctcgagagtgcggcgtgaaaattaaacagaggagataatttatgcgccgcactaacctggcggcagcgcaaaagatg

SEQ ID NO: 39514 - DNA, 103 bp, Artificial Sequence
  Synthetic Polynucleotide
taatacgactcactatagggccggtcccgatagtcccattgcccctgtgaaacagaggagatcacagatgcaatgggacaacctggcggcagcgcaaaagatg

SEQ ID NO: 39515 - DNA, 103 bp, Artificial Sequence
  Synthetic Polynucleotide
taatacgactcactatagggtaaagttgtactatcgtttaccagtccatcaacagaggagagatggaatggtaaacgataacctggcggcagcgcaaaagatg

SEQ ID NO: 39516 - DNA, 103 bp, Artificial Sequence
  Synthetic Polynucleotide
taatacgactcactatagggtctttcgaagtacaccgttagacccgctaaaacagaggagattagcgatgctaacggtgaacctggcggcagcgcaaaagatg

SEQ ID NO: 39517 - DNA, 103 bp, Artificial Sequence
  Synthetic Polynucleotide
taatacgactcactataggggtatgatccactacgtggtcaataggtattaacagaggagaaataccatgtgaccacgtaacctggcggcagcgcaaaagatg

SEQ ID NO: 39518 - DNA, 103 bp, Artificial Sequence
  Synthetic Polynucleotide
taatacgactcactatagggtggagggtggcatatccctcactatcctagaacagaggagactaggaatgtgagggataaacctggcggcagcgcaaaagatg

SEQ ID NO: 39519 - DNA, 103 bp, Artificial Sequence
  Synthetic Polynucleotide
taatacgactcactatagggacttcgcagattacactgccctaggcttgtaacagaggagaacaagcatggggcagtgtaacctggcggcagcgcaaaagatg

SEQ ID NO: 39520 - DNA, 103 bp, Artificial Sequence
  Synthetic Polynucleotide
taatacgactcactatagggaggaaggtgcatcaatcctctttggaagctaacagaggagaagcttcatgagaggattgaacctggcggcagcgcaaaagatg

SEQ ID NO: 39521 - DNA, 103 bp, Artificial Sequence
  Synthetic Polynucleotide
taatacgactcactatagggacccttcccgtgtcaggttcagtagctttcaacagaggagagaaagcatgtgaacctgaaacctggcggcagcgcaaaagatg

SEQ ID NO: 39522 - DNA, 103 bp, Artificial Sequence
  Synthetic Polynucleotide
taatacgactcactatagggtttcccgtttttggcaaatttcagtgttgcaacagaggagagcaacaatgaaatttgccaacctggcggcagcgcaaaagatg

SEQ ID NO: 39523 - DNA, 103 bp, Artificial Sequence
  Synthetic Polynucleotide
taatacgactcactatagggctaggaaaagtctgctagtgttggcctggcaacagaggagagccaggatgacactagcaaacctggcggcagcgcaaaagatg

SEQ ID NO: 39524 - DNA, 103 bp, Artificial Sequence
  Synthetic Polynucleotide
taatacgactcactatagggctccgttcatataggacagttaggccatataacagaggagaatatggatgaactgtcctaacctggcggcagcgcaaaagatg

SEQ ID NO: 39525 - DNA, 103 bp, Artificial Sequence
  Synthetic Polynucleotide
taatacgactcactatagggccggtcaacgttccaggataagaccaccacaacagaggagagtggtgatgttatcctggaacctggcggcagcgcaaaagatg

SEQ ID NO: 39526 - DNA, 103 bp, Artificial Sequence
  Synthetic Polynucleotide
taatacgactcactatagggtgaagcactcgtacaaattcgacctaaataaacagaggagatatttaatgcgaatttgtaacctggcggcagcgcaaaagatg

SEQ ID NO: 39527 - DNA, 103 bp, Artificial Sequence
  Synthetic Polynucleotide
taatacgactcactatagggtttgggcactcctgttttctggtccgcaaaaacagaggagatttgcgatgcagaaaacaaacctggcggcagcgcaaaagatg

SEQ ID NO: 39528 - DNA, 103 bp, Artificial Sequence
  Synthetic Polynucleotide
taatacgactcactatagggtggtaaaatggcgaccggcgagcaggctataacagaggagaatagccatgtcgccggtcaacctggcggcagcgcaaaagatg

SEQ ID NO: 39529 - DNA, 103 bp, Artificial Sequence
  Synthetic Polynucleotide
taatacgactcactataggggtcacagtcggggttcgcagcgcgacgtcaaacagaggagatgacgtatggctgcgaacaacctggcggcagcgcaaaagatg

SEQ ID NO: 39530 - DNA, 103 bp, Artificial Sequence
  Synthetic Polynucleotide
taatacgactcactatagggtttgcaccctctcttaacaatgaagtcgttaacagaggagaaacgacatgattgttaagaacctggcggcagcgcaaaagatg

SEQ ID NO: 39531 - DNA, 103 bp, Artificial Sequence
  Synthetic Polynucleotide
taatacgactcactatagggcatttcaagttctcggtaggcaactaagagaacagaggagactcttaatggcctaccgaaacctggcggcagcgcaaaagatg

SEQ ID NO: 39532 - DNA, 103 bp, Artificial Sequence
  Synthetic Polynucleotide
taatacgactcactatagggcgttcccgtttacatgtcacggttcctaacaacagaggagagttaggatgcgtgacatgaacctggcggcagcgcaaaagatg

SEQ ID NO: 39533 - DNA, 103 bp, Artificial Sequence
  Synthetic Polynucleotide
taatacgactcactatagggacatggttacctccaatgcctgcgtcgaggaacagaggagacctcgaatgaggcattggaacctggcggcagcgcaaaagatg

SEQ ID NO: 39534 - DNA, 103 bp, Artificial Sequence
  Synthetic Polynucleotide
taatacgactcactatagggcctgttctgttgcaaatttgatgaattgttaacagaggagaaacaatatgtcaaatttgaacctggcggcagcgcaaaagatg

SEQ ID NO: 39535 - DNA, 103 bp, Artificial Sequence
  Synthetic Polynucleotide
taatacgactcactatagggcgcaggtcgtgaactcaacccttaagcgataacagaggagaatcgctatggggttgagtaacctggcggcagcgcaaaagatg

SEQ ID NO: 39536 - DNA, 103 bp, Artificial Sequence
  Synthetic Polynucleotide
taatacgactcactataggggctcgatcgtatgcccagcaatttcaacccaacagaggagagggttgatgttgctgggcaacctggcggcagcgcaaaagatg

SEQ ID NO: 39537 - DNA, 103 bp, Artificial Sequence
  Synthetic Polynucleotide
taatacgactcactatagggtacttaggccatcattaaggaagcctgcgcaacagaggagagcgcagatgtccttaatgaacctggcggcagcgcaaaagatg

SEQ ID NO: 39538 - DNA, 103 bp, Artificial Sequence
  Synthetic Polynucleotide
taatacgactcactataggggtggaactccatcctccgtgcaggacaaaaaacagaggagattttgtatggcacggaggaacctggcggcagcgcaaaagatg

SEQ ID NO: 39539 - DNA, 103 bp, Artificial Sequence
  Synthetic Polynucleotide
taatacgactcactatagggctcctgttttccgacgcggcgaatgtgtcaaacagaggagatgacacatgcgccgcgtcaacctggcggcagcgcaaaagatg

SEQ ID NO: 39540 - DNA, 103 bp, Artificial Sequence
  Synthetic Polynucleotide
taatacgactcactataggggcgtcatccgaggaaacagccccagatattaacagaggagaaatatcatgggctgtttcaacctggcggcagcgcaaaagatg

SEQ ID NO: 39541 - DNA, 103 bp, Artificial Sequence
  Synthetic Polynucleotide
taatacgactcactatagggacgggactccaacgtggaacgaacactccgaacagaggagacggagtatgcgttccacgaacctggcggcagcgcaaaagatg

SEQ ID NO: 39542 - DNA, 103 bp, Artificial Sequence
  Synthetic Polynucleotide
taatacgactcactataggggcgcgatagtcgttaacgctgctgtggcagaacagaggagactgccaatgcagcgttaaaacctggcggcagcgcaaaagatg

SEQ ID NO: 39543 - DNA, 103 bp, Artificial Sequence
  Synthetic Polynucleotide
taatacgactcactatagggatggctacaatctgcacaaatccaccttctaacagaggagaagaaggatgatttgtgcaaacctggcggcagcgcaaaagatg

SEQ ID NO: 39544 - DNA, 103 bp, Artificial Sequence
  Synthetic Polynucleotide
taatacgactcactatagggcccaacatcgcgctgttggttcgcttgaggaacagaggagacctcaaatgaaccaacagaacctggcggcagcgcaaaagatg

SEQ ID NO: 39545 - DNA, 103 bp, Artificial Sequence
  Synthetic Polynucleotide
taatacgactcactatagggtggtgcaggcaatcattggtctatatgataaacagaggagatatcatatggaccaatgaaacctggcggcagcgcaaaagatg

SEQ ID NO: 39546 - DNA, 103 bp, Artificial Sequence
  Synthetic Polynucleotide
taatacgactcactataggggctagggtagattcgccgtgctccgggcttaacagaggagaaagcccatggcacggcgaaacctggcggcagcgcaaaagatg

SEQ ID NO: 39547 - DNA, 103 bp, Artificial Sequence
  Synthetic Polynucleotide
taatacgactcactatagggatcggataccgtccgttctgttcacgtaacaacagaggagagttacgatgacagaacggaacctggcggcagcgcaaaagatg

SEQ ID NO: 39548 - DNA, 103 bp, Artificial Sequence
  Synthetic Polynucleotide
taatacgactcactatagggtctgtgaggcacggcttgtcaaattgccagaacagaggagactggcaatgtgacaagccaacctggcggcagcgcaaaagatg

SEQ ID NO: 39549 - DNA, 103 bp, Artificial Sequence
  Synthetic Polynucleotide
taatacgactcactataggggtttaaacatcgcgatagccaactctatctaacagaggagaagatagatgtggctatcgaacctggcggcagcgcaaaagatg

SEQ ID NO: 39550 - DNA, 103 bp, Artificial Sequence
  Synthetic Polynucleotide
taatacgactcactatagggctccgtggctcttgggctctcctatgcgataacagaggagaatcgcaatggagagcccaaacctggcggcagcgcaaaagatg

SEQ ID NO: 39551 - DNA, 103 bp, Artificial Sequence
  Synthetic Polynucleotide
taatacgactcactatagggattccctcacgtaacccttttcagccttacaacagaggagagtaaggatgaaaagggttaacctggcggcagcgcaaaagatg

SEQ ID NO: 39552 - DNA, 103 bp, Artificial Sequence
  Synthetic Polynucleotide
taatacgactcactatagggccgcccggtgccatactattctggacgttgaacagaggagacaacgtatggaatagtataacctggcggcagcgcaaaagatg

SEQ ID NO: 39553 - DNA, 103 bp, Artificial Sequence
  Synthetic Polynucleotide
taatacgactcactatagggtacaagggacgggtgtgaatacggcaccagaacagaggagactggtgatgtattcacacaacctggcggcagcgcaaaagatg

SEQ ID NO: 39554 - DNA, 103 bp, Artificial Sequence
  Synthetic Polynucleotide
taatacgactcactataggggtaagtgacaacccttcgtgggtcgtaaccaacagaggagaggttacatgccacgaaggaacctggcggcagcgcaaaagatg

SEQ ID NO: 39555 - DNA, 103 bp, Artificial Sequence
  Synthetic Polynucleotide
taatacgactcactatagggcgtggtagtctaatatgccagttgagtcttaacagaggagaaagactatgctggcatataacctggcggcagcgcaaaagatg

SEQ ID NO: 39556 - DNA, 103 bp, Artificial Sequence
  Synthetic Polynucleotide
taatacgactcactatagggaaaaatagatgttttaaattgctgcctaagaacagaggagacttaggatgcaatttaaaaacctggcggcagcgcaaaagatg

SEQ ID NO: 39557 - DNA, 103 bp, Artificial Sequence
  Synthetic Polynucleotide
taatacgactcactatagggcccacagcatgctgtatttaagatgcaagtaacagaggagaacttgcatgttaaatacaaacctggcggcagcgcaaaagatg

SEQ ID NO: 39558 - DNA, 103 bp, Artificial Sequence
  Synthetic Polynucleotide
taatacgactcactatagggttgataaaagaagccgtaagctgtccgaataacagaggagaattcggatggcttacggcaacctggcggcagcgcaaaagatg

SEQ ID NO: 39559 - DNA, 103 bp, Artificial Sequence
  Synthetic Polynucleotide
taatacgactcactataggggcttgttcacgaacgctccacacggatataaacagaggagatatatcatggtggagcgtaacctggcggcagcgcaaaagatg

SEQ ID NO: 39560 - DNA, 103 bp, Artificial Sequence
  Synthetic Polynucleotide
taatacgactcactataggggagttaatcctgcgcaggccgtttgatactaacagaggagaagtatcatgcggcctgcgaacctggcggcagcgcaaaagatg

SEQ ID NO: 39561 - DNA, 103 bp, Artificial Sequence
  Synthetic Polynucleotide
taatacgactcactataggggggggggtatttctcaagtctaacgcgctaaacagaggagatagcgcatgagacttgagaacctggcggcagcgcaaaagatg

SEQ ID NO: 39562 - DNA, 103 bp, Artificial Sequence
  Synthetic Polynucleotide
taatacgactcactatagggtagctattaactggcactcaacgtctcaaaaacagaggagatttgagatgttgagtgccaacctggcggcagcgcaaaagatg

SEQ ID NO: 39563 - DNA, 103 bp, Artificial Sequence
  Synthetic Polynucleotide
taatacgactcactataggggttctggaaaataaagacgactcatttcggaacagaggagaccgaaaatggtcgtctttaacctggcggcagcgcaaaagatg

SEQ ID NO: 39564 - DNA, 103 bp, Artificial Sequence
  Synthetic Polynucleotide
taatacgactcactatagggtacgatcttaaccgtaagtccacgtgtgcaaacagaggagatgcacaatgggacttacgaacctggcggcagcgcaaaagatg

SEQ ID NO: 39565 - DNA, 103 bp, Artificial Sequence
  Synthetic Polynucleotide
taatacgactcactatagggcccccggctcggattttcgccacccctcataacagaggagaatgaggatgggcgaaaataacctggcggcagcgcaaaagatg

SEQ ID NO: 39566 - DNA, 103 bp, Artificial Sequence
  Synthetic Polynucleotide
taatacgactcactataggggtgcagccgcctcaaaatgactttgagccgaacagaggagacggctcatggtcattttgaacctggcggcagcgcaaaagatg

SEQ ID NO: 39567 - DNA, 103 bp, Artificial Sequence
  Synthetic Polynucleotide
taatacgactcactatagggcacttttggcctaggtctaggtgtaacaaaaacagaggagatttgttatgcctagacctaacctggcggcagcgcaaaagatg

SEQ ID NO: 39568 - DNA, 103 bp, Artificial Sequence
  Synthetic Polynucleotide
taatacgactcactatagggaagactgggagggtgttcctacgatagtctaacagaggagaagactaatgtaggaacacaacctggcggcagcgcaaaagatg

SEQ ID NO: 39569 - DNA, 103 bp, Artificial Sequence
  Synthetic Polynucleotide
taatacgactcactatagggtaaaagggtaactgcatttagatcatcgtcaacagaggagagacgatatgctaaatgcaaacctggcggcagcgcaaaagatg

SEQ ID NO: 39570 - DNA, 103 bp, Artificial Sequence
  Synthetic Polynucleotide
taatacgactcactatagggctcatcagcggttaccttccgttttttgctaacagaggagaagcaaaatgcggaaggtaaacctggcggcagcgcaaaagatg

SEQ ID NO: 39571 - DNA, 103 bp, Artificial Sequence
  Synthetic Polynucleotide
taatacgactcactatagggtctccccgtatacatgtatctcgcagatggaacagaggagaccatctatgagatacatgaacctggcggcagcgcaaaagatg

SEQ ID NO: 39572 - DNA, 103 bp, Artificial Sequence
  Synthetic Polynucleotide
taatacgactcactatagggccatatgaacgcatagagacaggcatatcgaacagaggagacgatatatgtgtctctataacctggcggcagcgcaaaagatg

SEQ ID NO: 39573 - DNA, 103 bp, Artificial Sequence
  Synthetic Polynucleotide
taatacgactcactatagggagtactttatagtagtcatcatcatctcggaacagaggagaccgagaatgtgatgactaaacctggcggcagcgcaaaagatg

SEQ ID NO: 39574 - DNA, 103 bp, Artificial Sequence
  Synthetic Polynucleotide
taatacgactcactatagggcgactcattgtgaacttttgcgcgctacgaaacagaggagatcgtagatggcaaaagttaacctggcggcagcgcaaaagatg

SEQ ID NO: 39575 - DNA, 103 bp, Artificial Sequence
  Synthetic Polynucleotide
taatacgactcactatagggcaactgtaatccgaagtacggatagtttaaaacagaggagattaaacatgccgtacttcaacctggcggcagcgcaaaagatg

SEQ ID NO: 39576 - DNA, 103 bp, Artificial Sequence
  Synthetic Polynucleotide
taatacgactcactataggggtgctagaatctaccttgttcagagtggttaacagaggagaaaccacatggaacaaggtaacctggcggcagcgcaaaagatg

SEQ ID NO: 39577 - DNA, 103 bp, Artificial Sequence
  Synthetic Polynucleotide
taatacgactcactatagggttcatctttttccaccatattagggacctgaacagaggagacaggtcatgaatatggtgaacctggcggcagcgcaaaagatg

SEQ ID NO: 39578 - DNA, 103 bp, Artificial Sequence
  Synthetic Polynucleotide
taatacgactcactatagggtaacttattgatgttacgattgatatagagaacagaggagactctatatgaatcgtaacaacctggcggcagcgcaaaagatg

SEQ ID NO: 39579 - DNA, 103 bp, Artificial Sequence
  Synthetic Polynucleotide
taatacgactcactataggggtagcagccgcgcggggttcactctcgtataacagaggagaatacgaatgtgaaccccgaacctggcggcagcgcaaaagatg

SEQ ID NO: 39580 - DNA, 103 bp, Artificial Sequence
  Synthetic Polynucleotide
taatacgactcactataggggtaattaacgtctcacctgatgctggccagaacagaggagactggccatgatcaggtgaaacctggcggcagcgcaaaagatg

SEQ ID NO: 39581 - DNA, 103 bp, Artificial Sequence
  Synthetic Polynucleotide
taatacgactcactatagggaagcctgttaatgctaacgaacagccttataacagaggagaataaggatgttcgttagcaacctggcggcagcgcaaaagatg

SEQ ID NO: 39582 - DNA, 103 bp, Artificial Sequence
  Synthetic Polynucleotide
taatacgactcactatagggtgcccctggtggtgaacctcaaggtggattaacagaggagaaatccaatgtgaggttcaaacctggcggcagcgcaaaagatg

SEQ ID NO: 39583 - DNA, 103 bp, Artificial Sequence
  Synthetic Polynucleotide
taatacgactcactatagggtagcatccgtataaagttctttgcacccttaacagaggagaaagggtatgaagaactttaacctggcggcagcgcaaaagatg

SEQ ID NO: 39584 - DNA, 103 bp, Artificial Sequence
  Synthetic Polynucleotide
taatacgactcactataggggcctcttataatccggccagtcaaagcggcaacagaggagagccgctatgactggccggaacctggcggcagcgcaaaagatg

SEQ ID NO: 39585 - DNA, 103 bp, Artificial Sequence
  Synthetic Polynucleotide
taatacgactcactatagggacagcgcttactaacccctgtggcatagagaacagaggagactctatatgacaggggttaacctggcggcagcgcaaaagatg

SEQ ID NO: 39586 - DNA, 103 bp, Artificial Sequence
  Synthetic Polynucleotide
taatacgactcactatagggacaagactggttcttgtgttagaaagtcacaacagaggagagtgactatgtaacacaagaacctggcggcagcgcaaaagatg

SEQ ID NO: 39587 - DNA, 103 bp, Artificial Sequence
  Synthetic Polynucleotide
taatacgactcactatagggatttttaaggaattgcgaaaacaatccgccaacagaggagaggcggaatgttttcgcaaaacctggcggcagcgcaaaagatg

SEQ ID NO: 39588 - DNA, 103 bp, Artificial Sequence
  Synthetic Polynucleotide
taatacgactcactatagggtggtccatcggttaagggtacgctcgatacaacagaggagagtatcgatggtacccttaaacctggcggcagcgcaaaagatg

SEQ ID NO: 39589 - DNA, 103 bp, Artificial Sequence
  Synthetic Polynucleotide
taatacgactcactataggggggctcaataaatctcgagtaagtagcaggaacagaggagacctgctatgtactcgagaaacctggcggcagcgcaaaagatg

SEQ ID NO: 39590 - DNA, 103 bp, Artificial Sequence
  Synthetic Polynucleotide
taatacgactcactatagggttcgcacacaattataaatagagaaagctcaacagaggagagagcttatgctatttataaacctggcggcagcgcaaaagatg

SEQ ID NO: 39591 - DNA, 103 bp, Artificial Sequence
  Synthetic Polynucleotide
taatacgactcactatagggaggaaggagtgaatcggtcataatgtagtaaacagaggagatactacatgatgaccgataacctggcggcagcgcaaaagatg

SEQ ID NO: 39592 - DNA, 103 bp, Artificial Sequence
  Synthetic Polynucleotide
taatacgactcactatagggtactttatgtccagcaaagagcactaattcaacagaggagagaattaatgctctttgctaacctggcggcagcgcaaaagatg

SEQ ID NO: 39593 - DNA, 103 bp, Artificial Sequence
  Synthetic Polynucleotide
taatacgactcactatagggaccgagtagaatggcgggggaccatggagtaacagaggagaactccaatgtcccccgccaacctggcggcagcgcaaaagatg

SEQ ID NO: 39594 - DNA, 103 bp, Artificial Sequence
  Synthetic Polynucleotide
taatacgactcactatagggtcccagcgatctgagatgcgaccgcctgcaaacagaggagatgcaggatgtcgcatctcaacctggcggcagcgcaaaagatg

SEQ ID NO: 39595 - DNA, 103 bp, Artificial Sequence
  Synthetic Polynucleotide
taatacgactcactataggggcgacacggacctacagacccggtcctctaaacagaggagatagaggatggggtctgtaaacctggcggcagcgcaaaagatg

SEQ ID NO: 39596 - DNA, 103 bp, Artificial Sequence
  Synthetic Polynucleotide
taatacgactcactatagggtccgagtagtcatctgccgccagtaggtccaacagaggagaggacctatgggcggcagaaacctggcggcagcgcaaaagatg

SEQ ID NO: 39597 - DNA, 103 bp, Artificial Sequence
  Synthetic Polynucleotide
taatacgactcactatagggtaagttcgtggacacgggctagttttatgcaacagaggagagcataaatgtagcccgtgaacctggcggcagcgcaaaagatg

SEQ ID NO: 39598 - DNA, 103 bp, Artificial Sequence
  Synthetic Polynucleotide
taatacgactcactataggggggtcgaacgtataaggaatcgtcacgccaaacagaggagatggcgtatggattccttaaacctggcggcagcgcaaaagatg

SEQ ID NO: 39599 - DNA, 103 bp, Artificial Sequence
  Synthetic Polynucleotide
taatacgactcactataggggcagtatacatcacttgcttaaccggcgaaaacagaggagattcgccatgtaagcaagtaacctggcggcagcgcaaaagatg

SEQ ID NO: 39600 - DNA, 103 bp, Artificial Sequence
  Synthetic Polynucleotide
taatacgactcactatagggcctaagatgtaagatagcgtttgcgcccaaaacagaggagattgggcatgaacgctatcaacctggcggcagcgcaaaagatg

SEQ ID NO: 39601 - DNA, 103 bp, Artificial Sequence
  Synthetic Polynucleotide
taatacgactcactatagggatgcaagtatccgcgaaagccagactcttcaacagaggagagaagagatgggctttcgcaacctggcggcagcgcaaaagatg

SEQ ID NO: 39602 - DNA, 103 bp, Artificial Sequence
  Synthetic Polynucleotide
taatacgactcactatagggcgttctatcccatctaccctccttctacccaacagaggagagggtagatggagggtagaaacctggcggcagcgcaaaagatg

SEQ ID NO: 39603 - DNA, 103 bp, Artificial Sequence
  Synthetic Polynucleotide
taatacgactcactatagggcgattaaagtgtagacacccagggcgcgtgaacagaggagacacgcgatgtgggtgtctaacctggcggcagcgcaaaagatg

SEQ ID NO: 39604 - DNA, 103 bp, Artificial Sequence
  Synthetic Polynucleotide
taatacgactcactatagggtgggttgtttcatcacgttgtgggcgcgcaaacagaggagatgcgcgatgacaacgtgaaacctggcggcagcgcaaaagatg

SEQ ID NO: 39605 - DNA, 103 bp, Artificial Sequence
  Synthetic Polynucleotide
taatacgactcactataggggaccatatatccaatatttattgacaaaacaacagaggagagttttgatgataaatattaacctggcggcagcgcaaaagatg

SEQ ID NO: 39606 - DNA, 103 bp, Artificial Sequence
  Synthetic Polynucleotide
taatacgactcactatagggacaactgcacgctaatgctagcccacccttaacagaggagaaagggtatgctagcattaaacctggcggcagcgcaaaagatg

SEQ ID NO: 39607 - DNA, 103 bp, Artificial Sequence
  Synthetic Polynucleotide
taatacgactcactatagggccgttttctcgcatttgcagtgttatggttaacagaggagaaaccatatgactgcaaataacctggcggcagcgcaaaagatg

SEQ ID NO: 39608 - DNA, 103 bp, Artificial Sequence
  Synthetic Polynucleotide
taatacgactcactataggggggaagcggcctagatgtgtcgccggggagaacagaggagactccccatggacacatctaacctggcggcagcgcaaaagatg

SEQ ID NO: 39609 - DNA, 103 bp, Artificial Sequence
  Synthetic Polynucleotide
taatacgactcactatagggttcttaagcgcaagaccaaccgaagtagtaaacagaggagatactacatgggttggtctaacctggcggcagcgcaaaagatg

SEQ ID NO: 39610 - DNA, 103 bp, Artificial Sequence
  Synthetic Polynucleotide
taatacgactcactataggggaggtcgtgcctaatgcgatagctgatgataacagaggagaatcatcatgtatcgcattaacctggcggcagcgcaaaagatg

SEQ ID NO: 39611 - DNA, 103 bp, Artificial Sequence
  Synthetic Polynucleotide
taatacgactcactatagggagcgtcgtggaattaagccaaagcagtggtaacagaggagaaccactatgttggcttaaaacctggcggcagcgcaaaagatg

SEQ ID NO: 39612 - DNA, 103 bp, Artificial Sequence
  Synthetic Polynucleotide
taatacgactcactataggggtgagacgcaacgacgttgatagcatctggaacagaggagaccagatatgatcaacgtcaacctggcggcagcgcaaaagatg

SEQ ID NO: 39613 - DNA, 103 bp, Artificial Sequence
  Synthetic Polynucleotide
taatacgactcactatagggcaggagacagccacagtccgtccagtcgataacagaggagaatcgacatgacggactgtaacctggcggcagcgcaaaagatg

SEQ ID NO: 39614 - DNA, 103 bp, Artificial Sequence
  Synthetic Polynucleotide
taatacgactcactatagggcgagctgtctgtaccgcgccaaatcctgctaacagaggagaagcaggatgtggcgcggtaacctggcggcagcgcaaaagatg

SEQ ID NO: 39615 - DNA, 103 bp, Artificial Sequence
  Synthetic Polynucleotide
taatacgactcactatagggaagcgacaagcggctgacttattaatactaaacagaggagatagtatatgtaagtcagcaacctggcggcagcgcaaaagatg

SEQ ID NO: 39616 - DNA, 103 bp, Artificial Sequence
  Synthetic Polynucleotide
taatacgactcactataggggattaaacagatctgatcgtcggcaaatggaacagaggagaccatttatggacgatcagaacctggcggcagcgcaaaagatg

SEQ ID NO: 39617 - DNA, 103 bp, Artificial Sequence
  Synthetic Polynucleotide
taatacgactcactatagggagggagtggccacttccacaggagcgccgcaacagaggagagcggcgatgctgtggaagaacctggcggcagcgcaaaagatg

SEQ ID NO: 39618 - DNA, 103 bp, Artificial Sequence
  Synthetic Polynucleotide
taatacgactcactatagggtcccctaacaaccctacaggcatgggttttaacagaggagaaaaaccatggcctgtaggaacctggcggcagcgcaaaagatg

SEQ ID NO: 39619 - DNA, 103 bp, Artificial Sequence
  Synthetic Polynucleotide
taatacgactcactataggggaggtccatgaggcgcccgacgatttctcgaacagaggagacgagaaatggtcgggcgcaacctggcggcagcgcaaaagatg

SEQ ID NO: 39620 - DNA, 103 bp, Artificial Sequence
  Synthetic Polynucleotide
taatacgactcactataggggcctaatacttagcatctattcctctccttaacagaggagaaaggagatgaatagatgcaacctggcggcagcgcaaaagatg

SEQ ID NO: 39621 - DNA, 103 bp, Artificial Sequence
  Synthetic Polynucleotide
taatacgactcactatagggcttgatccgccactcgcattccagaaggtaaacagaggagataccttatggaatgcgagaacctggcggcagcgcaaaagatg

SEQ ID NO: 39622 - DNA, 103 bp, Artificial Sequence
  Synthetic Polynucleotide
taatacgactcactatagggcggagcctggtaaatggttcgaagagcggtaacagaggagaaccgctatgcgaaccattaacctggcggcagcgcaaaagatg

SEQ ID NO: 39623 - DNA, 103 bp, Artificial Sequence
  Synthetic Polynucleotide
taatacgactcactatagggataggataggcactaacaccggattataccaacagaggagaggtataatgcggtgttagaacctggcggcagcgcaaaagatg

SEQ ID NO: 39624 - DNA, 103 bp, Artificial Sequence
  Synthetic Polynucleotide
taatacgactcactatagggacccccgcccactttagaacccgtgttataaacagaggagatataacatgggttctaaaaacctggcggcagcgcaaaagatg

SEQ ID NO: 39625 - DNA, 103 bp, Artificial Sequence
  Synthetic Polynucleotide
taatacgactcactatagggcttcgatgaagcagctagaaaatatggttgaacagaggagacaaccaatgtttctagctaacctggcggcagcgcaaaagatg

SEQ ID NO: 39626 - DNA, 103 bp, Artificial Sequence
  Synthetic Polynucleotide
taatacgactcactatagggttacgggtggtgggcggcgcaagagtatgcaacagaggagagcatacatgtgcgccgccaacctggcggcagcgcaaaagatg

SEQ ID NO: 39627 - DNA, 103 bp, Artificial Sequence
  Synthetic Polynucleotide
taatacgactcactataggggtcaactctattgtgcgcttaaacgttgacaacagaggagagtcaacatgtaagcgcacaacctggcggcagcgcaaaagatg

SEQ ID NO: 39628 - DNA, 103 bp, Artificial Sequence
  Synthetic Polynucleotide
taatacgactcactatagggcttctcgcgacacgcgcgcgagtatggtgcaacagaggagagcaccaatgtcgcgcgcgaacctggcggcagcgcaaaagatg

SEQ ID NO: 39629 - DNA, 103 bp, Artificial Sequence
  Synthetic Polynucleotide
taatacgactcactatagggagcatcgcatgcttactggagcccggccagaacagaggagactggccatgctccagtaaaacctggcggcagcgcaaaagatg

SEQ ID NO: 39630 - DNA, 103 bp, Artificial Sequence
  Synthetic Polynucleotide
taatacgactcactatagggacgcaccctcttgggacgcgtggcagccaaaacagaggagattggctatgacgcgtcccaacctggcggcagcgcaaaagatg

SEQ ID NO: 39631 - DNA, 103 bp, Artificial Sequence
  Synthetic Polynucleotide
taatacgactcactataggggatagccccgtgaatgcgaaagactagcacaacagaggagagtgctaatgtttcgcattaacctggcggcagcgcaaaagatg

SEQ ID NO: 39632 - DNA, 103 bp, Artificial Sequence
  Synthetic Polynucleotide
taatacgactcactatagggttgtcatcggaggtagggttgatggctaaaaacagaggagatttagcatgcaaccctacaacctggcggcagcgcaaaagatg

SEQ ID NO: 39633 - DNA, 103 bp, Artificial Sequence
  Synthetic Polynucleotide
taatacgactcactatagggtatcaagatattaatagcattacggatgcgaacagaggagacgcatcatgaatgctattaacctggcggcagcgcaaaagatg

SEQ ID NO: 39634 - DNA, 103 bp, Artificial Sequence
  Synthetic Polynucleotide
taatacgactcactatagggtcgtactttagcctattccatatcgcattcaacagaggagagaatgcatgatggaatagaacctggcggcagcgcaaaagatg

SEQ ID NO: 39635 - DNA, 103 bp, Artificial Sequence
  Synthetic Polynucleotide
taatacgactcactataggggtaacgtccgtatggtgcgggcaatattgcaacagaggagagcaataatgcccgcaccaaacctggcggcagcgcaaaagatg

SEQ ID NO: 39636 - DNA, 103 bp, Artificial Sequence
  Synthetic Polynucleotide
taatacgactcactatagggcgggctgtccgcgacagaatcacgctcgataacagaggagaatcgagatggattctgtcaacctggcggcagcgcaaaagatg

SEQ ID NO: 39637 - DNA, 103 bp, Artificial Sequence
  Synthetic Polynucleotide
taatacgactcactatagggtgcatatttaggcaggcccttgtcccaagcaacagaggagagcttggatgaagggcctgaacctggcggcagcgcaaaagatg

SEQ ID NO: 39638 - DNA, 103 bp, Artificial Sequence
  Synthetic Polynucleotide
taatacgactcactatagggaactcctcttcctctgaaggccggcaaaacaacagaggagagttttgatggccttcagaaacctggcggcagcgcaaaagatg

SEQ ID NO: 39639 - DNA, 103 bp, Artificial Sequence
  Synthetic Polynucleotide
taatacgactcactatagggcgtctactggtgatccttcacccccgcaagaacagaggagacttgcgatggtgaaggataacctggcggcagcgcaaaagatg

SEQ ID NO: 39640 - DNA, 103 bp, Artificial Sequence
  Synthetic Polynucleotide
taatacgactcactatagggatgatagccgcgttacgcaacaattaaagcaacagaggagagctttaatggttgcgtaaaacctggcggcagcgcaaaagatg

SEQ ID NO: 39641 - DNA, 103 bp, Artificial Sequence
  Synthetic Polynucleotide
taatacgactcactatagggccgaggtcgctatgagcacctccttattccaacagaggagaggaataatgaggtgctcaaacctggcggcagcgcaaaagatg

SEQ ID NO: 39642 - DNA, 103 bp, Artificial Sequence
  Synthetic Polynucleotide
taatacgactcactataggggttctgcttaccgagtagctatcagatgtcaacagaggagagacatcatgtagctactcaacctggcggcagcgcaaaagatg

SEQ ID NO: 39643 - DNA, 103 bp, Artificial Sequence
  Synthetic Polynucleotide
taatacgactcactatagggttcagcatttagcaccggtcgcatagatgaaacagaggagatcatctatgcgaccggtgaacctggcggcagcgcaaaagatg

SEQ ID NO: 39644 - DNA, 103 bp, Artificial Sequence
  Synthetic Polynucleotide
taatacgactcactataggggttcgttccaattatgaagcggataagactaacagaggagaagtcttatgcgcttcataaacctggcggcagcgcaaaagatg

SEQ ID NO: 39645 - DNA, 103 bp, Artificial Sequence
  Synthetic Polynucleotide
taatacgactcactatagggtgcataagtctaggttcctttccattttttaacagaggagaaaaaaaatgaaaggaaccaacctggcggcagcgcaaaagatg

SEQ ID NO: 39646 - DNA, 103 bp, Artificial Sequence
  Synthetic Polynucleotide
taatacgactcactatagggccgcgcgacaggtgagctaaaatatgaattaacagaggagaaattcaatgtttagctcaaacctggcggcagcgcaaaagatg

SEQ ID NO: 39647 - DNA, 103 bp, Artificial Sequence
  Synthetic Polynucleotide
taatacgactcactatagggtttattcgccgtccgtaatctttgcatataaacagaggagatatatgatgagattacggaacctggcggcagcgcaaaagatg

SEQ ID NO: 39648 - DNA, 103 bp, Artificial Sequence
  Synthetic Polynucleotide
taatacgactcactatagggcctaattcacgtgcaggtgggccgaaccggaacagaggagaccggttatgcccacctgcaacctggcggcagcgcaaaagatg

SEQ ID NO: 39649 - DNA, 103 bp, Artificial Sequence
  Synthetic Polynucleotide
taatacgactcactatagggccgttggggggcagagagcgtcccctccgtaacagaggagaacggagatgacgctctctaacctggcggcagcgcaaaagatg

SEQ ID NO: 39650 - DNA, 103 bp, Artificial Sequence
  Synthetic Polynucleotide
taatacgactcactatagggtaccgtcaggcgccatcattctaaatgatcaacagaggagagatcatatggaatgatggaacctggcggcagcgcaaaagatg

SEQ ID NO: 39651 - DNA, 103 bp, Artificial Sequence
  Synthetic Polynucleotide
taatacgactcactatagggtggggtactttagctacatcgagtatctataacagaggagaatagatatgcgatgtagcaacctggcggcagcgcaaaagatg

SEQ ID NO: 39652 - DNA, 103 bp, Artificial Sequence
  Synthetic Polynucleotide
taatacgactcactatagggttaccagaccttcccgagctattacgcatgaacagaggagacatgcgatgtagctcgggaacctggcggcagcgcaaaagatg

SEQ ID NO: 39653 - DNA, 103 bp, Artificial Sequence
  Synthetic Polynucleotide
taatacgactcactataggggcgtacacgaatgcacgcgccgcactacccaacagaggagagggtagatgggcgcgtgcaacctggcggcagcgcaaaagatg

SEQ ID NO: 39654 - DNA, 103 bp, Artificial Sequence
  Synthetic Polynucleotide
taatacgactcactatagggggggccgtcagtcaggatgctgggcgggtgaacagaggagacacccgatgagcatcctgaacctggcggcagcgcaaaagatg

SEQ ID NO: 39655 - DNA, 103 bp, Artificial Sequence
  Synthetic Polynucleotide
taatacgactcactatagggatgtcaaaagcattagaataggacaacccgaacagaggagacgggttatgctattctaaaacctggcggcagcgcaaaagatg

SEQ ID NO: 39656 - DNA, 103 bp, Artificial Sequence
  Synthetic Polynucleotide
taatacgactcactatagggtggccacggctgttggcgaactctcgtgaaaacagaggagattcacgatggttcgccaaaacctggcggcagcgcaaaagatg

SEQ ID NO: 39657 - DNA, 103 bp, Artificial Sequence
  Synthetic Polynucleotide
taatacgactcactatagggtttataattccttggtttcctcagcattgtaacagaggagaacaatgatgaggaaaccaaacctggcggcagcgcaaaagatg

SEQ ID NO: 39658 - DNA, 103 bp, Artificial Sequence
  Synthetic Polynucleotide
taatacgactcactatagggcggtgctatctacttagcagctgtatattaaacagaggagataatatatggctgctaagaacctggcggcagcgcaaaagatg

SEQ ID NO: 39659 - DNA, 103 bp, Artificial Sequence
  Synthetic Polynucleotide
taatacgactcactataggggtgactcgtcatcctgcatatctatgcccgaacagaggagacgggcaatgatatgcaggaacctggcggcagcgcaaaagatg

SEQ ID NO: 39660 - DNA, 103 bp, Artificial Sequence
  Synthetic Polynucleotide
taatacgactcactataggggatgcgttccacttgggtgtggatccttgcaacagaggagagcaaggatgcacacccaaaacctggcggcagcgcaaaagatg

SEQ ID NO: 39661 - DNA, 103 bp, Artificial Sequence
  Synthetic Polynucleotide
taatacgactcactatagggacttgcgtaaaccgtactttgcgcgccttaaacagaggagataaggcatgcaaagtacgaacctggcggcagcgcaaaagatg

SEQ ID NO: 39662 - DNA, 103 bp, Artificial Sequence
  Synthetic Polynucleotide
taatacgactcactatagggtaaatatgtcgtggtctgtaccgtcctgacaacagaggagagtcaggatggtacagaccaacctggcggcagcgcaaaagatg

SEQ ID NO: 39663 - DNA, 103 bp, Artificial Sequence
  Synthetic Polynucleotide
taatacgactcactataggggtagatcattttgctgaacactaatgcaagaacagaggagacttgcaatggtgttcagcaacctggcggcagcgcaaaagatg

SEQ ID NO: 39664 - DNA, 103 bp, Artificial Sequence
  Synthetic Polynucleotide
taatacgactcactatagggttattccccctcgtgtgacttctgacttacaacagaggagagtaagtatgaagtcacacaacctggcggcagcgcaaaagatg

SEQ ID NO: 39665 - DNA, 103 bp, Artificial Sequence
  Synthetic Polynucleotide
taatacgactcactatagggggtattaaagcaccgtaaactaagacccataacagaggagaatgggtatgagtttacggaacctggcggcagcgcaaaagatg

SEQ ID NO: 39666 - DNA, 103 bp, Artificial Sequence
  Synthetic Polynucleotide
taatacgactcactataggggtgtggcagcgctcttttaagcaatccgtcaacagaggagagacggaatgcttaaaagaaacctggcggcagcgcaaaagatg

SEQ ID NO: 39667 - DNA, 103 bp, Artificial Sequence
  Synthetic Polynucleotide
taatacgactcactatagggcgcggaagcagttttctattgctttcaccgaacagaggagacggtgaatgcaatagaaaaacctggcggcagcgcaaaagatg

SEQ ID NO: 39668 - DNA, 103 bp, Artificial Sequence
  Synthetic Polynucleotide
taatacgactcactatagggcactctatgtaggctgttatgcgcagtaggaacagaggagacctactatgcataacagcaacctggcggcagcgcaaaagatg

SEQ ID NO: 39669 - DNA, 103 bp, Artificial Sequence
  Synthetic Polynucleotide
taatacgactcactatagggaattcccttcctcttttacgcgctttgcttaacagaggagaaagcaaatggcgtaaaagaacctggcggcagcgcaaaagatg

SEQ ID NO: 39670 - DNA, 103 bp, Artificial Sequence
  Synthetic Polynucleotide
taatacgactcactataggggcctgctcggaatgtccagctacatcccctaacagaggagaaggggaatgagctggacaaacctggcggcagcgcaaaagatg

SEQ ID NO: 39671 - DNA, 103 bp, Artificial Sequence
  Synthetic Polynucleotide
taatacgactcactatagggcgaagagtcgtgtcgtcccgaggtggcgtgaacagaggagacacgccatgtcgggacgaaacctggcggcagcgcaaaagatg

SEQ ID NO: 39672 - DNA, 103 bp, Artificial Sequence
  Synthetic Polynucleotide
taatacgactcactatagggcactacaatcaggtggttcgtttcccgcataacagaggagaatgcggatgacgaaccacaacctggcggcagcgcaaaagatg

SEQ ID NO: 39673 - DNA, 103 bp, Artificial Sequence
  Synthetic Polynucleotide
taatacgactcactatagggagtcatttgatctcctcgcttacggcgcggaacagaggagaccgcgcatgaagcgaggaaacctggcggcagcgcaaaagatg

SEQ ID NO: 39674 - DNA, 103 bp, Artificial Sequence
  Synthetic Polynucleotide
taatacgactcactatagggctccccctaggcagtatctctcattcgtacaacagaggagagtacgaatgagagatactaacctggcggcagcgcaaaagatg

SEQ ID NO: 39675 - DNA, 103 bp, Artificial Sequence
  Synthetic Polynucleotide
taatacgactcactatagggagtgttctacgtaactgtattacagagcccaacagaggagagggctcatgaatacagttaacctggcggcagcgcaaaagatg

SEQ ID NO: 39676 - DNA, 103 bp, Artificial Sequence
  Synthetic Polynucleotide
taatacgactcactatagggaacataatgttcagtaacgattctatcatcaacagaggagagatgatatgatcgttactaacctggcggcagcgcaaaagatg

SEQ ID NO: 39677 - DNA, 103 bp, Artificial Sequence
  Synthetic Polynucleotide
taatacgactcactatagggagaaaaagacaataacggccacctatactcaacagaggagagagtatatgtggccgttaaacctggcggcagcgcaaaagatg

SEQ ID NO: 39678 - DNA, 103 bp, Artificial Sequence
  Synthetic Polynucleotide
taatacgactcactatagggtaatgagttattcgacgttaagtctgaagtaacagaggagaacttcaatgttaacgtcgaacctggcggcagcgcaaaagatg

SEQ ID NO: 39679 - DNA, 103 bp, Artificial Sequence
  Synthetic Polynucleotide
taatacgactcactatagggtgaatcatgttacattggccagagctaccaaacagaggagatggtagatgtggccaatgaacctggcggcagcgcaaaagatg

SEQ ID NO: 39680 - DNA, 103 bp, Artificial Sequence
  Synthetic Polynucleotide
taatacgactcactatagggcatggcagcaagcttacatataagaggctaaacagaggagatagcctatgatatgtaagaacctggcggcagcgcaaaagatg

SEQ ID NO: 39681 - DNA, 103 bp, Artificial Sequence
  Synthetic Polynucleotide
taatacgactcactatagggccagtaaggagcctgtgttccacccgaatcaacagaggagagattcgatgggaacacagaacctggcggcagcgcaaaagatg

SEQ ID NO: 39682 - DNA, 103 bp, Artificial Sequence
  Synthetic Polynucleotide
taatacgactcactatagggcttgccaatggcgtggatatcgcagttgccaacagaggagaggcaacatggatatccacaacctggcggcagcgcaaaagatg

SEQ ID NO: 39683 - DNA, 103 bp, Artificial Sequence
  Synthetic Polynucleotide
taatacgactcactatagggtagtagaagcaaattgttgcatcggcccgaaacagaggagatcgggcatgtgcaacaataacctggcggcagcgcaaaagatg

SEQ ID NO: 39684 - DNA, 103 bp, Artificial Sequence
  Synthetic Polynucleotide
taatacgactcactataggggtcgggagtagaaagaagccgcgtggacgtaacagaggagaacgtccatgcggcttcttaacctggcggcagcgcaaaagatg

SEQ ID NO: 39685 - DNA, 103 bp, Artificial Sequence
  Synthetic Polynucleotide
taatacgactcactatagggaggtctacgcggccggaagccaaaaatcccaacagaggagagggattatgggcttccggaacctggcggcagcgcaaaagatg

SEQ ID NO: 39686 - DNA, 103 bp, Artificial Sequence
  Synthetic Polynucleotide
taatacgactcactatagggcctaggcccagtttggagcttacctgccataacagaggagaatggcaatgaagctccaaaacctggcggcagcgcaaaagatg

SEQ ID NO: 39687 - DNA, 103 bp, Artificial Sequence
  Synthetic Polynucleotide
taatacgactcactatagggcggcggcaatcaaacacggcggagaatcgcaacagaggagagcgattatgcgccgtgttaacctggcggcagcgcaaaagatg

SEQ ID NO: 39688 - DNA, 103 bp, Artificial Sequence
  Synthetic Polynucleotide
taatacgactcactatagggcccctagctcataagtttaaaggccgagtgaacagaggagacactcgatgtttaaacttaacctggcggcagcgcaaaagatg

SEQ ID NO: 39689 - DNA, 103 bp, Artificial Sequence
  Synthetic Polynucleotide
taatacgactcactatagggagacgtcttgggccaatgtgcggaaagacaaacagaggagatgtcttatggcacattggaacctggcggcagcgcaaaagatg

SEQ ID NO: 39690 - DNA, 103 bp, Artificial Sequence
  Synthetic Polynucleotide
taatacgactcactataggggaccctgagcacaagttataaggaaccgacaacagaggagagtcggtatgttataacttaacctggcggcagcgcaaaagatg

SEQ ID NO: 39691 - DNA, 103 bp, Artificial Sequence
  Synthetic Polynucleotide
taatacgactcactatagggtgccatgatccagggtcggtagataacaataacagaggagaattgttatgtaccgacccaacctggcggcagcgcaaaagatg

SEQ ID NO: 39692 - DNA, 103 bp, Artificial Sequence
  Synthetic Polynucleotide
taatacgactcactataggggggttcgccccgacaaatataaatgctaataacagaggagaattagcatgtatatttgtaacctggcggcagcgcaaaagatg

SEQ ID NO: 39693 - DNA, 103 bp, Artificial Sequence
  Synthetic Polynucleotide
taatacgactcactatagggatgcaatcatttattctcctaggtgaatttaacagaggagaaaattcatgtaggagaataacctggcggcagcgcaaaagatg

SEQ ID NO: 39694 - DNA, 103 bp, Artificial Sequence
  Synthetic Polynucleotide
taatacgactcactatagggccaccctctagagggtttactcggtcgactaacagaggagaagtcgaatgagtaaacccaacctggcggcagcgcaaaagatg

SEQ ID NO: 39695 - DNA, 103 bp, Artificial Sequence
  Synthetic Polynucleotide
taatacgactcactatagggatagcactaaccaggaagattgacgacggcaacagaggagagccgtcatgaatcttcctaacctggcggcagcgcaaaagatg

SEQ ID NO: 39696 - DNA, 103 bp, Artificial Sequence
  Synthetic Polynucleotide
taatacgactcactatagggggggccatttacaactcaccagactcttggaacagaggagaccaagaatgtggtgagttaacctggcggcagcgcaaaagatg

SEQ ID NO: 39697 - DNA, 103 bp, Artificial Sequence
  Synthetic Polynucleotide
taatacgactcactataggggctactacgacctctgagcggacaaactcaaacagaggagatgagttatgccgctcagaaacctggcggcagcgcaaaagatg

SEQ ID NO: 39698 - DNA, 103 bp, Artificial Sequence
  Synthetic Polynucleotide
taatacgactcactatagggtacatagagaattgtgtcagtgttactcagaacagaggagactgagtatgactgacacaaacctggcggcagcgcaaaagatg

SEQ ID NO: 39699 - DNA, 103 bp, Artificial Sequence
  Synthetic Polynucleotide
taatacgactcactatagggccagttgaaacacccatcgccgaatttctgaacagaggagacagaaaatgggcgatgggaacctggcggcagcgcaaaagatg

SEQ ID NO: 39700 - DNA, 103 bp, Artificial Sequence
  Synthetic Polynucleotide
taatacgactcactatagggtagcgctattctatgccataaggcctatataacagaggagaatatagatgttatggcataacctggcggcagcgcaaaagatg

SEQ ID NO: 39701 - DNA, 103 bp, Artificial Sequence
  Synthetic Polynucleotide
taatacgactcactataggggtgtctgatgggcgcgtacacctagaacgaaacagaggagatcgttcatggtgtacgcgaacctggcggcagcgcaaaagatg

SEQ ID NO: 39702 - DNA, 103 bp, Artificial Sequence
  Synthetic Polynucleotide
taatacgactcactatagggccttcttctctcgattagagacttacgttcaacagaggagagaacgtatgtctctaatcaacctggcggcagcgcaaaagatg

SEQ ID NO: 39703 - DNA, 103 bp, Artificial Sequence
  Synthetic Polynucleotide
taatacgactcactatagggtagtgtgtagagaagatcgacaagcagataaacagaggagatatctgatggtcgatcttaacctggcggcagcgcaaaagatg

SEQ ID NO: 39704 - DNA, 103 bp, Artificial Sequence
  Synthetic Polynucleotide
taatacgactcactataggggcctatacgcatgtgctcgcttcccaaggaaacagaggagatccttgatgagcgagcacaacctggcggcagcgcaaaagatg

SEQ ID NO: 39705 - DNA, 103 bp, Artificial Sequence
  Synthetic Polynucleotide
taatacgactcactataggggccttgaagcttatgcccacatctggaagaaacagaggagatcttccatgtgtgggcataacctggcggcagcgcaaaagatg

SEQ ID NO: 39706 - DNA, 103 bp, Artificial Sequence
  Synthetic Polynucleotide
taatacgactcactataggggttaagaagttgagaacgttccggacagacaacagaggagagtctgtatggaacgttctaacctggcggcagcgcaaaagatg

SEQ ID NO: 39707 - DNA, 103 bp, Artificial Sequence
  Synthetic Polynucleotide
taatacgactcactatagggctcgatactatgtggcgaagttgttggaagaacagaggagacttccaatgacttcgccaaacctggcggcagcgcaaaagatg

SEQ ID NO: 39708 - DNA, 103 bp, Artificial Sequence
  Synthetic Polynucleotide
taatacgactcactatagggacaaggtaaactcagatattcagcgacacaaacagaggagatgtgtcatggaatatctgaacctggcggcagcgcaaaagatg

SEQ ID NO: 39709 - DNA, 103 bp, Artificial Sequence
  Synthetic Polynucleotide
taatacgactcactatagggtaccgcagtcgtcgagctgctttctatgaaaacagaggagattcataatgagcagctcgaacctggcggcagcgcaaaagatg

SEQ ID NO: 39710 - DNA, 103 bp, Artificial Sequence
  Synthetic Polynucleotide
taatacgactcactataggggtgctcccagcagctgcgagaagtaacttaaacagaggagataagttatgtctcgcagcaacctggcggcagcgcaaaagatg

SEQ ID NO: 39711 - DNA, 103 bp, Artificial Sequence
  Synthetic Polynucleotide
taatacgactcactatagggggtaagctaactcgtaagtagtgcaggctaaacagaggagatagcctatgctacttacgaacctggcggcagcgcaaaagatg

SEQ ID NO: 39712 - DNA, 103 bp, Artificial Sequence
  Synthetic Polynucleotide
taatacgactcactatagggcgagccagcactacgtcgaggtgttaggccaacagaggagaggcctaatgcctcgacgtaacctggcggcagcgcaaaagatg

SEQ ID NO: 39713 - DNA, 103 bp, Artificial Sequence
  Synthetic Polynucleotide
taatacgactcactatagggggggtattccgagataactcggatcggaagaacagaggagacttccgatgcgagttatcaacctggcggcagcgcaaaagatg

SEQ ID NO: 39714 - DNA, 103 bp, Artificial Sequence
  Synthetic Polynucleotide
taatacgactcactatagggcgatggctttcggggcatttgtattgacgaaacagaggagatcgtcaatgcaaatgcccaacctggcggcagcgcaaaagatg

SEQ ID NO: 39715 - DNA, 103 bp, Artificial Sequence
  Synthetic Polynucleotide
taatacgactcactatagggctagtcatgttatgtacctatctagctaggaacagaggagacctagcatgataggtacaaacctggcggcagcgcaaaagatg

SEQ ID NO: 39716 - DNA, 103 bp, Artificial Sequence
  Synthetic Polynucleotide
taatacgactcactataggggtgcctcttcctgatgatttgaaccgatagaacagaggagactatcgatgcaaatcatcaacctggcggcagcgcaaaagatg

SEQ ID NO: 39717 - DNA, 103 bp, Artificial Sequence
  Synthetic Polynucleotide
taatacgactcactatagggcttagatggctcgtattgcacatcttacccaacagaggagagggtaaatggtgcaatacaacctggcggcagcgcaaaagatg

SEQ ID NO: 39718 - DNA, 103 bp, Artificial Sequence
  Synthetic Polynucleotide
taatacgactcactataggggtcttcgcaccgaagctcaggctacaaataaacagaggagatatttgatgcctgagcttaacctggcggcagcgcaaaagatg

SEQ ID NO: 39719 - DNA, 103 bp, Artificial Sequence
  Synthetic Polynucleotide
taatacgactcactatagggttgcaactgcggctactcacaaaccgagacaacagaggagagtctcgatgtgtgagtagaacctggcggcagcgcaaaagatg

SEQ ID NO: 39720 - DNA, 103 bp, Artificial Sequence
  Synthetic Polynucleotide
taatacgactcactatagggcaagcgcggttaaaggttggctatttgccaaacagaggagatggcaaatggccaaccttaacctggcggcagcgcaaaagatg

SEQ ID NO: 39721 - DNA, 103 bp, Artificial Sequence
  Synthetic Polynucleotide
taatacgactcactatagggccggacacctgattcgggctaatcggcggtaacagaggagaaccgccatgtagcccgaaaacctggcggcagcgcaaaagatg

SEQ ID NO: 39722 - DNA, 103 bp, Artificial Sequence
  Synthetic Polynucleotide
taatacgactcactatagggattcaggtggcgttcagaaactaggtcaaaaacagaggagatttgacatggtttctgaaaacctggcggcagcgcaaaagatg

SEQ ID NO: 39723 - DNA, 103 bp, Artificial Sequence
  Synthetic Polynucleotide
taatacgactcactataggggccacacaggggccttaaactgggtgtgaaaacagaggagattcacaatgagtttaaggaacctggcggcagcgcaaaagatg

SEQ ID NO: 39724 - DNA, 103 bp, Artificial Sequence
  Synthetic Polynucleotide
taatacgactcactatagggactcggcgtggcgcagctaagtaaccgtgcaacagaggagagcacggatgcttagctgcaacctggcggcagcgcaaaagatg

SEQ ID NO: 39725 - DNA, 103 bp, Artificial Sequence
  Synthetic Polynucleotide
taatacgactcactatagggggtcgctcgcattcacacaccttccgtgataacagaggagaatcacgatgggtgtgtgaaacctggcggcagcgcaaaagatg

SEQ ID NO: 39726 - DNA, 103 bp, Artificial Sequence
  Synthetic Polynucleotide
taatacgactcactatagggataccaattacacaatatacgttgacaactaacagaggagaagttgtatgcgtatattgaacctggcggcagcgcaaaagatg

SEQ ID NO: 39727 - DNA, 103 bp, Artificial Sequence
  Synthetic Polynucleotide
taatacgactcactataggggcgccgatgccgaagcgccggggtgaggtgaacagaggagacacctcatgccggcgcttaacctggcggcagcgcaaaagatg

SEQ ID NO: 39728 - DNA, 103 bp, Artificial Sequence
  Synthetic Polynucleotide
taatacgactcactatagggtaccattggggctgctcctatagccacggaaacagaggagatccgtgatgataggagcaaacctggcggcagcgcaaaagatg

SEQ ID NO: 39729 - DNA, 103 bp, Artificial Sequence
  Synthetic Polynucleotide
taatacgactcactatagggccctgctattatgtcgctataagtacaattaacagaggagaaattgtatgtatagcgacaacctggcggcagcgcaaaagatg

SEQ ID NO: 39730 - DNA, 103 bp, Artificial Sequence
  Synthetic Polynucleotide
taatacgactcactatagggtacacctattgttgctctctcattgtgtcgaacagaggagacgacacatggagagagcaaacctggcggcagcgcaaaagatg

SEQ ID NO: 39731 - DNA, 103 bp, Artificial Sequence
  Synthetic Polynucleotide
taatacgactcactatagggactgtggcgaagaaccttaagcatcatactaacagaggagaagtatgatgcttaaggttaacctggcggcagcgcaaaagatg

SEQ ID NO: 39732 - DNA, 103 bp, Artificial Sequence
  Synthetic Polynucleotide
taatacgactcactataggggtgaaaatacgcgttcccgaattcccgggaaacagaggagatcccggatgttcgggaacaacctggcggcagcgcaaaagatg

SEQ ID NO: 39733 - DNA, 103 bp, Artificial Sequence
  Synthetic Polynucleotide
taatacgactcactatagggtgttatatctgatactcgatacatcctcggaacagaggagaccgaggatgtatcgagtaaacctggcggcagcgcaaaagatg

SEQ ID NO: 39734 - DNA, 103 bp, Artificial Sequence
  Synthetic Polynucleotide
taatacgactcactataggggtgggattacctggagtcggccaatctgagaacagaggagactcagaatggccgactccaacctggcggcagcgcaaaagatg

SEQ ID NO: 39735 - DNA, 103 bp, Artificial Sequence
  Synthetic Polynucleotide
taatacgactcactatagggttttccacaggaaatcacaatcaacgggaaaacagaggagattcccgatgattgtgattaacctggcggcagcgcaaaagatg

SEQ ID NO: 39736 - DNA, 103 bp, Artificial Sequence
  Synthetic Polynucleotide
taatacgactcactatagggtatgtttacaaagattgagggtgtggccgaaacagaggagatcggccatgccctcaatcaacctggcggcagcgcaaaagatg

SEQ ID NO: 39737 - DNA, 103 bp, Artificial Sequence
  Synthetic Polynucleotide
taatacgactcactataggggtagccaaaccgacgggggcattctttcagaacagaggagactgaaaatgtgcccccgtaacctggcggcagcgcaaaagatg

SEQ ID NO: 39738 - DNA, 103 bp, Artificial Sequence
  Synthetic Polynucleotide
taatacgactcactatagggacttggagtaaaaccatcgccagaccttggaacagaggagaccaaggatgggcgatggtaacctggcggcagcgcaaaagatg

SEQ ID NO: 39739 - DNA, 103 bp, Artificial Sequence
  Synthetic Polynucleotide
taatacgactcactatagggggccgcatccgcataagtgactaagatgggaacagaggagacccatcatggtcacttataacctggcggcagcgcaaaagatg

SEQ ID NO: 39740 - DNA, 103 bp, Artificial Sequence
  Synthetic Polynucleotide
taatacgactcactatagggtaagctctaagatatgtatcaagtttaatcaacagaggagagattaaatgtgatacataaacctggcggcagcgcaaaagatg

SEQ ID NO: 39741 - DNA, 103 bp, Artificial Sequence
  Synthetic Polynucleotide
taatacgactcactatagggaaaggcgatgcgcgaccgcctcacagcggaaacagaggagatccgctatgaggcggtcgaacctggcggcagcgcaaaagatg

SEQ ID NO: 39742 - DNA, 103 bp, Artificial Sequence
  Synthetic Polynucleotide
taatacgactcactatagggattagtgactcgtgccgcagctcattgatgaacagaggagacatcaaatggctgcggcaaacctggcggcagcgcaaaagatg

SEQ ID NO: 39743 - DNA, 103 bp, Artificial Sequence
  Synthetic Polynucleotide
taatacgactcactatagggcagggccggctagaggtgcgtcgccggctaaacagaggagatagccgatgacgcacctcaacctggcggcagcgcaaaagatg

SEQ ID NO: 39744 - DNA, 103 bp, Artificial Sequence
  Synthetic Polynucleotide
taatacgactcactatagggcctacaccagagtgtctctggtaaaagcataacagaggagaatgcttatgccagagacaaacctggcggcagcgcaaaagatg

SEQ ID NO: 39745 - DNA, 103 bp, Artificial Sequence
  Synthetic Polynucleotide
taatacgactcactatagggatcttcttgcgttggtgctaccttccaaataacagaggagaatttggatggtagcaccaaacctggcggcagcgcaaaagatg

SEQ ID NO: 39746 - DNA, 103 bp, Artificial Sequence
  Synthetic Polynucleotide
taatacgactcactatagggtcaacaccctctacggtcctgtccgtgagtaacagaggagaactcacatgcaggaccgtaacctggcggcagcgcaaaagatg

SEQ ID NO: 39747 - DNA, 103 bp, Artificial Sequence
  Synthetic Polynucleotide
taatacgactcactatagggtgcgtgaccaaaagcaaacatcccacaaagaacagaggagactttgtatgatgtttgctaacctggcggcagcgcaaaagatg

SEQ ID NO: 39748 - DNA, 103 bp, Artificial Sequence
  Synthetic Polynucleotide
taatacgactcactataggggcttataggggaaggagaaccggttcatagaacagaggagactatgaatgggttctcctaacctggcggcagcgcaaaagatg

SEQ ID NO: 39749 - DNA, 103 bp, Artificial Sequence
  Synthetic Polynucleotide
taatacgactcactataggggtcgctgctatcaatctgatgttggagactaacagaggagaagtctcatgcatcagattaacctggcggcagcgcaaaagatg

SEQ ID NO: 39750 - DNA, 103 bp, Artificial Sequence
  Synthetic Polynucleotide
taatacgactcactatagggatattgctccattcagcgctcgcagtgtgaaacagaggagatcacacatggagcgctgaaacctggcggcagcgcaaaagatg

SEQ ID NO: 39751 - DNA, 103 bp, Artificial Sequence
  Synthetic Polynucleotide
taatacgactcactatagggtccactcgaataatatattgatagtggaccaacagaggagaggtccaatgtcaatatataacctggcggcagcgcaaaagatg

SEQ ID NO: 39752 - DNA, 103 bp, Artificial Sequence
  Synthetic Polynucleotide
taatacgactcactatagggcgtatatgcactggaactatagcctagcttaacagaggagaaagctaatgtatagttccaacctggcggcagcgcaaaagatg

SEQ ID NO: 39753 - DNA, 103 bp, Artificial Sequence
  Synthetic Polynucleotide
taatacgactcactatagggacctcgtctggtgccggcgtcctcagcggaaacagaggagatccgctatggacgccggcaacctggcggcagcgcaaaagatg

SEQ ID NO: 39754 - DNA, 103 bp, Artificial Sequence
  Synthetic Polynucleotide
taatacgactcactatagggatataatgcaccccgcagggctttcttcataacagaggagaatgaagatggccctgcggaacctggcggcagcgcaaaagatg

SEQ ID NO: 39755 - DNA, 103 bp, Artificial Sequence
  Synthetic Polynucleotide
taatacgactcactatagggcgtaaacccagatggttgattaaatgaccaaacagaggagatggtcaatgaatcaaccaaacctggcggcagcgcaaaagatg

SEQ ID NO: 39756 - DNA, 103 bp, Artificial Sequence
  Synthetic Polynucleotide
taatacgactcactatagggttgtcagatggctcgtagcggcttctagcgaacagaggagacgctagatgccgctacgaaacctggcggcagcgcaaaagatg

SEQ ID NO: 39757 - DNA, 103 bp, Artificial Sequence
  Synthetic Polynucleotide
taatacgactcactatagggcatgaagatcataaagacgttgactagtggaacagaggagaccactaatgaacgtctttaacctggcggcagcgcaaaagatg

SEQ ID NO: 39758 - DNA, 103 bp, Artificial Sequence
  Synthetic Polynucleotide
taatacgactcactatagggacgctggatatagacgagaatctactgccgaacagaggagacggcagatgattctcgtcaacctggcggcagcgcaaaagatg

SEQ ID NO: 39759 - DNA, 103 bp, Artificial Sequence
  Synthetic Polynucleotide
taatacgactcactatagggggtagtaaacgcgaaacccttacctgctggaacagaggagaccagcaatgaagggtttcaacctggcggcagcgcaaaagatg

SEQ ID NO: 39760 - DNA, 103 bp, Artificial Sequence
  Synthetic Polynucleotide
taatacgactcactatagggttgcaccaccgccgtcacggtattctggccaacagaggagaggccagatgaccgtgacgaacctggcggcagcgcaaaagatg

SEQ ID NO: 39761 - DNA, 103 bp, Artificial Sequence
  Synthetic Polynucleotide
taatacgactcactatagggtgcataagttacgagggccatgcgacaaataacagaggagaatttgtatgatggccctcaacctggcggcagcgcaaaagatg

SEQ ID NO: 39762 - DNA, 103 bp, Artificial Sequence
  Synthetic Polynucleotide
taatacgactcactatagggttaagccacatgttgagacgatcgttggggaacagaggagaccccaaatgtcgtctcaaaacctggcggcagcgcaaaagatg

SEQ ID NO: 39763 - DNA, 103 bp, Artificial Sequence
  Synthetic Polynucleotide
taatacgactcactatagggaattgcaaagtttatgcttgattagttcgcaacagaggagagcgaacatgtcaagcataaacctggcggcagcgcaaaagatg

SEQ ID NO: 39764 - DNA, 103 bp, Artificial Sequence
  Synthetic Polynucleotide
taatacgactcactatagggtgggccgaagcgtgagtgaacttcgaagggaacagaggagacccttcatggttcactcaaacctggcggcagcgcaaaagatg

SEQ ID NO: 39765 - DNA, 103 bp, Artificial Sequence
  Synthetic Polynucleotide
taatacgactcactatagggcagccgaaatgacgatggccggggtctgggaacagaggagacccagaatgcggccatcgaacctggcggcagcgcaaaagatg

SEQ ID NO: 39766 - DNA, 103 bp, Artificial Sequence
  Synthetic Polynucleotide
taatacgactcactatagggaacttatactcgcccactccctagagctgtaacagaggagaacagctatggggagtgggaacctggcggcagcgcaaaagatg

SEQ ID NO: 39767 - DNA, 103 bp, Artificial Sequence
  Synthetic Polynucleotide
taatacgactcactatagggtaattgctaacattaagatgtgatctggtcaacagaggagagaccagatgacatcttaaaacctggcggcagcgcaaaagatg

SEQ ID NO: 39768 - DNA, 103 bp, Artificial Sequence
  Synthetic Polynucleotide
taatacgactcactatagggttgttaagctatgcgtggtattccaggcgaaacagaggagatcgcctatgataccacgcaacctggcggcagcgcaaaagatg

SEQ ID NO: 39769 - DNA, 103 bp, Artificial Sequence
  Synthetic Polynucleotide
taatacgactcactatagggcctcgggacatgacagagaccggagttggcaacagaggagagccaacatgggtctctgtaacctggcggcagcgcaaaagatg

SEQ ID NO: 39770 - DNA, 103 bp, Artificial Sequence
  Synthetic Polynucleotide
taatacgactcactatagggtgtaatggtaaaataaactcaacaggtggtaacagaggagaaccaccatgtgagtttataacctggcggcagcgcaaaagatg

SEQ ID NO: 39771 - DNA, 103 bp, Artificial Sequence
  Synthetic Polynucleotide
taatacgactcactatagggcgctcgttacgtttgattctatctacatagaacagaggagactatgtatgtagaatcaaaacctggcggcagcgcaaaagatg

SEQ ID NO: 39772 - DNA, 103 bp, Artificial Sequence
  Synthetic Polynucleotide
taatacgactcactatagggtcgccatcctttagaagagcctaccccgtaaacagaggagatacgggatgggctcttctaacctggcggcagcgcaaaagatg

SEQ ID NO: 39773 - DNA, 103 bp, Artificial Sequence
  Synthetic Polynucleotide
taatacgactcactataggggataatgtcttctggatagagtgaacgagtaacagaggagaactcgtatgctctatccaaacctggcggcagcgcaaaagatg

SEQ ID NO: 39774 - DNA, 103 bp, Artificial Sequence
  Synthetic Polynucleotide
taatacgactcactatagggatttatttatcataccatgcacgtttcgccaacagaggagaggcgaaatgtgcatggtaaacctggcggcagcgcaaaagatg

SEQ ID NO: 39775 - DNA, 103 bp, Artificial Sequence
  Synthetic Polynucleotide
taatacgactcactatagggcgcggccgactggccgaatcaatgcacatgaacagaggagacatgtgatgtgattcggcaacctggcggcagcgcaaaagatg

SEQ ID NO: 39776 - DNA, 103 bp, Artificial Sequence
  Synthetic Polynucleotide
taatacgactcactatagggctagagaagcgttgttaggactatctcggtaacagaggagaaccgagatggtcctaacaaacctggcggcagcgcaaaagatg

SEQ ID NO: 39777 - DNA, 103 bp, Artificial Sequence
  Synthetic Polynucleotide
taatacgactcactatagggagttatttcgcctgcatgtgtcatacgtggaacagaggagaccacgtatgacacatgcaaacctggcggcagcgcaaaagatg

SEQ ID NO: 39778 - DNA, 103 bp, Artificial Sequence
  Synthetic Polynucleotide
taatacgactcactatagggaataaaaagaacgtctaccaacctcaagacaacagaggagagtcttgatgttggtagacaacctggcggcagcgcaaaagatg

SEQ ID NO: 39779 - DNA, 103 bp, Artificial Sequence
  Synthetic Polynucleotide
taatacgactcactatagggcgactggactagttgtgacatgtctacgaaaacagaggagattcgtaatgatgtcacaaaacctggcggcagcgcaaaagatg

SEQ ID NO: 39780 - DNA, 103 bp, Artificial Sequence
  Synthetic Polynucleotide
taatacgactcactatagggagcagggtgcagacgagtccaaatgcggtcaacagaggagagaccgcatgtggactcgtaacctggcggcagcgcaaaagatg

SEQ ID NO: 39781 - DNA, 103 bp, Artificial Sequence
  Synthetic Polynucleotide
taatacgactcactatagggattaagagtatcggtatccaactaccttgaaacagaggagatcaaggatgttggataccaacctggcggcagcgcaaaagatg

SEQ ID NO: 39782 - DNA, 103 bp, Artificial Sequence
  Synthetic Polynucleotide
taatacgactcactatagggcatagacctgacagggacggtagatcaacaaacagaggagatgttgaatgaccgtccctaacctggcggcagcgcaaaagatg

SEQ ID NO: 39783 - DNA, 103 bp, Artificial Sequence
  Synthetic Polynucleotide
taatacgactcactatagggactaccactccgagcatatatcatttcggaaacagaggagatccgaaatgatatatgctaacctggcggcagcgcaaaagatg

SEQ ID NO: 39784 - DNA, 103 bp, Artificial Sequence
  Synthetic Polynucleotide
taatacgactcactatagggatttgcgatgaagagcaaggtggtgaagtaaacagaggagatacttcatgaccttgctcaacctggcggcagcgcaaaagatg

SEQ ID NO: 39785 - DNA, 103 bp, Artificial Sequence
  Synthetic Polynucleotide
taatacgactcactatagggccggaaggtaatcttcattagactatggtgaacagaggagacaccatatgctaatgaagaacctggcggcagcgcaaaagatg

SEQ ID NO: 39786 - DNA, 103 bp, Artificial Sequence
  Synthetic Polynucleotide
taatacgactcactataggggtctggttaaagccacggtgggactctaagaacagaggagacttagaatgccaccgtggaacctggcggcagcgcaaaagatg

SEQ ID NO: 39787 - DNA, 103 bp, Artificial Sequence
  Synthetic Polynucleotide
taatacgactcactatagggtcggagctatgaacctatggtatgttttataacagaggagaataaaaatgaccataggtaacctggcggcagcgcaaaagatg

SEQ ID NO: 39788 - DNA, 103 bp, Artificial Sequence
  Synthetic Polynucleotide
taatacgactcactataggggcacgaacatgctaccctggatagcatatgaacagaggagacatatgatgtccagggtaaacctggcggcagcgcaaaagatg

SEQ ID NO: 39789 - DNA, 103 bp, Artificial Sequence
  Synthetic Polynucleotide
taatacgactcactatagggtagtccagagcttttagttactgtaacatcaacagaggagagatgttatggtaactaaaaacctggcggcagcgcaaaagatg

SEQ ID NO: 39790 - DNA, 103 bp, Artificial Sequence
  Synthetic Polynucleotide
taatacgactcactatagggagtttcgcttatgtcgttgcaccgtgatacaacagaggagagtatcaatgtgcaacgacaacctggcggcagcgcaaaagatg

SEQ ID NO: 39791 - DNA, 103 bp, Artificial Sequence
  Synthetic Polynucleotide
taatacgactcactatagggtgagagagattaaccagcaattacaattgaaacagaggagatcaattatgattgctggtaacctggcggcagcgcaaaagatg

SEQ ID NO: 39792 - DNA, 103 bp, Artificial Sequence
  Synthetic Polynucleotide
taatacgactcactatagggtgaaggatacagttcctctccgagggcggtaacagaggagaaccgccatgggagaggaaaacctggcggcagcgcaaaagatg

SEQ ID NO: 39793 - DNA, 103 bp, Artificial Sequence
  Synthetic Polynucleotide
taatacgactcactatagggtcagcacctcaggaagaaatgcacaagattaacagaggagaaatcttatgcatttcttcaacctggcggcagcgcaaaagatg

SEQ ID NO: 39794 - DNA, 103 bp, Artificial Sequence
  Synthetic Polynucleotide
taatacgactcactatagggatgaaacctagtgagctcctatgacctccgaacagaggagacggaggatgtaggagctcaacctggcggcagcgcaaaagatg

SEQ ID NO: 39795 - DNA, 103 bp, Artificial Sequence
  Synthetic Polynucleotide
taatacgactcactatagggtgcctaagcgtgggcccttcatagtaaaggaacagaggagacctttaatgtgaagggccaacctggcggcagcgcaaaagatg

SEQ ID NO: 39796 - DNA, 103 bp, Artificial Sequence
  Synthetic Polynucleotide
taatacgactcactatagggtttctggaggaaatcggcagtcccctgtataacagaggagaatacagatgactgccgataacctggcggcagcgcaaaagatg

SEQ ID NO: 39797 - DNA, 103 bp, Artificial Sequence
  Synthetic Polynucleotide
taatacgactcactatagggttaccaaaggagcctactcttagtcgtacaaacagaggagatgtacgatgaagagtaggaacctggcggcagcgcaaaagatg

SEQ ID NO: 39798 - DNA, 103 bp, Artificial Sequence
  Synthetic Polynucleotide
taatacgactcactatagggagatggcaaccgttgcatccggatccctgaaacagaggagatcagggatgcggatgcaaaacctggcggcagcgcaaaagatg

SEQ ID NO: 39799 - DNA, 103 bp, Artificial Sequence
  Synthetic Polynucleotide
taatacgactcactatagggtgtggcagggtatagggggtccactcgcggaacagaggagaccgcgaatggaccccctaaacctggcggcagcgcaaaagatg

SEQ ID NO: 39800 - DNA, 103 bp, Artificial Sequence
  Synthetic Polynucleotide
taatacgactcactatagggtggtctcaaatacatcttcttggatacggaaacagaggagatccgtaatgaagaagatgaacctggcggcagcgcaaaagatg

SEQ ID NO: 39801 - DNA, 103 bp, Artificial Sequence
  Synthetic Polynucleotide
taatacgactcactatagggcgtactgtacttcgacttatccaatctagaaacagaggagatctagaatggataagtcgaacctggcggcagcgcaaaagatg

SEQ ID NO: 39802 - DNA, 103 bp, Artificial Sequence
  Synthetic Polynucleotide
taatacgactcactatagggcagtgcaaatctcgttacactgcgacacacaacagaggagagtgtgtatgagtgtaacgaacctggcggcagcgcaaaagatg

SEQ ID NO: 39803 - DNA, 103 bp, Artificial Sequence
  Synthetic Polynucleotide
taatacgactcactatagggcactgacgcagaaaagctccccgagatcccaacagaggagagggatcatggggagctttaacctggcggcagcgcaaaagatg

SEQ ID NO: 39804 - DNA, 103 bp, Artificial Sequence
  Synthetic Polynucleotide
taatacgactcactatagggatcgtcacagttccgattgtgactgaccggaacagaggagaccggtcatgcacaatcggaacctggcggcagcgcaaaagatg

SEQ ID NO: 39805 - DNA, 103 bp, Artificial Sequence
  Synthetic Polynucleotide
taatacgactcactatagggggaacggacatcctatgtgtcaatccctataacagaggagaatagggatggacacatagaacctggcggcagcgcaaaagatg

SEQ ID NO: 39806 - DNA, 103 bp, Artificial Sequence
  Synthetic Polynucleotide
taatacgactcactatagggaaggactcaagaagattatactaagctttgaacagaggagacaaagcatggtataatctaacctggcggcagcgcaaaagatg

SEQ ID NO: 39807 - DNA, 103 bp, Artificial Sequence
  Synthetic Polynucleotide
taatacgactcactatagggttacacgcaaacgagagcccggtacccatgaacagaggagacatgggatgcgggctctcaacctggcggcagcgcaaaagatg

SEQ ID NO: 39808 - DNA, 103 bp, Artificial Sequence
  Synthetic Polynucleotide
taatacgactcactatagggcttaaatgagatagacttctcgctgcctcaaacagaggagatgaggcatggagaagtctaacctggcggcagcgcaaaagatg

SEQ ID NO: 39809 - DNA, 103 bp, Artificial Sequence
  Synthetic Polynucleotide
taatacgactcactataggggcaatgcacgttatttcaagcgacttgctgaacagaggagacagcaaatggcttgaaataacctggcggcagcgcaaaagatg

SEQ ID NO: 39810 - DNA, 103 bp, Artificial Sequence
  Synthetic Polynucleotide
taatacgactcactatagggagcctcaaagggttgaagcttaggagataaaacagaggagattatctatgaagcttcaaaacctggcggcagcgcaaaagatg

SEQ ID NO: 39811 - DNA, 103 bp, Artificial Sequence
  Synthetic Polynucleotide
taatacgactcactatagggcaaacagagtccgcgacgcgtacttagtacaacagaggagagtactaatgacgcgtcgcaacctggcggcagcgcaaaagatg

SEQ ID NO: 39812 - DNA, 103 bp, Artificial Sequence
  Synthetic Polynucleotide
taatacgactcactatagggcggcaaagcctagcttcttatgaagtactaaacagaggagatagtacatgataagaagcaacctggcggcagcgcaaaagatg

SEQ ID NO: 39813 - DNA, 103 bp, Artificial Sequence
  Synthetic Polynucleotide
taatacgactcactatagggtagatctcagaaaataggtaaagtgtaggcaacagaggagagcctacatgttacctattaacctggcggcagcgcaaaagatg

SEQ ID NO: 39814 - DNA, 103 bp, Artificial Sequence
  Synthetic Polynucleotide
taatacgactcactatagggcactgcgctgggccgaataggaactactccaacagaggagaggagtaatgcctattcggaacctggcggcagcgcaaaagatg

SEQ ID NO: 39815 - DNA, 103 bp, Artificial Sequence
  Synthetic Polynucleotide
taatacgactcactataggggataaactccacccattcttgttccggagcaacagaggagagctccgatgcaagaatggaacctggcggcagcgcaaaagatg

SEQ ID NO: 39816 - DNA, 103 bp, Artificial Sequence
  Synthetic Polynucleotide
taatacgactcactatagggtcattgaaatcatcggataaccgtcaaatcaacagaggagagatttgatggttatccgaaacctggcggcagcgcaaaagatg

SEQ ID NO: 39817 - DNA, 103 bp, Artificial Sequence
  Synthetic Polynucleotide
taatacgactcactatagggatgaaaaacgcggttatattaaaagaagagaacagaggagactcttcatgtaatataacaacctggcggcagcgcaaaagatg

SEQ ID NO: 39818 - DNA, 103 bp, Artificial Sequence
  Synthetic Polynucleotide
taatacgactcactatagggggctacaaataagtacaaccgtacactgttaacagaggagaaacagtatgcggttgtacaacctggcggcagcgcaaaagatg

SEQ ID NO: 39819 - DNA, 103 bp, Artificial Sequence
  Synthetic Polynucleotide
taatacgactcactatagggcaaaaggtccgtcaccgtagcccctgcctaaacagaggagataggcaatggctacggtgaacctggcggcagcgcaaaagatg

SEQ ID NO: 39820 - DNA, 103 bp, Artificial Sequence
  Synthetic Polynucleotide
taatacgactcactatagggctcacatctttcgcctggctatttgagcctaacagaggagaaggctcatgtagccaggcaacctggcggcagcgcaaaagatg

SEQ ID NO: 39821 - DNA, 103 bp, Artificial Sequence
  Synthetic Polynucleotide
taatacgactcactataggggtctcgaagcctgatttacctgtccctgagaacagaggagactcaggatgaggtaaatcaacctggcggcagcgcaaaagatg

SEQ ID NO: 39822 - DNA, 103 bp, Artificial Sequence
  Synthetic Polynucleotide
taatacgactcactatagggtcgaatagctctggcgcgcctggtcgaattaacagaggagaaattcgatgaggcgcgccaacctggcggcagcgcaaaagatg

SEQ ID NO: 39823 - DNA, 103 bp, Artificial Sequence
  Synthetic Polynucleotide
taatacgactcactatagggagtgtccactcttggaactctcggtattcaaacagaggagatgaataatgagagttccaaacctggcggcagcgcaaaagatg

SEQ ID NO: 39824 - DNA, 103 bp, Artificial Sequence
  Synthetic Polynucleotide
taatacgactcactataggggtgtagatcagaaaggtcctggaccgaccgaacagaggagacggtcgatgcaggaccttaacctggcggcagcgcaaaagatg

SEQ ID NO: 39825 - DNA, 103 bp, Artificial Sequence
  Synthetic Polynucleotide
taatacgactcactatagggttgtctgatgggcattattacacgcacggaaacagaggagatccgtgatggtaataatgaacctggcggcagcgcaaaagatg

SEQ ID NO: 39826 - DNA, 103 bp, Artificial Sequence
  Synthetic Polynucleotide
taatacgactcactatagggaagattaccaccttcaggccaacgtacggtaacagaggagaaccgtaatgtggcctgaaaacctggcggcagcgcaaaagatg

SEQ ID NO: 39827 - DNA, 103 bp, Artificial Sequence
  Synthetic Polynucleotide
taatacgactcactatagggccggccattaagtagacaccatggctagccaacagaggagaggctagatgtggtgtctaaacctggcggcagcgcaaaagatg

SEQ ID NO: 39828 - DNA, 103 bp, Artificial Sequence
  Synthetic Polynucleotide
taatacgactcactatagggggacaatagagagcatgaattgagtctattaacagaggagaaatagaatgaattcatgcaacctggcggcagcgcaaaagatg

SEQ ID NO: 39829 - DNA, 103 bp, Artificial Sequence
  Synthetic Polynucleotide
taatacgactcactatagggtctcttaacacaaggcaagagggactatacaacagaggagagtatagatgctcttgcctaacctggcggcagcgcaaaagatg

SEQ ID NO: 39830 - DNA, 103 bp, Artificial Sequence
  Synthetic Polynucleotide
taatacgactcactatagggctacgcttttcgggttgatgaggggcaacaaacagaggagatgttgcatgtcatcaaccaacctggcggcagcgcaaaagatg

SEQ ID NO: 39831 - DNA, 103 bp, Artificial Sequence
  Synthetic Polynucleotide
taatacgactcactatagggccagtaaaatgtgtttaaggtaaggtaaagaacagaggagactttacatgaccttaaacaacctggcggcagcgcaaaagatg

SEQ ID NO: 39832 - DNA, 103 bp, Artificial Sequence
  Synthetic Polynucleotide
taatacgactcactatagggctccttctctgcgaacactgaggggggataaacagaggagatatcccatgtcagtgttcaacctggcggcagcgcaaaagatg

SEQ ID NO: 39833 - DNA, 103 bp, Artificial Sequence
  Synthetic Polynucleotide
taatacgactcactatagggttatgaggaatgacgagaaatattgacaggaacagaggagacctgtcatgatttctcgtaacctggcggcagcgcaaaagatg

SEQ ID NO: 39834 - DNA, 103 bp, Artificial Sequence
  Synthetic Polynucleotide
taatacgactcactataggggctcccagattgttcggccaggcggtttataacagaggagaataaacatgctggccgaaaacctggcggcagcgcaaaagatg

SEQ ID NO: 39835 - DNA, 103 bp, Artificial Sequence
  Synthetic Polynucleotide
taatacgactcactataggggaatacggagtattgccgtgcgttccagttaacagaggagaaactggatggcacggcaaaacctggcggcagcgcaaaagatg

SEQ ID NO: 39836 - DNA, 103 bp, Artificial Sequence
  Synthetic Polynucleotide
taatacgactcactatagggtccaacacgaatattccaccgcacagtctgaacagaggagacagactatgcggtggaataacctggcggcagcgcaaaagatg

SEQ ID NO: 39837 - DNA, 103 bp, Artificial Sequence
  Synthetic Polynucleotide
taatacgactcactatagggtcaccgtacatctccttagtttccgtatagaacagaggagactatacatgaactaaggaaacctggcggcagcgcaaaagatg

SEQ ID NO: 39838 - DNA, 103 bp, Artificial Sequence
  Synthetic Polynucleotide
taatacgactcactatagggatgactcgagtgtcgtatcctgctcgtgttaacagaggagaaacacgatgaggatacgaaacctggcggcagcgcaaaagatg

SEQ ID NO: 39839 - DNA, 103 bp, Artificial Sequence
  Synthetic Polynucleotide
taatacgactcactatagggaccataccgctattgttgaagcaaaagcacaacagaggagagtgcttatgcttcaacaaaacctggcggcagcgcaaaagatg

SEQ ID NO: 39840 - DNA, 103 bp, Artificial Sequence
  Synthetic Polynucleotide
taatacgactcactatagggtcagactacaagatgtcgcgtttacctcgcaacagaggagagcgaggatgacgcgacataacctggcggcagcgcaaaagatg

SEQ ID NO: 39841 - DNA, 103 bp, Artificial Sequence
  Synthetic Polynucleotide
taatacgactcactatagggtccgccgtatacgtctgaaccagggggattaacagaggagaaatcccatgggttcagacaacctggcggcagcgcaaaagatg

SEQ ID NO: 39842 - DNA, 103 bp, Artificial Sequence
  Synthetic Polynucleotide
taatacgactcactatagggggcgcatcccgctcgggcaccggatggtccaacagaggagaggaccaatgggtgcccgaaacctggcggcagcgcaaaagatg

SEQ ID NO: 39843 - DNA, 103 bp, Artificial Sequence
  Synthetic Polynucleotide
taatacgactcactatagggagtcctctaatctatggcacggcatgaatgaacagaggagacattcaatgcgtgccataaacctggcggcagcgcaaaagatg

SEQ ID NO: 39844 - DNA, 103 bp, Artificial Sequence
  Synthetic Polynucleotide
taatacgactcactatagggtttattcggcatagtatgctggggcttataaacagaggagatataagatgcagcatactaacctggcggcagcgcaaaagatg

SEQ ID NO: 39845 - DNA, 103 bp, Artificial Sequence
  Synthetic Polynucleotide
taatacgactcactatagggaaggcatttcctctataaaaatagcatggaaacagaggagatccatgatgtttttatagaacctggcggcagcgcaaaagatg

SEQ ID NO: 39846 - DNA, 103 bp, Artificial Sequence
  Synthetic Polynucleotide
taatacgactcactatagggatgcccatattggagtctgcacacgagaaaaacagaggagatttctcatgtgcagactcaacctggcggcagcgcaaaagatg

SEQ ID NO: 39847 - DNA, 103 bp, Artificial Sequence
  Synthetic Polynucleotide
taatacgactcactataggggacgatgtacggatagctaactcgatgcgtaacagaggagaacgcatatggttagctataacctggcggcagcgcaaaagatg

SEQ ID NO: 39848 - DNA, 103 bp, Artificial Sequence
  Synthetic Polynucleotide
taatacgactcactatagggacacgaaacatattaaccacgagctaaggtaacagaggagaaccttaatgcgtggttaaaacctggcggcagcgcaaaagatg

SEQ ID NO: 39849 - DNA, 103 bp, Artificial Sequence
  Synthetic Polynucleotide
taatacgactcactatagggctcttgccaacaagcatggtactagtcacgaacagaggagacgtgacatgtaccatgctaacctggcggcagcgcaaaagatg

SEQ ID NO: 39850 - DNA, 103 bp, Artificial Sequence
  Synthetic Polynucleotide
taatacgactcactatagggcaccgatactattccatggttgaagcggcgaacagaggagacgccgcatgaaccatggaaacctggcggcagcgcaaaagatg

SEQ ID NO: 39851 - DNA, 103 bp, Artificial Sequence
  Synthetic Polynucleotide
taatacgactcactatagggcgataaggctttgttaggtcggacacggagaacagaggagactccgtatgcgacctaacaacctggcggcagcgcaaaagatg

SEQ ID NO: 39852 - DNA, 103 bp, Artificial Sequence
  Synthetic Polynucleotide
taatacgactcactatagggcggcacccaactgactgccctgccgacatcaacagaggagagatgtcatgagggcagtcaacctggcggcagcgcaaaagatg

SEQ ID NO: 39853 - DNA, 103 bp, Artificial Sequence
  Synthetic Polynucleotide
taatacgactcactatagggaccgtggttaatgagcccctatgtgccgataacagaggagaatcggcatgtaggggctcaacctggcggcagcgcaaaagatg

SEQ ID NO: 39854 - DNA, 103 bp, Artificial Sequence
  Synthetic Polynucleotide
taatacgactcactatagggtacaagctatggtcgtttaaggacctcgtaaacagaggagatacgagatgcttaaacgaaacctggcggcagcgcaaaagatg

SEQ ID NO: 39855 - DNA, 103 bp, Artificial Sequence
  Synthetic Polynucleotide
taatacgactcactatagggtattcgacaccccgcctgttcaacatgactaacagaggagaagtcatatggaacaggcgaacctggcggcagcgcaaaagatg

SEQ ID NO: 39856 - DNA, 103 bp, Artificial Sequence
  Synthetic Polynucleotide
taatacgactcactataggggatgaattatcatagttcgtcgctaatttcaacagaggagagaaattatggacgaactaaacctggcggcagcgcaaaagatg

SEQ ID NO: 39857 - DNA, 103 bp, Artificial Sequence
  Synthetic Polynucleotide
taatacgactcactatagggtgacagcgcctaatccacggacctattgtaaacagaggagatacaatatgtccgtggataacctggcggcagcgcaaaagatg

SEQ ID NO: 39858 - DNA, 103 bp, Artificial Sequence
  Synthetic Polynucleotide
taatacgactcactatagggaaccttgagaatcgtagggttcggccatctaacagaggagaagatggatgaaccctacgaacctggcggcagcgcaaaagatg

SEQ ID NO: 39859 - DNA, 103 bp, Artificial Sequence
  Synthetic Polynucleotide
taatacgactcactatagggcttctcccaaaactatgtctcgaagcccagaacagaggagactgggcatggagacatagaacctggcggcagcgcaaaagatg

SEQ ID NO: 39860 - DNA, 103 bp, Artificial Sequence
  Synthetic Polynucleotide
taatacgactcactatagggtatcgaacggtcgtgctctaagcgctatacaacagaggagagtatagatgttagagcacaacctggcggcagcgcaaaagatg

SEQ ID NO: 39861 - DNA, 103 bp, Artificial Sequence
  Synthetic Polynucleotide
taatacgactcactatagggacgggcagcttcccgccgtattcccacgcaaacagaggagatgcgtgatgatacggcggaacctggcggcagcgcaaaagatg

SEQ ID NO: 39862 - DNA, 103 bp, Artificial Sequence
  Synthetic Polynucleotide
taatacgactcactatagggattagaaagcgcgctgacaccgataacagcaacagaggagagctgttatgggtgtcagcaacctggcggcagcgcaaaagatg

SEQ ID NO: 39863 - DNA, 103 bp, Artificial Sequence
  Synthetic Polynucleotide
taatacgactcactatagggctttcatagtgtcggcgagcacgggctccgaacagaggagacggagcatgtgctcgccgaacctggcggcagcgcaaaagatg

SEQ ID NO: 39864 - DNA, 103 bp, Artificial Sequence
  Synthetic Polynucleotide
taatacgactcactatagggtatgaatctaacgtaacgatacagcaggacaacagaggagagtcctgatgtatcgttacaacctggcggcagcgcaaaagatg

SEQ ID NO: 39865 - DNA, 103 bp, Artificial Sequence
  Synthetic Polynucleotide
taatacgactcactatagggccgttttcgagccttatgtctgaggcggctaacagaggagaagccgcatgagacataagaacctggcggcagcgcaaaagatg

SEQ ID NO: 39866 - DNA, 103 bp, Artificial Sequence
  Synthetic Polynucleotide
taatacgactcactataggggcgttagtactttcaattactcctataggcaacagaggagagcctatatgagtaattgaaacctggcggcagcgcaaaagatg

SEQ ID NO: 39867 - DNA, 103 bp, Artificial Sequence
  Synthetic Polynucleotide
taatacgactcactatagggaagtcttttagtaacgacatgggctcgggtaacagaggagaacccgaatgcatgtcgttaacctggcggcagcgcaaaagatg

SEQ ID NO: 39868 - DNA, 103 bp, Artificial Sequence
  Synthetic Polynucleotide
taatacgactcactatagggaggcaggccgtagtcaacctcactgcgggcaacagaggagagcccgcatggaggttgacaacctggcggcagcgcaaaagatg

SEQ ID NO: 39869 - DNA, 103 bp, Artificial Sequence
  Synthetic Polynucleotide
taatacgactcactatagggaatgtacaatataacccccattctgcatggaacagaggagaccatgcatgatgggggttaacctggcggcagcgcaaaagatg

SEQ ID NO: 39870 - DNA, 103 bp, Artificial Sequence
  Synthetic Polynucleotide
taatacgactcactatagggcatactccgccatgctattattgtcctctcaacagaggagagagaggatgataatagcaaacctggcggcagcgcaaaagatg

SEQ ID NO: 39871 - DNA, 103 bp, Artificial Sequence
  Synthetic Polynucleotide
taatacgactcactataggggctcgcggcgtatgctatttgttgagagataacagaggagaatctctatgcaaatagcaaacctggcggcagcgcaaaagatg

SEQ ID NO: 39872 - DNA, 103 bp, Artificial Sequence
  Synthetic Polynucleotide
taatacgactcactatagggtgagactttaaccactgcagagggtaagaaaacagaggagattcttaatgtctgcagtgaacctggcggcagcgcaaaagatg

SEQ ID NO: 39873 - DNA, 103 bp, Artificial Sequence
  Synthetic Polynucleotide
taatacgactcactatagggtagcggcctgaggattacgcggatccgctaaacagaggagatagcggatgcgcgtaatcaacctggcggcagcgcaaaagatg

SEQ ID NO: 39874 - DNA, 103 bp, Artificial Sequence
  Synthetic Polynucleotide
taatacgactcactatagggggctatgtcgcttcctcgcgacgcggtcctaacagaggagaaggaccatgtcgcgaggaaacctggcggcagcgcaaaagatg

SEQ ID NO: 39875 - DNA, 103 bp, Artificial Sequence
  Synthetic Polynucleotide
taatacgactcactatagggttgtttgccaagctgcccttaacgcacaaaaacagaggagatttgtgatgtaagggcagaacctggcggcagcgcaaaagatg

SEQ ID NO: 39876 - DNA, 103 bp, Artificial Sequence
  Synthetic Polynucleotide
taatacgactcactatagggcgatctcagcgcctgactctacacaagtataacagaggagaatacttatgtagagtcagaacctggcggcagcgcaaaagatg

SEQ ID NO: 39877 - DNA, 103 bp, Artificial Sequence
  Synthetic Polynucleotide
taatacgactcactatagggcttctcgattttgcccctctttcgtcaaggaacagaggagaccttgaatgaagaggggcaacctggcggcagcgcaaaagatg

SEQ ID NO: 39878 - DNA, 103 bp, Artificial Sequence
  Synthetic Polynucleotide
taatacgactcactatagggctttggatgggccgcgcgccgtataactcgaacagaggagacgagttatgcggcgcgcgaacctggcggcagcgcaaaagatg

SEQ ID NO: 39879 - DNA, 103 bp, Artificial Sequence
  Synthetic Polynucleotide
taatacgactcactatagggtggttgaatatacttggtttattacacggtaacagaggagaaccgtgatgtaaaccaagaacctggcggcagcgcaaaagatg

SEQ ID NO: 39880 - DNA, 103 bp, Artificial Sequence
  Synthetic Polynucleotide
taatacgactcactataggggctcgtggaccttggggctttggatggatcaacagaggagagatccaatgaaagccccaaacctggcggcagcgcaaaagatg

SEQ ID NO: 39881 - DNA, 103 bp, Artificial Sequence
  Synthetic Polynucleotide
taatacgactcactatagggcgcttgataagcaactattcttgcctctccaacagaggagaggagagatgagaatagttaacctggcggcagcgcaaaagatg

SEQ ID NO: 39882 - DNA, 103 bp, Artificial Sequence
  Synthetic Polynucleotide
taatacgactcactatagggacccgtcacggactgcaaaacagtcagacaaacagaggagatgtctgatggttttgcagaacctggcggcagcgcaaaagatg

SEQ ID NO: 39883 - DNA, 103 bp, Artificial Sequence
  Synthetic Polynucleotide
taatacgactcactatagggtcctacggccccaacaaccagtaatgcagtaacagaggagaactgcaatgctggttgttaacctggcggcagcgcaaaagatg

SEQ ID NO: 39884 - DNA, 103 bp, Artificial Sequence
  Synthetic Polynucleotide
taatacgactcactatagggaaatattcaagtcgtctgagcacacggtacaacagaggagagtaccgatggctcagacgaacctggcggcagcgcaaaagatg

SEQ ID NO: 39885 - DNA, 103 bp, Artificial Sequence
  Synthetic Polynucleotide
taatacgactcactatagggtgggtcacggaaaataaaccccggagattaaacagaggagataatctatggggtttattaacctggcggcagcgcaaaagatg

SEQ ID NO: 39886 - DNA, 103 bp, Artificial Sequence
  Synthetic Polynucleotide
taatacgactcactatagggaactagtgtgcgaagatccgcgtggtgtgtaacagaggagaacacacatggcggatcttaacctggcggcagcgcaaaagatg

SEQ ID NO: 39887 - DNA, 103 bp, Artificial Sequence
  Synthetic Polynucleotide
taatacgactcactataggggtaacgaatcgcaagttgcgctgagctgtgaacagaggagacacagcatggcgcaacttaacctggcggcagcgcaaaagatg

SEQ ID NO: 39888 - DNA, 103 bp, Artificial Sequence
  Synthetic Polynucleotide
taatacgactcactatagggcgcgattcctcaccattgttaggccggtagaacagaggagactaccgatgtaacaatggaacctggcggcagcgcaaaagatg

SEQ ID NO: 39889 - DNA, 103 bp, Artificial Sequence
  Synthetic Polynucleotide
taatacgactcactatagggcgatcgcgcaggtccctctggattgtgccaaacagaggagatggcacatgccagagggaaacctggcggcagcgcaaaagatg

SEQ ID NO: 39890 - DNA, 103 bp, Artificial Sequence
  Synthetic Polynucleotide
taatacgactcactatagggctgtttaagtgggttaagtttaagagcccaaacagaggagatgggctatgaaacttaacaacctggcggcagcgcaaaagatg

SEQ ID NO: 39891 - DNA, 103 bp, Artificial Sequence
  Synthetic Polynucleotide
taatacgactcactatagggagcgttaatcttcgcgcgaagttgccatataacagaggagaatatggatgcttcgcgcgaacctggcggcagcgcaaaagatg

SEQ ID NO: 39892 - DNA, 103 bp, Artificial Sequence
  Synthetic Polynucleotide
taatacgactcactatagggtcatgcttcggctactacgctcctgacaaaaacagaggagatttgtcatgagcgtagtaaacctggcggcagcgcaaaagatg

SEQ ID NO: 39893 - DNA, 103 bp, Artificial Sequence
  Synthetic Polynucleotide
taatacgactcactatagggatcgcgccgtggtcctacctagagagaccgaacagaggagacggtctatgtaggtaggaaacctggcggcagcgcaaaagatg

SEQ ID NO: 39894 - DNA, 103 bp, Artificial Sequence
  Synthetic Polynucleotide
taatacgactcactatagggcaagcccgcataagactccttcggcggttaaacagaggagataaccgatgaaggagtctaacctggcggcagcgcaaaagatg

SEQ ID NO: 39895 - DNA, 103 bp, Artificial Sequence
  Synthetic Polynucleotide
taatacgactcactatagggtcagcagtaaccggggcgttgtataccaccaacagaggagaggtggtatgcaacgccccaacctggcggcagcgcaaaagatg

SEQ ID NO: 39896 - DNA, 103 bp, Artificial Sequence
  Synthetic Polynucleotide
taatacgactcactatagggggattggtcgctgcttgacagccttacgagaacagaggagactcgtaatgctgtcaagcaacctggcggcagcgcaaaagatg

SEQ ID NO: 39897 - DNA, 103 bp, Artificial Sequence
  Synthetic Polynucleotide
taatacgactcactatagggtttcgtgcgaggcttggatctaaggtaagcaacagaggagagcttacatgagatccaagaacctggcggcagcgcaaaagatg

SEQ ID NO: 39898 - DNA, 103 bp, Artificial Sequence
  Synthetic Polynucleotide
taatacgactcactatagggcgtagagctgattgacgtggtctaatacagaacagaggagactgtatatgaccacgtcaaacctggcggcagcgcaaaagatg

SEQ ID NO: 39899 - DNA, 103 bp, Artificial Sequence
  Synthetic Polynucleotide
taatacgactcactatagggaatatcggtgtcgattagtgctgtagacccaacagaggagagggtctatggcactaatcaacctggcggcagcgcaaaagatg

SEQ ID NO: 39900 - DNA, 103 bp, Artificial Sequence
  Synthetic Polynucleotide
taatacgactcactatagggatcgtaatcatttgttaacaagtaccccaaaacagaggagattggggatgttgttaacaaacctggcggcagcgcaaaagatg

SEQ ID NO: 39901 - DNA, 103 bp, Artificial Sequence
  Synthetic Polynucleotide
taatacgactcactataggggaactagagctccccacacagggcgagcccaacagaggagagggctcatgctgtgtgggaacctggcggcagcgcaaaagatg

SEQ ID NO: 39902 - DNA, 103 bp, Artificial Sequence
  Synthetic Polynucleotide
taatacgactcactatagggccagagctattttatgagccgctcaaaactaacagaggagaagttttatgcggctcataaacctggcggcagcgcaaaagatg

SEQ ID NO: 39903 - DNA, 103 bp, Artificial Sequence
  Synthetic Polynucleotide
taatacgactcactataggggcccagattcctggcgtgcggattctggaaaacagaggagattccagatgccgcacgccaacctggcggcagcgcaaaagatg

SEQ ID NO: 39904 - DNA, 103 bp, Artificial Sequence
  Synthetic Polynucleotide
taatacgactcactatagggtgcgttttgcacggctacctatttcataagaacagaggagacttatgatgtaggtagccaacctggcggcagcgcaaaagatg

SEQ ID NO: 39905 - DNA, 103 bp, Artificial Sequence
  Synthetic Polynucleotide
taatacgactcactatagggcctccgaattactaatcgactctgaggtagaacagaggagactacctatgagtcgattaaacctggcggcagcgcaaaagatg

SEQ ID NO: 39906 - DNA, 103 bp, Artificial Sequence
  Synthetic Polynucleotide
taatacgactcactataggggacaacgactatttcatattaggccaacttaacagaggagaaagttgatgtaatatgaaaacctggcggcagcgcaaaagatg

SEQ ID NO: 39907 - DNA, 103 bp, Artificial Sequence
  Synthetic Polynucleotide
taatacgactcactataggggcaaaaatgtgctggggtgccggtcggataaacagaggagatatccgatgggcaccccaaacctggcggcagcgcaaaagatg

SEQ ID NO: 39908 - DNA, 103 bp, Artificial Sequence
  Synthetic Polynucleotide
taatacgactcactatagggttcagtccgacctaattattctttctacccaacagaggagagggtagatggaataattaaacctggcggcagcgcaaaagatg

SEQ ID NO: 39909 - DNA, 103 bp, Artificial Sequence
  Synthetic Polynucleotide
taatacgactcactataggggctccccagccagattccggtattgttagtaacagaggagaactaacatgaccggaatcaacctggcggcagcgcaaaagatg

SEQ ID NO: 39910 - DNA, 103 bp, Artificial Sequence
  Synthetic Polynucleotide
taatacgactcactatagggaagtccccctatctaagagtcagtgtaaacaacagaggagagtttacatggactcttagaacctggcggcagcgcaaaagatg

SEQ ID NO: 39911 - DNA, 103 bp, Artificial Sequence
  Synthetic Polynucleotide
taatacgactcactatagggaaccaaaactacgtgatggttaagtaagccaacagaggagaggcttaatgaaccatcacaacctggcggcagcgcaaaagatg

SEQ ID NO: 39912 - DNA, 103 bp, Artificial Sequence
  Synthetic Polynucleotide
taatacgactcactatagggctggagcacggagtctcaaggaagccacaaaacagaggagattgtggatgccttgagacaacctggcggcagcgcaaaagatg

SEQ ID NO: 39913 - DNA, 103 bp, Artificial Sequence
  Synthetic Polynucleotide
taatacgactcactataggggggtgcaaaagcaatacgttacgactggcaaacagaggagatgccagatgtaacgtattaacctggcggcagcgcaaaagatg

SEQ ID NO: 39914 - DNA, 103 bp, Artificial Sequence
  Synthetic Polynucleotide
taatacgactcactatagggggcctgtgaaagcgtccactctttacgagcaacagaggagagctcgtatggagtggacgaacctggcggcagcgcaaaagatg

SEQ ID NO: 39915 - DNA, 103 bp, Artificial Sequence
  Synthetic Polynucleotide
taatacgactcactataggggttattcaagatacaacgggcattgagtgtaacagaggagaacactcatggcccgttgtaacctggcggcagcgcaaaagatg

SEQ ID NO: 39916 - DNA, 103 bp, Artificial Sequence
  Synthetic Polynucleotide
taatacgactcactatagggcgagggttaggtgggcctaaaggtgtcacaaacagaggagatgtgacatgtttaggcccaacctggcggcagcgcaaaagatg

SEQ ID NO: 39917 - DNA, 103 bp, Artificial Sequence
  Synthetic Polynucleotide
taatacgactcactatagggtttagccatactcacatgcaataaggagacaacagaggagagtctccatgttgcatgtgaacctggcggcagcgcaaaagatg

SEQ ID NO: 39918 - DNA, 103 bp, Artificial Sequence
  Synthetic Polynucleotide
taatacgactcactatagggtaccgcaattgcggcgtctcagggttaggcaacagaggagagcctaaatgtgagacgccaacctggcggcagcgcaaaagatg

SEQ ID NO: 39919 - DNA, 103 bp, Artificial Sequence
  Synthetic Polynucleotide
taatacgactcactatagggataggcacccggatagtcttatgggtattgaacagaggagacaatacatgtaagactataacctggcggcagcgcaaaagatg

SEQ ID NO: 39920 - DNA, 103 bp, Artificial Sequence
  Synthetic Polynucleotide
taatacgactcactataggggataactatttcccaagaggtacatagttaaacagaggagataactaatgacctcttggaacctggcggcagcgcaaaagatg

SEQ ID NO: 39921 - DNA, 103 bp, Artificial Sequence
  Synthetic Polynucleotide
taatacgactcactataggggtacccgtggaacgaacatgccgagtacttaacagaggagaaagtacatggcatgttcgaacctggcggcagcgcaaaagatg

SEQ ID NO: 39922 - DNA, 103 bp, Artificial Sequence
  Synthetic Polynucleotide
taatacgactcactatagggactcaaagtgtcaactagccccggtgtcttaacagaggagaaagacaatggggctagttaacctggcggcagcgcaaaagatg

SEQ ID NO: 39923 - DNA, 103 bp, Artificial Sequence
  Synthetic Polynucleotide
taatacgactcactatagggcgcacgctcttccagcagcgttcagacttcaacagaggagagaagtcatgacgctgctgaacctggcggcagcgcaaaagatg

SEQ ID NO: 39924 - DNA, 103 bp, Artificial Sequence
  Synthetic Polynucleotide
taatacgactcactatagggccatgagtactaccctttatgtataggcctaacagaggagaaggcctatgcataaagggaacctggcggcagcgcaaaagatg

SEQ ID NO: 39925 - DNA, 103 bp, Artificial Sequence
  Synthetic Polynucleotide
taatacgactcactatagggccctctatactcaacctcgcaaacgacggtaacagaggagaaccgtcatgtgcgaggttaacctggcggcagcgcaaaagatg

SEQ ID NO: 39926 - DNA, 103 bp, Artificial Sequence
  Synthetic Polynucleotide
taatacgactcactatagggctatattgacttcgtgataaactcccgcttaacagaggagaaagcggatgtttatcacgaacctggcggcagcgcaaaagatg

SEQ ID NO: 39927 - DNA, 103 bp, Artificial Sequence
  Synthetic Polynucleotide
taatacgactcactatagggggaagggtgatctccagtcggacgatatccaacagaggagaggatatatgccgactggaaacctggcggcagcgcaaaagatg

SEQ ID NO: 39928 - DNA, 103 bp, Artificial Sequence
  Synthetic Polynucleotide
taatacgactcactataggggcccgcaggtcgcgttctgctgagcggctgaacagaggagacagccgatgagcagaacgaacctggcggcagcgcaaaagatg

SEQ ID NO: 39929 - DNA, 103 bp, Artificial Sequence
  Synthetic Polynucleotide
taatacgactcactatagggtaccagataaaatgtcaaatctgcgctgagaacagaggagactcagcatggatttgacaaacctggcggcagcgcaaaagatg

SEQ ID NO: 39930 - DNA, 103 bp, Artificial Sequence
  Synthetic Polynucleotide
taatacgactcactatagggaccgcggggacgatcgcgcttctccggcgaaacagaggagatcgccgatgaagcgcgataacctggcggcagcgcaaaagatg

SEQ ID NO: 39931 - DNA, 103 bp, Artificial Sequence
  Synthetic Polynucleotide
taatacgactcactataggggggtaccacagcttcatcaagcactgagtcaacagaggagagactcaatgcttgatgaaaacctggcggcagcgcaaaagatg

SEQ ID NO: 39932 - DNA, 103 bp, Artificial Sequence
  Synthetic Polynucleotide
taatacgactcactatagggcgtatgtaaacactcacgcaagtaataaacaacagaggagagtttatatgttgcgtgagaacctggcggcagcgcaaaagatg

SEQ ID NO: 39933 - DNA, 103 bp, Artificial Sequence
  Synthetic Polynucleotide
taatacgactcactatagggaaatatacctacacacgggcttctacggataacagaggagaatccgtatgagcccgtgtaacctggcggcagcgcaaaagatg

SEQ ID NO: 39934 - DNA, 103 bp, Artificial Sequence
  Synthetic Polynucleotide
taatacgactcactatagggttcgtccgcatactttacactttcttagcgaacagaggagacgctaaatgagtgtaaagaacctggcggcagcgcaaaagatg

SEQ ID NO: 39935 - DNA, 103 bp, Artificial Sequence
  Synthetic Polynucleotide
taatacgactcactataggggtgtaggcgatgagcgcggcctcgttccataacagaggagaatggaaatgggccgcgctaacctggcggcagcgcaaaagatg

SEQ ID NO: 39936 - DNA, 103 bp, Artificial Sequence
  Synthetic Polynucleotide
taatacgactcactatagggcgggcgcatcagaggatcttctggtagtagaacagaggagactactaatggaagatcctaacctggcggcagcgcaaaagatg

SEQ ID NO: 39937 - DNA, 103 bp, Artificial Sequence
  Synthetic Polynucleotide
taatacgactcactatagggactagcaagtgcgtccgctcggttacaaaaaacagaggagattttgtatgcgagcggacaacctggcggcagcgcaaaagatg

SEQ ID NO: 39938 - DNA, 103 bp, Artificial Sequence
  Synthetic Polynucleotide
taatacgactcactataggggcttgtgtgcttttttttctagtggttaggaacagaggagacctaacatgtagaaaaaaaacctggcggcagcgcaaaagatg

SEQ ID NO: 39939 - DNA, 103 bp, Artificial Sequence
  Synthetic Polynucleotide
taatacgactcactatagggcggagtggacagaaaggctgacgcggctctaacagaggagaagagccatgtcagcctttaacctggcggcagcgcaaaagatg

SEQ ID NO: 39940 - DNA, 103 bp, Artificial Sequence
  Synthetic Polynucleotide
taatacgactcactataggggcgtcccataacgagtaaaagccgcatctgaacagaggagacagatgatgcttttactcaacctggcggcagcgcaaaagatg

SEQ ID NO: 39941 - DNA, 103 bp, Artificial Sequence
  Synthetic Polynucleotide
taatacgactcactatagggcacttattaaagcgctatatccaattcatcaacagaggagagatgaaatggatatagcgaacctggcggcagcgcaaaagatg

SEQ ID NO: 39942 - DNA, 103 bp, Artificial Sequence
  Synthetic Polynucleotide
taatacgactcactatagggcttaaccctagactggatagagcaaatcctaacagaggagaaggattatgtctatccagaacctggcggcagcgcaaaagatg

SEQ ID NO: 39943 - DNA, 103 bp, Artificial Sequence
  Synthetic Polynucleotide
taatacgactcactatagggtggtcggttgcccgatgttcacccatcagcaacagaggagagctgatatgtgaacatcgaacctggcggcagcgcaaaagatg

SEQ ID NO: 39944 - DNA, 103 bp, Artificial Sequence
  Synthetic Polynucleotide
taatacgactcactatagggagtgataggatgctgtttaggagcgacgtaaacagaggagatacgtcatgcctaaacagaacctggcggcagcgcaaaagatg

SEQ ID NO: 39945 - DNA, 103 bp, Artificial Sequence
  Synthetic Polynucleotide
taatacgactcactatagggttaagccgataaggaatggtttcccacaaaaacagaggagatttgtgatgaaccattccaacctggcggcagcgcaaaagatg

SEQ ID NO: 39946 - DNA, 103 bp, Artificial Sequence
  Synthetic Polynucleotide
taatacgactcactatagggaccagccatttcggagttgccactctgtgtaacagaggagaacacagatgggcaactccaacctggcggcagcgcaaaagatg

SEQ ID NO: 39947 - DNA, 103 bp, Artificial Sequence
  Synthetic Polynucleotide
taatacgactcactatagggaggcaacgtcattggtctagccgggccgggaacagaggagacccggcatggctagaccaaacctggcggcagcgcaaaagatg

SEQ ID NO: 39948 - DNA, 103 bp, Artificial Sequence
  Synthetic Polynucleotide
taatacgactcactatagggtaaccgagttttgtacaaattcgtggctcaaacagaggagatgagccatgaatttgtacaacctggcggcagcgcaaaagatg

SEQ ID NO: 39949 - DNA, 103 bp, Artificial Sequence
  Synthetic Polynucleotide
taatacgactcactataggggtttcacggaatttagcctagtctttatagaacagaggagactataaatgctaggctaaaacctggcggcagcgcaaaagatg

SEQ ID NO: 39950 - DNA, 103 bp, Artificial Sequence
  Synthetic Polynucleotide
taatacgactcactataggggaggagaggtggcatttctggatgatgttgaacagaggagacaacatatgccagaaatgaacctggcggcagcgcaaaagatg

SEQ ID NO: 39951 - DNA, 103 bp, Artificial Sequence
  Synthetic Polynucleotide
taatacgactcactatagggatttgtatcgcctatattcgcggacccccaaacagaggagatgggggatggcgaatataaacctggcggcagcgcaaaagatg

SEQ ID NO: 39952 - DNA, 103 bp, Artificial Sequence
  Synthetic Polynucleotide
taatacgactcactatagggaccaccaacatcataaaagcgagtgaactcaacagaggagagagttcatgcgcttttataacctggcggcagcgcaaaagatg

SEQ ID NO: 39953 - DNA, 103 bp, Artificial Sequence
  Synthetic Polynucleotide
taatacgactcactatagggctgcctagttgccggtgataatctgtcataaacagaggagatatgacatgttatcaccgaacctggcggcagcgcaaaagatg

SEQ ID NO: 39954 - DNA, 103 bp, Artificial Sequence
  Synthetic Polynucleotide
taatacgactcactataggggtctgacgatggcgcaaacaactcgggtgaaacagaggagatcacccatgttgtttgcgaacctggcggcagcgcaaaagatg

SEQ ID NO: 39955 - DNA, 103 bp, Artificial Sequence
  Synthetic Polynucleotide
taatacgactcactatagggtgtacgataactaatagttctatgagttaaaacagaggagattaactatgagaactattaacctggcggcagcgcaaaagatg

SEQ ID NO: 39956 - DNA, 103 bp, Artificial Sequence
  Synthetic Polynucleotide
taatacgactcactatagggaatcgtgtgctcagcgtgatccagaatagcaacagaggagagctattatggatcacgctaacctggcggcagcgcaaaagatg

SEQ ID NO: 39957 - DNA, 103 bp, Artificial Sequence
  Synthetic Polynucleotide
taatacgactcactatagggcggagacaggttactcatgttaccgtgtgtaacagaggagaacacacatgaacatgagtaacctggcggcagcgcaaaagatg

SEQ ID NO: 39958 - DNA, 103 bp, Artificial Sequence
  Synthetic Polynucleotide
taatacgactcactatagggttctataggattcgtcctcttcccgagcctaacagaggagaaggctcatgaagaggacgaacctggcggcagcgcaaaagatg

SEQ ID NO: 39959 - DNA, 103 bp, Artificial Sequence
  Synthetic Polynucleotide
taatacgactcactatagggacccataaatcgctgcgcaaagacttgcagaacagaggagactgcaaatgtttgcgcagaacctggcggcagcgcaaaagatg

SEQ ID NO: 39960 - DNA, 103 bp, Artificial Sequence
  Synthetic Polynucleotide
taatacgactcactatagggagggtggatccctcccgcttggcgtaagttaacagaggagaaacttaatgcaagcgggaaacctggcggcagcgcaaaagatg

SEQ ID NO: 39961 - DNA, 103 bp, Artificial Sequence
  Synthetic Polynucleotide
taatacgactcactatagggagagccaaatctagacggcttctaagcgctaacagaggagaagcgctatgaagccgtctaacctggcggcagcgcaaaagatg

SEQ ID NO: 39962 - DNA, 103 bp, Artificial Sequence
  Synthetic Polynucleotide
taatacgactcactataggggttacacaactcggtggcctcaacataaataacagaggagaatttatatggaggccaccaacctggcggcagcgcaaaagatg

SEQ ID NO: 39963 - DNA, 103 bp, Artificial Sequence
  Synthetic Polynucleotide
taatacgactcactatagggcaggtaagagttttacggtgcaaggcaagaaacagaggagatcttgcatggcaccgtaaaacctggcggcagcgcaaaagatg

SEQ ID NO: 39964 - DNA, 103 bp, Artificial Sequence
  Synthetic Polynucleotide
taatacgactcactatagggcgggtccatcaatcacgttaatctggtcttaacagaggagaaagaccatgttaacgtgaaacctggcggcagcgcaaaagatg

SEQ ID NO: 39965 - DNA, 103 bp, Artificial Sequence
  Synthetic Polynucleotide
taatacgactcactatagggcttttatcgttaaatagaacagaatgttcaaacagaggagatgaacaatgtgttctattaacctggcggcagcgcaaaagatg

SEQ ID NO: 39966 - DNA, 103 bp, Artificial Sequence
  Synthetic Polynucleotide
taatacgactcactatagggctccgttcttgatgctcgtctacggacaataacagaggagaattgtcatgagacgagcaaacctggcggcagcgcaaaagatg

SEQ ID NO: 39967 - DNA, 103 bp, Artificial Sequence
  Synthetic Polynucleotide
taatacgactcactatagggatacaggcgacacgtggtgttgcagttcgaaacagaggagatcgaacatgaacaccacgaacctggcggcagcgcaaaagatg

SEQ ID NO: 39968 - DNA, 103 bp, Artificial Sequence
  Synthetic Polynucleotide
taatacgactcactatagggccctgttcaccagtgttgttagtcacggtgaacagaggagacaccgtatgtaacaacacaacctggcggcagcgcaaaagatg

SEQ ID NO: 39969 - DNA, 103 bp, Artificial Sequence
  Synthetic Polynucleotide
taatacgactcactataggggcttaggattgtcaagttctttgaattcagaacagaggagactgaatatgaagaacttgaacctggcggcagcgcaaaagatg

SEQ ID NO: 39970 - DNA, 103 bp, Artificial Sequence
  Synthetic Polynucleotide
taatacgactcactatagggttgagaacaccctccccgatagcgtgcaataacagaggagaattgcaatgtatcggggaaacctggcggcagcgcaaaagatg

SEQ ID NO: 39971 - DNA, 103 bp, Artificial Sequence
  Synthetic Polynucleotide
taatacgactcactatagggactgattggtagcgcccactgcacgattgcaacagaggagagcaatcatgcagtgggcgaacctggcggcagcgcaaaagatg

SEQ ID NO: 39972 - DNA, 103 bp, Artificial Sequence
  Synthetic Polynucleotide
taatacgactcactatagggatgcgtatgggaccacgttcttgaacaccgaacagaggagacggtgtatgagaacgtggaacctggcggcagcgcaaaagatg

SEQ ID NO: 39973 - DNA, 103 bp, Artificial Sequence
  Synthetic Polynucleotide
taatacgactcactatagggagtccttccgtacctccgtgttactacccaaacagaggagatgggtaatgacacggaggaacctggcggcagcgcaaaagatg

SEQ ID NO: 39974 - DNA, 103 bp, Artificial Sequence
  Synthetic Polynucleotide
taatacgactcactataggggtctgggtgggatggtcatagtaaaaacataacagaggagaatgtttatgctatgaccaaacctggcggcagcgcaaaagatg

SEQ ID NO: 39975 - DNA, 103 bp, Artificial Sequence
  Synthetic Polynucleotide
taatacgactcactatagggtggagggacagtgcacgcaagcgtgccaataacagaggagaattggcatgcttgcgtgcaacctggcggcagcgcaaaagatg

SEQ ID NO: 39976 - DNA, 103 bp, Artificial Sequence
  Synthetic Polynucleotide
taatacgactcactatagggacattgatgccccaatgttgcaaatagaaaaacagaggagatttctaatggcaacattgaacctggcggcagcgcaaaagatg

SEQ ID NO: 39977 - DNA, 103 bp, Artificial Sequence
  Synthetic Polynucleotide
taatacgactcactataggggaatcaaagtctgtgtgccgaccgcttaagaacagaggagacttaagatgtcggcacacaacctggcggcagcgcaaaagatg

SEQ ID NO: 39978 - DNA, 103 bp, Artificial Sequence
  Synthetic Polynucleotide
taatacgactcactatagggcctgcagtatcactaatcgattacataacaaacagaggagatgttatatgatcgattagaacctggcggcagcgcaaaagatg

SEQ ID NO: 39979 - DNA, 103 bp, Artificial Sequence
  Synthetic Polynucleotide
taatacgactcactatagggcgacgagagctccagacggagtgcccgacgaacagaggagacgtcggatgctccgtctgaacctggcggcagcgcaaaagatg

SEQ ID NO: 39980 - DNA, 103 bp, Artificial Sequence
  Synthetic Polynucleotide
taatacgactcactatagggctctttaacgttctttctagtcggacactgaacagaggagacagtgtatgactagaaagaacctggcggcagcgcaaaagatg

SEQ ID NO: 39981 - DNA, 103 bp, Artificial Sequence
  Synthetic Polynucleotide
taatacgactcactatagggctcctcgtacttcttaatgtacctagattcaacagaggagagaatctatgtacattaagaacctggcggcagcgcaaaagatg

SEQ ID NO: 39982 - DNA, 103 bp, Artificial Sequence
  Synthetic Polynucleotide
taatacgactcactatagggagattctggaggagtactctgtgctggaaaaacagaggagatttccaatgcagagtactaacctggcggcagcgcaaaagatg

SEQ ID NO: 39983 - DNA, 103 bp, Artificial Sequence
  Synthetic Polynucleotide
taatacgactcactatagggtttagcggcactccataacaaggtgagattaacagaggagaaatctcatgttgttatggaacctggcggcagcgcaaaagatg

SEQ ID NO: 39984 - DNA, 103 bp, Artificial Sequence
  Synthetic Polynucleotide
taatacgactcactatagggctatctaagagggagccgtagccgcgagtgaacagaggagacactcgatgctacggctcaacctggcggcagcgcaaaagatg

SEQ ID NO: 39985 - DNA, 103 bp, Artificial Sequence
  Synthetic Polynucleotide
taatacgactcactataggggacaagagccaatgattttagatgtcctcaaacagaggagatgaggaatgctaaaatcaaacctggcggcagcgcaaaagatg

SEQ ID NO: 39986 - DNA, 103 bp, Artificial Sequence
  Synthetic Polynucleotide
taatacgactcactatagggtactgctcgacgatataaaattttgtattaaacagaggagataatacatgattttatataacctggcggcagcgcaaaagatg

SEQ ID NO: 39987 - DNA, 103 bp, Artificial Sequence
  Synthetic Polynucleotide
taatacgactcactatagggagtgccctgcggcttgttacgtcatagagaaacagaggagatctctaatgcgtaacaagaacctggcggcagcgcaaaagatg

SEQ ID NO: 39988 - DNA, 103 bp, Artificial Sequence
  Synthetic Polynucleotide
taatacgactcactataggggcacaggcctccgctcatagctaaaagttcaacagaggagagaacttatggctatgagcaacctggcggcagcgcaaaagatg

SEQ ID NO: 39989 - DNA, 103 bp, Artificial Sequence
  Synthetic Polynucleotide
taatacgactcactatagggccgttctgacgttaccatggagccctagagaacagaggagactctagatgtccatggtaaacctggcggcagcgcaaaagatg

SEQ ID NO: 39990 - DNA, 103 bp, Artificial Sequence
  Synthetic Polynucleotide
taatacgactcactatagggcacctcaatgagcctaccacgaacgaatcaaacagaggagatgattcatgcgtggtaggaacctggcggcagcgcaaaagatg

SEQ ID NO: 39991 - DNA, 103 bp, Artificial Sequence
  Synthetic Polynucleotide
taatacgactcactataggggcggtcgccttgctcaccatgtaaaagatcaacagaggagagatcttatgcatggtgagaacctggcggcagcgcaaaagatg

SEQ ID NO: 39992 - DNA, 103 bp, Artificial Sequence
  Synthetic Polynucleotide
taatacgactcactataggggtccaacaccctcctttatactatcatcacaacagaggagagtgatgatggtataaaggaacctggcggcagcgcaaaagatg

SEQ ID NO: 39993 - DNA, 103 bp, Artificial Sequence
  Synthetic Polynucleotide
taatacgactcactataggggagtagcacacccctcactttgtactacttaacagaggagaaagtagatgaaagtgaggaacctggcggcagcgcaaaagatg

SEQ ID NO: 39994 - DNA, 103 bp, Artificial Sequence
  Synthetic Polynucleotide
taatacgactcactatagggcacgctactgcaagatagggcagaacggcaaacagaggagatgccgtatggccctatctaacctggcggcagcgcaaaagatg

SEQ ID NO: 39995 - DNA, 103 bp, Artificial Sequence
  Synthetic Polynucleotide
taatacgactcactatagggagatcgtgttcgaggagtaccacgctaacgaacagaggagacgttagatgggtactcctaacctggcggcagcgcaaaagatg

SEQ ID NO: 39996 - DNA, 103 bp, Artificial Sequence
  Synthetic Polynucleotide
taatacgactcactatagggttcgcagtgcacatcgagattacacacgcaaacagaggagatgcgtgatgaatctcgataacctggcggcagcgcaaaagatg

SEQ ID NO: 39997 - DNA, 103 bp, Artificial Sequence
  Synthetic Polynucleotide
taatacgactcactatagggttcgaaggtctgtgtgttcgaaagaagtataacagaggagaatacttatgtcgaacacaaacctggcggcagcgcaaaagatg

SEQ ID NO: 39998 - DNA, 103 bp, Artificial Sequence
  Synthetic Polynucleotide
taatacgactcactatagggttgacatgttcgaaagagaaccgctcgtggaacagaggagaccacgaatggttctctttaacctggcggcagcgcaaaagatg

SEQ ID NO: 39999 - DNA, 103 bp, Artificial Sequence
  Synthetic Polynucleotide
taatacgactcactatagggtatgctggaagacagtgggggtagcgcatcaacagaggagagatgcgatgcccccactgaacctggcggcagcgcaaaagatg

SEQ ID NO: 40000 - DNA, 103 bp, Artificial Sequence
  Synthetic Polynucleotide
taatacgactcactatagggcgtgagcccgagtaactcttggcctcgcgcaacagaggagagcgcgaatgcaagagttaaacctggcggcagcgcaaaagatg

SEQ ID NO: 40001 - DNA, 103 bp, Artificial Sequence
  Synthetic Polynucleotide
taatacgactcactatagggagccggatcataactattagtctactagcgaacagaggagacgctagatgactaatagtaacctggcggcagcgcaaaagatg

SEQ ID NO: 40002 - DNA, 103 bp, Artificial Sequence
  Synthetic Polynucleotide
taatacgactcactataggggaccgacatgaccgtccttatagcatgtcaaacagaggagatgacatatgataaggacgaacctggcggcagcgcaaaagatg

SEQ ID NO: 40003 - DNA, 103 bp, Artificial Sequence
  Synthetic Polynucleotide
taatacgactcactatagggagtgcaaccttgggcaagtcgccacacgaaaacagaggagattcgtgatgcgacttgccaacctggcggcagcgcaaaagatg

SEQ ID NO: 40004 - DNA, 103 bp, Artificial Sequence
  Synthetic Polynucleotide
taatacgactcactatagggctcagtcgtccactggactttgacattattaacagaggagaaataatatgaaagtccagaacctggcggcagcgcaaaagatg

SEQ ID NO: 40005 - DNA, 103 bp, Artificial Sequence
  Synthetic Polynucleotide
taatacgactcactatagggcccgtggtaggtattcgctctttcgatattaacagaggagaaatatcatgagagcgaataacctggcggcagcgcaaaagatg

SEQ ID NO: 40006 - DNA, 103 bp, Artificial Sequence
  Synthetic Polynucleotide
taatacgactcactataggggcgatgaacgtgttacgtaagtattagataaacagaggagatatctaatgcttacgtaaaacctggcggcagcgcaaaagatg

SEQ ID NO: 40007 - DNA, 103 bp, Artificial Sequence
  Synthetic Polynucleotide
taatacgactcactatagggcgtgaaagctctccgatgttcatgttaagtaacagaggagaacttaaatggaacatcggaacctggcggcagcgcaaaagatg

SEQ ID NO: 40008 - DNA, 103 bp, Artificial Sequence
  Synthetic Polynucleotide
taatacgactcactatagggaattgcggtcagcagtgtatttctctcattaacagaggagaaatgagatgaatacactgaacctggcggcagcgcaaaagatg

SEQ ID NO: 40009 - DNA, 103 bp, Artificial Sequence
  Synthetic Polynucleotide
taatacgactcactataggggagaggattaactggaaagtcagggtcatgaacagaggagacatgacatggactttccaaacctggcggcagcgcaaaagatg

SEQ ID NO: 40010 - DNA, 103 bp, Artificial Sequence
  Synthetic Polynucleotide
taatacgactcactatagggcatagaagagcttgaagaggattaatggccaacagaggagaggccatatgtcctcttcaaacctggcggcagcgcaaaagatg

SEQ ID NO: 40011 - DNA, 103 bp, Artificial Sequence
  Synthetic Polynucleotide
taatacgactcactatagggagcgcagcctccatcacctatggtggggcgaacagaggagacgccccatgataggtgataacctggcggcagcgcaaaagatg

SEQ ID NO: 40012 - DNA, 103 bp, Artificial Sequence
  Synthetic Polynucleotide
taatacgactcactatagggataagattggatagacacgtccatgcggtcaacagaggagagaccgcatggacgtgtctaacctggcggcagcgcaaaagatg

SEQ ID NO: 40013 - DNA, 103 bp, Artificial Sequence
  Synthetic Polynucleotide
taatacgactcactatagggttccgagaccaactgattttttaagcgtataacagaggagaatacgcatgaaaaatcagaacctggcggcagcgcaaaagatg

SEQ ID NO: 40014 - DNA, 103 bp, Artificial Sequence
  Synthetic Polynucleotide
taatacgactcactatagggcagtacgcagttatgattgtagatgacccaaacagaggagatgggtcatgtacaatcataacctggcggcagcgcaaaagatg

SEQ ID NO: 40015 - DNA, 103 bp, Artificial Sequence
  Synthetic Polynucleotide
taatacgactcactatagggtctcttcagctttggggacggcaatcgaaaaacagaggagatttcgaatgccgtccccaaacctggcggcagcgcaaaagatg

SEQ ID NO: 40016 - DNA, 103 bp, Artificial Sequence
  Synthetic Polynucleotide
taatacgactcactataggggtacaagaccccgcgtacggcaacgggcctaacagaggagaaggcccatggccgtacgcaacctggcggcagcgcaaaagatg

SEQ ID NO: 40017 - DNA, 103 bp, Artificial Sequence
  Synthetic Polynucleotide
taatacgactcactatagggtggttacttttcactcaaccgctggttaccaacagaggagaggtaacatgcggttgagtaacctggcggcagcgcaaaagatg

SEQ ID NO: 40018 - DNA, 103 bp, Artificial Sequence
  Synthetic Polynucleotide
taatacgactcactatagggcctaacatattttggttttagcacatcgccaacagaggagaggcgatatgctaaaaccaaacctggcggcagcgcaaaagatg

SEQ ID NO: 40019 - DNA, 103 bp, Artificial Sequence
  Synthetic Polynucleotide
taatacgactcactatagggcggtggaccacgagatctatctgtcataataacagaggagaattatgatggatagatctaacctggcggcagcgcaaaagatg

SEQ ID NO: 40020 - DNA, 103 bp, Artificial Sequence
  Synthetic Polynucleotide
taatacgactcactatagggcggtgttgccgaagagagatggtcttgattaacagaggagaaatcaaatgcatctctctaacctggcggcagcgcaaaagatg

SEQ ID NO: 40021 - DNA, 103 bp, Artificial Sequence
  Synthetic Polynucleotide
taatacgactcactatagggaaattcttggagtacggactcgaaagacacaacagaggagagtgtctatggagtccgtaaacctggcggcagcgcaaaagatg

SEQ ID NO: 40022 - DNA, 103 bp, Artificial Sequence
  Synthetic Polynucleotide
taatacgactcactatagggcccggcatcggcgcatagagatgtcaggacaacagaggagagtcctgatgtctctatgcaacctggcggcagcgcaaaagatg

SEQ ID NO: 40023 - DNA, 103 bp, Artificial Sequence
  Synthetic Polynucleotide
taatacgactcactatagggtaatcactttgctcagaggcgtggctcttaaacagaggagataagagatgcgcctctgaaacctggcggcagcgcaaaagatg

SEQ ID NO: 40024 - DNA, 103 bp, Artificial Sequence
  Synthetic Polynucleotide
taatacgactcactatagggagccgatgaaaattgaattggtctaggcataacagaggagaatgcctatgccaattcaaaacctggcggcagcgcaaaagatg

SEQ ID NO: 40025 - DNA, 103 bp, Artificial Sequence
  Synthetic Polynucleotide
taatacgactcactatagggtagggccagcggttcttctgtaactcttgcaacagaggagagcaagaatgacagaagaaaacctggcggcagcgcaaaagatg

SEQ ID NO: 40026 - DNA, 103 bp, Artificial Sequence
  Synthetic Polynucleotide
taatacgactcactatagggcctagaggactggcgaggacacgatgcaaaaacagaggagatttgcaatgtgtcctcgcaacctggcggcagcgcaaaagatg

SEQ ID NO: 40027 - DNA, 103 bp, Artificial Sequence
  Synthetic Polynucleotide
taatacgactcactataggggttgccgcactctaactgcaaccactaaagaacagaggagactttagatgttgcagttaaacctggcggcagcgcaaaagatg

SEQ ID NO: 40028 - DNA, 103 bp, Artificial Sequence
  Synthetic Polynucleotide
taatacgactcactataggggccgttcttaacaaggtcgtacccacaccgaacagaggagacggtgtatgtacgaccttaacctggcggcagcgcaaaagatg

SEQ ID NO: 40029 - DNA, 103 bp, Artificial Sequence
  Synthetic Polynucleotide
taatacgactcactatagggttcacctcatcagcaggggaatccgtatgaaacagaggagatcatacatgttcccctgcaacctggcggcagcgcaaaagatg

SEQ ID NO: 40030 - DNA, 103 bp, Artificial Sequence
  Synthetic Polynucleotide
taatacgactcactatagggggcttaagaggtcgggatagaatggaccctaacagaggagaagggtcatgtctatcccgaacctggcggcagcgcaaaagatg

SEQ ID NO: 40031 - DNA, 103 bp, Artificial Sequence
  Synthetic Polynucleotide
taatacgactcactataggggtctattattagacatttatagcaacttggaacagaggagaccaagtatgtataaatgtaacctggcggcagcgcaaaagatg

SEQ ID NO: 40032 - DNA, 103 bp, Artificial Sequence
  Synthetic Polynucleotide
taatacgactcactatagggtgggtcggcaactagatccacttaactactaacagaggagaagtagtatggtggatctaaacctggcggcagcgcaaaagatg

SEQ ID NO: 40033 - DNA, 103 bp, Artificial Sequence
  Synthetic Polynucleotide
taatacgactcactatagggaaaccccgggtaaacccgtcatatcccgataacagaggagaatcgggatgtgacgggttaacctggcggcagcgcaaaagatg

SEQ ID NO: 40034 - DNA, 103 bp, Artificial Sequence
  Synthetic Polynucleotide
taatacgactcactataggggctcttgccgcttgtaaccgtcgtcaacgtaacagaggagaacgttgatgacggttacaaacctggcggcagcgcaaaagatg

SEQ ID NO: 40035 - DNA, 103 bp, Artificial Sequence
  Synthetic Polynucleotide
taatacgactcactatagggggcccgcgtaggcctagcaaatacaggcttaacagaggagaaagcctatgtttgctaggaacctggcggcagcgcaaaagatg

SEQ ID NO: 40036 - DNA, 103 bp, Artificial Sequence
  Synthetic Polynucleotide
taatacgactcactatagggaggagcgaatataaaccgggatcgttactgaacagaggagacagtaaatgtcccggtttaacctggcggcagcgcaaaagatg

SEQ ID NO: 40037 - DNA, 103 bp, Artificial Sequence
  Synthetic Polynucleotide
taatacgactcactatagggatacaaagaagatatagtttcttccccaataacagaggagaattgggatggaaactataaacctggcggcagcgcaaaagatg

SEQ ID NO: 40038 - DNA, 103 bp, Artificial Sequence
  Synthetic Polynucleotide
taatacgactcactatagggcgtccaccaaggtaatgtatgcacatctggaacagaggagaccagatatgcatacattaaacctggcggcagcgcaaaagatg

SEQ ID NO: 40039 - DNA, 103 bp, Artificial Sequence
  Synthetic Polynucleotide
taatacgactcactatagggaggggccaaagaccgtgcgtaacagagtaaaacagaggagattactcatgtacgcacggaacctggcggcagcgcaaaagatg

SEQ ID NO: 40040 - DNA, 103 bp, Artificial Sequence
  Synthetic Polynucleotide
taatacgactcactatagggtatctaactaggggtccatgtagacccataaacagaggagatatgggatgacatggaccaacctggcggcagcgcaaaagatg

SEQ ID NO: 40041 - DNA, 103 bp, Artificial Sequence
  Synthetic Polynucleotide
taatacgactcactatagggctacgtcattacacgtccgaggaaggtgggaacagaggagacccaccatgctcggacgtaacctggcggcagcgcaaaagatg

SEQ ID NO: 40042 - DNA, 103 bp, Artificial Sequence
  Synthetic Polynucleotide
taatacgactcactatagggcagttcagacaaaatacggtctcccagctaaacagaggagatagctgatggaccgtattaacctggcggcagcgcaaaagatg

SEQ ID NO: 40043 - DNA, 103 bp, Artificial Sequence
  Synthetic Polynucleotide
taatacgactcactataggggctgctaatctaataatgtgcattgtgagtaacagaggagaactcacatggcacattataacctggcggcagcgcaaaagatg

SEQ ID NO: 40044 - DNA, 103 bp, Artificial Sequence
  Synthetic Polynucleotide
taatacgactcactatagggggatactagaagttcgacgctgtaggtctaaacagaggagatagaccatgagcgtcgaaaacctggcggcagcgcaaaagatg

SEQ ID NO: 40045 - DNA, 103 bp, Artificial Sequence
  Synthetic Polynucleotide
taatacgactcactatagggcattattagtcggtagtgccttataccaagaacagaggagacttggtatgaggcactacaacctggcggcagcgcaaaagatg

SEQ ID NO: 40046 - DNA, 103 bp, Artificial Sequence
  Synthetic Polynucleotide
taatacgactcactatagggccgaatgtctcgaaaaatagatcccataagaacagaggagacttatgatgtctatttttaacctggcggcagcgcaaaagatg

SEQ ID NO: 40047 - DNA, 103 bp, Artificial Sequence
  Synthetic Polynucleotide
taatacgactcactatagggcggcgttggtatctacgacttcggtctcttaacagaggagaaagagaatgaagtcgtagaacctggcggcagcgcaaaagatg

SEQ ID NO: 40048 - DNA, 103 bp, Artificial Sequence
  Synthetic Polynucleotide
taatacgactcactatagggccgtcgccgcctatcatagggatccaggtaaacagaggagatacctgatgccctatgataacctggcggcagcgcaaaagatg

SEQ ID NO: 40049 - DNA, 103 bp, Artificial Sequence
  Synthetic Polynucleotide
taatacgactcactatagggcgccaattaaaacgctcttcgctccttgacaacagaggagagtcaagatgcgaagagcgaacctggcggcagcgcaaaagatg

SEQ ID NO: 40050 - DNA, 103 bp, Artificial Sequence
  Synthetic Polynucleotide
taatacgactcactataggggcgacgccggtcaaatttgggacgcctgcgaacagaggagacgcaggatgcccaaatttaacctggcggcagcgcaaaagatg

SEQ ID NO: 40051 - DNA, 103 bp, Artificial Sequence
  Synthetic Polynucleotide
taatacgactcactatagggtcatatcgtgcgcgaccgatttgcctgagtaacagaggagaactcagatgaatcggtcgaacctggcggcagcgcaaaagatg

SEQ ID NO: 40052 - DNA, 103 bp, Artificial Sequence
  Synthetic Polynucleotide
taatacgactcactatagggtaatatgtgaaataataggaggtcgacagcaacagaggagagctgtcatgctcctattaaacctggcggcagcgcaaaagatg

SEQ ID NO: 40053 - DNA, 103 bp, Artificial Sequence
  Synthetic Polynucleotide
taatacgactcactatagggcacaagcacgagctgtgcacaagtagtcctaacagaggagaaggactatgtgtgcacagaacctggcggcagcgcaaaagatg

SEQ ID NO: 40054 - DNA, 103 bp, Artificial Sequence
  Synthetic Polynucleotide
taatacgactcactatagggccttcccctacgccctcgtctggaattctaaacagaggagatagaatatgagacgagggaacctggcggcagcgcaaaagatg

SEQ ID NO: 40055 - DNA, 103 bp, Artificial Sequence
  Synthetic Polynucleotide
taatacgactcactatagggcatctggtttaggtgtaggggccccctacaaacagaggagatgtaggatgcccctacacaacctggcggcagcgcaaaagatg

SEQ ID NO: 40056 - DNA, 103 bp, Artificial Sequence
  Synthetic Polynucleotide
taatacgactcactatagggaaaagtcttgaggttaccgcctcagaatataacagaggagaatattcatgggcggtaacaacctggcggcagcgcaaaagatg

SEQ ID NO: 40057 - DNA, 103 bp, Artificial Sequence
  Synthetic Polynucleotide
taatacgactcactatagggtttgcggactatcccctctcagaaaacccgaacagaggagacgggttatgtgagaggggaacctggcggcagcgcaaaagatg

SEQ ID NO: 40058 - DNA, 103 bp, Artificial Sequence
  Synthetic Polynucleotide
taatacgactcactatagggactcattatacctctaagtgcgatcctgtaaacagaggagatacaggatggcacttagaaacctggcggcagcgcaaaagatg

SEQ ID NO: 40059 - DNA, 103 bp, Artificial Sequence
  Synthetic Polynucleotide
taatacgactcactatagggcgggggcaggtttcggaccgctcttgaccaaacagaggagatggtcaatggcggtccgaaacctggcggcagcgcaaaagatg

SEQ ID NO: 40060 - DNA, 103 bp, Artificial Sequence
  Synthetic Polynucleotide
taatacgactcactataggggacccattcgcacttagtgagttatttgagaacagaggagactcaaaatgctcactaagaacctggcggcagcgcaaaagatg

SEQ ID NO: 40061 - DNA, 103 bp, Artificial Sequence
  Synthetic Polynucleotide
taatacgactcactatagggtatctatctaccagtgtcttctttggtttaaacagaggagataaaccatggaagacactaacctggcggcagcgcaaaagatg

SEQ ID NO: 40062 - DNA, 103 bp, Artificial Sequence
  Synthetic Polynucleotide
taatacgactcactatagggacggagttcgccacgttatcgctccgggccaacagaggagaggcccgatgcgataacgtaacctggcggcagcgcaaaagatg

SEQ ID NO: 40063 - DNA, 103 bp, Artificial Sequence
  Synthetic Polynucleotide
taatacgactcactataggggatgcattactcgtcgctacacagtgctgtaacagaggagaacagcaatgtgtagcgacaacctggcggcagcgcaaaagatg

SEQ ID NO: 40064 - DNA, 103 bp, Artificial Sequence
  Synthetic Polynucleotide
taatacgactcactatagggttaccagtagcaccccggcggaggctgctgaacagaggagacagcagatgccgccggggaacctggcggcagcgcaaaagatg

SEQ ID NO: 40065 - DNA, 103 bp, Artificial Sequence
  Synthetic Polynucleotide
taatacgactcactatagggagaatgggcaagatttagtgtaagcataccaacagaggagaggtatgatgacactaaataacctggcggcagcgcaaaagatg

SEQ ID NO: 40066 - DNA, 103 bp, Artificial Sequence
  Synthetic Polynucleotide
taatacgactcactatagggatgcaaacacatctcatgtaactgtgtggtaacagaggagaaccacaatgttacatgagaacctggcggcagcgcaaaagatg

SEQ ID NO: 40067 - DNA, 103 bp, Artificial Sequence
  Synthetic Polynucleotide
taatacgactcactatagggcgccatgcgcaaaccacaagaaagtagaggaacagaggagacctctaatgtcttgtggtaacctggcggcagcgcaaaagatg

SEQ ID NO: 40068 - DNA, 103 bp, Artificial Sequence
  Synthetic Polynucleotide
taatacgactcactatagggggaccatgacggccttaaccgcgtgtttttaacagaggagaaaaaacatgcggttaaggaacctggcggcagcgcaaaagatg

SEQ ID NO: 40069 - DNA, 103 bp, Artificial Sequence
  Synthetic Polynucleotide
taatacgactcactatagggtagtagtgtaggttggcttatactcataggaacagaggagacctatgatgataagccaaaacctggcggcagcgcaaaagatg

SEQ ID NO: 40070 - DNA, 103 bp, Artificial Sequence
  Synthetic Polynucleotide
taatacgactcactatagggccgattaaacaggccgcagctaaacatggaaacagaggagatccatgatgagctgcggcaacctggcggcagcgcaaaagatg

SEQ ID NO: 40071 - DNA, 103 bp, Artificial Sequence
  Synthetic Polynucleotide
taatacgactcactatagggtcggagaaagtggctgtcagacgttgacgaaacagaggagatcgtcaatgtctgacagcaacctggcggcagcgcaaaagatg

SEQ ID NO: 40072 - DNA, 103 bp, Artificial Sequence
  Synthetic Polynucleotide
taatacgactcactatagggggtgcggattttatttatccttgcgtcgtcaacagaggagagacgacatgaggataaataacctggcggcagcgcaaaagatg

SEQ ID NO: 40073 - DNA, 103 bp, Artificial Sequence
  Synthetic Polynucleotide
taatacgactcactatagggaactcacagagattgttagcgctctagtttaacagaggagaaaactaatgcgctaacaaaacctggcggcagcgcaaaagatg

SEQ ID NO: 40074 - DNA, 103 bp, Artificial Sequence
  Synthetic Polynucleotide
taatacgactcactatagggttctacatgttacctccactagtgatattgaacagaggagacaatatatgtagtggaggaacctggcggcagcgcaaaagatg

SEQ ID NO: 40075 - DNA, 103 bp, Artificial Sequence
  Synthetic Polynucleotide
taatacgactcactatagggcggacctagttattttattcgaaacctcggaacagaggagaccgaggatgcgaataaaaaacctggcggcagcgcaaaagatg

SEQ ID NO: 40076 - DNA, 103 bp, Artificial Sequence
  Synthetic Polynucleotide
taatacgactcactatagggaatgcgagtgcctcggagggggtcaagttgaacagaggagacaacttatgcccctccgaaacctggcggcagcgcaaaagatg

SEQ ID NO: 40077 - DNA, 103 bp, Artificial Sequence
  Synthetic Polynucleotide
taatacgactcactataggggacagccacggataaccgcatttgggcaacaacagaggagagttgccatgatgcggttaaacctggcggcagcgcaaaagatg

SEQ ID NO: 40078 - DNA, 103 bp, Artificial Sequence
  Synthetic Polynucleotide
taatacgactcactatagggtagttgatagcaacgcgcgagtagaccgaaaacagaggagattcggtatgctcgcgcgtaacctggcggcagcgcaaaagatg

SEQ ID NO: 40079 - DNA, 103 bp, Artificial Sequence
  Synthetic Polynucleotide
taatacgactcactatagggggatctgctgcgcaaggaagctaaggatccaacagaggagaggatccatggcttccttgaacctggcggcagcgcaaaagatg

SEQ ID NO: 40080 - DNA, 103 bp, Artificial Sequence
  Synthetic Polynucleotide
taatacgactcactatagggatgtttcacgtccacttcatcgggatatccaacagaggagaggatatatggatgaagtgaacctggcggcagcgcaaaagatg

SEQ ID NO: 40081 - DNA, 103 bp, Artificial Sequence
  Synthetic Polynucleotide
taatacgactcactataggggggtttatcacctcgactattaacggcaaaaacagaggagatttgccatgaatagtcgaaacctggcggcagcgcaaaagatg

SEQ ID NO: 40082 - DNA, 103 bp, Artificial Sequence
  Synthetic Polynucleotide
taatacgactcactatagggcaacttgctcactaagatttgctaggtcgaaacagaggagatcgaccatgcaaatcttaaacctggcggcagcgcaaaagatg

SEQ ID NO: 40083 - DNA, 103 bp, Artificial Sequence
  Synthetic Polynucleotide
taatacgactcactataggggttctgagctaccgctcctctcgccgatcaaacagaggagatgatcgatgagaggagcgaacctggcggcagcgcaaaagatg

SEQ ID NO: 40084 - DNA, 103 bp, Artificial Sequence
  Synthetic Polynucleotide
taatacgactcactatagggctacaagtgggaatcgtcagtagtgaaggtaacagaggagaaccttcatgactgacgataacctggcggcagcgcaaaagatg

SEQ ID NO: 40085 - DNA, 103 bp, Artificial Sequence
  Synthetic Polynucleotide
taatacgactcactataggggttccgtagataccagcgggtcagggaggcaacagaggagagcctccatgacccgctggaacctggcggcagcgcaaaagatg

SEQ ID NO: 40086 - DNA, 103 bp, Artificial Sequence
  Synthetic Polynucleotide
taatacgactcactatagggcggggtcccgcctgctatctaaagagagtgaacagaggagacactctatgtagatagcaaacctggcggcagcgcaaaagatg

SEQ ID NO: 40087 - DNA, 103 bp, Artificial Sequence
  Synthetic Polynucleotide
taatacgactcactatagggatagcggagctcgcgttgaacaactgtgacaacagaggagagtcacaatggttcaacgcaacctggcggcagcgcaaaagatg

SEQ ID NO: 40088 - DNA, 103 bp, Artificial Sequence
  Synthetic Polynucleotide
taatacgactcactatagggctagattatggtatcccttcaagactcgataacagaggagaatcgagatgtgaagggataacctggcggcagcgcaaaagatg

SEQ ID NO: 40089 - DNA, 103 bp, Artificial Sequence
  Synthetic Polynucleotide
taatacgactcactataggggtccgcagttcgtaagttagcaagcccctaaacagaggagataggggatggctaacttaaacctggcggcagcgcaaaagatg

SEQ ID NO: 40090 - DNA, 103 bp, Artificial Sequence
  Synthetic Polynucleotide
taatacgactcactatagggagcgagagatcaattgatatggagtaccccaacagaggagaggggtaatgcatatcaataacctggcggcagcgcaaaagatg

SEQ ID NO: 40091 - DNA, 103 bp, Artificial Sequence
  Synthetic Polynucleotide
taatacgactcactatagggggagacctccgtagcggaccaccagggggtaacagaggagaacccccatgtggtccgctaacctggcggcagcgcaaaagatg

SEQ ID NO: 40092 - DNA, 103 bp, Artificial Sequence
  Synthetic Polynucleotide
taatacgactcactataggggtacataagagctgagcccggtcgcaacacaacagaggagagtgttgatgccgggctcaaacctggcggcagcgcaaaagatg

SEQ ID NO: 40093 - DNA, 103 bp, Artificial Sequence
  Synthetic Polynucleotide
taatacgactcactatagggatgctgttcgaatccggccgtcgtacatttaacagaggagaaaatgtatgacggccggaaacctggcggcagcgcaaaagatg

SEQ ID NO: 40094 - DNA, 103 bp, Artificial Sequence
  Synthetic Polynucleotide
taatacgactcactatagggcatgtacgtctctggcgggcgctacgagggaacagaggagaccctcgatgcgcccgccaaacctggcggcagcgcaaaagatg

SEQ ID NO: 40095 - DNA, 103 bp, Artificial Sequence
  Synthetic Polynucleotide
taatacgactcactataggggttcttagaatgacacctgcggcacgccataacagaggagaatggcgatgcgcaggtgtaacctggcggcagcgcaaaagatg

SEQ ID NO: 40096 - DNA, 103 bp, Artificial Sequence
  Synthetic Polynucleotide
taatacgactcactatagggatcagtctcgaagctgagccatgattatgtaacagaggagaacataaatgtggctcagcaacctggcggcagcgcaaaagatg

SEQ ID NO: 40097 - DNA, 103 bp, Artificial Sequence
  Synthetic Polynucleotide
taatacgactcactatagggactgctaggcgccgagccctatggttggttaacagaggagaaaccaaatgtagggctcgaacctggcggcagcgcaaaagatg

SEQ ID NO: 40098 - DNA, 103 bp, Artificial Sequence
  Synthetic Polynucleotide
taatacgactcactatagggcgaatactgaacgactagaaccaactgtgaaacagaggagatcacagatggttctagtcaacctggcggcagcgcaaaagatg

SEQ ID NO: 40099 - DNA, 103 bp, Artificial Sequence
  Synthetic Polynucleotide
taatacgactcactatagggaagccagagtctgatgatgcctgccaggctaacagaggagaagcctgatgggcatcatcaacctggcggcagcgcaaaagatg

SEQ ID NO: 40100 - DNA, 103 bp, Artificial Sequence
  Synthetic Polynucleotide
taatacgactcactatagggttctaagttgttgtttttgctacggttcggaacagaggagaccgaacatgagcaaaaacaacctggcggcagcgcaaaagatg

SEQ ID NO: 40101 - DNA, 103 bp, Artificial Sequence
  Synthetic Polynucleotide
taatacgactcactatagggccgcacaagccctgtaattaacctttaaaaaacagaggagattttaaatgttaattacaaacctggcggcagcgcaaaagatg

SEQ ID NO: 40102 - DNA, 103 bp, Artificial Sequence
  Synthetic Polynucleotide
taatacgactcactatagggggccgaagtgaccgcattatattcactcgcaacagaggagagcgagtatgtataatgcgaacctggcggcagcgcaaaagatg

SEQ ID NO: 40103 - DNA, 103 bp, Artificial Sequence
  Synthetic Polynucleotide
taatacgactcactatagggcccacgtctatagtctttgagggggccgttaacagaggagaaacggcatgctcaaagacaacctggcggcagcgcaaaagatg

SEQ ID NO: 40104 - DNA, 103 bp, Artificial Sequence
  Synthetic Polynucleotide
taatacgactcactatagggcctcccccttgataagcctgacctcagtccaacagaggagaggactgatgtcaggcttaaacctggcggcagcgcaaaagatg

SEQ ID NO: 40105 - DNA, 103 bp, Artificial Sequence
  Synthetic Polynucleotide
taatacgactcactatagggaatgcagcgggcagaagaggttacgtccgcaacagaggagagcggacatgacctcttctaacctggcggcagcgcaaaagatg

SEQ ID NO: 40106 - DNA, 103 bp, Artificial Sequence
  Synthetic Polynucleotide
taatacgactcactatagggactgataaacacaatactattgtcttgtgcaacagaggagagcacaaatgaatagtattaacctggcggcagcgcaaaagatg

SEQ ID NO: 40107 - DNA, 103 bp, Artificial Sequence
  Synthetic Polynucleotide
taatacgactcactatagggaactgtacgcatatgaagtctctacctgggaacagaggagacccaggatgagacttcataacctggcggcagcgcaaaagatg

SEQ ID NO: 40108 - DNA, 103 bp, Artificial Sequence
  Synthetic Polynucleotide
taatacgactcactataggggcaaccggccaagtctacctcaattcaccaaacagaggagatggtgaatggaggtagacaacctggcggcagcgcaaaagatg

SEQ ID NO: 40109 - DNA, 103 bp, Artificial Sequence
  Synthetic Polynucleotide
taatacgactcactatagggtaacccaacgtttcgacattccactgcgggaacagaggagacccgcaatggaatgtcgaaacctggcggcagcgcaaaagatg

SEQ ID NO: 40110 - DNA, 103 bp, Artificial Sequence
  Synthetic Polynucleotide
taatacgactcactatagggcaaggggtcctgattatgggcgaacctatgaacagaggagacataggatggcccataataacctggcggcagcgcaaaagatg

SEQ ID NO: 40111 - DNA, 103 bp, Artificial Sequence
  Synthetic Polynucleotide
taatacgactcactataggggtgtgacgaattcgaggacgtaatcaggataacagaggagaatcctgatgacgtcctcgaacctggcggcagcgcaaaagatg

SEQ ID NO: 40112 - DNA, 103 bp, Artificial Sequence
  Synthetic Polynucleotide
taatacgactcactatagggtggcaaccactcccgtcactgaccgaccgcaacagaggagagcggtcatgcagtgacggaacctggcggcagcgcaaaagatg

SEQ ID NO: 40113 - DNA, 103 bp, Artificial Sequence
  Synthetic Polynucleotide
taatacgactcactatagggcacgccatgcagacggatggcgtagttagaaacagaggagatctaacatggccatccgtaacctggcggcagcgcaaaagatg

SEQ ID NO: 40114 - DNA, 103 bp, Artificial Sequence
  Synthetic Polynucleotide
taatacgactcactatagggtcgtgacgtcgtggactttaaataagcgccaacagaggagaggcgctatgttaaagtccaacctggcggcagcgcaaaagatg

SEQ ID NO: 40115 - DNA, 103 bp, Artificial Sequence
  Synthetic Polynucleotide
taatacgactcactatagggtcatcgcaaaagtgtccggcagtctaacctaacagaggagaaggttaatgtgccggacaaacctggcggcagcgcaaaagatg

SEQ ID NO: 40116 - DNA, 103 bp, Artificial Sequence
  Synthetic Polynucleotide
taatacgactcactatagggcaacctatgcgtacatgcgctataagcgagaacagaggagactcgctatgagcgcatgtaacctggcggcagcgcaaaagatg

SEQ ID NO: 40117 - DNA, 103 bp, Artificial Sequence
  Synthetic Polynucleotide
taatacgactcactatagggtgtacacgactcggttgttgcccacgctcgaacagaggagacgagcgatggcaacaaccaacctggcggcagcgcaaaagatg

SEQ ID NO: 40118 - DNA, 103 bp, Artificial Sequence
  Synthetic Polynucleotide
taatacgactcactatagggtattcatcaaaaaacactagtgtctctctgaacagaggagacagagaatgactagtgttaacctggcggcagcgcaaaagatg

SEQ ID NO: 40119 - DNA, 103 bp, Artificial Sequence
  Synthetic Polynucleotide
taatacgactcactatagggtcctctactctcctccagtccaccggggctaacagaggagaagccccatgggactggagaacctggcggcagcgcaaaagatg

SEQ ID NO: 40120 - DNA, 103 bp, Artificial Sequence
  Synthetic Polynucleotide
taatacgactcactataggggccccgacagtcctaactagtaccctatacaacagaggagagtatagatgactagttagaacctggcggcagcgcaaaagatg

SEQ ID NO: 40121 - DNA, 103 bp, Artificial Sequence
  Synthetic Polynucleotide
taatacgactcactatagggcataggtactgtttgtcgagataagtgaataacagaggagaattcacatgtctcgacaaaacctggcggcagcgcaaaagatg

SEQ ID NO: 40122 - DNA, 103 bp, Artificial Sequence
  Synthetic Polynucleotide
taatacgactcactatagggagtaaaaatattcggtggcgtcagtccactaacagaggagaagtggaatgacgccaccgaacctggcggcagcgcaaaagatg

SEQ ID NO: 40123 - DNA, 103 bp, Artificial Sequence
  Synthetic Polynucleotide
taatacgactcactatagggaggagacactggaaccgacgttaatatccgaacagaggagacggataatgacgtcggttaacctggcggcagcgcaaaagatg

SEQ ID NO: 40124 - DNA, 103 bp, Artificial Sequence
  Synthetic Polynucleotide
taatacgactcactatagggggaacttaacaggaagccgtgtgctgccttaacagaggagaaaggcaatgcacggcttcaacctggcggcagcgcaaaagatg

SEQ ID NO: 40125 - DNA, 103 bp, Artificial Sequence
  Synthetic Polynucleotide
taatacgactcactataggggtccgtccattgaggaattgatgcgggcgaaacagaggagatcgcccatgtcaattcctaacctggcggcagcgcaaaagatg

SEQ ID NO: 40126 - DNA, 103 bp, Artificial Sequence
  Synthetic Polynucleotide
taatacgactcactatagggcgatcagctatatgcccaaaactggacgtcaacagaggagagacgtcatgttttgggcaaacctggcggcagcgcaaaagatg

SEQ ID NO: 40127 - DNA, 103 bp, Artificial Sequence
  Synthetic Polynucleotide
taatacgactcactatagggtatatttctgtcgtgtcccctgtgcgatcgaacagaggagacgatcgatgaggggacacaacctggcggcagcgcaaaagatg

SEQ ID NO: 40128 - DNA, 103 bp, Artificial Sequence
  Synthetic Polynucleotide
taatacgactcactatagggcccagtagggaagggagaggttgaatacccaacagaggagagggtatatgacctctcccaacctggcggcagcgcaaaagatg

SEQ ID NO: 40129 - DNA, 103 bp, Artificial Sequence
  Synthetic Polynucleotide
taatacgactcactataggggataaacctgaatctataaaggtctgggttaacagaggagaaacccaatgctttatagaaacctggcggcagcgcaaaagatg

SEQ ID NO: 40130 - DNA, 103 bp, Artificial Sequence
  Synthetic Polynucleotide
taatacgactcactataggggacatgcagatcgacttgtccgaactgcggaacagaggagaccgcagatgggacaagtcaacctggcggcagcgcaaaagatg

SEQ ID NO: 40131 - DNA, 103 bp, Artificial Sequence
  Synthetic Polynucleotide
taatacgactcactatagggtgccgaatttttcatcccatcgactctttgaacagaggagacaaagaatggatgggatgaacctggcggcagcgcaaaagatg

SEQ ID NO: 40132 - DNA, 103 bp, Artificial Sequence
  Synthetic Polynucleotide
taatacgactcactatagggtgagggtcatttgccctagagatttccgacaacagaggagagtcggaatgctctagggcaacctggcggcagcgcaaaagatg

SEQ ID NO: 40133 - DNA, 103 bp, Artificial Sequence
  Synthetic Polynucleotide
taatacgactcactatagggtgaagttgggtgcgtacgattataggttgtaacagaggagaacaaccatgaatcgtacgaacctggcggcagcgcaaaagatg

SEQ ID NO: 40134 - DNA, 103 bp, Artificial Sequence
  Synthetic Polynucleotide
taatacgactcactatagggcataggaaacaaggccttacttcattacgtaacagaggagaacgtaaatgagtaaggccaacctggcggcagcgcaaaagatg

SEQ ID NO: 40135 - DNA, 103 bp, Artificial Sequence
  Synthetic Polynucleotide
taatacgactcactatagggcagtctgagatggatattccctcttgacgtaacagaggagaacgtcaatggggaatatcaacctggcggcagcgcaaaagatg

SEQ ID NO: 40136 - DNA, 103 bp, Artificial Sequence
  Synthetic Polynucleotide
taatacgactcactataggggcctatgtctaaggcccccctaacctgtggaacagaggagaccacagatgaggggggccaacctggcggcagcgcaaaagatg

SEQ ID NO: 40137 - DNA, 103 bp, Artificial Sequence
  Synthetic Polynucleotide
taatacgactcactatagggtacctccaaaattaatttagcatcgtcagcaacagaggagagctgacatggctaaattaaacctggcggcagcgcaaaagatg

SEQ ID NO: 40138 - DNA, 103 bp, Artificial Sequence
  Synthetic Polynucleotide
taatacgactcactatagggacccttcacgggaggtctccttccgacagtaacagaggagaactgtcatgaggagacctaacctggcggcagcgcaaaagatg

SEQ ID NO: 40139 - DNA, 103 bp, Artificial Sequence
  Synthetic Polynucleotide
taatacgactcactataggggggaccaacattacaatgcattctaaagggaacagaggagaccctttatgatgcattgtaacctggcggcagcgcaaaagatg

SEQ ID NO: 40140 - DNA, 103 bp, Artificial Sequence
  Synthetic Polynucleotide
taatacgactcactatagggagtactaagtactacttattgctcctgcgtaacagaggagaacgcagatgcaataagtaaacctggcggcagcgcaaaagatg

SEQ ID NO: 40141 - DNA, 103 bp, Artificial Sequence
  Synthetic Polynucleotide
taatacgactcactatagggctaacacacgaacctgatgataatttatggaacagaggagaccataaatgatcatcaggaacctggcggcagcgcaaaagatg

SEQ ID NO: 40142 - DNA, 103 bp, Artificial Sequence
  Synthetic Polynucleotide
taatacgactcactatagggattgtcagtgaccctggattcgaataccggaacagaggagaccggtaatggaatccaggaacctggcggcagcgcaaaagatg

SEQ ID NO: 40143 - DNA, 103 bp, Artificial Sequence
  Synthetic Polynucleotide
taatacgactcactatagggctcgctgcacgtcggccgcccatgtccactaacagaggagaagtggaatggggcggccgaacctggcggcagcgcaaaagatg

SEQ ID NO: 40144 - DNA, 103 bp, Artificial Sequence
  Synthetic Polynucleotide
taatacgactcactatagggacggaggcatcagcacagataaattgtatgaacagaggagacatacaatgtatctgtgcaacctggcggcagcgcaaaagatg

SEQ ID NO: 40145 - DNA, 103 bp, Artificial Sequence
  Synthetic Polynucleotide
taatacgactcactatagggggtaccctcggaaaccaggcgagacgctgaaacagaggagatcagcgatgcgcctggttaacctggcggcagcgcaaaagatg

SEQ ID NO: 40146 - DNA, 103 bp, Artificial Sequence
  Synthetic Polynucleotide
taatacgactcactatagggtaaacagttttaggggaacgtgaataggaaaacagaggagattcctaatgacgttccccaacctggcggcagcgcaaaagatg

SEQ ID NO: 40147 - DNA, 103 bp, Artificial Sequence
  Synthetic Polynucleotide
taatacgactcactatagggttctactaacgtctactccggttagtcgctaacagaggagaagcgacatgccggagtagaacctggcggcagcgcaaaagatg

SEQ ID NO: 40148 - DNA, 103 bp, Artificial Sequence
  Synthetic Polynucleotide
taatacgactcactatagggttccataggtagataggacccgggcataacaacagaggagagttatgatggggtcctataacctggcggcagcgcaaaagatg

SEQ ID NO: 40149 - DNA, 103 bp, Artificial Sequence
  Synthetic Polynucleotide
taatacgactcactatagggccatcggtgcgctcgttggaaaattacgcaaacagaggagatgcgtaatgttccaacgaaacctggcggcagcgcaaaagatg

SEQ ID NO: 40150 - DNA, 103 bp, Artificial Sequence
  Synthetic Polynucleotide
taatacgactcactatagggcgggagtctgcaccgagactgtgtatgcaaaacagaggagattgcatatgcagtctcggaacctggcggcagcgcaaaagatg

SEQ ID NO: 40151 - DNA, 103 bp, Artificial Sequence
  Synthetic Polynucleotide
taatacgactcactatagggccgtttaaagcggctaagaatagcccaattaacagaggagaaattggatgattcttagcaacctggcggcagcgcaaaagatg

SEQ ID NO: 40152 - DNA, 103 bp, Artificial Sequence
  Synthetic Polynucleotide
taatacgactcactatagggaaacatactgagtattactccaaggccaccaacagaggagaggtggcatgggagtaataaacctggcggcagcgcaaaagatg

SEQ ID NO: 40153 - DNA, 103 bp, Artificial Sequence
  Synthetic Polynucleotide
taatacgactcactatagggactgcttgaatgacaagcgaataaccccccaacagaggagaggggggatgttcgcttgtaacctggcggcagcgcaaaagatg

SEQ ID NO: 40154 - DNA, 103 bp, Artificial Sequence
  Synthetic Polynucleotide
taatacgactcactatagggctctgtactgcaaatatcccttaccgactaaacagaggagatagtcgatgagggatattaacctggcggcagcgcaaaagatg

SEQ ID NO: 40155 - DNA, 103 bp, Artificial Sequence
  Synthetic Polynucleotide
taatacgactcactatagggaatagcaagactttagagtctttgcgtttaaacagaggagataaacgatgagactctaaaacctggcggcagcgcaaaagatg

SEQ ID NO: 40156 - DNA, 103 bp, Artificial Sequence
  Synthetic Polynucleotide
taatacgactcactataggggctccggaatgtgaatgaatctgctctgaaaacagaggagattcagaatggattcattcaacctggcggcagcgcaaaagatg

SEQ ID NO: 40157 - DNA, 103 bp, Artificial Sequence
  Synthetic Polynucleotide
taatacgactcactataggggtcccatctctaccatgcgttttgatcggaaacagaggagatccgatatgaacgcatggaacctggcggcagcgcaaaagatg

SEQ ID NO: 40158 - DNA, 103 bp, Artificial Sequence
  Synthetic Polynucleotide
taatacgactcactatagggtcgtatgccttcatggcaccgattaactgtaacagaggagaacagttatgcggtgccataacctggcggcagcgcaaaagatg

SEQ ID NO: 40159 - DNA, 103 bp, Artificial Sequence
  Synthetic Polynucleotide
taatacgactcactatagggccactgaaacgtctctagtcttaaaacaacaacagaggagagttgttatgagactagagaacctggcggcagcgcaaaagatg

SEQ ID NO: 40160 - DNA, 103 bp, Artificial Sequence
  Synthetic Polynucleotide
taatacgactcactatagggcgtaaggagccgggcaaacaaccagcctgaaacagaggagatcaggcatgttgtttgccaacctggcggcagcgcaaaagatg

SEQ ID NO: 40161 - DNA, 103 bp, Artificial Sequence
  Synthetic Polynucleotide
taatacgactcactatagggcggagtgaccaactgggagcatttcggttaaacagaggagataaccgatgtgctcccagaacctggcggcagcgcaaaagatg

SEQ ID NO: 40162 - DNA, 103 bp, Artificial Sequence
  Synthetic Polynucleotide
taatacgactcactatagggcagccatgtggttacaggtattgcagtccaaacagaggagatggactatgatacctgtaaacctggcggcagcgcaaaagatg

SEQ ID NO: 40163 - DNA, 103 bp, Artificial Sequence
  Synthetic Polynucleotide
taatacgactcactataggggtctcgggagaaccggtgtcctctactcccaacagaggagagggagtatgggacaccggaacctggcggcagcgcaaaagatg

SEQ ID NO: 40164 - DNA, 103 bp, Artificial Sequence
  Synthetic Polynucleotide
taatacgactcactatagggtgccaacgagtggtagttttggcgttcaataacagaggagaattgaaatgcaaaactacaacctggcggcagcgcaaaagatg

SEQ ID NO: 40165 - DNA, 103 bp, Artificial Sequence
  Synthetic Polynucleotide
taatacgactcactatagggggctgtatctaaatgccatcctgcagcaagaacagaggagacttgctatgggatggcataacctggcggcagcgcaaaagatg

SEQ ID NO: 40166 - DNA, 103 bp, Artificial Sequence
  Synthetic Polynucleotide
taatacgactcactatagggggcgcgtaacgcctactgcgtgccctgcccaacagaggagagggcagatgacgcagtagaacctggcggcagcgcaaaagatg

SEQ ID NO: 40167 - DNA, 103 bp, Artificial Sequence
  Synthetic Polynucleotide
taatacgactcactatagggggccctattacccagaaattggccgctctaaacagaggagatagagcatgcaatttctgaacctggcggcagcgcaaaagatg

SEQ ID NO: 40168 - DNA, 103 bp, Artificial Sequence
  Synthetic Polynucleotide
taatacgactcactatagggtacccctaagtgccctcccttccagttcgcaacagaggagagcgaacatgaagggagggaacctggcggcagcgcaaaagatg

SEQ ID NO: 40169 - DNA, 103 bp, Artificial Sequence
  Synthetic Polynucleotide
taatacgactcactatagggggaggacatcaacagggtagctggcttggcaacagaggagagccaagatggctaccctgaacctggcggcagcgcaaaagatg

SEQ ID NO: 40170 - DNA, 103 bp, Artificial Sequence
  Synthetic Polynucleotide
taatacgactcactatagggtcaatcagagcaggtcccctcagccgccgtaacagaggagaacggcgatggaggggaccaacctggcggcagcgcaaaagatg

SEQ ID NO: 40171 - DNA, 103 bp, Artificial Sequence
  Synthetic Polynucleotide
taatacgactcactataggggtgcgcacaaatttgcataggggagctaccaacagaggagaggtagcatgcctatgcaaaacctggcggcagcgcaaaagatg

SEQ ID NO: 40172 - DNA, 103 bp, Artificial Sequence
  Synthetic Polynucleotide
taatacgactcactatagggtcttccagttggattcgacagtggctccgcaacagaggagagcggagatgctgtcgaataacctggcggcagcgcaaaagatg

SEQ ID NO: 40173 - DNA, 103 bp, Artificial Sequence
  Synthetic Polynucleotide
taatacgactcactatagggctgtggtcagtcacgcttcaagaaaggtttaacagaggagaaaacctatgttgaagcgtaacctggcggcagcgcaaaagatg

SEQ ID NO: 40174 - DNA, 103 bp, Artificial Sequence
  Synthetic Polynucleotide
taatacgactcactataggggacgccgccgcatgctgaaatcctctactcaacagaggagagagtagatgatttcagcaaacctggcggcagcgcaaaagatg

SEQ ID NO: 40175 - DNA, 103 bp, Artificial Sequence
  Synthetic Polynucleotide
taatacgactcactatagggccgacaaacgctggcgttgccgtggagcctaacagaggagaaggctcatgggcaacgccaacctggcggcagcgcaaaagatg

SEQ ID NO: 40176 - DNA, 103 bp, Artificial Sequence
  Synthetic Polynucleotide
taatacgactcactatagggtgaccaccttgcggtgctatgccccgctgcaacagaggagagcagcgatgcatagcaccaacctggcggcagcgcaaaagatg

SEQ ID NO: 40177 - DNA, 103 bp, Artificial Sequence
  Synthetic Polynucleotide
taatacgactcactatagggtaggcaccaataggaatgatgaattgcgccaacagaggagaggcgcaatgcatcattccaacctggcggcagcgcaaaagatg

SEQ ID NO: 40178 - DNA, 103 bp, Artificial Sequence
  Synthetic Polynucleotide
taatacgactcactataggggccgtacacatttgtgttctaacgcccccgaacagaggagacgggggatgtagaacacaaacctggcggcagcgcaaaagatg

SEQ ID NO: 40179 - DNA, 103 bp, Artificial Sequence
  Synthetic Polynucleotide
taatacgactcactataggggcttcgggtgaatagagatcattatgttggaacagaggagaccaacaatgtgatctctaaacctggcggcagcgcaaaagatg

SEQ ID NO: 40180 - DNA, 103 bp, Artificial Sequence
  Synthetic Polynucleotide
taatacgactcactatagggctgggcccatgtctgccggtcacagatttaaacagaggagataaatcatggaccggcagaacctggcggcagcgcaaaagatg

SEQ ID NO: 40181 - DNA, 103 bp, Artificial Sequence
  Synthetic Polynucleotide
taatacgactcactatagggctacagcggtaacccgcgaggagagtgagtaacagaggagaactcacatgcctcgcgggaacctggcggcagcgcaaaagatg

SEQ ID NO: 40182 - DNA, 103 bp, Artificial Sequence
  Synthetic Polynucleotide
taatacgactcactataggggtacggataaggcctcatacttaacataccaacagaggagaggtatgatgagtatgaggaacctggcggcagcgcaaaagatg

SEQ ID NO: 40183 - DNA, 103 bp, Artificial Sequence
  Synthetic Polynucleotide
taatacgactcactataggggccgtgcatctagtataagatataattggtaacagaggagaaccaatatgatcttatacaacctggcggcagcgcaaaagatg

SEQ ID NO: 40184 - DNA, 103 bp, Artificial Sequence
  Synthetic Polynucleotide
taatacgactcactatagggtctaatttggtttgtgacagagcggtcaagaacagaggagacttgacatgtctgtcacaaacctggcggcagcgcaaaagatg

SEQ ID NO: 40185 - DNA, 103 bp, Artificial Sequence
  Synthetic Polynucleotide
taatacgactcactatagggtcggttcagtaacaggcgaaatcgcgaaggaacagaggagaccttcgatgtttcgcctgaacctggcggcagcgcaaaagatg

SEQ ID NO: 40186 - DNA, 103 bp, Artificial Sequence
  Synthetic Polynucleotide
taatacgactcactatagggcgctgattaaagatttcgtcgttgtatctaaacagaggagatagataatgcgacgaaataacctggcggcagcgcaaaagatg

SEQ ID NO: 40187 - DNA, 103 bp, Artificial Sequence
  Synthetic Polynucleotide
taatacgactcactataggggaatgccgtcggcccagaagtgccacgtttaacagaggagaaaacgtatgacttctgggaacctggcggcagcgcaaaagatg

SEQ ID NO: 40188 - DNA, 103 bp, Artificial Sequence
  Synthetic Polynucleotide
taatacgactcactatagggtatcagaggttcatatgtctaggctagagcaacagaggagagctctaatgtagacatataacctggcggcagcgcaaaagatg

SEQ ID NO: 40189 - DNA, 103 bp, Artificial Sequence
  Synthetic Polynucleotide
taatacgactcactatagggctatgacaatttcggtatttttacttcctaaacagaggagataggaaatgaaaataccgaacctggcggcagcgcaaaagatg

SEQ ID NO: 40190 - DNA, 103 bp, Artificial Sequence
  Synthetic Polynucleotide
taatacgactcactatagggcatctgtgtgcatatattgggatactattcaacagaggagagaatagatgcccaatataaacctggcggcagcgcaaaagatg

SEQ ID NO: 40191 - DNA, 103 bp, Artificial Sequence
  Synthetic Polynucleotide
taatacgactcactatagggccgatcagcaccagatcggtcgagaatcgtaacagaggagaacgattatggaccgatctaacctggcggcagcgcaaaagatg

SEQ ID NO: 40192 - DNA, 103 bp, Artificial Sequence
  Synthetic Polynucleotide
taatacgactcactataggggaggatgatccagcgaagaccttgaaaatcaacagaggagagattttatgggtcttcgcaacctggcggcagcgcaaaagatg

SEQ ID NO: 40193 - DNA, 103 bp, Artificial Sequence
  Synthetic Polynucleotide
taatacgactcactataggggcgcgattacataatgtgcaggcttgtgaaaacagaggagattcacaatgctgcacattaacctggcggcagcgcaaaagatg

SEQ ID NO: 40194 - DNA, 103 bp, Artificial Sequence
  Synthetic Polynucleotide
taatacgactcactatagggtgatagcgggtcgttcagcaacgcaggatgaacagaggagacatcctatgttgctgaacaacctggcggcagcgcaaaagatg

SEQ ID NO: 40195 - DNA, 103 bp, Artificial Sequence
  Synthetic Polynucleotide
taatacgactcactatagggctaatcaaaaacggggactccatggggtaaaacagaggagattacccatgggagtccccaacctggcggcagcgcaaaagatg

SEQ ID NO: 40196 - DNA, 103 bp, Artificial Sequence
  Synthetic Polynucleotide
taatacgactcactatagggagtttttagccgaaccccaagtccgcacttaacagaggagaaagtgcatgcttggggttaacctggcggcagcgcaaaagatg

SEQ ID NO: 40197 - DNA, 103 bp, Artificial Sequence
  Synthetic Polynucleotide
taatacgactcactatagggtcaacggttttgacgagccctcttgcaagcaacagaggagagcttgcatgagggctcgtaacctggcggcagcgcaaaagatg

SEQ ID NO: 40198 - DNA, 103 bp, Artificial Sequence
  Synthetic Polynucleotide
taatacgactcactatagggttcgctactcaggtagactagtaaccaccaaacagaggagatggtggatgctagtctacaacctggcggcagcgcaaaagatg

SEQ ID NO: 40199 - DNA, 103 bp, Artificial Sequence
  Synthetic Polynucleotide
taatacgactcactatagggagccgcccatgcagtgggtacgcctcatataacagaggagaatatgaatggtacccactaacctggcggcagcgcaaaagatg

SEQ ID NO: 40200 - DNA, 103 bp, Artificial Sequence
  Synthetic Polynucleotide
taatacgactcactatagggtataaaccgtaacctttagagagccagcccaacagaggagagggctgatgctctaaaggaacctggcggcagcgcaaaagatg

SEQ ID NO: 40201 - DNA, 103 bp, Artificial Sequence
  Synthetic Polynucleotide
taatacgactcactatagggtaaagacggggcccttgggcacgcaggacgaacagaggagacgtcctatgtgcccaaggaacctggcggcagcgcaaaagatg

SEQ ID NO: 40202 - DNA, 103 bp, Artificial Sequence
  Synthetic Polynucleotide
taatacgactcactatagggagtttccaccgtctcgcatacgagtgggctaacagaggagaagcccaatggtatgcgagaacctggcggcagcgcaaaagatg

SEQ ID NO: 40203 - DNA, 103 bp, Artificial Sequence
  Synthetic Polynucleotide
taatacgactcactatagggttgatcgggtggcagaggttagctcgaagtaacagaggagaacttcgatgtaacctctgaacctggcggcagcgcaaaagatg

SEQ ID NO: 40204 - DNA, 103 bp, Artificial Sequence
  Synthetic Polynucleotide
taatacgactcactataggggtggatcacccacagacacggcaggtgttgaacagaggagacaacacatgccgtgtctgaacctggcggcagcgcaaaagatg

SEQ ID NO: 40205 - DNA, 103 bp, Artificial Sequence
  Synthetic Polynucleotide
taatacgactcactatagggaaaccccccgttcttagtgtagaacacaagaacagaggagacttgtgatgtacactaagaacctggcggcagcgcaaaagatg

SEQ ID NO: 40206 - DNA, 103 bp, Artificial Sequence
  Synthetic Polynucleotide
taatacgactcactataggggccccaaagagagggcgtaggcaggaattgaacagaggagacaattcatgcctacgcccaacctggcggcagcgcaaaagatg

SEQ ID NO: 40207 - DNA, 103 bp, Artificial Sequence
  Synthetic Polynucleotide
taatacgactcactatagggataaagccgcaggtgggtgagaaaccttagaacagaggagactaaggatgctcacccacaacctggcggcagcgcaaaagatg

SEQ ID NO: 40208 - DNA, 103 bp, Artificial Sequence
  Synthetic Polynucleotide
taatacgactcactatagggcggcagactgtattgcggcgggagcggaaaaacagaggagatttccgatgccgccgcaaaacctggcggcagcgcaaaagatg

SEQ ID NO: 40209 - DNA, 103 bp, Artificial Sequence
  Synthetic Polynucleotide
taatacgactcactataggggttgtattctgggactgggcacacaggtgtaacagaggagaacacctatgtgcccagtcaacctggcggcagcgcaaaagatg

SEQ ID NO: 40210 - DNA, 103 bp, Artificial Sequence
  Synthetic Polynucleotide
taatacgactcactatagggatagtgactataagctaactgggatggttcaacagaggagagaaccaatgcagttagctaacctggcggcagcgcaaaagatg

SEQ ID NO: 40211 - DNA, 103 bp, Artificial Sequence
  Synthetic Polynucleotide
taatacgactcactatagggtttgcgatatgatgccgctaagccatttaaaacagaggagattaaatatgttagcggcaaacctggcggcagcgcaaaagatg

SEQ ID NO: 40212 - DNA, 103 bp, Artificial Sequence
  Synthetic Polynucleotide
taatacgactcactatagggagtcgccaatacgagtaactgtgtttggtgaacagaggagacaccaaatgcagttactcaacctggcggcagcgcaaaagatg

SEQ ID NO: 40213 - DNA, 103 bp, Artificial Sequence
  Synthetic Polynucleotide
taatacgactcactataggggatccctagagctgaaccccataggaaagcaacagaggagagctttcatgtggggttcaaacctggcggcagcgcaaaagatg

SEQ ID NO: 40214 - DNA, 103 bp, Artificial Sequence
  Synthetic Polynucleotide
taatacgactcactatagggtggtgtgcaagcaagacttatagagtcgcgaacagaggagacgcgacatgataagtcttaacctggcggcagcgcaaaagatg

SEQ ID NO: 40215 - DNA, 103 bp, Artificial Sequence
  Synthetic Polynucleotide
taatacgactcactatagggcacgagaggtttaggacaagtgtagttcagaacagaggagactgaacatgacttgtcctaacctggcggcagcgcaaaagatg

SEQ ID NO: 40216 - DNA, 103 bp, Artificial Sequence
  Synthetic Polynucleotide
taatacgactcactatagggaacgagggccggggtctgaggtagggcgggaacagaggagacccgccatgcctcagaccaacctggcggcagcgcaaaagatg

SEQ ID NO: 40217 - DNA, 103 bp, Artificial Sequence
  Synthetic Polynucleotide
taatacgactcactataggggcatatcctcgtcacatggcaccgtataccaacagaggagaggtataatgtgccatgtgaacctggcggcagcgcaaaagatg

SEQ ID NO: 40218 - DNA, 103 bp, Artificial Sequence
  Synthetic Polynucleotide
taatacgactcactatagggttcatatcgacccaaacgctttcgagagctaacagaggagaagctctatgaagcgtttgaacctggcggcagcgcaaaagatg

SEQ ID NO: 40219 - DNA, 103 bp, Artificial Sequence
  Synthetic Polynucleotide
taatacgactcactatagggaaaaaatgtctatgtcagtgcggggatgcgaacagaggagacgcatcatggcactgacaaacctggcggcagcgcaaaagatg

SEQ ID NO: 40220 - DNA, 103 bp, Artificial Sequence
  Synthetic Polynucleotide
taatacgactcactatagggcctatcgcacctcgcgatgagcgggaaactaacagaggagaagtttcatgctcatcgcgaacctggcggcagcgcaaaagatg

SEQ ID NO: 40221 - DNA, 103 bp, Artificial Sequence
  Synthetic Polynucleotide
taatacgactcactatagggtatcatacggtaattcctcagaagttctcgaacagaggagacgagaaatgctgaggaataacctggcggcagcgcaaaagatg

SEQ ID NO: 40222 - DNA, 103 bp, Artificial Sequence
  Synthetic Polynucleotide
taatacgactcactatagggagcgtagtagtccatacaggtgcctttgtaaacagaggagatacaaaatgacctgtatgaacctggcggcagcgcaaaagatg

SEQ ID NO: 40223 - DNA, 103 bp, Artificial Sequence
  Synthetic Polynucleotide
taatacgactcactatagggggtatatagccagtgatcacccggacgaagaacagaggagacttcgtatgggtgatcacaacctggcggcagcgcaaaagatg

SEQ ID NO: 40224 - DNA, 103 bp, Artificial Sequence
  Synthetic Polynucleotide
taatacgactcactatagggacctatcgtcggaacctttgcaatgccgaaaacagaggagattcggcatggcaaaggttaacctggcggcagcgcaaaagatg

SEQ ID NO: 40225 - DNA, 103 bp, Artificial Sequence
  Synthetic Polynucleotide
taatacgactcactataggggaataatgaatagtgtatgggtttacgcctaacagaggagaaggcgtatgcccatacacaacctggcggcagcgcaaaagatg

SEQ ID NO: 40226 - DNA, 103 bp, Artificial Sequence
  Synthetic Polynucleotide
taatacgactcactatagggtctgtcgatctctgatatagaagcacgggcaacagaggagagcccgtatgtctatatcaaacctggcggcagcgcaaaagatg

SEQ ID NO: 40227 - DNA, 103 bp, Artificial Sequence
  Synthetic Polynucleotide
taatacgactcactatagggtcctgtcggccccacgaggcccttacccgaaacagaggagatcgggtatgggcctcgtgaacctggcggcagcgcaaaagatg

SEQ ID NO: 40228 - DNA, 103 bp, Artificial Sequence
  Synthetic Polynucleotide
taatacgactcactataggggggggtgttaatatctaaaatggctgagggaacagaggagaccctcaatgattttagataacctggcggcagcgcaaaagatg

SEQ ID NO: 40229 - DNA, 103 bp, Artificial Sequence
  Synthetic Polynucleotide
taatacgactcactataggggttggacccagttagccccagaaatccaaaaacagaggagatttggaatgctggggctaaacctggcggcagcgcaaaagatg

SEQ ID NO: 40230 - DNA, 103 bp, Artificial Sequence
  Synthetic Polynucleotide
taatacgactcactataggggtcagttcgctcccaagtacgggcgcacccaacagaggagagggtgcatgcgtacttggaacctggcggcagcgcaaaagatg

SEQ ID NO: 40231 - DNA, 103 bp, Artificial Sequence
  Synthetic Polynucleotide
taatacgactcactataggggctcgaggttactagcttgagatgtacactaacagaggagaagtgtaatgctcaagctaaacctggcggcagcgcaaaagatg

SEQ ID NO: 40232 - DNA, 103 bp, Artificial Sequence
  Synthetic Polynucleotide
taatacgactcactatagggcaaatttcggctggcgtcttattgttgaacaacagaggagagttcaaatgtaagacgccaacctggcggcagcgcaaaagatg

SEQ ID NO: 40233 - DNA, 103 bp, Artificial Sequence
  Synthetic Polynucleotide
taatacgactcactatagggacattaaccttccttgttgaatgggtacataacagaggagaatgtacatgttcaacaagaacctggcggcagcgcaaaagatg

SEQ ID NO: 40234 - DNA, 103 bp, Artificial Sequence
  Synthetic Polynucleotide
taatacgactcactatagggctgccctggtgtggggtacatcgctactacaacagaggagagtagtaatgatgtaccccaacctggcggcagcgcaaaagatg

SEQ ID NO: 40235 - DNA, 103 bp, Artificial Sequence
  Synthetic Polynucleotide
taatacgactcactataggggtcagacaaggcggcctatgccgcggatataacagaggagaatatccatggcataggccaacctggcggcagcgcaaaagatg

SEQ ID NO: 40236 - DNA, 103 bp, Artificial Sequence
  Synthetic Polynucleotide
taatacgactcactatagggcgtcagacacatctagtcaaaagcagtgacaacagaggagagtcactatgtttgactagaacctggcggcagcgcaaaagatg

SEQ ID NO: 40237 - DNA, 103 bp, Artificial Sequence
  Synthetic Polynucleotide
taatacgactcactatagggccatacaaagcgaagtgtcttaagacctggaacagaggagaccaggtatgaagacacttaacctggcggcagcgcaaaagatg

SEQ ID NO: 40238 - DNA, 103 bp, Artificial Sequence
  Synthetic Polynucleotide
taatacgactcactatagggcacgtcatatgcggagcgcggcatgcaattaacagaggagaaattgcatgccgcgctccaacctggcggcagcgcaaaagatg

SEQ ID NO: 40239 - DNA, 103 bp, Artificial Sequence
  Synthetic Polynucleotide
taatacgactcactatagggttccactcgatggtaataacagttataggaaacagaggagatcctatatgtgttattacaacctggcggcagcgcaaaagatg

SEQ ID NO: 40240 - DNA, 103 bp, Artificial Sequence
  Synthetic Polynucleotide
taatacgactcactataggggaattacccagggaattactttatggtgagaacagaggagactcaccatgaagtaattcaacctggcggcagcgcaaaagatg

SEQ ID NO: 40241 - DNA, 103 bp, Artificial Sequence
  Synthetic Polynucleotide
taatacgactcactatagggcggttgacttccagtcttttgaagcaagttaacagaggagaaacttgatgcaaaagactaacctggcggcagcgcaaaagatg

SEQ ID NO: 40242 - DNA, 103 bp, Artificial Sequence
  Synthetic Polynucleotide
taatacgactcactataggggcgccggatcctataaagatgagttaataaaacagaggagattattaatgcatctttataacctggcggcagcgcaaaagatg

SEQ ID NO: 40243 - DNA, 103 bp, Artificial Sequence
  Synthetic Polynucleotide
taatacgactcactataggggaggtggctgacataggacacgggtgtctcaacagaggagagagacaatggtgtcctataacctggcggcagcgcaaaagatg

SEQ ID NO: 40244 - DNA, 103 bp, Artificial Sequence
  Synthetic Polynucleotide
taatacgactcactatagggacaggccgtaacctcagctcagttttcactaacagaggagaagtgaaatgtgagctgagaacctggcggcagcgcaaaagatg

SEQ ID NO: 40245 - DNA, 103 bp, Artificial Sequence
  Synthetic Polynucleotide
taatacgactcactatagggacggcagtggaacaatgtacacttcgcgcaaacagaggagatgcgcgatgtgtacattgaacctggcggcagcgcaaaagatg

SEQ ID NO: 40246 - DNA, 103 bp, Artificial Sequence
  Synthetic Polynucleotide
taatacgactcactatagggagggcagattcgctgaggttcctcagctgtaacagaggagaacagctatggaacctcagaacctggcggcagcgcaaaagatg

SEQ ID NO: 40247 - DNA, 103 bp, Artificial Sequence
  Synthetic Polynucleotide
taatacgactcactatagggtagttttttcaggcgggaactcaggcgaacaacagaggagagttcgcatgagttcccgcaacctggcggcagcgcaaaagatg

SEQ ID NO: 40248 - DNA, 103 bp, Artificial Sequence
  Synthetic Polynucleotide
taatacgactcactatagggtaggacctccagttcacacagcaccttaggaacagaggagacctaagatgctgtgtgaaaacctggcggcagcgcaaaagatg

SEQ ID NO: 40249 - DNA, 103 bp, Artificial Sequence
  Synthetic Polynucleotide
taatacgactcactataggggtttaccttgcggacgggctcaatagatttaacagaggagaaaatctatggagcccgtcaacctggcggcagcgcaaaagatg

SEQ ID NO: 40250 - DNA, 103 bp, Artificial Sequence
  Synthetic Polynucleotide
taatacgactcactatagggctgagattcatagtatataggtatgggataaacagaggagatatcccatgcctatatacaacctggcggcagcgcaaaagatg

SEQ ID NO: 40251 - DNA, 103 bp, Artificial Sequence
  Synthetic Polynucleotide
taatacgactcactatagggatctctgtcatcccacccgctgcacgcgagaacagaggagactcgcgatgagcgggtggaacctggcggcagcgcaaaagatg

SEQ ID NO: 40252 - DNA, 103 bp, Artificial Sequence
  Synthetic Polynucleotide
taatacgactcactatagggggccgagtaacttaagactatcaaccacggaacagaggagaccgtggatgatagtcttaaacctggcggcagcgcaaaagatg

SEQ ID NO: 40253 - DNA, 103 bp, Artificial Sequence
  Synthetic Polynucleotide
taatacgactcactatagggagtgcggaaacaacttctgccatgtattataacagaggagaataataatgggcagaagtaacctggcggcagcgcaaaagatg

SEQ ID NO: 40254 - DNA, 103 bp, Artificial Sequence
  Synthetic Polynucleotide
taatacgactcactatagggcactgagaatagatatgcggaattaacctgaacagaggagacaggttatgtccgcatataacctggcggcagcgcaaaagatg

SEQ ID NO: 40255 - DNA, 103 bp, Artificial Sequence
  Synthetic Polynucleotide
taatacgactcactataggggtcggacaggcggaccgagattgaacggttaacagaggagaaaccgtatgatctcggtcaacctggcggcagcgcaaaagatg

SEQ ID NO: 40256 - DNA, 103 bp, Artificial Sequence
  Synthetic Polynucleotide
taatacgactcactatagggagcagtagaagagtccgcatccggctccgcaacagaggagagcggagatggatgcggacaacctggcggcagcgcaaaagatg

SEQ ID NO: 40257 - DNA, 103 bp, Artificial Sequence
  Synthetic Polynucleotide
taatacgactcactatagggttcggacgttggatagataagaatgagcgtaacagaggagaacgctcatgcttatctataacctggcggcagcgcaaaagatg

SEQ ID NO: 40258 - DNA, 103 bp, Artificial Sequence
  Synthetic Polynucleotide
taatacgactcactatagggagccgaatgcggaatccttatcggtacttgaacagaggagacaagtaatgataaggattaacctggcggcagcgcaaaagatg

SEQ ID NO: 40259 - DNA, 103 bp, Artificial Sequence
  Synthetic Polynucleotide
taatacgactcactataggggagatgacgattgttgaaacgtggatatgaaacagaggagatcatatatgcgtttcaacaacctggcggcagcgcaaaagatg

SEQ ID NO: 40260 - DNA, 103 bp, Artificial Sequence
  Synthetic Polynucleotide
taatacgactcactatagggcttgctcagtcgttagcgtagatctattgaaacagaggagatcaataatgctacgctaaaacctggcggcagcgcaaaagatg

SEQ ID NO: 40261 - DNA, 103 bp, Artificial Sequence
  Synthetic Polynucleotide
taatacgactcactatagggttcggtgctagtgcggctacttgcctagcgaacagaggagacgctagatgagtagccgcaacctggcggcagcgcaaaagatg

SEQ ID NO: 40262 - DNA, 103 bp, Artificial Sequence
  Synthetic Polynucleotide
taatacgactcactatagggtttcttcctcaagactcgggtcccccactaaacagaggagatagtggatgacccgagtcaacctggcggcagcgcaaaagatg

SEQ ID NO: 40263 - DNA, 103 bp, Artificial Sequence
  Synthetic Polynucleotide
taatacgactcactataggggcgcctgacagtggtcaagacaagcacgtgaacagaggagacacgtgatggtcttgaccaacctggcggcagcgcaaaagatg

SEQ ID NO: 40264 - DNA, 103 bp, Artificial Sequence
  Synthetic Polynucleotide
taatacgactcactatagggcgaattagagcagcgacttgagggctgcctaacagaggagaaggcagatgtcaagtcgcaacctggcggcagcgcaaaagatg

SEQ ID NO: 40265 - DNA, 103 bp, Artificial Sequence
  Synthetic Polynucleotide
taatacgactcactatagggtaacgtggagcagtgtgaaggaaggtgaacaacagaggagagttcacatgccttcacacaacctggcggcagcgcaaaagatg

SEQ ID NO: 40266 - DNA, 103 bp, Artificial Sequence
  Synthetic Polynucleotide
taatacgactcactataggggccgggatgtcaattgagtcaccatataggaacagaggagacctataatgtgactcaataacctggcggcagcgcaaaagatg

SEQ ID NO: 40267 - DNA, 103 bp, Artificial Sequence
  Synthetic Polynucleotide
taatacgactcactatagggtcacctcacgagagttactacaagcgctcaaacagaggagatgagcgatggtagtaactaacctggcggcagcgcaaaagatg

SEQ ID NO: 40268 - DNA, 103 bp, Artificial Sequence
  Synthetic Polynucleotide
taatacgactcactatagggtagtttcagattgatatcactctacactgcaacagaggagagcagtgatgagtgatatcaacctggcggcagcgcaaaagatg

SEQ ID NO: 40269 - DNA, 103 bp, Artificial Sequence
  Synthetic Polynucleotide
taatacgactcactatagggcccaatatcgttcggcagccatgagcagtaaacagaggagatactgcatgtggctgccgaacctggcggcagcgcaaaagatg

SEQ ID NO: 40270 - DNA, 103 bp, Artificial Sequence
  Synthetic Polynucleotide
taatacgactcactataggggtatgcgaccagatcgcccctgggggcgcaaacagaggagatgcgccatgaggggcgataacctggcggcagcgcaaaagatg

SEQ ID NO: 40271 - DNA, 103 bp, Artificial Sequence
  Synthetic Polynucleotide
taatacgactcactatagggcagctgagtgctactcccgtcagaatcaacaacagaggagagttgatatggacgggagtaacctggcggcagcgcaaaagatg

SEQ ID NO: 40272 - DNA, 103 bp, Artificial Sequence
  Synthetic Polynucleotide
taatacgactcactatagggccaggtctagacaactagggtctatttcctaacagaggagaaggaaaatgaccctagttaacctggcggcagcgcaaaagatg

SEQ ID NO: 40273 - DNA, 103 bp, Artificial Sequence
  Synthetic Polynucleotide
taatacgactcactataggggtcaattgaccctatgacacgttaagattgaacagaggagacaatctatgcgtgtcataaacctggcggcagcgcaaaagatg

SEQ ID NO: 40274 - DNA, 103 bp, Artificial Sequence
  Synthetic Polynucleotide
taatacgactcactataggggtcccagctaagagagggaccagatgggaaaacagaggagattcccaatgggtccctctaacctggcggcagcgcaaaagatg

SEQ ID NO: 40275 - DNA, 103 bp, Artificial Sequence
  Synthetic Polynucleotide
taatacgactcactatagggttaggaaaaagtcggatggcataaacatttaacagaggagaaaatgtatgtgccatccgaacctggcggcagcgcaaaagatg

SEQ ID NO: 40276 - DNA, 103 bp, Artificial Sequence
  Synthetic Polynucleotide
taatacgactcactatagggcattccctaatgaatctctcgattgttctgaacagaggagacagaacatgcgagagattaacctggcggcagcgcaaaagatg

SEQ ID NO: 40277 - DNA, 103 bp, Artificial Sequence
  Synthetic Polynucleotide
taatacgactcactatagggaatcagtggcgatatctcactgagtctactaacagaggagaagtagaatgagtgagataaacctggcggcagcgcaaaagatg

SEQ ID NO: 40278 - DNA, 103 bp, Artificial Sequence
  Synthetic Polynucleotide
taatacgactcactatagggttacatataacaaggagtgtccctgaagggaacagaggagacccttcatggacactcctaacctggcggcagcgcaaaagatg

SEQ ID NO: 40279 - DNA, 103 bp, Artificial Sequence
  Synthetic Polynucleotide
taatacgactcactatagggcctagaattataggagcaggacagcgagataacagaggagaatctcgatgtcctgctccaacctggcggcagcgcaaaagatg

SEQ ID NO: 40280 - DNA, 103 bp, Artificial Sequence
  Synthetic Polynucleotide
taatacgactcactatagggtgcaagcacagtaccaacagcatcaggtggaacagaggagaccacctatggctgttggtaacctggcggcagcgcaaaagatg

SEQ ID NO: 40281 - DNA, 103 bp, Artificial Sequence
  Synthetic Polynucleotide
taatacgactcactatagggcttaaacggggtaaaaatggttgtagcgggaacagaggagacccgctatgaccatttttaacctggcggcagcgcaaaagatg

SEQ ID NO: 40282 - DNA, 103 bp, Artificial Sequence
  Synthetic Polynucleotide
taatacgactcactatagggtgcaccctgcgccacagacttgaaccaaagaacagaggagactttggatgaagtctgtgaacctggcggcagcgcaaaagatg

SEQ ID NO: 40283 - DNA, 103 bp, Artificial Sequence
  Synthetic Polynucleotide
taatacgactcactatagggtgatgagtaaaccctttttttttagcctaaaacagaggagattaggcatgaaaaaaaggaacctggcggcagcgcaaaagatg

SEQ ID NO: 40284 - DNA, 103 bp, Artificial Sequence
  Synthetic Polynucleotide
taatacgactcactatagggaacgctccaattcctcgaccaaaggccaagaacagaggagacttggcatgtggtcgaggaacctggcggcagcgcaaaagatg

SEQ ID NO: 40285 - DNA, 103 bp, Artificial Sequence
  Synthetic Polynucleotide
taatacgactcactatagggctgatgaaccgctccactactggctatctcaacagaggagagagataatgagtagtggaaacctggcggcagcgcaaaagatg

SEQ ID NO: 40286 - DNA, 103 bp, Artificial Sequence
  Synthetic Polynucleotide
taatacgactcactatagggtttgatttaattcctcatgtgatctgtgaaaacagaggagattcacaatgcacatgaggaacctggcggcagcgcaaaagatg

SEQ ID NO: 40287 - DNA, 103 bp, Artificial Sequence
  Synthetic Polynucleotide
taatacgactcactatagggataattgctggaccgatcttattgcttgtcaacagaggagagacaagatgtaagatcggaacctggcggcagcgcaaaagatg

SEQ ID NO: 40288 - DNA, 103 bp, Artificial Sequence
  Synthetic Polynucleotide
taatacgactcactatagggggagtcgccatgcgccggatcgcactttttaacagaggagaaaaaagatggatccggcgaacctggcggcagcgcaaaagatg

SEQ ID NO: 40289 - DNA, 103 bp, Artificial Sequence
  Synthetic Polynucleotide
taatacgactcactataggggcgttaggtcttgggctgacagtgtgggacaacagaggagagtcccaatgtgtcagcccaacctggcggcagcgcaaaagatg

SEQ ID NO: 40290 - DNA, 103 bp, Artificial Sequence
  Synthetic Polynucleotide
taatacgactcactatagggctgctacgacgaggatagcgagaccagcataacagaggagaatgctgatgtcgctatccaacctggcggcagcgcaaaagatg

SEQ ID NO: 40291 - DNA, 103 bp, Artificial Sequence
  Synthetic Polynucleotide
taatacgactcactatagggaaatcggctaaccacgtccacggcctgccaaacagaggagatggcagatggtggacgtgaacctggcggcagcgcaaaagatg

SEQ ID NO: 40292 - DNA, 103 bp, Artificial Sequence
  Synthetic Polynucleotide
taatacgactcactatagggcaccgtagggacactcgcgcctattctgacaacagaggagagtcagaatgggcgcgagtaacctggcggcagcgcaaaagatg

SEQ ID NO: 40293 - DNA, 103 bp, Artificial Sequence
  Synthetic Polynucleotide
taatacgactcactatagggtttgtgccgggtagtggtctctgacgcaccaacagaggagaggtgcgatggagaccactaacctggcggcagcgcaaaagatg

SEQ ID NO: 40294 - DNA, 103 bp, Artificial Sequence
  Synthetic Polynucleotide
taatacgactcactatagggtttgtcgttagacgtacaacgcatattgcgaacagaggagacgcaatatgcgttgtacgaacctggcggcagcgcaaaagatg

SEQ ID NO: 40295 - DNA, 103 bp, Artificial Sequence
  Synthetic Polynucleotide
taatacgactcactatagggccaaaccaacattaggtctcacaattcctgaacagaggagacaggaaatgtgagacctaaacctggcggcagcgcaaaagatg

SEQ ID NO: 40296 - DNA, 103 bp, Artificial Sequence
  Synthetic Polynucleotide
taatacgactcactatagggccgcggtgccagtttagccatagtatactgaacagaggagacagtatatgatggctaaaaacctggcggcagcgcaaaagatg

SEQ ID NO: 40297 - DNA, 103 bp, Artificial Sequence
  Synthetic Polynucleotide
taatacgactcactatagggacctaaacgtgtgttagtcgtatcgctgataacagaggagaatcagcatgacgactaacaacctggcggcagcgcaaaagatg

SEQ ID NO: 40298 - DNA, 103 bp, Artificial Sequence
  Synthetic Polynucleotide
taatacgactcactatagggcacgtttaaactgcggtaactaggctgaataacagaggagaattcagatgagttaccgcaacctggcggcagcgcaaaagatg

SEQ ID NO: 40299 - DNA, 103 bp, Artificial Sequence
  Synthetic Polynucleotide
taatacgactcactatagggctgatcaaaacgtcgttgattacacaaccgaacagaggagacggttgatgaatcaacgaaacctggcggcagcgcaaaagatg

SEQ ID NO: 40300 - DNA, 103 bp, Artificial Sequence
  Synthetic Polynucleotide
taatacgactcactatagggatccaggcacagccattaccaaagttgtccaacagaggagaggacaaatgtggtaatggaacctggcggcagcgcaaaagatg

SEQ ID NO: 40301 - DNA, 103 bp, Artificial Sequence
  Synthetic Polynucleotide
taatacgactcactatagggtgagtactatgttaggagaccggctgggctaacagaggagaagcccaatgggtctcctaaacctggcggcagcgcaaaagatg

SEQ ID NO: 40302 - DNA, 103 bp, Artificial Sequence
  Synthetic Polynucleotide
taatacgactcactatagggcaatgccacactacgttataaccacagttaaacagaggagataactgatgttataacgtaacctggcggcagcgcaaaagatg

SEQ ID NO: 40303 - DNA, 103 bp, Artificial Sequence
  Synthetic Polynucleotide
taatacgactcactatagggtaccacataagtaagcgagacgctgtctggaacagaggagaccagacatggtctcgcttaacctggcggcagcgcaaaagatg

SEQ ID NO: 40304 - DNA, 103 bp, Artificial Sequence
  Synthetic Polynucleotide
taatacgactcactatagggactacgcattaattatgcttttaaattgtgaacagaggagacacaatatgaaagcataaaacctggcggcagcgcaaaagatg

SEQ ID NO: 40305 - DNA, 103 bp, Artificial Sequence
  Synthetic Polynucleotide
taatacgactcactatagggtatccgcatacccaggccaagctaccggcgaacagaggagacgccggatgcttggcctgaacctggcggcagcgcaaaagatg

SEQ ID NO: 40306 - DNA, 103 bp, Artificial Sequence
  Synthetic Polynucleotide
taatacgactcactataggggacgaacctagggataaggtgcgggatagtaacagaggagaactatcatgcaccttatcaacctggcggcagcgcaaaagatg

SEQ ID NO: 40307 - DNA, 103 bp, Artificial Sequence
  Synthetic Polynucleotide
taatacgactcactatagggtcagatgataacggtgcattaaccaaaacaaacagaggagatgttttatgtaatgcaccaacctggcggcagcgcaaaagatg

SEQ ID NO: 40308 - DNA, 103 bp, Artificial Sequence
  Synthetic Polynucleotide
taatacgactcactatagggcccctttgtagtcccaagttcagccacgctaacagaggagaagcgtgatggaacttgggaacctggcggcagcgcaaaagatg

SEQ ID NO: 40309 - DNA, 103 bp, Artificial Sequence
  Synthetic Polynucleotide
taatacgactcactatagggagattcttctaaacaacttcgggtatccggaacagaggagaccggatatgcgaagttgtaacctggcggcagcgcaaaagatg

SEQ ID NO: 40310 - DNA, 103 bp, Artificial Sequence
  Synthetic Polynucleotide
taatacgactcactatagggtgtagaggtgggcgatcgtccagctattagaacagaggagactaataatgggacgatcgaacctggcggcagcgcaaaagatg

SEQ ID NO: 40311 - DNA, 103 bp, Artificial Sequence
  Synthetic Polynucleotide
taatacgactcactatagggtactagccgccccgacgatcagattagaaaaacagaggagatttctaatgtgatcgtcgaacctggcggcagcgcaaaagatg

SEQ ID NO: 40312 - DNA, 103 bp, Artificial Sequence
  Synthetic Polynucleotide
taatacgactcactatagggtatggtcattagtggtgacgtggacttagtaacagaggagaactaagatgacgtcaccaaacctggcggcagcgcaaaagatg

SEQ ID NO: 40313 - DNA, 103 bp, Artificial Sequence
  Synthetic Polynucleotide
taatacgactcactataggggaatgacccgcccctcccgagtctcacgccaacagaggagaggcgtgatgctcgggaggaacctggcggcagcgcaaaagatg

SEQ ID NO: 40314 - DNA, 103 bp, Artificial Sequence
  Synthetic Polynucleotide
taatacgactcactatagggagacccccacgcgcttagaataacatcataaacagaggagatatgatatgattctaagcaacctggcggcagcgcaaaagatg

SEQ ID NO: 40315 - DNA, 103 bp, Artificial Sequence
  Synthetic Polynucleotide
taatacgactcactatagggtggtagctgttgcgtatatgatgtgcaacgaacagaggagacgttgcatgtcatatacgaacctggcggcagcgcaaaagatg

SEQ ID NO: 40316 - DNA, 103 bp, Artificial Sequence
  Synthetic Polynucleotide
taatacgactcactatagggagctagtggaactgggtcttctactcttagaacagaggagactaagaatggaagacccaaacctggcggcagcgcaaaagatg

SEQ ID NO: 40317 - DNA, 103 bp, Artificial Sequence
  Synthetic Polynucleotide
taatacgactcactatagggtacattgacatactggaattagggtgaagtaacagaggagaacttcaatgtaattccagaacctggcggcagcgcaaaagatg

SEQ ID NO: 40318 - DNA, 103 bp, Artificial Sequence
  Synthetic Polynucleotide
taatacgactcactataggggctctcgcggttttgcgttgaccggtacacaacagaggagagtgtacatgtcaacgcaaaacctggcggcagcgcaaaagatg

SEQ ID NO: 40319 - DNA, 103 bp, Artificial Sequence
  Synthetic Polynucleotide
taatacgactcactatagggtctgtagggtgggatccttttccggcttgaaacagaggagatcaagcatgaaaaggatcaacctggcggcagcgcaaaagatg

SEQ ID NO: 40320 - DNA, 103 bp, Artificial Sequence
  Synthetic Polynucleotide
taatacgactcactatagggccagatcggatacgtcgtggctgacgtccgaacagaggagacggacgatggccacgacgaacctggcggcagcgcaaaagatg

SEQ ID NO: 40321 - DNA, 103 bp, Artificial Sequence
  Synthetic Polynucleotide
taatacgactcactatagggaaccagaaatttcgaccggtttggtgggggaacagaggagacccccaatgaaccggtcgaacctggcggcagcgcaaaagatg

SEQ ID NO: 40322 - DNA, 103 bp, Artificial Sequence
  Synthetic Polynucleotide
taatacgactcactatagggcgcatgaccgatgtgtggccttccttatacaacagaggagagtataaatgaggccacacaacctggcggcagcgcaaaagatg

SEQ ID NO: 40323 - DNA, 103 bp, Artificial Sequence
  Synthetic Polynucleotide
taatacgactcactatagggacgacatccgcagtacacatgccggaatctaacagaggagaagattcatgcatgtgtacaacctggcggcagcgcaaaagatg

SEQ ID NO: 40324 - DNA, 103 bp, Artificial Sequence
  Synthetic Polynucleotide
taatacgactcactatagggatgaaatacgagtttcaacatctcgtgggtaacagaggagaacccacatgatgttgaaaaacctggcggcagcgcaaaagatg

SEQ ID NO: 40325 - DNA, 103 bp, Artificial Sequence
  Synthetic Polynucleotide
taatacgactcactatagggtaagcgtactaaagaacgaggaagccatataacagaggagaatatggatgcctcgttctaacctggcggcagcgcaaaagatg

SEQ ID NO: 40326 - DNA, 103 bp, Artificial Sequence
  Synthetic Polynucleotide
taatacgactcactatagggtcgctgtccatacgagttcaatacggtattaacagaggagaaataccatgttgaactcgaacctggcggcagcgcaaaagatg

SEQ ID NO: 40327 - DNA, 103 bp, Artificial Sequence
  Synthetic Polynucleotide
taatacgactcactatagggcgcaaatcatttagctcctgagcccagtataacagaggagaatactgatgtcaggagctaacctggcggcagcgcaaaagatg

SEQ ID NO: 40328 - DNA, 103 bp, Artificial Sequence
  Synthetic Polynucleotide
taatacgactcactatagggagacgggatcttccatagaggatgtcggacaacagaggagagtccgaatgcctctatggaacctggcggcagcgcaaaagatg

SEQ ID NO: 40329 - DNA, 103 bp, Artificial Sequence
  Synthetic Polynucleotide
taatacgactcactatagggggaagacctgggcgtagaccccagcgtacgaacagaggagacgtacgatggggtctacgaacctggcggcagcgcaaaagatg

SEQ ID NO: 40330 - DNA, 103 bp, Artificial Sequence
  Synthetic Polynucleotide
taatacgactcactataggggatgcggaatagtggtcagcttcacctactaacagaggagaagtaggatgagctgaccaaacctggcggcagcgcaaaagatg

SEQ ID NO: 40331 - DNA, 103 bp, Artificial Sequence
  Synthetic Polynucleotide
taatacgactcactatagggacccagtggtatacgtgtgaataagtactcaacagaggagagagtacatgttcacacgtaacctggcggcagcgcaaaagatg

SEQ ID NO: 40332 - DNA, 103 bp, Artificial Sequence
  Synthetic Polynucleotide
taatacgactcactatagggggctacaggtcggcttaacaggctcgtggaaacagaggagatccacgatgctgttaagcaacctggcggcagcgcaaaagatg

SEQ ID NO: 40333 - DNA, 103 bp, Artificial Sequence
  Synthetic Polynucleotide
taatacgactcactataggggagagcaccctctaccactcgtggctagtcaacagaggagagactagatgcgagtggtaaacctggcggcagcgcaaaagatg

SEQ ID NO: 40334 - DNA, 103 bp, Artificial Sequence
  Synthetic Polynucleotide
taatacgactcactatagggggcgccttccgccgtggactgttacccagaaacagaggagatctgggatgcagtccacgaacctggcggcagcgcaaaagatg

SEQ ID NO: 40335 - DNA, 103 bp, Artificial Sequence
  Synthetic Polynucleotide
taatacgactcactataggggccaggcccgtcatgagcccttggtataggaacagaggagacctataatgagggctcataacctggcggcagcgcaaaagatg

SEQ ID NO: 40336 - DNA, 103 bp, Artificial Sequence
  Synthetic Polynucleotide
taatacgactcactataggggttagcatactatggtgcttaaagaactttaacagaggagaaaagttatgtaagcaccaaacctggcggcagcgcaaaagatg

SEQ ID NO: 40337 - DNA, 103 bp, Artificial Sequence
  Synthetic Polynucleotide
taatacgactcactataggggatttatatcactctcaaatattgtagctgaacagaggagacagctaatgtatttgagaaacctggcggcagcgcaaaagatg

SEQ ID NO: 40338 - DNA, 103 bp, Artificial Sequence
  Synthetic Polynucleotide
taatacgactcactatagggcgcgaacaatccttgtctcttcaacctttgaacagaggagacaaaggatgaagagacaaaacctggcggcagcgcaaaagatg

SEQ ID NO: 40339 - DNA, 103 bp, Artificial Sequence
  Synthetic Polynucleotide
taatacgactcactatagggcctaggccttagcgatcgataccactatcgaacagaggagacgatagatgtatcgatcgaacctggcggcagcgcaaaagatg

SEQ ID NO: 40340 - DNA, 103 bp, Artificial Sequence
  Synthetic Polynucleotide
taatacgactcactatagggacatatgaagggtaattaggagaaaccccaaacagaggagatggggtatgtcctaattaaacctggcggcagcgcaaaagatg

SEQ ID NO: 40341 - DNA, 103 bp, Artificial Sequence
  Synthetic Polynucleotide
taatacgactcactatagggtgatcgaaactccttcgtttgtagctccgcaacagaggagagcggagatgcaaacgaagaacctggcggcagcgcaaaagatg

SEQ ID NO: 40342 - DNA, 103 bp, Artificial Sequence
  Synthetic Polynucleotide
taatacgactcactatagggtacgactcttaagctcaataaccggaatcgaacagaggagacgattcatgttattgagcaacctggcggcagcgcaaaagatg

SEQ ID NO: 40343 - DNA, 103 bp, Artificial Sequence
  Synthetic Polynucleotide
taatacgactcactatagggtagaaccggctagtacgcgatccactacgaaacagaggagatcgtagatgatcgcgtacaacctggcggcagcgcaaaagatg

SEQ ID NO: 40344 - DNA, 103 bp, Artificial Sequence
  Synthetic Polynucleotide
taatacgactcactatagggctcgtgcgcgaaagcaccagtgtaatcttgaacagaggagacaagatatgactggtgctaacctggcggcagcgcaaaagatg

SEQ ID NO: 40345 - DNA, 103 bp, Artificial Sequence
  Synthetic Polynucleotide
taatacgactcactatagggtatcagcaacccgatgtattgctcaacgttaacagaggagaaacgttatgcaatacatcaacctggcggcagcgcaaaagatg

SEQ ID NO: 40346 - DNA, 103 bp, Artificial Sequence
  Synthetic Polynucleotide
taatacgactcactatagggcccggcaccaatgtctggcgtccgacatacaacagaggagagtatgtatgacgccagacaacctggcggcagcgcaaaagatg

SEQ ID NO: 40347 - DNA, 103 bp, Artificial Sequence
  Synthetic Polynucleotide
taatacgactcactatagggctacggggcatcgccgcattttatctgaacaacagaggagagttcagatgaaatgcggcaacctggcggcagcgcaaaagatg

SEQ ID NO: 40348 - DNA, 103 bp, Artificial Sequence
  Synthetic Polynucleotide
taatacgactcactatagggtcaatggcggcaggggtggttccgctccgcaacagaggagagcggagatgaaccaccccaacctggcggcagcgcaaaagatg

SEQ ID NO: 40349 - DNA, 103 bp, Artificial Sequence
  Synthetic Polynucleotide
taatacgactcactataggggacctttgtggaagaggcaactttgcatacaacagaggagagtatgcatggttgcctctaacctggcggcagcgcaaaagatg

SEQ ID NO: 40350 - DNA, 103 bp, Artificial Sequence
  Synthetic Polynucleotide
taatacgactcactataggggaatagactaaagcactcaactccatcttaaacagaggagataagatatggttgagtgcaacctggcggcagcgcaaaagatg

SEQ ID NO: 40351 - DNA, 103 bp, Artificial Sequence
  Synthetic Polynucleotide
taatacgactcactatagggaagagccaaaatcctattgatgatttgatgaacagaggagacatcaaatgatcaataggaacctggcggcagcgcaaaagatg

SEQ ID NO: 40352 - DNA, 103 bp, Artificial Sequence
  Synthetic Polynucleotide
taatacgactcactatagggtttacggcaaacagtccctgtgtgttctgtaacagaggagaacagaaatgacagggactaacctggcggcagcgcaaaagatg

SEQ ID NO: 40353 - DNA, 103 bp, Artificial Sequence
  Synthetic Polynucleotide
taatacgactcactatagggcgagagaggaatctcgcgacaaaaatagctaacagaggagaagctatatgtgtcgcgagaacctggcggcagcgcaaaagatg

SEQ ID NO: 40354 - DNA, 103 bp, Artificial Sequence
  Synthetic Polynucleotide
taatacgactcactatagggatcctattcccagccaacatagacgctacgaacagaggagacgtagcatgtatgttggcaacctggcggcagcgcaaaagatg

SEQ ID NO: 40355 - DNA, 103 bp, Artificial Sequence
  Synthetic Polynucleotide
taatacgactcactatagggcgcggtcaggttctggactaggacgttaacaacagaggagagttaacatgctagtccagaacctggcggcagcgcaaaagatg

SEQ ID NO: 40356 - DNA, 103 bp, Artificial Sequence
  Synthetic Polynucleotide
taatacgactcactatagggatcaggtaaatgtcctaagcgcagctgagcaacagaggagagctcagatgcgcttaggaaacctggcggcagcgcaaaagatg

SEQ ID NO: 40357 - DNA, 103 bp, Artificial Sequence
  Synthetic Polynucleotide
taatacgactcactatagggttaagaattgaaggcatcggccaacgtcgaaacagaggagatcgacgatggccgatgccaacctggcggcagcgcaaaagatg

SEQ ID NO: 40358 - DNA, 103 bp, Artificial Sequence
  Synthetic Polynucleotide
taatacgactcactatagggtggggacccaaaatgcgatggttcagattaaacagaggagataatctatgccatcgcataacctggcggcagcgcaaaagatg

SEQ ID NO: 40359 - DNA, 103 bp, Artificial Sequence
  Synthetic Polynucleotide
taatacgactcactatagggaaaaacctgtagcttaaggtgaggtgaactaacagaggagaagttcaatgcaccttaagaacctggcggcagcgcaaaagatg

SEQ ID NO: 40360 - DNA, 103 bp, Artificial Sequence
  Synthetic Polynucleotide
taatacgactcactataggggcccatttgggttaggccacacttgtttttaacagaggagaaaaaacatgtgtggcctaaacctggcggcagcgcaaaagatg

SEQ ID NO: 40361 - DNA, 103 bp, Artificial Sequence
  Synthetic Polynucleotide
taatacgactcactatagggcccaggggcatagcctttacccttcggcataacagaggagaatgccgatgggtaaaggcaacctggcggcagcgcaaaagatg

SEQ ID NO: 40362 - DNA, 103 bp, Artificial Sequence
  Synthetic Polynucleotide
taatacgactcactatagggataatcgcgtagtggtctctgtcaaaattgaacagaggagacaatttatgcagagaccaaacctggcggcagcgcaaaagatg

SEQ ID NO: 40363 - DNA, 103 bp, Artificial Sequence
  Synthetic Polynucleotide
taatacgactcactatagggggtccccaatgccccgcttgtcattctcctaacagaggagaaggagaatgacaagcgggaacctggcggcagcgcaaaagatg

SEQ ID NO: 40364 - DNA, 103 bp, Artificial Sequence
  Synthetic Polynucleotide
taatacgactcactatagggacgaggccactaagtaccgcgacgcgggttaacagaggagaaacccgatgcgcggtactaacctggcggcagcgcaaaagatg

SEQ ID NO: 40365 - DNA, 103 bp, Artificial Sequence
  Synthetic Polynucleotide
taatacgactcactatagggcaggaactaagtggatagactcatctcaggaacagaggagacctgagatgagtctatccaacctggcggcagcgcaaaagatg

SEQ ID NO: 40366 - DNA, 103 bp, Artificial Sequence
  Synthetic Polynucleotide
taatacgactcactatagggattggcttgtcagtaacgcatgggaagaataacagaggagaattcttatgatgcgttacaacctggcggcagcgcaaaagatg

SEQ ID NO: 40367 - DNA, 103 bp, Artificial Sequence
  Synthetic Polynucleotide
taatacgactcactatagggtgcaccgcgcaataagtcggtaaggtttcgaacagaggagacgaaacatgaccgacttaaacctggcggcagcgcaaaagatg

SEQ ID NO: 40368 - DNA, 103 bp, Artificial Sequence
  Synthetic Polynucleotide
taatacgactcactatagggaactgttccttcagaccatactaatgagtgaacagaggagacactcaatggtatggtctaacctggcggcagcgcaaaagatg

SEQ ID NO: 40369 - DNA, 103 bp, Artificial Sequence
  Synthetic Polynucleotide
taatacgactcactataggggagtctaccgggatggacgccctgtttcacaacagaggagagtgaaaatgggcgtccataacctggcggcagcgcaaaagatg

SEQ ID NO: 40370 - DNA, 103 bp, Artificial Sequence
  Synthetic Polynucleotide
taatacgactcactatagggaaggagggagggatactcacagtgagctcaaacagaggagatgagctatgtgtgagtataacctggcggcagcgcaaaagatg

SEQ ID NO: 40371 - DNA, 103 bp, Artificial Sequence
  Synthetic Polynucleotide
taatacgactcactatagggttccattcctcatatcacgcactactgagaaacagaggagatctcagatgtgcgtgataaacctggcggcagcgcaaaagatg

SEQ ID NO: 40372 - DNA, 103 bp, Artificial Sequence
  Synthetic Polynucleotide
taatacgactcactatagggtgagaacctatcttcgtttccagaaggccaaacagaggagatggcctatgggaaacgaaaacctggcggcagcgcaaaagatg

SEQ ID NO: 40373 - DNA, 103 bp, Artificial Sequence
  Synthetic Polynucleotide
taatacgactcactataggggaggtgacttcaacacatgaaactaacttaaacagaggagataagttatgttcatgtgtaacctggcggcagcgcaaaagatg

SEQ ID NO: 40374 - DNA, 103 bp, Artificial Sequence
  Synthetic Polynucleotide
taatacgactcactataggggtagactgttcaccggtcatctgtaattaaaacagaggagattaattatggatgaccggaacctggcggcagcgcaaaagatg

SEQ ID NO: 40375 - DNA, 103 bp, Artificial Sequence
  Synthetic Polynucleotide
taatacgactcactatagggctgtgactagttgacatcacttggtttcttaacagaggagaaagaaaatgagtgatgtcaacctggcggcagcgcaaaagatg

SEQ ID NO: 40376 - DNA, 103 bp, Artificial Sequence
  Synthetic Polynucleotide
taatacgactcactatagggatgcacctcgtcccatacacgttctaccataacagaggagaatggtaatgcgtgtatggaacctggcggcagcgcaaaagatg

SEQ ID NO: 40377 - DNA, 103 bp, Artificial Sequence
  Synthetic Polynucleotide
taatacgactcactatagggacagttatggaaggataaggtagggaggtgaacagaggagacacctcatgaccttatccaacctggcggcagcgcaaaagatg

SEQ ID NO: 40378 - DNA, 103 bp, Artificial Sequence
  Synthetic Polynucleotide
taatacgactcactatagggcatcgatgtcacccctgcctttggaccatcaacagaggagagatggtatgaaggcagggaacctggcggcagcgcaaaagatg

SEQ ID NO: 40379 - DNA, 103 bp, Artificial Sequence
  Synthetic Polynucleotide
taatacgactcactatagggtctccggaaaccatgcagacgggctcagctaacagaggagaagctgaatgcgtctgcataacctggcggcagcgcaaaagatg

SEQ ID NO: 40380 - DNA, 103 bp, Artificial Sequence
  Synthetic Polynucleotide
taatacgactcactatagggagaattctgcaggaaagctagaaaattggaaacagaggagatccaatatgctagctttcaacctggcggcagcgcaaaagatg

SEQ ID NO: 40381 - DNA, 103 bp, Artificial Sequence
  Synthetic Polynucleotide
taatacgactcactatagggcaggtgccgcttgtataaatgtgaggtgagaacagaggagactcaccatgcatttatacaacctggcggcagcgcaaaagatg

SEQ ID NO: 40382 - DNA, 103 bp, Artificial Sequence
  Synthetic Polynucleotide
taatacgactcactatagggaccggctgttcgtatttcatagttttgtaaaacagaggagattacaaatgtatgaaataaacctggcggcagcgcaaaagatg

SEQ ID NO: 40383 - DNA, 103 bp, Artificial Sequence
  Synthetic Polynucleotide
taatacgactcactatagggcacaaaatcctgaatccggttagagtcgctaacagaggagaagcgacatgaaccggattaacctggcggcagcgcaaaagatg

SEQ ID NO: 40384 - DNA, 103 bp, Artificial Sequence
  Synthetic Polynucleotide
taatacgactcactatagggacgtgaagataccatagtcataacgggggcaacagaggagagcccccatgatgactatgaacctggcggcagcgcaaaagatg

SEQ ID NO: 40385 - DNA, 103 bp, Artificial Sequence
  Synthetic Polynucleotide
taatacgactcactataggggatgatattgtgcgtctaatgtccctatgaaacagaggagatcatagatgcattagacgaacctggcggcagcgcaaaagatg

SEQ ID NO: 40386 - DNA, 103 bp, Artificial Sequence
  Synthetic Polynucleotide
taatacgactcactatagggtgtaggtgtggcgctctcatcgtccgtataaacagaggagatatacgatggatgagagcaacctggcggcagcgcaaaagatg

SEQ ID NO: 40387 - DNA, 103 bp, Artificial Sequence
  Synthetic Polynucleotide
taatacgactcactataggggaggcccgcaccccgcgtgtcatatcacgtaacagaggagaacgtgaatggacacgcggaacctggcggcagcgcaaaagatg

SEQ ID NO: 40388 - DNA, 103 bp, Artificial Sequence
  Synthetic Polynucleotide
taatacgactcactatagggagtcatctgtgttagtttctttatttggtgaacagaggagacaccaaatgaagaaactaaacctggcggcagcgcaaaagatg

SEQ ID NO: 40389 - DNA, 103 bp, Artificial Sequence
  Synthetic Polynucleotide
taatacgactcactataggggcgtgacgaagtggcagcgatttaaagtctaacagaggagaagacttatgatcgctgccaacctggcggcagcgcaaaagatg

SEQ ID NO: 40390 - DNA, 103 bp, Artificial Sequence
  Synthetic Polynucleotide
taatacgactcactatagggaccgtagctacttcaattgcgtgggcctctaacagaggagaagaggcatgcgcaattgaaacctggcggcagcgcaaaagatg

SEQ ID NO: 40391 - DNA, 103 bp, Artificial Sequence
  Synthetic Polynucleotide
taatacgactcactatagggtactgttagtgctctagaattcgcgaagggaacagaggagacccttcatgaattctagaaacctggcggcagcgcaaaagatg

SEQ ID NO: 40392 - DNA, 103 bp, Artificial Sequence
  Synthetic Polynucleotide
taatacgactcactatagggaggacggtatgattgtggaatcagcccagaaacagaggagatctgggatgattccacaaaacctggcggcagcgcaaaagatg

SEQ ID NO: 40393 - DNA, 103 bp, Artificial Sequence
  Synthetic Polynucleotide
taatacgactcactatagggttgccttggctgtaattgaaggatgtcccaaacagaggagatgggacatgcttcaattaaacctggcggcagcgcaaaagatg

SEQ ID NO: 40394 - DNA, 103 bp, Artificial Sequence
  Synthetic Polynucleotide
taatacgactcactatagggcatgaactggtggcaatgcgtgcccgaggaaacagaggagatcctcgatgacgcattgcaacctggcggcagcgcaaaagatg

SEQ ID NO: 40395 - DNA, 103 bp, Artificial Sequence
  Synthetic Polynucleotide
taatacgactcactatagggcgtcgatcccggaagcaccccagaaatcggaacagaggagaccgattatgggggtgcttaacctggcggcagcgcaaaagatg

SEQ ID NO: 40396 - DNA, 103 bp, Artificial Sequence
  Synthetic Polynucleotide
taatacgactcactatagggcgcttcctgcactcgttttgacgtccgattaacagaggagaaatcggatgtcaaaacgaaacctggcggcagcgcaaaagatg

SEQ ID NO: 40397 - DNA, 103 bp, Artificial Sequence
  Synthetic Polynucleotide
taatacgactcactataggggtggggcactaactcagcgacgccccaggcaacagaggagagcctggatggtcgctgagaacctggcggcagcgcaaaagatg

SEQ ID NO: 40398 - DNA, 103 bp, Artificial Sequence
  Synthetic Polynucleotide
taatacgactcactatagggggccagcacgatgcgactagagatgcttacaacagaggagagtaagcatgtctagtcgcaacctggcggcagcgcaaaagatg

SEQ ID NO: 40399 - DNA, 103 bp, Artificial Sequence
  Synthetic Polynucleotide
taatacgactcactataggggagattattgtaccttgacacgatagtagtaacagaggagaactactatggtgtcaaggaacctggcggcagcgcaaaagatg

SEQ ID NO: 40400 - DNA, 103 bp, Artificial Sequence
  Synthetic Polynucleotide
taatacgactcactatagggtttgggtccgggcagcatccatgttggcggaacagaggagaccgccaatgtggatgctgaacctggcggcagcgcaaaagatg

SEQ ID NO: 40401 - DNA, 103 bp, Artificial Sequence
  Synthetic Polynucleotide
taatacgactcactatagggagaggcccataaatgctcactgcatagcagaacagaggagactgctaatgagtgagcataacctggcggcagcgcaaaagatg

SEQ ID NO: 40402 - DNA, 103 bp, Artificial Sequence
  Synthetic Polynucleotide
taatacgactcactatagggacatacaagaggttccaagtcgcttagagtaacagaggagaactctaatggacttggaaaacctggcggcagcgcaaaagatg

SEQ ID NO: 40403 - DNA, 103 bp, Artificial Sequence
  Synthetic Polynucleotide
taatacgactcactataggggttatagtaagactatcattagcaggtcagaacagaggagactgaccatgtaatgatagaacctggcggcagcgcaaaagatg

SEQ ID NO: 40404 - DNA, 103 bp, Artificial Sequence
  Synthetic Polynucleotide
taatacgactcactatagggacgttgctgaggtgcaatgaatacctgtctaacagaggagaagacagatgttcattgcaaacctggcggcagcgcaaaagatg

SEQ ID NO: 40405 - DNA, 103 bp, Artificial Sequence
  Synthetic Polynucleotide
taatacgactcactatagggcgccgaacatagaatacctagatgcaacctaacagaggagaaggttgatgctaggtattaacctggcggcagcgcaaaagatg

SEQ ID NO: 40406 - DNA, 103 bp, Artificial Sequence
  Synthetic Polynucleotide
taatacgactcactatagggcgatttctattttcagttggggggccatgaaacagaggagatcatggatgcccaactgaaacctggcggcagcgcaaaagatg

SEQ ID NO: 40407 - DNA, 103 bp, Artificial Sequence
  Synthetic Polynucleotide
taatacgactcactatagggtaactaggcaaagcgtagatgcatccgttcaacagaggagagaacggatgcatctacgcaacctggcggcagcgcaaaagatg

SEQ ID NO: 40408 - DNA, 103 bp, Artificial Sequence
  Synthetic Polynucleotide
taatacgactcactatagggcagcgcaaacgatcctttcctcttgacttgaacagaggagacaagtcatgaggaaaggaaacctggcggcagcgcaaaagatg

SEQ ID NO: 40409 - DNA, 103 bp, Artificial Sequence
  Synthetic Polynucleotide
taatacgactcactatagggggtcccggctctatgcaaaggggattccttaacagaggagaaaggaaatgcctttgcataacctggcggcagcgcaaaagatg

SEQ ID NO: 40410 - DNA, 103 bp, Artificial Sequence
  Synthetic Polynucleotide
taatacgactcactatagggcggcatatctgtgatgcaacatagggggacaacagaggagagtccccatgtgttgcatcaacctggcggcagcgcaaaagatg

SEQ ID NO: 40411 - DNA, 103 bp, Artificial Sequence
  Synthetic Polynucleotide
taatacgactcactataggggggaaaaattaatgggacgaaccagtgcagaacagaggagactgcacatgttcgtcccaaacctggcggcagcgcaaaagatg

SEQ ID NO: 40412 - DNA, 103 bp, Artificial Sequence
  Synthetic Polynucleotide
taatacgactcactatagggatgatgttgaaacctgaatgaaagctacataacagaggagaatgtagatgtcattcaggaacctggcggcagcgcaaaagatg

SEQ ID NO: 40413 - DNA, 103 bp, Artificial Sequence
  Synthetic Polynucleotide
taatacgactcactatagggagcatgcaggatacttggtccgccgaacacaacagaggagagtgttcatgggaccaagtaacctggcggcagcgcaaaagatg

SEQ ID NO: 40414 - DNA, 103 bp, Artificial Sequence
  Synthetic Polynucleotide
taatacgactcactatagggtggatcttttcatctcacctgtgtggctcaaacagaggagatgagccatgcaggtgagaaacctggcggcagcgcaaaagatg

SEQ ID NO: 40415 - DNA, 103 bp, Artificial Sequence
  Synthetic Polynucleotide
taatacgactcactatagggtatacatgtacattgcgggaactgaagctgaacagaggagacagcttatgttcccgcaaaacctggcggcagcgcaaaagatg

SEQ ID NO: 40416 - DNA, 103 bp, Artificial Sequence
  Synthetic Polynucleotide
taatacgactcactatagggcctaaatttgtacgcagggagctgcgccaaaacagaggagattggcgatgctccctgcgaacctggcggcagcgcaaaagatg

SEQ ID NO: 40417 - DNA, 103 bp, Artificial Sequence
  Synthetic Polynucleotide
taatacgactcactataggggtcagagtgtgcaggatcgagttcataagtaacagaggagaacttatatgctcgatcctaacctggcggcagcgcaaaagatg

SEQ ID NO: 40418 - DNA, 103 bp, Artificial Sequence
  Synthetic Polynucleotide
taatacgactcactatagggtgagtctgcacgaagattgtccctaacggcaacagaggagagccgttatggacaatcttaacctggcggcagcgcaaaagatg

SEQ ID NO: 40419 - DNA, 103 bp, Artificial Sequence
  Synthetic Polynucleotide
taatacgactcactatagggacaggttgaacatctggaatggggggtcctaacagaggagaaggaccatgcattccagaaacctggcggcagcgcaaaagatg

SEQ ID NO: 40420 - DNA, 103 bp, Artificial Sequence
  Synthetic Polynucleotide
taatacgactcactatagggatcgtcgccgggacggggggttcccctgtgaacagaggagacacaggatgaccccccgtaacctggcggcagcgcaaaagatg

SEQ ID NO: 40421 - DNA, 103 bp, Artificial Sequence
  Synthetic Polynucleotide
taatacgactcactatagggagcttagagtaacgttgcgccccccccgcaaacagaggagatgcgggatgggcgcaacgaacctggcggcagcgcaaaagatg

SEQ ID NO: 40422 - DNA, 103 bp, Artificial Sequence
  Synthetic Polynucleotide
taatacgactcactataggggccccttttcttaaagaggctaacacccacaacagaggagagtgggtatgagcctctttaacctggcggcagcgcaaaagatg

SEQ ID NO: 40423 - DNA, 103 bp, Artificial Sequence
  Synthetic Polynucleotide
taatacgactcactatagggccaagcaagaagtgggacaagaacaccgctaacagaggagaagcggtatgcttgtcccaaacctggcggcagcgcaaaagatg

SEQ ID NO: 40424 - DNA, 103 bp, Artificial Sequence
  Synthetic Polynucleotide
taatacgactcactatagggtgttaactggggagctgagcgctattcaataacagaggagaattgaaatgcgctcagctaacctggcggcagcgcaaaagatg

SEQ ID NO: 40425 - DNA, 103 bp, Artificial Sequence
  Synthetic Polynucleotide
taatacgactcactatagggtatcactgcaaacaccggtcgatagttttgaacagaggagacaaaacatgcgaccggtgaacctggcggcagcgcaaaagatg

SEQ ID NO: 40426 - DNA, 103 bp, Artificial Sequence
  Synthetic Polynucleotide
taatacgactcactatagggaggtgcggcttcgctcccagtcccatgcagaacagaggagactgcatatgactgggagcaacctggcggcagcgcaaaagatg

SEQ ID NO: 40427 - DNA, 103 bp, Artificial Sequence
  Synthetic Polynucleotide
taatacgactcactatagggcgtccgatattgcgactattagagacagttaacagaggagaaactgtatgtaatagtcgaacctggcggcagcgcaaaagatg

SEQ ID NO: 40428 - DNA, 103 bp, Artificial Sequence
  Synthetic Polynucleotide
taatacgactcactatagggtccatgcgtttttgtgcttttctcagaggcaacagaggagagcctctatgaaaagcacaaacctggcggcagcgcaaaagatg

SEQ ID NO: 40429 - DNA, 103 bp, Artificial Sequence
  Synthetic Polynucleotide
taatacgactcactatagggtaatgcacctatgattaattgaattgacgtaacagaggagaacgtcaatgcaattaatcaacctggcggcagcgcaaaagatg

SEQ ID NO: 40430 - DNA, 103 bp, Artificial Sequence
  Synthetic Polynucleotide
taatacgactcactatagggagcggccacgggactagcaagaatccagataacagaggagaatctggatgcttgctagtaacctggcggcagcgcaaaagatg

SEQ ID NO: 40431 - DNA, 103 bp, Artificial Sequence
  Synthetic Polynucleotide
taatacgactcactataggggttcgcatctgtataagtaagctgaattcaaacagaggagatgaattatgcttacttataacctggcggcagcgcaaaagatg

SEQ ID NO: 40432 - DNA, 103 bp, Artificial Sequence
  Synthetic Polynucleotide
taatacgactcactatagggaactcacgttcaaaaccaaagaccatcaacaacagaggagagttgatatgctttggtttaacctggcggcagcgcaaaagatg

SEQ ID NO: 40433 - DNA, 103 bp, Artificial Sequence
  Synthetic Polynucleotide
taatacgactcactatagggtgttagaggtattcgaaaaatctcctgataaacagaggagatatcagatgatttttcgaaacctggcggcagcgcaaaagatg

SEQ ID NO: 40434 - DNA, 103 bp, Artificial Sequence
  Synthetic Polynucleotide
taatacgactcactataggggttctacgcattcttgagcgctcaaaagcaaacagaggagatgctttatggcgctcaagaacctggcggcagcgcaaaagatg

SEQ ID NO: 40435 - DNA, 103 bp, Artificial Sequence
  Synthetic Polynucleotide
taatacgactcactatagggcatagacgcggcgtacaccagactcgcgcaaacagaggagatgcgcgatgctggtgtacaacctggcggcagcgcaaaagatg

SEQ ID NO: 40436 - DNA, 103 bp, Artificial Sequence
  Synthetic Polynucleotide
taatacgactcactataggggcttttcaggtaccttgaggcgtaaatagcaacagaggagagctattatggcctcaaggaacctggcggcagcgcaaaagatg

SEQ ID NO: 40437 - DNA, 103 bp, Artificial Sequence
  Synthetic Polynucleotide
taatacgactcactatagggccatatcaattacgtgtgtagttgcttgtcaacagaggagagacaagatgctacacacgaacctggcggcagcgcaaaagatg

SEQ ID NO: 40438 - DNA, 103 bp, Artificial Sequence
  Synthetic Polynucleotide
taatacgactcactataggggtacgttattgatcggatctggctgatattaacagaggagaaatatcatgcagatccgaaacctggcggcagcgcaaaagatg

SEQ ID NO: 40439 - DNA, 103 bp, Artificial Sequence
  Synthetic Polynucleotide
taatacgactcactataggggaactcggaagggggaccgtgattgcttccaacagaggagaggaagcatgcacggtcccaacctggcggcagcgcaaaagatg

SEQ ID NO: 40440 - DNA, 103 bp, Artificial Sequence
  Synthetic Polynucleotide
taatacgactcactataggggggcttgatcgtcctctggcgaggcaatcgaacagaggagacgattgatgcgccagaggaacctggcggcagcgcaaaagatg

SEQ ID NO: 40441 - DNA, 103 bp, Artificial Sequence
  Synthetic Polynucleotide
taatacgactcactatagggggtcccccataggtcaactaaactaagacgaacagaggagacgtcttatgttagttgacaacctggcggcagcgcaaaagatg

SEQ ID NO: 40442 - DNA, 103 bp, Artificial Sequence
  Synthetic Polynucleotide
taatacgactcactatagggctgtgagcgcgccgggaggcggacacccacaacagaggagagtgggtatgcgcctcccgaacctggcggcagcgcaaaagatg

SEQ ID NO: 40443 - DNA, 103 bp, Artificial Sequence
  Synthetic Polynucleotide
taatacgactcactatagggaaaggatcacgggggcagtgcatacctattaacagaggagaaataggatggcactgcccaacctggcggcagcgcaaaagatg

SEQ ID NO: 40444 - DNA, 103 bp, Artificial Sequence
  Synthetic Polynucleotide
taatacgactcactatagggaattttaagcgccgttgatttaatatgcgtaacagaggagaacgcatatgaaatcaacgaacctggcggcagcgcaaaagatg

SEQ ID NO: 40445 - DNA, 103 bp, Artificial Sequence
  Synthetic Polynucleotide
taatacgactcactatagggacctgggttgaaattaatgtgtgcgcacgaaacagaggagatcgtgcatgcacattaataacctggcggcagcgcaaaagatg

SEQ ID NO: 40446 - DNA, 103 bp, Artificial Sequence
  Synthetic Polynucleotide
taatacgactcactatagggttcggtgtattaaatcacctcttaagaagaaacagaggagatcttctatggaggtgattaacctggcggcagcgcaaaagatg

SEQ ID NO: 40447 - DNA, 103 bp, Artificial Sequence
  Synthetic Polynucleotide
taatacgactcactataggggtatatagccgccacattcctggatatttgaacagaggagacaaataatgaggaatgtgaacctggcggcagcgcaaaagatg

SEQ ID NO: 40448 - DNA, 103 bp, Artificial Sequence
  Synthetic Polynucleotide
taatacgactcactatagggtctttagcgaattatcatgccgaatcgggaaacagaggagatcccgaatgggcatgataaacctggcggcagcgcaaaagatg

SEQ ID NO: 40449 - DNA, 103 bp, Artificial Sequence
  Synthetic Polynucleotide
taatacgactcactatagggtaacaggatactaatacatcagctgtagcgaacagaggagacgctacatgtgatgtattaacctggcggcagcgcaaaagatg

SEQ ID NO: 40450 - DNA, 103 bp, Artificial Sequence
  Synthetic Polynucleotide
taatacgactcactatagggctccctgcttgcccccctggccgcacctgcaacagaggagagcaggtatggccagggggaacctggcggcagcgcaaaagatg

SEQ ID NO: 40451 - DNA, 103 bp, Artificial Sequence
  Synthetic Polynucleotide
taatacgactcactataggggagtggcacgctaccattatctatataagtaacagaggagaacttatatggataatggtaacctggcggcagcgcaaaagatg

SEQ ID NO: 40452 - DNA, 103 bp, Artificial Sequence
  Synthetic Polynucleotide
taatacgactcactatagggacaaattttgctcagtgtctgaaggggcacaacagaggagagtgcccatgcagacactgaacctggcggcagcgcaaaagatg

SEQ ID NO: 40453 - DNA, 103 bp, Artificial Sequence
  Synthetic Polynucleotide
taatacgactcactatagggtcagcgagtttgtgcctgtagtgcatcgtcaacagaggagagacgatatgctacaggcaaacctggcggcagcgcaaaagatg

SEQ ID NO: 40454 - DNA, 103 bp, Artificial Sequence
  Synthetic Polynucleotide
taatacgactcactatagggcactctagccatccctctacgcttcctcgcaacagaggagagcgaggatgcgtagagggaacctggcggcagcgcaaaagatg

SEQ ID NO: 40455 - DNA, 103 bp, Artificial Sequence
  Synthetic Polynucleotide
taatacgactcactatagggtcagagacttgcctcctgtaagactgccctaacagaggagaagggcaatgttacaggagaacctggcggcagcgcaaaagatg

SEQ ID NO: 40456 - DNA, 103 bp, Artificial Sequence
  Synthetic Polynucleotide
taatacgactcactatagggctgcgacccgacagtgtgtgattagatagtaacagaggagaactatcatgtcacacactaacctggcggcagcgcaaaagatg

SEQ ID NO: 40457 - DNA, 103 bp, Artificial Sequence
  Synthetic Polynucleotide
taatacgactcactatagggttaaggttaccccactctttcgagcaggtgaacagaggagacacctgatggaaagagtgaacctggcggcagcgcaaaagatg

SEQ ID NO: 40458 - DNA, 103 bp, Artificial Sequence
  Synthetic Polynucleotide
taatacgactcactatagggtgaaggcaaagtatggcgggatacgtagttaacagaggagaaactacatgtcccgccataacctggcggcagcgcaaaagatg

SEQ ID NO: 40459 - DNA, 103 bp, Artificial Sequence
  Synthetic Polynucleotide
taatacgactcactatagggatagctagtcctaatagtcactgtaggactaacagaggagaagtcctatggtgactattaacctggcggcagcgcaaaagatg

SEQ ID NO: 40460 - DNA, 103 bp, Artificial Sequence
  Synthetic Polynucleotide
taatacgactcactataggggtggagaaagatatgtctttagaaggtgtgaacagaggagacacaccatgtaaagacataacctggcggcagcgcaaaagatg

SEQ ID NO: 40461 - DNA, 103 bp, Artificial Sequence
  Synthetic Polynucleotide
taatacgactcactataggggggccagttcctggcagaatcggcaaaaagaacagaggagactttttatggattctgccaacctggcggcagcgcaaaagatg

SEQ ID NO: 40462 - DNA, 103 bp, Artificial Sequence
  Synthetic Polynucleotide
taatacgactcactatagggaagacagaatccctcctcatggcgtcactcaacagaggagagagtgaatgcatgaggagaacctggcggcagcgcaaaagatg

SEQ ID NO: 40463 - DNA, 103 bp, Artificial Sequence
  Synthetic Polynucleotide
taatacgactcactatagggggagacaacggggaacgtaggcgtgtcagtaacagaggagaactgacatgcctacgttcaacctggcggcagcgcaaaagatg

SEQ ID NO: 40464 - DNA, 103 bp, Artificial Sequence
  Synthetic Polynucleotide
taatacgactcactatagggtttcaccagacgtgtttctatgttagacaaaacagaggagattgtctatgatagaaacaaacctggcggcagcgcaaaagatg

SEQ ID NO: 40465 - DNA, 103 bp, Artificial Sequence
  Synthetic Polynucleotide
taatacgactcactatagggtccctctccgaacaacctcgatatacgctaaacagaggagatagcgtatgtcgaggttgaacctggcggcagcgcaaaagatg

SEQ ID NO: 40466 - DNA, 103 bp, Artificial Sequence
  Synthetic Polynucleotide
taatacgactcactatagggtccaaccgtgtctagggcttcgcaagaccaaacagaggagatggtctatggaagccctaaacctggcggcagcgcaaaagatg

SEQ ID NO: 40467 - DNA, 103 bp, Artificial Sequence
  Synthetic Polynucleotide
taatacgactcactatagggcgctgtttctgctgacgtcgctccagccgtaacagaggagaacggctatggcgacgtcaaacctggcggcagcgcaaaagatg

SEQ ID NO: 40468 - DNA, 103 bp, Artificial Sequence
  Synthetic Polynucleotide
taatacgactcactatagggctcgactgcgttagtcctaagaggcacaaaaacagaggagatttgtgatgcttaggactaacctggcggcagcgcaaaagatg

SEQ ID NO: 40469 - DNA, 103 bp, Artificial Sequence
  Synthetic Polynucleotide
taatacgactcactataggggttgaggcctctacgctccaacaactcgtcaacagaggagagacgagatgttggagcgtaacctggcggcagcgcaaaagatg

SEQ ID NO: 40470 - DNA, 103 bp, Artificial Sequence
  Synthetic Polynucleotide
taatacgactcactatagggcgtacgtcctgaagtccaaatgcatgtagcaacagaggagagctacaatgatttggactaacctggcggcagcgcaaaagatg

SEQ ID NO: 40471 - DNA, 103 bp, Artificial Sequence
  Synthetic Polynucleotide
taatacgactcactatagggcgcccccaattacaccgcgcgccctttataaacagaggagatataaaatgcgcgcggtgaacctggcggcagcgcaaaagatg

SEQ ID NO: 40472 - DNA, 103 bp, Artificial Sequence
  Synthetic Polynucleotide
taatacgactcactatagggggaccgagctatctctggattcagcacgaaaacagaggagattcgtgatgaatccagagaacctggcggcagcgcaaaagatg

SEQ ID NO: 40473 - DNA, 103 bp, Artificial Sequence
  Synthetic Polynucleotide
taatacgactcactatagggacgactctacacatgtgccaatacaggcaaaacagaggagattgcctatgttggcacataacctggcggcagcgcaaaagatg

SEQ ID NO: 40474 - DNA, 103 bp, Artificial Sequence
  Synthetic Polynucleotide
taatacgactcactatagggaggaagacaaaaagctgtcggcacaacataaacagaggagatatgttatgccgacagctaacctggcggcagcgcaaaagatg

SEQ ID NO: 40475 - DNA, 103 bp, Artificial Sequence
  Synthetic Polynucleotide
taatacgactcactatagggtacactctcaccggcttatgggaggcgaataacagaggagaattcgcatgccataagccaacctggcggcagcgcaaaagatg

SEQ ID NO: 40476 - DNA, 103 bp, Artificial Sequence
  Synthetic Polynucleotide
taatacgactcactataggggttgaccgaatatgcaattaggtcgaacgaaacagaggagatcgttcatgctaattgcaaacctggcggcagcgcaaaagatg

SEQ ID NO: 40477 - DNA, 103 bp, Artificial Sequence
  Synthetic Polynucleotide
taatacgactcactatagggccaccttcgccgattaaggaactccgtaagaacagaggagacttacgatgttccttaataacctggcggcagcgcaaaagatg

SEQ ID NO: 40478 - DNA, 103 bp, Artificial Sequence
  Synthetic Polynucleotide
taatacgactcactataggggagttccgtgaaatgtgtaaggcattctggaacagaggagaccagaaatgcttacacataacctggcggcagcgcaaaagatg

SEQ ID NO: 40479 - DNA, 103 bp, Artificial Sequence
  Synthetic Polynucleotide
taatacgactcactataggggtcagccagcggtttgaaacctggattgccaacagaggagaggcaatatgggtttcaaaaacctggcggcagcgcaaaagatg

SEQ ID NO: 40480 - DNA, 103 bp, Artificial Sequence
  Synthetic Polynucleotide
taatacgactcactatagggggaagcgccgcgaattctatatgactcctcaacagaggagagaggagatgtatagaattaacctggcggcagcgcaaaagatg

SEQ ID NO: 40481 - DNA, 103 bp, Artificial Sequence
  Synthetic Polynucleotide
taatacgactcactataggggcctaagataagatccgtacaggtgtgtcgaacagaggagacgacacatgtgtacggataacctggcggcagcgcaaaagatg

SEQ ID NO: 40482 - DNA, 103 bp, Artificial Sequence
  Synthetic Polynucleotide
taatacgactcactatagggtgtgcccagtttctccaactgatcgcaattaacagaggagaaattgcatgcagttggagaacctggcggcagcgcaaaagatg

SEQ ID NO: 40483 - DNA, 103 bp, Artificial Sequence
  Synthetic Polynucleotide
taatacgactcactataggggaaagttgcgtactcaacgttgatcgataaaacagaggagattatcgatgaacgttgagaacctggcggcagcgcaaaagatg

SEQ ID NO: 40484 - DNA, 103 bp, Artificial Sequence
  Synthetic Polynucleotide
taatacgactcactatagggattgacactctgatgtgggtgtgacgcttaaacagaggagataagcgatgcacccacataacctggcggcagcgcaaaagatg

SEQ ID NO: 40485 - DNA, 103 bp, Artificial Sequence
  Synthetic Polynucleotide
taatacgactcactataggggttggataagccacacatcaaccatacccgaacagaggagacgggtaatgttgatgtgtaacctggcggcagcgcaaaagatg

SEQ ID NO: 40486 - DNA, 103 bp, Artificial Sequence
  Synthetic Polynucleotide
taatacgactcactataggggtaaccgttatggagggcgggtcaataaggaacagaggagaccttatatgcccgccctcaacctggcggcagcgcaaaagatg

SEQ ID NO: 40487 - DNA, 103 bp, Artificial Sequence
  Synthetic Polynucleotide
taatacgactcactatagggaacaaaatcgcttgcgttccaggattgggtaacagaggagaacccaaatgtggaacgcaaacctggcggcagcgcaaaagatg

SEQ ID NO: 40488 - DNA, 103 bp, Artificial Sequence
  Synthetic Polynucleotide
taatacgactcactataggggcaaacggcaattagtcgggagacgtgtagaacagaggagactacacatgtcccgactaaacctggcggcagcgcaaaagatg

SEQ ID NO: 40489 - DNA, 103 bp, Artificial Sequence
  Synthetic Polynucleotide
taatacgactcactataggggcttaggactagaaatcgccttgatggtgtaacagaggagaacaccaatgaggcgatttaacctggcggcagcgcaaaagatg

SEQ ID NO: 40490 - DNA, 103 bp, Artificial Sequence
  Synthetic Polynucleotide
taatacgactcactatagggaagctgctcactacaatcgagagctcacgcaacagaggagagcgtgaatgctcgattgtaacctggcggcagcgcaaaagatg

SEQ ID NO: 40491 - DNA, 103 bp, Artificial Sequence
  Synthetic Polynucleotide
taatacgactcactatagggttcttccagctgagttcccacttcgcgtcaaacagaggagatgacgcatggtgggaactaacctggcggcagcgcaaaagatg

SEQ ID NO: 40492 - DNA, 103 bp, Artificial Sequence
  Synthetic Polynucleotide
taatacgactcactatagggctatgggaatccgttagtccaacacacggcaacagaggagagccgtgatgtggactaacaacctggcggcagcgcaaaagatg

SEQ ID NO: 40493 - DNA, 103 bp, Artificial Sequence
  Synthetic Polynucleotide
taatacgactcactatagggtatatgccctctagttcgctttccactccgaacagaggagacggagtatgaagcgaactaacctggcggcagcgcaaaagatg

SEQ ID NO: 40494 - DNA, 103 bp, Artificial Sequence
  Synthetic Polynucleotide
taatacgactcactataggggtgcattcaatccttaaatgttccgtacataacagaggagaatgtacatgacatttaagaacctggcggcagcgcaaaagatg

SEQ ID NO: 40495 - DNA, 103 bp, Artificial Sequence
  Synthetic Polynucleotide
taatacgactcactatagggggtaagtatgtaagccagcatttgtttgaaaacagaggagattcaaaatgatgctggctaacctggcggcagcgcaaaagatg

SEQ ID NO: 40496 - DNA, 103 bp, Artificial Sequence
  Synthetic Polynucleotide
taatacgactcactatagggagctctccttaaccgaacgagggtagtggaaacagaggagatccactatgctcgttcggaacctggcggcagcgcaaaagatg

SEQ ID NO: 40497 - DNA, 103 bp, Artificial Sequence
  Synthetic Polynucleotide
taatacgactcactatagggtgggcacaacagggatagtctagccacctgaacagaggagacaggtgatgagactatccaacctggcggcagcgcaaaagatg

SEQ ID NO: 40498 - DNA, 103 bp, Artificial Sequence
  Synthetic Polynucleotide
taatacgactcactatagggtaagcgcatattacaacatctagttgtccgaacagaggagacggacaatgagatgttgtaacctggcggcagcgcaaaagatg

SEQ ID NO: 40499 - DNA, 103 bp, Artificial Sequence
  Synthetic Polynucleotide
taatacgactcactatagggccgtcgtcgtatggggtaggttgccagctgaacagaggagacagctgatgacctaccccaacctggcggcagcgcaaaagatg

SEQ ID NO: 40500 - DNA, 103 bp, Artificial Sequence
  Synthetic Polynucleotide
taatacgactcactatagggcttctcgcttcagaagaccgtccatatcataacagaggagaatgataatgacggtcttcaacctggcggcagcgcaaaagatg

SEQ ID NO: 40501 - DNA, 103 bp, Artificial Sequence
  Synthetic Polynucleotide
taatacgactcactatagggggtatcccatctcgagatcggctaggtgtgaacagaggagacacaccatgccgatctcgaacctggcggcagcgcaaaagatg

SEQ ID NO: 40502 - DNA, 103 bp, Artificial Sequence
  Synthetic Polynucleotide
taatacgactcactatagggttagctccccacagatcgagactctgattcaacagaggagagaatcaatgtctcgatctaacctggcggcagcgcaaaagatg

SEQ ID NO: 40503 - DNA, 103 bp, Artificial Sequence
  Synthetic Polynucleotide
taatacgactcactatagggctatgcgtgtaggagttgccaaggcgtattaacagaggagaaatacgatgtggcaactcaacctggcggcagcgcaaaagatg

SEQ ID NO: 40504 - DNA, 103 bp, Artificial Sequence
  Synthetic Polynucleotide
taatacgactcactataggggacaagatactcggagtcatccatccggggaacagaggagaccccggatggatgactccaacctggcggcagcgcaaaagatg

SEQ ID NO: 40505 - DNA, 103 bp, Artificial Sequence
  Synthetic Polynucleotide
taatacgactcactatagggagcgctcactctggtgaagtatagatcaataacagaggagaattgatatgtacttcaccaacctggcggcagcgcaaaagatg

SEQ ID NO: 40506 - DNA, 103 bp, Artificial Sequence
  Synthetic Polynucleotide
taatacgactcactatagggcggttggagggcgccggcgggtcatcagggaacagaggagaccctgaatgcccgccggcaacctggcggcagcgcaaaagatg

SEQ ID NO: 40507 - DNA, 103 bp, Artificial Sequence
  Synthetic Polynucleotide
taatacgactcactatagggattagggccctacccgcgatcaccacgggcaacagaggagagcccgtatggatcgcgggaacctggcggcagcgcaaaagatg

SEQ ID NO: 40508 - DNA, 103 bp, Artificial Sequence
  Synthetic Polynucleotide
taatacgactcactatagggtcgccttccgggaagtagcgtggagctaggaacagaggagacctagcatgacgctacttaacctggcggcagcgcaaaagatg

SEQ ID NO: 40509 - DNA, 103 bp, Artificial Sequence
  Synthetic Polynucleotide
taatacgactcactatagggccgttttcgccatctcttatccaacgggggaacagaggagacccccgatggataagagaaacctggcggcagcgcaaaagatg

SEQ ID NO: 40510 - DNA, 103 bp, Artificial Sequence
  Synthetic Polynucleotide
taatacgactcactataggggttcccccagggtacaaatacgaggtctcaaacagaggagatgagacatggtatttgtaaacctggcggcagcgcaaaagatg

SEQ ID NO: 40511 - DNA, 103 bp, Artificial Sequence
  Synthetic Polynucleotide
taatacgactcactatagggcattgaacaagtgcggcacggcgcgactcgaacagaggagacgagtcatgccgtgccgcaacctggcggcagcgcaaaagatg

SEQ ID NO: 40512 - DNA, 103 bp, Artificial Sequence
  Synthetic Polynucleotide
taatacgactcactatagggtgggacggagaagaatagtacttaacgttaaacagaggagataacgtatggtactattcaacctggcggcagcgcaaaagatg

SEQ ID NO: 40513 - DNA, 103 bp, Artificial Sequence
  Synthetic Polynucleotide
taatacgactcactatagggttactcagccaattagcagggttccagggtaacagaggagaaccctgatgccctgctaaaacctggcggcagcgcaaaagatg

SEQ ID NO: 40514 - DNA, 103 bp, Artificial Sequence
  Synthetic Polynucleotide
taatacgactcactatagggaacacgagatgaccaggaatcgtagtcggtaacagaggagaaccgacatggattcctggaacctggcggcagcgcaaaagatg

SEQ ID NO: 40515 - DNA, 103 bp, Artificial Sequence
  Synthetic Polynucleotide
taatacgactcactataggggactgttctgagaagactttcttgagtcgtaacagaggagaacgactatggaaagtcttaacctggcggcagcgcaaaagatg

SEQ ID NO: 40516 - DNA, 103 bp, Artificial Sequence
  Synthetic Polynucleotide
taatacgactcactatagggactgaatggcaaccaaaaaatctatcttttaacagaggagaaaaagaatgattttttggaacctggcggcagcgcaaaagatg

SEQ ID NO: 40517 - DNA, 103 bp, Artificial Sequence
  Synthetic Polynucleotide
taatacgactcactataggggggttcaatgaaagtagatgctggggtgttaacagaggagaaacaccatggcatctactaacctggcggcagcgcaaaagatg

SEQ ID NO: 40518 - DNA, 103 bp, Artificial Sequence
  Synthetic Polynucleotide
taatacgactcactataggggaccagaaggttcgtgagtgagcttctcgtaacagaggagaacgagaatgtcactcacgaacctggcggcagcgcaaaagatg

SEQ ID NO: 40519 - DNA, 103 bp, Artificial Sequence
  Synthetic Polynucleotide
taatacgactcactatagggacgcatgacaaagaaagtgtgcaggagcctaacagaggagaaggctcatgcacactttcaacctggcggcagcgcaaaagatg

SEQ ID NO: 40520 - DNA, 103 bp, Artificial Sequence
  Synthetic Polynucleotide
taatacgactcactatagggcttccgatttctggcatggggtcatgattgaacagaggagacaatcaatgccccatgccaacctggcggcagcgcaaaagatg

SEQ ID NO: 40521 - DNA, 103 bp, Artificial Sequence
  Synthetic Polynucleotide
taatacgactcactatagggtttcgtcctgcagacttagcacatacatacaacagaggagagtatgtatgtgctaagtcaacctggcggcagcgcaaaagatg

SEQ ID NO: 40522 - DNA, 103 bp, Artificial Sequence
  Synthetic Polynucleotide
taatacgactcactatagggagcagatgctcctttttctgggtcgcgtccaacagaggagaggacgcatgccagaaaaaaacctggcggcagcgcaaaagatg

SEQ ID NO: 40523 - DNA, 103 bp, Artificial Sequence
  Synthetic Polynucleotide
taatacgactcactatagggacaacgactacactggctggaagttctagcaacagaggagagctagaatgtccagccagaacctggcggcagcgcaaaagatg

SEQ ID NO: 40524 - DNA, 103 bp, Artificial Sequence
  Synthetic Polynucleotide
taatacgactcactataggggtacggtggagtatagaacgagtcactggtaacagaggagaaccagtatgtcgttctataacctggcggcagcgcaaaagatg

SEQ ID NO: 40525 - DNA, 103 bp, Artificial Sequence
  Synthetic Polynucleotide
taatacgactcactatagggccatgagtattagcgaaagtgacacataataacagaggagaattatgatgcactttcgcaacctggcggcagcgcaaaagatg

SEQ ID NO: 40526 - DNA, 103 bp, Artificial Sequence
  Synthetic Polynucleotide
taatacgactcactatagggggcgctactctccctaggatctcactaaagaacagaggagactttagatggatcctaggaacctggcggcagcgcaaaagatg

SEQ ID NO: 40527 - DNA, 103 bp, Artificial Sequence
  Synthetic Polynucleotide
taatacgactcactatagggctttgacgctccgctaaggagctagccggaaacagaggagatccggcatgctccttagcaacctggcggcagcgcaaaagatg

SEQ ID NO: 40528 - DNA, 103 bp, Artificial Sequence
  Synthetic Polynucleotide
taatacgactcactatagggccaagcaatttctcgttctggtatggcaacaacagaggagagttgccatgccagaacgaaacctggcggcagcgcaaaagatg

SEQ ID NO: 40529 - DNA, 103 bp, Artificial Sequence
  Synthetic Polynucleotide
taatacgactcactatagggggcgttcctcctcaagtaaacatagcccaaaacagaggagattgggcatggtttacttgaacctggcggcagcgcaaaagatg

SEQ ID NO: 40530 - DNA, 103 bp, Artificial Sequence
  Synthetic Polynucleotide
taatacgactcactatagggcaagcagactgcaggacggccctgccattaaacagaggagataatggatgggccgtcctaacctggcggcagcgcaaaagatg

SEQ ID NO: 40531 - DNA, 103 bp, Artificial Sequence
  Synthetic Polynucleotide
taatacgactcactatagggaaagatctgtgcactagtaccgcagttatcaacagaggagagataacatgggtactagtaacctggcggcagcgcaaaagatg

SEQ ID NO: 40532 - DNA, 103 bp, Artificial Sequence
  Synthetic Polynucleotide
taatacgactcactatagggggctcgcagttccgggtatacgcccacacgaacagaggagacgtgtgatggtatacccgaacctggcggcagcgcaaaagatg

SEQ ID NO: 40533 - DNA, 103 bp, Artificial Sequence
  Synthetic Polynucleotide
taatacgactcactatagggaccccacacaacattgtagacacaagacctaacagaggagaaggtctatggtctacaataacctggcggcagcgcaaaagatg

SEQ ID NO: 40534 - DNA, 103 bp, Artificial Sequence
  Synthetic Polynucleotide
taatacgactcactataggggatcagaccatgatcctgtgcgaatttaaaaacagaggagatttaaaatggcacaggataacctggcggcagcgcaaaagatg

SEQ ID NO: 40535 - DNA, 103 bp, Artificial Sequence
  Synthetic Polynucleotide
taatacgactcactatagggccgaccttatggtatatacgcggaaactgtaacagaggagaacagttatggcgtatataaacctggcggcagcgcaaaagatg

SEQ ID NO: 40536 - DNA, 103 bp, Artificial Sequence
  Synthetic Polynucleotide
taatacgactcactataggggggtcggttgttggataaccagcagatgccaacagaggagaggcatcatgtggttatccaacctggcggcagcgcaaaagatg

SEQ ID NO: 40537 - DNA, 103 bp, Artificial Sequence
  Synthetic Polynucleotide
taatacgactcactatagggcaagtcgggatttgtcttaaggattggagtaacagaggagaactccaatgcttaagacaaacctggcggcagcgcaaaagatg

SEQ ID NO: 40538 - DNA, 103 bp, Artificial Sequence
  Synthetic Polynucleotide
taatacgactcactatagggaacaggtgcagctcttaccacgagtctatgaacagaggagacatagaatggtggtaagaaacctggcggcagcgcaaaagatg

SEQ ID NO: 40539 - DNA, 103 bp, Artificial Sequence
  Synthetic Polynucleotide
taatacgactcactatagggtatcacgttactgacagattagtcagggggaacagaggagaccccctatgtaatctgtcaacctggcggcagcgcaaaagatg

SEQ ID NO: 40540 - DNA, 103 bp, Artificial Sequence
  Synthetic Polynucleotide
taatacgactcactatagggcggctccaacgcaagtcgtaagctggcgccaacagaggagaggcgccatgttacgacttaacctggcggcagcgcaaaagatg

SEQ ID NO: 40541 - DNA, 103 bp, Artificial Sequence
  Synthetic Polynucleotide
taatacgactcactatagggacatagtcgggccgttacaaactagtccgcaacagaggagagcggacatgtttgtaacgaacctggcggcagcgcaaaagatg

SEQ ID NO: 40542 - DNA, 103 bp, Artificial Sequence
  Synthetic Polynucleotide
taatacgactcactatagggaatagatgttacatgtggggagcgacaaacaacagaggagagtttgtatgtccccacataacctggcggcagcgcaaaagatg

SEQ ID NO: 40543 - DNA, 103 bp, Artificial Sequence
  Synthetic Polynucleotide
taatacgactcactatagggctgtacccatagttagcttgccctgacttgaacagaggagacaagtcatggcaagctaaaacctggcggcagcgcaaaagatg

SEQ ID NO: 40544 - DNA, 103 bp, Artificial Sequence
  Synthetic Polynucleotide
taatacgactcactatagggaccagtcataactacgctaggggttcggggaacagaggagaccccgaatgcctagcgtaaacctggcggcagcgcaaaagatg

SEQ ID NO: 40545 - DNA, 103 bp, Artificial Sequence
  Synthetic Polynucleotide
taatacgactcactatagggttcgaagttactgagctgacacagccccataacagaggagaatggggatgtgtcagctcaacctggcggcagcgcaaaagatg

SEQ ID NO: 40546 - DNA, 103 bp, Artificial Sequence
  Synthetic Polynucleotide
taatacgactcactatagggtctagttacccccgctttatacctgcatagaacagaggagactatgcatgtataaagcgaacctggcggcagcgcaaaagatg

SEQ ID NO: 40547 - DNA, 103 bp, Artificial Sequence
  Synthetic Polynucleotide
taatacgactcactatagggctagtagatactatagtgtaacagtacctgaacagaggagacaggtaatgttacactataacctggcggcagcgcaaaagatg

SEQ ID NO: 40548 - DNA, 103 bp, Artificial Sequence
  Synthetic Polynucleotide
taatacgactcactataggggagagttcactctatacaggcgactttggtaacagaggagaaccaaaatggcctgtataaacctggcggcagcgcaaaagatg

SEQ ID NO: 40549 - DNA, 103 bp, Artificial Sequence
  Synthetic Polynucleotide
taatacgactcactatagggtagtctcgcggcaatcccccagcagggtgaaacagaggagatcacccatgtgggggattaacctggcggcagcgcaaaagatg

SEQ ID NO: 40550 - DNA, 103 bp, Artificial Sequence
  Synthetic Polynucleotide
taatacgactcactatagggatgagagtgggatccgaaggccgatccgtcaacagaggagagacggaatggccttcggaaacctggcggcagcgcaaaagatg

SEQ ID NO: 40551 - DNA, 103 bp, Artificial Sequence
  Synthetic Polynucleotide
taatacgactcactataggggatgatatttcatagattcggataatgacaaacagaggagatgtcatatgccgaatctaaacctggcggcagcgcaaaagatg

SEQ ID NO: 40552 - DNA, 103 bp, Artificial Sequence
  Synthetic Polynucleotide
taatacgactcactatagggttcctgcattcctataactacgagcgcaccaacagaggagaggtgcgatggtagttataaacctggcggcagcgcaaaagatg

SEQ ID NO: 40553 - DNA, 103 bp, Artificial Sequence
  Synthetic Polynucleotide
taatacgactcactatagggaaaggtcactctgagggtcacttggccgtgaacagaggagacacggcatggtgaccctcaacctggcggcagcgcaaaagatg

SEQ ID NO: 40554 - DNA, 103 bp, Artificial Sequence
  Synthetic Polynucleotide
taatacgactcactatagggggcgtttatgttattagcgttactcctctgaacagaggagacagaggatgaacgctaataacctggcggcagcgcaaaagatg

SEQ ID NO: 40555 - DNA, 103 bp, Artificial Sequence
  Synthetic Polynucleotide
taatacgactcactatagggccgtgcttctatcgcaaacgcgagttcgtaaacagaggagatacgaaatggcgtttgcgaacctggcggcagcgcaaaagatg

SEQ ID NO: 40556 - DNA, 103 bp, Artificial Sequence
  Synthetic Polynucleotide
taatacgactcactataggggcatttacgcccggctcgaaatgaagatccaacagaggagaggatctatgtttcgagccaacctggcggcagcgcaaaagatg

SEQ ID NO: 40557 - DNA, 103 bp, Artificial Sequence
  Synthetic Polynucleotide
taatacgactcactatagggtaccgtggtggttacgaaaggttaatcgctaacagaggagaagcgatatgcctttcgtaaacctggcggcagcgcaaaagatg

SEQ ID NO: 40558 - DNA, 103 bp, Artificial Sequence
  Synthetic Polynucleotide
taatacgactcactatagggggactggggagcctttgttctaagaattgtaacagaggagaacaattatgagaacaaagaacctggcggcagcgcaaaagatg

SEQ ID NO: 40559 - DNA, 103 bp, Artificial Sequence
  Synthetic Polynucleotide
taatacgactcactataggggctattcgtgattaacgaggtgatgtatcgaacagaggagacgatacatgacctcgttaaacctggcggcagcgcaaaagatg

SEQ ID NO: 40560 - DNA, 103 bp, Artificial Sequence
  Synthetic Polynucleotide
taatacgactcactatagggattacgtcgtcgacgatgaactgcttatataacagaggagaatataaatggttcatcgtaacctggcggcagcgcaaaagatg

SEQ ID NO: 40561 - DNA, 103 bp, Artificial Sequence
  Synthetic Polynucleotide
taatacgactcactatagggtaggcccgactattacagaccttttctctgaacagaggagacagagaatgggtctgtaaaacctggcggcagcgcaaaagatg

SEQ ID NO: 40562 - DNA, 103 bp, Artificial Sequence
  Synthetic Polynucleotide
taatacgactcactataggggataatactgggcgcttgagggagataccgaacagaggagacggtatatgcctcaagcgaacctggcggcagcgcaaaagatg

SEQ ID NO: 40563 - DNA, 103 bp, Artificial Sequence
  Synthetic Polynucleotide
taatacgactcactatagggtagcgttaaaatctagaagttatctttgccaacagaggagaggcaaaatgaacttctagaacctggcggcagcgcaaaagatg

SEQ ID NO: 40564 - DNA, 103 bp, Artificial Sequence
  Synthetic Polynucleotide
taatacgactcactataggggacacgtcgcgatcctccggggccggccgcaacagaggagagcggccatgcccggaggaaacctggcggcagcgcaaaagatg

SEQ ID NO: 40565 - DNA, 103 bp, Artificial Sequence
  Synthetic Polynucleotide
taatacgactcactataggggctacctatctacgtctggcaaaccatcctaacagaggagaaggatgatgtgccagacgaacctggcggcagcgcaaaagatg

SEQ ID NO: 40566 - DNA, 103 bp, Artificial Sequence
  Synthetic Polynucleotide
taatacgactcactatagggcagttccctcagataagattgggcgcccaaaacagaggagattgggcatgcaatcttataacctggcggcagcgcaaaagatg

SEQ ID NO: 40567 - DNA, 103 bp, Artificial Sequence
  Synthetic Polynucleotide
taatacgactcactatagggaaataactcgcgtttcttgtttgttaatagaacagaggagactattaatgaacaagaaaaacctggcggcagcgcaaaagatg

SEQ ID NO: 40568 - DNA, 103 bp, Artificial Sequence
  Synthetic Polynucleotide
taatacgactcactatagggggaggtgtttacggacgtgatgcagaaattaacagaggagaaatttcatgatcacgtccaacctggcggcagcgcaaaagatg

SEQ ID NO: 40569 - DNA, 103 bp, Artificial Sequence
  Synthetic Polynucleotide
taatacgactcactatagggcgtaaaggttttctatcgcgaatgagtcgcaacagaggagagcgactatgtcgcgatagaacctggcggcagcgcaaaagatg

SEQ ID NO: 40570 - DNA, 103 bp, Artificial Sequence
  Synthetic Polynucleotide
taatacgactcactatagggtgggatgaacgcggtccgctcctggtgtccaacagaggagaggacacatggagcggaccaacctggcggcagcgcaaaagatg

SEQ ID NO: 40571 - DNA, 103 bp, Artificial Sequence
  Synthetic Polynucleotide
taatacgactcactatagggtacaccttagggtcagaacagaaagatcccaacagaggagagggatcatgctgttctgaaacctggcggcagcgcaaaagatg

SEQ ID NO: 40572 - DNA, 103 bp, Artificial Sequence
  Synthetic Polynucleotide
taatacgactcactataggggtaggaaatagttgccagtgtacacggtggaacagaggagaccaccgatgacactggcaaacctggcggcagcgcaaaagatg

SEQ ID NO: 40573 - DNA, 103 bp, Artificial Sequence
  Synthetic Polynucleotide
taatacgactcactatagggtacaaatcagggtcacgggttgcattagtcaacagaggagagactaaatgaacccgtgaaacctggcggcagcgcaaaagatg

SEQ ID NO: 40574 - DNA, 103 bp, Artificial Sequence
  Synthetic Polynucleotide
taatacgactcactatagggatttgagtggcttcgtgtgacggagccatgaacagaggagacatggcatggtcacacgaaacctggcggcagcgcaaaagatg

SEQ ID NO: 40575 - DNA, 103 bp, Artificial Sequence
  Synthetic Polynucleotide
taatacgactcactataggggacagtgaagtgccaatcgctgaactacgcaacagaggagagcgtagatgagcgattggaacctggcggcagcgcaaaagatg

SEQ ID NO: 40576 - DNA, 103 bp, Artificial Sequence
  Synthetic Polynucleotide
taatacgactcactatagggcgcaatgctccccatgttcgaaagcggggcaacagaggagagccccgatgtcgaacatgaacctggcggcagcgcaaaagatg

SEQ ID NO: 40577 - DNA, 103 bp, Artificial Sequence
  Synthetic Polynucleotide
taatacgactcactatagggcctttggtgagcccccaccggggacgctgcaacagaggagagcagcgatgccggtggggaacctggcggcagcgcaaaagatg

SEQ ID NO: 40578 - DNA, 103 bp, Artificial Sequence
  Synthetic Polynucleotide
taatacgactcactatagggctgtcatttacgcgatgcctctgacaaaccaacagaggagaggtttgatggaggcatcgaacctggcggcagcgcaaaagatg

SEQ ID NO: 40579 - DNA, 103 bp, Artificial Sequence
  Synthetic Polynucleotide
taatacgactcactatagggagagtagacacgttattggacgtccttcagaacagaggagactgaagatggtccaataaaacctggcggcagcgcaaaagatg

SEQ ID NO: 40580 - DNA, 103 bp, Artificial Sequence
  Synthetic Polynucleotide
taatacgactcactataggggttggtttttttagtcagggccgagcgacgaacagaggagacgtcgcatggccctgactaacctggcggcagcgcaaaagatg

SEQ ID NO: 40581 - DNA, 103 bp, Artificial Sequence
  Synthetic Polynucleotide
taatacgactcactatagggaaaactctagcatcgtcccgtttggatcttaacagaggagaaagatcatgacgggacgaaacctggcggcagcgcaaaagatg

SEQ ID NO: 40582 - DNA, 103 bp, Artificial Sequence
  Synthetic Polynucleotide
taatacgactcactatagggaattcgcgacatttcgagtctgtatcaacgaacagaggagacgttgaatgagactcgaaaacctggcggcagcgcaaaagatg

SEQ ID NO: 40583 - DNA, 103 bp, Artificial Sequence
  Synthetic Polynucleotide
taatacgactcactatagggttgtattaagctgctaatctctccttgcaaaacagaggagattgcaaatggagattagcaacctggcggcagcgcaaaagatg

SEQ ID NO: 40584 - DNA, 103 bp, Artificial Sequence
  Synthetic Polynucleotide
taatacgactcactatagggtaaaaatccctatgcatgtaatactactccaacagaggagaggagtaatgttacatgcaaacctggcggcagcgcaaaagatg

SEQ ID NO: 40585 - DNA, 103 bp, Artificial Sequence
  Synthetic Polynucleotide
taatacgactcactatagggttcccttgcaatgtgacctataggatctacaacagaggagagtagatatgataggtcacaacctggcggcagcgcaaaagatg

SEQ ID NO: 40586 - DNA, 103 bp, Artificial Sequence
  Synthetic Polynucleotide
taatacgactcactataggggccattttagttataagtcctcacctctgtaacagaggagaacagagatgaggacttataacctggcggcagcgcaaaagatg

SEQ ID NO: 40587 - DNA, 103 bp, Artificial Sequence
  Synthetic Polynucleotide
taatacgactcactatagggatataaccctatgctttctcacctcttaaaaacagaggagatttaagatgtgagaaagcaacctggcggcagcgcaaaagatg

SEQ ID NO: 40588 - DNA, 103 bp, Artificial Sequence
  Synthetic Polynucleotide
taatacgactcactatagggtaagtaaggctaggataaagctgacagtcgaacagaggagacgactgatggctttatccaacctggcggcagcgcaaaagatg

SEQ ID NO: 40589 - DNA, 103 bp, Artificial Sequence
  Synthetic Polynucleotide
taatacgactcactataggggaagcagtatgtcgcaagtcttcactttgaaacagaggagatcaaagatgagacttgcgaacctggcggcagcgcaaaagatg

SEQ ID NO: 40590 - DNA, 103 bp, Artificial Sequence
  Synthetic Polynucleotide
taatacgactcactatagggacacttagaactgttgactcctccgctaacaacagaggagagttagcatgggagtcaacaacctggcggcagcgcaaaagatg

SEQ ID NO: 40591 - DNA, 103 bp, Artificial Sequence
  Synthetic Polynucleotide
taatacgactcactatagggttgttgcgtcgagctgtagtatgagctggaaacagaggagatccagcatgtactacagcaacctggcggcagcgcaaaagatg

SEQ ID NO: 40592 - DNA, 103 bp, Artificial Sequence
  Synthetic Polynucleotide
taatacgactcactataggggttcggggacgaggacacaaccgggactgcaacagaggagagcagtcatggttgtgtccaacctggcggcagcgcaaaagatg

SEQ ID NO: 40593 - DNA, 103 bp, Artificial Sequence
  Synthetic Polynucleotide
taatacgactcactatagggcctatcgacttctagaacctgcagattctcaacagaggagagagaatatgcaggttctaaacctggcggcagcgcaaaagatg

SEQ ID NO: 40594 - DNA, 103 bp, Artificial Sequence
  Synthetic Polynucleotide
taatacgactcactatagggacactccatacggctcggatacaggcaattaacagaggagaaattgcatgtatccgagcaacctggcggcagcgcaaaagatg

SEQ ID NO: 40595 - DNA, 103 bp, Artificial Sequence
  Synthetic Polynucleotide
taatacgactcactataggggacgacgtatggagtcgacaacacctttttaacagaggagaaaaaagatgttgtcgactaacctggcggcagcgcaaaagatg

SEQ ID NO: 40596 - DNA, 103 bp, Artificial Sequence
  Synthetic Polynucleotide
taatacgactcactatagggcgctctccggccacgtaatactgcggactaaacagaggagatagtccatggtattacgtaacctggcggcagcgcaaaagatg

SEQ ID NO: 40597 - DNA, 103 bp, Artificial Sequence
  Synthetic Polynucleotide
taatacgactcactatagggactgaacgagagttgagcctacggaattagaacagaggagactaattatgtaggctcaaaacctggcggcagcgcaaaagatg

SEQ ID NO: 40598 - DNA, 103 bp, Artificial Sequence
  Synthetic Polynucleotide
taatacgactcactatagggtgctgggaagagactcttcattgcttccgtaacagaggagaacggaaatgatgaagagtaacctggcggcagcgcaaaagatg

SEQ ID NO: 40599 - DNA, 103 bp, Artificial Sequence
  Synthetic Polynucleotide
taatacgactcactatagggagcttttgtaaaactatcatgagagcttataacagaggagaataagcatgcatgatagtaacctggcggcagcgcaaaagatg

SEQ ID NO: 40600 - DNA, 103 bp, Artificial Sequence
  Synthetic Polynucleotide
taatacgactcactatagggcttacctttgggtactgtactcaagtagacaacagaggagagtctacatgagtacagtaaacctggcggcagcgcaaaagatg

SEQ ID NO: 40601 - DNA, 103 bp, Artificial Sequence
  Synthetic Polynucleotide
taatacgactcactatagggctcttttgatgggcgtagtcgagttaagacaacagaggagagtcttaatgcgactacgcaacctggcggcagcgcaaaagatg

SEQ ID NO: 40602 - DNA, 103 bp, Artificial Sequence
  Synthetic Polynucleotide
taatacgactcactataggggcctgtaagattcgaggacctggggggcttaacagaggagaaagcccatgaggtcctcgaacctggcggcagcgcaaaagatg

SEQ ID NO: 40603 - DNA, 103 bp, Artificial Sequence
  Synthetic Polynucleotide
taatacgactcactatagggtacgtcttattagggtcgagcgggcctcctaacagaggagaaggaggatggctcgacccaacctggcggcagcgcaaaagatg

SEQ ID NO: 40604 - DNA, 103 bp, Artificial Sequence
  Synthetic Polynucleotide
taatacgactcactatagggagggatctaagaggtttaatctctccctaaaacagaggagattagggatggattaaaccaacctggcggcagcgcaaaagatg

SEQ ID NO: 40605 - DNA, 103 bp, Artificial Sequence
  Synthetic Polynucleotide
taatacgactcactatagggaccacttgtaaatcttgacagtcatcaaaaaacagaggagattttgaatgctgtcaagaaacctggcggcagcgcaaaagatg

SEQ ID NO: 40606 - DNA, 103 bp, Artificial Sequence
  Synthetic Polynucleotide
taatacgactcactatagggtccggagtaatatatacaattgtccccgaaaacagaggagattcgggatgaattgtataaacctggcggcagcgcaaaagatg

SEQ ID NO: 40607 - DNA, 103 bp, Artificial Sequence
  Synthetic Polynucleotide
taatacgactcactataggggttagactatttcctaatacactaccccccaacagaggagaggggggatgtgtattaggaacctggcggcagcgcaaaagatg

SEQ ID NO: 40608 - DNA, 103 bp, Artificial Sequence
  Synthetic Polynucleotide
taatacgactcactatagggggacctttttacggacacacatcacacgcaaacagaggagatgcgtgatgtgtgtgtccaacctggcggcagcgcaaaagatg

SEQ ID NO: 40609 - DNA, 103 bp, Artificial Sequence
  Synthetic Polynucleotide
taatacgactcactatagggccatcaatttctcggctgattacataggttaacagaggagaaacctaatgaatcagccgaacctggcggcagcgcaaaagatg

SEQ ID NO: 40610 - DNA, 103 bp, Artificial Sequence
  Synthetic Polynucleotide
taatacgactcactatagggaatataacgtacaaacctcgtcagcgcgttaacagaggagaaacgcgatgacgaggtttaacctggcggcagcgcaaaagatg

SEQ ID NO: 40611 - DNA, 103 bp, Artificial Sequence
  Synthetic Polynucleotide
taatacgactcactatagggacacagcatgggcttgaaccgaggcaggcaaacagaggagatgcctgatgcggttcaagaacctggcggcagcgcaaaagatg

SEQ ID NO: 40612 - DNA, 103 bp, Artificial Sequence
  Synthetic Polynucleotide
taatacgactcactatagggtttctctcaaaatgtataaatcgagacgtgaacagaggagacacgtcatgatttatacaaacctggcggcagcgcaaaagatg

SEQ ID NO: 40613 - DNA, 103 bp, Artificial Sequence
  Synthetic Polynucleotide
taatacgactcactataggggcaattgtttctggatgcaacgatgtaaagaacagaggagactttacatggttgcatccaacctggcggcagcgcaaaagatg

SEQ ID NO: 40614 - DNA, 103 bp, Artificial Sequence
  Synthetic Polynucleotide
taatacgactcactataggggatcatagaagtatgcacgtccccgacgctaacagaggagaagcgtcatggacgtgcataacctggcggcagcgcaaaagatg

SEQ ID NO: 40615 - DNA, 103 bp, Artificial Sequence
  Synthetic Polynucleotide
taatacgactcactatagggcgtagacaaaaacccaatgagtatgcggtgaacagaggagacaccgcatgctcattgggaacctggcggcagcgcaaaagatg

SEQ ID NO: 40616 - DNA, 103 bp, Artificial Sequence
  Synthetic Polynucleotide
taatacgactcactatagggtagccattcttatttaacatagtcttctgtaacagaggagaacagaaatgtatgttaaaaacctggcggcagcgcaaaagatg

SEQ ID NO: 40617 - DNA, 103 bp, Artificial Sequence
  Synthetic Polynucleotide
taatacgactcactataggggccgttgacgttgatttatcagacataagcaacagaggagagcttatatgtgataaatcaacctggcggcagcgcaaaagatg

SEQ ID NO: 40618 - DNA, 103 bp, Artificial Sequence
  Synthetic Polynucleotide
taatacgactcactatagggagcaaaatgaatggacctaaagcttatgggaacagaggagacccataatgtttaggtccaacctggcggcagcgcaaaagatg

SEQ ID NO: 40619 - DNA, 103 bp, Artificial Sequence
  Synthetic Polynucleotide
taatacgactcactataggggctgtagcccggctacatataaggtaggcgaacagaggagacgcctaatgtatatgtagaacctggcggcagcgcaaaagatg

SEQ ID NO: 40620 - DNA, 103 bp, Artificial Sequence
  Synthetic Polynucleotide
taatacgactcactatagggatgtttgatctgagtctttttaaaagatataacagaggagaatatctatgaaaaagactaacctggcggcagcgcaaaagatg

SEQ ID NO: 40621 - DNA, 103 bp, Artificial Sequence
  Synthetic Polynucleotide
taatacgactcactatagggattggcaagtcataggccttcgaacagttgaacagaggagacaactgatggaaggcctaaacctggcggcagcgcaaaagatg

SEQ ID NO: 40622 - DNA, 103 bp, Artificial Sequence
  Synthetic Polynucleotide
taatacgactcactatagggtgaggggtataaatatattcggcgatgatgaacagaggagacatcatatgcgaatatataacctggcggcagcgcaaaagatg

SEQ ID NO: 40623 - DNA, 103 bp, Artificial Sequence
  Synthetic Polynucleotide
taatacgactcactataggggtattaggatacatgttagtcaggaacttaaacagaggagataagttatggactaacataacctggcggcagcgcaaaagatg

SEQ ID NO: 40624 - DNA, 103 bp, Artificial Sequence
  Synthetic Polynucleotide
taatacgactcactatagggcgtagtaaccggcaagggggtccttacggaaacagaggagatccgtaatgacccccttgaacctggcggcagcgcaaaagatg

SEQ ID NO: 40625 - DNA, 103 bp, Artificial Sequence
  Synthetic Polynucleotide
taatacgactcactatagggttagcatcgagtaccgccctttttcctcgcaacagaggagagcgaggatgaagggcggtaacctggcggcagcgcaaaagatg

SEQ ID NO: 40626 - DNA, 103 bp, Artificial Sequence
  Synthetic Polynucleotide
taatacgactcactatagggattgaggcggtaaagatagcgtgcgtgccaaacagaggagatggcacatgcgctatcttaacctggcggcagcgcaaaagatg

SEQ ID NO: 40627 - DNA, 103 bp, Artificial Sequence
  Synthetic Polynucleotide
taatacgactcactataggggcagaatgattagagaactgcacagtgttaaacagaggagataacacatggcagttctcaacctggcggcagcgcaaaagatg

SEQ ID NO: 40628 - DNA, 103 bp, Artificial Sequence
  Synthetic Polynucleotide
taatacgactcactatagggttcatcaggcttccagcacagtccaaagttaacagaggagaaactttatgctgtgctggaacctggcggcagcgcaaaagatg

SEQ ID NO: 40629 - DNA, 103 bp, Artificial Sequence
  Synthetic Polynucleotide
taatacgactcactatagggtattcctataatctggccgcgtgaagtgcgaacagaggagacgcactatgcgcggccagaacctggcggcagcgcaaaagatg

SEQ ID NO: 40630 - DNA, 103 bp, Artificial Sequence
  Synthetic Polynucleotide
taatacgactcactatagggtcgctcggtgtcttcttcgactgacggacgaacagaggagacgtccgatggtcgaagaaaacctggcggcagcgcaaaagatg

SEQ ID NO: 40631 - DNA, 103 bp, Artificial Sequence
  Synthetic Polynucleotide
taatacgactcactataggggcttgaccccgtcgtttactcagagggtataacagaggagaatacccatggagtaaacgaacctggcggcagcgcaaaagatg

SEQ ID NO: 40632 - DNA, 103 bp, Artificial Sequence
  Synthetic Polynucleotide
taatacgactcactatagggtatatgcttcgctttttgctgcctgcatttaacagaggagaaaatgcatgcagcaaaaaaacctggcggcagcgcaaaagatg

SEQ ID NO: 40633 - DNA, 103 bp, Artificial Sequence
  Synthetic Polynucleotide
taatacgactcactatagggttaacgttgtgtcggtgtgaagtctgcgtgaacagaggagacacgcaatgttcacaccgaacctggcggcagcgcaaaagatg

SEQ ID NO: 40634 - DNA, 103 bp, Artificial Sequence
  Synthetic Polynucleotide
taatacgactcactatagggagtggctccaatctcttttgtcagcgacataacagaggagaatgtcgatgacaaaagagaacctggcggcagcgcaaaagatg

SEQ ID NO: 40635 - DNA, 103 bp, Artificial Sequence
  Synthetic Polynucleotide
taatacgactcactatagggttagccggaacagcggtcgaggttcttggcaacagaggagagccaagatgctcgaccgcaacctggcggcagcgcaaaagatg

SEQ ID NO: 40636 - DNA, 103 bp, Artificial Sequence
  Synthetic Polynucleotide
taatacgactcactatagggtgaacggataacaccgtgagatggcaaggcaacagaggagagccttgatgtctcacggtaacctggcggcagcgcaaaagatg

SEQ ID NO: 40637 - DNA, 103 bp, Artificial Sequence
  Synthetic Polynucleotide
taatacgactcactatagggcctatcgttacttcccagcgcatataaccgaacagaggagacggttaatggcgctgggaaacctggcggcagcgcaaaagatg

SEQ ID NO: 40638 - DNA, 103 bp, Artificial Sequence
  Synthetic Polynucleotide
taatacgactcactatagggtggtcggtacatataggccctgctacaataaacagaggagatattgtatgagggcctataacctggcggcagcgcaaaagatg

SEQ ID NO: 40639 - DNA, 103 bp, Artificial Sequence
  Synthetic Polynucleotide
taatacgactcactatagggaaaaagtgggtctaactaatgcgtagaaggaacagaggagaccttctatgcattagttaaacctggcggcagcgcaaaagatg

SEQ ID NO: 40640 - DNA, 103 bp, Artificial Sequence
  Synthetic Polynucleotide
taatacgactcactataggggctccactgcgcatagctggtgattttgaaaacagaggagattcaaaatgaccagctataacctggcggcagcgcaaaagatg

SEQ ID NO: 40641 - DNA, 103 bp, Artificial Sequence
  Synthetic Polynucleotide
taatacgactcactataggggtggtccctatatcgttttacagcaaccctaacagaggagaagggttatggtaaaacgaaacctggcggcagcgcaaaagatg

SEQ ID NO: 40642 - DNA, 103 bp, Artificial Sequence
  Synthetic Polynucleotide
taatacgactcactatagggggcctcatggtcagcccaggagatcagttaaacagaggagataactgatgtcctgggctaacctggcggcagcgcaaaagatg

SEQ ID NO: 40643 - DNA, 103 bp, Artificial Sequence
  Synthetic Polynucleotide
taatacgactcactatagggtgactgaggtcctttcgttctcctagggggaacagaggagaccccctatgagaacgaaaaacctggcggcagcgcaaaagatg

SEQ ID NO: 40644 - DNA, 103 bp, Artificial Sequence
  Synthetic Polynucleotide
taatacgactcactatagggttgagcggacttggtgtcatacacgcgttaaacagaggagataacgcatgtatgacaccaacctggcggcagcgcaaaagatg

SEQ ID NO: 40645 - DNA, 103 bp, Artificial Sequence
  Synthetic Polynucleotide
taatacgactcactatagggctgaccgcctgtaattctagtccaacctacaacagaggagagtaggtatgactagaattaacctggcggcagcgcaaaagatg

SEQ ID NO: 40646 - DNA, 103 bp, Artificial Sequence
  Synthetic Polynucleotide
taatacgactcactataggggttggctgcaaaaccatgcatagcgctgttaacagaggagaaacagcatgatgcatggtaacctggcggcagcgcaaaagatg

SEQ ID NO: 40647 - DNA, 103 bp, Artificial Sequence
  Synthetic Polynucleotide
taatacgactcactatagggcgtgtactgtgttagactgggccccaatttaacagaggagaaaattgatgcccagtctaaacctggcggcagcgcaaaagatg

SEQ ID NO: 40648 - DNA, 103 bp, Artificial Sequence
  Synthetic Polynucleotide
taatacgactcactatagggcgccgggtgcgttgcaaggacacacgcaaaaacagaggagatttgcgatggtccttgcaaacctggcggcagcgcaaaagatg

SEQ ID NO: 40649 - DNA, 103 bp, Artificial Sequence
  Synthetic Polynucleotide
taatacgactcactatagggatgctgagtcggccggcgatttggccgacaaacagaggagatgtcggatgaatcgccggaacctggcggcagcgcaaaagatg

SEQ ID NO: 40650 - DNA, 103 bp, Artificial Sequence
  Synthetic Polynucleotide
taatacgactcactatagggaaggcagtggggggtccgatgtctagagataacagaggagaatctctatgcatcggaccaacctggcggcagcgcaaaagatg

SEQ ID NO: 40651 - DNA, 103 bp, Artificial Sequence
  Synthetic Polynucleotide
taatacgactcactatagggttgtattgtgtacctatgcggtcccggtacaacagaggagagtaccgatgccgcataggaacctggcggcagcgcaaaagatg

SEQ ID NO: 40652 - DNA, 103 bp, Artificial Sequence
  Synthetic Polynucleotide
taatacgactcactatagggatgcaataactttggatgtttagacacgtgaacagaggagacacgtgatgaaacatccaaacctggcggcagcgcaaaagatg

SEQ ID NO: 40653 - DNA, 103 bp, Artificial Sequence
  Synthetic Polynucleotide
taatacgactcactatagggtagcccccgctaggtcctcctggcgtatcaaacagaggagatgatacatgaggaggaccaacctggcggcagcgcaaaagatg

SEQ ID NO: 40654 - DNA, 103 bp, Artificial Sequence
  Synthetic Polynucleotide
taatacgactcactatagggacactagcgatgtgtcaatggcgccaaggaaacagaggagatccttgatgccattgacaaacctggcggcagcgcaaaagatg

SEQ ID NO: 40655 - DNA, 103 bp, Artificial Sequence
  Synthetic Polynucleotide
taatacgactcactatagggggatactagttagaagatccctcttgtatcaacagaggagagatacaatggggatcttcaacctggcggcagcgcaaaagatg

SEQ ID NO: 40656 - DNA, 103 bp, Artificial Sequence
  Synthetic Polynucleotide
taatacgactcactatagggtgtaagagacatctcacggtagatacaagaaacagaggagatcttgtatgtaccgtgagaacctggcggcagcgcaaaagatg

SEQ ID NO: 40657 - DNA, 103 bp, Artificial Sequence
  Synthetic Polynucleotide
taatacgactcactataggggttccagcgttcccgcactgtaacttttggaacagaggagaccaaaaatgacagtgcggaacctggcggcagcgcaaaagatg

SEQ ID NO: 40658 - DNA, 103 bp, Artificial Sequence
  Synthetic Polynucleotide
taatacgactcactatagggtaagccgcacgcgtatggtcttaccccagaaacagaggagatctgggatgagaccatacaacctggcggcagcgcaaaagatg

SEQ ID NO: 40659 - DNA, 103 bp, Artificial Sequence
  Synthetic Polynucleotide
taatacgactcactataggggaccctgaatagtcactagttcctggccggaacagaggagaccggccatgaactagtgaaacctggcggcagcgcaaaagatg

SEQ ID NO: 40660 - DNA, 103 bp, Artificial Sequence
  Synthetic Polynucleotide
taatacgactcactatagggtttcaaaaagcgggcgcttggttagtatttaacagaggagaaaatacatgccaagcgccaacctggcggcagcgcaaaagatg

SEQ ID NO: 40661 - DNA, 103 bp, Artificial Sequence
  Synthetic Polynucleotide
taatacgactcactatagggggcttcggcggtctgcggtcagctacgcccaacagaggagagggcgtatgtgaccgcagaacctggcggcagcgcaaaagatg

SEQ ID NO: 40662 - DNA, 103 bp, Artificial Sequence
  Synthetic Polynucleotide
taatacgactcactatagggaagtatcgcgcaacatatttgtcgacaaacaacagaggagagtttgtatgcaaatatgtaacctggcggcagcgcaaaagatg

SEQ ID NO: 40663 - DNA, 103 bp, Artificial Sequence
  Synthetic Polynucleotide
taatacgactcactatagggagcaaattcaaagacacacagtaacacatgaacagaggagacatgtgatgctgtgtgtcaacctggcggcagcgcaaaagatg

SEQ ID NO: 40664 - DNA, 103 bp, Artificial Sequence
  Synthetic Polynucleotide
taatacgactcactatagggcttggcctcggacccgctgtgcctgcccagaacagaggagactgggcatgcacagcgggaacctggcggcagcgcaaaagatg

SEQ ID NO: 40665 - DNA, 103 bp, Artificial Sequence
  Synthetic Polynucleotide
taatacgactcactatagggggtttactgttagaataacggctttccaccaacagaggagaggtggaatgccgttattcaacctggcggcagcgcaaaagatg

SEQ ID NO: 40666 - DNA, 103 bp, Artificial Sequence
  Synthetic Polynucleotide
taatacgactcactatagggaactgctacgtcattggacaggattcatacaacagaggagagtatgaatgctgtccaataacctggcggcagcgcaaaagatg

SEQ ID NO: 40667 - DNA, 103 bp, Artificial Sequence
  Synthetic Polynucleotide
taatacgactcactatagggtaattcagcttatatataaactgttctgcgaacagaggagacgcagaatggtttatataaacctggcggcagcgcaaaagatg

SEQ ID NO: 40668 - DNA, 103 bp, Artificial Sequence
  Synthetic Polynucleotide
taatacgactcactatagggtgagttgtgtacattccaatcaactacttcaacagaggagagaagtaatggattggaataacctggcggcagcgcaaaagatg

SEQ ID NO: 40669 - DNA, 103 bp, Artificial Sequence
  Synthetic Polynucleotide
taatacgactcactatagggacccagcgcagtattaaaaattcagacccgaacagaggagacgggtcatgatttttaataacctggcggcagcgcaaaagatg

SEQ ID NO: 40670 - DNA, 103 bp, Artificial Sequence
  Synthetic Polynucleotide
taatacgactcactataggggccttacgcgtaggatgatctttctgctccaacagaggagaggagcaatgagatcatccaacctggcggcagcgcaaaagatg

SEQ ID NO: 40671 - DNA, 103 bp, Artificial Sequence
  Synthetic Polynucleotide
taatacgactcactataggggttattcatcgaacagcgactcggaaatgtaacagaggagaacatttatgagtcgctgtaacctggcggcagcgcaaaagatg

SEQ ID NO: 40672 - DNA, 103 bp, Artificial Sequence
  Synthetic Polynucleotide
taatacgactcactataggggacacatcagatgcacctgctggtgctaccaacagaggagaggtagcatgagcaggtgcaacctggcggcagcgcaaaagatg

SEQ ID NO: 40673 - DNA, 103 bp, Artificial Sequence
  Synthetic Polynucleotide
taatacgactcactatagggacgaccatccttcctatccatcagtcctaaaacagaggagattaggaatgatggataggaacctggcggcagcgcaaaagatg

SEQ ID NO: 40674 - DNA, 103 bp, Artificial Sequence
  Synthetic Polynucleotide
taatacgactcactatagggtttaacaactaattatgcgtgggggtgtgaaacagaggagatcacacatgcacgcataaaacctggcggcagcgcaaaagatg

SEQ ID NO: 40675 - DNA, 103 bp, Artificial Sequence
  Synthetic Polynucleotide
taatacgactcactatagggcaaggcaacagtaagtgagcgcttcgaggtaacagaggagaacctcgatgcgctcacttaacctggcggcagcgcaaaagatg

SEQ ID NO: 40676 - DNA, 103 bp, Artificial Sequence
  Synthetic Polynucleotide
taatacgactcactatagggaggtccgccccttgtaggaggcagatgatcaacagaggagagatcatatgcctcctacaaacctggcggcagcgcaaaagatg

SEQ ID NO: 40677 - DNA, 103 bp, Artificial Sequence
  Synthetic Polynucleotide
taatacgactcactatagggaatcccgtagctcgtgcacggccgtaccaaaacagaggagattggtaatgccgtgcacgaacctggcggcagcgcaaaagatg

SEQ ID NO: 40678 - DNA, 103 bp, Artificial Sequence
  Synthetic Polynucleotide
taatacgactcactatagggaatgagaaccctgcccttgcgaaggaacctaacagaggagaaggttcatgcgcaagggcaacctggcggcagcgcaaaagatg

SEQ ID NO: 40679 - DNA, 103 bp, Artificial Sequence
  Synthetic Polynucleotide
taatacgactcactatagggacatgtatttcccaaagtgtcgaagatgttaacagaggagaaacatcatggacactttgaacctggcggcagcgcaaaagatg

SEQ ID NO: 40680 - DNA, 103 bp, Artificial Sequence
  Synthetic Polynucleotide
taatacgactcactataggggacaagtatcgtagggctaagccaatcgtcaacagaggagagacgatatgcttagccctaacctggcggcagcgcaaaagatg

SEQ ID NO: 40681 - DNA, 103 bp, Artificial Sequence
  Synthetic Polynucleotide
taatacgactcactatagggggatcggtacccttcagattggggtacgtcaacagaggagagacgtaatgcaatctgaaaacctggcggcagcgcaaaagatg

SEQ ID NO: 40682 - DNA, 103 bp, Artificial Sequence
  Synthetic Polynucleotide
taatacgactcactatagggtcacacggttggatctttaataagtagacgaacagaggagacgtctaatgattaaagataacctggcggcagcgcaaaagatg

SEQ ID NO: 40683 - DNA, 103 bp, Artificial Sequence
  Synthetic Polynucleotide
taatacgactcactatagggcaagcgctaacgacccagctccacagatctaacagaggagaagatctatggagctgggtaacctggcggcagcgcaaaagatg

SEQ ID NO: 40684 - DNA, 103 bp, Artificial Sequence
  Synthetic Polynucleotide
taatacgactcactatagggcccttgacgaactgacactaacagacgaagaacagaggagacttcgtatgttagtgtcaaacctggcggcagcgcaaaagatg

SEQ ID NO: 40685 - DNA, 103 bp, Artificial Sequence
  Synthetic Polynucleotide
taatacgactcactatagggtctagtgatctattctttttgctatagatcaacagaggagagatctaatgcaaaaagaaaacctggcggcagcgcaaaagatg

SEQ ID NO: 40686 - DNA, 103 bp, Artificial Sequence
  Synthetic Polynucleotide
taatacgactcactatagggcgggtaatcgctttaagactaattgtaatgaacagaggagacattacatgtagtcttaaaacctggcggcagcgcaaaagatg

SEQ ID NO: 40687 - DNA, 103 bp, Artificial Sequence
  Synthetic Polynucleotide
taatacgactcactataggggtgcggccagtaggttagcaacacagaaataacagaggagaatttctatgttgctaaccaacctggcggcagcgcaaaagatg

SEQ ID NO: 40688 - DNA, 103 bp, Artificial Sequence
  Synthetic Polynucleotide
taatacgactcactataggggcacggaatagtgatgcctcaagtgctatgaacagaggagacatagcatgtgaggcatcaacctggcggcagcgcaaaagatg

SEQ ID NO: 40689 - DNA, 103 bp, Artificial Sequence
  Synthetic Polynucleotide
taatacgactcactataggggtgatcttggcctataatgtacccaccgccaacagaggagaggcggtatgtacattataaacctggcggcagcgcaaaagatg

SEQ ID NO: 40690 - DNA, 103 bp, Artificial Sequence
  Synthetic Polynucleotide
taatacgactcactatagggctcaggcctgaaaacgagtaacgttcgctcaacagaggagagagcgaatgttactcgttaacctggcggcagcgcaaaagatg

SEQ ID NO: 40691 - DNA, 103 bp, Artificial Sequence
  Synthetic Polynucleotide
taatacgactcactatagggctttagttggcacaatccatcagtaagaaaaacagaggagatttcttatggatggattgaacctggcggcagcgcaaaagatg

SEQ ID NO: 40692 - DNA, 103 bp, Artificial Sequence
  Synthetic Polynucleotide
taatacgactcactatagggggatgagccaccccgccaggcacgcgtgataacagaggagaatcacgatggcctggcggaacctggcggcagcgcaaaagatg

SEQ ID NO: 40693 - DNA, 103 bp, Artificial Sequence
  Synthetic Polynucleotide
taatacgactcactataggggctgcgtatcggtggcgctcgcagaattgcaacagaggagagcaattatgcgagcgccaaacctggcggcagcgcaaaagatg

SEQ ID NO: 40694 - DNA, 103 bp, Artificial Sequence
  Synthetic Polynucleotide
taatacgactcactatagggtacacttcatgcatgttgtacatatatagcaacagaggagagctataatggtacaacataacctggcggcagcgcaaaagatg

SEQ ID NO: 40695 - DNA, 103 bp, Artificial Sequence
  Synthetic Polynucleotide
taatacgactcactataggggcggatgaccccggcacggcttacatggagaacagaggagactccatatgagccgtgccaacctggcggcagcgcaaaagatg

SEQ ID NO: 40696 - DNA, 103 bp, Artificial Sequence
  Synthetic Polynucleotide
taatacgactcactatagggtataagtggtcggatttaaaatctatggtcaacagaggagagaccatatgttttaaatcaacctggcggcagcgcaaaagatg

SEQ ID NO: 40697 - DNA, 103 bp, Artificial Sequence
  Synthetic Polynucleotide
taatacgactcactataggggcctgcccttcaggcgcttcttcattgtctaacagaggagaagacaaatgagaagcgccaacctggcggcagcgcaaaagatg

SEQ ID NO: 40698 - DNA, 103 bp, Artificial Sequence
  Synthetic Polynucleotide
taatacgactcactatagggcaaggtcgactagccgaatggactccgtgaaacagaggagatcacggatgccattcggcaacctggcggcagcgcaaaagatg

SEQ ID NO: 40699 - DNA, 103 bp, Artificial Sequence
  Synthetic Polynucleotide
taatacgactcactatagggtaagtgttcacatagacggcccggaactgtaacagaggagaacagttatgggccgtctaaacctggcggcagcgcaaaagatg

SEQ ID NO: 40700 - DNA, 103 bp, Artificial Sequence
  Synthetic Polynucleotide
taatacgactcactatagggtgaaaccacttcgtagaccaaaagacatataacagaggagaatatgtatgttggtctacaacctggcggcagcgcaaaagatg

SEQ ID NO: 40701 - DNA, 103 bp, Artificial Sequence
  Synthetic Polynucleotide
taatacgactcactatagggggggtaagcctgtgggcgcatggtatggccaacagaggagaggccatatgatgcgcccaaacctggcggcagcgcaaaagatg

SEQ ID NO: 40702 - DNA, 103 bp, Artificial Sequence
  Synthetic Polynucleotide
taatacgactcactatagggggatgctgggtagcctatcactacccgcacaacagaggagagtgcggatggtgataggcaacctggcggcagcgcaaaagatg

SEQ ID NO: 40703 - DNA, 103 bp, Artificial Sequence
  Synthetic Polynucleotide
taatacgactcactatagggcacgagctctccaaggacgatcctttttgcaacagaggagagcaaaaatgatcgtccttaacctggcggcagcgcaaaagatg

SEQ ID NO: 40704 - DNA, 103 bp, Artificial Sequence
  Synthetic Polynucleotide
taatacgactcactataggggtatagttttggcctgggctttaaagaaataacagaggagaatttctatgaagcccaggaacctggcggcagcgcaaaagatg

SEQ ID NO: 40705 - DNA, 103 bp, Artificial Sequence
  Synthetic Polynucleotide
taatacgactcactatagggctgtttgtgatcagcttatggggttcgcgcaacagaggagagcgcgaatgccataagctaacctggcggcagcgcaaaagatg

SEQ ID NO: 40706 - DNA, 103 bp, Artificial Sequence
  Synthetic Polynucleotide
taatacgactcactatagggtggataggcggatcttcagtagcctacactaacagaggagaagtgtaatgtactgaagaaacctggcggcagcgcaaaagatg

SEQ ID NO: 40707 - DNA, 103 bp, Artificial Sequence
  Synthetic Polynucleotide
taatacgactcactatagggctcttgggttcgccgtgcctaacgtaaatgaacagaggagacatttaatgtaggcacggaacctggcggcagcgcaaaagatg

SEQ ID NO: 40708 - DNA, 103 bp, Artificial Sequence
  Synthetic Polynucleotide
taatacgactcactataggggccacagccgacgtcagagggagttcttctaacagaggagaagaagaatgccctctgacaacctggcggcagcgcaaaagatg

SEQ ID NO: 40709 - DNA, 103 bp, Artificial Sequence
  Synthetic Polynucleotide
taatacgactcactatagggcaggaactgtatggccccgcacccgtttgtaacagaggagaacaaacatgtgcggggccaacctggcggcagcgcaaaagatg

SEQ ID NO: 40710 - DNA, 103 bp, Artificial Sequence
  Synthetic Polynucleotide
taatacgactcactatagggtagatccgatctctctaattactgatggccaacagaggagaggccatatgtaattagagaacctggcggcagcgcaaaagatg

SEQ ID NO: 40711 - DNA, 103 bp, Artificial Sequence
  Synthetic Polynucleotide
taatacgactcactatagggtggattgctttccgggagaactgcatatttaacagaggagaaaatatatggttctcccgaacctggcggcagcgcaaaagatg

SEQ ID NO: 40712 - DNA, 103 bp, Artificial Sequence
  Synthetic Polynucleotide
taatacgactcactatagggctgtcccagttttcctttccgtcatgcaccaacagaggagaggtgcaatgcggaaaggaaacctggcggcagcgcaaaagatg

SEQ ID NO: 40713 - DNA, 103 bp, Artificial Sequence
  Synthetic Polynucleotide
taatacgactcactataggggctccggtagagccttaatacaactaggacaacagaggagagtcctaatggtattaaggaacctggcggcagcgcaaaagatg

SEQ ID NO: 40714 - DNA, 103 bp, Artificial Sequence
  Synthetic Polynucleotide
taatacgactcactatagggggattacatgcagatggtagttctcaggtgaacagaggagacacctgatgactaccatcaacctggcggcagcgcaaaagatg

SEQ ID NO: 40715 - DNA, 103 bp, Artificial Sequence
  Synthetic Polynucleotide
taatacgactcactatagggcaggctacgagggagtgccgacacgtctacaacagaggagagtagacatgtcggcactcaacctggcggcagcgcaaaagatg

SEQ ID NO: 40716 - DNA, 103 bp, Artificial Sequence
  Synthetic Polynucleotide
taatacgactcactatagggatttagtaacctttgtgctcagcgtctccgaacagaggagacggagaatgtgagcacaaaacctggcggcagcgcaaaagatg

SEQ ID NO: 40717 - DNA, 103 bp, Artificial Sequence
  Synthetic Polynucleotide
taatacgactcactatagggggtcaagtgtgaaagctttgtatcagtcccaacagaggagagggactatgacaaagcttaacctggcggcagcgcaaaagatg

SEQ ID NO: 40718 - DNA, 103 bp, Artificial Sequence
  Synthetic Polynucleotide
taatacgactcactatagggttagcacgaaagggaaagtgagtgaatataaacagaggagatatattatgtcactttccaacctggcggcagcgcaaaagatg

SEQ ID NO: 40719 - DNA, 103 bp, Artificial Sequence
  Synthetic Polynucleotide
taatacgactcactatagggaattgttgattttggatttagccgtgtgacaacagaggagagtcacaatgctaaatccaaacctggcggcagcgcaaaagatg

SEQ ID NO: 40720 - DNA, 103 bp, Artificial Sequence
  Synthetic Polynucleotide
taatacgactcactatagggcgctcttacgaccgctagcgaaggctcttgaacagaggagacaagagatgtcgctagcgaacctggcggcagcgcaaaagatg

SEQ ID NO: 40721 - DNA, 103 bp, Artificial Sequence
  Synthetic Polynucleotide
taatacgactcactatagggaatcgaccagcgggttgggcgcacctttacaacagaggagagtaaagatgcgcccaaccaacctggcggcagcgcaaaagatg

SEQ ID NO: 40722 - DNA, 103 bp, Artificial Sequence
  Synthetic Polynucleotide
taatacgactcactatagggggactcacgaaatgttggtaacccaccacaaacagaggagatgtggtatgttaccaacaaacctggcggcagcgcaaaagatg

SEQ ID NO: 40723 - DNA, 103 bp, Artificial Sequence
  Synthetic Polynucleotide
taatacgactcactatagggttaccctgcaacacaaccccgttgaagtctaacagaggagaagacttatgcggggttgtaacctggcggcagcgcaaaagatg

SEQ ID NO: 40724 - DNA, 103 bp, Artificial Sequence
  Synthetic Polynucleotide
taatacgactcactatagggttccagtaacagaaattgggtacactgcacaacagaggagagtgcagatgacccaatttaacctggcggcagcgcaaaagatg

SEQ ID NO: 40725 - DNA, 103 bp, Artificial Sequence
  Synthetic Polynucleotide
taatacgactcactatagggcgcctacgcctttaacgactgagacggctaaacagaggagatagccgatgcagtcgttaaacctggcggcagcgcaaaagatg

SEQ ID NO: 40726 - DNA, 103 bp, Artificial Sequence
  Synthetic Polynucleotide
taatacgactcactatagggtgctcgccctctcgataaggatcgcgacgtaacagaggagaacgtcgatgtccttatcgaacctggcggcagcgcaaaagatg

SEQ ID NO: 40727 - DNA, 103 bp, Artificial Sequence
  Synthetic Polynucleotide
taatacgactcactatagggattgaccttgttacccttcggctatagagtaacagaggagaactctaatgccgaagggtaacctggcggcagcgcaaaagatg

SEQ ID NO: 40728 - DNA, 103 bp, Artificial Sequence
  Synthetic Polynucleotide
taatacgactcactatagggaaatacgcaccttgatgacccctttttaaaaacagaggagatttaaaatggggtcatcaaacctggcggcagcgcaaaagatg

SEQ ID NO: 40729 - DNA, 103 bp, Artificial Sequence
  Synthetic Polynucleotide
taatacgactcactatagggagtccgtcctagggcctccagccgcagaataacagaggagaattctgatgctggaggccaacctggcggcagcgcaaaagatg

SEQ ID NO: 40730 - DNA, 103 bp, Artificial Sequence
  Synthetic Polynucleotide
taatacgactcactatagggaccttcagcatgaccacaaatacaacggagaacagaggagactccgtatgatttgtggtaacctggcggcagcgcaaaagatg

SEQ ID NO: 40731 - DNA, 103 bp, Artificial Sequence
  Synthetic Polynucleotide
taatacgactcactataggggcacttagccgtgccgtaggctgtacttacaacagaggagagtaagtatggcctacggcaacctggcggcagcgcaaaagatg

SEQ ID NO: 40732 - DNA, 103 bp, Artificial Sequence
  Synthetic Polynucleotide
taatacgactcactatagggatttccgtgcacgtaggcagaacggtcgagaacagaggagactcgacatgtctgcctacaacctggcggcagcgcaaaagatg

SEQ ID NO: 40733 - DNA, 103 bp, Artificial Sequence
  Synthetic Polynucleotide
taatacgactcactataggggacgacggccaggctgttagaatttgtttaaacagaggagataaacaatgtctaacagcaacctggcggcagcgcaaaagatg

SEQ ID NO: 40734 - DNA, 103 bp, Artificial Sequence
  Synthetic Polynucleotide
taatacgactcactatagggaatcttgagtcgtatgtcttggggtttcgtaacagaggagaacgaaaatgcaagacataaacctggcggcagcgcaaaagatg

SEQ ID NO: 40735 - DNA, 103 bp, Artificial Sequence
  Synthetic Polynucleotide
taatacgactcactatagggagtaaacgtgtaaagctgcgtctagcctgaaacagaggagatcaggcatgacgcagcttaacctggcggcagcgcaaaagatg

SEQ ID NO: 40736 - DNA, 103 bp, Artificial Sequence
  Synthetic Polynucleotide
taatacgactcactatagggagcgaaccggcagtccgacaccctgattacaacagaggagagtaatcatggtgtcggacaacctggcggcagcgcaaaagatg

SEQ ID NO: 40737 - DNA, 103 bp, Artificial Sequence
  Synthetic Polynucleotide
taatacgactcactatagggtatgggcttttctaattgcgcgatcggcttaacagaggagaaagccgatggcgcaattaaacctggcggcagcgcaaaagatg

SEQ ID NO: 40738 - DNA, 103 bp, Artificial Sequence
  Synthetic Polynucleotide
taatacgactcactatagggggattacgctgtgttatggcccacatagataacagaggagaatctatatgggccataacaacctggcggcagcgcaaaagatg

SEQ ID NO: 40739 - DNA, 103 bp, Artificial Sequence
  Synthetic Polynucleotide
taatacgactcactatagggagcgtcgtacacacctgcggggcgatctctaacagaggagaagagatatgcccgcaggtaacctggcggcagcgcaaaagatg

SEQ ID NO: 40740 - DNA, 103 bp, Artificial Sequence
  Synthetic Polynucleotide
taatacgactcactatagggaaactgccttgtattgacgtgatttcatcaaacagaggagatgatgaatgcacgtcaataacctggcggcagcgcaaaagatg

SEQ ID NO: 40741 - DNA, 103 bp, Artificial Sequence
  Synthetic Polynucleotide
taatacgactcactatagggtgcctttcaaaagagctgacttcccgagtaaacagaggagatactcgatgagtcagctcaacctggcggcagcgcaaaagatg

SEQ ID NO: 40742 - DNA, 103 bp, Artificial Sequence
  Synthetic Polynucleotide
taatacgactcactatagggaaccagccctgttttttagcgtacgcgattaacagaggagaaatcgcatgcgctaaaaaaacctggcggcagcgcaaaagatg

SEQ ID NO: 40743 - DNA, 103 bp, Artificial Sequence
  Synthetic Polynucleotide
taatacgactcactatagggttacaactattatatcagtctagtggcataaacagaggagatatgccatgagactgataaacctggcggcagcgcaaaagatg

SEQ ID NO: 40744 - DNA, 103 bp, Artificial Sequence
  Synthetic Polynucleotide
taatacgactcactatagggtaggccctttttgatttttaagatgtaaacaacagaggagagtttacatgttaaaaatcaacctggcggcagcgcaaaagatg

SEQ ID NO: 40745 - DNA, 103 bp, Artificial Sequence
  Synthetic Polynucleotide
taatacgactcactatagggggcgaaccatcgcggtgagagattgtaccgaacagaggagacggtacatgctctcaccgaacctggcggcagcgcaaaagatg

SEQ ID NO: 40746 - DNA, 103 bp, Artificial Sequence
  Synthetic Polynucleotide
taatacgactcactataggggttacctccttcccggaggtacttactcggaacagaggagaccgagtatgtacctccggaacctggcggcagcgcaaaagatg

SEQ ID NO: 40747 - DNA, 103 bp, Artificial Sequence
  Synthetic Polynucleotide
taatacgactcactatagggtctctctgttggataccggtccgttgggccaacagaggagaggcccaatggaccggtataacctggcggcagcgcaaaagatg

SEQ ID NO: 40748 - DNA, 103 bp, Artificial Sequence
  Synthetic Polynucleotide
taatacgactcactatagggtcgtctgatctggcaaccaatcaacgctttaacagaggagaaaagcgatgattggttgcaacctggcggcagcgcaaaagatg

SEQ ID NO: 40749 - DNA, 103 bp, Artificial Sequence
  Synthetic Polynucleotide
taatacgactcactatagggagcgcggactggttttccaggccacccccaaacagaggagatgggggatgcctggaaaaaacctggcggcagcgcaaaagatg

SEQ ID NO: 40750 - DNA, 103 bp, Artificial Sequence
  Synthetic Polynucleotide
taatacgactcactatagggcagacatttgtaatttcttgtcttcgggacaacagaggagagtcccgatgacaagaaataacctggcggcagcgcaaaagatg

SEQ ID NO: 40751 - DNA, 103 bp, Artificial Sequence
  Synthetic Polynucleotide
taatacgactcactataggggcaaacagtcgcatgaacgttgatatgcctaacagaggagaaggcatatgaacgttcataacctggcggcagcgcaaaagatg

SEQ ID NO: 40752 - DNA, 103 bp, Artificial Sequence
  Synthetic Polynucleotide
taatacgactcactatagggttaattttctaacatatgatgcagcgccgaaacagaggagatcggcgatgcatcatatgaacctggcggcagcgcaaaagatg

SEQ ID NO: 40753 - DNA, 103 bp, Artificial Sequence
  Synthetic Polynucleotide
taatacgactcactatagggagacgtcagcaggtatttaaggaccccaccaacagaggagaggtgggatgcttaaatacaacctggcggcagcgcaaaagatg

SEQ ID NO: 40754 - DNA, 103 bp, Artificial Sequence
  Synthetic Polynucleotide
taatacgactcactatagggtatctggacgtaccgtgggatacgcctataaacagaggagatataggatgatcccacggaacctggcggcagcgcaaaagatg

SEQ ID NO: 40755 - DNA, 103 bp, Artificial Sequence
  Synthetic Polynucleotide
taatacgactcactatagggctgacttcgtagccacgtactactatccgtaacagaggagaacggatatgagtacgtggaacctggcggcagcgcaaaagatg

SEQ ID NO: 40756 - DNA, 103 bp, Artificial Sequence
  Synthetic Polynucleotide
taatacgactcactatagggtcacaccaccaataatggcgacctcggctcaacagaggagagagccgatgtcgccattaaacctggcggcagcgcaaaagatg

SEQ ID NO: 40757 - DNA, 103 bp, Artificial Sequence
  Synthetic Polynucleotide
taatacgactcactatagggaatactgttctccttgagtaccctcggaataacagaggagaattccgatggtactcaagaacctggcggcagcgcaaaagatg

SEQ ID NO: 40758 - DNA, 103 bp, Artificial Sequence
  Synthetic Polynucleotide
taatacgactcactatagggaactttgttacgttggagagcagaagaatcaacagaggagagattctatggctctccaaaacctggcggcagcgcaaaagatg

SEQ ID NO: 40759 - DNA, 103 bp, Artificial Sequence
  Synthetic Polynucleotide
taatacgactcactatagggtagcatgatacgcatccccacgcgattaccaacagaggagaggtaatatggtggggatgaacctggcggcagcgcaaaagatg

SEQ ID NO: 40760 - DNA, 103 bp, Artificial Sequence
  Synthetic Polynucleotide
taatacgactcactataggggagatcatgtctaactgggtgacactcgacaacagaggagagtcgagatgcacccagttaacctggcggcagcgcaaaagatg

SEQ ID NO: 40761 - DNA, 103 bp, Artificial Sequence
  Synthetic Polynucleotide
taatacgactcactatagggcgcatttaccggaccagatcatgacaggccaacagaggagaggcctgatgtgatctggtaacctggcggcagcgcaaaagatg

SEQ ID NO: 40762 - DNA, 103 bp, Artificial Sequence
  Synthetic Polynucleotide
taatacgactcactataggggaatccagtctattatgcgcgcagttcgggaacagaggagacccgaaatgcgcgcataaaacctggcggcagcgcaaaagatg

SEQ ID NO: 40763 - DNA, 103 bp, Artificial Sequence
  Synthetic Polynucleotide
taatacgactcactatagggcgggcgctggtctattggggataggatagcaacagaggagagctatcatgtccccaataaacctggcggcagcgcaaaagatg

SEQ ID NO: 40764 - DNA, 103 bp, Artificial Sequence
  Synthetic Polynucleotide
taatacgactcactataggggcttaccgtccgtactgtattttttcacgaaacagaggagatcgtgaatgaatacagtaaacctggcggcagcgcaaaagatg

SEQ ID NO: 40765 - DNA, 103 bp, Artificial Sequence
  Synthetic Polynucleotide
taatacgactcactatagggtaagttaatcggagctccataacccaccagaacagaggagactggtgatgtatggagctaacctggcggcagcgcaaaagatg

SEQ ID NO: 40766 - DNA, 103 bp, Artificial Sequence
  Synthetic Polynucleotide
taatacgactcactatagggtgtagtgtacattcactgctaaagtgggataacagaggagaatcccaatgtagcagtgaaacctggcggcagcgcaaaagatg

SEQ ID NO: 40767 - DNA, 103 bp, Artificial Sequence
  Synthetic Polynucleotide
taatacgactcactatagggattaggatccgcattgcctgcagttagttaaacagaggagataactaatggcaggcaataacctggcggcagcgcaaaagatg

SEQ ID NO: 40768 - DNA, 103 bp, Artificial Sequence
  Synthetic Polynucleotide
taatacgactcactatagggctctgaggggctttgggcctttgtacacataacagaggagaatgtgtatgaaggcccaaaacctggcggcagcgcaaaagatg

SEQ ID NO: 40769 - DNA, 103 bp, Artificial Sequence
  Synthetic Polynucleotide
taatacgactcactatagggagtgggtgccgtattttcgaatcgcgtagaaacagaggagatctacgatgttcgaaaataacctggcggcagcgcaaaagatg

SEQ ID NO: 40770 - DNA, 103 bp, Artificial Sequence
  Synthetic Polynucleotide
taatacgactcactatagggaaccaccgttatccatgaccgcagccgagcaacagaggagagctcggatgcggtcatggaacctggcggcagcgcaaaagatg

SEQ ID NO: 40771 - DNA, 103 bp, Artificial Sequence
  Synthetic Polynucleotide
taatacgactcactatagggatattccccggcgccctccgctcagggctgaacagaggagacagcccatggcggagggcaacctggcggcagcgcaaaagatg

SEQ ID NO: 40772 - DNA, 103 bp, Artificial Sequence
  Synthetic Polynucleotide
taatacgactcactataggggaggtgtcgccgacctcaagccgttaattgaacagaggagacaattaatggcttgaggtaacctggcggcagcgcaaaagatg

SEQ ID NO: 40773 - DNA, 103 bp, Artificial Sequence
  Synthetic Polynucleotide
taatacgactcactatagggccgtgtcatgggtccgataatccgtgccacaacagaggagagtggcaatgattatcggaaacctggcggcagcgcaaaagatg

SEQ ID NO: 40774 - DNA, 103 bp, Artificial Sequence
  Synthetic Polynucleotide
taatacgactcactataggggcatacttgcgtcctgggaccttaacttgaaacagaggagatcaagtatgggtcccaggaacctggcggcagcgcaaaagatg

SEQ ID NO: 40775 - DNA, 103 bp, Artificial Sequence
  Synthetic Polynucleotide
taatacgactcactatagggtaaggtattagacacggtggatggggtgacaacagaggagagtcaccatgtccaccgtgaacctggcggcagcgcaaaagatg

SEQ ID NO: 40776 - DNA, 103 bp, Artificial Sequence
  Synthetic Polynucleotide
taatacgactcactatagggacagccttgctacagtattgacataggaccaacagaggagaggtcctatgtcaatactgaacctggcggcagcgcaaaagatg

SEQ ID NO: 40777 - DNA, 103 bp, Artificial Sequence
  Synthetic Polynucleotide
taatacgactcactatagggaccccaatgggtctggaaatgtctgtttaaaacagaggagattaaacatgcatttccagaacctggcggcagcgcaaaagatg

SEQ ID NO: 40778 - DNA, 103 bp, Artificial Sequence
  Synthetic Polynucleotide
taatacgactcactataggggctgcgatggcgcacatcccgcctaactgcaacagaggagagcagttatgcgggatgtgaacctggcggcagcgcaaaagatg

SEQ ID NO: 40779 - DNA, 103 bp, Artificial Sequence
  Synthetic Polynucleotide
taatacgactcactatagggtgaccgttgaattggatgacagttttgtcgaacagaggagacgacaaatgtgtcatccaaacctggcggcagcgcaaaagatg

SEQ ID NO: 40780 - DNA, 103 bp, Artificial Sequence
  Synthetic Polynucleotide
taatacgactcactataggggtcgaaggacatgctgatgtgaggatgaataacagaggagaattcatatgcacatcagcaacctggcggcagcgcaaaagatg

SEQ ID NO: 40781 - DNA, 103 bp, Artificial Sequence
  Synthetic Polynucleotide
taatacgactcactatagggcccttagaatgagtccccggctataggttaaacagaggagataacctatggccggggacaacctggcggcagcgcaaaagatg

SEQ ID NO: 40782 - DNA, 103 bp, Artificial Sequence
  Synthetic Polynucleotide
taatacgactcactatagggagtaggctggggtggtttaaggcccattgaaacagaggagatcaatgatgcttaaaccaaacctggcggcagcgcaaaagatg

SEQ ID NO: 40783 - DNA, 103 bp, Artificial Sequence
  Synthetic Polynucleotide
taatacgactcactatagggatctcgtcacctcacagcgcccttcatacaaacagaggagatgtatgatgggcgctgtgaacctggcggcagcgcaaaagatg

SEQ ID NO: 40784 - DNA, 103 bp, Artificial Sequence
  Synthetic Polynucleotide
taatacgactcactatagggtcgagtcgttgtggcccaactagagggggaaacagaggagatcccccatgagttgggccaacctggcggcagcgcaaaagatg

SEQ ID NO: 40785 - DNA, 103 bp, Artificial Sequence
  Synthetic Polynucleotide
taatacgactcactatagggttatgcgatccaacaccgtaccccgcccggaacagaggagaccgggcatggtacggtgtaacctggcggcagcgcaaaagatg

SEQ ID NO: 40786 - DNA, 103 bp, Artificial Sequence
  Synthetic Polynucleotide
taatacgactcactatagggatcagcctcgaataatggtttgggttgcggaacagaggagaccgcaaatgaaaccattaaacctggcggcagcgcaaaagatg

SEQ ID NO: 40787 - DNA, 103 bp, Artificial Sequence
  Synthetic Polynucleotide
taatacgactcactatagggaggtctacagaggggctatactgcagagcaaacagaggagatgctctatggtatagcccaacctggcggcagcgcaaaagatg

SEQ ID NO: 40788 - DNA, 103 bp, Artificial Sequence
  Synthetic Polynucleotide
taatacgactcactataggggacctcggcagcgttcggagtcgggtcggcaacagaggagagccgacatgactccgaacaacctggcggcagcgcaaaagatg

SEQ ID NO: 40789 - DNA, 103 bp, Artificial Sequence
  Synthetic Polynucleotide
taatacgactcactatagggactcgttgcccattgggactgttgaccccgaacagaggagacggggtatgcagtcccaaaacctggcggcagcgcaaaagatg

SEQ ID NO: 40790 - DNA, 103 bp, Artificial Sequence
  Synthetic Polynucleotide
taatacgactcactatagggtttgacgaaggatcccgaacactcacgttgaacagaggagacaacgtatgtgttcgggaaacctggcggcagcgcaaaagatg

SEQ ID NO: 40791 - DNA, 103 bp, Artificial Sequence
  Synthetic Polynucleotide
taatacgactcactataggggaagggggggcccggccaggacttgtagcgaacagaggagacgctacatgtcctggccgaacctggcggcagcgcaaaagatg

SEQ ID NO: 40792 - DNA, 103 bp, Artificial Sequence
  Synthetic Polynucleotide
taatacgactcactatagggcactagagtagtgactaactgccatctcgaaacagaggagatcgagaatgcagttagtcaacctggcggcagcgcaaaagatg

SEQ ID NO: 40793 - DNA, 103 bp, Artificial Sequence
  Synthetic Polynucleotide
taatacgactcactatagggtcctatagtcgtgtcaggccgtcgagatgcaacagaggagagcatctatgcggcctgacaacctggcggcagcgcaaaagatg

SEQ ID NO: 40794 - DNA, 103 bp, Artificial Sequence
  Synthetic Polynucleotide
taatacgactcactatagggacagagagcaaacatacattatatgcactcaacagaggagagagtgcatgtaatgtatgaacctggcggcagcgcaaaagatg

SEQ ID NO: 40795 - DNA, 103 bp, Artificial Sequence
  Synthetic Polynucleotide
taatacgactcactataggggctggcgtacagcgttgctcactcacgctcaacagaggagagagcgtatgtgagcaacgaacctggcggcagcgcaaaagatg

SEQ ID NO: 40796 - DNA, 103 bp, Artificial Sequence
  Synthetic Polynucleotide
taatacgactcactataggggcgacttaccaatcagtgatgcccaatttgaacagaggagacaaattatgcatcactgaaacctggcggcagcgcaaaagatg

SEQ ID NO: 40797 - DNA, 103 bp, Artificial Sequence
  Synthetic Polynucleotide
taatacgactcactatagggtccgcctccttatctgaccctgcggtctcaaacagaggagatgagacatgagggtcagaaacctggcggcagcgcaaaagatg

SEQ ID NO: 40798 - DNA, 103 bp, Artificial Sequence
  Synthetic Polynucleotide
taatacgactcactatagggctaagatgcggattgagcttcggcggctggaacagaggagaccagccatggaagctcaaaacctggcggcagcgcaaaagatg

SEQ ID NO: 40799 - DNA, 103 bp, Artificial Sequence
  Synthetic Polynucleotide
taatacgactcactatagggcgtctgggtagaataaagctgccagcacgcaacagaggagagcgtgcatgcagctttataacctggcggcagcgcaaaagatg

SEQ ID NO: 40800 - DNA, 103 bp, Artificial Sequence
  Synthetic Polynucleotide
taatacgactcactatagggggccactgacaacagaatcgaaattgtcaaaacagaggagattgacaatgtcgattctgaacctggcggcagcgcaaaagatg

SEQ ID NO: 40801 - DNA, 103 bp, Artificial Sequence
  Synthetic Polynucleotide
taatacgactcactataggggcgtcgcgtacaatcctacctccacgcagcaacagaggagagctgcgatgaggtaggataacctggcggcagcgcaaaagatg

SEQ ID NO: 40802 - DNA, 103 bp, Artificial Sequence
  Synthetic Polynucleotide
taatacgactcactatagggatcgtggcgacatgaactgatgccgagaccaacagaggagaggtctcatgatcagttcaaacctggcggcagcgcaaaagatg

SEQ ID NO: 40803 - DNA, 103 bp, Artificial Sequence
  Synthetic Polynucleotide
taatacgactcactatagggaatggtgcgacgtgcttgcttctcagttctaacagaggagaagaactatgaagcaagcaaacctggcggcagcgcaaaagatg

SEQ ID NO: 40804 - DNA, 103 bp, Artificial Sequence
  Synthetic Polynucleotide
taatacgactcactatagggtgcctgacacgatcgagccagtgtgtatgaaacagaggagatcatacatgctggctcgaaacctggcggcagcgcaaaagatg

SEQ ID NO: 40805 - DNA, 103 bp, Artificial Sequence
  Synthetic Polynucleotide
taatacgactcactatagggctcacggtcgtcagccagtatttaatgctcaacagaggagagagcatatgatactggctaacctggcggcagcgcaaaagatg

SEQ ID NO: 40806 - DNA, 103 bp, Artificial Sequence
  Synthetic Polynucleotide
taatacgactcactatagggtgggctggttaacgaacgtcgtcacacggcaacagaggagagccgtgatgcgacgttcgaacctggcggcagcgcaaaagatg

SEQ ID NO: 40807 - DNA, 103 bp, Artificial Sequence
  Synthetic Polynucleotide
taatacgactcactataggggcctaggactatagggttaaaaaaggttgtaacagaggagaacaaccatgtttaaccctaacctggcggcagcgcaaaagatg

SEQ ID NO: 40808 - DNA, 103 bp, Artificial Sequence
  Synthetic Polynucleotide
taatacgactcactatagggaccgagggtgctaagcgcgccaggttacgtaacagaggagaacgtaaatgggcgcgcttaacctggcggcagcgcaaaagatg

SEQ ID NO: 40809 - DNA, 103 bp, Artificial Sequence
  Synthetic Polynucleotide
taatacgactcactatagggcagggtcaatgtaggtcgctacatgcgtcgaacagaggagacgacgcatgtagcgacctaacctggcggcagcgcaaaagatg

SEQ ID NO: 40810 - DNA, 103 bp, Artificial Sequence
  Synthetic Polynucleotide
taatacgactcactatagggggcctgagtgggttacggtaggagggtatcaacagaggagagataccatgctaccgtaaaacctggcggcagcgcaaaagatg

SEQ ID NO: 40811 - DNA, 103 bp, Artificial Sequence
  Synthetic Polynucleotide
taatacgactcactatagggccaatcccgtaaacacccccagcgcccccgaacagaggagacgggggatgtgggggtgtaacctggcggcagcgcaaaagatg

SEQ ID NO: 40812 - DNA, 103 bp, Artificial Sequence
  Synthetic Polynucleotide
taatacgactcactatagggatcgacatggatgtgaggcgattggtggataacagaggagaatccacatgtcgcctcacaacctggcggcagcgcaaaagatg

SEQ ID NO: 40813 - DNA, 103 bp, Artificial Sequence
  Synthetic Polynucleotide
taatacgactcactatagggtggacttagaagtaatgggtataaacggcaaacagaggagatgccgtatgtacccattaaacctggcggcagcgcaaaagatg

SEQ ID NO: 40814 - DNA, 103 bp, Artificial Sequence
  Synthetic Polynucleotide
taatacgactcactatagggaaacagggttcttgtaagtctaaccaggttaacagaggagaaacctgatgagacttacaaacctggcggcagcgcaaaagatg

SEQ ID NO: 40815 - DNA, 103 bp, Artificial Sequence
  Synthetic Polynucleotide
taatacgactcactataggggttacggcgcaccccggcgtctccaagtaaaacagaggagattacttatggacgccgggaacctggcggcagcgcaaaagatg

SEQ ID NO: 40816 - DNA, 103 bp, Artificial Sequence
  Synthetic Polynucleotide
taatacgactcactatagggatagtgaacccgctacgcacgtccaaattgaacagaggagacaatttatgcgtgcgtagaacctggcggcagcgcaaaagatg

SEQ ID NO: 40817 - DNA, 103 bp, Artificial Sequence
  Synthetic Polynucleotide
taatacgactcactatagggggtgtcccttttacgggagaagtgcaggtgaacagaggagacacctgatgttctcccgtaacctggcggcagcgcaaaagatg

SEQ ID NO: 40818 - DNA, 103 bp, Artificial Sequence
  Synthetic Polynucleotide
taatacgactcactatagggaggtttgttttgtttctccgtaatcaacccaacagaggagagggttgatgacggagaaaaacctggcggcagcgcaaaagatg

SEQ ID NO: 40819 - DNA, 103 bp, Artificial Sequence
  Synthetic Polynucleotide
taatacgactcactatagggttgacaagcattcagttgttctcttcggataacagaggagaatccgaatggaacaactgaacctggcggcagcgcaaaagatg

SEQ ID NO: 40820 - DNA, 103 bp, Artificial Sequence
  Synthetic Polynucleotide
taatacgactcactatagggctcgcgttcaggtcccttgatccggttcgtaacagaggagaacgaacatgatcaagggaaacctggcggcagcgcaaaagatg

SEQ ID NO: 40821 - DNA, 103 bp, Artificial Sequence
  Synthetic Polynucleotide
taatacgactcactatagggacgataggtggcatacttgccagttttttcaacagaggagagaaaaaatgggcaagtataacctggcggcagcgcaaaagatg

SEQ ID NO: 40822 - DNA, 103 bp, Artificial Sequence
  Synthetic Polynucleotide
taatacgactcactatagggtacggctttcgagatgtacctctggcatgaaacagaggagatcatgcatgaggtacatcaacctggcggcagcgcaaaagatg

SEQ ID NO: 40823 - DNA, 103 bp, Artificial Sequence
  Synthetic Polynucleotide
taatacgactcactatagggaaacgtcgtcgagtcacagaaaggtcttcgaacagaggagacgaagaatgttctgtgacaacctggcggcagcgcaaaagatg

SEQ ID NO: 40824 - DNA, 103 bp, Artificial Sequence
  Synthetic Polynucleotide
taatacgactcactataggggacacggtggcgctcatactggcggcggacaacagaggagagtccgcatgcagtatgagaacctggcggcagcgcaaaagatg

SEQ ID NO: 40825 - DNA, 103 bp, Artificial Sequence
  Synthetic Polynucleotide
taatacgactcactatagggacaccgcaatccccggatcgtccattatgtaacagaggagaacataaatgacgatccggaacctggcggcagcgcaaaagatg

SEQ ID NO: 40826 - DNA, 103 bp, Artificial Sequence
  Synthetic Polynucleotide
taatacgactcactatagggaacttagacgcgtgcgatatcactggcataaacagaggagatatgccatggatatcgcaaacctggcggcagcgcaaaagatg

SEQ ID NO: 40827 - DNA, 103 bp, Artificial Sequence
  Synthetic Polynucleotide
taatacgactcactatagggatagtatggagtcgtgcgtgcctaaacgtgaacagaggagacacgttatggcacgcacgaacctggcggcagcgcaaaagatg

SEQ ID NO: 40828 - DNA, 103 bp, Artificial Sequence
  Synthetic Polynucleotide
taatacgactcactataggggcaatacggtaggtacgactgttctacctaaacagaggagataggtaatgcagtcgtacaacctggcggcagcgcaaaagatg

SEQ ID NO: 40829 - DNA, 103 bp, Artificial Sequence
  Synthetic Polynucleotide
taatacgactcactatagggtcttattgtgtccaatcaactgctcacactaacagaggagaagtgtgatgagttgattgaacctggcggcagcgcaaaagatg

SEQ ID NO: 40830 - DNA, 103 bp, Artificial Sequence
  Synthetic Polynucleotide
taatacgactcactatagggcttaggtgagcagtccggcatcaaggttacaacagaggagagtaaccatgatgccggacaacctggcggcagcgcaaaagatg

SEQ ID NO: 40831 - DNA, 103 bp, Artificial Sequence
  Synthetic Polynucleotide
taatacgactcactataggggacgcaccgagtttccgaatgaggttacctaacagaggagaaggtaaatgcattcggaaaacctggcggcagcgcaaaagatg

SEQ ID NO: 40832 - DNA, 103 bp, Artificial Sequence
  Synthetic Polynucleotide
taatacgactcactatagggttaggtgtttgtttcgtgactggtctgtctaacagaggagaagacagatgagtcacgaaaacctggcggcagcgcaaaagatg

SEQ ID NO: 40833 - DNA, 103 bp, Artificial Sequence
  Synthetic Polynucleotide
taatacgactcactatagggtaagaaacggcgtacccacaacagttagaaaacagaggagattctaaatgttgtgggtaaacctggcggcagcgcaaaagatg

SEQ ID NO: 40834 - DNA, 103 bp, Artificial Sequence
  Synthetic Polynucleotide
taatacgactcactatagggcctaaagtatcacggctcgtcgcgtccagtaacagaggagaactggaatggacgagccgaacctggcggcagcgcaaaagatg

SEQ ID NO: 40835 - DNA, 103 bp, Artificial Sequence
  Synthetic Polynucleotide
taatacgactcactataggggcagaaggtgatgcgtggagtgtctacaataacagaggagaattgtaatgactccacgcaacctggcggcagcgcaaaagatg

SEQ ID NO: 40836 - DNA, 103 bp, Artificial Sequence
  Synthetic Polynucleotide
taatacgactcactatagggacaaaggtagcgggcagcaccgaacgacgtaacagaggagaacgtcgatgggtgctgccaacctggcggcagcgcaaaagatg

SEQ ID NO: 40837 - DNA, 103 bp, Artificial Sequence
  Synthetic Polynucleotide
taatacgactcactatagggaacctaacaagcgtatcccattccttaaccaacagaggagaggttaaatgatgggatacaacctggcggcagcgcaaaagatg

SEQ ID NO: 40838 - DNA, 103 bp, Artificial Sequence
  Synthetic Polynucleotide
taatacgactcactatagggtcacgggagaatccctgactgtgaacagagaacagaggagactctgtatgcagtcagggaacctggcggcagcgcaaaagatg

SEQ ID NO: 40839 - DNA, 103 bp, Artificial Sequence
  Synthetic Polynucleotide
taatacgactcactatagggtctttggcatttgcatgttaccttcgttgtaacagaggagaacaacgatggtaacatgcaacctggcggcagcgcaaaagatg

SEQ ID NO: 40840 - DNA, 103 bp, Artificial Sequence
  Synthetic Polynucleotide
taatacgactcactataggggaataagcgagcactgtcttgcctattgcgaacagaggagacgcaatatgcaagacagtaacctggcggcagcgcaaaagatg

SEQ ID NO: 40841 - DNA, 103 bp, Artificial Sequence
  Synthetic Polynucleotide
taatacgactcactataggggtctagcatttgaatcggtgcaatgtttgaaacagaggagatcaaacatggcaccgattaacctggcggcagcgcaaaagatg

SEQ ID NO: 40842 - DNA, 103 bp, Artificial Sequence
  Synthetic Polynucleotide
taatacgactcactataggggggagcaaagacagaatcctttcaatgcgcaacagaggagagcgcatatgaaggattctaacctggcggcagcgcaaaagatg

SEQ ID NO: 40843 - DNA, 103 bp, Artificial Sequence
  Synthetic Polynucleotide
taatacgactcactatagggcaggctaatcaaggagatgccgaaggctcgaacagaggagacgagccatgggcatctccaacctggcggcagcgcaaaagatg

SEQ ID NO: 40844 - DNA, 103 bp, Artificial Sequence
  Synthetic Polynucleotide
taatacgactcactatagggagcgtagtctcagtcaaaatgatatatgtcaacagaggagagacataatgcattttgacaacctggcggcagcgcaaaagatg

SEQ ID NO: 40845 - DNA, 103 bp, Artificial Sequence
  Synthetic Polynucleotide
taatacgactcactatagggcagcaggtttatccttttcttccccttccgaacagaggagacggaagatgaagaaaaggaacctggcggcagcgcaaaagatg

SEQ ID NO: 40846 - DNA, 103 bp, Artificial Sequence
  Synthetic Polynucleotide
taatacgactcactatagggctcggtcccttaaggttggcccaatgtggtaacagaggagaaccacaatgggccaacctaacctggcggcagcgcaaaagatg

SEQ ID NO: 40847 - DNA, 103 bp, Artificial Sequence
  Synthetic Polynucleotide
taatacgactcactataggggagggtttggattgtcgctcacctttttgcaacagaggagagcaaaaatgtgagcgacaaacctggcggcagcgcaaaagatg

SEQ ID NO: 40848 - DNA, 103 bp, Artificial Sequence
  Synthetic Polynucleotide
taatacgactcactatagggaactgctcgcgtgctgagtatattattcacaacagaggagagtgaatatgatactcagcaacctggcggcagcgcaaaagatg

SEQ ID NO: 40849 - DNA, 103 bp, Artificial Sequence
  Synthetic Polynucleotide
taatacgactcactatagggctacgtttccagttcaatttgtactacggtaacagaggagaaccgtaatgcaaattgaaaacctggcggcagcgcaaaagatg

SEQ ID NO: 40850 - DNA, 103 bp, Artificial Sequence
  Synthetic Polynucleotide
taatacgactcactataggggcatgcccaatcgacaggaaacaagtccctaacagaggagaagggacatgtttcctgtcaacctggcggcagcgcaaaagatg

SEQ ID NO: 40851 - DNA, 103 bp, Artificial Sequence
  Synthetic Polynucleotide
taatacgactcactataggggaacgccagcttgttgaaactcgaggccacaacagaggagagtggccatgagtttcaacaacctggcggcagcgcaaaagatg

SEQ ID NO: 40852 - DNA, 103 bp, Artificial Sequence
  Synthetic Polynucleotide
taatacgactcactatagggtggataacttatccgctgtatgatacagctaacagaggagaagctgtatgatacagcggaacctggcggcagcgcaaaagatg

SEQ ID NO: 40853 - DNA, 103 bp, Artificial Sequence
  Synthetic Polynucleotide
taatacgactcactatagggacccgccttgagcgatcagacacacctcacaacagaggagagtgaggatggtctgatcgaacctggcggcagcgcaaaagatg

SEQ ID NO: 40854 - DNA, 103 bp, Artificial Sequence
  Synthetic Polynucleotide
taatacgactcactataggggctcggggcaaacgcgagttgggataacgcaacagaggagagcgttaatgcaactcgcgaacctggcggcagcgcaaaagatg

SEQ ID NO: 40855 - DNA, 103 bp, Artificial Sequence
  Synthetic Polynucleotide
taatacgactcactatagggtaaggagtgcgcgtctatcccagtgggtgtaacagaggagaacacccatggggatagacaacctggcggcagcgcaaaagatg

SEQ ID NO: 40856 - DNA, 103 bp, Artificial Sequence
  Synthetic Polynucleotide
taatacgactcactatagggacgtcgaccacccgccctgatcatgttaggaacagaggagacctaacatgatcagggcgaacctggcggcagcgcaaaagatg

SEQ ID NO: 40857 - DNA, 103 bp, Artificial Sequence
  Synthetic Polynucleotide
taatacgactcactatagggggaagccagcggctaggtgcccgttgtgataacagaggagaatcacaatgggcacctagaacctggcggcagcgcaaaagatg

SEQ ID NO: 40858 - DNA, 103 bp, Artificial Sequence
  Synthetic Polynucleotide
taatacgactcactatagggctcatgattgagatacatagacaagttcataacagaggagaatgaacatgtctatgtataacctggcggcagcgcaaaagatg

SEQ ID NO: 40859 - DNA, 103 bp, Artificial Sequence
  Synthetic Polynucleotide
taatacgactcactatagggtttcctaatgccttgacctgaaaaattgtcaacagaggagagacaatatgtcaggtcaaaacctggcggcagcgcaaaagatg

SEQ ID NO: 40860 - DNA, 103 bp, Artificial Sequence
  Synthetic Polynucleotide
taatacgactcactatagggaaacagcatgacgcagccggttaattgatgaacagaggagacatcaaatgaccggctgcaacctggcggcagcgcaaaagatg

SEQ ID NO: 40861 - DNA, 103 bp, Artificial Sequence
  Synthetic Polynucleotide
taatacgactcactatagggcaaaggccaaacctagaacaacagttgatgaacagaggagacatcaaatgttgttctagaacctggcggcagcgcaaaagatg

SEQ ID NO: 40862 - DNA, 103 bp, Artificial Sequence
  Synthetic Polynucleotide
taatacgactcactataggggcataattactgttcgtggaccaacgcaataacagaggagaattgcgatggtccacgaaaacctggcggcagcgcaaaagatg

SEQ ID NO: 40863 - DNA, 103 bp, Artificial Sequence
  Synthetic Polynucleotide
taatacgactcactatagggatctgcatgaagatggtggctagcatgcgaaacagaggagatcgcatatgagccaccataacctggcggcagcgcaaaagatg

SEQ ID NO: 40864 - DNA, 103 bp, Artificial Sequence
  Synthetic Polynucleotide
taatacgactcactataggggtgcgcagtaatatagcggagaagttcgtgaacagaggagacacgaaatgctccgctataacctggcggcagcgcaaaagatg

SEQ ID NO: 40865 - DNA, 103 bp, Artificial Sequence
  Synthetic Polynucleotide
taatacgactcactatagggctggtctcttgttatagacctagctcccataacagaggagaatgggaatgaggtctataaacctggcggcagcgcaaaagatg

SEQ ID NO: 40866 - DNA, 103 bp, Artificial Sequence
  Synthetic Polynucleotide
taatacgactcactatagggacaattttggcgagcgtctgccaatagtggaacagaggagaccactaatggcagacgctaacctggcggcagcgcaaaagatg

SEQ ID NO: 40867 - DNA, 103 bp, Artificial Sequence
  Synthetic Polynucleotide
taatacgactcactatagggagtagggcacctgtgtgtcccaactacccgaacagaggagacgggtaatggggacacacaacctggcggcagcgcaaaagatg

SEQ ID NO: 40868 - DNA, 103 bp, Artificial Sequence
  Synthetic Polynucleotide
taatacgactcactataggggatggaaacctcttacacgattaggtaccaaacagaggagatggtacatgatcgtgtaaaacctggcggcagcgcaaaagatg

SEQ ID NO: 40869 - DNA, 103 bp, Artificial Sequence
  Synthetic Polynucleotide
taatacgactcactatagggcacccaatcggagccgagctcttaatcaagaacagaggagacttgatatggagctcggcaacctggcggcagcgcaaaagatg

SEQ ID NO: 40870 - DNA, 103 bp, Artificial Sequence
  Synthetic Polynucleotide
taatacgactcactataggggcgtcgcactacgactcgaacagggctgcgaacagaggagacgcagcatggttcgagtcaacctggcggcagcgcaaaagatg

SEQ ID NO: 40871 - DNA, 103 bp, Artificial Sequence
  Synthetic Polynucleotide
taatacgactcactataggggcttgggtccgtcgtggccctgtttttaataacagaggagaattaaaatgagggccacgaacctggcggcagcgcaaaagatg

SEQ ID NO: 40872 - DNA, 103 bp, Artificial Sequence
  Synthetic Polynucleotide
taatacgactcactatagggcaatatatgggatcgcacagtttgcttgaaaacagaggagattcaagatgactgtgcgaaacctggcggcagcgcaaaagatg

SEQ ID NO: 40873 - DNA, 103 bp, Artificial Sequence
  Synthetic Polynucleotide
taatacgactcactatagggcattattgtgttatccttaccgcgaatggcaacagaggagagccattatgggtaaggataacctggcggcagcgcaaaagatg

SEQ ID NO: 40874 - DNA, 103 bp, Artificial Sequence
  Synthetic Polynucleotide
taatacgactcactatagggccacgccagtcgcaaaagaacctctcgtgaaacagaggagatcacgaatggttcttttgaacctggcggcagcgcaaaagatg

SEQ ID NO: 40875 - DNA, 103 bp, Artificial Sequence
  Synthetic Polynucleotide
taatacgactcactatagggaggtgggctctagggagaagttatggggtaaacagaggagataccccatgacttctcccaacctggcggcagcgcaaaagatg

SEQ ID NO: 40876 - DNA, 103 bp, Artificial Sequence
  Synthetic Polynucleotide
taatacgactcactatagggtagtctccagcgacccatctagatataaccaacagaggagaggttatatgtagatgggtaacctggcggcagcgcaaaagatg

SEQ ID NO: 40877 - DNA, 103 bp, Artificial Sequence
  Synthetic Polynucleotide
taatacgactcactatagggaatatcgattaaatctagtgaagatggagcaacagaggagagctccaatgtcactagataacctggcggcagcgcaaaagatg

SEQ ID NO: 40878 - DNA, 103 bp, Artificial Sequence
  Synthetic Polynucleotide
taatacgactcactataggggggggtgcgaaggaccgataacattaacctaacagaggagaaggttaatgttatcggtcaacctggcggcagcgcaaaagatg

SEQ ID NO: 40879 - DNA, 103 bp, Artificial Sequence
  Synthetic Polynucleotide
taatacgactcactataggggcgtatcgtaggcagtcgtctgattaattcaacagaggagagaattaatgagacgactgaacctggcggcagcgcaaaagatg

SEQ ID NO: 40880 - DNA, 103 bp, Artificial Sequence
  Synthetic Polynucleotide
taatacgactcactatagggggtcggattgtgagacttattttctatcgcaacagaggagagcgataatgaataagtctaacctggcggcagcgcaaaagatg

SEQ ID NO: 40881 - DNA, 103 bp, Artificial Sequence
  Synthetic Polynucleotide
taatacgactcactatagggcagctgcgctcatacaacaagactaatcataacagaggagaatgattatgcttgttgtaaacctggcggcagcgcaaaagatg

SEQ ID NO: 40882 - DNA, 103 bp, Artificial Sequence
  Synthetic Polynucleotide
taatacgactcactatagggtctggagccagatcacagcgagattttcaaaacagaggagattgaaaatgtcgctgtgaaacctggcggcagcgcaaaagatg

SEQ ID NO: 40883 - DNA, 103 bp, Artificial Sequence
  Synthetic Polynucleotide
taatacgactcactatagggttcgcgccttggataacgcgacacagcgtaaacagaggagatacgctatgtcgcgttataacctggcggcagcgcaaaagatg

SEQ ID NO: 40884 - DNA, 103 bp, Artificial Sequence
  Synthetic Polynucleotide
taatacgactcactataggggcgcctggtcttcttcattctgcagagttcaacagaggagagaactcatgagaatgaagaacctggcggcagcgcaaaagatg

SEQ ID NO: 40885 - DNA, 103 bp, Artificial Sequence
  Synthetic Polynucleotide
taatacgactcactataggggcgcttcggtgcccgagtctttcgacagcaaacagaggagatgctgtatgaagactcggaacctggcggcagcgcaaaagatg

SEQ ID NO: 40886 - DNA, 103 bp, Artificial Sequence
  Synthetic Polynucleotide
taatacgactcactatagggctagggtaaatgggggttcctaatcgacgcaacagaggagagcgtcgatgaggaaccccaacctggcggcagcgcaaaagatg

SEQ ID NO: 40887 - DNA, 103 bp, Artificial Sequence
  Synthetic Polynucleotide
taatacgactcactatagggaacagaaatggtccgtcaacagatggggcaaacagaggagatgccccatgtgttgacggaacctggcggcagcgcaaaagatg

SEQ ID NO: 40888 - DNA, 103 bp, Artificial Sequence
  Synthetic Polynucleotide
taatacgactcactatagggtcgactagcgtaaactggccatgtaagtacaacagaggagagtacttatgtggccagttaacctggcggcagcgcaaaagatg

SEQ ID NO: 40889 - DNA, 103 bp, Artificial Sequence
  Synthetic Polynucleotide
taatacgactcactatagggtgtagccccttaaactaatgtggctcccgaaacagaggagatcgggaatgacattagttaacctggcggcagcgcaaaagatg

SEQ ID NO: 40890 - DNA, 103 bp, Artificial Sequence
  Synthetic Polynucleotide
taatacgactcactatagggcgtgccgcaacatcagggcagcgcgccaccaacagaggagaggtggcatgctgccctgaaacctggcggcagcgcaaaagatg

SEQ ID NO: 40891 - DNA, 103 bp, Artificial Sequence
  Synthetic Polynucleotide
taatacgactcactatagggctctcctttgcgctttccctgcgcacctaaaacagaggagattaggtatgcagggaaagaacctggcggcagcgcaaaagatg

SEQ ID NO: 40892 - DNA, 103 bp, Artificial Sequence
  Synthetic Polynucleotide
taatacgactcactatagggggagacctgatgcagaaatttaaactagcgaacagaggagacgctagatgaaatttctgaacctggcggcagcgcaaaagatg

SEQ ID NO: 40893 - DNA, 103 bp, Artificial Sequence
  Synthetic Polynucleotide
taatacgactcactataggggtcagtgataagtgagtctggacgcggtctaacagaggagaagaccgatgccagactcaaacctggcggcagcgcaaaagatg

SEQ ID NO: 40894 - DNA, 103 bp, Artificial Sequence
  Synthetic Polynucleotide
taatacgactcactatagggtattaggaagtcgtccctactgcaccccacaacagaggagagtggggatgagtagggacaacctggcggcagcgcaaaagatg

SEQ ID NO: 40895 - DNA, 103 bp, Artificial Sequence
  Synthetic Polynucleotide
taatacgactcactatagggagccgcaccttggatcatctcttaagagacaacagaggagagtctctatggagatgatcaacctggcggcagcgcaaaagatg

SEQ ID NO: 40896 - DNA, 103 bp, Artificial Sequence
  Synthetic Polynucleotide
taatacgactcactatagggatttacgcagcttaggtcataccacttaagaacagaggagacttaagatgtatgacctaaacctggcggcagcgcaaaagatg

SEQ ID NO: 40897 - DNA, 103 bp, Artificial Sequence
  Synthetic Polynucleotide
taatacgactcactatagggacttctctcgggcgtattctgcgatcacggaacagaggagaccgtgaatgcagaatacgaacctggcggcagcgcaaaagatg

SEQ ID NO: 40898 - DNA, 103 bp, Artificial Sequence
  Synthetic Polynucleotide
taatacgactcactatagggtccccctatttcgccataggcccatattgtaacagaggagaacaataatggcctatggcaacctggcggcagcgcaaaagatg

SEQ ID NO: 40899 - DNA, 103 bp, Artificial Sequence
  Synthetic Polynucleotide
taatacgactcactatagggagacgatacattcgtgagtgcgtttctaacaacagaggagagttagaatggcactcacgaacctggcggcagcgcaaaagatg

SEQ ID NO: 40900 - DNA, 103 bp, Artificial Sequence
  Synthetic Polynucleotide
taatacgactcactatagggactcggttagcacacgccactataggactaaacagaggagatagtccatgagtggcgtgaacctggcggcagcgcaaaagatg

SEQ ID NO: 40901 - DNA, 103 bp, Artificial Sequence
  Synthetic Polynucleotide
taatacgactcactataggggtggggcgaagatctgcggttcagtggctaaacagaggagatagccaatgaaccgcagaaacctggcggcagcgcaaaagatg

SEQ ID NO: 40902 - DNA, 103 bp, Artificial Sequence
  Synthetic Polynucleotide
taatacgactcactatagggcttactagtcattagaacaaccatacgattaacagaggagaaatcgtatggttgttctaaacctggcggcagcgcaaaagatg

SEQ ID NO: 40903 - DNA, 103 bp, Artificial Sequence
  Synthetic Polynucleotide
taatacgactcactatagggttcttactgcctcgataatcgggaggttggaacagaggagaccaaccatgcgattatcgaacctggcggcagcgcaaaagatg

SEQ ID NO: 40904 - DNA, 103 bp, Artificial Sequence
  Synthetic Polynucleotide
taatacgactcactatagggttgtacatgaggagactttcacgtctgaagaacagaggagacttcagatgtgaaagtctaacctggcggcagcgcaaaagatg

SEQ ID NO: 40905 - DNA, 103 bp, Artificial Sequence
  Synthetic Polynucleotide
taatacgactcactataggggaaggtatgaatgtccaacttcgattctctaacagaggagaagagaaatgaagttggacaacctggcggcagcgcaaaagatg

SEQ ID NO: 40906 - DNA, 103 bp, Artificial Sequence
  Synthetic Polynucleotide
taatacgactcactatagggaatgtgcctaacagtctgcggtgaccccagaacagaggagactggggatgccgcagactaacctggcggcagcgcaaaagatg

SEQ ID NO: 40907 - DNA, 103 bp, Artificial Sequence
  Synthetic Polynucleotide
taatacgactcactatagggcaggaaccaagtgggagggcatcttttgagaacagaggagactcaaaatgtgccctcccaacctggcggcagcgcaaaagatg

SEQ ID NO: 40908 - DNA, 103 bp, Artificial Sequence
  Synthetic Polynucleotide
taatacgactcactatagggttgatctttgagttccctactgaatcgcccaacagaggagagggcgaatgagtagggaaaacctggcggcagcgcaaaagatg

SEQ ID NO: 40909 - DNA, 103 bp, Artificial Sequence
  Synthetic Polynucleotide
taatacgactcactataggggcgggtggccaactgctgctaatccagagtaacagaggagaactctgatgtagcagcagaacctggcggcagcgcaaaagatg

SEQ ID NO: 40910 - DNA, 103 bp, Artificial Sequence
  Synthetic Polynucleotide
taatacgactcactatagggaatgtcctacggacggaacctgcagtctagaacagaggagactagacatgaggttccgtaacctggcggcagcgcaaaagatg

SEQ ID NO: 40911 - DNA, 103 bp, Artificial Sequence
  Synthetic Polynucleotide
taatacgactcactatagggggattaactgttaaattttcttaccgttcaaacagaggagatgaacgatgagaaaatttaacctggcggcagcgcaaaagatg

SEQ ID NO: 40912 - DNA, 103 bp, Artificial Sequence
  Synthetic Polynucleotide
taatacgactcactataggggagcgcgacgaatgcgctagcggtatcggcaacagaggagagccgatatggctagcgcaaacctggcggcagcgcaaaagatg

SEQ ID NO: 40913 - DNA, 103 bp, Artificial Sequence
  Synthetic Polynucleotide
taatacgactcactatagggaggcagccaagctacttctaaaaatacactaacagaggagaagtgtaatgttagaagtaaacctggcggcagcgcaaaagatg

SEQ ID NO: 40914 - DNA, 103 bp, Artificial Sequence
  Synthetic Polynucleotide
taatacgactcactatagggttgatcatacctatgcgcatcatgaatacaaacagaggagatgtattatggatgcgcataacctggcggcagcgcaaaagatg

SEQ ID NO: 40915 - DNA, 103 bp, Artificial Sequence
  Synthetic Polynucleotide
taatacgactcactatagggggcatactattggcagtcacactgttggacaacagaggagagtccaaatgtgtgactgcaacctggcggcagcgcaaaagatg

SEQ ID NO: 40916 - DNA, 103 bp, Artificial Sequence
  Synthetic Polynucleotide
taatacgactcactataggggatcgtctgcctgccgcttcctgctatgccaacagaggagaggcataatgggaagcggcaacctggcggcagcgcaaaagatg

SEQ ID NO: 40917 - DNA, 103 bp, Artificial Sequence
  Synthetic Polynucleotide
taatacgactcactatagggcaccccggtcacagactgatgtcgttctccaacagaggagaggagaaatgcatcagtctaacctggcggcagcgcaaaagatg

SEQ ID NO: 40918 - DNA, 103 bp, Artificial Sequence
  Synthetic Polynucleotide
taatacgactcactatagggcattggggtctggcattatgggtttgccgaaacagaggagatcggcaatgccataatgcaacctggcggcagcgcaaaagatg

SEQ ID NO: 40919 - DNA, 103 bp, Artificial Sequence
  Synthetic Polynucleotide
taatacgactcactatagggtcacccacataactgcatcggtacgttagtaacagaggagaactaacatgccgatgcagaacctggcggcagcgcaaaagatg

SEQ ID NO: 40920 - DNA, 103 bp, Artificial Sequence
  Synthetic Polynucleotide
taatacgactcactatagggcgtacacgttttttaccagccccttatgtgaacagaggagacacataatgggctggtaaaacctggcggcagcgcaaaagatg

SEQ ID NO: 40921 - DNA, 103 bp, Artificial Sequence
  Synthetic Polynucleotide
taatacgactcactatagggttcttccagtacataaagggacacagggggaacagaggagaccccctatgtccctttataacctggcggcagcgcaaaagatg

SEQ ID NO: 40922 - DNA, 103 bp, Artificial Sequence
  Synthetic Polynucleotide
taatacgactcactataggggcctcagtgtgtttgacacgaggacaaatcaacagaggagagatttgatgtcgtgtcaaaacctggcggcagcgcaaaagatg

SEQ ID NO: 40923 - DNA, 103 bp, Artificial Sequence
  Synthetic Polynucleotide
taatacgactcactatagggaaccggacctatccgctcccaaatgataataacagaggagaattatcatgtgggagcggaacctggcggcagcgcaaaagatg

SEQ ID NO: 40924 - DNA, 103 bp, Artificial Sequence
  Synthetic Polynucleotide
taatacgactcactatagggggtttcccacgggtctgagtgacttacacgaacagaggagacgtgtaatgcactcagacaacctggcggcagcgcaaaagatg

SEQ ID NO: 40925 - DNA, 103 bp, Artificial Sequence
  Synthetic Polynucleotide
taatacgactcactatagggtggctgggcacacttcaaagagcgtctgtcaacagaggagagacagaatgtctttgaagaacctggcggcagcgcaaaagatg

SEQ ID NO: 40926 - DNA, 103 bp, Artificial Sequence
  Synthetic Polynucleotide
taatacgactcactatagggtcacgcggccgatctcaacatctcatgttcaacagaggagagaacatatgatgttgagaaacctggcggcagcgcaaaagatg

SEQ ID NO: 40927 - DNA, 103 bp, Artificial Sequence
  Synthetic Polynucleotide
taatacgactcactatagggattgcacgcacctaaaccatttaccaaagtaacagaggagaactttgatgaatggtttaaacctggcggcagcgcaaaagatg

SEQ ID NO: 40928 - DNA, 103 bp, Artificial Sequence
  Synthetic Polynucleotide
taatacgactcactatagggcagttggcacattttcgatgcgacctaccaaacagaggagatggtagatggcatcgaaaaacctggcggcagcgcaaaagatg

SEQ ID NO: 40929 - DNA, 103 bp, Artificial Sequence
  Synthetic Polynucleotide
taatacgactcactatagggtccaaccaacccaatggatttgatttcgtcaacagaggagagacgaaatgaaatccattaacctggcggcagcgcaaaagatg

SEQ ID NO: 40930 - DNA, 103 bp, Artificial Sequence
  Synthetic Polynucleotide
taatacgactcactataggggtcctatcaagtgagatctgttaactttgaaacagaggagatcaaagatgacagatctcaacctggcggcagcgcaaaagatg

SEQ ID NO: 40931 - DNA, 103 bp, Artificial Sequence
  Synthetic Polynucleotide
taatacgactcactataggggtagcgggttttatggtgccgcggggtacgaacagaggagacgtaccatgcggcaccataacctggcggcagcgcaaaagatg

SEQ ID NO: 40932 - DNA, 103 bp, Artificial Sequence
  Synthetic Polynucleotide
taatacgactcactatagggtttccccccgtccacagctcgtgactagcaaacagaggagatgctagatgcgagctgtgaacctggcggcagcgcaaaagatg

SEQ ID NO: 40933 - DNA, 103 bp, Artificial Sequence
  Synthetic Polynucleotide
taatacgactcactatagggtggatagattgcttccccgaaggcagctataacagaggagaatagctatgttcggggaaaacctggcggcagcgcaaaagatg

SEQ ID NO: 40934 - DNA, 103 bp, Artificial Sequence
  Synthetic Polynucleotide
taatacgactcactatagggtcgccactgacaggcggatagcgagtcgataacagaggagaatcgacatgctatccgccaacctggcggcagcgcaaaagatg

SEQ ID NO: 40935 - DNA, 103 bp, Artificial Sequence
  Synthetic Polynucleotide
taatacgactcactatagggtgttgcttcccgttttcccgcactggggctaacagaggagaagccccatggcgggaaaaaacctggcggcagcgcaaaagatg

SEQ ID NO: 40936 - DNA, 103 bp, Artificial Sequence
  Synthetic Polynucleotide
taatacgactcactataggggctacttgcatgcgaatacacagactgtctaacagaggagaagacagatggtgtattcgaacctggcggcagcgcaaaagatg

SEQ ID NO: 40937 - DNA, 103 bp, Artificial Sequence
  Synthetic Polynucleotide
taatacgactcactatagggccagcacggtttagttattgccgatgaggtaacagaggagaacctcaatggcaataactaacctggcggcagcgcaaaagatg

SEQ ID NO: 40938 - DNA, 103 bp, Artificial Sequence
  Synthetic Polynucleotide
taatacgactcactataggggcatgaaatccagagaggctcatcttccgcaacagaggagagcggaaatggagcctctcaacctggcggcagcgcaaaagatg

SEQ ID NO: 40939 - DNA, 103 bp, Artificial Sequence
  Synthetic Polynucleotide
taatacgactcactatagggctcgttttttgtaaggcctcacctgatgacaacagaggagagtcatcatgtgaggccttaacctggcggcagcgcaaaagatg

SEQ ID NO: 40940 - DNA, 103 bp, Artificial Sequence
  Synthetic Polynucleotide
taatacgactcactatagggcataatggcaattagacattgtcgctctagaacagaggagactagagatgcaatgtctaaacctggcggcagcgcaaaagatg

SEQ ID NO: 40941 - DNA, 103 bp, Artificial Sequence
  Synthetic Polynucleotide
taatacgactcactatagggttacgattccggccgtgggggatttttaacaacagaggagagttaaaatgcccccacggaacctggcggcagcgcaaaagatg

SEQ ID NO: 40942 - DNA, 103 bp, Artificial Sequence
  Synthetic Polynucleotide
taatacgactcactatagggctattattatgtagccactttactaccgtaaacagaggagatacggtatgaaagtggctaacctggcggcagcgcaaaagatg

SEQ ID NO: 40943 - DNA, 103 bp, Artificial Sequence
  Synthetic Polynucleotide
taatacgactcactataggggcatcgtgcgaactaaacacctactcccttaacagaggagaaagggaatgggtgtttagaacctggcggcagcgcaaaagatg

SEQ ID NO: 40944 - DNA, 103 bp, Artificial Sequence
  Synthetic Polynucleotide
taatacgactcactatagggtaagttaacatgcctaccgaaaagctcgggaacagaggagacccgagatgttcggtaggaacctggcggcagcgcaaaagatg

SEQ ID NO: 40945 - DNA, 103 bp, Artificial Sequence
  Synthetic Polynucleotide
taatacgactcactatagggagctcgggttgcacacgccttgtcttggggaacagaggagaccccaaatgaaggcgtgtaacctggcggcagcgcaaaagatg

SEQ ID NO: 40946 - DNA, 103 bp, Artificial Sequence
  Synthetic Polynucleotide
taatacgactcactatagggtgaaccgtcgtggggaaacccacgctgactaacagaggagaagtcagatggggtttcccaacctggcggcagcgcaaaagatg

SEQ ID NO: 40947 - DNA, 103 bp, Artificial Sequence
  Synthetic Polynucleotide
taatacgactcactatagggtcgcctcagacgcccttacatagttatgcaaacagaggagatgcataatgatgtaagggaacctggcggcagcgcaaaagatg

SEQ ID NO: 40948 - DNA, 103 bp, Artificial Sequence
  Synthetic Polynucleotide
taatacgactcactatagggagaggaggatttaatgtagcgccatataagaacagaggagacttataatgcgctacattaacctggcggcagcgcaaaagatg

SEQ ID NO: 40949 - DNA, 103 bp, Artificial Sequence
  Synthetic Polynucleotide
taatacgactcactataggggttgcggaactctaactgggcatcactccaaacagaggagatggagtatggcccagttaaacctggcggcagcgcaaaagatg

SEQ ID NO: 40950 - DNA, 103 bp, Artificial Sequence
  Synthetic Polynucleotide
taatacgactcactataggggttcccacgaacaagtcaaacatacaggataacagaggagaatcctgatggtttgacttaacctggcggcagcgcaaaagatg

SEQ ID NO: 40951 - DNA, 103 bp, Artificial Sequence
  Synthetic Polynucleotide
taatacgactcactatagggttccagccgagaatggctctgcccccctttaacagaggagaaaagggatgcagagccataacctggcggcagcgcaaaagatg

SEQ ID NO: 40952 - DNA, 103 bp, Artificial Sequence
  Synthetic Polynucleotide
taatacgactcactatagggcctgatatgtcatttaacggcctccatggaaacagaggagatccatgatggccgttaaaaacctggcggcagcgcaaaagatg

SEQ ID NO: 40953 - DNA, 103 bp, Artificial Sequence
  Synthetic Polynucleotide
taatacgactcactataggggactctcagtcaagccttggctgccagccgaacagaggagacggctgatggccaaggctaacctggcggcagcgcaaaagatg

SEQ ID NO: 40954 - DNA, 103 bp, Artificial Sequence
  Synthetic Polynucleotide
taatacgactcactatagggcactggggttgttcgaagcgtgtacactagaacagaggagactagtgatgacgcttcgaaacctggcggcagcgcaaaagatg

SEQ ID NO: 40955 - DNA, 103 bp, Artificial Sequence
  Synthetic Polynucleotide
taatacgactcactatagggcaaatcagaaagttccgggcacgaaccggaaacagaggagatccggtatgtgcccggaaaacctggcggcagcgcaaaagatg

SEQ ID NO: 40956 - DNA, 103 bp, Artificial Sequence
  Synthetic Polynucleotide
taatacgactcactatagggtatcgagtagggatcgtggcgaaacatggtaacagaggagaaccatgatgcgccacgataacctggcggcagcgcaaaagatg

SEQ ID NO: 40957 - DNA, 103 bp, Artificial Sequence
  Synthetic Polynucleotide
taatacgactcactatagggatcattgcgggaatctgtgaccaaaggtggaacagaggagaccacctatggtcacagataacctggcggcagcgcaaaagatg

SEQ ID NO: 40958 - DNA, 103 bp, Artificial Sequence
  Synthetic Polynucleotide
taatacgactcactatagggttttgacttctgcgtttgtgcgggtgccataacagaggagaatggcaatggcacaaacgaacctggcggcagcgcaaaagatg

SEQ ID NO: 40959 - DNA, 103 bp, Artificial Sequence
  Synthetic Polynucleotide
taatacgactcactataggggaccctacggggaagccaccccgacagataaacagaggagatatctgatggggtggcttaacctggcggcagcgcaaaagatg

SEQ ID NO: 40960 - DNA, 103 bp, Artificial Sequence
  Synthetic Polynucleotide
taatacgactcactatagggaccgcagatcctcgatacctgccacattggaacagaggagaccaatgatgcaggtatcgaacctggcggcagcgcaaaagatg

SEQ ID NO: 40961 - DNA, 103 bp, Artificial Sequence
  Synthetic Polynucleotide
taatacgactcactatagggagggattaagcacgagcttggcgacccaagaacagaggagacttgggatgccaagctcgaacctggcggcagcgcaaaagatg

SEQ ID NO: 40962 - DNA, 103 bp, Artificial Sequence
  Synthetic Polynucleotide
taatacgactcactatagggatggacgggttcaacttgtcgcctatgatcaacagaggagagatcatatgcgacaagttaacctggcggcagcgcaaaagatg

SEQ ID NO: 40963 - DNA, 103 bp, Artificial Sequence
  Synthetic Polynucleotide
taatacgactcactatagggagctagttccagaggcgaagcgtcataaaaaacagaggagattttatatggcttcgcctaacctggcggcagcgcaaaagatg

SEQ ID NO: 40964 - DNA, 103 bp, Artificial Sequence
  Synthetic Polynucleotide
taatacgactcactatagggttttttagattgtccgtatgccgcacgtgaaacagaggagatcacgtatggcatacggaaacctggcggcagcgcaaaagatg

SEQ ID NO: 40965 - DNA, 103 bp, Artificial Sequence
  Synthetic Polynucleotide
taatacgactcactataggggcttccccggtctcatatacgagagaaaacaacagaggagagttttcatgcgtatatgaaacctggcggcagcgcaaaagatg

SEQ ID NO: 40966 - DNA, 103 bp, Artificial Sequence
  Synthetic Polynucleotide
taatacgactcactatagggttgtagcgtccagcgctctgcatcaccgagaacagaggagactcggtatggcagagcgcaacctggcggcagcgcaaaagatg

SEQ ID NO: 40967 - DNA, 103 bp, Artificial Sequence
  Synthetic Polynucleotide
taatacgactcactatagggggggcacgctttgtgcggccatattcagggaacagaggagaccctgaatgtggccgcacaacctggcggcagcgcaaaagatg

SEQ ID NO: 40968 - DNA, 103 bp, Artificial Sequence
  Synthetic Polynucleotide
taatacgactcactatagggagagcgagccctaaatcgggcacccataataacagaggagaattatgatggcccgatttaacctggcggcagcgcaaaagatg

SEQ ID NO: 40969 - DNA, 103 bp, Artificial Sequence
  Synthetic Polynucleotide
taatacgactcactatagggcgagtaattctcgtagagagtcaatattgcaacagaggagagcaataatgactctctacaacctggcggcagcgcaaaagatg

SEQ ID NO: 40970 - DNA, 103 bp, Artificial Sequence
  Synthetic Polynucleotide
taatacgactcactatagggtggtttgcttacgagatgatttaacaacgaaacagaggagatcgttgatgaatcatctcaacctggcggcagcgcaaaagatg

SEQ ID NO: 40971 - DNA, 103 bp, Artificial Sequence
  Synthetic Polynucleotide
taatacgactcactataggggtgggccgtcaacttcaccgaagttttcacaacagaggagagtgaaaatgtcggtgaagaacctggcggcagcgcaaaagatg

SEQ ID NO: 40972 - DNA, 103 bp, Artificial Sequence
  Synthetic Polynucleotide
taatacgactcactatagggacttaacactaagaatctacgctggagaacaacagaggagagttctcatgcgtagattcaacctggcggcagcgcaaaagatg

SEQ ID NO: 40973 - DNA, 103 bp, Artificial Sequence
  Synthetic Polynucleotide
taatacgactcactatagggacatttatcgctaggaccactggtcggaccaacagaggagaggtccgatgagtggtcctaacctggcggcagcgcaaaagatg

SEQ ID NO: 40974 - DNA, 103 bp, Artificial Sequence
  Synthetic Polynucleotide
taatacgactcactatagggtaatcttatacggatgggggcctttagtagaacagaggagactactaatggcccccatcaacctggcggcagcgcaaaagatg

SEQ ID NO: 40975 - DNA, 103 bp, Artificial Sequence
  Synthetic Polynucleotide
taatacgactcactatagggagtagtacgtttcgagaaagagcacttcttaacagaggagaaagaagatgtctttctcgaacctggcggcagcgcaaaagatg

SEQ ID NO: 40976 - DNA, 103 bp, Artificial Sequence
  Synthetic Polynucleotide
taatacgactcactatagggagaaaaccgcgacacgattaacgggctaccaacagaggagaggtagcatgttaatcgtgaacctggcggcagcgcaaaagatg

SEQ ID NO: 40977 - DNA, 103 bp, Artificial Sequence
  Synthetic Polynucleotide
taatacgactcactatagggacttttaggtagcgagaaagggcatcacccaacagaggagagggtgaatgcctttctcgaacctggcggcagcgcaaaagatg

SEQ ID NO: 40978 - DNA, 103 bp, Artificial Sequence
  Synthetic Polynucleotide
taatacgactcactatagggtattttaggacagcagtaggacaacacagtaacagaggagaactgtgatgtcctactgcaacctggcggcagcgcaaaagatg

SEQ ID NO: 40979 - DNA, 103 bp, Artificial Sequence
  Synthetic Polynucleotide
taatacgactcactataggggacgtcttctcgtagtgggagatatacctaaacagaggagataggtaatgctcccactaaacctggcggcagcgcaaaagatg

SEQ ID NO: 40980 - DNA, 103 bp, Artificial Sequence
  Synthetic Polynucleotide
taatacgactcactataggggcgaggctaaacttcagcgtcacccaccgaaacagaggagatcggtgatggacgctgaaaacctggcggcagcgcaaaagatg

SEQ ID NO: 40981 - DNA, 103 bp, Artificial Sequence
  Synthetic Polynucleotide
taatacgactcactatagggcgctcagtcagtactcggcatctccggctcaacagaggagagagccgatgatgccgagtaacctggcggcagcgcaaaagatg

SEQ ID NO: 40982 - DNA, 103 bp, Artificial Sequence
  Synthetic Polynucleotide
taatacgactcactatagggttggataccatctgatctttatagccaagaaacagaggagatcttggatgtaaagatcaaacctggcggcagcgcaaaagatg

SEQ ID NO: 40983 - DNA, 103 bp, Artificial Sequence
  Synthetic Polynucleotide
taatacgactcactatagggatacccgtaaccgcactatgtctattcaccaacagaggagaggtgaaatgacatagtgcaacctggcggcagcgcaaaagatg

SEQ ID NO: 40984 - DNA, 103 bp, Artificial Sequence
  Synthetic Polynucleotide
taatacgactcactatagggtcccctaacgggaccggtcgcggtcgccgtaacagaggagaacggcgatggcgaccggtaacctggcggcagcgcaaaagatg

SEQ ID NO: 40985 - DNA, 103 bp, Artificial Sequence
  Synthetic Polynucleotide
taatacgactcactatagggctaaaactattcggttcgtcacattagaagaacagaggagacttctaatgtgacgaaccaacctggcggcagcgcaaaagatg

SEQ ID NO: 40986 - DNA, 103 bp, Artificial Sequence
  Synthetic Polynucleotide
taatacgactcactatagggagtagggcactgcgtaattttcgctaccaaaacagaggagattggtaatgaaaattacgaacctggcggcagcgcaaaagatg

SEQ ID NO: 40987 - DNA, 103 bp, Artificial Sequence
  Synthetic Polynucleotide
taatacgactcactatagggggcggagcgcatgggaggatacgccagtttaacagaggagaaaactgatgtatcctcccaacctggcggcagcgcaaaagatg

SEQ ID NO: 40988 - DNA, 103 bp, Artificial Sequence
  Synthetic Polynucleotide
taatacgactcactatagggagaatgacctttttcctagcggagccatgcaacagaggagagcatggatgcgctaggaaaacctggcggcagcgcaaaagatg

SEQ ID NO: 40989 - DNA, 103 bp, Artificial Sequence
  Synthetic Polynucleotide
taatacgactcactataggggaaagagcgtaacatcgggacgaggcccctaacagaggagaaggggcatggtcccgatgaacctggcggcagcgcaaaagatg

SEQ ID NO: 40990 - DNA, 103 bp, Artificial Sequence
  Synthetic Polynucleotide
taatacgactcactatagggcgtggggcttattaggcatcttgcccaagcaacagaggagagcttggatgagatgcctaaacctggcggcagcgcaaaagatg

SEQ ID NO: 40991 - DNA, 103 bp, Artificial Sequence
  Synthetic Polynucleotide
taatacgactcactatagggtttgtccatatttaagtcctaccaacgtttaacagaggagaaaacgtatgtaggacttaaacctggcggcagcgcaaaagatg

SEQ ID NO: 40992 - DNA, 103 bp, Artificial Sequence
  Synthetic Polynucleotide
taatacgactcactatagggaactgcatataagccccgcaacaaccgaccaacagaggagaggtcggatgttgcggggcaacctggcggcagcgcaaaagatg

SEQ ID NO: 40993 - DNA, 103 bp, Artificial Sequence
  Synthetic Polynucleotide
taatacgactcactataggggctctgcaacttatatgcgttctcgaagtcaacagaggagagacttcatgaacgcatataacctggcggcagcgcaaaagatg

SEQ ID NO: 40994 - DNA, 103 bp, Artificial Sequence
  Synthetic Polynucleotide
taatacgactcactatagggctcgctctgtttcctgatcgggctagagaaaacagaggagattctctatgccgatcaggaacctggcggcagcgcaaaagatg

SEQ ID NO: 40995 - DNA, 103 bp, Artificial Sequence
  Synthetic Polynucleotide
taatacgactcactatagggcacacgcattgtagttcgtatgttaggagaaacagaggagatctcctatgatacgaactaacctggcggcagcgcaaaagatg

SEQ ID NO: 40996 - DNA, 103 bp, Artificial Sequence
  Synthetic Polynucleotide
taatacgactcactatagggttgactcgaattatcacggtactagagcgtaacagaggagaacgctcatgtaccgtgataacctggcggcagcgcaaaagatg

SEQ ID NO: 40997 - DNA, 103 bp, Artificial Sequence
  Synthetic Polynucleotide
taatacgactcactatagggaccccgattcgtatgatggtctcaggtgcaaacagaggagatgcaccatggaccatcataacctggcggcagcgcaaaagatg

SEQ ID NO: 40998 - DNA, 103 bp, Artificial Sequence
  Synthetic Polynucleotide
taatacgactcactatagggttaccatagtggcttgatataggcaatccgaacagaggagacggattatgtatatcaagaacctggcggcagcgcaaaagatg

SEQ ID NO: 40999 - DNA, 103 bp, Artificial Sequence
  Synthetic Polynucleotide
taatacgactcactataggggcgcagacttagcattaccgttgaaattgcaacagaggagagcaattatgacggtaatgaacctggcggcagcgcaaaagatg

SEQ ID NO: 41000 - DNA, 103 bp, Artificial Sequence
  Synthetic Polynucleotide
taatacgactcactataggggcatccgggttcagtagtctagtcaatccgaacagaggagacggattatgtagactactaacctggcggcagcgcaaaagatg

SEQ ID NO: 41001 - DNA, 103 bp, Artificial Sequence
  Synthetic Polynucleotide
taatacgactcactatagggaacagcgcgaggggtacctggggctaacgtaacagaggagaacgttaatgccaggtaccaacctggcggcagcgcaaaagatg

SEQ ID NO: 41002 - DNA, 103 bp, Artificial Sequence
  Synthetic Polynucleotide
taatacgactcactatagggacatcgagttagttcaatgagcggctatcgaacagaggagacgatagatgctcattgaaaacctggcggcagcgcaaaagatg

SEQ ID NO: 41003 - DNA, 103 bp, Artificial Sequence
  Synthetic Polynucleotide
taatacgactcactatagggccagattgagtaggtcctggtcatctttgcaacagaggagagcaaagatgaccaggaccaacctggcggcagcgcaaaagatg

SEQ ID NO: 41004 - DNA, 103 bp, Artificial Sequence
  Synthetic Polynucleotide
taatacgactcactataggggggcacggagtgaggttaggccaccattataacagaggagaataatgatggcctaacctaacctggcggcagcgcaaaagatg

SEQ ID NO: 41005 - DNA, 103 bp, Artificial Sequence
  Synthetic Polynucleotide
taatacgactcactatagggttcggcacacttgaattgtttcatagacccaacagaggagagggtctatgaaacaattcaacctggcggcagcgcaaaagatg

SEQ ID NO: 41006 - DNA, 103 bp, Artificial Sequence
  Synthetic Polynucleotide
taatacgactcactatagggtgctggttggtaagagagaaaccccgccagaacagaggagactggcgatgtttctctctaacctggcggcagcgcaaaagatg

SEQ ID NO: 41007 - DNA, 103 bp, Artificial Sequence
  Synthetic Polynucleotide
taatacgactcactatagggtctcacggccacccgcattgacttgaatacaacagaggagagtattcatgtcaatgcggaacctggcggcagcgcaaaagatg

SEQ ID NO: 41008 - DNA, 103 bp, Artificial Sequence
  Synthetic Polynucleotide
taatacgactcactataggggtacaaaaatagggctgccacacgaccaggaacagaggagacctggtatggtggcagccaacctggcggcagcgcaaaagatg

SEQ ID NO: 41009 - DNA, 103 bp, Artificial Sequence
  Synthetic Polynucleotide
taatacgactcactataggggctgctcatatctccctaacgagaagacctaacagaggagaaggtctatgcgttagggaaacctggcggcagcgcaaaagatg

SEQ ID NO: 41010 - DNA, 103 bp, Artificial Sequence
  Synthetic Polynucleotide
taatacgactcactatagggctgtaaagagatacttatcctgcataacagaacagaggagactgttaatgaggataagtaacctggcggcagcgcaaaagatg

SEQ ID NO: 41011 - DNA, 103 bp, Artificial Sequence
  Synthetic Polynucleotide
taatacgactcactatagggggtataaaccatataacgagccaactgttcaacagaggagagaacagatggctcgttataacctggcggcagcgcaaaagatg

SEQ ID NO: 41012 - DNA, 103 bp, Artificial Sequence
  Synthetic Polynucleotide
taatacgactcactatagggattgggtataggtacagtcgtcgtggtcggaacagaggagaccgaccatgacgactgtaaacctggcggcagcgcaaaagatg

SEQ ID NO: 41013 - DNA, 103 bp, Artificial Sequence
  Synthetic Polynucleotide
taatacgactcactatagggacgtaagctcaccaatggttgttgcgtccgaacagaggagacggacgatgcaaccattgaacctggcggcagcgcaaaagatg

SEQ ID NO: 41014 - DNA, 103 bp, Artificial Sequence
  Synthetic Polynucleotide
taatacgactcactatagggactacgcgttgggcgaatcaccctacgctcaacagaggagagagcgtatggtgattcgcaacctggcggcagcgcaaaagatg

SEQ ID NO: 41015 - DNA, 103 bp, Artificial Sequence
  Synthetic Polynucleotide
taatacgactcactatagggcttcgacggtgtccgagctcctcactgaaaaacagaggagatttcagatgggagctcggaacctggcggcagcgcaaaagatg

SEQ ID NO: 41016 - DNA, 103 bp, Artificial Sequence
  Synthetic Polynucleotide
taatacgactcactatagggaataggtctaccggtcgccagtagccaatgaacagaggagacattggatgctggcgaccaacctggcggcagcgcaaaagatg

SEQ ID NO: 41017 - DNA, 103 bp, Artificial Sequence
  Synthetic Polynucleotide
taatacgactcactatagggacctggtcaacaagaactagcctcccttcaaacagaggagatgaaggatggctagttctaacctggcggcagcgcaaaagatg

SEQ ID NO: 41018 - DNA, 103 bp, Artificial Sequence
  Synthetic Polynucleotide
taatacgactcactataggggccggtgggggcgatatgattgtgccatgcaacagaggagagcatggatgaatcatatcaacctggcggcagcgcaaaagatg

SEQ ID NO: 41019 - DNA, 103 bp, Artificial Sequence
  Synthetic Polynucleotide
taatacgactcactatagggtaattggcctcttgatcctctttctcatccaacagaggagaggatgaatgagaggatcaaacctggcggcagcgcaaaagatg

SEQ ID NO: 41020 - DNA, 103 bp, Artificial Sequence
  Synthetic Polynucleotide
taatacgactcactatagggctctggtcacgtcgagggtcttatcgagtaaacagaggagatactcgatgagaccctcgaacctggcggcagcgcaaaagatg

SEQ ID NO: 41021 - DNA, 103 bp, Artificial Sequence
  Synthetic Polynucleotide
taatacgactcactatagggtgtgggcttctcagcagcacagtgtaaaataacagaggagaattttaatgtgtgctgctaacctggcggcagcgcaaaagatg

SEQ ID NO: 41022 - DNA, 103 bp, Artificial Sequence
  Synthetic Polynucleotide
taatacgactcactataggggaccacacgttctccctgaatcttcagattaacagaggagaaatctgatgattcagggaaacctggcggcagcgcaaaagatg

SEQ ID NO: 41023 - DNA, 103 bp, Artificial Sequence
  Synthetic Polynucleotide
taatacgactcactatagggggtaccgtgcaatatagtactcactgagtaaacagaggagatactcaatgagtactataaacctggcggcagcgcaaaagatg

SEQ ID NO: 41024 - DNA, 103 bp, Artificial Sequence
  Synthetic Polynucleotide
taatacgactcactataggggatcccacgccaacaaacttgcaattgcccaacagaggagagggcaaatgcaagtttgtaacctggcggcagcgcaaaagatg

SEQ ID NO: 41025 - DNA, 103 bp, Artificial Sequence
  Synthetic Polynucleotide
taatacgactcactataggggtacagtaagcatccagatgagagtcccttaacagaggagaaagggaatgtcatctggaaacctggcggcagcgcaaaagatg

SEQ ID NO: 41026 - DNA, 103 bp, Artificial Sequence
  Synthetic Polynucleotide
taatacgactcactataggggtggaattgtcgtagaatgcttgacgcgtcaacagaggagagacgcgatgagcattctaaacctggcggcagcgcaaaagatg

SEQ ID NO: 41027 - DNA, 103 bp, Artificial Sequence
  Synthetic Polynucleotide
taatacgactcactatagggtgagcgcgtaccatagtgctctcgtaactgaacagaggagacagttaatggagcactataacctggcggcagcgcaaaagatg

SEQ ID NO: 41028 - DNA, 103 bp, Artificial Sequence
  Synthetic Polynucleotide
taatacgactcactatagggtcccatagtcgccaggccattgataaaattaacagaggagaaattttatgaatggcctgaacctggcggcagcgcaaaagatg

SEQ ID NO: 41029 - DNA, 103 bp, Artificial Sequence
  Synthetic Polynucleotide
taatacgactcactataggggtcgagttcctcatattcaattgtgcgtacaacagaggagagtacgcatgattgaatataacctggcggcagcgcaaaagatg

SEQ ID NO: 41030 - DNA, 103 bp, Artificial Sequence
  Synthetic Polynucleotide
taatacgactcactatagggtgaaggcgggcatcactagcttagtagcaaaacagaggagattgctaatgagctagtgaaacctggcggcagcgcaaaagatg

SEQ ID NO: 41031 - DNA, 103 bp, Artificial Sequence
  Synthetic Polynucleotide
taatacgactcactatagggggttagaacaacgtccgcccaatagagtttaacagaggagaaaactcatgtgggcggacaacctggcggcagcgcaaaagatg

SEQ ID NO: 41032 - DNA, 103 bp, Artificial Sequence
  Synthetic Polynucleotide
taatacgactcactatagggctgcggcctgagggggataaatgaaggccgaacagaggagacggcctatgtttatccccaacctggcggcagcgcaaaagatg

SEQ ID NO: 41033 - DNA, 103 bp, Artificial Sequence
  Synthetic Polynucleotide
taatacgactcactatagggtgtttaacgttttattggttggcggttaaaaacagaggagatttaacatgcaaccaataaacctggcggcagcgcaaaagatg

SEQ ID NO: 41034 - DNA, 103 bp, Artificial Sequence
  Synthetic Polynucleotide
taatacgactcactatagggcagactttctcgtagcgtgagacccatgcgaacagaggagacgcatgatgctcacgctaaacctggcggcagcgcaaaagatg

SEQ ID NO: 41035 - DNA, 103 bp, Artificial Sequence
  Synthetic Polynucleotide
taatacgactcactatagggcctccgacgtcactcaaagaagatcaggctaacagaggagaagcctgatgttctttgagaacctggcggcagcgcaaaagatg

SEQ ID NO: 41036 - DNA, 103 bp, Artificial Sequence
  Synthetic Polynucleotide
taatacgactcactatagggccggaacgaaagccaggaaggacgtgggccaacagaggagaggcccaatgccttcctggaacctggcggcagcgcaaaagatg

SEQ ID NO: 41037 - DNA, 103 bp, Artificial Sequence
  Synthetic Polynucleotide
taatacgactcactatagggtagctacgaccgccgagtgcgcttgagtttaacagaggagaaaactcatgcgcactcggaacctggcggcagcgcaaaagatg

SEQ ID NO: 41038 - DNA, 103 bp, Artificial Sequence
  Synthetic Polynucleotide
taatacgactcactataggggcaattaacggtaatcttaaggtcataataaacagaggagatattatatgcttaagattaacctggcggcagcgcaaaagatg

SEQ ID NO: 41039 - DNA, 103 bp, Artificial Sequence
  Synthetic Polynucleotide
taatacgactcactatagggcgacataaaagataagagacgatctcttagaacagaggagactaagaatgcgtctcttaaacctggcggcagcgcaaaagatg

SEQ ID NO: 41040 - DNA, 103 bp, Artificial Sequence
  Synthetic Polynucleotide
taatacgactcactatagggttaagttgacccgacaagatcaaattccagaacagaggagactggaaatggatcttgtcaacctggcggcagcgcaaaagatg

SEQ ID NO: 41041 - DNA, 103 bp, Artificial Sequence
  Synthetic Polynucleotide
taatacgactcactatagggtcagatggcagaactgcccgctataccggaaacagaggagatccggtatggcgggcagtaacctggcggcagcgcaaaagatg

SEQ ID NO: 41042 - DNA, 103 bp, Artificial Sequence
  Synthetic Polynucleotide
taatacgactcactataggggggacgcagtgtcgctcatcatggccagtcaacagaggagagactggatgtgatgagcgaacctggcggcagcgcaaaagatg

SEQ ID NO: 41043 - DNA, 103 bp, Artificial Sequence
  Synthetic Polynucleotide
taatacgactcactataggggtccgctagatgggcccaccccgtcgcctgaacagaggagacaggcgatggggtgggccaacctggcggcagcgcaaaagatg

SEQ ID NO: 41044 - DNA, 103 bp, Artificial Sequence
  Synthetic Polynucleotide
taatacgactcactatagggctgtaactcgattgctttagaaagcacctcaacagaggagagaggtgatgtctaaagcaaacctggcggcagcgcaaaagatg

SEQ ID NO: 41045 - DNA, 103 bp, Artificial Sequence
  Synthetic Polynucleotide
taatacgactcactatagggtgagcccacaggtattcggcttatggagagaacagaggagactctccatgagccgaataaacctggcggcagcgcaaaagatg

SEQ ID NO: 41046 - DNA, 103 bp, Artificial Sequence
  Synthetic Polynucleotide
taatacgactcactatagggccagaggaccaggttcgtctgtcacgtgataacagaggagaatcacgatgcagacgaacaacctggcggcagcgcaaaagatg

SEQ ID NO: 41047 - DNA, 103 bp, Artificial Sequence
  Synthetic Polynucleotide
taatacgactcactatagggagccagcatgcaattaggttcgcacatatgaacagaggagacatatgatggaacctaataacctggcggcagcgcaaaagatg

SEQ ID NO: 41048 - DNA, 103 bp, Artificial Sequence
  Synthetic Polynucleotide
taatacgactcactatagggagacaagtgagatttgcaaatagctacacgaacagaggagacgtgtaatgatttgcaaaaacctggcggcagcgcaaaagatg

SEQ ID NO: 41049 - DNA, 103 bp, Artificial Sequence
  Synthetic Polynucleotide
taatacgactcactatagggcccgatcagcaagtgcggcaggcattcttgaacagaggagacaagaaatgctgccgcacaacctggcggcagcgcaaaagatg

SEQ ID NO: 41050 - DNA, 103 bp, Artificial Sequence
  Synthetic Polynucleotide
taatacgactcactatagggggcatggggtcactcagcacggagcacaataacagaggagaattgtgatgcgtgctgagaacctggcggcagcgcaaaagatg

SEQ ID NO: 41051 - DNA, 103 bp, Artificial Sequence
  Synthetic Polynucleotide
taatacgactcactatagggagatgctgtcttggagagacgatagtccagaacagaggagactggacatgcgtctctccaacctggcggcagcgcaaaagatg

SEQ ID NO: 41052 - DNA, 103 bp, Artificial Sequence
  Synthetic Polynucleotide
taatacgactcactatagggagagcaacggtaaacgcggtccgccttattaacagaggagaaataagatggaccgcgttaacctggcggcagcgcaaaagatg

SEQ ID NO: 41053 - DNA, 103 bp, Artificial Sequence
  Synthetic Polynucleotide
taatacgactcactatagggctatttgttgtgcgtagcctaaacggcccaaacagaggagatgggccatgtaggctacgaacctggcggcagcgcaaaagatg

SEQ ID NO: 41054 - DNA, 103 bp, Artificial Sequence
  Synthetic Polynucleotide
taatacgactcactatagggggttgatgaaccgtgagacagtgggtccgcaacagaggagagcggacatgctgtctcacaacctggcggcagcgcaaaagatg

SEQ ID NO: 41055 - DNA, 103 bp, Artificial Sequence
  Synthetic Polynucleotide
taatacgactcactatagggccgacgtgtcggggagaaagggatacttcgaacagaggagacgaagtatgcctttctccaacctggcggcagcgcaaaagatg

SEQ ID NO: 41056 - DNA, 103 bp, Artificial Sequence
  Synthetic Polynucleotide
taatacgactcactatagggtcattccacactgatttctggtttggatagaacagaggagactatccatgccagaaatcaacctggcggcagcgcaaaagatg

SEQ ID NO: 41057 - DNA, 103 bp, Artificial Sequence
  Synthetic Polynucleotide
taatacgactcactataggggcgttggatcgagtcggtacgacatactttaacagaggagaaaagtaatgcgtaccgacaacctggcggcagcgcaaaagatg

SEQ ID NO: 41058 - DNA, 103 bp, Artificial Sequence
  Synthetic Polynucleotide
taatacgactcactatagggtctactgcaactgtatggaggatcgccgccaacagaggagaggcggcatgcctccatacaacctggcggcagcgcaaaagatg

SEQ ID NO: 41059 - DNA, 103 bp, Artificial Sequence
  Synthetic Polynucleotide
taatacgactcactatagggttctccctgattttaacaccgaaagggccgaacagaggagacggcccatgcggtgttaaaacctggcggcagcgcaaaagatg

SEQ ID NO: 41060 - DNA, 103 bp, Artificial Sequence
  Synthetic Polynucleotide
taatacgactcactataggggtgagaaagcacgctgttgggtttttctcgaacagaggagacgagaaatgcccaacagcaacctggcggcagcgcaaaagatg

SEQ ID NO: 41061 - DNA, 103 bp, Artificial Sequence
  Synthetic Polynucleotide
taatacgactcactatagggaatcttgtacacgtcccacgtatgttttcaaacagaggagatgaaaaatgacgtgggacaacctggcggcagcgcaaaagatg

SEQ ID NO: 41062 - DNA, 103 bp, Artificial Sequence
  Synthetic Polynucleotide
taatacgactcactataggggcacgctaagttcgctccgactcctaagagaacagaggagactcttaatggtcggagcgaacctggcggcagcgcaaaagatg

SEQ ID NO: 41063 - DNA, 103 bp, Artificial Sequence
  Synthetic Polynucleotide
taatacgactcactatagggccggcctataagtctcgcttctgccgcgacaacagaggagagtcgcgatggaagcgagaaacctggcggcagcgcaaaagatg

SEQ ID NO: 41064 - DNA, 103 bp, Artificial Sequence
  Synthetic Polynucleotide
taatacgactcactataggggctaccttccgcgacgtaattagcagtaccaacagaggagaggtactatgaattacgtcaacctggcggcagcgcaaaagatg

SEQ ID NO: 41065 - DNA, 103 bp, Artificial Sequence
  Synthetic Polynucleotide
taatacgactcactatagggcggaaactcgttgctataccctactgttgcaacagaggagagcaacaatggggtatagcaacctggcggcagcgcaaaagatg

SEQ ID NO: 41066 - DNA, 103 bp, Artificial Sequence
  Synthetic Polynucleotide
taatacgactcactataggggcgacacatagtgtacactggtgtatcttgaacagaggagacaagatatgccagtgtacaacctggcggcagcgcaaaagatg

SEQ ID NO: 41067 - DNA, 103 bp, Artificial Sequence
  Synthetic Polynucleotide
taatacgactcactatagggttagaccttgggatacgttctgtgcagcgaaacagaggagatcgctgatgagaacgtataacctggcggcagcgcaaaagatg

SEQ ID NO: 41068 - DNA, 103 bp, Artificial Sequence
  Synthetic Polynucleotide
taatacgactcactatagggtcgattaaatcctcgaatagtaaatcgatcaacagaggagagatcgaatgactattcgaaacctggcggcagcgcaaaagatg

SEQ ID NO: 41069 - DNA, 103 bp, Artificial Sequence
  Synthetic Polynucleotide
taatacgactcactatagggcggagtaacggtaggttaaattcaacatcaaacagaggagatgatgtatgatttaacctaacctggcggcagcgcaaaagatg

SEQ ID NO: 41070 - DNA, 103 bp, Artificial Sequence
  Synthetic Polynucleotide
taatacgactcactatagggctaacgctcgcagtgggctgtacgttgggcaacagaggagagcccaaatgacagcccacaacctggcggcagcgcaaaagatg

SEQ ID NO: 41071 - DNA, 103 bp, Artificial Sequence
  Synthetic Polynucleotide
taatacgactcactatagggtcaataatctctcattgatgagagatccgtaacagaggagaacggatatgtcatcaatgaacctggcggcagcgcaaaagatg

SEQ ID NO: 41072 - DNA, 103 bp, Artificial Sequence
  Synthetic Polynucleotide
taatacgactcactatagggctgcagtatcccccacccgtccttatcgcaaacagaggagatgcgatatggacgggtggaacctggcggcagcgcaaaagatg

SEQ ID NO: 41073 - DNA, 103 bp, Artificial Sequence
  Synthetic Polynucleotide
taatacgactcactatagggtctaaggacagggaccgtcggcctgatgccaacagaggagaggcatcatgccgacggtcaacctggcggcagcgcaaaagatg

SEQ ID NO: 41074 - DNA, 103 bp, Artificial Sequence
  Synthetic Polynucleotide
taatacgactcactatagggaacgccgcgcgtatgcggtcccagtggaccaacagaggagaggtccaatgggaccgcataacctggcggcagcgcaaaagatg

SEQ ID NO: 41075 - DNA, 103 bp, Artificial Sequence
  Synthetic Polynucleotide
taatacgactcactataggggatacccacttgtctaaataatctagctgcaacagaggagagcagctatgttatttagaaacctggcggcagcgcaaaagatg

SEQ ID NO: 41076 - DNA, 103 bp, Artificial Sequence
  Synthetic Polynucleotide
taatacgactcactatagggcgtccccgtacgccagttttggcacacgcgaacagaggagacgcgtgatgcaaaactggaacctggcggcagcgcaaaagatg

SEQ ID NO: 41077 - DNA, 103 bp, Artificial Sequence
  Synthetic Polynucleotide
taatacgactcactataggggccgggcggtatagatcatcctgactcaccaacagaggagaggtgagatgggatgatctaacctggcggcagcgcaaaagatg

SEQ ID NO: 41078 - DNA, 103 bp, Artificial Sequence
  Synthetic Polynucleotide
taatacgactcactatagggccgtagtcaaagaacatggtataagctttgaacagaggagacaaagcatgtaccatgttaacctggcggcagcgcaaaagatg

SEQ ID NO: 41079 - DNA, 103 bp, Artificial Sequence
  Synthetic Polynucleotide
taatacgactcactatagggccagatcggagcgggggacgatgggtcgtcaacagaggagagacgacatgtcgtcccccaacctggcggcagcgcaaaagatg

SEQ ID NO: 41080 - DNA, 103 bp, Artificial Sequence
  Synthetic Polynucleotide
taatacgactcactatagggtgcaattgatggcccctccttccgcttctcaacagaggagagagaagatgaaggaggggaacctggcggcagcgcaaaagatg

SEQ ID NO: 41081 - DNA, 103 bp, Artificial Sequence
  Synthetic Polynucleotide
taatacgactcactatagggtcgggacccatataaatacacgttcgcataaacagaggagatatgcgatggtgtatttaaacctggcggcagcgcaaaagatg

SEQ ID NO: 41082 - DNA, 103 bp, Artificial Sequence
  Synthetic Polynucleotide
taatacgactcactatagggtggggtctgtcgcataagtgttcaacggggaacagaggagaccccgtatgacacttatgaacctggcggcagcgcaaaagatg

SEQ ID NO: 41083 - DNA, 103 bp, Artificial Sequence
  Synthetic Polynucleotide
taatacgactcactatagggtgtggcggggtgttcattgtgcgccgtgttaacagaggagaaacacgatgcacaatgaaaacctggcggcagcgcaaaagatg

SEQ ID NO: 41084 - DNA, 103 bp, Artificial Sequence
  Synthetic Polynucleotide
taatacgactcactatagggaaaactcctccggggatctcatatgcatgcaacagaggagagcatgcatgtgagatcccaacctggcggcagcgcaaaagatg

SEQ ID NO: 41085 - DNA, 103 bp, Artificial Sequence
  Synthetic Polynucleotide
taatacgactcactatagggcatcagaagtcgtacttgcagaagcttttgaacagaggagacaaaagatgctgcaagtaaacctggcggcagcgcaaaagatg

SEQ ID NO: 41086 - DNA, 103 bp, Artificial Sequence
  Synthetic Polynucleotide
taatacgactcactatagggtgggtaccctcccgaccgctcacgtactctaacagaggagaagagtaatggagcggtcgaacctggcggcagcgcaaaagatg

SEQ ID NO: 41087 - DNA, 103 bp, Artificial Sequence
  Synthetic Polynucleotide
taatacgactcactatagggagtagagcgtcccgcacagtccgtaaaatgaacagaggagacattttatggactgtgcgaacctggcggcagcgcaaaagatg

SEQ ID NO: 41088 - DNA, 103 bp, Artificial Sequence
  Synthetic Polynucleotide
taatacgactcactatagggccacgcaaagctaagtatctttgtagcggcaacagaggagagccgctatgaagatacttaacctggcggcagcgcaaaagatg

SEQ ID NO: 41089 - DNA, 103 bp, Artificial Sequence
  Synthetic Polynucleotide
taatacgactcactatagggcatacgtttagatcgatagttaaattatagaacagaggagactataaatgaactatcgaaacctggcggcagcgcaaaagatg

SEQ ID NO: 41090 - DNA, 103 bp, Artificial Sequence
  Synthetic Polynucleotide
taatacgactcactatagggtctccagtactcagcaccggcctgcattagaacagaggagactaatgatggccggtgctaacctggcggcagcgcaaaagatg

SEQ ID NO: 41091 - DNA, 103 bp, Artificial Sequence
  Synthetic Polynucleotide
taatacgactcactatagggctattagatctacttagtgaggatgcagacaacagaggagagtctgcatgctcactaagaacctggcggcagcgcaaaagatg

SEQ ID NO: 41092 - DNA, 103 bp, Artificial Sequence
  Synthetic Polynucleotide
taatacgactcactatagggtgatggccttcttcggtgttattgcgcaaaaacagaggagatttgcgatgtaacaccgaaacctggcggcagcgcaaaagatg

SEQ ID NO: 41093 - DNA, 103 bp, Artificial Sequence
  Synthetic Polynucleotide
taatacgactcactatagggcgcccgcatcgctcatcatcacatcctgtaaacagaggagatacaggatgtgatgatgaaacctggcggcagcgcaaaagatg

SEQ ID NO: 41094 - DNA, 103 bp, Artificial Sequence
  Synthetic Polynucleotide
taatacgactcactatagggcttcgccgctttgcgctaaaagtatagacaaacagaggagatgtctaatgttttagcgcaacctggcggcagcgcaaaagatg

SEQ ID NO: 41095 - DNA, 103 bp, Artificial Sequence
  Synthetic Polynucleotide
taatacgactcactatagggttcttttagaatagaagcaattcatggtaaaacagaggagattaccaatgattgcttctaacctggcggcagcgcaaaagatg

SEQ ID NO: 41096 - DNA, 103 bp, Artificial Sequence
  Synthetic Polynucleotide
taatacgactcactatagggtgccttacttgggcgtaaggcaatgcgtgaaacagaggagatcacgcatggccttacgcaacctggcggcagcgcaaaagatg

SEQ ID NO: 41097 - DNA, 103 bp, Artificial Sequence
  Synthetic Polynucleotide
taatacgactcactatagggccccggaagagggctgagctttgtactctgaacagaggagacagagtatgaagctcagcaacctggcggcagcgcaaaagatg

SEQ ID NO: 41098 - DNA, 103 bp, Artificial Sequence
  Synthetic Polynucleotide
taatacgactcactatagggtttaccaaagcgtaggtatttgatgcgatcaacagaggagagatcgcatgaaatacctaaacctggcggcagcgcaaaagatg

SEQ ID NO: 41099 - DNA, 103 bp, Artificial Sequence
  Synthetic Polynucleotide
taatacgactcactatagggtattctgtgctgcagcgcacagatacaccaaacagaggagatggtgtatgtgtgcgctgaacctggcggcagcgcaaaagatg

SEQ ID NO: 41100 - DNA, 103 bp, Artificial Sequence
  Synthetic Polynucleotide
taatacgactcactatagggcaagatggctggggatgctgtcaaatctcgaacagaggagacgagatatgacagcatccaacctggcggcagcgcaaaagatg

SEQ ID NO: 41101 - DNA, 103 bp, Artificial Sequence
  Synthetic Polynucleotide
taatacgactcactatagggtcgcgagctcgcctgggttctgctggtatcaacagaggagagataccatgagaacccagaacctggcggcagcgcaaaagatg

SEQ ID NO: 41102 - DNA, 103 bp, Artificial Sequence
  Synthetic Polynucleotide
taatacgactcactatagggatagagtcccttttgcgatcggtatcaaacaacagaggagagtttgaatgcgatcgcaaaacctggcggcagcgcaaaagatg

SEQ ID NO: 41103 - DNA, 103 bp, Artificial Sequence
  Synthetic Polynucleotide
taatacgactcactatagggggccagaaacacggcattgtgtggccgcctaacagaggagaaggcggatgcacaatgccaacctggcggcagcgcaaaagatg

SEQ ID NO: 41104 - DNA, 103 bp, Artificial Sequence
  Synthetic Polynucleotide
taatacgactcactataggggaatccatcctaattcgtcggttttctacgaacagaggagacgtagaatgccgacgaataacctggcggcagcgcaaaagatg

SEQ ID NO: 41105 - DNA, 103 bp, Artificial Sequence
  Synthetic Polynucleotide
taatacgactcactatagggctacgctataggcggtgtctccgcctgctgaacagaggagacagcagatggagacaccgaacctggcggcagcgcaaaagatg

SEQ ID NO: 41106 - DNA, 103 bp, Artificial Sequence
  Synthetic Polynucleotide
taatacgactcactatagggatccttcgcacaaaaaactcgtgttgtatcaacagaggagagatacaatgcgagtttttaacctggcggcagcgcaaaagatg

SEQ ID NO: 41107 - DNA, 103 bp, Artificial Sequence
  Synthetic Polynucleotide
taatacgactcactataggggctctgtatcgtctatggatcggaccttctaacagaggagaagaaggatggatccatagaacctggcggcagcgcaaaagatg

SEQ ID NO: 41108 - DNA, 103 bp, Artificial Sequence
  Synthetic Polynucleotide
taatacgactcactatagggaggcacaatgagtcgctaatcgagtttaacaacagaggagagttaaaatggattagcgaaacctggcggcagcgcaaaagatg

SEQ ID NO: 41109 - DNA, 103 bp, Artificial Sequence
  Synthetic Polynucleotide
taatacgactcactatagggatagtcttcctggaagtaatcaacaaggcaaacagaggagatgccttatggattacttcaacctggcggcagcgcaaaagatg

SEQ ID NO: 41110 - DNA, 103 bp, Artificial Sequence
  Synthetic Polynucleotide
taatacgactcactatagggtgtagaaatgacgagttatcgtgtggccttaacagaggagaaaggccatgcgataactcaacctggcggcagcgcaaaagatg

SEQ ID NO: 41111 - DNA, 103 bp, Artificial Sequence
  Synthetic Polynucleotide
taatacgactcactataggggttaacaggtggtgacaatgcagttcgaataacagaggagaattcgaatggcattgtcaaacctggcggcagcgcaaaagatg

SEQ ID NO: 41112 - DNA, 103 bp, Artificial Sequence
  Synthetic Polynucleotide
taatacgactcactatagggtgcggaaaagccggtcatagttacccccataacagaggagaatggggatgactatgaccaacctggcggcagcgcaaaagatg

SEQ ID NO: 41113 - DNA, 103 bp, Artificial Sequence
  Synthetic Polynucleotide
taatacgactcactatagggactgagagggttaaacgtagactcacgccaaacagaggagatggcgtatgtctacgtttaacctggcggcagcgcaaaagatg

SEQ ID NO: 41114 - DNA, 103 bp, Artificial Sequence
  Synthetic Polynucleotide
taatacgactcactatagggggagtttgcgctggctattgtggaattgtgaacagaggagacacaatatgacaatagccaacctggcggcagcgcaaaagatg

SEQ ID NO: 41115 - DNA, 103 bp, Artificial Sequence
  Synthetic Polynucleotide
taatacgactcactatagggggtctactaaaccgatcatcgcacccaaataacagaggagaatttggatgcgatgatcgaacctggcggcagcgcaaaagatg

SEQ ID NO: 41116 - DNA, 103 bp, Artificial Sequence
  Synthetic Polynucleotide
taatacgactcactatagggcgactgcagctcatggtctgcacagcgagaaacagaggagatctcgcatggcagaccataacctggcggcagcgcaaaagatg

SEQ ID NO: 41117 - DNA, 103 bp, Artificial Sequence
  Synthetic Polynucleotide
taatacgactcactatagggcactcgcttatgctcaggccccctgcgtgcaacagaggagagcacgcatggggcctgagaacctggcggcagcgcaaaagatg

SEQ ID NO: 41118 - DNA, 103 bp, Artificial Sequence
  Synthetic Polynucleotide
taatacgactcactatagggcggcaaaattaagtcagtttgttatgatgaaacagaggagatcatcaatgcaaactgacaacctggcggcagcgcaaaagatg

SEQ ID NO: 41119 - DNA, 103 bp, Artificial Sequence
  Synthetic Polynucleotide
taatacgactcactatagggactatacagtcaaaaaaaacacgcaataacaacagaggagagttattatgtgtttttttaacctggcggcagcgcaaaagatg

SEQ ID NO: 41120 - DNA, 103 bp, Artificial Sequence
  Synthetic Polynucleotide
taatacgactcactatagggtcaagtacttcttcttagggctggggattgaacagaggagacaatccatggccctaagaaacctggcggcagcgcaaaagatg

SEQ ID NO: 41121 - DNA, 103 bp, Artificial Sequence
  Synthetic Polynucleotide
taatacgactcactatagggctatccggtatttgcttccgttataccataaacagaggagatatggtatgacggaagcaaacctggcggcagcgcaaaagatg

SEQ ID NO: 41122 - DNA, 103 bp, Artificial Sequence
  Synthetic Polynucleotide
taatacgactcactatagggggagctccttgtcgaattcttcggcttcacaacagaggagagtgaagatgaagaattcgaacctggcggcagcgcaaaagatg

SEQ ID NO: 41123 - DNA, 103 bp, Artificial Sequence
  Synthetic Polynucleotide
taatacgactcactatagggctgataaggttgatctatgggggtttgaagaacagaggagacttcaaatgcccatagataacctggcggcagcgcaaaagatg

SEQ ID NO: 41124 - DNA, 103 bp, Artificial Sequence
  Synthetic Polynucleotide
taatacgactcactatagggcttgcggcataccatgagagggattgcttaaacagaggagataagcaatgcctctcatgaacctggcggcagcgcaaaagatg

SEQ ID NO: 41125 - DNA, 103 bp, Artificial Sequence
  Synthetic Polynucleotide
taatacgactcactatagggacactgcgtgccgggtttaaaaggaatcggaacagaggagaccgattatgtttaaacccaacctggcggcagcgcaaaagatg

SEQ ID NO: 41126 - DNA, 103 bp, Artificial Sequence
  Synthetic Polynucleotide
taatacgactcactatagggtaccgaaagggtacgcattcgcatccggtgaacagaggagacaccggatgcgaatgcgtaacctggcggcagcgcaaaagatg

SEQ ID NO: 41127 - DNA, 103 bp, Artificial Sequence
  Synthetic Polynucleotide
taatacgactcactataggggcgatccttctatcgtcgggcggcttactcaacagaggagagagtaaatggcccgacgaaacctggcggcagcgcaaaagatg

SEQ ID NO: 41128 - DNA, 103 bp, Artificial Sequence
  Synthetic Polynucleotide
taatacgactcactatagggctgctctcgaggcaggcctcgattagatcgaacagaggagacgatctatgcgaggcctgaacctggcggcagcgcaaaagatg

SEQ ID NO: 41129 - DNA, 103 bp, Artificial Sequence
  Synthetic Polynucleotide
taatacgactcactatagggtgacgactattgttttttcttgcacaccgtaacagaggagaacggtgatgaagaaaaaaaacctggcggcagcgcaaaagatg

SEQ ID NO: 41130 - DNA, 103 bp, Artificial Sequence
  Synthetic Polynucleotide
taatacgactcactatagggtaacaaggctagcctaaagccgagcggtctaacagaggagaagaccgatgggctttaggaacctggcggcagcgcaaaagatg

SEQ ID NO: 41131 - DNA, 103 bp, Artificial Sequence
  Synthetic Polynucleotide
taatacgactcactatagggtcattgccgctgtgcacagctttaaacgagaacagaggagactcgttatgagctgtgcaaacctggcggcagcgcaaaagatg

SEQ ID NO: 41132 - DNA, 103 bp, Artificial Sequence
  Synthetic Polynucleotide
taatacgactcactataggggttttgccggccacgcctctccttctgcccaacagaggagagggcagatggagaggcgtaacctggcggcagcgcaaaagatg

SEQ ID NO: 41133 - DNA, 103 bp, Artificial Sequence
  Synthetic Polynucleotide
taatacgactcactatagggataattataagtgtctacccggatacccccaacagaggagagggggtatgcgggtagacaacctggcggcagcgcaaaagatg

SEQ ID NO: 41134 - DNA, 103 bp, Artificial Sequence
  Synthetic Polynucleotide
taatacgactcactatagggagaggcctagtttagcaccgaaacgttaacaacagaggagagttaacatgtcggtgctaaacctggcggcagcgcaaaagatg

SEQ ID NO: 41135 - DNA, 103 bp, Artificial Sequence
  Synthetic Polynucleotide
taatacgactcactatagggtttcttttgatatcggcatatgacgtacgaaacagaggagatcgtacatgatatgccgaaacctggcggcagcgcaaaagatg

SEQ ID NO: 41136 - DNA, 103 bp, Artificial Sequence
  Synthetic Polynucleotide
taatacgactcactatagggtgtcatgccatgtctcagatgtgtttctggaacagaggagaccagaaatgcatctgagaaacctggcggcagcgcaaaagatg

SEQ ID NO: 41137 - DNA, 103 bp, Artificial Sequence
  Synthetic Polynucleotide
taatacgactcactatagggccggaacattagattacagtatccagggttaacagaggagaaaccctatgtactgtaataacctggcggcagcgcaaaagatg

SEQ ID NO: 41138 - DNA, 103 bp, Artificial Sequence
  Synthetic Polynucleotide
taatacgactcactatagggcaagtcgagacgtgccgtcagcgccagcgcaacagaggagagcgctgatgctgacggcaaacctggcggcagcgcaaaagatg

SEQ ID NO: 41139 - DNA, 103 bp, Artificial Sequence
  Synthetic Polynucleotide
taatacgactcactatagggatgacggacctcgcgaggcgtccgagatgtaacagaggagaacatctatgacgcctcgcaacctggcggcagcgcaaaagatg

SEQ ID NO: 41140 - DNA, 103 bp, Artificial Sequence
  Synthetic Polynucleotide
taatacgactcactatagggtacaggggaggcaacgtcgggatcgtaggaaacagaggagatcctacatgcccgacgttaacctggcggcagcgcaaaagatg

SEQ ID NO: 41141 - DNA, 103 bp, Artificial Sequence
  Synthetic Polynucleotide
taatacgactcactataggggatgaagtttattttgcgaggcctacaaaaaacagaggagattttgtatgcctcgcaaaaacctggcggcagcgcaaaagatg

SEQ ID NO: 41142 - DNA, 103 bp, Artificial Sequence
  Synthetic Polynucleotide
taatacgactcactataggggtagactgtcggtgtcctagatgatgccgtaacagaggagaacggcaatgtctaggacaaacctggcggcagcgcaaaagatg

SEQ ID NO: 41143 - DNA, 103 bp, Artificial Sequence
  Synthetic Polynucleotide
taatacgactcactatagggtgcagagcgaaaacggagagaacgtgctagaacagaggagactagcaatgtctctccgtaacctggcggcagcgcaaaagatg

SEQ ID NO: 41144 - DNA, 103 bp, Artificial Sequence
  Synthetic Polynucleotide
taatacgactcactatagggtgcaatgaggctgccttttggagcacacacaacagaggagagtgtgtatgccaaaaggcaacctggcggcagcgcaaaagatg

SEQ ID NO: 41145 - DNA, 103 bp, Artificial Sequence
  Synthetic Polynucleotide
taatacgactcactatagggatcattgaaattggaccgaaatgaatgcgcaacagaggagagcgcatatgtttcggtccaacctggcggcagcgcaaaagatg

SEQ ID NO: 41146 - DNA, 103 bp, Artificial Sequence
  Synthetic Polynucleotide
taatacgactcactatagggtggtacgaataacttacgaaagtaggcatgaacagaggagacatgccatgtttcgtaagaacctggcggcagcgcaaaagatg

SEQ ID NO: 41147 - DNA, 103 bp, Artificial Sequence
  Synthetic Polynucleotide
taatacgactcactatagggggtgctgtaataatcgttcggctcaatgcgaacagaggagacgcattatgccgaacgataacctggcggcagcgcaaaagatg

SEQ ID NO: 41148 - DNA, 103 bp, Artificial Sequence
  Synthetic Polynucleotide
taatacgactcactatagggcagatccccatgcgggtctgacaattaaataacagaggagaatttaaatgtcagacccgaacctggcggcagcgcaaaagatg

SEQ ID NO: 41149 - DNA, 103 bp, Artificial Sequence
  Synthetic Polynucleotide
taatacgactcactatagggcagctcacggaatcgggaattgtatgtcagaacagaggagactgacaatgaattcccgaaacctggcggcagcgcaaaagatg

SEQ ID NO: 41150 - DNA, 103 bp, Artificial Sequence
  Synthetic Polynucleotide
taatacgactcactatagggctaatgtcataacttatggtttcgaggctgaacagaggagacagcctatgaaccataagaacctggcggcagcgcaaaagatg

SEQ ID NO: 41151 - DNA, 103 bp, Artificial Sequence
  Synthetic Polynucleotide
taatacgactcactatagggttcacacttcccgcactagcgtcgtcgtataacagaggagaatacgaatgcgctagtgcaacctggcggcagcgcaaaagatg

SEQ ID NO: 41152 - DNA, 103 bp, Artificial Sequence
  Synthetic Polynucleotide
taatacgactcactatagggcatcacaaggtctttcaggtaccggtgattaacagaggagaaatcacatgtacctgaaaaacctggcggcagcgcaaaagatg

SEQ ID NO: 41153 - DNA, 103 bp, Artificial Sequence
  Synthetic Polynucleotide
taatacgactcactataggggcggtagtctaaggtcctttacgcatcagtaacagaggagaactgatatgtaaaggaccaacctggcggcagcgcaaaagatg

SEQ ID NO: 41154 - DNA, 103 bp, Artificial Sequence
  Synthetic Polynucleotide
taatacgactcactatagggctggagagaataggcctagactatccttataacagaggagaataaggatggtctaggccaacctggcggcagcgcaaaagatg

SEQ ID NO: 41155 - DNA, 103 bp, Artificial Sequence
  Synthetic Polynucleotide
taatacgactcactatagggggcacgacatggcagcaccgtagtttttataacagaggagaataaaaatgacggtgctgaacctggcggcagcgcaaaagatg

SEQ ID NO: 41156 - DNA, 103 bp, Artificial Sequence
  Synthetic Polynucleotide
taatacgactcactataggggcttggggttgactattattcttatatgcgaacagaggagacgcataatggaataatagaacctggcggcagcgcaaaagatg

SEQ ID NO: 41157 - DNA, 103 bp, Artificial Sequence
  Synthetic Polynucleotide
taatacgactcactatagggtgtctcactcattgacgttgtggtggtcctaacagaggagaaggaccatgacaacgtcaaacctggcggcagcgcaaaagatg

SEQ ID NO: 41158 - DNA, 103 bp, Artificial Sequence
  Synthetic Polynucleotide
taatacgactcactataggggcgtgagtttctaaagcacgggggacgtccaacagaggagaggacgtatgccgtgctttaacctggcggcagcgcaaaagatg

SEQ ID NO: 41159 - DNA, 103 bp, Artificial Sequence
  Synthetic Polynucleotide
taatacgactcactatagggggccaaagtggagccgcgcatcgggatcacaacagaggagagtgatcatgatgcgcggcaacctggcggcagcgcaaaagatg

SEQ ID NO: 41160 - DNA, 103 bp, Artificial Sequence
  Synthetic Polynucleotide
taatacgactcactatagggttcaatgaagagttatcgactcccctttaaaacagaggagattaaagatgagtcgataaaacctggcggcagcgcaaaagatg

SEQ ID NO: 41161 - DNA, 103 bp, Artificial Sequence
  Synthetic Polynucleotide
taatacgactcactataggggaagaatgggcggccgaagtatgcccggagaacagaggagactccggatgtacttcggcaacctggcggcagcgcaaaagatg

SEQ ID NO: 41162 - DNA, 103 bp, Artificial Sequence
  Synthetic Polynucleotide
taatacgactcactatagggtcttcatgctagtgtgccgagtaggcagaaaacagaggagattctgcatgctcggcacaaacctggcggcagcgcaaaagatg

SEQ ID NO: 41163 - DNA, 103 bp, Artificial Sequence
  Synthetic Polynucleotide
taatacgactcactatagggatatggtgggcgcccgaactttcttcgcttaacagaggagaaagcgaatgaagttcgggaacctggcggcagcgcaaaagatg

SEQ ID NO: 41164 - DNA, 103 bp, Artificial Sequence
  Synthetic Polynucleotide
taatacgactcactatagggctacctaccccatcggcaatagcttcttccaacagaggagaggaagaatgtattgccgaaacctggcggcagcgcaaaagatg

SEQ ID NO: 41165 - DNA, 103 bp, Artificial Sequence
  Synthetic Polynucleotide
taatacgactcactataggggtagttttacgacgtaatccgccactaccgaacagaggagacggtagatgcggattacgaacctggcggcagcgcaaaagatg

SEQ ID NO: 41166 - DNA, 103 bp, Artificial Sequence
  Synthetic Polynucleotide
taatacgactcactatagggtgcttgagtcactagtgcatccaggtgatcaacagaggagagatcacatggatgcactaaacctggcggcagcgcaaaagatg

SEQ ID NO: 41167 - DNA, 103 bp, Artificial Sequence
  Synthetic Polynucleotide
taatacgactcactataggggcccacaaagcgattacaccgtgatcgcaaaacagaggagattgcgaatgcggtgtaataacctggcggcagcgcaaaagatg

SEQ ID NO: 41168 - DNA, 103 bp, Artificial Sequence
  Synthetic Polynucleotide
taatacgactcactataggggcaagatcctcagttgctgtcagataatacaacagaggagagtattaatggacagcaacaacctggcggcagcgcaaaagatg

SEQ ID NO: 41169 - DNA, 103 bp, Artificial Sequence
  Synthetic Polynucleotide
taatacgactcactatagggcctccagacgctgctgggtcgtaatgctccaacagaggagaggagcaatgcgacccagcaacctggcggcagcgcaaaagatg

SEQ ID NO: 41170 - DNA, 103 bp, Artificial Sequence
  Synthetic Polynucleotide
taatacgactcactatagggcaaaatatggatggactgctaactagtgtaaacagaggagatacactatgtagcagtccaacctggcggcagcgcaaaagatg

SEQ ID NO: 41171 - DNA, 103 bp, Artificial Sequence
  Synthetic Polynucleotide
taatacgactcactatagggactgacagccgttaagcttatcgggaccctaacagaggagaagggtcatgataagcttaaacctggcggcagcgcaaaagatg

SEQ ID NO: 41172 - DNA, 103 bp, Artificial Sequence
  Synthetic Polynucleotide
taatacgactcactatagggcgaaattcaatttgctgaagttatagaggcaacagaggagagcctctatgacttcagcaaacctggcggcagcgcaaaagatg

SEQ ID NO: 41173 - DNA, 103 bp, Artificial Sequence
  Synthetic Polynucleotide
taatacgactcactatagggtgctccgaagaattcctacctgagcttgaaaacagaggagattcaagatgaggtaggaaaacctggcggcagcgcaaaagatg

SEQ ID NO: 41174 - DNA, 103 bp, Artificial Sequence
  Synthetic Polynucleotide
taatacgactcactataggggctacgtggggtaaagctacgtgcacttgcaacagaggagagcaagtatgcgtagctttaacctggcggcagcgcaaaagatg

SEQ ID NO: 41175 - DNA, 103 bp, Artificial Sequence
  Synthetic Polynucleotide
taatacgactcactatagggtaactttgcgctctcggacaaccgagaagtaacagaggagaacttctatgttgtccgagaacctggcggcagcgcaaaagatg

SEQ ID NO: 41176 - DNA, 103 bp, Artificial Sequence
  Synthetic Polynucleotide
taatacgactcactatagggagtactaggttccgcgatccatcgcttaacaacagaggagagttaagatgtggatcgcgaacctggcggcagcgcaaaagatg

SEQ ID NO: 41177 - DNA, 103 bp, Artificial Sequence
  Synthetic Polynucleotide
taatacgactcactatagggtcttccttagacaagtgatactcctaggttaacagaggagaaacctaatggtatcacttaacctggcggcagcgcaaaagatg

SEQ ID NO: 41178 - DNA, 103 bp, Artificial Sequence
  Synthetic Polynucleotide
taatacgactcactatagggtctggctgacgctgaacaagtgatgatctaaacagaggagatagatcatgacttgttcaaacctggcggcagcgcaaaagatg

SEQ ID NO: 41179 - DNA, 103 bp, Artificial Sequence
  Synthetic Polynucleotide
taatacgactcactatagggtagacgaacttcttgggtcggtggattgcaaacagaggagatgcaatatgccgacccaaaacctggcggcagcgcaaaagatg

SEQ ID NO: 41180 - DNA, 103 bp, Artificial Sequence
  Synthetic Polynucleotide
taatacgactcactataggggccaaggtgtcgtatacatagtacttgcttaacagaggagaaagcaaatgctatgtataaacctggcggcagcgcaaaagatg

SEQ ID NO: 41181 - DNA, 103 bp, Artificial Sequence
  Synthetic Polynucleotide
taatacgactcactataggggttattgcttggcggtcaccccttcgcctgaacagaggagacaggcgatggggtgaccgaacctggcggcagcgcaaaagatg

SEQ ID NO: 41182 - DNA, 103 bp, Artificial Sequence
  Synthetic Polynucleotide
taatacgactcactatagggtctggtcatcactatataattctgtgaatcaacagaggagagattcaatgaattatataaacctggcggcagcgcaaaagatg

SEQ ID NO: 41183 - DNA, 103 bp, Artificial Sequence
  Synthetic Polynucleotide
taatacgactcactatagggaggaccttaggaggtctcgagattttagtaaacagaggagatactaaatgctcgagaccaacctggcggcagcgcaaaagatg

SEQ ID NO: 41184 - DNA, 103 bp, Artificial Sequence
  Synthetic Polynucleotide
taatacgactcactatagggatgatcgcgcgcaatactagcgtttctcagaacagaggagactgagaatggctagtattaacctggcggcagcgcaaaagatg

SEQ ID NO: 41185 - DNA, 103 bp, Artificial Sequence
  Synthetic Polynucleotide
taatacgactcactataggggcatattataatgtcgcataatcattaaataacagaggagaatttaaatgttatgcgacaacctggcggcagcgcaaaagatg

SEQ ID NO: 41186 - DNA, 103 bp, Artificial Sequence
  Synthetic Polynucleotide
taatacgactcactataggggtgaaccattggacccacatctccacatttaacagaggagaaaatgtatggatgtgggtaacctggcggcagcgcaaaagatg

SEQ ID NO: 41187 - DNA, 103 bp, Artificial Sequence
  Synthetic Polynucleotide
taatacgactcactataggggtcaataatagtaagggaggtctgaactcgaacagaggagacgagttatgacctcccttaacctggcggcagcgcaaaagatg

SEQ ID NO: 41188 - DNA, 103 bp, Artificial Sequence
  Synthetic Polynucleotide
taatacgactcactatagggttgtggttccctctagccgatgcgatttacaacagaggagagtaaatatgatcggctagaacctggcggcagcgcaaaagatg

SEQ ID NO: 41189 - DNA, 103 bp, Artificial Sequence
  Synthetic Polynucleotide
taatacgactcactatagggtatataagaattgatccatggtgagagctaaacagaggagatagctcatgccatggatcaacctggcggcagcgcaaaagatg

SEQ ID NO: 41190 - DNA, 103 bp, Artificial Sequence
  Synthetic Polynucleotide
taatacgactcactatagggtatatcgcacctgttcgccgttaacccacgaacagaggagacgtgggatgacggcgaacaacctggcggcagcgcaaaagatg

SEQ ID NO: 41191 - DNA, 103 bp, Artificial Sequence
  Synthetic Polynucleotide
taatacgactcactataggggctttcaaacgccaggtcctagacatttccaacagaggagaggaaatatgtaggacctgaacctggcggcagcgcaaaagatg

SEQ ID NO: 41192 - DNA, 103 bp, Artificial Sequence
  Synthetic Polynucleotide
taatacgactcactatagggggtcgtatgtggaccgctccgtattgtcgaaacagaggagatcgacaatgcggagcggtaacctggcggcagcgcaaaagatg

SEQ ID NO: 41193 - DNA, 103 bp, Artificial Sequence
  Synthetic Polynucleotide
taatacgactcactatagggtggggtatatcacctgatcgtggaaccggcaacagaggagagccggtatgacgatcaggaacctggcggcagcgcaaaagatg

SEQ ID NO: 41194 - DNA, 103 bp, Artificial Sequence
  Synthetic Polynucleotide
taatacgactcactatagggttgaacttaacgggccccaccgtttcggcgaacagaggagacgccgaatgggtggggccaacctggcggcagcgcaaaagatg

SEQ ID NO: 41195 - DNA, 103 bp, Artificial Sequence
  Synthetic Polynucleotide
taatacgactcactataggggacctgatcataccggtgttctagcgagtgaacagaggagacactcgatggaacaccggaacctggcggcagcgcaaaagatg

SEQ ID NO: 41196 - DNA, 103 bp, Artificial Sequence
  Synthetic Polynucleotide
taatacgactcactatagggactggacccctgactgtcactttctccttcaacagaggagagaaggaatgagtgacagtaacctggcggcagcgcaaaagatg

SEQ ID NO: 41197 - DNA, 103 bp, Artificial Sequence
  Synthetic Polynucleotide
taatacgactcactatagggtatagtggagcagatacggttagcacgtcaaacagaggagatgacgtatgaaccgtatcaacctggcggcagcgcaaaagatg

SEQ ID NO: 41198 - DNA, 103 bp, Artificial Sequence
  Synthetic Polynucleotide
taatacgactcactatagggtaacgaaaagtattatggtcctccgtaggtaacagaggagaacctacatgggaccataaaacctggcggcagcgcaaaagatg

SEQ ID NO: 41199 - DNA, 103 bp, Artificial Sequence
  Synthetic Polynucleotide
taatacgactcactataggggtactttaggatgagtgactagacgtttaaaacagaggagattaaacatgtagtcactcaacctggcggcagcgcaaaagatg

SEQ ID NO: 41200 - DNA, 103 bp, Artificial Sequence
  Synthetic Polynucleotide
taatacgactcactatagggtatatggcgcgagtacgaggatcagcttaaaacagaggagattaagcatgtcctcgtacaacctggcggcagcgcaaaagatg

SEQ ID NO: 41201 - DNA, 103 bp, Artificial Sequence
  Synthetic Polynucleotide
taatacgactcactatagggccaatctcacgaggtgatacgcgccagcctaacagaggagaaggctgatgcgtatcaccaacctggcggcagcgcaaaagatg

SEQ ID NO: 41202 - DNA, 103 bp, Artificial Sequence
  Synthetic Polynucleotide
taatacgactcactataggggcgctcccaaataaccacataaccgcctgaaacagaggagatcaggcatgtatgtggttaacctggcggcagcgcaaaagatg

SEQ ID NO: 41203 - DNA, 103 bp, Artificial Sequence
  Synthetic Polynucleotide
taatacgactcactataggggggtccagccaaataagtgggaggcaacgcaacagaggagagcgttgatgcccacttataacctggcggcagcgcaaaagatg

SEQ ID NO: 41204 - DNA, 103 bp, Artificial Sequence
  Synthetic Polynucleotide
taatacgactcactatagggttacacgaggcagggcgatgaaggcttaggaacagaggagacctaagatgtcatcgcccaacctggcggcagcgcaaaagatg

SEQ ID NO: 41205 - DNA, 103 bp, Artificial Sequence
  Synthetic Polynucleotide
taatacgactcactataggggcgggtcctccttggttggcggcaaggcagaacagaggagactgcctatgcgccaaccaaacctggcggcagcgcaaaagatg

SEQ ID NO: 41206 - DNA, 103 bp, Artificial Sequence
  Synthetic Polynucleotide
taatacgactcactatagggatacgtaattgttgcatgggtatatcggctaacagaggagaagccgaatgacccatgcaaacctggcggcagcgcaaaagatg

SEQ ID NO: 41207 - DNA, 103 bp, Artificial Sequence
  Synthetic Polynucleotide
taatacgactcactatagggcactctagaatagtatattaaagtaaggctaacagaggagaagccttatgttaatatacaacctggcggcagcgcaaaagatg

SEQ ID NO: 41208 - DNA, 103 bp, Artificial Sequence
  Synthetic Polynucleotide
taatacgactcactatagggcgaaaaagcacggtcatcgtgctagaacctaacagaggagaaggttcatgcacgatgacaacctggcggcagcgcaaaagatg

SEQ ID NO: 41209 - DNA, 103 bp, Artificial Sequence
  Synthetic Polynucleotide
taatacgactcactatagggccgatatgcaatacgatgccgcatttatacaacagaggagagtataaatgcggcatcgtaacctggcggcagcgcaaaagatg

SEQ ID NO: 41210 - DNA, 103 bp, Artificial Sequence
  Synthetic Polynucleotide
taatacgactcactatagggggaccttctttgctcaagcgaagaaaacggaacagaggagaccgtttatgtcgcttgagaacctggcggcagcgcaaaagatg

SEQ ID NO: 41211 - DNA, 103 bp, Artificial Sequence
  Synthetic Polynucleotide
taatacgactcactataggggctcccttatcataccgtgcttcttagcgtaacagaggagaacgctaatgagcacggtaaacctggcggcagcgcaaaagatg

SEQ ID NO: 41212 - DNA, 103 bp, Artificial Sequence
  Synthetic Polynucleotide
taatacgactcactatagggtcgacgttggtaagcatagattcccgatataacagaggagaatatcgatgatctatgctaacctggcggcagcgcaaaagatg

SEQ ID NO: 41213 - DNA, 103 bp, Artificial Sequence
  Synthetic Polynucleotide
taatacgactcactatagggtttctcgcagattatgaaagtccccactggaacagaggagaccagtgatgactttcataaacctggcggcagcgcaaaagatg

SEQ ID NO: 41214 - DNA, 103 bp, Artificial Sequence
  Synthetic Polynucleotide
taatacgactcactatagggtgaaaagccccttagctgttagccagatcaaacagaggagatgatctatgtaacagctaaacctggcggcagcgcaaaagatg

SEQ ID NO: 41215 - DNA, 103 bp, Artificial Sequence
  Synthetic Polynucleotide
taatacgactcactataggggtagctacgccgatcttaagggctcgttcaaacagaggagatgaacgatgccttaagataacctggcggcagcgcaaaagatg

SEQ ID NO: 41216 - DNA, 103 bp, Artificial Sequence
  Synthetic Polynucleotide
taatacgactcactataggggacgatcggcgttccaaccccggttcacccaacagaggagagggtgaatgggggttggaaacctggcggcagcgcaaaagatg

SEQ ID NO: 41217 - DNA, 103 bp, Artificial Sequence
  Synthetic Polynucleotide
taatacgactcactatagggcggtgcaatccgctaaaatcgcgtacccgaaacagaggagatcgggtatgcgattttagaacctggcggcagcgcaaaagatg

SEQ ID NO: 41218 - DNA, 103 bp, Artificial Sequence
  Synthetic Polynucleotide
taatacgactcactataggggaagagtgtgtatcctagagcttgtcctggaacagaggagaccaggaatggctctaggaaacctggcggcagcgcaaaagatg

SEQ ID NO: 41219 - DNA, 103 bp, Artificial Sequence
  Synthetic Polynucleotide
taatacgactcactatagggcttgtgagtgtcaagtaaaacgtttgaatcaacagaggagagattcaatggttttacttaacctggcggcagcgcaaaagatg

SEQ ID NO: 41220 - DNA, 103 bp, Artificial Sequence
  Synthetic Polynucleotide
taatacgactcactatagggacaaggtcattaaaactgcggcataccgccaacagaggagaggcggtatgccgcagtttaacctggcggcagcgcaaaagatg

SEQ ID NO: 41221 - DNA, 103 bp, Artificial Sequence
  Synthetic Polynucleotide
taatacgactcactatagggtcacagaaaaacttatagaaataatctatcaacagaggagagatagaatgtttctataaaacctggcggcagcgcaaaagatg

SEQ ID NO: 41222 - DNA, 103 bp, Artificial Sequence
  Synthetic Polynucleotide
taatacgactcactatagggaattggtttcgacggtaaagtgtccgcttcaacagaggagagaagcgatgactttaccgaacctggcggcagcgcaaaagatg

SEQ ID NO: 41223 - DNA, 103 bp, Artificial Sequence
  Synthetic Polynucleotide
taatacgactcactatagggagaaaattgacatattacaggtccgacttcaacagaggagagaagtcatgcctgtaataaacctggcggcagcgcaaaagatg

SEQ ID NO: 41224 - DNA, 103 bp, Artificial Sequence
  Synthetic Polynucleotide
taatacgactcactatagggtcagccgcaagattacgaaggttaggattaaacagaggagataatccatgccttcgtaaaacctggcggcagcgcaaaagatg

SEQ ID NO: 41225 - DNA, 103 bp, Artificial Sequence
  Synthetic Polynucleotide
taatacgactcactatagggttactcgcgacgtcattagttagtatcaggaacagaggagacctgatatgaactaatgaaacctggcggcagcgcaaaagatg

SEQ ID NO: 41226 - DNA, 103 bp, Artificial Sequence
  Synthetic Polynucleotide
taatacgactcactatagggaatttatctggtgatctagcagtgatactgaacagaggagacagtatatgtgctagatcaacctggcggcagcgcaaaagatg

SEQ ID NO: 41227 - DNA, 103 bp, Artificial Sequence
  Synthetic Polynucleotide
taatacgactcactatagggggtctgcttgctgtggacttgcgggtccctaacagaggagaagggacatgcaagtccacaacctggcggcagcgcaaaagatg

SEQ ID NO: 41228 - DNA, 103 bp, Artificial Sequence
  Synthetic Polynucleotide
taatacgactcactataggggggtacagaatacgggtctaaacatgacataacagaggagaatgtcaatgttagacccgaacctggcggcagcgcaaaagatg

SEQ ID NO: 41229 - DNA, 103 bp, Artificial Sequence
  Synthetic Polynucleotide
taatacgactcactatagggtatcacgtcggggcagacctggtgaacatcaacagaggagagatgttatgcaggtctgcaacctggcggcagcgcaaaagatg

SEQ ID NO: 41230 - DNA, 103 bp, Artificial Sequence
  Synthetic Polynucleotide
taatacgactcactatagggataactattcttgaccagtagcagtgcaaaaacagaggagatttgcaatgctactggtcaacctggcggcagcgcaaaagatg

SEQ ID NO: 41231 - DNA, 103 bp, Artificial Sequence
  Synthetic Polynucleotide
taatacgactcactatagggaggcataggagtctcgccgtaactaacaggaacagaggagacctgttatgtacggcgagaacctggcggcagcgcaaaagatg

SEQ ID NO: 41232 - DNA, 103 bp, Artificial Sequence
  Synthetic Polynucleotide
taatacgactcactatagggagagtgtcagccggtcgtatcctgcattagaacagaggagactaatgatggatacgaccaacctggcggcagcgcaaaagatg

SEQ ID NO: 41233 - DNA, 103 bp, Artificial Sequence
  Synthetic Polynucleotide
taatacgactcactatagggcttggatcttgtggctgatcatgctgttgcaacagaggagagcaacaatgtgatcagccaacctggcggcagcgcaaaagatg

SEQ ID NO: 41234 - DNA, 103 bp, Artificial Sequence
  Synthetic Polynucleotide
taatacgactcactatagggcccctgttacgttcccaaggttgtgaggaaaacagaggagattcctcatgaccttgggaaacctggcggcagcgcaaaagatg

SEQ ID NO: 41235 - DNA, 103 bp, Artificial Sequence
  Synthetic Polynucleotide
taatacgactcactatagggttgtcgtgagttgcgccccatccggtgagtaacagaggagaactcacatgatggggcgcaacctggcggcagcgcaaaagatg

SEQ ID NO: 41236 - DNA, 103 bp, Artificial Sequence
  Synthetic Polynucleotide
taatacgactcactataggggtggacaaggtgattcacggcacatgataaaacagaggagattatcaatggccgtgaataacctggcggcagcgcaaaagatg

SEQ ID NO: 41237 - DNA, 103 bp, Artificial Sequence
  Synthetic Polynucleotide
taatacgactcactatagggtcgtgttctccctacgcgaggggtcgtagaaacagaggagatctacgatgcctcgcgtaaacctggcggcagcgcaaaagatg

SEQ ID NO: 41238 - DNA, 103 bp, Artificial Sequence
  Synthetic Polynucleotide
taatacgactcactatagggcctgaactaaatgcgaataggatcgatttaaacagaggagataaatcatgcctattcgcaacctggcggcagcgcaaaagatg

SEQ ID NO: 41239 - DNA, 103 bp, Artificial Sequence
  Synthetic Polynucleotide
taatacgactcactatagggttgccgtaaacttggatagaaacccaagataacagaggagaatcttgatgttctatccaaacctggcggcagcgcaaaagatg

SEQ ID NO: 41240 - DNA, 103 bp, Artificial Sequence
  Synthetic Polynucleotide
taatacgactcactatagggagcaaacgattattcttgtgtatttctctgaacagaggagacagagaatgacacaagaaaacctggcggcagcgcaaaagatg

SEQ ID NO: 41241 - DNA, 103 bp, Artificial Sequence
  Synthetic Polynucleotide
taatacgactcactatagggggcgcgggtaataacccgtctccagttaagaacagaggagacttaacatgagacgggttaacctggcggcagcgcaaaagatg

SEQ ID NO: 41242 - DNA, 103 bp, Artificial Sequence
  Synthetic Polynucleotide
taatacgactcactatagggagtcaccaaagactaaagagctcccgccgtaacagaggagaacggcgatggctctttagaacctggcggcagcgcaaaagatg

SEQ ID NO: 41243 - DNA, 103 bp, Artificial Sequence
  Synthetic Polynucleotide
taatacgactcactatagggttgtcctcaggggcataacaccatttagttaacagaggagaaactaaatggtgttatgcaacctggcggcagcgcaaaagatg

SEQ ID NO: 41244 - DNA, 103 bp, Artificial Sequence
  Synthetic Polynucleotide
taatacgactcactatagggtagccgtcccaggcgggatgacgcccatgtaacagaggagaacatggatgtcatcccgcaacctggcggcagcgcaaaagatg

SEQ ID NO: 41245 - DNA, 103 bp, Artificial Sequence
  Synthetic Polynucleotide
taatacgactcactatagggcaatgccgcaccatacaacctatgtccaacaacagaggagagttggaatgaggttgtataacctggcggcagcgcaaaagatg

SEQ ID NO: 41246 - DNA, 103 bp, Artificial Sequence
  Synthetic Polynucleotide
taatacgactcactatagggcgttagtaaataggcgctgtaccgacctttaacagaggagaaaaggtatgtacagcgccaacctggcggcagcgcaaaagatg

SEQ ID NO: 41247 - DNA, 103 bp, Artificial Sequence
  Synthetic Polynucleotide
taatacgactcactatagggtaatgttgttcctataatagctcatgtacaaacagaggagatgtacaatggctattataaacctggcggcagcgcaaaagatg

SEQ ID NO: 41248 - DNA, 103 bp, Artificial Sequence
  Synthetic Polynucleotide
taatacgactcactatagggaagtcttaacaatatggtacactctaaccaaacagaggagatggttaatgtgtaccataaacctggcggcagcgcaaaagatg

SEQ ID NO: 41249 - DNA, 103 bp, Artificial Sequence
  Synthetic Polynucleotide
taatacgactcactataggggcaggcactttgcgtggcccctggtcagcgaacagaggagacgctgaatgggggccacgaacctggcggcagcgcaaaagatg

SEQ ID NO: 41250 - DNA, 103 bp, Artificial Sequence
  Synthetic Polynucleotide
taatacgactcactatagggcatttcctgcgtctatctgcatcggctggaaacagaggagatccagcatgtgcagatagaacctggcggcagcgcaaaagatg

SEQ ID NO: 41251 - DNA, 103 bp, Artificial Sequence
  Synthetic Polynucleotide
taatacgactcactatagggacgtgatggcaagtctttcccgcagaagtcaacagaggagagacttcatggggaaagacaacctggcggcagcgcaaaagatg

SEQ ID NO: 41252 - DNA, 103 bp, Artificial Sequence
  Synthetic Polynucleotide
taatacgactcactatagggaccacgtttttacgcatcaagtgttcatagaacagaggagactatgaatgcttgatgcgaacctggcggcagcgcaaaagatg

SEQ ID NO: 41253 - DNA, 103 bp, Artificial Sequence
  Synthetic Polynucleotide
taatacgactcactatagggccccgctgatgtgttgtgtggagtcctttaaacagaggagataaaggatgccacacaacaacctggcggcagcgcaaaagatg

SEQ ID NO: 41254 - DNA, 103 bp, Artificial Sequence
  Synthetic Polynucleotide
taatacgactcactatagggggtctgcatgaaggtcattggatcgcgtaaaacagaggagattacgcatgccaatgaccaacctggcggcagcgcaaaagatg

SEQ ID NO: 41255 - DNA, 103 bp, Artificial Sequence
  Synthetic Polynucleotide
taatacgactcactataggggttaccctgcagtccgatataactcccttgaacagaggagacaagggatgtatatcggaaacctggcggcagcgcaaaagatg

SEQ ID NO: 41256 - DNA, 103 bp, Artificial Sequence
  Synthetic Polynucleotide
taatacgactcactatagggtaccatcaacaacataggctaatagatattaacagaggagaaatatcatgtagcctatgaacctggcggcagcgcaaaagatg

SEQ ID NO: 41257 - DNA, 103 bp, Artificial Sequence
  Synthetic Polynucleotide
taatacgactcactataggggtgtttcgatgagcatacggatagcctgagaacagaggagactcaggatgtccgtatgcaacctggcggcagcgcaaaagatg

SEQ ID NO: 41258 - DNA, 103 bp, Artificial Sequence
  Synthetic Polynucleotide
taatacgactcactatagggaaggccaacgtctgacccgggaaccttcttaacagaggagaaagaagatgcccgggtcaaacctggcggcagcgcaaaagatg

SEQ ID NO: 41259 - DNA, 103 bp, Artificial Sequence
  Synthetic Polynucleotide
taatacgactcactatagggcccccgcaacggacctagccttatggggccaacagaggagaggccccatgaggctaggtaacctggcggcagcgcaaaagatg

SEQ ID NO: 41260 - DNA, 103 bp, Artificial Sequence
  Synthetic Polynucleotide
taatacgactcactataggggccgccgcttcatgagctatatgtacgagcaacagaggagagctcgtatgtatagctcaaacctggcggcagcgcaaaagatg

SEQ ID NO: 41261 - DNA, 103 bp, Artificial Sequence
  Synthetic Polynucleotide
taatacgactcactatagggcacgcagatcaaatttgtctgggattgtaaaacagaggagattacaaatgcagacaaataacctggcggcagcgcaaaagatg

SEQ ID NO: 41262 - DNA, 103 bp, Artificial Sequence
  Synthetic Polynucleotide
taatacgactcactatagggcacttataaggagtcccacacgctaacagaaacagaggagatctgttatggtgtgggacaacctggcggcagcgcaaaagatg

SEQ ID NO: 41263 - DNA, 103 bp, Artificial Sequence
  Synthetic Polynucleotide
taatacgactcactatagggaaaaaagctcggcttacgtgttgtacgcaaaacagaggagattgcgtatgacacgtaagaacctggcggcagcgcaaaagatg

SEQ ID NO: 41264 - DNA, 103 bp, Artificial Sequence
  Synthetic Polynucleotide
taatacgactcactatagggttaaaatgctccctcgtgttttgacagcggaacagaggagaccgctgatgaaacacgagaacctggcggcagcgcaaaagatg

SEQ ID NO: 41265 - DNA, 103 bp, Artificial Sequence
  Synthetic Polynucleotide
taatacgactcactataggggcacagtgtgatggagatgtggattcgtcgaacagaggagacgacgaatgcacatctccaacctggcggcagcgcaaaagatg

SEQ ID NO: 41266 - DNA, 103 bp, Artificial Sequence
  Synthetic Polynucleotide
taatacgactcactatagggccaaagcccgccaacaactgccgacgacgcaacagaggagagcgtcgatggcagttgttaacctggcggcagcgcaaaagatg

SEQ ID NO: 41267 - DNA, 103 bp, Artificial Sequence
  Synthetic Polynucleotide
taatacgactcactatagggggtaacacattgacgccgaccgacttccggaacagaggagaccggaaatgggtcggcgtaacctggcggcagcgcaaaagatg

SEQ ID NO: 41268 - DNA, 103 bp, Artificial Sequence
  Synthetic Polynucleotide
taatacgactcactatagggtccttaaatcttaggcgttcatatcgagtaaacagaggagatactcgatgtgaacgcctaacctggcggcagcgcaaaagatg

SEQ ID NO: 41269 - DNA, 103 bp, Artificial Sequence
  Synthetic Polynucleotide
taatacgactcactatagggggatatcgattagatgaggccgaagtcgaaaacagaggagattcgacatgggcctcatcaacctggcggcagcgcaaaagatg

SEQ ID NO: 41270 - DNA, 103 bp, Artificial Sequence
  Synthetic Polynucleotide
taatacgactcactatagggaccaaggcgccaggcaaccccggtagaagtaacagaggagaacttctatgggggttgccaacctggcggcagcgcaaaagatg

SEQ ID NO: 41271 - DNA, 103 bp, Artificial Sequence
  Synthetic Polynucleotide
taatacgactcactataggggagcatagcaagtgaccaatatatcctggcaacagaggagagccaggatgtattggtcaaacctggcggcagcgcaaaagatg

SEQ ID NO: 41272 - DNA, 103 bp, Artificial Sequence
  Synthetic Polynucleotide
taatacgactcactatagggcaacagcgtgccagactggacaaagtcttgaacagaggagacaagacatggtccagtctaacctggcggcagcgcaaaagatg

SEQ ID NO: 41273 - DNA, 103 bp, Artificial Sequence
  Synthetic Polynucleotide
taatacgactcactatagggtgtctactcgaaagctaggtccagatcctaaacagaggagataggatatggacctagctaacctggcggcagcgcaaaagatg

SEQ ID NO: 41274 - DNA, 103 bp, Artificial Sequence
  Synthetic Polynucleotide
taatacgactcactatagggagagacccaccccttttcggtatgggctttaacagaggagaaaagccatgaccgaaaagaacctggcggcagcgcaaaagatg

SEQ ID NO: 41275 - DNA, 103 bp, Artificial Sequence
  Synthetic Polynucleotide
taatacgactcactatagggtaatgctgggttttgcgggaaagcaccttaaacagaggagataaggtatgttcccgcaaaacctggcggcagcgcaaaagatg

SEQ ID NO: 41276 - DNA, 103 bp, Artificial Sequence
  Synthetic Polynucleotide
taatacgactcactatagggagagtcggagagcgctgttaacacacacctaacagaggagaaggtgtatgttaacagcgaacctggcggcagcgcaaaagatg

SEQ ID NO: 41277 - DNA, 103 bp, Artificial Sequence
  Synthetic Polynucleotide
taatacgactcactataggggcatgtggagcgcaattagacctgatgactaacagaggagaagtcatatggtctaattgaacctggcggcagcgcaaaagatg

SEQ ID NO: 41278 - DNA, 103 bp, Artificial Sequence
  Synthetic Polynucleotide
taatacgactcactatagggtggaatgaatacacttcccccgtatggggtaacagaggagaaccccaatggggggaagtaacctggcggcagcgcaaaagatg

SEQ ID NO: 41279 - DNA, 103 bp, Artificial Sequence
  Synthetic Polynucleotide
taatacgactcactataggggtattcaaagacaattgcacaacggatcacaacagaggagagtgatcatgtgtgcaattaacctggcggcagcgcaaaagatg

SEQ ID NO: 41280 - DNA, 103 bp, Artificial Sequence
  Synthetic Polynucleotide
taatacgactcactataggggcgatgcggtcctatcgcagactatcaggcaacagaggagagcctgaatgtctgcgataaacctggcggcagcgcaaaagatg

SEQ ID NO: 41281 - DNA, 103 bp, Artificial Sequence
  Synthetic Polynucleotide
taatacgactcactatagggtagaagtgcaaaactaagcagctgtacaccaacagaggagaggtgtaatgctgcttagtaacctggcggcagcgcaaaagatg

SEQ ID NO: 41282 - DNA, 103 bp, Artificial Sequence
  Synthetic Polynucleotide
taatacgactcactatagggtcacgcgactagaaggggccgacaatccaaaacagaggagattggatatgcggccccttaacctggcggcagcgcaaaagatg

SEQ ID NO: 41283 - DNA, 103 bp, Artificial Sequence
  Synthetic Polynucleotide
taatacgactcactatagggtcgaagtgtcattcaaaggggtccgtttggaacagaggagaccaaacatgcccctttgaaacctggcggcagcgcaaaagatg

SEQ ID NO: 41284 - DNA, 103 bp, Artificial Sequence
  Synthetic Polynucleotide
taatacgactcactatagggaccctaaaccacgcttagcgatttctggtaaacagaggagataccagatgtcgctaagcaacctggcggcagcgcaaaagatg

SEQ ID NO: 41285 - DNA, 103 bp, Artificial Sequence
  Synthetic Polynucleotide
taatacgactcactataggggttcgttattagtgcctttctgccgacctgaacagaggagacaggtcatgagaaaggcaaacctggcggcagcgcaaaagatg

SEQ ID NO: 41286 - DNA, 103 bp, Artificial Sequence
  Synthetic Polynucleotide
taatacgactcactatagggagacgacaacttgctggttggctaggagtgaacagaggagacactccatgccaaccagcaacctggcggcagcgcaaaagatg

SEQ ID NO: 41287 - DNA, 103 bp, Artificial Sequence
  Synthetic Polynucleotide
taatacgactcactataggggcgagggactggcattatacaagaagattaaacagaggagataatctatgtgtataatgaacctggcggcagcgcaaaagatg

SEQ ID NO: 41288 - DNA, 103 bp, Artificial Sequence
  Synthetic Polynucleotide
taatacgactcactatagggtatgacgcgccgctaccgtttgtcacctgcaacagaggagagcaggtatgaaacggtagaacctggcggcagcgcaaaagatg

SEQ ID NO: 41289 - DNA, 103 bp, Artificial Sequence
  Synthetic Polynucleotide
taatacgactcactatagggtctccttcagaatcttcccaatgcaggaggaacagaggagacctcctatgttgggaagaaacctggcggcagcgcaaaagatg

SEQ ID NO: 41290 - DNA, 103 bp, Artificial Sequence
  Synthetic Polynucleotide
taatacgactcactatagggggctcgtctcccttcggtcgcaccatccctaacagaggagaagggatatggcgaccgaaaacctggcggcagcgcaaaagatg

SEQ ID NO: 41291 - DNA, 103 bp, Artificial Sequence
  Synthetic Polynucleotide
taatacgactcactataggggtagaatatcggtacatagtacgcgccgccaacagaggagaggcggcatgtactatgtaaacctggcggcagcgcaaaagatg

SEQ ID NO: 41292 - DNA, 103 bp, Artificial Sequence
  Synthetic Polynucleotide
taatacgactcactatagggatgagtcaggcgcagactggagtcctactgaacagaggagacagtagatgtccagtctgaacctggcggcagcgcaaaagatg

SEQ ID NO: 41293 - DNA, 103 bp, Artificial Sequence
  Synthetic Polynucleotide
taatacgactcactatagggaacgatgtctgttaagccatcgggctcatcaacagaggagagatgagatggatggcttaaacctggcggcagcgcaaaagatg

SEQ ID NO: 41294 - DNA, 103 bp, Artificial Sequence
  Synthetic Polynucleotide
taatacgactcactatagggatcagctcgaggacgttcatatccttggccaacagaggagaggccaaatgtatgaacgtaacctggcggcagcgcaaaagatg

SEQ ID NO: 41295 - DNA, 103 bp, Artificial Sequence
  Synthetic Polynucleotide
taatacgactcactatagggttgggactaatccttcagcatctggtggcaaacagaggagatgccacatgatgctgaagaacctggcggcagcgcaaaagatg

SEQ ID NO: 41296 - DNA, 103 bp, Artificial Sequence
  Synthetic Polynucleotide
taatacgactcactatagggcgatcgctgaagatatacttacgtagaataaacagaggagatattctatgtaagtatataacctggcggcagcgcaaaagatg

SEQ ID NO: 41297 - DNA, 103 bp, Artificial Sequence
  Synthetic Polynucleotide
taatacgactcactatagggggggtctgtcctttaacgatgagccactctaacagaggagaagagtgatgcatcgttaaaacctggcggcagcgcaaaagatg

SEQ ID NO: 41298 - DNA, 103 bp, Artificial Sequence
  Synthetic Polynucleotide
taatacgactcactatagggcaatgttcttcacacccacgggataggttaaacagaggagataacctatgccgtgggtgaacctggcggcagcgcaaaagatg

SEQ ID NO: 41299 - DNA, 103 bp, Artificial Sequence
  Synthetic Polynucleotide
taatacgactcactatagggttggtaaaaagtatcacagacggtgatccgaacagaggagacggatcatggtctgtgataacctggcggcagcgcaaaagatg

SEQ ID NO: 41300 - DNA, 103 bp, Artificial Sequence
  Synthetic Polynucleotide
taatacgactcactatagggtcagaataatgccttgatcgttctctggtaaacagaggagataccagatgacgatcaagaacctggcggcagcgcaaaagatg

SEQ ID NO: 41301 - DNA, 103 bp, Artificial Sequence
  Synthetic Polynucleotide
taatacgactcactatagggaagacctactcgctatgtacggtccaagtgaacagaggagacacttgatgcgtacatagaacctggcggcagcgcaaaagatg

SEQ ID NO: 41302 - DNA, 103 bp, Artificial Sequence
  Synthetic Polynucleotide
taatacgactcactatagggaggcgccggctcgggtactagcgaccatttaacagaggagaaaatggatgctagtacccaacctggcggcagcgcaaaagatg

SEQ ID NO: 41303 - DNA, 103 bp, Artificial Sequence
  Synthetic Polynucleotide
taatacgactcactatagggtgatctgacgtcagctataattgccttgtgaacagaggagacacaagatgattatagctaacctggcggcagcgcaaaagatg

SEQ ID NO: 41304 - DNA, 103 bp, Artificial Sequence
  Synthetic Polynucleotide
taatacgactcactatagggggtctctctccaacagggccatgtgttacgaacagaggagacgtaacatgtggccctgtaacctggcggcagcgcaaaagatg

SEQ ID NO: 41305 - DNA, 103 bp, Artificial Sequence
  Synthetic Polynucleotide
taatacgactcactatagggcggtaaccgtcgtaaatgcgtacaccaggtaacagaggagaacctggatgacgcatttaaacctggcggcagcgcaaaagatg

SEQ ID NO: 41306 - DNA, 103 bp, Artificial Sequence
  Synthetic Polynucleotide
taatacgactcactatagggacattcacgcgattctaacacgatggagtgaacagaggagacactccatggtgttagaaaacctggcggcagcgcaaaagatg

SEQ ID NO: 41307 - DNA, 103 bp, Artificial Sequence
  Synthetic Polynucleotide
taatacgactcactataggggatgagtgcggtgatgtgtactctatagttaacagaggagaaactatatggtacacatcaacctggcggcagcgcaaaagatg

SEQ ID NO: 41308 - DNA, 103 bp, Artificial Sequence
  Synthetic Polynucleotide
taatacgactcactataggggagtagcggtaagggctcgattagtttactaacagaggagaagtaaaatgatcgagcccaacctggcggcagcgcaaaagatg

SEQ ID NO: 41309 - DNA, 103 bp, Artificial Sequence
  Synthetic Polynucleotide
taatacgactcactatagggtaccacaggcaggggacatgtgatgtcgggaacagaggagacccgacatgacatgtcccaacctggcggcagcgcaaaagatg

SEQ ID NO: 41310 - DNA, 103 bp, Artificial Sequence
  Synthetic Polynucleotide
taatacgactcactataggggtaccgttgccctttgcaatacgcagtcttaacagaggagaaagactatgtattgcaaaaacctggcggcagcgcaaaagatg

SEQ ID NO: 41311 - DNA, 103 bp, Artificial Sequence
  Synthetic Polynucleotide
taatacgactcactataggggcaattcgtatcctgtgggcaggcttgcagaacagaggagactgcaaatgtgcccacagaacctggcggcagcgcaaaagatg

SEQ ID NO: 41312 - DNA, 103 bp, Artificial Sequence
  Synthetic Polynucleotide
taatacgactcactatagggtacgcaaaatttatatggcatttttcttaaaacagaggagattaagaatgatgccatataacctggcggcagcgcaaaagatg

SEQ ID NO: 41313 - DNA, 103 bp, Artificial Sequence
  Synthetic Polynucleotide
taatacgactcactatagggattcggacatcgttccttgctgggactgataacagaggagaatcagtatgagcaaggaaaacctggcggcagcgcaaaagatg

SEQ ID NO: 41314 - DNA, 103 bp, Artificial Sequence
  Synthetic Polynucleotide
taatacgactcactatagggtccgttcatggccctagaacaggtcaaatgaacagaggagacatttgatgtgttctaggaacctggcggcagcgcaaaagatg

SEQ ID NO: 41315 - DNA, 103 bp, Artificial Sequence
  Synthetic Polynucleotide
taatacgactcactatagggttttgcaacgctgcgcgatgcacgaagtagaacagaggagactacttatggcatcgcgcaacctggcggcagcgcaaaagatg

SEQ ID NO: 41316 - DNA, 103 bp, Artificial Sequence
  Synthetic Polynucleotide
taatacgactcactatagggggggttggtataggatttacactggcaggcaacagaggagagcctgcatgtgtaaatccaacctggcggcagcgcaaaagatg

SEQ ID NO: 41317 - DNA, 103 bp, Artificial Sequence
  Synthetic Polynucleotide
taatacgactcactatagggtgcgacattccgtgacagtcccttgaaatcaacagaggagagatttcatgggactgtcaaacctggcggcagcgcaaaagatg

SEQ ID NO: 41318 - DNA, 103 bp, Artificial Sequence
  Synthetic Polynucleotide
taatacgactcactatagggtgaaagatcgcctcgccaatagtaaagaggaacagaggagacctcttatgtattggcgaaacctggcggcagcgcaaaagatg

SEQ ID NO: 41319 - DNA, 103 bp, Artificial Sequence
  Synthetic Polynucleotide
taatacgactcactatagggagaaagggcgaacaggacgattcaggcaggaacagaggagacctgccatgatcgtcctgaacctggcggcagcgcaaaagatg

SEQ ID NO: 41320 - DNA, 103 bp, Artificial Sequence
  Synthetic Polynucleotide
taatacgactcactatagggattcatgtggcgtatagacagagggtttgcaacagaggagagcaaacatgctgtctataaacctggcggcagcgcaaaagatg

SEQ ID NO: 41321 - DNA, 103 bp, Artificial Sequence
  Synthetic Polynucleotide
taatacgactcactatagggggtactatcatatttgagtcctaataaaacaacagaggagagttttaatgggactcaaaaacctggcggcagcgcaaaagatg

SEQ ID NO: 41322 - DNA, 103 bp, Artificial Sequence
  Synthetic Polynucleotide
taatacgactcactatagggtctatataaataagggcgtacacacgttctaacagaggagaagaacgatggtacgccctaacctggcggcagcgcaaaagatg

SEQ ID NO: 41323 - DNA, 103 bp, Artificial Sequence
  Synthetic Polynucleotide
taatacgactcactatagggagagcgcacccaggagttatcgactcgatcaacagaggagagatcgaatggataactccaacctggcggcagcgcaaaagatg

SEQ ID NO: 41324 - DNA, 103 bp, Artificial Sequence
  Synthetic Polynucleotide
taatacgactcactatagggctggggaggtgcggaggcttgctccgatataacagaggagaatatcgatgcaagcctccaacctggcggcagcgcaaaagatg

SEQ ID NO: 41325 - DNA, 103 bp, Artificial Sequence
  Synthetic Polynucleotide
taatacgactcactataggggtctcaataaggctccatgttgtgcgcaacaacagaggagagttgcgatgaacatggagaacctggcggcagcgcaaaagatg

SEQ ID NO: 41326 - DNA, 103 bp, Artificial Sequence
  Synthetic Polynucleotide
taatacgactcactataggggtttccaccaccaaacgcattatagaagtaaacagaggagatacttcatgaatgcgtttaacctggcggcagcgcaaaagatg

SEQ ID NO: 41327 - DNA, 103 bp, Artificial Sequence
  Synthetic Polynucleotide
taatacgactcactatagggatcccctttttaaccagctacccaaagatgaacagaggagacatcttatggtagctggtaacctggcggcagcgcaaaagatg

SEQ ID NO: 41328 - DNA, 103 bp, Artificial Sequence
  Synthetic Polynucleotide
taatacgactcactatagggctcttgacgctggcgtaattgttcatcttgaacagaggagacaagatatgcaattacgcaacctggcggcagcgcaaaagatg

SEQ ID NO: 41329 - DNA, 103 bp, Artificial Sequence
  Synthetic Polynucleotide
taatacgactcactatagggatatctagacggactaaatcagtcgcaaagaacagaggagactttgcatgtgatttagtaacctggcggcagcgcaaaagatg

SEQ ID NO: 41330 - DNA, 103 bp, Artificial Sequence
  Synthetic Polynucleotide
taatacgactcactataggggactcaccctactgtgtctattacttgcttaacagaggagaaagcaaatgatagacacaaacctggcggcagcgcaaaagatg

SEQ ID NO: 41331 - DNA, 103 bp, Artificial Sequence
  Synthetic Polynucleotide
taatacgactcactataggggatatgctgatttggcctacgtaaggacccaacagaggagagggtccatgcgtaggccaaacctggcggcagcgcaaaagatg

SEQ ID NO: 41332 - DNA, 103 bp, Artificial Sequence
  Synthetic Polynucleotide
taatacgactcactataggggccatgtgcagaggtggacttcgtcaaccgaacagaggagacggttgatgaagtccaccaacctggcggcagcgcaaaagatg

SEQ ID NO: 41333 - DNA, 103 bp, Artificial Sequence
  Synthetic Polynucleotide
taatacgactcactatagggtgcctacttccgtctgacagtggccgcggcaacagaggagagccgcgatgactgtcagaaacctggcggcagcgcaaaagatg

SEQ ID NO: 41334 - DNA, 103 bp, Artificial Sequence
  Synthetic Polynucleotide
taatacgactcactatagggcccgccggtaaagtgtgatgattgcccttgaacagaggagacaagggatgtcatcacacaacctggcggcagcgcaaaagatg

SEQ ID NO: 41335 - DNA, 103 bp, Artificial Sequence
  Synthetic Polynucleotide
taatacgactcactataggggtaaacaaaactcactccctaacaggaatgaacagaggagacattccatgtagggagtgaacctggcggcagcgcaaaagatg

SEQ ID NO: 41336 - DNA, 103 bp, Artificial Sequence
  Synthetic Polynucleotide
taatacgactcactatagggttttgatgaacgacaacccgatgctctcacaacagaggagagtgagaatgtcgggttgtaacctggcggcagcgcaaaagatg

SEQ ID NO: 41337 - DNA, 103 bp, Artificial Sequence
  Synthetic Polynucleotide
taatacgactcactatagggttttgtactgatctcaggaagattgggataaacagaggagatatcccatgcttcctgagaacctggcggcagcgcaaaagatg

SEQ ID NO: 41338 - DNA, 103 bp, Artificial Sequence
  Synthetic Polynucleotide
taatacgactcactatagggaccacatctggaacgttgttcctgttcatcaacagaggagagatgaaatggaacaacgtaacctggcggcagcgcaaaagatg

SEQ ID NO: 41339 - DNA, 103 bp, Artificial Sequence
  Synthetic Polynucleotide
taatacgactcactataggggccgtctcagcagtttgttttggacggtgcaacagaggagagcaccgatgaaaacaaacaacctggcggcagcgcaaaagatg

SEQ ID NO: 41340 - DNA, 103 bp, Artificial Sequence
  Synthetic Polynucleotide
taatacgactcactatagggttagccttactggcttgccttgggaacgcgaacagaggagacgcgttatgaaggcaagcaacctggcggcagcgcaaaagatg

SEQ ID NO: 41341 - DNA, 103 bp, Artificial Sequence
  Synthetic Polynucleotide
taatacgactcactatagggtgtcatagagcagtccaatggtagaactaaaacagaggagattagttatgccattggacaacctggcggcagcgcaaaagatg

SEQ ID NO: 41342 - DNA, 103 bp, Artificial Sequence
  Synthetic Polynucleotide
taatacgactcactataggggcatatatgtaagtccgctcgaggaacgaaaacagaggagattcgttatgcgagcggacaacctggcggcagcgcaaaagatg

SEQ ID NO: 41343 - DNA, 103 bp, Artificial Sequence
  Synthetic Polynucleotide
taatacgactcactatagggcgagatagaaggcggactcgtcttgttaccaacagaggagaggtaacatgacgagtccgaacctggcggcagcgcaaaagatg

SEQ ID NO: 41344 - DNA, 103 bp, Artificial Sequence
  Synthetic Polynucleotide
taatacgactcactatagggttcatgtctaaattgggctttactccgtggaacagaggagaccacggatgaaagcccaaaacctggcggcagcgcaaaagatg

SEQ ID NO: 41345 - DNA, 103 bp, Artificial Sequence
  Synthetic Polynucleotide
taatacgactcactatagggcgaggtggtactcaacaaaaatttaatgagaacagaggagactcattatgtttttgttgaacctggcggcagcgcaaaagatg

SEQ ID NO: 41346 - DNA, 103 bp, Artificial Sequence
  Synthetic Polynucleotide
taatacgactcactatagggtattacggctgcagggtggtaacatagtggaacagaggagaccactaatgtaccaccctaacctggcggcagcgcaaaagatg

SEQ ID NO: 41347 - DNA, 103 bp, Artificial Sequence
  Synthetic Polynucleotide
taatacgactcactatagggaggtcgtcccacaattgagtgcgcttactaaacagaggagatagtaaatgcactcaattaacctggcggcagcgcaaaagatg

SEQ ID NO: 41348 - DNA, 103 bp, Artificial Sequence
  Synthetic Polynucleotide
taatacgactcactataggggcggcgccctaaatcacgtggacggacaaaaacagaggagatttgtcatgccacgtgataacctggcggcagcgcaaaagatg

SEQ ID NO: 41349 - DNA, 103 bp, Artificial Sequence
  Synthetic Polynucleotide
taatacgactcactatagggaccccgtatctctaaagactagactcactcaacagaggagagagtgaatgtagtctttaaacctggcggcagcgcaaaagatg

SEQ ID NO: 41350 - DNA, 103 bp, Artificial Sequence
  Synthetic Polynucleotide
taatacgactcactatagggcccaaaagtctcctgataacctaaaagctgaacagaggagacagcttatgggttatcagaacctggcggcagcgcaaaagatg

SEQ ID NO: 41351 - DNA, 103 bp, Artificial Sequence
  Synthetic Polynucleotide
taatacgactcactatagggtgaatacaccactgtccgcatgttctccgaaacagaggagatcggagatgatgcggacaaacctggcggcagcgcaaaagatg

SEQ ID NO: 41352 - DNA, 103 bp, Artificial Sequence
  Synthetic Polynucleotide
taatacgactcactataggggatcattcgagatcttattcccgccgcggaaacagaggagatccgcgatgggaataagaaacctggcggcagcgcaaaagatg

SEQ ID NO: 41353 - DNA, 103 bp, Artificial Sequence
  Synthetic Polynucleotide
taatacgactcactataggggtgcggaactgccggatcacgagtaaccaaaacagaggagattggttatgcgtgatccgaacctggcggcagcgcaaaagatg

SEQ ID NO: 41354 - DNA, 103 bp, Artificial Sequence
  Synthetic Polynucleotide
taatacgactcactatagggcgcaccatcttgcaagatcggattagctgaaacagaggagatcagctatgccgatcttgaacctggcggcagcgcaaaagatg

SEQ ID NO: 41355 - DNA, 103 bp, Artificial Sequence
  Synthetic Polynucleotide
taatacgactcactatagggagattattttgactccggctcaattcaaccaacagaggagaggttgaatggagccggagaacctggcggcagcgcaaaagatg

SEQ ID NO: 41356 - DNA, 103 bp, Artificial Sequence
  Synthetic Polynucleotide
taatacgactcactatagggagaaggagtgtagtacaaggcttcgcacaaaacagaggagattgtgcatggccttgtacaacctggcggcagcgcaaaagatg

SEQ ID NO: 41357 - DNA, 103 bp, Artificial Sequence
  Synthetic Polynucleotide
taatacgactcactatagggttttttacttcgaacgaataaggctaatctaacagaggagaagattaatgttattcgttaacctggcggcagcgcaaaagatg

SEQ ID NO: 41358 - DNA, 103 bp, Artificial Sequence
  Synthetic Polynucleotide
taatacgactcactatagggctttagcgtgtgtcgaggaggccaccccataacagaggagaatggggatgcctcctcgaaacctggcggcagcgcaaaagatg

SEQ ID NO: 41359 - DNA, 103 bp, Artificial Sequence
  Synthetic Polynucleotide
taatacgactcactatagggcgaatacgagctgtggtgcttggatttaggaacagaggagacctaaaatgaagcaccacaacctggcggcagcgcaaaagatg

SEQ ID NO: 41360 - DNA, 103 bp, Artificial Sequence
  Synthetic Polynucleotide
taatacgactcactatagggctggtggtacatgtcctatgtcgcaaggccaacagaggagaggccttatgacataggacaacctggcggcagcgcaaaagatg

SEQ ID NO: 41361 - DNA, 103 bp, Artificial Sequence
  Synthetic Polynucleotide
taatacgactcactatagggcgtgtttgtttacaatttgagcaaggacttaacagaggagaaagtccatgctcaaattgaacctggcggcagcgcaaaagatg

SEQ ID NO: 41362 - DNA, 103 bp, Artificial Sequence
  Synthetic Polynucleotide
taatacgactcactataggggccgaagattcttggccgattcggacatttaacagaggagaaaatgtatgaatcggccaaacctggcggcagcgcaaaagatg

SEQ ID NO: 41363 - DNA, 103 bp, Artificial Sequence
  Synthetic Polynucleotide
taatacgactcactataggggcgcgactggcagggcgtatgagtcgcttaaacagaggagataagcgatgcatacgcccaacctggcggcagcgcaaaagatg

SEQ ID NO: 41364 - DNA, 103 bp, Artificial Sequence
  Synthetic Polynucleotide
taatacgactcactatagggtagcgagcacagattagctattaaggcactaacagaggagaagtgccatgatagctaataacctggcggcagcgcaaaagatg

SEQ ID NO: 41365 - DNA, 103 bp, Artificial Sequence
  Synthetic Polynucleotide
taatacgactcactatagggtagcattctctgtgagttaccgggtcgtgtaacagaggagaacacgaatgggtaactcaaacctggcggcagcgcaaaagatg

SEQ ID NO: 41366 - DNA, 103 bp, Artificial Sequence
  Synthetic Polynucleotide
taatacgactcactatagggatgccttccacagggggaacacatattgataacagaggagaatcaatatgtgttcccccaacctggcggcagcgcaaaagatg

SEQ ID NO: 41367 - DNA, 103 bp, Artificial Sequence
  Synthetic Polynucleotide
taatacgactcactatagggctcatgagacccattaatttcgtccgtggcaacagaggagagccacgatggaaattaataacctggcggcagcgcaaaagatg

SEQ ID NO: 41368 - DNA, 103 bp, Artificial Sequence
  Synthetic Polynucleotide
taatacgactcactatagggctcccctggtgattaggacctccttgaaataacagaggagaatttcaatgaggtcctaaaacctggcggcagcgcaaaagatg

SEQ ID NO: 41369 - DNA, 103 bp, Artificial Sequence
  Synthetic Polynucleotide
taatacgactcactatagggccagtgtaagacagatgcatgccaggccggaacagaggagaccggccatgcatgcatctaacctggcggcagcgcaaaagatg

SEQ ID NO: 41370 - DNA, 103 bp, Artificial Sequence
  Synthetic Polynucleotide
taatacgactcactatagggatgatgatgggtgggtgacttgcattctgtaacagaggagaacagaaatgaagtcacccaacctggcggcagcgcaaaagatg

SEQ ID NO: 41371 - DNA, 103 bp, Artificial Sequence
  Synthetic Polynucleotide
taatacgactcactatagggccggtgttgttcatcggtttcgtgtgggcaaacagaggagatgcccaatggaaaccgataacctggcggcagcgcaaaagatg

SEQ ID NO: 41372 - DNA, 103 bp, Artificial Sequence
  Synthetic Polynucleotide
taatacgactcactatagggtgcggtcttgagcgtatgaagggcggcagtaacagaggagaactgccatgcttcatacgaacctggcggcagcgcaaaagatg

SEQ ID NO: 41373 - DNA, 103 bp, Artificial Sequence
  Synthetic Polynucleotide
taatacgactcactatagggagctccaccataaataaaccctagtttctaaacagaggagatagaaaatggggtttattaacctggcggcagcgcaaaagatg

SEQ ID NO: 41374 - DNA, 103 bp, Artificial Sequence
  Synthetic Polynucleotide
taatacgactcactatagggggactgctgacgggactctacattataggtaacagaggagaacctatatggtagagtccaacctggcggcagcgcaaaagatg

SEQ ID NO: 41375 - DNA, 103 bp, Artificial Sequence
  Synthetic Polynucleotide
taatacgactcactatagggattgtttcgagttcacggcaagctcgacgcaacagaggagagcgtcgatgttgccgtgaaacctggcggcagcgcaaaagatg

SEQ ID NO: 41376 - DNA, 103 bp, Artificial Sequence
  Synthetic Polynucleotide
taatacgactcactatagggctaaaatgcagccaggcaggggcgtttctgaacagaggagacagaaaatgccctgcctgaacctggcggcagcgcaaaagatg

SEQ ID NO: 41377 - DNA, 103 bp, Artificial Sequence
  Synthetic Polynucleotide
taatacgactcactatagggtcgttctacaacccaggcctcagcccatggaacagaggagaccatggatggaggcctggaacctggcggcagcgcaaaagatg

SEQ ID NO: 41378 - DNA, 103 bp, Artificial Sequence
  Synthetic Polynucleotide
taatacgactcactatagggtccctgcaatagtatcctaacggaccacggaacagaggagaccgtggatggttaggataaacctggcggcagcgcaaaagatg

SEQ ID NO: 41379 - DNA, 103 bp, Artificial Sequence
  Synthetic Polynucleotide
taatacgactcactatagggctcttcgggtgccatcacgtactagcccagaacagaggagactgggcatgtacgtgatgaacctggcggcagcgcaaaagatg

SEQ ID NO: 41380 - DNA, 103 bp, Artificial Sequence
  Synthetic Polynucleotide
taatacgactcactatagggctagtaccacgggtcggtcgctctcgttcgaacagaggagacgaacgatggcgaccgacaacctggcggcagcgcaaaagatg

SEQ ID NO: 41381 - DNA, 103 bp, Artificial Sequence
  Synthetic Polynucleotide
taatacgactcactatagggtggtaactggcgcaaaacctgtcactaaggaacagaggagaccttagatgcaggttttgaacctggcggcagcgcaaaagatg

SEQ ID NO: 41382 - DNA, 103 bp, Artificial Sequence
  Synthetic Polynucleotide
taatacgactcactataggggacctatctgtactcggaatagcgtctcctaacagaggagaaggagaatgtattccgagaacctggcggcagcgcaaaagatg

SEQ ID NO: 41383 - DNA, 103 bp, Artificial Sequence
  Synthetic Polynucleotide
taatacgactcactataggggctatccaaatgcgttcgtccgctgcggctaacagaggagaagccgcatgggacgaacgaacctggcggcagcgcaaaagatg

SEQ ID NO: 41384 - DNA, 103 bp, Artificial Sequence
  Synthetic Polynucleotide
taatacgactcactatagggctaggcatgtcaacgggacaagcctagagaaacagaggagatctctaatgttgtcccgtaacctggcggcagcgcaaaagatg

SEQ ID NO: 41385 - DNA, 103 bp, Artificial Sequence
  Synthetic Polynucleotide
taatacgactcactataggggagaaccgttttcacctcagagcctcgtgaaacagaggagatcacgaatgtctgaggtgaacctggcggcagcgcaaaagatg

SEQ ID NO: 41386 - DNA, 103 bp, Artificial Sequence
  Synthetic Polynucleotide
taatacgactcactatagggtcgaagcctgggatcttacccagaataattaacagaggagaaattatatggggtaagataacctggcggcagcgcaaaagatg

SEQ ID NO: 41387 - DNA, 103 bp, Artificial Sequence
  Synthetic Polynucleotide
taatacgactcactatagggtacgaattttctttacttgttgaacaccataacagaggagaatggtgatgaacaagtaaaacctggcggcagcgcaaaagatg

SEQ ID NO: 41388 - DNA, 103 bp, Artificial Sequence
  Synthetic Polynucleotide
taatacgactcactatagggtcttcttgatcctggagacctttgtagggaaacagaggagatccctaatgaggtctccaaacctggcggcagcgcaaaagatg

SEQ ID NO: 41389 - DNA, 103 bp, Artificial Sequence
  Synthetic Polynucleotide
taatacgactcactatagggtttacaagtaaccgcctcttgcgccttaataacagaggagaattaagatgcaagaggcgaacctggcggcagcgcaaaagatg

SEQ ID NO: 41390 - DNA, 103 bp, Artificial Sequence
  Synthetic Polynucleotide
taatacgactcactatagggggcaacaacaataaattgagccgcaggttcaacagaggagagaacctatggctcaatttaacctggcggcagcgcaaaagatg

SEQ ID NO: 41391 - DNA, 103 bp, Artificial Sequence
  Synthetic Polynucleotide
taatacgactcactatagggaggcgatgtgcggtgagtggacgcagttagaacagaggagactaactatgtccactcacaacctggcggcagcgcaaaagatg

SEQ ID NO: 41392 - DNA, 103 bp, Artificial Sequence
  Synthetic Polynucleotide
taatacgactcactatagggatcctgataagaagcgctgtgggccctacaaacagaggagatgtaggatgcacagcgctaacctggcggcagcgcaaaagatg

SEQ ID NO: 41393 - DNA, 103 bp, Artificial Sequence
  Synthetic Polynucleotide
taatacgactcactatagggcctggttgggatacccgacgcggtacagcgaacagaggagacgctgtatggcgtcgggtaacctggcggcagcgcaaaagatg

SEQ ID NO: 41394 - DNA, 103 bp, Artificial Sequence
  Synthetic Polynucleotide
taatacgactcactataggggataccaggtgaatagcgctaccactaacgaacagaggagacgttagatgtagcgctataacctggcggcagcgcaaaagatg

SEQ ID NO: 41395 - DNA, 103 bp, Artificial Sequence
  Synthetic Polynucleotide
taatacgactcactatagggatataaatgcgggatactccagaaggtttaaacagaggagataaaccatgtggagtatcaacctggcggcagcgcaaaagatg

SEQ ID NO: 41396 - DNA, 103 bp, Artificial Sequence
  Synthetic Polynucleotide
taatacgactcactataggggcgtgaattccaggggtaggtcgtacccagaacagaggagactgggtatgacctaccccaacctggcggcagcgcaaaagatg

SEQ ID NO: 41397 - DNA, 103 bp, Artificial Sequence
  Synthetic Polynucleotide
taatacgactcactatagggctcgccgaataacaacatgtaccttagtagaacagaggagactactaatgtacatgttgaacctggcggcagcgcaaaagatg

SEQ ID NO: 41398 - DNA, 103 bp, Artificial Sequence
  Synthetic Polynucleotide
taatacgactcactatagggactaatcatccttaataaaccagtagcacgaacagaggagacgtgctatgggtttattaaacctggcggcagcgcaaaagatg

SEQ ID NO: 41399 - DNA, 103 bp, Artificial Sequence
  Synthetic Polynucleotide
taatacgactcactatagggaaggcgcccggacgccgaccgggtaacgagaacagaggagactcgttatgcggtcggcgaacctggcggcagcgcaaaagatg

SEQ ID NO: 41400 - DNA, 103 bp, Artificial Sequence
  Synthetic Polynucleotide
taatacgactcactatagggaaagtccatacatctgccaatcgcctcggcaacagaggagagccgagatgattggcagaaacctggcggcagcgcaaaagatg

SEQ ID NO: 41401 - DNA, 103 bp, Artificial Sequence
  Synthetic Polynucleotide
taatacgactcactatagggcctgcgattctaattttgaccccgaagcgcaacagaggagagcgcttatgggtcaaaataacctggcggcagcgcaaaagatg

SEQ ID NO: 41402 - DNA, 103 bp, Artificial Sequence
  Synthetic Polynucleotide
taatacgactcactatagggtacgtaacagatagatcaagggggtaggataacagaggagaatcctaatgccttgatctaacctggcggcagcgcaaaagatg

SEQ ID NO: 41403 - DNA, 103 bp, Artificial Sequence
  Synthetic Polynucleotide
taatacgactcactatagggtagcgtcgcccgccgggccgctccacagataacagaggagaatctgtatggcggcccggaacctggcggcagcgcaaaagatg

SEQ ID NO: 41404 - DNA, 103 bp, Artificial Sequence
  Synthetic Polynucleotide
taatacgactcactatagggcatccgagaggttaaatctgagggcgtcgcaacagaggagagcgacgatgtcagatttaaacctggcggcagcgcaaaagatg

SEQ ID NO: 41405 - DNA, 103 bp, Artificial Sequence
  Synthetic Polynucleotide
taatacgactcactatagggcaaccaaacgtcctggacactggttccgaaaacagaggagattcggaatgagtgtccagaacctggcggcagcgcaaaagatg

SEQ ID NO: 41406 - DNA, 103 bp, Artificial Sequence
  Synthetic Polynucleotide
taatacgactcactatagggctctgtaaaggacccttccattggcgtaataacagaggagaattacgatgatggaagggaacctggcggcagcgcaaaagatg

SEQ ID NO: 41407 - DNA, 103 bp, Artificial Sequence
  Synthetic Polynucleotide
taatacgactcactatagggcccctttgggcaagtcttcgcactagtataaacagaggagatatactatggcgaagactaacctggcggcagcgcaaaagatg

SEQ ID NO: 41408 - DNA, 103 bp, Artificial Sequence
  Synthetic Polynucleotide
taatacgactcactatagggaatgcactgtctttgatacgcagcacaacgaacagaggagacgttgtatggcgtatcaaaacctggcggcagcgcaaaagatg

SEQ ID NO: 41409 - DNA, 103 bp, Artificial Sequence
  Synthetic Polynucleotide
taatacgactcactatagggaggaaaatactgccctccacccaattacgcaacagaggagagcgtaaatgggtggagggaacctggcggcagcgcaaaagatg

SEQ ID NO: 41410 - DNA, 103 bp, Artificial Sequence
  Synthetic Polynucleotide
taatacgactcactatagggaacaacacgtgataaattggcacaattttaaacagaggagataaaatatggccaatttaaacctggcggcagcgcaaaagatg

SEQ ID NO: 41411 - DNA, 103 bp, Artificial Sequence
  Synthetic Polynucleotide
taatacgactcactatagggtttgaatattttatcctgtggccaagggttaacagaggagaaaccctatgccacaggataacctggcggcagcgcaaaagatg

SEQ ID NO: 41412 - DNA, 103 bp, Artificial Sequence
  Synthetic Polynucleotide
taatacgactcactatagggcggtcggcgcaccgccaagccttcgacccgaacagaggagacgggtcatgggcttggcgaacctggcggcagcgcaaaagatg

SEQ ID NO: 41413 - DNA, 103 bp, Artificial Sequence
  Synthetic Polynucleotide
taatacgactcactataggggtactccatactgcaccggctggctgatgcaacagaggagagcatcaatgagccggtgcaacctggcggcagcgcaaaagatg

SEQ ID NO: 41414 - DNA, 103 bp, Artificial Sequence
  Synthetic Polynucleotide
taatacgactcactatagggaatatgcgtagtgaaccctcgctaaatcgcaacagaggagagcgattatgcgagggttcaacctggcggcagcgcaaaagatg

SEQ ID NO: 41415 - DNA, 103 bp, Artificial Sequence
  Synthetic Polynucleotide
taatacgactcactatagggccacaggcacccgaagcagttacaatccgtaacagaggagaacggatatgaactgcttcaacctggcggcagcgcaaaagatg

SEQ ID NO: 41416 - DNA, 103 bp, Artificial Sequence
  Synthetic Polynucleotide
taatacgactcactataggggcagctgcgtcgtagtttgtttgacaagttaacagaggagaaacttgatgaacaaactaaacctggcggcagcgcaaaagatg

SEQ ID NO: 41417 - DNA, 103 bp, Artificial Sequence
  Synthetic Polynucleotide
taatacgactcactataggggtaggggaccgcgtcaatactagtagaggaaacagaggagatcctctatgagtattgacaacctggcggcagcgcaaaagatg

SEQ ID NO: 41418 - DNA, 103 bp, Artificial Sequence
  Synthetic Polynucleotide
taatacgactcactatagggtctaaccatacagggggtatgaaccgagtgaacagaggagacactcgatgcatacccccaacctggcggcagcgcaaaagatg

SEQ ID NO: 41419 - DNA, 103 bp, Artificial Sequence
  Synthetic Polynucleotide
taatacgactcactatagggctgatcgcggtccatctcgtcatccgtcccaacagaggagagggacgatggacgagatgaacctggcggcagcgcaaaagatg

SEQ ID NO: 41420 - DNA, 103 bp, Artificial Sequence
  Synthetic Polynucleotide
taatacgactcactatagggggagtggctctcctaagccgccccatcgtgaacagaggagacacgatatggcggcttagaacctggcggcagcgcaaaagatg

SEQ ID NO: 41421 - DNA, 103 bp, Artificial Sequence
  Synthetic Polynucleotide
taatacgactcactataggggcgaaatcgcaaagtgactcgtaaacggggaacagaggagaccccgtatgcgagtcactaacctggcggcagcgcaaaagatg

SEQ ID NO: 41422 - DNA, 103 bp, Artificial Sequence
  Synthetic Polynucleotide
taatacgactcactataggggtttctccctctttctggacggaagcgagtaacagaggagaactcgcatgcgtccagaaaacctggcggcagcgcaaaagatg

SEQ ID NO: 41423 - DNA, 103 bp, Artificial Sequence
  Synthetic Polynucleotide
taatacgactcactatagggggcccggcatcaacctagtcgttgagtgttaacagaggagaaacactatgcgactaggtaacctggcggcagcgcaaaagatg

SEQ ID NO: 41424 - DNA, 103 bp, Artificial Sequence
  Synthetic Polynucleotide
taatacgactcactatagggcgaaggattgtcagtgtgagacttaggcgaaacagaggagatcgcctatgtctcacactaacctggcggcagcgcaaaagatg

SEQ ID NO: 41425 - DNA, 103 bp, Artificial Sequence
  Synthetic Polynucleotide
taatacgactcactatagggaatccacctcgttgttatgcgggccccagaaacagaggagatctgggatgcgcataacaaacctggcggcagcgcaaaagatg

SEQ ID NO: 41426 - DNA, 103 bp, Artificial Sequence
  Synthetic Polynucleotide
taatacgactcactatagggactacgcgcacgggtgtgctgtttggccctaacagaggagaagggccatgcagcacaccaacctggcggcagcgcaaaagatg

SEQ ID NO: 41427 - DNA, 103 bp, Artificial Sequence
  Synthetic Polynucleotide
taatacgactcactataggggacagaccgcgcggaagcacgagctcgtgaaacagaggagatcacgaatgcgtgcttccaacctggcggcagcgcaaaagatg

SEQ ID NO: 41428 - DNA, 103 bp, Artificial Sequence
  Synthetic Polynucleotide
taatacgactcactataggggacacgttctataccggtttgcgctcccagaacagaggagactgggaatgcaaaccggtaacctggcggcagcgcaaaagatg

SEQ ID NO: 41429 - DNA, 103 bp, Artificial Sequence
  Synthetic Polynucleotide
taatacgactcactataggggtcatctcctttgacattggttctccgctaaacagaggagatagcggatgaccaatgtcaacctggcggcagcgcaaaagatg

SEQ ID NO: 41430 - DNA, 103 bp, Artificial Sequence
  Synthetic Polynucleotide
taatacgactcactatagggttggattcgcagacaaacgaaaaatccgacaacagaggagagtcggaatgttcgtttgtaacctggcggcagcgcaaaagatg

SEQ ID NO: 41431 - DNA, 103 bp, Artificial Sequence
  Synthetic Polynucleotide
taatacgactcactatagggatgaacccaaagatacccttccacgtaaataacagaggagaatttacatggaagggtataacctggcggcagcgcaaaagatg

SEQ ID NO: 41432 - DNA, 103 bp, Artificial Sequence
  Synthetic Polynucleotide
taatacgactcactatagggatccatccttgtgcctagcaggggcccgataacagaggagaatcgggatgctgctaggcaacctggcggcagcgcaaaagatg

SEQ ID NO: 41433 - DNA, 103 bp, Artificial Sequence
  Synthetic Polynucleotide
taatacgactcactataggggaccatatgggcggacaaagaaactgctagaacagaggagactagcaatgtctttgtccaacctggcggcagcgcaaaagatg

SEQ ID NO: 41434 - DNA, 103 bp, Artificial Sequence
  Synthetic Polynucleotide
taatacgactcactataggggtggcgcatttcagacacatgaggatctataacagaggagaatagatatgcatgtgtctaacctggcggcagcgcaaaagatg

SEQ ID NO: 41435 - DNA, 103 bp, Artificial Sequence
  Synthetic Polynucleotide
taatacgactcactatagggaaggatgtaagtcgtttatttggcgaaggaaacagaggagatccttcatgaaataaacgaacctggcggcagcgcaaaagatg

SEQ ID NO: 41436 - DNA, 103 bp, Artificial Sequence
  Synthetic Polynucleotide
taatacgactcactatagggacgtgtcgtaccgaaccacatatgatcacaaacagaggagatgtgatatgatgtggttcaacctggcggcagcgcaaaagatg

SEQ ID NO: 41437 - DNA, 103 bp, Artificial Sequence
  Synthetic Polynucleotide
taatacgactcactataggggccagcgggtttacatcacgatgcagagctaacagaggagaagctctatgtcgtgatgtaacctggcggcagcgcaaaagatg

SEQ ID NO: 41438 - DNA, 103 bp, Artificial Sequence
  Synthetic Polynucleotide
taatacgactcactataggggtaagtacccgaggccgagctctagggggaaacagaggagatcccccatgagctcggccaacctggcggcagcgcaaaagatg

SEQ ID NO: 41439 - DNA, 103 bp, Artificial Sequence
  Synthetic Polynucleotide
taatacgactcactatagggaacttccgaggcaactatggggtccgcgtgaacagaggagacacgcgatgcccatagttaacctggcggcagcgcaaaagatg

SEQ ID NO: 41440 - DNA, 103 bp, Artificial Sequence
  Synthetic Polynucleotide
taatacgactcactatagggctcctagacgtggaacgcggaactaacactaacagaggagaagtgttatgtccgcgttcaacctggcggcagcgcaaaagatg

SEQ ID NO: 41441 - DNA, 103 bp, Artificial Sequence
  Synthetic Polynucleotide
taatacgactcactatagggcttagagatgcgccacgccacaacttagagaacagaggagactctaaatggtggcgtggaacctggcggcagcgcaaaagatg

SEQ ID NO: 41442 - DNA, 103 bp, Artificial Sequence
  Synthetic Polynucleotide
taatacgactcactataggggccgacttcccgctgccctcatggtatcaaaacagaggagattgataatgtgagggcagaacctggcggcagcgcaaaagatg

SEQ ID NO: 41443 - DNA, 103 bp, Artificial Sequence
  Synthetic Polynucleotide
taatacgactcactatagggctcaacagaacactcgagtctgttcgttgtaacagaggagaacaacgatgagactcgagaacctggcggcagcgcaaaagatg

SEQ ID NO: 41444 - DNA, 103 bp, Artificial Sequence
  Synthetic Polynucleotide
taatacgactcactataggggatacgctctcataatacaaaatcgccaagaacagaggagacttggcatgtttgtattaaacctggcggcagcgcaaaagatg

SEQ ID NO: 41445 - DNA, 103 bp, Artificial Sequence
  Synthetic Polynucleotide
taatacgactcactataggggcttatcgtgtaacctctagtcagaacgttaacagaggagaaacgttatgactagaggtaacctggcggcagcgcaaaagatg

SEQ ID NO: 41446 - DNA, 103 bp, Artificial Sequence
  Synthetic Polynucleotide
taatacgactcactataggggaaccgcaagagaaatctaacgaaatcatcaacagaggagagatgatatggttagatttaacctggcggcagcgcaaaagatg

SEQ ID NO: 41447 - DNA, 103 bp, Artificial Sequence
  Synthetic Polynucleotide
taatacgactcactatagggtctcataccatgctacgtacttgtgcataaaacagaggagattatgcatgagtacgtagaacctggcggcagcgcaaaagatg

SEQ ID NO: 41448 - DNA, 103 bp, Artificial Sequence
  Synthetic Polynucleotide
taatacgactcactatagggcatccgaggtagctttcactctgtgagctgaacagaggagacagctcatggagtgaaagaacctggcggcagcgcaaaagatg

SEQ ID NO: 41449 - DNA, 103 bp, Artificial Sequence
  Synthetic Polynucleotide
taatacgactcactataggggagtcttccggtggtatggtttccacaaacaacagaggagagtttgtatgaaccataccaacctggcggcagcgcaaaagatg

SEQ ID NO: 41450 - DNA, 103 bp, Artificial Sequence
  Synthetic Polynucleotide
taatacgactcactatagggttgtagtagtgcactctaacggtcggcattaacagaggagaaatgccatgcgttagagtaacctggcggcagcgcaaaagatg

SEQ ID NO: 41451 - DNA, 103 bp, Artificial Sequence
  Synthetic Polynucleotide
taatacgactcactatagggaagtgtggaagcagacgagtgcagcaccctaacagaggagaagggtgatgcactcgtctaacctggcggcagcgcaaaagatg

SEQ ID NO: 41452 - DNA, 103 bp, Artificial Sequence
  Synthetic Polynucleotide
taatacgactcactatagggcccccgggttggaggtcattcattgcgagcaacagaggagagctcgcatggaatgacctaacctggcggcagcgcaaaagatg

SEQ ID NO: 41453 - DNA, 103 bp, Artificial Sequence
  Synthetic Polynucleotide
taatacgactcactataggggcgcggcggtggcccctgcatgggtactgcaacagaggagagcagtaatgatgcaggggaacctggcggcagcgcaaaagatg

SEQ ID NO: 41454 - DNA, 103 bp, Artificial Sequence
  Synthetic Polynucleotide
taatacgactcactatagggaatggtatgaaaggtcggttaacgggaaagaacagaggagactttccatgtaaccgaccaacctggcggcagcgcaaaagatg

SEQ ID NO: 41455 - DNA, 103 bp, Artificial Sequence
  Synthetic Polynucleotide
taatacgactcactataggggaggtgtcccgagtgtgctatcctcccgtcaacagaggagagacgggatgatagcacacaacctggcggcagcgcaaaagatg

SEQ ID NO: 41456 - DNA, 103 bp, Artificial Sequence
  Synthetic Polynucleotide
taatacgactcactatagggttagttcttcttgcgttagtatataatattaacagaggagaaatattatgtactaacgcaacctggcggcagcgcaaaagatg

SEQ ID NO: 41457 - DNA, 103 bp, Artificial Sequence
  Synthetic Polynucleotide
taatacgactcactataggggttttaatggcggcttccgtagattaacataacagaggagaatgttaatgtacggaagcaacctggcggcagcgcaaaagatg

SEQ ID NO: 41458 - DNA, 103 bp, Artificial Sequence
  Synthetic Polynucleotide
taatacgactcactataggggatgtccgagctccataatcgcgattctataacagaggagaatagaaatgcgattatggaacctggcggcagcgcaaaagatg

SEQ ID NO: 41459 - DNA, 103 bp, Artificial Sequence
  Synthetic Polynucleotide
taatacgactcactatagggtatgaatcgacaacggtaaagtcaacgtcaaacagaggagatgacgtatgctttaccgtaacctggcggcagcgcaaaagatg

SEQ ID NO: 41460 - DNA, 103 bp, Artificial Sequence
  Synthetic Polynucleotide
taatacgactcactataggggctgcaggccacatttttaacccacgtcataacagaggagaatgacgatggttaaaaataacctggcggcagcgcaaaagatg

SEQ ID NO: 41461 - DNA, 103 bp, Artificial Sequence
  Synthetic Polynucleotide
taatacgactcactatagggggcgccggagtcataaacaacgtattgaacaacagaggagagttcaaatggttgtttataacctggcggcagcgcaaaagatg

SEQ ID NO: 41462 - DNA, 103 bp, Artificial Sequence
  Synthetic Polynucleotide
taatacgactcactatagggtcactcagtagcccagctgcaagatcgcagaacagaggagactgcgaatgtgcagctggaacctggcggcagcgcaaaagatg

SEQ ID NO: 41463 - DNA, 103 bp, Artificial Sequence
  Synthetic Polynucleotide
taatacgactcactatagggactactcacccgcgatgcccgaggggatttaacagaggagaaaatccatgcgggcatcgaacctggcggcagcgcaaaagatg

SEQ ID NO: 41464 - DNA, 103 bp, Artificial Sequence
  Synthetic Polynucleotide
taatacgactcactatagggacttgatatatttcggggtgttggaggcttaacagaggagaaagcctatgacaccccgaaacctggcggcagcgcaaaagatg

SEQ ID NO: 41465 - DNA, 103 bp, Artificial Sequence
  Synthetic Polynucleotide
taatacgactcactatagggaaacagggtagacagcggattacaggatggaacagaggagaccatccatgaatccgctgaacctggcggcagcgcaaaagatg

SEQ ID NO: 41466 - DNA, 103 bp, Artificial Sequence
  Synthetic Polynucleotide
taatacgactcactatagggtggagtgtggtcttagttaaatgacgatacaacagaggagagtatcgatgtttaactaaaacctggcggcagcgcaaaagatg

SEQ ID NO: 41467 - DNA, 103 bp, Artificial Sequence
  Synthetic Polynucleotide
taatacgactcactatagggagagcttggctagatagtagtcttctcaccaacagaggagaggtgagatgactactatcaacctggcggcagcgcaaaagatg

SEQ ID NO: 41468 - DNA, 103 bp, Artificial Sequence
  Synthetic Polynucleotide
taatacgactcactatagggatgcgccatctctccatttagccgcgtcagaacagaggagactgacgatgctaaatggaaacctggcggcagcgcaaaagatg

SEQ ID NO: 41469 - DNA, 103 bp, Artificial Sequence
  Synthetic Polynucleotide
taatacgactcactatagggttgcgtagcttggcatcgaccttatttagaaacagaggagatctaaaatgggtcgatgcaacctggcggcagcgcaaaagatg

SEQ ID NO: 41470 - DNA, 103 bp, Artificial Sequence
  Synthetic Polynucleotide
taatacgactcactatagggctatcgctgccgcgcgcatacgtgtatttaaacagaggagataaataatggtatgcgcgaacctggcggcagcgcaaaagatg

SEQ ID NO: 41471 - DNA, 103 bp, Artificial Sequence
  Synthetic Polynucleotide
taatacgactcactatagggatttgtattcgtcgtgttgaactgtaagggaacagaggagacccttaatgttcaacacgaacctggcggcagcgcaaaagatg

SEQ ID NO: 41472 - DNA, 103 bp, Artificial Sequence
  Synthetic Polynucleotide
taatacgactcactatagggcaataatctcaatcctcttggcctacttgcaacagaggagagcaagtatgccaagaggaaacctggcggcagcgcaaaagatg

SEQ ID NO: 41473 - DNA, 103 bp, Artificial Sequence
  Synthetic Polynucleotide
taatacgactcactatagggtgtggtgccccgcgggctcatctagtatagaacagaggagactatacatgatgagcccgaacctggcggcagcgcaaaagatg

SEQ ID NO: 41474 - DNA, 103 bp, Artificial Sequence
  Synthetic Polynucleotide
taatacgactcactatagggataaaggttacacccgctgaaaacggtcgaaacagaggagatcgaccatgttcagcgggaacctggcggcagcgcaaaagatg

SEQ ID NO: 41475 - DNA, 103 bp, Artificial Sequence
  Synthetic Polynucleotide
taatacgactcactatagggcccggttaggctaaacaagagtgaacaatcaacagaggagagattgtatgctcttgtttaacctggcggcagcgcaaaagatg

SEQ ID NO: 41476 - DNA, 103 bp, Artificial Sequence
  Synthetic Polynucleotide
taatacgactcactatagggtaatcacggtgggacaggattgcgtatgaaaacagaggagattcataatgaatcctgtcaacctggcggcagcgcaaaagatg

SEQ ID NO: 41477 - DNA, 103 bp, Artificial Sequence
  Synthetic Polynucleotide
taatacgactcactatagggatcaatactagatactacgtaagggagacaaacagaggagatgtctcatgtacgtagtaaacctggcggcagcgcaaaagatg

SEQ ID NO: 41478 - DNA, 103 bp, Artificial Sequence
  Synthetic Polynucleotide
taatacgactcactatagggagggtgcatttcctgaacagtgcctaggcaaacagaggagatgcctaatgactgttcagaacctggcggcagcgcaaaagatg

SEQ ID NO: 41479 - DNA, 103 bp, Artificial Sequence
  Synthetic Polynucleotide
taatacgactcactatagggccagcttgtccaacgaatgatagagatcataacagaggagaatgatcatgatcattcgtaacctggcggcagcgcaaaagatg

SEQ ID NO: 41480 - DNA, 103 bp, Artificial Sequence
  Synthetic Polynucleotide
taatacgactcactatagggtctaataccctctgttgccaacgcgatcggaacagaggagaccgatcatgttggcaacaaacctggcggcagcgcaaaagatg

SEQ ID NO: 41481 - DNA, 103 bp, Artificial Sequence
  Synthetic Polynucleotide
taatacgactcactataggggggtggaaaccaatccatgcatgatgaattaacagaggagaaattcaatgtgcatggataacctggcggcagcgcaaaagatg

SEQ ID NO: 41482 - DNA, 103 bp, Artificial Sequence
  Synthetic Polynucleotide
taatacgactcactatagggtggctgtagtcaggctcgttcccaggggcgaacagaggagacgccccatggaacgagccaacctggcggcagcgcaaaagatg

SEQ ID NO: 41483 - DNA, 103 bp, Artificial Sequence
  Synthetic Polynucleotide
taatacgactcactatagggaattcgctaatattgcttcccggcttctcaaacagaggagatgagaaatggggaagcaaaacctggcggcagcgcaaaagatg

SEQ ID NO: 41484 - DNA, 103 bp, Artificial Sequence
  Synthetic Polynucleotide
taatacgactcactatagggcaactaacttagtacaagaggctggtaggaaacagaggagatcctacatgcctcttgtaaacctggcggcagcgcaaaagatg

SEQ ID NO: 41485 - DNA, 103 bp, Artificial Sequence
  Synthetic Polynucleotide
taatacgactcactatagggtctgaagaaatcctacggcagcttcgcacaaacagaggagatgtgcgatgctgccgtagaacctggcggcagcgcaaaagatg

SEQ ID NO: 41486 - DNA, 103 bp, Artificial Sequence
  Synthetic Polynucleotide
taatacgactcactatagggaagtaaaactaatgtagcagtgcccacggaaacagaggagatccgtgatgactgctacaaacctggcggcagcgcaaaagatg

SEQ ID NO: 41487 - DNA, 103 bp, Artificial Sequence
  Synthetic Polynucleotide
taatacgactcactataggggcgctgagttccagttcgaattggctaacaaacagaggagatgttagatgattcgaactaacctggcggcagcgcaaaagatg

SEQ ID NO: 41488 - DNA, 103 bp, Artificial Sequence
  Synthetic Polynucleotide
taatacgactcactatagggtgcgagctgtgcattccccagtagagtcacaacagaggagagtgactatgctggggaataacctggcggcagcgcaaaagatg

SEQ ID NO: 41489 - DNA, 103 bp, Artificial Sequence
  Synthetic Polynucleotide
taatacgactcactataggggttgaagcgatagttagcacactgtaataaaacagaggagattattaatgtgtgctaacaacctggcggcagcgcaaaagatg

SEQ ID NO: 41490 - DNA, 103 bp, Artificial Sequence
  Synthetic Polynucleotide
taatacgactcactatagggtactccctgctgggactatgtagcgggggtaacagaggagaacccccatgacatagtccaacctggcggcagcgcaaaagatg

SEQ ID NO: 41491 - DNA, 103 bp, Artificial Sequence
  Synthetic Polynucleotide
taatacgactcactatagggattatttagtcctggagcctgccgggcggaaacagaggagatccgccatgcaggctccaaacctggcggcagcgcaaaagatg

SEQ ID NO: 41492 - DNA, 103 bp, Artificial Sequence
  Synthetic Polynucleotide
taatacgactcactataggggcgcacatgacccggcgcagaacttcgctcaacagaggagagagcgaatgtctgcgccgaacctggcggcagcgcaaaagatg

SEQ ID NO: 41493 - DNA, 103 bp, Artificial Sequence
  Synthetic Polynucleotide
taatacgactcactatagggacggccattgtgtagcggcaggacatacataacagaggagaatgtatatgctgccgctaaacctggcggcagcgcaaaagatg

SEQ ID NO: 41494 - DNA, 103 bp, Artificial Sequence
  Synthetic Polynucleotide
taatacgactcactataggggctataagtcggtgtgaccggctgaaagacaacagaggagagtctttatgccggtcacaaacctggcggcagcgcaaaagatg

SEQ ID NO: 41495 - DNA, 103 bp, Artificial Sequence
  Synthetic Polynucleotide
taatacgactcactatagggcgcggtatctctgagagatcgcgaacactcaacagaggagagagtgtatgcgatctctcaacctggcggcagcgcaaaagatg

SEQ ID NO: 41496 - DNA, 103 bp, Artificial Sequence
  Synthetic Polynucleotide
taatacgactcactatagggagaccgatcagcctggattgaatccactggaacagaggagaccagtgatgtcaatccagaacctggcggcagcgcaaaagatg

SEQ ID NO: 41497 - DNA, 103 bp, Artificial Sequence
  Synthetic Polynucleotide
taatacgactcactatagggaataattgttggaaaaggaacgaaagtttgaacagaggagacaaactatggttccttttaacctggcggcagcgcaaaagatg

SEQ ID NO: 41498 - DNA, 103 bp, Artificial Sequence
  Synthetic Polynucleotide
taatacgactcactatagggtactgcaacatccttcgtacatcgaaacacaacagaggagagtgtttatgtgtacgaagaacctggcggcagcgcaaaagatg

SEQ ID NO: 41499 - DNA, 103 bp, Artificial Sequence
  Synthetic Polynucleotide
taatacgactcactataggggatgtaacttctccaggaccgtttaaatacaacagaggagagtatttatgcggtcctggaacctggcggcagcgcaaaagatg

SEQ ID NO: 41500 - DNA, 103 bp, Artificial Sequence
  Synthetic Polynucleotide
taatacgactcactataggggtaatcgtgatctttcgttcgacggcccgcaacagaggagagcgggcatgcgaacgaaaaacctggcggcagcgcaaaagatg

SEQ ID NO: 41501 - DNA, 103 bp, Artificial Sequence
  Synthetic Polynucleotide
taatacgactcactatagggattgattgagcgaatttatgtccagtagagaacagaggagactctacatgacataaattaacctggcggcagcgcaaaagatg

SEQ ID NO: 41502 - DNA, 103 bp, Artificial Sequence
  Synthetic Polynucleotide
taatacgactcactataggggagctagttggcagtgtctgcgtatagtttaacagaggagaaaactaatggcagacactaacctggcggcagcgcaaaagatg

SEQ ID NO: 41503 - DNA, 103 bp, Artificial Sequence
  Synthetic Polynucleotide
taatacgactcactatagggactctttacatggagttgggatgcttagcgaacagaggagacgctaaatgtcccaactcaacctggcggcagcgcaaaagatg

SEQ ID NO: 41504 - DNA, 103 bp, Artificial Sequence
  Synthetic Polynucleotide
taatacgactcactatagggaccagtctgctcttctgcgtcctgaagcggaacagaggagaccgcttatggacgcagaaaacctggcggcagcgcaaaagatg

SEQ ID NO: 41505 - DNA, 103 bp, Artificial Sequence
  Synthetic Polynucleotide
taatacgactcactataggggataatatctctgctgcctgagcgatggcgaacagaggagacgccatatgtcaggcagcaacctggcggcagcgcaaaagatg

SEQ ID NO: 41506 - DNA, 103 bp, Artificial Sequence
  Synthetic Polynucleotide
taatacgactcactatagggcgtagtcgtgcgaggccagttaatgcgttcaacagaggagagaacgcatgaactggcctaacctggcggcagcgcaaaagatg

SEQ ID NO: 41507 - DNA, 103 bp, Artificial Sequence
  Synthetic Polynucleotide
taatacgactcactatagggaagagttaaagagatccggcgttactctccaacagaggagaggagagatgcgccggatcaacctggcggcagcgcaaaagatg

SEQ ID NO: 41508 - DNA, 103 bp, Artificial Sequence
  Synthetic Polynucleotide
taatacgactcactatagggtatatcgcaataccaaaatttcgttcacacaacagaggagagtgtgaatgaaattttggaacctggcggcagcgcaaaagatg

SEQ ID NO: 41509 - DNA, 103 bp, Artificial Sequence
  Synthetic Polynucleotide
taatacgactcactatagggtcttctattattgcatggaccgttgagtccaacagaggagaggactcatgggtccatgcaacctggcggcagcgcaaaagatg

SEQ ID NO: 41510 - DNA, 103 bp, Artificial Sequence
  Synthetic Polynucleotide
taatacgactcactatagggcattagaaacacgctgggcaagtaaatcataacagaggagaatgattatgttgcccagcaacctggcggcagcgcaaaagatg

SEQ ID NO: 41511 - DNA, 103 bp, Artificial Sequence
  Synthetic Polynucleotide
taatacgactcactatagggataacggctcgacggggctctgtacctcaaaacagaggagattgaggatgagagccccgaacctggcggcagcgcaaaagatg

SEQ ID NO: 41512 - DNA, 103 bp, Artificial Sequence
  Synthetic Polynucleotide
taatacgactcactatagggctaccgacatgacatcggagttagaattgcaacagaggagagcaattatgactccgatgaacctggcggcagcgcaaaagatg

SEQ ID NO: 41513 - DNA, 103 bp, Artificial Sequence
  Synthetic Polynucleotide
taatacgactcactataggggtcccgctgaacacggatacagctgacataaacagaggagatatgtcatgtgtatccgtaacctggcggcagcgcaaaagatg

SEQ ID NO: 41514 - DNA, 103 bp, Artificial Sequence
  Synthetic Polynucleotide
taatacgactcactataggggagcaccgatggaatcctcagaaacctaagaacagaggagacttaggatgctgaggattaacctggcggcagcgcaaaagatg

SEQ ID NO: 41515 - DNA, 103 bp, Artificial Sequence
  Synthetic Polynucleotide
taatacgactcactatagggcatacggtcgagccagacatgacctcttctaacagaggagaagaagaatgcatgtctggaacctggcggcagcgcaaaagatg

SEQ ID NO: 41516 - DNA, 103 bp, Artificial Sequence
  Synthetic Polynucleotide
taatacgactcactatagggtatgaacggggtcgtctcgccatgcacattaacagaggagaaatgtgatgggcgagacgaacctggcggcagcgcaaaagatg

SEQ ID NO: 41517 - DNA, 103 bp, Artificial Sequence
  Synthetic Polynucleotide
taatacgactcactatagggaatgaggtggtggatgatggcgttaacgggaacagaggagacccgttatggccatcatcaacctggcggcagcgcaaaagatg

SEQ ID NO: 41518 - DNA, 103 bp, Artificial Sequence
  Synthetic Polynucleotide
taatacgactcactatagggctcgcgctgtctagtgcctacacatccttgaacagaggagacaaggaatggtaggcactaacctggcggcagcgcaaaagatg

SEQ ID NO: 41519 - DNA, 103 bp, Artificial Sequence
  Synthetic Polynucleotide
taatacgactcactatagggacctctttgacaggcggaactacatagtttaacagaggagaaaactaatgagttccgccaacctggcggcagcgcaaaagatg

SEQ ID NO: 41520 - DNA, 103 bp, Artificial Sequence
  Synthetic Polynucleotide
taatacgactcactatagggccgacctagtgaacggagttttctcgagacaacagaggagagtctcgatgaaactccgtaacctggcggcagcgcaaaagatg

SEQ ID NO: 41521 - DNA, 103 bp, Artificial Sequence
  Synthetic Polynucleotide
taatacgactcactatagggggaactaattatcgttaggctgtcagtgggaacagaggagacccactatgagcctaacgaacctggcggcagcgcaaaagatg

SEQ ID NO: 41522 - DNA, 103 bp, Artificial Sequence
  Synthetic Polynucleotide
taatacgactcactatagggtcactcgcaatttccctttatggagctccgaacagaggagacggagcatgataaagggaaacctggcggcagcgcaaaagatg

SEQ ID NO: 41523 - DNA, 103 bp, Artificial Sequence
  Synthetic Polynucleotide
taatacgactcactatagggccagggacctacgcatcggcactatagtcgaacagaggagacgactaatgtgccgatgcaacctggcggcagcgcaaaagatg

SEQ ID NO: 41524 - DNA, 103 bp, Artificial Sequence
  Synthetic Polynucleotide
taatacgactcactatagggagtttcgttattctgaaatacccacagaggaacagaggagacctctgatggtatttcagaacctggcggcagcgcaaaagatg

SEQ ID NO: 41525 - DNA, 103 bp, Artificial Sequence
  Synthetic Polynucleotide
taatacgactcactatagggttggccgagtaagtgcctgagtaaacagtgaacagaggagacactgtatgctcaggcacaacctggcggcagcgcaaaagatg

SEQ ID NO: 41526 - DNA, 103 bp, Artificial Sequence
  Synthetic Polynucleotide
taatacgactcactatagggcgcatggcttgtaggtagccttatgacaacaacagaggagagttgtcatgaggctacctaacctggcggcagcgcaaaagatg

SEQ ID NO: 41527 - DNA, 103 bp, Artificial Sequence
  Synthetic Polynucleotide
taatacgactcactataggggaccggctcaacaatacgcagacaatgataaacagaggagatatcatatgctgcgtattaacctggcggcagcgcaaaagatg

SEQ ID NO: 41528 - DNA, 103 bp, Artificial Sequence
  Synthetic Polynucleotide
taatacgactcactatagggaccatgcggctagttacgccgtcggccaataacagaggagaattggcatgcggcgtaacaacctggcggcagcgcaaaagatg

SEQ ID NO: 41529 - DNA, 103 bp, Artificial Sequence
  Synthetic Polynucleotide
taatacgactcactatagggctcaggattttgtcaattgggacgtcagttaacagaggagaaactgaatgcccaattgaaacctggcggcagcgcaaaagatg

SEQ ID NO: 41530 - DNA, 103 bp, Artificial Sequence
  Synthetic Polynucleotide
taatacgactcactatagggcttgattattcagggggtttgcacaggcgaaacagaggagatcgcctatgcaaacccccaacctggcggcagcgcaaaagatg

SEQ ID NO: 41531 - DNA, 103 bp, Artificial Sequence
  Synthetic Polynucleotide
taatacgactcactatagggtaaagccgacaggcagattggtattaggctaacagaggagaagcctaatgccaatctgcaacctggcggcagcgcaaaagatg

SEQ ID NO: 41532 - DNA, 103 bp, Artificial Sequence
  Synthetic Polynucleotide
taatacgactcactatagggagtctcggcgagtcttttttgtatcgagcaaacagaggagatgctcgatgcaaaaaagaaacctggcggcagcgcaaaagatg

SEQ ID NO: 41533 - DNA, 103 bp, Artificial Sequence
  Synthetic Polynucleotide
taatacgactcactatagggacaggctatgacgagatgaacctgctgaataacagaggagaattcagatggttcatctcaacctggcggcagcgcaaaagatg

SEQ ID NO: 41534 - DNA, 103 bp, Artificial Sequence
  Synthetic Polynucleotide
taatacgactcactatagggaaaaccatttcttagatgaggattaataagaacagaggagacttattatgcctcatctaaacctggcggcagcgcaaaagatg

SEQ ID NO: 41535 - DNA, 103 bp, Artificial Sequence
  Synthetic Polynucleotide
taatacgactcactataggggatacgtttcatgtccctctgtggacttctaacagaggagaagaagtatgcagagggacaacctggcggcagcgcaaaagatg

SEQ ID NO: 41536 - DNA, 103 bp, Artificial Sequence
  Synthetic Polynucleotide
taatacgactcactataggggctcgaaagtgccccgggggtccgctagggaacagaggagaccctagatgacccccgggaacctggcggcagcgcaaaagatg

SEQ ID NO: 41537 - DNA, 103 bp, Artificial Sequence
  Synthetic Polynucleotide
taatacgactcactataggggggggagacggtcgctcacagacctaaactaacagaggagaagtttaatgctgtgagcgaacctggcggcagcgcaaaagatg

SEQ ID NO: 41538 - DNA, 103 bp, Artificial Sequence
  Synthetic Polynucleotide
taatacgactcactatagggtatactgtgctttttgctcgggtgcgtcgtaacagaggagaacgacgatgccgagcaaaaacctggcggcagcgcaaaagatg

SEQ ID NO: 41539 - DNA, 103 bp, Artificial Sequence
  Synthetic Polynucleotide
taatacgactcactatagggcattgacagcttcgttagcccgggcaatataacagaggagaatattgatggggctaacgaacctggcggcagcgcaaaagatg

SEQ ID NO: 41540 - DNA, 103 bp, Artificial Sequence
  Synthetic Polynucleotide
taatacgactcactatagggtgctatattggcttacgggcgcctgttctcaacagaggagagagaacatgcgcccgtaaaacctggcggcagcgcaaaagatg

SEQ ID NO: 41541 - DNA, 103 bp, Artificial Sequence
  Synthetic Polynucleotide
taatacgactcactatagggtaacagaaagccgtatccgctgatgtacgaaacagaggagatcgtacatgagcggatacaacctggcggcagcgcaaaagatg

SEQ ID NO: 41542 - DNA, 103 bp, Artificial Sequence
  Synthetic Polynucleotide
taatacgactcactatagggtaaccgcgaggaccaacgcgcgagttccgcaacagaggagagcggaaatggcgcgttggaacctggcggcagcgcaaaagatg

SEQ ID NO: 41543 - DNA, 103 bp, Artificial Sequence
  Synthetic Polynucleotide
taatacgactcactatagggattgcctccgcgggcgtgattacctgtgataacagaggagaatcacaatgaatcacgccaacctggcggcagcgcaaaagatg

SEQ ID NO: 41544 - DNA, 103 bp, Artificial Sequence
  Synthetic Polynucleotide
taatacgactcactatagggtctggtttgctaacaccatcctctaggaacaacagaggagagttcctatgggatggtgtaacctggcggcagcgcaaaagatg

SEQ ID NO: 41545 - DNA, 103 bp, Artificial Sequence
  Synthetic Polynucleotide
taatacgactcactataggggctgatctagcatctgagtatccagcatacaacagaggagagtatgcatgatactcagaaacctggcggcagcgcaaaagatg

SEQ ID NO: 41546 - DNA, 103 bp, Artificial Sequence
  Synthetic Polynucleotide
taatacgactcactatagggggtgatggaggaggagcgactcaatttccaaacagaggagatggaaaatgagtcgctccaacctggcggcagcgcaaaagatg

SEQ ID NO: 41547 - DNA, 103 bp, Artificial Sequence
  Synthetic Polynucleotide
taatacgactcactataggggatggcccggttaccgacttactaaatacgaacagaggagacgtattatgtaagtcggtaacctggcggcagcgcaaaagatg

SEQ ID NO: 41548 - DNA, 103 bp, Artificial Sequence
  Synthetic Polynucleotide
taatacgactcactatagggtagttgactccgtgcatcaccggctagcgtaacagaggagaacgctaatgggtgatgcaaacctggcggcagcgcaaaagatg

SEQ ID NO: 41549 - DNA, 103 bp, Artificial Sequence
  Synthetic Polynucleotide
taatacgactcactatagggtctctcatggcacagatgacgcattggtgaaacagaggagatcaccaatgcgtcatctgaacctggcggcagcgcaaaagatg

SEQ ID NO: 41550 - DNA, 103 bp, Artificial Sequence
  Synthetic Polynucleotide
taatacgactcactatagggatccattgatgtcttttttcaattgggtataacagaggagaatacccatgtgaaaaaagaacctggcggcagcgcaaaagatg

SEQ ID NO: 41551 - DNA, 103 bp, Artificial Sequence
  Synthetic Polynucleotide
taatacgactcactatagggtactaagcgccatcattagttattattatcaacagaggagagataatatgaactaatgaaacctggcggcagcgcaaaagatg

SEQ ID NO: 41552 - DNA, 103 bp, Artificial Sequence
  Synthetic Polynucleotide
taatacgactcactatagggttccggtcaaggtccttcacttgctgatacaacagaggagagtatcaatgagtgaaggaaacctggcggcagcgcaaaagatg

SEQ ID NO: 41553 - DNA, 103 bp, Artificial Sequence
  Synthetic Polynucleotide
taatacgactcactataggggtgcactaccctgtgaaaaattgcgcacataacagaggagaatgtgcatgatttttcacaacctggcggcagcgcaaaagatg

SEQ ID NO: 41554 - DNA, 103 bp, Artificial Sequence
  Synthetic Polynucleotide
taatacgactcactatagggcgttcgcatcagctttcataggctgacggtaacagaggagaaccgtcatgctatgaaagaacctggcggcagcgcaaaagatg

SEQ ID NO: 41555 - DNA, 103 bp, Artificial Sequence
  Synthetic Polynucleotide
taatacgactcactataggggaacctcctgatctatacgcattgttttaaaacagaggagattaaaaatgtgcgtatagaacctggcggcagcgcaaaagatg

SEQ ID NO: 41556 - DNA, 103 bp, Artificial Sequence
  Synthetic Polynucleotide
taatacgactcactatagggaaataagcgattgataatgatttatctcaaaacagaggagattgagaatgatcattatcaacctggcggcagcgcaaaagatg

SEQ ID NO: 41557 - DNA, 103 bp, Artificial Sequence
  Synthetic Polynucleotide
taatacgactcactatagggttcattggataataaactgtcgtgccggacaacagaggagagtccggatggacagtttaaacctggcggcagcgcaaaagatg

SEQ ID NO: 41558 - DNA, 103 bp, Artificial Sequence
  Synthetic Polynucleotide
taatacgactcactataggggacgccgaccaacggtgagggagcaacgccaacagaggagaggcgttatgccctcaccgaacctggcggcagcgcaaaagatg

SEQ ID NO: 41559 - DNA, 103 bp, Artificial Sequence
  Synthetic Polynucleotide
taatacgactcactatagggacttgaccccgcatgacctaggtgcgtgcgaacagaggagacgcacgatgctaggtcataacctggcggcagcgcaaaagatg

SEQ ID NO: 41560 - DNA, 103 bp, Artificial Sequence
  Synthetic Polynucleotide
taatacgactcactatagggagagcttgaggtggacgcaccgctctagagaacagaggagactctagatgggtgcgtccaacctggcggcagcgcaaaagatg

SEQ ID NO: 41561 - DNA, 103 bp, Artificial Sequence
  Synthetic Polynucleotide
taatacgactcactatagggcacgaagtcaagctgatccccccgttaacaaacagaggagatgttaaatgggggatcagaacctggcggcagcgcaaaagatg

SEQ ID NO: 41562 - DNA, 103 bp, Artificial Sequence
  Synthetic Polynucleotide
taatacgactcactataggggtcctacctggttagatcctatgttgtaataacagaggagaattacaatgtaggatctaaacctggcggcagcgcaaaagatg

SEQ ID NO: 41563 - DNA, 103 bp, Artificial Sequence
  Synthetic Polynucleotide
taatacgactcactatagggtctgttgagtagtacaagtaaatgttaatgaacagaggagacattaaatgttacttgtaaacctggcggcagcgcaaaagatg

SEQ ID NO: 41564 - DNA, 103 bp, Artificial Sequence
  Synthetic Polynucleotide
taatacgactcactatagggcttactcttggttctccgcgacaaaagataaacagaggagatatcttatgtcgcggagaaacctggcggcagcgcaaaagatg

SEQ ID NO: 41565 - DNA, 103 bp, Artificial Sequence
  Synthetic Polynucleotide
taatacgactcactatagggattctccatgttcactcttctatggatagaaacagaggagatctatcatgagaagagtgaacctggcggcagcgcaaaagatg

SEQ ID NO: 41566 - DNA, 103 bp, Artificial Sequence
  Synthetic Polynucleotide
taatacgactcactatagggatttgactggccgggttctcatatccttgtaacagaggagaacaaggatgtgagaacccaacctggcggcagcgcaaaagatg

SEQ ID NO: 41567 - DNA, 103 bp, Artificial Sequence
  Synthetic Polynucleotide
taatacgactcactatagggtcatcacccatggccaggcctccgccccacaacagaggagagtggggatgaggcctggcaacctggcggcagcgcaaaagatg

SEQ ID NO: 41568 - DNA, 103 bp, Artificial Sequence
  Synthetic Polynucleotide
taatacgactcactatagggatgttcggcctttatcactaatatcccgctaacagaggagaagcgggatgttagtgataaacctggcggcagcgcaaaagatg

SEQ ID NO: 41569 - DNA, 103 bp, Artificial Sequence
  Synthetic Polynucleotide
taatacgactcactataggggtcgatgatcgttaacgatccgaagcctgaaacagaggagatcaggcatgggatcgttaaacctggcggcagcgcaaaagatg

SEQ ID NO: 41570 - DNA, 103 bp, Artificial Sequence
  Synthetic Polynucleotide
taatacgactcactatagggttcaaccctcgcctctagtaaacaaccgggaacagaggagacccggtatgttactagagaacctggcggcagcgcaaaagatg

SEQ ID NO: 41571 - DNA, 103 bp, Artificial Sequence
  Synthetic Polynucleotide
taatacgactcactatagggcctgagttacaattattgtacagttacttaaacagaggagataagtaatggtacaataaaacctggcggcagcgcaaaagatg

SEQ ID NO: 41572 - DNA, 103 bp, Artificial Sequence
  Synthetic Polynucleotide
taatacgactcactatagggcttccataaaaaggtcatgtaggtggagagaacagaggagactctccatgtacatgaccaacctggcggcagcgcaaaagatg

SEQ ID NO: 41573 - DNA, 103 bp, Artificial Sequence
  Synthetic Polynucleotide
taatacgactcactataggggtgccactcttattaagctgttatctctgtaacagaggagaacagagatgacagcttaaaacctggcggcagcgcaaaagatg

SEQ ID NO: 41574 - DNA, 103 bp, Artificial Sequence
  Synthetic Polynucleotide
taatacgactcactatagggcgaaattgatttcgaacattgtaaggtggaaacagaggagatccaccatgcaatgttcgaacctggcggcagcgcaaaagatg

SEQ ID NO: 41575 - DNA, 103 bp, Artificial Sequence
  Synthetic Polynucleotide
taatacgactcactatagggatggacacctgatgaacctattgcaacgtcaacagaggagagacgttatgataggttcaaacctggcggcagcgcaaaagatg

SEQ ID NO: 41576 - DNA, 103 bp, Artificial Sequence
  Synthetic Polynucleotide
taatacgactcactatagggacattcacctacatcgaatggtaaaggttgaacagaggagacaacctatgccattcgataacctggcggcagcgcaaaagatg

SEQ ID NO: 41577 - DNA, 103 bp, Artificial Sequence
  Synthetic Polynucleotide
taatacgactcactatagggttccctctataaacataacgacgcctaccaaacagaggagatggtagatgtcgttatgtaacctggcggcagcgcaaaagatg

SEQ ID NO: 41578 - DNA, 103 bp, Artificial Sequence
  Synthetic Polynucleotide
taatacgactcactatagggatcgtcgtcggtataaactcattcagaagaaacagaggagatcttctatgtgagtttataacctggcggcagcgcaaaagatg

SEQ ID NO: 41579 - DNA, 103 bp, Artificial Sequence
  Synthetic Polynucleotide
taatacgactcactatagggttactccggcatcaacgccgcaaacgaatcaacagaggagagattcgatggcggcgttgaacctggcggcagcgcaaaagatg

SEQ ID NO: 41580 - DNA, 103 bp, Artificial Sequence
  Synthetic Polynucleotide
taatacgactcactatagggcgaatttcccaatggatataagagagctcgaacagaggagacgagctatgttatatccaaacctggcggcagcgcaaaagatg

SEQ ID NO: 41581 - DNA, 103 bp, Artificial Sequence
  Synthetic Polynucleotide
taatacgactcactatagggggtaaccctgcgagacttttaagagctgacaacagaggagagtcagcatgtaaaagtctaacctggcggcagcgcaaaagatg

SEQ ID NO: 41582 - DNA, 103 bp, Artificial Sequence
  Synthetic Polynucleotide
taatacgactcactatagggtgaagcggaggccgcgttgcggtgggctgcaacagaggagagcagccatgcgcaacgcgaacctggcggcagcgcaaaagatg

SEQ ID NO: 41583 - DNA, 103 bp, Artificial Sequence
  Synthetic Polynucleotide
taatacgactcactatagggtctacggagtcggaaatatgtgtggtactgaacagaggagacagtacatgacatatttcaacctggcggcagcgcaaaagatg

SEQ ID NO: 41584 - DNA, 103 bp, Artificial Sequence
  Synthetic Polynucleotide
taatacgactcactatagggcggctgtctagacggcctgcagccgctaccaacagaggagaggtagcatgtgcaggccgaacctggcggcagcgcaaaagatg

SEQ ID NO: 41585 - DNA, 103 bp, Artificial Sequence
  Synthetic Polynucleotide
taatacgactcactatagggaacaatatagagtaattaatgtcactttacaacagaggagagtaaagatgcattaattaaacctggcggcagcgcaaaagatg

SEQ ID NO: 41586 - DNA, 103 bp, Artificial Sequence
  Synthetic Polynucleotide
taatacgactcactatagggcgtttttacccaaatagagcgaattgacagaacagaggagactgtcaatgcgctctattaacctggcggcagcgcaaaagatg

SEQ ID NO: 41587 - DNA, 103 bp, Artificial Sequence
  Synthetic Polynucleotide
taatacgactcactataggggctcgtcacctttatataactgacaagggcaacagaggagagcccttatgagttatataaacctggcggcagcgcaaaagatg

SEQ ID NO: 41588 - DNA, 103 bp, Artificial Sequence
  Synthetic Polynucleotide
taatacgactcactataggggtcttatcgagtgcttgtagtccgtatcaaaacagaggagattgataatgactacaagcaacctggcggcagcgcaaaagatg

SEQ ID NO: 41589 - DNA, 103 bp, Artificial Sequence
  Synthetic Polynucleotide
taatacgactcactatagggtacacgccacacggggacggccatgtttagaacagaggagactaaacatggccgtccccaacctggcggcagcgcaaaagatg

SEQ ID NO: 41590 - DNA, 103 bp, Artificial Sequence
  Synthetic Polynucleotide
taatacgactcactatagggctccaacccgcgagtagagctgctactcggaacagaggagaccgagtatgagctctactaacctggcggcagcgcaaaagatg

SEQ ID NO: 41591 - DNA, 103 bp, Artificial Sequence
  Synthetic Polynucleotide
taatacgactcactataggggactcttcttgttgtattgccgattcgaacaacagaggagagttcgaatgggcaatacaaacctggcggcagcgcaaaagatg

SEQ ID NO: 41592 - DNA, 103 bp, Artificial Sequence
  Synthetic Polynucleotide
taatacgactcactatagggaggaaaggataagttcgggatattgcgggtaacagaggagaacccgcatgatcccgaacaacctggcggcagcgcaaaagatg

SEQ ID NO: 41593 - DNA, 103 bp, Artificial Sequence
  Synthetic Polynucleotide
taatacgactcactataggggccgtacgagcgcccctggggacaatgaataacagaggagaattcatatgccccaggggaacctggcggcagcgcaaaagatg

SEQ ID NO: 41594 - DNA, 103 bp, Artificial Sequence
  Synthetic Polynucleotide
taatacgactcactatagggcggcataaggggggctaccacgggcaagtgaacagaggagacacttgatggtggtagccaacctggcggcagcgcaaaagatg

SEQ ID NO: 41595 - DNA, 103 bp, Artificial Sequence
  Synthetic Polynucleotide
taatacgactcactatagggcggcaagagatataaagactttgggtggtcaacagaggagagaccacatgaagtctttaaacctggcggcagcgcaaaagatg

SEQ ID NO: 41596 - DNA, 103 bp, Artificial Sequence
  Synthetic Polynucleotide
taatacgactcactatagggtgccttattcacatgatctctgcacgaactaacagaggagaagttcgatgagagatcataacctggcggcagcgcaaaagatg

SEQ ID NO: 41597 - DNA, 103 bp, Artificial Sequence
  Synthetic Polynucleotide
taatacgactcactatagggccccgaagtccaatactacgattatgacacaacagaggagagtgtcaatgtcgtagtataacctggcggcagcgcaaaagatg

SEQ ID NO: 41598 - DNA, 103 bp, Artificial Sequence
  Synthetic Polynucleotide
taatacgactcactatagggagtctgtaatgcgtctcctcccgaagagacaacagaggagagtctctatgggaggagacaacctggcggcagcgcaaaagatg

SEQ ID NO: 41599 - DNA, 103 bp, Artificial Sequence
  Synthetic Polynucleotide
taatacgactcactatagggggggccctgcttaacaagattactaagatcaacagaggagagatcttatgaatcttgttaacctggcggcagcgcaaaagatg

SEQ ID NO: 41600 - DNA, 103 bp, Artificial Sequence
  Synthetic Polynucleotide
taatacgactcactataggggcccaccgccatacaaattgcctgtctcaaaacagaggagattgagaatggcaatttgtaacctggcggcagcgcaaaagatg

SEQ ID NO: 41601 - DNA, 103 bp, Artificial Sequence
  Synthetic Polynucleotide
taatacgactcactatagggatcgtggcgtacagcccggtcccagagtataacagaggagaatactcatggaccgggctaacctggcggcagcgcaaaagatg

SEQ ID NO: 41602 - DNA, 103 bp, Artificial Sequence
  Synthetic Polynucleotide
taatacgactcactataggggagtctgagcagtagcccttgtgtactgggaacagaggagacccagtatgcaagggctaaacctggcggcagcgcaaaagatg

SEQ ID NO: 41603 - DNA, 103 bp, Artificial Sequence
  Synthetic Polynucleotide
taatacgactcactatagggtcgtcgattagttggttagacatccggaggaacagaggagacctccgatggtctaaccaaacctggcggcagcgcaaaagatg

SEQ ID NO: 41604 - DNA, 103 bp, Artificial Sequence
  Synthetic Polynucleotide
taatacgactcactataggggtctttggcattctgttgttaacggacagcaacagaggagagctgtcatgtaacaacagaacctggcggcagcgcaaaagatg

SEQ ID NO: 41605 - DNA, 103 bp, Artificial Sequence
  Synthetic Polynucleotide
taatacgactcactataggggctttgtcaaccagccagactgtcgccatcaacagaggagagatggcatgagtctggctaacctggcggcagcgcaaaagatg

SEQ ID NO: 41606 - DNA, 103 bp, Artificial Sequence
  Synthetic Polynucleotide
taatacgactcactatagggactctccccacatccaggcggtagaaatctaacagaggagaagatttatgccgcctggaaacctggcggcagcgcaaaagatg

SEQ ID NO: 41607 - DNA, 103 bp, Artificial Sequence
  Synthetic Polynucleotide
taatacgactcactataggggagagaccccgatgccctagggctaacattaacagaggagaaatgttatgcctagggcaaacctggcggcagcgcaaaagatg

SEQ ID NO: 41608 - DNA, 103 bp, Artificial Sequence
  Synthetic Polynucleotide
taatacgactcactataggggatagagtggttgccaactggttgttatataacagaggagaatataaatgccagttggcaacctggcggcagcgcaaaagatg

SEQ ID NO: 41609 - DNA, 103 bp, Artificial Sequence
  Synthetic Polynucleotide
taatacgactcactatagggcgcggctgtgcatagctaccttctgccgacaacagaggagagtcggcatgaggtagctaaacctggcggcagcgcaaaagatg

SEQ ID NO: 41610 - DNA, 103 bp, Artificial Sequence
  Synthetic Polynucleotide
taatacgactcactatagggtgagcattaacccgtgccccggtgatcagcaacagaggagagctgatatgcggggcacgaacctggcggcagcgcaaaagatg

SEQ ID NO: 41611 - DNA, 103 bp, Artificial Sequence
  Synthetic Polynucleotide
taatacgactcactatagggagggggtacgcggtgtgaaggctagcaggtaacagaggagaacctgcatgccttcacacaacctggcggcagcgcaaaagatg

SEQ ID NO: 41612 - DNA, 103 bp, Artificial Sequence
  Synthetic Polynucleotide
taatacgactcactatagggcgggttcgatgagtcctgctcctgacgggaaacagaggagatcccgtatggagcaggacaacctggcggcagcgcaaaagatg

SEQ ID NO: 41613 - DNA, 103 bp, Artificial Sequence
  Synthetic Polynucleotide
taatacgactcactataggggtgtttcaaaccctacagcgagaatttgcaaacagaggagatgcaaaatgtcgctgtagaacctggcggcagcgcaaaagatg

SEQ ID NO: 41614 - DNA, 103 bp, Artificial Sequence
  Synthetic Polynucleotide
taatacgactcactatagggggacggtccctcagtctctttccattggacaacagaggagagtccaaatgaaagagactaacctggcggcagcgcaaaagatg

SEQ ID NO: 41615 - DNA, 103 bp, Artificial Sequence
  Synthetic Polynucleotide
taatacgactcactatagggagcagctgtcagttatcctcaaaggtctgaaacagaggagatcagacatgtgaggataaaacctggcggcagcgcaaaagatg

SEQ ID NO: 41616 - DNA, 103 bp, Artificial Sequence
  Synthetic Polynucleotide
taatacgactcactatagggtggctttacgcacctgtgtagggttgtaaaaacagaggagatttacaatgctacacaggaacctggcggcagcgcaaaagatg

SEQ ID NO: 41617 - DNA, 103 bp, Artificial Sequence
  Synthetic Polynucleotide
taatacgactcactataggggcacaacttaagtcacataatttgcttcataacagaggagaatgaagatgattatgtgaaacctggcggcagcgcaaaagatg

SEQ ID NO: 41618 - DNA, 103 bp, Artificial Sequence
  Synthetic Polynucleotide
taatacgactcactatagggttgtaagtacggtgcggaggattgtcccgtaacagaggagaacgggaatgtcctccgcaaacctggcggcagcgcaaaagatg

SEQ ID NO: 41619 - DNA, 103 bp, Artificial Sequence
  Synthetic Polynucleotide
taatacgactcactatagggacctcttcacaggacgcggttttcgctcgcaacagaggagagcgagcatgaaccgcgtcaacctggcggcagcgcaaaagatg

SEQ ID NO: 41620 - DNA, 103 bp, Artificial Sequence
  Synthetic Polynucleotide
taatacgactcactatagggggactgtgcacgaaaggtgaagcctaagccaacagaggagaggcttaatgttcacctttaacctggcggcagcgcaaaagatg

SEQ ID NO: 41621 - DNA, 103 bp, Artificial Sequence
  Synthetic Polynucleotide
taatacgactcactataggggggggaagaaacgaatatacgagccccggcaacagaggagagccgggatgcgtatattcaacctggcggcagcgcaaaagatg

SEQ ID NO: 41622 - DNA, 103 bp, Artificial Sequence
  Synthetic Polynucleotide
taatacgactcactatagggacaaagtcctgtgctgaacgcccaacgcataacagaggagaatgcgtatggcgttcagcaacctggcggcagcgcaaaagatg

SEQ ID NO: 41623 - DNA, 103 bp, Artificial Sequence
  Synthetic Polynucleotide
taatacgactcactataggggccgatgtaattagtggcaactactgtatcaacagaggagagatacaatggttgccactaacctggcggcagcgcaaaagatg

SEQ ID NO: 41624 - DNA, 103 bp, Artificial Sequence
  Synthetic Polynucleotide
taatacgactcactatagggccgttggaaactcgggttttgttataaaataacagaggagaattttaatgcaaaacccgaacctggcggcagcgcaaaagatg

SEQ ID NO: 41625 - DNA, 103 bp, Artificial Sequence
  Synthetic Polynucleotide
taatacgactcactatagggagtggacagaaaagggactgacgtgtgcctaacagaggagaaggcacatgtcagtccctaacctggcggcagcgcaaaagatg

SEQ ID NO: 41626 - DNA, 103 bp, Artificial Sequence
  Synthetic Polynucleotide
taatacgactcactataggggcgcctgacaccctgagggggagcgagggcaacagaggagagccctcatgccccctcagaacctggcggcagcgcaaaagatg

SEQ ID NO: 41627 - DNA, 103 bp, Artificial Sequence
  Synthetic Polynucleotide
taatacgactcactatagggagcgagtcccgcgctctcctcagaagcaacaacagaggagagttgctatggaggagagcaacctggcggcagcgcaaaagatg

SEQ ID NO: 41628 - DNA, 103 bp, Artificial Sequence
  Synthetic Polynucleotide
taatacgactcactatagggtcaggtacaggatgcgccaacggaggcataaacagaggagatatgccatggttggcgcaaacctggcggcagcgcaaaagatg

SEQ ID NO: 41629 - DNA, 103 bp, Artificial Sequence
  Synthetic Polynucleotide
taatacgactcactataggggtctgacaattttcctagggtgttatgagaaacagaggagatctcatatgaccctaggaaacctggcggcagcgcaaaagatg

SEQ ID NO: 41630 - DNA, 103 bp, Artificial Sequence
  Synthetic Polynucleotide
taatacgactcactatagggggtgcaacggataggcgggcaacgcctgaaaacagaggagattcaggatgtgcccgcctaacctggcggcagcgcaaaagatg

SEQ ID NO: 41631 - DNA, 103 bp, Artificial Sequence
  Synthetic Polynucleotide
taatacgactcactatagggggttttctaattattccgcatatatgcccgaacagaggagacgggcaatgatgcggaataacctggcggcagcgcaaaagatg

SEQ ID NO: 41632 - DNA, 103 bp, Artificial Sequence
  Synthetic Polynucleotide
taatacgactcactatagggctggaaatacatggagtacccggatgtcttaacagaggagaaagacaatggggtactccaacctggcggcagcgcaaaagatg

SEQ ID NO: 41633 - DNA, 103 bp, Artificial Sequence
  Synthetic Polynucleotide
taatacgactcactatagggtggctcgagctcgcaatgcatgatcaaataaacagaggagatatttgatgatgcattgcaacctggcggcagcgcaaaagatg

SEQ ID NO: 41634 - DNA, 103 bp, Artificial Sequence
  Synthetic Polynucleotide
taatacgactcactatagggttgcgccccctatgggctcccgcagcgtggaacagaggagaccacgcatggggagcccaaacctggcggcagcgcaaaagatg

SEQ ID NO: 41635 - DNA, 103 bp, Artificial Sequence
  Synthetic Polynucleotide
taatacgactcactatagggattcgtagtctgttcctagcaggcacaaccaacagaggagaggttgtatgtgctaggaaaacctggcggcagcgcaaaagatg

SEQ ID NO: 41636 - DNA, 103 bp, Artificial Sequence
  Synthetic Polynucleotide
taatacgactcactatagggatgtcttagtaggaccataaccaggttgtcaacagaggagagacaacatggttatggtcaacctggcggcagcgcaaaagatg

SEQ ID NO: 41637 - DNA, 103 bp, Artificial Sequence
  Synthetic Polynucleotide
taatacgactcactataggggggttgttggcgctttgtaatcactttcacaacagaggagagtgaaaatgattacaaagaacctggcggcagcgcaaaagatg

SEQ ID NO: 41638 - DNA, 103 bp, Artificial Sequence
  Synthetic Polynucleotide
taatacgactcactatagggcactacgttaatctgcggggtaacgctgagaacagaggagactcagcatgaccccgcagaacctggcggcagcgcaaaagatg

SEQ ID NO: 41639 - DNA, 103 bp, Artificial Sequence
  Synthetic Polynucleotide
taatacgactcactatagggtttctgacctccgtgcacgtggggtgctgaaacagaggagatcagcaatgcacgtgcacaacctggcggcagcgcaaaagatg

SEQ ID NO: 41640 - DNA, 103 bp, Artificial Sequence
  Synthetic Polynucleotide
taatacgactcactatagggcctcctaaccgagcggatgggtggccggacaacagaggagagtccggatgcccatccgcaacctggcggcagcgcaaaagatg

SEQ ID NO: 41641 - DNA, 103 bp, Artificial Sequence
  Synthetic Polynucleotide
taatacgactcactatagggcgcttgacgtcaatgcttaaatgaaactgcaacagaggagagcagttatgtttaagcataacctggcggcagcgcaaaagatg

SEQ ID NO: 41642 - DNA, 103 bp, Artificial Sequence
  Synthetic Polynucleotide
taatacgactcactatagggttacttagagtggaaaggagccgtattggtaacagaggagaaccaatatggctcctttcaacctggcggcagcgcaaaagatg

SEQ ID NO: 41643 - DNA, 103 bp, Artificial Sequence
  Synthetic Polynucleotide
taatacgactcactataggggggctttcctaagcaagttaatctatcgccaacagaggagaggcgatatgttaacttgcaacctggcggcagcgcaaaagatg

SEQ ID NO: 41644 - DNA, 103 bp, Artificial Sequence
  Synthetic Polynucleotide
taatacgactcactatagggacattaatcgtctgatgccttgcgtagattaacagaggagaaatctaatgaaggcatcaaacctggcggcagcgcaaaagatg

SEQ ID NO: 41645 - DNA, 103 bp, Artificial Sequence
  Synthetic Polynucleotide
taatacgactcactatagggcgtcccattcgacggtatgaccaagaacgtaacagaggagaacgttcatggtcataccgaacctggcggcagcgcaaaagatg

SEQ ID NO: 41646 - DNA, 103 bp, Artificial Sequence
  Synthetic Polynucleotide
taatacgactcactataggggtaagcggaggcctcaaggcgtatgcctttaacagaggagaaaaggcatgcgccttgagaacctggcggcagcgcaaaagatg

SEQ ID NO: 41647 - DNA, 103 bp, Artificial Sequence
  Synthetic Polynucleotide
taatacgactcactatagggctatcattggcatcaacctagatatggtcaaacagaggagatgaccaatgctaggttgaaacctggcggcagcgcaaaagatg

SEQ ID NO: 41648 - DNA, 103 bp, Artificial Sequence
  Synthetic Polynucleotide
taatacgactcactatagggttaggaagataaaaccagtagtcggagtcaaacagaggagatgactcatgctactggttaacctggcggcagcgcaaaagatg

SEQ ID NO: 41649 - DNA, 103 bp, Artificial Sequence
  Synthetic Polynucleotide
taatacgactcactatagggagcctattggcataggttgagacattccttaacagaggagaaaggaaatgctcaacctaaacctggcggcagcgcaaaagatg

SEQ ID NO: 41650 - DNA, 103 bp, Artificial Sequence
  Synthetic Polynucleotide
taatacgactcactatagggagctggtcaaagaaacgcgaactgcccgcaaacagaggagatgcgggatgttcgcgtttaacctggcggcagcgcaaaagatg

SEQ ID NO: 41651 - DNA, 103 bp, Artificial Sequence
  Synthetic Polynucleotide
taatacgactcactatagggattcggtccgtccattgtccaacaaatggtaacagaggagaaccattatgtggacaatgaacctggcggcagcgcaaaagatg

SEQ ID NO: 41652 - DNA, 103 bp, Artificial Sequence
  Synthetic Polynucleotide
taatacgactcactatagggttcccccattagcacggaccgtatattaaaaacagaggagatttaatatgcggtccgtgaacctggcggcagcgcaaaagatg

SEQ ID NO: 41653 - DNA, 103 bp, Artificial Sequence
  Synthetic Polynucleotide
taatacgactcactatagggttgaagaccgcatagccgtcgcttttgggtaacagaggagaacccaaatgcgacggctaaacctggcggcagcgcaaaagatg

SEQ ID NO: 41654 - DNA, 103 bp, Artificial Sequence
  Synthetic Polynucleotide
taatacgactcactatagggaccaactcaaatcccatcatgacgacggcaaacagaggagatgccgtatgcatgatgggaacctggcggcagcgcaaaagatg

SEQ ID NO: 41655 - DNA, 103 bp, Artificial Sequence
  Synthetic Polynucleotide
taatacgactcactatagggagtgctgccttggagttaatgcgcccacataacagaggagaatgtggatgcattaactcaacctggcggcagcgcaaaagatg

SEQ ID NO: 41656 - DNA, 103 bp, Artificial Sequence
  Synthetic Polynucleotide
taatacgactcactatagggaaagaacaaatattggacgacaaatggcgtaacagaggagaacgccaatggtcgtccaaaacctggcggcagcgcaaaagatg

SEQ ID NO: 41657 - DNA, 103 bp, Artificial Sequence
  Synthetic Polynucleotide
taatacgactcactatagggatcgagaaggagctcttggcgttgggaagaaacagaggagatcttccatgcgccaagagaacctggcggcagcgcaaaagatg

SEQ ID NO: 41658 - DNA, 103 bp, Artificial Sequence
  Synthetic Polynucleotide
taatacgactcactatagggggcaaatgttcgtgaatcccgaggatatctaacagaggagaagatatatgcgggattcaaacctggcggcagcgcaaaagatg

SEQ ID NO: 41659 - DNA, 103 bp, Artificial Sequence
  Synthetic Polynucleotide
taatacgactcactatagggcatgcccgtcataataaacgtgttgttacgaacagaggagacgtaacatgacgtttattaacctggcggcagcgcaaaagatg

SEQ ID NO: 41660 - DNA, 103 bp, Artificial Sequence
  Synthetic Polynucleotide
taatacgactcactatagggagtctcaacggtttatgtacggttgtgatgaacagaggagacatcacatgcgtacataaaacctggcggcagcgcaaaagatg

SEQ ID NO: 41661 - DNA, 103 bp, Artificial Sequence
  Synthetic Polynucleotide
taatacgactcactatagggcgtggcgagtcccagcgtcgttagccaaagaacagaggagactttggatgacgacgctgaacctggcggcagcgcaaaagatg

SEQ ID NO: 41662 - DNA, 103 bp, Artificial Sequence
  Synthetic Polynucleotide
taatacgactcactatagggtgaatttagcaggagttccacctactagaaaacagaggagattctagatggtggaactcaacctggcggcagcgcaaaagatg

SEQ ID NO: 41663 - DNA, 103 bp, Artificial Sequence
  Synthetic Polynucleotide
taatacgactcactatagggatcctagatggcgcgggactctctcaattgaacagaggagacaattgatggagtcccgcaacctggcggcagcgcaaaagatg

SEQ ID NO: 41664 - DNA, 103 bp, Artificial Sequence
  Synthetic Polynucleotide
taatacgactcactatagggtttcgtgttgtgggtccacgcgtccgccagaacagaggagactggcgatggcgtggaccaacctggcggcagcgcaaaagatg

SEQ ID NO: 41665 - DNA, 103 bp, Artificial Sequence
  Synthetic Polynucleotide
taatacgactcactatagggccagtaaaagtttaccacctcatatgatacaacagaggagagtatcaatggaggtggtaaacctggcggcagcgcaaaagatg

SEQ ID NO: 41666 - DNA, 103 bp, Artificial Sequence
  Synthetic Polynucleotide
taatacgactcactatagggttctacgtacacgaacaaaaagctgccttgaacagaggagacaaggcatgtttttgttcaacctggcggcagcgcaaaagatg

SEQ ID NO: 41667 - DNA, 103 bp, Artificial Sequence
  Synthetic Polynucleotide
taatacgactcactataggggcaggatgtcattttcctgcggtgagcattaacagaggagaaatgctatgcgcaggaaaaacctggcggcagcgcaaaagatg

SEQ ID NO: 41668 - DNA, 103 bp, Artificial Sequence
  Synthetic Polynucleotide
taatacgactcactatagggtggtgcagaagttctaatcccggccctgtaaacagaggagatacaggatggggattagaaacctggcggcagcgcaaaagatg

SEQ ID NO: 41669 - DNA, 103 bp, Artificial Sequence
  Synthetic Polynucleotide
taatacgactcactatagggtcctagtatggattgctctcattatagtgaaacagaggagatcactaatgtgagagcaaaacctggcggcagcgcaaaagatg

SEQ ID NO: 41670 - DNA, 103 bp, Artificial Sequence
  Synthetic Polynucleotide
taatacgactcactatagggcctcgcgacgagaccagtatagcttgaaagaacagaggagactttcaatgtatactggtaacctggcggcagcgcaaaagatg

SEQ ID NO: 41671 - DNA, 103 bp, Artificial Sequence
  Synthetic Polynucleotide
taatacgactcactataggggctagctatcagaaatatgtactgataagcaacagaggagagcttatatgtacatatttaacctggcggcagcgcaaaagatg

SEQ ID NO: 41672 - DNA, 103 bp, Artificial Sequence
  Synthetic Polynucleotide
taatacgactcactatagggcctggaacgactctccgtttggggggcattaacagaggagaaatgccatgcaaacggagaacctggcggcagcgcaaaagatg

SEQ ID NO: 41673 - DNA, 103 bp, Artificial Sequence
  Synthetic Polynucleotide
taatacgactcactatagggggcgcgagcagtgcatggaatctcagacgaaacagaggagatcgtctatgattccatgcaacctggcggcagcgcaaaagatg

SEQ ID NO: 41674 - DNA, 103 bp, Artificial Sequence
  Synthetic Polynucleotide
taatacgactcactatagggaatacattgcaccgccaacagtgccgccgaaacagaggagatcggcgatgctgttggcgaacctggcggcagcgcaaaagatg

SEQ ID NO: 41675 - DNA, 103 bp, Artificial Sequence
  Synthetic Polynucleotide
taatacgactcactatagggacactacttggctcgagaccgtactgtgccaacagaggagaggcacaatgcggtctcgaaacctggcggcagcgcaaaagatg

SEQ ID NO: 41676 - DNA, 103 bp, Artificial Sequence
  Synthetic Polynucleotide
taatacgactcactatagggaggaactgcccggacgaatcggtctaaagaaacagaggagatctttaatgcgattcgtcaacctggcggcagcgcaaaagatg

SEQ ID NO: 41677 - DNA, 103 bp, Artificial Sequence
  Synthetic Polynucleotide
taatacgactcactatagggcacacccacgacagctccaatgctcgaaacaacagaggagagtttcgatgattggagctaacctggcggcagcgcaaaagatg

SEQ ID NO: 41678 - DNA, 103 bp, Artificial Sequence
  Synthetic Polynucleotide
taatacgactcactatagggtatctaggctccagtatgctggcactatttaacagaggagaaaatagatgcagcatactaacctggcggcagcgcaaaagatg

SEQ ID NO: 41679 - DNA, 103 bp, Artificial Sequence
  Synthetic Polynucleotide
taatacgactcactataggggtatgtttctacctaaaaaggcaaaacaccaacagaggagaggtgttatgcctttttagaacctggcggcagcgcaaaagatg

SEQ ID NO: 41680 - DNA, 103 bp, Artificial Sequence
  Synthetic Polynucleotide
taatacgactcactatagggcgaccgccaaggtcttaatgagcattagataacagaggagaatctaaatgtcattaagaaacctggcggcagcgcaaaagatg

SEQ ID NO: 41681 - DNA, 103 bp, Artificial Sequence
  Synthetic Polynucleotide
taatacgactcactataggggcgagctagccctgtcgaagctacttgagtaacagaggagaactcaaatggcttcgacaaacctggcggcagcgcaaaagatg

SEQ ID NO: 41682 - DNA, 103 bp, Artificial Sequence
  Synthetic Polynucleotide
taatacgactcactataggggtatcaatagagagtagaattaaggcggcgaacagaggagacgccgcatgaattctactaacctggcggcagcgcaaaagatg

SEQ ID NO: 41683 - DNA, 103 bp, Artificial Sequence
  Synthetic Polynucleotide
taatacgactcactataggggaggcgaaccatggggtcgcacgtacttccaacagaggagaggaagtatgtgcgaccccaacctggcggcagcgcaaaagatg

SEQ ID NO: 41684 - DNA, 103 bp, Artificial Sequence
  Synthetic Polynucleotide
taatacgactcactatagggacgtgcctgacattgcgccgggtcaggcacaacagaggagagtgcctatgccggcgcaaaacctggcggcagcgcaaaagatg

SEQ ID NO: 41685 - DNA, 103 bp, Artificial Sequence
  Synthetic Polynucleotide
taatacgactcactatagggtcacagacctggactgtcattaccagggtgaacagaggagacaccctatgaatgacagtaacctggcggcagcgcaaaagatg

SEQ ID NO: 41686 - DNA, 103 bp, Artificial Sequence
  Synthetic Polynucleotide
taatacgactcactatagggctaggccccattaactagttgccagttagaaacagaggagatctaacatgcaactagttaacctggcggcagcgcaaaagatg

SEQ ID NO: 41687 - DNA, 103 bp, Artificial Sequence
  Synthetic Polynucleotide
taatacgactcactatagggtgagggaggcgacgtccaatgggaagagcgaacagaggagacgctctatgcattggacgaacctggcggcagcgcaaaagatg

SEQ ID NO: 41688 - DNA, 103 bp, Artificial Sequence
  Synthetic Polynucleotide
taatacgactcactatagggtgcatgcaccggtggttgaataatttgccgaacagaggagacggcaaatgattcaaccaaacctggcggcagcgcaaaagatg

SEQ ID NO: 41689 - DNA, 103 bp, Artificial Sequence
  Synthetic Polynucleotide
taatacgactcactataggggcatcggcccattgttgcgtaagccgcccaaacagaggagatgggcgatgtacgcaacaaacctggcggcagcgcaaaagatg

SEQ ID NO: 41690 - DNA, 103 bp, Artificial Sequence
  Synthetic Polynucleotide
taatacgactcactatagggacccagggtggttcggtgatacaaggagggaacagaggagaccctccatgtatcaccgaaacctggcggcagcgcaaaagatg

SEQ ID NO: 41691 - DNA, 103 bp, Artificial Sequence
  Synthetic Polynucleotide
taatacgactcactatagggtctgtagaggcatgcatgagcgaatttttgaacagaggagacaaaaaatggctcatgcaaacctggcggcagcgcaaaagatg

SEQ ID NO: 41692 - DNA, 103 bp, Artificial Sequence
  Synthetic Polynucleotide
taatacgactcactatagggctcttttgtcagagatccgggctttgtcggaacagaggagaccgacaatgcccggatctaacctggcggcagcgcaaaagatg

SEQ ID NO: 41693 - DNA, 103 bp, Artificial Sequence
  Synthetic Polynucleotide
taatacgactcactatagggcccaaatccatagtcgatgagtgcgtggaaaacagaggagattccacatgctcatcgacaacctggcggcagcgcaaaagatg

SEQ ID NO: 41694 - DNA, 103 bp, Artificial Sequence
  Synthetic Polynucleotide
taatacgactcactatagggtaaagtaaacctgcagtaaccatgggagccaacagaggagaggctccatgggttactgcaacctggcggcagcgcaaaagatg

SEQ ID NO: 41695 - DNA, 103 bp, Artificial Sequence
  Synthetic Polynucleotide
taatacgactcactatagggcgtcttcgagtatccggcttgccagacagcaacagaggagagctgtcatgcaagccggaaacctggcggcagcgcaaaagatg

SEQ ID NO: 41696 - DNA, 103 bp, Artificial Sequence
  Synthetic Polynucleotide
taatacgactcactataggggtcaattaagggcaacactgccttaccaagaacagaggagacttggtatggcagtgttgaacctggcggcagcgcaaaagatg

SEQ ID NO: 41697 - DNA, 103 bp, Artificial Sequence
  Synthetic Polynucleotide
taatacgactcactatagggtttactacttccattaagttgcacccgtgtaacagaggagaacacggatgcaacttaataacctggcggcagcgcaaaagatg

SEQ ID NO: 41698 - DNA, 103 bp, Artificial Sequence
  Synthetic Polynucleotide
taatacgactcactatagggcactaaaaaactccagtatccggttatcgtaacagaggagaacgataatgggatactggaacctggcggcagcgcaaaagatg

SEQ ID NO: 41699 - DNA, 103 bp, Artificial Sequence
  Synthetic Polynucleotide
taatacgactcactatagggttacggggtccagcgcctctctaatttggtaacagaggagaaccaaaatggagaggcgcaacctggcggcagcgcaaaagatg

SEQ ID NO: 41700 - DNA, 103 bp, Artificial Sequence
  Synthetic Polynucleotide
taatacgactcactatagggtttgtcaatatgggccatacacgtcgtgagaacagaggagactcacgatgtgtatggccaacctggcggcagcgcaaaagatg

SEQ ID NO: 41701 - DNA, 103 bp, Artificial Sequence
  Synthetic Polynucleotide
taatacgactcactatagggtaacaacacgtatatcccgagacaggcaccaacagaggagaggtgccatgctcgggataaacctggcggcagcgcaaaagatg

SEQ ID NO: 41702 - DNA, 103 bp, Artificial Sequence
  Synthetic Polynucleotide
taatacgactcactatagggattaagtttgaaaagtgcgcttccactgccaacagaggagaggcagtatgagcgcacttaacctggcggcagcgcaaaagatg

SEQ ID NO: 41703 - DNA, 103 bp, Artificial Sequence
  Synthetic Polynucleotide
taatacgactcactatagggtaaatgatgggaagttggacgctatgagtgaacagaggagacactcaatgcgtccaactaacctggcggcagcgcaaaagatg

SEQ ID NO: 41704 - DNA, 103 bp, Artificial Sequence
  Synthetic Polynucleotide
taatacgactcactatagggagcatagtttccactcatgctataactgggaacagaggagacccagtatgagcatgagtaacctggcggcagcgcaaaagatg

SEQ ID NO: 41705 - DNA, 103 bp, Artificial Sequence
  Synthetic Polynucleotide
taatacgactcactatagggatcccgcaaggttaccagtaatttcttggaaacagaggagatccaagatgttactggtaaacctggcggcagcgcaaaagatg

SEQ ID NO: 41706 - DNA, 103 bp, Artificial Sequence
  Synthetic Polynucleotide
taatacgactcactatagggtgggtcggaagccctcgaaagagctgccacaacagaggagagtggcaatgctttcgaggaacctggcggcagcgcaaaagatg

SEQ ID NO: 41707 - DNA, 103 bp, Artificial Sequence
  Synthetic Polynucleotide
taatacgactcactataggggcgtcttatcaccctcaacgaaatgaagtaaacagaggagatacttcatgtcgttgaggaacctggcggcagcgcaaaagatg

SEQ ID NO: 41708 - DNA, 103 bp, Artificial Sequence
  Synthetic Polynucleotide
taatacgactcactatagggtggaacgaaccgttaaaaggaatcgataagaacagaggagacttatcatgtccttttaaaacctggcggcagcgcaaaagatg

SEQ ID NO: 41709 - DNA, 103 bp, Artificial Sequence
  Synthetic Polynucleotide
taatacgactcactatagggtcctccgatcgcctaagtgttggtttgcaaaacagaggagattgcaaatgaacacttagaacctggcggcagcgcaaaagatg

SEQ ID NO: 41710 - DNA, 103 bp, Artificial Sequence
  Synthetic Polynucleotide
taatacgactcactatagggctctgacttcggaaccaagtgccaaccccaaacagaggagatggggtatgcacttggttaacctggcggcagcgcaaaagatg

SEQ ID NO: 41711 - DNA, 103 bp, Artificial Sequence
  Synthetic Polynucleotide
taatacgactcactatagggtgacgtatagtactctttttggtgttatctaacagaggagaagataaatgcaaaaagagaacctggcggcagcgcaaaagatg

SEQ ID NO: 41712 - DNA, 103 bp, Artificial Sequence
  Synthetic Polynucleotide
taatacgactcactatagggttcacaatcggacgtcgggacccattggcaaacagaggagatgccaaatggtcccgacgaacctggcggcagcgcaaaagatg

SEQ ID NO: 41713 - DNA, 103 bp, Artificial Sequence
  Synthetic Polynucleotide
taatacgactcactatagggatcaaggtcgacggtgtcaggtgagtcccgaacagaggagacgggacatgcctgacaccaacctggcggcagcgcaaaagatg

SEQ ID NO: 41714 - DNA, 103 bp, Artificial Sequence
  Synthetic Polynucleotide
taatacgactcactatagggagctagtagacgccacaaagggtccggctcaacagaggagagagccgatgcctttgtggaacctggcggcagcgcaaaagatg

SEQ ID NO: 41715 - DNA, 103 bp, Artificial Sequence
  Synthetic Polynucleotide
taatacgactcactatagggtctcgctttagcaatctatagggagacagaaacagaggagatctgtcatgctatagattaacctggcggcagcgcaaaagatg

SEQ ID NO: 41716 - DNA, 103 bp, Artificial Sequence
  Synthetic Polynucleotide
taatacgactcactatagggtaccgtgccggcgaccgagtgcttgaagataacagaggagaatcttcatgcactcggtcaacctggcggcagcgcaaaagatg

SEQ ID NO: 41717 - DNA, 103 bp, Artificial Sequence
  Synthetic Polynucleotide
taatacgactcactataggggactaagcgaatccgtatgtgtaatactcgaacagaggagacgagtaatgcacatacggaacctggcggcagcgcaaaagatg

SEQ ID NO: 41718 - DNA, 103 bp, Artificial Sequence
  Synthetic Polynucleotide
taatacgactcactatagggccctcgaagccaatcattcgggtcctctataacagaggagaatagagatgccgaatgataacctggcggcagcgcaaaagatg

SEQ ID NO: 41719 - DNA, 103 bp, Artificial Sequence
  Synthetic Polynucleotide
taatacgactcactatagggtacgagcaagtactgaccgtcagtccagcgaacagaggagacgctggatggacggtcagaacctggcggcagcgcaaaagatg

SEQ ID NO: 41720 - DNA, 103 bp, Artificial Sequence
  Synthetic Polynucleotide
taatacgactcactatagggtccagcttaagcctgcgcgggccgccagtcaacagaggagagactggatgcccgcgcagaacctggcggcagcgcaaaagatg

SEQ ID NO: 41721 - DNA, 103 bp, Artificial Sequence
  Synthetic Polynucleotide
taatacgactcactatagggcctttgggggaaattaggaagattaccgaaaacagaggagattcggtatgcttcctaataacctggcggcagcgcaaaagatg

SEQ ID NO: 41722 - DNA, 103 bp, Artificial Sequence
  Synthetic Polynucleotide
taatacgactcactatagggcactttagtctattaccacattccgcgaccaacagaggagaggtcgcatgatgtggtaaaacctggcggcagcgcaaaagatg

SEQ ID NO: 41723 - DNA, 103 bp, Artificial Sequence
  Synthetic Polynucleotide
taatacgactcactataggggaccgacatattaactgtgtagaaacttggaacagaggagaccaagtatgtacacagttaacctggcggcagcgcaaaagatg

SEQ ID NO: 41724 - DNA, 103 bp, Artificial Sequence
  Synthetic Polynucleotide
taatacgactcactatagggctcatcacgctaaggcatcttcaaaggaggaacagaggagacctcctatgaagatgcctaacctggcggcagcgcaaaagatg

SEQ ID NO: 41725 - DNA, 103 bp, Artificial Sequence
  Synthetic Polynucleotide
taatacgactcactatagggttaccggggtaaattgacggtggctgctccaacagaggagaggagcaatgaccgtcaataacctggcggcagcgcaaaagatg

SEQ ID NO: 41726 - DNA, 103 bp, Artificial Sequence
  Synthetic Polynucleotide
taatacgactcactataggggccaacagtatgcctcaagcggcgtctgagaacagaggagactcagaatgcgcttgaggaacctggcggcagcgcaaaagatg

SEQ ID NO: 41727 - DNA, 103 bp, Artificial Sequence
  Synthetic Polynucleotide
taatacgactcactataggggctgacctctatatccagttgcgatgtcacaacagaggagagtgacaatgcaactggataacctggcggcagcgcaaaagatg

SEQ ID NO: 41728 - DNA, 103 bp, Artificial Sequence
  Synthetic Polynucleotide
taatacgactcactatagggttgctcaactggggacgaaaacgaaaagttaacagaggagaaactttatgttttcgtccaacctggcggcagcgcaaaagatg

SEQ ID NO: 41729 - DNA, 103 bp, Artificial Sequence
  Synthetic Polynucleotide
taatacgactcactatagggacgagtttccggcacgcgtttcattctggaaacagaggagatccagaatgaaacgcgtgaacctggcggcagcgcaaaagatg

SEQ ID NO: 41730 - DNA, 103 bp, Artificial Sequence
  Synthetic Polynucleotide
taatacgactcactatagggatatgcccgggttgggcatcccggtacgcaaacagaggagatgcgtaatgggatgcccaaacctggcggcagcgcaaaagatg

SEQ ID NO: 41731 - DNA, 103 bp, Artificial Sequence
  Synthetic Polynucleotide
taatacgactcactataggggcctgaaaggtagatataaacggaacagataacagaggagaatctgtatggtttatatcaacctggcggcagcgcaaaagatg

SEQ ID NO: 41732 - DNA, 103 bp, Artificial Sequence
  Synthetic Polynucleotide
taatacgactcactatagggccttgtacttcacgaccctcccgcccaagaaacagaggagatcttggatgggagggtcgaacctggcggcagcgcaaaagatg

SEQ ID NO: 41733 - DNA, 103 bp, Artificial Sequence
  Synthetic Polynucleotide
taatacgactcactatagggtgcgatcgccccggtagattatgatgacgtaacagaggagaacgtcaatgtaatctaccaacctggcggcagcgcaaaagatg

SEQ ID NO: 41734 - DNA, 103 bp, Artificial Sequence
  Synthetic Polynucleotide
taatacgactcactatagggcacgcttcttaccataagcgaaagctgtcgaacagaggagacgacagatgtcgcttatgaacctggcggcagcgcaaaagatg

SEQ ID NO: 41735 - DNA, 103 bp, Artificial Sequence
  Synthetic Polynucleotide
taatacgactcactatagggtcggctaatttatggtatcctcccctttgaaacagaggagatcaaagatgaggataccaaacctggcggcagcgcaaaagatg

SEQ ID NO: 41736 - DNA, 103 bp, Artificial Sequence
  Synthetic Polynucleotide
taatacgactcactatagggcgcaaatacagctgagggccagaattagagaacagaggagactctaaatgtggccctcaaacctggcggcagcgcaaaagatg

SEQ ID NO: 41737 - DNA, 103 bp, Artificial Sequence
  Synthetic Polynucleotide
taatacgactcactatagggttagaccaaggtccagtgtcccggctgtcgaacagaggagacgacagatgggacactggaacctggcggcagcgcaaaagatg

SEQ ID NO: 41738 - DNA, 103 bp, Artificial Sequence
  Synthetic Polynucleotide
taatacgactcactatagggtccaaggtgggagccaatcacgattactataacagaggagaatagtaatggtgattggcaacctggcggcagcgcaaaagatg

SEQ ID NO: 41739 - DNA, 103 bp, Artificial Sequence
  Synthetic Polynucleotide
taatacgactcactataggggatcgatacccatcgaactacataatgaagaacagaggagacttcatatggtagttcgaaacctggcggcagcgcaaaagatg

SEQ ID NO: 41740 - DNA, 103 bp, Artificial Sequence
  Synthetic Polynucleotide
taatacgactcactatagggcttctgaagttttcatgcaatttctaatacaacagaggagagtattaatgattgcatgaaacctggcggcagcgcaaaagatg

SEQ ID NO: 41741 - DNA, 103 bp, Artificial Sequence
  Synthetic Polynucleotide
taatacgactcactatagggatccgtgtgaacatcgccgtcgaggtctccaacagaggagaggagacatggacggcgataacctggcggcagcgcaaaagatg

SEQ ID NO: 41742 - DNA, 103 bp, Artificial Sequence
  Synthetic Polynucleotide
taatacgactcactatagggtccgcaactacgttaatcacggttcctaccaacagaggagaggtaggatgcgtgattaaaacctggcggcagcgcaaaagatg

SEQ ID NO: 41743 - DNA, 103 bp, Artificial Sequence
  Synthetic Polynucleotide
taatacgactcactataggggtagttcaccgagtacccgcgtagaatcgtaacagaggagaacgattatgcgcgggtacaacctggcggcagcgcaaaagatg

SEQ ID NO: 41744 - DNA, 103 bp, Artificial Sequence
  Synthetic Polynucleotide
taatacgactcactatagggcacattggaaacgttacgaacaggtatatgaacagaggagacatataatggttcgtaacaacctggcggcagcgcaaaagatg

SEQ ID NO: 41745 - DNA, 103 bp, Artificial Sequence
  Synthetic Polynucleotide
taatacgactcactatagggctcatatatctataataaagcatctaatataacagaggagaatattaatggctttattaaacctggcggcagcgcaaaagatg

SEQ ID NO: 41746 - DNA, 103 bp, Artificial Sequence
  Synthetic Polynucleotide
taatacgactcactatagggacccggtggaaaaagctccccaccattaccaacagaggagaggtaatatgggggagcttaacctggcggcagcgcaaaagatg

SEQ ID NO: 41747 - DNA, 103 bp, Artificial Sequence
  Synthetic Polynucleotide
taatacgactcactataggggattcagcgatgttaccgtagtgtgctctcaacagaggagagagagcatgctacggtaaaacctggcggcagcgcaaaagatg

SEQ ID NO: 41748 - DNA, 103 bp, Artificial Sequence
  Synthetic Polynucleotide
taatacgactcactataggggatccccaagagacgaaaacttgtcgactcaacagaggagagagtcgatgagttttcgtaacctggcggcagcgcaaaagatg

SEQ ID NO: 41749 - DNA, 103 bp, Artificial Sequence
  Synthetic Polynucleotide
taatacgactcactatagggtcgtctctcgacccgcccgagtcacgatccaacagaggagaggatcgatgctcgggcggaacctggcggcagcgcaaaagatg

SEQ ID NO: 41750 - DNA, 103 bp, Artificial Sequence
  Synthetic Polynucleotide
taatacgactcactatagggtcgatcattcatactactttttcatggcaaaacagaggagattgccaatgaaaagtagtaacctggcggcagcgcaaaagatg

SEQ ID NO: 41751 - DNA, 103 bp, Artificial Sequence
  Synthetic Polynucleotide
taatacgactcactataggggcgccttagggcgtaatgacggtttttaggaacagaggagacctaaaatgcgtcattacaacctggcggcagcgcaaaagatg

SEQ ID NO: 41752 - DNA, 103 bp, Artificial Sequence
  Synthetic Polynucleotide
taatacgactcactatagggaatcaatatggcggcaccgtaaagatatagaacagaggagactatatatgtacggtgccaacctggcggcagcgcaaaagatg

SEQ ID NO: 41753 - DNA, 103 bp, Artificial Sequence
  Synthetic Polynucleotide
taatacgactcactatagggcagcacttattggaaattcccgttactttcaacagaggagagaaagtatggggaatttcaacctggcggcagcgcaaaagatg

SEQ ID NO: 41754 - DNA, 103 bp, Artificial Sequence
  Synthetic Polynucleotide
taatacgactcactatagggatgacattcggcaatggcccgtggattattaacagaggagaaataatatgcgggccattaacctggcggcagcgcaaaagatg

SEQ ID NO: 41755 - DNA, 103 bp, Artificial Sequence
  Synthetic Polynucleotide
taatacgactcactatagggtgtgcaattggagtatcagacgtgagtcacaacagaggagagtgactatggtctgatacaacctggcggcagcgcaaaagatg

SEQ ID NO: 41756 - DNA, 103 bp, Artificial Sequence
  Synthetic Polynucleotide
taatacgactcactatagggtcgcagcccgaggtcatgaaagcagtccagaacagaggagactggacatgtttcatgacaacctggcggcagcgcaaaagatg

SEQ ID NO: 41757 - DNA, 103 bp, Artificial Sequence
  Synthetic Polynucleotide
taatacgactcactataggggataagacttcccactttacagtagagcggaacagaggagaccgctcatgtgtaaagtgaacctggcggcagcgcaaaagatg

SEQ ID NO: 41758 - DNA, 103 bp, Artificial Sequence
  Synthetic Polynucleotide
taatacgactcactatagggaaggttgtccttaaaatcatatgtagaaaaaacagaggagattttctatgtatgattttaacctggcggcagcgcaaaagatg

SEQ ID NO: 41759 - DNA, 103 bp, Artificial Sequence
  Synthetic Polynucleotide
taatacgactcactatagggagtggattgggaagtatgagatgaataaataacagaggagaatttatatgtctcatactaacctggcggcagcgcaaaagatg

SEQ ID NO: 41760 - DNA, 103 bp, Artificial Sequence
  Synthetic Polynucleotide
taatacgactcactatagggggttttctctacaacggagaaaccaatggaaacagaggagatccattatgttctccgttaacctggcggcagcgcaaaagatg

SEQ ID NO: 41761 - DNA, 103 bp, Artificial Sequence
  Synthetic Polynucleotide
taatacgactcactatagggccgactagtcgaccggtgcctgcctaccgaaacagaggagatcggtaatgaggcaccggaacctggcggcagcgcaaaagatg

SEQ ID NO: 41762 - DNA, 103 bp, Artificial Sequence
  Synthetic Polynucleotide
taatacgactcactatagggagagaacctactcatccaattctaaagcgcaacagaggagagcgcttatgaattggatgaacctggcggcagcgcaaaagatg

SEQ ID NO: 41763 - DNA, 103 bp, Artificial Sequence
  Synthetic Polynucleotide
taatacgactcactatagggcaggcgtctgttaggcggggagcctgccagaacagaggagactggcaatgtccccgcctaacctggcggcagcgcaaaagatg

SEQ ID NO: 41764 - DNA, 103 bp, Artificial Sequence
  Synthetic Polynucleotide
taatacgactcactatagggttgcggacgcgtaatcaccggaatgcagggaacagaggagaccctgcatgccggtgattaacctggcggcagcgcaaaagatg

SEQ ID NO: 41765 - DNA, 103 bp, Artificial Sequence
  Synthetic Polynucleotide
taatacgactcactatagggcgctatcgttccctgcctcaacactcgaaaaacagaggagatttcgaatgttgaggcagaacctggcggcagcgcaaaagatg

SEQ ID NO: 41766 - DNA, 103 bp, Artificial Sequence
  Synthetic Polynucleotide
taatacgactcactatagggcggcgtccattatgaatggatctgctatacaacagaggagagtatagatgatccattcaaacctggcggcagcgcaaaagatg

SEQ ID NO: 41767 - DNA, 103 bp, Artificial Sequence
  Synthetic Polynucleotide
taatacgactcactatagggaacgaacggagccatagtcgctcgacggcaaacagaggagatgccgtatggcgactatgaacctggcggcagcgcaaaagatg

SEQ ID NO: 41768 - DNA, 103 bp, Artificial Sequence
  Synthetic Polynucleotide
taatacgactcactatagggcgggctgcgtgtaaagatgcctccaatatgaacagaggagacatattatgggcatctttaacctggcggcagcgcaaaagatg

SEQ ID NO: 41769 - DNA, 103 bp, Artificial Sequence
  Synthetic Polynucleotide
taatacgactcactatagggtctaccgacctcttaattagtaacgttataaacagaggagatataacatgactaattaaaacctggcggcagcgcaaaagatg

SEQ ID NO: 41770 - DNA, 103 bp, Artificial Sequence
  Synthetic Polynucleotide
taatacgactcactatagggcgaactctcgtccgctcccaccgcgaggccaacagaggagaggcctcatggtgggagcgaacctggcggcagcgcaaaagatg

SEQ ID NO: 41771 - DNA, 103 bp, Artificial Sequence
  Synthetic Polynucleotide
taatacgactcactataggggtcttgtttaagccattcccgcgcaagccaaacagaggagatggcttatgcgggaatggaacctggcggcagcgcaaaagatg

SEQ ID NO: 41772 - DNA, 103 bp, Artificial Sequence
  Synthetic Polynucleotide
taatacgactcactatagggaatttgcccctctttagtctactctataagaacagaggagacttataatgtagactaaaaacctggcggcagcgcaaaagatg

SEQ ID NO: 41773 - DNA, 103 bp, Artificial Sequence
  Synthetic Polynucleotide
taatacgactcactatagggtcctgtcatgctcatcggattctgcctgttaacagaggagaaacaggatgaatccgatgaacctggcggcagcgcaaaagatg

SEQ ID NO: 41774 - DNA, 103 bp, Artificial Sequence
  Synthetic Polynucleotide
taatacgactcactataggggtctgcacagcgtaagttaaggtctacttaaacagaggagataagtaatgcttaacttaaacctggcggcagcgcaaaagatg

SEQ ID NO: 41775 - DNA, 103 bp, Artificial Sequence
  Synthetic Polynucleotide
taatacgactcactatagggcggccaggagtgatttattagaggacatgaaacagaggagatcatgtatgctaataaataacctggcggcagcgcaaaagatg

SEQ ID NO: 41776 - DNA, 103 bp, Artificial Sequence
  Synthetic Polynucleotide
taatacgactcactatagggtagatagtattccgaaaggctacagtgaacaacagaggagagttcacatgagcctttcgaacctggcggcagcgcaaaagatg

SEQ ID NO: 41777 - DNA, 103 bp, Artificial Sequence
  Synthetic Polynucleotide
taatacgactcactatagggctgtacgggctgaaccattagggctcaaacaacagaggagagtttgaatgctaatggttaacctggcggcagcgcaaaagatg

SEQ ID NO: 41778 - DNA, 103 bp, Artificial Sequence
  Synthetic Polynucleotide
taatacgactcactatagggttcaacctaagggcgtccgacctggaagggaacagaggagacccttcatggtcggacgcaacctggcggcagcgcaaaagatg

SEQ ID NO: 41779 - DNA, 103 bp, Artificial Sequence
  Synthetic Polynucleotide
taatacgactcactatagggcataggccaaaactttcgggtctcagacctaacagaggagaaggtctatgacccgaaagaacctggcggcagcgcaaaagatg

SEQ ID NO: 41780 - DNA, 103 bp, Artificial Sequence
  Synthetic Polynucleotide
taatacgactcactatagggctctgcaaaatgcaccttaacgtccgagtgaacagaggagacactcgatggttaaggtgaacctggcggcagcgcaaaagatg

SEQ ID NO: 41781 - DNA, 103 bp, Artificial Sequence
  Synthetic Polynucleotide
taatacgactcactatagggtccagccgaaagggtgccacgactcgttcaaacagaggagatgaacgatgcgtggcaccaacctggcggcagcgcaaaagatg

SEQ ID NO: 41782 - DNA, 103 bp, Artificial Sequence
  Synthetic Polynucleotide
taatacgactcactatagggaaggaaagctgtcgctctatctctctcctcaacagaggagagaggagatggatagagcgaacctggcggcagcgcaaaagatg

SEQ ID NO: 41783 - DNA, 103 bp, Artificial Sequence
  Synthetic Polynucleotide
taatacgactcactatagggggcaggtggatagtccaccagcggatatacaacagaggagagtatatatgctggtggacaacctggcggcagcgcaaaagatg

SEQ ID NO: 41784 - DNA, 103 bp, Artificial Sequence
  Synthetic Polynucleotide
taatacgactcactataggggtgcttccctatatgacccgttaatgagtcaacagaggagagactcaatgacgggtcataacctggcggcagcgcaaaagatg

SEQ ID NO: 41785 - DNA, 103 bp, Artificial Sequence
  Synthetic Polynucleotide
taatacgactcactatagggactggatttcatccatgtagataccactggaacagaggagaccagtgatgtctacatggaacctggcggcagcgcaaaagatg

SEQ ID NO: 41786 - DNA, 103 bp, Artificial Sequence
  Synthetic Polynucleotide
taatacgactcactatagggacacggtagctgagcactcggtctttcccaaacagaggagatgggaaatgccgagtgctaacctggcggcagcgcaaaagatg

SEQ ID NO: 41787 - DNA, 103 bp, Artificial Sequence
  Synthetic Polynucleotide
taatacgactcactatagggctctcggttcgattggatctgtgtgcagtgaacagaggagacactgcatgcagatccaaaacctggcggcagcgcaaaagatg

SEQ ID NO: 41788 - DNA, 103 bp, Artificial Sequence
  Synthetic Polynucleotide
taatacgactcactatagggggcgccccggtcaagggtacgaggcaggacaacagaggagagtcctgatgcgtacccttaacctggcggcagcgcaaaagatg

SEQ ID NO: 41789 - DNA, 103 bp, Artificial Sequence
  Synthetic Polynucleotide
taatacgactcactatagggcaccgaaacgcataccgtggatcgctgataaacagaggagatatcagatgtccacggtaaacctggcggcagcgcaaaagatg

SEQ ID NO: 41790 - DNA, 103 bp, Artificial Sequence
  Synthetic Polynucleotide
taatacgactcactatagggagttcgcgcccccggaaggcaacgcaacggaacagaggagaccgttgatgtgccttccgaacctggcggcagcgcaaaagatg

SEQ ID NO: 41791 - DNA, 103 bp, Artificial Sequence
  Synthetic Polynucleotide
taatacgactcactatagggcaataacgttcaacaacatatactctcgagaacagaggagactcgagatgatatgttgtaacctggcggcagcgcaaaagatg

SEQ ID NO: 41792 - DNA, 103 bp, Artificial Sequence
  Synthetic Polynucleotide
taatacgactcactatagggctacaataaatgcaaaccattctgatgcataacagaggagaatgcatatgaatggtttgaacctggcggcagcgcaaaagatg

SEQ ID NO: 41793 - DNA, 103 bp, Artificial Sequence
  Synthetic Polynucleotide
taatacgactcactatagggtcagaaatgactccatgaaaaccgccaaagaacagaggagactttggatgttttcatggaacctggcggcagcgcaaaagatg

SEQ ID NO: 41794 - DNA, 103 bp, Artificial Sequence
  Synthetic Polynucleotide
taatacgactcactatagggaggatgtgtggaacatatgcctaagtttagaacagaggagactaaacatgggcatatgtaacctggcggcagcgcaaaagatg

SEQ ID NO: 41795 - DNA, 103 bp, Artificial Sequence
  Synthetic Polynucleotide
taatacgactcactatagggctgtatctggaagctattaactccgacattaacagaggagaaatgtcatggttaatagcaacctggcggcagcgcaaaagatg

SEQ ID NO: 41796 - DNA, 103 bp, Artificial Sequence
  Synthetic Polynucleotide
taatacgactcactatagggaatcactgtatctggaagctattaactccgaacagaggagacggagtatgtagcttccaaacctggcggcagcgcaaaagatg

SEQ ID NO: 41797 - DNA, 103 bp, Artificial Sequence
  Synthetic Polynucleotide
taatacgactcactataggggccaaaatcactgtatctggaagctattaaaacagaggagattaataatgtccagatacaacctggcggcagcgcaaaagatg

SEQ ID NO: 41798 - DNA, 103 bp, Artificial Sequence
  Synthetic Polynucleotide
taatacgactcactatagggctattgccaaaatcactgtatctggaagctaacagaggagaagcttcatgatacagtgaaacctggcggcagcgcaaaagatg

SEQ ID NO: 41799 - DNA, 103 bp, Artificial Sequence
  Synthetic Polynucleotide
taatacgactcactatagggacggactattgccaaaatcactgtatctggaacagaggagaccagatatggtgattttgaacctggcggcagcgcaaaagatg

SEQ ID NO: 41800 - DNA, 103 bp, Artificial Sequence
  Synthetic Polynucleotide
taatacgactcactatagggattacacggactattgccaaaatcactgtaaacagaggagatacagtatgtttggcaataacctggcggcagcgcaaaagatg

SEQ ID NO: 41801 - DNA, 103 bp, Artificial Sequence
  Synthetic Polynucleotide
taatacgactcactatagggtatggattacacggactattgccaaaatcaaacagaggagatgatttatgcaatagtccaacctggcggcagcgcaaaagatg

SEQ ID NO: 41802 - DNA, 103 bp, Artificial Sequence
  Synthetic Polynucleotide
taatacgactcactatagggtggattatggattacacggactattgccaaaacagaggagattggcaatggtccgtgtaaacctggcggcagcgcaaaagatg

SEQ ID NO: 41803 - DNA, 103 bp, Artificial Sequence
  Synthetic Polynucleotide
taatacgactcactataggggttactggattatggattacacggactattaacagaggagaaatagtatgtgtaatccaaacctggcggcagcgcaaaagatg

SEQ ID NO: 41804 - DNA, 103 bp, Artificial Sequence
  Synthetic Polynucleotide
taatacgactcactatagggctcgtgttactggattatggattacacggaaacagaggagatccgtgatgtccataatcaacctggcggcagcgcaaaagatg

SEQ ID NO: 41805 - DNA, 103 bp, Artificial Sequence
  Synthetic Polynucleotide
taatacgactcactatagggtgttcaggatgtgtggaacatatgcctaagaacagaggagacttaggatgatgttccacaacctggcggcagcgcaaaagatg

SEQ ID NO: 41806 - DNA, 103 bp, Artificial Sequence
  Synthetic Polynucleotide
taatacgactcactatagggaccagctcgtgttactggattatggattacaacagaggagagtaatcatgaatccagtaaacctggcggcagcgcaaaagatg

SEQ ID NO: 41807 - DNA, 103 bp, Artificial Sequence
  Synthetic Polynucleotide
taatacgactcactatagggcaagcaccagctcgtgttactggattatggaacagaggagaccataaatgagtaacacgaacctggcggcagcgcaaaagatg

SEQ ID NO: 41808 - DNA, 103 bp, Artificial Sequence
  Synthetic Polynucleotide
taatacgactcactatagggtctagcaagcaccagctcgtgttactggataacagaggagaatccagatgcacgagctgaacctggcggcagcgcaaaagatg

SEQ ID NO: 41809 - DNA, 103 bp, Artificial Sequence
  Synthetic Polynucleotide
taatacgactcactatagggaggtgtctagcaagcaccagctcgtgttacaacagaggagagtaacaatggctggtgctaacctggcggcagcgcaaaagatg

SEQ ID NO: 41810 - DNA, 103 bp, Artificial Sequence
  Synthetic Polynucleotide
taatacgactcactatagggtgaaaaggtgtctagcaagcaccagctcgtaacagaggagaacgagcatgtgcttgctaaacctggcggcagcgcaaaagatg

SEQ ID NO: 41811 - DNA, 103 bp, Artificial Sequence
  Synthetic Polynucleotide
taatacgactcactatagggaacattgaaaaggtgtctagcaagcaccagaacagaggagactggtgatggctagacacaacctggcggcagcgcaaaagatg

SEQ ID NO: 41812 - DNA, 103 bp, Artificial Sequence
  Synthetic Polynucleotide
taatacgactcactatagggaattaaacattgaaaaggtgtctagcaagcaacagaggagagcttgcatgacaccttttaacctggcggcagcgcaaaagatg

SEQ ID NO: 41813 - DNA, 103 bp, Artificial Sequence
  Synthetic Polynucleotide
taatacgactcactatagggaaaaaaattaaacattgaaaaggtgtctagaacagaggagactagacatgttttcaatgaacctggcggcagcgcaaaagatg

SEQ ID NO: 41814 - DNA, 103 bp, Artificial Sequence
  Synthetic Polynucleotide
taatacgactcactatagggatttcaaaaaaattaaacattgaaaaggtgaacagaggagacaccttatgaatgtttaaaacctggcggcagcgcaaaagatg

SEQ ID NO: 41815 - DNA, 103 bp, Artificial Sequence
  Synthetic Polynucleotide
taatacgactcactatagggagcttatttcaaaaaaattaaacattgaaaaacagaggagatttcaaatgttaatttttaacctggcggcagcgcaaaagatg

SEQ ID NO: 41816 - DNA, 103 bp, Artificial Sequence
  Synthetic Polynucleotide
taatacgactcactatagggtttattgttcaggatgtgtggaacatatgcaacagaggagagcatatatgccacacatcaacctggcggcagcgcaaaagatg

SEQ ID NO: 41817 - DNA, 103 bp, Artificial Sequence
  Synthetic Polynucleotide
taatacgactcactatagggatcaaagcttatttcaaaaaaattaaacataacagaggagaatgtttatgttttttgaaaacctggcggcagcgcaaaagatg

SEQ ID NO: 41818 - DNA, 103 bp, Artificial Sequence
  Synthetic Polynucleotide
taatacgactcactataggggctttatcaaagcttatttcaaaaaaattaaacagaggagataatttatgtgaaataagaacctggcggcagcgcaaaagatg

SEQ ID NO: 41819 - DNA, 103 bp, Artificial Sequence
  Synthetic Polynucleotide
taatacgactcactatagggggaaggctttatcaaagcttatttcaaaaaaacagaggagatttttgatgtaagctttgaacctggcggcagcgcaaaagatg

SEQ ID NO: 41820 - DNA, 103 bp, Artificial Sequence
  Synthetic Polynucleotide
taatacgactcactatagggtgcaaggaaggctttatcaaagcttatttcaacagaggagagaaataatgtttgataaaaacctggcggcagcgcaaaagatg

SEQ ID NO: 41821 - DNA, 103 bp, Artificial Sequence
  Synthetic Polynucleotide
taatacgactcactataggggaatttgcaaggaaggctttatcaaagcttaacagaggagaaagcttatgtaaagccttaacctggcggcagcgcaaaagatg

SEQ ID NO: 41822 - DNA, 103 bp, Artificial Sequence
  Synthetic Polynucleotide
taatacgactcactatagggatccggaatttgcaaggaaggctttatcaaaacagaggagattgataatgccttccttgaacctggcggcagcgcaaaagatg

SEQ ID NO: 41823 - DNA, 103 bp, Artificial Sequence
  Synthetic Polynucleotide
taatacgactcactatagggcatgtatccggaatttgcaaggaaggctttaacagaggagaaaagccatgcttgcaaataacctggcggcagcgcaaaagatg

SEQ ID NO: 41824 - DNA, 103 bp, Artificial Sequence
  Synthetic Polynucleotide
taatacgactcactatagggatgttcatgtatccggaatttgcaaggaagaacagaggagacttcctatgaaattccggaacctggcggcagcgcaaaagatg

SEQ ID NO: 41825 - DNA, 103 bp, Artificial Sequence
  Synthetic Polynucleotide
taatacgactcactataggggcgacatgttcatgtatccggaatttgcaaaacagaggagattgcaaatgccggatacaaacctggcggcagcgcaaaagatg

SEQ ID NO: 41826 - DNA, 103 bp, Artificial Sequence
  Synthetic Polynucleotide
taatacgactcactatagggtgtcggcgacatgttcatgtatccggaattaacagaggagaaattccatgtacatgaacaacctggcggcagcgcaaaagatg

SEQ ID NO: 41827 - DNA, 103 bp, Artificial Sequence
  Synthetic Polynucleotide
taatacgactcactatagggagaattttattgttcaggatgtgtggaacaaacagaggagatgttccatgcatcctgaaaacctggcggcagcgcaaaagatg

SEQ ID NO: 41828 - DNA, 103 bp, Artificial Sequence
  Synthetic Polynucleotide
taatacgactcactatagggattcatgtcggcgacatgttcatgtatccgaacagaggagacggataatggaacatgtcaacctggcggcagcgcaaaagatg

SEQ ID NO: 41829 - DNA, 103 bp, Artificial Sequence
  Synthetic Polynucleotide
taatacgactcactatagggtactcattcatgtcggcgacatgttcatgtaacagaggagaacatgaatgtgtcgccgaaacctggcggcagcgcaaaagatg

SEQ ID NO: 41830 - DNA, 103 bp, Artificial Sequence
  Synthetic Polynucleotide
taatacgactcactatagggaaaaatactcattcatgtcggcgacatgttaacagaggagaaacatgatgccgacatgaaacctggcggcagcgcaaaagatg

SEQ ID NO: 41831 - DNA, 103 bp, Artificial Sequence
  Synthetic Polynucleotide
taatacgactcactatagggtgaaaaaaaatactcattcatgtcggcgacaacagaggagagtcgccatgatgaatgagaacctggcggcagcgcaaaagatg

SEQ ID NO: 41832 - DNA, 103 bp, Artificial Sequence
  Synthetic Polynucleotide
taatacgactcactatagggaatactgaaaaaaaatactcattcatgtcgaacagaggagacgacatatgtgagtatttaacctggcggcagcgcaaaagatg

SEQ ID NO: 41833 - DNA, 103 bp, Artificial Sequence
  Synthetic Polynucleotide
taatacgactcactatagggtataaaatactgaaaaaaaatactcattcaaacagaggagatgaatgatgattttttttaacctggcggcagcgcaaaagatg

SEQ ID NO: 41834 - DNA, 103 bp, Artificial Sequence
  Synthetic Polynucleotide
taatacgactcactatagggaaaaatataaaatactgaaaaaaaatactcaacagaggagagagtatatgttttcagtaaacctggcggcagcgcaaaagatg

SEQ ID NO: 41835 - DNA, 103 bp, Artificial Sequence
  Synthetic Polynucleotide
taatacgactcactatagggttaagaaaaatataaaatactgaaaaaaaaaacagaggagattttttatgagtattttaaacctggcggcagcgcaaaagatg

SEQ ID NO: 41836 - DNA, 103 bp, Artificial Sequence
  Synthetic Polynucleotide
taatacgactcactatagggacttgttaagaaaaatataaaatactgaaaaacagaggagatttcagatgtttatatttaacctggcggcagcgcaaaagatg

SEQ ID NO: 41837 - DNA, 103 bp, Artificial Sequence
  Synthetic Polynucleotide
taatacgactcactatagggtgagaacttgttaagaaaaatataaaatacaacagaggagagtatttatgatttttcttaacctggcggcagcgcaaaagatg

SEQ ID NO: 41838 - DNA, 103 bp, Artificial Sequence
  Synthetic Polynucleotide
taatacgactcactatagggtctggagaattttattgttcaggatgtgtgaacagaggagacacacaatgtgaacaataaacctggcggcagcgcaaaagatg

SEQ ID NO: 41839 - DNA, 103 bp, Artificial Sequence
  Synthetic Polynucleotide
taatacgactcactatagggtgtattgagaacttgttaagaaaaatataaaacagaggagattatatatgtcttaacaaaacctggcggcagcgcaaaagatg

SEQ ID NO: 41840 - DNA, 103 bp, Artificial Sequence
  Synthetic Polynucleotide
taatacgactcactatagggattggtgtattgagaacttgttaagaaaaaaacagaggagatttttcatgacaagttctaacctggcggcagcgcaaaagatg

SEQ ID NO: 41841 - DNA, 103 bp, Artificial Sequence
  Synthetic Polynucleotide
taatacgactcactatagggcatctattggtgtattgagaacttgttaagaacagaggagacttaacatgttctcaataaacctggcggcagcgcaaaagatg

SEQ ID NO: 41842 - DNA, 103 bp, Artificial Sequence
  Synthetic Polynucleotide
taatacgactcactatagggtctatcatctattggtgtattgagaacttgaacagaggagacaagttatgaatacaccaaacctggcggcagcgcaaaagatg

SEQ ID NO: 41843 - DNA, 103 bp, Artificial Sequence
  Synthetic Polynucleotide
taatacgactcactataggggatattctatcatctattggtgtattgagaaacagaggagatctcaaatgaccaatagaaacctggcggcagcgcaaaagatg

SEQ ID NO: 41844 - DNA, 103 bp, Artificial Sequence
  Synthetic Polynucleotide
taatacgactcactatagggtgggtgatattctatcatctattggtgtataacagaggagaatacacatgtagatgataaacctggcggcagcgcaaaagatg

SEQ ID NO: 41845 - DNA, 103 bp, Artificial Sequence
  Synthetic Polynucleotide
taatacgactcactatagggcgcattgggtgatattctatcatctattggaacagaggagaccaataatggatagaataaacctggcggcagcgcaaaagatg

SEQ ID NO: 41846 - DNA, 103 bp, Artificial Sequence
  Synthetic Polynucleotide
taatacgactcactatagggatggacgcattgggtgatattctatcatctaacagaggagaagatgaatgaatatcaccaacctggcggcagcgcaaaagatg

SEQ ID NO: 41847 - DNA, 103 bp, Artificial Sequence
  Synthetic Polynucleotide
taatacgactcactatagggacaacatggacgcattgggtgatattctataacagaggagaatagaaatgcacccaatgaacctggcggcagcgcaaaagatg

SEQ ID NO: 41848 - DNA, 103 bp, Artificial Sequence
  Synthetic Polynucleotide
taatacgactcactatagggaatagacaacatggacgcattgggtgatataacagaggagaatatcaatgaatgcgtccaacctggcggcagcgcaaaagatg

SEQ ID NO: 41849 - DNA, 103 bp, Artificial Sequence
  Synthetic Polynucleotide
taatacgactcactatagggcatcatctggagaattttattgttcaggataacagaggagaatcctgatgaataaaattaacctggcggcagcgcaaaagatg

SEQ ID NO: 41850 - DNA, 103 bp, Artificial Sequence
  Synthetic Polynucleotide
taatacgactcactatagggttggaaatagacaacatggacgcattgggtaacagaggagaacccaaatggtccatgttaacctggcggcagcgcaaaagatg

SEQ ID NO: 41851 - DNA, 103 bp, Artificial Sequence
  Synthetic Polynucleotide
taatacgactcactatagggacctgttggaaatagacaacatggacgcataacagaggagaatgcgtatgtgttgtctaaacctggcggcagcgcaaaagatg

SEQ ID NO: 41852 - DNA, 103 bp, Artificial Sequence
  Synthetic Polynucleotide
taatacgactcactatagggtagcgacctgttggaaatagacaacatggaaacagaggagatccatgatgtctatttccaacctggcggcagcgcaaaagatg

SEQ ID NO: 41853 - DNA, 103 bp, Artificial Sequence
  Synthetic Polynucleotide
taatacgactcactatagggggatatagcgacctgttggaaatagacaacaacagaggagagttgtcatgttccaacagaacctggcggcagcgcaaaagatg

SEQ ID NO: 41854 - DNA, 103 bp, Artificial Sequence
  Synthetic Polynucleotide
taatacgactcactatagggttggtggatatagcgacctgttggaaatagaacagaggagactatttatgacaggtcgcaacctggcggcagcgcaaaagatg

SEQ ID NO: 41855 - DNA, 103 bp, Artificial Sequence
  Synthetic Polynucleotide
taatacgactcactatagggttctattggtggatatagcgacctgttggaaacagaggagatccaacatgtcgctatataacctggcggcagcgcaaaagatg

SEQ ID NO: 41856 - DNA, 103 bp, Artificial Sequence
  Synthetic Polynucleotide
taatacgactcactatagggaaaacttctattggtggatatagcgacctgaacagaggagacaggtcatgatatccaccaacctggcggcagcgcaaaagatg

SEQ ID NO: 41857 - DNA, 103 bp, Artificial Sequence
  Synthetic Polynucleotide
taatacgactcactatagggttgggaaaacttctattggtggatatagcgaacagaggagacgctatatgcaccaatagaacctggcggcagcgcaaaagatg

SEQ ID NO: 41858 - DNA, 103 bp, Artificial Sequence
  Synthetic Polynucleotide
taatacgactcactatagggattttttgggaaaacttctattggtggataaacagaggagatatccaatgatagaagttaacctggcggcagcgcaaaagatg

SEQ ID NO: 41859 - DNA, 103 bp, Artificial Sequence
  Synthetic Polynucleotide
taatacgactcactatagggagaatattttttgggaaaacttctattggtaacagaggagaaccaatatgagttttcccaacctggcggcagcgcaaaagatg

SEQ ID NO: 41860 - DNA, 103 bp, Artificial Sequence
  Synthetic Polynucleotide
taatacgactcactatagggtgtaacatcatctggagaattttattgttcaacagaggagagaacaaatgaattctccaaacctggcggcagcgcaaaagatg

SEQ ID NO: 41861 - DNA, 103 bp, Artificial Sequence
  Synthetic Polynucleotide
taatacgactcactatagggttcctagaatattttttgggaaaacttctaaacagaggagatagaagatgtcccaaaaaaacctggcggcagcgcaaaagatg

SEQ ID NO: 41862 - DNA, 103 bp, Artificial Sequence
  Synthetic Polynucleotide
taatacgactcactatagggaactgttcctagaatattttttgggaaaacaacagaggagagttttcatgaaaaatattaacctggcggcagcgcaaaagatg

SEQ ID NO: 41863 - DNA, 103 bp, Artificial Sequence
  Synthetic Polynucleotide
taatacgactcactatagggggtagaactgttcctagaatattttttgggaacagaggagacccaaaatgtattctaggaacctggcggcagcgcaaaagatg

SEQ ID NO: 41864 - DNA, 103 bp, Artificial Sequence
  Synthetic Polynucleotide
taatacgactcactatagggctggtggtagaactgttcctagaatattttaacagaggagaaaaataatgtaggaacagaacctggcggcagcgcaaaagatg

SEQ ID NO: 41865 - DNA, 103 bp, Artificial Sequence
  Synthetic Polynucleotide
taatacgactcactatagggaattactggtggtagaactgttcctagaataacagaggagaattctaatgacagttctaaacctggcggcagcgcaaaagatg

SEQ ID NO: 41866 - DNA, 103 bp, Artificial Sequence
  Synthetic Polynucleotide
taatacgactcactataggggaacaaattactggtggtagaactgttcctaacagaggagaaggaacatgtctaccaccaacctggcggcagcgcaaaagatg

SEQ ID NO: 41867 - DNA, 103 bp, Artificial Sequence
  Synthetic Polynucleotide
taatacgactcactatagggattttgaacaaattactggtggtagaactgaacagaggagacagttcatgcaccagtaaaacctggcggcagcgcaaaagatg

SEQ ID NO: 41868 - DNA, 103 bp, Artificial Sequence
  Synthetic Polynucleotide
taatacgactcactatagggcgactattttgaacaaattactggtggtagaacagaggagactaccaatggtaatttgtaacctggcggcagcgcaaaagatg

SEQ ID NO: 41869 - DNA, 103 bp, Artificial Sequence
  Synthetic Polynucleotide
taatacgactcactatagggttgcacgactattttgaacaaattactggtaacagaggagaaccagtatgttgttcaaaaacctggcggcagcgcaaaagatg

SEQ ID NO: 41870 - DNA, 103 bp, Artificial Sequence
  Synthetic Polynucleotide
taatacgactcactatagggataaattgcacgactattttgaacaaattaaacagaggagataatttatgcaaaatagtaacctggcggcagcgcaaaagatg

SEQ ID NO: 41871 - DNA, 103 bp, Artificial Sequence
  Synthetic Polynucleotide
taatacgactcactataggggacattgtaacatcatctggagaattttataacagaggagaataaaaatgtccagatgaaacctggcggcagcgcaaaagatg

SEQ ID NO: 41872 - DNA, 103 bp, Artificial Sequence
  Synthetic Polynucleotide
taatacgactcactatagggcgaaaataaattgcacgactattttgaacaaacagaggagatgttcaatgtagtcgtgcaacctggcggcagcgcaaaagatg

SEQ ID NO: 41873 - DNA, 103 bp, Artificial Sequence
  Synthetic Polynucleotide
taatacgactcactatagggaaacccgaaaataaattgcacgactattttaacagaggagaaaaataatggtgcaatttaacctggcggcagcgcaaaagatg

SEQ ID NO: 41874 - DNA, 103 bp, Artificial Sequence
  Synthetic Polynucleotide
taatacgactcactatagggaatttaaacccgaaaataaattgcacgactaacagaggagaagtcgtatgatttattttaacctggcggcagcgcaaaagatg

SEQ ID NO: 41875 - DNA, 103 bp, Artificial Sequence
  Synthetic Polynucleotide
taatacgactcactatagggtaaagaatttaaacccgaaaataaattgcaaacagaggagatgcaatatgttttcgggtaacctggcggcagcgcaaaagatg

SEQ ID NO: 41876 - DNA, 103 bp, Artificial Sequence
  Synthetic Polynucleotide
taatacgactcactataggggatattaaagaatttaaacccgaaaataaaaacagaggagatttattatggggtttaaaaacctggcggcagcgcaaaagatg

SEQ ID NO: 41877 - DNA, 103 bp, Artificial Sequence
  Synthetic Polynucleotide
taatacgactcactatagggttgtcgatattaaagaatttaaacccgaaaaacagaggagatttcggatgtaaattcttaacctggcggcagcgcaaaagatg

SEQ ID NO: 41878 - DNA, 103 bp, Artificial Sequence
  Synthetic Polynucleotide
taatacgactcactatagggtgaaattgtcgatattaaagaatttaaaccaacagaggagaggtttaatgtctttaataaacctggcggcagcgcaaaagatg

SEQ ID NO: 41879 - DNA, 103 bp, Artificial Sequence
  Synthetic Polynucleotide
taatacgactcactataggggcgtatgaaattgtcgatattaaagaatttaacagaggagaaaattcatgaatatcgacaacctggcggcagcgcaaaagatg

SEQ ID NO: 41880 - DNA, 103 bp, Artificial Sequence
  Synthetic Polynucleotide
taatacgactcactataggggaggagcgtatgaaattgtcgatattaaagaacagaggagactttaaatgcgacaatttaacctggcggcagcgcaaaagatg

SEQ ID NO: 41881 - DNA, 103 bp, Artificial Sequence
  Synthetic Polynucleotide
taatacgactcactatagggcaaaagaggagcgtatgaaattgtcgatataacagaggagaatatcgatgatttcatacaacctggcggcagcgcaaaagatg

SEQ ID NO: 41882 - DNA, 103 bp, Artificial Sequence
  Synthetic Polynucleotide
taatacgactcactatagggatctagacattgtaacatcatctggagaataacagaggagaattctcatgatgatgttaaacctggcggcagcgcaaaagatg

SEQ ID NO: 41883 - DNA, 103 bp, Artificial Sequence
  Synthetic Polynucleotide
taatacgactcactatagggagtttcaaaagaggagcgtatgaaattgtcaacagaggagagacaatatgatacgctccaacctggcggcagcgcaaaagatg

SEQ ID NO: 41884 - DNA, 103 bp, Artificial Sequence
  Synthetic Polynucleotide
taatacgactcactatagggagtttagtttcaaaagaggagcgtatgaaaaacagaggagatttcatatgctcctctttaacctggcggcagcgcaaaagatg

SEQ ID NO: 41885 - DNA, 103 bp, Artificial Sequence
  Synthetic Polynucleotide
taatacgactcactatagggaaataagtttagtttcaaaagaggagcgtaaacagaggagatacgctatgcttttgaaaaacctggcggcagcgcaaaagatg

SEQ ID NO: 41886 - DNA, 103 bp, Artificial Sequence
  Synthetic Polynucleotide
taatacgactcactatagggattctaaataagtttagtttcaaaagaggaaacagaggagatcctctatggaaactaaaaacctggcggcagcgcaaaagatg

SEQ ID NO: 41887 - DNA, 103 bp, Artificial Sequence
  Synthetic Polynucleotide
taatacgactcactatagggtggatattctaaataagtttagtttcaaaaaacagaggagattttgaatgtaaacttataacctggcggcagcgcaaaagatg

SEQ ID NO: 41888 - DNA, 103 bp, Artificial Sequence
  Synthetic Polynucleotide
taatacgactcactatagggcgcactggatattctaaataagtttagtttaacagaggagaaaactaatgttatttagaaacctggcggcagcgcaaaagatg

SEQ ID NO: 41889 - DNA, 103 bp, Artificial Sequence
  Synthetic Polynucleotide
taatacgactcactatagggagaaacgcactggatattctaaataagtttaacagaggagaaaacttatgtagaatatcaacctggcggcagcgcaaaagatg

SEQ ID NO: 41890 - DNA, 103 bp, Artificial Sequence
  Synthetic Polynucleotide
taatacgactcactatagggtttgtagaaacgcactggatattctaaataaacagaggagatatttaatgtatccagtgaacctggcggcagcgcaaaagatg

SEQ ID NO: 41891 - DNA, 103 bp, Artificial Sequence
  Synthetic Polynucleotide
taatacgactcactatagggtcctttttgtagaaacgcactggatattctaacagaggagaagaataatgagtgcgtttaacctggcggcagcgcaaaagatg

SEQ ID NO: 41892 - DNA, 103 bp, Artificial Sequence
  Synthetic Polynucleotide
taatacgactcactatagggacatgtcctttttgtagaaacgcactggataacagaggagaatccagatggtttctacaaacctggcggcagcgcaaaagatg

SEQ ID NO: 41893 - DNA, 103 bp, Artificial Sequence
  Synthetic Polynucleotide
taatacgactcactatagggtccaaatctagacattgtaacatcatctggaacagaggagaccagatatggttacaatgaacctggcggcagcgcaaaagatg

SEQ ID NO: 41894 - DNA, 103 bp, Artificial Sequence
  Synthetic Polynucleotide
taatacgactcactatagggagtttacatgtcctttttgtagaaacgcacaacagaggagagtgcgtatgtacaaaaagaacctggcggcagcgcaaaagatg

SEQ ID NO: 41895 - DNA, 103 bp, Artificial Sequence
  Synthetic Polynucleotide
taatacgactcactatagggtgtcaagtttacatgtcctttttgtagaaaaacagaggagatttctaatgaaaggacataacctggcggcagcgcaaaagatg

SEQ ID NO: 41896 - DNA, 103 bp, Artificial Sequence
  Synthetic Polynucleotide
taatacgactcactatagggatttttgtcaagtttacatgtcctttttgtaacagaggagaacaaaaatgacatgtaaaaacctggcggcagcgcaaaagatg

SEQ ID NO: 41897 - DNA, 103 bp, Artificial Sequence
  Synthetic Polynucleotide
taatacgactcactatagggtcacaatttttgtcaagtttacatgtccttaacagaggagaaaggacatgtaaacttgaaacctggcggcagcgcaaaagatg

SEQ ID NO: 41898 - DNA, 103 bp, Artificial Sequence
  Synthetic Polynucleotide
taatacgactcactatagggcaaagtcacaatttttgtcaagtttacatgaacagaggagacatgtaatgttgacaaaaaacctggcggcagcgcaaaagatg

SEQ ID NO: 41899 - DNA, 103 bp, Artificial Sequence
  Synthetic Polynucleotide
taatacgactcactatagggaataacaaagtcacaatttttgtcaagtttaacagaggagaaaacttatgaaaaattgtaacctggcggcagcgcaaaagatg

SEQ ID NO: 41900 - DNA, 103 bp, Artificial Sequence
  Synthetic Polynucleotide
taatacgactcactatagggtgaccaataacaaagtcacaatttttgtcaaacagaggagatgacaaatgttgtgacttaacctggcggcagcgcaaaagatg

SEQ ID NO: 41901 - DNA, 103 bp, Artificial Sequence
  Synthetic Polynucleotide
taatacgactcactatagggaaggttgaccaataacaaagtcacaattttaacagaggagaaaaattatgactttgttaaacctggcggcagcgcaaaagatg

SEQ ID NO: 41902 - DNA, 103 bp, Artificial Sequence
  Synthetic Polynucleotide
taatacgactcactatagggcaacaaaggttgaccaataacaaagtcacaaacagaggagatgtgacatggttattggtaacctggcggcagcgcaaaagatg

SEQ ID NO: 41903 - DNA, 103 bp, Artificial Sequence
  Synthetic Polynucleotide
taatacgactcactatagggttgtacaacaaaggttgaccaataacaaagaacagaggagactttgtatgtggtcaaccaacctggcggcagcgcaaaagatg

SEQ ID NO: 41904 - DNA, 103 bp, Artificial Sequence
  Synthetic Polynucleotide
taatacgactcactatagggtttcatcagaaatgactccatgaaaaccgcaacagaggagagcggttatgatggagtcaaacctggcggcagcgcaaaagatg

SEQ ID NO: 41905 - DNA, 103 bp, Artificial Sequence
  Synthetic Polynucleotide
taatacgactcactatagggaaatgtccaaatctagacattgtaacatcaaacagaggagatgatgtatgaatgtctagaacctggcggcagcgcaaaagatg

SEQ ID NO: 41906 - DNA, 103 bp, Artificial Sequence
  Synthetic Polynucleotide
taatacgactcactatagggggaatttgtacaacaaaggttgaccaataaaacagaggagattattgatgaacctttgtaacctggcggcagcgcaaaagatg

SEQ ID NO: 41907 - DNA, 103 bp, Artificial Sequence
  Synthetic Polynucleotide
taatacgactcactataggggccgaggaatttgtacaacaaaggttgaccaacagaggagaggtcaaatgttgttgtacaacctggcggcagcgcaaaagatg

SEQ ID NO: 41908 - DNA, 103 bp, Artificial Sequence
  Synthetic Polynucleotide
taatacgactcactatagggaaatggccgaggaatttgtacaacaaaggtaacagaggagaacctttatggtacaaattaacctggcggcagcgcaaaagatg

SEQ ID NO: 41909 - DNA, 103 bp, Artificial Sequence
  Synthetic Polynucleotide
taatacgactcactatagggtattaaaatggccgaggaatttgtacaacaaacagaggagatgttgtatgaattcctcgaacctggcggcagcgcaaaagatg

SEQ ID NO: 41910 - DNA, 103 bp, Artificial Sequence
  Synthetic Polynucleotide
taatacgactcactatagggttaaatattaaaatggccgaggaatttgtaaacagaggagatacaaaatgctcggccataacctggcggcagcgcaaaagatg

SEQ ID NO: 41911 - DNA, 103 bp, Artificial Sequence
  Synthetic Polynucleotide
taatacgactcactatagggatcacttaaatattaaaatggccgaggaataacagaggagaattcctatgccattttaaaacctggcggcagcgcaaaagatg

SEQ ID NO: 41912 - DNA, 103 bp, Artificial Sequence
  Synthetic Polynucleotide
taatacgactcactatagggtttatatcacttaaatattaaaatggccgaaacagaggagatcggccatgttaatatttaacctggcggcagcgcaaaagatg

SEQ ID NO: 41913 - DNA, 103 bp, Artificial Sequence
  Synthetic Polynucleotide
taatacgactcactatagggaatgttttatatcacttaaatattaaaatgaacagaggagacattttatgatttaagtgaacctggcggcagcgcaaaagatg

SEQ ID NO: 41914 - DNA, 103 bp, Artificial Sequence
  Synthetic Polynucleotide
taatacgactcactatagggtcgagaatgttttatatcacttaaatattaaacagaggagataatatatgagtgatataaacctggcggcagcgcaaaagatg

SEQ ID NO: 41915 - DNA, 103 bp, Artificial Sequence
  Synthetic Polynucleotide
taatacgactcactatagggataagtcgagaatgttttatatcacttaaaaacagaggagatttaagatgtataaaacaaacctggcggcagcgcaaaagatg

SEQ ID NO: 41916 - DNA, 103 bp, Artificial Sequence
  Synthetic Polynucleotide
taatacgactcactatagggaaaccaaatgtccaaatctagacattgtaaaacagaggagattacaaatgctagatttgaacctggcggcagcgcaaaagatg

SEQ ID NO: 41917 - DNA, 103 bp, Artificial Sequence
  Synthetic Polynucleotide
taatacgactcactataggggttaaataagtcgagaatgttttatatcacaacagaggagagtgataatgaacattctcaacctggcggcagcgcaaaagatg

SEQ ID NO: 41918 - DNA, 103 bp, Artificial Sequence
  Synthetic Polynucleotide
taatacgactcactatagggaaagagttaaataagtcgagaatgttttataacagaggagaataaaaatgtctcgacttaacctggcggcagcgcaaaagatg

SEQ ID NO: 41919 - DNA, 103 bp, Artificial Sequence
  Synthetic Polynucleotide
taatacgactcactatagggcgactaaagagttaaataagtcgagaatgtaacagaggagaacattcatgacttatttaaacctggcggcagcgcaaaagatg

SEQ ID NO: 41920 - DNA, 103 bp, Artificial Sequence
  Synthetic Polynucleotide
taatacgactcactatagggtatctcgactaaagagttaaataagtcgagaacagaggagactcgacatgtttaactctaacctggcggcagcgcaaaagatg

SEQ ID NO: 41921 - DNA, 103 bp, Artificial Sequence
  Synthetic Polynucleotide
taatacgactcactatagggccatatatctcgactaaagagttaaataagaacagaggagacttattatgctctttagtaacctggcggcagcgcaaaagatg

SEQ ID NO: 41922 - DNA, 103 bp, Artificial Sequence
  Synthetic Polynucleotide
taatacgactcactatagggtgcgtccatatatctcgactaaagagttaaaacagaggagattaactatgtagtcgagaaacctggcggcagcgcaaaagatg

SEQ ID NO: 41923 - DNA, 103 bp, Artificial Sequence
  Synthetic Polynucleotide
taatacgactcactatagggctatctgcgtccatatatctcgactaaagaaacagaggagatctttaatggagatatataacctggcggcagcgcaaaagatg

SEQ ID NO: 41924 - DNA, 103 bp, Artificial Sequence
  Synthetic Polynucleotide
taatacgactcactatagggtatagctatctgcgtccatatatctcgactaacagaggagaagtcgaatgatatggacgaacctggcggcagcgcaaaagatg

SEQ ID NO: 41925 - DNA, 103 bp, Artificial Sequence
  Synthetic Polynucleotide
taatacgactcactatagggtatcatatagctatctgcgtccatatatctaacagaggagaagatatatggacgcagataacctggcggcagcgcaaaagatg

SEQ ID NO: 41926 - DNA, 103 bp, Artificial Sequence
  Synthetic Polynucleotide
taatacgactcactatagggttggttatcatatagctatctgcgtccataaacagaggagatatggaatgagatagctaaacctggcggcagcgcaaaagatg

SEQ ID NO: 41927 - DNA, 103 bp, Artificial Sequence
  Synthetic Polynucleotide
taatacgactcactatagggggttgaaaccaaatgtccaaatctagacataacagaggagaatgtctatgtttggacataacctggcggcagcgcaaaagatg

SEQ ID NO: 41928 - DNA, 103 bp, Artificial Sequence
  Synthetic Polynucleotide
taatacgactcactatagggtgtagttggttatcatatagctatctgcgtaacagaggagaacgcagatggctatatgaaacctggcggcagcgcaaaagatg

SEQ ID NO: 41929 - DNA, 103 bp, Artificial Sequence
  Synthetic Polynucleotide
taatacgactcactatagggccttctgtagttggttatcatatagctatcaacagaggagagatagcatgatgataaccaacctggcggcagcgcaaaagatg

SEQ ID NO: 41930 - DNA, 103 bp, Artificial Sequence
  Synthetic Polynucleotide
taatacgactcactataggggttcgccttctgtagttggttatcatatagaacagaggagactatatatgaaccaactaaacctggcggcagcgcaaaagatg

SEQ ID NO: 41931 - DNA, 103 bp, Artificial Sequence
  Synthetic Polynucleotide
taatacgactcactatagggatagcgttcgccttctgtagttggttatcaaacagaggagatgataaatgactacagaaaacctggcggcagcgcaaaagatg

SEQ ID NO: 41932 - DNA, 103 bp, Artificial Sequence
  Synthetic Polynucleotide
taatacgactcactatagggtttttatagcgttcgccttctgtagttggtaacagaggagaaccaacatgagaaggcgaaacctggcggcagcgcaaaagatg

SEQ ID NO: 41933 - DNA, 103 bp, Artificial Sequence
  Synthetic Polynucleotide
taatacgactcactatagggtatgttttttatagcgttcgccttctgtagaacagaggagactacagatggcgaacgctaacctggcggcagcgcaaaagatg

SEQ ID NO: 41934 - DNA, 103 bp, Artificial Sequence
  Synthetic Polynucleotide
taatacgactcactataggggtaattatgttttttatagcgttcgccttcaacagaggagagaaggcatgcgctataaaaacctggcggcagcgcaaaagatg

SEQ ID NO: 41935 - DNA, 103 bp, Artificial Sequence
  Synthetic Polynucleotide
taatacgactcactatagggtcgtcgtaattatgttttttatagcgttcgaacagaggagacgaacgatgtaaaaaacaaacctggcggcagcgcaaaagatg

SEQ ID NO: 41936 - DNA, 103 bp, Artificial Sequence
  Synthetic Polynucleotide
taatacgactcactatagggtatgctcgtcgtaattatgttttttatagcaacagaggagagctataatgaacataattaacctggcggcagcgcaaaagatg

SEQ ID NO: 41937 - DNA, 103 bp, Artificial Sequence
  Synthetic Polynucleotide
taatacgactcactatagggatgaatatgctcgtcgtaattatgttttttaacagaggagaaaaaaaatgaattacgacaacctggcggcagcgcaaaagatg

SEQ ID NO: 41938 - DNA, 103 bp, Artificial Sequence
  Synthetic Polynucleotide
taatacgactcactatagggaacgcggttgaaaccaaatgtccaaatctaaacagaggagatagattatgacatttggtaacctggcggcagcgcaaaagatg

SEQ ID NO: 41939 - DNA, 103 bp, Artificial Sequence
  Synthetic Polynucleotide
taatacgactcactatagggtatttatgaatatgctcgtcgtaattatgtaacagaggagaacataaatgcgacgagcaaacctggcggcagcgcaaaagatg

SEQ ID NO: 41940 - DNA, 103 bp, Artificial Sequence
  Synthetic Polynucleotide
taatacgactcactatagggaaaaatatttatgaatatgctcgtcgtaataacagaggagaattacgatgagcatattcaacctggcggcagcgcaaaagatg

SEQ ID NO: 41941 - DNA, 103 bp, Artificial Sequence
  Synthetic Polynucleotide
taatacgactcactatagggtgaataaaaatatttatgaatatgctcgtcaacagaggagagacgagatgattcataaaaacctggcggcagcgcaaaagatg

SEQ ID NO: 41942 - DNA, 103 bp, Artificial Sequence
  Synthetic Polynucleotide
taatacgactcactatagggaatgctgaataaaaatatttatgaatatgcaacagaggagagcatatatgtaaatatttaacctggcggcagcgcaaaagatg

SEQ ID NO: 41943 - DNA, 103 bp, Artificial Sequence
  Synthetic Polynucleotide
taatacgactcactatagggcaagtaatgctgaataaaaatatttatgaaaacagaggagattcataatgatttttattaacctggcggcagcgcaaaagatg

SEQ ID NO: 41944 - DNA, 103 bp, Artificial Sequence
  Synthetic Polynucleotide
taatacgactcactatagggtatatcaagtaatgctgaataaaaatatttaacagaggagaaaatatatgtattcagcaaacctggcggcagcgcaaaagatg

SEQ ID NO: 41945 - DNA, 103 bp, Artificial Sequence
  Synthetic Polynucleotide
taatacgactcactatagggattactatatcaagtaatgctgaataaaaaaacagaggagatttttaatgagcattactaacctggcggcagcgcaaaagatg

SEQ ID NO: 41946 - DNA, 103 bp, Artificial Sequence
  Synthetic Polynucleotide
taatacgactcactatagggctaatattactatatcaagtaatgctgaataacagaggagaattcagatgtacttgataaacctggcggcagcgcaaaagatg

SEQ ID NO: 41947 - DNA, 103 bp, Artificial Sequence
  Synthetic Polynucleotide
taatacgactcactatagggtgtgcctaatattactatatcaagtaatgcaacagaggagagcattaatggatatagtaaacctggcggcagcgcaaaagatg

SEQ ID NO: 41948 - DNA, 103 bp, Artificial Sequence
  Synthetic Polynucleotide
taatacgactcactatagggttgactgtgcctaatattactatatcaagtaacagaggagaacttgaatgagtaatattaacctggcggcagcgcaaaagatg

SEQ ID NO: 41949 - DNA, 103 bp, Artificial Sequence
  Synthetic Polynucleotide
taatacgactcactatagggatgttaacgcggttgaaaccaaatgtccaaaacagaggagattggacatgtggtttcaaaacctggcggcagcgcaaaagatg

SEQ ID NO: 41950 - DNA, 103 bp, Artificial Sequence
  Synthetic Polynucleotide
taatacgactcactatagggaatgtttgactgtgcctaatattactatataacagaggagaatatagatgtattaggcaaacctggcggcagcgcaaaagatg

SEQ ID NO: 41951 - DNA, 103 bp, Artificial Sequence
  Synthetic Polynucleotide
taatacgactcactatagggggttgaatgtttgactgtgcctaatattacaacagaggagagtaataatgggcacagtcaacctggcggcagcgcaaaagatg

SEQ ID NO: 41952 - DNA, 103 bp, Artificial Sequence
  Synthetic Polynucleotide
taatacgactcactatagggagagtggttgaatgtttgactgtgcctaataacagaggagaattaggatgagtcaaacaaacctggcggcagcgcaaaagatg

SEQ ID NO: 41953 - DNA, 103 bp, Artificial Sequence
  Synthetic Polynucleotide
taatacgactcactatagggtatcgagagtggttgaatgtttgactgtgcaacagaggagagcacagatgaacattcaaaacctggcggcagcgcaaaagatg

SEQ ID NO: 41954 - DNA, 103 bp, Artificial Sequence
  Synthetic Polynucleotide
taatacgactcactatagggtgatgtatcgagagtggttgaatgtttgacaacagaggagagtcaaaatgtcaaccactaacctggcggcagcgcaaaagatg

SEQ ID NO: 41955 - DNA, 103 bp, Artificial Sequence
  Synthetic Polynucleotide
taatacgactcactatagggagagttgatgtatcgagagtggttgaatgtaacagaggagaacattcatgcactctcgaaacctggcggcagcgcaaaagatg

SEQ ID NO: 41956 - DNA, 103 bp, Artificial Sequence
  Synthetic Polynucleotide
taatacgactcactatagggatgagagagttgatgtatcgagagtggttgaacagaggagacaaccaatgtcgatacataacctggcggcagcgcaaaagatg

SEQ ID NO: 41957 - DNA, 103 bp, Artificial Sequence
  Synthetic Polynucleotide
taatacgactcactatagggagaaaatgagagagttgatgtatcgagagtaacagaggagaactctcatgacatcaactaacctggcggcagcgcaaaagatg

SEQ ID NO: 41958 - DNA, 103 bp, Artificial Sequence
  Synthetic Polynucleotide
taatacgactcactataggggttgaagaaaatgagagagttgatgtatcgaacagaggagacgatacatgaactctctcaacctggcggcagcgcaaaagatg

SEQ ID NO: 41959 - DNA, 103 bp, Artificial Sequence
  Synthetic Polynucleotide
taatacgactcactatagggaatttgttgaagaaaatgagagagttgatgaacagaggagacatcaaatgtctcattttaacctggcggcagcgcaaaagatg

SEQ ID NO: 41960 - DNA, 103 bp, Artificial Sequence
  Synthetic Polynucleotide
taatacgactcactatagggctcatatgttaacgcggttgaaaccaaatgaacagaggagacatttgatgtcaaccgcgaacctggcggcagcgcaaaagatg

SEQ ID NO: 41961 - DNA, 103 bp, Artificial Sequence
  Synthetic Polynucleotide
taatacgactcactatagggtgcagaatttgttgaagaaaatgagagagtaacagaggagaactctcatgttttcttcaaacctggcggcagcgcaaaagatg

SEQ ID NO: 41962 - DNA, 103 bp, Artificial Sequence
  Synthetic Polynucleotide
taatacgactcactataggggatattgcagaatttgttgaagaaaatgagaacagaggagactcattatgttcaacaaaaacctggcggcagcgcaaaagatg

SEQ ID NO: 41963 - DNA, 103 bp, Artificial Sequence
  Synthetic Polynucleotide
taatacgactcactatagggacgaagatattgcagaatttgttgaagaaaaacagaggagatttcttatgcaaattctgaacctggcggcagcgcaaaagatg

SEQ ID NO: 41964 - DNA, 103 bp, Artificial Sequence
  Synthetic Polynucleotide
taatacgactcactatagggtttttacgaagatattgcagaatttgttgaaacagaggagatcaacaatgtctgcaataaacctggcggcagcgcaaaagatg

SEQ ID NO: 41965 - DNA, 103 bp, Artificial Sequence
  Synthetic Polynucleotide
taatacgactcactataggggaatctttttacgaagatattgcagaatttaacagaggagaaaattcatgaatatcttcaacctggcggcagcgcaaaagatg

SEQ ID NO: 41966 - DNA, 103 bp, Artificial Sequence
  Synthetic Polynucleotide
taatacgactcactatagggttcaagaatctttttacgaagatattgcagaacagaggagactgcaaatgcttcgtaaaaacctggcggcagcgcaaaagatg

SEQ ID NO: 41967 - DNA, 103 bp, Artificial Sequence
  Synthetic Polynucleotide
taatacgactcactatagggaaagtttcaagaatctttttacgaagatataacagaggagaatatctatgtaaaaagataacctggcggcagcgcaaaagatg

SEQ ID NO: 41968 - DNA, 103 bp, Artificial Sequence
  Synthetic Polynucleotide
taatacgactcactatagggtctgaaaagtttcaagaatctttttacgaaaacagaggagattcgtaatgagattcttgaacctggcggcagcgcaaaagatg

SEQ ID NO: 41969 - DNA, 103 bp, Artificial Sequence
  Synthetic Polynucleotide
taatacgactcactataggggatattctgaaaagtttcaagaatctttttaacagaggagaaaaaagatgcttgaaactaacctggcggcagcgcaaaagatg

SEQ ID NO: 41970 - DNA, 103 bp, Artificial Sequence
  Synthetic Polynucleotide
taatacgactcactatagggcgatagatattctgaaaagtttcaagaatcaacagaggagagattctatgaacttttcaaacctggcggcagcgcaaaagatg

SEQ ID NO: 41971 - DNA, 103 bp, Artificial Sequence
  Synthetic Polynucleotide
taatacgactcactataggggttcactcatatgttaacgcggttgaaaccaacagaggagaggtttcatgcgcgttaacaacctggcggcagcgcaaaagatg

SEQ ID NO: 41972 - DNA, 103 bp, Artificial Sequence
  Synthetic Polynucleotide
taatacgactcactataggggaagtcgatagatattctgaaaagtttcaaaacagaggagattgaaaatgttcagaataaacctggcggcagcgcaaaagatg

SEQ ID NO: 41973 - DNA, 103 bp, Artificial Sequence
  Synthetic Polynucleotide
taatacgactcactatagggcatctgaagtcgatagatattctgaaaagtaacagaggagaacttttatgaatatctataacctggcggcagcgcaaaagatg

SEQ ID NO: 41974 - DNA, 103 bp, Artificial Sequence
  Synthetic Polynucleotide
taatacgactcactatagggtatttcatctgaagtcgatagatattctgaaacagaggagatcagaaatgctatcgactaacctggcggcagcgcaaaagatg

SEQ ID NO: 41975 - DNA, 103 bp, Artificial Sequence
  Synthetic Polynucleotide
taatacgactcactatagggaacgctatttcatctgaagtcgatagatataacagaggagaatatctatggacttcagaaacctggcggcagcgcaaaagatg

SEQ ID NO: 41976 - DNA, 103 bp, Artificial Sequence
  Synthetic Polynucleotide
taatacgactcactatagggtgacgaacgctatttcatctgaagtcgataaacagaggagatatcgaatgcagatgaaaaacctggcggcagcgcaaaagatg

SEQ ID NO: 41977 - DNA, 103 bp, Artificial Sequence
  Synthetic Polynucleotide
taatacgactcactatagggtatgttgacgaacgctatttcatctgaagtaacagaggagaacttcaatggaaatagcgaacctggcggcagcgcaaaagatg

SEQ ID NO: 41978 - DNA, 103 bp, Artificial Sequence
  Synthetic Polynucleotide
taatacgactcactatagggcatagtatgttgacgaacgctatttcatctaacagaggagaagatgaatgagcgttcgtaacctggcggcagcgcaaaagatg

SEQ ID NO: 41979 - DNA, 103 bp, Artificial Sequence
  Synthetic Polynucleotide
taatacgactcactatagggcaaaacatagtatgttgacgaacgctatttaacagaggagaaaatagatgtcgtcaacaaacctggcggcagcgcaaaagatg

SEQ ID NO: 41980 - DNA, 103 bp, Artificial Sequence
  Synthetic Polynucleotide
taatacgactcactataggggtatacaaaacatagtatgttgacgaacgcaacagaggagagcgttcatgaacatactaaacctggcggcagcgcaaaagatg

SEQ ID NO: 41981 - DNA, 103 bp, Artificial Sequence
  Synthetic Polynucleotide
taatacgactcactatagggtttatgtatacaaaacatagtatgttgacgaacagaggagacgtcaaatgactatgtttaacctggcggcagcgcaaaagatg

SEQ ID NO: 41982 - DNA, 103 bp, Artificial Sequence
  Synthetic Polynucleotide
taatacgactcactataggggctgtgttcactcatatgttaacgcggttgaacagaggagacaaccgatgtaacatatgaacctggcggcagcgcaaaagatg

SEQ ID NO: 41983 - DNA, 103 bp, Artificial Sequence
  Synthetic Polynucleotide
taatacgactcactataggggcgcctttatgtatacaaaacatagtatgtaacagaggagaacatacatggttttgtataacctggcggcagcgcaaaagatg

SEQ ID NO: 41984 - DNA, 103 bp, Artificial Sequence
  Synthetic Polynucleotide
taatacgactcactatagggaatgggcgcctttatgtatacaaaacatagaacagaggagactatgtatggtatacataaacctggcggcagcgcaaaagatg

SEQ ID NO: 41985 - DNA, 103 bp, Artificial Sequence
  Synthetic Polynucleotide
taatacgactcactataggggttgaaatgggcgcctttatgtatacaaaaaacagaggagattttgtatgcataaaggcaacctggcggcagcgcaaaagatg

SEQ ID NO: 41986 - DNA, 103 bp, Artificial Sequence
  Synthetic Polynucleotide
taatacgactcactatagggaaactgttgaaatgggcgcctttatgtataaacagaggagatatacaatgaggcgcccaaacctggcggcagcgcaaaagatg

SEQ ID NO: 41987 - DNA, 103 bp, Artificial Sequence
  Synthetic Polynucleotide
taatacgactcactatagggactagaaactgttgaaatgggcgcctttataacagaggagaataaagatgcccatttcaaacctggcggcagcgcaaaagatg

SEQ ID NO: 41988 - DNA, 103 bp, Artificial Sequence
  Synthetic Polynucleotide
taatacgactcactatagggttgtcactagaaactgttgaaatgggcgccaacagaggagaggcgccatgttcaacagtaacctggcggcagcgcaaaagatg

SEQ ID NO: 41989 - DNA, 103 bp, Artificial Sequence
  Synthetic Polynucleotide
taatacgactcactataggggcattttgtcactagaaactgttgaaatggaacagaggagaccatttatgcagtttctaaacctggcggcagcgcaaaagatg

SEQ ID NO: 41990 - DNA, 103 bp, Artificial Sequence
  Synthetic Polynucleotide
taatacgactcactatagggcgctagcattttgtcactagaaactgttgaaacagaggagatcaacaatgtctagtgacaacctggcggcagcgcaaaagatg

SEQ ID NO: 41991 - DNA, 103 bp, Artificial Sequence
  Synthetic Polynucleotide
taatacgactcactatagggaggatcgctagcattttgtcactagaaactaacagaggagaagtttcatgtgacaaaataacctggcggcagcgcaaaagatg

SEQ ID NO: 41992 - DNA, 103 bp, Artificial Sequence
  Synthetic Polynucleotide
taatacgactcactatagggatcctaggatcgctagcattttgtcactagaacagaggagactagtgatgaaatgctagaacctggcggcagcgcaaaagatg

SEQ ID NO: 41993 - DNA, 103 bp, Artificial Sequence
  Synthetic Polynucleotide
taatacgactcactataggggtatggctgtgttcactcatatgttaacgcaacagaggagagcgttaatgtatgagtgaaacctggcggcagcgcaaaagatg

SEQ ID NO: 41994 - DNA, 103 bp, Artificial Sequence
  Synthetic Polynucleotide
taatacgactcactataggggaaggatcctaggatcgctagcattttgtcaacagaggagagacaaaatgctagcgatcaacctggcggcagcgcaaaagatg

SEQ ID NO: 41995 - DNA, 103 bp, Artificial Sequence
  Synthetic Polynucleotide
taatacgactcactatagggattctgaaggatcctaggatcgctagcattaacagaggagaaatgctatggatcctaggaacctggcggcagcgcaaaagatg

SEQ ID NO: 41996 - DNA, 103 bp, Artificial Sequence
  Synthetic Polynucleotide
taatacgactcactatagggatgtgattctgaaggatcctaggatcgctaaacagaggagatagcgaatgtaggatcctaacctggcggcagcgcaaaagatg

SEQ ID NO: 41997 - DNA, 103 bp, Artificial Sequence
  Synthetic Polynucleotide
taatacgactcactatagggaatctatgtgattctgaaggatcctaggataacagaggagaatcctaatgtccttcagaaacctggcggcagcgcaaaagatg

SEQ ID NO: 41998 - DNA, 103 bp, Artificial Sequence
  Synthetic Polynucleotide
taatacgactcactatagggtcgtcaatctatgtgattctgaaggatcctaacagaggagaaggatcatgcagaatcacaacctggcggcagcgcaaaagatg

SEQ ID NO: 41999 - DNA, 103 bp, Artificial Sequence
  Synthetic Polynucleotide
taatacgactcactatagggacgaatcgtcaatctatgtgattctgaaggaacagaggagaccttcaatgtcacatagaaacctggcggcagcgcaaaagatg

SEQ ID NO: 42000 - DNA, 103 bp, Artificial Sequence
  Synthetic Polynucleotide
taatacgactcactataggggagagacgaatcgtcaatctatgtgattctaacagaggagaagaatcatgtagattgacaacctggcggcagcgcaaaagatg

SEQ ID NO: 42001 - DNA, 103 bp, Artificial Sequence
  Synthetic Polynucleotide
taatacgactcactatagggactaagagagacgaatcgtcaatctatgtgaacagaggagacacataatgtgacgattcaacctggcggcagcgcaaaagatg

SEQ ID NO: 42002 - DNA, 103 bp, Artificial Sequence
  Synthetic Polynucleotide
taatacgactcactataggggagttactaagagagacgaatcgtcaatctaacagaggagaagattgatgattcgtctcaacctggcggcagcgcaaaagatg

SEQ ID NO: 42003 - DNA, 103 bp, Artificial Sequence
  Synthetic Polynucleotide
taatacgactcactatagggtactagagttactaagagagacgaatcgtcaacagaggagagacgatatgtctctcttaaacctggcggcagcgcaaaagatg

SEQ ID NO: 42004 - DNA, 103 bp, Artificial Sequence
  Synthetic Polynucleotide
taatacgactcactatagggttcatgtatggctgtgttcactcatatgttaacagaggagaaacataatggtgaacacaaacctggcggcagcgcaaaagatg

SEQ ID NO: 42005 - DNA, 103 bp, Artificial Sequence
  Synthetic Polynucleotide
taatacgactcactatagggtattttactagagttactaagagagacgaaaacagaggagattcgtcatgcttagtaacaacctggcggcagcgcaaaagatg

SEQ ID NO: 42006 - DNA, 103 bp, Artificial Sequence
  Synthetic Polynucleotide
taatacgactcactatagggatgattattttactagagttactaagagagaacagaggagactctctatgtaactctagaacctggcggcagcgcaaaagatg

SEQ ID NO: 42007 - DNA, 103 bp, Artificial Sequence
  Synthetic Polynucleotide
taatacgactcactatagggattgtatgattattttactagagttactaaaacagaggagattagtaatgctagtaaaaaacctggcggcagcgcaaaagatg

SEQ ID NO: 42008 - DNA, 103 bp, Artificial Sequence
  Synthetic Polynucleotide
taatacgactcactatagggactagattgtatgattattttactagagttaacagaggagaaactctatgaaaataatcaacctggcggcagcgcaaaagatg

SEQ ID NO: 42009 - DNA, 103 bp, Artificial Sequence
  Synthetic Polynucleotide
taatacgactcactatagggcgagtactagattgtatgattattttactaaacagaggagatagtaaatgaatcatacaaacctggcggcagcgcaaaagatg

SEQ ID NO: 42010 - DNA, 103 bp, Artificial Sequence
  Synthetic Polynucleotide
taatacgactcactatagggtatttcgagtactagattgtatgattatttaacagaggagaaaataaatgtacaatctaaacctggcggcagcgcaaaagatg

SEQ ID NO: 42011 - DNA, 103 bp, Artificial Sequence
  Synthetic Polynucleotide
taatacgactcactatagggaatattatttcgagtactagattgtatgataacagaggagaatcataatgtctagtactaacctggcggcagcgcaaaagatg

SEQ ID NO: 42012 - DNA, 103 bp, Artificial Sequence
  Synthetic Polynucleotide
taatacgactcactatagggaggataatattatttcgagtactagattgtaacagaggagaacaatcatgtactcgaaaaacctggcggcagcgcaaaagatg

SEQ ID NO: 42013 - DNA, 103 bp, Artificial Sequence
  Synthetic Polynucleotide
taatacgactcactatagggagtcaaggataatattatttcgagtactagaacagaggagactagtaatggaaataataaacctggcggcagcgcaaaagatg

SEQ ID NO: 42014 - DNA, 103 bp, Artificial Sequence
  Synthetic Polynucleotide
taatacgactcactatagggcctcaagtcaaggataatattatttcgagtaacagaggagaactcgaatgaatattatcaacctggcggcagcgcaaaagatg

SEQ ID NO: 42015 - DNA, 103 bp, Artificial Sequence
  Synthetic Polynucleotide
taatacgactcactatagggaaatgtttcatcagaaatgactccatgaaaaacagaggagatttcatatggtcatttctaacctggcggcagcgcaaaagatg

SEQ ID NO: 42016 - DNA, 103 bp, Artificial Sequence
  Synthetic Polynucleotide
taatacgactcactatagggtcgctttcatgtatggctgtgttcactcataacagaggagaatgagtatgcacagccataacctggcggcagcgcaaaagatg

SEQ ID NO: 42017 - DNA, 103 bp, Artificial Sequence
  Synthetic Polynucleotide
taatacgactcactataggggatctcctcaagtcaaggataatattatttaacagaggagaaaataaatgtatccttgaaacctggcggcagcgcaaaagatg

SEQ ID NO: 42018 - DNA, 103 bp, Artificial Sequence
  Synthetic Polynucleotide
taatacgactcactataggggtttagatctcctcaagtcaaggataatataacagaggagaatattaatgttgacttgaaacctggcggcagcgcaaaagatg

SEQ ID NO: 42019 - DNA, 103 bp, Artificial Sequence
  Synthetic Polynucleotide
taatacgactcactatagggagatcgtttagatctcctcaagtcaaggataacagaggagaatccttatgttgaggagaaacctggcggcagcgcaaaagatg

SEQ ID NO: 42020 - DNA, 103 bp, Artificial Sequence
  Synthetic Polynucleotide
taatacgactcactatagggaaactagatcgtttagatctcctcaagtcaaacagaggagatgacttatggagatctaaaacctggcggcagcgcaaaagatg

SEQ ID NO: 42021 - DNA, 103 bp, Artificial Sequence
  Synthetic Polynucleotide
taatacgactcactatagggtctcaaaactagatcgtttagatctcctcaaacagaggagatgaggaatgctaaacgataacctggcggcagcgcaaaagatg

SEQ ID NO: 42022 - DNA, 103 bp, Artificial Sequence
  Synthetic Polynucleotide
taatacgactcactataggggatgttctcaaaactagatcgtttagatctaacagaggagaagatctatgcgatctagtaacctggcggcagcgcaaaagatg

SEQ ID NO: 42023 - DNA, 103 bp, Artificial Sequence
  Synthetic Polynucleotide
taatacgactcactatagggttatcgatgttctcaaaactagatcgtttaaacagaggagataaacgatgtagttttgaaacctggcggcagcgcaaaagatg

SEQ ID NO: 42024 - DNA, 103 bp, Artificial Sequence
  Synthetic Polynucleotide
taatacgactcactatagggtgaacttatcgatgttctcaaaactagatcaacagaggagagatctaatgttgagaacaaacctggcggcagcgcaaaagatg

SEQ ID NO: 42025 - DNA, 103 bp, Artificial Sequence
  Synthetic Polynucleotide
taatacgactcactatagggcccgatgaacttatcgatgttctcaaaactaacagaggagaagttttatgaacatcgataacctggcggcagcgcaaaagatg

SEQ ID NO: 42026 - DNA, 103 bp, Artificial Sequence
  Synthetic Polynucleotide
taatacgactcactatagggtcattcccgatgaacttatcgatgttctcaaacagaggagatgagaaatgcgataagttaacctggcggcagcgcaaaagatg

SEQ ID NO: 42027 - DNA, 103 bp, Artificial Sequence
  Synthetic Polynucleotide
taatacgactcactatagggtctcatcgctttcatgtatggctgtgttcaaacagaggagatgaacaatgccatacatgaacctggcggcagcgcaaaagatg

SEQ ID NO: 42028 - DNA, 103 bp, Artificial Sequence
  Synthetic Polynucleotide
taatacgactcactataggggtatgtcattcccgatgaacttatcgatgtaacagaggagaacatcgatgagttcatcgaacctggcggcagcgcaaaagatg

SEQ ID NO: 42029 - DNA, 103 bp, Artificial Sequence
  Synthetic Polynucleotide
taatacgactcactatagggagtatgtatgtcattcccgatgaacttatcaacagaggagagataagatgatcgggaataacctggcggcagcgcaaaagatg

SEQ ID NO: 42030 - DNA, 103 bp, Artificial Sequence
  Synthetic Polynucleotide
taatacgactcactatagggaagatagtatgtatgtcattcccgatgaacaacagaggagagttcatatggaatgacataacctggcggcagcgcaaaagatg

SEQ ID NO: 42031 - DNA, 103 bp, Artificial Sequence
  Synthetic Polynucleotide
taatacgactcactatagggtattaaagatagtatgtatgtcattcccgaaacagaggagatcgggaatgacatacataaacctggcggcagcgcaaaagatg

SEQ ID NO: 42032 - DNA, 103 bp, Artificial Sequence
  Synthetic Polynucleotide
taatacgactcactatagggagttctattaaagatagtatgtatgtcattaacagaggagaaatgacatgcatactatcaacctggcggcagcgcaaaagatg

SEQ ID NO: 42033 - DNA, 103 bp, Artificial Sequence
  Synthetic Polynucleotide
taatacgactcactatagggaaaagagttctattaaagatagtatgtatgaacagaggagacatacaatgtatctttaaaacctggcggcagcgcaaaagatg

SEQ ID NO: 42034 - DNA, 103 bp, Artificial Sequence
  Synthetic Polynucleotide
taatacgactcactatagggggatgaaaagagttctattaaagatagtataacagaggagaatactaatgttaatagaaaacctggcggcagcgcaaaagatg

SEQ ID NO: 42035 - DNA, 103 bp, Artificial Sequence
  Synthetic Polynucleotide
taatacgactcactatagggcaactggatgaaaagagttctattaaagataacagaggagaatctttatgagaactcttaacctggcggcagcgcaaaagatg

SEQ ID NO: 42036 - DNA, 103 bp, Artificial Sequence
  Synthetic Polynucleotide
taatacgactcactatagggccattcaactggatgaaaagagttctattaaacagaggagataatagatgtcttttcataacctggcggcagcgcaaaagatg

SEQ ID NO: 42037 - DNA, 103 bp, Artificial Sequence
  Synthetic Polynucleotide
taatacgactcactatagggcgagtccattcaactggatgaaaagagttcaacagaggagagaactcatgtcatccagtaacctggcggcagcgcaaaagatg

SEQ ID NO: 42038 - DNA, 103 bp, Artificial Sequence
  Synthetic Polynucleotide
taatacgactcactatagggctatttctcatcgctttcatgtatggctgtaacagaggagaacagccatgcatgaaagcaacctggcggcagcgcaaaagatg

SEQ ID NO: 42039 - DNA, 103 bp, Artificial Sequence
  Synthetic Polynucleotide
taatacgactcactatagggaaggacgagtccattcaactggatgaaaagaacagaggagacttttcatgcagttgaataacctggcggcagcgcaaaagatg

SEQ ID NO: 42040 - DNA, 103 bp, Artificial Sequence
  Synthetic Polynucleotide
taatacgactcactatagggtggttaaggacgagtccattcaactggatgaacagaggagacatccaatggaatggactaacctggcggcagcgcaaaagatg

SEQ ID NO: 42041 - DNA, 103 bp, Artificial Sequence
  Synthetic Polynucleotide
taatacgactcactatagggtcagttggttaaggacgagtccattcaactaacagaggagaagttgaatggactcgtccaacctggcggcagcgcaaaagatg

SEQ ID NO: 42042 - DNA, 103 bp, Artificial Sequence
  Synthetic Polynucleotide
taatacgactcactatagggattaatcagttggttaaggacgagtccattaacagaggagaaatggaatggtccttaacaacctggcggcagcgcaaaagatg

SEQ ID NO: 42043 - DNA, 103 bp, Artificial Sequence
  Synthetic Polynucleotide
taatacgactcactatagggatcttattaatcagttggttaaggacgagtaacagaggagaactcgtatgtaaccaactaacctggcggcagcgcaaaagatg

SEQ ID NO: 42044 - DNA, 103 bp, Artificial Sequence
  Synthetic Polynucleotide
taatacgactcactatagggagaagatcttattaatcagttggttaaggaaacagaggagatccttaatgaactgattaaacctggcggcagcgcaaaagatg

SEQ ID NO: 42045 - DNA, 103 bp, Artificial Sequence
  Synthetic Polynucleotide
taatacgactcactatagggaaaatagaagatcttattaatcagttggttaacagaggagaaaccaaatgattaataagaacctggcggcagcgcaaaagatg

SEQ ID NO: 42046 - DNA, 103 bp, Artificial Sequence
  Synthetic Polynucleotide
taatacgactcactatagggatgataaaatagaagatcttattaatcagtaacagaggagaactgatatgtaagatcttaacctggcggcagcgcaaaagatg

SEQ ID NO: 42047 - DNA, 103 bp, Artificial Sequence
  Synthetic Polynucleotide
taatacgactcactatagggggaaaatgataaaatagaagatcttattaaaacagaggagattaataatgtcttctattaacctggcggcagcgcaaaagatg

SEQ ID NO: 42048 - DNA, 103 bp, Artificial Sequence
  Synthetic Polynucleotide
taatacgactcactatagggcatctggaaaatgataaaatagaagatcttaacagaggagaaagatcatgtattttatcaacctggcggcagcgcaaaagatg

SEQ ID NO: 42049 - DNA, 103 bp, Artificial Sequence
  Synthetic Polynucleotide
taatacgactcactataggggaatcctatttctcatcgctttcatgtatgaacagaggagacatacaatgaagcgatgaaacctggcggcagcgcaaaagatg

SEQ ID NO: 42050 - DNA, 103 bp, Artificial Sequence
  Synthetic Polynucleotide
taatacgactcactatagggcatatcatctggaaaatgataaaatagaagaacagaggagacttctaatgtatcattttaacctggcggcagcgcaaaagatg

SEQ ID NO: 42051 - DNA, 103 bp, Artificial Sequence
  Synthetic Polynucleotide
taatacgactcactatagggacatacatatcatctggaaaatgataaaataacagaggagaattttaatgttttccagaaacctggcggcagcgcaaaagatg

SEQ ID NO: 42052 - DNA, 103 bp, Artificial Sequence
  Synthetic Polynucleotide
taatacgactcactatagggaatggacatacatatcatctggaaaatgataacagaggagaatcattatgcagatgataaacctggcggcagcgcaaaagatg

SEQ ID NO: 42053 - DNA, 103 bp, Artificial Sequence
  Synthetic Polynucleotide
taatacgactcactatagggactttaatggacatacatatcatctggaaaaacagaggagatttccaatggatatgtataacctggcggcagcgcaaaagatg

SEQ ID NO: 42054 - DNA, 103 bp, Artificial Sequence
  Synthetic Polynucleotide
taatacgactcactatagggatttaactttaatggacatacatatcatctaacagaggagaagatgaatggtatgtccaaacctggcggcagcgcaaaagatg

SEQ ID NO: 42055 - DNA, 103 bp, Artificial Sequence
  Synthetic Polynucleotide
taatacgactcactatagggacacaatttaactttaatggacatacatataacagaggagaatatgtatgtccattaaaaacctggcggcagcgcaaaagatg

SEQ ID NO: 42056 - DNA, 103 bp, Artificial Sequence
  Synthetic Polynucleotide
taatacgactcactataggggcgctacacaatttaactttaatggacataaacagaggagatatgtcatgtaaagttaaaacctggcggcagcgcaaaagatg

SEQ ID NO: 42057 - DNA, 103 bp, Artificial Sequence
  Synthetic Polynucleotide
taatacgactcactatagggaagaagcgctacacaatttaactttaatggaacagaggagaccattaatgttaaattgtaacctggcggcagcgcaaaagatg

SEQ ID NO: 42058 - DNA, 103 bp, Artificial Sequence
  Synthetic Polynucleotide
taatacgactcactatagggctaaaaagaagcgctacacaatttaactttaacagaggagaaaagttatgttgtgtagcaacctggcggcagcgcaaaagatg

SEQ ID NO: 42059 - DNA, 103 bp, Artificial Sequence
  Synthetic Polynucleotide
taatacgactcactatagggctagactaaaaagaagcgctacacaatttaaacagaggagataaattatgtagcgcttcaacctggcggcagcgcaaaagatg

SEQ ID NO: 42060 - DNA, 103 bp, Artificial Sequence
  Synthetic Polynucleotide
taatacgactcactataggggatgagaatcctatttctcatcgctttcataacagaggagaatgaaaatgatgagaaataacctggcggcagcgcaaaagatg

SEQ ID NO: 42061 - DNA, 103 bp, Artificial Sequence
  Synthetic Polynucleotide
taatacgactcactatagggggctgctagactaaaaagaagcgctacacaaacagaggagatgtgtaatgcttctttttaacctggcggcagcgcaaaagatg

SEQ ID NO: 42062 - DNA, 103 bp, Artificial Sequence
  Synthetic Polynucleotide
taatacgactcactataggggtattggctgctagactaaaaagaagcgctaacagaggagaagcgctatgttttagtctaacctggcggcagcgcaaaagatg

SEQ ID NO: 42063 - DNA, 103 bp, Artificial Sequence
  Synthetic Polynucleotide
taatacgactcactatagggttaaagtattggctgctagactaaaaagaaaacagaggagattctttatggtctagcagaacctggcggcagcgcaaaagatg

SEQ ID NO: 42064 - DNA, 103 bp, Artificial Sequence
  Synthetic Polynucleotide
taatacgactcactatagggtgatgttaaagtattggctgctagactaaaaacagaggagatttagtatggcagccaataacctggcggcagcgcaaaagatg

SEQ ID NO: 42065 - DNA, 103 bp, Artificial Sequence
  Synthetic Polynucleotide
taatacgactcactatagggattagtgatgttaaagtattggctgctagaaacagaggagatctagcatgcaatactttaacctggcggcagcgcaaaagatg

SEQ ID NO: 42066 - DNA, 103 bp, Artificial Sequence
  Synthetic Polynucleotide
taatacgactcactatagggttgatattagtgatgttaaagtattggctgaacagaggagacagccaatgctttaacataacctggcggcagcgcaaaagatg

SEQ ID NO: 42067 - DNA, 103 bp, Artificial Sequence
  Synthetic Polynucleotide
taatacgactcactataggggtatattgatattagtgatgttaaagtattaacagaggagaaatactatgacatcactaaacctggcggcagcgcaaaagatg

SEQ ID NO: 42068 - DNA, 103 bp, Artificial Sequence
  Synthetic Polynucleotide
taatacgactcactatagggcctttgtatattgatattagtgatgttaaaaacagaggagatttaacatgactaatatcaacctggcggcagcgcaaaagatg

SEQ ID NO: 42069 - DNA, 103 bp, Artificial Sequence
  Synthetic Polynucleotide
taatacgactcactatagggcatctcctttgtatattgatattagtgatgaacagaggagacatcacatgtatcaatataacctggcggcagcgcaaaagatg

SEQ ID NO: 42070 - DNA, 103 bp, Artificial Sequence
  Synthetic Polynucleotide
taatacgactcactatagggtaaatcatctcctttgtatattgatattagaacagaggagactaataatgatatacaaaaacctggcggcagcgcaaaagatg

SEQ ID NO: 42071 - DNA, 103 bp, Artificial Sequence
  Synthetic Polynucleotide
taatacgactcactatagggggcgagatgagaatcctatttctcatcgctaacagaggagaagcgatatgaaataggataacctggcggcagcgcaaaagatg

SEQ ID NO: 42072 - DNA, 103 bp, Artificial Sequence
  Synthetic Polynucleotide
taatacgactcactataggggtcgataaatcatctcctttgtatattgataacagaggagaatcaatatgcaaaggagaaacctggcggcagcgcaaaagatg

SEQ ID NO: 42073 - DNA, 103 bp, Artificial Sequence
  Synthetic Polynucleotide
taatacgactcactatagggataccgtcgataaatcatctcctttgtataaacagaggagatatacaatggagatgattaacctggcggcagcgcaaaagatg

SEQ ID NO: 42074 - DNA, 103 bp, Artificial Sequence
  Synthetic Polynucleotide
taatacgactcactatagggtcttaataccgtcgataaatcatctcctttaacagaggagaaaaggaatggatttatcgaacctggcggcagcgcaaaagatg

SEQ ID NO: 42075 - DNA, 103 bp, Artificial Sequence
  Synthetic Polynucleotide
taatacgactcactatagggcgaattcttaataccgtcgataaatcatctaacagaggagaagatgaatgatcgacggtaacctggcggcagcgcaaaagatg

SEQ ID NO: 42076 - DNA, 103 bp, Artificial Sequence
  Synthetic Polynucleotide
taatacgactcactatagggaaaaacgaattcttaataccgtcgataaataacagaggagaatttatatgcggtattaaaacctggcggcagcgcaaaagatg

SEQ ID NO: 42077 - DNA, 103 bp, Artificial Sequence
  Synthetic Polynucleotide
taatacgactcactatagggtgttgaaaaacgaattcttaataccgtcgaaacagaggagatcgacgatgttaagaattaacctggcggcagcgcaaaagatg

SEQ ID NO: 42078 - DNA, 103 bp, Artificial Sequence
  Synthetic Polynucleotide
taatacgactcactatagggacggatgttgaaaaacgaattcttaataccaacagaggagaggtattatgaattcgtttaacctggcggcagcgcaaaagatg

SEQ ID NO: 42079 - DNA, 103 bp, Artificial Sequence
  Synthetic Polynucleotide
taatacgactcactatagggttttgacggatgttgaaaaacgaattcttaaacagaggagataagaaatggtttttcaaaacctggcggcagcgcaaaagatg

SEQ ID NO: 42080 - DNA, 103 bp, Artificial Sequence
  Synthetic Polynucleotide
taatacgactcactatagggattggttttgacggatgttgaaaaacgaataacagaggagaattcgtatgtcaacatccaacctggcggcagcgcaaaagatg

SEQ ID NO: 42081 - DNA, 103 bp, Artificial Sequence
  Synthetic Polynucleotide
taatacgactcactatagggaaggaattggttttgacggatgttgaaaaaaacagaggagatttttcatgatccgtcaaaacctggcggcagcgcaaaagatg

SEQ ID NO: 42082 - DNA, 103 bp, Artificial Sequence
  Synthetic Polynucleotide
taatacgactcactatagggattttggcgagatgagaatcctatttctcaaacagaggagatgagaaatgggattctcaaacctggcggcagcgcaaaagatg

SEQ ID NO: 42083 - DNA, 103 bp, Artificial Sequence
  Synthetic Polynucleotide
taatacgactcactataggggcaaaaaggaattggttttgacggatgttgaacagaggagacaacatatgtcaaaaccaaacctggcggcagcgcaaaagatg

SEQ ID NO: 42084 - DNA, 103 bp, Artificial Sequence
  Synthetic Polynucleotide
taatacgactcactatagggtacaggcaaaaaggaattggttttgacggaaacagaggagatccgtcatgaccaattccaacctggcggcagcgcaaaagatg

SEQ ID NO: 42085 - DNA, 103 bp, Artificial Sequence
  Synthetic Polynucleotide
taatacgactcactataggggatgatacaggcaaaaaggaattggttttgaacagaggagacaaaacatgttcctttttaacctggcggcagcgcaaaagatg

SEQ ID NO: 42086 - DNA, 103 bp, Artificial Sequence
  Synthetic Polynucleotide
taatacgactcactatagggaactggatgatacaggcaaaaaggaattggaacagaggagaccaattatgttttgcctgaacctggcggcagcgcaaaagatg

SEQ ID NO: 42087 - DNA, 103 bp, Artificial Sequence
  Synthetic Polynucleotide
taatacgactcactatagggtggcaaactggatgatacaggcaaaaaggaaacagaggagatcctttatgcctgtatcaaacctggcggcagcgcaaaagatg

SEQ ID NO: 42088 - DNA, 103 bp, Artificial Sequence
  Synthetic Polynucleotide
taatacgactcactatagggaagaatggcaaactggatgatacaggcaaaaacagaggagatttgccatgatcatccagaacctggcggcagcgcaaaagatg

SEQ ID NO: 42089 - DNA, 103 bp, Artificial Sequence
  Synthetic Polynucleotide
taatacgactcactatagggttacaaagaatggcaaactggatgatacagaacagaggagactgtatatgccagtttgcaacctggcggcagcgcaaaagatg

SEQ ID NO: 42090 - DNA, 103 bp, Artificial Sequence
  Synthetic Polynucleotide
taatacgactcactatagggtttctttacaaagaatggcaaactggatgaaacagaggagatcatccatgttgccattcaacctggcggcagcgcaaaagatg

SEQ ID NO: 42091 - DNA, 103 bp, Artificial Sequence
  Synthetic Polynucleotide
taatacgactcactatagggaataatttctttacaaagaatggcaaactgaacagaggagacagtttatgattctttgtaacctggcggcagcgcaaaagatg

SEQ ID NO: 42092 - DNA, 103 bp, Artificial Sequence
  Synthetic Polynucleotide
taatacgactcactatagggtagaaaataatttctttacaaagaatggcaaacagaggagatgccatatgttgtaaagaaacctggcggcagcgcaaaagatg

SEQ ID NO: 42093 - DNA, 103 bp, Artificial Sequence
  Synthetic Polynucleotide
taatacgactcactataggggtgatattttggcgagatgagaatcctattaacagaggagaaataggatgctcatctcgaacctggcggcagcgcaaaagatg

SEQ ID NO: 42094 - DNA, 103 bp, Artificial Sequence
  Synthetic Polynucleotide
taatacgactcactatagggtctagtagaaaataatttctttacaaagaaaacagaggagattctttatgaagaaattaaacctggcggcagcgcaaaagatg

SEQ ID NO: 42095 - DNA, 103 bp, Artificial Sequence
  Synthetic Polynucleotide
taatacgactcactatagggaatagtctagtagaaaataatttctttacaaacagaggagatgtaaaatgattattttcaacctggcggcagcgcaaaagatg

SEQ ID NO: 42096 - DNA, 103 bp, Artificial Sequence
  Synthetic Polynucleotide
taatacgactcactatagggttattaatagtctagtagaaaataatttctaacagaggagaagaaatatgtttctactaaacctggcggcagcgcaaaagatg

SEQ ID NO: 42097 - DNA, 103 bp, Artificial Sequence
  Synthetic Polynucleotide
taatacgactcactatagggcagtcttattaatagtctagtagaaaataaaacagaggagattatttatgactagactaaacctggcggcagcgcaaaagatg

SEQ ID NO: 42098 - DNA, 103 bp, Artificial Sequence
  Synthetic Polynucleotide
taatacgactcactatagggcttatcagtcttattaatagtctagtagaaaacagaggagattctacatgactattaataacctggcggcagcgcaaaagatg

SEQ ID NO: 42099 - DNA, 103 bp, Artificial Sequence
  Synthetic Polynucleotide
taatacgactcactataggggaatccttatcagtcttattaatagtctagaacagaggagactagacatgtaataagacaacctggcggcagcgcaaaagatg

SEQ ID NO: 42100 - DNA, 103 bp, Artificial Sequence
  Synthetic Polynucleotide
taatacgactcactatagggtggaggaatccttatcagtcttattaatagaacagaggagactattaatgagactgataaacctggcggcagcgcaaaagatg

SEQ ID NO: 42101 - DNA, 103 bp, Artificial Sequence
  Synthetic Polynucleotide
taatacgactcactatagggaattatggaggaatccttatcagtcttattaacagaggagaaataagatggataaggataacctggcggcagcgcaaaagatg

SEQ ID NO: 42102 - DNA, 103 bp, Artificial Sequence
  Synthetic Polynucleotide
taatacgactcactatagggtgtgcaattatggaggaatccttatcagtcaacagaggagagactgaatgggattcctcaacctggcggcagcgcaaaagatg

SEQ ID NO: 42103 - DNA, 103 bp, Artificial Sequence
  Synthetic Polynucleotide
taatacgactcactatagggtggattgtgcaattatggaggaatccttataacagaggagaataaggatgcctccataaaacctggcggcagcgcaaaagatg

SEQ ID NO: 42104 - DNA, 103 bp, Artificial Sequence
  Synthetic Polynucleotide
taatacgactcactatagggttctagtgatattttggcgagatgagaatcaacagaggagagattctatgctcgccaaaaacctggcggcagcgcaaaagatg

SEQ ID NO: 42105 - DNA, 103 bp, Artificial Sequence
  Synthetic Polynucleotide
taatacgactcactatagggaagtttggattgtgcaattatggaggaatcaacagaggagagattccatgataattgcaaacctggcggcagcgcaaaagatg

SEQ ID NO: 42106 - DNA, 103 bp, Artificial Sequence
  Synthetic Polynucleotide
taatacgactcactatagggtaaaaaagtttggattgtgcaattatggagaacagaggagactccatatgtgcacaatcaacctggcggcagcgcaaaagatg

SEQ ID NO: 42107 - DNA, 103 bp, Artificial Sequence
  Synthetic Polynucleotide
taatacgactcactatagggttttgtaaaaaagtttggattgtgcaattaaacagaggagataattgatgaatccaaacaacctggcggcagcgcaaaagatg

SEQ ID NO: 42108 - DNA, 103 bp, Artificial Sequence
  Synthetic Polynucleotide
taatacgactcactatagggtctagttttgtaaaaaagtttggattgtgcaacagaggagagcacaaatgaaactttttaacctggcggcagcgcaaaagatg

SEQ ID NO: 42109 - DNA, 103 bp, Artificial Sequence
  Synthetic Polynucleotide
taatacgactcactatagggtaaagtctagttttgtaaaaaagtttggataacagaggagaatccaaatgtttttacaaaacctggcggcagcgcaaaagatg

SEQ ID NO: 42110 - DNA, 103 bp, Artificial Sequence
  Synthetic Polynucleotide
taatacgactcactatagggtctcgtaaagtctagttttgtaaaaaagttaacagaggagaaactttatgacaaaactaaacctggcggcagcgcaaaagatg

SEQ ID NO: 42111 - DNA, 103 bp, Artificial Sequence
  Synthetic Polynucleotide
taatacgactcactataggggtagatctcgtaaagtctagttttgtaaaaaacagaggagattttacatgactagacttaacctggcggcagcgcaaaagatg

SEQ ID NO: 42112 - DNA, 103 bp, Artificial Sequence
  Synthetic Polynucleotide
taatacgactcactatagggttcctgtagatctcgtaaagtctagttttgaacagaggagacaaaacatgactttacgaaacctggcggcagcgcaaaagatg

SEQ ID NO: 42113 - DNA, 103 bp, Artificial Sequence
  Synthetic Polynucleotide
taatacgactcactatagggacgcattcctgtagatctcgtaaagtctagaacagaggagactagacatgacgagatctaacctggcggcagcgcaaaagatg

SEQ ID NO: 42114 - DNA, 103 bp, Artificial Sequence
  Synthetic Polynucleotide
taatacgactcactataggggaagtacgcattcctgtagatctcgtaaagaacagaggagactttacatgatctacaggaacctggcggcagcgcaaaagatg

SEQ ID NO: 42115 - DNA, 103 bp, Artificial Sequence
  Synthetic Polynucleotide
taatacgactcactatagggattttttctagtgatattttggcgagatgaaacagaggagatcatctatgcaaaatatcaacctggcggcagcgcaaaagatg

SEQ ID NO: 42116 - DNA, 103 bp, Artificial Sequence
  Synthetic Polynucleotide
taatacgactcactatagggaacctgaagtacgcattcctgtagatctcgaacagaggagacgagatatgcaggaatgcaacctggcggcagcgcaaaagatg

SEQ ID NO: 42117 - DNA, 103 bp, Artificial Sequence
  Synthetic Polynucleotide
taatacgactcactatagggtaagaaacctgaagtacgcattcctgtagaaacagaggagatctacaatgatgcgtactaacctggcggcagcgcaaaagatg

SEQ ID NO: 42118 - DNA, 103 bp, Artificial Sequence
  Synthetic Polynucleotide
taatacgactcactatagggcaagctaagaaacctgaagtacgcattcctaacagaggagaaggaatatgtacttcaggaacctggcggcagcgcaaaagatg

SEQ ID NO: 42119 - DNA, 103 bp, Artificial Sequence
  Synthetic Polynucleotide
taatacgactcactatagggaatcacaagctaagaaacctgaagtacgcaaacagaggagatgcgtaatgcaggtttctaacctggcggcagcgcaaaagatg

SEQ ID NO: 42120 - DNA, 103 bp, Artificial Sequence
  Synthetic Polynucleotide
taatacgactcactataggggaaaaaatcacaagctaagaaacctgaagtaacagaggagaacttcaatgttcttagctaacctggcggcagcgcaaaagatg

SEQ ID NO: 42121 - DNA, 103 bp, Artificial Sequence
  Synthetic Polynucleotide
taatacgactcactatagggcaaaagaaaaaatcacaagctaagaaacctaacagaggagaaggtttatgagcttgtgaaacctggcggcagcgcaaaagatg

SEQ ID NO: 42122 - DNA, 103 bp, Artificial Sequence
  Synthetic Polynucleotide
taatacgactcactataggggtccacaaaagaaaaaatcacaagctaagaaacagaggagatcttagatggtgatttttaacctggcggcagcgcaaaagatg

SEQ ID NO: 42123 - DNA, 103 bp, Artificial Sequence
  Synthetic Polynucleotide
taatacgactcactatagggaaaatgtccacaaaagaaaaaatcacaagcaacagaggagagcttgtatgtttttctttaacctggcggcagcgcaaaagatg

SEQ ID NO: 42124 - DNA, 103 bp, Artificial Sequence
  Synthetic Polynucleotide
taatacgactcactatagggactagaaaatgtccacaaaagaaaaaatcaaacagaggagatgatttatgcttttgtggaacctggcggcagcgcaaaagatg

SEQ ID NO: 42125 - DNA, 103 bp, Artificial Sequence
  Synthetic Polynucleotide
taatacgactcactatagggtggtcactagaaaatgtccacaaaagaaaaaacagaggagattttctatggtggacattaacctggcggcagcgcaaaagatg

SEQ ID NO: 42126 - DNA, 103 bp, Artificial Sequence
  Synthetic Polynucleotide
taatacgactcactatagggtcattaaatgtttcatcagaaatgactccaaacagaggagatggagtatgttctgatgaaacctggcggcagcgcaaaagatg

SEQ ID NO: 42127 - DNA, 103 bp, Artificial Sequence
  Synthetic Polynucleotide
taatacgactcactatagggaataaattttttctagtgatattttggcgaaacagaggagatcgccaatgtatcactagaacctggcggcagcgcaaaagatg

SEQ ID NO: 42128 - DNA, 103 bp, Artificial Sequence
  Synthetic Polynucleotide
taatacgactcactatagggtgagttggtcactagaaaatgtccacaaaaaacagaggagattttgtatgcattttctaaacctggcggcagcgcaaaagatg

SEQ ID NO: 42129 - DNA, 103 bp, Artificial Sequence
  Synthetic Polynucleotide
taatacgactcactataggggtagatgagttggtcactagaaaatgtccaaacagaggagatggacaatgtctagtgacaacctggcggcagcgcaaaagatg

SEQ ID NO: 42130 - DNA, 103 bp, Artificial Sequence
  Synthetic Polynucleotide
taatacgactcactatagggaaatggtagatgagttggtcactagaaaataacagaggagaattttcatgtgaccaactaacctggcggcagcgcaaaagatg

SEQ ID NO: 42131 - DNA, 103 bp, Artificial Sequence
  Synthetic Polynucleotide
taatacgactcactatagggcaatgaaatggtagatgagttggtcactagaacagaggagactagtgatgaactcatctaacctggcggcagcgcaaaagatg

SEQ ID NO: 42132 - DNA, 103 bp, Artificial Sequence
  Synthetic Polynucleotide
taatacgactcactatagggaaaatcaatgaaatggtagatgagttggtcaacagaggagagaccaaatgatctaccataacctggcggcagcgcaaaagatg

SEQ ID NO: 42133 - DNA, 103 bp, Artificial Sequence
  Synthetic Polynucleotide
taatacgactcactatagggctgctaaaatcaatgaaatggtagatgagtaacagaggagaactcatatgccatttcataacctggcggcagcgcaaaagatg

SEQ ID NO: 42134 - DNA, 103 bp, Artificial Sequence
  Synthetic Polynucleotide
taatacgactcactatagggtttcactgctaaaatcaatgaaatggtagaaacagaggagatctaccatgtcattgattaacctggcggcagcgcaaaagatg

SEQ ID NO: 42135 - DNA, 103 bp, Artificial Sequence
  Synthetic Polynucleotide
taatacgactcactataggggcttatttcactgctaaaatcaatgaaatgaacagaggagacatttcatggattttagcaacctggcggcagcgcaaaagatg

SEQ ID NO: 42136 - DNA, 103 bp, Artificial Sequence
  Synthetic Polynucleotide
taatacgactcactatagggtgaaagcttatttcactgctaaaatcaatgaacagaggagacattgaatgtagcagtgaaacctggcggcagcgcaaaagatg

SEQ ID NO: 42137 - DNA, 103 bp, Artificial Sequence
  Synthetic Polynucleotide
taatacgactcactatagggtgcattgaaagcttatttcactgctaaaataacagaggagaattttaatggtgaaataaaacctggcggcagcgcaaaagatg

SEQ ID NO: 42138 - DNA, 103 bp, Artificial Sequence
  Synthetic Polynucleotide
taatacgactcactatagggtgataaataaattttttctagtgatattttaacagaggagaaaaataatgctagaaaaaaacctggcggcagcgcaaaagatg

SEQ ID NO: 42139 - DNA, 103 bp, Artificial Sequence
  Synthetic Polynucleotide
taatacgactcactataggggcccgtgcattgaaagcttatttcactgctaacagaggagaagcagtatgataagctttaacctggcggcagcgcaaaagatg

SEQ ID NO: 42140 - DNA, 103 bp, Artificial Sequence
  Synthetic Polynucleotide
taatacgactcactatagggtcagtgcccgtgcattgaaagcttatttcaaacagaggagatgaaatatgctttcaatgaacctggcggcagcgcaaaagatg

SEQ ID NO: 42141 - DNA, 103 bp, Artificial Sequence
  Synthetic Polynucleotide
taatacgactcactatagggtagtatcagtgcccgtgcattgaaagcttaaacagaggagataagctatgaatgcacggaacctggcggcagcgcaaaagatg

SEQ ID NO: 42142 - DNA, 103 bp, Artificial Sequence
  Synthetic Polynucleotide
taatacgactcactatagggtttaatagtatcagtgcccgtgcattgaaaaacagaggagatttcaaatgacgggcactaacctggcggcagcgcaaaagatg

SEQ ID NO: 42143 - DNA, 103 bp, Artificial Sequence
  Synthetic Polynucleotide
taatacgactcactatagggtcgtttttaatagtatcagtgcccgtgcataacagaggagaatgcacatgcactgatacaacctggcggcagcgcaaaagatg

SEQ ID NO: 42144 - DNA, 103 bp, Artificial Sequence
  Synthetic Polynucleotide
taatacgactcactatagggtcaactcgtttttaatagtatcagtgcccgaacagaggagacgggcaatgatactattaaacctggcggcagcgcaaaagatg

SEQ ID NO: 42145 - DNA, 103 bp, Artificial Sequence
  Synthetic Polynucleotide
taatacgactcactataggggaagatcaactcgtttttaatagtatcagtaacagaggagaactgatatgattaaaaacaacctggcggcagcgcaaaagatg

SEQ ID NO: 42146 - DNA, 103 bp, Artificial Sequence
  Synthetic Polynucleotide
taatacgactcactatagggaatttgaagatcaactcgtttttaatagtaaacagaggagatactatatgaaacgagttaacctggcggcagcgcaaaagatg

SEQ ID NO: 42147 - DNA, 103 bp, Artificial Sequence
  Synthetic Polynucleotide
taatacgactcactatagggggtggaatttgaagatcaactcgtttttaaaacagaggagattaaaaatgagttgatctaacctggcggcagcgcaaaagatg

SEQ ID NO: 42148 - DNA, 103 bp, Artificial Sequence
  Synthetic Polynucleotide
taatacgactcactatagggtaaatggtggaatttgaagatcaactcgttaacagaggagaaacgagatgatcttcaaaaacctggcggcagcgcaaaagatg

SEQ ID NO: 42149 - DNA, 103 bp, Artificial Sequence
  Synthetic Polynucleotide
taatacgactcactatagggaaaattgataaataaattttttctagtgataacagaggagaatcactatgaaaaatttaaacctggcggcagcgcaaaagatg

SEQ ID NO: 42150 - DNA, 103 bp, Artificial Sequence
  Synthetic Polynucleotide
taatacgactcactataggggaacttaaatggtggaatttgaagatcaacaacagaggagagttgatatgcaaattccaaacctggcggcagcgcaaaagatg

SEQ ID NO: 42151 - DNA, 103 bp, Artificial Sequence
  Synthetic Polynucleotide
taatacgactcactatagggttggtgaacttaaatggtggaatttgaagaaacagaggagatcttcaatgtccaccattaacctggcggcagcgcaaaagatg

SEQ ID NO: 42152 - DNA, 103 bp, Artificial Sequence
  Synthetic Polynucleotide
taatacgactcactataggggttgtttggtgaacttaaatggtggaatttaacagaggagaaaattcatgcatttaagtaacctggcggcagcgcaaaagatg

SEQ ID NO: 42153 - DNA, 103 bp, Artificial Sequence
  Synthetic Polynucleotide
taatacgactcactatagggtaaaagttgtttggtgaacttaaatggtggaacagaggagaccaccaatgaagttcaccaacctggcggcagcgcaaaagatg

SEQ ID NO: 42154 - DNA, 103 bp, Artificial Sequence
  Synthetic Polynucleotide
taatacgactcactataggggtatttaaaagttgtttggtgaacttaaataacagaggagaatttaaatgcaccaaacaaacctggcggcagcgcaaaagatg

SEQ ID NO: 42155 - DNA, 103 bp, Artificial Sequence
  Synthetic Polynucleotide
taatacgactcactatagggtatttgtatttaaaagttgtttggtgaactaacagaggagaagttcaatgaacaactttaacctggcggcagcgcaaaagatg

SEQ ID NO: 42156 - DNA, 103 bp, Artificial Sequence
  Synthetic Polynucleotide
taatacgactcactatagggtgatatatttgtatttaaaagttgtttggtaacagaggagaaccaaaatgcttttaaataacctggcggcagcgcaaaagatg

SEQ ID NO: 42157 - DNA, 103 bp, Artificial Sequence
  Synthetic Polynucleotide
taatacgactcactatagggactattgatatatttgtatttaaaagttgtaacagaggagaacaactatgaaatacaaaaacctggcggcagcgcaaaagatg

SEQ ID NO: 42158 - DNA, 103 bp, Artificial Sequence
  Synthetic Polynucleotide
taatacgactcactatagggctactactattgatatatttgtatttaaaaaacagaggagattttaaatgcaaatatataacctggcggcagcgcaaaagatg

SEQ ID NO: 42159 - DNA, 103 bp, Artificial Sequence
  Synthetic Polynucleotide
taatacgactcactatagggttattctactactattgatatatttgtattaacagaggagaaatacaatgatatcaataaacctggcggcagcgcaaaagatg

SEQ ID NO: 42160 - DNA, 103 bp, Artificial Sequence
  Synthetic Polynucleotide
taatacgactcactatagggcctttaaaattgataaataaattttttctaaacagaggagatagaaaatgtttatttataacctggcggcagcgcaaaagatg

SEQ ID NO: 42161 - DNA, 103 bp, Artificial Sequence
  Synthetic Polynucleotide
taatacgactcactatagggagttcttattctactactattgatatatttaacagaggagaaaatatatgaatagtagtaacctggcggcagcgcaaaagatg

SEQ ID NO: 42162 - DNA, 103 bp, Artificial Sequence
  Synthetic Polynucleotide
taatacgactcactatagggtttatagttcttattctactactattgataaacagaggagatatcaaatgtagtagaataacctggcggcagcgcaaaagatg

SEQ ID NO: 42163 - DNA, 103 bp, Artificial Sequence
  Synthetic Polynucleotide
taatacgactcactatagggttttttttatagttcttattctactactataacagaggagaatagtaatggaataagaaaacctggcggcagcgcaaaagatg

SEQ ID NO: 42164 - DNA, 103 bp, Artificial Sequence
  Synthetic Polynucleotide
taatacgactcactatagggtattattttttttatagttcttattctactaacagaggagaagtagaatgagaactataaacctggcggcagcgcaaaagatg

SEQ ID NO: 42165 - DNA, 103 bp, Artificial Sequence
  Synthetic Polynucleotide
taatacgactcactatagggttaattattattttttttatagttcttattaacagaggagaaataagatgtataaaaaaaacctggcggcagcgcaaaagatg

SEQ ID NO: 42166 - DNA, 103 bp, Artificial Sequence
  Synthetic Polynucleotide
taatacgactcactatagggattggttaattattattttttttatagttcaacagaggagagaactaatgaaaaaataaaacctggcggcagcgcaaaagatg

SEQ ID NO: 42167 - DNA, 103 bp, Artificial Sequence
  Synthetic Polynucleotide
taatacgactcactatagggttggtattggttaattattattttttttataacagaggagaataaaaatgataataattaacctggcggcagcgcaaaagatg

SEQ ID NO: 42168 - DNA, 103 bp, Artificial Sequence
  Synthetic Polynucleotide
taatacgactcactatagggtggggttggtattggttaattattatttttaacagaggagaaaaaatatgaattaaccaaacctggcggcagcgcaaaagatg

SEQ ID NO: 42169 - DNA, 103 bp, Artificial Sequence
  Synthetic Polynucleotide
taatacgactcactataggggttgttggggttggtattggttaattattaaacagaggagataataaatgaccaataccaacctggcggcagcgcaaaagatg

SEQ ID NO: 42170 - DNA, 103 bp, Artificial Sequence
  Synthetic Polynucleotide
taatacgactcactatagggtaccggttgttggggttggtattggttaataacagaggagaattaacatgtaccaacccaacctggcggcagcgcaaaagatg

SEQ ID NO: 42171 - DNA, 103 bp, Artificial Sequence
  Synthetic Polynucleotide
taatacgactcactatagggttatacctttaaaattgataaataaattttaacagaggagaaaaattatgttatcaattaacctggcggcagcgcaaaagatg

SEQ ID NO: 42172 - DNA, 103 bp, Artificial Sequence
  Synthetic Polynucleotide
taatacgactcactatagggaataataccggttgttggggttggtattggaacagaggagaccaataatgaccccaacaaacctggcggcagcgcaaaagatg

SEQ ID NO: 42173 - DNA, 103 bp, Artificial Sequence
  Synthetic Polynucleotide
taatacgactcactatagggcaactaataataccggttgttggggttggtaacagaggagaaccaacatgaacaaccggaacctggcggcagcgcaaaagatg

SEQ ID NO: 42174 - DNA, 103 bp, Artificial Sequence
  Synthetic Polynucleotide
taatacgactcactatagggcacatcaactaataataccggttgttggggaacagaggagaccccaaatgccggtattaaacctggcggcagcgcaaaagatg

SEQ ID NO: 42175 - DNA, 103 bp, Artificial Sequence
  Synthetic Polynucleotide
taatacgactcactatagggactgtcacatcaactaataataccggttgtaacagaggagaacaaccatgattattagtaacctggcggcagcgcaaaagatg

SEQ ID NO: 42176 - DNA, 103 bp, Artificial Sequence
  Synthetic Polynucleotide
taatacgactcactatagggagaaaactgtcacatcaactaataataccgaacagaggagacggtatatgtagttgatgaacctggcggcagcgcaaaagatg

SEQ ID NO: 42177 - DNA, 103 bp, Artificial Sequence
  Synthetic Polynucleotide
taatacgactcactatagggtgatgagaaaactgtcacatcaactaataaaacagaggagattattaatggatgtgacaaacctggcggcagcgcaaaagatg

SEQ ID NO: 42178 - DNA, 103 bp, Artificial Sequence
  Synthetic Polynucleotide
taatacgactcactatagggctaagtgatgagaaaactgtcacatcaactaacagaggagaagttgaatggacagttttaacctggcggcagcgcaaaagatg

SEQ ID NO: 42179 - DNA, 103 bp, Artificial Sequence
  Synthetic Polynucleotide
taatacgactcactatagggctgttctaagtgatgagaaaactgtcacataacagaggagaatgtgaatgttttctcataacctggcggcagcgcaaaagatg

SEQ ID NO: 42180 - DNA, 103 bp, Artificial Sequence
  Synthetic Polynucleotide
taatacgactcactatagggtaaatctgttctaagtgatgagaaaactgtaacagaggagaacagttatgtcatcacttaacctggcggcagcgcaaaagatg

SEQ ID NO: 42181 - DNA, 103 bp, Artificial Sequence
  Synthetic Polynucleotide
taatacgactcactatagggattgttaaatctgttctaagtgatgagaaaaacagaggagatttctcatgacttagaacaacctggcggcagcgcaaaagatg

SEQ ID NO: 42182 - DNA, 103 bp, Artificial Sequence
  Synthetic Polynucleotide
taatacgactcactataggggtattttatacctttaaaattgataaataaaacagaggagattatttatgaattttaaaaacctggcggcagcgcaaaagatg

SEQ ID NO: 42183 - DNA, 103 bp, Artificial Sequence
  Synthetic Polynucleotide
taatacgactcactatagggtagaaattgttaaatctgttctaagtgatgaacagaggagacatcacatggaacagattaacctggcggcagcgcaaaagatg

SEQ ID NO: 42184 - DNA, 103 bp, Artificial Sequence
  Synthetic Polynucleotide
taatacgactcactatagggctttatagaaattgttaaatctgttctaagaacagaggagacttagaatggatttaacaaacctggcggcagcgcaaaagatg

SEQ ID NO: 42185 - DNA, 103 bp, Artificial Sequence
  Synthetic Polynucleotide
taatacgactcactatagggacagactttatagaaattgttaaatctgttaacagaggagaaacagaatgaacaatttcaacctggcggcagcgcaaaagatg

SEQ ID NO: 42186 - DNA, 103 bp, Artificial Sequence
  Synthetic Polynucleotide
taatacgactcactatagggatttgacagactttatagaaattgttaaataacagaggagaatttaaatgtttctataaaacctggcggcagcgcaaaagatg

SEQ ID NO: 42187 - DNA, 103 bp, Artificial Sequence
  Synthetic Polynucleotide
taatacgactcactatagggagatgatttgacagactttatagaaattgtaacagaggagaacaattatgataaagtctaacctggcggcagcgcaaaagatg

SEQ ID NO: 42188 - DNA, 103 bp, Artificial Sequence
  Synthetic Polynucleotide
taatacgactcactatagggccggaagatgatttgacagactttatagaaaacagaggagattctatatggtctgtcaaaacctggcggcagcgcaaaagatg

SEQ ID NO: 42189 - DNA, 103 bp, Artificial Sequence
  Synthetic Polynucleotide
taatacgactcactataggggttctccggaagatgatttgacagactttaaacagaggagataaagtatgtcaaatcataacctggcggcagcgcaaaagatg

SEQ ID NO: 42190 - DNA, 103 bp, Artificial Sequence
  Synthetic Polynucleotide
taatacgactcactatagggtatgggttctccggaagatgatttgacagaaacagaggagatctgtcatgtcatcttccaacctggcggcagcgcaaaagatg

SEQ ID NO: 42191 - DNA, 103 bp, Artificial Sequence
  Synthetic Polynucleotide
taatacgactcactataggggtatttatgggttctccggaagatgatttgaacagaggagacaaatcatgttccggagaaacctggcggcagcgcaaaagatg

SEQ ID NO: 42192 - DNA, 103 bp, Artificial Sequence
  Synthetic Polynucleotide
taatacgactcactatagggttggtgtatttatgggttctccggaagatgaacagaggagacatcttatggagaacccaaacctggcggcagcgcaaaagatg

SEQ ID NO: 42193 - DNA, 103 bp, Artificial Sequence
  Synthetic Polynucleotide
taatacgactcactatagggaataagtattttatacctttaaaattgataaacagaggagatatcaaatgtaaaggtataacctggcggcagcgcaaaagatg

SEQ ID NO: 42194 - DNA, 103 bp, Artificial Sequence
  Synthetic Polynucleotide
taatacgactcactatagggtatatttggtgtatttatgggttctccggaaacagaggagatccggaatgcccataaataacctggcggcagcgcaaaagatg

SEQ ID NO: 42195 - DNA, 103 bp, Artificial Sequence
  Synthetic Polynucleotide
taatacgactcactataggggccgctatatttggtgtatttatgggttctaacagaggagaagaaccatgaaatacaccaacctggcggcagcgcaaaagatg

SEQ ID NO: 42196 - DNA, 103 bp, Artificial Sequence
  Synthetic Polynucleotide
taatacgactcactatagggtgtacgccgctatatttggtgtatttatggaacagaggagaccataaatgcaccaaataaacctggcggcagcgcaaaagatg

SEQ ID NO: 42197 - DNA, 103 bp, Artificial Sequence
  Synthetic Polynucleotide
taatacgactcactatagggtaagttgtacgccgctatatttggtgtattaacagaggagaaatacaatgaatatagcgaacctggcggcagcgcaaaagatg

SEQ ID NO: 42198 - DNA, 103 bp, Artificial Sequence
  Synthetic Polynucleotide
taatacgactcactatagggatggataagttgtacgccgctatatttggtaacagaggagaaccaaaatgagcggcgtaaacctggcggcagcgcaaaagatg

SEQ ID NO: 42199 - DNA, 103 bp, Artificial Sequence
  Synthetic Polynucleotide
taatacgactcactatagggtataaatggataagttgtacgccgctatataacagaggagaatatagatgcgtacaactaacctggcggcagcgcaaaagatg

SEQ ID NO: 42200 - DNA, 103 bp, Artificial Sequence
  Synthetic Polynucleotide
taatacgactcactatagggcaatgtataaatggataagttgtacgccgcaacagaggagagcggcgatgaacttatccaacctggcggcagcgcaaaagatg

SEQ ID NO: 42201 - DNA, 103 bp, Artificial Sequence
  Synthetic Polynucleotide
taatacgactcactatagggatattcaatgtataaatggataagttgtacaacagaggagagtacaaatgatccatttaaacctggcggcagcgcaaaagatg

SEQ ID NO: 42202 - DNA, 103 bp, Artificial Sequence
  Synthetic Polynucleotide
taatacgactcactatagggagccaatattcaatgtataaatggataagtaacagaggagaacttatatgtttatacataacctggcggcagcgcaaaagatg

SEQ ID NO: 42203 - DNA, 103 bp, Artificial Sequence
  Synthetic Polynucleotide
taatacgactcactatagggagaaaagccaatattcaatgtataaatggaaacagaggagatccattatgacattgaataacctggcggcagcgcaaaagatg

SEQ ID NO: 42204 - DNA, 103 bp, Artificial Sequence
  Synthetic Polynucleotide
taatacgactcactatagggacaacaataagtattttatacctttaaaataacagaggagaattttaatggtataaaataacctggcggcagcgcaaaagatg

SEQ ID NO: 42205 - DNA, 103 bp, Artificial Sequence
  Synthetic Polynucleotide
taatacgactcactataggggataaagaaaagccaatattcaatgtataaaacagaggagattatacatggaatattggaacctggcggcagcgcaaaagatg

SEQ ID NO: 42206 - DNA, 103 bp, Artificial Sequence
  Synthetic Polynucleotide
taatacgactcactatagggatagtgataaagaaaagccaatattcaatgaacagaggagacattgaatgttggcttttaacctggcggcagcgcaaaagatg

SEQ ID NO: 42207 - DNA, 103 bp, Artificial Sequence
  Synthetic Polynucleotide
taatacgactcactatagggtgaagatagtgataaagaaaagccaatattaacagaggagaaatattatgttttctttaaacctggcggcagcgcaaaagatg

SEQ ID NO: 42208 - DNA, 103 bp, Artificial Sequence
  Synthetic Polynucleotide
taatacgactcactatagggtatgatgaagatagtgataaagaaaagccaaacagaggagatggcttatgtttatcactaacctggcggcagcgcaaaagatg

SEQ ID NO: 42209 - DNA, 103 bp, Artificial Sequence
  Synthetic Polynucleotide
taatacgactcactatagggatgaatatgatgaagatagtgataaagaaaaacagaggagatttcttatgcactatcttaacctggcggcagcgcaaaagatg

SEQ ID NO: 42210 - DNA, 103 bp, Artificial Sequence
  Synthetic Polynucleotide
taatacgactcactatagggcgatgatgaatatgatgaagatagtgataaaacagaggagattatcaatgtcttcatcaaacctggcggcagcgcaaaagatg

SEQ ID NO: 42211 - DNA, 103 bp, Artificial Sequence
  Synthetic Polynucleotide
taatacgactcactataggggatatcgatgatgaatatgatgaagatagtaacagaggagaactatcatgatcatattcaacctggcggcagcgcaaaagatg

SEQ ID NO: 42212 - DNA, 103 bp, Artificial Sequence
  Synthetic Polynucleotide
taatacgactcactatagggttgttgatatcgatgatgaatatgatgaagaacagaggagacttcatatgattcatcataacctggcggcagcgcaaaagatg

SEQ ID NO: 42213 - DNA, 103 bp, Artificial Sequence
  Synthetic Polynucleotide
taatacgactcactataggggggacttgttgatatcgatgatgaatatgaaacagaggagatcatatatgtcatcgataaacctggcggcagcgcaaaagatg

SEQ ID NO: 42214 - DNA, 103 bp, Artificial Sequence
  Synthetic Polynucleotide
taatacgactcactatagggaatttgggacttgttgatatcgatgatgaaaacagaggagattcatcatggatatcaacaacctggcggcagcgcaaaagatg

SEQ ID NO: 42215 - DNA, 103 bp, Artificial Sequence
  Synthetic Polynucleotide
taatacgactcactatagggcgaggacaacaataagtattttatacctttaacagaggagaaaaggtatgaaatacttaaacctggcggcagcgcaaaagatg

SEQ ID NO: 42216 - DNA, 103 bp, Artificial Sequence
  Synthetic Polynucleotide
taatacgactcactatagggctcgtaatttgggacttgttgatatcgatgaacagaggagacatcgaatgcaacaagtcaacctggcggcagcgcaaaagatg

SEQ ID NO: 42217 - DNA, 103 bp, Artificial Sequence
  Synthetic Polynucleotide
taatacgactcactatagggtttggctcgtaatttgggacttgttgatataacagaggagaatatcaatgagtcccaaaaacctggcggcagcgcaaaagatg

SEQ ID NO: 42218 - DNA, 103 bp, Artificial Sequence
  Synthetic Polynucleotide
taatacgactcactataggggaagatttggctcgtaatttgggacttgttaacagaggagaaacaagatgcaaattacgaacctggcggcagcgcaaaagatg

SEQ ID NO: 42219 - DNA, 103 bp, Artificial Sequence
  Synthetic Polynucleotide
taatacgactcactatagggtagaagaagatttggctcgtaatttgggacaacagaggagagtcccaatgtacgagccaaacctggcggcagcgcaaaagatg

SEQ ID NO: 42220 - DNA, 103 bp, Artificial Sequence
  Synthetic Polynucleotide
taatacgactcactatagggaaatgtagaagaagatttggctcgtaatttaacagaggagaaaattaatggccaaatctaacctggcggcagcgcaaaagatg

SEQ ID NO: 42221 - DNA, 103 bp, Artificial Sequence
  Synthetic Polynucleotide
taatacgactcactatagggactgaaaatgtagaagaagatttggctcgtaacagaggagaacgagcatgatcttcttcaacctggcggcagcgcaaaagatg

SEQ ID NO: 42222 - DNA, 103 bp, Artificial Sequence
  Synthetic Polynucleotide
taatacgactcactatagggcaatgactgaaaatgtagaagaagatttggaacagaggagaccaaatatgcttctacataacctggcggcagcgcaaaagatg

SEQ ID NO: 42223 - DNA, 103 bp, Artificial Sequence
  Synthetic Polynucleotide
taatacgactcactatagggtgtatcaatgactgaaaatgtagaagaagaaacagaggagatcttctatgacattttcaaacctggcggcagcgcaaaagatg

SEQ ID NO: 42224 - DNA, 103 bp, Artificial Sequence
  Synthetic Polynucleotide
taatacgactcactataggggaacgtgtatcaatgactgaaaatgtagaaaacagaggagattctacatgttcagtcataacctggcggcagcgcaaaagatg

SEQ ID NO: 42225 - DNA, 103 bp, Artificial Sequence
  Synthetic Polynucleotide
taatacgactcactatagggatagtgaacgtgtatcaatgactgaaaatgaacagaggagacattttatgtcattgataaacctggcggcagcgcaaaagatg

SEQ ID NO: 42226 - DNA, 103 bp, Artificial Sequence
  Synthetic Polynucleotide
taatacgactcactatagggacaaacgaggacaacaataagtattttataaacagaggagatataaaatgcttattgttaacctggcggcagcgcaaaagatg

SEQ ID NO: 42227 - DNA, 103 bp, Artificial Sequence
  Synthetic Polynucleotide
taatacgactcactatagggtggagatagtgaacgtgtatcaatgactgaaacagaggagatcagtcatggatacacgtaacctggcggcagcgcaaaagatg

SEQ ID NO: 42228 - DNA, 103 bp, Artificial Sequence
  Synthetic Polynucleotide
taatacgactcactatagggctctctggagatagtgaacgtgtatcaatgaacagaggagacattgaatgacgttcactaacctggcggcagcgcaaaagatg

SEQ ID NO: 42229 - DNA, 103 bp, Artificial Sequence
  Synthetic Polynucleotide
taatacgactcactatagggtcggactctctggagatagtgaacgtgtataacagaggagaatacacatgcactatctcaacctggcggcagcgcaaaagatg

SEQ ID NO: 42230 - DNA, 103 bp, Artificial Sequence
  Synthetic Polynucleotide
taatacgactcactatagggcgttatcggactctctggagatagtgaacgaacagaggagacgttcaatgtctccagagaacctggcggcagcgcaaaagatg

SEQ ID NO: 42231 - DNA, 103 bp, Artificial Sequence
  Synthetic Polynucleotide
taatacgactcactataggggctaacgttatcggactctctggagatagtaacagaggagaactatcatgagagagtccaacctggcggcagcgcaaaagatg

SEQ ID NO: 42232 - DNA, 103 bp, Artificial Sequence
  Synthetic Polynucleotide
taatacgactcactatagggtggtggctaacgttatcggactctctggagaacagaggagactccagatggtccgataaaacctggcggcagcgcaaaagatg

SEQ ID NO: 42233 - DNA, 103 bp, Artificial Sequence
  Synthetic Polynucleotide
taatacgactcactatagggagaagtggtggctaacgttatcggactctcaacagaggagagagagtatgataacgttaaacctggcggcagcgcaaaagatg

SEQ ID NO: 42234 - DNA, 103 bp, Artificial Sequence
  Synthetic Polynucleotide
taatacgactcactataggggatagagaagtggtggctaacgttatcggaaacagaggagatccgatatggttagccacaacctggcggcagcgcaaaagatg

SEQ ID NO: 42235 - DNA, 103 bp, Artificial Sequence
  Synthetic Polynucleotide
taatacgactcactatagggtcattgatagagaagtggtggctaacgttaaacagaggagataacgtatgccaccacttaacctggcggcagcgcaaaagatg

SEQ ID NO: 42236 - DNA, 103 bp, Artificial Sequence
  Synthetic Polynucleotide
taatacgactcactatagggactaatcattgatagagaagtggtggctaaaacagaggagattagccatgacttctctaaacctggcggcagcgcaaaagatg

SEQ ID NO: 42237 - DNA, 103 bp, Artificial Sequence
  Synthetic Polynucleotide
taatacgactcactatagggggagatcattaaatgtttcatcagaaatgaaacagaggagatcatttatgatgaaacataacctggcggcagcgcaaaagatg

SEQ ID NO: 42238 - DNA, 103 bp, Artificial Sequence
  Synthetic Polynucleotide
taatacgactcactataggggattgacaaacgaggacaacaataagtattaacagaggagaaatactatgtgttgtcctaacctggcggcagcgcaaaagatg

SEQ ID NO: 42239 - DNA, 103 bp, Artificial Sequence
  Synthetic Polynucleotide
taatacgactcactatagggaagaaactaatcattgatagagaagtggtgaacagaggagacaccacatgtctatcaataacctggcggcagcgcaaaagatg

SEQ ID NO: 42240 - DNA, 103 bp, Artificial Sequence
  Synthetic Polynucleotide
taatacgactcactatagggcacttaagaaactaatcattgatagagaagaacagaggagacttctcatgcaatgattaaacctggcggcagcgcaaaagatg

SEQ ID NO: 42241 - DNA, 103 bp, Artificial Sequence
  Synthetic Polynucleotide
taatacgactcactatagggatttgcacttaagaaactaatcattgatagaacagaggagactatcaatgattagtttcaacctggcggcagcgcaaaagatg

SEQ ID NO: 42242 - DNA, 103 bp, Artificial Sequence
  Synthetic Polynucleotide
taatacgactcactatagggattacatttgcacttaagaaactaatcattaacagaggagaaatgatatgtttcttaagaacctggcggcagcgcaaaagatg

SEQ ID NO: 42243 - DNA, 103 bp, Artificial Sequence
  Synthetic Polynucleotide
taatacgactcactatagggcaaaaattacatttgcacttaagaaactaaaacagaggagattagttatgtaagtgcaaaacctggcggcagcgcaaaagatg

SEQ ID NO: 42244 - DNA, 103 bp, Artificial Sequence
  Synthetic Polynucleotide
taatacgactcactatagggtgaaacaaaaattacatttgcacttaagaaaacagaggagattcttaatggcaaatgtaaacctggcggcagcgcaaaagatg

SEQ ID NO: 42245 - DNA, 103 bp, Artificial Sequence
  Synthetic Polynucleotide
taatacgactcactatagggggaactgaaacaaaaattacatttgcacttaacagaggagaaagtgcatgtgtaattttaacctggcggcagcgcaaaagatg

SEQ ID NO: 42246 - DNA, 103 bp, Artificial Sequence
  Synthetic Polynucleotide
taatacgactcactataggggatccggaactgaaacaaaaattacatttgaacagaggagacaaatgatgtttttgtttaacctggcggcagcgcaaaagatg

SEQ ID NO: 42247 - DNA, 103 bp, Artificial Sequence
  Synthetic Polynucleotide
taatacgactcactatagggctatagatccggaactgaaacaaaaattacaacagaggagagtaattatggtttcagttaacctggcggcagcgcaaaagatg

SEQ ID NO: 42248 - DNA, 103 bp, Artificial Sequence
  Synthetic Polynucleotide
taatacgactcactataggggttttctatagatccggaactgaaacaaaaaacagaggagattttgtatgagttccggaaacctggcggcagcgcaaaagatg

SEQ ID NO: 42249 - DNA, 103 bp, Artificial Sequence
  Synthetic Polynucleotide
taatacgactcactatagggaacatgattgacaaacgaggacaacaataaaacagaggagattattgatgtcctcgtttaacctggcggcagcgcaaaagatg

SEQ ID NO: 42250 - DNA, 103 bp, Artificial Sequence
  Synthetic Polynucleotide
taatacgactcactatagggctgtagttttctatagatccggaactgaaaaacagaggagatttcagatgcggatctataacctggcggcagcgcaaaagatg

SEQ ID NO: 42251 - DNA, 103 bp, Artificial Sequence
  Synthetic Polynucleotide
taatacgactcactatagggcacacctgtagttttctatagatccggaacaacagaggagagttccgatgctatagaaaaacctggcggcagcgcaaaagatg

SEQ ID NO: 42252 - DNA, 103 bp, Artificial Sequence
  Synthetic Polynucleotide
taatacgactcactatagggattatcacacctgtagttttctatagatccaacagaggagaggatctatggaaaactacaacctggcggcagcgcaaaagatg

SEQ ID NO: 42253 - DNA, 103 bp, Artificial Sequence
  Synthetic Polynucleotide
taatacgactcactatagggaggcaattatcacacctgtagttttctataaacagaggagatatagaatgctacaggtgaacctggcggcagcgcaaaagatg

SEQ ID NO: 42254 - DNA, 103 bp, Artificial Sequence
  Synthetic Polynucleotide
taatacgactcactatagggagccaaggcaattatcacacctgtagttttaacagaggagaaaaactatgggtgtgataaacctggcggcagcgcaaaagatg

SEQ ID NO: 42255 - DNA, 103 bp, Artificial Sequence
  Synthetic Polynucleotide
taatacgactcactatagggcaattagccaaggcaattatcacacctgtaaacagaggagatacaggatggataattgcaacctggcggcagcgcaaaagatg

SEQ ID NO: 42256 - DNA, 103 bp, Artificial Sequence
  Synthetic Polynucleotide
taatacgactcactatagggaaagacaattagccaaggcaattatcacacaacagaggagagtgtgaatgttgccttggaacctggcggcagcgcaaaagatg

SEQ ID NO: 42257 - DNA, 103 bp, Artificial Sequence
  Synthetic Polynucleotide
taatacgactcactatagggaagagaaagacaattagccaaggcaattataacagaggagaataattatgttggctaataacctggcggcagcgcaaaagatg

SEQ ID NO: 42258 - DNA, 103 bp, Artificial Sequence
  Synthetic Polynucleotide
taatacgactcactatagggagtaaaagagaaagacaattagccaaggcaaacagaggagatgccttatgtaattgtctaacctggcggcagcgcaaaagatg

SEQ ID NO: 42259 - DNA, 103 bp, Artificial Sequence
  Synthetic Polynucleotide
taatacgactcactatagggcactcagtaaaagagaaagacaattagccaaacagaggagatggctaatggtctttctcaacctggcggcagcgcaaaagatg

SEQ ID NO: 42260 - DNA, 103 bp, Artificial Sequence
  Synthetic Polynucleotide
taatacgactcactatagggacattaacatgattgacaaacgaggacaacaacagaggagagttgtcatggtttgtcaaaacctggcggcagcgcaaaagatg

SEQ ID NO: 42261 - DNA, 103 bp, Artificial Sequence
  Synthetic Polynucleotide
taatacgactcactatagggagaatcactcagtaaaagagaaagacaattaacagaggagaaattgtatgtctcttttaaacctggcggcagcgcaaaagatg

SEQ ID NO: 42262 - DNA, 103 bp, Artificial Sequence
  Synthetic Polynucleotide
taatacgactcactataggggaactagaatcactcagtaaaagagaaagaaacagaggagatctttcatgtttactgagaacctggcggcagcgcaaaagatg

SEQ ID NO: 42263 - DNA, 103 bp, Artificial Sequence
  Synthetic Polynucleotide
taatacgactcactatagggaaggtgaactagaatcactcagtaaaagagaacagaggagactctttatgtgagtgattaacctggcggcagcgcaaaagatg

SEQ ID NO: 42264 - DNA, 103 bp, Artificial Sequence
  Synthetic Polynucleotide
taatacgactcactatagggtatagaaggtgaactagaatcactcagtaaaacagaggagattactgatggattctagtaacctggcggcagcgcaaaagatg

SEQ ID NO: 42265 - DNA, 103 bp, Artificial Sequence
  Synthetic Polynucleotide
taatacgactcactatagggagatctatagaaggtgaactagaatcactcaacagaggagagagtgaatgtagttcaccaacctggcggcagcgcaaaagatg

SEQ ID NO: 42266 - DNA, 103 bp, Artificial Sequence
  Synthetic Polynucleotide
taatacgactcactatagggttctcagatctatagaaggtgaactagaataacagaggagaattctaatgcaccttctaaacctggcggcagcgcaaaagatg

SEQ ID NO: 42267 - DNA, 103 bp, Artificial Sequence
  Synthetic Polynucleotide
taatacgactcactatagggatccattctcagatctatagaaggtgaactaacagaggagaagttcaatgtctatagataacctggcggcagcgcaaaagatg

SEQ ID NO: 42268 - DNA, 103 bp, Artificial Sequence
  Synthetic Polynucleotide
taatacgactcactataggggaattatccattctcagatctatagaaggtaacagaggagaaccttcatgagatctgagaacctggcggcagcgcaaaagatg

SEQ ID NO: 42269 - DNA, 103 bp, Artificial Sequence
  Synthetic Polynucleotide
taatacgactcactatagggctggagaattatccattctcagatctatagaacagaggagactatagatgtgagaatggaacctggcggcagcgcaaaagatg

SEQ ID NO: 42270 - DNA, 103 bp, Artificial Sequence
  Synthetic Polynucleotide
taatacgactcactatagggttcgactggagaattatccattctcagatcaacagaggagagatctgatgatggataataacctggcggcagcgcaaaagatg

SEQ ID NO: 42271 - DNA, 103 bp, Artificial Sequence
  Synthetic Polynucleotide
taatacgactcactatagggtaaagacattaacatgattgacaaacgaggaacagaggagacctcgtatgtcaatcatgaacctggcggcagcgcaaaagatg

SEQ ID NO: 42272 - DNA, 103 bp, Artificial Sequence
  Synthetic Polynucleotide
taatacgactcactatagggtatgtttcgactggagaattatccattctcaacagaggagagagaatatgtaattctccaacctggcggcagcgcaaaagatg

SEQ ID NO: 42273 - DNA, 103 bp, Artificial Sequence
  Synthetic Polynucleotide
taatacgactcactatagggtagaatatgtttcgactggagaattatccaaacagaggagatggataatgctccagtcgaacctggcggcagcgcaaaagatg

SEQ ID NO: 42274 - DNA, 103 bp, Artificial Sequence
  Synthetic Polynucleotide
taatacgactcactatagggcatggtagaatatgtttcgactggagaattaacagaggagaaattctatggtcgaaacaaacctggcggcagcgcaaaagatg

SEQ ID NO: 42275 - DNA, 103 bp, Artificial Sequence
  Synthetic Polynucleotide
taatacgactcactatagggggagccatggtagaatatgtttcgactggaaacagaggagatccagtatgaacatattcaacctggcggcagcgcaaaagatg

SEQ ID NO: 42276 - DNA, 103 bp, Artificial Sequence
  Synthetic Polynucleotide
taatacgactcactatagggtaaacggagccatggtagaatatgtttcgaaacagaggagatcgaaaatgattctaccaaacctggcggcagcgcaaaagatg

SEQ ID NO: 42277 - DNA, 103 bp, Artificial Sequence
  Synthetic Polynucleotide
taatacgactcactatagggcaaattaaacggagccatggtagaatatgtaacagaggagaacatatatgaccatggctaacctggcggcagcgcaaaagatg

SEQ ID NO: 42278 - DNA, 103 bp, Artificial Sequence
  Synthetic Polynucleotide
taatacgactcactatagggattaacaaattaaacggagccatggtagaaaacagaggagattctacatgggctccgttaacctggcggcagcgcaaaagatg

SEQ ID NO: 42279 - DNA, 103 bp, Artificial Sequence
  Synthetic Polynucleotide
taatacgactcactatagggtcttcattaacaaattaaacggagccatggaacagaggagaccatggatgcgtttaattaacctggcggcagcgcaaaagatg

SEQ ID NO: 42280 - DNA, 103 bp, Artificial Sequence
  Synthetic Polynucleotide
taatacgactcactatagggatccatcttcattaacaaattaaacggagcaacagaggagagctccgatgaatttgttaaacctggcggcagcgcaaaagatg

SEQ ID NO: 42281 - DNA, 103 bp, Artificial Sequence
  Synthetic Polynucleotide
taatacgactcactataggggatgaatccatcttcattaacaaattaaacaacagaggagagtttaaatggttaatgaaaacctggcggcagcgcaaaagatg

SEQ ID NO: 42282 - DNA, 103 bp, Artificial Sequence
  Synthetic Polynucleotide
taatacgactcactatagggtatcttaaagacattaacatgattgacaaaaacagaggagatttgtcatgcatgttaataacctggcggcagcgcaaaagatg

SEQ ID NO: 42283 - DNA, 103 bp, Artificial Sequence
  Synthetic Polynucleotide
taatacgactcactatagggttaaggatgaatccatcttcattaacaaataacagaggagaatttgtatgtgaagatggaacctggcggcagcgcaaaagatg

SEQ ID NO: 42284 - DNA, 103 bp, Artificial Sequence
  Synthetic Polynucleotide
taatacgactcactatagggaacatttaaggatgaatccatcttcattaaaacagaggagattaatgatgatggattcaaacctggcggcagcgcaaaagatg

SEQ ID NO: 42285 - DNA, 103 bp, Artificial Sequence
  Synthetic Polynucleotide
taatacgactcactataggggagaaaacatttaaggatgaatccatcttcaacagaggagagaagatatgttcatccttaacctggcggcagcgcaaaagatg

SEQ ID NO: 42286 - DNA, 103 bp, Artificial Sequence
  Synthetic Polynucleotide
taatacgactcactatagggttacagagaaaacatttaaggatgaatccaaacagaggagatggattatgccttaaatgaacctggcggcagcgcaaaagatg

SEQ ID NO: 42287 - DNA, 103 bp, Artificial Sequence
  Synthetic Polynucleotide
taatacgactcactatagggaactattacagagaaaacatttaaggatgaaacagaggagatcatccatgaatgttttcaacctggcggcagcgcaaaagatg

SEQ ID NO: 42288 - DNA, 103 bp, Artificial Sequence
  Synthetic Polynucleotide
taatacgactcactataggggtggaaactattacagagaaaacatttaagaacagaggagacttaaaatgtttctctgtaacctggcggcagcgcaaaagatg

SEQ ID NO: 42289 - DNA, 103 bp, Artificial Sequence
  Synthetic Polynucleotide
taatacgactcactatagggttttggtggaaactattacagagaaaacataacagaggagaatgtttatgctgtaatagaacctggcggcagcgcaaaagatg

SEQ ID NO: 42290 - DNA, 103 bp, Artificial Sequence
  Synthetic Polynucleotide
taatacgactcactatagggtagtcttttggtggaaactattacagagaaaacagaggagattctctatgatagtttccaacctggcggcagcgcaaaagatg

SEQ ID NO: 42291 - DNA, 103 bp, Artificial Sequence
  Synthetic Polynucleotide
taatacgactcactatagggttgcatagtcttttggtggaaactattacaaacagaggagatgtaatatgttccaccaaaacctggcggcagcgcaaaagatg

SEQ ID NO: 42292 - DNA, 103 bp, Artificial Sequence
  Synthetic Polynucleotide
taatacgactcactatagggattctttgcatagtcttttggtggaaactaaacagaggagatagtttatgccaaaagacaacctggcggcagcgcaaaagatg

SEQ ID NO: 42293 - DNA, 103 bp, Artificial Sequence
  Synthetic Polynucleotide
taatacgactcactatagggtgccttatcttaaagacattaacatgattgaacagaggagacaatcaatgtaatgtcttaacctggcggcagcgcaaaagatg

SEQ ID NO: 42294 - DNA, 103 bp, Artificial Sequence
  Synthetic Polynucleotide
taatacgactcactatagggtccaaattctttgcatagtcttttggtggaaacagaggagatccaccatgagactatgcaacctggcggcagcgcaaaagatg

SEQ ID NO: 42295 - DNA, 103 bp, Artificial Sequence
  Synthetic Polynucleotide
taatacgactcactatagggcgcattccaaattctttgcatagtcttttgaacagaggagacaaaagatgatgcaaagaaacctggcggcagcgcaaaagatg

SEQ ID NO: 42296 - DNA, 103 bp, Artificial Sequence
  Synthetic Polynucleotide
taatacgactcactatagggaggaacgcattccaaattctttgcatagtcaacagaggagagactatatgaagaatttgaacctggcggcagcgcaaaagatg

SEQ ID NO: 42297 - DNA, 103 bp, Artificial Sequence
  Synthetic Polynucleotide
taatacgactcactataggggcacaaggaacgcattccaaattctttgcaaacagaggagatgcaaaatgtttggaatgaacctggcggcagcgcaaaagatg

SEQ ID NO: 42298 - DNA, 103 bp, Artificial Sequence
  Synthetic Polynucleotide
taatacgactcactatagggattaagcacaaggaacgcattccaaattctaacagaggagaagaattatgaatgcgttcaacctggcggcagcgcaaaagatg

SEQ ID NO: 42299 - DNA, 103 bp, Artificial Sequence
  Synthetic Polynucleotide
taatacgactcactataggggaaacattaagcacaaggaacgcattccaaaacagaggagattggaaatggttccttgtaacctggcggcagcgcaaaagatg

SEQ ID NO: 42300 - DNA, 103 bp, Artificial Sequence
  Synthetic Polynucleotide
taatacgactcactatagggctatggaaacattaagcacaaggaacgcataacagaggagaatgcgtatgttgtgcttaaacctggcggcagcgcaaaagatg

SEQ ID NO: 42301 - DNA, 103 bp, Artificial Sequence
  Synthetic Polynucleotide
taatacgactcactataggggctgtctatggaaacattaagcacaaggaaaacagaggagattccttatgcttaatgttaacctggcggcagcgcaaaagatg

SEQ ID NO: 42302 - DNA, 103 bp, Artificial Sequence
  Synthetic Polynucleotide
taatacgactcactatagggtagaagctgtctatggaaacattaagcacaaacagaggagatgtgctatgtgtttccataacctggcggcagcgcaaaagatg

SEQ ID NO: 42303 - DNA, 103 bp, Artificial Sequence
  Synthetic Polynucleotide
taatacgactcactatagggacttctagaagctgtctatggaaacattaaaacagaggagattaatgatgccatagacaaacctggcggcagcgcaaaagatg

SEQ ID NO: 42304 - DNA, 103 bp, Artificial Sequence
  Synthetic Polynucleotide
taatacgactcactatagggttgcctgccttatcttaaagacattaacataacagaggagaatgttaatgtctttaagaaacctggcggcagcgcaaaagatg

SEQ ID NO: 42305 - DNA, 103 bp, Artificial Sequence
  Synthetic Polynucleotide
taatacgactcactatagggtatcaacttctagaagctgtctatggaaacaacagaggagagtttccatggacagcttcaacctggcggcagcgcaaaagatg

SEQ ID NO: 42306 - DNA, 103 bp, Artificial Sequence
  Synthetic Polynucleotide
taatacgactcactatagggtgttgtatcaacttctagaagctgtctatgaacagaggagacatagaatgcttctagaaaacctggcggcagcgcaaaagatg

SEQ ID NO: 42307 - DNA, 103 bp, Artificial Sequence
  Synthetic Polynucleotide
taatacgactcactatagggtcctatgttgtatcaacttctagaagctgtaacagaggagaacagctatgagaagttgaaacctggcggcagcgcaaaagatg

SEQ ID NO: 42308 - DNA, 103 bp, Artificial Sequence
  Synthetic Polynucleotide
taatacgactcactataggggctagtcctatgttgtatcaacttctagaaaacagaggagattctagatgttgatacaaaacctggcggcagcgcaaaagatg

SEQ ID NO: 42309 - DNA, 103 bp, Artificial Sequence
  Synthetic Polynucleotide
taatacgactcactatagggccgcggctagtcctatgttgtatcaacttcaacagaggagagaagttatgacaacatagaacctggcggcagcgcaaaagatg

SEQ ID NO: 42310 - DNA, 103 bp, Artificial Sequence
  Synthetic Polynucleotide
taatacgactcactatagggagttaccgcggctagtcctatgttgtatcaaacagaggagatgatacatgataggactaaacctggcggcagcgcaaaagatg

SEQ ID NO: 42311 - DNA, 103 bp, Artificial Sequence
  Synthetic Polynucleotide
taatacgactcactatagggataaaagttaccgcggctagtcctatgttgaacagaggagacaacatatgactagccgcaacctggcggcagcgcaaaagatg

SEQ ID NO: 42312 - DNA, 103 bp, Artificial Sequence
  Synthetic Polynucleotide
taatacgactcactatagggtaaaaataaaagttaccgcggctagtcctaaacagaggagataggacatgccgcggtaaaacctggcggcagcgcaaaagatg

SEQ ID NO: 42313 - DNA, 103 bp, Artificial Sequence
  Synthetic Polynucleotide
taatacgactcactatagggctttctaaaaataaaagttaccgcggctagaacagaggagactagccatggtaacttttaacctggcggcagcgcaaaagatg

SEQ ID NO: 42314 - DNA, 103 bp, Artificial Sequence
  Synthetic Polynucleotide
taatacgactcactatagggggatactttctaaaaataaaagttaccgcgaacagaggagacgcggtatgttttattttaacctggcggcagcgcaaaagatg

SEQ ID NO: 42315 - DNA, 103 bp, Artificial Sequence
  Synthetic Polynucleotide
taatacgactcactatagggaacatttgcctgccttatcttaaagacattaacagaggagaaatgtcatgaagataaggaacctggcggcagcgcaaaagatg

SEQ ID NO: 42316 - DNA, 103 bp, Artificial Sequence
  Synthetic Polynucleotide
taatacgactcactataggggtgatggatactttctaaaaataaaagttaaacagaggagataacttatgtttttagaaaacctggcggcagcgcaaaagatg

SEQ ID NO: 42317 - DNA, 103 bp, Artificial Sequence
  Synthetic Polynucleotide
taatacgactcactatagggtagaagtgatggatactttctaaaaataaaaacagaggagatttattatgagaaagtataacctggcggcagcgcaaaagatg

SEQ ID NO: 42318 - DNA, 103 bp, Artificial Sequence
  Synthetic Polynucleotide
taatacgactcactatagggcaagatagaagtgatggatactttctaaaaaacagaggagattttagatggtatccatcaacctggcggcagcgcaaaagatg

SEQ ID NO: 42319 - DNA, 103 bp, Artificial Sequence
  Synthetic Polynucleotide
taatacgactcactatagggctaaacaagatagaagtgatggatactttcaacagaggagagaaagtatgcatcacttcaacctggcggcagcgcaaaagatg

SEQ ID NO: 42320 - DNA, 103 bp, Artificial Sequence
  Synthetic Polynucleotide
taatacgactcactatagggtaaatctaaacaagatagaagtgatggataaacagaggagatatccaatgcttctatctaacctggcggcagcgcaaaagatg

SEQ ID NO: 42321 - DNA, 103 bp, Artificial Sequence
  Synthetic Polynucleotide
taatacgactcactatagggaaaaataaatctaaacaagatagaagtgataacagaggagaatcactatgatcttgtttaacctggcggcagcgcaaaagatg

SEQ ID NO: 42322 - DNA, 103 bp, Artificial Sequence
  Synthetic Polynucleotide
taatacgactcactatagggtttataaaaataaatctaaacaagatagaaaacagaggagattctatatggtttagattaacctggcggcagcgcaaaagatg

SEQ ID NO: 42323 - DNA, 103 bp, Artificial Sequence
  Synthetic Polynucleotide
taatacgactcactatagggtaaactttataaaaataaatctaaacaagaaacagaggagatcttgtatggatttatttaacctggcggcagcgcaaaagatg

SEQ ID NO: 42324 - DNA, 103 bp, Artificial Sequence
  Synthetic Polynucleotide
taatacgactcactataggggagactaaactttataaaaataaatctaaaaacagaggagatttagaatgatttttataaacctggcggcagcgcaaaagatg

SEQ ID NO: 42325 - DNA, 103 bp, Artificial Sequence
  Synthetic Polynucleotide
taatacgactcactatagggaaggagagactaaactttataaaaataaataacagaggagaatttatatgtataaagttaacctggcggcagcgcaaaagatg

SEQ ID NO: 42326 - DNA, 103 bp, Artificial Sequence
  Synthetic Polynucleotide
taatacgactcactatagggctataaacatttgcctgccttatcttaaagaacagaggagactttaaatgaaggcaggcaacctggcggcagcgcaaaagatg

SEQ ID NO: 42327 - DNA, 103 bp, Artificial Sequence
  Synthetic Polynucleotide
taatacgactcactataggggttggaaggagagactaaactttataaaaaaacagaggagatttttaatgagtttagtcaacctggcggcagcgcaaaagatg

SEQ ID NO: 42328 - DNA, 103 bp, Artificial Sequence
  Synthetic Polynucleotide
taatacgactcactatagggattatgttggaaggagagactaaactttataacagaggagaataaagatgagtctctccaacctggcggcagcgcaaaagatg

SEQ ID NO: 42329 - DNA, 103 bp, Artificial Sequence
  Synthetic Polynucleotide
taatacgactcactatagggcttttattatgttggaaggagagactaaacaacagaggagagtttagatgctccttccaaacctggcggcagcgcaaaagatg

SEQ ID NO: 42330 - DNA, 103 bp, Artificial Sequence
  Synthetic Polynucleotide
taatacgactcactatagggttccacttttattatgttggaaggagagacaacagaggagagtctctatgtccaacataaacctggcggcagcgcaaaagatg

SEQ ID NO: 42331 - DNA, 103 bp, Artificial Sequence
  Synthetic Polynucleotide
taatacgactcactatagggatgacttccacttttattatgttggaaggaaacagaggagatccttcatgcataataaaaacctggcggcagcgcaaaagatg

SEQ ID NO: 42332 - DNA, 103 bp, Artificial Sequence
  Synthetic Polynucleotide
taatacgactcactataggggtcaaatgacttccacttttattatgttggaacagaggagaccaacaatgtaaaagtggaacctggcggcagcgcaaaagatg

SEQ ID NO: 42333 - DNA, 103 bp, Artificial Sequence
  Synthetic Polynucleotide
taatacgactcactatagggatctagtcaaatgacttccacttttattataacagaggagaataataatggtggaagtcaacctggcggcagcgcaaaagatg

SEQ ID NO: 42334 - DNA, 103 bp, Artificial Sequence
  Synthetic Polynucleotide
taatacgactcactatagggagtttatctagtcaaatgacttccacttttaacagaggagaaaaagtatgagtcatttgaacctggcggcagcgcaaaagatg

SEQ ID NO: 42335 - DNA, 103 bp, Artificial Sequence
  Synthetic Polynucleotide
taatacgactcactatagggctgatagtttatctagtcaaatgacttccaaacagaggagatggaagatgtttgactagaacctggcggcagcgcaaaagatg

SEQ ID NO: 42336 - DNA, 103 bp, Artificial Sequence
  Synthetic Polynucleotide
taatacgactcactatagggacttactgatagtttatctagtcaaatgacaacagaggagagtcattatgctagataaaaacctggcggcagcgcaaaagatg

SEQ ID NO: 42337 - DNA, 103 bp, Artificial Sequence
  Synthetic Polynucleotide
taatacgactcactatagggtaatactataaacatttgcctgccttatctaacagaggagaagataaatgaggcaaatgaacctggcggcagcgcaaaagatg

SEQ ID NO: 42338 - DNA, 103 bp, Artificial Sequence
  Synthetic Polynucleotide
taatacgactcactatagggataaaacttactgatagtttatctagtcaaaacagaggagattgactatgtaaactatcaacctggcggcagcgcaaaagatg

SEQ ID NO: 42339 - DNA, 103 bp, Artificial Sequence
  Synthetic Polynucleotide
taatacgactcactatagggtctctataaaacttactgatagtttatctaaacagaggagatagataatgtatcagtaaaacctggcggcagcgcaaaagatg

SEQ ID NO: 42340 - DNA, 103 bp, Artificial Sequence
  Synthetic Polynucleotide
taatacgactcactatagggatctatctctataaaacttactgatagtttaacagaggagaaaactaatggtaagttttaacctggcggcagcgcaaaagatg

SEQ ID NO: 42341 - DNA, 103 bp, Artificial Sequence
  Synthetic Polynucleotide
taatacgactcactatagggtgttcatctatctctataaaacttactgataacagaggagaatcagtatgttttatagaaacctggcggcagcgcaaaagatg

SEQ ID NO: 42342 - DNA, 103 bp, Artificial Sequence
  Synthetic Polynucleotide
taatacgactcactatagggctaattgttcatctatctctataaaacttaaacagaggagataagttatgtagagatagaacctggcggcagcgcaaaagatg

SEQ ID NO: 42343 - DNA, 103 bp, Artificial Sequence
  Synthetic Polynucleotide
taatacgactcactatagggatacgctaattgttcatctatctctataaaaacagaggagatttataatgatagatgaaaacctggcggcagcgcaaaagatg

SEQ ID NO: 42344 - DNA, 103 bp, Artificial Sequence
  Synthetic Polynucleotide
taatacgactcactatagggtctcaatacgctaattgttcatctatctctaacagaggagaagagatatgtgaacaattaacctggcggcagcgcaaaagatg

SEQ ID NO: 42345 - DNA, 103 bp, Artificial Sequence
  Synthetic Polynucleotide
taatacgactcactatagggatgcttctcaatacgctaattgttcatctaaacagaggagatagatgatgaattagcgtaacctggcggcagcgcaaaagatg

SEQ ID NO: 42346 - DNA, 103 bp, Artificial Sequence
  Synthetic Polynucleotide
taatacgactcactatagggactaaatgcttctcaatacgctaattgttcaacagaggagagaacaaatggcgtattgaaacctggcggcagcgcaaaagatg

SEQ ID NO: 42347 - DNA, 103 bp, Artificial Sequence
  Synthetic Polynucleotide
taatacgactcactataggggtcacactaaatgcttctcaatacgctaataacagaggagaattagcatgttgagaagcaacctggcggcagcgcaaaagatg

SEQ ID NO: 42348 - DNA, 103 bp, Artificial Sequence
  Synthetic Polynucleotide
taatacgactcactatagggtgcgtggagatcattaaatgtttcatcagaaacagaggagatctgatatgacatttaataacctggcggcagcgcaaaagatg

SEQ ID NO: 42349 - DNA, 103 bp, Artificial Sequence
  Synthetic Polynucleotide
taatacgactcactatagggattcttaatactataaacatttgcctgcctaacagaggagaaggcagatgaatgtttataacctggcggcagcgcaaaagatg

SEQ ID NO: 42350 - DNA, 103 bp, Artificial Sequence
  Synthetic Polynucleotide
taatacgactcactatagggaatacgtcacactaaatgcttctcaatacgaacagaggagacgtattatgaagcatttaaacctggcggcagcgcaaaagatg

SEQ ID NO: 42351 - DNA, 103 bp, Artificial Sequence
  Synthetic Polynucleotide
taatacgactcactatagggtatcgaatacgtcacactaaatgcttctcaaacagaggagatgagaaatgtttagtgtgaacctggcggcagcgcaaaagatg

SEQ ID NO: 42352 - DNA, 103 bp, Artificial Sequence
  Synthetic Polynucleotide
taatacgactcactatagggaaatgtatcgaatacgtcacactaaatgctaacagaggagaagcattatgtgtgacgtaaacctggcggcagcgcaaaagatg

SEQ ID NO: 42353 - DNA, 103 bp, Artificial Sequence
  Synthetic Polynucleotide
taatacgactcactatagggatgcaaaatgtatcgaatacgtcacactaaaacagaggagattagtgatgcgtattcgaaacctggcggcagcgcaaaagatg

SEQ ID NO: 42354 - DNA, 103 bp, Artificial Sequence
  Synthetic Polynucleotide
taatacgactcactatagggatctaatgcaaaatgtatcgaatacgtcacaacagaggagagtgacgatgtcgatacataacctggcggcagcgcaaaagatg

SEQ ID NO: 42355 - DNA, 103 bp, Artificial Sequence
  Synthetic Polynucleotide
taatacgactcactatagggagtaaatctaatgcaaaatgtatcgaatacaacagaggagagtattcatgacattttgcaacctggcggcagcgcaaaagatg

SEQ ID NO: 42356 - DNA, 103 bp, Artificial Sequence
  Synthetic Polynucleotide
taatacgactcactatagggcgattagtaaatctaatgcaaaatgtatcgaacagaggagacgatacatgttgcattagaacctggcggcagcgcaaaagatg

SEQ ID NO: 42357 - DNA, 103 bp, Artificial Sequence
  Synthetic Polynucleotide
taatacgactcactatagggaaaatcgattagtaaatctaatgcaaaatgaacagaggagacattttatgttagatttaaacctggcggcagcgcaaaagatg

SEQ ID NO: 42358 - DNA, 103 bp, Artificial Sequence
  Synthetic Polynucleotide
taatacgactcactatagggtatgcaaaatcgattagtaaatctaatgcaaacagaggagatgcattatgtttactaataacctggcggcagcgcaaaagatg

SEQ ID NO: 42359 - DNA, 103 bp, Artificial Sequence
  Synthetic Polynucleotide
taatacgactcactatagggtagagtatgcaaaatcgattagtaaatctaaacagaggagatagattatgtaatcgattaacctggcggcagcgcaaaagatg

SEQ ID NO: 42360 - DNA, 103 bp, Artificial Sequence
  Synthetic Polynucleotide
taatacgactcactataggggcccaattcttaatactataaacatttgccaacagaggagaggcaaaatgttatagtataacctggcggcagcgcaaaagatg

SEQ ID NO: 42361 - DNA, 103 bp, Artificial Sequence
  Synthetic Polynucleotide
taatacgactcactatagggtgttatagagtatgcaaaatcgattagtaaaacagaggagattactaatggattttgcaaacctggcggcagcgcaaaagatg

SEQ ID NO: 42362 - DNA, 103 bp, Artificial Sequence
  Synthetic Polynucleotide
taatacgactcactataggggcgggtgttatagagtatgcaaaatcgattaacagaggagaaatcgaatgtgcatactcaacctggcggcagcgcaaaagatg

SEQ ID NO: 42363 - DNA, 103 bp, Artificial Sequence
  Synthetic Polynucleotide
taatacgactcactatagggcttgtgcgggtgttatagagtatgcaaaataacagaggagaattttgatgactctataaaacctggcggcagcgcaaaagatg

SEQ ID NO: 42364 - DNA, 103 bp, Artificial Sequence
  Synthetic Polynucleotide
taatacgactcactatagggacagacttgtgcgggtgttatagagtatgcaacagaggagagcatacatgataacacccaacctggcggcagcgcaaaagatg

SEQ ID NO: 42365 - DNA, 103 bp, Artificial Sequence
  Synthetic Polynucleotide
taatacgactcactatagggtctctacagacttgtgcgggtgttatagagaacagaggagactctatatgacccgcacaaacctggcggcagcgcaaaagatg

SEQ ID NO: 42366 - DNA, 103 bp, Artificial Sequence
  Synthetic Polynucleotide
taatacgactcactataggggcgattctctacagacttgtgcgggtgttaaacagaggagataacacatgcacaagtctaacctggcggcagcgcaaaagatg

SEQ ID NO: 42367 - DNA, 103 bp, Artificial Sequence
  Synthetic Polynucleotide
taatacgactcactatagggatctagcgattctctacagacttgtgcgggaacagaggagacccgcaatggtctgtagaaacctggcggcagcgcaaaagatg

SEQ ID NO: 42368 - DNA, 103 bp, Artificial Sequence
  Synthetic Polynucleotide
taatacgactcactatagggacagcatctagcgattctctacagacttgtaacagaggagaacaagtatgtagagaatcaacctggcggcagcgcaaaagatg

SEQ ID NO: 42369 - DNA, 103 bp, Artificial Sequence
  Synthetic Polynucleotide
taatacgactcactataggggacctacagcatctagcgattctctacagaaacagaggagatctgtaatgaatcgctagaacctggcggcagcgcaaaagatg

SEQ ID NO: 42370 - DNA, 103 bp, Artificial Sequence
  Synthetic Polynucleotide
taatacgactcactatagggaccaagacctacagcatctagcgattctctaacagaggagaagagaaatgctagatgctaacctggcggcagcgcaaaagatg

SEQ ID NO: 42371 - DNA, 103 bp, Artificial Sequence
  Synthetic Polynucleotide
taatacgactcactatagggtgcttgcccaattcttaatactataaacataacagaggagaatgtttatggtattaagaaacctggcggcagcgcaaaagatg

SEQ ID NO: 42372 - DNA, 103 bp, Artificial Sequence
  Synthetic Polynucleotide
taatacgactcactatagggacttcaccaagacctacagcatctagcgataacagaggagaatcgctatgtgctgtaggaacctggcggcagcgcaaaagatg

SEQ ID NO: 42373 - DNA, 103 bp, Artificial Sequence
  Synthetic Polynucleotide
taatacgactcactatagggttgaaacttcaccaagacctacagcatctaaacagaggagatagatgatgtaggtcttgaacctggcggcagcgcaaaagatg

SEQ ID NO: 42374 - DNA, 103 bp, Artificial Sequence
  Synthetic Polynucleotide
taatacgactcactataggggagagttgaaacttcaccaagacctacagcaacagaggagagctgtaatgcttggtgaaaacctggcggcagcgcaaaagatg

SEQ ID NO: 42375 - DNA, 103 bp, Artificial Sequence
  Synthetic Polynucleotide
taatacgactcactatagggaaaaagagagttgaaacttcaccaagacctaacagaggagaaggtctatgtgaagtttcaacctggcggcagcgcaaaagatg

SEQ ID NO: 42376 - DNA, 103 bp, Artificial Sequence
  Synthetic Polynucleotide
taatacgactcactatagggtaatcaaaaagagagttgaaacttcaccaaaacagaggagattggtgatgtttcaactcaacctggcggcagcgcaaaagatg

SEQ ID NO: 42377 - DNA, 103 bp, Artificial Sequence
  Synthetic Polynucleotide
taatacgactcactatagggtaaggtaatcaaaaagagagttgaaacttcaacagaggagagaagttatgactctctttaacctggcggcagcgcaaaagatg

SEQ ID NO: 42378 - DNA, 103 bp, Artificial Sequence
  Synthetic Polynucleotide
taatacgactcactatagggatgagtaaggtaatcaaaaagagagttgaaaacagaggagattcaacatgctttttgataacctggcggcagcgcaaaagatg

SEQ ID NO: 42379 - DNA, 103 bp, Artificial Sequence
  Synthetic Polynucleotide
taatacgactcactatagggtaatcatgagtaaggtaatcaaaaagagagaacagaggagactctctatgtgattacctaacctggcggcagcgcaaaagatg

SEQ ID NO: 42380 - DNA, 103 bp, Artificial Sequence
  Synthetic Polynucleotide
taatacgactcactatagggaggtttaatcatgagtaaggtaatcaaaaaaacagaggagatttttgatgaccttactcaacctggcggcagcgcaaaagatg

SEQ ID NO: 42381 - DNA, 103 bp, Artificial Sequence
  Synthetic Polynucleotide
taatacgactcactatagggtatttaggtttaatcatgagtaaggtaatcaacagaggagagattacatgactcatgataacctggcggcagcgcaaaagatg

SEQ ID NO: 42382 - DNA, 103 bp, Artificial Sequence
  Synthetic Polynucleotide
taatacgactcactatagggtcttatgcttgcccaattcttaatactataaacagaggagatatagtatgaagaattggaacctggcggcagcgcaaaagatg

SEQ ID NO: 42383 - DNA, 103 bp, Artificial Sequence
  Synthetic Polynucleotide
taatacgactcactatagggataattatttaggtttaatcatgagtaaggaacagaggagaccttacatgtgattaaacaacctggcggcagcgcaaaagatg

SEQ ID NO: 42384 - DNA, 103 bp, Artificial Sequence
  Synthetic Polynucleotide
taatacgactcactatagggaaagtataattatttaggtttaatcatgagaacagaggagactcatgatgaaacctaaaaacctggcggcagcgcaaaagatg

SEQ ID NO: 42385 - DNA, 103 bp, Artificial Sequence
  Synthetic Polynucleotide
taatacgactcactatagggattacaaagtataattatttaggtttaatcaacagaggagagattaaatgtaaataattaacctggcggcagcgcaaaagatg

SEQ ID NO: 42386 - DNA, 103 bp, Artificial Sequence
  Synthetic Polynucleotide
taatacgactcactatagggattatattacaaagtataattatttaggttaacagaggagaaacctaatgaattatactaacctggcggcagcgcaaaagatg

SEQ ID NO: 42387 - DNA, 103 bp, Artificial Sequence
  Synthetic Polynucleotide
taatacgactcactatagggatatcattatattacaaagtataattatttaacagaggagaaaataaatgtactttgtaaacctggcggcagcgcaaaagatg

SEQ ID NO: 42388 - DNA, 103 bp, Artificial Sequence
  Synthetic Polynucleotide
taatacgactcactatagggaatatatatcattatattacaaagtataataacagaggagaattataatgtgtaatataaacctggcggcagcgcaaaagatg

SEQ ID NO: 42389 - DNA, 103 bp, Artificial Sequence
  Synthetic Polynucleotide
taatacgactcactataggggtgaaaatatatatcattatattacaaagtaacagaggagaactttgatgtataatgataacctggcggcagcgcaaaagatg

SEQ ID NO: 42390 - DNA, 103 bp, Artificial Sequence
  Synthetic Polynucleotide
taatacgactcactatagggataaagtgaaaatatatatcattatattacaacagaggagagtaataatgtgatatataaacctggcggcagcgcaaaagatg

SEQ ID NO: 42391 - DNA, 103 bp, Artificial Sequence
  Synthetic Polynucleotide
taatacgactcactatagggatgagataaagtgaaaatatatatcattataacagaggagaataatgatgtatattttcaacctggcggcagcgcaaaagatg

SEQ ID NO: 42392 - DNA, 103 bp, Artificial Sequence
  Synthetic Polynucleotide
taatacgactcactatagggttcaaatgagataaagtgaaaatatatatcaacagaggagagatataatgtttcactttaacctggcggcagcgcaaaagatg

SEQ ID NO: 42393 - DNA, 103 bp, Artificial Sequence
  Synthetic Polynucleotide
taatacgactcactatagggtcatgtcttatgcttgcccaattcttaataaacagaggagatattaaatgttgggcaagaacctggcggcagcgcaaaagatg

SEQ ID NO: 42394 - DNA, 103 bp, Artificial Sequence
  Synthetic Polynucleotide
taatacgactcactatagggttattttcaaatgagataaagtgaaaatataacagaggagaatatttatgctttatctcaacctggcggcagcgcaaaagatg

SEQ ID NO: 42395 - DNA, 103 bp, Artificial Sequence
  Synthetic Polynucleotide
taatacgactcactatagggcatttttattttcaaatgagataaagtgaaaacagaggagattcactatgtctcatttgaacctggcggcagcgcaaaagatg

SEQ ID NO: 42396 - DNA, 103 bp, Artificial Sequence
  Synthetic Polynucleotide
taatacgactcactatagggaaaaacatttttattttcaaatgagataaaaacagaggagatttatcatgtttgaaaataacctggcggcagcgcaaaagatg

SEQ ID NO: 42397 - DNA, 103 bp, Artificial Sequence
  Synthetic Polynucleotide
taatacgactcactatagggtaaacaaaaacatttttattttcaaatgagaacagaggagactcattatgaaataaaaaaacctggcggcagcgcaaaagatg

SEQ ID NO: 42398 - DNA, 103 bp, Artificial Sequence
  Synthetic Polynucleotide
taatacgactcactataggggcggttaaacaaaaacatttttattttcaaaacagaggagattgaaaatgaaaatgtttaacctggcggcagcgcaaaagatg

SEQ ID NO: 42399 - DNA, 103 bp, Artificial Sequence
  Synthetic Polynucleotide
taatacgactcactatagggatgcagcggttaaacaaaaacatttttattaacagaggagaaataaaatggtttttgttaacctggcggcagcgcaaaagatg

SEQ ID NO: 42400 - DNA, 103 bp, Artificial Sequence
  Synthetic Polynucleotide
taatacgactcactatagggacatcatgcagcggttaaacaaaaacatttaacagaggagaaaatgtatgtgtttaaccaacctggcggcagcgcaaaagatg

SEQ ID NO: 42401 - DNA, 103 bp, Artificial Sequence
  Synthetic Polynucleotide
taatacgactcactatagggtctgtacatcatgcagcggttaaacaaaaaaacagaggagatttttgatgaaccgctgcaacctggcggcagcgcaaaagatg

SEQ ID NO: 42402 - DNA, 103 bp, Artificial Sequence
  Synthetic Polynucleotide
taatacgactcactatagggcgaaatctgtacatcatgcagcggttaaacaacagaggagagtttaaatgctgcatgataacctggcggcagcgcaaaagatg

SEQ ID NO: 42403 - DNA, 103 bp, Artificial Sequence
  Synthetic Polynucleotide
taatacgactcactataggggattccgaaatctgtacatcatgcagcggtaacagaggagaaccgctatgtgatgtacaaacctggcggcagcgcaaaagatg

SEQ ID NO: 42404 - DNA, 103 bp, Artificial Sequence
  Synthetic Polynucleotide
taatacgactcactatagggttgtgtcatgtcttatgcttgcccaattctaacagaggagaagaattatgcaagcataaaacctggcggcagcgcaaaagatg

SEQ ID NO: 42405 - DNA, 103 bp, Artificial Sequence
  Synthetic Polynucleotide
taatacgactcactatagggtttgtgattccgaaatctgtacatcatgcaaacagaggagatgcatgatgtacagatttaacctggcggcagcgcaaaagatg

SEQ ID NO: 42406 - DNA, 103 bp, Artificial Sequence
  Synthetic Polynucleotide
taatacgactcactatagggggtggtttgtgattccgaaatctgtacatcaacagaggagagatgtaatgatttcggaaaacctggcggcagcgcaaaagatg

SEQ ID NO: 42407 - DNA, 103 bp, Artificial Sequence
  Synthetic Polynucleotide
taatacgactcactatagggccactggtggtttgtgattccgaaatctgtaacagaggagaacagatatgggaatcacaaacctggcggcagcgcaaaagatg

SEQ ID NO: 42408 - DNA, 103 bp, Artificial Sequence
  Synthetic Polynucleotide
taatacgactcactatagggtaaaaccactggtggtttgtgattccgaaaaacagaggagatttcggatgcacaaaccaaacctggcggcagcgcaaaagatg

SEQ ID NO: 42409 - DNA, 103 bp, Artificial Sequence
  Synthetic Polynucleotide
taatacgactcactatagggtaaaataaaaccactggtggtttgtgattcaacagaggagagaatcaatgaccaccagtaacctggcggcagcgcaaaagatg

SEQ ID NO: 42410 - DNA, 103 bp, Artificial Sequence
  Synthetic Polynucleotide
taatacgactcactatagggaaggataaaataaaaccactggtggtttgtaacagaggagaacaaacatgcagtggtttaacctggcggcagcgcaaaagatg

SEQ ID NO: 42411 - DNA, 103 bp, Artificial Sequence
  Synthetic Polynucleotide
taatacgactcactatagggtggacaaggataaaataaaaccactggtggaacagaggagaccaccaatggttttatttaacctggcggcagcgcaaaagatg

SEQ ID NO: 42412 - DNA, 103 bp, Artificial Sequence
  Synthetic Polynucleotide
taatacgactcactatagggcacattggacaaggataaaataaaaccactaacagaggagaagtggtatgattttatccaacctggcggcagcgcaaaagatg

SEQ ID NO: 42413 - DNA, 103 bp, Artificial Sequence
  Synthetic Polynucleotide
taatacgactcactatagggcaattcacattggacaaggataaaataaaaaacagaggagattttatatgatccttgtcaacctggcggcagcgcaaaagatg

SEQ ID NO: 42414 - DNA, 103 bp, Artificial Sequence
  Synthetic Polynucleotide
taatacgactcactatagggccattcaattcacattggacaaggataaaaaacagaggagattttatatgtgtccaatgaacctggcggcagcgcaaaagatg

SEQ ID NO: 42415 - DNA, 103 bp, Artificial Sequence
  Synthetic Polynucleotide
taatacgactcactatagggggtctttgtgtcatgtcttatgcttgcccaaacagaggagatgggcaatgataagacataacctggcggcagcgcaaaagatg

SEQ ID NO: 42416 - DNA, 103 bp, Artificial Sequence
  Synthetic Polynucleotide
taatacgactcactatagggcgctcccattcaattcacattggacaaggaaacagaggagatccttgatgaatgtgaataacctggcggcagcgcaaaagatg

SEQ ID NO: 42417 - DNA, 103 bp, Artificial Sequence
  Synthetic Polynucleotide
taatacgactcactataggggcatccgctcccattcaattcacattggacaacagaggagagtccaaatggaattgaataacctggcggcagcgcaaaagatg

SEQ ID NO: 42418 - DNA, 103 bp, Artificial Sequence
  Synthetic Polynucleotide
taatacgactcactatagggaacccgcatccgctcccattcaattcacataacagaggagaatgtgaatggaatgggagaacctggcggcagcgcaaaagatg

SEQ ID NO: 42419 - DNA, 103 bp, Artificial Sequence
  Synthetic Polynucleotide
taatacgactcactatagggtacgaaacccgcatccgctcccattcaattaacagaggagaaattgaatgggagcggataacctggcggcagcgcaaaagatg

SEQ ID NO: 42420 - DNA, 103 bp, Artificial Sequence
  Synthetic Polynucleotide
taatacgactcactatagggctacgtacgaaacccgcatccgctcccattaacagaggagaaatgggatgggatgcgggaacctggcggcagcgcaaaagatg

SEQ ID NO: 42421 - DNA, 103 bp, Artificial Sequence
  Synthetic Polynucleotide
taatacgactcactatagggactatctacgtacgaaacccgcatccgctcaacagaggagagagcggatgcgggtttcgaacctggcggcagcgcaaaagatg

SEQ ID NO: 42422 - DNA, 103 bp, Artificial Sequence
  Synthetic Polynucleotide
taatacgactcactatagggaatgtactatctacgtacgaaacccgcatcaacagaggagagatgcgatgttcgtacgtaacctggcggcagcgcaaaagatg

SEQ ID NO: 42423 - DNA, 103 bp, Artificial Sequence
  Synthetic Polynucleotide
taatacgactcactatagggacgggaatgtactatctacgtacgaaacccaacagaggagagggtttatgacgtagataaacctggcggcagcgcaaaagatg

SEQ ID NO: 42424 - DNA, 103 bp, Artificial Sequence
  Synthetic Polynucleotide
taatacgactcactatagggtaaaaacgggaatgtactatctacgtacgaaacagaggagatcgtacatggatagtacaaacctggcggcagcgcaaaagatg

SEQ ID NO: 42425 - DNA, 103 bp, Artificial Sequence
  Synthetic Polynucleotide
taatacgactcactatagggcggtctaaaaacgggaatgtactatctacgaacagaggagacgtagaatgtacattcccaacctggcggcagcgcaaaagatg

SEQ ID NO: 42426 - DNA, 103 bp, Artificial Sequence
  Synthetic Polynucleotide
taatacgactcactatagggaaaagggtctttgtgtcatgtcttatgcttaacagaggagaaagcatatgacatgacacaacctggcggcagcgcaaaagatg

SEQ ID NO: 42427 - DNA, 103 bp, Artificial Sequence
  Synthetic Polynucleotide
taatacgactcactatagggagtctcggtctaaaaacgggaatgtactataacagaggagaatagtaatgtcccgttttaacctggcggcagcgcaaaagatg

SEQ ID NO: 42428 - DNA, 103 bp, Artificial Sequence
  Synthetic Polynucleotide
taatacgactcactataggggatggagtctcggtctaaaaacgggaatgtaacagaggagaacattcatgtttttagacaacctggcggcagcgcaaaagatg

SEQ ID NO: 42429 - DNA, 103 bp, Artificial Sequence
  Synthetic Polynucleotide
taatacgactcactatagggttacggatggagtctcggtctaaaaacgggaacagaggagacccgttatgagaccgagaaacctggcggcagcgcaaaagatg

SEQ ID NO: 42430 - DNA, 103 bp, Artificial Sequence
  Synthetic Polynucleotide
taatacgactcactatagggcatttttacggatggagtctcggtctaaaaaacagaggagattttagatggagactccaaacctggcggcagcgcaaaagatg

SEQ ID NO: 42431 - DNA, 103 bp, Artificial Sequence
  Synthetic Polynucleotide
taatacgactcactataggggtatgcatttttacggatggagtctcggtcaacagaggagagaccgaatgtccatccgtaacctggcggcagcgcaaaagatg

SEQ ID NO: 42432 - DNA, 103 bp, Artificial Sequence
  Synthetic Polynucleotide
taatacgactcactatagggaacaagtatgcatttttacggatggagtctaacagaggagaagactcatgccgtaaaaaaacctggcggcagcgcaaaagatg

SEQ ID NO: 42433 - DNA, 103 bp, Artificial Sequence
  Synthetic Polynucleotide
taatacgactcactatagggaaactaacaagtatgcatttttacggatggaacagaggagaccatccatgaaaatgcataacctggcggcagcgcaaaagatg

SEQ ID NO: 42434 - DNA, 103 bp, Artificial Sequence
  Synthetic Polynucleotide
taatacgactcactatagggattccaaactaacaagtatgcatttttacgaacagaggagacgtaaaatggcatacttgaacctggcggcagcgcaaaagatg

SEQ ID NO: 42435 - DNA, 103 bp, Artificial Sequence
  Synthetic Polynucleotide
taatacgactcactataggggagttattccaaactaacaagtatgcatttaacagaggagaaaatgcatgcttgttagtaacctggcggcagcgcaaaagatg

SEQ ID NO: 42436 - DNA, 103 bp, Artificial Sequence
  Synthetic Polynucleotide
taatacgactcactataggggatccgagttattccaaactaacaagtatgaacagaggagacatactatgtagtttggaaacctggcggcagcgcaaaagatg

SEQ ID NO: 42437 - DNA, 103 bp, Artificial Sequence
  Synthetic Polynucleotide
taatacgactcactatagggatacaaaaagggtctttgtgtcatgtcttaaacagaggagataagacatgacacaaagaaacctggcggcagcgcaaaagatg

SEQ ID NO: 42438 - DNA, 103 bp, Artificial Sequence
  Synthetic Polynucleotide
taatacgactcactatagggtagcagatccgagttattccaaactaacaaaacagaggagattgttaatgtggaataacaacctggcggcagcgcaaaagatg

SEQ ID NO: 42439 - DNA, 103 bp, Artificial Sequence
  Synthetic Polynucleotide
taatacgactcactatagggccatatagcagatccgagttattccaaactaacagaggagaagtttgatgtaactcggaaacctggcggcagcgcaaaagatg

SEQ ID NO: 42440 - DNA, 103 bp, Artificial Sequence
  Synthetic Polynucleotide
taatacgactcactatagggaatatccatatagcagatccgagttattccaacagaggagaggaataatgcggatctgcaacctggcggcagcgcaaaagatg

SEQ ID NO: 42441 - DNA, 103 bp, Artificial Sequence
  Synthetic Polynucleotide
taatacgactcactatagggctatgaatatccatatagcagatccgagttaacagaggagaaactcgatgctgctatataacctggcggcagcgcaaaagatg

SEQ ID NO: 42442 - DNA, 103 bp, Artificial Sequence
  Synthetic Polynucleotide
taatacgactcactatagggtcaatctatgaatatccatatagcagatccaacagaggagaggatctatgatatggataaacctggcggcagcgcaaaagatg

SEQ ID NO: 42443 - DNA, 103 bp, Artificial Sequence
  Synthetic Polynucleotide
taatacgactcactatagggcaaagtcaatctatgaatatccatatagcaaacagaggagatgctatatggatattcataacctggcggcagcgcaaaagatg

SEQ ID NO: 42444 - DNA, 103 bp, Artificial Sequence
  Synthetic Polynucleotide
taatacgactcactatagggtcgatcaaagtcaatctatgaatatccataaacagaggagatatggaatgtcatagattaacctggcggcagcgcaaaagatg

SEQ ID NO: 42445 - DNA, 103 bp, Artificial Sequence
  Synthetic Polynucleotide
taatacgactcactatagggcttcatcgatcaaagtcaatctatgaatataacagaggagaatattcatggattgacttaacctggcggcagcgcaaaagatg

SEQ ID NO: 42446 - DNA, 103 bp, Artificial Sequence
  Synthetic Polynucleotide
taatacgactcactatagggggagccttcatcgatcaaagtcaatctatgaacagaggagacatagaatgactttgatcaacctggcggcagcgcaaaagatg

SEQ ID NO: 42447 - DNA, 103 bp, Artificial Sequence
  Synthetic Polynucleotide
taatacgactcactatagggacaggggagccttcatcgatcaaagtcaataacagaggagaattgacatggatcgatgaaacctggcggcagcgcaaaagatg

SEQ ID NO: 42448 - DNA, 103 bp, Artificial Sequence
  Synthetic Polynucleotide
taatacgactcactatagggtatatatacaaaaagggtctttgtgtcatgaacagaggagacatgacatgaagacccttaacctggcggcagcgcaaaagatg

SEQ ID NO: 42449 - DNA, 103 bp, Artificial Sequence
  Synthetic Polynucleotide
taatacgactcactatagggtgcagacaggggagccttcatcgatcaaagaacagaggagactttgaatgatgaaggctaacctggcggcagcgcaaaagatg

SEQ ID NO: 42450 - DNA, 103 bp, Artificial Sequence
  Synthetic Polynucleotide
taatacgactcactatagggatggctgcagacaggggagccttcatcgataacagaggagaatcgatatgggctcccctaacctggcggcagcgcaaaagatg

SEQ ID NO: 42451 - DNA, 103 bp, Artificial Sequence
  Synthetic Polynucleotide
taatacgactcactatagggtaaaaatggctgcagacaggggagccttcaaacagaggagatgaaggatgccctgtctgaacctggcggcagcgcaaaagatg

SEQ ID NO: 42452 - DNA, 103 bp, Artificial Sequence
  Synthetic Polynucleotide
taatacgactcactataggggatcataaaaatggctgcagacaggggagcaacagaggagagctcccatgtctgcagccaacctggcggcagcgcaaaagatg

SEQ ID NO: 42453 - DNA, 103 bp, Artificial Sequence
  Synthetic Polynucleotide
taatacgactcactatagggaagacgatcataaaaatggctgcagacaggaacagaggagacctgtcatgagccattttaacctggcggcagcgcaaaagatg

SEQ ID NO: 42454 - DNA, 103 bp, Artificial Sequence
  Synthetic Polynucleotide
taatacgactcactatagggcacaaaagacgatcataaaaatggctgcagaacagaggagactgcagatgtttttatgaaacctggcggcagcgcaaaagatg

SEQ ID NO: 42455 - DNA, 103 bp, Artificial Sequence
  Synthetic Polynucleotide
taatacgactcactatagggaattccacaaaagacgatcataaaaatggcaacagaggagagccattatgatgatcgtcaacctggcggcagcgcaaaagatg

SEQ ID NO: 42456 - DNA, 103 bp, Artificial Sequence
  Synthetic Polynucleotide
taatacgactcactatagggtgggaaattccacaaaagacgatcataaaaaacagaggagattttatatgcgtcttttgaacctggcggcagcgcaaaagatg

SEQ ID NO: 42457 - DNA, 103 bp, Artificial Sequence
  Synthetic Polynucleotide
taatacgactcactatagggctatttgggaaattccacaaaagacgatcaaacagaggagatgatcgatgtttgtggaaaacctggcggcagcgcaaaagatg

SEQ ID NO: 42458 - DNA, 103 bp, Artificial Sequence
  Synthetic Polynucleotide
taatacgactcactatagggtaaaactatttgggaaattccacaaaagacaacagaggagagtctttatgggaatttccaacctggcggcagcgcaaaagatg

SEQ ID NO: 42459 - DNA, 103 bp, Artificial Sequence
  Synthetic Polynucleotide
taatacgactcactatagggacaattgcgtggagatcattaaatgtttcaaacagaggagatgaaacatgtaatgatctaacctggcggcagcgcaaaagatg

SEQ ID NO: 42460 - DNA, 103 bp, Artificial Sequence
  Synthetic Polynucleotide
taatacgactcactatagggacacttatatatacaaaaagggtctttgtgaacagaggagacacaaaatgcctttttgtaacctggcggcagcgcaaaagatg

SEQ ID NO: 42461 - DNA, 103 bp, Artificial Sequence
  Synthetic Polynucleotide
taatacgactcactataggggtttataaaactatttgggaaattccacaaaacagaggagattgtggatgttcccaaataacctggcggcagcgcaaaagatg

SEQ ID NO: 42462 - DNA, 103 bp, Artificial Sequence
  Synthetic Polynucleotide
taatacgactcactatagggagcgagtttataaaactatttgggaaattcaacagaggagagaatttatgaaatagtttaacctggcggcagcgcaaaagatg

SEQ ID NO: 42463 - DNA, 103 bp, Artificial Sequence
  Synthetic Polynucleotide
taatacgactcactatagggtattaagcgagtttataaaactatttgggaaacagaggagatcccaaatggttttataaaacctggcggcagcgcaaaagatg

SEQ ID NO: 42464 - DNA, 103 bp, Artificial Sequence
  Synthetic Polynucleotide
taatacgactcactataggggaagatattaagcgagtttataaaactattaacagaggagaaatagtatgataaactcgaacctggcggcagcgcaaaagatg

SEQ ID NO: 42465 - DNA, 103 bp, Artificial Sequence
  Synthetic Polynucleotide
taatacgactcactatagggttccagaagatattaagcgagtttataaaaaacagaggagattttatatgctcgcttaaaacctggcggcagcgcaaaagatg

SEQ ID NO: 42466 - DNA, 103 bp, Artificial Sequence
  Synthetic Polynucleotide
taatacgactcactatagggaaaccttccagaagatattaagcgagtttaaacagaggagataaactatgttaatatctaacctggcggcagcgcaaaagatg

SEQ ID NO: 42467 - DNA, 103 bp, Artificial Sequence
  Synthetic Polynucleotide
taatacgactcactatagggaatacaaaccttccagaagatattaagcgaaacagaggagatcgcttatgatcttctggaacctggcggcagcgcaaaagatg

SEQ ID NO: 42468 - DNA, 103 bp, Artificial Sequence
  Synthetic Polynucleotide
taatacgactcactatagggttcagaatacaaaccttccagaagatattaaacagaggagataatatatgctggaaggtaacctggcggcagcgcaaaagatg

SEQ ID NO: 42469 - DNA, 103 bp, Artificial Sequence
  Synthetic Polynucleotide
taatacgactcactatagggatctattcagaatacaaaccttccagaagaaacagaggagatcttctatgaggtttgtaaacctggcggcagcgcaaaagatg

SEQ ID NO: 42470 - DNA, 103 bp, Artificial Sequence
  Synthetic Polynucleotide
taatacgactcactatagggggtggatctattcagaatacaaaccttccaaacagaggagatggaagatgtgtattctgaacctggcggcagcgcaaaagatg

SEQ ID NO: 42471 - DNA, 103 bp, Artificial Sequence
  Synthetic Polynucleotide
taatacgactcactatagggtttctacacttatatatacaaaaagggtctaacagaggagaagacccatgttgtatataaacctggcggcagcgcaaaagatg

SEQ ID NO: 42472 - DNA, 103 bp, Artificial Sequence
  Synthetic Polynucleotide
taatacgactcactatagggtagatggtggatctattcagaatacaaaccaacagaggagaggtttgatgtctgaatagaacctggcggcagcgcaaaagatg

SEQ ID NO: 42473 - DNA, 103 bp, Artificial Sequence
  Synthetic Polynucleotide
taatacgactcactatagggtatggtagatggtggatctattcagaatacaacagaggagagtattcatgatagatccaaacctggcggcagcgcaaaagatg

SEQ ID NO: 42474 - DNA, 103 bp, Artificial Sequence
  Synthetic Polynucleotide
taatacgactcactatagggaggattatggtagatggtggatctattcagaacagaggagactgaatatgtccaccatcaacctggcggcagcgcaaaagatg

SEQ ID NO: 42475 - DNA, 103 bp, Artificial Sequence
  Synthetic Polynucleotide
taatacgactcactatagggagaataggattatggtagatggtggatctaaacagaggagatagatcatgcatctaccaaacctggcggcagcgcaaaagatg

SEQ ID NO: 42476 - DNA, 103 bp, Artificial Sequence
  Synthetic Polynucleotide
taatacgactcactataggggatcaagaataggattatggtagatggtggaacagaggagaccaccaatgaccataatcaacctggcggcagcgcaaaagatg

SEQ ID NO: 42477 - DNA, 103 bp, Artificial Sequence
  Synthetic Polynucleotide
taatacgactcactataggggatgagatcaagaataggattatggtagataacagaggagaatctacatgaatcctattaacctggcggcagcgcaaaagatg

SEQ ID NO: 42478 - DNA, 103 bp, Artificial Sequence
  Synthetic Polynucleotide
taatacgactcactatagggggaatgatgagatcaagaataggattatggaacagaggagaccataaatgtattcttgaaacctggcggcagcgcaaaagatg

SEQ ID NO: 42479 - DNA, 103 bp, Artificial Sequence
  Synthetic Polynucleotide
taatacgactcactatagggattatggaatgatgagatcaagaataggataacagaggagaatcctaatgttgatctcaaacctggcggcagcgcaaaagatg

SEQ ID NO: 42480 - DNA, 103 bp, Artificial Sequence
  Synthetic Polynucleotide
taatacgactcactatagggagaaaattatggaatgatgagatcaagaataacagaggagaattcttatgctcatcattaacctggcggcagcgcaaaagatg

SEQ ID NO: 42481 - DNA, 103 bp, Artificial Sequence
  Synthetic Polynucleotide
taatacgactcactatagggccgagagaaaattatggaatgatgagatcaaacagaggagatgatctatgcattccataaacctggcggcagcgcaaaagatg

SEQ ID NO: 42482 - DNA, 103 bp, Artificial Sequence
  Synthetic Polynucleotide
taatacgactcactatagggtataatttctacacttatatatacaaaaagaacagaggagactttttatgtatataagtaacctggcggcagcgcaaaagatg

SEQ ID NO: 42483 - DNA, 103 bp, Artificial Sequence
  Synthetic Polynucleotide
taatacgactcactatagggtttaaccgagagaaaattatggaatgatgaaacagaggagatcatcaatgcataattttaacctggcggcagcgcaaaagatg

SEQ ID NO: 42484 - DNA, 103 bp, Artificial Sequence
  Synthetic Polynucleotide
taatacgactcactatagggagagttttaaccgagagaaaattatggaataacagaggagaattccaatgttttctctcaacctggcggcagcgcaaaagatg

SEQ ID NO: 42485 - DNA, 103 bp, Artificial Sequence
  Synthetic Polynucleotide
taatacgactcactatagggtccttagagttttaaccgagagaaaattataacagaggagaataattatgtctcggttaaacctggcggcagcgcaaaagatg

SEQ ID NO: 42486 - DNA, 103 bp, Artificial Sequence
  Synthetic Polynucleotide
taatacgactcactataggggcatctccttagagttttaaccgagagaaaaacagaggagatttctcatggttaaaactaacctggcggcagcgcaaaagatg

SEQ ID NO: 42487 - DNA, 103 bp, Artificial Sequence
  Synthetic Polynucleotide
taatacgactcactatagggaatccgcatctccttagagttttaaccgagaacagaggagactcggtatgaactctaagaacctggcggcagcgcaaaagatg

SEQ ID NO: 42488 - DNA, 103 bp, Artificial Sequence
  Synthetic Polynucleotide
taatacgactcactatagggtagttaatccgcatctccttagagttttaaaacagaggagattaaaaatgtaaggagataacctggcggcagcgcaaaagatg

SEQ ID NO: 42489 - DNA, 103 bp, Artificial Sequence
  Synthetic Polynucleotide
taatacgactcactatagggtcaagtagttaatccgcatctccttagagtaacagaggagaactctaatgagatgcggaaacctggcggcagcgcaaaagatg

SEQ ID NO: 42490 - DNA, 103 bp, Artificial Sequence
  Synthetic Polynucleotide
taatacgactcactataggggaatttcaagtagttaatccgcatctccttaacagaggagaaaggagatgcggattaacaacctggcggcagcgcaaaagatg

SEQ ID NO: 42491 - DNA, 103 bp, Artificial Sequence
  Synthetic Polynucleotide
taatacgactcactatagggctggagaatttcaagtagttaatccgcatcaacagaggagagatgcgatgtaactacttaacctggcggcagcgcaaaagatg

SEQ ID NO: 42492 - DNA, 103 bp, Artificial Sequence
  Synthetic Polynucleotide
taatacgactcactatagggattgtctggagaatttcaagtagttaatccaacagaggagaggattaatgacttgaaataacctggcggcagcgcaaaagatg

SEQ ID NO: 42493 - DNA, 103 bp, Artificial Sequence
  Synthetic Polynucleotide
taatacgactcactataggggatgttataatttctacacttatatatacaaacagaggagatgtataatgaagtgtagaaacctggcggcagcgcaaaagatg

SEQ ID NO: 42494 - DNA, 103 bp, Artificial Sequence
  Synthetic Polynucleotide
taatacgactcactatagggagagtattgtctggagaatttcaagtagttaacagaggagaaactacatgaaattctccaacctggcggcagcgcaaaagatg

SEQ ID NO: 42495 - DNA, 103 bp, Artificial Sequence
  Synthetic Polynucleotide
taatacgactcactatagggctcggagagtattgtctggagaatttcaagaacagaggagacttgaaatgctccagacaaacctggcggcagcgcaaaagatg

SEQ ID NO: 42496 - DNA, 103 bp, Artificial Sequence
  Synthetic Polynucleotide
taatacgactcactatagggttacactcggagagtattgtctggagaattaacagaggagaaattctatggacaatactaacctggcggcagcgcaaaagatg

SEQ ID NO: 42497 - DNA, 103 bp, Artificial Sequence
  Synthetic Polynucleotide
taatacgactcactatagggaatatttacactcggagagtattgtctggaaacagaggagatccagaatgtactctccgaacctggcggcagcgcaaaagatg

SEQ ID NO: 42498 - DNA, 103 bp, Artificial Sequence
  Synthetic Polynucleotide
taatacgactcactatagggccagtaatatttacactcggagagtattgtaacagaggagaacaataatgtccgagtgtaacctggcggcagcgcaaaagatg

SEQ ID NO: 42499 - DNA, 103 bp, Artificial Sequence
  Synthetic Polynucleotide
taatacgactcactataggggtataccagtaatatttacactcggagagtaacagaggagaactctcatggtgtaaataaacctggcggcagcgcaaaagatg

SEQ ID NO: 42500 - DNA, 103 bp, Artificial Sequence
  Synthetic Polynucleotide
taatacgactcactataggggaaccgtataccagtaatatttacactcggaacagaggagaccgagtatgaatattactaacctggcggcagcgcaaaagatg

SEQ ID NO: 42501 - DNA, 103 bp, Artificial Sequence
  Synthetic Polynucleotide
taatacgactcactatagggctgtggaaccgtataccagtaatatttacaaacagaggagatgtaaaatgtactggtataacctggcggcagcgcaaaagatg

SEQ ID NO: 42502 - DNA, 103 bp, Artificial Sequence
  Synthetic Polynucleotide
taatacgactcactatagggtgagtctgtggaaccgtataccagtaatataacagaggagaatattaatggtatacggtaacctggcggcagcgcaaaagatg

SEQ ID NO: 42503 - DNA, 103 bp, Artificial Sequence
  Synthetic Polynucleotide
taatacgactcactatagggaataatgagtctgtggaaccgtataccagtaacagaggagaactggtatgcggttccacaacctggcggcagcgcaaaagatg

SEQ ID NO: 42504 - DNA, 103 bp, Artificial Sequence
  Synthetic Polynucleotide
taatacgactcactatagggctatggatgttataatttctacacttatataacagaggagaatataaatgtagaaattaaacctggcggcagcgcaaaagatg

SEQ ID NO: 42505 - DNA, 103 bp, Artificial Sequence
  Synthetic Polynucleotide
taatacgactcactatagggtgggaaataatgagtctgtggaaccgtataaacagaggagatatacgatgccacagactaacctggcggcagcgcaaaagatg

SEQ ID NO: 42506 - DNA, 103 bp, Artificial Sequence
  Synthetic Polynucleotide
taatacgactcactatagggaattttgggaaataatgagtctgtggaaccaacagaggagaggttccatggactcattaaacctggcggcagcgcaaaagatg

SEQ ID NO: 42507 - DNA, 103 bp, Artificial Sequence
  Synthetic Polynucleotide
taatacgactcactataggggctcaaattttgggaaataatgagtctgtgaacagaggagacacagaatgattatttccaacctggcggcagcgcaaaagatg

SEQ ID NO: 42508 - DNA, 103 bp, Artificial Sequence
  Synthetic Polynucleotide
taatacgactcactatagggcaactgctcaaattttgggaaataatgagtaacagaggagaactcatatgttcccaaaaaacctggcggcagcgcaaaagatg

SEQ ID NO: 42509 - DNA, 103 bp, Artificial Sequence
  Synthetic Polynucleotide
taatacgactcactatagggtgcatcaactgctcaaattttgggaaataaaacagaggagattatttatgaaaatttgaaacctggcggcagcgcaaaagatg

SEQ ID NO: 42510 - DNA, 103 bp, Artificial Sequence
  Synthetic Polynucleotide
taatacgactcactatagggccgactgcatcaactgctcaaattttgggaaacagaggagatcccaaatgttgagcagtaacctggcggcagcgcaaaagatg

SEQ ID NO: 42511 - DNA, 103 bp, Artificial Sequence
  Synthetic Polynucleotide
taatacgactcactatagggctatgccgactgcatcaactgctcaaatttaacagaggagaaaatttatgcagttgatgaacctggcggcagcgcaaaagatg

SEQ ID NO: 42512 - DNA, 103 bp, Artificial Sequence
  Synthetic Polynucleotide
taatacgactcactatagggggcacctatgccgactgcatcaactgctcaaacagaggagatgagcaatggatgcagtcaacctggcggcagcgcaaaagatg

SEQ ID NO: 42513 - DNA, 103 bp, Artificial Sequence
  Synthetic Polynucleotide
taatacgactcactatagggttggtggcacctatgccgactgcatcaactaacagaggagaagttgaatgagtcggcataacctggcggcagcgcaaaagatg

SEQ ID NO: 42514 - DNA, 103 bp, Artificial Sequence
  Synthetic Polynucleotide
taatacgactcactataggggtttattggtggcacctatgccgactgcataacagaggagaatgcagatggcataggtgaacctggcggcagcgcaaaagatg

SEQ ID NO: 42515 - DNA, 103 bp, Artificial Sequence
  Synthetic Polynucleotide
taatacgactcactatagggtccaactatggatgttataatttctacactaacagaggagaagtgtaatgattataacaaacctggcggcagcgcaaaagatg

SEQ ID NO: 42516 - DNA, 103 bp, Artificial Sequence
  Synthetic Polynucleotide
taatacgactcactatagggaaatagtttattggtggcacctatgccgacaacagaggagagtcggcatgggtgccaccaacctggcggcagcgcaaaagatg

SEQ ID NO: 42517 - DNA, 103 bp, Artificial Sequence
  Synthetic Polynucleotide
taatacgactcactatagggcttagaaatagtttattggtggcacctatgaacagaggagacataggatgcaccaataaaacctggcggcagcgcaaaagatg

SEQ ID NO: 42518 - DNA, 103 bp, Artificial Sequence
  Synthetic Polynucleotide
taatacgactcactatagggacggtcttagaaatagtttattggtggcacaacagaggagagtgccaatgataaactataacctggcggcagcgcaaaagatg

SEQ ID NO: 42519 - DNA, 103 bp, Artificial Sequence
  Synthetic Polynucleotide
taatacgactcactatagggaacatacggtcttagaaatagtttattggtaacagaggagaaccaatatgctatttctaaacctggcggcagcgcaaaagatg

SEQ ID NO: 42520 - DNA, 103 bp, Artificial Sequence
  Synthetic Polynucleotide
taatacgactcactatagggatcagaacatacggtcttagaaatagtttaaacagaggagataaactatgtctaagaccaacctggcggcagcgcaaaagatg

SEQ ID NO: 42521 - DNA, 103 bp, Artificial Sequence
  Synthetic Polynucleotide
taatacgactcactatagggataaaatcagaacatacggtcttagaaataaacagaggagatatttcatggaccgtatgaacctggcggcagcgcaaaagatg

SEQ ID NO: 42522 - DNA, 103 bp, Artificial Sequence
  Synthetic Polynucleotide
taatacgactcactatagggaaaagataaaatcagaacatacggtcttagaacagaggagactaagaatgtatgttctgaacctggcggcagcgcaaaagatg

SEQ ID NO: 42523 - DNA, 103 bp, Artificial Sequence
  Synthetic Polynucleotide
taatacgactcactatagggcctctaaaagataaaatcagaacatacggtaacagaggagaaccgtaatgtctgattttaacctggcggcagcgcaaaagatg

SEQ ID NO: 42524 - DNA, 103 bp, Artificial Sequence
  Synthetic Polynucleotide
taatacgactcactataggggggaacctctaaaagataaaatcagaacataacagaggagaatgttcatgttttatcttaacctggcggcagcgcaaaagatg

SEQ ID NO: 42525 - DNA, 103 bp, Artificial Sequence
  Synthetic Polynucleotide
taatacgactcactataggggaattgggaacctctaaaagataaaatcagaacagaggagactgattatgtcttttagaaacctggcggcagcgcaaaagatg

SEQ ID NO: 42526 - DNA, 103 bp, Artificial Sequence
  Synthetic Polynucleotide
taatacgactcactataggggtaaatccaactatggatgttataatttctaacagaggagaagaaatatgaacatccataacctggcggcagcgcaaaagatg

SEQ ID NO: 42527 - DNA, 103 bp, Artificial Sequence
  Synthetic Polynucleotide
taatacgactcactatagggctttggaattgggaacctctaaaagataaaaacagaggagatttatcatgtagaggttcaacctggcggcagcgcaaaagatg

SEQ ID NO: 42528 - DNA, 103 bp, Artificial Sequence
  Synthetic Polynucleotide
taatacgactcactatagggcggatctttggaattgggaacctctaaaagaacagaggagacttttaatggttcccaataacctggcggcagcgcaaaagatg

SEQ ID NO: 42529 - DNA, 103 bp, Artificial Sequence
  Synthetic Polynucleotide
taatacgactcactatagggaccgtcggatctttggaattgggaacctctaacagaggagaagaggtatgcaattccaaaacctggcggcagcgcaaaagatg

SEQ ID NO: 42530 - DNA, 103 bp, Artificial Sequence
  Synthetic Polynucleotide
taatacgactcactataggggttgtaccgtcggatctttggaattgggaaaacagaggagattcccaatgccaaagatcaacctggcggcagcgcaaaagatg

SEQ ID NO: 42531 - DNA, 103 bp, Artificial Sequence
  Synthetic Polynucleotide
taatacgactcactatagggggaatgttgtaccgtcggatctttggaattaacagaggagaaattccatggatccgacgaacctggcggcagcgcaaaagatg

SEQ ID NO: 42532 - DNA, 103 bp, Artificial Sequence
  Synthetic Polynucleotide
taatacgactcactatagggtctttggaatgttgtaccgtcggatctttgaacagaggagacaaagaatggacggtacaaacctggcggcagcgcaaaagatg

SEQ ID NO: 42533 - DNA, 103 bp, Artificial Sequence
  Synthetic Polynucleotide
taatacgactcactatagggtatgatctttggaatgttgtaccgtcggataacagaggagaatccgaatgtacaacattaacctggcggcagcgcaaaagatg

SEQ ID NO: 42534 - DNA, 103 bp, Artificial Sequence
  Synthetic Polynucleotide
taatacgactcactatagggtacaatatgatctttggaatgttgtaccgtaacagaggagaacggtaatgcattccaaaaacctggcggcagcgcaaaagatg

SEQ ID NO: 42535 - DNA, 103 bp, Artificial Sequence
  Synthetic Polynucleotide
taatacgactcactatagggtattctacaatatgatctttggaatgttgtaacagaggagaacaacaatgcaaagatcaaacctggcggcagcgcaaaagatg

SEQ ID NO: 42536 - DNA, 103 bp, Artificial Sequence
  Synthetic Polynucleotide
taatacgactcactatagggaacggtattctacaatatgatctttggaataacagaggagaattccaatgatcatattgaacctggcggcagcgcaaaagatg

SEQ ID NO: 42537 - DNA, 103 bp, Artificial Sequence
  Synthetic Polynucleotide
taatacgactcactatagggcctatgtaaatccaactatggatgttataaaacagaggagattataaatgccatagttgaacctggcggcagcgcaaaagatg

SEQ ID NO: 42538 - DNA, 103 bp, Artificial Sequence
  Synthetic Polynucleotide
taatacgactcactatagggccagtaacggtattctacaatatgatctttaacagaggagaaaagatatgattgtagaaaacctggcggcagcgcaaaagatg

SEQ ID NO: 42539 - DNA, 103 bp, Artificial Sequence
  Synthetic Polynucleotide
taatacgactcactataggggtacgccagtaacggtattctacaatatgaaacagaggagatcatatatgagaataccgaacctggcggcagcgcaaaagatg

SEQ ID NO: 42540 - DNA, 103 bp, Artificial Sequence
  Synthetic Polynucleotide
taatacgactcactatagggggatcgtacgccagtaacggtattctacaaaacagaggagattgtagatgaccgttactaacctggcggcagcgcaaaagatg

SEQ ID NO: 42541 - DNA, 103 bp, Artificial Sequence
  Synthetic Polynucleotide
taatacgactcactatagggatgtaggatcgtacgccagtaacggtattcaacagaggagagaatacatgtactggcgtaacctggcggcagcgcaaaagatg

SEQ ID NO: 42542 - DNA, 103 bp, Artificial Sequence
  Synthetic Polynucleotide
taatacgactcactatagggtacatatgtaggatcgtacgccagtaacggaacagaggagaccgttaatggcgtacgataacctggcggcagcgcaaaagatg

SEQ ID NO: 42543 - DNA, 103 bp, Artificial Sequence
  Synthetic Polynucleotide
taatacgactcactatagggtacgatacatatgtaggatcgtacgccagtaacagaggagaactggcatgcgatcctacaacctggcggcagcgcaaaagatg

SEQ ID NO: 42544 - DNA, 103 bp, Artificial Sequence
  Synthetic Polynucleotide
taatacgactcactataggggaccatacgatacatatgtaggatcgtacgaacagaggagacgtacgatgctacatatgaacctggcggcagcgcaaaagatg

SEQ ID NO: 42545 - DNA, 103 bp, Artificial Sequence
  Synthetic Polynucleotide
taatacgactcactatagggggaaggaccatacgatacatatgtaggatcaacagaggagagatcctatgtatgtatcgaacctggcggcagcgcaaaagatg

SEQ ID NO: 42546 - DNA, 103 bp, Artificial Sequence
  Synthetic Polynucleotide
taatacgactcactataggggagaaggaaggaccatacgatacatatgtaaacagaggagatacataatgatcgtatggaacctggcggcagcgcaaaagatg

SEQ ID NO: 42547 - DNA, 103 bp, Artificial Sequence
  Synthetic Polynucleotide
taatacgactcactatagggtagctgagaaggaaggaccatacgatacataacagaggagaatgtatatgatggtccttaacctggcggcagcgcaaaagatg

SEQ ID NO: 42548 - DNA, 103 bp, Artificial Sequence
  Synthetic Polynucleotide
taatacgactcactatagggggacacctatgtaaatccaactatggatgtaacagaggagaacatccatggttggatttaacctggcggcagcgcaaaagatg

SEQ ID NO: 42549 - DNA, 103 bp, Artificial Sequence
  Synthetic Polynucleotide
taatacgactcactatagggtgaactagctgagaaggaaggaccatacgaaacagaggagatcgtatatgccttccttcaacctggcggcagcgcaaaagatg

SEQ ID NO: 42550 - DNA, 103 bp, Artificial Sequence
  Synthetic Polynucleotide
taatacgactcactatagggagttgtgaactagctgagaaggaaggaccaaacagaggagatggtccatgcttctcagcaacctggcggcagcgcaaaagatg

SEQ ID NO: 42551 - DNA, 103 bp, Artificial Sequence
  Synthetic Polynucleotide
taatacgactcactatagggaggcgagttgtgaactagctgagaaggaagaacagaggagacttcctatgcagctagttaacctggcggcagcgcaaaagatg

SEQ ID NO: 42552 - DNA, 103 bp, Artificial Sequence
  Synthetic Polynucleotide
taatacgactcactatagggattagaggcgagttgtgaactagctgagaaaacagaggagattctcaatgagttcacaaaacctggcggcagcgcaaaagatg

SEQ ID NO: 42553 - DNA, 103 bp, Artificial Sequence
  Synthetic Polynucleotide
taatacgactcactatagggggtgcattagaggcgagttgtgaactagctaacagaggagaagctagatgacaactcgcaacctggcggcagcgcaaaagatg

SEQ ID NO: 42554 - DNA, 103 bp, Artificial Sequence
  Synthetic Polynucleotide
taatacgactcactatagggattacggtgcattagaggcgagttgtgaacaacagaggagagttcacatgtcgcctctaaacctggcggcagcgcaaaagatg

SEQ ID NO: 42555 - DNA, 103 bp, Artificial Sequence
  Synthetic Polynucleotide
taatacgactcactatagggcatttattacggtgcattagaggcgagttgaacagaggagacaactcatgtctaatgcaaacctggcggcagcgcaaaagatg

SEQ ID NO: 42556 - DNA, 103 bp, Artificial Sequence
  Synthetic Polynucleotide
taatacgactcactataggggaaaccatttattacggtgcattagaggcgaacagaggagacgcctcatgtgcaccgtaaacctggcggcagcgcaaaagatg

SEQ ID NO: 42557 - DNA, 103 bp, Artificial Sequence
  Synthetic Polynucleotide
taatacgactcactatagggtcttcgaaaccatttattacggtgcattagaacagaggagactaatgatgcgtaataaaaacctggcggcagcgcaaaagatg

SEQ ID NO: 42558 - DNA, 103 bp, Artificial Sequence
  Synthetic Polynucleotide
taatacgactcactataggggaagatcttcgaaaccatttattacggtgcaacagaggagagcaccgatgtaaatggttaacctggcggcagcgcaaaagatg

SEQ ID NO: 42559 - DNA, 103 bp, Artificial Sequence
  Synthetic Polynucleotide
taatacgactcactatagggcaattggacacctatgtaaatccaactatgaacagaggagacatagtatgatttacataaacctggcggcagcgcaaaagatg

SEQ ID NO: 42560 - DNA, 103 bp, Artificial Sequence
  Synthetic Polynucleotide
taatacgactcactatagggaataagaagatcttcgaaaccatttattacaacagaggagagtaataatgggtttcgaaaacctggcggcagcgcaaaagatg

SEQ ID NO: 42561 - DNA, 103 bp, Artificial Sequence
  Synthetic Polynucleotide
taatacgactcactatagggatctaaataagaagatcttcgaaaccatttaacagaggagaaaatggatgcgaagatctaacctggcggcagcgcaaaagatg

SEQ ID NO: 42562 - DNA, 103 bp, Artificial Sequence
  Synthetic Polynucleotide
taatacgactcactatagggacaagatctaaataagaagatcttcgaaacaacagaggagagtttcgatgatcttcttaaacctggcggcagcgcaaaagatg

SEQ ID NO: 42563 - DNA, 103 bp, Artificial Sequence
  Synthetic Polynucleotide
taatacgactcactataggggaagcacaagatctaaataagaagatcttcaacagaggagagaagatatgcttatttagaacctggcggcagcgcaaaagatg

SEQ ID NO: 42564 - DNA, 103 bp, Artificial Sequence
  Synthetic Polynucleotide
taatacgactcactataggggcctggaagcacaagatctaaataagaagaaacagaggagatcttctatgttagatcttaacctggcggcagcgcaaaagatg

SEQ ID NO: 42565 - DNA, 103 bp, Artificial Sequence
  Synthetic Polynucleotide
taatacgactcactatagggtgatagcctggaagcacaagatctaaataaaacagaggagattatttatgtcttgtgctaacctggcggcagcgcaaaagatg

SEQ ID NO: 42566 - DNA, 103 bp, Artificial Sequence
  Synthetic Polynucleotide
taatacgactcactatagggccatttgatagcctggaagcacaagatctaaacagaggagatagatcatgtgcttccagaacctggcggcagcgcaaaagatg

SEQ ID NO: 42567 - DNA, 103 bp, Artificial Sequence
  Synthetic Polynucleotide
taatacgactcactatagggattatccatttgatagcctggaagcacaagaacagaggagacttgtgatgccaggctataacctggcggcagcgcaaaagatg

SEQ ID NO: 42568 - DNA, 103 bp, Artificial Sequence
  Synthetic Polynucleotide
taatacgactcactatagggcttaaattatccatttgatagcctggaagcaacagaggagagcttccatgctatcaaataacctggcggcagcgcaaaagatg

SEQ ID NO: 42569 - DNA, 103 bp, Artificial Sequence
  Synthetic Polynucleotide
taatacgactcactatagggattctcttaaattatccatttgatagcctgaacagaggagacaggctatgaaatggataaacctggcggcagcgcaaaagatg

SEQ ID NO: 42570 - DNA, 103 bp, Artificial Sequence
  Synthetic Polynucleotide
taatacgactcactatagggtatagacaattgcgtggagatcattaaatgaacagaggagacatttaatgatctccacgaacctggcggcagcgcaaaagatg

SEQ ID NO: 42571 - DNA, 103 bp, Artificial Sequence
  Synthetic Polynucleotide
taatacgactcactataggggatcccaattggacacctatgtaaatccaaaacagaggagattggatatgcataggtgtaacctggcggcagcgcaaaagatg

SEQ ID NO: 42572 - DNA, 103 bp, Artificial Sequence
  Synthetic Polynucleotide
taatacgactcactatagggcgtttattctcttaaattatccatttgataaacagaggagatatcaaatggataatttaaacctggcggcagcgcaaaagatg

SEQ ID NO: 42573 - DNA, 103 bp, Artificial Sequence
  Synthetic Polynucleotide
taatacgactcactatagggagacgcgtttattctcttaaattatccattaacagaggagaaatggaatgtttaagagaaacctggcggcagcgcaaaagatg

SEQ ID NO: 42574 - DNA, 103 bp, Artificial Sequence
  Synthetic Polynucleotide
taatacgactcactatagggttagcagacgcgtttattctcttaaattataacagaggagaataattatggagaataaaaacctggcggcagcgcaaaagatg

SEQ ID NO: 42575 - DNA, 103 bp, Artificial Sequence
  Synthetic Polynucleotide
taatacgactcactatagggaaggattagcagacgcgtttattctcttaaaacagaggagattaagaatgtaaacgcgtaacctggcggcagcgcaaaagatg

SEQ ID NO: 42576 - DNA, 103 bp, Artificial Sequence
  Synthetic Polynucleotide
taatacgactcactatagggtgttcaaggattagcagacgcgtttattctaacagaggagaagaataatggcgtctgctaacctggcggcagcgcaaaagatg

SEQ ID NO: 42577 - DNA, 103 bp, Artificial Sequence
  Synthetic Polynucleotide
taatacgactcactatagggattggtgttcaaggattagcagacgcgtttaacagaggagaaaacgcatgtgctaatccaacctggcggcagcgcaaaagatg

SEQ ID NO: 42578 - DNA, 103 bp, Artificial Sequence
  Synthetic Polynucleotide
taatacgactcactatagggtcggtattggtgttcaaggattagcagacgaacagaggagacgtctgatgatccttgaaaacctggcggcagcgcaaaagatg

SEQ ID NO: 42579 - DNA, 103 bp, Artificial Sequence
  Synthetic Polynucleotide
taatacgactcactatagggacctatcggtattggtgttcaaggattagcaacagaggagagctaatatgtgaacaccaaacctggcggcagcgcaaaagatg

SEQ ID NO: 42580 - DNA, 103 bp, Artificial Sequence
  Synthetic Polynucleotide
taatacgactcactatagggcatagacctatcggtattggtgttcaaggaaacagaggagatccttgatgaccaataccaacctggcggcagcgcaaaagatg

SEQ ID NO: 42581 - DNA, 103 bp, Artificial Sequence
  Synthetic Polynucleotide
taatacgactcactatagggagagacatagacctatcggtattggtgttcaacagaggagagaacacatgtaccgatagaacctggcggcagcgcaaaagatg

SEQ ID NO: 42582 - DNA, 103 bp, Artificial Sequence
  Synthetic Polynucleotide
taatacgactcactatagggggtgagatcccaattggacacctatgtaaaaacagaggagatttacaatggtgtccaataacctggcggcagcgcaaaagatg

SEQ ID NO: 42583 - DNA, 103 bp, Artificial Sequence
  Synthetic Polynucleotide
taatacgactcactatagggtaataagagacatagacctatcggtattggaacagaggagaccaataatgataggtctaaacctggcggcagcgcaaaagatg

SEQ ID NO: 42584 - DNA, 103 bp, Artificial Sequence
  Synthetic Polynucleotide
taatacgactcactatagggatctctaataagagacatagacctatcggtaacagaggagaaccgatatgtctatgtctaacctggcggcagcgcaaaagatg

SEQ ID NO: 42585 - DNA, 103 bp, Artificial Sequence
  Synthetic Polynucleotide
taatacgactcactatagggctgaaatctctaataagagacatagacctaaacagaggagataggtcatggtctcttataacctggcggcagcgcaaaagatg

SEQ ID NO: 42586 - DNA, 103 bp, Artificial Sequence
  Synthetic Polynucleotide
taatacgactcactatagggagaagctgaaatctctaataagagacatagaacagaggagactatgtatgttattagagaacctggcggcagcgcaaaagatg

SEQ ID NO: 42587 - DNA, 103 bp, Artificial Sequence
  Synthetic Polynucleotide
taatacgactcactatagggattccagaagctgaaatctctaataagagaaacagaggagatctcttatgagagatttcaacctggcggcagcgcaaaagatg

SEQ ID NO: 42588 - DNA, 103 bp, Artificial Sequence
  Synthetic Polynucleotide
taatacgactcactatagggatcctattccagaagctgaaatctctaataaacagaggagatattagatgtttcagcttaacctggcggcagcgcaaaagatg

SEQ ID NO: 42589 - DNA, 103 bp, Artificial Sequence
  Synthetic Polynucleotide
taatacgactcactatagggttattatcctattccagaagctgaaatctcaacagaggagagagattatggcttctggaaacctggcggcagcgcaaaagatg

SEQ ID NO: 42590 - DNA, 103 bp, Artificial Sequence
  Synthetic Polynucleotide
taatacgactcactatagggattaattattatcctattccagaagctgaaaacagaggagattcagcatgtggaataggaacctggcggcagcgcaaaagatg

SEQ ID NO: 42591 - DNA, 103 bp, Artificial Sequence
  Synthetic Polynucleotide
taatacgactcactatagggtagatattaattattatcctattccagaagaacagaggagacttctgatgtaggataataacctggcggcagcgcaaaagatg

SEQ ID NO: 42592 - DNA, 103 bp, Artificial Sequence
  Synthetic Polynucleotide
taatacgactcactatagggaattatagatattaattattatcctattccaacagaggagaggaataatgtaataattaaacctggcggcagcgcaaaagatg

SEQ ID NO: 42593 - DNA, 103 bp, Artificial Sequence
  Synthetic Polynucleotide
taatacgactcactatagggatgatggtgagatcccaattggacacctataacagaggagaataggtatgcaattgggaaacctggcggcagcgcaaaagatg

SEQ ID NO: 42594 - DNA, 103 bp, Artificial Sequence
  Synthetic Polynucleotide
taatacgactcactatagggaataaaattatagatattaattattatcctaacagaggagaaggataatgattaatatcaacctggcggcagcgcaaaagatg

SEQ ID NO: 42595 - DNA, 103 bp, Artificial Sequence
  Synthetic Polynucleotide
taatacgactcactatagggacctcaataaaattatagatattaattattaacagaggagaaataatatgtatctataaaacctggcggcagcgcaaaagatg

SEQ ID NO: 42596 - DNA, 103 bp, Artificial Sequence
  Synthetic Polynucleotide
taatacgactcactatagggcagaaacctcaataaaattatagatattaaaacagaggagattaataatgataattttaaacctggcggcagcgcaaaagatg

SEQ ID NO: 42597 - DNA, 103 bp, Artificial Sequence
  Synthetic Polynucleotide
taatacgactcactatagggattgtcagaaacctcaataaaattatagataacagaggagaatctatatgtttattgagaacctggcggcagcgcaaaagatg

SEQ ID NO: 42598 - DNA, 103 bp, Artificial Sequence
  Synthetic Polynucleotide
taatacgactcactatagggaagtaattgtcagaaacctcaataaaattaaacagaggagataatttatgtgaggtttcaacctggcggcagcgcaaaagatg

SEQ ID NO: 42599 - DNA, 103 bp, Artificial Sequence
  Synthetic Polynucleotide
taatacgactcactatagggggtcaaagtaattgtcagaaacctcaataaaacagaggagattattgatgtttctgacaaacctggcggcagcgcaaaagatg

SEQ ID NO: 42600 - DNA, 103 bp, Artificial Sequence
  Synthetic Polynucleotide
taatacgactcactataggggatgtggtcaaagtaattgtcagaaacctcaacagaggagagaggttatggacaattacaacctggcggcagcgcaaaagatg

SEQ ID NO: 42601 - DNA, 103 bp, Artificial Sequence
  Synthetic Polynucleotide
taatacgactcactatagggtgaaggatgtggtcaaagtaattgtcagaaaacagaggagattctgaatgttactttgaaacctggcggcagcgcaaaagatg

SEQ ID NO: 42602 - DNA, 103 bp, Artificial Sequence
  Synthetic Polynucleotide
taatacgactcactatagggcaaactgaaggatgtggtcaaagtaattgtaacagaggagaacaattatgttgaccacaaacctggcggcagcgcaaaagatg

SEQ ID NO: 42603 - DNA, 103 bp, Artificial Sequence
  Synthetic Polynucleotide
taatacgactcactatagggtttctcaaactgaaggatgtggtcaaagtaaacagaggagatactttatgcacatccttaacctggcggcagcgcaaaagatg

SEQ ID NO: 42604 - DNA, 103 bp, Artificial Sequence
  Synthetic Polynucleotide
taatacgactcactatagggtctcgatgatggtgagatcccaattggacaaacagaggagatgtccaatggggatctcaaacctggcggcagcgcaaaagatg

SEQ ID NO: 42605 - DNA, 103 bp, Artificial Sequence
  Synthetic Polynucleotide
taatacgactcactatagggttgattttctcaaactgaaggatgtggtcaaacagaggagatgaccaatgccttcagttaacctggcggcagcgcaaaagatg

SEQ ID NO: 42606 - DNA, 103 bp, Artificial Sequence
  Synthetic Polynucleotide
taatacgactcactatagggacaatttgattttctcaaactgaaggatgtaacagaggagaacatccatgagtttgagaaacctggcggcagcgcaaaagatg

SEQ ID NO: 42607 - DNA, 103 bp, Artificial Sequence
  Synthetic Polynucleotide
taatacgactcactataggggatggacaatttgattttctcaaactgaagaacagaggagacttcagatggagaaaatcaacctggcggcagcgcaaaagatg

SEQ ID NO: 42608 - DNA, 103 bp, Artificial Sequence
  Synthetic Polynucleotide
taatacgactcactatagggtaatagatggacaatttgattttctcaaacaacagaggagagtttgaatgaatcaaattaacctggcggcagcgcaaaagatg

SEQ ID NO: 42609 - DNA, 103 bp, Artificial Sequence
  Synthetic Polynucleotide
taatacgactcactataggggtttgtaatagatggacaatttgattttctaacagaggagaagaaaaatgaattgtccaaacctggcggcagcgcaaaagatg

SEQ ID NO: 42610 - DNA, 103 bp, Artificial Sequence
  Synthetic Polynucleotide
taatacgactcactatagggaacatgtttgtaatagatggacaatttgataacagaggagaatcaaaatgtccatctataacctggcggcagcgcaaaagatg

SEQ ID NO: 42611 - DNA, 103 bp, Artificial Sequence
  Synthetic Polynucleotide
taatacgactcactatagggcattgaacatgtttgtaatagatggacaataacagaggagaattgtcatgctattacaaaacctggcggcagcgcaaaagatg

SEQ ID NO: 42612 - DNA, 103 bp, Artificial Sequence
  Synthetic Polynucleotide
taatacgactcactatagggtattgcattgaacatgtttgtaatagatggaacagaggagaccatctatgacaaacatgaacctggcggcagcgcaaaagatg

SEQ ID NO: 42613 - DNA, 103 bp, Artificial Sequence
  Synthetic Polynucleotide
taatacgactcactataggggcatctattgcattgaacatgtttgtaataaacagaggagatattacatgcatgttcaaaacctggcggcagcgcaaaagatg

SEQ ID NO: 42614 - DNA, 103 bp, Artificial Sequence
  Synthetic Polynucleotide
taatacgactcactatagggatctggcatctattgcattgaacatgtttgaacagaggagacaaacaatgtcaatgcaaaacctggcggcagcgcaaaagatg

SEQ ID NO: 42615 - DNA, 103 bp, Artificial Sequence
  Synthetic Polynucleotide
taatacgactcactatagggaattatctcgatgatggtgagatcccaattaacagaggagaaattggatgctcaccatcaacctggcggcagcgcaaaagatg

SEQ ID NO: 42616 - DNA, 103 bp, Artificial Sequence
  Synthetic Polynucleotide
taatacgactcactatagggttgtaatctggcatctattgcattgaacataacagaggagaatgttcatggcaatagataacctggcggcagcgcaaaagatg

SEQ ID NO: 42617 - DNA, 103 bp, Artificial Sequence
  Synthetic Polynucleotide
taatacgactcactataggggccgtttgtaatctggcatctattgcattgaacagaggagacaatgcatgagatgccagaacctggcggcagcgcaaaagatg

SEQ ID NO: 42618 - DNA, 103 bp, Artificial Sequence
  Synthetic Polynucleotide
taatacgactcactatagggaggtagccgtttgtaatctggcatctattgaacagaggagacaatagatgccagattacaacctggcggcagcgcaaaagatg

SEQ ID NO: 42619 - DNA, 103 bp, Artificial Sequence
  Synthetic Polynucleotide
taatacgactcactatagggtaatgaggtagccgtttgtaatctggcatcaacagaggagagatgccatgttacaaacgaacctggcggcagcgcaaaagatg

SEQ ID NO: 42620 - DNA, 103 bp, Artificial Sequence
  Synthetic Polynucleotide
taatacgactcactataggggatgctaatgaggtagccgtttgtaatctgaacagaggagacagattatgaacggctacaacctggcggcagcgcaaaagatg

SEQ ID NO: 42621 - DNA, 103 bp, Artificial Sequence
  Synthetic Polynucleotide
taatacgactcactatagggatgcggatgctaatgaggtagccgtttgtaaacagaggagatacaaaatgctacctcataacctggcggcagcgcaaaagatg

SEQ ID NO: 42622 - DNA, 103 bp, Artificial Sequence
  Synthetic Polynucleotide
taatacgactcactatagggacaatatgcggatgctaatgaggtagccgtaacagaggagaacggctatgtcattagcaaacctggcggcagcgcaaaagatg

SEQ ID NO: 42623 - DNA, 103 bp, Artificial Sequence
  Synthetic Polynucleotide
taatacgactcactatagggataatacaatatgcggatgctaatgaggtaaacagaggagatacctcatgagcatccgcaacctggcggcagcgcaaaagatg

SEQ ID NO: 42624 - DNA, 103 bp, Artificial Sequence
  Synthetic Polynucleotide
taatacgactcactatagggctgagataatacaatatgcggatgctaatgaacagaggagacattagatgccgcatattaacctggcggcagcgcaaaagatg

SEQ ID NO: 42625 - DNA, 103 bp, Artificial Sequence
  Synthetic Polynucleotide
taatacgactcactatagggttgcactgagataatacaatatgcggatgcaacagaggagagcatccatgtattgtattaacctggcggcagcgcaaaagatg

SEQ ID NO: 42626 - DNA, 103 bp, Artificial Sequence
  Synthetic Polynucleotide
taatacgactcactatagggtcatcaattatctcgatgatggtgagatccaacagaggagaggatctatgcatcatcgaaacctggcggcagcgcaaaagatg

SEQ ID NO: 42627 - DNA, 103 bp, Artificial Sequence
  Synthetic Polynucleotide
taatacgactcactatagggaatctttgcactgagataatacaatatgcgaacagaggagacgcataatgtattatctcaacctggcggcagcgcaaaagatg

SEQ ID NO: 42628 - DNA, 103 bp, Artificial Sequence
  Synthetic Polynucleotide
taatacgactcactataggggtagtaatctttgcactgagataatacaataacagaggagaattgtaatgtctcagtgcaacctggcggcagcgcaaaagatg

SEQ ID NO: 42629 - DNA, 103 bp, Artificial Sequence
  Synthetic Polynucleotide
taatacgactcactatagggcaagtgtagtaatctttgcactgagataataacagaggagaattatcatggtgcaaagaaacctggcggcagcgcaaaagatg

SEQ ID NO: 42630 - DNA, 103 bp, Artificial Sequence
  Synthetic Polynucleotide
taatacgactcactatagggaccatcaagtgtagtaatctttgcactgagaacagaggagactcagtatgaagattactaacctggcggcagcgcaaaagatg

SEQ ID NO: 42631 - DNA, 103 bp, Artificial Sequence
  Synthetic Polynucleotide
taatacgactcactatagggtaggaaccatcaagtgtagtaatctttgcaaacagaggagatgcaaaatgtactacactaacctggcggcagcgcaaaagatg

SEQ ID NO: 42632 - DNA, 103 bp, Artificial Sequence
  Synthetic Polynucleotide
taatacgactcactatagggaaatttaggaaccatcaagtgtagtaatctaacagaggagaagattaatgcacttgatgaacctggcggcagcgcaaaagatg

SEQ ID NO: 42633 - DNA, 103 bp, Artificial Sequence
  Synthetic Polynucleotide
taatacgactcactatagggcaacaaaatttaggaaccatcaagtgtagtaacagaggagaactacaatggatggttccaacctggcggcagcgcaaaagatg

SEQ ID NO: 42634 - DNA, 103 bp, Artificial Sequence
  Synthetic Polynucleotide
taatacgactcactataggggtaatcaacaaaatttaggaaccatcaagtaacagaggagaacttgaatgttcctaaataacctggcggcagcgcaaaagatg

SEQ ID NO: 42635 - DNA, 103 bp, Artificial Sequence
  Synthetic Polynucleotide
taatacgactcactatagggaaagagtaatcaacaaaatttaggaaccataacagaggagaatggttatgaaattttgtaacctggcggcagcgcaaaagatg

SEQ ID NO: 42636 - DNA, 103 bp, Artificial Sequence
  Synthetic Polynucleotide
taatacgactcactatagggaacaaaaagagtaatcaacaaaatttaggaaacagaggagatcctaaatgttgttgattaacctggcggcagcgcaaaagatg

SEQ ID NO: 42637 - DNA, 103 bp, Artificial Sequence
  Synthetic Polynucleotide
taatacgactcactatagggagatgtcatcaattatctcgatgatggtgaaacagaggagatcaccaatgtcgagataaaacctggcggcagcgcaaaagatg

SEQ ID NO: 42638 - DNA, 103 bp, Artificial Sequence
  Synthetic Polynucleotide
taatacgactcactatagggcgtgtaacaaaaagagtaatcaacaaaattaacagaggagaaattttatggattactctaacctggcggcagcgcaaaagatg

SEQ ID NO: 42639 - DNA, 103 bp, Artificial Sequence
  Synthetic Polynucleotide
taatacgactcactatagggggatgcgtgtaacaaaaagagtaatcaacaaacagaggagatgttgaatgctctttttgaacctggcggcagcgcaaaagatg

SEQ ID NO: 42640 - DNA, 103 bp, Artificial Sequence
  Synthetic Polynucleotide
taatacgactcactatagggtataaggatgcgtgtaacaaaaagagtaataacagaggagaattactatgtttgttacaaacctggcggcagcgcaaaagatg

SEQ ID NO: 42641 - DNA, 103 bp, Artificial Sequence
  Synthetic Polynucleotide
taatacgactcactatagggttctttataaggatgcgtgtaacaaaaagaaacagaggagatcttttatgtacacgcataacctggcggcagcgcaaaagatg

SEQ ID NO: 42642 - DNA, 103 bp, Artificial Sequence
  Synthetic Polynucleotide
taatacgactcactatagggattcattctttataaggatgcgtgtaacaaaacagaggagattgttaatggcatccttaaacctggcggcagcgcaaaagatg

SEQ ID NO: 42643 - DNA, 103 bp, Artificial Sequence
  Synthetic Polynucleotide
taatacgactcactatagggacgccattcattctttataaggatgcgtgtaacagaggagaacacgcatgcttataaagaacctggcggcagcgcaaaagatg

SEQ ID NO: 42644 - DNA, 103 bp, Artificial Sequence
  Synthetic Polynucleotide
taatacgactcactatagggctggtacgccattcattctttataaggatgaacagaggagacatcctatgaaagaatgaaacctggcggcagcgcaaaagatg

SEQ ID NO: 42645 - DNA, 103 bp, Artificial Sequence
  Synthetic Polynucleotide
taatacgactcactatagggtgaaactggtacgccattcattctttataaaacagaggagattataaatgatgaatggcaacctggcggcagcgcaaaagatg

SEQ ID NO: 42646 - DNA, 103 bp, Artificial Sequence
  Synthetic Polynucleotide
taatacgactcactatagggcagattgaaactggtacgccattcattcttaacagaggagaaagaatatgtggcgtaccaacctggcggcagcgcaaaagatg

SEQ ID NO: 42647 - DNA, 103 bp, Artificial Sequence
  Synthetic Polynucleotide
taatacgactcactatagggaatcccagattgaaactggtacgccattcaaacagaggagatgaatgatgtaccagtttaacctggcggcagcgcaaaagatg

SEQ ID NO: 42648 - DNA, 103 bp, Artificial Sequence
  Synthetic Polynucleotide
taatacgactcactataggggggggagatgtcatcaattatctcgatgataacagaggagaatcatcatgataattgataacctggcggcagcgcaaaagatg

SEQ ID NO: 42649 - DNA, 103 bp, Artificial Sequence
  Synthetic Polynucleotide
taatacgactcactatagggtatagaatcccagattgaaactggtacgccaacagaggagaggcgtaatggtttcaatcaacctggcggcagcgcaaaagatg

SEQ ID NO: 42650 - DNA, 103 bp, Artificial Sequence
  Synthetic Polynucleotide
taatacgactcactataggggcgattatagaatcccagattgaaactggtaacagaggagaaccagtatgaatctgggaaacctggcggcagcgcaaaagatg

SEQ ID NO: 42651 - DNA, 103 bp, Artificial Sequence
  Synthetic Polynucleotide
taatacgactcactatagggggaaagcgattatagaatcccagattgaaaaacagaggagatttcaaatggggattctaaacctggcggcagcgcaaaagatg

SEQ ID NO: 42652 - DNA, 103 bp, Artificial Sequence
  Synthetic Polynucleotide
taatacgactcactatagggcgtctggaaagcgattatagaatcccagataacagaggagaatctggatgtctataatcaacctggcggcagcgcaaaagatg

SEQ ID NO: 42653 - DNA, 103 bp, Artificial Sequence
  Synthetic Polynucleotide
taatacgactcactatagggcgtgtcgtctggaaagcgattatagaatccaacagaggagaggattcatgaatcgctttaacctggcggcagcgcaaaagatg

SEQ ID NO: 42654 - DNA, 103 bp, Artificial Sequence
  Synthetic Polynucleotide
taatacgactcactatagggaggctcgtgtcgtctggaaagcgattatagaacagaggagactataaatgctttccagaaacctggcggcagcgcaaaagatg

SEQ ID NO: 42655 - DNA, 103 bp, Artificial Sequence
  Synthetic Polynucleotide
taatacgactcactatagggaataaaggctcgtgtcgtctggaaagcgataacagaggagaatcgctatgcagacgacaaacctggcggcagcgcaaaagatg

SEQ ID NO: 42656 - DNA, 103 bp, Artificial Sequence
  Synthetic Polynucleotide
taatacgactcactatagggtctataataaaggctcgtgtcgtctggaaaaacagaggagatttccaatggacacgagcaacctggcggcagcgcaaaagatg

SEQ ID NO: 42657 - DNA, 103 bp, Artificial Sequence
  Synthetic Polynucleotide
taatacgactcactatagggacaaatctataataaaggctcgtgtcgtctaacagaggagaagacgaatggagcctttaaacctggcggcagcgcaaaagatg

SEQ ID NO: 42658 - DNA, 103 bp, Artificial Sequence
  Synthetic Polynucleotide
taatacgactcactataggggagatacaaatctataataaaggctcgtgtaacagaggagaacacgaatgtttattataaacctggcggcagcgcaaaagatg

SEQ ID NO: 42659 - DNA, 103 bp, Artificial Sequence
  Synthetic Polynucleotide
taatacgactcactatagggagaaagggggagatgtcatcaattatctcgaacagaggagacgagatatgtgatgacataacctggcggcagcgcaaaagatg

SEQ ID NO: 42660 - DNA, 103 bp, Artificial Sequence
  Synthetic Polynucleotide
taatacgactcactataggggaaaagagatacaaatctataataaaggctaacagaggagaagccttatgtatagatttaacctggcggcagcgcaaaagatg

SEQ ID NO: 42661 - DNA, 103 bp, Artificial Sequence
  Synthetic Polynucleotide
taatacgactcactatagggaaagagaaaagagatacaaatctataataaaacagaggagattattaatgatttgtatcaacctggcggcagcgcaaaagatg

SEQ ID NO: 42662 - DNA, 103 bp, Artificial Sequence
  Synthetic Polynucleotide
taatacgactcactatagggatacgaaagagaaaagagatacaaatctataacagaggagaatagatatgtatctctttaacctggcggcagcgcaaaagatg

SEQ ID NO: 42663 - DNA, 103 bp, Artificial Sequence
  Synthetic Polynucleotide
taatacgactcactatagggacactatacgaaagagaaaagagatacaaaaacagaggagatttgtaatgcttttctctaacctggcggcagcgcaaaagatg

SEQ ID NO: 42664 - DNA, 103 bp, Artificial Sequence
  Synthetic Polynucleotide
taatacgactcactatagggtgtatacactatacgaaagagaaaagagataacagaggagaatctctatgctctttcgtaacctggcggcagcgcaaaagatg

SEQ ID NO: 42665 - DNA, 103 bp, Artificial Sequence
  Synthetic Polynucleotide
taatacgactcactatagggacgattgtatacactatacgaaagagaaaaaacagaggagattttctatgtcgtatagtaacctggcggcagcgcaaaagatg

SEQ ID NO: 42666 - DNA, 103 bp, Artificial Sequence
  Synthetic Polynucleotide
taatacgactcactatagggtttgaacgattgtatacactatacgaaagaaacagaggagatctttcatgtagtgtataaacctggcggcagcgcaaaagatg

SEQ ID NO: 42667 - DNA, 103 bp, Artificial Sequence
  Synthetic Polynucleotide
taatacgactcactatagggacgagtttgaacgattgtatacactatacgaacagaggagacgtataatgtatacaatcaacctggcggcagcgcaaaagatg

SEQ ID NO: 42668 - DNA, 103 bp, Artificial Sequence
  Synthetic Polynucleotide
taatacgactcactataggggggagacgagtttgaacgattgtatacactaacagaggagaagtgtaatgaatcgttcaaacctggcggcagcgcaaaagatg

SEQ ID NO: 42669 - DNA, 103 bp, Artificial Sequence
  Synthetic Polynucleotide
taatacgactcactataggggtttggggagacgagtttgaacgattgtataacagaggagaatacaaatgttcaaactcaacctggcggcagcgcaaaagatg

SEQ ID NO: 42670 - DNA, 103 bp, Artificial Sequence
  Synthetic Polynucleotide
taatacgactcactatagggaaaaaagaaagggggagatgtcatcaattaaacagaggagataattgatgacatctcccaacctggcggcagcgcaaaagatg

SEQ ID NO: 42671 - DNA, 103 bp, Artificial Sequence
  Synthetic Polynucleotide
taatacgactcactatagggacaatgtttggggagacgagtttgaacgataacagaggagaatcgttatgactcgtctcaacctggcggcagcgcaaaagatg

SEQ ID NO: 42672 - DNA, 103 bp, Artificial Sequence
  Synthetic Polynucleotide
taatacgactcactatagggattggacaatgtttggggagacgagtttgaaacagaggagatcaaacatgtctccccaaaacctggcggcagcgcaaaagatg

SEQ ID NO: 42673 - DNA, 103 bp, Artificial Sequence
  Synthetic Polynucleotide
taatacgactcactatagggcctggattggacaatgtttggggagacgagaacagaggagactcgtcatgccaaacattaacctggcggcagcgcaaaagatg

SEQ ID NO: 42674 - DNA, 103 bp, Artificial Sequence
  Synthetic Polynucleotide
taatacgactcactatagggaatgtcctggattggacaatgtttggggagaacagaggagactccccatgcattgtccaaacctggcggcagcgcaaaagatg

SEQ ID NO: 42675 - DNA, 103 bp, Artificial Sequence
  Synthetic Polynucleotide
taatacgactcactatagggggatgaatgtcctggattggacaatgtttgaacagaggagacaaacaatgtccaatccaaacctggcggcagcgcaaaagatg

SEQ ID NO: 42676 - DNA, 103 bp, Artificial Sequence
  Synthetic Polynucleotide
taatacgactcactatagggtgtccggatgaatgtcctggattggacaataacagaggagaattgtcatgtccaggacaaacctggcggcagcgcaaaagatg

SEQ ID NO: 42677 - DNA, 103 bp, Artificial Sequence
  Synthetic Polynucleotide
taatacgactcactatagggtgatgtgtccggatgaatgtcctggattggaacagaggagaccaatcatggacattcataacctggcggcagcgcaaaagatg

SEQ ID NO: 42678 - DNA, 103 bp, Artificial Sequence
  Synthetic Polynucleotide
taatacgactcactataggggtcgttgatgtgtccggatgaatgtcctggaacagaggagaccaggaatgtcatccggaaacctggcggcagcgcaaaagatg

SEQ ID NO: 42679 - DNA, 103 bp, Artificial Sequence
  Synthetic Polynucleotide
taatacgactcactataggggagtggtcgttgatgtgtccggatgaatgtaacagaggagaacattcatgcggacacataacctggcggcagcgcaaaagatg

SEQ ID NO: 42680 - DNA, 103 bp, Artificial Sequence
  Synthetic Polynucleotide
taatacgactcactatagggacggagagtggtcgttgatgtgtccggatgaacagaggagacatccgatgacatcaacgaacctggcggcagcgcaaaagatg

SEQ ID NO: 42681 - DNA, 103 bp, Artificial Sequence
  Synthetic Polynucleotide
taatacgactcactataggggacaatatagacaattgcgtggagatcattaacagaggagaaatgatatgcacgcaattaacctggcggcagcgcaaaagatg

SEQ ID NO: 42682 - DNA, 103 bp, Artificial Sequence
  Synthetic Polynucleotide
taatacgactcactatagggctactaaaaaagaaagggggagatgtcatcaacagaggagagatgacatgtccccctttaacctggcggcagcgcaaaagatg

SEQ ID NO: 42683 - DNA, 103 bp, Artificial Sequence
  Synthetic Polynucleotide
taatacgactcactatagggggatgacggagagtggtcgttgatgtgtccaacagaggagaggacacatgaacgaccacaacctggcggcagcgcaaaagatg

SEQ ID NO: 42684 - DNA, 103 bp, Artificial Sequence
  Synthetic Polynucleotide
taatacgactcactataggggtgaaggatgacggagagtggtcgttgatgaacagaggagacatcaaatgccactctccaacctggcggcagcgcaaaagatg

SEQ ID NO: 42685 - DNA, 103 bp, Artificial Sequence
  Synthetic Polynucleotide
taatacgactcactatagggaacgagtgaaggatgacggagagtggtcgtaacagaggagaacgaccatgctccgtcataacctggcggcagcgcaaaagatg

SEQ ID NO: 42686 - DNA, 103 bp, Artificial Sequence
  Synthetic Polynucleotide
taatacgactcactatagggtatgaaacgagtgaaggatgacggagagtgaacagaggagacactctatgtcatccttcaacctggcggcagcgcaaaagatg

SEQ ID NO: 42687 - DNA, 103 bp, Artificial Sequence
  Synthetic Polynucleotide
taatacgactcactatagggctctttatgaaacgagtgaaggatgacggaaacagaggagatccgtcatgcttcactcgaacctggcggcagcgcaaaagatg

SEQ ID NO: 42688 - DNA, 103 bp, Artificial Sequence
  Synthetic Polynucleotide
taatacgactcactatagggctgatctctttatgaaacgagtgaaggatgaacagaggagacatcctatgctcgtttcaaacctggcggcagcgcaaaagatg

SEQ ID NO: 42689 - DNA, 103 bp, Artificial Sequence
  Synthetic Polynucleotide
taatacgactcactataggggattcctgatctctttatgaaacgagtgaaaacagaggagattcactatgttcataaagaacctggcggcagcgcaaaagatg

SEQ ID NO: 42690 - DNA, 103 bp, Artificial Sequence
  Synthetic Polynucleotide
taatacgactcactatagggctttggattcctgatctctttatgaaacgaaacagaggagatcgtttatgaaagagatcaacctggcggcagcgcaaaagatg

SEQ ID NO: 42691 - DNA, 103 bp, Artificial Sequence
  Synthetic Polynucleotide
taatacgactcactatagggtagctctttggattcctgatctctttatgaaacagaggagatcataaatggatcaggaaaacctggcggcagcgcaaaagatg

SEQ ID NO: 42692 - DNA, 103 bp, Artificial Sequence
  Synthetic Polynucleotide
taatacgactcactatagggatttatagctctttggattcctgatctcttaacagaggagaaagagaatgggaatccaaaacctggcggcagcgcaaaagatg

SEQ ID NO: 42693 - DNA, 103 bp, Artificial Sequence
  Synthetic Polynucleotide
taatacgactcactatagggaatatctactaaaaaagaaagggggagatgaacagaggagacatctcatgctttcttttaacctggcggcagcgcaaaagatg

SEQ ID NO: 42694 - DNA, 103 bp, Artificial Sequence
  Synthetic Polynucleotide
taatacgactcactataggggatctatttatagctctttggattcctgataacagaggagaatcaggatgccaaagagcaacctggcggcagcgcaaaagatg

SEQ ID NO: 42695 - DNA, 103 bp, Artificial Sequence
  Synthetic Polynucleotide
taatacgactcactatagggccagagatctatttatagctctttggattcaacagaggagagaatccatggagctataaaacctggcggcagcgcaaaagatg

SEQ ID NO: 42696 - DNA, 103 bp, Artificial Sequence
  Synthetic Polynucleotide
taatacgactcactatagggtagaaccagagatctatttatagctctttgaacagaggagacaaagaatgataaatagaaacctggcggcagcgcaaaagatg

SEQ ID NO: 42697 - DNA, 103 bp, Artificial Sequence
  Synthetic Polynucleotide
taatacgactcactataggggaacatagaaccagagatctatttatagctaacagaggagaagctatatgtagatctctaacctggcggcagcgcaaaagatg

SEQ ID NO: 42698 - DNA, 103 bp, Artificial Sequence
  Synthetic Polynucleotide
taatacgactcactatagggacgaggaacatagaaccagagatctatttaaacagaggagataaataatgctctggttcaacctggcggcagcgcaaaagatg

SEQ ID NO: 42699 - DNA, 103 bp, Artificial Sequence
  Synthetic Polynucleotide
taatacgactcactatagggaggaaacgaggaacatagaaccagagatctaacagaggagaagatctatggttctatgtaacctggcggcagcgcaaaagatg

SEQ ID NO: 42700 - DNA, 103 bp, Artificial Sequence
  Synthetic Polynucleotide
taatacgactcactatagggaatacaggaaacgaggaacatagaaccagaaacagaggagatctggtatgatgttcctcaacctggcggcagcgcaaaagatg

SEQ ID NO: 42701 - DNA, 103 bp, Artificial Sequence
  Synthetic Polynucleotide
taatacgactcactatagggaaaagaatacaggaaacgaggaacatagaaaacagaggagattctatatgcctcgtttcaacctggcggcagcgcaaaagatg

SEQ ID NO: 42702 - DNA, 103 bp, Artificial Sequence
  Synthetic Polynucleotide
taatacgactcactatagggtcttaaaaagaatacaggaaacgaggaacaaacagaggagatgttccatgtttcctgtaaacctggcggcagcgcaaaagatg

SEQ ID NO: 42703 - DNA, 103 bp, Artificial Sequence
  Synthetic Polynucleotide
taatacgactcactatagggctcgatcttaaaaagaatacaggaaacgagaacagaggagactcgttatgtgtattcttaacctggcggcagcgcaaaagatg

SEQ ID NO: 42704 - DNA, 103 bp, Artificial Sequence
  Synthetic Polynucleotide
taatacgactcactataggggatgaaatatctactaaaaaagaaagggggaacagaggagaccccctatgttttttagtaacctggcggcagcgcaaaagatg

SEQ ID NO: 42705 - DNA, 103 bp, Artificial Sequence
  Synthetic Polynucleotide
taatacgactcactatagggcgttcctcgatcttaaaaagaatacaggaaaacagaggagattcctgatgtctttttaaaacctggcggcagcgcaaaagatg

SEQ ID NO: 42706 - DNA, 103 bp, Artificial Sequence
  Synthetic Polynucleotide
taatacgactcactatagggtatggcgttcctcgatcttaaaaagaatacaacagaggagagtattcatgttaagatcgaacctggcggcagcgcaaaagatg

SEQ ID NO: 42707 - DNA, 103 bp, Artificial Sequence
  Synthetic Polynucleotide
taatacgactcactataggggatattatggcgttcctcgatcttaaaaagaacagaggagactttttatgatcgaggaaaacctggcggcagcgcaaaagatg

SEQ ID NO: 42708 - DNA, 103 bp, Artificial Sequence
  Synthetic Polynucleotide
taatacgactcactatagggattctgatattatggcgttcctcgatcttaaacagaggagataagatatgggaacgccaaacctggcggcagcgcaaaagatg

SEQ ID NO: 42709 - DNA, 103 bp, Artificial Sequence
  Synthetic Polynucleotide
taatacgactcactataggggtggcattctgatattatggcgttcctcgaaacagaggagatcgaggatggccataataaacctggcggcagcgcaaaagatg

SEQ ID NO: 42710 - DNA, 103 bp, Artificial Sequence
  Synthetic Polynucleotide
taatacgactcactataggggaaccgtggcattctgatattatggcgttcaacagaggagagaacgcatgaatatcagaaacctggcggcagcgcaaaagatg

SEQ ID NO: 42711 - DNA, 103 bp, Artificial Sequence
  Synthetic Polynucleotide
taatacgactcactatagggacttggaaccgtggcattctgatattatggaacagaggagaccataaatgcagaatgccaacctggcggcagcgcaaaagatg

SEQ ID NO: 42712 - DNA, 103 bp, Artificial Sequence
  Synthetic Polynucleotide
taatacgactcactatagggcatatacttggaaccgtggcattctgatataacagaggagaatatcaatgtgccacggtaacctggcggcagcgcaaaagatg

SEQ ID NO: 42713 - DNA, 103 bp, Artificial Sequence
  Synthetic Polynucleotide
taatacgactcactatagggatgaccatatacttggaaccgtggcattctaacagaggagaagaatgatgcggttccaaaacctggcggcagcgcaaaagatg

SEQ ID NO: 42714 - DNA, 103 bp, Artificial Sequence
  Synthetic Polynucleotide
taatacgactcactataggggagttatgaccatatacttggaaccgtggcaacagaggagagccacgatgccaagtataaacctggcggcagcgcaaaagatg

SEQ ID NO: 42715 - DNA, 103 bp, Artificial Sequence
  Synthetic Polynucleotide
taatacgactcactatagggtacacgatgaaatatctactaaaaaagaaaaacagaggagatttcttatgtagtagataaacctggcggcagcgcaaaagatg

SEQ ID NO: 42716 - DNA, 103 bp, Artificial Sequence
  Synthetic Polynucleotide
taatacgactcactataggggcctggagttatgaccatatacttggaaccaacagaggagaggttccatgtatatggtcaacctggcggcagcgcaaaagatg

SEQ ID NO: 42717 - DNA, 103 bp, Artificial Sequence
  Synthetic Polynucleotide
taatacgactcactatagggaaacggcctggagttatgaccatatacttgaacagaggagacaagtaatgggtcataacaacctggcggcagcgcaaaagatg

SEQ ID NO: 42718 - DNA, 103 bp, Artificial Sequence
  Synthetic Polynucleotide
taatacgactcactataggggaaacaaacggcctggagttatgaccatataacagaggagaatatggatgtaactccagaacctggcggcagcgcaaaagatg

SEQ ID NO: 42719 - DNA, 103 bp, Artificial Sequence
  Synthetic Polynucleotide
taatacgactcactataggggggaggaaacaaacggcctggagttatgacaacagaggagagtcataatgccaggccgtaacctggcggcagcgcaaaagatg

SEQ ID NO: 42720 - DNA, 103 bp, Artificial Sequence
  Synthetic Polynucleotide
taatacgactcactataggggatcagggaggaaacaaacggcctggagttaacagaggagaaactccatgccgtttgttaacctggcggcagcgcaaaagatg

SEQ ID NO: 42721 - DNA, 103 bp, Artificial Sequence
  Synthetic Polynucleotide
taatacgactcactatagggacatagatcagggaggaaacaaacggcctgaacagaggagacaggccatgtgtttcctcaacctggcggcagcgcaaaagatg

SEQ ID NO: 42722 - DNA, 103 bp, Artificial Sequence
  Synthetic Polynucleotide
taatacgactcactatagggtagatacatagatcagggaggaaacaaacgaacagaggagacgtttgatgcctccctgaaacctggcggcagcgcaaaagatg

SEQ ID NO: 42723 - DNA, 103 bp, Artificial Sequence
  Synthetic Polynucleotide
taatacgactcactatagggaccgctagatacatagatcagggaggaaacaacagaggagagtttccatgctgatctataacctggcggcagcgcaaaagatg

SEQ ID NO: 42724 - DNA, 103 bp, Artificial Sequence
  Synthetic Polynucleotide
taatacgactcactatagggataacaccgctagatacatagatcagggagaacagaggagactccctatgctatgtatcaacctggcggcagcgcaaaagatg

SEQ ID NO: 42725 - DNA, 103 bp, Artificial Sequence
  Synthetic Polynucleotide
taatacgactcactatagggttataataacaccgctagatacatagatcaaacagaggagatgatctatgtatctagcgaacctggcggcagcgcaaaagatg

SEQ ID NO: 42726 - DNA, 103 bp, Artificial Sequence
  Synthetic Polynucleotide
taatacgactcactatagggattcttacacgatgaaatatctactaaaaaaacagaggagatttttaatggatatttcaaacctggcggcagcgcaaaagatg

SEQ ID NO: 42727 - DNA, 103 bp, Artificial Sequence
  Synthetic Polynucleotide
taatacgactcactatagggagagtttataataacaccgctagatacataaacagaggagatatgtaatgagcggtgttaacctggcggcagcgcaaaagatg

SEQ ID NO: 42728 - DNA, 103 bp, Artificial Sequence
  Synthetic Polynucleotide
taatacgactcactatagggtgttgagagtttataataacaccgctagataacagaggagaatctagatgtgttattataacctggcggcagcgcaaaagatg

SEQ ID NO: 42729 - DNA, 103 bp, Artificial Sequence
  Synthetic Polynucleotide
taatacgactcactatagggtccaatgttgagagtttataataacaccgcaacagaggagagcggtgatgttataaactaacctggcggcagcgcaaaagatg

SEQ ID NO: 42730 - DNA, 103 bp, Artificial Sequence
  Synthetic Polynucleotide
taatacgactcactatagggattattccaatgttgagagtttataataacaacagaggagagttattatgaactctcaaaacctggcggcagcgcaaaagatg

SEQ ID NO: 42731 - DNA, 103 bp, Artificial Sequence
  Synthetic Polynucleotide
taatacgactcactatagggatggtattattccaatgttgagagtttataaacagaggagatataaaatgtcaacattgaacctggcggcagcgcaaaagatg

SEQ ID NO: 42732 - DNA, 103 bp, Artificial Sequence
  Synthetic Polynucleotide
taatacgactcactatagggatccaatggtattattccaatgttgagagtaacagaggagaactctcatgattggaataaacctggcggcagcgcaaaagatg

SEQ ID NO: 42733 - DNA, 103 bp, Artificial Sequence
  Synthetic Polynucleotide
taatacgactcactatagggggtgcatccaatggtattattccaatgttgaacagaggagacaacatatgaataataccaacctggcggcagcgcaaaagatg

SEQ ID NO: 42734 - DNA, 103 bp, Artificial Sequence
  Synthetic Polynucleotide
taatacgactcactatagggccaatggtgcatccaatggtattattccaaaacagaggagattggaaatgtaccattggaacctggcggcagcgcaaaagatg

SEQ ID NO: 42735 - DNA, 103 bp, Artificial Sequence
  Synthetic Polynucleotide
taatacgactcactatagggcgggaccaatggtgcatccaatggtattataacagaggagaataataatgttggatgcaaacctggcggcagcgcaaaagatg

SEQ ID NO: 42736 - DNA, 103 bp, Artificial Sequence
  Synthetic Polynucleotide
taatacgactcactatagggatctccgggaccaatggtgcatccaatggtaacagaggagaaccattatgtgcaccattaacctggcggcagcgcaaaagatg

SEQ ID NO: 42737 - DNA, 103 bp, Artificial Sequence
  Synthetic Polynucleotide
taatacgactcactatagggtattgattcttacacgatgaaatatctactaacagaggagaagtagaatgttcatcgtgaacctggcggcagcgcaaaagatg

SEQ ID NO: 42738 - DNA, 103 bp, Artificial Sequence
  Synthetic Polynucleotide
taatacgactcactataggggctatatctccgggaccaatggtgcatccaaacagaggagatggatgatgcattggtccaacctggcggcagcgcaaaagatg

SEQ ID NO: 42739 - DNA, 103 bp, Artificial Sequence
  Synthetic Polynucleotide
taatacgactcactatagggtggaagctatatctccgggaccaatggtgcaacagaggagagcaccaatggtcccggagaacctggcggcagcgcaaaagatg

SEQ ID NO: 42740 - DNA, 103 bp, Artificial Sequence
  Synthetic Polynucleotide
taatacgactcactataggggccagtggaagctatatctccgggaccaataacagaggagaattggtatgggagatataaacctggcggcagcgcaaaagatg

SEQ ID NO: 42741 - DNA, 103 bp, Artificial Sequence
  Synthetic Polynucleotide
taatacgactcactatagggttcgtgccagtggaagctatatctccgggaaacagaggagatcccggatgtatagcttcaacctggcggcagcgcaaaagatg

SEQ ID NO: 42742 - DNA, 103 bp, Artificial Sequence
  Synthetic Polynucleotide
taatacgactcactatagggtaatattcgtgccagtggaagctatatctcaacagaggagagagataatgcttccactgaacctggcggcagcgcaaaagatg

SEQ ID NO: 42743 - DNA, 103 bp, Artificial Sequence
  Synthetic Polynucleotide
taatacgactcactatagggattagtaatattcgtgccagtggaagctataacagaggagaatagctatgactggcacgaacctggcggcagcgcaaaagatg

SEQ ID NO: 42744 - DNA, 103 bp, Artificial Sequence
  Synthetic Polynucleotide
taatacgactcactatagggtatcaattagtaatattcgtgccagtggaaaacagaggagattccacatgcacgaatataacctggcggcagcgcaaaagatg

SEQ ID NO: 42745 - DNA, 103 bp, Artificial Sequence
  Synthetic Polynucleotide
taatacgactcactatagggaggtctatcaattagtaatattcgtgccagaacagaggagactggcaatgatattactaaacctggcggcagcgcaaaagatg

SEQ ID NO: 42746 - DNA, 103 bp, Artificial Sequence
  Synthetic Polynucleotide
taatacgactcactataggggggataggtctatcaattagtaatattcgtaacagaggagaacgaatatgactaattgaaacctggcggcagcgcaaaagatg

SEQ ID NO: 42747 - DNA, 103 bp, Artificial Sequence
  Synthetic Polynucleotide
taatacgactcactatagggcaggggggataggtctatcaattagtaataaacagaggagatattacatgttgatagacaacctggcggcagcgcaaaagatg

SEQ ID NO: 42748 - DNA, 103 bp, Artificial Sequence
  Synthetic Polynucleotide
taatacgactcactatagggattaatattgattcttacacgatgaaatataacagaggagaatatttatgcgtgtaagaaacctggcggcagcgcaaaagatg

SEQ ID NO: 42749 - DNA, 103 bp, Artificial Sequence
  Synthetic Polynucleotide
taatacgactcactatagggaatggcaggggggataggtctatcaattagaacagaggagactaattatgagacctatcaacctggcggcagcgcaaaagatg

SEQ ID NO: 42750 - DNA, 103 bp, Artificial Sequence
  Synthetic Polynucleotide
taatacgactcactatagggtctaaaatggcaggggggataggtctatcaaacagaggagatgatagatgtatccccccaacctggcggcagcgcaaaagatg

SEQ ID NO: 42751 - DNA, 103 bp, Artificial Sequence
  Synthetic Polynucleotide
taatacgactcactatagggtaatctctaaaatggcaggggggataggtcaacagaggagagacctaatgcccctgccaaacctggcggcagcgcaaaagatg

SEQ ID NO: 42752 - DNA, 103 bp, Artificial Sequence
  Synthetic Polynucleotide
taatacgactcactatagggcgcattaatctctaaaatggcaggggggataacagaggagaatccccatggccattttaaacctggcggcagcgcaaaagatg

SEQ ID NO: 42753 - DNA, 103 bp, Artificial Sequence
  Synthetic Polynucleotide
taatacgactcactatagggcgatgcgcattaatctctaaaatggcagggaacagaggagaccctgcatgtttagagataacctggcggcagcgcaaaagatg

SEQ ID NO: 42754 - DNA, 103 bp, Artificial Sequence
  Synthetic Polynucleotide
taatacgactcactatagggtaaaacgatgcgcattaatctctaaaatggaacagaggagaccatttatgagattaatgaacctggcggcagcgcaaaagatg

SEQ ID NO: 42755 - DNA, 103 bp, Artificial Sequence
  Synthetic Polynucleotide
taatacgactcactatagggtacgttaaaacgatgcgcattaatctctaaaacagaggagattagagatgaatgcgcataacctggcggcagcgcaaaagatg

SEQ ID NO: 42756 - DNA, 103 bp, Artificial Sequence
  Synthetic Polynucleotide
taatacgactcactatagggtatgatacgttaaaacgatgcgcattaatcaacagaggagagattaaatggcatcgtttaacctggcggcagcgcaaaagatg

SEQ ID NO: 42757 - DNA, 103 bp, Artificial Sequence
  Synthetic Polynucleotide
taatacgactcactataggggcatctatgatacgttaaaacgatgcgcataacagaggagaatgcgcatggttttaacgaacctggcggcagcgcaaaagatg

SEQ ID NO: 42758 - DNA, 103 bp, Artificial Sequence
  Synthetic Polynucleotide
taatacgactcactatagggagagggcatctatgatacgttaaaacgatgaacagaggagacatcgtatgaacgtatcaaacctggcggcagcgcaaaagatg

SEQ ID NO: 42759 - DNA, 103 bp, Artificial Sequence
  Synthetic Polynucleotide
taatacgactcactataggggaaatattaatattgattcttacacgatgaaacagaggagatcatcgatgaagaatcaaaacctggcggcagcgcaaaagatg

SEQ ID NO: 42760 - DNA, 103 bp, Artificial Sequence
  Synthetic Polynucleotide
taatacgactcactatagggagtatagagggcatctatgatacgttaaaaaacagaggagattttaaatgatcatagataacctggcggcagcgcaaaagatg

SEQ ID NO: 42761 - DNA, 103 bp, Artificial Sequence
  Synthetic Polynucleotide
taatacgactcactatagggatgatagtatagagggcatctatgatacgtaacagaggagaacgtatatgagatgccctaacctggcggcagcgcaaaagatg

SEQ ID NO: 42762 - DNA, 103 bp, Artificial Sequence
  Synthetic Polynucleotide
taatacgactcactataggggatggatgatagtatagagggcatctatgaaacagaggagatcatagatgccctctataaacctggcggcagcgcaaaagatg

SEQ ID NO: 42763 - DNA, 103 bp, Artificial Sequence
  Synthetic Polynucleotide
taatacgactcactatagggaacatgatggatgatagtatagagggcatcaacagaggagagatgccatgtatactatcaacctggcggcagcgcaaaagatg

SEQ ID NO: 42764 - DNA, 103 bp, Artificial Sequence
  Synthetic Polynucleotide
taatacgactcactatagggtacttaacatgatggatgatagtatagaggaacagaggagacctctaatgtatcatccaaacctggcggcagcgcaaaagatg

SEQ ID NO: 42765 - DNA, 103 bp, Artificial Sequence
  Synthetic Polynucleotide
taatacgactcactatagggttttctacttaacatgatggatgatagtataacagaggagaatactaatgtccatcatgaacctggcggcagcgcaaaagatg

SEQ ID NO: 42766 - DNA, 103 bp, Artificial Sequence
  Synthetic Polynucleotide
taatacgactcactatagggagctgttttctacttaacatgatggatgataacagaggagaatcatcatgcatgttaagaacctggcggcagcgcaaaagatg

SEQ ID NO: 42767 - DNA, 103 bp, Artificial Sequence
  Synthetic Polynucleotide
taatacgactcactatagggtgtctagctgttttctacttaacatgatggaacagaggagaccatcaatgtaagtagaaaacctggcggcagcgcaaaagatg

SEQ ID NO: 42768 - DNA, 103 bp, Artificial Sequence
  Synthetic Polynucleotide
taatacgactcactatagggccaaatgtctagctgttttctacttaacataacagaggagaatgttaatgagaaaacagaacctggcggcagcgcaaaagatg

SEQ ID NO: 42769 - DNA, 103 bp, Artificial Sequence
  Synthetic Polynucleotide
taatacgactcactatagggcgtcaccaaatgtctagctgttttctacttaacagaggagaaagtagatgacagctagaaacctggcggcagcgcaaaagatg

SEQ ID NO: 42770 - DNA, 103 bp, Artificial Sequence
  Synthetic Polynucleotide
taatacgactcactatagggctttagaaatattaatattgattcttacacaacagaggagagtgtaaatgtcaatattaaacctggcggcagcgcaaaagatg

SEQ ID NO: 42771 - DNA, 103 bp, Artificial Sequence
  Synthetic Polynucleotide
taatacgactcactatagggctagtcgtcaccaaatgtctagctgttttcaacagaggagagaaaacatgtagacatttaacctggcggcagcgcaaaagatg

SEQ ID NO: 42772 - DNA, 103 bp, Artificial Sequence
  Synthetic Polynucleotide
taatacgactcactataggggggaactagtcgtcaccaaatgtctagctgaacagaggagacagctaatgatttggtgaaacctggcggcagcgcaaaagatg

SEQ ID NO: 42773 - DNA, 103 bp, Artificial Sequence
  Synthetic Polynucleotide
taatacgactcactatagggaatgcgggaactagtcgtcaccaaatgtctaacagaggagaagacatatggtgacgactaacctggcggcagcgcaaaagatg

SEQ ID NO: 42774 - DNA, 103 bp, Artificial Sequence
  Synthetic Polynucleotide
taatacgactcactatagggtatttaatgcgggaactagtcgtcaccaaaaacagaggagatttggtatggactagttcaacctggcggcagcgcaaaagatg

SEQ ID NO: 42775 - DNA, 103 bp, Artificial Sequence
  Synthetic Polynucleotide
taatacgactcactatagggtaccttatttaatgcgggaactagtcgtcaaacagaggagatgacgaatggttcccgcaaacctggcggcagcgcaaaagatg

SEQ ID NO: 42776 - DNA, 103 bp, Artificial Sequence
  Synthetic Polynucleotide
taatacgactcactatagggtctcctaccttatttaatgcgggaactagtaacagaggagaactagtatgcgcattaaaaacctggcggcagcgcaaaagatg

SEQ ID NO: 42777 - DNA, 103 bp, Artificial Sequence
  Synthetic Polynucleotide
taatacgactcactatagggacgcttctcctaccttatttaatgcgggaaaacagaggagattcccgatgtaaataaggaacctggcggcagcgcaaaagatg

SEQ ID NO: 42778 - DNA, 103 bp, Artificial Sequence
  Synthetic Polynucleotide
taatacgactcactatagggtacgcacgcttctcctaccttatttaatgcaacagaggagagcattaatgaaggtaggaaacctggcggcagcgcaaaagatg

SEQ ID NO: 42779 - DNA, 103 bp, Artificial Sequence
  Synthetic Polynucleotide
taatacgactcactatagggtggtttacgcacgcttctcctaccttatttaacagaggagaaaataaatgaggagaagcaacctggcggcagcgcaaaagatg

SEQ ID NO: 42780 - DNA, 103 bp, Artificial Sequence
  Synthetic Polynucleotide
taatacgactcactatagggaaaaatggtttacgcacgcttctcctacctaacagaggagaaggtagatgaagcgtgcgaacctggcggcagcgcaaaagatg

SEQ ID NO: 42781 - DNA, 103 bp, Artificial Sequence
  Synthetic Polynucleotide
taatacgactcactatagggggatactttagaaatattaatattgattctaacagaggagaagaatcatgattaatattaacctggcggcagcgcaaaagatg

SEQ ID NO: 42782 - DNA, 103 bp, Artificial Sequence
  Synthetic Polynucleotide
taatacgactcactatagggttctgaaaaatggtttacgcacgcttctccaacagaggagaggagaaatgtgcgtaaacaacctggcggcagcgcaaaagatg

SEQ ID NO: 42783 - DNA, 103 bp, Artificial Sequence
  Synthetic Polynucleotide
taatacgactcactatagggctactttctgaaaaatggtttacgcacgctaacagaggagaagcgtgatgaaaccatttaacctggcggcagcgcaaaagatg

SEQ ID NO: 42784 - DNA, 103 bp, Artificial Sequence
  Synthetic Polynucleotide
taatacgactcactatagggacaatctactttctgaaaaatggtttacgcaacagaggagagcgtaaatgatttttcagaacctggcggcagcgcaaaagatg

SEQ ID NO: 42785 - DNA, 103 bp, Artificial Sequence
  Synthetic Polynucleotide
taatacgactcactataggggacgtacaatctactttctgaaaaatggttaacagaggagaaaccatatgtcagaaagtaacctggcggcagcgcaaaagatg

SEQ ID NO: 42786 - DNA, 103 bp, Artificial Sequence
  Synthetic Polynucleotide
taatacgactcactatagggatcgagacgtacaatctactttctgaaaaaaacagaggagatttttcatgaagtagattaacctggcggcagcgcaaaagatg

SEQ ID NO: 42787 - DNA, 103 bp, Artificial Sequence
  Synthetic Polynucleotide
taatacgactcactatagggcagctatcgagacgtacaatctactttctgaacagaggagacagaaaatggattgtacgaacctggcggcagcgcaaaagatg

SEQ ID NO: 42788 - DNA, 103 bp, Artificial Sequence
  Synthetic Polynucleotide
taatacgactcactatagggagactcagctatcgagacgtacaatctactaacagaggagaagtagaatgtacgtctcgaacctggcggcagcgcaaaagatg

SEQ ID NO: 42789 - DNA, 103 bp, Artificial Sequence
  Synthetic Polynucleotide
taatacgactcactataggggatatagactcagctatcgagacgtacaataacagaggagaattgtaatgctcgatagcaacctggcggcagcgcaaaagatg

SEQ ID NO: 42790 - DNA, 103 bp, Artificial Sequence
  Synthetic Polynucleotide
taatacgactcactatagggaatgggatatagactcagctatcgagacgtaacagaggagaacgtctatgtagctgagtaacctggcggcagcgcaaaagatg

SEQ ID NO: 42791 - DNA, 103 bp, Artificial Sequence
  Synthetic Polynucleotide
taatacgactcactatagggtcatcaatgggatatagactcagctatcgaaacagaggagatcgataatggagtctataaacctggcggcagcgcaaaagatg

SEQ ID NO: 42792 - DNA, 103 bp, Artificial Sequence
  Synthetic Polynucleotide
taatacgactcactatagggcgtgggacaatatagacaattgcgtggagaaacagaggagatctccaatgaattgtctaaacctggcggcagcgcaaaagatg

SEQ ID NO: 42793 - DNA, 103 bp, Artificial Sequence
  Synthetic Polynucleotide
taatacgactcactatagggtacacggatactttagaaatattaatattgaacagaggagacaatatatgtatttctaaaacctggcggcagcgcaaaagatg

SEQ ID NO: 42794 - DNA, 103 bp, Artificial Sequence
  Synthetic Polynucleotide
taatacgactcactatagggggaattcatcaatgggatatagactcagctaacagaggagaagctgaatgtatatcccaaacctggcggcagcgcaaaagatg

SEQ ID NO: 42795 - DNA, 103 bp, Artificial Sequence
  Synthetic Polynucleotide
taatacgactcactatagggcagtaggaattcatcaatgggatatagactaacagaggagaagtctaatgcccattgataacctggcggcagcgcaaaagatg

SEQ ID NO: 42796 - DNA, 103 bp, Artificial Sequence
  Synthetic Polynucleotide
taatacgactcactatagggtgtcgcagtaggaattcatcaatgggatataacagaggagaatatccatgtgatgaattaacctggcggcagcgcaaaagatg

SEQ ID NO: 42797 - DNA, 103 bp, Artificial Sequence
  Synthetic Polynucleotide
taatacgactcactatagggatgcgtgtcgcagtaggaattcatcaatggaacagaggagaccattgatgaattcctacaacctggcggcagcgcaaaagatg

SEQ ID NO: 42798 - DNA, 103 bp, Artificial Sequence
  Synthetic Polynucleotide
taatacgactcactatagggtgttaatgcgtgtcgcagtaggaattcatcaacagaggagagatgaaatgctactgcgaaacctggcggcagcgcaaaagatg

SEQ ID NO: 42799 - DNA, 103 bp, Artificial Sequence
  Synthetic Polynucleotide
taatacgactcactataggggcacatgttaatgcgtgtcgcagtaggaataacagaggagaattcctatggcgacacgcaacctggcggcagcgcaaaagatg

SEQ ID NO: 42800 - DNA, 103 bp, Artificial Sequence
  Synthetic Polynucleotide
taatacgactcactatagggcctcagcacatgttaatgcgtgtcgcagtaaacagaggagatactgcatgacgcattaaaacctggcggcagcgcaaaagatg

SEQ ID NO: 42801 - DNA, 103 bp, Artificial Sequence
  Synthetic Polynucleotide
taatacgactcactatagggaaagacctcagcacatgttaatgcgtgtcgaacagaggagacgacacatgttaacatgtaacctggcggcagcgcaaaagatg

SEQ ID NO: 42802 - DNA, 103 bp, Artificial Sequence
  Synthetic Polynucleotide
taatacgactcactatagggcgttgaaagacctcagcacatgttaatgcgaacagaggagacgcattatgatgtgctgaaacctggcggcagcgcaaaagatg

SEQ ID NO: 42803 - DNA, 103 bp, Artificial Sequence
  Synthetic Polynucleotide
taatacgactcactatagggaagatcgttgaaagacctcagcacatgttaaacagaggagataacatatgctgaggtctaacctggcggcagcgcaaaagatg

SEQ ID NO: 42804 - DNA, 103 bp, Artificial Sequence
  Synthetic Polynucleotide
taatacgactcactatagggggctatacacggatactttagaaatattaaaacagaggagattaataatgctaaagtataacctggcggcagcgcaaaagatg

SEQ ID NO: 42805 - DNA, 103 bp, Artificial Sequence
  Synthetic Polynucleotide
taatacgactcactatagggacaacaagatcgttgaaagacctcagcacaaacagaggagatgtgctatggtctttcaaaacctggcggcagcgcaaaagatg

SEQ ID NO: 42806 - DNA, 103 bp, Artificial Sequence
  Synthetic Polynucleotide
taatacgactcactatagggaataaacaacaagatcgttgaaagacctcaaacagaggagatgaggtatgtcaacgatcaacctggcggcagcgcaaaagatg

SEQ ID NO: 42807 - DNA, 103 bp, Artificial Sequence
  Synthetic Polynucleotide
taatacgactcactatagggctgaaaataaacaacaagatcgttgaaagaaacagaggagatctttcatggatcttgttaacctggcggcagcgcaaaagatg

SEQ ID NO: 42808 - DNA, 103 bp, Artificial Sequence
  Synthetic Polynucleotide
taatacgactcactatagggacttgctgaaaataaacaacaagatcgttgaacagaggagacaacgaatgtgttgtttaaacctggcggcagcgcaaaagatg

SEQ ID NO: 42809 - DNA, 103 bp, Artificial Sequence
  Synthetic Polynucleotide
taatacgactcactatagggatcctacttgctgaaaataaacaacaagataacagaggagaatcttgatgtttattttcaacctggcggcagcgcaaaagatg

SEQ ID NO: 42810 - DNA, 103 bp, Artificial Sequence
  Synthetic Polynucleotide
taatacgactcactataggggaaaaatcctacttgctgaaaataaacaacaacagaggagagttgttatgtttcagcaaaacctggcggcagcgcaaaagatg

SEQ ID NO: 42811 - DNA, 103 bp, Artificial Sequence
  Synthetic Polynucleotide
taatacgactcactatagggctttggaaaaatcctacttgctgaaaataaaacagaggagattatttatggcaagtaggaacctggcggcagcgcaaaagatg

SEQ ID NO: 42812 - DNA, 103 bp, Artificial Sequence
  Synthetic Polynucleotide
taatacgactcactatagggtaaaactttggaaaaatcctacttgctgaaaacagaggagattcagcatgtaggattttaacctggcggcagcgcaaaagatg

SEQ ID NO: 42813 - DNA, 103 bp, Artificial Sequence
  Synthetic Polynucleotide
taatacgactcactatagggggttttaaaactttggaaaaatcctacttgaacagaggagacaagtaatgtttttccaaaacctggcggcagcgcaaaagatg

SEQ ID NO: 42814 - DNA, 103 bp, Artificial Sequence
  Synthetic Polynucleotide
taatacgactcactatagggattttggttttaaaactttggaaaaatcctaacagaggagaaggattatgccaaagtttaacctggcggcagcgcaaaagatg

SEQ ID NO: 42815 - DNA, 103 bp, Artificial Sequence
  Synthetic Polynucleotide
taatacgactcactatagggaaagaggctatacacggatactttagaaataacagaggagaatttctatggtatccgtgaacctggcggcagcgcaaaagatg

SEQ ID NO: 42816 - DNA, 103 bp, Artificial Sequence
  Synthetic Polynucleotide
taatacgactcactatagggcaactattttggttttaaaactttggaaaaaacagaggagattttccatggttttaaaaaacctggcggcagcgcaaaagatg

SEQ ID NO: 42817 - DNA, 103 bp, Artificial Sequence
  Synthetic Polynucleotide
taatacgactcactatagggtcatacaactattttggttttaaaactttgaacagaggagacaaagtatgaaaaccaaaaacctggcggcagcgcaaaagatg

SEQ ID NO: 42818 - DNA, 103 bp, Artificial Sequence
  Synthetic Polynucleotide
taatacgactcactatagggacttttcatacaactattttggttttaaaaaacagaggagattttaaatgcaaaatagtaacctggcggcagcgcaaaagatg

SEQ ID NO: 42819 - DNA, 103 bp, Artificial Sequence
  Synthetic Polynucleotide
taatacgactcactatagggacgagacttttcatacaactattttggtttaacagaggagaaaaccaatgtagttgtataacctggcggcagcgcaaaagatg

SEQ ID NO: 42820 - DNA, 103 bp, Artificial Sequence
  Synthetic Polynucleotide
taatacgactcactatagggtacgaacgagacttttcatacaactattttaacagaggagaaaaataatggtatgaaaaaacctggcggcagcgcaaaagatg

SEQ ID NO: 42821 - DNA, 103 bp, Artificial Sequence
  Synthetic Polynucleotide
taatacgactcactatagggttatttacgaacgagacttttcatacaactaacagaggagaagttgtatgaaaagtctcaacctggcggcagcgcaaaagatg

SEQ ID NO: 42822 - DNA, 103 bp, Artificial Sequence
  Synthetic Polynucleotide
taatacgactcactatagggagttattatttacgaacgagacttttcataaacagaggagatatgaaatgtctcgttcgaacctggcggcagcgcaaaagatg

SEQ ID NO: 42823 - DNA, 103 bp, Artificial Sequence
  Synthetic Polynucleotide
taatacgactcactatagggaactcagttattatttacgaacgagactttaacagaggagaaaagtcatgttcgtaaataacctggcggcagcgcaaaagatg

SEQ ID NO: 42824 - DNA, 103 bp, Artificial Sequence
  Synthetic Polynucleotide
taatacgactcactatagggaactcaactcagttattatttacgaacgagaacagaggagactcgttatgaaataataaaacctggcggcagcgcaaaagatg

SEQ ID NO: 42825 - DNA, 103 bp, Artificial Sequence
  Synthetic Polynucleotide
taatacgactcactatagggggataaactcaactcagttattatttacgaaacagaggagatcgtaaatgataactgagaacctggcggcagcgcaaaagatg

SEQ ID NO: 42826 - DNA, 103 bp, Artificial Sequence
  Synthetic Polynucleotide
taatacgactcactatagggtaaataaagaggctatacacggatactttaaacagaggagataaagtatgcgtgtatagaacctggcggcagcgcaaaagatg

SEQ ID NO: 42827 - DNA, 103 bp, Artificial Sequence
  Synthetic Polynucleotide
taatacgactcactatagggtataaggataaactcaactcagttattattaacagaggagaaataatatgtgagttgagaacctggcggcagcgcaaaagatg

SEQ ID NO: 42828 - DNA, 103 bp, Artificial Sequence
  Synthetic Polynucleotide
taatacgactcactatagggacaaatataaggataaactcaactcagttaaacagaggagataactgatgtgagtttataacctggcggcagcgcaaaagatg

SEQ ID NO: 42829 - DNA, 103 bp, Artificial Sequence
  Synthetic Polynucleotide
taatacgactcactatagggagttaacaaatataaggataaactcaactcaacagaggagagagttgatgttatccttaaacctggcggcagcgcaaaagatg

SEQ ID NO: 42830 - DNA, 103 bp, Artificial Sequence
  Synthetic Polynucleotide
taatacgactcactataggggatgtagttaacaaatataaggataaactcaacagaggagagagtttatgcttatatttaacctggcggcagcgcaaaagatg

SEQ ID NO: 42831 - DNA, 103 bp, Artificial Sequence
  Synthetic Polynucleotide
taatacgactcactatagggccatggatgtagttaacaaatataaggataaacagaggagatatcctatgatttgttaaaacctggcggcagcgcaaaagatg

SEQ ID NO: 42832 - DNA, 103 bp, Artificial Sequence
  Synthetic Polynucleotide
taatacgactcactatagggtattaccatggatgtagttaacaaatataaaacagaggagattatatatgttaactacaaacctggcggcagcgcaaaagatg

SEQ ID NO: 42833 - DNA, 103 bp, Artificial Sequence
  Synthetic Polynucleotide
taatacgactcactatagggtcaagtattaccatggatgtagttaacaaaaacagaggagatttgttatgtacatccataacctggcggcagcgcaaaagatg

SEQ ID NO: 42834 - DNA, 103 bp, Artificial Sequence
  Synthetic Polynucleotide
taatacgactcactatagggttatttcaagtattaccatggatgtagttaaacagaggagataactaatgccatggtaaaacctggcggcagcgcaaaagatg

SEQ ID NO: 42835 - DNA, 103 bp, Artificial Sequence
  Synthetic Polynucleotide
taatacgactcactatagggtccgattatttcaagtattaccatggatgtaacagaggagaacatccatggtaatacttaacctggcggcagcgcaaaagatg

SEQ ID NO: 42836 - DNA, 103 bp, Artificial Sequence
  Synthetic Polynucleotide
taatacgactcactatagggcattctccgattatttcaagtattaccatgaacagaggagacatggtatgacttgaaataacctggcggcagcgcaaaagatg

SEQ ID NO: 42837 - DNA, 103 bp, Artificial Sequence
  Synthetic Polynucleotide
taatacgactcactatagggtgtggtaaataaagaggctatacacggataaacagaggagatatccgatgatagcctctaacctggcggcagcgcaaaagatg

SEQ ID NO: 42838 - DNA, 103 bp, Artificial Sequence
  Synthetic Polynucleotide
taatacgactcactatagggggaaacattctccgattatttcaagtattaaacagaggagataatacatgaaataatcgaacctggcggcagcgcaaaagatg

SEQ ID NO: 42839 - DNA, 103 bp, Artificial Sequence
  Synthetic Polynucleotide
taatacgactcactatagggaaatgggaaacattctccgattatttcaagaacagaggagacttgaaatgatcggagaaaacctggcggcagcgcaaaagatg

SEQ ID NO: 42840 - DNA, 103 bp, Artificial Sequence
  Synthetic Polynucleotide
taatacgactcactatagggcctaaaaatgggaaacattctccgattattaacagaggagaaataatatgagaatgtttaacctggcggcagcgcaaaagatg

SEQ ID NO: 42841 - DNA, 103 bp, Artificial Sequence
  Synthetic Polynucleotide
taatacgactcactatagggtcaatcctaaaaatgggaaacattctccgaaacagaggagatcggagatggtttcccataacctggcggcagcgcaaaagatg

SEQ ID NO: 42842 - DNA, 103 bp, Artificial Sequence
  Synthetic Polynucleotide
taatacgactcactatagggctatgtcaatcctaaaaatgggaaacattcaacagaggagagaatgtatgccatttttaaacctggcggcagcgcaaaagatg

SEQ ID NO: 42843 - DNA, 103 bp, Artificial Sequence
  Synthetic Polynucleotide
taatacgactcactatagggtttaactatgtcaatcctaaaaatgggaaaaacagaggagatttcccatgtttaggattaacctggcggcagcgcaaaagatg

SEQ ID NO: 42844 - DNA, 103 bp, Artificial Sequence
  Synthetic Polynucleotide
taatacgactcactatagggatttatttaactatgtcaatcctaaaaatgaacagaggagacattttatggattgacataacctggcggcagcgcaaaagatg

SEQ ID NO: 42845 - DNA, 103 bp, Artificial Sequence
  Synthetic Polynucleotide
taatacgactcactataggggaaggatttatttaactatgtcaatcctaaaacagaggagattaggaatgacatagttaaacctggcggcagcgcaaaagatg

SEQ ID NO: 42846 - DNA, 103 bp, Artificial Sequence
  Synthetic Polynucleotide
taatacgactcactataggggtgatgaaggatttatttaactatgtcaataacagaggagaattgacatggttaaataaaacctggcggcagcgcaaaagatg

SEQ ID NO: 42847 - DNA, 103 bp, Artificial Sequence
  Synthetic Polynucleotide
taatacgactcactataggggtgaagtgatgaaggatttatttaactatgaacagaggagacatagtatgataaatcctaacctggcggcagcgcaaaagatg

SEQ ID NO: 42848 - DNA, 103 bp, Artificial Sequence
  Synthetic Polynucleotide
taatacgactcactatagggggagctgtggtaaataaagaggctatacacaacagaggagagtgtatatgctctttattaacctggcggcagcgcaaaagatg

SEQ ID NO: 42849 - DNA, 103 bp, Artificial Sequence
  Synthetic Polynucleotide
taatacgactcactatagggatttagtgaagtgatgaaggatttatttaaaacagaggagattaaatatgtccttcatcaacctggcggcagcgcaaaagatg

SEQ ID NO: 42850 - DNA, 103 bp, Artificial Sequence
  Synthetic Polynucleotide
taatacgactcactatagggaaactatttagtgaagtgatgaaggatttaaacagaggagataaatcatgcatcacttcaacctggcggcagcgcaaaagatg

SEQ ID NO: 42851 - DNA, 103 bp, Artificial Sequence
  Synthetic Polynucleotide
taatacgactcactatagggcaaaaaaactatttagtgaagtgatgaaggaacagaggagaccttcaatgcttcactaaaacctggcggcagcgcaaaagatg

SEQ ID NO: 42852 - DNA, 103 bp, Artificial Sequence
  Synthetic Polynucleotide
taatacgactcactatagggagaaacaaaaaaactatttagtgaagtgataacagaggagaatcactatgctaaatagtaacctggcggcagcgcaaaagatg

SEQ ID NO: 42853 - DNA, 103 bp, Artificial Sequence
  Synthetic Polynucleotide
taatacgactcactatagggcacaaagaaacaaaaaaactatttagtgaaaacagaggagattcactatgtagttttttaacctggcggcagcgcaaaagatg

SEQ ID NO: 42854 - DNA, 103 bp, Artificial Sequence
  Synthetic Polynucleotide
taatacgactcactatagggatctacacaaagaaacaaaaaaactatttaaacagaggagataaataatgtttttgtttaacctggcggcagcgcaaaagatg

SEQ ID NO: 42855 - DNA, 103 bp, Artificial Sequence
  Synthetic Polynucleotide
taatacgactcactatagggatcaaatctacacaaagaaacaaaaaaactaacagaggagaagttttatggtttctttgaacctggcggcagcgcaaaagatg

SEQ ID NO: 42856 - DNA, 103 bp, Artificial Sequence
  Synthetic Polynucleotide
taatacgactcactataggggccgtatcaaatctacacaaagaaacaaaaaacagaggagattttgtatgtttgtgtagaacctggcggcagcgcaaaagatg

SEQ ID NO: 42857 - DNA, 103 bp, Artificial Sequence
  Synthetic Polynucleotide
taatacgactcactataggggaatagccgtatcaaatctacacaaagaaaaacagaggagatttcttatggtagatttgaacctggcggcagcgcaaaagatg

SEQ ID NO: 42858 - DNA, 103 bp, Artificial Sequence
  Synthetic Polynucleotide
taatacgactcactatagggcgctagaatagccgtatcaaatctacacaaaacagaggagattgtgtatgtttgatacgaacctggcggcagcgcaaaagatg

SEQ ID NO: 42859 - DNA, 103 bp, Artificial Sequence
  Synthetic Polynucleotide
taatacgactcactatagggcatatggagctgtggtaaataaagaggctaaacagaggagatagcctatgtatttaccaaacctggcggcagcgcaaaagatg

SEQ ID NO: 42860 - DNA, 103 bp, Artificial Sequence
  Synthetic Polynucleotide
taatacgactcactatagggctagccgctagaatagccgtatcaaatctaaacagaggagatagattatgtacggctataacctggcggcagcgcaaaagatg

SEQ ID NO: 42861 - DNA, 103 bp, Artificial Sequence
  Synthetic Polynucleotide
taatacgactcactatagggccattctagccgctagaatagccgtatcaaaacagaggagattgataatgctattctagaacctggcggcagcgcaaaagatg

SEQ ID NO: 42862 - DNA, 103 bp, Artificial Sequence
  Synthetic Polynucleotide
taatacgactcactatagggttatgccattctagccgctagaatagccgtaacagaggagaacggctatgctagcggctaacctggcggcagcgcaaaagatg

SEQ ID NO: 42863 - DNA, 103 bp, Artificial Sequence
  Synthetic Polynucleotide
taatacgactcactatagggccggattatgccattctagccgctagaataaacagaggagatattctatgggctagaataacctggcggcagcgcaaaagatg

SEQ ID NO: 42864 - DNA, 103 bp, Artificial Sequence
  Synthetic Polynucleotide
taatacgactcactatagggaacatccggattatgccattctagccgctaaacagaggagatagcggatggaatggcataacctggcggcagcgcaaaagatg

SEQ ID NO: 42865 - DNA, 103 bp, Artificial Sequence
  Synthetic Polynucleotide
taatacgactcactatagggtacacaacatccggattatgccattctagcaacagaggagagctagaatggcataatccaacctggcggcagcgcaaaagatg

SEQ ID NO: 42866 - DNA, 103 bp, Artificial Sequence
  Synthetic Polynucleotide
taatacgactcactatagggtgtactacacaacatccggattatgccattaacagaggagaaatggcatgatccggatgaacctggcggcagcgcaaaagatg

SEQ ID NO: 42867 - DNA, 103 bp, Artificial Sequence
  Synthetic Polynucleotide
taatacgactcactatagggccacttgtactacacaacatccggattatgaacagaggagacataatatggatgttgtgaacctggcggcagcgcaaaagatg

SEQ ID NO: 42868 - DNA, 103 bp, Artificial Sequence
  Synthetic Polynucleotide
taatacgactcactatagggagcagccacttgtactacacaacatccggaaacagaggagatccggaatgtgtgtagtaaacctggcggcagcgcaaaagatg

SEQ ID NO: 42869 - DNA, 103 bp, Artificial Sequence
  Synthetic Polynucleotide
taatacgactcactataggggaaatagcagccacttgtactacacaacataacagaggagaatgttgatgagtacaagtaacctggcggcagcgcaaaagatg

SEQ ID NO: 42870 - DNA, 103 bp, Artificial Sequence
  Synthetic Polynucleotide
taatacgactcactataggggttggcatatggagctgtggtaaataaagaaacagaggagatctttaatgaccacagctaacctggcggcagcgcaaaagatg

SEQ ID NO: 42871 - DNA, 103 bp, Artificial Sequence
  Synthetic Polynucleotide
taatacgactcactatagggcagccgaaatagcagccacttgtactacacaacagaggagagtgtagatgaagtggctgaacctggcggcagcgcaaaagatg

SEQ ID NO: 42872 - DNA, 103 bp, Artificial Sequence
  Synthetic Polynucleotide
taatacgactcactatagggtctgacagccgaaatagcagccacttgtacaacagaggagagtacaaatggctgctattaacctggcggcagcgcaaaagatg

SEQ ID NO: 42873 - DNA, 103 bp, Artificial Sequence
  Synthetic Polynucleotide
taatacgactcactataggggacactctgacagccgaaatagcagccactaacagaggagaagtggcatgtatttcggcaacctggcggcagcgcaaaagatg

SEQ ID NO: 42874 - DNA, 103 bp, Artificial Sequence
  Synthetic Polynucleotide
taatacgactcactatagggaattggacactctgacagccgaaatagcagaacagaggagactgctaatgcggctgtcaaacctggcggcagcgcaaaagatg

SEQ ID NO: 42875 - DNA, 103 bp, Artificial Sequence
  Synthetic Polynucleotide
taatacgactcactatagggggtagaattggacactctgacagccgaaataacagaggagaatttcgatggtcagagtgaacctggcggcagcgcaaaagatg

SEQ ID NO: 42876 - DNA, 103 bp, Artificial Sequence
  Synthetic Polynucleotide
taatacgactcactatagggacaacggtagaattggacactctgacagccaacagaggagaggctgtatgagtgtccaaaacctggcggcagcgcaaaagatg

SEQ ID NO: 42877 - DNA, 103 bp, Artificial Sequence
  Synthetic Polynucleotide
taatacgactcactataggggagtaacaacggtagaattggacactctgaaacagaggagatcagagatgccaattctaaacctggcggcagcgcaaaagatg

SEQ ID NO: 42878 - DNA, 103 bp, Artificial Sequence
  Synthetic Polynucleotide
taatacgactcactatagggtaatggagtaacaacggtagaattggacacaacagaggagagtgtccatgtctaccgttaacctggcggcagcgcaaaagatg

SEQ ID NO: 42879 - DNA, 103 bp, Artificial Sequence
  Synthetic Polynucleotide
taatacgactcactatagggatatataatggagtaacaacggtagaattgaacagaggagacaattcatgcgttgttacaacctggcggcagcgcaaaagatg

SEQ ID NO: 42880 - DNA, 103 bp, Artificial Sequence
  Synthetic Polynucleotide
taatacgactcactatagggaaggaatatataatggagtaacaacggtagaacagaggagactaccgatgttactccataacctggcggcagcgcaaaagatg

SEQ ID NO: 42881 - DNA, 103 bp, Artificial Sequence
  Synthetic Polynucleotide
taatacgactcactatagggtgcatgttggcatatggagctgtggtaaataacagaggagaatttacatgagctccataaacctggcggcagcgcaaaagatg

SEQ ID NO: 42882 - DNA, 103 bp, Artificial Sequence
  Synthetic Polynucleotide
taatacgactcactatagggtatccaaggaatatataatggagtaacaacaacagaggagagttgttatgccattatataacctggcggcagcgcaaaagatg

SEQ ID NO: 42883 - DNA, 103 bp, Artificial Sequence
  Synthetic Polynucleotide
taatacgactcactatagggaaggttatccaaggaatatataatggagtaaacagaggagatactccatgatatattccaacctggcggcagcgcaaaagatg

SEQ ID NO: 42884 - DNA, 103 bp, Artificial Sequence
  Synthetic Polynucleotide
taatacgactcactatagggctatgaaggttatccaaggaatatataatgaacagaggagacattatatgttccttggaaacctggcggcagcgcaaaagatg

SEQ ID NO: 42885 - DNA, 103 bp, Artificial Sequence
  Synthetic Polynucleotide
taatacgactcactatagggaatagctatgaaggttatccaaggaatataaacagaggagatatattatgtggataaccaacctggcggcagcgcaaaagatg

SEQ ID NO: 42886 - DNA, 103 bp, Artificial Sequence
  Synthetic Polynucleotide
taatacgactcactatagggattaaaatagctatgaaggttatccaaggaaacagaggagatccttgatgaaccttcataacctggcggcagcgcaaaagatg

SEQ ID NO: 42887 - DNA, 103 bp, Artificial Sequence
  Synthetic Polynucleotide
taatacgactcactatagggatcctattaaaatagctatgaaggttatccaacagaggagaggataaatgtcatagctaaacctggcggcagcgcaaaagatg

SEQ ID NO: 42888 - DNA, 103 bp, Artificial Sequence
  Synthetic Polynucleotide
taatacgactcactatagggtatagatcctattaaaatagctatgaaggtaacagaggagaaccttcatggctattttaaacctggcggcagcgcaaaagatg

SEQ ID NO: 42889 - DNA, 103 bp, Artificial Sequence
  Synthetic Polynucleotide
taatacgactcactataggggatcatatagatcctattaaaatagctatgaacagaggagacatagcatgtttaataggaacctggcggcagcgcaaaagatg

SEQ ID NO: 42890 - DNA, 103 bp, Artificial Sequence
  Synthetic Polynucleotide
taatacgactcactatagggacactgatcatatagatcctattaaaatagaacagaggagactatttatgtaggatctaaacctggcggcagcgcaaaagatg

SEQ ID NO: 42891 - DNA, 103 bp, Artificial Sequence
  Synthetic Polynucleotide
taatacgactcactatagggcttaaacactgatcatatagatcctattaaaacagaggagattaataatgtctatatgaaacctggcggcagcgcaaaagatg

SEQ ID NO: 42892 - DNA, 103 bp, Artificial Sequence
  Synthetic Polynucleotide
taatacgactcactatagggtggaatgcatgttggcatatggagctgtggaacagaggagaccacagatgcatatgccaaacctggcggcagcgcaaaagatg

SEQ ID NO: 42893 - DNA, 103 bp, Artificial Sequence
  Synthetic Polynucleotide
taatacgactcactatagggtatggcttaaacactgatcatatagatcctaacagaggagaaggatcatgatgatcagtaacctggcggcagcgcaaaagatg

SEQ ID NO: 42894 - DNA, 103 bp, Artificial Sequence
  Synthetic Polynucleotide
taatacgactcactatagggtatgttatggcttaaacactgatcatatagaacagaggagactatatatgcagtgtttaaacctggcggcagcgcaaaagatg

SEQ ID NO: 42895 - DNA, 103 bp, Artificial Sequence
  Synthetic Polynucleotide
taatacgactcactatagggaaaattatgttatggcttaaacactgatcaaacagaggagatgatcaatgtttaagccaaacctggcggcagcgcaaaagatg

SEQ ID NO: 42896 - DNA, 103 bp, Artificial Sequence
  Synthetic Polynucleotide
taatacgactcactatagggattagaaaattatgttatggcttaaacactaacagaggagaagtgttatggccataacaaacctggcggcagcgcaaaagatg

SEQ ID NO: 42897 - DNA, 103 bp, Artificial Sequence
  Synthetic Polynucleotide
taatacgactcactatagggctcgtattagaaaattatgttatggcttaaaacagaggagattaagcatgaacataattaacctggcggcagcgcaaaagatg

SEQ ID NO: 42898 - DNA, 103 bp, Artificial Sequence
  Synthetic Polynucleotide
taatacgactcactatagggcacatctcgtattagaaaattatgttatggaacagaggagaccataaatgaattttctaaacctggcggcagcgcaaaagatg

SEQ ID NO: 42899 - DNA, 103 bp, Artificial Sequence
  Synthetic Polynucleotide
taatacgactcactatagggaaaatcacatctcgtattagaaaattatgtaacagaggagaacataaatgtctaatacgaacctggcggcagcgcaaaagatg

SEQ ID NO: 42900 - DNA, 103 bp, Artificial Sequence
  Synthetic Polynucleotide
taatacgactcactatagggttgataaaatcacatctcgtattagaaaataacagaggagaattttcatgtacgagatgaacctggcggcagcgcaaaagatg

SEQ ID NO: 42901 - DNA, 103 bp, Artificial Sequence
  Synthetic Polynucleotide
taatacgactcactatagggcatgtttgataaaatcacatctcgtattagaacagaggagactaataatggatgtgattaacctggcggcagcgcaaaagatg

SEQ ID NO: 42902 - DNA, 103 bp, Artificial Sequence
  Synthetic Polynucleotide
taatacgactcactatagggaatgtcatgtttgataaaatcacatctcgtaacagaggagaacgagaatggattttatcaacctggcggcagcgcaaaagatg

SEQ ID NO: 42903 - DNA, 103 bp, Artificial Sequence
  Synthetic Polynucleotide
taatacgactcactatagggtacgtctacaataaatgcaaaccattctgaaacagaggagatcagaaatgtttgcatttaacctggcggcagcgcaaaagatg

SEQ ID NO: 42904 - DNA, 103 bp, Artificial Sequence
  Synthetic Polynucleotide
taatacgactcactatagggacttccgtgggacaatatagacaattgcgtaacagaggagaacgcaaatgtctatattgaacctggcggcagcgcaaaagatg

SEQ ID NO: 42905 - DNA, 103 bp, Artificial Sequence
  Synthetic Polynucleotide
taatacgactcactatagggtctagtggaatgcatgttggcatatggagcaacagaggagagctccaatggccaacatgaacctggcggcagcgcaaaagatg

SEQ ID NO: 42906 - DNA, 103 bp, Artificial Sequence
  Synthetic Polynucleotide
taatacgactcactatagggaggaaaatgtcatgtttgataaaatcacataacagaggagaatgtgaatgtatcaaacaaacctggcggcagcgcaaaagatg

SEQ ID NO: 42907 - DNA, 103 bp, Artificial Sequence
  Synthetic Polynucleotide
taatacgactcactatagggatacaaggaaaatgtcatgtttgataaaataacagaggagaattttaatgaacatgacaaacctggcggcagcgcaaaagatg

SEQ ID NO: 42908 - DNA, 103 bp, Artificial Sequence
  Synthetic Polynucleotide
taatacgactcactatagggaatggatacaaggaaaatgtcatgtttgataacagaggagaatcaaaatggacattttcaacctggcggcagcgcaaaagatg

SEQ ID NO: 42909 - DNA, 103 bp, Artificial Sequence
  Synthetic Polynucleotide
taatacgactcactatagggaacgaaatggatacaaggaaaatgtcatgtaacagaggagaacatgaatgtttccttgtaacctggcggcagcgcaaaagatg

SEQ ID NO: 42910 - DNA, 103 bp, Artificial Sequence
  Synthetic Polynucleotide
taatacgactcactatagggcattaaacgaaatggatacaaggaaaatgtaacagaggagaacatttatgttgtatccaaacctggcggcagcgcaaaagatg

SEQ ID NO: 42911 - DNA, 103 bp, Artificial Sequence
  Synthetic Polynucleotide
taatacgactcactatagggtttgtcattaaacgaaatggatacaaggaaaacagaggagattccttatgtccatttcgaacctggcggcagcgcaaaagatg

SEQ ID NO: 42912 - DNA, 103 bp, Artificial Sequence
  Synthetic Polynucleotide
taatacgactcactatagggaaatgtttgtcattaaacgaaatggatacaaacagaggagatgtatcatgttcgtttaaaacctggcggcagcgcaaaagatg

SEQ ID NO: 42913 - DNA, 103 bp, Artificial Sequence
  Synthetic Polynucleotide
taatacgactcactatagggaacaaaaatgtttgtcattaaacgaaatggaacagaggagaccatttatgttaatgacaaacctggcggcagcgcaaaagatg

SEQ ID NO: 42914 - DNA, 103 bp, Artificial Sequence
  Synthetic Polynucleotide
taatacgactcactatagggacaccaacaaaaatgtttgtcattaaacgaaacagaggagatcgtttatggacaaacataacctggcggcagcgcaaaagatg

SEQ ID NO: 42915 - DNA, 103 bp, Artificial Sequence
  Synthetic Polynucleotide
taatacgactcactatagggttattacaccaacaaaaatgtttgtcattaaacagaggagataatgaatgacatttttgaacctggcggcagcgcaaaagatg

SEQ ID NO: 42916 - DNA, 103 bp, Artificial Sequence
  Synthetic Polynucleotide
taatacgactcactatagggatccatctagtggaatgcatgttggcatataacagaggagaatatgcatgcatgcattcaacctggcggcagcgcaaaagatg

SEQ ID NO: 42917 - DNA, 103 bp, Artificial Sequence
  Synthetic Polynucleotide
taatacgactcactatagggtttttttattacaccaacaaaaatgtttgtaacagaggagaacaaacatgtttgttggtaacctggcggcagcgcaaaagatg

SEQ ID NO: 42918 - DNA, 103 bp, Artificial Sequence
  Synthetic Polynucleotide
taatacgactcactatagggataattttttttattacaccaacaaaaatgaacagaggagacattttatgtggtgtaataacctggcggcagcgcaaaagatg

SEQ ID NO: 42919 - DNA, 103 bp, Artificial Sequence
  Synthetic Polynucleotide
taatacgactcactataggggttaaataattttttttattacaccaacaaaacagaggagattgttgatgtaataaaaaaacctggcggcagcgcaaaagatg

SEQ ID NO: 42920 - DNA, 103 bp, Artificial Sequence
  Synthetic Polynucleotide
taatacgactcactataggggaaaagttaaataattttttttattacaccaacagaggagaggtgtaatgaaaaaaattaacctggcggcagcgcaaaagatg

SEQ ID NO: 42921 - DNA, 103 bp, Artificial Sequence
  Synthetic Polynucleotide
taatacgactcactatagggttaatgaaaagttaaataattttttttattaacagaggagaaataaaatgaattatttaaacctggcggcagcgcaaaagatg

SEQ ID NO: 42922 - DNA, 103 bp, Artificial Sequence
  Synthetic Polynucleotide
taatacgactcactatagggccctattaatgaaaagttaaataattttttaacagaggagaaaaaaaatgtttaactttaacctggcggcagcgcaaaagatg

SEQ ID NO: 42923 - DNA, 103 bp, Artificial Sequence
  Synthetic Polynucleotide
taatacgactcactatagggcaaatccctattaatgaaaagttaaataataacagaggagaattattatgcttttcattaacctggcggcagcgcaaaagatg

SEQ ID NO: 42924 - DNA, 103 bp, Artificial Sequence
  Synthetic Polynucleotide
taatacgactcactatagggtacatcaaatccctattaatgaaaagttaaaacagaggagattaactatgcattaatagaacctggcggcagcgcaaaagatg

SEQ ID NO: 42925 - DNA, 103 bp, Artificial Sequence
  Synthetic Polynucleotide
taatacgactcactatagggctacgtacatcaaatccctattaatgaaaaaacagaggagattttcaatgatagggattaacctggcggcagcgcaaaagatg

SEQ ID NO: 42926 - DNA, 103 bp, Artificial Sequence
  Synthetic Polynucleotide
taatacgactcactataggggtacgctacgtacatcaaatccctattaataacagaggagaattaatatggatttgatgaacctggcggcagcgcaaaagatg

SEQ ID NO: 42927 - DNA, 103 bp, Artificial Sequence
  Synthetic Polynucleotide
taatacgactcactatagggtcgatatccatctagtggaatgcatgttggaacagaggagaccaacaatgattccactaaacctggcggcagcgcaaaagatg

SEQ ID NO: 42928 - DNA, 103 bp, Artificial Sequence
  Synthetic Polynucleotide
taatacgactcactatagggattttgtacgctacgtacatcaaatccctaaacagaggagatagggaatggatgtacgtaacctggcggcagcgcaaaagatg

SEQ ID NO: 42929 - DNA, 103 bp, Artificial Sequence
  Synthetic Polynucleotide
taatacgactcactatagggcgataattttgtacgctacgtacatcaaataacagaggagaatttgaatgacgtagcgtaacctggcggcagcgcaaaagatg

SEQ ID NO: 42930 - DNA, 103 bp, Artificial Sequence
  Synthetic Polynucleotide
taatacgactcactatagggaggaacgataattttgtacgctacgtacataacagaggagaatgtacatggcgtacaaaaacctggcggcagcgcaaaagatg

SEQ ID NO: 42931 - DNA, 103 bp, Artificial Sequence
  Synthetic Polynucleotide
taatacgactcactatagggataccaggaacgataattttgtacgctacgaacagaggagacgtagcatgcaaaattataacctggcggcagcgcaaaagatg

SEQ ID NO: 42932 - DNA, 103 bp, Artificial Sequence
  Synthetic Polynucleotide
taatacgactcactatagggtctatataccaggaacgataattttgtacgaacagaggagacgtacaatgttatcgttcaacctggcggcagcgcaaaagatg

SEQ ID NO: 42933 - DNA, 103 bp, Artificial Sequence
  Synthetic Polynucleotide
taatacgactcactatagggctttatctatataccaggaacgataattttaacagaggagaaaaattatggttcctggtaacctggcggcagcgcaaaagatg

SEQ ID NO: 42934 - DNA, 103 bp, Artificial Sequence
  Synthetic Polynucleotide
taatacgactcactatagggggactctttatctatataccaggaacgataaacagaggagatatcgtatgtggtatataaacctggcggcagcgcaaaagatg

SEQ ID NO: 42935 - DNA, 103 bp, Artificial Sequence
  Synthetic Polynucleotide
taatacgactcactatagggatataggactctttatctatataccaggaaaacagaggagattcctgatgtatagataaaacctggcggcagcgcaaaagatg

SEQ ID NO: 42936 - DNA, 103 bp, Artificial Sequence
  Synthetic Polynucleotide
taatacgactcactatagggcaaatatataggactctttatctatataccaacagaggagaggtataatgataaagagtaacctggcggcagcgcaaaagatg

SEQ ID NO: 42937 - DNA, 103 bp, Artificial Sequence
  Synthetic Polynucleotide
taatacgactcactatagggattttcaaatatataggactctttatctataacagaggagaatagatatggagtcctataacctggcggcagcgcaaaagatg

SEQ ID NO: 42938 - DNA, 103 bp, Artificial Sequence
  Synthetic Polynucleotide
taatacgactcactatagggcgatatcgatatccatctagtggaatgcataacagaggagaatgcatatgactagatggaacctggcggcagcgcaaaagatg

SEQ ID NO: 42939 - DNA, 103 bp, Artificial Sequence
  Synthetic Polynucleotide
taatacgactcactatagggtaacgattttcaaatatataggactctttaaacagaggagataaagaatgctatatattaacctggcggcagcgcaaaagatg

SEQ ID NO: 42940 - DNA, 103 bp, Artificial Sequence
  Synthetic Polynucleotide
taatacgactcactatagggagccgtaacgattttcaaatatataggactaacagaggagaagtcctatgtatttgaaaaacctggcggcagcgcaaaagatg

SEQ ID NO: 42941 - DNA, 103 bp, Artificial Sequence
  Synthetic Polynucleotide
taatacgactcactatagggaatcgagccgtaacgattttcaaatatataaacagaggagatatataatggaaaatcgtaacctggcggcagcgcaaaagatg

SEQ ID NO: 42942 - DNA, 103 bp, Artificial Sequence
  Synthetic Polynucleotide
taatacgactcactatagggagtttaatcgagccgtaacgattttcaaataacagaggagaatttgaatgtcgttacggaacctggcggcagcgcaaaagatg

SEQ ID NO: 42943 - DNA, 103 bp, Artificial Sequence
  Synthetic Polynucleotide
taatacgactcactatagggattaaagtttaatcgagccgtaacgattttaacagaggagaaaaatcatgacggctcgaaacctggcggcagcgcaaaagatg

SEQ ID NO: 42944 - DNA, 103 bp, Artificial Sequence
  Synthetic Polynucleotide
taatacgactcactatagggcaatcattaaagtttaatcgagccgtaacgaacagaggagacgttacatgtcgattaaaaacctggcggcagcgcaaaagatg

SEQ ID NO: 42945 - DNA, 103 bp, Artificial Sequence
  Synthetic Polynucleotide
taatacgactcactatagggcaatgcaatcattaaagtttaatcgagccgaacagaggagacggctcatgtaaactttaaacctggcggcagcgcaaaagatg

SEQ ID NO: 42946 - DNA, 103 bp, Artificial Sequence
  Synthetic Polynucleotide
taatacgactcactatagggattcacaatgcaatcattaaagtttaatcgaacagaggagacgattaatgtttaatgataacctggcggcagcgcaaaagatg

SEQ ID NO: 42947 - DNA, 103 bp, Artificial Sequence
  Synthetic Polynucleotide
taatacgactcactataggggatatattcacaatgcaatcattaaagtttaacagaggagaaaacttatgtgattgcataacctggcggcagcgcaaaagatg

SEQ ID NO: 42948 - DNA, 103 bp, Artificial Sequence
  Synthetic Polynucleotide
taatacgactcactatagggctaatgatatattcacaatgcaatcattaaaacagaggagattaatgatggcattgtgaaacctggcggcagcgcaaaagatg

SEQ ID NO: 42949 - DNA, 103 bp, Artificial Sequence
  Synthetic Polynucleotide
taatacgactcactatagggttcgacgatatcgatatccatctagtggaaaacagaggagattccacatgatggatatcaacctggcggcagcgcaaaagatg

SEQ ID NO: 42950 - DNA, 103 bp, Artificial Sequence
  Synthetic Polynucleotide
taatacgactcactatagggaaatcctaatgatatattcacaatgcaatcaacagaggagagattgcatggtgaatataaacctggcggcagcgcaaaagatg

SEQ ID NO: 42951 - DNA, 103 bp, Artificial Sequence
  Synthetic Polynucleotide
taatacgactcactataggggagttaaatcctaatgatatattcacaatgaacagaggagacattgtatgtatatcattaacctggcggcagcgcaaaagatg

SEQ ID NO: 42952 - DNA, 103 bp, Artificial Sequence
  Synthetic Polynucleotide
taatacgactcactatagggtcaaggagttaaatcctaatgatatattcaaacagaggagatgaataatgcattaggataacctggcggcagcgcaaaagatg

SEQ ID NO: 42953 - DNA, 103 bp, Artificial Sequence
  Synthetic Polynucleotide
taatacgactcactataggggatagtcaaggagttaaatcctaatgatataacagaggagaatatcaatgggatttaacaacctggcggcagcgcaaaagatg

SEQ ID NO: 42954 - DNA, 103 bp, Artificial Sequence
  Synthetic Polynucleotide
taatacgactcactataggggccatgatagtcaaggagttaaatcctaataacagaggagaattaggatgtaactccttaacctggcggcagcgcaaaagatg

SEQ ID NO: 42955 - DNA, 103 bp, Artificial Sequence
  Synthetic Polynucleotide
taatacgactcactataggggcaccgccatgatagtcaaggagttaaatcaacagaggagagatttaatgccttgactaaacctggcggcagcgcaaaagatg

SEQ ID NO: 42956 - DNA, 103 bp, Artificial Sequence
  Synthetic Polynucleotide
taatacgactcactatagggttctggcaccgccatgatagtcaaggagttaacagaggagaaactccatgactatcatgaacctggcggcagcgcaaaagatg

SEQ ID NO: 42957 - DNA, 103 bp, Artificial Sequence
  Synthetic Polynucleotide
taatacgactcactataggggtaatttctggcaccgccatgatagtcaagaacagaggagacttgacatgcatggcggtaacctggcggcagcgcaaaagatg

SEQ ID NO: 42958 - DNA, 103 bp, Artificial Sequence
  Synthetic Polynucleotide
taatacgactcactatagggtgatggtaatttctggcaccgccatgatagaacagaggagactatcaatgcggtgccagaacctggcggcagcgcaaaagatg

SEQ ID NO: 42959 - DNA, 103 bp, Artificial Sequence
  Synthetic Polynucleotide
taatacgactcactataggggcttttgatggtaatttctggcaccgccataacagaggagaatggcgatgccagaaattaacctggcggcagcgcaaaagatg

SEQ ID NO: 42960 - DNA, 103 bp, Artificial Sequence
  Synthetic Polynucleotide
taatacgactcactatagggtgacattcgacgatatcgatatccatctagaacagaggagactagatatgtatcgatataacctggcggcagcgcaaaagatg

SEQ ID NO: 42961 - DNA, 103 bp, Artificial Sequence
  Synthetic Polynucleotide
taatacgactcactatagggttaatgcttttgatggtaatttctggcaccaacagaggagaggtgccatgaattaccataacctggcggcagcgcaaaagatg

SEQ ID NO: 42962 - DNA, 103 bp, Artificial Sequence
  Synthetic Polynucleotide
taatacgactcactatagggctgtattaatgcttttgatggtaatttctgaacagaggagacagaaaatgccatcaaaaaacctggcggcagcgcaaaagatg

SEQ ID NO: 42963 - DNA, 103 bp, Artificial Sequence
  Synthetic Polynucleotide
taatacgactcactatagggtataactgtattaatgcttttgatggtaataacagaggagaattaccatgaaaagcattaacctggcggcagcgcaaaagatg

SEQ ID NO: 42964 - DNA, 103 bp, Artificial Sequence
  Synthetic Polynucleotide
taatacgactcactatagggatcggtataactgtattaatgcttttgatgaacagaggagacatcaaatgcattaatacaacctggcggcagcgcaaaagatg

SEQ ID NO: 42965 - DNA, 103 bp, Artificial Sequence
  Synthetic Polynucleotide
taatacgactcactatagggctgcgatcggtataactgtattaatgctttaacagaggagaaaagcaatgatacagttaaacctggcggcagcgcaaaagatg

SEQ ID NO: 42966 - DNA, 103 bp, Artificial Sequence
  Synthetic Polynucleotide
taatacgactcactatagggtctaactgcgatcggtataactgtattaataacagaggagaattaatatggttataccgaacctggcggcagcgcaaaagatg

SEQ ID NO: 42967 - DNA, 103 bp, Artificial Sequence
  Synthetic Polynucleotide
taatacgactcactatagggaccgttctaactgcgatcggtataactgtaaacagaggagatacagtatgaccgatcgcaacctggcggcagcgcaaaagatg

SEQ ID NO: 42968 - DNA, 103 bp, Artificial Sequence
  Synthetic Polynucleotide
taatacgactcactatagggctataaccgttctaactgcgatcggtataaaacagaggagattatacatgtcgcagttaaacctggcggcagcgcaaaagatg

SEQ ID NO: 42969 - DNA, 103 bp, Artificial Sequence
  Synthetic Polynucleotide
taatacgactcactatagggggatgctataaccgttctaactgcgatcggaacagaggagaccgatcatggttagaacgaacctggcggcagcgcaaaagatg

SEQ ID NO: 42970 - DNA, 103 bp, Artificial Sequence
  Synthetic Polynucleotide
taatacgactcactatagggatggcggatgctataaccgttctaactgcgaacagaggagacgcagtatgaacggttataacctggcggcagcgcaaaagatg

SEQ ID NO: 42971 - DNA, 103 bp, Artificial Sequence
  Synthetic Polynucleotide
taatacgactcactataggggtatatgacattcgacgatatcgatatccaaacagaggagatggataatgatatcgtcgaacctggcggcagcgcaaaagatg

SEQ ID NO: 42972 - DNA, 103 bp, Artificial Sequence
  Synthetic Polynucleotide
taatacgactcactatagggtataaatggcggatgctataaccgttctaaaacagaggagattagaaatgttatagcataacctggcggcagcgcaaaagatg

SEQ ID NO: 42973 - DNA, 103 bp, Artificial Sequence
  Synthetic Polynucleotide
taatacgactcactatagggttagatataaatggcggatgctataaccgtaacagaggagaacggttatggcatccgccaacctggcggcagcgcaaaagatg

SEQ ID NO: 42974 - DNA, 103 bp, Artificial Sequence
  Synthetic Polynucleotide
taatacgactcactatagggaatttttagatataaatggcggatgctataaacagaggagatatagcatgcgccatttaaacctggcggcagcgcaaaagatg

SEQ ID NO: 42975 - DNA, 103 bp, Artificial Sequence
  Synthetic Polynucleotide
taatacgactcactataggggatctaatttttagatataaatggcggatgaacagaggagacatccgatgtttatatctaacctggcggcagcgcaaaagatg

SEQ ID NO: 42976 - DNA, 103 bp, Artificial Sequence
  Synthetic Polynucleotide
taatacgactcactatagggtctttgatctaatttttagatataaatggcaacagaggagagccattatgatctaaaaaaacctggcggcagcgcaaaagatg

SEQ ID NO: 42977 - DNA, 103 bp, Artificial Sequence
  Synthetic Polynucleotide
taatacgactcactatagggcatattctttgatctaatttttagatataaaacagaggagattatatatgaaaattagaaacctggcggcagcgcaaaagatg

SEQ ID NO: 42978 - DNA, 103 bp, Artificial Sequence
  Synthetic Polynucleotide
taatacgactcactatagggtgtcacatattctttgatctaatttttagaaacagaggagatctaaaatgtagatcaaaaacctggcggcagcgcaaaagatg

SEQ ID NO: 42979 - DNA, 103 bp, Artificial Sequence
  Synthetic Polynucleotide
taatacgactcactataggggactttgtcacatattctttgatctaatttaacagaggagaaaattaatgcaaagaataaacctggcggcagcgcaaaagatg

SEQ ID NO: 42980 - DNA, 103 bp, Artificial Sequence
  Synthetic Polynucleotide
taatacgactcactatagggactaggactttgtcacatattctttgatctaacagaggagaagatcaatgaatatgtgaaacctggcggcagcgcaaaagatg

SEQ ID NO: 42981 - DNA, 103 bp, Artificial Sequence
  Synthetic Polynucleotide
taatacgactcactatagggatacaactaggactttgtcacatattctttaacagaggagaaaagaaatggtgacaaagaacctggcggcagcgcaaaagatg

SEQ ID NO: 42982 - DNA, 103 bp, Artificial Sequence
  Synthetic Polynucleotide
taatacgactcactatagggattgagtatatgacattcgacgatatcgataacagaggagaatcgatatggtcgaatgtaacctggcggcagcgcaaaagatg

SEQ ID NO: 42983 - DNA, 103 bp, Artificial Sequence
  Synthetic Polynucleotide
taatacgactcactatagggtcagtatacaactaggactttgtcacatataacagaggagaatatgtatgaaagtcctaaacctggcggcagcgcaaaagatg

SEQ ID NO: 42984 - DNA, 103 bp, Artificial Sequence
  Synthetic Polynucleotide
taatacgactcactatagggaattctcagtatacaactaggactttgtcaaacagaggagatgacaaatgcctagttgtaacctggcggcagcgcaaaagatg

SEQ ID NO: 42985 - DNA, 103 bp, Artificial Sequence
  Synthetic Polynucleotide
taatacgactcactatagggtcgttaattctcagtatacaactaggacttaacagaggagaaagtccatgttgtatactaacctggcggcagcgcaaaagatg

SEQ ID NO: 42986 - DNA, 103 bp, Artificial Sequence
  Synthetic Polynucleotide
taatacgactcactatagggttgtttcgttaattctcagtatacaactagaacagaggagactagttatgtactgagaaaacctggcggcagcgcaaaagatg

SEQ ID NO: 42987 - DNA, 103 bp, Artificial Sequence
  Synthetic Polynucleotide
taatacgactcactatagggaaacattgtttcgttaattctcagtatacaaacagaggagatgtataatgagaattaacaacctggcggcagcgcaaaagatg

SEQ ID NO: 42988 - DNA, 103 bp, Artificial Sequence
  Synthetic Polynucleotide
taatacgactcactataggggtaagaaacattgtttcgttaattctcagtaacagaggagaactgagatgtaacgaaacaacctggcggcagcgcaaaagatg

SEQ ID NO: 42989 - DNA, 103 bp, Artificial Sequence
  Synthetic Polynucleotide
taatacgactcactatagggaatatgtaagaaacattgtttcgttaattcaacagaggagagaattaatgaaacaatgtaacctggcggcagcgcaaaagatg

SEQ ID NO: 42990 - DNA, 103 bp, Artificial Sequence
  Synthetic Polynucleotide
taatacgactcactatagggaaaaaaatatgtaagaaacattgtttcgttaacagaggagaaacgaaatgatgtttcttaacctggcggcagcgcaaaagatg

SEQ ID NO: 42991 - DNA, 103 bp, Artificial Sequence
  Synthetic Polynucleotide
taatacgactcactatagggataagaaaaaaatatgtaagaaacattgttaacagaggagaaacaatatgtcttacataaacctggcggcagcgcaaaagatg

SEQ ID NO: 42992 - DNA, 103 bp, Artificial Sequence
  Synthetic Polynucleotide
taatacgactcactatagggtactaataagaaaaaaatatgtaagaaacaaacagaggagatgtttcatgcatatttttaacctggcggcagcgcaaaagatg

SEQ ID NO: 42993 - DNA, 103 bp, Artificial Sequence
  Synthetic Polynucleotide
taatacgactcactatagggtactaattgagtatatgacattcgacgataaacagaggagatatcgtatgatgtcatataacctggcggcagcgcaaaagatg

SEQ ID NO: 42994 - DNA, 103 bp, Artificial Sequence
  Synthetic Polynucleotide
taatacgactcactatagggtcagttactaataagaaaaaaatatgtaagaacagaggagacttacaatgttttttcttaacctggcggcagcgcaaaagatg

SEQ ID NO: 42995 - DNA, 103 bp, Artificial Sequence
  Synthetic Polynucleotide
taatacgactcactatagggttaagtcagttactaataagaaaaaaatataacagaggagaatatttatgtcttattagaacctggcggcagcgcaaaagatg

SEQ ID NO: 42996 - DNA, 103 bp, Artificial Sequence
  Synthetic Polynucleotide
taatacgactcactatagggtactattaagtcagttactaataagaaaaaaacagaggagatttttcatgttagtaactaacctggcggcagcgcaaaagatg

SEQ ID NO: 42997 - DNA, 103 bp, Artificial Sequence
  Synthetic Polynucleotide
taatacgactcactataggggttcctactattaagtcagttactaataagaacagaggagacttattatgaactgacttaacctggcggcagcgcaaaagatg

SEQ ID NO: 42998 - DNA, 103 bp, Artificial Sequence
  Synthetic Polynucleotide
taatacgactcactatagggttccagttcctactattaagtcagttactaaacagaggagatagtaaatgacttaatagaacctggcggcagcgcaaaagatg

SEQ ID NO: 42999 - DNA, 103 bp, Artificial Sequence
  Synthetic Polynucleotide
taatacgactcactatagggtagctttccagttcctactattaagtcagtaacagaggagaactgacatgatagtaggaaacctggcggcagcgcaaaagatg

SEQ ID NO: 43000 - DNA, 103 bp, Artificial Sequence
  Synthetic Polynucleotide
taatacgactcactatagggaagtctagctttccagttcctactattaagaacagaggagacttaatatgaggaactggaacctggcggcagcgcaaaagatg

SEQ ID NO: 43001 - DNA, 103 bp, Artificial Sequence
  Synthetic Polynucleotide
taatacgactcactatagggtaatcaagtctagctttccagttcctactaaacagaggagatagtagatgctggaaagcaacctggcggcagcgcaaaagatg

SEQ ID NO: 43002 - DNA, 103 bp, Artificial Sequence
  Synthetic Polynucleotide
taatacgactcactatagggtagaataatcaagtctagctttccagttccaacagaggagaggaactatgaagctagacaacctggcggcagcgcaaaagatg

SEQ ID NO: 43003 - DNA, 103 bp, Artificial Sequence
  Synthetic Polynucleotide
taatacgactcactatagggacttatagaataatcaagtctagctttccaaacagaggagatggaaaatgagacttgataacctggcggcagcgcaaaagatg

SEQ ID NO: 43004 - DNA, 103 bp, Artificial Sequence
  Synthetic Polynucleotide
taatacgactcactatagggacatatactaattgagtatatgacattcgaaacagaggagatcgaatatgatatactcaaacctggcggcagcgcaaaagatg

SEQ ID NO: 43005 - DNA, 103 bp, Artificial Sequence
  Synthetic Polynucleotide
taatacgactcactatagggtttatacttatagaataatcaagtctagctaacagaggagaagctagatgtgattattcaacctggcggcagcgcaaaagatg

SEQ ID NO: 43006 - DNA, 103 bp, Artificial Sequence
  Synthetic Polynucleotide
taatacgactcactataggggggtatttatacttatagaataatcaagtcaacagaggagagacttgatgattctataaaacctggcggcagcgcaaaagatg

SEQ ID NO: 43007 - DNA, 103 bp, Artificial Sequence
  Synthetic Polynucleotide
taatacgactcactatagggtggaagggtatttatacttatagaataatcaacagaggagagattatatgataagtataaacctggcggcagcgcaaaagatg

SEQ ID NO: 43008 - DNA, 103 bp, Artificial Sequence
  Synthetic Polynucleotide
taatacgactcactatagggttatttggaagggtatttatacttatagaaaacagaggagattctatatgtataaatacaacctggcggcagcgcaaaagatg

SEQ ID NO: 43009 - DNA, 103 bp, Artificial Sequence
  Synthetic Polynucleotide
taatacgactcactataggggaatattatttggaagggtatttatacttaaacagaggagataagtaatgatacccttcaacctggcggcagcgcaaaagatg

SEQ ID NO: 43010 - DNA, 103 bp, Artificial Sequence
  Synthetic Polynucleotide
taatacgactcactatagggaaagagaatattatttggaagggtatttataacagaggagaataaatatgcttccaaataacctggcggcagcgcaaaagatg

SEQ ID NO: 43011 - DNA, 103 bp, Artificial Sequence
  Synthetic Polynucleotide
taatacgactcactatagggttatcaaagagaatattatttggaagggtaaacagaggagataccctatgaaataatataacctggcggcagcgcaaaagatg

SEQ ID NO: 43012 - DNA, 103 bp, Artificial Sequence
  Synthetic Polynucleotide
taatacgactcactatagggaacttttatcaaagagaatattatttggaaaacagaggagattccaaatgatattctctaacctggcggcagcgcaaaagatg

SEQ ID NO: 43013 - DNA, 103 bp, Artificial Sequence
  Synthetic Polynucleotide
taatacgactcactatagggtctggaacttttatcaaagagaatattattaacagaggagaaataatatgctctttgataacctggcggcagcgcaaaagatg

SEQ ID NO: 43014 - DNA, 103 bp, Artificial Sequence
  Synthetic Polynucleotide
taatacgactcactatagggcattttctggaacttttatcaaagagaataaacagaggagatattctatgtgataaaagaacctggcggcagcgcaaaagatg

SEQ ID NO: 43015 - DNA, 103 bp, Artificial Sequence
  Synthetic Polynucleotide
taatacgactcactataggggattcacttccgtgggacaatatagacaataacagaggagaattgtcatgattgtcccaaacctggcggcagcgcaaaagatg

SEQ ID NO: 43016 - DNA, 103 bp, Artificial Sequence
  Synthetic Polynucleotide
taatacgactcactatagggctccaacatatactaattgagtatatgacaaacagaggagatgtcatatgctcaattagaacctggcggcagcgcaaaagatg

SEQ ID NO: 43017 - DNA, 103 bp, Artificial Sequence
  Synthetic Polynucleotide
taatacgactcactatagggttctacattttctggaacttttatcaaagaaacagaggagatctttgatgaaagttccaaacctggcggcagcgcaaaagatg

SEQ ID NO: 43018 - DNA, 103 bp, Artificial Sequence
  Synthetic Polynucleotide
taatacgactcactatagggaaaaattctacattttctggaacttttatcaacagaggagagataaaatgtccagaaaaaacctggcggcagcgcaaaagatg

SEQ ID NO: 43019 - DNA, 103 bp, Artificial Sequence
  Synthetic Polynucleotide
taatacgactcactatagggttttaaaaaattctacattttctggaacttaacagaggagaaagttcatgaaaatgtagaacctggcggcagcgcaaaagatg

SEQ ID NO: 43020 - DNA, 103 bp, Artificial Sequence
  Synthetic Polynucleotide
taatacgactcactatagggtaactttttaaaaaattctacattttctggaacagaggagaccagaaatggtagaatttaacctggcggcagcgcaaaagatg

SEQ ID NO: 43021 - DNA, 103 bp, Artificial Sequence
  Synthetic Polynucleotide
taatacgactcactatagggaaagataactttttaaaaaattctacatttaacagaggagaaaatgtatgattttttaaaacctggcggcagcgcaaaagatg

SEQ ID NO: 43022 - DNA, 103 bp, Artificial Sequence
  Synthetic Polynucleotide
taatacgactcactatagggtagcaaaagataactttttaaaaaattctaaacagaggagatagaatatgttaaaaagtaacctggcggcagcgcaaaagatg

SEQ ID NO: 43023 - DNA, 103 bp, Artificial Sequence
  Synthetic Polynucleotide
taatacgactcactatagggggtaatagcaaaagataactttttaaaaaaaacagaggagattttttatgaagttatctaacctggcggcagcgcaaaagatg

SEQ ID NO: 43024 - DNA, 103 bp, Artificial Sequence
  Synthetic Polynucleotide
taatacgactcactatagggatcttggtaatagcaaaagataactttttaaacagaggagataaaaaatgatcttttgcaacctggcggcagcgcaaaagatg

SEQ ID NO: 43025 - DNA, 103 bp, Artificial Sequence
  Synthetic Polynucleotide
taatacgactcactatagggacacaatcttggtaatagcaaaagataactaacagaggagaagttatatgttgctattaaacctggcggcagcgcaaaagatg

SEQ ID NO: 43026 - DNA, 103 bp, Artificial Sequence
  Synthetic Polynucleotide
taatacgactcactatagggtctaaacacaatcttggtaatagcaaaagaaacagaggagatcttttatgattaccaagaacctggcggcagcgcaaaagatg

SEQ ID NO: 43027 - DNA, 103 bp, Artificial Sequence
  Synthetic Polynucleotide
taatacgactcactatagggatatcctccaacatatactaattgagtataaacagaggagatatactatgttagtatataacctggcggcagcgcaaaagatg

SEQ ID NO: 43028 - DNA, 103 bp, Artificial Sequence
  Synthetic Polynucleotide
taatacgactcactatagggaagcgtctaaacacaatcttggtaatagcaaacagaggagatgctatatgcaagattgtaacctggcggcagcgcaaaagatg

SEQ ID NO: 43029 - DNA, 103 bp, Artificial Sequence
  Synthetic Polynucleotide
taatacgactcactatagggataataagcgtctaaacacaatcttggtaaaacagaggagattaccaatgttgtgtttaaacctggcggcagcgcaaaagatg

SEQ ID NO: 43030 - DNA, 103 bp, Artificial Sequence
  Synthetic Polynucleotide
taatacgactcactatagggtattaataataagcgtctaaacacaatcttaacagaggagaaagattatgtttagacgcaacctggcggcagcgcaaaagatg

SEQ ID NO: 43031 - DNA, 103 bp, Artificial Sequence
  Synthetic Polynucleotide
taatacgactcactatagggactcatattaataataagcgtctaaacacaaacagaggagatgtgttatgacgcttattaacctggcggcagcgcaaaagatg

SEQ ID NO: 43032 - DNA, 103 bp, Artificial Sequence
  Synthetic Polynucleotide
taatacgactcactatagggttatcactcatattaataataagcgtctaaaacagaggagattagacatgtattattaaaacctggcggcagcgcaaaagatg

SEQ ID NO: 43033 - DNA, 103 bp, Artificial Sequence
  Synthetic Polynucleotide
taatacgactcactatagggggattttatcactcatattaataataagcgaacagaggagacgcttaatgttaatatgaaacctggcggcagcgcaaaagatg

SEQ ID NO: 43034 - DNA, 103 bp, Artificial Sequence
  Synthetic Polynucleotide
taatacgactcactatagggggtgtggattttatcactcatattaataataacagaggagaattattatgatgagtgataacctggcggcagcgcaaaagatg

SEQ ID NO: 43035 - DNA, 103 bp, Artificial Sequence
  Synthetic Polynucleotide
taatacgactcactataggggaggcggtgtggattttatcactcatattaaacagaggagataatatatgtgataaaataacctggcggcagcgcaaaagatg

SEQ ID NO: 43036 - DNA, 103 bp, Artificial Sequence
  Synthetic Polynucleotide
taatacgactcactatagggatctagaggcggtgtggattttatcactcaaacagaggagatgagtgatgaaatccacaaacctggcggcagcgcaaaagatg

SEQ ID NO: 43037 - DNA, 103 bp, Artificial Sequence
  Synthetic Polynucleotide
taatacgactcactataggggctatatctagaggcggtgtggattttatcaacagaggagagataaaatgcacaccgccaacctggcggcagcgcaaaagatg

SEQ ID NO: 43038 - DNA, 103 bp, Artificial Sequence
  Synthetic Polynucleotide
taatacgactcactatagggctcgaatatcctccaacatatactaattgaaacagaggagatcaattatgatatgttggaacctggcggcagcgcaaaagatg

SEQ ID NO: 43039 - DNA, 103 bp, Artificial Sequence
  Synthetic Polynucleotide
taatacgactcactatagggtaaaagctatatctagaggcggtgtggattaacagaggagaaatccaatgcgcctctagaacctggcggcagcgcaaaagatg

SEQ ID NO: 43040 - DNA, 103 bp, Artificial Sequence
  Synthetic Polynucleotide
taatacgactcactatagggggaaataaaagctatatctagaggcggtgtaacagaggagaacaccgatgctagatataaacctggcggcagcgcaaaagatg

SEQ ID NO: 43041 - DNA, 103 bp, Artificial Sequence
  Synthetic Polynucleotide
taatacgactcactatagggaatgtggaaataaaagctatatctagaggcaacagaggagagcctctatgtatagctttaacctggcggcagcgcaaaagatg

SEQ ID NO: 43042 - DNA, 103 bp, Artificial Sequence
  Synthetic Polynucleotide
taatacgactcactatagggcatctaatgtggaaataaaagctatatctaaacagaggagatagataatgcttttatttaacctggcggcagcgcaaaagatg

SEQ ID NO: 43043 - DNA, 103 bp, Artificial Sequence
  Synthetic Polynucleotide
taatacgactcactatagggtttaccatctaatgtggaaataaaagctataacagaggagaatagctatgatttccacaaacctggcggcagcgcaaaagatg

SEQ ID NO: 43044 - DNA, 103 bp, Artificial Sequence
  Synthetic Polynucleotide
taatacgactcactatagggttggatttaccatctaatgtggaaataaaaaacagaggagattttatatgcacattagaaacctggcggcagcgcaaaagatg

SEQ ID NO: 43045 - DNA, 103 bp, Artificial Sequence
  Synthetic Polynucleotide
taatacgactcactatagggcactattggatttaccatctaatgtggaaaaacagaggagatttccaatgtagatggtaaacctggcggcagcgcaaaagatg

SEQ ID NO: 43046 - DNA, 103 bp, Artificial Sequence
  Synthetic Polynucleotide
taatacgactcactatagggagtttcactattggatttaccatctaatgtaacagaggagaacattaatgggtaaatccaacctggcggcagcgcaaaagatg

SEQ ID NO: 43047 - DNA, 103 bp, Artificial Sequence
  Synthetic Polynucleotide
taatacgactcactatagggaagatagtttcactattggatttaccatctaacagaggagaagatggatgatccaatagaacctggcggcagcgcaaaagatg

SEQ ID NO: 43048 - DNA, 103 bp, Artificial Sequence
  Synthetic Polynucleotide
taatacgactcactatagggctaaaaagatagtttcactattggatttacaacagaggagagtaaatatgatagtgaaaaacctggcggcagcgcaaaagatg

SEQ ID NO: 43049 - DNA, 103 bp, Artificial Sequence
  Synthetic Polynucleotide
taatacgactcactatagggatgaactcgaatatcctccaacatatactaaacagaggagatagtatatgttggaggataacctggcggcagcgcaaaagatg

SEQ ID NO: 43050 - DNA, 103 bp, Artificial Sequence
  Synthetic Polynucleotide
taatacgactcactatagggcattcctaaaaagatagtttcactattggaaacagaggagatccaatatggaaactatcaacctggcggcagcgcaaaagatg

SEQ ID NO: 43051 - DNA, 103 bp, Artificial Sequence
  Synthetic Polynucleotide
taatacgactcactatagggccatacattcctaaaaagatagtttcactaaacagaggagatagtgaatgtatctttttaacctggcggcagcgcaaaagatg

SEQ ID NO: 43052 - DNA, 103 bp, Artificial Sequence
  Synthetic Polynucleotide
taatacgactcactatagggcgagtccatacattcctaaaaagatagtttaacagaggagaaaactaatgttttaggaaaacctggcggcagcgcaaaagatg

SEQ ID NO: 43053 - DNA, 103 bp, Artificial Sequence
  Synthetic Polynucleotide
taatacgactcactatagggaaacgcgagtccatacattcctaaaaagataacagaggagaatctttatgggaatgtataacctggcggcagcgcaaaagatg

SEQ ID NO: 43054 - DNA, 103 bp, Artificial Sequence
  Synthetic Polynucleotide
taatacgactcactatagggcctctaaacgcgagtccatacattcctaaaaacagaggagatttaggatggtatggactaacctggcggcagcgcaaaagatg

SEQ ID NO: 43055 - DNA, 103 bp, Artificial Sequence
  Synthetic Polynucleotide
taatacgactcactatagggtcactcctctaaacgcgagtccatacattcaacagaggagagaatgtatggactcgcgtaacctggcggcagcgcaaaagatg

SEQ ID NO: 43056 - DNA, 103 bp, Artificial Sequence
  Synthetic Polynucleotide
taatacgactcactataggggacgttcactcctctaaacgcgagtccataaacagaggagatatggaatggcgtttagaaacctggcggcagcgcaaaagatg

SEQ ID NO: 43057 - DNA, 103 bp, Artificial Sequence
  Synthetic Polynucleotide
taatacgactcactatagggcctaagacgttcactcctctaaacgcgagtaacagaggagaactcgcatgtagaggagtaacctggcggcagcgcaaaagatg

SEQ ID NO: 43058 - DNA, 103 bp, Artificial Sequence
  Synthetic Polynucleotide
taatacgactcactatagggcgacgcctaagacgttcactcctctaaacgaacagaggagacgtttaatggagtgaacgaacctggcggcagcgcaaaagatg

SEQ ID NO: 43059 - DNA, 103 bp, Artificial Sequence
  Synthetic Polynucleotide
taatacgactcactatagggctttccgacgcctaagacgttcactcctctaacagaggagaagaggaatgaacgtcttaaacctggcggcagcgcaaaagatg

SEQ ID NO: 43060 - DNA, 103 bp, Artificial Sequence
  Synthetic Polynucleotide
taatacgactcactatagggaaacaatgaactcgaatatcctccaacataaacagaggagatatgttatgggatattcgaacctggcggcagcgcaaaagatg

SEQ ID NO: 43061 - DNA, 103 bp, Artificial Sequence
  Synthetic Polynucleotide
taatacgactcactatagggtcatcctttccgacgcctaagacgttcactaacagaggagaagtgaaatgcttaggcgtaacctggcggcagcgcaaaagatg

SEQ ID NO: 43062 - DNA, 103 bp, Artificial Sequence
  Synthetic Polynucleotide
taatacgactcactatagggatgaatcatcctttccgacgcctaagacgtaacagaggagaacgtctatggcgtcggaaaacctggcggcagcgcaaaagatg

SEQ ID NO: 43063 - DNA, 103 bp, Artificial Sequence
  Synthetic Polynucleotide
taatacgactcactataggggtttgatgaatcatcctttccgacgcctaaaacagaggagattaggcatgggaaaggataacctggcggcagcgcaaaagatg

SEQ ID NO: 43064 - DNA, 103 bp, Artificial Sequence
  Synthetic Polynucleotide
taatacgactcactatagggtattcgtttgatgaatcatcctttccgacgaacagaggagacgtcggatgggatgattcaacctggcggcagcgcaaaagatg

SEQ ID NO: 43065 - DNA, 103 bp, Artificial Sequence
  Synthetic Polynucleotide
taatacgactcactatagggttgtttattcgtttgatgaatcatcctttcaacagaggagagaaaggatgattcatcaaaacctggcggcagcgcaaaagatg

SEQ ID NO: 43066 - DNA, 103 bp, Artificial Sequence
  Synthetic Polynucleotide
taatacgactcactatagggtgaaattgtttattcgtttgatgaatcatcaacagaggagagatgatatgtcaaacgaaaacctggcggcagcgcaaaagatg

SEQ ID NO: 43067 - DNA, 103 bp, Artificial Sequence
  Synthetic Polynucleotide
taatacgactcactatagggatttgtgaaattgtttattcgtttgatgaaaacagaggagattcatcatgcgaataaacaacctggcggcagcgcaaaagatg

SEQ ID NO: 43068 - DNA, 103 bp, Artificial Sequence
  Synthetic Polynucleotide
taatacgactcactatagggcatccatttgtgaaattgtttattcgtttgaacagaggagacaaacgatgaaacaatttaacctggcggcagcgcaaaagatg

SEQ ID NO: 43069 - DNA, 103 bp, Artificial Sequence
  Synthetic Polynucleotide
taatacgactcactatagggattaacatccatttgtgaaattgtttattcaacagaggagagaataaatgatttcacaaaacctggcggcagcgcaaaagatg

SEQ ID NO: 43070 - DNA, 103 bp, Artificial Sequence
  Synthetic Polynucleotide
taatacgactcactatagggaatacattaacatccatttgtgaaattgttaacagaggagaaacaatatgacaaatggaaacctggcggcagcgcaaaagatg

SEQ ID NO: 43071 - DNA, 103 bp, Artificial Sequence
  Synthetic Polynucleotide
taatacgactcactatagggattgaaaacaatgaactcgaatatcctccaaacagaggagatggaggatgttcgagttcaacctggcggcagcgcaaaagatg

SEQ ID NO: 43072 - DNA, 103 bp, Artificial Sequence
  Synthetic Polynucleotide
taatacgactcactatagggctactaatacattaacatccatttgtgaaaaacagaggagatttcacatgtggatgttaaacctggcggcagcgcaaaagatg

SEQ ID NO: 43073 - DNA, 103 bp, Artificial Sequence
  Synthetic Polynucleotide
taatacgactcactatagggatttcctactaatacattaacatccatttgaacagaggagacaaatgatggttaatgtaaacctggcggcagcgcaaaagatg

SEQ ID NO: 43074 - DNA, 103 bp, Artificial Sequence
  Synthetic Polynucleotide
taatacgactcactatagggaaaaaatttcctactaatacattaacatccaacagaggagaggatgtatgtgtattagtaacctggcggcagcgcaaaagatg

SEQ ID NO: 43075 - DNA, 103 bp, Artificial Sequence
  Synthetic Polynucleotide
taatacgactcactataggggcgtcaaaaaatttcctactaatacattaaaacagaggagattaatgatgtagtaggaaaacctggcggcagcgcaaaagatg

SEQ ID NO: 43076 - DNA, 103 bp, Artificial Sequence
  Synthetic Polynucleotide
taatacgactcactatagggcactagcgtcaaaaaatttcctactaatacaacagaggagagtattaatgggaaattttaacctggcggcagcgcaaaagatg

SEQ ID NO: 43077 - DNA, 103 bp, Artificial Sequence
  Synthetic Polynucleotide
taatacgactcactatagggaattccactagcgtcaaaaaatttcctactaacagaggagaagtaggatgttttttgacaacctggcggcagcgcaaaagatg

SEQ ID NO: 43078 - DNA, 103 bp, Artificial Sequence
  Synthetic Polynucleotide
taatacgactcactatagggttttcaattccactagcgtcaaaaaatttcaacagaggagagaaattatgtgacgctagaacctggcggcagcgcaaaagatg

SEQ ID NO: 43079 - DNA, 103 bp, Artificial Sequence
  Synthetic Polynucleotide
taatacgactcactatagggtagaattttcaattccactagcgtcaaaaaaacagaggagatttttgatgctagtggaaaacctggcggcagcgcaaaagatg

SEQ ID NO: 43080 - DNA, 103 bp, Artificial Sequence
  Synthetic Polynucleotide
taatacgactcactatagggtccattagaattttcaattccactagcgtcaacagaggagagacgctatgggaattgaaaacctggcggcagcgcaaaagatg

SEQ ID NO: 43081 - DNA, 103 bp, Artificial Sequence
  Synthetic Polynucleotide
taatacgactcactatagggcatcatccattagaattttcaattccactaaacagaggagatagtggatgtgaaaattcaacctggcggcagcgcaaaagatg

SEQ ID NO: 43082 - DNA, 103 bp, Artificial Sequence
  Synthetic Polynucleotide
taatacgactcactatagggttgatattgaaaacaatgaactcgaatatcaacagaggagagatattatggttcattgtaacctggcggcagcgcaaaagatg

SEQ ID NO: 43083 - DNA, 103 bp, Artificial Sequence
  Synthetic Polynucleotide
taatacgactcactatagggtagaacatcatccattagaattttcaattcaacagaggagagaattgatgattctaatgaacctggcggcagcgcaaaagatg

SEQ ID NO: 43084 - DNA, 103 bp, Artificial Sequence
  Synthetic Polynucleotide
taatacgactcactatagggataggtagaacatcatccattagaattttcaacagaggagagaaaatatgaatggatgaaacctggcggcagcgcaaaagatg

SEQ ID NO: 43085 - DNA, 103 bp, Artificial Sequence
  Synthetic Polynucleotide
taatacgactcactatagggatgaaataggtagaacatcatccattagaaaacagaggagattctaaatgatgatgttcaacctggcggcagcgcaaaagatg

SEQ ID NO: 43086 - DNA, 103 bp, Artificial Sequence
  Synthetic Polynucleotide
taatacgactcactatagggatctgatgaaataggtagaacatcatccataacagaggagaatggatatggttctacctaacctggcggcagcgcaaaagatg

SEQ ID NO: 43087 - DNA, 103 bp, Artificial Sequence
  Synthetic Polynucleotide
taatacgactcactatagggatgttatctgatgaaataggtagaacatcaaacagaggagatgatgtatgacctatttcaacctggcggcagcgcaaaagatg

SEQ ID NO: 43088 - DNA, 103 bp, Artificial Sequence
  Synthetic Polynucleotide
taatacgactcactatagggttaacatgttatctgatgaaataggtagaaaacagaggagattctacatgtttcatcagaacctggcggcagcgcaaaagatg

SEQ ID NO: 43089 - DNA, 103 bp, Artificial Sequence
  Synthetic Polynucleotide
taatacgactcactatagggggaaattaacatgttatctgatgaaataggaacagaggagacctattatgtcagataacaacctggcggcagcgcaaaagatg

SEQ ID NO: 43090 - DNA, 103 bp, Artificial Sequence
  Synthetic Polynucleotide
taatacgactcactatagggatgtcggaaattaacatgttatctgatgaaaacagaggagattcatcatgtaacatgttaacctggcggcagcgcaaaagatg

SEQ ID NO: 43091 - DNA, 103 bp, Artificial Sequence
  Synthetic Polynucleotide
taatacgactcactatagggcgttgatgtcggaaattaacatgttatctgaacagaggagacagataatgtgttaatttaacctggcggcagcgcaaaagatg

SEQ ID NO: 43092 - DNA, 103 bp, Artificial Sequence
  Synthetic Polynucleotide
taatacgactcactatagggaaaaccgttgatgtcggaaattaacatgttaacagaggagaaacatgatgatttccgacaacctggcggcagcgcaaaagatg

SEQ ID NO: 43093 - DNA, 103 bp, Artificial Sequence
  Synthetic Polynucleotide
taatacgactcactatagggtctctttgatattgaaaacaatgaactcgaaacagaggagatcgagtatgttgttttcaaacctggcggcagcgcaaaagatg

SEQ ID NO: 43094 - DNA, 103 bp, Artificial Sequence
  Synthetic Polynucleotide
taatacgactcactatagggatattaaaaccgttgatgtcggaaattaacaacagaggagagttaatatgcgacatcaaaacctggcggcagcgcaaaagatg

SEQ ID NO: 43095 - DNA, 103 bp, Artificial Sequence
  Synthetic Polynucleotide
taatacgactcactatagggtcgaaatattaaaaccgttgatgtcggaaaaacagaggagatttccgatgtcaacggttaacctggcggcagcgcaaaagatg

SEQ ID NO: 43096 - DNA, 103 bp, Artificial Sequence
  Synthetic Polynucleotide
taatacgactcactatagggtattatcgaaatattaaaaccgttgatgtcaacagaggagagacatcatgggttttaataacctggcggcagcgcaaaagatg

SEQ ID NO: 43097 - DNA, 103 bp, Artificial Sequence
  Synthetic Polynucleotide
taatacgactcactatagggccgtatattatcgaaatattaaaaccgttgaacagaggagacaacggatgtaatatttcaacctggcggcagcgcaaaagatg

SEQ ID NO: 43098 - DNA, 103 bp, Artificial Sequence
  Synthetic Polynucleotide
taatacgactcactataggggattaccgtatattatcgaaatattaaaacaacagaggagagttttaatgtttcgataaaacctggcggcagcgcaaaagatg

SEQ ID NO: 43099 - DNA, 103 bp, Artificial Sequence
  Synthetic Polynucleotide
taatacgactcactatagggagagagattaccgtatattatcgaaatattaacagaggagaaatattatgataatatacaacctggcggcagcgcaaaagatg

SEQ ID NO: 43100 - DNA, 103 bp, Artificial Sequence
  Synthetic Polynucleotide
taatacgactcactatagggccgaaagagagattaccgtatattatcgaaaacagaggagattcgatatgatacggtaaaacctggcggcagcgcaaaagatg

SEQ ID NO: 43101 - DNA, 103 bp, Artificial Sequence
  Synthetic Polynucleotide
taatacgactcactatagggtaagtccgaaagagagattaccgtatattaaacagaggagataatatatggtaatctctaacctggcggcagcgcaaaagatg

SEQ ID NO: 43102 - DNA, 103 bp, Artificial Sequence
  Synthetic Polynucleotide
taatacgactcactatagggctatataagtccgaaagagagattaccgtaaacagaggagatacggtatgctctctttcaacctggcggcagcgcaaaagatg

SEQ ID NO: 43103 - DNA, 103 bp, Artificial Sequence
  Synthetic Polynucleotide
taatacgactcactatagggataagctatataagtccgaaagagagattaaacagaggagataatctatgtttcggactaacctggcggcagcgcaaaagatg

SEQ ID NO: 43104 - DNA, 103 bp, Artificial Sequence
  Synthetic Polynucleotide
taatacgactcactatagggaaccatctctttgatattgaaaacaatgaaaacagaggagattcattatgttcaatatcaacctggcggcagcgcaaaagatg

SEQ ID NO: 43105 - DNA, 103 bp, Artificial Sequence
  Synthetic Polynucleotide
taatacgactcactataggggtggaataagctatataagtccgaaagagaaacagaggagatctcttatggacttatataacctggcggcagcgcaaaagatg

SEQ ID NO: 43106 - DNA, 103 bp, Artificial Sequence
  Synthetic Polynucleotide
taatacgactcactataggggtattgtggaataagctatataagtccgaaaacagaggagattcggaatgatatagcttaacctggcggcagcgcaaaagatg

SEQ ID NO: 43107 - DNA, 103 bp, Artificial Sequence
  Synthetic Polynucleotide
taatacgactcactataggggactcgtattgtggaataagctatataagtaacagaggagaacttatatggcttattccaacctggcggcagcgcaaaagatg

SEQ ID NO: 43108 - DNA, 103 bp, Artificial Sequence
  Synthetic Polynucleotide
taatacgactcactatagggataatgactcgtattgtggaataagctataaacagaggagatatagcatgttccacaataacctggcggcagcgcaaaagatg

SEQ ID NO: 43109 - DNA, 103 bp, Artificial Sequence
  Synthetic Polynucleotide
taatacgactcactatagggagtatataatgactcgtattgtggaataagaacagaggagacttattatgcaatacgagaacctggcggcagcgcaaaagatg

SEQ ID NO: 43110 - DNA, 103 bp, Artificial Sequence
  Synthetic Polynucleotide
taatacgactcactatagggtttggagtatataatgactcgtattgtggaaacagaggagatccacaatgcgagtcattaacctggcggcagcgcaaaagatg

SEQ ID NO: 43111 - DNA, 103 bp, Artificial Sequence
  Synthetic Polynucleotide
taatacgactcactatagggtgttttttggagtatataatgactcgtattaacagaggagaaatacgatgcattatataaacctggcggcagcgcaaaagatg

SEQ ID NO: 43112 - DNA, 103 bp, Artificial Sequence
  Synthetic Polynucleotide
taatacgactcactatagggtattttgttttttggagtatataatgactcaacagaggagagagtcaatgtatactccaaacctggcggcagcgcaaaagatg

SEQ ID NO: 43113 - DNA, 103 bp, Artificial Sequence
  Synthetic Polynucleotide
taatacgactcactatagggctagttattttgttttttggagtatataataacagaggagaattataatgtccaaaaaaaacctggcggcagcgcaaaagatg

SEQ ID NO: 43114 - DNA, 103 bp, Artificial Sequence
  Synthetic Polynucleotide
taatacgactcactatagggttatactagttattttgttttttggagtataacagaggagaatactcatgaaaacaaaaaacctggcggcagcgcaaaagatg

SEQ ID NO: 43115 - DNA, 103 bp, Artificial Sequence
  Synthetic Polynucleotide
taatacgactcactatagggaaggaaaccatctctttgatattgaaaacaaacagaggagatgttttatgtatcaaagaaacctggcggcagcgcaaaagatg

SEQ ID NO: 43116 - DNA, 103 bp, Artificial Sequence
  Synthetic Polynucleotide
taatacgactcactatagggagattttatactagttattttgttttttggaacagaggagaccaaaaatgaaaataactaacctggcggcagcgcaaaagatg

SEQ ID NO: 43117 - DNA, 103 bp, Artificial Sequence
  Synthetic Polynucleotide
taatacgactcactataggggatacagattttatactagttattttgtttaacagaggagaaaacaaatgaactagtataacctggcggcagcgcaaaagatg

SEQ ID NO: 43118 - DNA, 103 bp, Artificial Sequence
  Synthetic Polynucleotide
taatacgactcactatagggcattcgatacagattttatactagttatttaacagaggagaaaataaatggtataaaataacctggcggcagcgcaaaagatg

SEQ ID NO: 43119 - DNA, 103 bp, Artificial Sequence
  Synthetic Polynucleotide
taatacgactcactatagggtttcccattcgatacagattttatactagtaacagaggagaactagtatgaaatctgtaaacctggcggcagcgcaaaagatg

SEQ ID NO: 43120 - DNA, 103 bp, Artificial Sequence
  Synthetic Polynucleotide
taatacgactcactatagggtcgtttttcccattcgatacagattttataaacagaggagatataaaatgtgtatcgaaaacctggcggcagcgcaaaagatg

SEQ ID NO: 43121 - DNA, 103 bp, Artificial Sequence
  Synthetic Polynucleotide
taatacgactcactatagggtaatttcgtttttcccattcgatacagattaacagaggagaaatctgatgcgaatgggaaacctggcggcagcgcaaaagatg

SEQ ID NO: 43122 - DNA, 103 bp, Artificial Sequence
  Synthetic Polynucleotide
taatacgactcactataggggtcgataatttcgtttttcccattcgatacaacagaggagagtatcgatggggaaaaacaacctggcggcagcgcaaaagatg

SEQ ID NO: 43123 - DNA, 103 bp, Artificial Sequence
  Synthetic Polynucleotide
taatacgactcactatagggcctatgtcgataatttcgtttttcccattcaacagaggagagaatggatgaaacgaaataacctggcggcagcgcaaaagatg

SEQ ID NO: 43124 - DNA, 103 bp, Artificial Sequence
  Synthetic Polynucleotide
taatacgactcactatagggctatacctatgtcgataatttcgtttttccaacagaggagaggaaaaatgaaattatcgaacctggcggcagcgcaaaagatg

SEQ ID NO: 43125 - DNA, 103 bp, Artificial Sequence
  Synthetic Polynucleotide
taatacgactcactatagggggattctatacctatgtcgataatttcgttaacagaggagaaacgaaatgatcgacataaacctggcggcagcgcaaaagatg

SEQ ID NO: 43126 - DNA, 103 bp, Artificial Sequence
  Synthetic Polynucleotide
taatacgactcactatagggtctcggattcacttccgtgggacaatatagaacagaggagactatatatgcccacggaaaacctggcggcagcgcaaaagatg

SEQ ID NO: 43127 - DNA, 103 bp, Artificial Sequence
  Synthetic Polynucleotide
taatacgactcactatagggatgataaggaaaccatctctttgatattgaaacagaggagatcaataatgaagagatggaacctggcggcagcgcaaaagatg

SEQ ID NO: 43128 - DNA, 103 bp, Artificial Sequence
  Synthetic Polynucleotide
taatacgactcactataggggttccggattctatacctatgtcgataattaacagaggagaaattatatgcataggtataacctggcggcagcgcaaaagatg

SEQ ID NO: 43129 - DNA, 103 bp, Artificial Sequence
  Synthetic Polynucleotide
taatacgactcactatagggtcaatgttccggattctatacctatgtcgaaacagaggagatcgacaatggtatagaataacctggcggcagcgcaaaagatg

SEQ ID NO: 43130 - DNA, 103 bp, Artificial Sequence
  Synthetic Polynucleotide
taatacgactcactatagggtacgttcaatgttccggattctatacctataacagaggagaataggtatggaatccggaaacctggcggcagcgcaaaagatg

SEQ ID NO: 43131 - DNA, 103 bp, Artificial Sequence
  Synthetic Polynucleotide
taatacgactcactatagggattaatacgttcaatgttccggattctataaacagaggagatatagaatgcggaacattaacctggcggcagcgcaaaagatg

SEQ ID NO: 43132 - DNA, 103 bp, Artificial Sequence
  Synthetic Polynucleotide
taatacgactcactatagggtaagtattaatacgttcaatgttccggattaacagaggagaaatccgatgcattgaacgaacctggcggcagcgcaaaagatg

SEQ ID NO: 43133 - DNA, 103 bp, Artificial Sequence
  Synthetic Polynucleotide
taatacgactcactatagggagaattaagtattaatacgttcaatgttccaacagaggagaggaacaatgaacgtattaaacctggcggcagcgcaaaagatg

SEQ ID NO: 43134 - DNA, 103 bp, Artificial Sequence
  Synthetic Polynucleotide
taatacgactcactataggggaaaaagaattaagtattaatacgttcaataacagaggagaattgaaatgattaatactaacctggcggcagcgcaaaagatg

SEQ ID NO: 43135 - DNA, 103 bp, Artificial Sequence
  Synthetic Polynucleotide
taatacgactcactatagggccactgaaaaagaattaagtattaatacgtaacagaggagaacgtatatgtacttaattaacctggcggcagcgcaaaagatg

SEQ ID NO: 43136 - DNA, 103 bp, Artificial Sequence
  Synthetic Polynucleotide
taatacgactcactatagggacttaccactgaaaaagaattaagtattaaaacagaggagattaataatgaattcttttaacctggcggcagcgcaaaagatg

SEQ ID NO: 43137 - DNA, 103 bp, Artificial Sequence
  Synthetic Polynucleotide
taatacgactcactatagggtcggtacttaccactgaaaaagaattaagtaacagaggagaacttaaatgtttttcagtaacctggcggcagcgcaaaagatg

SEQ ID NO: 43138 - DNA, 103 bp, Artificial Sequence
  Synthetic Polynucleotide
taatacgactcactataggggagaaatgataaggaaaccatctctttgataacagaggagaatcaaaatgatggtttccaacctggcggcagcgcaaaagatg

SEQ ID NO: 43139 - DNA, 103 bp, Artificial Sequence
  Synthetic Polynucleotide
taatacgactcactatagggacctatcggtacttaccactgaaaaagaataacagaggagaattcttatgcagtggtaaaacctggcggcagcgcaaaagatg

SEQ ID NO: 43140 - DNA, 103 bp, Artificial Sequence
  Synthetic Polynucleotide
taatacgactcactatagggcaataacctatcggtacttaccactgaaaaaacagaggagattttcaatggtaagtaccaacctggcggcagcgcaaaagatg

SEQ ID NO: 43141 - DNA, 103 bp, Artificial Sequence
  Synthetic Polynucleotide
taatacgactcactatagggaatgtcaataacctatcggtacttaccactaacagaggagaagtggtatgtaccgatagaacctggcggcagcgcaaaagatg

SEQ ID NO: 43142 - DNA, 103 bp, Artificial Sequence
  Synthetic Polynucleotide
taatacgactcactatagggcatacaatgtcaataacctatcggtacttaaacagaggagataagtaatgataggttataacctggcggcagcgcaaaagatg

SEQ ID NO: 43143 - DNA, 103 bp, Artificial Sequence
  Synthetic Polynucleotide
taatacgactcactatagggaaaaccatacaatgtcaataacctatcggtaacagaggagaaccgatatgttattgacaaacctggcggcagcgcaaaagatg

SEQ ID NO: 43144 - DNA, 103 bp, Artificial Sequence
  Synthetic Polynucleotide
taatacgactcactatagggtatttaaaaccatacaatgtcaataacctaaacagaggagataggttatggacattgtaaacctggcggcagcgcaaaagatg

SEQ ID NO: 43145 - DNA, 103 bp, Artificial Sequence
  Synthetic Polynucleotide
taatacgactcactatagggtagaatatttaaaaccatacaatgtcaataaacagaggagatattgaatgtgtatggttaacctggcggcagcgcaaaagatg

SEQ ID NO: 43146 - DNA, 103 bp, Artificial Sequence
  Synthetic Polynucleotide
taatacgactcactatagggagttatagaatatttaaaaccatacaatgtaacagaggagaacattgatgggttttaaaaacctggcggcagcgcaaaagatg

SEQ ID NO: 43147 - DNA, 103 bp, Artificial Sequence
  Synthetic Polynucleotide
taatacgactcactatagggtctcaagttatagaatatttaaaaccatacaacagaggagagtatggatgtaaatattcaacctggcggcagcgcaaaagatg

SEQ ID NO: 43148 - DNA, 103 bp, Artificial Sequence
  Synthetic Polynucleotide
taatacgactcactatagggtcaagtctcaagttatagaatatttaaaacaacagaggagagttttaatgattctataaaacctggcggcagcgcaaaagatg

SEQ ID NO: 43149 - DNA, 103 bp, Artificial Sequence
  Synthetic Polynucleotide
taatacgactcactatagggctatggagaaatgataaggaaaccatctctaacagaggagaagagatatgttccttatcaacctggcggcagcgcaaaagatg

SEQ ID NO: 43150 - DNA, 103 bp, Artificial Sequence
  Synthetic Polynucleotide
taatacgactcactatagggatctatcaagtctcaagttatagaatatttaacagaggagaaaatatatgataacttgaaacctggcggcagcgcaaaagatg

SEQ ID NO: 43151 - DNA, 103 bp, Artificial Sequence
  Synthetic Polynucleotide
taatacgactcactatagggttaatatctatcaagtctcaagttatagaaaacagaggagattctatatgttgagacttaacctggcggcagcgcaaaagatg

SEQ ID NO: 43152 - DNA, 103 bp, Artificial Sequence
  Synthetic Polynucleotide
taatacgactcactatagggcgtcattaatatctatcaagtctcaagttaaacagaggagataacttatgacttgatagaacctggcggcagcgcaaaagatg

SEQ ID NO: 43153 - DNA, 103 bp, Artificial Sequence
  Synthetic Polynucleotide
taatacgactcactatagggcaattcgtcattaatatctatcaagtctcaaacagaggagatgagacatgatagatattaacctggcggcagcgcaaaagatg

SEQ ID NO: 43154 - DNA, 103 bp, Artificial Sequence
  Synthetic Polynucleotide
taatacgactcactatagggattttcaattcgtcattaatatctatcaagaacagaggagacttgatatgtattaatgaaacctggcggcagcgcaaaagatg

SEQ ID NO: 43155 - DNA, 103 bp, Artificial Sequence
  Synthetic Polynucleotide
taatacgactcactatagggaaataattttcaattcgtcattaatatctaaacagaggagatagataatgatgacgaataacctggcggcagcgcaaaagatg

SEQ ID NO: 43156 - DNA, 103 bp, Artificial Sequence
  Synthetic Polynucleotide
taatacgactcactataggggataaaaataattttcaattcgtcattaataacagaggagaattaatatggaattgaaaaacctggcggcagcgcaaaagatg

SEQ ID NO: 43157 - DNA, 103 bp, Artificial Sequence
  Synthetic Polynucleotide
taatacgactcactataggggtggtgataaaaataattttcaattcgtcaaacagaggagatgacgaatggaaaattataacctggcggcagcgcaaaagatg

SEQ ID NO: 43158 - DNA, 103 bp, Artificial Sequence
  Synthetic Polynucleotide
taatacgactcactatagggcacacgtggtgataaaaataattttcaattaacagaggagaaattgaatgttatttttaaacctggcggcagcgcaaaagatg

SEQ ID NO: 43159 - DNA, 103 bp, Artificial Sequence
  Synthetic Polynucleotide
taatacgactcactatagggtgaaacacacgtggtgataaaaataattttaacagaggagaaaaattatgtttatcaccaacctggcggcagcgcaaaagatg

SEQ ID NO: 43160 - DNA, 103 bp, Artificial Sequence
  Synthetic Polynucleotide
taatacgactcactatagggtaccactatggagaaatgataaggaaaccaaacagaggagatggtttatgtatcatttcaacctggcggcagcgcaaaagatg

SEQ ID NO: 43161 - DNA, 103 bp, Artificial Sequence
  Synthetic Polynucleotide
taatacgactcactataggggatcctgaaacacacgtggtgataaaaataaacagaggagatattttatgcaccacgtgaacctggcggcagcgcaaaagatg

SEQ ID NO: 43162 - DNA, 103 bp, Artificial Sequence
  Synthetic Polynucleotide
taatacgactcactatagggatgacgatcctgaaacacacgtggtgataaaacagaggagattatcaatgcgtgtgtttaacctggcggcagcgcaaaagatg

SEQ ID NO: 43163 - DNA, 103 bp, Artificial Sequence
  Synthetic Polynucleotide
taatacgactcactatagggtatcgatgacgatcctgaaacacacgtggtaacagaggagaaccacgatggtttcaggaaacctggcggcagcgcaaaagatg

SEQ ID NO: 43164 - DNA, 103 bp, Artificial Sequence
  Synthetic Polynucleotide
taatacgactcactatagggacgggtatcgatgacgatcctgaaacacacaacagaggagagtgtgtatgaggatcgtcaacctggcggcagcgcaaaagatg

SEQ ID NO: 43165 - DNA, 103 bp, Artificial Sequence
  Synthetic Polynucleotide
taatacgactcactatagggggttgacgggtatcgatgacgatcctgaaaaacagaggagatttcagatgcgtcatcgaaacctggcggcagcgcaaaagatg

SEQ ID NO: 43166 - DNA, 103 bp, Artificial Sequence
  Synthetic Polynucleotide
taatacgactcactatagggtggttggttgacgggtatcgatgacgatccaacagaggagaggatcgatgtcgatacccaacctggcggcagcgcaaaagatg

SEQ ID NO: 43167 - DNA, 103 bp, Artificial Sequence
  Synthetic Polynucleotide
taatacgactcactatagggccgtttggttggttgacgggtatcgatgacaacagaggagagtcatcatgacccgtcaaaacctggcggcagcgcaaaagatg

SEQ ID NO: 43168 - DNA, 103 bp, Artificial Sequence
  Synthetic Polynucleotide
taatacgactcactatagggttactccgtttggttggttgacgggtatcgaacagaggagacgatacatgtcaaccaacaacctggcggcagcgcaaaagatg

SEQ ID NO: 43169 - DNA, 103 bp, Artificial Sequence
  Synthetic Polynucleotide
taatacgactcactatagggttattttactccgtttggttggttgacgggaacagaggagacccgtcatgcaaccaaacaacctggcggcagcgcaaaagatg

SEQ ID NO: 43170 - DNA, 103 bp, Artificial Sequence
  Synthetic Polynucleotide
taatacgactcactataggggatatttattttactccgtttggttggttgaacagaggagacaaccaatgaaacggagtaacctggcggcagcgcaaaagatg

SEQ ID NO: 43171 - DNA, 103 bp, Artificial Sequence
  Synthetic Polynucleotide
taatacgactcactatagggtattgtaccactatggagaaatgataaggaaacagaggagatccttaatgtttctccataacctggcggcagcgcaaaagatg

SEQ ID NO: 43172 - DNA, 103 bp, Artificial Sequence
  Synthetic Polynucleotide
taatacgactcactatagggttaatgatatttattttactccgtttggttaacagaggagaaaccaaatggagtaaaataacctggcggcagcgcaaaagatg

SEQ ID NO: 43173 - DNA, 103 bp, Artificial Sequence
  Synthetic Polynucleotide
taatacgactcactatagggatatattaatgatatttattttactccgttaacagaggagaaacggaatgaaataaataaacctggcggcagcgcaaaagatg

SEQ ID NO: 43174 - DNA, 103 bp, Artificial Sequence
  Synthetic Polynucleotide
taatacgactcactatagggagagcatatattaatgatatttattttactaacagaggagaagtaaaatgaatatcattaacctggcggcagcgcaaaagatg

SEQ ID NO: 43175 - DNA, 103 bp, Artificial Sequence
  Synthetic Polynucleotide
taatacgactcactatagggtatctagagcatatattaatgatatttattaacagaggagaaataaaatgcattaatataacctggcggcagcgcaaaagatg

SEQ ID NO: 43176 - DNA, 103 bp, Artificial Sequence
  Synthetic Polynucleotide
taatacgactcactatagggactaatatctagagcatatattaatgatataacagaggagaatatcaatgatatatgctaacctggcggcagcgcaaaagatg

SEQ ID NO: 43177 - DNA, 103 bp, Artificial Sequence
  Synthetic Polynucleotide
taatacgactcactatagggaaaatactaatatctagagcatatattaataacagaggagaattaatatgtgctctagaaacctggcggcagcgcaaaagatg

SEQ ID NO: 43178 - DNA, 103 bp, Artificial Sequence
  Synthetic Polynucleotide
taatacgactcactatagggtaataaaaatactaatatctagagcatataaacagaggagatatatgatgtagatattaaacctggcggcagcgcaaaagatg

SEQ ID NO: 43179 - DNA, 103 bp, Artificial Sequence
  Synthetic Polynucleotide
taatacgactcactatagggaggattaataaaaatactaatatctagagcaacagaggagagctctaatgattagtattaacctggcggcagcgcaaaagatg

SEQ ID NO: 43180 - DNA, 103 bp, Artificial Sequence
  Synthetic Polynucleotide
taatacgactcactatagggatcaaaggattaataaaaatactaatatctaacagaggagaagatatatgtatttttataacctggcggcagcgcaaaagatg

SEQ ID NO: 43181 - DNA, 103 bp, Artificial Sequence
  Synthetic Polynucleotide
taatacgactcactatagggtgataatcaaaggattaataaaaatactaaaacagaggagattagtaatgttattaatcaacctggcggcagcgcaaaagatg

SEQ ID NO: 43182 - DNA, 103 bp, Artificial Sequence
  Synthetic Polynucleotide
taatacgactcactatagggtgtagtattgtaccactatggagaaatgataacagaggagaatcattatgccatagtggaacctggcggcagcgcaaaagatg

SEQ ID NO: 43183 - DNA, 103 bp, Artificial Sequence
  Synthetic Polynucleotide
taatacgactcactataggggaagatgataatcaaaggattaataaaaataacagaggagaatttttatgaatcctttgaacctggcggcagcgcaaaagatg

SEQ ID NO: 43184 - DNA, 103 bp, Artificial Sequence
  Synthetic Polynucleotide
taatacgactcactatagggtacgagaagatgataatcaaaggattaataaacagaggagatattaaatgtttgattataacctggcggcagcgcaaaagatg

SEQ ID NO: 43185 - DNA, 103 bp, Artificial Sequence
  Synthetic Polynucleotide
taatacgactcactatagggtcgcgtacgagaagatgataatcaaaggataacagaggagaatccttatgttatcatctaacctggcggcagcgcaaaagatg

SEQ ID NO: 43186 - DNA, 103 bp, Artificial Sequence
  Synthetic Polynucleotide
taatacgactcactatagggatcattcgcgtacgagaagatgataatcaaaacagaggagattgattatgatcttctcgaacctggcggcagcgcaaaagatg

SEQ ID NO: 43187 - DNA, 103 bp, Artificial Sequence
  Synthetic Polynucleotide
taatacgactcactatagggatggaatcattcgcgtacgagaagatgataaacagaggagatatcatatgctcgtacgcaacctggcggcagcgcaaaagatg

SEQ ID NO: 43188 - DNA, 103 bp, Artificial Sequence
  Synthetic Polynucleotide
taatacgactcactatagggtgatcatggaatcattcgcgtacgagaagaaacagaggagatcttctatgacgcgaatgaacctggcggcagcgcaaaagatg

SEQ ID NO: 43189 - DNA, 103 bp, Artificial Sequence
  Synthetic Polynucleotide
taatacgactcactatagggactcttgatcatggaatcattcgcgtacgaaacagaggagatcgtacatgaatgattccaacctggcggcagcgcaaaagatg

SEQ ID NO: 43190 - DNA, 103 bp, Artificial Sequence
  Synthetic Polynucleotide
taatacgactcactatagggaaatcactcttgatcatggaatcattcgcgaacagaggagacgcgaaatgttccatgataacctggcggcagcgcaaaagatg

SEQ ID NO: 43191 - DNA, 103 bp, Artificial Sequence
  Synthetic Polynucleotide
taatacgactcactatagggttctcaaatcactcttgatcatggaatcataacagaggagaatgattatgtgatcaagaaacctggcggcagcgcaaaagatg

SEQ ID NO: 43192 - DNA, 103 bp, Artificial Sequence
  Synthetic Polynucleotide
taatacgactcactatagggggatgttctcaaatcactcttgatcatggaaacagaggagatccatgatgaagagtgataacctggcggcagcgcaaaagatg

SEQ ID NO: 43193 - DNA, 103 bp, Artificial Sequence
  Synthetic Polynucleotide
taatacgactcactatagggtaatgtgtagtattgtaccactatggagaaaacagaggagattctccatggtggtacaaaacctggcggcagcgcaaaagatg

SEQ ID NO: 43194 - DNA, 103 bp, Artificial Sequence
  Synthetic Polynucleotide
taatacgactcactatagggccggaggatgttctcaaatcactcttgatcaacagaggagagatcaaatgtgatttgagaacctggcggcagcgcaaaagatg

SEQ ID NO: 43195 - DNA, 103 bp, Artificial Sequence
  Synthetic Polynucleotide
taatacgactcactatagggatactccggaggatgttctcaaatcactctaacagaggagaagagtgatgtgagaacataacctggcggcagcgcaaaagatg

SEQ ID NO: 43196 - DNA, 103 bp, Artificial Sequence
  Synthetic Polynucleotide
taatacgactcactatagggcattaatactccggaggatgttctcaaatcaacagaggagagatttgatgacatcctccaacctggcggcagcgcaaaagatg

SEQ ID NO: 43197 - DNA, 103 bp, Artificial Sequence
  Synthetic Polynucleotide
taatacgactcactatagggaagcccattaatactccggaggatgttctcaacagaggagagagaacatgctccggagtaacctggcggcagcgcaaaagatg

SEQ ID NO: 43198 - DNA, 103 bp, Artificial Sequence
  Synthetic Polynucleotide
taatacgactcactatagggttactaagcccattaatactccggaggatgaacagaggagacatcctatggagtattaaaacctggcggcagcgcaaaagatg

SEQ ID NO: 43199 - DNA, 103 bp, Artificial Sequence
  Synthetic Polynucleotide
taatacgactcactatagggactgtttactaagcccattaatactccggaaacagaggagatccggaatgttaatgggcaacctggcggcagcgcaaaagatg

SEQ ID NO: 43200 - DNA, 103 bp, Artificial Sequence
  Synthetic Polynucleotide
taatacgactcactataggggatggactgtttactaagcccattaatactaacagaggagaagtattatggggcttagtaacctggcggcagcgcaaaagatg

SEQ ID NO: 43201 - DNA, 103 bp, Artificial Sequence
  Synthetic Polynucleotide
taatacgactcactataggggcaacgatggactgtttactaagcccattaaacagaggagataatggatgtagtaaacaaacctggcggcagcgcaaaagatg

SEQ ID NO: 43202 - DNA, 103 bp, Artificial Sequence
  Synthetic Polynucleotide
taatacgactcactatagggttattgcaacgatggactgtttactaagccaacagaggagaggcttaatgaacagtccaaacctggcggcagcgcaaaagatg

SEQ ID NO: 43203 - DNA, 103 bp, Artificial Sequence
  Synthetic Polynucleotide
taatacgactcactatagggttttattattgcaacgatggactgtttactaacagaggagaagtaaaatgtccatcgttaacctggcggcagcgcaaaagatg

SEQ ID NO: 43204 - DNA, 103 bp, Artificial Sequence
  Synthetic Polynucleotide
taatacgactcactatagggcggaataatgtgtagtattgtaccactatgaacagaggagacatagtatgacaatactaaacctggcggcagcgcaaaagatg

SEQ ID NO: 43205 - DNA, 103 bp, Artificial Sequence
  Synthetic Polynucleotide
taatacgactcactatagggataacttttattattgcaacgatggactgtaacagaggagaacagtcatgcgttgcaataacctggcggcagcgcaaaagatg

SEQ ID NO: 43206 - DNA, 103 bp, Artificial Sequence
  Synthetic Polynucleotide
taatacgactcactatagggcttggataacttttattattgcaacgatggaacagaggagaccatcgatgcaataataaaacctggcggcagcgcaaaagatg

SEQ ID NO: 43207 - DNA, 103 bp, Artificial Sequence
  Synthetic Polynucleotide
taatacgactcactatagggtttaacttggataacttttattattgcaacaacagaggagagttgcaatgataaaagttaacctggcggcagcgcaaaagatg

SEQ ID NO: 43208 - DNA, 103 bp, Artificial Sequence
  Synthetic Polynucleotide
taatacgactcactatagggtatcctttaacttggataacttttattattaacagaggagaaataatatgagttatccaaacctggcggcagcgcaaaagatg

SEQ ID NO: 43209 - DNA, 103 bp, Artificial Sequence
  Synthetic Polynucleotide
taatacgactcactatagggcataatatcctttaacttggataacttttaaacagaggagataaaagatgtccaagttaaacctggcggcagcgcaaaagatg

SEQ ID NO: 43210 - DNA, 103 bp, Artificial Sequence
  Synthetic Polynucleotide
taatacgactcactataggggaatgcataatatcctttaacttggataacaacagaggagagttatcatggttaaaggaaacctggcggcagcgcaaaagatg

SEQ ID NO: 43211 - DNA, 103 bp, Artificial Sequence
  Synthetic Polynucleotide
taatacgactcactatagggtaaacgaatgcataatatcctttaacttggaacagaggagaccaagtatgaggatattaaacctggcggcagcgcaaaagatg

SEQ ID NO: 43212 - DNA, 103 bp, Artificial Sequence
  Synthetic Polynucleotide
taatacgactcactatagggatctttaaacgaatgcataatatcctttaaaacagaggagattaaagatgattatgcataacctggcggcagcgcaaaagatg

SEQ ID NO: 43213 - DNA, 103 bp, Artificial Sequence
  Synthetic Polynucleotide
taatacgactcactataggggtaatatctttaaacgaatgcataatatccaacagaggagaggatatatggcattcgttaacctggcggcagcgcaaaagatg

SEQ ID NO: 43214 - DNA, 103 bp, Artificial Sequence
  Synthetic Polynucleotide
taatacgactcactatagggatgaggtaatatctttaaacgaatgcataaaacagaggagattatgcatgcgtttaaagaacctggcggcagcgcaaaagatg

SEQ ID NO: 43215 - DNA, 103 bp, Artificial Sequence
  Synthetic Polynucleotide
taatacgactcactatagggccacacggaataatgtgtagtattgtaccaaacagaggagatggtacatgactacacataacctggcggcagcgcaaaagatg

SEQ ID NO: 43216 - DNA, 103 bp, Artificial Sequence
  Synthetic Polynucleotide
taatacgactcactataggggtcagatgaggtaatatctttaaacgaatgaacagaggagacattcgatgaaagatattaacctggcggcagcgcaaaagatg

SEQ ID NO: 43217 - DNA, 103 bp, Artificial Sequence
  Synthetic Polynucleotide
taatacgactcactatagggtctccgtcagatgaggtaatatctttaaacaacagaggagagtttaaatgtattacctcaacctggcggcagcgcaaaagatg

SEQ ID NO: 43218 - DNA, 103 bp, Artificial Sequence
  Synthetic Polynucleotide
taatacgactcactatagggaattgtctccgtcagatgaggtaatatcttaacagaggagaaagataatgcctcatctgaacctggcggcagcgcaaaagatg

SEQ ID NO: 43219 - DNA, 103 bp, Artificial Sequence
  Synthetic Polynucleotide
taatacgactcactatagggcaaaaaattgtctccgtcagatgaggtaataacagaggagaattaccatgtctgacggaaacctggcggcagcgcaaaagatg

SEQ ID NO: 43220 - DNA, 103 bp, Artificial Sequence
  Synthetic Polynucleotide
taatacgactcactatagggcctaccaaaaaattgtctccgtcagatgagaacagaggagactcatcatgcggagacaaaacctggcggcagcgcaaaagatg

SEQ ID NO: 43221 - DNA, 103 bp, Artificial Sequence
  Synthetic Polynucleotide
taatacgactcactatagggtaaaacctaccaaaaaattgtctccgtcagaacagaggagactgacgatgacaatttttaacctggcggcagcgcaaaagatg

SEQ ID NO: 43222 - DNA, 103 bp, Artificial Sequence
  Synthetic Polynucleotide
taatacgactcactataggggtctctaaaacctaccaaaaaattgtctccaacagaggagaggagacatgtttttggtaaacctggcggcagcgcaaaagatg

SEQ ID NO: 43223 - DNA, 103 bp, Artificial Sequence
  Synthetic Polynucleotide
taatacgactcactatagggtcaaagtctctaaaacctaccaaaaaattgaacagaggagacaatttatgggtaggtttaacctggcggcagcgcaaaagatg

SEQ ID NO: 43224 - DNA, 103 bp, Artificial Sequence
  Synthetic Polynucleotide
taatacgactcactatagggtagcttcaaagtctctaaaacctaccaaaaaacagaggagattttggatggttttagagaacctggcggcagcgcaaaagatg

SEQ ID NO: 43225 - DNA, 103 bp, Artificial Sequence
  Synthetic Polynucleotide
taatacgactcactatagggacaagtagcttcaaagtctctaaaacctacaacagaggagagtaggtatgagagactttaacctggcggcagcgcaaaagatg

SEQ ID NO: 43226 - DNA, 103 bp, Artificial Sequence
  Synthetic Polynucleotide
taatacgactcactataggggaaagccacacggaataatgtgtagtattgaacagaggagacaatacatgacattattcaacctggcggcagcgcaaaagatg

SEQ ID NO: 43227 - DNA, 103 bp, Artificial Sequence
  Synthetic Polynucleotide
taatacgactcactataggggttaaacaagtagcttcaaagtctctaaaaaacagaggagattttagatgctttgaagcaacctggcggcagcgcaaaagatg

SEQ ID NO: 43228 - DNA, 103 bp, Artificial Sequence
  Synthetic Polynucleotide
taatacgactcactatagggactttgttaaacaagtagcttcaaagtctcaacagaggagagagactatgaagctacttaacctggcggcagcgcaaaagatg

SEQ ID NO: 43229 - DNA, 103 bp, Artificial Sequence
  Synthetic Polynucleotide
taatacgactcactataggggaataactttgttaaacaagtagcttcaaaaacagaggagatttgaaatgacttgtttaaacctggcggcagcgcaaaagatg

SEQ ID NO: 43230 - DNA, 103 bp, Artificial Sequence
  Synthetic Polynucleotide
taatacgactcactatagggacgatgaataactttgttaaacaagtagctaacagaggagaagctacatgtttaacaaaaacctggcggcagcgcaaaagatg

SEQ ID NO: 43231 - DNA, 103 bp, Artificial Sequence
  Synthetic Polynucleotide
taatacgactcactatagggagacgacgatgaataactttgttaaacaagaacagaggagacttgttatgcaaagttataacctggcggcagcgcaaaagatg

SEQ ID NO: 43232 - DNA, 103 bp, Artificial Sequence
  Synthetic Polynucleotide
taatacgactcactatagggatagtagacgacgatgaataactttgttaaaacagaggagattaacaatgttattcatcaacctggcggcagcgcaaaagatg

SEQ ID NO: 43233 - DNA, 103 bp, Artificial Sequence
  Synthetic Polynucleotide
taatacgactcactatagggatagaatagtagacgacgatgaataactttaacagaggagaaaagttatgcatcgtcgtaacctggcggcagcgcaaaagatg

SEQ ID NO: 43234 - DNA, 103 bp, Artificial Sequence
  Synthetic Polynucleotide
taatacgactcactatagggattaaatagaatagtagacgacgatgaataaacagaggagatattcaatgtcgtctactaacctggcggcagcgcaaaagatg

SEQ ID NO: 43235 - DNA, 103 bp, Artificial Sequence
  Synthetic Polynucleotide
taatacgactcactatagggacaaaattaaatagaatagtagacgacgataacagaggagaatcgtcatgtactattctaacctggcggcagcgcaaaagatg

SEQ ID NO: 43236 - DNA, 103 bp, Artificial Sequence
  Synthetic Polynucleotide
taatacgactcactatagggtaactacaaaattaaatagaatagtagacgaacagaggagacgtctaatgttctatttaaacctggcggcagcgcaaaagatg

SEQ ID NO: 43237 - DNA, 103 bp, Artificial Sequence
  Synthetic Polynucleotide
taatacgactcactatagggggagttctcggattcacttccgtgggacaaaacagaggagattgtccatgggaagtgaaaacctggcggcagcgcaaaagatg

SEQ ID NO: 43238 - DNA, 103 bp, Artificial Sequence
  Synthetic Polynucleotide
taatacgactcactatagggaaatggaaagccacacggaataatgtgtagaacagaggagactacacatgattccgtgtaacctggcggcagcgcaaaagatg

SEQ ID NO: 43239 - DNA, 103 bp, Artificial Sequence
  Synthetic Polynucleotide
taatacgactcactatagggtaaattaactacaaaattaaatagaatagtaacagaggagaactattatgtttaattttaacctggcggcagcgcaaaagatg

SEQ ID NO: 43240 - DNA, 103 bp, Artificial Sequence
  Synthetic Polynucleotide
taatacgactcactatagggtgtgataaattaactacaaaattaaatagaaacagaggagatctattatgttttgtagtaacctggcggcagcgcaaaagatg

SEQ ID NO: 43241 - DNA, 103 bp, Artificial Sequence
  Synthetic Polynucleotide
taatacgactcactatagggtgatatgtgataaattaactacaaaattaaaacagaggagattaattatgtagttaattaacctggcggcagcgcaaaagatg

SEQ ID NO: 43242 - DNA, 103 bp, Artificial Sequence
  Synthetic Polynucleotide
taatacgactcactatagggtaatgtgatatgtgataaattaactacaaaaacagaggagatttgtaatgaatttatcaaacctggcggcagcgcaaaagatg

SEQ ID NO: 43243 - DNA, 103 bp, Artificial Sequence
  Synthetic Polynucleotide
taatacgactcactatagggtcaattaatgtgatatgtgataaattaactaacagaggagaagttaaatgatcacatataacctggcggcagcgcaaaagatg

SEQ ID NO: 43244 - DNA, 103 bp, Artificial Sequence
  Synthetic Polynucleotide
taatacgactcactatagggaaaagtcaattaatgtgatatgtgataaataacagaggagaatttatatgatatcacataacctggcggcagcgcaaaagatg

SEQ ID NO: 43245 - DNA, 103 bp, Artificial Sequence
  Synthetic Polynucleotide
taatacgactcactataggggaccaaaaagtcaattaatgtgatatgtgaaacagaggagatcacatatgacattaattaacctggcggcagcgcaaaagatg

SEQ ID NO: 43246 - DNA, 103 bp, Artificial Sequence
  Synthetic Polynucleotide
taatacgactcactatagggaagtggaccaaaaagtcaattaatgtgataaacagaggagatatcacatgaattgacttaacctggcggcagcgcaaaagatg

SEQ ID NO: 43247 - DNA, 103 bp, Artificial Sequence
  Synthetic Polynucleotide
taatacgactcactatagggtggaaaagtggaccaaaaagtcaattaatgaacagaggagacattaaatgactttttggaacctggcggcagcgcaaaagatg

SEQ ID NO: 43248 - DNA, 103 bp, Artificial Sequence
  Synthetic Polynucleotide
taatacgactcactatagggacgtatggaaaagtggaccaaaaagtcaataacagaggagaattgacatgttggtccacaacctggcggcagcgcaaaagatg

SEQ ID NO: 43249 - DNA, 103 bp, Artificial Sequence
  Synthetic Polynucleotide
taatacgactcactatagggttggaaaatggaaagccacacggaataatgaacagaggagacattatatggtgtggcttaacctggcggcagcgcaaaagatg

SEQ ID NO: 43250 - DNA, 103 bp, Artificial Sequence
  Synthetic Polynucleotide
taatacgactcactatagggtataaacgtatggaaaagtggaccaaaaagaacagaggagactttttatgccacttttcaacctggcggcagcgcaaaagatg

SEQ ID NO: 43251 - DNA, 103 bp, Artificial Sequence
  Synthetic Polynucleotide
taatacgactcactatagggaagaatataaacgtatggaaaagtggaccaaacagaggagatggtccatgtttccatacaacctggcggcagcgcaaaagatg

SEQ ID NO: 43252 - DNA, 103 bp, Artificial Sequence
  Synthetic Polynucleotide
taatacgactcactatagggattaaaagaatataaacgtatggaaaagtgaacagaggagacactttatgatacgtttaaacctggcggcagcgcaaaagatg

SEQ ID NO: 43253 - DNA, 103 bp, Artificial Sequence
  Synthetic Polynucleotide
taatacgactcactataggggcaggattaaaagaatataaacgtatggaaaacagaggagattccatatgtttatattcaacctggcggcagcgcaaaagatg

SEQ ID NO: 43254 - DNA, 103 bp, Artificial Sequence
  Synthetic Polynucleotide
taatacgactcactatagggataacgcaggattaaaagaatataaacgtaaacagaggagatacgttatgattcttttaaacctggcggcagcgcaaaagatg

SEQ ID NO: 43255 - DNA, 103 bp, Artificial Sequence
  Synthetic Polynucleotide
taatacgactcactatagggaacggataacgcaggattaaaagaatataaaacagaggagattatatatgtttaatcctaacctggcggcagcgcaaaagatg

SEQ ID NO: 43256 - DNA, 103 bp, Artificial Sequence
  Synthetic Polynucleotide
taatacgactcactatagggacggaaacggataacgcaggattaaaagaaaacagaggagattctttatgtcctgcgttaacctggcggcagcgcaaaagatg

SEQ ID NO: 43257 - DNA, 103 bp, Artificial Sequence
  Synthetic Polynucleotide
taatacgactcactatagggatataacggaaacggataacgcaggattaaaacagaggagattaatcatgcgttatccgaacctggcggcagcgcaaaagatg

SEQ ID NO: 43258 - DNA, 103 bp, Artificial Sequence
  Synthetic Polynucleotide
taatacgactcactatagggcctggatataacggaaacggataacgcaggaacagaggagacctgcgatgtccgtttccaacctggcggcagcgcaaaagatg

SEQ ID NO: 43259 - DNA, 103 bp, Artificial Sequence
  Synthetic Polynucleotide
taatacgactcactatagggctatccctggatataacggaaacggataacaacagaggagagttatcatgttccgttataacctggcggcagcgcaaaagatg

SEQ ID NO: 43260 - DNA, 103 bp, Artificial Sequence
  Synthetic Polynucleotide
taatacgactcactatagggtgtttttggaaaatggaaagccacacggaaaacagaggagattccgtatggctttccataacctggcggcagcgcaaaagatg

SEQ ID NO: 43261 - DNA, 103 bp, Artificial Sequence
  Synthetic Polynucleotide
taatacgactcactatagggaagatctatccctggatataacggaaacggaacagaggagaccgtttatgttatatccaaacctggcggcagcgcaaaagatg

SEQ ID NO: 43262 - DNA, 103 bp, Artificial Sequence
  Synthetic Polynucleotide
taatacgactcactatagggcttgcaagatctatccctggatataacggaaacagaggagatccgttatgtccagggataacctggcggcagcgcaaaagatg

SEQ ID NO: 43263 - DNA, 103 bp, Artificial Sequence
  Synthetic Polynucleotide
taatacgactcactatagggtttaacttgcaagatctatccctggatataaacagaggagatatatcatgggatagatcaacctggcggcagcgcaaaagatg

SEQ ID NO: 43264 - DNA, 103 bp, Artificial Sequence
  Synthetic Polynucleotide
taatacgactcactatagggttctatttaacttgcaagatctatccctggaacagaggagaccagggatggatcttgcaaacctggcggcagcgcaaaagatg

SEQ ID NO: 43265 - DNA, 103 bp, Artificial Sequence
  Synthetic Polynucleotide
taatacgactcactataggggagcattctatttaacttgcaagatctatcaacagaggagagatagaatgtgcaagttaaacctggcggcagcgcaaaagatg

SEQ ID NO: 43266 - DNA, 103 bp, Artificial Sequence
  Synthetic Polynucleotide
taatacgactcactatagggtttaagagcattctatttaacttgcaagataacagaggagaatcttgatggttaaatagaacctggcggcagcgcaaaagatg

SEQ ID NO: 43267 - DNA, 103 bp, Artificial Sequence
  Synthetic Polynucleotide
taatacgactcactatagggcattatttaagagcattctatttaacttgcaacagaggagagcaagtatgatagaatgcaacctggcggcagcgcaaaagatg

SEQ ID NO: 43268 - DNA, 103 bp, Artificial Sequence
  Synthetic Polynucleotide
taatacgactcactatagggaatgacattatttaagagcattctatttaaaacagaggagattaaatatgatgctcttaaacctggcggcagcgcaaaagatg

SEQ ID NO: 43269 - DNA, 103 bp, Artificial Sequence
  Synthetic Polynucleotide
taatacgactcactatagggaaaaaaatgacattatttaagagcattctaaacagaggagatagaatatgcttaaataaaacctggcggcagcgcaaaagatg

SEQ ID NO: 43270 - DNA, 103 bp, Artificial Sequence
  Synthetic Polynucleotide
taatacgactcactatagggcggataaaaaaatgacattatttaagagcaaacagaggagatgctctatgataatgtcaaacctggcggcagcgcaaaagatg

SEQ ID NO: 43271 - DNA, 103 bp, Artificial Sequence
  Synthetic Polynucleotide
taatacgactcactatagggcaaattgtttttggaaaatggaaagccacaaacagaggagatgtggcatgccattttccaacctggcggcagcgcaaaagatg

SEQ ID NO: 43272 - DNA, 103 bp, Artificial Sequence
  Synthetic Polynucleotide
taatacgactcactatagggtttagcggataaaaaaatgacattatttaaaacagaggagattaaatatggtcatttttaacctggcggcagcgcaaaagatg

SEQ ID NO: 43273 - DNA, 103 bp, Artificial Sequence
  Synthetic Polynucleotide
taatacgactcactatagggaaatttttagcggataaaaaaatgacattaaacagaggagataatgtatgttttttatcaacctggcggcagcgcaaaagatg

SEQ ID NO: 43274 - DNA, 103 bp, Artificial Sequence
  Synthetic Polynucleotide
taatacgactcactatagggtctttaaatttttagcggataaaaaaatgaaacagaggagatcatttatgtatccgctaaacctggcggcagcgcaaaagatg

SEQ ID NO: 43275 - DNA, 103 bp, Artificial Sequence
  Synthetic Polynucleotide
taatacgactcactatagggtacattctttaaatttttagcggataaaaaaacagaggagatttttaatggctaaaaataacctggcggcagcgcaaaagatg

SEQ ID NO: 43276 - DNA, 103 bp, Artificial Sequence
  Synthetic Polynucleotide
taatacgactcactataggggtttatacattctttaaatttttagcggataacagaggagaatccgcatgaaatttaaaaacctggcggcagcgcaaaagatg

SEQ ID NO: 43277 - DNA, 103 bp, Artificial Sequence
  Synthetic Polynucleotide
taatacgactcactatagggaaaaggtttatacattctttaaatttttagaacagaggagactaaaaatgtaaagaatgaacctggcggcagcgcaaaagatg

SEQ ID NO: 43278 - DNA, 103 bp, Artificial Sequence
  Synthetic Polynucleotide
taatacgactcactatagggtctaaaaaaggtttatacattctttaaattaacagaggagaaatttaatgaatgtataaaacctggcggcagcgcaaaagatg

SEQ ID NO: 43279 - DNA, 103 bp, Artificial Sequence
  Synthetic Polynucleotide
taatacgactcactatagggaaatctctaaaaaaggtttatacattctttaacagaggagaaaagaaatgataaaccttaacctggcggcagcgcaaaagatg

SEQ ID NO: 43280 - DNA, 103 bp, Artificial Sequence
  Synthetic Polynucleotide
taatacgactcactataggggtttcaaatctctaaaaaaggtttatacataacagaggagaatgtatatgccttttttaaacctggcggcagcgcaaaagatg

SEQ ID NO: 43281 - DNA, 103 bp, Artificial Sequence
  Synthetic Polynucleotide
taatacgactcactatagggtaagagtttcaaatctctaaaaaaggtttaaacagaggagataaaccatgtttagagataacctggcggcagcgcaaaagatg

SEQ ID NO: 43282 - DNA, 103 bp, Artificial Sequence
  Synthetic Polynucleotide
taatacgactcactatagggttggtcaaattgtttttggaaaatggaaagaacagaggagactttccatgttccaaaaaaacctggcggcagcgcaaaagatg

SEQ ID NO: 43283 - DNA, 103 bp, Artificial Sequence
  Synthetic Polynucleotide
taatacgactcactatagggccacctaagagtttcaaatctctaaaaaagaacagaggagactttttatgagatttgaaaacctggcggcagcgcaaaagatg

SEQ ID NO: 43284 - DNA, 103 bp, Artificial Sequence
  Synthetic Polynucleotide
taatacgactcactatagggggacaccacctaagagtttcaaatctctaaaacagaggagattagagatgtgaaactctaacctggcggcagcgcaaaagatg

SEQ ID NO: 43285 - DNA, 103 bp, Artificial Sequence
  Synthetic Polynucleotide
taatacgactcactatagggtactaggacaccacctaagagtttcaaatcaacagaggagagatttgatgctcttaggtaacctggcggcagcgcaaaagatg

SEQ ID NO: 43286 - DNA, 103 bp, Artificial Sequence
  Synthetic Polynucleotide
taatacgactcactatagggttgtgtactaggacaccacctaagagtttcaacagaggagagaaactatgaggtggtgtaacctggcggcagcgcaaaagatg

SEQ ID NO: 43287 - DNA, 103 bp, Artificial Sequence
  Synthetic Polynucleotide
taatacgactcactatagggtgatattgtgtactaggacaccacctaagaaacagaggagatcttagatggtgtcctagaacctggcggcagcgcaaaagatg

SEQ ID NO: 43288 - DNA, 103 bp, Artificial Sequence
  Synthetic Polynucleotide
taatacgactcactataggggtttatgatattgtgtactaggacaccaccaacagaggagaggtggtatgctagtacacaacctggcggcagcgcaaaagatg

SEQ ID NO: 43289 - DNA, 103 bp, Artificial Sequence
  Synthetic Polynucleotide
taatacgactcactatagggagtttgtttatgatattgtgtactaggacaaacagaggagatgtcctatgacacaatataacctggcggcagcgcaaaagatg

SEQ ID NO: 43290 - DNA, 103 bp, Artificial Sequence
  Synthetic Polynucleotide
taatacgactcactatagggttattagtttgtttatgatattgtgtactaaacagaggagatagtacatgatatcataaaacctggcggcagcgcaaaagatg

SEQ ID NO: 43291 - DNA, 103 bp, Artificial Sequence
  Synthetic Polynucleotide
taatacgactcactatagggaatgtttattagtttgtttatgatattgtgaacagaggagacacaatatgataaacaaaaacctggcggcagcgcaaaagatg

SEQ ID NO: 43292 - DNA, 103 bp, Artificial Sequence
  Synthetic Polynucleotide
taatacgactcactatagggtgtggaatgtttattagtttgtttatgataaacagaggagatatcatatgcaaactaataacctggcggcagcgcaaaagatg

SEQ ID NO: 43293 - DNA, 103 bp, Artificial Sequence
  Synthetic Polynucleotide
taatacgactcactatagggtagatttggtcaaattgtttttggaaaatgaacagaggagacattttatgaaaacaattaacctggcggcagcgcaaaagatg

SEQ ID NO: 43294 - DNA, 103 bp, Artificial Sequence
  Synthetic Polynucleotide
taatacgactcactatagggctgaatgtggaatgtttattagtttgtttaaacagaggagataaacaatgtaataaacaaacctggcggcagcgcaaaagatg

SEQ ID NO: 43295 - DNA, 103 bp, Artificial Sequence
  Synthetic Polynucleotide
taatacgactcactatagggggaatctgaatgtggaatgtttattagtttaacagaggagaaaactaatgaacattccaaacctggcggcagcgcaaaagatg

SEQ ID NO: 43296 - DNA, 103 bp, Artificial Sequence
  Synthetic Polynucleotide
taatacgactcactatagggctgttggaatctgaatgtggaatgtttattaacagaggagaaataaaatgtccacattcaacctggcggcagcgcaaaagatg

SEQ ID NO: 43297 - DNA, 103 bp, Artificial Sequence
  Synthetic Polynucleotide
taatacgactcactatagggatcaactgttggaatctgaatgtggaatgtaacagaggagaacattcatgattcagattaacctggcggcagcgcaaaagatg

SEQ ID NO: 43298 - DNA, 103 bp, Artificial Sequence
  Synthetic Polynucleotide
taatacgactcactatagggagttaatcaactgttggaatctgaatgtggaacagaggagaccacatatggattccaacaacctggcggcagcgcaaaagatg

SEQ ID NO: 43299 - DNA, 103 bp, Artificial Sequence
  Synthetic Polynucleotide
taatacgactcactataggggtggaagttaatcaactgttggaatctgaaaacagaggagattcagaatgcaacagttgaacctggcggcagcgcaaaagatg

SEQ ID NO: 43300 - DNA, 103 bp, Artificial Sequence
  Synthetic Polynucleotide
taatacgactcactatagggttaatgtggaagttaatcaactgttggaataacagaggagaattccaatggttgattaaaacctggcggcagcgcaaaagatg

SEQ ID NO: 43301 - DNA, 103 bp, Artificial Sequence
  Synthetic Polynucleotide
taatacgactcactatagggctgtattaatgtggaagttaatcaactgttaacagaggagaaacagtatgttaacttccaacctggcggcagcgcaaaagatg

SEQ ID NO: 43302 - DNA, 103 bp, Artificial Sequence
  Synthetic Polynucleotide
taatacgactcactatagggataggctgtattaatgtggaagttaatcaaaacagaggagattgattatgttccacattaacctggcggcagcgcaaaagatg

SEQ ID NO: 43303 - DNA, 103 bp, Artificial Sequence
  Synthetic Polynucleotide
taatacgactcactatagggcgaaaataggctgtattaatgtggaagttaaacagaggagataacttatgcattaatacaacctggcggcagcgcaaaagatg

SEQ ID NO: 43304 - DNA, 103 bp, Artificial Sequence
  Synthetic Polynucleotide
taatacgactcactataggggaatttagatttggtcaaattgtttttggaaacagaggagatccaaaatgaatttgaccaacctggcggcagcgcaaaagatg

SEQ ID NO: 43305 - DNA, 103 bp, Artificial Sequence
  Synthetic Polynucleotide
taatacgactcactatagggtggagcgaaaataggctgtattaatgtggaaacagaggagatccacaatgatacagcctaacctggcggcagcgcaaaagatg

SEQ ID NO: 43306 - DNA, 103 bp, Artificial Sequence
  Synthetic Polynucleotide
taatacgactcactatagggatatttggagcgaaaataggctgtattaataacagaggagaattaatatggcctattttaacctggcggcagcgcaaaagatg

SEQ ID NO: 43307 - DNA, 103 bp, Artificial Sequence
  Synthetic Polynucleotide
taatacgactcactatagggaatgtatatttggagcgaaaataggctgtaaacagaggagatacagcatgttttcgctcaacctggcggcagcgcaaaagatg

SEQ ID NO: 43308 - DNA, 103 bp, Artificial Sequence
  Synthetic Polynucleotide
taatacgactcactatagggtttcgaatgtatatttggagcgaaaataggaacagaggagacctattatggctccaaataacctggcggcagcgcaaaagatg

SEQ ID NO: 43309 - DNA, 103 bp, Artificial Sequence
  Synthetic Polynucleotide
taatacgactcactatagggagatttttcgaatgtatatttggagcgaaaaacagaggagatttcgcatgaaatatacaaacctggcggcagcgcaaaagatg

SEQ ID NO: 43310 - DNA, 103 bp, Artificial Sequence
  Synthetic Polynucleotide
taatacgactcactatagggtattcagatttttcgaatgtatatttggagaacagaggagactccaaatgtacattcgaaacctggcggcagcgcaaaagatg

SEQ ID NO: 43311 - DNA, 103 bp, Artificial Sequence
  Synthetic Polynucleotide
taatacgactcactatagggtgttttattcagatttttcgaatgtatattaacagaggagaaatataatgtcgaaaaataacctggcggcagcgcaaaagatg

SEQ ID NO: 43312 - DNA, 103 bp, Artificial Sequence
  Synthetic Polynucleotide
taatacgactcactatagggattgatgttttattcagatttttcgaatgtaacagaggagaacattcatgaaatctgaaaacctggcggcagcgcaaaagatg

SEQ ID NO: 43313 - DNA, 103 bp, Artificial Sequence
  Synthetic Polynucleotide
taatacgactcactataggggcgacattgatgttttattcagatttttcgaacagaggagacgaaaaatgtgaataaaaaacctggcggcagcgcaaaagatg

SEQ ID NO: 43314 - DNA, 103 bp, Artificial Sequence
  Synthetic Polynucleotide
taatacgactcactatagggaaattgcgacattgatgttttattcagattaacagaggagaaatctgatgaaaacatcaaacctggcggcagcgcaaaagatg

SEQ ID NO: 43315 - DNA, 103 bp, Artificial Sequence
  Synthetic Polynucleotide
taatacgactcactataggggatgtgaatttagatttggtcaaattgtttaacagaggagaaaacaaatggaccaaatcaacctggcggcagcgcaaaagatg

SEQ ID NO: 43316 - DNA, 103 bp, Artificial Sequence
  Synthetic Polynucleotide
taatacgactcactatagggaatacaaattgcgacattgatgttttattcaacagaggagagaataaatgatcaatgtcaacctggcggcagcgcaaaagatg

SEQ ID NO: 43317 - DNA, 103 bp, Artificial Sequence
  Synthetic Polynucleotide
taatacgactcactatagggtggataatacaaattgcgacattgatgtttaacagaggagaaaacatatgtgtcgcaataacctggcggcagcgcaaaagatg

SEQ ID NO: 43318 - DNA, 103 bp, Artificial Sequence
  Synthetic Polynucleotide
taatacgactcactatagggtgtattggataatacaaattgcgacattgaaacagaggagatcaatgatgcaatttgtaaacctggcggcagcgcaaaagatg

SEQ ID NO: 43319 - DNA, 103 bp, Artificial Sequence
  Synthetic Polynucleotide
taatacgactcactatagggcattctgtattggataatacaaattgcgacaacagaggagagtcgcaatgtgtattatcaacctggcggcagcgcaaaagatg

SEQ ID NO: 43320 - DNA, 103 bp, Artificial Sequence
  Synthetic Polynucleotide
taatacgactcactatagggacagacattctgtattggataatacaaattaacagaggagaaatttgatgtatccaataaacctggcggcagcgcaaaagatg

SEQ ID NO: 43321 - DNA, 103 bp, Artificial Sequence
  Synthetic Polynucleotide
taatacgactcactataggggaatcacagacattctgtattggataatacaacagaggagagtattaatgaatacagaaaacctggcggcagcgcaaaagatg

SEQ ID NO: 43322 - DNA, 103 bp, Artificial Sequence
  Synthetic Polynucleotide
taatacgactcactatagggaacacgaatcacagacattctgtattggataacagaggagaatccaaatgagaatgtctaacctggcggcagcgcaaaagatg

SEQ ID NO: 43323 - DNA, 103 bp, Artificial Sequence
  Synthetic Polynucleotide
taatacgactcactataggggttttaacacgaatcacagacattctgtataacagaggagaatacagatggtctgtgataacctggcggcagcgcaaaagatg

SEQ ID NO: 43324 - DNA, 103 bp, Artificial Sequence
  Synthetic Polynucleotide
taatacgactcactatagggcgatggttttaacacgaatcacagacattcaacagaggagagaatgtatgtgattcgtgaacctggcggcagcgcaaaagatg

SEQ ID NO: 43325 - DNA, 103 bp, Artificial Sequence
  Synthetic Polynucleotide
taatacgactcactatagggttctccgatggttttaacacgaatcacagaaacagaggagatctgtgatgcgtgttaaaaacctggcggcagcgcaaaagatg

SEQ ID NO: 43326 - DNA, 103 bp, Artificial Sequence
  Synthetic Polynucleotide
taatacgactcactatagggatgaagatgtgaatttagatttggtcaaataacagaggagaatttgaatgaatctaaataacctggcggcagcgcaaaagatg

SEQ ID NO: 43327 - DNA, 103 bp, Artificial Sequence
  Synthetic Polynucleotide
taatacgactcactatagggattccttctccgatggttttaacacgaatcaacagaggagagattcgatgtaaaaccataacctggcggcagcgcaaaagatg

SEQ ID NO: 43328 - DNA, 103 bp, Artificial Sequence
  Synthetic Polynucleotide
taatacgactcactatagggtttctattccttctccgatggttttaacacaacagaggagagtgttaatgccatcggagaacctggcggcagcgcaaaagatg

SEQ ID NO: 43329 - DNA, 103 bp, Artificial Sequence
  Synthetic Polynucleotide
taatacgactcactatagggttttatttctattccttctccgatggttttaacagaggagaaaaaccatgggagaaggaaacctggcggcagcgcaaaagatg

SEQ ID NO: 43330 - DNA, 103 bp, Artificial Sequence
  Synthetic Polynucleotide
taatacgactcactatagggataatttttatttctattccttctccgatgaacagaggagacatcggatgaggaatagaaacctggcggcagcgcaaaagatg

SEQ ID NO: 43331 - DNA, 103 bp, Artificial Sequence
  Synthetic Polynucleotide
taatacgactcactatagggctataataatttttatttctattccttctcaacagaggagagagaagatgtagaaataaaacctggcggcagcgcaaaagatg

SEQ ID NO: 43332 - DNA, 103 bp, Artificial Sequence
  Synthetic Polynucleotide
taatacgactcactatagggcaccactataataatttttatttctattccaacagaggagaggaataatgataaaaattaacctggcggcagcgcaaaagatg

SEQ ID NO: 43333 - DNA, 103 bp, Artificial Sequence
  Synthetic Polynucleotide
taatacgactcactatagggaattccaccactataataatttttatttctaacagaggagaagaaatatgaattattataacctggcggcagcgcaaaagatg

SEQ ID NO: 43334 - DNA, 103 bp, Artificial Sequence
  Synthetic Polynucleotide
taatacgactcactatagggaactgaattccaccactataataatttttaaacagaggagataaaaaatgttatagtggaacctggcggcagcgcaaaagatg

SEQ ID NO: 43335 - DNA, 103 bp, Artificial Sequence
  Synthetic Polynucleotide
taatacgactcactatagggattccaactgaattccaccactataataataacagaggagaattattatggtggtggaaaacctggcggcagcgcaaaagatg

SEQ ID NO: 43336 - DNA, 103 bp, Artificial Sequence
  Synthetic Polynucleotide
taatacgactcactataggggcaatattccaactgaattccaccactataaacagaggagatatagtatgggaattcagaacctggcggcagcgcaaaagatg

SEQ ID NO: 43337 - DNA, 103 bp, Artificial Sequence
  Synthetic Polynucleotide
taatacgactcactatagggatacaatgaagatgtgaatttagatttggtaacagaggagaaccaaaatgaaattcacaaacctggcggcagcgcaaaagatg

SEQ ID NO: 43338 - DNA, 103 bp, Artificial Sequence
  Synthetic Polynucleotide
taatacgactcactatagggcggaggcaatattccaactgaattccaccaaacagaggagatggtggatgtcagttggaaacctggcggcagcgcaaaagatg

SEQ ID NO: 43339 - DNA, 103 bp, Artificial Sequence
  Synthetic Polynucleotide
taatacgactcactataggggactccggaggcaatattccaactgaattcaacagaggagagaattcatgtggaatattaacctggcggcagcgcaaaagatg

SEQ ID NO: 43340 - DNA, 103 bp, Artificial Sequence
  Synthetic Polynucleotide
taatacgactcactatagggtttatgactccggaggcaatattccaactgaacagaggagacagttgatgtattgcctcaacctggcggcagcgcaaaagatg

SEQ ID NO: 43341 - DNA, 103 bp, Artificial Sequence
  Synthetic Polynucleotide
taatacgactcactatagggatccttttatgactccggaggcaatattccaacagaggagaggaataatgcctccggagaacctggcggcagcgcaaaagatg

SEQ ID NO: 43342 - DNA, 103 bp, Artificial Sequence
  Synthetic Polynucleotide
taatacgactcactatagggttagtatccttttatgactccggaggcaataacagaggagaattgccatgggagtcataaacctggcggcagcgcaaaagatg

SEQ ID NO: 43343 - DNA, 103 bp, Artificial Sequence
  Synthetic Polynucleotide
taatacgactcactatagggaatgtttagtatccttttatgactccggagaacagaggagactccggatgcataaaaggaacctggcggcagcgcaaaagatg

SEQ ID NO: 43344 - DNA, 103 bp, Artificial Sequence
  Synthetic Polynucleotide
taatacgactcactatagggaaaacaatgtttagtatccttttatgactcaacagaggagagagtcaatgaaggatactaacctggcggcagcgcaaaagatg

SEQ ID NO: 43345 - DNA, 103 bp, Artificial Sequence
  Synthetic Polynucleotide
taatacgactcactataggggataaaaaacaatgtttagtatccttttataacagaggagaataaaaatgtactaaacaaacctggcggcagcgcaaaagatg

SEQ ID NO: 43346 - DNA, 103 bp, Artificial Sequence
  Synthetic Polynucleotide
taatacgactcactatagggtttatgataaaaaacaatgtttagtatcctaacagaggagaaggataatgaacattgttaacctggcggcagcgcaaaagatg

SEQ ID NO: 43347 - DNA, 103 bp, Artificial Sequence
  Synthetic Polynucleotide
taatacgactcactatagggtgtaatttatgataaaaaacaatgtttagtaacagaggagaactaaaatgtgttttttaaacctggcggcagcgcaaaagatg

SEQ ID NO: 43348 - DNA, 103 bp, Artificial Sequence
  Synthetic Polynucleotide
taatacgactcactatagggttgaaggagttctcggattcacttccgtggaacagaggagaccacggatgtgaatccgaaacctggcggcagcgcaaaagatg

SEQ ID NO: 43349 - DNA, 103 bp, Artificial Sequence
  Synthetic Polynucleotide
taatacgactcactatagggtatagatacaatgaagatgtgaatttagataacagaggagaatctaaatgcacatcttcaacctggcggcagcgcaaaagatg

SEQ ID NO: 43350 - DNA, 103 bp, Artificial Sequence
  Synthetic Polynucleotide
taatacgactcactatagggaaatgtgtaatttatgataaaaaacaatgtaacagaggagaacattgatgtttatcataaacctggcggcagcgcaaaagatg

SEQ ID NO: 43351 - DNA, 103 bp, Artificial Sequence
  Synthetic Polynucleotide
taatacgactcactatagggattggaaatgtgtaatttatgataaaaaacaacagaggagagtttttatgcataaattaaacctggcggcagcgcaaaagatg

SEQ ID NO: 43352 - DNA, 103 bp, Artificial Sequence
  Synthetic Polynucleotide
taatacgactcactataggggtctcattggaaatgtgtaatttatgataaaacagaggagattatcaatgattacacataacctggcggcagcgcaaaagatg

SEQ ID NO: 43353 - DNA, 103 bp, Artificial Sequence
  Synthetic Polynucleotide
taatacgactcactatagggtatttgtctcattggaaatgtgtaatttataacagaggagaataaatatgacatttccaaacctggcggcagcgcaaaagatg

SEQ ID NO: 43354 - DNA, 103 bp, Artificial Sequence
  Synthetic Polynucleotide
taatacgactcactatagggtttgttatttgtctcattggaaatgtgtaaaacagaggagattacacatgtccaatgagaacctggcggcagcgcaaaagatg

SEQ ID NO: 43355 - DNA, 103 bp, Artificial Sequence
  Synthetic Polynucleotide
taatacgactcactatagggtggattttgttatttgtctcattggaaatgaacagaggagacatttcatgtgagacaaaaacctggcggcagcgcaaaagatg

SEQ ID NO: 43356 - DNA, 103 bp, Artificial Sequence
  Synthetic Polynucleotide
taatacgactcactatagggatgtttggattttgttatttgtctcattggaacagaggagaccaatgatgcaaataacaaacctggcggcagcgcaaaagatg

SEQ ID NO: 43357 - DNA, 103 bp, Artificial Sequence
  Synthetic Polynucleotide
taatacgactcactatagggttgtaatgtttggattttgttatttgtctcaacagaggagagagacaatgaacaaaatcaacctggcggcagcgcaaaagatg

SEQ ID NO: 43358 - DNA, 103 bp, Artificial Sequence
  Synthetic Polynucleotide
taatacgactcactatagggtagatttgtaatgtttggattttgttatttaacagaggagaaaataaatgaatccaaacaacctggcggcagcgcaaaagatg

SEQ ID NO: 43359 - DNA, 103 bp, Artificial Sequence
  Synthetic Polynucleotide
taatacgactcactatagggacctctagatttgtaatgtttggattttgtaacagaggagaacaaaaatgaaacattacaacctggcggcagcgcaaaagatg

SEQ ID NO: 43360 - DNA, 103 bp, Artificial Sequence
  Synthetic Polynucleotide
taatacgactcactataggggtgattatagatacaatgaagatgtgaattaacagaggagaaattcaatgcttcattgtaacctggcggcagcgcaaaagatg

SEQ ID NO: 43361 - DNA, 103 bp, Artificial Sequence
  Synthetic Polynucleotide
taatacgactcactataggggttctacctctagatttgtaatgtttggataacagaggagaatccaaatgttacaaatcaacctggcggcagcgcaaaagatg

SEQ ID NO: 43362 - DNA, 103 bp, Artificial Sequence
  Synthetic Polynucleotide
taatacgactcactatagggtaaaagttctacctctagatttgtaatgttaacagaggagaaacattatgaatctagagaacctggcggcagcgcaaaagatg

SEQ ID NO: 43363 - DNA, 103 bp, Artificial Sequence
  Synthetic Polynucleotide
taatacgactcactatagggaaaattaaaagttctacctctagatttgtaaacagaggagatacaaaatgagaggtagaaacctggcggcagcgcaaaagatg

SEQ ID NO: 43364 - DNA, 103 bp, Artificial Sequence
  Synthetic Polynucleotide
taatacgactcactatagggaagacaaaattaaaagttctacctctagataacagaggagaatctagatgtagaactttaacctggcggcagcgcaaaagatg

SEQ ID NO: 43365 - DNA, 103 bp, Artificial Sequence
  Synthetic Polynucleotide
taatacgactcactatagggacttaaagacaaaattaaaagttctacctcaacagaggagagaggtaatgcttttaattaacctggcggcagcgcaaaagatg

SEQ ID NO: 43366 - DNA, 103 bp, Artificial Sequence
  Synthetic Polynucleotide
taatacgactcactatagggtatatacttaaagacaaaattaaaagttctaacagaggagaagaactatgaattttgtcaacctggcggcagcgcaaaagatg

SEQ ID NO: 43367 - DNA, 103 bp, Artificial Sequence
  Synthetic Polynucleotide
taatacgactcactatagggtatcgtatatacttaaagacaaaattaaaaaacagaggagattttaaatgtgtctttaaaacctggcggcagcgcaaaagatg

SEQ ID NO: 43368 - DNA, 103 bp, Artificial Sequence
  Synthetic Polynucleotide
taatacgactcactatagggtatcttatcgtatatacttaaagacaaaataacagaggagaattttgatgttaagtataaacctggcggcagcgcaaaagatg

SEQ ID NO: 43369 - DNA, 103 bp, Artificial Sequence
  Synthetic Polynucleotide
taatacgactcactatagggaaacatatcttatcgtatatacttaaagacaacagaggagagtctttatgtatatacgaaacctggcggcagcgcaaaagatg

SEQ ID NO: 43370 - DNA, 103 bp, Artificial Sequence
  Synthetic Polynucleotide
taatacgactcactatagggtgaataaacatatcttatcgtatatacttaaacagaggagataagtaatgacgataagaaacctggcggcagcgcaaaagatg

SEQ ID NO: 43371 - DNA, 103 bp, Artificial Sequence
  Synthetic Polynucleotide
taatacgactcactataggggaatagtgattatagatacaatgaagatgtaacagaggagaacatctatgttgtatctaaacctggcggcagcgcaaaagatg

SEQ ID NO: 43372 - DNA, 103 bp, Artificial Sequence
  Synthetic Polynucleotide
taatacgactcactataggggtttatgaataaacatatcttatcgtatataacagaggagaatatacatgaagatatgtaacctggcggcagcgcaaaagatg

SEQ ID NO: 43373 - DNA, 103 bp, Artificial Sequence
  Synthetic Polynucleotide
taatacgactcactataggggacgcgtttatgaataaacatatcttatcgaacagaggagacgataaatgatgtttattaacctggcggcagcgcaaaagatg

SEQ ID NO: 43374 - DNA, 103 bp, Artificial Sequence
  Synthetic Polynucleotide
taatacgactcactatagggaatttgacgcgtttatgaataaacatatctaacagaggagaagatatatgtattcataaaacctggcggcagcgcaaaagatg

SEQ ID NO: 43375 - DNA, 103 bp, Artificial Sequence
  Synthetic Polynucleotide
taatacgactcactatagggtgaaaaatttgacgcgtttatgaataaacaaacagaggagatgtttaatgataaacgcgaacctggcggcagcgcaaaagatg

SEQ ID NO: 43376 - DNA, 103 bp, Artificial Sequence
  Synthetic Polynucleotide
taatacgactcactatagggattcatgaaaaatttgacgcgtttatgaataacagaggagaattcatatgcgcgtcaaaaacctggcggcagcgcaaaagatg

SEQ ID NO: 43377 - DNA, 103 bp, Artificial Sequence
  Synthetic Polynucleotide
taatacgactcactatagggtagcgattcatgaaaaatttgacgcgtttaaacagaggagataaacgatgcaaatttttaacctggcggcagcgcaaaagatg

SEQ ID NO: 43378 - DNA, 103 bp, Artificial Sequence
  Synthetic Polynucleotide
taatacgactcactatagggctccttagcgattcatgaaaaatttgacgcaacagaggagagcgtcaatgttttcatgaaacctggcggcagcgcaaaagatg

SEQ ID NO: 43379 - DNA, 103 bp, Artificial Sequence
  Synthetic Polynucleotide
taatacgactcactatagggttaaactccttagcgattcatgaaaaatttaacagaggagaaaatttatgatgaatcgcaacctggcggcagcgcaaaagatg

SEQ ID NO: 43380 - DNA, 103 bp, Artificial Sequence
  Synthetic Polynucleotide
taatacgactcactataggggattcttaaactccttagcgattcatgaaaaacagaggagatttcatatgtcgctaaggaacctggcggcagcgcaaaagatg

SEQ ID NO: 43381 - DNA, 103 bp, Artificial Sequence
  Synthetic Polynucleotide
taatacgactcactatagggcatgagattcttaaactccttagcgattcaaacagaggagatgaatcatgaaggagtttaacctggcggcagcgcaaaagatg

SEQ ID NO: 43382 - DNA, 103 bp, Artificial Sequence
  Synthetic Polynucleotide
taatacgactcactatagggtatctgaatagtgattatagatacaatgaaaacagaggagattcattatgtctataatcaacctggcggcagcgcaaaagatg

SEQ ID NO: 43383 - DNA, 103 bp, Artificial Sequence
  Synthetic Polynucleotide
taatacgactcactatagggtttgacatgagattcttaaactccttagcgaacagaggagacgctaaatggtttaagaaaacctggcggcagcgcaaaagatg

SEQ ID NO: 43384 - DNA, 103 bp, Artificial Sequence
  Synthetic Polynucleotide
taatacgactcactataggggacaatttgacatgagattcttaaactcctaacagaggagaaggagtatgagaatctcaaacctggcggcagcgcaaaagatg

SEQ ID NO: 43385 - DNA, 103 bp, Artificial Sequence
  Synthetic Polynucleotide
taatacgactcactatagggtataggacaatttgacatgagattcttaaaaacagaggagatttaagatgctcatgtcaaacctggcggcagcgcaaaagatg

SEQ ID NO: 43386 - DNA, 103 bp, Artificial Sequence
  Synthetic Polynucleotide
taatacgactcactataggggattatataggacaatttgacatgagattcaacagaggagagaatctatggtcaaattgaacctggcggcagcgcaaaagatg

SEQ ID NO: 43387 - DNA, 103 bp, Artificial Sequence
  Synthetic Polynucleotide
taatacgactcactatagggaagtggattatataggacaatttgacatgaaacagaggagatcatgtatgattgtcctaaacctggcggcagcgcaaaagatg

SEQ ID NO: 43388 - DNA, 103 bp, Artificial Sequence
  Synthetic Polynucleotide
taatacgactcactatagggatccgaagtggattatataggacaatttgaaacagaggagatcaaatatgcctatataaaacctggcggcagcgcaaaagatg

SEQ ID NO: 43389 - DNA, 103 bp, Artificial Sequence
  Synthetic Polynucleotide
taatacgactcactatagggtatggatccgaagtggattatataggacaaaacagaggagattgtccatgataatccacaacctggcggcagcgcaaaagatg

SEQ ID NO: 43390 - DNA, 103 bp, Artificial Sequence
  Synthetic Polynucleotide
taatacgactcactatagggttgcttatggatccgaagtggattatatagaacagaggagactatatatgccacttcggaacctggcggcagcgcaaaagatg

SEQ ID NO: 43391 - DNA, 103 bp, Artificial Sequence
  Synthetic Polynucleotide
taatacgactcactatagggtcagtttgcttatggatccgaagtggattaaacagaggagataatccatgtcggatccaaacctggcggcagcgcaaaagatg

SEQ ID NO: 43392 - DNA, 103 bp, Artificial Sequence
  Synthetic Polynucleotide
taatacgactcactataggggtctctcagtttgcttatggatccgaagtgaacagaggagacacttcatgtccataagcaacctggcggcagcgcaaaagatg

SEQ ID NO: 43393 - DNA, 103 bp, Artificial Sequence
  Synthetic Polynucleotide
taatacgactcactatagggctgattatctgaatagtgattatagatacaaacagaggagatgtatcatgaatcactataacctggcggcagcgcaaaagatg

SEQ ID NO: 43394 - DNA, 103 bp, Artificial Sequence
  Synthetic Polynucleotide
taatacgactcactatagggacttagtctctcagtttgcttatggatccgaacagaggagacggatcatgaagcaaactaacctggcggcagcgcaaaagatg

SEQ ID NO: 43395 - DNA, 103 bp, Artificial Sequence
  Synthetic Polynucleotide
taatacgactcactatagggtaagaacttagtctctcagtttgcttatggaacagaggagaccataaatgaactgagagaacctggcggcagcgcaaaagatg

SEQ ID NO: 43396 - DNA, 103 bp, Artificial Sequence
  Synthetic Polynucleotide
taatacgactcactatagggagtattaagaacttagtctctcagtttgctaacagaggagaagcaaaatgagagactaaaacctggcggcagcgcaaaagatg

SEQ ID NO: 43397 - DNA, 103 bp, Artificial Sequence
  Synthetic Polynucleotide
taatacgactcactatagggatcgaagtattaagaacttagtctctcagtaacagaggagaactgagatgctaagttctaacctggcggcagcgcaaaagatg

SEQ ID NO: 43398 - DNA, 103 bp, Artificial Sequence
  Synthetic Polynucleotide
taatacgactcactataggggagcaatcgaagtattaagaacttagtctcaacagaggagagagactatgttcttaataaacctggcggcagcgcaaaagatg

SEQ ID NO: 43399 - DNA, 103 bp, Artificial Sequence
  Synthetic Polynucleotide
taatacgactcactatagggtggatgagcaatcgaagtattaagaacttaaacagaggagataagttatgaatacttcgaacctggcggcagcgcaaaagatg

SEQ ID NO: 43400 - DNA, 103 bp, Artificial Sequence
  Synthetic Polynucleotide
taatacgactcactataggggagcctggatgagcaatcgaagtattaagaaacagaggagatcttaaatgttcgattgcaacctggcggcagcgcaaaagatg

SEQ ID NO: 43401 - DNA, 103 bp, Artificial Sequence
  Synthetic Polynucleotide
taatacgactcactataggggagaggagcctggatgagcaatcgaagtataacagaggagaatacttatgttgctcatcaacctggcggcagcgcaaaagatg

SEQ ID NO: 43402 - DNA, 103 bp, Artificial Sequence
  Synthetic Polynucleotide
taatacgactcactatagggcctgagagaggagcctggatgagcaatcgaaacagaggagatcgattatgcatccaggcaacctggcggcagcgcaaaagatg

SEQ ID NO: 43403 - DNA, 103 bp, Artificial Sequence
  Synthetic Polynucleotide
taatacgactcactatagggtagagcctgagagaggagcctggatgagcaaacagaggagatgctcaatgaggctcctcaacctggcggcagcgcaaaagatg

SEQ ID NO: 43404 - DNA, 103 bp, Artificial Sequence
  Synthetic Polynucleotide
taatacgactcactatagggtatggctgattatctgaatagtgattatagaacagaggagactataaatgctattcagaaacctggcggcagcgcaaaagatg

SEQ ID NO: 43405 - DNA, 103 bp, Artificial Sequence
  Synthetic Polynucleotide
taatacgactcactataggggaaaatagagcctgagagaggagcctggataacagaggagaatccagatgcctctctcaaacctggcggcagcgcaaaagatg

SEQ ID NO: 43406 - DNA, 103 bp, Artificial Sequence
  Synthetic Polynucleotide
taatacgactcactatagggaagatgaaaatagagcctgagagaggagccaacagaggagaggctccatgctcaggctcaacctggcggcagcgcaaaagatg

SEQ ID NO: 43407 - DNA, 103 bp, Artificial Sequence
  Synthetic Polynucleotide
taatacgactcactatagggtcgtcaagatgaaaatagagcctgagagagaacagaggagactctctatggctctatttaacctggcggcagcgcaaaagatg

SEQ ID NO: 43408 - DNA, 103 bp, Artificial Sequence
  Synthetic Polynucleotide
taatacgactcactatagggaaaggtcgtcaagatgaaaatagagcctgaaacagaggagatcaggcatgattttcatcaacctggcggcagcgcaaaagatg

SEQ ID NO: 43409 - DNA, 103 bp, Artificial Sequence
  Synthetic Polynucleotide
taatacgactcactatagggaatccaaaggtcgtcaagatgaaaatagagaacagaggagactctatatgcatcttgacaacctggcggcagcgcaaaagatg

SEQ ID NO: 43410 - DNA, 103 bp, Artificial Sequence
  Synthetic Polynucleotide
taatacgactcactataggggtgaaaatccaaaggtcgtcaagatgaaaaaacagaggagattttcaatgtgacgacctaacctggcggcagcgcaaaagatg

SEQ ID NO: 43411 - DNA, 103 bp, Artificial Sequence
  Synthetic Polynucleotide
taatacgactcactatagggtactggtgaaaatccaaaggtcgtcaagataacagaggagaatcttgatgacctttggaaacctggcggcagcgcaaaagatg

SEQ ID NO: 43412 - DNA, 103 bp, Artificial Sequence
  Synthetic Polynucleotide
taatacgactcactatagggatacatactggtgaaaatccaaaggtcgtcaacagaggagagacgacatgtggattttcaacctggcggcagcgcaaaagatg

SEQ ID NO: 43413 - DNA, 103 bp, Artificial Sequence
  Synthetic Polynucleotide
taatacgactcactatagggaaggaatacatactggtgaaaatccaaaggaacagaggagacctttgatgtttcaccagaacctggcggcagcgcaaaagatg

SEQ ID NO: 43414 - DNA, 103 bp, Artificial Sequence
  Synthetic Polynucleotide
taatacgactcactatagggacgtaaaggaatacatactggtgaaaatccaacagaggagaggatttatgccagtatgtaacctggcggcagcgcaaaagatg

SEQ ID NO: 43415 - DNA, 103 bp, Artificial Sequence
  Synthetic Polynucleotide
taatacgactcactataggggtaattatggctgattatctgaatagtgataacagaggagaatcactatgcagataatcaacctggcggcagcgcaaaagatg

SEQ ID NO: 43416 - DNA, 103 bp, Artificial Sequence
  Synthetic Polynucleotide
taatacgactcactatagggttatcacgtaaaggaatacatactggtgaaaacagaggagattcaccatgatgtattccaacctggcggcagcgcaaaagatg

SEQ ID NO: 43417 - DNA, 103 bp, Artificial Sequence
  Synthetic Polynucleotide
taatacgactcactatagggatgatttatcacgtaaaggaatacatactgaacagaggagacagtatatgttcctttacaacctggcggcagcgcaaaagatg

SEQ ID NO: 43418 - DNA, 103 bp, Artificial Sequence
  Synthetic Polynucleotide
taatacgactcactatagggaatcgatgatttatcacgtaaaggaatacaaacagaggagatgtattatgttacgtgataacctggcggcagcgcaaaagatg

SEQ ID NO: 43419 - DNA, 103 bp, Artificial Sequence
  Synthetic Polynucleotide
taatacgactcactatagggttgaaaatcgatgatttatcacgtaaaggaaacagaggagatcctttatgtgataaatcaacctggcggcagcgcaaaagatg

SEQ ID NO: 43420 - DNA, 103 bp, Artificial Sequence
  Synthetic Polynucleotide
taatacgactcactatagggtggatttgaaaatcgatgatttatcacgtaaacagaggagatacgtgatgaatcatcgaaacctggcggcagcgcaaaagatg

SEQ ID NO: 43421 - DNA, 103 bp, Artificial Sequence
  Synthetic Polynucleotide
taatacgactcactatagggacaaatggatttgaaaatcgatgatttatcaacagaggagagataaaatgtcgattttcaacctggcggcagcgcaaaagatg

SEQ ID NO: 43422 - DNA, 103 bp, Artificial Sequence
  Synthetic Polynucleotide
taatacgactcactatagggttctcacaaatggatttgaaaatcgatgataacagaggagaatcatcatgtttcaaatcaacctggcggcagcgcaaaagatg

SEQ ID NO: 43423 - DNA, 103 bp, Artificial Sequence
  Synthetic Polynucleotide
taatacgactcactatagggtagacttctcacaaatggatttgaaaatcgaacagaggagacgatttatgaatccatttaacctggcggcagcgcaaaagatg

SEQ ID NO: 43424 - DNA, 103 bp, Artificial Sequence
  Synthetic Polynucleotide
taatacgactcactatagggggcaatagacttctcacaaatggatttgaaaacagaggagattcaaaatgatttgtgagaacctggcggcagcgcaaaagatg

SEQ ID NO: 43425 - DNA, 103 bp, Artificial Sequence
  Synthetic Polynucleotide
taatacgactcactatagggtctaaggcaatagacttctcacaaatggataacagaggagaatccatatgtgagaagtcaacctggcggcagcgcaaaagatg

SEQ ID NO: 43426 - DNA, 103 bp, Artificial Sequence
  Synthetic Polynucleotide
taatacgactcactatagggctcgagtaattatggctgattatctgaataaacagaggagatattcaatgaatcagccaaacctggcggcagcgcaaaagatg

SEQ ID NO: 43427 - DNA, 103 bp, Artificial Sequence
  Synthetic Polynucleotide
taatacgactcactatagggaagtatctaaggcaatagacttctcacaaaaacagaggagatttgtgatgagtctattgaacctggcggcagcgcaaaagatg

SEQ ID NO: 43428 - DNA, 103 bp, Artificial Sequence
  Synthetic Polynucleotide
taatacgactcactatagggggaaaaagtatctaaggcaatagacttctcaacagaggagagagaagatgattgccttaaacctggcggcagcgcaaaagatg

SEQ ID NO: 43429 - DNA, 103 bp, Artificial Sequence
  Synthetic Polynucleotide
taatacgactcactatagggctacgggaaaaagtatctaaggcaatagacaacagaggagagtctatatgcttagatacaacctggcggcagcgcaaaagatg

SEQ ID NO: 43430 - DNA, 103 bp, Artificial Sequence
  Synthetic Polynucleotide
taatacgactcactatagggctcgactacgggaaaaagtatctaaggcaaaacagaggagattgcctatgatactttttaacctggcggcagcgcaaaagatg

SEQ ID NO: 43431 - DNA, 103 bp, Artificial Sequence
  Synthetic Polynucleotide
taatacgactcactatagggtaaacctcgactacgggaaaaagtatctaaaacagaggagattagatatgttttcccgtaacctggcggcagcgcaaaagatg

SEQ ID NO: 43432 - DNA, 103 bp, Artificial Sequence
  Synthetic Polynucleotide
taatacgactcactatagggttctttaaacctcgactacgggaaaaagtaaacagaggagatactttatgccgtagtcgaacctggcggcagcgcaaaagatg

SEQ ID NO: 43433 - DNA, 103 bp, Artificial Sequence
  Synthetic Polynucleotide
taatacgactcactatagggcgtatttctttaaacctcgactacgggaaaaacagaggagatttcccatggtcgaggttaacctggcggcagcgcaaaagatg

SEQ ID NO: 43434 - DNA, 103 bp, Artificial Sequence
  Synthetic Polynucleotide
taatacgactcactataggggttagcgtatttctttaaacctcgactacgaacagaggagacgtagtatgggtttaaagaacctggcggcagcgcaaaagatg

SEQ ID NO: 43435 - DNA, 103 bp, Artificial Sequence
  Synthetic Polynucleotide
taatacgactcactatagggataccgttagcgtatttctttaaacctcgaaacagaggagatcgaggatgaaagaaataaacctggcggcagcgcaaaagatg

SEQ ID NO: 43436 - DNA, 103 bp, Artificial Sequence
  Synthetic Polynucleotide
taatacgactcactatagggctagtataccgttagcgtatttctttaaacaacagaggagagtttaaatgaatacgctaaacctggcggcagcgcaaaagatg

SEQ ID NO: 43437 - DNA, 103 bp, Artificial Sequence
  Synthetic Polynucleotide
taatacgactcactatagggttgcactcgagtaattatggctgattatctaacagaggagaagataaatggccataattaacctggcggcagcgcaaaagatg

SEQ ID NO: 43438 - DNA, 103 bp, Artificial Sequence
  Synthetic Polynucleotide
taatacgactcactatagggacctactagtataccgttagcgtatttcttaacagaggagaaagaaaatggctaacggtaacctggcggcagcgcaaaagatg

SEQ ID NO: 43439 - DNA, 103 bp, Artificial Sequence
  Synthetic Polynucleotide
taatacgactcactataggggagttacctactagtataccgttagcgtataacagaggagaatacgcatgcggtatactaacctggcggcagcgcaaaagatg

SEQ ID NO: 43440 - DNA, 103 bp, Artificial Sequence
  Synthetic Polynucleotide
taatacgactcactatagggtctttgagttacctactagtataccgttagaacagaggagactaacgatgtactagtagaacctggcggcagcgcaaaagatg

SEQ ID NO: 43441 - DNA, 103 bp, Artificial Sequence
  Synthetic Polynucleotide
taatacgactcactatagggtgatgtctttgagttacctactagtataccaacagaggagaggtataatggtaggtaacaacctggcggcagcgcaaaagatg

SEQ ID NO: 43442 - DNA, 103 bp, Artificial Sequence
  Synthetic Polynucleotide
taatacgactcactatagggatatatgatgtctttgagttacctactagtaacagaggagaactagtatgtaactcaaaaacctggcggcagcgcaaaagatg

SEQ ID NO: 43443 - DNA, 103 bp, Artificial Sequence
  Synthetic Polynucleotide
taatacgactcactatagggattctatatatgatgtctttgagttacctaaacagaggagataggtaatgcaaagacataacctggcggcagcgcaaaagatg

SEQ ID NO: 43444 - DNA, 103 bp, Artificial Sequence
  Synthetic Polynucleotide
taatacgactcactatagggttatcattctatatatgatgtctttgagttaacagaggagaaactcaatgacatcatataacctggcggcagcgcaaaagatg

SEQ ID NO: 43445 - DNA, 103 bp, Artificial Sequence
  Synthetic Polynucleotide
taatacgactcactatagggacgcgttatcattctatatatgatgtctttaacagaggagaaaagacatgatatatagaaacctggcggcagcgcaaaagatg

SEQ ID NO: 43446 - DNA, 103 bp, Artificial Sequence
  Synthetic Polynucleotide
taatacgactcactatagggtaaagacgcgttatcattctatatatgatgaacagaggagacatcatatgtagaatgataacctggcggcagcgcaaaagatg

SEQ ID NO: 43447 - DNA, 103 bp, Artificial Sequence
  Synthetic Polynucleotide
taatacgactcactatagggtgagttaaagacgcgttatcattctatataaacagaggagatatataatgtgataacgcaacctggcggcagcgcaaaagatg

SEQ ID NO: 43448 - DNA, 103 bp, Artificial Sequence
  Synthetic Polynucleotide
taatacgactcactatagggacacgttgcactcgagtaattatggctgataacagaggagaatcagcatgaattactcgaacctggcggcagcgcaaaagatg

SEQ ID NO: 43449 - DNA, 103 bp, Artificial Sequence
  Synthetic Polynucleotide
taatacgactcactatagggaccgatgagttaaagacgcgttatcattctaacagaggagaagaatgatgacgcgtcttaacctggcggcagcgcaaaagatg

SEQ ID NO: 43450 - DNA, 103 bp, Artificial Sequence
  Synthetic Polynucleotide
taatacgactcactatagggagttaaccgatgagttaaagacgcgttatcaacagaggagagataacatgtctttaactaacctggcggcagcgcaaaagatg

SEQ ID NO: 43451 - DNA, 103 bp, Artificial Sequence
  Synthetic Polynucleotide
taatacgactcactataggggaaagagttaaccgatgagttaaagacgcgaacagaggagacgcgtcatgaactcatcgaacctggcggcagcgcaaaagatg

SEQ ID NO: 43452 - DNA, 103 bp, Artificial Sequence
  Synthetic Polynucleotide
taatacgactcactatagggcaaaagaaagagttaaccgatgagttaaagaacagaggagactttaaatgatcggttaaaacctggcggcagcgcaaaagatg

SEQ ID NO: 43453 - DNA, 103 bp, Artificial Sequence
  Synthetic Polynucleotide
taatacgactcactatagggtcgatcaaaagaaagagttaaccgatgagtaacagaggagaactcatatgttaactcttaacctggcggcagcgcaaaagatg

SEQ ID NO: 43454 - DNA, 103 bp, Artificial Sequence
  Synthetic Polynucleotide
taatacgactcactatagggcgaactcgatcaaaagaaagagttaaccgaaacagaggagatcggttatgtctttctttaacctggcggcagcgcaaaagatg

SEQ ID NO: 43455 - DNA, 103 bp, Artificial Sequence
  Synthetic Polynucleotide
taatacgactcactatagggagcgacgaactcgatcaaaagaaagagttaaacagaggagataactcatgcttttgatcaacctggcggcagcgcaaaagatg

SEQ ID NO: 43456 - DNA, 103 bp, Artificial Sequence
  Synthetic Polynucleotide
taatacgactcactatagggatagtagcgacgaactcgatcaaaagaaagaacagaggagactttctatggatcgagttaacctggcggcagcgcaaaagatg

SEQ ID NO: 43457 - DNA, 103 bp, Artificial Sequence
  Synthetic Polynucleotide
taatacgactcactatagggacccaatagtagcgacgaactcgatcaaaaaacagaggagattttgaatgagttcgtcgaacctggcggcagcgcaaaagatg

SEQ ID NO: 43458 - DNA, 103 bp, Artificial Sequence
  Synthetic Polynucleotide
taatacgactcactatagggagcagacccaatagtagcgacgaactcgataacagaggagaatcgagatggtcgctactaacctggcggcagcgcaaaagatg

SEQ ID NO: 43459 - DNA, 103 bp, Artificial Sequence
  Synthetic Polynucleotide
taatacgactcactataggggcgagttgaaggagttctcggattcacttcaacagaggagagaagtgatgccgagaactaacctggcggcagcgcaaaagatg

SEQ ID NO: 43460 - DNA, 103 bp, Artificial Sequence
  Synthetic Polynucleotide
taatacgactcactatagggatctaacacgttgcactcgagtaattatggaacagaggagaccataaatgctcgagtgcaacctggcggcagcgcaaaagatg

SEQ ID NO: 43461 - DNA, 103 bp, Artificial Sequence
  Synthetic Polynucleotide
taatacgactcactatagggacctgagcagacccaatagtagcgacgaacaacagaggagagttcgtatgtactattggaacctggcggcagcgcaaaagatg

SEQ ID NO: 43462 - DNA, 103 bp, Artificial Sequence
  Synthetic Polynucleotide
taatacgactcactataggggaggcacctgagcagacccaatagtagcgaaacagaggagatcgctaatgttgggtctgaacctggcggcagcgcaaaagatg

SEQ ID NO: 43463 - DNA, 103 bp, Artificial Sequence
  Synthetic Polynucleotide
taatacgactcactataggggagtcgaggcacctgagcagacccaatagtaacagaggagaactattatgtctgctcagaacctggcggcagcgcaaaagatg

SEQ ID NO: 43464 - DNA, 103 bp, Artificial Sequence
  Synthetic Polynucleotide
taatacgactcactatagggtagtagagtcgaggcacctgagcagacccaaacagaggagatgggtcatgtcaggtgccaacctggcggcagcgcaaaagatg

SEQ ID NO: 43465 - DNA, 103 bp, Artificial Sequence
  Synthetic Polynucleotide
taatacgactcactatagggggaactagtagagtcgaggcacctgagcagaacagaggagactgctcatgtgcctcgacaacctggcggcagcgcaaaagatg

SEQ ID NO: 43466 - DNA, 103 bp, Artificial Sequence
  Synthetic Polynucleotide
taatacgactcactatagggatgttggaactagtagagtcgaggcacctgaacagaggagacaggtgatgcgactctacaacctggcggcagcgcaaaagatg

SEQ ID NO: 43467 - DNA, 103 bp, Artificial Sequence
  Synthetic Polynucleotide
taatacgactcactataggggtatgatgttggaactagtagagtcgaggcaacagaggagagcctcgatgctactagttaacctggcggcagcgcaaaagatg

SEQ ID NO: 43468 - DNA, 103 bp, Artificial Sequence
  Synthetic Polynucleotide
taatacgactcactatagggtattggtatgatgttggaactagtagagtcaacagaggagagactctatgagttccaacaacctggcggcagcgcaaaagatg

SEQ ID NO: 43469 - DNA, 103 bp, Artificial Sequence
  Synthetic Polynucleotide
taatacgactcactatagggattcctattggtatgatgttggaactagtaaacagaggagatactagatgcaacatcataacctggcggcagcgcaaaagatg

SEQ ID NO: 43470 - DNA, 103 bp, Artificial Sequence
  Synthetic Polynucleotide
taatacgactcactatagggcttgtattcctattggtatgatgttggaacaacagaggagagttccaatgtcataccaaaacctggcggcagcgcaaaagatg

SEQ ID NO: 43471 - DNA, 103 bp, Artificial Sequence
  Synthetic Polynucleotide
taatacgactcactatagggagacgatctaacacgttgcactcgagtaataacagaggagaattactatggtgcaacgtaacctggcggcagcgcaaaagatg

SEQ ID NO: 43472 - DNA, 103 bp, Artificial Sequence
  Synthetic Polynucleotide
taatacgactcactatagggagtgtcttgtattcctattggtatgatgttaacagaggagaaacatcatgccaataggaaacctggcggcagcgcaaaagatg

SEQ ID NO: 43473 - DNA, 103 bp, Artificial Sequence
  Synthetic Polynucleotide
taatacgactcactatagggggcaaagtgtcttgtattcctattggtatgaacagaggagacataccatgaggaatacaaacctggcggcagcgcaaaagatg

SEQ ID NO: 43474 - DNA, 103 bp, Artificial Sequence
  Synthetic Polynucleotide
taatacgactcactatagggccgctggcaaagtgtcttgtattcctattgaacagaggagacaatagatgtacaagacaaacctggcggcagcgcaaaagatg

SEQ ID NO: 43475 - DNA, 103 bp, Artificial Sequence
  Synthetic Polynucleotide
taatacgactcactatagggtacaaccgctggcaaagtgtcttgtattccaacagaggagaggaataatggacactttgaacctggcggcagcgcaaaagatg

SEQ ID NO: 43476 - DNA, 103 bp, Artificial Sequence
  Synthetic Polynucleotide
taatacgactcactatagggaaatctacaaccgctggcaaagtgtcttgtaacagaggagaacaagaatgtttgccagcaacctggcggcagcgcaaaagatg

SEQ ID NO: 43477 - DNA, 103 bp, Artificial Sequence
  Synthetic Polynucleotide
taatacgactcactatagggatgataaatctacaaccgctggcaaagtgtaacagaggagaacacttatgcagcggttgaacctggcggcagcgcaaaagatg

SEQ ID NO: 43478 - DNA, 103 bp, Artificial Sequence
  Synthetic Polynucleotide
taatacgactcactataggggaaatatgataaatctacaaccgctggcaaaacagaggagattgccaatggttgtagataacctggcggcagcgcaaaagatg

SEQ ID NO: 43479 - DNA, 103 bp, Artificial Sequence
  Synthetic Polynucleotide
taatacgactcactataggggtggagaaatatgataaatctacaaccgctaacagaggagaagcggtatgagatttatcaacctggcggcagcgcaaaagatg

SEQ ID NO: 43480 - DNA, 103 bp, Artificial Sequence
  Synthetic Polynucleotide
taatacgactcactatagggatgtagtggagaaatatgataaatctacaaaacagaggagattgtagatgtatcatattaacctggcggcagcgcaaaagatg

SEQ ID NO: 43481 - DNA, 103 bp, Artificial Sequence
  Synthetic Polynucleotide
taatacgactcactatagggcggatatgtagtggagaaatatgataaatcaacagaggagagatttaatgtatttctccaacctggcggcagcgcaaaagatg

SEQ ID NO: 43482 - DNA, 103 bp, Artificial Sequence
  Synthetic Polynucleotide
taatacgactcactatagggtatatagacgatctaacacgttgcactcgaaacagaggagatcgagtatgacgtgttagaacctggcggcagcgcaaaagatg

SEQ ID NO: 43483 - DNA, 103 bp, Artificial Sequence
  Synthetic Polynucleotide
taatacgactcactatagggtgtaacggatatgtagtggagaaatatgataacagaggagaatcataatgctccactacaacctggcggcagcgcaaaagatg

SEQ ID NO: 43484 - DNA, 103 bp, Artificial Sequence
  Synthetic Polynucleotide
taatacgactcactatagggcaaattgtaacggatatgtagtggagaaataacagaggagaatttctatgctacatatcaacctggcggcagcgcaaaagatg

SEQ ID NO: 43485 - DNA, 103 bp, Artificial Sequence
  Synthetic Polynucleotide
taatacgactcactatagggcttaacaaattgtaacggatatgtagtggaaacagaggagatccactatgtatccgttaaacctggcggcagcgcaaaagatg

SEQ ID NO: 43486 - DNA, 103 bp, Artificial Sequence
  Synthetic Polynucleotide
taatacgactcactatagggaaattcttaacaaattgtaacggatatgtaaacagaggagatacataatggttacaattaacctggcggcagcgcaaaagatg

SEQ ID NO: 43487 - DNA, 103 bp, Artificial Sequence
  Synthetic Polynucleotide
taatacgactcactatagggtatctaaattcttaacaaattgtaacggataacagaggagaatccgtatgaatttgttaaacctggcggcagcgcaaaagatg

SEQ ID NO: 43488 - DNA, 103 bp, Artificial Sequence
  Synthetic Polynucleotide
taatacgactcactatagggagatgtatctaaattcttaacaaattgtaaaacagaggagattacaaatggttaagaataacctggcggcagcgcaaaagatg

SEQ ID NO: 43489 - DNA, 103 bp, Artificial Sequence
  Synthetic Polynucleotide
taatacgactcactatagggaatatagatgtatctaaattcttaacaaataacagaggagaatttgtatggaatttagaaacctggcggcagcgcaaaagatg

SEQ ID NO: 43490 - DNA, 103 bp, Artificial Sequence
  Synthetic Polynucleotide
taatacgactcactataggggtagcaatatagatgtatctaaattcttaaaacagaggagattaagaatgtagatacataacctggcggcagcgcaaaagatg

SEQ ID NO: 43491 - DNA, 103 bp, Artificial Sequence
  Synthetic Polynucleotide
taatacgactcactatagggattatgtagcaatatagatgtatctaaattaacagaggagaaatttaatgacatctataaacctggcggcagcgcaaaagatg

SEQ ID NO: 43492 - DNA, 103 bp, Artificial Sequence
  Synthetic Polynucleotide
taatacgactcactataggggctggattatgtagcaatatagatgtatctaacagaggagaagatacatgtatattgctaacctggcggcagcgcaaaagatg

SEQ ID NO: 43493 - DNA, 103 bp, Artificial Sequence
  Synthetic Polynucleotide
taatacgactcactatagggattcatatatagacgatctaacacgttgcaaacagaggagatgcaacatgttagatcgtaacctggcggcagcgcaaaagatg

SEQ ID NO: 43494 - DNA, 103 bp, Artificial Sequence
  Synthetic Polynucleotide
taatacgactcactatagggcactagctggattatgtagcaatatagatgaacagaggagacatctaatgtgctacataaacctggcggcagcgcaaaagatg

SEQ ID NO: 43495 - DNA, 103 bp, Artificial Sequence
  Synthetic Polynucleotide
taatacgactcactatagggatattcactagctggattatgtagcaatataacagaggagaatattgatgcataatccaaacctggcggcagcgcaaaagatg

SEQ ID NO: 43496 - DNA, 103 bp, Artificial Sequence
  Synthetic Polynucleotide
taatacgactcactatagggcatatatattcactagctggattatgtagcaacagaggagagctacaatgtccagctagaacctggcggcagcgcaaaagatg

SEQ ID NO: 43497 - DNA, 103 bp, Artificial Sequence
  Synthetic Polynucleotide
taatacgactcactatagggtatgtcatatatattcactagctggattataacagaggagaataatcatgctagtgaataacctggcggcagcgcaaaagatg

SEQ ID NO: 43498 - DNA, 103 bp, Artificial Sequence
  Synthetic Polynucleotide
taatacgactcactatagggtttattatgtcatatatattcactagctggaacagaggagaccagctatggaatatataaacctggcggcagcgcaaaagatg

SEQ ID NO: 43499 - DNA, 103 bp, Artificial Sequence
  Synthetic Polynucleotide
taatacgactcactatagggaccaatttattatgtcatatatattcactaaacagaggagatagtgaatgtatatgacaaacctggcggcagcgcaaaagatg

SEQ ID NO: 43500 - DNA, 103 bp, Artificial Sequence
  Synthetic Polynucleotide
taatacgactcactataggggatttaccaatttattatgtcatatatattaacagaggagaaatataatggacataataaacctggcggcagcgcaaaagatg

SEQ ID NO: 43501 - DNA, 103 bp, Artificial Sequence
  Synthetic Polynucleotide
taatacgactcactatagggactaggatttaccaatttattatgtcatataacagaggagaatatgaatgaataaattgaacctggcggcagcgcaaaagatg

SEQ ID NO: 43502 - DNA, 103 bp, Artificial Sequence
  Synthetic Polynucleotide
taatacgactcactatagggccagaactaggatttaccaatttattatgtaacagaggagaacataaatgattggtaaaaacctggcggcagcgcaaaagatg

SEQ ID NO: 43503 - DNA, 103 bp, Artificial Sequence
  Synthetic Polynucleotide
taatacgactcactatagggaaataccagaactaggatttaccaatttataacagaggagaataaatatgtaaatcctaaacctggcggcagcgcaaaagatg

SEQ ID NO: 43504 - DNA, 103 bp, Artificial Sequence
  Synthetic Polynucleotide
taatacgactcactatagggtgcttattcatatatagacgatctaacacgaacagaggagacgtgttatgtcgtctataaacctggcggcagcgcaaaagatg

SEQ ID NO: 43505 - DNA, 103 bp, Artificial Sequence
  Synthetic Polynucleotide
taatacgactcactatagggtagtaaaataccagaactaggatttaccaaaacagaggagattggtaatgcctagttctaacctggcggcagcgcaaaagatg

SEQ ID NO: 43506 - DNA, 103 bp, Artificial Sequence
  Synthetic Polynucleotide
taatacgactcactataggggtaattagtaaaataccagaactaggatttaacagaggagaaaatccatgttctggtataacctggcggcagcgcaaaagatg

SEQ ID NO: 43507 - DNA, 103 bp, Artificial Sequence
  Synthetic Polynucleotide
taatacgactcactatagggatttagtaattagtaaaataccagaactagaacagaggagactagttatggtattttacaacctggcggcagcgcaaaagatg

SEQ ID NO: 43508 - DNA, 103 bp, Artificial Sequence
  Synthetic Polynucleotide
taatacgactcactatagggtacagatttagtaattagtaaaataccagaaacagaggagatctggtatgttactaattaacctggcggcagcgcaaaagatg

SEQ ID NO: 43509 - DNA, 103 bp, Artificial Sequence
  Synthetic Polynucleotide
taatacgactcactatagggagatatacagatttagtaattagtaaaataaacagaggagatattttatgaattactaaaacctggcggcagcgcaaaagatg

SEQ ID NO: 43510 - DNA, 103 bp, Artificial Sequence
  Synthetic Polynucleotide
taatacgactcactatagggtggaaagatatacagatttagtaattagtaaacagaggagatactaaatgctaaatctgaacctggcggcagcgcaaaagatg

SEQ ID NO: 43511 - DNA, 103 bp, Artificial Sequence
  Synthetic Polynucleotide
taatacgactcactatagggataaatggaaagatatacagatttagtaataacagaggagaattactatgtctgtatataacctggcggcagcgcaaaagatg

SEQ ID NO: 43512 - DNA, 103 bp, Artificial Sequence
  Synthetic Polynucleotide
taatacgactcactatagggccatgataaatggaaagatatacagatttaaacagaggagataaatcatgatatctttcaacctggcggcagcgcaaaagatg

SEQ ID NO: 43513 - DNA, 103 bp, Artificial Sequence
  Synthetic Polynucleotide
taatacgactcactatagggcttttccatgataaatggaaagatatacagaacagaggagactgtatatgtttccatttaacctggcggcagcgcaaaagatg

SEQ ID NO: 43514 - DNA, 103 bp, Artificial Sequence
  Synthetic Polynucleotide
taatacgactcactatagggaaattcttttccatgataaatggaaagataaacagaggagatatcttatgatttatcataacctggcggcagcgcaaaagatg

SEQ ID NO: 43515 - DNA, 103 bp, Artificial Sequence
  Synthetic Polynucleotide
taatacgactcactatagggaacactgcttattcatatatagacgatctaaacagaggagatagatcatgtatatatgaaacctggcggcagcgcaaaagatg

SEQ ID NO: 43516 - DNA, 103 bp, Artificial Sequence
  Synthetic Polynucleotide
taatacgactcactatagggctggtaaattcttttccatgataaatggaaaacagaggagattccatatgtcatggaaaaacctggcggcagcgcaaaagatg

SEQ ID NO: 43517 - DNA, 103 bp, Artificial Sequence
  Synthetic Polynucleotide
taatacgactcactataggggatatctggtaaattcttttccatgataaaaacagaggagatttatcatggaaaagaataacctggcggcagcgcaaaagatg

SEQ ID NO: 43518 - DNA, 103 bp, Artificial Sequence
  Synthetic Polynucleotide
taatacgactcactatagggaagaagatatctggtaaattcttttccatgaacagaggagacatggaatggaatttaccaacctggcggcagcgcaaaagatg

SEQ ID NO: 43519 - DNA, 103 bp, Artificial Sequence
  Synthetic Polynucleotide
taatacgactcactataggggaaaaaagaagatatctggtaaattcttttaacagaggagaaaaagaatgtaccagataaacctggcggcagcgcaaaagatg

SEQ ID NO: 43520 - DNA, 103 bp, Artificial Sequence
  Synthetic Polynucleotide
taatacgactcactataggggtttggaaaaaagaagatatctggtaaattaacagaggagaaatttaatggatatcttcaacctggcggcagcgcaaaagatg

SEQ ID NO: 43521 - DNA, 103 bp, Artificial Sequence
  Synthetic Polynucleotide
taatacgactcactatagggacgcagtttggaaaaaagaagatatctggtaacagaggagaaccagaatgcttctttttaacctggcggcagcgcaaaagatg

SEQ ID NO: 43522 - DNA, 103 bp, Artificial Sequence
  Synthetic Polynucleotide
taatacgactcactatagggcattaacgcagtttggaaaaaagaagatataacagaggagaatatctatgtttttccaaaacctggcggcagcgcaaaagatg

SEQ ID NO: 43523 - DNA, 103 bp, Artificial Sequence
  Synthetic Polynucleotide
taatacgactcactataggggaatacattaacgcagtttggaaaaaagaaaacagaggagattctttatgccaaactgcaacctggcggcagcgcaaaagatg

SEQ ID NO: 43524 - DNA, 103 bp, Artificial Sequence
  Synthetic Polynucleotide
taatacgactcactatagggtaagagaatacattaacgcagtttggaaaaaacagaggagattttccatgctgcgttaaaacctggcggcagcgcaaaagatg

SEQ ID NO: 43525 - DNA, 103 bp, Artificial Sequence
  Synthetic Polynucleotide
taatacgactcactatagggatttgtaagagaatacattaacgcagtttgaacagaggagacaaactatgttaatgtataacctggcggcagcgcaaaagatg

SEQ ID NO: 43526 - DNA, 103 bp, Artificial Sequence
  Synthetic Polynucleotide
taatacgactcactatagggtagataacactgcttattcatatatagacgaacagaggagacgtctaatgatgaataagaacctggcggcagcgcaaaagatg

SEQ ID NO: 43527 - DNA, 103 bp, Artificial Sequence
  Synthetic Polynucleotide
taatacgactcactatagggtgaatatttgtaagagaatacattaacgcaaacagaggagatgcgttatggtattctctaacctggcggcagcgcaaaagatg

SEQ ID NO: 43528 - DNA, 103 bp, Artificial Sequence
  Synthetic Polynucleotide
taatacgactcactatagggtcttgtgaatatttgtaagagaatacattaaacagaggagataatgtatgctcttacaaaacctggcggcagcgcaaaagatg

SEQ ID NO: 43529 - DNA, 103 bp, Artificial Sequence
  Synthetic Polynucleotide
taatacgactcactatagggattcatcttgtgaatatttgtaagagaataaacagaggagatattctatgacaaatattaacctggcggcagcgcaaaagatg

SEQ ID NO: 43530 - DNA, 103 bp, Artificial Sequence
  Synthetic Polynucleotide
taatacgactcactatagggactaaattcatcttgtgaatatttgtaagaaacagaggagatcttacatgtattcacaaaacctggcggcagcgcaaaagatg

SEQ ID NO: 43531 - DNA, 103 bp, Artificial Sequence
  Synthetic Polynucleotide
taatacgactcactatagggatattactaaattcatcttgtgaatatttgaacagaggagacaaataatgacaagatgaaacctggcggcagcgcaaaagatg

SEQ ID NO: 43532 - DNA, 103 bp, Artificial Sequence
  Synthetic Polynucleotide
taatacgactcactatagggtactcatattactaaattcatcttgtgaataacagaggagaattcacatgatgaatttaaacctggcggcagcgcaaaagatg

SEQ ID NO: 43533 - DNA, 103 bp, Artificial Sequence
  Synthetic Polynucleotide
taatacgactcactatagggcatgttactcatattactaaattcatcttgaacagaggagacaagatatgtttagtaataacctggcggcagcgcaaaagatg

SEQ ID NO: 43534 - DNA, 103 bp, Artificial Sequence
  Synthetic Polynucleotide
taatacgactcactatagggcgttccatgttactcatattactaaattcaaacagaggagatgaattatgtaatatgagaacctggcggcagcgcaaaagatg

SEQ ID NO: 43535 - DNA, 103 bp, Artificial Sequence
  Synthetic Polynucleotide
taatacgactcactatagggtatcacgttccatgttactcatattactaaaacagaggagattagtaatgtgagtaacaaacctggcggcagcgcaaaagatg

SEQ ID NO: 43536 - DNA, 103 bp, Artificial Sequence
  Synthetic Polynucleotide
taatacgactcactataggggaaactatcacgttccatgttactcatattaacagaggagaaatatgatgaacatggaaaacctggcggcagcgcaaaagatg

SEQ ID NO: 43537 - DNA, 103 bp, Artificial Sequence
  Synthetic Polynucleotide
taatacgactcactatagggaggaatagataacactgcttattcatatataacagaggagaatatatatgtaagcagtgaacctggcggcagcgcaaaagatg

SEQ ID NO: 43538 - DNA, 103 bp, Artificial Sequence
  Synthetic Polynucleotide
taatacgactcactatagggaaagagaaactatcacgttccatgttactcaacagaggagagagtaaatgggaacgtgaaacctggcggcagcgcaaaagatg

SEQ ID NO: 43539 - DNA, 103 bp, Artificial Sequence
  Synthetic Polynucleotide
taatacgactcactatagggccgccaaagagaaactatcacgttccatgtaacagaggagaacatggatggtgatagttaacctggcggcagcgcaaaagatg

SEQ ID NO: 43540 - DNA, 103 bp, Artificial Sequence
  Synthetic Polynucleotide
taatacgactcactatagggaaacaccgccaaagagaaactatcacgttcaacagaggagagaacgtatgagtttctctaacctggcggcagcgcaaaagatg

SEQ ID NO: 43541 - DNA, 103 bp, Artificial Sequence
  Synthetic Polynucleotide
taatacgactcactatagggactggaaacaccgccaaagagaaactatcaaacagaggagatgatagatgctctttggcaacctggcggcagcgcaaaagatg

SEQ ID NO: 43542 - DNA, 103 bp, Artificial Sequence
  Synthetic Polynucleotide
taatacgactcactatagggttataactggaaacaccgccaaagagaaacaacagaggagagtttctatgtggcggtgtaacctggcggcagcgcaaaagatg

SEQ ID NO: 43543 - DNA, 103 bp, Artificial Sequence
  Synthetic Polynucleotide
taatacgactcactatagggatgttttataactggaaacaccgccaaagaaacagaggagatctttgatggtgtttccaaacctggcggcagcgcaaaagatg

SEQ ID NO: 43544 - DNA, 103 bp, Artificial Sequence
  Synthetic Polynucleotide
taatacgactcactatagggcatctatgttttataactggaaacaccgccaacagaggagaggcggtatgtccagttataacctggcggcagcgcaaaagatg

SEQ ID NO: 43545 - DNA, 103 bp, Artificial Sequence
  Synthetic Polynucleotide
taatacgactcactatagggtatgccatctatgttttataactggaaacaaacagaggagatgtttcatgttataaaacaacctggcggcagcgcaaaagatg

SEQ ID NO: 43546 - DNA, 103 bp, Artificial Sequence
  Synthetic Polynucleotide
taatacgactcactatagggtgcgttatgccatctatgttttataactggaacagaggagaccagttatgaaacatagaaacctggcggcagcgcaaaagatg

SEQ ID NO: 43547 - DNA, 103 bp, Artificial Sequence
  Synthetic Polynucleotide
taatacgactcactatagggacgtgtgcgttatgccatctatgttttataaacagaggagatataaaatgtagatggcaaacctggcggcagcgcaaaagatg

SEQ ID NO: 43548 - DNA, 103 bp, Artificial Sequence
  Synthetic Polynucleotide
taatacgactcactatagggatgaaaggaatagataacactgcttattcaaacagaggagatgaataatgagtgttatcaacctggcggcagcgcaaaagatg

SEQ ID NO: 43549 - DNA, 103 bp, Artificial Sequence
  Synthetic Polynucleotide
taatacgactcactatagggttacaacgtgtgcgttatgccatctatgttaacagaggagaaacataatgggcataacgaacctggcggcagcgcaaaagatg

SEQ ID NO: 43550 - DNA, 103 bp, Artificial Sequence
  Synthetic Polynucleotide
taatacgactcactatagggatgttttacaacgtgtgcgttatgccatctaacagaggagaagatggatgaacgcacacaacctggcggcagcgcaaaagatg

SEQ ID NO: 43551 - DNA, 103 bp, Artificial Sequence
  Synthetic Polynucleotide
taatacgactcactatagggcctttatgttttacaacgtgtgcgttatgcaacagaggagagcataaatgacacgttgtaacctggcggcagcgcaaaagatg

SEQ ID NO: 43552 - DNA, 103 bp, Artificial Sequence
  Synthetic Polynucleotide
taatacgactcactatagggatattcctttatgttttacaacgtgtgcgtaacagaggagaacgcacatgttgtaaaacaacctggcggcagcgcaaaagatg

SEQ ID NO: 43553 - DNA, 103 bp, Artificial Sequence
  Synthetic Polynucleotide
taatacgactcactatagggtttgtatattcctttatgttttacaacgtgaacagaggagacacgttatgaaacataaaaacctggcggcagcgcaaaagatg

SEQ ID NO: 43554 - DNA, 103 bp, Artificial Sequence
  Synthetic Polynucleotide
taatacgactcactatagggctaactttgtatattcctttatgttttacaaacagaggagatgtaaaatgtaaaggaataacctggcggcagcgcaaaagatg

SEQ ID NO: 43555 - DNA, 103 bp, Artificial Sequence
  Synthetic Polynucleotide
taatacgactcactatagggctgtactaactttgtatattcctttatgttaacagaggagaaacataatggaatatacaaacctggcggcagcgcaaaagatg

SEQ ID NO: 43556 - DNA, 103 bp, Artificial Sequence
  Synthetic Polynucleotide
taatacgactcactatagggtgcttctgtactaactttgtatattcctttaacagaggagaaaaggaatgtacaaagttaacctggcggcagcgcaaaagatg

SEQ ID NO: 43557 - DNA, 103 bp, Artificial Sequence
  Synthetic Polynucleotide
taatacgactcactatagggccatgtgcttctgtactaactttgtatattaacagaggagaaatataatgagttagtacaacctggcggcagcgcaaaagatg

SEQ ID NO: 43558 - DNA, 103 bp, Artificial Sequence
  Synthetic Polynucleotide
taatacgactcactatagggtttttccatgtgcttctgtactaactttgtaacagaggagaacaaagatggtacagaagaacctggcggcagcgcaaaagatg

SEQ ID NO: 43559 - DNA, 103 bp, Artificial Sequence
  Synthetic Polynucleotide
taatacgactcactatagggtgttaatgaaaggaatagataacactgcttaacagaggagaaagcagatgtatctattcaacctggcggcagcgcaaaagatg

SEQ ID NO: 43560 - DNA, 103 bp, Artificial Sequence
  Synthetic Polynucleotide
taatacgactcactatagggtactttttttccatgtgcttctgtactaacaacagaggagagttagtatggaagcacataacctggcggcagcgcaaaagatg

SEQ ID NO: 43561 - DNA, 103 bp, Artificial Sequence
  Synthetic Polynucleotide
taatacgactcactatagggggagatactttttttccatgtgcttctgtaaacagaggagatacagaatgacatggaaaaacctggcggcagcgcaaaagatg

SEQ ID NO: 43562 - DNA, 103 bp, Artificial Sequence
  Synthetic Polynucleotide
taatacgactcactatagggatggaggagatactttttttccatgtgcttaacagaggagaaagcacatggaaaaaaagaacctggcggcagcgcaaaagatg

SEQ ID NO: 43563 - DNA, 103 bp, Artificial Sequence
  Synthetic Polynucleotide
taatacgactcactatagggtagtgatggaggagatactttttttccatgaacagaggagacatggaatgaaagtatctaacctggcggcagcgcaaaagatg

SEQ ID NO: 43564 - DNA, 103 bp, Artificial Sequence
  Synthetic Polynucleotide
taatacgactcactatagggtttcctagtgatggaggagatactttttttaacagaggagaaaaaaaatgatctcctccaacctggcggcagcgcaaaagatg

SEQ ID NO: 43565 - DNA, 103 bp, Artificial Sequence
  Synthetic Polynucleotide
taatacgactcactatagggagggttttcctagtgatggaggagatacttaacagaggagaaagtatatgctccatcacaacctggcggcagcgcaaaagatg

SEQ ID NO: 43566 - DNA, 103 bp, Artificial Sequence
  Synthetic Polynucleotide
taatacgactcactataggggtgtgagggttttcctagtgatggaggagaaacagaggagatctcctatgtcactaggaaacctggcggcagcgcaaaagatg

SEQ ID NO: 43567 - DNA, 103 bp, Artificial Sequence
  Synthetic Polynucleotide
taatacgactcactatagggtttatgtgtgagggttttcctagtgatggaaacagaggagatccatcatgaggaaaaccaacctggcggcagcgcaaaagatg

SEQ ID NO: 43568 - DNA, 103 bp, Artificial Sequence
  Synthetic Polynucleotide
taatacgactcactatagggttaggtttatgtgtgagggttttcctagtgaacagaggagacactagatgaaccctcacaacctggcggcagcgcaaaagatg

SEQ ID NO: 43569 - DNA, 103 bp, Artificial Sequence
  Synthetic Polynucleotide
taatacgactcactatagggcgcggttaggtttatgtgtgagggttttccaacagaggagaggaaaaatgtcacacataaacctggcggcagcgcaaaagatg

SEQ ID NO: 43570 - DNA, 103 bp, Artificial Sequence
  Synthetic Polynucleotide
taatacgactcactatagggtggtagcgagttgaaggagttctcggattcaacagaggagagaatccatgaactccttcaacctggcggcagcgcaaaagatg

SEQ ID NO: 43571 - DNA, 103 bp, Artificial Sequence
  Synthetic Polynucleotide
taatacgactcactatagggtaaattgttaatgaaaggaatagataacacaacagaggagagtgttaatgattcctttcaacctggcggcagcgcaaaagatg

SEQ ID NO: 43572 - DNA, 103 bp, Artificial Sequence
  Synthetic Polynucleotide
taatacgactcactatagggtgcttcgcggttaggtttatgtgtgagggtaacagaggagaaccctcatgcataaacctaacctggcggcagcgcaaaagatg

SEQ ID NO: 43573 - DNA, 103 bp, Artificial Sequence
  Synthetic Polynucleotide
taatacgactcactatagggtatattgcttcgcggttaggtttatgtgtgaacagaggagacacacaatgacctaaccgaacctggcggcagcgcaaaagatg

SEQ ID NO: 43574 - DNA, 103 bp, Artificial Sequence
  Synthetic Polynucleotide
taatacgactcactataggggtatatatattgcttcgcggttaggtttataacagaggagaataaacatgaccgcgaagaacctggcggcagcgcaaaagatg

SEQ ID NO: 43575 - DNA, 103 bp, Artificial Sequence
  Synthetic Polynucleotide
taatacgactcactatagggtcactgtatatatattgcttcgcggttaggaacagaggagacctaacatggaagcaataaacctggcggcagcgcaaaagatg

SEQ ID NO: 43576 - DNA, 103 bp, Artificial Sequence
  Synthetic Polynucleotide
taatacgactcactatagggtgtgttcactgtatatatattgcttcgcggaacagaggagaccgcgaatgaatatatataacctggcggcagcgcaaaagatg

SEQ ID NO: 43577 - DNA, 103 bp, Artificial Sequence
  Synthetic Polynucleotide
taatacgactcactatagggtattgtgtgttcactgtatatatattgcttaacagaggagaaagcaaatgatatacagtaacctggcggcagcgcaaaagatg

SEQ ID NO: 43578 - DNA, 103 bp, Artificial Sequence
  Synthetic Polynucleotide
taatacgactcactatagggaagcttattgtgtgttcactgtatatatataacagaggagaatatatatgcagtgaacaaacctggcggcagcgcaaaagatg

SEQ ID NO: 43579 - DNA, 103 bp, Artificial Sequence
  Synthetic Polynucleotide
taatacgactcactatagggattcaaagcttattgtgtgttcactgtataaacagaggagatatacaatgaacacacaaaacctggcggcagcgcaaaagatg

SEQ ID NO: 43580 - DNA, 103 bp, Artificial Sequence
  Synthetic Polynucleotide
taatacgactcactatagggataacattcaaagcttattgtgtgttcactaacagaggagaagtgaaatgacaataagcaacctggcggcagcgcaaaagatg

SEQ ID NO: 43581 - DNA, 103 bp, Artificial Sequence
  Synthetic Polynucleotide
taatacgactcactatagggaaactataacattcaaagcttattgtgtgtaacagaggagaacacacatgaagctttgaaacctggcggcagcgcaaaagatg

SEQ ID NO: 43582 - DNA, 103 bp, Artificial Sequence
  Synthetic Polynucleotide
taatacgactcactatagggatcgttaaattgttaatgaaaggaatagataacagaggagaatctatatgtttcattaaaacctggcggcagcgcaaaagatg

SEQ ID NO: 43583 - DNA, 103 bp, Artificial Sequence
  Synthetic Polynucleotide
taatacgactcactatagggttagaaaactataacattcaaagcttattgaacagaggagacaataaatgttgaatgttaacctggcggcagcgcaaaagatg

SEQ ID NO: 43584 - DNA, 103 bp, Artificial Sequence
  Synthetic Polynucleotide
taatacgactcactatagggacattttagaaaactataacattcaaagctaacagaggagaagctttatgtgttatagtaacctggcggcagcgcaaaagatg

SEQ ID NO: 43585 - DNA, 103 bp, Artificial Sequence
  Synthetic Polynucleotide
taatacgactcactataggggttatacattttagaaaactataacattcaaacagaggagatgaatgatgtagttttctaacctggcggcagcgcaaaagatg

SEQ ID NO: 43586 - DNA, 103 bp, Artificial Sequence
  Synthetic Polynucleotide
taatacgactcactatagggcatttgttatacattttagaaaactataacaacagaggagagttataatgttctaaaataacctggcggcagcgcaaaagatg

SEQ ID NO: 43587 - DNA, 103 bp, Artificial Sequence
  Synthetic Polynucleotide
taatacgactcactatagggttctgcatttgttatacattttagaaaactaacagaggagaagttttatgaaatgtataaacctggcggcagcgcaaaagatg

SEQ ID NO: 43588 - DNA, 103 bp, Artificial Sequence
  Synthetic Polynucleotide
taatacgactcactatagggttaatttctgcatttgttatacattttagaaacagaggagatctaaaatgtataacaaaaacctggcggcagcgcaaaagatg

SEQ ID NO: 43589 - DNA, 103 bp, Artificial Sequence
  Synthetic Polynucleotide
taatacgactcactatagggacgaattaatttctgcatttgttatacattaacagaggagaaatgtaatgcaaatgcagaacctggcggcagcgcaaaagatg

SEQ ID NO: 43590 - DNA, 103 bp, Artificial Sequence
  Synthetic Polynucleotide
taatacgactcactatagggatcgaacgaattaatttctgcatttgttataacagaggagaataacaatggcagaaattaacctggcggcagcgcaaaagatg

SEQ ID NO: 43591 - DNA, 103 bp, Artificial Sequence
  Synthetic Polynucleotide
taatacgactcactatagggtactcatcgaacgaattaatttctgcatttaacagaggagaaaatgcatgaattaattcaacctggcggcagcgcaaaagatg

SEQ ID NO: 43592 - DNA, 103 bp, Artificial Sequence
  Synthetic Polynucleotide
taatacgactcactatagggatatatactcatcgaacgaattaatttctgaacagaggagacagaaaatgattcgttcgaacctggcggcagcgcaaaagatg

SEQ ID NO: 43593 - DNA, 103 bp, Artificial Sequence
  Synthetic Polynucleotide
taatacgactcactatagggtagacatcgttaaattgttaatgaaaggaaaacagaggagattccttatgttaacaattaacctggcggcagcgcaaaagatg

SEQ ID NO: 43594 - DNA, 103 bp, Artificial Sequence
  Synthetic Polynucleotide
taatacgactcactatagggtcttaatatatactcatcgaacgaattaataacagaggagaattaatatgttcgatgagaacctggcggcagcgcaaaagatg

SEQ ID NO: 43595 - DNA, 103 bp, Artificial Sequence
  Synthetic Polynucleotide
taatacgactcactatagggagtcctcttaatatatactcatcgaacgaaaacagaggagattcgttatgtgagtatataacctggcggcagcgcaaaagatg

SEQ ID NO: 43596 - DNA, 103 bp, Artificial Sequence
  Synthetic Polynucleotide
taatacgactcactatagggctaatagtcctcttaatatatactcatcgaaacagaggagatcgatgatgatatattaaaacctggcggcagcgcaaaagatg

SEQ ID NO: 43597 - DNA, 103 bp, Artificial Sequence
  Synthetic Polynucleotide
taatacgactcactatagggagcttctaatagtcctcttaatatatactcaacagaggagagagtatatgttaagaggaaacctggcggcagcgcaaaagatg

SEQ ID NO: 43598 - DNA, 103 bp, Artificial Sequence
  Synthetic Polynucleotide
taatacgactcactatagggttaccagcttctaatagtcctcttaatataaacagaggagatatattatgaggactattaacctggcggcagcgcaaaagatg

SEQ ID NO: 43599 - DNA, 103 bp, Artificial Sequence
  Synthetic Polynucleotide
taatacgactcactatagggaactattaccagcttctaatagtcctcttaaacagaggagataagagatgtattagaagaacctggcggcagcgcaaaagatg

SEQ ID NO: 43600 - DNA, 103 bp, Artificial Sequence
  Synthetic Polynucleotide
taatacgactcactatagggctgtaaactattaccagcttctaatagtccaacagaggagaggactaatggaagctggtaacctggcggcagcgcaaaagatg

SEQ ID NO: 43601 - DNA, 103 bp, Artificial Sequence
  Synthetic Polynucleotide
taatacgactcactatagggaatatctgtaaactattaccagcttctaataacagaggagaattagaatgtggtaatagaacctggcggcagcgcaaaagatg

SEQ ID NO: 43602 - DNA, 103 bp, Artificial Sequence
  Synthetic Polynucleotide
taatacgactcactatagggtggaaaatatctgtaaactattaccagcttaacagaggagaaagctgatgatagtttacaacctggcggcagcgcaaaagatg

SEQ ID NO: 43603 - DNA, 103 bp, Artificial Sequence
  Synthetic Polynucleotide
taatacgactcactatagggggaattggaaaatatctgtaaactattaccaacagaggagaggtaatatgttacagataaacctggcggcagcgcaaaagatg

SEQ ID NO: 43604 - DNA, 103 bp, Artificial Sequence
  Synthetic Polynucleotide
taatacgactcactatagggagatatagacatcgttaaattgttaatgaaaacagaggagattcattatgaatttaacgaacctggcggcagcgcaaaagatg

SEQ ID NO: 43605 - DNA, 103 bp, Artificial Sequence
  Synthetic Polynucleotide
taatacgactcactatagggcctacggaattggaaaatatctgtaaactaaacagaggagatagtttatggatattttcaacctggcggcagcgcaaaagatg

SEQ ID NO: 43606 - DNA, 103 bp, Artificial Sequence
  Synthetic Polynucleotide
taatacgactcactataggggtttacctacggaattggaaaatatctgtaaacagaggagatacagaatgtttccaattaacctggcggcagcgcaaaagatg

SEQ ID NO: 43607 - DNA, 103 bp, Artificial Sequence
  Synthetic Polynucleotide
taatacgactcactatagggtgttcgtttacctacggaattggaaaatataacagaggagaatatttatgaattccgtaaacctggcggcagcgcaaaagatg

SEQ ID NO: 43608 - DNA, 103 bp, Artificial Sequence
  Synthetic Polynucleotide
taatacgactcactataggggtatctgttcgtttacctacggaattggaaaacagaggagattccaaatgcgtaggtaaaacctggcggcagcgcaaaagatg

SEQ ID NO: 43609 - DNA, 103 bp, Artificial Sequence
  Synthetic Polynucleotide
taatacgactcactatagggctatagtatctgttcgtttacctacggaataacagaggagaattccgatggtaaacgaaaacctggcggcagcgcaaaagatg

SEQ ID NO: 43610 - DNA, 103 bp, Artificial Sequence
  Synthetic Polynucleotide
taatacgactcactatagggtacacctatagtatctgttcgtttacctacaacagaggagagtaggtatgcgaacagataacctggcggcagcgcaaaagatg

SEQ ID NO: 43611 - DNA, 103 bp, Artificial Sequence
  Synthetic Polynucleotide
taatacgactcactatagggcctagtacacctatagtatctgttcgtttaaacagaggagataaacgatgagatactataacctggcggcagcgcaaaagatg

SEQ ID NO: 43612 - DNA, 103 bp, Artificial Sequence
  Synthetic Polynucleotide
taatacgactcactatagggtattccctagtacacctatagtatctgttcaacagaggagagaacagatgctataggtgaacctggcggcagcgcaaaagatg

SEQ ID NO: 43613 - DNA, 103 bp, Artificial Sequence
  Synthetic Polynucleotide
taatacgactcactatagggatacttattccctagtacacctatagtatcaacagaggagagatactatgggtgtactaaacctggcggcagcgcaaaagatg

SEQ ID NO: 43614 - DNA, 103 bp, Artificial Sequence
  Synthetic Polynucleotide
taatacgactcactatagggaatggatacttattccctagtacacctataaacagaggagatataggatgactagggaaaacctggcggcagcgcaaaagatg

SEQ ID NO: 43615 - DNA, 103 bp, Artificial Sequence
  Synthetic Polynucleotide
taatacgactcactatagggcatatagatatagacatcgttaaattgttaaacagaggagataacaaatgaacgatgtcaacctggcggcagcgcaaaagatg

SEQ ID NO: 43616 - DNA, 103 bp, Artificial Sequence
  Synthetic Polynucleotide
taatacgactcactatagggtgctaaatggatacttattccctagtacacaacagaggagagtgtacatgggaataagtaacctggcggcagcgcaaaagatg

SEQ ID NO: 43617 - DNA, 103 bp, Artificial Sequence
  Synthetic Polynucleotide
taatacgactcactatagggaattttgctaaatggatacttattccctagaacagaggagactagggatgaagtatccaaacctggcggcagcgcaaaagatg

SEQ ID NO: 43618 - DNA, 103 bp, Artificial Sequence
  Synthetic Polynucleotide
taatacgactcactatagggaatggaattttgctaaatggatacttattcaacagaggagagaataaatgtccatttagaacctggcggcagcgcaaaagatg

SEQ ID NO: 43619 - DNA, 103 bp, Artificial Sequence
  Synthetic Polynucleotide
taatacgactcactatagggaggccaatggaattttgctaaatggatactaacagaggagaagtatcatgttagcaaaaaacctggcggcagcgcaaaagatg

SEQ ID NO: 43620 - DNA, 103 bp, Artificial Sequence
  Synthetic Polynucleotide
taatacgactcactatagggtaatgaggccaatggaattttgctaaatggaacagaggagaccatttatgaaaattccaaacctggcggcagcgcaaaagatg

SEQ ID NO: 43621 - DNA, 103 bp, Artificial Sequence
  Synthetic Polynucleotide
taatacgactcactatagggggagttaatgaggccaatggaattttgctaaacagaggagatagcaaatgtccattggcaacctggcggcagcgcaaaagatg

SEQ ID NO: 43622 - DNA, 103 bp, Artificial Sequence
  Synthetic Polynucleotide
taatacgactcactatagggctttaggagttaatgaggccaatggaatttaacagaggagaaaattcatgtggcctcataacctggcggcagcgcaaaagatg

SEQ ID NO: 43623 - DNA, 103 bp, Artificial Sequence
  Synthetic Polynucleotide
taatacgactcactatagggttgtgctttaggagttaatgaggccaatggaacagaggagaccattgatgtcattaactaacctggcggcagcgcaaaagatg

SEQ ID NO: 43624 - DNA, 103 bp, Artificial Sequence
  Synthetic Polynucleotide
taatacgactcactatagggtctcgttgtgctttaggagttaatgaggccaacagaggagaggcctcatgaactcctaaaacctggcggcagcgcaaaagatg

SEQ ID NO: 43625 - DNA, 103 bp, Artificial Sequence
  Synthetic Polynucleotide
taatacgactcactatagggatatctctcgttgtgctttaggagttaatgaacagaggagacattaaatgctaaagcacaacctggcggcagcgcaaaagatg

SEQ ID NO: 43626 - DNA, 103 bp, Artificial Sequence
  Synthetic Polynucleotide
taatacgactcactatagggcatctcatatagatatagacatcgttaaataacagaggagaatttaaatgtgtctatataacctggcggcagcgcaaaagatg

SEQ ID NO: 43627 - DNA, 103 bp, Artificial Sequence
  Synthetic Polynucleotide
taatacgactcactatagggtgaaaatatctctcgttgtgctttaggagtaacagaggagaactcctatggcacaacgaaacctggcggcagcgcaaaagatg

SEQ ID NO: 43628 - DNA, 103 bp, Artificial Sequence
  Synthetic Polynucleotide
taatacgactcactatagggcatgctgaaaatatctctcgttgtgctttaaacagaggagataaagcatgacgagagataacctggcggcagcgcaaaagatg

SEQ ID NO: 43629 - DNA, 103 bp, Artificial Sequence
  Synthetic Polynucleotide
taatacgactcactatagggaaatccatgctgaaaatatctctcgttgtgaacagaggagacacaacatgagatattttaacctggcggcagcgcaaaagatg

SEQ ID NO: 43630 - DNA, 103 bp, Artificial Sequence
  Synthetic Polynucleotide
taatacgactcactatagggatgagaaatccatgctgaaaatatctctcgaacagaggagacgagagatgttttcagcaaacctggcggcagcgcaaaagatg

SEQ ID NO: 43631 - DNA, 103 bp, Artificial Sequence
  Synthetic Polynucleotide
taatacgactcactatagggggtctatgagaaatccatgctgaaaatatcaacagaggagagatattatgagcatggataacctggcggcagcgcaaaagatg

SEQ ID NO: 43632 - DNA, 103 bp, Artificial Sequence
  Synthetic Polynucleotide
taatacgactcactatagggctacgggtctatgagaaatccatgctgaaaaacagaggagatttcagatgggatttctcaacctggcggcagcgcaaaagatg

SEQ ID NO: 43633 - DNA, 103 bp, Artificial Sequence
  Synthetic Polynucleotide
taatacgactcactatagggtaaaactacgggtctatgagaaatccatgcaacagaggagagcatggatgtctcatagaaacctggcggcagcgcaaaagatg

SEQ ID NO: 43634 - DNA, 103 bp, Artificial Sequence
  Synthetic Polynucleotide
taatacgactcactatagggccagttaaaactacgggtctatgagaaatcaacagaggagagatttcatgtagacccgtaacctggcggcagcgcaaaagatg

SEQ ID NO: 43635 - DNA, 103 bp, Artificial Sequence
  Synthetic Polynucleotide
taatacgactcactatagggttcctccagttaaaactacgggtctatgagaacagaggagactcataatgccgtagtttaacctggcggcagcgcaaaagatg

SEQ ID NO: 43636 - DNA, 103 bp, Artificial Sequence
  Synthetic Polynucleotide
taatacgactcactatagggtccggttcctccagttaaaactacgggtctaacagaggagaagacccatggttttaactaacctggcggcagcgcaaaagatg

SEQ ID NO: 43637 - DNA, 103 bp, Artificial Sequence
  Synthetic Polynucleotide
taatacgactcactatagggtaagtcatctcatatagatatagacatcgtaacagaggagaacgatgatgatatctataaacctggcggcagcgcaaaagatg

SEQ ID NO: 43638 - DNA, 103 bp, Artificial Sequence
  Synthetic Polynucleotide
taatacgactcactatagggcccactccggttcctccagttaaaactacgaacagaggagacgtagtatgaactggaggaacctggcggcagcgcaaaagatg

SEQ ID NO: 43639 - DNA, 103 bp, Artificial Sequence
  Synthetic Polynucleotide
taatacgactcactatagggtcttacccactccggttcctccagttaaaaaacagaggagattttaaatggaggaaccgaacctggcggcagcgcaaaagatg

SEQ ID NO: 43640 - DNA, 103 bp, Artificial Sequence
  Synthetic Polynucleotide
taatacgactcactatagggtgacgtcttacccactccggttcctccagtaacagaggagaactggaatgaccggagtgaacctggcggcagcgcaaaagatg

SEQ ID NO: 43641 - DNA, 103 bp, Artificial Sequence
  Synthetic Polynucleotide
taatacgactcactatagggacctgtgacgtcttacccactccggttcctaacagaggagaaggaacatgagtgggtaaaacctggcggcagcgcaaaagatg

SEQ ID NO: 43642 - DNA, 103 bp, Artificial Sequence
  Synthetic Polynucleotide
taatacgactcactatagggtgggtacctgtgacgtcttacccactccggaacagaggagaccggagatggtaagacgtaacctggcggcagcgcaaaagatg

SEQ ID NO: 43643 - DNA, 103 bp, Artificial Sequence
  Synthetic Polynucleotide
taatacgactcactatagggtaacttgggtacctgtgacgtcttacccacaacagaggagagtgggtatgacgtcacagaacctggcggcagcgcaaaagatg

SEQ ID NO: 43644 - DNA, 103 bp, Artificial Sequence
  Synthetic Polynucleotide
taatacgactcactatagggagcaataacttgggtacctgtgacgtcttaaacagaggagataagacatgacaggtaccaacctggcggcagcgcaaaagatg

SEQ ID NO: 43645 - DNA, 103 bp, Artificial Sequence
  Synthetic Polynucleotide
taatacgactcactatagggaccaaagcaataacttgggtacctgtgacgaacagaggagacgtcacatgtacccaagtaacctggcggcagcgcaaaagatg

SEQ ID NO: 43646 - DNA, 103 bp, Artificial Sequence
  Synthetic Polynucleotide
taatacgactcactatagggattaaaccaaagcaataacttgggtacctgaacagaggagacaggtaatgaagttattgaacctggcggcagcgcaaaagatg

SEQ ID NO: 43647 - DNA, 103 bp, Artificial Sequence
  Synthetic Polynucleotide
taatacgactcactatagggaaataattaaaccaaagcaataacttgggtaacagaggagaacccaaatgattgctttgaacctggcggcagcgcaaaagatg

SEQ ID NO: 43648 - DNA, 103 bp, Artificial Sequence
  Synthetic Polynucleotide
taatacgactcactatagggtatattaagtcatctcatatagatatagacaacagaggagagtctatatgtatatgagaaacctggcggcagcgcaaaagatg

SEQ ID NO: 43649 - DNA, 103 bp, Artificial Sequence
  Synthetic Polynucleotide
taatacgactcactatagggcaaataaataattaaaccaaagcaataactaacagaggagaagttatatgtttggtttaaacctggcggcagcgcaaaagatg

SEQ ID NO: 43650 - DNA, 103 bp, Artificial Sequence
  Synthetic Polynucleotide
taatacgactcactatagggtccaccaaataaataattaaaccaaagcaaaacagaggagattgcttatgtttaattataacctggcggcagcgcaaaagatg

SEQ ID NO: 43651 - DNA, 103 bp, Artificial Sequence
  Synthetic Polynucleotide
taatacgactcactataggggagaatccaccaaataaataattaaaccaaaacagaggagattggttatgttatttattaacctggcggcagcgcaaaagatg

SEQ ID NO: 43652 - DNA, 103 bp, Artificial Sequence
  Synthetic Polynucleotide
taatacgactcactataggggagtagagaatccaccaaataaataattaaaacagaggagattaattatgtatttggtgaacctggcggcagcgcaaaagatg

SEQ ID NO: 43653 - DNA, 103 bp, Artificial Sequence
  Synthetic Polynucleotide
taatacgactcactatagggatctagagtagagaatccaccaaataaataaacagaggagatatttaatgggtggattcaacctggcggcagcgcaaaagatg

SEQ ID NO: 43654 - DNA, 103 bp, Artificial Sequence
  Synthetic Polynucleotide
taatacgactcactatagggattttatctagagtagagaatccaccaaataacagaggagaatttggatgattctctacaacctggcggcagcgcaaaagatg

SEQ ID NO: 43655 - DNA, 103 bp, Artificial Sequence
  Synthetic Polynucleotide
taatacgactcactatagggcagtgattttatctagagtagagaatccacaacagaggagagtggatatgctactctagaacctggcggcagcgcaaaagatg

SEQ ID NO: 43656 - DNA, 103 bp, Artificial Sequence
  Synthetic Polynucleotide
taatacgactcactatagggaaagtcagtgattttatctagagtagagaaaacagaggagattctctatgctagataaaaacctggcggcagcgcaaaagatg

SEQ ID NO: 43657 - DNA, 103 bp, Artificial Sequence
  Synthetic Polynucleotide
taatacgactcactatagggtcgtgaaagtcagtgattttatctagagtaaacagaggagatactctatgtaaaatcacaacctggcggcagcgcaaaagatg

SEQ ID NO: 43658 - DNA, 103 bp, Artificial Sequence
  Synthetic Polynucleotide
taatacgactcactataggggtctttcgtgaaagtcagtgattttatctaaacagaggagatagataatgtcactgactaacctggcggcagcgcaaaagatg

SEQ ID NO: 43659 - DNA, 103 bp, Artificial Sequence
  Synthetic Polynucleotide
taatacgactcactatagggaatattatattaagtcatctcatatagataaacagaggagatatctaatggagatgactaacctggcggcagcgcaaaagatg

SEQ ID NO: 43660 - DNA, 103 bp, Artificial Sequence
  Synthetic Polynucleotide
taatacgactcactataggggactggtctttcgtgaaagtcagtgattttaacagaggagaaaaatcatggactttcacaacctggcggcagcgcaaaagatg

SEQ ID NO: 43661 - DNA, 103 bp, Artificial Sequence
  Synthetic Polynucleotide
taatacgactcactatagggagaatgactggtctttcgtgaaagtcagtgaacagaggagacactgaatgtcacgaaagaacctggcggcagcgcaaaagatg

SEQ ID NO: 43662 - DNA, 103 bp, Artificial Sequence
  Synthetic Polynucleotide
taatacgactcactataggggagatagaatgactggtctttcgtgaaagtaacagaggagaactttcatgaaagaccagaacctggcggcagcgcaaaagatg

SEQ ID NO: 43663 - DNA, 103 bp, Artificial Sequence
  Synthetic Polynucleotide
taatacgactcactatagggaggaagagatagaatgactggtctttcgtgaacagaggagacacgaaatgccagtcattaacctggcggcagcgcaaaagatg

SEQ ID NO: 43664 - DNA, 103 bp, Artificial Sequence
  Synthetic Polynucleotide
taatacgactcactatagggatcctaggaagagatagaatgactggtcttaacagaggagaaagaccatgcattctatcaacctggcggcagcgcaaaagatg

SEQ ID NO: 43665 - DNA, 103 bp, Artificial Sequence
  Synthetic Polynucleotide
taatacgactcactatagggaagctatcctaggaagagatagaatgactgaacagaggagacagtcaatgtatctcttcaacctggcggcagcgcaaaagatg

SEQ ID NO: 43666 - DNA, 103 bp, Artificial Sequence
  Synthetic Polynucleotide
taatacgactcactatagggaactaaagctatcctaggaagagatagaataacagaggagaattctaatgcttcctaggaacctggcggcagcgcaaaagatg

SEQ ID NO: 43667 - DNA, 103 bp, Artificial Sequence
  Synthetic Polynucleotide
taatacgactcactatagggaatctaactaaagctatcctaggaagagataacagaggagaatctctatgtaggatagcaacctggcggcagcgcaaaagatg

SEQ ID NO: 43668 - DNA, 103 bp, Artificial Sequence
  Synthetic Polynucleotide
taatacgactcactatagggtatgcaatctaactaaagctatcctaggaaaacagaggagattcctaatgtagctttagaacctggcggcagcgcaaaagatg

SEQ ID NO: 43669 - DNA, 103 bp, Artificial Sequence
  Synthetic Polynucleotide
taatacgactcactatagggattgctatgcaatctaactaaagctatcctaacagaggagaaggataatgttagttagaaacctggcggcagcgcaaaagatg

SEQ ID NO: 43670 - DNA, 103 bp, Artificial Sequence
  Synthetic Polynucleotide
taatacgactcactatagggtcttcaatattatattaagtcatctcatataacagaggagaatatgaatggacttaataaacctggcggcagcgcaaaagatg

SEQ ID NO: 43671 - DNA, 103 bp, Artificial Sequence
  Synthetic Polynucleotide
taatacgactcactatagggatggtattgctatgcaatctaactaaagctaacagaggagaagctttatgtagattgcaaacctggcggcagcgcaaaagatg

SEQ ID NO: 43672 - DNA, 103 bp, Artificial Sequence
  Synthetic Polynucleotide
taatacgactcactatagggttaaaatggtattgctatgcaatctaactaaacagaggagatagttaatgtgcatagcaaacctggcggcagcgcaaaagatg

SEQ ID NO: 43673 - DNA, 103 bp, Artificial Sequence
  Synthetic Polynucleotide
taatacgactcactatagggtgattttaaaatggtattgctatgcaatctaacagaggagaagattgatgagcaataccaacctggcggcagcgcaaaagatg

SEQ ID NO: 43674 - DNA, 103 bp, Artificial Sequence
  Synthetic Polynucleotide
taatacgactcactatagggcccaatgattttaaaatggtattgctatgcaacagaggagagcatagatgtaccattttaacctggcggcagcgcaaaagatg

SEQ ID NO: 43675 - DNA, 103 bp, Artificial Sequence
  Synthetic Polynucleotide
taatacgactcactatagggtaaatcccaatgattttaaaatggtattgcaacagaggagagcaataatgttttaaaataacctggcggcagcgcaaaagatg

SEQ ID NO: 43676 - DNA, 103 bp, Artificial Sequence
  Synthetic Polynucleotide
taatacgactcactatagggtaccttaaatcccaatgattttaaaatggtaacagaggagaaccattatgaaatcattgaacctggcggcagcgcaaaagatg

SEQ ID NO: 43677 - DNA, 103 bp, Artificial Sequence
  Synthetic Polynucleotide
taatacgactcactatagggtctagtaccttaaatcccaatgattttaaaaacagaggagatttaaaatgattgggattaacctggcggcagcgcaaaagatg

SEQ ID NO: 43678 - DNA, 103 bp, Artificial Sequence
  Synthetic Polynucleotide
taatacgactcactatagggatccatctagtaccttaaatcccaatgattaacagaggagaaatcatatggatttaaggaacctggcggcagcgcaaaagatg

SEQ ID NO: 43679 - DNA, 103 bp, Artificial Sequence
  Synthetic Polynucleotide
taatacgactcactatagggaggagatccatctagtaccttaaatcccaaaacagaggagattgggaatgaaggtactaaacctggcggcagcgcaaaagatg

SEQ ID NO: 43680 - DNA, 103 bp, Artificial Sequence
  Synthetic Polynucleotide
taatacgactcactataggggaaataggagatccatctagtaccttaaataacagaggagaatttaaatgactagatggaacctggcggcagcgcaaaagatg

SEQ ID NO: 43681 - DNA, 103 bp, Artificial Sequence
  Synthetic Polynucleotide
taatacgactcactatagggctctttggtagcgagttgaaggagttctcgaacagaggagacgagaaatgcttcaactcaacctggcggcagcgcaaaagatg

SEQ ID NO: 43682 - DNA, 103 bp, Artificial Sequence
  Synthetic Polynucleotide
taatacgactcactatagggacagctcttcaatattatattaagtcatctaacagaggagaagatgaatgaatataataaacctggcggcagcgcaaaagatg

SEQ ID NO: 43683 - DNA, 103 bp, Artificial Sequence
  Synthetic Polynucleotide
taatacgactcactataggggtaaagaaataggagatccatctagtacctaacagaggagaaggtacatgatggatctcaacctggcggcagcgcaaaagatg

SEQ ID NO: 43684 - DNA, 103 bp, Artificial Sequence
  Synthetic Polynucleotide
taatacgactcactataggggtaccgtaaagaaataggagatccatctagaacagaggagactagatatgtctcctattaacctggcggcagcgcaaaagatg

SEQ ID NO: 43685 - DNA, 103 bp, Artificial Sequence
  Synthetic Polynucleotide
taatacgactcactataggggatccgtaccgtaaagaaataggagatccaaacagaggagatggatcatgtatttctttaacctggcggcagcgcaaaagatg

SEQ ID NO: 43686 - DNA, 103 bp, Artificial Sequence
  Synthetic Polynucleotide
taatacgactcactataggggtatagatccgtaccgtaaagaaataggagaacagaggagactcctaatgctttacggtaacctggcggcagcgcaaaagatg

SEQ ID NO: 43687 - DNA, 103 bp, Artificial Sequence
  Synthetic Polynucleotide
taatacgactcactatagggttccggtatagatccgtaccgtaaagaaataacagaggagaatttctatgcggtacggaaacctggcggcagcgcaaaagatg

SEQ ID NO: 43688 - DNA, 103 bp, Artificial Sequence
  Synthetic Polynucleotide
taatacgactcactatagggaattcttccggtatagatccgtaccgtaaaaacagaggagatttacgatgcggatctataacctggcggcagcgcaaaagatg

SEQ ID NO: 43689 - DNA, 103 bp, Artificial Sequence
  Synthetic Polynucleotide
taatacgactcactatagggttattaattcttccggtatagatccgtaccaacagaggagaggtacgatgctataccggaacctggcggcagcgcaaaagatg

SEQ ID NO: 43690 - DNA, 103 bp, Artificial Sequence
  Synthetic Polynucleotide
taatacgactcactatagggtttgtttattaattcttccggtatagatccaacagaggagaggatctatgccggaagaaaacctggcggcagcgcaaaagatg

SEQ ID NO: 43691 - DNA, 103 bp, Artificial Sequence
  Synthetic Polynucleotide
taatacgactcactatagggggttgtttgtttattaattcttccggtataaacagaggagatataccatgagaattaataacctggcggcagcgcaaaagatg

SEQ ID NO: 43692 - DNA, 103 bp, Artificial Sequence
  Synthetic Polynucleotide
taatacgactcactatagggtttttggttgtttgtttattaattcttccgaacagaggagacggaagatgtaataaacaaacctggcggcagcgcaaaagatg

SEQ ID NO: 43693 - DNA, 103 bp, Artificial Sequence
  Synthetic Polynucleotide
taatacgactcactatagggattgtacagctcttcaatattatattaagtaacagaggagaacttaaatgaatattgaaaacctggcggcagcgcaaaagatg

SEQ ID NO: 43694 - DNA, 103 bp, Artificial Sequence
  Synthetic Polynucleotide
taatacgactcactatagggatatttttttggttgtttgtttattaattcaacagaggagagaattaatgaacaaacaaaacctggcggcagcgcaaaagatg

SEQ ID NO: 43695 - DNA, 103 bp, Artificial Sequence
  Synthetic Polynucleotide
taatacgactcactatagggattccatatttttttggttgtttgtttattaacagaggagaaataaaatgacaaccaaaaacctggcggcagcgcaaaagatg

SEQ ID NO: 43696 - DNA, 103 bp, Artificial Sequence
  Synthetic Polynucleotide
taatacgactcactatagggatacaattccatatttttttggttgtttgtaacagaggagaacaaacatgcaaaaaaataacctggcggcagcgcaaaagatg

SEQ ID NO: 43697 - DNA, 103 bp, Artificial Sequence
  Synthetic Polynucleotide
taatacgactcactatagggagaaaatacaattccatatttttttggttgaacagaggagacaaccaatgaaatatggaaacctggcggcagcgcaaaagatg

SEQ ID NO: 43698 - DNA, 103 bp, Artificial Sequence
  Synthetic Polynucleotide
taatacgactcactatagggtgggtagaaaatacaattccatatttttttaacagaggagaaaaaaaatgtggaattgtaacctggcggcagcgcaaaagatg

SEQ ID NO: 43699 - DNA, 103 bp, Artificial Sequence
  Synthetic Polynucleotide
taatacgactcactatagggacttatgggtagaaaatacaattccatattaacagaggagaaatatgatgttgtattttaacctggcggcagcgcaaaagatg

SEQ ID NO: 43700 - DNA, 103 bp, Artificial Sequence
  Synthetic Polynucleotide
taatacgactcactatagggagataacttatgggtagaaaatacaattccaacagaggagaggaattatgttttctaccaacctggcggcagcgcaaaagatg

SEQ ID NO: 43701 - DNA, 103 bp, Artificial Sequence
  Synthetic Polynucleotide
taatacgactcactataggggttagagataacttatgggtagaaaatacaaacagaggagatgtattatgtacccataaaacctggcggcagcgcaaaagatg

SEQ ID NO: 43702 - DNA, 103 bp, Artificial Sequence
  Synthetic Polynucleotide
taatacgactcactataggggttttgttagagataacttatgggtagaaaaacagaggagatttctaatgataagttataacctggcggcagcgcaaaagatg

SEQ ID NO: 43703 - DNA, 103 bp, Artificial Sequence
  Synthetic Polynucleotide
taatacgactcactatagggaaatagttttgttagagataacttatgggtaacagaggagaacccatatgttatctctaaacctggcggcagcgcaaaagatg

SEQ ID NO: 43704 - DNA, 103 bp, Artificial Sequence
  Synthetic Polynucleotide
taatacgactcactatagggaaactattgtacagctcttcaatattatataacagaggagaatataaatgtgaagagctaacctggcggcagcgcaaaagatg

SEQ ID NO: 43705 - DNA, 103 bp, Artificial Sequence
  Synthetic Polynucleotide
taatacgactcactatagggtaactaaatagttttgttagagataacttaaacagaggagataagttatgtctaacaaaaacctggcggcagcgcaaaagatg

SEQ ID NO: 43706 - DNA, 103 bp, Artificial Sequence
  Synthetic Polynucleotide
taatacgactcactatagggtgccataactaaatagttttgttagagataaacagaggagatatctcatgcaaaactataacctggcggcagcgcaaaagatg

SEQ ID NO: 43707 - DNA, 103 bp, Artificial Sequence
  Synthetic Polynucleotide
taatacgactcactatagggaagagtgccataactaaatagttttgttagaacagaggagactaacaatgctatttagtaacctggcggcagcgcaaaagatg

SEQ ID NO: 43708 - DNA, 103 bp, Artificial Sequence
  Synthetic Polynucleotide
taatacgactcactatagggataataagagtgccataactaaatagttttaacagaggagaaaaactatgtagttatggaacctggcggcagcgcaaaagatg

SEQ ID NO: 43709 - DNA, 103 bp, Artificial Sequence
  Synthetic Polynucleotide
taatacgactcactatagggcgtctataataagagtgccataactaaataaacagaggagatatttaatgatggcactcaacctggcggcagcgcaaaagatg

SEQ ID NO: 43710 - DNA, 103 bp, Artificial Sequence
  Synthetic Polynucleotide
taatacgactcactatagggaacttcgtctataataagagtgccataactaacagaggagaagttatatgactcttattaacctggcggcagcgcaaaagatg

SEQ ID NO: 43711 - DNA, 103 bp, Artificial Sequence
  Synthetic Polynucleotide
taatacgactcactatagggtcatgaacttcgtctataataagagtgccaaacagaggagatggcacatgtattatagaaacctggcggcagcgcaaaagatg

SEQ ID NO: 43712 - DNA, 103 bp, Artificial Sequence
  Synthetic Polynucleotide
taatacgactcactatagggcatgctcatgaacttcgtctataataagagaacagaggagactcttaatgtagacgaagaacctggcggcagcgcaaaagatg

SEQ ID NO: 43713 - DNA, 103 bp, Artificial Sequence
  Synthetic Polynucleotide
taatacgactcactatagggttgatcatgctcatgaacttcgtctataataacagaggagaattataatggaagttcataacctggcggcagcgcaaaagatg

SEQ ID NO: 43714 - DNA, 103 bp, Artificial Sequence
  Synthetic Polynucleotide
taatacgactcactatagggcctatttgatcatgctcatgaacttcgtctaacagaggagaagacgaatgtcatgagcaaacctggcggcagcgcaaaagatg

SEQ ID NO: 43715 - DNA, 103 bp, Artificial Sequence
  Synthetic Polynucleotide
taatacgactcactataggggataaaaactattgtacagctcttcaatataacagaggagaatattgatgagctgtacaaacctggcggcagcgcaaaagatg

SEQ ID NO: 43716 - DNA, 103 bp, Artificial Sequence
  Synthetic Polynucleotide
taatacgactcactatagggtatctcctatttgatcatgctcatgaacttaacagaggagaaagttcatgagcatgatcaacctggcggcagcgcaaaagatg

SEQ ID NO: 43717 - DNA, 103 bp, Artificial Sequence
  Synthetic Polynucleotide
taatacgactcactatagggaataatatctcctatttgatcatgctcatgaacagaggagacatgagatggatcaaataaacctggcggcagcgcaaaagatg

SEQ ID NO: 43718 - DNA, 103 bp, Artificial Sequence
  Synthetic Polynucleotide
taatacgactcactataggggctataataatatctcctatttgatcatgcaacagaggagagcatgaatgaataggagaaacctggcggcagcgcaaaagatg

SEQ ID NO: 43719 - DNA, 103 bp, Artificial Sequence
  Synthetic Polynucleotide
taatacgactcactatagggctactgctataataatatctcctatttgataacagaggagaatcaaaatggagatattaaacctggcggcagcgcaaaagatg

SEQ ID NO: 43720 - DNA, 103 bp, Artificial Sequence
  Synthetic Polynucleotide
taatacgactcactatagggtctcgctactgctataataatatctcctataacagaggagaataggaatgattattataaacctggcggcagcgcaaaagatg

SEQ ID NO: 43721 - DNA, 103 bp, Artificial Sequence
  Synthetic Polynucleotide
taatacgactcactatagggtgctttctcgctactgctataataatatctaacagaggagaagatatatgtatagcagtaacctggcggcagcgcaaaagatg

SEQ ID NO: 43722 - DNA, 103 bp, Artificial Sequence
  Synthetic Polynucleotide
taatacgactcactatagggtatgatgctttctcgctactgctataataaaacagaggagattattaatgcagtagcgaaacctggcggcagcgcaaaagatg

SEQ ID NO: 43723 - DNA, 103 bp, Artificial Sequence
  Synthetic Polynucleotide
taatacgactcactatagggtttcgtatgatgctttctcgctactgctataacagaggagaatagcaatggcgagaaagaacctggcggcagcgcaaaagatg

SEQ ID NO: 43724 - DNA, 103 bp, Artificial Sequence
  Synthetic Polynucleotide
taatacgactcactatagggtctattttcgtatgatgctttctcgctactaacagaggagaagtagcatgaaagcatcaaacctggcggcagcgcaaaagatg

SEQ ID NO: 43725 - DNA, 103 bp, Artificial Sequence
  Synthetic Polynucleotide
taatacgactcactatagggtagaatctattttcgtatgatgctttctcgaacagaggagacgagaaatgatcatacgaaacctggcggcagcgcaaaagatg

SEQ ID NO: 43726 - DNA, 103 bp, Artificial Sequence
  Synthetic Polynucleotide
taatacgactcactatagggctatagataaaaactattgtacagctcttcaacagaggagagaagagatgtacaatagtaacctggcggcagcgcaaaagatg

SEQ ID NO: 43727 - DNA, 103 bp, Artificial Sequence
  Synthetic Polynucleotide
taatacgactcactatagggaaacatagaatctattttcgtatgatgcttaacagaggagaaagcatatgacgaaaataaacctggcggcagcgcaaaagatg

SEQ ID NO: 43728 - DNA, 103 bp, Artificial Sequence
  Synthetic Polynucleotide
taatacgactcactatagggattaaaaacatagaatctattttcgtatgaaacagaggagatcatacatgaatagattcaacctggcggcagcgcaaaagatg

SEQ ID NO: 43729 - DNA, 103 bp, Artificial Sequence
  Synthetic Polynucleotide
taatacgactcactatagggcagtcattaaaaacatagaatctattttcgaacagaggagacgaaaaatgattctatgtaacctggcggcagcgcaaaagatg

SEQ ID NO: 43730 - DNA, 103 bp, Artificial Sequence
  Synthetic Polynucleotide
taatacgactcactatagggcgtggcagtcattaaaaacatagaatctataacagaggagaatagatatgatgtttttaaacctggcggcagcgcaaaagatg

SEQ ID NO: 43731 - DNA, 103 bp, Artificial Sequence
  Synthetic Polynucleotide
taatacgactcactatagggtctaacgtggcagtcattaaaaacatagaaaacagaggagattctatatgtttaatgacaacctggcggcagcgcaaaagatg

SEQ ID NO: 43732 - DNA, 103 bp, Artificial Sequence
  Synthetic Polynucleotide
taatacgactcactatagggcatcctctaacgtggcagtcattaaaaacaaacagaggagatgttttatgtgactgccaaacctggcggcagcgcaaaagatg

SEQ ID NO: 43733 - DNA, 103 bp, Artificial Sequence
  Synthetic Polynucleotide
taatacgactcactatagggcctgtcatcctctaacgtggcagtcattaaaacagaggagattaatgatggccacgttaaacctggcggcagcgcaaaagatg

SEQ ID NO: 43734 - DNA, 103 bp, Artificial Sequence
  Synthetic Polynucleotide
taatacgactcactatagggcgttccctgtcatcctctaacgtggcagtcaacagaggagagactgcatggttagaggaaacctggcggcagcgcaaaagatg

SEQ ID NO: 43735 - DNA, 103 bp, Artificial Sequence
  Synthetic Polynucleotide
taatacgactcactatagggttagccgttccctgtcatcctctaacgtggaacagaggagaccacgtatgaggatgacaaacctggcggcagcgcaaaagatg

SEQ ID NO: 43736 - DNA, 103 bp, Artificial Sequence
  Synthetic Polynucleotide
taatacgactcactatagggtacttttagccgttccctgtcatcctctaaaacagaggagattagagatggacagggaaaacctggcggcagcgcaaaagatg

SEQ ID NO: 43737 - DNA, 103 bp, Artificial Sequence
  Synthetic Polynucleotide
taatacgactcactataggggtcttctatagataaaaactattgtacagcaacagaggagagctgtaatgtagtttttaaacctggcggcagcgcaaaagatg

SEQ ID NO: 43738 - DNA, 103 bp, Artificial Sequence
  Synthetic Polynucleotide
taatacgactcactatagggaaaaatacttttagccgttccctgtcatccaacagaggagaggatgaatgggaacggctaacctggcggcagcgcaaaagatg

SEQ ID NO: 43739 - DNA, 103 bp, Artificial Sequence
  Synthetic Polynucleotide
taatacgactcactatagggtaggtaaaaatacttttagccgttccctgtaacagaggagaacagggatgggctaaaagaacctggcggcagcgcaaaagatg

SEQ ID NO: 43740 - DNA, 103 bp, Artificial Sequence
  Synthetic Polynucleotide
taatacgactcactataggggggattaggtaaaaatacttttagccgttcaacagaggagagaacggatgaaagtatttaacctggcggcagcgcaaaagatg

SEQ ID NO: 43741 - DNA, 103 bp, Artificial Sequence
  Synthetic Polynucleotide
taatacgactcactatagggaatgcgggattaggtaaaaatacttttagcaacagaggagagctaaaatgatttttaccaacctggcggcagcgcaaaagatg

SEQ ID NO: 43742 - DNA, 103 bp, Artificial Sequence
  Synthetic Polynucleotide
taatacgactcactataggggtataaatgcgggattaggtaaaaatacttaacagaggagaaagtatatgtacctaatcaacctggcggcagcgcaaaagatg

SEQ ID NO: 43743 - DNA, 103 bp, Artificial Sequence
  Synthetic Polynucleotide
taatacgactcactatagggaatatgtataaatgcgggattaggtaaaaaaacagaggagatttttaatgaatcccgcaaacctggcggcagcgcaaaagatg

SEQ ID NO: 43744 - DNA, 103 bp, Artificial Sequence
  Synthetic Polynucleotide
taatacgactcactatagggccaggaatatgtataaatgcgggattaggtaacagaggagaacctaaatgcgcatttataacctggcggcagcgcaaaagatg

SEQ ID NO: 43745 - DNA, 103 bp, Artificial Sequence
  Synthetic Polynucleotide
taatacgactcactatagggtatctccaggaatatgtataaatgcgggataacagaggagaatcccgatgttatacataaacctggcggcagcgcaaaagatg

SEQ ID NO: 43746 - DNA, 103 bp, Artificial Sequence
  Synthetic Polynucleotide
taatacgactcactatagggcagtgtatctccaggaatatgtataaatgcaacagaggagagcatttatgcatattcctaacctggcggcagcgcaaaagatg

SEQ ID NO: 43747 - DNA, 103 bp, Artificial Sequence
  Synthetic Polynucleotide
taatacgactcactatagggttaaacagtgtatctccaggaatatgtataaacagaggagatatacaatgtcctggagaaacctggcggcagcgcaaaagatg

SEQ ID NO: 43748 - DNA, 103 bp, Artificial Sequence
  Synthetic Polynucleotide
taatacgactcactatagggaagccgtcttctatagataaaaactattgtaacagaggagaacaataatgtttatctataacctggcggcagcgcaaaagatg

SEQ ID NO: 43749 - DNA, 103 bp, Artificial Sequence
  Synthetic Polynucleotide
taatacgactcactatagggtaattttaaacagtgtatctccaggaatataacagaggagaatattcatggagatacacaacctggcggcagcgcaaaagatg

SEQ ID NO: 43750 - DNA, 103 bp, Artificial Sequence
  Synthetic Polynucleotide
taatacgactcactatagggctcgctaattttaaacagtgtatctccaggaacagaggagacctggaatgacactgtttaacctggcggcagcgcaaaagatg

SEQ ID NO: 43751 - DNA, 103 bp, Artificial Sequence
  Synthetic Polynucleotide
taatacgactcactatagggaatacctcgctaattttaaacagtgtatctaacagaggagaagatacatggtttaaaataacctggcggcagcgcaaaagatg

SEQ ID NO: 43752 - DNA, 103 bp, Artificial Sequence
  Synthetic Polynucleotide
taatacgactcactataggggaataaatacctcgctaattttaaacagtgaacagaggagacactgtatgaaattagcgaacctggcggcagcgcaaaagatg

SEQ ID NO: 43753 - DNA, 103 bp, Artificial Sequence
  Synthetic Polynucleotide
taatacgactcactatagggattatgaataaatacctcgctaattttaaaaacagaggagatttaaaatgagcgaggtaaacctggcggcagcgcaaaagatg

SEQ ID NO: 43754 - DNA, 103 bp, Artificial Sequence
  Synthetic Polynucleotide
taatacgactcactatagggatcttattatgaataaatacctcgctaattaacagaggagaaattagatgggtatttataacctggcggcagcgcaaaagatg

SEQ ID NO: 43755 - DNA, 103 bp, Artificial Sequence
  Synthetic Polynucleotide
taatacgactcactataggggatttatcttattatgaataaatacctcgcaacagaggagagcgaggatgttattcataaacctggcggcagcgcaaaagatg

SEQ ID NO: 43756 - DNA, 103 bp, Artificial Sequence
  Synthetic Polynucleotide
taatacgactcactatagggagatggatttatcttattatgaataaatacaacagaggagagtatttatgcataataagaacctggcggcagcgcaaaagatg

SEQ ID NO: 43757 - DNA, 103 bp, Artificial Sequence
  Synthetic Polynucleotide
taatacgactcactatagggctggaagatggatttatcttattatgaataaacagaggagatattcaatgtaagataaaaacctggcggcagcgcaaaagatg

SEQ ID NO: 43758 - DNA, 103 bp, Artificial Sequence
  Synthetic Polynucleotide
taatacgactcactatagggccattctggaagatggatttatcttattataacagaggagaataataatgtaaatccataacctggcggcagcgcaaaagatg

SEQ ID NO: 43759 - DNA, 103 bp, Artificial Sequence
  Synthetic Polynucleotide
taatacgactcactataggggaatcaagccgtcttctatagataaaaactaacagaggagaagttttatgctatagaagaacctggcggcagcgcaaaagatg

SEQ ID NO: 43760 - DNA, 103 bp, Artificial Sequence
  Synthetic Polynucleotide
taatacgactcactataggggtatgccattctggaagatggatttatcttaacagaggagaaagataatgccatcttccaacctggcggcagcgcaaaagatg

SEQ ID NO: 43761 - DNA, 103 bp, Artificial Sequence
  Synthetic Polynucleotide
taatacgactcactatagggtctatgtatgccattctggaagatggatttaacagaggagaaaatccatgttccagaataacctggcggcagcgcaaaagatg

SEQ ID NO: 43762 - DNA, 103 bp, Artificial Sequence
  Synthetic Polynucleotide
taatacgactcactatagggcttcttctatgtatgccattctggaagatgaacagaggagacatcttatggaatggcataacctggcggcagcgcaaaagatg

SEQ ID NO: 43763 - DNA, 103 bp, Artificial Sequence
  Synthetic Polynucleotide
taatacgactcactatagggcttttcttcttctatgtatgccattctggaaacagaggagatccagaatggcatacataaacctggcggcagcgcaaaagatg

SEQ ID NO: 43764 - DNA, 103 bp, Artificial Sequence
  Synthetic Polynucleotide
taatacgactcactatagggtttctcttttcttcttctatgtatgccattaacagaggagaaatggcatgcatagaagaaacctggcggcagcgcaaaagatg

SEQ ID NO: 43765 - DNA, 103 bp, Artificial Sequence
  Synthetic Polynucleotide
taatacgactcactatagggctaaatttctcttttcttcttctatgtatgaacagaggagacatacaatgaagaagaaaaacctggcggcagcgcaaaagatg

SEQ ID NO: 43766 - DNA, 103 bp, Artificial Sequence
  Synthetic Polynucleotide
taatacgactcactatagggagtaactaaatttctcttttcttcttctataacagaggagaatagaaatggaaaagagaaacctggcggcagcgcaaaagatg

SEQ ID NO: 43767 - DNA, 103 bp, Artificial Sequence
  Synthetic Polynucleotide
taatacgactcactatagggatagcagtaactaaatttctcttttcttctaacagaggagaagaagaatggagaaatttaacctggcggcagcgcaaaagatg

SEQ ID NO: 43768 - DNA, 103 bp, Artificial Sequence
  Synthetic Polynucleotide
taatacgactcactatagggtctgtatagcagtaactaaatttctcttttaacagaggagaaaaagaatgatttagttaaacctggcggcagcgcaaaagatg

SEQ ID NO: 43769 - DNA, 103 bp, Artificial Sequence
  Synthetic Polynucleotide
taatacgactcactatagggatacatctgtatagcagtaactaaatttctaacagaggagaagaaatatggttactgctaacctggcggcagcgcaaaagatg

SEQ ID NO: 43770 - DNA, 103 bp, Artificial Sequence
  Synthetic Polynucleotide
taatacgactcactatagggtcacggaatcaagccgtcttctatagataaaacagaggagattatctatggaagacggcaacctggcggcagcgcaaaagatg

SEQ ID NO: 43771 - DNA, 103 bp, Artificial Sequence
  Synthetic Polynucleotide
taatacgactcactatagggggagtatacatctgtatagcagtaactaaaaacagaggagatttagtatgtgctatacaaacctggcggcagcgcaaaagatg

SEQ ID NO: 43772 - DNA, 103 bp, Artificial Sequence
  Synthetic Polynucleotide
taatacgactcactatagggcaggaggagtatacatctgtatagcagtaaaacagaggagattactgatgtacagatgtaacctggcggcagcgcaaaagatg

SEQ ID NO: 43773 - DNA, 103 bp, Artificial Sequence
  Synthetic Polynucleotide
taatacgactcactatagggtccatcaggaggagtatacatctgtatagcaacagaggagagctataatgatgtatactaacctggcggcagcgcaaaagatg

SEQ ID NO: 43774 - DNA, 103 bp, Artificial Sequence
  Synthetic Polynucleotide
taatacgactcactataggggatgatccatcaggaggagtatacatctgtaacagaggagaacagatatgtactcctccaacctggcggcagcgcaaaagatg

SEQ ID NO: 43775 - DNA, 103 bp, Artificial Sequence
  Synthetic Polynucleotide
taatacgactcactatagggtaccagatgatccatcaggaggagtatacaaacagaggagatgtataatgctcctgatgaacctggcggcagcgcaaaagatg

SEQ ID NO: 43776 - DNA, 103 bp, Artificial Sequence
  Synthetic Polynucleotide
taatacgactcactataggggactataccagatgatccatcaggaggagtaacagaggagaactcctatggatggatcaaacctggcggcagcgcaaaagatg

SEQ ID NO: 43777 - DNA, 103 bp, Artificial Sequence
  Synthetic Polynucleotide
taatacgactcactatagggacaaagactataccagatgatccatcaggaaacagaggagatcctgaatgatcatctggaacctggcggcagcgcaaaagatg

SEQ ID NO: 43778 - DNA, 103 bp, Artificial Sequence
  Synthetic Polynucleotide
taatacgactcactatagggatgccacaaagactataccagatgatccataacagaggagaatggatatgctggtatagaacctggcggcagcgcaaaagatg

SEQ ID NO: 43779 - DNA, 103 bp, Artificial Sequence
  Synthetic Polynucleotide
taatacgactcactatagggaacggatgccacaaagactataccagatgaaacagaggagatcatctatgatagtctttaacctggcggcagcgcaaaagatg

SEQ ID NO: 43780 - DNA, 103 bp, Artificial Sequence
  Synthetic Polynucleotide
taatacgactcactatagggtgtgcaacggatgccacaaagactataccaaacagaggagatggtatatgctttgtggcaacctggcggcagcgcaaaagatg

SEQ ID NO: 43781 - DNA, 103 bp, Artificial Sequence
  Synthetic Polynucleotide
taatacgactcactatagggattaatcacggaatcaagccgtcttctataaacagaggagatatagaatgcggcttgataacctggcggcagcgcaaaagatg

SEQ ID NO: 43782 - DNA, 103 bp, Artificial Sequence
  Synthetic Polynucleotide
taatacgactcactataggggacactgtgcaacggatgccacaaagactaaacagaggagatagtctatgtggcatccgaacctggcggcagcgcaaaagatg

SEQ ID NO: 43783 - DNA, 103 bp, Artificial Sequence
  Synthetic Polynucleotide
taatacgactcactatagggttcgtgacactgtgcaacggatgccacaaaaacagaggagatttgtgatgtccgttgcaaacctggcggcagcgcaaaagatg

SEQ ID NO: 43784 - DNA, 103 bp, Artificial Sequence
  Synthetic Polynucleotide
taatacgactcactatagggttatattcgtgacactgtgcaacggatgccaacagaggagaggcatcatgtgcacagtgaacctggcggcagcgcaaaagatg

SEQ ID NO: 43785 - DNA, 103 bp, Artificial Sequence
  Synthetic Polynucleotide
taatacgactcactatagggatgatttatattcgtgacactgtgcaacggaacagaggagaccgttgatgagtgtcacgaacctggcggcagcgcaaaagatg

SEQ ID NO: 43786 - DNA, 103 bp, Artificial Sequence
  Synthetic Polynucleotide
taatacgactcactatagggtaaatatgatttatattcgtgacactgtgcaacagaggagagcacagatgcacgaatataacctggcggcagcgcaaaagatg

SEQ ID NO: 43787 - DNA, 103 bp, Artificial Sequence
  Synthetic Polynucleotide
taatacgactcactatagggttttctaaatatgatttatattcgtgacacaacagaggagagtgtcaatgatataaatcaacctggcggcagcgcaaaagatg

SEQ ID NO: 43788 - DNA, 103 bp, Artificial Sequence
  Synthetic Polynucleotide
taatacgactcactatagggatcttttttctaaatatgatttatattcgtaacagaggagaacgaatatgaatcatattaacctggcggcagcgcaaaagatg

SEQ ID NO: 43789 - DNA, 103 bp, Artificial Sequence
  Synthetic Polynucleotide
taatacgactcactatagggcggtaatcttttttctaaatatgatttataaacagaggagatataaaatgtatttagaaaacctggcggcagcgcaaaagatg

SEQ ID NO: 43790 - DNA, 103 bp, Artificial Sequence
  Synthetic Polynucleotide
taatacgactcactatagggtcatacggtaatcttttttctaaatatgataacagaggagaatcataatgagaaaaaagaacctggcggcagcgcaaaagatg

SEQ ID NO: 43791 - DNA, 103 bp, Artificial Sequence
  Synthetic Polynucleotide
taatacgactcactatagggacatatcatacggtaatcttttttctaaataacagaggagaatttagatgaaagattacaacctggcggcagcgcaaaagatg

SEQ ID NO: 43792 - DNA, 103 bp, Artificial Sequence
  Synthetic Polynucleotide
taatacgactcactatagggcggagctctttggtagcgagttgaaggagtaacagaggagaactcctatgactcgctacaacctggcggcagcgcaaaagatg

SEQ ID NO: 43793 - DNA, 103 bp, Artificial Sequence
  Synthetic Polynucleotide
taatacgactcactataggggtctaattaatcacggaatcaagccgtcttaacagaggagaaagacgatgtgattccgtaacctggcggcagcgcaaaagatg

SEQ ID NO: 43794 - DNA, 103 bp, Artificial Sequence
  Synthetic Polynucleotide
taatacgactcactatagggaatatacatatcatacggtaatcttttttcaacagaggagagaaaaaatgttaccgtataacctggcggcagcgcaaaagatg

SEQ ID NO: 43795 - DNA, 103 bp, Artificial Sequence
  Synthetic Polynucleotide
taatacgactcactatagggtgaataatatacatatcatacggtaatcttaacagaggagaaagattatggtatgatataacctggcggcagcgcaaaagatg

SEQ ID NO: 43796 - DNA, 103 bp, Artificial Sequence
  Synthetic Polynucleotide
taatacgactcactatagggtaccatgaataatatacatatcatacggtaaacagaggagataccgtatgatatgtataaacctggcggcagcgcaaaagatg

SEQ ID NO: 43797 - DNA, 103 bp, Artificial Sequence
  Synthetic Polynucleotide
taatacgactcactataggggaccttaccatgaataatatacatatcataaacagaggagatatgatatgtatattattaacctggcggcagcgcaaaagatg

SEQ ID NO: 43798 - DNA, 103 bp, Artificial Sequence
  Synthetic Polynucleotide
taatacgactcactatagggtctaagaccttaccatgaataatatacataaacagaggagatatgtaatgtattcatggaacctggcggcagcgcaaaagatg

SEQ ID NO: 43799 - DNA, 103 bp, Artificial Sequence
  Synthetic Polynucleotide
taatacgactcactatagggctatttctaagaccttaccatgaataatataacagaggagaatattaatgatggtaaggaacctggcggcagcgcaaaagatg

SEQ ID NO: 43800 - DNA, 103 bp, Artificial Sequence
  Synthetic Polynucleotide
taatacgactcactatagggtttgtctatttctaagaccttaccatgaataacagaggagaattcatatgaaggtcttaaacctggcggcagcgcaaaagatg

SEQ ID NO: 43801 - DNA, 103 bp, Artificial Sequence
  Synthetic Polynucleotide
taatacgactcactatagggaatattttgtctatttctaagaccttaccaaacagaggagatggtaaatgcttagaaataacctggcggcagcgcaaaagatg

SEQ ID NO: 43802 - DNA, 103 bp, Artificial Sequence
  Synthetic Polynucleotide
taatacgactcactatagggtttctaatattttgtctatttctaagacctaacagaggagaaggtctatgaaatagacaaacctggcggcagcgcaaaagatg

SEQ ID NO: 43803 - DNA, 103 bp, Artificial Sequence
  Synthetic Polynucleotide
taatacgactcactatagggcactttttctaatattttgtctatttctaaaacagaggagattagaaatggacaaaataaacctggcggcagcgcaaaagatg

SEQ ID NO: 43804 - DNA, 103 bp, Artificial Sequence
  Synthetic Polynucleotide
taatacgactcactatagggtaaatgtctaattaatcacggaatcaagccaacagaggagaggcttgatgccgtgattaaacctggcggcagcgcaaaagatg

SEQ ID NO: 43805 - DNA, 103 bp, Artificial Sequence
  Synthetic Polynucleotide
taatacgactcactataggggaatacactttttctaatattttgtctattaacagaggagaaatagaatgaatattagaaacctggcggcagcgcaaaagatg

SEQ ID NO: 43806 - DNA, 103 bp, Artificial Sequence
  Synthetic Polynucleotide
taatacgactcactataggggcgatgaatacactttttctaatattttgtaacagaggagaacaaaaatgtagaaaaagaacctggcggcagcgcaaaagatg

SEQ ID NO: 43807 - DNA, 103 bp, Artificial Sequence
  Synthetic Polynucleotide
taatacgactcactatagggattaggcgatgaatacactttttctaatataacagaggagaatattaatgaaagtgtataacctggcggcagcgcaaaagatg

SEQ ID NO: 43808 - DNA, 103 bp, Artificial Sequence
  Synthetic Polynucleotide
taatacgactcactataggggatacattaggcgatgaatacactttttctaacagaggagaagaaaaatggtattcatcaacctggcggcagcgcaaaagatg

SEQ ID NO: 43809 - DNA, 103 bp, Artificial Sequence
  Synthetic Polynucleotide
taatacgactcactatagggttatcgatacattaggcgatgaatacacttaacagaggagaaagtgtatgcatcgcctaaacctggcggcagcgcaaaagatg

SEQ ID NO: 43810 - DNA, 103 bp, Artificial Sequence
  Synthetic Polynucleotide
taatacgactcactatagggaataattatcgatacattaggcgatgaataaacagaggagatattcaatgcctaatgtaaacctggcggcagcgcaaaagatg

SEQ ID NO: 43811 - DNA, 103 bp, Artificial Sequence
  Synthetic Polynucleotide
taatacgactcactataggggcagaaataattatcgatacattaggcgataacagaggagaatcgccatgtgtatcgataacctggcggcagcgcaaaagatg

SEQ ID NO: 43812 - DNA, 103 bp, Artificial Sequence
  Synthetic Polynucleotide
taatacgactcactatagggaaggagcagaaataattatcgatacattagaacagaggagactaatgatgcgataattaaacctggcggcagcgcaaaagatg

SEQ ID NO: 43813 - DNA, 103 bp, Artificial Sequence
  Synthetic Polynucleotide
taatacgactcactatagggcaaataaggagcagaaataattatcgatacaacagaggagagtatcgatgattatttctaacctggcggcagcgcaaaagatg

SEQ ID NO: 43814 - DNA, 103 bp, Artificial Sequence
  Synthetic Polynucleotide
taatacgactcactataggggattccaaataaggagcagaaataattatcaacagaggagagataatatgttctgctccaacctggcggcagcgcaaaagatg

SEQ ID NO: 43815 - DNA, 103 bp, Artificial Sequence
  Synthetic Polynucleotide
taatacgactcactataggggttgttaaatgtctaattaatcacggaatcaacagaggagagattccatgattaattagaacctggcggcagcgcaaaagatg

SEQ ID NO: 43816 - DNA, 103 bp, Artificial Sequence
  Synthetic Polynucleotide
taatacgactcactatagggcgctggattccaaataaggagcagaaataaaacagaggagattatttatgctccttattaacctggcggcagcgcaaaagatg

SEQ ID NO: 43817 - DNA, 103 bp, Artificial Sequence
  Synthetic Polynucleotide
taatacgactcactatagggagtaacgctggattccaaataaggagcagaaacagaggagatctgctatgtatttggaaaacctggcggcagcgcaaaagatg

SEQ ID NO: 43818 - DNA, 103 bp, Artificial Sequence
  Synthetic Polynucleotide
taatacgactcactatagggtgtatagtaacgctggattccaaataaggaaacagaggagatccttaatgggaatccagaacctggcggcagcgcaaaagatg

SEQ ID NO: 43819 - DNA, 103 bp, Artificial Sequence
  Synthetic Polynucleotide
taatacgactcactatagggcattgtgtatagtaacgctggattccaaataacagaggagaatttggatgccagcgttaaacctggcggcagcgcaaaagatg

SEQ ID NO: 43820 - DNA, 103 bp, Artificial Sequence
  Synthetic Polynucleotide
taatacgactcactatagggagtaacattgtgtatagtaacgctggattcaacagaggagagaatccatggttactataaacctggcggcagcgcaaaagatg

SEQ ID NO: 43821 - DNA, 103 bp, Artificial Sequence
  Synthetic Polynucleotide
taatacgactcactatagggatgtgagtaacattgtgtatagtaacgctgaacagaggagacagcgtatgtatacacaaaacctggcggcagcgcaaaagatg

SEQ ID NO: 43822 - DNA, 103 bp, Artificial Sequence
  Synthetic Polynucleotide
taatacgactcactatagggcataaatgtgagtaacattgtgtatagtaaaacagaggagattactaatgacaatgttaaacctggcggcagcgcaaaagatg

SEQ ID NO: 43823 - DNA, 103 bp, Artificial Sequence
  Synthetic Polynucleotide
taatacgactcactatagggcatatcataaatgtgagtaacattgtgtataacagaggagaatacacatggttactcacaacctggcggcagcgcaaaagatg

SEQ ID NO: 43824 - DNA, 103 bp, Artificial Sequence
  Synthetic Polynucleotide
taatacgactcactatagggctacccatatcataaatgtgagtaacattgaacagaggagacaatgtatgtcacatttaaacctggcggcagcgcaaaagatg

SEQ ID NO: 43825 - DNA, 103 bp, Artificial Sequence
  Synthetic Polynucleotide
taatacgactcactatagggaaactctacccatatcataaatgtgagtaaaacagaggagattactcatgtttatgataaacctggcggcagcgcaaaagatg

SEQ ID NO: 43826 - DNA, 103 bp, Artificial Sequence
  Synthetic Polynucleotide
taatacgactcactatagggcggaagttgttaaatgtctaattaatcacgaacagaggagacgtgatatgttagacattaacctggcggcagcgcaaaagatg

SEQ ID NO: 43827 - DNA, 103 bp, Artificial Sequence
  Synthetic Polynucleotide
taatacgactcactatagggaacaaaaactctacccatatcataaatgtgaacagaggagacacattatggatatgggtaacctggcggcagcgcaaaagatg

SEQ ID NO: 43828 - DNA, 103 bp, Artificial Sequence
  Synthetic Polynucleotide
taatacgactcactataggggcgggaacaaaaactctacccatatcataaaacagaggagattatgaatggggtagagtaacctggcggcagcgcaaaagatg

SEQ ID NO: 43829 - DNA, 103 bp, Artificial Sequence
  Synthetic Polynucleotide
taatacgactcactatagggaaggagcgggaacaaaaactctacccatataacagaggagaatatggatggagtttttgaacctggcggcagcgcaaaagatg

SEQ ID NO: 43830 - DNA, 103 bp, Artificial Sequence
  Synthetic Polynucleotide
taatacgactcactatagggtccaaaaggagcgggaacaaaaactctaccaacagaggagaggtagaatgtttgttcccaacctggcggcagcgcaaaagatg

SEQ ID NO: 43831 - DNA, 103 bp, Artificial Sequence
  Synthetic Polynucleotide
taatacgactcactataggggatcctccaaaaggagcgggaacaaaaactaacagaggagaagttttatgtcccgctccaacctggcggcagcgcaaaagatg

SEQ ID NO: 43832 - DNA, 103 bp, Artificial Sequence
  Synthetic Polynucleotide
taatacgactcactataggggttgtgatcctccaaaaggagcgggaacaaaacagaggagattgttcatgctccttttgaacctggcggcagcgcaaaagatg

SEQ ID NO: 43833 - DNA, 103 bp, Artificial Sequence
  Synthetic Polynucleotide
taatacgactcactatagggaaattgttgtgatcctccaaaaggagcgggaacagaggagacccgctatgtttggaggaaacctggcggcagcgcaaaagatg

SEQ ID NO: 43834 - DNA, 103 bp, Artificial Sequence
  Synthetic Polynucleotide
taatacgactcactataggggaaataaattgttgtgatcctccaaaaggaaacagaggagatcctttatgaggatcacaaacctggcggcagcgcaaaagatg

SEQ ID NO: 43835 - DNA, 103 bp, Artificial Sequence
  Synthetic Polynucleotide
taatacgactcactatagggatttagaaataaattgttgtgatcctccaaaacagaggagattggagatgcacaacaataacctggcggcagcgcaaaagatg

SEQ ID NO: 43836 - DNA, 103 bp, Artificial Sequence
  Synthetic Polynucleotide
taatacgactcactatagggcatagatttagaaataaattgttgtgatccaacagaggagaggatcaatgcaatttattaacctggcggcagcgcaaaagatg

SEQ ID NO: 43837 - DNA, 103 bp, Artificial Sequence
  Synthetic Polynucleotide
taatacgactcactataggggcgtccggaagttgttaaatgtctaattaaaacagaggagattaattatgcatttaacaaacctggcggcagcgcaaaagatg

SEQ ID NO: 43838 - DNA, 103 bp, Artificial Sequence
  Synthetic Polynucleotide
taatacgactcactatagggtctctcatagatttagaaataaattgttgtaacagaggagaacaacaatgtatttctaaaacctggcggcagcgcaaaagatg

SEQ ID NO: 43839 - DNA, 103 bp, Artificial Sequence
  Synthetic Polynucleotide
taatacgactcactataggggttgatctctcatagatttagaaataaattaacagaggagaaatttaatgctaaatctaaacctggcggcagcgcaaaagatg

SEQ ID NO: 43840 - DNA, 103 bp, Artificial Sequence
  Synthetic Polynucleotide
taatacgactcactatagggttttcgttgatctctcatagatttagaaataacagaggagaatttctatgtctatgagaaacctggcggcagcgcaaaagatg

SEQ ID NO: 43841 - DNA, 103 bp, Artificial Sequence
  Synthetic Polynucleotide
taatacgactcactatagggcttccttttcgttgatctctcatagatttaaacagaggagataaatcatggagagatcaaacctggcggcagcgcaaaagatg

SEQ ID NO: 43842 - DNA, 103 bp, Artificial Sequence
  Synthetic Polynucleotide
taatacgactcactatagggctactcttccttttcgttgatctctcatagaacagaggagactatgaatgatcaacgaaaacctggcggcagcgcaaaagatg

SEQ ID NO: 43843 - DNA, 103 bp, Artificial Sequence
  Synthetic Polynucleotide
taatacgactcactatagggtcttcctactcttccttttcgttgatctctaacagaggagaagagatatgcgaaaaggaaacctggcggcagcgcaaaagatg

SEQ ID NO: 43844 - DNA, 103 bp, Artificial Sequence
  Synthetic Polynucleotide
taatacgactcactatagggttaactcttcctactcttccttttcgttgaaacagaggagatcaacgatgaggaagagtaacctggcggcagcgcaaaagatg

SEQ ID NO: 43845 - DNA, 103 bp, Artificial Sequence
  Synthetic Polynucleotide
taatacgactcactatagggcaggattaactcttcctactcttccttttcaacagaggagagaaaagatggagtaggaaaacctggcggcagcgcaaaagatg

SEQ ID NO: 43846 - DNA, 103 bp, Artificial Sequence
  Synthetic Polynucleotide
taatacgactcactatagggtgtaccaggattaactcttcctactcttccaacagaggagaggaagaatgggaagagttaacctggcggcagcgcaaaagatg

SEQ ID NO: 43847 - DNA, 103 bp, Artificial Sequence
  Synthetic Polynucleotide
taatacgactcactatagggacgtatgtaccaggattaactcttcctactaacagaggagaagtaggatgagttaatccaacctggcggcagcgcaaaagatg

SEQ ID NO: 43848 - DNA, 103 bp, Artificial Sequence
  Synthetic Polynucleotide
taatacgactcactatagggtatgtgcgtccggaagttgttaaatgtctaaacagaggagatagacaatgaacaacttcaacctggcggcagcgcaaaagatg

SEQ ID NO: 43849 - DNA, 103 bp, Artificial Sequence
  Synthetic Polynucleotide
taatacgactcactatagggaatagacgtatgtaccaggattaactcttcaacagaggagagaagagatgatcctggtaaacctggcggcagcgcaaaagatg

SEQ ID NO: 43850 - DNA, 103 bp, Artificial Sequence
  Synthetic Polynucleotide
taatacgactcactatagggatagaaatagacgtatgtaccaggattaacaacagaggagagttaatatgggtacatacaacctggcggcagcgcaaaagatg

SEQ ID NO: 43851 - DNA, 103 bp, Artificial Sequence
  Synthetic Polynucleotide
taatacgactcactatagggagatcatagaaatagacgtatgtaccaggaaacagaggagatcctggatgatacgtctaaacctggcggcagcgcaaaagatg

SEQ ID NO: 43852 - DNA, 103 bp, Artificial Sequence
  Synthetic Polynucleotide
taatacgactcactatagggaagacagatcatagaaatagacgtatgtacaacagaggagagtacatatgtctatttctaacctggcggcagcgcaaaagatg

SEQ ID NO: 43853 - DNA, 103 bp, Artificial Sequence
  Synthetic Polynucleotide
taatacgactcactatagggcatataagacagatcatagaaatagacgtaaacagaggagatacgtcatgttctatgataacctggcggcagcgcaaaagatg

SEQ ID NO: 43854 - DNA, 103 bp, Artificial Sequence
  Synthetic Polynucleotide
taatacgactcactataggggacttcatataagacagatcatagaaatagaacagaggagactatttatgtgatctgtcaacctggcggcagcgcaaaagatg

SEQ ID NO: 43855 - DNA, 103 bp, Artificial Sequence
  Synthetic Polynucleotide
taatacgactcactataggggtatagacttcatataagacagatcatagaaacagaggagatctatgatgtgtcttataaacctggcggcagcgcaaaagatg

SEQ ID NO: 43856 - DNA, 103 bp, Artificial Sequence
  Synthetic Polynucleotide
taatacgactcactatagggtcgctgtatagacttcatataagacagatcaacagaggagagatctgatgtatatgaagaacctggcggcagcgcaaaagatg

SEQ ID NO: 43857 - DNA, 103 bp, Artificial Sequence
  Synthetic Polynucleotide
taatacgactcactatagggtttattcgctgtatagacttcatataagacaacagaggagagtcttaatggaagtctataacctggcggcagcgcaaaagatg

SEQ ID NO: 43858 - DNA, 103 bp, Artificial Sequence
  Synthetic Polynucleotide
taatacgactcactatagggctgaatttattcgctgtatagacttcatataacagaggagaatatgaatgctatacagcaacctggcggcagcgcaaaagatg

SEQ ID NO: 43859 - DNA, 103 bp, Artificial Sequence
  Synthetic Polynucleotide
taatacgactcactataggggagcatatgtgcgtccggaagttgttaaataacagaggagaatttaaatgcttccggacaacctggcggcagcgcaaaagatg

SEQ ID NO: 43860 - DNA, 103 bp, Artificial Sequence
  Synthetic Polynucleotide
taatacgactcactatagggaaattctgaatttattcgctgtatagacttaacagaggagaaagtctatgcagcgaataaacctggcggcagcgcaaaagatg

SEQ ID NO: 43861 - DNA, 103 bp, Artificial Sequence
  Synthetic Polynucleotide
taatacgactcactatagggtgtagaaattctgaatttattcgctgtataaacagaggagatatacaatgaataaattcaacctggcggcagcgcaaaagatg

SEQ ID NO: 43862 - DNA, 103 bp, Artificial Sequence
  Synthetic Polynucleotide
taatacgactcactatagggaattatgtagaaattctgaatttattcgctaacagaggagaagcgaaatgattcagaataacctggcggcagcgcaaaagatg

SEQ ID NO: 43863 - DNA, 103 bp, Artificial Sequence
  Synthetic Polynucleotide
taatacgactcactatagggtatataattatgtagaaattctgaatttataacagaggagaataaatatggaatttctaaacctggcggcagcgcaaaagatg

SEQ ID NO: 43864 - DNA, 103 bp, Artificial Sequence
  Synthetic Polynucleotide
taatacgactcactatagggtacaatatataattatgtagaaattctgaaaacagaggagattcagaatgtctacataaaacctggcggcagcgcaaaagatg

SEQ ID NO: 43865 - DNA, 103 bp, Artificial Sequence
  Synthetic Polynucleotide
taatacgactcactatagggtagcgtacaatatataattatgtagaaattaacagaggagaaatttcatgataattataaacctggcggcagcgcaaaagatg

SEQ ID NO: 43866 - DNA, 103 bp, Artificial Sequence
  Synthetic Polynucleotide
taatacgactcactatagggcttattagcgtacaatatataattatgtagaacagaggagactacatatgtatatattgaacctggcggcagcgcaaaagatg

SEQ ID NO: 43867 - DNA, 103 bp, Artificial Sequence
  Synthetic Polynucleotide
taatacgactcactatagggttaaacttattagcgtacaatatataattaaacagaggagataattaatgattgtacgcaacctggcggcagcgcaaaagatg

SEQ ID NO: 43868 - DNA, 103 bp, Artificial Sequence
  Synthetic Polynucleotide
taatacgactcactatagggttaaattaaacttattagcgtacaatatataacagaggagaatatatatgacgctaataaacctggcggcagcgcaaaagatg

SEQ ID NO: 43869 - DNA, 103 bp, Artificial Sequence
  Synthetic Polynucleotide
taatacgactcactatagggaagtgttaaattaaacttattagcgtacaaaacagaggagattgtacatgaataagtttaacctggcggcagcgcaaaagatg

SEQ ID NO: 43870 - DNA, 103 bp, Artificial Sequence
  Synthetic Polynucleotide
taatacgactcactatagggtacgagagcatatgtgcgtccggaagttgtaacagaggagaacaactatgggacgcacaaacctggcggcagcgcaaaagatg

SEQ ID NO: 43871 - DNA, 103 bp, Artificial Sequence
  Synthetic Polynucleotide
taatacgactcactatagggtcgggaagtgttaaattaaacttattagcgaacagaggagacgctaaatggtttaatttaacctggcggcagcgcaaaagatg

SEQ ID NO: 43872 - DNA, 103 bp, Artificial Sequence
  Synthetic Polynucleotide
taatacgactcactatagggaatcttcgggaagtgttaaattaaacttataacagaggagaataagtatgatttaacacaacctggcggcagcgcaaaagatg

SEQ ID NO: 43873 - DNA, 103 bp, Artificial Sequence
  Synthetic Polynucleotide
taatacgactcactatagggaaacaaatcttcgggaagtgttaaattaaaaacagaggagatttaatatgacacttcccaacctggcggcagcgcaaaagatg

SEQ ID NO: 43874 - DNA, 103 bp, Artificial Sequence
  Synthetic Polynucleotide
taatacgactcactatagggattataaacaaatcttcgggaagtgttaaaaacagaggagatttaacatgtcccgaagaaacctggcggcagcgcaaaagatg

SEQ ID NO: 43875 - DNA, 103 bp, Artificial Sequence
  Synthetic Polynucleotide
taatacgactcactatagggtagggattataaacaaatcttcgggaagtgaacagaggagacacttcatgaagatttgtaacctggcggcagcgcaaaagatg

SEQ ID NO: 43876 - DNA, 103 bp, Artificial Sequence
  Synthetic Polynucleotide
taatacgactcactatagggatttgtagggattataaacaaatcttcgggaacagaggagacccgaaatgttgtttataaacctggcggcagcgcaaaagatg

SEQ ID NO: 43877 - DNA, 103 bp, Artificial Sequence
  Synthetic Polynucleotide
taatacgactcactatagggtccaaatttgtagggattataaacaaatctaacagaggagaagatttatgtataatcccaacctggcggcagcgcaaaagatg

SEQ ID NO: 43878 - DNA, 103 bp, Artificial Sequence
  Synthetic Polynucleotide
taatacgactcactataggggaatatccaaatttgtagggattataaacaaacagaggagatgtttaatgtccctacaaaacctggcggcagcgcaaaagatg

SEQ ID NO: 43879 - DNA, 103 bp, Artificial Sequence
  Synthetic Polynucleotide
taatacgactcactatagggccatagaatatccaaatttgtagggattataacagaggagaataatcatgacaaatttgaacctggcggcagcgcaaaagatg

SEQ ID NO: 43880 - DNA, 103 bp, Artificial Sequence
  Synthetic Polynucleotide
taatacgactcactataggggtacgccatagaatatccaaatttgtagggaacagaggagaccctacatgtttggatataacctggcggcagcgcaaaagatg

SEQ ID NO: 43881 - DNA, 103 bp, Artificial Sequence
  Synthetic Polynucleotide
taatacgactcactatagggtcggatacgagagcatatgtgcgtccggaaaacagaggagattccggatgcacatatgcaacctggcggcagcgcaaaagatg

SEQ ID NO: 43882 - DNA, 103 bp, Artificial Sequence
  Synthetic Polynucleotide
taatacgactcactatagggcctttgtacgccatagaatatccaaatttgaacagaggagacaaattatgatattctataacctggcggcagcgcaaaagatg

SEQ ID NO: 43883 - DNA, 103 bp, Artificial Sequence
  Synthetic Polynucleotide
taatacgactcactatagggatattcctttgtacgccatagaatatccaaaacagaggagattggatatgctatggcgtaacctggcggcagcgcaaaagatg

SEQ ID NO: 43884 - DNA, 103 bp, Artificial Sequence
  Synthetic Polynucleotide
taatacgactcactatagggtctatatattcctttgtacgccatagaataaacagaggagatattctatggcgtacaaaaacctggcggcagcgcaaaagatg

SEQ ID NO: 43885 - DNA, 103 bp, Artificial Sequence
  Synthetic Polynucleotide
taatacgactcactatagggacgagtctatatattcctttgtacgccataaacagaggagatatggcatgcaaaggaataacctggcggcagcgcaaaagatg

SEQ ID NO: 43886 - DNA, 103 bp, Artificial Sequence
  Synthetic Polynucleotide
taatacgactcactatagggatcgaacgagtctatatattcctttgtacgaacagaggagacgtacaatggaatatataaacctggcggcagcgcaaaagatg

SEQ ID NO: 43887 - DNA, 103 bp, Artificial Sequence
  Synthetic Polynucleotide
taatacgactcactatagggctaatatcgaacgagtctatatattcctttaacagaggagaaaaggaatgtatagactcaacctggcggcagcgcaaaagatg

SEQ ID NO: 43888 - DNA, 103 bp, Artificial Sequence
  Synthetic Polynucleotide
taatacgactcactatagggctgtactaatatcgaacgagtctatatattaacagaggagaaatataatgactcgttcgaacctggcggcagcgcaaaagatg

SEQ ID NO: 43889 - DNA, 103 bp, Artificial Sequence
  Synthetic Polynucleotide
taatacgactcactatagggtgtttctgtactaatatcgaacgagtctataacagaggagaatagacatgttcgatattaacctggcggcagcgcaaaagatg

SEQ ID NO: 43890 - DNA, 103 bp, Artificial Sequence
  Synthetic Polynucleotide
taatacgactcactatagggttccatgtttctgtactaatatcgaacgagaacagaggagactcgttatgtattagtacaacctggcggcagcgcaaaagatg

SEQ ID NO: 43891 - DNA, 103 bp, Artificial Sequence
  Synthetic Polynucleotide
taatacgactcactatagggatttattccatgtttctgtactaatatcgaaacagaggagatcgataatggtacagaaaaacctggcggcagcgcaaaagatg

SEQ ID NO: 43892 - DNA, 103 bp, Artificial Sequence
  Synthetic Polynucleotide
taatacgactcactatagggcagagtcggatacgagagcatatgtgcgtcaacagaggagagacgcaatgatgctctcgaacctggcggcagcgcaaaagatg

SEQ ID NO: 43893 - DNA, 103 bp, Artificial Sequence
  Synthetic Polynucleotide
taatacgactcactatagggtaataatttattccatgtttctgtactaataacagaggagaattagtatggaaacatggaacctggcggcagcgcaaaagatg

SEQ ID NO: 43894 - DNA, 103 bp, Artificial Sequence
  Synthetic Polynucleotide
taatacgactcactatagggttggataataatttattccatgtttctgtaaacagaggagatacagaatgatggaataaaacctggcggcagcgcaaaagatg

SEQ ID NO: 43895 - DNA, 103 bp, Artificial Sequence
  Synthetic Polynucleotide
taatacgactcactatagggaataattggataataatttattccatgtttaacagaggagaaaacatatgataaattataacctggcggcagcgcaaaagatg

SEQ ID NO: 43896 - DNA, 103 bp, Artificial Sequence
  Synthetic Polynucleotide
taatacgactcactatagggcatataataattggataataatttattccaaacagaggagatggaatatgttattatccaacctggcggcagcgcaaaagatg

SEQ ID NO: 43897 - DNA, 103 bp, Artificial Sequence
  Synthetic Polynucleotide
taatacgactcactatagggatcttcatataataattggataataatttaaacagaggagataaattatgatccaattaaacctggcggcagcgcaaaagatg

SEQ ID NO: 43898 - DNA, 103 bp, Artificial Sequence
  Synthetic Polynucleotide
taatacgactcactatagggctatcatcttcatataataattggataataaacagaggagatattatatgattattataaacctggcggcagcgcaaaagatg

SEQ ID NO: 43899 - DNA, 103 bp, Artificial Sequence
  Synthetic Polynucleotide
taatacgactcactatagggatactctatcatcttcatataataattggaaacagaggagatccaatatgtatatgaagaacctggcggcagcgcaaaagatg

SEQ ID NO: 43900 - DNA, 103 bp, Artificial Sequence
  Synthetic Polynucleotide
taatacgactcactatagggttagcatactctatcatcttcatataataaaacagaggagattattaatggaagatgataacctggcggcagcgcaaaagatg

SEQ ID NO: 43901 - DNA, 103 bp, Artificial Sequence
  Synthetic Polynucleotide
taatacgactcactatagggaaagtttagcatactctatcatcttcatataacagaggagaatatgaatgtgatagagtaacctggcggcagcgcaaaagatg

SEQ ID NO: 43902 - DNA, 103 bp, Artificial Sequence
  Synthetic Polynucleotide
taatacgactcactatagggtacataaagtttagcatactctatcatcttaacagaggagaaagatgatggagtatgctaacctggcggcagcgcaaaagatg

SEQ ID NO: 43903 - DNA, 103 bp, Artificial Sequence
  Synthetic Polynucleotide
taatacgactcactatagggtgcaacggagctctttggtagcgagttgaaaacagaggagattcaacatgctaccaaagaacctggcggcagcgcaaaagatg

SEQ ID NO: 43904 - DNA, 103 bp, Artificial Sequence
  Synthetic Polynucleotide
taatacgactcactataggggtattcagagtcggatacgagagcatatgtaacagaggagaacatatatgctcgtatccaacctggcggcagcgcaaaagatg

SEQ ID NO: 43905 - DNA, 103 bp, Artificial Sequence
  Synthetic Polynucleotide
taatacgactcactatagggcttagtacataaagtttagcatactctatcaacagaggagagatagaatgtgctaaactaacctggcggcagcgcaaaagatg

SEQ ID NO: 43906 - DNA, 103 bp, Artificial Sequence
  Synthetic Polynucleotide
taatacgactcactatagggtaggacttagtacataaagtttagcatactaacagaggagaagtatgatgaactttatgaacctggcggcagcgcaaaagatg

SEQ ID NO: 43907 - DNA, 103 bp, Artificial Sequence
  Synthetic Polynucleotide
taatacgactcactataggggagaataggacttagtacataaagtttagcaacagaggagagctaaaatgtatgtactaaacctggcggcagcgcaaaagatg

SEQ ID NO: 43908 - DNA, 103 bp, Artificial Sequence
  Synthetic Polynucleotide
taatacgactcactatagggtcagcgagaataggacttagtacataaagtaacagaggagaactttaatgactaagtccaacctggcggcagcgcaaaagatg

SEQ ID NO: 43909 - DNA, 103 bp, Artificial Sequence
  Synthetic Polynucleotide
taatacgactcactatagggactcctcagcgagaataggacttagtacataacagaggagaatgtacatggtcctattcaacctggcggcagcgcaaaagatg

SEQ ID NO: 43910 - DNA, 103 bp, Artificial Sequence
  Synthetic Polynucleotide
taatacgactcactatagggatccaactcctcagcgagaataggacttagaacagaggagactaagtatgattctcgctaacctggcggcagcgcaaaagatg

SEQ ID NO: 43911 - DNA, 103 bp, Artificial Sequence
  Synthetic Polynucleotide
taatacgactcactatagggaagttatccaactcctcagcgagaataggaaacagaggagatcctatatgcgctgaggaaacctggcggcagcgcaaaagatg

SEQ ID NO: 43912 - DNA, 103 bp, Artificial Sequence
  Synthetic Polynucleotide
taatacgactcactatagggtctcaaagttatccaactcctcagcgagaaaacagaggagattctcgatgaggagttggaacctggcggcagcgcaaaagatg

SEQ ID NO: 43913 - DNA, 103 bp, Artificial Sequence
  Synthetic Polynucleotide
taatacgactcactatagggcgtcctctcaaagttatccaactcctcagcaacagaggagagctgagatgttggataacaacctggcggcagcgcaaaagatg

SEQ ID NO: 43914 - DNA, 103 bp, Artificial Sequence
  Synthetic Polynucleotide
taatacgactcactatagggtctcccgtcctctcaaagttatccaactccaacagaggagaggagttatgtaactttgaaacctggcggcagcgcaaaagatg

SEQ ID NO: 43915 - DNA, 103 bp, Artificial Sequence
  Synthetic Polynucleotide
taatacgactcactatagggcatctgtattcagagtcggatacgagagcaaacagaggagatgctctatgatccgactcaacctggcggcagcgcaaaagatg

SEQ ID NO: 43916 - DNA, 103 bp, Artificial Sequence
  Synthetic Polynucleotide
taatacgactcactatagggttaattctcccgtcctctcaaagttatccaaacagaggagatggataatgttgagaggaaacctggcggcagcgcaaaagatg

SEQ ID NO: 43917 - DNA, 103 bp, Artificial Sequence
  Synthetic Polynucleotide
taatacgactcactatagggactagttaattctcccgtcctctcaaagttaacagaggagaaactttatgaggacgggaaacctggcggcagcgcaaaagatg

SEQ ID NO: 43918 - DNA, 103 bp, Artificial Sequence
  Synthetic Polynucleotide
taatacgactcactatagggacaatactagttaattctcccgtcctctcaaacagaggagatgagagatggggagaattaacctggcggcagcgcaaaagatg

SEQ ID NO: 43919 - DNA, 103 bp, Artificial Sequence
  Synthetic Polynucleotide
taatacgactcactatagggcttgtacaatactagttaattctcccgtccaacagaggagaggacggatgaattaactaaacctggcggcagcgcaaaagatg

SEQ ID NO: 43920 - DNA, 103 bp, Artificial Sequence
  Synthetic Polynucleotide
taatacgactcactatagggggcttcttgtacaatactagttaattctccaacagaggagaggagaaatgactagtattaacctggcggcagcgcaaaagatg

SEQ ID NO: 43921 - DNA, 103 bp, Artificial Sequence
  Synthetic Polynucleotide
taatacgactcactatagggaaaatggcttcttgtacaatactagttaataacagaggagaattaacatgtattgtacaaacctggcggcagcgcaaaagatg

SEQ ID NO: 43922 - DNA, 103 bp, Artificial Sequence
  Synthetic Polynucleotide
taatacgactcactataggggagataaaatggcttcttgtacaatactagaacagaggagactagtaatgtacaagaagaacctggcggcagcgcaaaagatg

SEQ ID NO: 43923 - DNA, 103 bp, Artificial Sequence
  Synthetic Polynucleotide
taatacgactcactatagggatttagagataaaatggcttcttgtacaataacagaggagaattgtaatggaagccattaacctggcggcagcgcaaaagatg

SEQ ID NO: 43924 - DNA, 103 bp, Artificial Sequence
  Synthetic Polynucleotide
taatacgactcactatagggcgtaaatttagagataaaatggcttcttgtaacagaggagaacaagaatgcattttatcaacctggcggcagcgcaaaagatg

SEQ ID NO: 43925 - DNA, 103 bp, Artificial Sequence
  Synthetic Polynucleotide
taatacgactcactatagggtaattcgtaaatttagagataaaatggcttaacagaggagaaagccaatgtatctctaaaacctggcggcagcgcaaaagatg

SEQ ID NO: 43926 - DNA, 103 bp, Artificial Sequence
  Synthetic Polynucleotide
taatacgactcactatagggtctctcatctgtattcagagtcggatacgaaacagaggagatcgtatatgactctgaataacctggcggcagcgcaaaagatg

SEQ ID NO: 43927 - DNA, 103 bp, Artificial Sequence
  Synthetic Polynucleotide
taatacgactcactatagggaatcttaattcgtaaatttagagataaaataacagaggagaattttaatgctaaatttaaacctggcggcagcgcaaaagatg

SEQ ID NO: 43928 - DNA, 103 bp, Artificial Sequence
  Synthetic Polynucleotide
taatacgactcactatagggtttaaaatcttaattcgtaaatttagagataacagaggagaatctctatgtttacgaataacctggcggcagcgcaaaagatg

SEQ ID NO: 43929 - DNA, 103 bp, Artificial Sequence
  Synthetic Polynucleotide
taatacgactcactatagggtaaaatttaaaatcttaattcgtaaatttaaacagaggagataaattatggaattaagaaacctggcggcagcgcaaaagatg

SEQ ID NO: 43930 - DNA, 103 bp, Artificial Sequence
  Synthetic Polynucleotide
taatacgactcactatagggatgtttaaaatttaaaatcttaattcgtaaaacagaggagattacgaatgaagattttaaacctggcggcagcgcaaaagatg

SEQ ID NO: 43931 - DNA, 103 bp, Artificial Sequence
  Synthetic Polynucleotide
taatacgactcactatagggtctttatgtttaaaatttaaaatcttaattaacagaggagaaattaaatgtttaaatttaacctggcggcagcgcaaaagatg

SEQ ID NO: 43932 - DNA, 103 bp, Artificial Sequence
  Synthetic Polynucleotide
taatacgactcactatagggcattatctttatgtttaaaatttaaaatctaacagaggagaagatttatgattttaaacaacctggcggcagcgcaaaagatg

SEQ ID NO: 43933 - DNA, 103 bp, Artificial Sequence
  Synthetic Polynucleotide
taatacgactcactatagggcgtatcattatctttatgtttaaaatttaaaacagaggagattaaatatgaaacataaaaacctggcggcagcgcaaaagatg

SEQ ID NO: 43934 - DNA, 103 bp, Artificial Sequence
  Synthetic Polynucleotide
taatacgactcactatagggatatacgtatcattatctttatgtttaaaaaacagaggagattttaaatgtaaagataaaacctggcggcagcgcaaaagatg

SEQ ID NO: 43935 - DNA, 103 bp, Artificial Sequence
  Synthetic Polynucleotide
taatacgactcactatagggagtgtatatacgtatcattatctttatgttaacagaggagaaacataatgataatgataaacctggcggcagcgcaaaagatg

SEQ ID NO: 43936 - DNA, 103 bp, Artificial Sequence
  Synthetic Polynucleotide
taatacgactcactatagggacaaaagtgtatatacgtatcattatctttaacagaggagaaaagatatggatacgtataacctggcggcagcgcaaaagatg

SEQ ID NO: 43937 - DNA, 103 bp, Artificial Sequence
  Synthetic Polynucleotide
taatacgactcactatagggtattatctctcatctgtattcagagtcggaaacagaggagatccgacatggaatacagaaacctggcggcagcgcaaaagatg

SEQ ID NO: 43938 - DNA, 103 bp, Artificial Sequence
  Synthetic Polynucleotide
taatacgactcactatagggattttacaaaagtgtatatacgtatcattaaacagaggagataatgaatggtatatacaaacctggcggcagcgcaaaagatg

SEQ ID NO: 43939 - DNA, 103 bp, Artificial Sequence
  Synthetic Polynucleotide
taatacgactcactatagggataatattttacaaaagtgtatatacgtataacagaggagaatacgtatgtacacttttaacctggcggcagcgcaaaagatg

SEQ ID NO: 43940 - DNA, 103 bp, Artificial Sequence
  Synthetic Polynucleotide
taatacgactcactatagggaccaaataatattttacaaaagtgtatataaacagaggagatatataatgttttgtaaaaacctggcggcagcgcaaaagatg

SEQ ID NO: 43941 - DNA, 103 bp, Artificial Sequence
  Synthetic Polynucleotide
taatacgactcactatagggtagacaccaaataatattttacaaaagtgtaacagaggagaacacttatgtaaaatattaacctggcggcagcgcaaaagatg

SEQ ID NO: 43942 - DNA, 103 bp, Artificial Sequence
  Synthetic Polynucleotide
taatacgactcactatagggcgttatagacaccaaataatattttacaaaaacagaggagatttgtaatgtattatttgaacctggcggcagcgcaaaagatg

SEQ ID NO: 43943 - DNA, 103 bp, Artificial Sequence
  Synthetic Polynucleotide
taatacgactcactatagggtgttccgttatagacaccaaataatattttaacagaggagaaaaataatgtttggtgtcaacctggcggcagcgcaaaagatg

SEQ ID NO: 43944 - DNA, 103 bp, Artificial Sequence
  Synthetic Polynucleotide
taatacgactcactataggggcgtttgttccgttatagacaccaaataataacagaggagaattattatgtgtctataaaacctggcggcagcgcaaaagatg

SEQ ID NO: 43945 - DNA, 103 bp, Artificial Sequence
  Synthetic Polynucleotide
taatacgactcactatagggtagtagcgtttgttccgttatagacaccaaaacagaggagattggtgatgataacggaaaacctggcggcagcgcaaaagatg

SEQ ID NO: 43946 - DNA, 103 bp, Artificial Sequence
  Synthetic Polynucleotide
taatacgactcactatagggatatatagtagcgtttgttccgttatagacaacagaggagagtctatatgggaacaaacaacctggcggcagcgcaaaagatg

SEQ ID NO: 43947 - DNA, 103 bp, Artificial Sequence
  Synthetic Polynucleotide
taatacgactcactatagggtgataatatatagtagcgtttgttccgttaaacagaggagataacggatgaaacgctacaacctggcggcagcgcaaaagatg

SEQ ID NO: 43948 - DNA, 103 bp, Artificial Sequence
  Synthetic Polynucleotide
taatacgactcactatagggttgtatattatctctcatctgtattcagagaacagaggagactctgaatgcagatgagaaacctggcggcagcgcaaaagatg

SEQ ID NO: 43949 - DNA, 103 bp, Artificial Sequence
  Synthetic Polynucleotide
taatacgactcactataggggtctatgataatatatagtagcgtttgttcaacagaggagagaacaaatgctactatataacctggcggcagcgcaaaagatg

SEQ ID NO: 43950 - DNA, 103 bp, Artificial Sequence
  Synthetic Polynucleotide
taatacgactcactatagggtagaggtctatgataatatatagtagcgttaacagaggagaaacgctatgatatattataacctggcggcagcgcaaaagatg

SEQ ID NO: 43951 - DNA, 103 bp, Artificial Sequence
  Synthetic Polynucleotide
taatacgactcactatagggcccgttagaggtctatgataatatatagtaaacagaggagatactatatgttatcatagaacctggcggcagcgcaaaagatg

SEQ ID NO: 43952 - DNA, 103 bp, Artificial Sequence
  Synthetic Polynucleotide
taatacgactcactatagggtatatcccgttagaggtctatgataatataaacagaggagatatattatgatagacctcaacctggcggcagcgcaaaagatg

SEQ ID NO: 43953 - DNA, 103 bp, Artificial Sequence
  Synthetic Polynucleotide
taatacgactcactatagggattcatatatcccgttagaggtctatgataaacagaggagatatcatatgcctctaacgaacctggcggcagcgcaaaagatg

SEQ ID NO: 43954 - DNA, 103 bp, Artificial Sequence
  Synthetic Polynucleotide
taatacgactcactatagggatcatattcatatatcccgttagaggtctaaacagaggagatagaccatgaacgggataaacctggcggcagcgcaaaagatg

SEQ ID NO: 43955 - DNA, 103 bp, Artificial Sequence
  Synthetic Polynucleotide
taatacgactcactatagggctgaaatcatattcatatatcccgttagagaacagaggagactctaaatggatatatgaaacctggcggcagcgcaaaagatg

SEQ ID NO: 43956 - DNA, 103 bp, Artificial Sequence
  Synthetic Polynucleotide
taatacgactcactatagggagtatctgaaatcatattcatatatcccgtaacagaggagaacgggaatgatgaatatgaacctggcggcagcgcaaaagatg

SEQ ID NO: 43957 - DNA, 103 bp, Artificial Sequence
  Synthetic Polynucleotide
taatacgactcactatagggaatatagtatctgaaatcatattcatatataacagaggagaatatatatgtatgatttcaacctggcggcagcgcaaaagatg

SEQ ID NO: 43958 - DNA, 103 bp, Artificial Sequence
  Synthetic Polynucleotide
taatacgactcactataggggaacaaatatagtatctgaaatcatattcaaacagaggagatgaataatgtttcagataaacctggcggcagcgcaaaagatg

SEQ ID NO: 43959 - DNA, 103 bp, Artificial Sequence
  Synthetic Polynucleotide
taatacgactcactatagggtgcatttgtatattatctctcatctgtattaacagaggagaaatacaatggagagataaaacctggcggcagcgcaaaagatg

SEQ ID NO: 43960 - DNA, 103 bp, Artificial Sequence
  Synthetic Polynucleotide
taatacgactcactatagggtacaggaacaaatatagtatctgaaatcataacagaggagaatgattatggatactataaacctggcggcagcgcaaaagatg

SEQ ID NO: 43961 - DNA, 103 bp, Artificial Sequence
  Synthetic Polynucleotide
taatacgactcactatagggttatctacaggaacaaatatagtatctgaaaacagaggagattcagaatgtatatttgtaacctggcggcagcgcaaaagatg

SEQ ID NO: 43962 - DNA, 103 bp, Artificial Sequence
  Synthetic Polynucleotide
taatacgactcactatagggagttattatctacaggaacaaatatagtataacagaggagaatactaatgttgttcctgaacctggcggcagcgcaaaagatg

SEQ ID NO: 43963 - DNA, 103 bp, Artificial Sequence
  Synthetic Polynucleotide
taatacgactcactatagggtttttagttattatctacaggaacaaatataacagaggagaatatttatgcctgtagataacctggcggcagcgcaaaagatg

SEQ ID NO: 43964 - DNA, 103 bp, Artificial Sequence
  Synthetic Polynucleotide
taatacgactcactatagggtttgatttttagttattatctacaggaacaaacagaggagatgttccatgagataataaaacctggcggcagcgcaaaagatg

SEQ ID NO: 43965 - DNA, 103 bp, Artificial Sequence
  Synthetic Polynucleotide
taatacgactcactatagggtagagtttgatttttagttattatctacagaacagaggagactgtagatgataactaaaaacctggcggcagcgcaaaagatg

SEQ ID NO: 43966 - DNA, 103 bp, Artificial Sequence
  Synthetic Polynucleotide
taatacgactcactataggggtcattagagtttgatttttagttattatcaacagaggagagataatatgtaaaaatcaaacctggcggcagcgcaaaagatg

SEQ ID NO: 43967 - DNA, 103 bp, Artificial Sequence
  Synthetic Polynucleotide
taatacgactcactatagggatgtggtcattagagtttgatttttagttaaacagaggagataactaatgatcaaactcaacctggcggcagcgcaaaagatg

SEQ ID NO: 43968 - DNA, 103 bp, Artificial Sequence
  Synthetic Polynucleotide
taatacgactcactatagggaaaagatgtggtcattagagtttgatttttaacagaggagaaaaaatatgactctaatgaacctggcggcagcgcaaaagatg

SEQ ID NO: 43969 - DNA, 103 bp, Artificial Sequence
  Synthetic Polynucleotide
taatacgactcactatagggctaaaaaaagatgtggtcattagagtttgaaacagaggagatcaaacatgaatgaccacaacctggcggcagcgcaaaagatg

SEQ ID NO: 43970 - DNA, 103 bp, Artificial Sequence
  Synthetic Polynucleotide
taatacgactcactatagggcgtattgcatttgtatattatctctcatctaacagaggagaagatgaatgataatatacaacctggcggcagcgcaaaagatg

SEQ ID NO: 43971 - DNA, 103 bp, Artificial Sequence
  Synthetic Polynucleotide
taatacgactcactatagggcatctctaaaaaaagatgtggtcattagagaacagaggagactctaaatgccacatcttaacctggcggcagcgcaaaagatg

SEQ ID NO: 43972 - DNA, 103 bp, Artificial Sequence
  Synthetic Polynucleotide
taatacgactcactatagggtttttcatctctaaaaaaagatgtggtcataacagaggagaatgaccatgtctttttttaacctggcggcagcgcaaaagatg

SEQ ID NO: 43973 - DNA, 103 bp, Artificial Sequence
  Synthetic Polynucleotide
taatacgactcactataggggaaaatttttcatctctaaaaaaagatgtgaacagaggagacacatcatgttttagagaaacctggcggcagcgcaaaagatg

SEQ ID NO: 43974 - DNA, 103 bp, Artificial Sequence
  Synthetic Polynucleotide
taatacgactcactatagggatgtggaaaatttttcatctctaaaaaaagaacagaggagactttttatggagatgaaaaacctggcggcagcgcaaaagatg

SEQ ID NO: 43975 - DNA, 103 bp, Artificial Sequence
  Synthetic Polynucleotide
taatacgactcactatagggaggagatgtggaaaatttttcatctctaaaaacagaggagatttagaatggaaaaatttaacctggcggcagcgcaaaagatg

SEQ ID NO: 43976 - DNA, 103 bp, Artificial Sequence
  Synthetic Polynucleotide
taatacgactcactatagggacaaaaggagatgtggaaaatttttcatctaacagaggagaagatgaatgattttccacaacctggcggcagcgcaaaagatg

SEQ ID NO: 43977 - DNA, 103 bp, Artificial Sequence
  Synthetic Polynucleotide
taatacgactcactatagggtatctacaaaaggagatgtggaaaatttttaacagaggagaaaaaatatgccacatctcaacctggcggcagcgcaaaagatg

SEQ ID NO: 43978 - DNA, 103 bp, Artificial Sequence
  Synthetic Polynucleotide
taatacgactcactatagggagtcatatctacaaaaggagatgtggaaaaaacagaggagattttccatgtctccttttaacctggcggcagcgcaaaagatg

SEQ ID NO: 43979 - DNA, 103 bp, Artificial Sequence
  Synthetic Polynucleotide
taatacgactcactatagggtgtttagtcatatctacaaaaggagatgtgaacagaggagacacatcatgttttgtagaaacctggcggcagcgcaaaagatg

SEQ ID NO: 43980 - DNA, 103 bp, Artificial Sequence
  Synthetic Polynucleotide
taatacgactcactatagggcaaaatgtttagtcatatctacaaaaggagaacagaggagactccttatgtagatatgaaacctggcggcagcgcaaaagatg

SEQ ID NO: 43981 - DNA, 103 bp, Artificial Sequence
  Synthetic Polynucleotide
taatacgactcactatagggggtaccgtattgcatttgtatattatctctaacagaggagaagagatatgatacaaatgaacctggcggcagcgcaaaagatg

SEQ ID NO: 43982 - DNA, 103 bp, Artificial Sequence
  Synthetic Polynucleotide
taatacgactcactatagggttctgcaaaatgtttagtcatatctacaaaaacagaggagatttgtaatgatgactaaaaacctggcggcagcgcaaaagatg

SEQ ID NO: 43983 - DNA, 103 bp, Artificial Sequence
  Synthetic Polynucleotide
taatacgactcactatagggcttttttctgcaaaatgtttagtcatatctaacagaggagaagatatatgtaaacatttaacctggcggcagcgcaaaagatg

SEQ ID NO: 43984 - DNA, 103 bp, Artificial Sequence
  Synthetic Polynucleotide
taatacgactcactatagggataaacttttttctgcaaaatgtttagtcaaacagaggagatgactaatgattttgcagaacctggcggcagcgcaaaagatg

SEQ ID NO: 43985 - DNA, 103 bp, Artificial Sequence
  Synthetic Polynucleotide
taatacgactcactatagggcactaataaacttttttctgcaaaatgtttaacagaggagaaaacatatggcagaaaaaaacctggcggcagcgcaaaagatg

SEQ ID NO: 43986 - DNA, 103 bp, Artificial Sequence
  Synthetic Polynucleotide
taatacgactcactatagggctaaacactaataaacttttttctgcaaaaaacagaggagattttgcatgaaaaagtttaacctggcggcagcgcaaaagatg

SEQ ID NO: 43987 - DNA, 103 bp, Artificial Sequence
  Synthetic Polynucleotide
taatacgactcactatagggattatctaaacactaataaacttttttctgaacagaggagacagaaaatggtttattagaacctggcggcagcgcaaaagatg

SEQ ID NO: 43988 - DNA, 103 bp, Artificial Sequence
  Synthetic Polynucleotide
taatacgactcactatagggatacgattatctaaacactaataaacttttaacagaggagaaaaagtatgttagtgtttaacctggcggcagcgcaaaagatg

SEQ ID NO: 43989 - DNA, 103 bp, Artificial Sequence
  Synthetic Polynucleotide
taatacgactcactataggggaagtatacgattatctaaacactaataaaaacagaggagatttattatggtttagataaacctggcggcagcgcaaaagatg

SEQ ID NO: 43990 - DNA, 103 bp, Artificial Sequence
  Synthetic Polynucleotide
taatacgactcactatagggctgatgaagtatacgattatctaaacactaaacagaggagatagtgtatggataatcgtaacctggcggcagcgcaaaagatg

SEQ ID NO: 43991 - DNA, 103 bp, Artificial Sequence
  Synthetic Polynucleotide
taatacgactcactatagggctacactgatgaagtatacgattatctaaaaacagaggagatttagaatgtcgtatactaacctggcggcagcgcaaaagatg

SEQ ID NO: 43992 - DNA, 103 bp, Artificial Sequence
  Synthetic Polynucleotide
taatacgactcactatagggattgcggtaccgtattgcatttgtatattaaacagaggagataatatatgaatgcaataaacctggcggcagcgcaaaagatg

SEQ ID NO: 43993 - DNA, 103 bp, Artificial Sequence
  Synthetic Polynucleotide
taatacgactcactatagggactatctacactgatgaagtatacgattataacagaggagaataatcatgtacttcatcaacctggcggcagcgcaaaagatg

SEQ ID NO: 43994 - DNA, 103 bp, Artificial Sequence
  Synthetic Polynucleotide
taatacgactcactatagggcatttactatctacactgatgaagtatacgaacagaggagacgtataatgcatcagtgtaacctggcggcagcgcaaaagatg

SEQ ID NO: 43995 - DNA, 103 bp, Artificial Sequence
  Synthetic Polynucleotide
taatacgactcactataggggttcacatttactatctacactgatgaagtaacagaggagaacttcaatggtgtagataaacctggcggcagcgcaaaagatg

SEQ ID NO: 43996 - DNA, 103 bp, Artificial Sequence
  Synthetic Polynucleotide
taatacgactcactatagggtatctgttcacatttactatctacactgataacagaggagaatcagtatggatagtaaaaacctggcggcagcgcaaaagatg

SEQ ID NO: 43997 - DNA, 103 bp, Artificial Sequence
  Synthetic Polynucleotide
taatacgactcactatagggccttttatctgttcacatttactatctacaaacagaggagatgtagaatgtaaatgtgaaacctggcggcagcgcaaaagatg

SEQ ID NO: 43998 - DNA, 103 bp, Artificial Sequence
  Synthetic Polynucleotide
taatacgactcactataggggaataccttttatctgttcacatttactataacagaggagaatagtaatggtgaacagaaacctggcggcagcgcaaaagatg

SEQ ID NO: 43999 - DNA, 103 bp, Artificial Sequence
  Synthetic Polynucleotide
taatacgactcactatagggagcaagaataccttttatctgttcacatttaacagaggagaaaatgtatgcagataaaaaacctggcggcagcgcaaaagatg

SEQ ID NO: 44000 - DNA, 103 bp, Artificial Sequence
  Synthetic Polynucleotide
taatacgactcactatagggtattgagcaagaataccttttatctgttcaaacagaggagatgaacaatgaaaaggtataacctggcggcagcgcaaaagatg

SEQ ID NO: 44001 - DNA, 103 bp, Artificial Sequence
  Synthetic Polynucleotide
taatacgactcactatagggcaatctattgagcaagaataccttttatctaacagaggagaagataaatggtattcttgaacctggcggcagcgcaaaagatg

SEQ ID NO: 44002 - DNA, 103 bp, Artificial Sequence
  Synthetic Polynucleotide
taatacgactcactatagggtttaccaatctattgagcaagaatacctttaacagaggagaaaaggtatgcttgctcaaaacctggcggcagcgcaaaagatg

SEQ ID NO: 44003 - DNA, 103 bp, Artificial Sequence
  Synthetic Polynucleotide
taatacgactcactatagggacaaaattgcggtaccgtattgcatttgtaaacagaggagatacaaaatgaatacggtaaacctggcggcagcgcaaaagatg

SEQ ID NO: 44004 - DNA, 103 bp, Artificial Sequence
  Synthetic Polynucleotide
taatacgactcactatagggtggaatttaccaatctattgagcaagaataaacagaggagatattctatgtcaatagataacctggcggcagcgcaaaagatg

SEQ ID NO: 44005 - DNA, 103 bp, Artificial Sequence
  Synthetic Polynucleotide
taatacgactcactatagggttctatggaatttaccaatctattgagcaaaacagaggagattgctcatgagattggtaaacctggcggcagcgcaaaagatg

SEQ ID NO: 44006 - DNA, 103 bp, Artificial Sequence
  Synthetic Polynucleotide
taatacgactcactatagggatatattctatggaatttaccaatctattgaacagaggagacaatagatgggtaaattcaacctggcggcagcgcaaaagatg

SEQ ID NO: 44007 - DNA, 103 bp, Artificial Sequence
  Synthetic Polynucleotide
taatacgactcactataggggattaatatattctatggaatttaccaatcaacagaggagagattggatgattccatagaacctggcggcagcgcaaaagatg

SEQ ID NO: 44008 - DNA, 103 bp, Artificial Sequence
  Synthetic Polynucleotide
taatacgactcactatagggaaaaggattaatatattctatggaatttacaacagaggagagtaaatatgatagaatataacctggcggcagcgcaaaagatg

SEQ ID NO: 44009 - DNA, 103 bp, Artificial Sequence
  Synthetic Polynucleotide
taatacgactcactatagggaagaaaaaaggattaatatattctatggaaaacagaggagattccatatgatatattaaaacctggcggcagcgcaaaagatg

SEQ ID NO: 44010 - DNA, 103 bp, Artificial Sequence
  Synthetic Polynucleotide
taatacgactcactatagggatctcaagaaaaaaggattaatatattctaaacagaggagatagaatatgttaatccttaacctggcggcagcgcaaaagatg

SEQ ID NO: 44011 - DNA, 103 bp, Artificial Sequence
  Synthetic Polynucleotide
taatacgactcactataggggtgggatctcaagaaaaaaggattaatataaacagaggagatatattatgccttttttcaacctggcggcagcgcaaaagatg

SEQ ID NO: 44012 - DNA, 103 bp, Artificial Sequence
  Synthetic Polynucleotide
taatacgactcactatagggatgatgtgggatctcaagaaaaaaggattaaacagaggagataatccatgtttcttgagaacctggcggcagcgcaaaagatg

SEQ ID NO: 44013 - DNA, 103 bp, Artificial Sequence
  Synthetic Polynucleotide
taatacgactcactatagggttgaaatgatgtgggatctcaagaaaaaagaacagaggagactttttatgtgagatcccaacctggcggcagcgcaaaagatg

SEQ ID NO: 44014 - DNA, 103 bp, Artificial Sequence
  Synthetic Polynucleotide
taatacgactcactatagggattattacgtctacaataaatgcaaaccataacagaggagaatggttatgatttattgtaacctggcggcagcgcaaaagatg

SEQ ID NO: 44015 - DNA, 103 bp, Artificial Sequence
  Synthetic Polynucleotide
taatacgactcactatagggactgatgcaacggagctctttggtagcgagaacagaggagactcgctatgaaagagctcaacctggcggcagcgcaaaagatg

SEQ ID NO: 44016 - DNA, 103 bp, Artificial Sequence
  Synthetic Polynucleotide
taatacgactcactatagggcaaccacaaaattgcggtaccgtattgcataacagaggagaatgcaaatgggtaccgcaaacctggcggcagcgcaaaagatg

SEQ ID NO: 44017 - DNA, 103 bp, Artificial Sequence
  Synthetic Polynucleotide
taatacgactcactatagggtctggttgaaatgatgtgggatctcaagaaaacagaggagattcttgatgtcccacatcaacctggcggcagcgcaaaagatg

SEQ ID NO: 44018 - DNA, 103 bp, Artificial Sequence
  Synthetic Polynucleotide
taatacgactcactatagggacttctctggttgaaatgatgtgggatctcaacagaggagagagatcatgcatcatttcaacctggcggcagcgcaaaagatg

SEQ ID NO: 44019 - DNA, 103 bp, Artificial Sequence
  Synthetic Polynucleotide
taatacgactcactatagggataaaacttctctggttgaaatgatgtgggaacagaggagacccacaatgtttcaaccaaacctggcggcagcgcaaaagatg

SEQ ID NO: 44020 - DNA, 103 bp, Artificial Sequence
  Synthetic Polynucleotide
taatacgactcactatagggattggataaaacttctctggttgaaatgataacagaggagaatcattatgaccagagaaaacctggcggcagcgcaaaagatg

SEQ ID NO: 44021 - DNA, 103 bp, Artificial Sequence
  Synthetic Polynucleotide
taatacgactcactatagggaaattattggataaaacttctctggttgaaaacagaggagattcaacatgagaagttttaacctggcggcagcgcaaaagatg

SEQ ID NO: 44022 - DNA, 103 bp, Artificial Sequence
  Synthetic Polynucleotide
taatacgactcactataggggaggtaaattattggataaaacttctctggaacagaggagaccagagatgttttatccaaacctggcggcagcgcaaaagatg

SEQ ID NO: 44023 - DNA, 103 bp, Artificial Sequence
  Synthetic Polynucleotide
taatacgactcactatagggagtacgaggtaaattattggataaaacttcaacagaggagagaagttatgtccaataataacctggcggcagcgcaaaagatg

SEQ ID NO: 44024 - DNA, 103 bp, Artificial Sequence
  Synthetic Polynucleotide
taatacgactcactatagggggtatagtacgaggtaaattattggataaaaacagaggagatttatcatgtaatttaccaacctggcggcagcgcaaaagatg

SEQ ID NO: 44025 - DNA, 103 bp, Artificial Sequence
  Synthetic Polynucleotide
taatacgactcactatagggtatgtggtatagtacgaggtaaattattggaacagaggagaccaataatgtacctcgtaaacctggcggcagcgcaaaagatg

SEQ ID NO: 44026 - DNA, 103 bp, Artificial Sequence
  Synthetic Polynucleotide
taatacgactcactatagggttttgtatgtggtatagtacgaggtaaattaacagaggagaaatttaatgcgtactataaacctggcggcagcgcaaaagatg

SEQ ID NO: 44027 - DNA, 103 bp, Artificial Sequence
  Synthetic Polynucleotide
taatacgactcactatagggattatcaaccacaaaattgcggtaccgtataacagaggagaatacggatgcgcaattttaacctggcggcagcgcaaaagatg

SEQ ID NO: 44028 - DNA, 103 bp, Artificial Sequence
  Synthetic Polynucleotide
taatacgactcactatagggtctagttttgtatgtggtatagtacgaggtaacagaggagaacctcgatgtataccacaaacctggcggcagcgcaaaagatg

SEQ ID NO: 44029 - DNA, 103 bp, Artificial Sequence
  Synthetic Polynucleotide
taatacgactcactatagggcaaaatctagttttgtatgtggtatagtacaacagaggagagtactaatgcacatacaaaacctggcggcagcgcaaaagatg

SEQ ID NO: 44030 - DNA, 103 bp, Artificial Sequence
  Synthetic Polynucleotide
taatacgactcactatagggcactacaaaatctagttttgtatgtggtataacagaggagaataccaatgacaaaactaaacctggcggcagcgcaaaagatg

SEQ ID NO: 44031 - DNA, 103 bp, Artificial Sequence
  Synthetic Polynucleotide
taatacgactcactataggggacgtcactacaaaatctagttttgtatgtaacagaggagaacatacatgactagatttaacctggcggcagcgcaaaagatg

SEQ ID NO: 44032 - DNA, 103 bp, Artificial Sequence
  Synthetic Polynucleotide
taatacgactcactatagggggtacgacgtcactacaaaatctagttttgaacagaggagacaaaacatgattttgtagaacctggcggcagcgcaaaagatg

SEQ ID NO: 44033 - DNA, 103 bp, Artificial Sequence
  Synthetic Polynucleotide
taatacgactcactatagggtgccaggtacgacgtcactacaaaatctagaacagaggagactagatatggtagtgacgaacctggcggcagcgcaaaagatg

SEQ ID NO: 44034 - DNA, 103 bp, Artificial Sequence
  Synthetic Polynucleotide
taatacgactcactatagggaggaatgccaggtacgacgtcactacaaaaaacagaggagattttgtatggacgtcgtaaacctggcggcagcgcaaaagatg

SEQ ID NO: 44035 - DNA, 103 bp, Artificial Sequence
  Synthetic Polynucleotide
taatacgactcactatagggttggtaggaatgccaggtacgacgtcactaaacagaggagatagtgaatgcgtacctggaacctggcggcagcgcaaaagatg

SEQ ID NO: 44036 - DNA, 103 bp, Artificial Sequence
  Synthetic Polynucleotide
taatacgactcactatagggtttgtttggtaggaatgccaggtacgacgtaacagaggagaacgtcgatgctggcattcaacctggcggcagcgcaaaagatg

SEQ ID NO: 44037 - DNA, 103 bp, Artificial Sequence
  Synthetic Polynucleotide
taatacgactcactatagggaaaattttgtttggtaggaatgccaggtacaacagaggagagtacctatgattcctaccaacctggcggcagcgcaaaagatg

SEQ ID NO: 44038 - DNA, 103 bp, Artificial Sequence
  Synthetic Polynucleotide
taatacgactcactatagggtgatgattatcaaccacaaaattgcggtacaacagaggagagtaccgatgttttgtggtaacctggcggcagcgcaaaagatg

SEQ ID NO: 44039 - DNA, 103 bp, Artificial Sequence
  Synthetic Polynucleotide
taatacgactcactatagggaaagtaaaattttgtttggtaggaatgccaaacagaggagatggcatatgtaccaaacaaacctggcggcagcgcaaaagatg

SEQ ID NO: 44040 - DNA, 103 bp, Artificial Sequence
  Synthetic Polynucleotide
taatacgactcactatagggaactaaaagtaaaattttgtttggtaggaaaacagaggagattcctaatgaacaaaattaacctggcggcagcgcaaaagatg

SEQ ID NO: 44041 - DNA, 103 bp, Artificial Sequence
  Synthetic Polynucleotide
taatacgactcactatagggaaaaaaactaaaagtaaaattttgtttggtaacagaggagaaccaaaatgaattttactaacctggcggcagcgcaaaagatg

SEQ ID NO: 44042 - DNA, 103 bp, Artificial Sequence
  Synthetic Polynucleotide
taatacgactcactatagggtttctaaaaaaactaaaagtaaaattttgtaacagaggagaacaaaaatgtacttttagaacctggcggcagcgcaaaagatg

SEQ ID NO: 44043 - DNA, 103 bp, Artificial Sequence
  Synthetic Polynucleotide
taatacgactcactatagggagaattttctaaaaaaactaaaagtaaaataacagaggagaattttaatgttagtttttaacctggcggcagcgcaaaagatg

SEQ ID NO: 44044 - DNA, 103 bp, Artificial Sequence
  Synthetic Polynucleotide
taatacgactcactatagggaccttagaattttctaaaaaaactaaaagtaacagaggagaacttttatgttttttagaaacctggcggcagcgcaaaagatg

SEQ ID NO: 44045 - DNA, 103 bp, Artificial Sequence
  Synthetic Polynucleotide
taatacgactcactatagggattctaccttagaattttctaaaaaaactaaacagaggagatagtttatgtagaaaattaacctggcggcagcgcaaaagatg

SEQ ID NO: 44046 - DNA, 103 bp, Artificial Sequence
  Synthetic Polynucleotide
taatacgactcactatagggtagagattctaccttagaattttctaaaaaaacagaggagatttttaatgaattctaagaacctggcggcagcgcaaaagatg

SEQ ID NO: 44047 - DNA, 103 bp, Artificial Sequence
  Synthetic Polynucleotide
taatacgactcactatagggacaaatagagattctaccttagaattttctaacagaggagaagaaaaatgtaaggtagaaacctggcggcagcgcaaaagatg

SEQ ID NO: 44048 - DNA, 103 bp, Artificial Sequence
  Synthetic Polynucleotide
taatacgactcactatagggtattgacaaatagagattctaccttagaataacagaggagaattctaatgtagaatctcaacctggcggcagcgcaaaagatg

SEQ ID NO: 44049 - DNA, 103 bp, Artificial Sequence
  Synthetic Polynucleotide
taatacgactcactatagggacgtatgatgattatcaaccacaaaattgcaacagaggagagcaattatgtggttgataaacctggcggcagcgcaaaagatg

SEQ ID NO: 44050 - DNA, 103 bp, Artificial Sequence
  Synthetic Polynucleotide
taatacgactcactatagggtgacatattgacaaatagagattctaccttaacagaggagaaaggtaatgtctctatttaacctggcggcagcgcaaaagatg

SEQ ID NO: 44051 - DNA, 103 bp, Artificial Sequence
  Synthetic Polynucleotide
taatacgactcactatagggatagatgacatattgacaaatagagattctaacagaggagaagaatcatgatttgtcaaaacctggcggcagcgcaaaagatg

SEQ ID NO: 44052 - DNA, 103 bp, Artificial Sequence
  Synthetic Polynucleotide
taatacgactcactatagggattccatagatgacatattgacaaatagagaacagaggagactctatatgtcaatatgtaacctggcggcagcgcaaaagatg

SEQ ID NO: 44053 - DNA, 103 bp, Artificial Sequence
  Synthetic Polynucleotide
taatacgactcactatagggtggtaattccatagatgacatattgacaaaaacagaggagatttgtcatgatgtcatctaacctggcggcagcgcaaaagatg

SEQ ID NO: 44054 - DNA, 103 bp, Artificial Sequence
  Synthetic Polynucleotide
taatacgactcactataggggctagtggtaattccatagatgacatattgaacagaggagacaatatatgatctatggaaacctggcggcagcgcaaaagatg

SEQ ID NO: 44055 - DNA, 103 bp, Artificial Sequence
  Synthetic Polynucleotide
taatacgactcactatagggtttttgctagtggtaattccatagatgacaaacagaggagatgtcatatgtggaattacaacctggcggcagcgcaaaagatg

SEQ ID NO: 44056 - DNA, 103 bp, Artificial Sequence
  Synthetic Polynucleotide
taatacgactcactatagggatcattttttgctagtggtaattccatagaaacagaggagatctatgatgttaccactaaacctggcggcagcgcaaaagatg

SEQ ID NO: 44057 - DNA, 103 bp, Artificial Sequence
  Synthetic Polynucleotide
taatacgactcactatagggtttctatcattttttgctagtggtaattccaacagaggagaggaattatgactagcaaaaacctggcggcagcgcaaaagatg

SEQ ID NO: 44058 - DNA, 103 bp, Artificial Sequence
  Synthetic Polynucleotide
taatacgactcactatagggatatatttctatcattttttgctagtggtaaacagaggagataccacatgcaaaaaatgaacctggcggcagcgcaaaagatg

SEQ ID NO: 44059 - DNA, 103 bp, Artificial Sequence
  Synthetic Polynucleotide
taatacgactcactatagggtcaatatatatttctatcattttttgctagaacagaggagactagcaatgaatgatagaaacctggcggcagcgcaaaagatg

SEQ ID NO: 44060 - DNA, 103 bp, Artificial Sequence
  Synthetic Polynucleotide
taatacgactcactataggggatacacgtatgatgattatcaaccacaaaaacagaggagatttgtgatggataatcataacctggcggcagcgcaaaagatg

SEQ ID NO: 44061 - DNA, 103 bp, Artificial Sequence
  Synthetic Polynucleotide
taatacgactcactatagggatgtatcaatatatatttctatcattttttaacagaggagaaaaaaaatgtagaaatataacctggcggcagcgcaaaagatg

SEQ ID NO: 44062 - DNA, 103 bp, Artificial Sequence
  Synthetic Polynucleotide
taatacgactcactatagggctgcgatgtatcaatatatatttctatcataacagaggagaatgataatgatatatattaacctggcggcagcgcaaaagatg

SEQ ID NO: 44063 - DNA, 103 bp, Artificial Sequence
  Synthetic Polynucleotide
taatacgactcactatagggaccagctgcgatgtatcaatatatatttctaacagaggagaagaaatatgtattgatacaacctggcggcagcgcaaaagatg

SEQ ID NO: 44064 - DNA, 103 bp, Artificial Sequence
  Synthetic Polynucleotide
taatacgactcactatagggtcaaaaccagctgcgatgtatcaatatataaacagaggagatatataatgatacatcgcaacctggcggcagcgcaaaagatg

SEQ ID NO: 44065 - DNA, 103 bp, Artificial Sequence
  Synthetic Polynucleotide
taatacgactcactataggggtagatcaaaaccagctgcgatgtatcaataacagaggagaattgatatgtcgcagctgaacctggcggcagcgcaaaagatg

SEQ ID NO: 44066 - DNA, 103 bp, Artificial Sequence
  Synthetic Polynucleotide
taatacgactcactatagggatatagtagatcaaaaccagctgcgatgtaaacagaggagatacatcatggctggttttaacctggcggcagcgcaaaagatg

SEQ ID NO: 44067 - DNA, 103 bp, Artificial Sequence
  Synthetic Polynucleotide
taatacgactcactatagggttaaaatatagtagatcaaaaccagctgcgaacagaggagacgcagcatgttttgatctaacctggcggcagcgcaaaagatg

SEQ ID NO: 44068 - DNA, 103 bp, Artificial Sequence
  Synthetic Polynucleotide
taatacgactcactatagggcgtttttaaaatatagtagatcaaaaccagaacagaggagactggttatgatctactataacctggcggcagcgcaaaagatg

SEQ ID NO: 44069 - DNA, 103 bp, Artificial Sequence
  Synthetic Polynucleotide
taatacgactcactatagggtgattcgtttttaaaatatagtagatcaaaaacagaggagatttgatatgctatattttaacctggcggcagcgcaaaagatg

SEQ ID NO: 44070 - DNA, 103 bp, Artificial Sequence
  Synthetic Polynucleotide
taatacgactcactataggggaatctgattcgtttttaaaatatagtagaaacagaggagatctactatgttttaaaaaaacctggcggcagcgcaaaagatg

SEQ ID NO: 44071 - DNA, 103 bp, Artificial Sequence
  Synthetic Polynucleotide
taatacgactcactataggggtatggatacacgtatgatgattatcaaccaacagaggagaggttgaatgtcatcatacaacctggcggcagcgcaaaagatg

SEQ ID NO: 44072 - DNA, 103 bp, Artificial Sequence
  Synthetic Polynucleotide
taatacgactcactatagggttatggaatctgattcgtttttaaaatataaacagaggagatatattatgaaaacgaataacctggcggcagcgcaaaagatg

SEQ ID NO: 44073 - DNA, 103 bp, Artificial Sequence
  Synthetic Polynucleotide
taatacgactcactatagggggcaattatggaatctgattcgtttttaaaaacagaggagatttaaaatggaatcagataacctggcggcagcgcaaaagatg

SEQ ID NO: 44074 - DNA, 103 bp, Artificial Sequence
  Synthetic Polynucleotide
taatacgactcactatagggatacaggcaattatggaatctgattcgtttaacagaggagaaaacgaatgagattccataacctggcggcagcgcaaaagatg

SEQ ID NO: 44075 - DNA, 103 bp, Artificial Sequence
  Synthetic Polynucleotide
taatacgactcactatagggatgatatacaggcaattatggaatctgattaacagaggagaaatcagatgccataattgaacctggcggcagcgcaaaagatg

SEQ ID NO: 44076 - DNA, 103 bp, Artificial Sequence
  Synthetic Polynucleotide
taatacgactcactatagggagctgatgatatacaggcaattatggaatcaacagaggagagattccatgattgcctgtaacctggcggcagcgcaaaagatg

SEQ ID NO: 44077 - DNA, 103 bp, Artificial Sequence
  Synthetic Polynucleotide
taatacgactcactatagggttttcagctgatgatatacaggcaattatgaacagaggagacataatatgctgtatatcaacctggcggcagcgcaaaagatg

SEQ ID NO: 44078 - DNA, 103 bp, Artificial Sequence
  Synthetic Polynucleotide
taatacgactcactatagggatagtttttcagctgatgatatacaggcaaaacagaggagattgcctatgtatcatcagaacctggcggcagcgcaaaagatg

SEQ ID NO: 44079 - DNA, 103 bp, Artificial Sequence
  Synthetic Polynucleotide
taatacgactcactatagggaaaacatagtttttcagctgatgatatacaaacagaggagatgtataatgtcagctgaaaacctggcggcagcgcaaaagatg

SEQ ID NO: 44080 - DNA, 103 bp, Artificial Sequence
  Synthetic Polynucleotide
taatacgactcactatagggcgtgtaaaacatagtttttcagctgatgataacagaggagaatcatcatgtgaaaaactaacctggcggcagcgcaaaagatg

SEQ ID NO: 44081 - DNA, 103 bp, Artificial Sequence
  Synthetic Polynucleotide
taatacgactcactataggggaatacgtgtaaaacatagtttttcagctgaacagaggagacagctgatgaactatgttaacctggcggcagcgcaaaagatg

SEQ ID NO: 44082 - DNA, 103 bp, Artificial Sequence
  Synthetic Polynucleotide
taatacgactcactataggggacgagtatggatacacgtatgatgattataacagaggagaataatcatgatacgtgtaaacctggcggcagcgcaaaagatg

SEQ ID NO: 44083 - DNA, 103 bp, Artificial Sequence
  Synthetic Polynucleotide
taatacgactcactatagggcgaaggaatacgtgtaaaacatagtttttcaacagaggagagaaaaaatgtgttttacaaacctggcggcagcgcaaaagatg

SEQ ID NO: 44084 - DNA, 103 bp, Artificial Sequence
  Synthetic Polynucleotide
taatacgactcactatagggaatgccgaaggaatacgtgtaaaacatagtaacagaggagaactatgatgtacacgtataacctggcggcagcgcaaaagatg

SEQ ID NO: 44085 - DNA, 103 bp, Artificial Sequence
  Synthetic Polynucleotide
taatacgactcactatagggaaagaaatgccgaaggaatacgtgtaaaacaacagaggagagttttaatggtattccttaacctggcggcagcgcaaaagatg

SEQ ID NO: 44086 - DNA, 103 bp, Artificial Sequence
  Synthetic Polynucleotide
taatacgactcactatagggattaaaaagaaatgccgaaggaatacgtgtaacagaggagaacacgtatgccttcggcaaacctggcggcagcgcaaaagatg

SEQ ID NO: 44087 - DNA, 103 bp, Artificial Sequence
  Synthetic Polynucleotide
taatacgactcactatagggatatcattaaaaagaaatgccgaaggaataaacagaggagatattccatgggcatttctaacctggcggcagcgcaaaagatg

SEQ ID NO: 44088 - DNA, 103 bp, Artificial Sequence
  Synthetic Polynucleotide
taatacgactcactatagggaagatatatcattaaaaagaaatgccgaagaacagaggagacttcggatgttctttttaaacctggcggcagcgcaaaagatg

SEQ ID NO: 44089 - DNA, 103 bp, Artificial Sequence
  Synthetic Polynucleotide
taatacgactcactatagggtaaacaagatatatcattaaaaagaaatgcaacagaggagagcatttatgtttaatgataacctggcggcagcgcaaaagatg

SEQ ID NO: 44090 - DNA, 103 bp, Artificial Sequence
  Synthetic Polynucleotide
taatacgactcactatagggttgtctaaacaagatatatcattaaaaagaaacagaggagatcttttatgtgatatatcaacctggcggcagcgcaaaagatg

SEQ ID NO: 44091 - DNA, 103 bp, Artificial Sequence
  Synthetic Polynucleotide
taatacgactcactatagggtatcattgtctaaacaagatatatcattaaaacagaggagattaatgatgtatcttgttaacctggcggcagcgcaaaagatg

SEQ ID NO: 44092 - DNA, 103 bp, Artificial Sequence
  Synthetic Polynucleotide
taatacgactcactatagggaactttatcattgtctaaacaagatatatcaacagaggagagatataatgtgtttagacaacctggcggcagcgcaaaagatg

SEQ ID NO: 44093 - DNA, 103 bp, Artificial Sequence
  Synthetic Polynucleotide
taatacgactcactatagggaggatgacgagtatggatacacgtatgatgaacagaggagacatcatatgtgtatccataacctggcggcagcgcaaaagatg

SEQ ID NO: 44094 - DNA, 103 bp, Artificial Sequence
  Synthetic Polynucleotide
taatacgactcactatagggatgataactttatcattgtctaaacaagataacagaggagaatcttgatgagacaatgaaacctggcggcagcgcaaaagatg

SEQ ID NO: 44095 - DNA, 103 bp, Artificial Sequence
  Synthetic Polynucleotide
taatacgactcactatagggtggacatgataactttatcattgtctaaacaacagaggagagtttagatgatgataaagaacctggcggcagcgcaaaagatg

SEQ ID NO: 44096 - DNA, 103 bp, Artificial Sequence
  Synthetic Polynucleotide
taatacgactcactatagggtctcatggacatgataactttatcattgtcaacagaggagagacaatatgaaagttatcaacctggcggcagcgcaaaagatg

SEQ ID NO: 44097 - DNA, 103 bp, Artificial Sequence
  Synthetic Polynucleotide
taatacgactcactataggggcgtctctcatggacatgataactttatcaaacagaggagatgataaatgtatcatgtcaacctggcggcagcgcaaaagatg

SEQ ID NO: 44098 - DNA, 103 bp, Artificial Sequence
  Synthetic Polynucleotide
taatacgactcactataggggagacgcgtctctcatggacatgataacttaacagaggagaaagttaatgtgtccatgaaacctggcggcagcgcaaaagatg

SEQ ID NO: 44099 - DNA, 103 bp, Artificial Sequence
  Synthetic Polynucleotide
taatacgactcactatagggatacggagacgcgtctctcatggacatgataacagaggagaatcatgatgatgagagacaacctggcggcagcgcaaaagatg

SEQ ID NO: 44100 - DNA, 103 bp, Artificial Sequence
  Synthetic Polynucleotide
taatacgactcactatagggatacgatacggagacgcgtctctcatggacaacagaggagagtccatatgagacgcgtcaacctggcggcagcgcaaaagatg

SEQ ID NO: 44101 - DNA, 103 bp, Artificial Sequence
  Synthetic Polynucleotide
taatacgactcactatagggtatttatacgatacggagacgcgtctctcaaacagaggagatgagagatgcgtctccgtaacctggcggcagcgcaaaagatg

SEQ ID NO: 44102 - DNA, 103 bp, Artificial Sequence
  Synthetic Polynucleotide
taatacgactcactatagggtgaaatatttatacgatacggagacgcgtcaacagaggagagacgcgatgccgtatcgtaacctggcggcagcgcaaaagatg

SEQ ID NO: 44103 - DNA, 103 bp, Artificial Sequence
  Synthetic Polynucleotide
taatacgactcactatagggtctaatgaaatatttatacgatacggagacaacagaggagagtctccatgtcgtataaaaacctggcggcagcgcaaaagatg

SEQ ID NO: 44104 - DNA, 103 bp, Artificial Sequence
  Synthetic Polynucleotide
taatacgactcactatagggttatgaggatgacgagtatggatacacgtaaacagaggagatacgtgatgccatactcgaacctggcggcagcgcaaaagatg

SEQ ID NO: 44105 - DNA, 103 bp, Artificial Sequence
  Synthetic Polynucleotide
taatacgactcactatagggtaacatctaatgaaatatttatacgatacgaacagaggagacgtatcatgtaaatatttaacctggcggcagcgcaaaagatg

SEQ ID NO: 44106 - DNA, 103 bp, Artificial Sequence
  Synthetic Polynucleotide
taatacgactcactataggggcgtctaacatctaatgaaatatttatacgaacagaggagacgtataatgatttcattaaacctggcggcagcgcaaaagatg

SEQ ID NO: 44107 - DNA, 103 bp, Artificial Sequence
  Synthetic Polynucleotide
taatacgactcactatagggatgaagcgtctaacatctaatgaaatatttaacagaggagaaaatatatgattagatgtaacctggcggcagcgcaaaagatg

SEQ ID NO: 44108 - DNA, 103 bp, Artificial Sequence
  Synthetic Polynucleotide
taatacgactcactatagggccctaatgaagcgtctaacatctaatgaaaaacagaggagatttcatatgatgttagacaacctggcggcagcgcaaaagatg

SEQ ID NO: 44109 - DNA, 103 bp, Artificial Sequence
  Synthetic Polynucleotide
taatacgactcactatagggtatacccctaatgaagcgtctaacatctaaaacagaggagattagatatgagacgcttcaacctggcggcagcgcaaaagatg

SEQ ID NO: 44110 - DNA, 103 bp, Artificial Sequence
  Synthetic Polynucleotide
taatacgactcactatagggagaagtatacccctaatgaagcgtctaacaaacagaggagatgttagatgcttcattagaacctggcggcagcgcaaaagatg

SEQ ID NO: 44111 - DNA, 103 bp, Artificial Sequence
  Synthetic Polynucleotide
taatacgactcactatagggcttatagaagtatacccctaatgaagcgtcaacagaggagagacgctatgttaggggtaaacctggcggcagcgcaaaagatg

SEQ ID NO: 44112 - DNA, 103 bp, Artificial Sequence
  Synthetic Polynucleotide
taatacgactcactataggggaaaccttatagaagtatacccctaatgaaaacagaggagattcattatgggtatacttaacctggcggcagcgcaaaagatg

SEQ ID NO: 44113 - DNA, 103 bp, Artificial Sequence
  Synthetic Polynucleotide
taatacgactcactatagggatcaagaaaccttatagaagtatacccctaaacagaggagataggggatgacttctataaacctggcggcagcgcaaaagatg

SEQ ID NO: 44114 - DNA, 103 bp, Artificial Sequence
  Synthetic Polynucleotide
taatacgactcactatagggggctaatcaagaaaccttatagaagtatacaacagaggagagtatacatgtataaggttaacctggcggcagcgcaaaagatg

SEQ ID NO: 44115 - DNA, 103 bp, Artificial Sequence
  Synthetic Polynucleotide
taatacgactcactataggggttctttatgaggatgacgagtatggatacaacagaggagagtatccatgctcgtcatcaacctggcggcagcgcaaaagatg

SEQ ID NO: 44116 - DNA, 103 bp, Artificial Sequence
  Synthetic Polynucleotide
taatacgactcactatagggtgatgggctaatcaagaaaccttatagaagaacagaggagacttctaatgggtttcttgaacctggcggcagcgcaaaagatg

SEQ ID NO: 44117 - DNA, 103 bp, Artificial Sequence
  Synthetic Polynucleotide
taatacgactcactatagggacaaatgatgggctaatcaagaaaccttataacagaggagaataaggatgcttgattagaacctggcggcagcgcaaaagatg

SEQ ID NO: 44118 - DNA, 103 bp, Artificial Sequence
  Synthetic Polynucleotide
taatacgactcactatagggacgcaacaaatgatgggctaatcaagaaacaacagaggagagtttctatgttagcccataacctggcggcagcgcaaaagatg

SEQ ID NO: 44119 - DNA, 103 bp, Artificial Sequence
  Synthetic Polynucleotide
taatacgactcactatagggtcttgacgcaacaaatgatgggctaatcaaaacagaggagattgattatgccatcatttaacctggcggcagcgcaaaagatg

SEQ ID NO: 44120 - DNA, 103 bp, Artificial Sequence
  Synthetic Polynucleotide
taatacgactcactataggggtagttcttgacgcaacaaatgatgggctaaacagaggagatagcccatgatttgttgcaacctggcggcagcgcaaaagatg

SEQ ID NO: 44121 - DNA, 103 bp, Artificial Sequence
  Synthetic Polynucleotide
taatacgactcactatagggcgatagtagttcttgacgcaacaaatgatgaacagaggagacatcatatgttgcgtcaaaacctggcggcagcgcaaaagatg

SEQ ID NO: 44122 - DNA, 103 bp, Artificial Sequence
  Synthetic Polynucleotide
taatacgactcactatagggacatccgatagtagttcttgacgcaacaaaaacagaggagatttgttatgtcaagaactaacctggcggcagcgcaaaagatg

SEQ ID NO: 44123 - DNA, 103 bp, Artificial Sequence
  Synthetic Polynucleotide
taatacgactcactatagggcaacaacatccgatagtagttcttgacgcaaacagaggagatgcgtcatgaactactataacctggcggcagcgcaaaagatg

SEQ ID NO: 44124 - DNA, 103 bp, Artificial Sequence
  Synthetic Polynucleotide
taatacgactcactatagggatacccaacaacatccgatagtagttcttgaacagaggagacaagaaatgctatcggataacctggcggcagcgcaaaagatg

SEQ ID NO: 44125 - DNA, 103 bp, Artificial Sequence
  Synthetic Polynucleotide
taatacgactcactatagggtagagatacccaacaacatccgatagtagtaacagaggagaactactatgggatgttgtaacctggcggcagcgcaaaagatg

SEQ ID NO: 44126 - DNA, 103 bp, Artificial Sequence
  Synthetic Polynucleotide
taatacgactcactatagggtcagaactgatgcaacggagctctttggtaaacagaggagataccaaatggctccgttgaacctggcggcagcgcaaaagatg

SEQ ID NO: 44127 - DNA, 103 bp, Artificial Sequence
  Synthetic Polynucleotide
taatacgactcactataggggcaatgttctttatgaggatgacgagtatgaacagaggagacatactatgcatcctcataacctggcggcagcgcaaaagatg

SEQ ID NO: 44128 - DNA, 103 bp, Artificial Sequence
  Synthetic Polynucleotide
taatacgactcactatagggaacactagagatacccaacaacatccgataaacagaggagatatcggatgttgttgggtaacctggcggcagcgcaaaagatg

SEQ ID NO: 44129 - DNA, 103 bp, Artificial Sequence
  Synthetic Polynucleotide
taatacgactcactatagggtgtgtaacactagagatacccaacaacatcaacagaggagagatgttatggggtatctcaacctggcggcagcgcaaaagatg

SEQ ID NO: 44130 - DNA, 103 bp, Artificial Sequence
  Synthetic Polynucleotide
taatacgactcactatagggggccatgtgtaacactagagatacccaacaaacagaggagatgttggatgtctctagtgaacctggcggcagcgcaaaagatg

SEQ ID NO: 44131 - DNA, 103 bp, Artificial Sequence
  Synthetic Polynucleotide
taatacgactcactatagggagtaaggccatgtgtaacactagagataccaacagaggagaggtatcatgagtgttacaaacctggcggcagcgcaaaagatg

SEQ ID NO: 44132 - DNA, 103 bp, Artificial Sequence
  Synthetic Polynucleotide
taatacgactcactatagggactttagtaaggccatgtgtaacactagagaacagaggagactctagatgtacacatggaacctggcggcagcgcaaaagatg

SEQ ID NO: 44133 - DNA, 103 bp, Artificial Sequence
  Synthetic Polynucleotide
taatacgactcactatagggcccaaactttagtaaggccatgtgtaacacaacagaggagagtgttaatgatggccttaaacctggcggcagcgcaaaagatg

SEQ ID NO: 44134 - DNA, 103 bp, Artificial Sequence
  Synthetic Polynucleotide
taatacgactcactatagggatttacccaaactttagtaaggccatgtgtaacagaggagaacacatatgcttactaaaaacctggcggcagcgcaaaagatg

SEQ ID NO: 44135 - DNA, 103 bp, Artificial Sequence
  Synthetic Polynucleotide
taatacgactcactatagggtagttatttacccaaactttagtaaggccaaacagaggagatggcctatgtaaagtttgaacctggcggcagcgcaaaagatg

SEQ ID NO: 44136 - DNA, 103 bp, Artificial Sequence
  Synthetic Polynucleotide
taatacgactcactatagggtatcatagttatttacccaaactttagtaaaacagaggagattactaatgtttgggtaaaacctggcggcagcgcaaaagatg

SEQ ID NO: 44137 - DNA, 103 bp, Artificial Sequence
  Synthetic Polynucleotide
taatacgactcactatagggagagatatcatagttatttacccaaactttaacagaggagaaaagttatggtaaataacaacctggcggcagcgcaaaagatg

SEQ ID NO: 44138 - DNA, 103 bp, Artificial Sequence
  Synthetic Polynucleotide
taatacgactcactatagggtggctgcaatgttctttatgaggatgacgaaacagaggagatcgtcaatgtcataaagaaacctggcggcagcgcaaaagatg

SEQ ID NO: 44139 - DNA, 103 bp, Artificial Sequence
  Synthetic Polynucleotide
taatacgactcactatagggttaatagagatatcatagttatttacccaaaacagaggagattgggtatgtaactatgaaacctggcggcagcgcaaaagatg

SEQ ID NO: 44140 - DNA, 103 bp, Artificial Sequence
  Synthetic Polynucleotide
taatacgactcactatagggtataattaatagagatatcatagttatttaaacagaggagataaataatgatgatatctaacctggcggcagcgcaaaagatg

SEQ ID NO: 44141 - DNA, 103 bp, Artificial Sequence
  Synthetic Polynucleotide
taatacgactcactatagggacatctataattaatagagatatcatagttaacagaggagaaactatatgatctctattaacctggcggcagcgcaaaagatg

SEQ ID NO: 44142 - DNA, 103 bp, Artificial Sequence
  Synthetic Polynucleotide
taatacgactcactatagggtatatacatctataattaatagagatatcaaacagaggagatgatatatgtattaattaaacctggcggcagcgcaaaagatg

SEQ ID NO: 44143 - DNA, 103 bp, Artificial Sequence
  Synthetic Polynucleotide
taatacgactcactatagggtgaaatatatacatctataattaatagagaaacagaggagatctctaatgattatagataacctggcggcagcgcaaaagatg

SEQ ID NO: 44144 - DNA, 103 bp, Artificial Sequence
  Synthetic Polynucleotide
taatacgactcactatagggacgaatgaaatatatacatctataattaataacagaggagaattaatatgagatgtataaacctggcggcagcgcaaaagatg

SEQ ID NO: 44145 - DNA, 103 bp, Artificial Sequence
  Synthetic Polynucleotide
taatacgactcactatagggccttgacgaatgaaatatatacatctataaaacagaggagattatagatgtatatatttaacctggcggcagcgcaaaagatg

SEQ ID NO: 44146 - DNA, 103 bp, Artificial Sequence
  Synthetic Polynucleotide
taatacgactcactatagggaatatccttgacgaatgaaatatatacatcaacagaggagagatgtaatgatttcattcaacctggcggcagcgcaaaagatg

SEQ ID NO: 44147 - DNA, 103 bp, Artificial Sequence
  Synthetic Polynucleotide
taatacgactcactatagggatactaatatccttgacgaatgaaatatataacagaggagaatatatatgattcgtcaaaacctggcggcagcgcaaaagatg

SEQ ID NO: 44148 - DNA, 103 bp, Artificial Sequence
  Synthetic Polynucleotide
taatacgactcactatagggagtcgatactaatatccttgacgaatgaaaaacagaggagatttcatatgtcaaggataaacctggcggcagcgcaaaagatg

SEQ ID NO: 44149 - DNA, 103 bp, Artificial Sequence
  Synthetic Polynucleotide
taatacgactcactataggggaaaatggctgcaatgttctttatgaggataacagaggagaatcctcatgaagaacattaacctggcggcagcgcaaaagatg

SEQ ID NO: 44150 - DNA, 103 bp, Artificial Sequence
  Synthetic Polynucleotide
taatacgactcactatagggtagcaagtcgatactaatatccttgacgaaaacagaggagattcgtcatggatattagtaacctggcggcagcgcaaaagatg

SEQ ID NO: 44151 - DNA, 103 bp, Artificial Sequence
  Synthetic Polynucleotide
taatacgactcactataggggacgatagcaagtcgatactaatatccttgaacagaggagacaaggaatgtagtatcgaaacctggcggcagcgcaaaagatg

SEQ ID NO: 44152 - DNA, 103 bp, Artificial Sequence
  Synthetic Polynucleotide
taatacgactcactatagggttaatgacgatagcaagtcgatactaatataacagaggagaatattaatgtcgacttgcaacctggcggcagcgcaaaagatg

SEQ ID NO: 44153 - DNA, 103 bp, Artificial Sequence
  Synthetic Polynucleotide
taatacgactcactatagggacgtattaatgacgatagcaagtcgatactaacagaggagaagtatcatgttgctatcgaacctggcggcagcgcaaaagatg

SEQ ID NO: 44154 - DNA, 103 bp, Artificial Sequence
  Synthetic Polynucleotide
taatacgactcactatagggattacacgtattaatgacgatagcaagtcgaacagaggagacgacttatgatcgtcattaacctggcggcagcgcaaaagatg

SEQ ID NO: 44155 - DNA, 103 bp, Artificial Sequence
  Synthetic Polynucleotide
taatacgactcactatagggattacattacacgtattaatgacgatagcaaacagaggagatgctatatgcattaatacaacctggcggcagcgcaaaagatg

SEQ ID NO: 44156 - DNA, 103 bp, Artificial Sequence
  Synthetic Polynucleotide
taatacgactcactatagggatatgattacattacacgtattaatgacgaaacagaggagatcgtcaatgatacgtgtaaacctggcggcagcgcaaaagatg

SEQ ID NO: 44157 - DNA, 103 bp, Artificial Sequence
  Synthetic Polynucleotide
taatacgactcactataggggatttatatgattacattacacgtattaataacagaggagaattaatatgtgtaatgtaaacctggcggcagcgcaaaagatg

SEQ ID NO: 44158 - DNA, 103 bp, Artificial Sequence
  Synthetic Polynucleotide
taatacgactcactatagggcgcatgatttatatgattacattacacgtaaacagaggagatacgtgatgtgtaatcataacctggcggcagcgcaaaagatg

SEQ ID NO: 44159 - DNA, 103 bp, Artificial Sequence
  Synthetic Polynucleotide
taatacgactcactataggggctatcgcatgatttatatgattacattacaacagaggagagtaatgatgtcatataaaaacctggcggcagcgcaaaagatg

SEQ ID NO: 44160 - DNA, 103 bp, Artificial Sequence
  Synthetic Polynucleotide
taatacgactcactatagggtcatagaaaatggctgcaatgttctttatgaacagaggagacataaaatgcattgcagcaacctggcggcagcgcaaaagatg

SEQ ID NO: 44161 - DNA, 103 bp, Artificial Sequence
  Synthetic Polynucleotide
taatacgactcactatagggccttggctatcgcatgatttatatgattacaacagaggagagtaatcatgtaaatcatgaacctggcggcagcgcaaaagatg

SEQ ID NO: 44162 - DNA, 103 bp, Artificial Sequence
  Synthetic Polynucleotide
taatacgactcactatagggattttccttggctatcgcatgatttatatgaacagaggagacatataatgcatgcgataaacctggcggcagcgcaaaagatg

SEQ ID NO: 44163 - DNA, 103 bp, Artificial Sequence
  Synthetic Polynucleotide
taatacgactcactatagggtttgaattttccttggctatcgcatgatttaacagaggagaaaatcaatggatagccaaaacctggcggcagcgcaaaagatg

SEQ ID NO: 44164 - DNA, 103 bp, Artificial Sequence
  Synthetic Polynucleotide
taatacgactcactatagggatctatttgaattttccttggctatcgcataacagaggagaatgcgaatgccaaggaaaaacctggcggcagcgcaaaagatg

SEQ ID NO: 44165 - DNA, 103 bp, Artificial Sequence
  Synthetic Polynucleotide
taatacgactcactatagggtgaacatctatttgaattttccttggctataacagaggagaatagccatggaaaattcaaacctggcggcagcgcaaaagatg

SEQ ID NO: 44166 - DNA, 103 bp, Artificial Sequence
  Synthetic Polynucleotide
taatacgactcactatagggtatgatgaacatctatttgaattttccttgaacagaggagacaaggaatgttcaaatagaacctggcggcagcgcaaaagatg

SEQ ID NO: 44167 - DNA, 103 bp, Artificial Sequence
  Synthetic Polynucleotide
taatacgactcactataggggattatatgatgaacatctatttgaattttaacagaggagaaaaattatgatagatgttaacctggcggcagcgcaaaagatg

SEQ ID NO: 44168 - DNA, 103 bp, Artificial Sequence
  Synthetic Polynucleotide
taatacgactcactataggggcgatgattatatgatgaacatctatttgaaacagaggagatcaaatatgtgttcatcaaacctggcggcagcgcaaaagatg

SEQ ID NO: 44169 - DNA, 103 bp, Artificial Sequence
  Synthetic Polynucleotide
taatacgactcactatagggttatagcgatgattatatgatgaacatctaaacagaggagatagatgatgatcatataaaacctggcggcagcgcaaaagatg

SEQ ID NO: 44170 - DNA, 103 bp, Artificial Sequence
  Synthetic Polynucleotide
taatacgactcactatagggatgaattatagcgatgattatatgatgaacaacagaggagagttcatatgataatcatcaacctggcggcagcgcaaaagatg

SEQ ID NO: 44171 - DNA, 103 bp, Artificial Sequence
  Synthetic Polynucleotide
taatacgactcactatagggtttgttcatagaaaatggctgcaatgttctaacagaggagaagaacaatgcagccatttaacctggcggcagcgcaaaagatg

SEQ ID NO: 44172 - DNA, 103 bp, Artificial Sequence
  Synthetic Polynucleotide
taatacgactcactatagggttaatatgaattatagcgatgattatatgaaacagaggagatcatatatgcatcgctataacctggcggcagcgcaaaagatg

SEQ ID NO: 44173 - DNA, 103 bp, Artificial Sequence
  Synthetic Polynucleotide
taatacgactcactatagggacgtattaatatgaattatagcgatgattaaacagaggagataatcaatgctataattcaacctggcggcagcgcaaaagatg

SEQ ID NO: 44174 - DNA, 103 bp, Artificial Sequence
  Synthetic Polynucleotide
taatacgactcactatagggtgtcaacgtattaatatgaattatagcgataacagaggagaatcgctatgattcatattaacctggcggcagcgcaaaagatg

SEQ ID NO: 44175 - DNA, 103 bp, Artificial Sequence
  Synthetic Polynucleotide
taatacgactcactataggggtcaatgtcaacgtattaatatgaattataaacagaggagatataatatgtattaatacaacctggcggcagcgcaaaagatg

SEQ ID NO: 44176 - DNA, 103 bp, Artificial Sequence
  Synthetic Polynucleotide
taatacgactcactatagggaattagtcaatgtcaacgtattaatatgaaaacagaggagattcataatgatacgttgaaacctggcggcagcgcaaaagatg

SEQ ID NO: 44177 - DNA, 103 bp, Artificial Sequence
  Synthetic Polynucleotide
taatacgactcactatagggttacaaattagtcaatgtcaacgtattaataacagaggagaattaatatgttgacattgaacctggcggcagcgcaaaagatg

SEQ ID NO: 44178 - DNA, 103 bp, Artificial Sequence
  Synthetic Polynucleotide
taatacgactcactatagggctatattacaaattagtcaatgtcaacgtaaacagaggagatacgttatgattgactaaaacctggcggcagcgcaaaagatg

SEQ ID NO: 44179 - DNA, 103 bp, Artificial Sequence
  Synthetic Polynucleotide
taatacgactcactatagggcgaggctatattacaaattagtcaatgtcaaacagaggagatgacatatgctaatttgtaacctggcggcagcgcaaaagatg

SEQ ID NO: 44180 - DNA, 103 bp, Artificial Sequence
  Synthetic Polynucleotide
taatacgactcactatagggcgtggcgaggctatattacaaattagtcaaaacagaggagattgactatgttgtaatataacctggcggcagcgcaaaagatg

SEQ ID NO: 44181 - DNA, 103 bp, Artificial Sequence
  Synthetic Polynucleotide
taatacgactcactatagggttcttcgtggcgaggctatattacaaattaaacagaggagataatttatgatatagcctaacctggcggcagcgcaaaagatg

SEQ ID NO: 44182 - DNA, 103 bp, Artificial Sequence
  Synthetic Polynucleotide
taatacgactcactatagggattgatttgttcatagaaaatggctgcaataacagaggagaattgcaatgattttctataacctggcggcagcgcaaaagatg

SEQ ID NO: 44183 - DNA, 103 bp, Artificial Sequence
  Synthetic Polynucleotide
taatacgactcactataggggagctttcttcgtggcgaggctatattacaaacagaggagatgtaatatggcctcgccaaacctggcggcagcgcaaaagatg

SEQ ID NO: 44184 - DNA, 103 bp, Artificial Sequence
  Synthetic Polynucleotide
taatacgactcactatagggtacgagagctttcttcgtggcgaggctataaacagaggagatatagcatggccacgaagaacctggcggcagcgcaaaagatg

SEQ ID NO: 44185 - DNA, 103 bp, Artificial Sequence
  Synthetic Polynucleotide
taatacgactcactatagggctgaatacgagagctttcttcgtggcgaggaacagaggagacctcgcatggaagaaagcaacctggcggcagcgcaaaagatg

SEQ ID NO: 44186 - DNA, 103 bp, Artificial Sequence
  Synthetic Polynucleotide
taatacgactcactatagggtgaaactgaatacgagagctttcttcgtggaacagaggagaccacgaatgaagctctcgaacctggcggcagcgcaaaagatg

SEQ ID NO: 44187 - DNA, 103 bp, Artificial Sequence
  Synthetic Polynucleotide
taatacgactcactatagggattgatgaaactgaatacgagagctttcttaacagaggagaaagaaaatgctcgtattcaacctggcggcagcgcaaaagatg

SEQ ID NO: 44188 - DNA, 103 bp, Artificial Sequence
  Synthetic Polynucleotide
taatacgactcactatagggcctttattgatgaaactgaatacgagagctaacagaggagaagctctatgattcagtttaacctggcggcagcgcaaaagatg

SEQ ID NO: 44189 - DNA, 103 bp, Artificial Sequence
  Synthetic Polynucleotide
taatacgactcactatagggggtatcctttattgatgaaactgaatacgaaacagaggagatcgtatatggtttcatcaaacctggcggcagcgcaaaagatg

SEQ ID NO: 44190 - DNA, 103 bp, Artificial Sequence
  Synthetic Polynucleotide
taatacgactcactatagggttaacggtatcctttattgatgaaactgaaaacagaggagattcagtatgatcaataaaaacctggcggcagcgcaaaagatg

SEQ ID NO: 44191 - DNA, 103 bp, Artificial Sequence
  Synthetic Polynucleotide
taatacgactcactatagggtatatttaacggtatcctttattgatgaaaaacagaggagatttcatatgtaaaggataaacctggcggcagcgcaaaagatg

SEQ ID NO: 44192 - DNA, 103 bp, Artificial Sequence
  Synthetic Polynucleotide
taatacgactcactatagggccagttatatttaacggtatcctttattgaaacagaggagatcaataatggataccgttaacctggcggcagcgcaaaagatg

SEQ ID NO: 44193 - DNA, 103 bp, Artificial Sequence
  Synthetic Polynucleotide
taatacgactcactatagggaaattattgatttgttcatagaaaatggctaacagaggagaagccatatgctatgaacaaacctggcggcagcgcaaaagatg

SEQ ID NO: 44194 - DNA, 103 bp, Artificial Sequence
  Synthetic Polynucleotide
taatacgactcactatagggggcaaccagttatatttaacggtatcctttaacagaggagaaaaggaatgcgttaaataaacctggcggcagcgcaaaagatg

SEQ ID NO: 44195 - DNA, 103 bp, Artificial Sequence
  Synthetic Polynucleotide
taatacgactcactatagggcaatcggcaaccagttatatttaacggtataacagaggagaataccgatgaatataactaacctggcggcagcgcaaaagatg

SEQ ID NO: 44196 - DNA, 103 bp, Artificial Sequence
  Synthetic Polynucleotide
taatacgactcactatagggtgagacaatcggcaaccagttatatttaacaacagaggagagttaaaatgaactggttgaacctggcggcagcgcaaaagatg

SEQ ID NO: 44197 - DNA, 103 bp, Artificial Sequence
  Synthetic Polynucleotide
taatacgactcactataggggactatgagacaatcggcaaccagttatataacagaggagaatataaatggttgccgataacctggcggcagcgcaaaagatg

SEQ ID NO: 44198 - DNA, 103 bp, Artificial Sequence
  Synthetic Polynucleotide
taatacgactcactatagggtaatagactatgagacaatcggcaaccagtaacagaggagaactggtatgcgattgtctaacctggcggcagcgcaaaagatg

SEQ ID NO: 44199 - DNA, 103 bp, Artificial Sequence
  Synthetic Polynucleotide
taatacgactcactatagggccacttaatagactatgagacaatcggcaaaacagaggagattgccgatggtctcatagaacctggcggcagcgcaaaagatg

SEQ ID NO: 44200 - DNA, 103 bp, Artificial Sequence
  Synthetic Polynucleotide
taatacgactcactatagggacttaccacttaatagactatgagacaatcaacagaggagagattgtatgatagtctataacctggcggcagcgcaaaagatg

SEQ ID NO: 44201 - DNA, 103 bp, Artificial Sequence
  Synthetic Polynucleotide
taatacgactcactatagggacgaaacttaccacttaatagactatgagaaacagaggagatctcatatgctattaagtaacctggcggcagcgcaaaagatg

SEQ ID NO: 44202 - DNA, 103 bp, Artificial Sequence
  Synthetic Polynucleotide
taatacgactcactatagggtttgtacgaaacttaccacttaatagactaaacagaggagatagtctatgaagtggtaaaacctggcggcagcgcaaaagatg

SEQ ID NO: 44203 - DNA, 103 bp, Artificial Sequence
  Synthetic Polynucleotide
taatacgactcactatagggctgtatttgtacgaaacttaccacttaataaacagaggagatattaaatggtaagtttcaacctggcggcagcgcaaaagatg

SEQ ID NO: 44204 - DNA, 103 bp, Artificial Sequence
  Synthetic Polynucleotide
taatacgactcactatagggtcctgaaattattgatttgttcatagaaaaaacagaggagattttctatgaacaaatcaaacctggcggcagcgcaaaagatg

SEQ ID NO: 44205 - DNA, 103 bp, Artificial Sequence
  Synthetic Polynucleotide
taatacgactcactatagggggattctgtatttgtacgaaacttaccactaacagaggagaagtggtatgtttcgtacaaacctggcggcagcgcaaaagatg

SEQ ID NO: 44206 - DNA, 103 bp, Artificial Sequence
  Synthetic Polynucleotide
taatacgactcactatagggtttagggattctgtatttgtacgaaacttaaacagaggagataagttatgtacaaatacaacctggcggcagcgcaaaagatg

SEQ ID NO: 44207 - DNA, 103 bp, Artificial Sequence
  Synthetic Polynucleotide
taatacgactcactatagggaatattttagggattctgtatttgtacgaaaacagaggagattcgtaatgatacagaataacctggcggcagcgcaaaagatg

SEQ ID NO: 44208 - DNA, 103 bp, Artificial Sequence
  Synthetic Polynucleotide
taatacgactcactatagggtagataatattttagggattctgtatttgtaacagaggagaacaaatatggaatccctaaacctggcggcagcgcaaaagatg

SEQ ID NO: 44209 - DNA, 103 bp, Artificial Sequence
  Synthetic Polynucleotide
taatacgactcactatagggaacattagataatattttagggattctgtaaacagaggagatacagaatgcctaaaataaacctggcggcagcgcaaaagatg

SEQ ID NO: 44210 - DNA, 103 bp, Artificial Sequence
  Synthetic Polynucleotide
taatacgactcactatagggaatccaacattagataatattttagggattaacagaggagaaatcccatgaatattatcaacctggcggcagcgcaaaagatg

SEQ ID NO: 44211 - DNA, 103 bp, Artificial Sequence
  Synthetic Polynucleotide
taatacgactcactatagggagattaatccaacattagataatattttagaacagaggagactaaaaatgtatctaatgaacctggcggcagcgcaaaagatg

SEQ ID NO: 44212 - DNA, 103 bp, Artificial Sequence
  Synthetic Polynucleotide
taatacgactcactatagggggtaaagattaatccaacattagataatataacagaggagaatattaatgaatgttggaaacctggcggcagcgcaaaagatg

SEQ ID NO: 44213 - DNA, 103 bp, Artificial Sequence
  Synthetic Polynucleotide
taatacgactcactataggggttatggtaaagattaatccaacattagataacagaggagaatctaaatgtggattaataacctggcggcagcgcaaaagatg

SEQ ID NO: 44214 - DNA, 103 bp, Artificial Sequence
  Synthetic Polynucleotide
taatacgactcactatagggatacagttatggtaaagattaatccaacataacagaggagaatgttgatgtaatctttaaacctggcggcagcgcaaaagatg

SEQ ID NO: 44215 - DNA, 103 bp, Artificial Sequence
  Synthetic Polynucleotide
taatacgactcactatagggcctgttcctgaaattattgatttgttcataaacagaggagatatgaaatgatcaataataacctggcggcagcgcaaaagatg

SEQ ID NO: 44216 - DNA, 103 bp, Artificial Sequence
  Synthetic Polynucleotide
taatacgactcactatagggattttatacagttatggtaaagattaatccaacagaggagaggattaatgtttaccataaacctggcggcagcgcaaaagatg

SEQ ID NO: 44217 - DNA, 103 bp, Artificial Sequence
  Synthetic Polynucleotide
taatacgactcactatagggtctccattttatacagttatggtaaagattaacagaggagaaatcttatgcataactgtaacctggcggcagcgcaaaagatg

SEQ ID NO: 44218 - DNA, 103 bp, Artificial Sequence
  Synthetic Polynucleotide
taatacgactcactatagggctccgtctccattttatacagttatggtaaaacagaggagattaccaatgctgtataaaaacctggcggcagcgcaaaagatg

SEQ ID NO: 44219 - DNA, 103 bp, Artificial Sequence
  Synthetic Polynucleotide
taatacgactcactatagggtatgactccgtctccattttatacagttataacagaggagaataactatgtaaaatggaaacctggcggcagcgcaaaagatg

SEQ ID NO: 44220 - DNA, 103 bp, Artificial Sequence
  Synthetic Polynucleotide
taatacgactcactatagggatagttatgactccgtctccattttatacaaacagaggagatgtataatgtggagacggaacctggcggcagcgcaaaagatg

SEQ ID NO: 44221 - DNA, 103 bp, Artificial Sequence
  Synthetic Polynucleotide
taatacgactcactataggggtaaaatagttatgactccgtctccattttaacagaggagaaaaatgatgacggagtcaaacctggcggcagcgcaaaagatg

SEQ ID NO: 44222 - DNA, 103 bp, Artificial Sequence
  Synthetic Polynucleotide
taatacgactcactatagggaaacggtaaaatagttatgactccgtctccaacagaggagaggagacatggtcataactaacctggcggcagcgcaaaagatg

SEQ ID NO: 44223 - DNA, 103 bp, Artificial Sequence
  Synthetic Polynucleotide
taatacgactcactatagggagtacaaacggtaaaatagttatgactccgaacagaggagacggagtatgaactattttaacctggcggcagcgcaaaagatg

SEQ ID NO: 44224 - DNA, 103 bp, Artificial Sequence
  Synthetic Polynucleotide
taatacgactcactatagggcagtaagtacaaacggtaaaatagttatgaaacagaggagatcataaatgttttaccgtaacctggcggcagcgcaaaagatg

SEQ ID NO: 44225 - DNA, 103 bp, Artificial Sequence
  Synthetic Polynucleotide
taatacgactcactatagggtattccagtaagtacaaacggtaaaatagtaacagaggagaactattatgccgtttgtaaacctggcggcagcgcaaaagatg

SEQ ID NO: 44226 - DNA, 103 bp, Artificial Sequence
  Synthetic Polynucleotide
taatacgactcactatagggatgatcctgttcctgaaattattgatttgtaacagaggagaacaaatatgtaatttcagaacctggcggcagcgcaaaagatg

SEQ ID NO: 44227 - DNA, 103 bp, Artificial Sequence
  Synthetic Polynucleotide
taatacgactcactatagggtcatctattccagtaagtacaaacggtaaaaacagaggagatttaccatgtgtacttacaacctggcggcagcgcaaaagatg

SEQ ID NO: 44228 - DNA, 103 bp, Artificial Sequence
  Synthetic Polynucleotide
taatacgactcactatagggttccttcatctattccagtaagtacaaacgaacagaggagacgtttgatgttactggaaaacctggcggcagcgcaaaagatg

SEQ ID NO: 44229 - DNA, 103 bp, Artificial Sequence
  Synthetic Polynucleotide
taatacgactcactataggggattattccttcatctattccagtaagtacaacagaggagagtacttatgggaatagataacctggcggcagcgcaaaagatg

SEQ ID NO: 44230 - DNA, 103 bp, Artificial Sequence
  Synthetic Polynucleotide
taatacgactcactatagggccggagattattccttcatctattccagtaaacagaggagatactggatgagatgaaggaacctggcggcagcgcaaaagatg

SEQ ID NO: 44231 - DNA, 103 bp, Artificial Sequence
  Synthetic Polynucleotide
taatacgactcactatagggcatgtccggagattattccttcatctattcaacagaggagagaatagatgaaggaataaaacctggcggcagcgcaaaagatg

SEQ ID NO: 44232 - DNA, 103 bp, Artificial Sequence
  Synthetic Polynucleotide
taatacgactcactatagggaccagcatgtccggagattattccttcatcaacagaggagagatgaaatgataatctccaacctggcggcagcgcaaaagatg

SEQ ID NO: 44233 - DNA, 103 bp, Artificial Sequence
  Synthetic Polynucleotide
taatacgactcactatagggtctttaccagcatgtccggagattattcctaacagaggagaaggaatatgctccggacaaacctggcggcagcgcaaaagatg

SEQ ID NO: 44234 - DNA, 103 bp, Artificial Sequence
  Synthetic Polynucleotide
taatacgactcactatagggttgggtctttaccagcatgtccggagattaaacagaggagataatctatggacatgctgaacctggcggcagcgcaaaagatg

SEQ ID NO: 44235 - DNA, 103 bp, Artificial Sequence
  Synthetic Polynucleotide
taatacgactcactataggggacatttgggtctttaccagcatgtccggaaacagaggagatccggaatggctggtaaaaacctggcggcagcgcaaaagatg

SEQ ID NO: 44236 - DNA, 103 bp, Artificial Sequence
  Synthetic Polynucleotide
taatacgactcactatagggaaccagacatttgggtctttaccagcatgtaacagaggagaacatgcatgtaaagacccaacctggcggcagcgcaaaagatg

SEQ ID NO: 44237 - DNA, 103 bp, Artificial Sequence
  Synthetic Polynucleotide
taatacgactcactatagggctctttcagaactgatgcaacggagctcttaacagaggagaaagagcatggttgcatcaaacctggcggcagcgcaaaagatg

SEQ ID NO: 44238 - DNA, 103 bp, Artificial Sequence
  Synthetic Polynucleotide
taatacgactcactataggggacagatgatcctgttcctgaaattattgaaacagaggagatcaataatgtcaggaacaaacctggcggcagcgcaaaagatg

SEQ ID NO: 44239 - DNA, 103 bp, Artificial Sequence
  Synthetic Polynucleotide
taatacgactcactatagggtcttcaaccagacatttgggtctttaccagaacagaggagactggtaatgacccaaatgaacctggcggcagcgcaaaagatg

SEQ ID NO: 44240 - DNA, 103 bp, Artificial Sequence
  Synthetic Polynucleotide
taatacgactcactatagggggatttcttcaaccagacatttgggtctttaacagaggagaaaagacatgaatgtctggaacctggcggcagcgcaaaagatg

SEQ ID NO: 44241 - DNA, 103 bp, Artificial Sequence
  Synthetic Polynucleotide
taatacgactcactatagggacattggatttcttcaaccagacatttgggaacagaggagacccaaaatgctggttgaaaacctggcggcagcgcaaaagatg

SEQ ID NO: 44242 - DNA, 103 bp, Artificial Sequence
  Synthetic Polynucleotide
taatacgactcactatagggccggaacattggatttcttcaaccagacataacagaggagaatgtctatgtgaagaaataacctggcggcagcgcaaaagatg

SEQ ID NO: 44243 - DNA, 103 bp, Artificial Sequence
  Synthetic Polynucleotide
taatacgactcactatagggaggacccggaacattggatttcttcaaccaaacagaggagatggttgatgaaatccaataacctggcggcagcgcaaaagatg

SEQ ID NO: 44244 - DNA, 103 bp, Artificial Sequence
  Synthetic Polynucleotide
taatacgactcactatagggagattaggacccggaacattggatttcttcaacagaggagagaagaaatgcaatgttccaacctggcggcagcgcaaaagatg

SEQ ID NO: 44245 - DNA, 103 bp, Artificial Sequence
  Synthetic Polynucleotide
taatacgactcactatagggtcaagagattaggacccggaacattggattaacagaggagaaatccaatgttccgggtcaacctggcggcagcgcaaaagatg

SEQ ID NO: 44246 - DNA, 103 bp, Artificial Sequence
  Synthetic Polynucleotide
taatacgactcactatagggttttgtcaagagattaggacccggaacattaacagaggagaaatgttatgggtcctaataacctggcggcagcgcaaaagatg

SEQ ID NO: 44247 - DNA, 103 bp, Artificial Sequence
  Synthetic Polynucleotide
taatacgactcactataggggtaatttttgtcaagagattaggacccggaaacagaggagatccgggatgtaatctcttaacctggcggcagcgcaaaagatg

SEQ ID NO: 44248 - DNA, 103 bp, Artificial Sequence
  Synthetic Polynucleotide
taatacgactcactatagggatatcgtaatttttgtcaagagattaggacaacagaggagagtcctaatgtcttgacaaaacctggcggcagcgcaaaagatg

SEQ ID NO: 44249 - DNA, 103 bp, Artificial Sequence
  Synthetic Polynucleotide
taatacgactcactataggggtaatgacagatgatcctgttcctgaaattaacagaggagaaatttcatgaacaggatcaacctggcggcagcgcaaaagatg

SEQ ID NO: 44250 - DNA, 103 bp, Artificial Sequence
  Synthetic Polynucleotide
taatacgactcactatagggatcgaatatcgtaatttttgtcaagagattaacagaggagaaatctcatgacaaaaattaacctggcggcagcgcaaaagatg

SEQ ID NO: 44251 - DNA, 103 bp, Artificial Sequence
  Synthetic Polynucleotide
taatacgactcactatagggtcgggatcgaatatcgtaatttttgtcaagaacagaggagacttgacatgaattacgataacctggcggcagcgcaaaagatg

SEQ ID NO: 44252 - DNA, 103 bp, Artificial Sequence
  Synthetic Polynucleotide
taatacgactcactatagggggatatcgggatcgaatatcgtaatttttgaacagaggagacaaaaaatgcgatattcgaacctggcggcagcgcaaaagatg

SEQ ID NO: 44253 - DNA, 103 bp, Artificial Sequence
  Synthetic Polynucleotide
taatacgactcactataggggcaaaggatatcgggatcgaatatcgtaataacagaggagaattacgatgttcgatcccaacctggcggcagcgcaaaagatg

SEQ ID NO: 44254 - DNA, 103 bp, Artificial Sequence
  Synthetic Polynucleotide
taatacgactcactatagggagaatgcaaaggatatcgggatcgaatatcaacagaggagagatattatgtcccgatataacctggcggcagcgcaaaagatg

SEQ ID NO: 44255 - DNA, 103 bp, Artificial Sequence
  Synthetic Polynucleotide
taatacgactcactatagggtaaatagaatgcaaaggatatcgggatcgaaacagaggagatcgatcatgatatcctttaacctggcggcagcgcaaaagatg

SEQ ID NO: 44256 - DNA, 103 bp, Artificial Sequence
  Synthetic Polynucleotide
taatacgactcactataggggctggtaaatagaatgcaaaggatatcgggaacagaggagacccgatatgctttgcattaacctggcggcagcgcaaaagatg

SEQ ID NO: 44257 - DNA, 103 bp, Artificial Sequence
  Synthetic Polynucleotide
taatacgactcactataggggatatgctggtaaatagaatgcaaaggataaacagaggagatatcctatgcattctattaacctggcggcagcgcaaaagatg

SEQ ID NO: 44258 - DNA, 103 bp, Artificial Sequence
  Synthetic Polynucleotide
taatacgactcactatagggttcgtgatatgctggtaaatagaatgcaaaaacagaggagatttgcaatgtatttaccaaacctggcggcagcgcaaaagatg

SEQ ID NO: 44259 - DNA, 103 bp, Artificial Sequence
  Synthetic Polynucleotide
taatacgactcactatagggtatagttcgtgatatgctggtaaatagaataacagaggagaattctaatgaccagcataaacctggcggcagcgcaaaagatg

SEQ ID NO: 44260 - DNA, 103 bp, Artificial Sequence
  Synthetic Polynucleotide
taatacgactcactatagggattatgtaatgacagatgatcctgttcctgaacagaggagacaggaaatggatcatctgaacctggcggcagcgcaaaagatg

SEQ ID NO: 44261 - DNA, 103 bp, Artificial Sequence
  Synthetic Polynucleotide
taatacgactcactatagggcttaatatagttcgtgatatgctggtaaataacagaggagaatttacatgcatatcacgaacctggcggcagcgcaaaagatg

SEQ ID NO: 44262 - DNA, 103 bp, Artificial Sequence
  Synthetic Polynucleotide
taatacgactcactatagggataatcttaatatagttcgtgatatgctggaacagaggagaccagcaatgcacgaactaaacctggcggcagcgcaaaagatg

SEQ ID NO: 44263 - DNA, 103 bp, Artificial Sequence
  Synthetic Polynucleotide
taatacgactcactataggggatagataatcttaatatagttcgtgatataacagaggagaatatcaatgactatattaaacctggcggcagcgcaaaagatg

SEQ ID NO: 44264 - DNA, 103 bp, Artificial Sequence
  Synthetic Polynucleotide
taatacgactcactataggggacatgatagataatcttaatatagttcgtaacagaggagaacgaacatgattaagattaacctggcggcagcgcaaaagatg

SEQ ID NO: 44265 - DNA, 103 bp, Artificial Sequence
  Synthetic Polynucleotide
taatacgactcactataggggaatagacatgatagataatcttaatatagaacagaggagactatatatggattatctaaacctggcggcagcgcaaaagatg

SEQ ID NO: 44266 - DNA, 103 bp, Artificial Sequence
  Synthetic Polynucleotide
taatacgactcactatagggtgggagaatagacatgatagataatcttaaaacagaggagattaagaatgtctatcatgaacctggcggcagcgcaaaagatg

SEQ ID NO: 44267 - DNA, 103 bp, Artificial Sequence
  Synthetic Polynucleotide
taatacgactcactatagggaacggtgggagaatagacatgatagataataacagaggagaattatcatgcatgtctataacctggcggcagcgcaaaagatg

SEQ ID NO: 44268 - DNA, 103 bp, Artificial Sequence
  Synthetic Polynucleotide
taatacgactcactatagggtatataacggtgggagaatagacatgatagaacagaggagactatcaatgctattctccaacctggcggcagcgcaaaagatg

SEQ ID NO: 44269 - DNA, 103 bp, Artificial Sequence
  Synthetic Polynucleotide
taatacgactcactatagggcgatttatataacggtgggagaatagacataacagaggagaatgtctatgctcccaccgaacctggcggcagcgcaaaagatg

SEQ ID NO: 44270 - DNA, 103 bp, Artificial Sequence
  Synthetic Polynucleotide
taatacgactcactatagggggaggcgatttatataacggtgggagaataaacagaggagatattctatgaccgttataaacctggcggcagcgcaaaagatg

SEQ ID NO: 44271 - DNA, 103 bp, Artificial Sequence
  Synthetic Polynucleotide
taatacgactcactatagggagaaaattatgtaatgacagatgatcctgtaacagaggagaacaggaatgtctgtcattaacctggcggcagcgcaaaagatg

SEQ ID NO: 44272 - DNA, 103 bp, Artificial Sequence
  Synthetic Polynucleotide
taatacgactcactatagggttagcggaggcgatttatataacggtgggaaacagaggagatcccacatgtatataaataacctggcggcagcgcaaaagatg

SEQ ID NO: 44273 - DNA, 103 bp, Artificial Sequence
  Synthetic Polynucleotide
taatacgactcactataggggtttcttagcggaggcgatttatataacggaacagaggagaccgttaatgaaatcgcctaacctggcggcagcgcaaaagatg

SEQ ID NO: 44274 - DNA, 103 bp, Artificial Sequence
  Synthetic Polynucleotide
taatacgactcactatagggctaacgtttcttagcggaggcgatttatataacagaggagaatataaatggcctccgctaacctggcggcagcgcaaaagatg

SEQ ID NO: 44275 - DNA, 103 bp, Artificial Sequence
  Synthetic Polynucleotide
taatacgactcactatagggatatactaacgtttcttagcggaggcgattaacagaggagaaatcgcatgcgctaagaaaacctggcggcagcgcaaaagatg

SEQ ID NO: 44276 - DNA, 103 bp, Artificial Sequence
  Synthetic Polynucleotide
taatacgactcactatagggtatggatatactaacgtttcttagcggaggaacagaggagacctccgatgagaaacgttaacctggcggcagcgcaaaagatg

SEQ ID NO: 44277 - DNA, 103 bp, Artificial Sequence
  Synthetic Polynucleotide
taatacgactcactatagggcattgtatggatatactaacgtttcttagcaacagaggagagctaagatgcgttagtataacctggcggcagcgcaaaagatg

SEQ ID NO: 44278 - DNA, 103 bp, Artificial Sequence
  Synthetic Polynucleotide
taatacgactcactatagggtattccattgtatggatatactaacgtttcaacagaggagagaaacgatggtatatccaaacctggcggcagcgcaaaagatg

SEQ ID NO: 44279 - DNA, 103 bp, Artificial Sequence
  Synthetic Polynucleotide
taatacgactcactatagggtgaagtattccattgtatggatatactaacaacagaggagagttagtatgtccatacaaaacctggcggcagcgcaaaagatg

SEQ ID NO: 44280 - DNA, 103 bp, Artificial Sequence
  Synthetic Polynucleotide
taatacgactcactatagggagaaatgaagtattccattgtatggatataaacagaggagatatatcatgacaatggaaaacctggcggcagcgcaaaagatg

SEQ ID NO: 44281 - DNA, 103 bp, Artificial Sequence
  Synthetic Polynucleotide
taatacgactcactatagggattttagaaatgaagtattccattgtatggaacagaggagaccatacatgggaatacttaacctggcggcagcgcaaaagatg

SEQ ID NO: 44282 - DNA, 103 bp, Artificial Sequence
  Synthetic Polynucleotide
taatacgactcactataggggttatagaaaattatgtaatgacagatgataacagaggagaatcatcatgcattacataaacctggcggcagcgcaaaagatg

SEQ ID NO: 44283 - DNA, 103 bp, Artificial Sequence
  Synthetic Polynucleotide
taatacgactcactatagggatactattttagaaatgaagtattccattgaacagaggagacaatggatgacttcatttaacctggcggcagcgcaaaagatg

SEQ ID NO: 44284 - DNA, 103 bp, Artificial Sequence
  Synthetic Polynucleotide
taatacgactcactatagggaacgaatactattttagaaatgaagtattcaacagaggagagaatacatgatttctaaaaacctggcggcagcgcaaaagatg

SEQ ID NO: 44285 - DNA, 103 bp, Artificial Sequence
  Synthetic Polynucleotide
taatacgactcactatagggtagaaaacgaatactattttagaaatgaagaacagaggagacttcatatgtaaaatagtaacctggcggcagcgcaaaagatg

SEQ ID NO: 44286 - DNA, 103 bp, Artificial Sequence
  Synthetic Polynucleotide
taatacgactcactatagggagaattagaaaacgaatactattttagaaaaacagaggagatttctaatgtagtattcgaacctggcggcagcgcaaaagatg

SEQ ID NO: 44287 - DNA, 103 bp, Artificial Sequence
  Synthetic Polynucleotide
taatacgactcactatagggattaaagaattagaaaacgaatactattttaacagaggagaaaaataatgttcgttttcaacctggcggcagcgcaaaagatg

SEQ ID NO: 44288 - DNA, 103 bp, Artificial Sequence
  Synthetic Polynucleotide
taatacgactcactatagggttcacattaaagaattagaaaacgaatactaacagaggagaagtattatgtttctaattaacctggcggcagcgcaaaagatg

SEQ ID NO: 44289 - DNA, 103 bp, Artificial Sequence
  Synthetic Polynucleotide
taatacgactcactatagggacgatttcacattaaagaattagaaaacgaaacagaggagatcgtttatgaattctttaaacctggcggcagcgcaaaagatg

SEQ ID NO: 44290 - DNA, 103 bp, Artificial Sequence
  Synthetic Polynucleotide
taatacgactcactatagggagtatacgatttcacattaaagaattagaaaacagaggagattctaaatgtttaatgtgaacctggcggcagcgcaaaagatg

SEQ ID NO: 44291 - DNA, 103 bp, Artificial Sequence
  Synthetic Polynucleotide
taatacgactcactatagggtttctagtatacgatttcacattaaagaataacagaggagaattcttatgtgtgaaatcaacctggcggcagcgcaaaagatg

SEQ ID NO: 44292 - DNA, 103 bp, Artificial Sequence
  Synthetic Polynucleotide
taatacgactcactatagggttccctttctagtatacgatttcacattaaaacagaggagattaatgatgaatcgtataaacctggcggcagcgcaaaagatg

SEQ ID NO: 44293 - DNA, 103 bp, Artificial Sequence
  Synthetic Polynucleotide
taatacgactcactataggggttcagttatagaaaattatgtaatgacagaacagaggagactgtcaatgcataattttaacctggcggcagcgcaaaagatg

SEQ ID NO: 44294 - DNA, 103 bp, Artificial Sequence
  Synthetic Polynucleotide
taatacgactcactatagggaatttttccctttctagtatacgatttcacaacagaggagagtgaaaatgtatactagaaacctggcggcagcgcaaaagatg

SEQ ID NO: 44295 - DNA, 103 bp, Artificial Sequence
  Synthetic Polynucleotide
taatacgactcactatagggaagataatttttccctttctagtatacgataacagaggagaatcgtaatgtagaaagggaacctggcggcagcgcaaaagatg

SEQ ID NO: 44296 - DNA, 103 bp, Artificial Sequence
  Synthetic Polynucleotide
taatacgactcactatagggacttaaagataatttttccctttctagtataacagaggagaatactaatgagggaaaaaaacctggcggcagcgcaaaagatg

SEQ ID NO: 44297 - DNA, 103 bp, Artificial Sequence
  Synthetic Polynucleotide
taatacgactcactatagggggaaaacttaaagataatttttccctttctaacagaggagaagaaagatgaaaattatcaacctggcggcagcgcaaaagatg

SEQ ID NO: 44298 - DNA, 103 bp, Artificial Sequence
  Synthetic Polynucleotide
taatacgactcactatagggctaacggaaaacttaaagataatttttcccaacagaggagagggaaaatgtatctttaaaacctggcggcagcgcaaaagatg

SEQ ID NO: 44299 - DNA, 103 bp, Artificial Sequence
  Synthetic Polynucleotide
taatacgactcactatagggcttttctaacggaaaacttaaagataatttaacagaggagaaaattaatgttaagttttaacctggcggcagcgcaaaagatg

SEQ ID NO: 44300 - DNA, 103 bp, Artificial Sequence
  Synthetic Polynucleotide
taatacgactcactatagggtggttcttttctaacggaaaacttaaagataacagaggagaatctttatgttttccgttaacctggcggcagcgcaaaagatg

SEQ ID NO: 44301 - DNA, 103 bp, Artificial Sequence
  Synthetic Polynucleotide
taatacgactcactatagggtttcgtggttcttttctaacggaaaacttaaacagaggagataagttatgcgttagaaaaacctggcggcagcgcaaaagatg

SEQ ID NO: 44302 - DNA, 103 bp, Artificial Sequence
  Synthetic Polynucleotide
taatacgactcactatagggattagtttcgtggttcttttctaacggaaaaacagaggagatttccgatggaaaagaacaacctggcggcagcgcaaaagatg

SEQ ID NO: 44303 - DNA, 103 bp, Artificial Sequence
  Synthetic Polynucleotide
taatacgactcactatagggagaacattagtttcgtggttcttttctaacaacagaggagagttagaatggaaccacgaaacctggcggcagcgcaaaagatg

SEQ ID NO: 44304 - DNA, 103 bp, Artificial Sequence
  Synthetic Polynucleotide
taatacgactcactatagggccatcgttcagttatagaaaattatgtaataacagaggagaattacaatgttttctataaacctggcggcagcgcaaaagatg

SEQ ID NO: 44305 - DNA, 103 bp, Artificial Sequence
  Synthetic Polynucleotide
taatacgactcactatagggcaatcagaacattagtttcgtggttcttttaacagaggagaaaaagaatgacgaaactaaacctggcggcagcgcaaaagatg

SEQ ID NO: 44306 - DNA, 103 bp, Artificial Sequence
  Synthetic Polynucleotide
taatacgactcactatagggagacgcaatcagaacattagtttcgtggttaacagaggagaaaccacatgactaatgttaacctggcggcagcgcaaaagatg

SEQ ID NO: 44307 - DNA, 103 bp, Artificial Sequence
  Synthetic Polynucleotide
taatacgactcactataggggagtcagacgcaatcagaacattagtttcgaacagaggagacgaaacatgtgttctgataacctggcggcagcgcaaaagatg

SEQ ID NO: 44308 - DNA, 103 bp, Artificial Sequence
  Synthetic Polynucleotide
taatacgactcactatagggcgacggagtcagacgcaatcagaacattagaacagaggagactaatgatgtgattgcgtaacctggcggcagcgcaaaagatg

SEQ ID NO: 44309 - DNA, 103 bp, Artificial Sequence
  Synthetic Polynucleotide
taatacgactcactatagggttcagcgacggagtcagacgcaatcagaacaacagaggagagttctgatggcgtctgacaacctggcggcagcgcaaaagatg

SEQ ID NO: 44310 - DNA, 103 bp, Artificial Sequence
  Synthetic Polynucleotide
taatacgactcactatagggattaattcagcgacggagtcagacgcaatcaacagaggagagattgcatgtgactccgtaacctggcggcagcgcaaaagatg

SEQ ID NO: 44311 - DNA, 103 bp, Artificial Sequence
  Synthetic Polynucleotide
taatacgactcactatagggaatccattaattcagcgacggagtcagacgaacagaggagacgtctgatgccgtcgctgaacctggcggcagcgcaaaagatg

SEQ ID NO: 44312 - DNA, 103 bp, Artificial Sequence
  Synthetic Polynucleotide
taatacgactcactataggggtgtaaatccattaattcagcgacggagtcaacagaggagagactccatggctgaattaaacctggcggcagcgcaaaagatg

SEQ ID NO: 44313 - DNA, 103 bp, Artificial Sequence
  Synthetic Polynucleotide
taatacgactcactatagggttttggtgtaaatccattaattcagcgacgaacagaggagacgtcgcatgattaatggaaacctggcggcagcgcaaaagatg

SEQ ID NO: 44314 - DNA, 103 bp, Artificial Sequence
  Synthetic Polynucleotide
taatacgactcactatagggtgagtttttggtgtaaatccattaattcagaacagaggagactgaatatgtggatttacaacctggcggcagcgcaaaagatg

SEQ ID NO: 44315 - DNA, 103 bp, Artificial Sequence
  Synthetic Polynucleotide
taatacgactcactataggggaaaaccatcgttcagttatagaaaattataacagaggagaataattatgtataactgaaacctggcggcagcgcaaaagatg

SEQ ID NO: 44316 - DNA, 103 bp, Artificial Sequence
  Synthetic Polynucleotide
taatacgactcactatagggttatatgagtttttggtgtaaatccattaaaacagaggagattaatgatgttacaccaaaacctggcggcagcgcaaaagatg

SEQ ID NO: 44317 - DNA, 103 bp, Artificial Sequence
  Synthetic Polynucleotide
taatacgactcactatagggagaagttatatgagtttttggtgtaaatccaacagaggagaggatttatgccaaaaactaacctggcggcagcgcaaaagatg

SEQ ID NO: 44318 - DNA, 103 bp, Artificial Sequence
  Synthetic Polynucleotide
taatacgactcactatagggcatctagaagttatatgagtttttggtgtaaacagaggagatacaccatgaactcatataacctggcggcagcgcaaaagatg

SEQ ID NO: 44319 - DNA, 103 bp, Artificial Sequence
  Synthetic Polynucleotide
taatacgactcactatagggttctacatctagaagttatatgagtttttgaacagaggagacaaaaaatgatataacttaacctggcggcagcgcaaaagatg

SEQ ID NO: 44320 - DNA, 103 bp, Artificial Sequence
  Synthetic Polynucleotide
taatacgactcactatagggaatgcttctacatctagaagttatatgagtaacagaggagaactcatatgacttctagaaacctggcggcagcgcaaaagatg

SEQ ID NO: 44321 - DNA, 103 bp, Artificial Sequence
  Synthetic Polynucleotide
taatacgactcactatagggtagctaatgcttctacatctagaagttataaacagaggagatataacatgtagatgtagaacctggcggcagcgcaaaagatg

SEQ ID NO: 44322 - DNA, 103 bp, Artificial Sequence
  Synthetic Polynucleotide
taatacgactcactatagggttttttagctaatgcttctacatctagaagaacagaggagacttctaatggtagaagcaaacctggcggcagcgcaaaagatg

SEQ ID NO: 44323 - DNA, 103 bp, Artificial Sequence
  Synthetic Polynucleotide
taatacgactcactatagggactatttttttagctaatgcttctacatctaacagaggagaagatgtatgagcattagcaacctggcggcagcgcaaaagatg

SEQ ID NO: 44324 - DNA, 103 bp, Artificial Sequence
  Synthetic Polynucleotide
taatacgactcactatagggattctactatttttttagctaatgcttctaaacagaggagatagaagatgtagctaaaaaacctggcggcagcgcaaaagatg

SEQ ID NO: 44325 - DNA, 103 bp, Artificial Sequence
  Synthetic Polynucleotide
taatacgactcactatagggctttgattctactatttttttagctaatgcaacagaggagagcattaatgaaaaaaataaacctggcggcagcgcaaaagatg

SEQ ID NO: 44326 - DNA, 103 bp, Artificial Sequence
  Synthetic Polynucleotide
taatacgactcactatagggaatgtgaaaaccatcgttcagttatagaaaaacagaggagatttctaatgctgaacgataacctggcggcagcgcaaaagatg

SEQ ID NO: 44327 - DNA, 103 bp, Artificial Sequence
  Synthetic Polynucleotide
taatacgactcactatagggatatcctttgattctactatttttttagctaacagaggagaagctaaatgaatagtagaaacctggcggcagcgcaaaagatg

SEQ ID NO: 44328 - DNA, 103 bp, Artificial Sequence
  Synthetic Polynucleotide
taatacgactcactatagggtacttatatcctttgattctactattttttaacagaggagaaaaaaaatgtagaatcaaaacctggcggcagcgcaaaagatg

SEQ ID NO: 44329 - DNA, 103 bp, Artificial Sequence
  Synthetic Polynucleotide
taatacgactcactatagggacatctacttatatcctttgattctactataacagaggagaatagtaatgtcaaaggataacctggcggcagcgcaaaagatg

SEQ ID NO: 44330 - DNA, 103 bp, Artificial Sequence
  Synthetic Polynucleotide
taatacgactcactatagggttggaacatctacttatatcctttgattctaacagaggagaagaatcatgggatataagaacctggcggcagcgcaaaagatg

SEQ ID NO: 44331 - DNA, 103 bp, Artificial Sequence
  Synthetic Polynucleotide
taatacgactcactatagggacttgttggaacatctacttatatcctttgaacagaggagacaaaggatgtaagtagataacctggcggcagcgcaaaagatg

SEQ ID NO: 44332 - DNA, 103 bp, Artificial Sequence
  Synthetic Polynucleotide
taatacgactcactatagggtgctcacttgttggaacatctacttatatcaacagaggagagatataatgagatgttccaacctggcggcagcgcaaaagatg

SEQ ID NO: 44333 - DNA, 103 bp, Artificial Sequence
  Synthetic Polynucleotide
taatacgactcactatagggggaattgctcacttgttggaacatctacttaacagaggagaaagtagatgttccaacaaaacctggcggcagcgcaaaagatg

SEQ ID NO: 44334 - DNA, 103 bp, Artificial Sequence
  Synthetic Polynucleotide
taatacgactcactatagggttttgggaattgctcacttgttggaacatcaacagaggagagatgttatgacaagtgagaacctggcggcagcgcaaaagatg

SEQ ID NO: 44335 - DNA, 103 bp, Artificial Sequence
  Synthetic Polynucleotide
taatacgactcactatagggtgaaattttgggaattgctcacttgttggaaacagaggagatccaacatgtgagcaattaacctggcggcagcgcaaaagatg

SEQ ID NO: 44336 - DNA, 103 bp, Artificial Sequence
  Synthetic Polynucleotide
taatacgactcactatagggatagatgaaattttgggaattgctcacttgaacagaggagacaagtgatgaattcccaaaacctggcggcagcgcaaaagatg

SEQ ID NO: 44337 - DNA, 103 bp, Artificial Sequence
  Synthetic Polynucleotide
taatacgactcactatagggtgttaaatgtgaaaaccatcgttcagttataacagaggagaataactatgcgatggtttaacctggcggcagcgcaaaagatg

SEQ ID NO: 44338 - DNA, 103 bp, Artificial Sequence
  Synthetic Polynucleotide
taatacgactcactatagggatgatatagatgaaattttgggaattgctcaacagaggagagagcaaatgccaaaatttaacctggcggcagcgcaaaagatg

SEQ ID NO: 44339 - DNA, 103 bp, Artificial Sequence
  Synthetic Polynucleotide
taatacgactcactatagggtgagaatgatatagatgaaattttgggaataacagaggagaattcccatgatttcatctaacctggcggcagcgcaaaagatg

SEQ ID NO: 44340 - DNA, 103 bp, Artificial Sequence
  Synthetic Polynucleotide
taatacgactcactatagggggatttgagaatgatatagatgaaattttgaacagaggagacaaaatatgatctatatcaacctggcggcagcgcaaaagatg

SEQ ID NO: 44341 - DNA, 103 bp, Artificial Sequence
  Synthetic Polynucleotide
taatacgactcactatagggatttcggatttgagaatgatatagatgaaaaacagaggagatttcatatgtatcattctaacctggcggcagcgcaaaagatg

SEQ ID NO: 44342 - DNA, 103 bp, Artificial Sequence
  Synthetic Polynucleotide
taatacgactcactatagggttctaatttcggatttgagaatgatatagaaacagaggagatctataatgttctcaaataacctggcggcagcgcaaaagatg

SEQ ID NO: 44343 - DNA, 103 bp, Artificial Sequence
  Synthetic Polynucleotide
taatacgactcactatagggggaatttctaatttcggatttgagaatgataacagaggagaatcattatgaaatccgaaaacctggcggcagcgcaaaagatg

SEQ ID NO: 44344 - DNA, 103 bp, Artificial Sequence
  Synthetic Polynucleotide
taatacgactcactatagggacttgggaatttctaatttcggatttgagaaacagaggagatctcaaatgcgaaattagaacctggcggcagcgcaaaagatg

SEQ ID NO: 44345 - DNA, 103 bp, Artificial Sequence
  Synthetic Polynucleotide
taatacgactcactatagggtatctacttgggaatttctaatttcggattaacagaggagaaatccgatgttagaaattaacctggcggcagcgcaaaagatg

SEQ ID NO: 44346 - DNA, 103 bp, Artificial Sequence
  Synthetic Polynucleotide
taatacgactcactatagggaaagatatctacttgggaatttctaatttcaacagaggagagaaattatgaattcccaaaacctggcggcagcgcaaaagatg

SEQ ID NO: 44347 - DNA, 103 bp, Artificial Sequence
  Synthetic Polynucleotide
taatacgactcactatagggtgaaaaaagatatctacttgggaatttctaaacagaggagatagaaaatgccaagtagaaacctggcggcagcgcaaaagatg

SEQ ID NO: 44348 - DNA, 103 bp, Artificial Sequence
  Synthetic Polynucleotide
taatacgactcactatagggctcatctctttcagaactgatgcaacggagaacagaggagactccgtatgatcagttctaacctggcggcagcgcaaaagatg

SEQ ID NO: 44349 - DNA, 103 bp, Artificial Sequence
  Synthetic Polynucleotide
taatacgactcactatagggttgagtgttaaatgtgaaaaccatcgttcaaacagaggagatgaacgatggttttcacaaacctggcggcagcgcaaaagatg

SEQ ID NO: 44350 - DNA, 103 bp, Artificial Sequence
  Synthetic Polynucleotide
taatacgactcactatagggtcggatgaaaaaagatatctacttgggaataacagaggagaattcccatgtagatatctaacctggcggcagcgcaaaagatg

SEQ ID NO: 44351 - DNA, 103 bp, Artificial Sequence
  Synthetic Polynucleotide
taatacgactcactatagggaatgatcggatgaaaaaagatatctacttgaacagaggagacaagtaatgatcttttttaacctggcggcagcgcaaaagatg

SEQ ID NO: 44352 - DNA, 103 bp, Artificial Sequence
  Synthetic Polynucleotide
taatacgactcactatagggttattaatgatcggatgaaaaaagatatctaacagaggagaagatatatgttttcatccaacctggcggcagcgcaaaagatg

SEQ ID NO: 44353 - DNA, 103 bp, Artificial Sequence
  Synthetic Polynucleotide
taatacgactcactatagggtatttttattaatgatcggatgaaaaaagaaacagaggagatcttttatgatccgatcaaacctggcggcagcgcaaaagatg

SEQ ID NO: 44354 - DNA, 103 bp, Artificial Sequence
  Synthetic Polynucleotide
taatacgactcactataggggttcgtatttttattaatgatcggatgaaaaacagaggagatttcatatgatcattaataacctggcggcagcgcaaaagatg

SEQ ID NO: 44355 - DNA, 103 bp, Artificial Sequence
  Synthetic Polynucleotide
taatacgactcactatagggataaagttcgtatttttattaatgatcggaaacagaggagatccgatatgtaataaaaaaacctggcggcagcgcaaaagatg

SEQ ID NO: 44356 - DNA, 103 bp, Artificial Sequence
  Synthetic Polynucleotide
taatacgactcactatagggaccgaataaagttcgtatttttattaatgaaacagaggagatcattaatgaaaatacgaaacctggcggcagcgcaaaagatg

SEQ ID NO: 44357 - DNA, 103 bp, Artificial Sequence
  Synthetic Polynucleotide
taatacgactcactataggggtcttaccgaataaagttcgtatttttattaacagaggagaaataaaatgacgaactttaacctggcggcagcgcaaaagatg

SEQ ID NO: 44358 - DNA, 103 bp, Artificial Sequence
  Synthetic Polynucleotide
taatacgactcactatagggtgatcgtcttaccgaataaagttcgtatttaacagaggagaaaatacatgctttattcgaacctggcggcagcgcaaaagatg

SEQ ID NO: 44359 - DNA, 103 bp, Artificial Sequence
  Synthetic Polynucleotide
taatacgactcactataggggtaaatgatcgtcttaccgaataaagttcgaacagaggagacgaactatgttcggtaagaacctggcggcagcgcaaaagatg

SEQ ID NO: 44360 - DNA, 103 bp, Artificial Sequence
  Synthetic Polynucleotide
taatacgactcactatagggttgacttgagtgttaaatgtgaaaaccatcaacagaggagagatggtatgcacatttaaaacctggcggcagcgcaaaagatg

SEQ ID NO: 44361 - DNA, 103 bp, Artificial Sequence
  Synthetic Polynucleotide
taatacgactcactatagggccttagtaaatgatcgtcttaccgaataaaaacagaggagatttattatgtaagacgataacctggcggcagcgcaaaagatg

SEQ ID NO: 44362 - DNA, 103 bp, Artificial Sequence
  Synthetic Polynucleotide
taatacgactcactatagggttactccttagtaaatgatcgtcttaccgaaacagaggagatcggtaatgcgatcatttaacctggcggcagcgcaaaagatg

SEQ ID NO: 44363 - DNA, 103 bp, Artificial Sequence
  Synthetic Polynucleotide
taatacgactcactatagggctattttactccttagtaaatgatcgtcttaacagaggagaaagacgatgatttactaaaacctggcggcagcgcaaaagatg

SEQ ID NO: 44364 - DNA, 103 bp, Artificial Sequence
  Synthetic Polynucleotide
taatacgactcactatagggacttcctattttactccttagtaaatgatcaacagaggagagatcatatgctaaggagtaacctggcggcagcgcaaaagatg

SEQ ID NO: 44365 - DNA, 103 bp, Artificial Sequence
  Synthetic Polynucleotide
taatacgactcactatagggacattacttcctattttactccttagtaaaaacagaggagatttactatggagtaaaataacctggcggcagcgcaaaagatg

SEQ ID NO: 44366 - DNA, 103 bp, Artificial Sequence
  Synthetic Polynucleotide
taatacgactcactatagggtacgaacattacttcctattttactccttaaacagaggagataaggaatgaaataggaaaacctggcggcagcgcaaaagatg

SEQ ID NO: 44367 - DNA, 103 bp, Artificial Sequence
  Synthetic Polynucleotide
taatacgactcactatagggcgatatacgaacattacttcctattttactaacagaggagaagtaaaatgggaagtaataacctggcggcagcgcaaaagatg

SEQ ID NO: 44368 - DNA, 103 bp, Artificial Sequence
  Synthetic Polynucleotide
taatacgactcactataggggataacgatatacgaacattacttcctattaacagaggagaaataggatgtaatgttcgaacctggcggcagcgcaaaagatg

SEQ ID NO: 44369 - DNA, 103 bp, Artificial Sequence
  Synthetic Polynucleotide
taatacgactcactatagggacgatgataacgatatacgaacattacttcaacagaggagagaagtaatgttcgtatataacctggcggcagcgcaaaagatg

SEQ ID NO: 44370 - DNA, 103 bp, Artificial Sequence
  Synthetic Polynucleotide
taatacgactcactatagggtttatacgatgataacgatatacgaacattaacagaggagaaatgttatgatatcgttaaacctggcggcagcgcaaaagatg

SEQ ID NO: 44371 - DNA, 103 bp, Artificial Sequence
  Synthetic Polynucleotide
taatacgactcactatagggtggatttgacttgagtgttaaatgtgaaaaaacagaggagattttcaatgttaacactcaacctggcggcagcgcaaaagatg

SEQ ID NO: 44372 - DNA, 103 bp, Artificial Sequence
  Synthetic Polynucleotide
taatacgactcactatagggtttaatttatacgatgataacgatatacgaaacagaggagatcgtatatggttatcatcaacctggcggcagcgcaaaagatg

SEQ ID NO: 44373 - DNA, 103 bp, Artificial Sequence
  Synthetic Polynucleotide
taatacgactcactatagggacacctttaatttatacgatgataacgataaacagaggagatatcgtatgcatcgtataaacctggcggcagcgcaaaagatg

SEQ ID NO: 44374 - DNA, 103 bp, Artificial Sequence
  Synthetic Polynucleotide
taatacgactcactatagggaaaacacacctttaatttatacgatgataaaacagaggagattatcaatgtataaattaaacctggcggcagcgcaaaagatg

SEQ ID NO: 44375 - DNA, 103 bp, Artificial Sequence
  Synthetic Polynucleotide
taatacgactcactatagggggtaaaaaacacacctttaatttatacgataacagaggagaatcgtaatgattaaaggtaacctggcggcagcgcaaaagatg

SEQ ID NO: 44376 - DNA, 103 bp, Artificial Sequence
  Synthetic Polynucleotide
taatacgactcactatagggttaatggtaaaaaacacacctttaatttataacagaggagaataaatatgaggtgtgttaacctggcggcagcgcaaaagatg

SEQ ID NO: 44377 - DNA, 103 bp, Artificial Sequence
  Synthetic Polynucleotide
taatacgactcactataggggtcacttaatggtaaaaaacacacctttaaaacagaggagattaaagatgtgttttttaaacctggcggcagcgcaaaagatg

SEQ ID NO: 44378 - DNA, 103 bp, Artificial Sequence
  Synthetic Polynucleotide
taatacgactcactatagggataatgtcacttaatggtaaaaaacacaccaacagaggagaggtgtgatgtttaccattaacctggcggcagcgcaaaagatg

SEQ ID NO: 44379 - DNA, 103 bp, Artificial Sequence
  Synthetic Polynucleotide
taatacgactcactatagggaaattataatgtcacttaatggtaaaaaacaacagaggagagtttttatgcattaagtgaacctggcggcagcgcaaaagatg

SEQ ID NO: 44380 - DNA, 103 bp, Artificial Sequence
  Synthetic Polynucleotide
taatacgactcactatagggtggtaaaattataatgtcacttaatggtaaaacagaggagattaccaatgagtgacattaacctggcggcagcgcaaaagatg

SEQ ID NO: 44381 - DNA, 103 bp, Artificial Sequence
  Synthetic Polynucleotide
taatacgactcactatagggaatattggtaaaattataatgtcacttaataacagaggagaattaagatgcattataataacctggcggcagcgcaaaagatg

SEQ ID NO: 44382 - DNA, 103 bp, Artificial Sequence
  Synthetic Polynucleotide
taatacgactcactataggggaacatggatttgacttgagtgttaaatgtaacagaggagaacatttatgactcaagtcaacctggcggcagcgcaaaagatg

SEQ ID NO: 44383 - DNA, 103 bp, Artificial Sequence
  Synthetic Polynucleotide
taatacgactcactatagggattccaatattggtaaaattataatgtcacaacagaggagagtgacaatgtaattttacaacctggcggcagcgcaaaagatg

SEQ ID NO: 44384 - DNA, 103 bp, Artificial Sequence
  Synthetic Polynucleotide
taatacgactcactatagggttataattccaatattggtaaaattataataacagaggagaattataatgttaccaataaacctggcggcagcgcaaaagatg

SEQ ID NO: 44385 - DNA, 103 bp, Artificial Sequence
  Synthetic Polynucleotide
taatacgactcactatagggctatattataattccaatattggtaaaattaacagaggagaaattttatgaatattggaaacctggcggcagcgcaaaagatg

SEQ ID NO: 44386 - DNA, 103 bp, Artificial Sequence
  Synthetic Polynucleotide
taatacgactcactatagggtatacctatattataattccaatattggtaaacagaggagataccaaatgtggaattataacctggcggcagcgcaaaagatg

SEQ ID NO: 44387 - DNA, 103 bp, Artificial Sequence
  Synthetic Polynucleotide
taatacgactcactataggggcaaatatacctatattataattccaatataacagaggagaatattgatgttataatataacctggcggcagcgcaaaagatg

SEQ ID NO: 44388 - DNA, 103 bp, Artificial Sequence
  Synthetic Polynucleotide
taatacgactcactatagggagtgcgcaaatatacctatattataattccaacagaggagaggaattatgatataggtaaacctggcggcagcgcaaaagatg

SEQ ID NO: 44389 - DNA, 103 bp, Artificial Sequence
  Synthetic Polynucleotide
taatacgactcactatagggtcgcaagtgcgcaaatatacctatattataaacagaggagatataatatgggtatatttaacctggcggcagcgcaaaagatg

SEQ ID NO: 44390 - DNA, 103 bp, Artificial Sequence
  Synthetic Polynucleotide
taatacgactcactatagggaactgtcgcaagtgcgcaaatatacctataaacagaggagatataggatgatttgcgcaaacctggcggcagcgcaaaagatg

SEQ ID NO: 44391 - DNA, 103 bp, Artificial Sequence
  Synthetic Polynucleotide
taatacgactcactataggggcatcaactgtcgcaagtgcgcaaatatacaacagaggagagtatatatgcgcacttgcaacctggcggcagcgcaaaagatg

SEQ ID NO: 44392 - DNA, 103 bp, Artificial Sequence
  Synthetic Polynucleotide
taatacgactcactatagggccgatgcatcaactgtcgcaagtgcgcaaaaacagaggagatttgcgatgttgcgacagaacctggcggcagcgcaaaagatg

SEQ ID NO: 44393 - DNA, 103 bp, Artificial Sequence
  Synthetic Polynucleotide
taatacgactcactatagggtggtagaacatggatttgacttgagtgttaaacagaggagataacacatgagtcaaatcaacctggcggcagcgcaaaagatg

SEQ ID NO: 44394 - DNA, 103 bp, Artificial Sequence
  Synthetic Polynucleotide
taatacgactcactatagggatttaccgatgcatcaactgtcgcaagtgcaacagaggagagcacttatgacagttgataacctggcggcagcgcaaaagatg

SEQ ID NO: 44395 - DNA, 103 bp, Artificial Sequence
  Synthetic Polynucleotide
taatacgactcactataggggctatatttaccgatgcatcaactgtcgcaaacagaggagatgcgacatgtgatgcatcaacctggcggcagcgcaaaagatg

SEQ ID NO: 44396 - DNA, 103 bp, Artificial Sequence
  Synthetic Polynucleotide
taatacgactcactatagggatacagctatatttaccgatgcatcaactgaacagaggagacagttgatgcatcggtaaaacctggcggcagcgcaaaagatg

SEQ ID NO: 44397 - DNA, 103 bp, Artificial Sequence
  Synthetic Polynucleotide
taatacgactcactatagggattagatacagctatatttaccgatgcatcaacagaggagagatgcaatggtaaatataaacctggcggcagcgcaaaagatg

SEQ ID NO: 44398 - DNA, 103 bp, Artificial Sequence
  Synthetic Polynucleotide
taatacgactcactatagggagaacattagatacagctatatttaccgataacagaggagaatcggtatgtatagctgtaacctggcggcagcgcaaaagatg

SEQ ID NO: 44399 - DNA, 103 bp, Artificial Sequence
  Synthetic Polynucleotide
taatacgactcactatagggcgactagaacattagatacagctatatttaaacagaggagataaataatgctgtatctaaacctggcggcagcgcaaaagatg

SEQ ID NO: 44400 - DNA, 103 bp, Artificial Sequence
  Synthetic Polynucleotide
taatacgactcactatagggaataccgactagaacattagatacagctataacagaggagaatagctatgtctaatgttaacctggcggcagcgcaaaagatg

SEQ ID NO: 44401 - DNA, 103 bp, Artificial Sequence
  Synthetic Polynucleotide
taatacgactcactataggggatgaaataccgactagaacattagatacaaacagaggagatgtatcatgtgttctagtaacctggcggcagcgcaaaagatg

SEQ ID NO: 44402 - DNA, 103 bp, Artificial Sequence
  Synthetic Polynucleotide
taatacgactcactataggggaaatgatgaaataccgactagaacattagaacagaggagactaatgatgtagtcggtaaacctggcggcagcgcaaaagatg

SEQ ID NO: 44403 - DNA, 103 bp, Artificial Sequence
  Synthetic Polynucleotide
taatacgactcactatagggacagcgaaatgatgaaataccgactagaacaacagaggagagttctaatgggtatttcaaacctggcggcagcgcaaaagatg

SEQ ID NO: 44404 - DNA, 103 bp, Artificial Sequence
  Synthetic Polynucleotide
taatacgactcactatagggggtgttggtagaacatggatttgacttgagaacagaggagactcaagatgaatccatgtaacctggcggcagcgcaaaagatg

SEQ ID NO: 44405 - DNA, 103 bp, Artificial Sequence
  Synthetic Polynucleotide
taatacgactcactatagggattatacagcgaaatgatgaaataccgactaacagaggagaagtcggatgttcatcattaacctggcggcagcgcaaaagatg

SEQ ID NO: 44406 - DNA, 103 bp, Artificial Sequence
  Synthetic Polynucleotide
taatacgactcactatagggctattattatacagcgaaatgatgaaatacaacagaggagagtatttatgcatttcgctaacctggcggcagcgcaaaagatg

SEQ ID NO: 44407 - DNA, 103 bp, Artificial Sequence
  Synthetic Polynucleotide
taatacgactcactatagggaaacgctattattatacagcgaaatgatgaaacagaggagatcatcaatgcgctgtataaacctggcggcagcgcaaaagatg

SEQ ID NO: 44408 - DNA, 103 bp, Artificial Sequence
  Synthetic Polynucleotide
taatacgactcactatagggagagaaaacgctattattatacagcgaaataacagaggagaatttcgatgtataataataacctggcggcagcgcaaaagatg

SEQ ID NO: 44409 - DNA, 103 bp, Artificial Sequence
  Synthetic Polynucleotide
taatacgactcactatagggcagatagagaaaacgctattattatacagcaacagaggagagctgtaatgtaatagcgtaacctggcggcagcgcaaaagatg

SEQ ID NO: 44410 - DNA, 103 bp, Artificial Sequence
  Synthetic Polynucleotide
taatacgactcactatagggggaaacagatagagaaaacgctattattataacagaggagaataataatggcgttttctaacctggcggcagcgcaaaagatg

SEQ ID NO: 44411 - DNA, 103 bp, Artificial Sequence
  Synthetic Polynucleotide
taatacgactcactataggggtaatggaaacagatagagaaaacgctattaacagaggagaaatagcatgttctctatcaacctggcggcagcgcaaaagatg

SEQ ID NO: 44412 - DNA, 103 bp, Artificial Sequence
  Synthetic Polynucleotide
taatacgactcactatagggcagctgtaatggaaacagatagagaaaacgaacagaggagacgttttatgtatctgtttaacctggcggcagcgcaaaagatg

SEQ ID NO: 44413 - DNA, 103 bp, Artificial Sequence
  Synthetic Polynucleotide
taatacgactcactatagggtcaggcagctgtaatggaaacagatagagaaacagaggagatctctaatggtttccattaacctggcggcagcgcaaaagatg

SEQ ID NO: 44414 - DNA, 103 bp, Artificial Sequence
  Synthetic Polynucleotide
taatacgactcactatagggaaacttcaggcagctgtaatggaaacagataacagaggagaatctgtatgcattacagcaacctggcggcagcgcaaaagatg

SEQ ID NO: 44415 - DNA, 103 bp, Artificial Sequence
  Synthetic Polynucleotide
taatacgactcactatagggataaaggtgttggtagaacatggatttgacaacagaggagagtcaaaatgatgttctacaacctggcggcagcgcaaaagatg

SEQ ID NO: 44416 - DNA, 103 bp, Artificial Sequence
  Synthetic Polynucleotide
taatacgactcactatagggccaataaacttcaggcagctgtaatggaaaaacagaggagatttccaatgcagctgcctaacctggcggcagcgcaaaagatg

SEQ ID NO: 44417 - DNA, 103 bp, Artificial Sequence
  Synthetic Polynucleotide
taatacgactcactatagggtccgaccaataaacttcaggcagctgtaataacagaggagaattacaatggcctgaagtaacctggcggcagcgcaaaagatg

SEQ ID NO: 44418 - DNA, 103 bp, Artificial Sequence
  Synthetic Polynucleotide
taatacgactcactatagggtattatccgaccaataaacttcaggcagctaacagaggagaagctgcatgaagtttattaacctggcggcagcgcaaaagatg

SEQ ID NO: 44419 - DNA, 103 bp, Artificial Sequence
  Synthetic Polynucleotide
taatacgactcactatagggttacatattatccgaccaataaacttcaggaacagaggagacctgaaatgtattggtcgaacctggcggcagcgcaaaagatg

SEQ ID NO: 44420 - DNA, 103 bp, Artificial Sequence
  Synthetic Polynucleotide
taatacgactcactatagggttattttacatattatccgaccaataaactaacagaggagaagtttaatggtcggataaaacctggcggcagcgcaaaagatg

SEQ ID NO: 44421 - DNA, 103 bp, Artificial Sequence
  Synthetic Polynucleotide
taatacgactcactatagggtcttattattttacatattatccgaccaataacagaggagaattggtatgataatatgtaacctggcggcagcgcaaaagatg

SEQ ID NO: 44422 - DNA, 103 bp, Artificial Sequence
  Synthetic Polynucleotide
taatacgactcactataggggtatttcttattattttacatattatccgaaacagaggagatcggatatgatgtaaaataacctggcggcagcgcaaaagatg

SEQ ID NO: 44423 - DNA, 103 bp, Artificial Sequence
  Synthetic Polynucleotide
taatacgactcactatagggcgtatgtatttcttattattttacatattaaacagaggagataatatatgaaataataaaacctggcggcagcgcaaaagatg

SEQ ID NO: 44424 - DNA, 103 bp, Artificial Sequence
  Synthetic Polynucleotide
taatacgactcactatagggttattcgtatgtatttcttattattttacaaacagaggagatgtaaaatgataagaaataacctggcggcagcgcaaaagatg

SEQ ID NO: 44425 - DNA, 103 bp, Artificial Sequence
  Synthetic Polynucleotide
taatacgactcactatagggttttgttattcgtatgtatttcttattattaacagaggagaaataatatgaaatacataaacctggcggcagcgcaaaagatg

SEQ ID NO: 44426 - DNA, 103 bp, Artificial Sequence
  Synthetic Polynucleotide
taatacgactcactatagggacttaataaaggtgttggtagaacatggataacagaggagaatccatatgctaccaacaaacctggcggcagcgcaaaagatg

SEQ ID NO: 44427 - DNA, 103 bp, Artificial Sequence
  Synthetic Polynucleotide
taatacgactcactatagggtttatttttgttattcgtatgtatttcttaaacagaggagataagaaatgcatacgaataacctggcggcagcgcaaaagatg

SEQ ID NO: 44428 - DNA, 103 bp, Artificial Sequence
  Synthetic Polynucleotide
taatacgactcactatagggtttattttatttttgttattcgtatgtattaacagaggagaaatacaatggaataacaaaacctggcggcagcgcaaaagatg

SEQ ID NO: 44429 - DNA, 103 bp, Artificial Sequence
  Synthetic Polynucleotide
taatacgactcactatagggtatattttattttatttttgttattcgtataacagaggagaatacgaatgacaaaaataaacctggcggcagcgcaaaagatg

SEQ ID NO: 44430 - DNA, 103 bp, Artificial Sequence
  Synthetic Polynucleotide
taatacgactcactatagggtttattatattttattttatttttgttattaacagaggagaaataacatgaataaaataaacctggcggcagcgcaaaagatg

SEQ ID NO: 44431 - DNA, 103 bp, Artificial Sequence
  Synthetic Polynucleotide
taatacgactcactataggggcatctttattatattttattttatttttgaacagaggagacaaaaaatgaataaaataaacctggcggcagcgcaaaagatg

SEQ ID NO: 44432 - DNA, 103 bp, Artificial Sequence
  Synthetic Polynucleotide
taatacgactcactatagggaaatggcatctttattatattttattttataacagaggagaataaaaatgaatataataaacctggcggcagcgcaaaagatg

SEQ ID NO: 44433 - DNA, 103 bp, Artificial Sequence
  Synthetic Polynucleotide
taatacgactcactatagggtctctaaatggcatctttattatattttataacagaggagaataaaaatgaataaagataacctggcggcagcgcaaaagatg

SEQ ID NO: 44434 - DNA, 103 bp, Artificial Sequence
  Synthetic Polynucleotide
taatacgactcactatagggttagatctctaaatggcatctttattatataacagaggagaatataaatgagatgccataacctggcggcagcgcaaaagatg

SEQ ID NO: 44435 - DNA, 103 bp, Artificial Sequence
  Synthetic Polynucleotide
taatacgactcactatagggcaaaattagatctctaaatggcatctttataacagaggagaataaagatgccatttagaaacctggcggcagcgcaaaagatg

SEQ ID NO: 44436 - DNA, 103 bp, Artificial Sequence
  Synthetic Polynucleotide
taatacgactcactatagggttgaacaaaattagatctctaaatggcatcaacagaggagagatgccatgtagagatctaacctggcggcagcgcaaaagatg

SEQ ID NO: 44437 - DNA, 103 bp, Artificial Sequence
  Synthetic Polynucleotide
taatacgactcactatagggcgttgacttaataaaggtgttggtagaacaaacagaggagatgttctatgaacacctttaacctggcggcagcgcaaaagatg

SEQ ID NO: 44438 - DNA, 103 bp, Artificial Sequence
  Synthetic Polynucleotide
taatacgactcactatagggacaagttgaacaaaattagatctctaaatgaacagaggagacatttaatgatctaatttaacctggcggcagcgcaaaagatg

SEQ ID NO: 44439 - DNA, 103 bp, Artificial Sequence
  Synthetic Polynucleotide
taatacgactcactatagggtttggacaagttgaacaaaattagatctctaacagaggagaagagatatgattttgttcaacctggcggcagcgcaaaagatg

SEQ ID NO: 44440 - DNA, 103 bp, Artificial Sequence
  Synthetic Polynucleotide
taatacgactcactatagggaggaatttggacaagttgaacaaaattagaaacagaggagatctaatatggttcaacttaacctggcggcagcgcaaaagatg

SEQ ID NO: 44441 - DNA, 103 bp, Artificial Sequence
  Synthetic Polynucleotide
taatacgactcactatagggtaagtaggaatttggacaagttgaacaaaaaacagaggagattttgtatgacttgtccaaacctggcggcagcgcaaaagatg

SEQ ID NO: 44442 - DNA, 103 bp, Artificial Sequence
  Synthetic Polynucleotide
taatacgactcactatagggttctgtaagtaggaatttggacaagttgaaaacagaggagattcaacatgtccaaattcaacctggcggcagcgcaaaagatg

SEQ ID NO: 44443 - DNA, 103 bp, Artificial Sequence
  Synthetic Polynucleotide
taatacgactcactatagggttatcttctgtaagtaggaatttggacaagaacagaggagacttgtcatgattcctactaacctggcggcagcgcaaaagatg

SEQ ID NO: 44444 - DNA, 103 bp, Artificial Sequence
  Synthetic Polynucleotide
taatacgactcactatagggattccttatcttctgtaagtaggaatttggaacagaggagaccaaatatgtacttacagaacctggcggcagcgcaaaagatg

SEQ ID NO: 44445 - DNA, 103 bp, Artificial Sequence
  Synthetic Polynucleotide
taatacgactcactatagggcaacgattccttatcttctgtaagtaggaaaacagaggagattcctaatgacagaagataacctggcggcagcgcaaaagatg

SEQ ID NO: 44446 - DNA, 103 bp, Artificial Sequence
  Synthetic Polynucleotide
taatacgactcactatagggatctccaacgattccttatcttctgtaagtaacagaggagaacttacatgagataaggaaacctggcggcagcgcaaaagatg

SEQ ID NO: 44447 - DNA, 103 bp, Artificial Sequence
  Synthetic Polynucleotide
taatacgactcactatagggacactatctccaacgattccttatcttctgaacagaggagacagaagatgaggaatcgtaacctggcggcagcgcaaaagatg

SEQ ID NO: 44448 - DNA, 103 bp, Artificial Sequence
  Synthetic Polynucleotide
taatacgactcactataggggtaaacgttgacttaataaaggtgttggtaaacagaggagataccaaatgctttattaaaacctggcggcagcgcaaaagatg

SEQ ID NO: 44449 - DNA, 103 bp, Artificial Sequence
  Synthetic Polynucleotide
taatacgactcactatagggggaagacactatctccaacgattccttatcaacagaggagagataagatgtcgttggagaacctggcggcagcgcaaaagatg

SEQ ID NO: 44450 - DNA, 103 bp, Artificial Sequence
  Synthetic Polynucleotide
taatacgactcactatagggcataaggaagacactatctccaacgattccaacagaggagaggaatcatgggagatagtaacctggcggcagcgcaaaagatg

SEQ ID NO: 44451 - DNA, 103 bp, Artificial Sequence
  Synthetic Polynucleotide
taatacgactcactatagggctctacataaggaagacactatctccaacgaacagaggagacgttggatgtagtgtcttaacctggcggcagcgcaaaagatg

SEQ ID NO: 44452 - DNA, 103 bp, Artificial Sequence
  Synthetic Polynucleotide
taatacgactcactatagggaaatcctctacataaggaagacactatctcaacagaggagagagataatgtcttccttaaacctggcggcagcgcaaaagatg

SEQ ID NO: 44453 - DNA, 103 bp, Artificial Sequence
  Synthetic Polynucleotide
taatacgactcactatagggatttcaaatcctctacataaggaagacactaacagaggagaagtgtcatgcttatgtagaacctggcggcagcgcaaaagatg

SEQ ID NO: 44454 - DNA, 103 bp, Artificial Sequence
  Synthetic Polynucleotide
taatacgactcactatagggaagatatttcaaatcctctacataaggaagaacagaggagacttcctatggtagaggataacctggcggcagcgcaaaagatg

SEQ ID NO: 44455 - DNA, 103 bp, Artificial Sequence
  Synthetic Polynucleotide
taatacgactcactatagggatcataagatatttcaaatcctctacataaaacagaggagattatgtatgggatttgaaaacctggcggcagcgcaaaagatg

SEQ ID NO: 44456 - DNA, 103 bp, Artificial Sequence
  Synthetic Polynucleotide
taatacgactcactatagggaagtcatcataagatatttcaaatcctctaaacagaggagatagaggatgtgaaatatcaacctggcggcagcgcaaaagatg

SEQ ID NO: 44457 - DNA, 103 bp, Artificial Sequence
  Synthetic Polynucleotide
taatacgactcactatagggttatcaagtcatcataagatatttcaaatcaacagaggagagatttgatgtatcttatgaacctggcggcagcgcaaaagatg

SEQ ID NO: 44458 - DNA, 103 bp, Artificial Sequence
  Synthetic Polynucleotide
taatacgactcactataggggtaagttatcaagtcatcataagatatttcaacagaggagagaaataatgtatgatgacaacctggcggcagcgcaaaagatg

SEQ ID NO: 44459 - DNA, 103 bp, Artificial Sequence
  Synthetic Polynucleotide
taatacgactcactatagggggcttctcatctctttcagaactgatgcaaaacagaggagattgcatatgttctgaaagaacctggcggcagcgcaaaagatg

SEQ ID NO: 44460 - DNA, 103 bp, Artificial Sequence
  Synthetic Polynucleotide
taatacgactcactatagggaaaatgtaaacgttgacttaataaaggtgtaacagaggagaacacctatgttaagtcaaaacctggcggcagcgcaaaagatg

SEQ ID NO: 44461 - DNA, 103 bp, Artificial Sequence
  Synthetic Polynucleotide
taatacgactcactatagggggaaagtaagttatcaagtcatcataagataacagaggagaatcttaatgtgacttgataacctggcggcagcgcaaaagatg

SEQ ID NO: 44462 - DNA, 103 bp, Artificial Sequence
  Synthetic Polynucleotide
taatacgactcactatagggtatctggaaagtaagttatcaagtcatcataacagaggagaatgatgatgtgataacttaacctggcggcagcgcaaaagatg

SEQ ID NO: 44463 - DNA, 103 bp, Artificial Sequence
  Synthetic Polynucleotide
taatacgactcactatagggttttctatctggaaagtaagttatcaagtcaacagaggagagacttgatgacttactttaacctggcggcagcgcaaaagatg

SEQ ID NO: 44464 - DNA, 103 bp, Artificial Sequence
  Synthetic Polynucleotide
taatacgactcactatagggtgatattttctatctggaaagtaagttatcaacagaggagagataacatgctttccagaaacctggcggcagcgcaaaagatg

SEQ ID NO: 44465 - DNA, 103 bp, Artificial Sequence
  Synthetic Polynucleotide
taatacgactcactatagggatttatgatattttctatctggaaagtaagaacagaggagacttactatgcagatagaaaacctggcggcagcgcaaaagatg

SEQ ID NO: 44466 - DNA, 103 bp, Artificial Sequence
  Synthetic Polynucleotide
taatacgactcactatagggaatatatttatgatattttctatctggaaaaacagaggagatttccaatgagaaaatataacctggcggcagcgcaaaagatg

SEQ ID NO: 44467 - DNA, 103 bp, Artificial Sequence
  Synthetic Polynucleotide
taatacgactcactatagggttataaatatatttatgatattttctatctaacagaggagaagatagatgatatcataaaacctggcggcagcgcaaaagatg

SEQ ID NO: 44468 - DNA, 103 bp, Artificial Sequence
  Synthetic Polynucleotide
taatacgactcactatagggatactttataaatatatttatgatattttcaacagaggagagaaaatatgataaatataaacctggcggcagcgcaaaagatg

SEQ ID NO: 44469 - DNA, 103 bp, Artificial Sequence
  Synthetic Polynucleotide
taatacgactcactatagggttcaaatactttataaatatatttatgataaacagaggagatatcatatgtatatttataacctggcggcagcgcaaaagatg

SEQ ID NO: 44470 - DNA, 103 bp, Artificial Sequence
  Synthetic Polynucleotide
taatacgactcactatagggacatgttcaaatactttataaatatatttaaacagaggagataaataatgttataaagtaacctggcggcagcgcaaaagatg

SEQ ID NO: 44471 - DNA, 103 bp, Artificial Sequence
  Synthetic Polynucleotide
taatacgactcactatagggatccaaaaatgtaaacgttgacttaataaaaacagaggagatttattatgtcaacgtttaacctggcggcagcgcaaaagatg

SEQ ID NO: 44472 - DNA, 103 bp, Artificial Sequence
  Synthetic Polynucleotide
taatacgactcactatagggaatctacatgttcaaatactttataaatataacagaggagaatatttatgaagtatttgaacctggcggcagcgcaaaagatg

SEQ ID NO: 44473 - DNA, 103 bp, Artificial Sequence
  Synthetic Polynucleotide
taatacgactcactatagggcgataaatctacatgttcaaatactttataaacagaggagatataaaatgtttgaacataacctggcggcagcgcaaaagatg

SEQ ID NO: 44474 - DNA, 103 bp, Artificial Sequence
  Synthetic Polynucleotide
taatacgactcactatagggtcctccgataaatctacatgttcaaatactaacagaggagaagtattatgacatgtagaaacctggcggcagcgcaaaagatg

SEQ ID NO: 44475 - DNA, 103 bp, Artificial Sequence
  Synthetic Polynucleotide
taatacgactcactatagggttaattcctccgataaatctacatgttcaaaacagaggagattgaacatgtagatttataacctggcggcagcgcaaaagatg

SEQ ID NO: 44476 - DNA, 103 bp, Artificial Sequence
  Synthetic Polynucleotide
taatacgactcactatagggcatacttaattcctccgataaatctacatgaacagaggagacatgtaatgttatcggagaacctggcggcagcgcaaaagatg

SEQ ID NO: 44477 - DNA, 103 bp, Artificial Sequence
  Synthetic Polynucleotide
taatacgactcactatagggaattccatacttaattcctccgataaatctaacagaggagaagatttatgggaggaattaacctggcggcagcgcaaaagatg

SEQ ID NO: 44478 - DNA, 103 bp, Artificial Sequence
  Synthetic Polynucleotide
taatacgactcactatagggcatggaattccatacttaattcctccgataaacagaggagatatcggatgaattaagtaaacctggcggcagcgcaaaagatg

SEQ ID NO: 44479 - DNA, 103 bp, Artificial Sequence
  Synthetic Polynucleotide
taatacgactcactatagggtgtatcatggaattccatacttaattcctcaacagaggagagaggaaatgagtatggaaaacctggcggcagcgcaaaagatg

SEQ ID NO: 44480 - DNA, 103 bp, Artificial Sequence
  Synthetic Polynucleotide
taatacgactcactatagggagagttgtatcatggaattccatacttaataacagaggagaattaagatgggaattccaaacctggcggcagcgcaaaagatg

SEQ ID NO: 44481 - DNA, 103 bp, Artificial Sequence
  Synthetic Polynucleotide
taatacgactcactatagggctcgcagagttgtatcatggaattccatacaacagaggagagtatggatgtccatgataaacctggcggcagcgcaaaagatg

SEQ ID NO: 44482 - DNA, 103 bp, Artificial Sequence
  Synthetic Polynucleotide
taatacgactcactatagggatgaaatccaaaaatgtaaacgttgacttaaacagaggagataagtcatggtttacattaacctggcggcagcgcaaaagatg

SEQ ID NO: 44483 - DNA, 103 bp, Artificial Sequence
  Synthetic Polynucleotide
taatacgactcactatagggtaaatctcgcagagttgtatcatggaattcaacagaggagagaattcatggatacaactaacctggcggcagcgcaaaagatg

SEQ ID NO: 44484 - DNA, 103 bp, Artificial Sequence
  Synthetic Polynucleotide
taatacgactcactatagggtagactaaatctcgcagagttgtatcatggaacagaggagaccatgaatgaactctgcgaacctggcggcagcgcaaaagatg

SEQ ID NO: 44485 - DNA, 103 bp, Artificial Sequence
  Synthetic Polynucleotide
taatacgactcactatagggtaagatagactaaatctcgcagagttgtataacagaggagaatacaaatgtgcgagattaacctggcggcagcgcaaaagatg

SEQ ID NO: 44486 - DNA, 103 bp, Artificial Sequence
  Synthetic Polynucleotide
taatacgactcactatagggcaatttaagatagactaaatctcgcagagtaacagaggagaactctgatggatttagtcaacctggcggcagcgcaaaagatg

SEQ ID NO: 44487 - DNA, 103 bp, Artificial Sequence
  Synthetic Polynucleotide
taatacgactcactatagggttatacaatttaagatagactaaatctcgcaacagaggagagcgagaatgagtctatctaacctggcggcagcgcaaaagatg

SEQ ID NO: 44488 - DNA, 103 bp, Artificial Sequence
  Synthetic Polynucleotide
taatacgactcactatagggaatacttatacaatttaagatagactaaataacagaggagaatttagatgatcttaaataacctggcggcagcgcaaaagatg

SEQ ID NO: 44489 - DNA, 103 bp, Artificial Sequence
  Synthetic Polynucleotide
taatacgactcactatagggcttggaatacttatacaatttaagatagacaacagaggagagtctatatgaaattgtataacctggcggcagcgcaaaagatg

SEQ ID NO: 44490 - DNA, 103 bp, Artificial Sequence
  Synthetic Polynucleotide
taatacgactcactatagggatacacttggaatacttatacaatttaagaaacagaggagatcttaaatggtataagtaaacctggcggcagcgcaaaagatg

SEQ ID NO: 44491 - DNA, 103 bp, Artificial Sequence
  Synthetic Polynucleotide
taatacgactcactataggggtcgtatacacttggaatacttatacaattaacagaggagaaattgtatgagtattccaaacctggcggcagcgcaaaagatg

SEQ ID NO: 44492 - DNA, 103 bp, Artificial Sequence
  Synthetic Polynucleotide
taatacgactcactatagggacacggtcgtatacacttggaatacttataaacagaggagatataagatgtccaagtgtaacctggcggcagcgcaaaagatg

SEQ ID NO: 44493 - DNA, 103 bp, Artificial Sequence
  Synthetic Polynucleotide
taatacgactcactatagggactatatgaaatccaaaaatgtaaacgttgaacagaggagacaacgtatgcatttttggaacctggcggcagcgcaaaagatg

SEQ ID NO: 44494 - DNA, 103 bp, Artificial Sequence
  Synthetic Polynucleotide
taatacgactcactatagggttataacacggtcgtatacacttggaatacaacagaggagagtattcatggtgtatacgaacctggcggcagcgcaaaagatg

SEQ ID NO: 44495 - DNA, 103 bp, Artificial Sequence
  Synthetic Polynucleotide
taatacgactcactatagggctaatttataacacggtcgtatacacttggaacagaggagaccaagtatgtacgaccgtaacctggcggcagcgcaaaagatg

SEQ ID NO: 44496 - DNA, 103 bp, Artificial Sequence
  Synthetic Polynucleotide
taatacgactcactatagggatctcctaatttataacacggtcgtatacaaacagaggagatgtataatgccgtgttataacctggcggcagcgcaaaagatg

SEQ ID NO: 44497 - DNA, 103 bp, Artificial Sequence
  Synthetic Polynucleotide
taatacgactcactatagggagattatctcctaatttataacacggtcgtaacagaggagaacgaccatgttataaattaacctggcggcagcgcaaaagatg

SEQ ID NO: 44498 - DNA, 103 bp, Artificial Sequence
  Synthetic Polynucleotide
taatacgactcactatagggcttttagattatctcctaatttataacacgaacagaggagacgtgttatgaattaggagaacctggcggcagcgcaaaagatg

SEQ ID NO: 44499 - DNA, 103 bp, Artificial Sequence
  Synthetic Polynucleotide
taatacgactcactatagggtatgccttttagattatctcctaatttataaacagaggagatataaaatgggagataataacctggcggcagcgcaaaagatg

SEQ ID NO: 44500 - DNA, 103 bp, Artificial Sequence
  Synthetic Polynucleotide
taatacgactcactatagggacaactatgccttttagattatctcctaataacagaggagaattaggatgtaatctaaaaacctggcggcagcgcaaaagatg

SEQ ID NO: 44501 - DNA, 103 bp, Artificial Sequence
  Synthetic Polynucleotide
taatacgactcactatagggttataacaactatgccttttagattatctcaacagaggagagagataatgtaaaaggcaaacctggcggcagcgcaaaagatg

SEQ ID NO: 44502 - DNA, 103 bp, Artificial Sequence
  Synthetic Polynucleotide
taatacgactcactataggggtcctttataacaactatgccttttagattaacagaggagaaatctaatgggcatagttaacctggcggcagcgcaaaagatg

SEQ ID NO: 44503 - DNA, 103 bp, Artificial Sequence
  Synthetic Polynucleotide
taatacgactcactatagggtttctgtcctttataacaactatgccttttaacagaggagaaaaaggatgagttgttataacctggcggcagcgcaaaagatg

SEQ ID NO: 44504 - DNA, 103 bp, Artificial Sequence
  Synthetic Polynucleotide
taatacgactcactatagggattcaactatatgaaatccaaaaatgtaaaaacagaggagatttacaatgttggatttcaacctggcggcagcgcaaaagatg

SEQ ID NO: 44505 - DNA, 103 bp, Artificial Sequence
  Synthetic Polynucleotide
taatacgactcactatagggatatatttctgtcctttataacaactatgcaacagaggagagcatagatgttataaaggaacctggcggcagcgcaaaagatg

SEQ ID NO: 44506 - DNA, 103 bp, Artificial Sequence
  Synthetic Polynucleotide
taatacgactcactatagggaatatatatatttctgtcctttataacaacaacagaggagagttgttatgaaggacagaaacctggcggcagcgcaaaagatg

SEQ ID NO: 44507 - DNA, 103 bp, Artificial Sequence
  Synthetic Polynucleotide
taatacgactcactatagggtctctaatatatatatttctgtcctttataaacagaggagatataaaatgcagaaatataacctggcggcagcgcaaaagatg

SEQ ID NO: 44508 - DNA, 103 bp, Artificial Sequence
  Synthetic Polynucleotide
taatacgactcactatagggttgcttctctaatatatatatttctgtcctaacagaggagaaggacaatgatatatataaacctggcggcagcgcaaaagatg

SEQ ID NO: 44509 - DNA, 103 bp, Artificial Sequence
  Synthetic Polynucleotide
taatacgactcactatagggatcatttgcttctctaatatatatatttctaacagaggagaagaaatatgtatattagaaacctggcggcagcgcaaaagatg

SEQ ID NO: 44510 - DNA, 103 bp, Artificial Sequence
  Synthetic Polynucleotide
taatacgactcactatagggaagtcatcatttgcttctctaatatatataaacagaggagatatataatgtagagaagcaacctggcggcagcgcaaaagatg

SEQ ID NO: 44511 - DNA, 103 bp, Artificial Sequence
  Synthetic Polynucleotide
taatacgactcactatagggctatcaagtcatcatttgcttctctaatataacagaggagaatattaatgaagcaaatgaacctggcggcagcgcaaaagatg

SEQ ID NO: 44512 - DNA, 103 bp, Artificial Sequence
  Synthetic Polynucleotide
taatacgactcactatagggatattctatcaagtcatcatttgcttctctaacagaggagaagagaaatgaatgatgacaacctggcggcagcgcaaaagatg

SEQ ID NO: 44513 - DNA, 103 bp, Artificial Sequence
  Synthetic Polynucleotide
taatacgactcactatagggaggagatattctatcaagtcatcatttgctaacagaggagaagcaaaatgtgacttgataacctggcggcagcgcaaaagatg

SEQ ID NO: 44514 - DNA, 103 bp, Artificial Sequence
  Synthetic Polynucleotide
taatacgactcactatagggccttgaggagatattctatcaagtcatcataacagaggagaatgatgatgtgatagaataacctggcggcagcgcaaaagatg

SEQ ID NO: 44515 - DNA, 103 bp, Artificial Sequence
  Synthetic Polynucleotide
taatacgactcactatagggaatatattcaactatatgaaatccaaaaataacagaggagaatttttatgtttcatataaacctggcggcagcgcaaaagatg

SEQ ID NO: 44516 - DNA, 103 bp, Artificial Sequence
  Synthetic Polynucleotide
taatacgactcactataggggtattccttgaggagatattctatcaagtcaacagaggagagacttgatggaatatctcaacctggcggcagcgcaaaagatg

SEQ ID NO: 44517 - DNA, 103 bp, Artificial Sequence
  Synthetic Polynucleotide
taatacgactcactatagggggagtgtattccttgaggagatattctatcaacagaggagagatagaatgtctcctcaaaacctggcggcagcgcaaaagatg

SEQ ID NO: 44518 - DNA, 103 bp, Artificial Sequence
  Synthetic Polynucleotide
taatacgactcactatagggtctgaggagtgtattccttgaggagatattaacagaggagaaatatcatgtcaaggaataacctggcggcagcgcaaaagatg

SEQ ID NO: 44519 - DNA, 103 bp, Artificial Sequence
  Synthetic Polynucleotide
taatacgactcactatagggataaatctgaggagtgtattccttgaggagaacagaggagactcctcatggaatacactaacctggcggcagcgcaaaagatg

SEQ ID NO: 44520 - DNA, 103 bp, Artificial Sequence
  Synthetic Polynucleotide
taatacgactcactatagggtatgtataaatctgaggagtgtattccttgaacagaggagacaaggaatgcactcctcaaacctggcggcagcgcaaaagatg

SEQ ID NO: 44521 - DNA, 103 bp, Artificial Sequence
  Synthetic Polynucleotide
taatacgactcactatagggtagaatatgtataaatctgaggagtgtattaacagaggagaaatacaatgctcagatttaacctggcggcagcgcaaaagatg

SEQ ID NO: 44522 - DNA, 103 bp, Artificial Sequence
  Synthetic Polynucleotide
taatacgactcactatagggctcattagaatatgtataaatctgaggagtaacagaggagaactcctatgatttatacaaacctggcggcagcgcaaaagatg

SEQ ID NO: 44523 - DNA, 103 bp, Artificial Sequence
  Synthetic Polynucleotide
taatacgactcactatagggacgtgctcattagaatatgtataaatctgaaacagaggagatcagatatgtacatattcaacctggcggcagcgcaaaagatg

SEQ ID NO: 44524 - DNA, 103 bp, Artificial Sequence
  Synthetic Polynucleotide
taatacgactcactatagggtgggaacgtgctcattagaatatgtataaaaacagaggagatttataatgattctaatgaacctggcggcagcgcaaaagatg

SEQ ID NO: 44525 - DNA, 103 bp, Artificial Sequence
  Synthetic Polynucleotide
taatacgactcactatagggagctatgggaacgtgctcattagaatatgtaacagaggagaacatatatgaatgagcacaacctggcggcagcgcaaaagatg

SEQ ID NO: 44526 - DNA, 103 bp, Artificial Sequence
  Synthetic Polynucleotide
taatacgactcactatagggactttaatatattcaactatatgaaatccaaacagaggagatggattatgtatagttgaaacctggcggcagcgcaaaagatg

SEQ ID NO: 44527 - DNA, 103 bp, Artificial Sequence
  Synthetic Polynucleotide
taatacgactcactataggggaaccagctatgggaacgtgctcattagaaaacagaggagattctaaatggcacgttccaacctggcggcagcgcaaaagatg

SEQ ID NO: 44528 - DNA, 103 bp, Artificial Sequence
  Synthetic Polynucleotide
taatacgactcactatagggattttgaaccagctatgggaacgtgctcataacagaggagaatgagcatgttcccatagaacctggcggcagcgcaaaagatg

SEQ ID NO: 44529 - DNA, 103 bp, Artificial Sequence
  Synthetic Polynucleotide
taatacgactcactatagggaattaattttgaaccagctatgggaacgtgaacagaggagacacgttatgatagctggtaacctggcggcagcgcaaaagatg

SEQ ID NO: 44530 - DNA, 103 bp, Artificial Sequence
  Synthetic Polynucleotide
taatacgactcactatagggcaaagaattaattttgaaccagctatgggaaacagaggagatcccatatgtggttcaaaaacctggcggcagcgcaaaagatg

SEQ ID NO: 44531 - DNA, 103 bp, Artificial Sequence
  Synthetic Polynucleotide
taatacgactcactatagggatccgcaaagaattaattttgaaccagctaaacagaggagatagctgatgcaaaattaaaacctggcggcagcgcaaaagatg

SEQ ID NO: 44532 - DNA, 103 bp, Artificial Sequence
  Synthetic Polynucleotide
taatacgactcactatagggagaaaatccgcaaagaattaattttgaaccaacagaggagaggttcaatgttaattcttaacctggcggcagcgcaaaagatg

SEQ ID NO: 44533 - DNA, 103 bp, Artificial Sequence
  Synthetic Polynucleotide
taatacgactcactatagggacttgagaaaatccgcaaagaattaattttaacagaggagaaaaattatgtctttgcggaacctggcggcagcgcaaaagatg

SEQ ID NO: 44534 - DNA, 103 bp, Artificial Sequence
  Synthetic Polynucleotide
taatacgactcactatagggatgtaacttgagaaaatccgcaaagaattaaacagaggagataattcatggcggattttaacctggcggcagcgcaaaagatg

SEQ ID NO: 44535 - DNA, 103 bp, Artificial Sequence
  Synthetic Polynucleotide
taatacgactcactatagggcataaatgtaacttgagaaaatccgcaaagaacagaggagactttgcatgttttctcaaaacctggcggcagcgcaaaagatg

SEQ ID NO: 44536 - DNA, 103 bp, Artificial Sequence
  Synthetic Polynucleotide
taatacgactcactatagggtacgccataaatgtaacttgagaaaatccgaacagaggagacggattatgtcaagttacaacctggcggcagcgcaaaagatg

SEQ ID NO: 44537 - DNA, 103 bp, Artificial Sequence
  Synthetic Polynucleotide
taatacgactcactatagggaaataactttaatatattcaactatatgaaaacagaggagattcataatgttgaatataaacctggcggcagcgcaaaagatg

SEQ ID NO: 44538 - DNA, 103 bp, Artificial Sequence
  Synthetic Polynucleotide
taatacgactcactatagggttgtatacgccataaatgtaacttgagaaaaacagaggagatttctcatgttacatttaaacctggcggcagcgcaaaagatg

SEQ ID NO: 44539 - DNA, 103 bp, Artificial Sequence
  Synthetic Polynucleotide
taatacgactcactatagggagacgttgtatacgccataaatgtaacttgaacagaggagacaagttatgtttatggcgaacctggcggcagcgcaaaagatg

SEQ ID NO: 44540 - DNA, 103 bp, Artificial Sequence
  Synthetic Polynucleotide
taatacgactcactatagggatatgagacgttgtatacgccataaatgtaaacagaggagatacattatgggcgtatacaacctggcggcagcgcaaaagatg

SEQ ID NO: 44541 - DNA, 103 bp, Artificial Sequence
  Synthetic Polynucleotide
taatacgactcactatagggttgttatatgagacgttgtatacgccataaaacagaggagattatggatgatacaacgtaacctggcggcagcgcaaaagatg

SEQ ID NO: 44542 - DNA, 103 bp, Artificial Sequence
  Synthetic Polynucleotide
taatacgactcactatagggatttgttgttatatgagacgttgtatacgcaacagaggagagcgtatatgacgtctcataacctggcggcagcgcaaaagatg

SEQ ID NO: 44543 - DNA, 103 bp, Artificial Sequence
  Synthetic Polynucleotide
taatacgactcactatagggtttttatttgttgttatatgagacgttgtaaacagaggagatacaacatgtcatataacaacctggcggcagcgcaaaagatg

SEQ ID NO: 44544 - DNA, 103 bp, Artificial Sequence
  Synthetic Polynucleotide
taatacgactcactatagggctacctttttatttgttgttatatgagacgaacagaggagacgtctcatgtaacaacaaaacctggcggcagcgcaaaagatg

SEQ ID NO: 44545 - DNA, 103 bp, Artificial Sequence
  Synthetic Polynucleotide
taatacgactcactatagggaacatctacctttttatttgttgttatatgaacagaggagacatataatgacaaataaaaacctggcggcagcgcaaaagatg

SEQ ID NO: 44546 - DNA, 103 bp, Artificial Sequence
  Synthetic Polynucleotide
taatacgactcactatagggacgagaacatctacctttttatttgttgttaacagaggagaaacaacatgtaaaaaggtaacctggcggcagcgcaaaagatg

SEQ ID NO: 44547 - DNA, 103 bp, Artificial Sequence
  Synthetic Polynucleotide
taatacgactcactatagggtggaaacgagaacatctacctttttatttgaacagaggagacaaataatgaggtagatgaacctggcggcagcgcaaaagatg

SEQ ID NO: 44548 - DNA, 103 bp, Artificial Sequence
  Synthetic Polynucleotide
taatacgactcactatagggaacataaataactttaatatattcaactataacagaggagaatagttatgtatattaaaaacctggcggcagcgcaaaagatg

SEQ ID NO: 44549 - DNA, 103 bp, Artificial Sequence
  Synthetic Polynucleotide
taatacgactcactatagggttttttggaaacgagaacatctacctttttaacagaggagaaaaaagatggatgttctcaacctggcggcagcgcaaaagatg

SEQ ID NO: 44550 - DNA, 103 bp, Artificial Sequence
  Synthetic Polynucleotide
taatacgactcactatagggatacattttttggaaacgagaacatctaccaacagaggagaggtagaatgtctcgtttcaacctggcggcagcgcaaaagatg

SEQ ID NO: 44551 - DNA, 103 bp, Artificial Sequence
  Synthetic Polynucleotide
taatacgactcactatagggtatctatacattttttggaaacgagaacataacagaggagaatgttcatgtttccaaaaaacctggcggcagcgcaaaagatg

SEQ ID NO: 44552 - DNA, 103 bp, Artificial Sequence
  Synthetic Polynucleotide
taatacgactcactatagggtagtttatctatacattttttggaaacgagaacagaggagactcgttatgaaaaaatgtaacctggcggcagcgcaaaagatg

SEQ ID NO: 44553 - DNA, 103 bp, Artificial Sequence
  Synthetic Polynucleotide
taatacgactcactatagggtcgactagtttatctatacattttttggaaaacagaggagattccaaatgatgtatagaaacctggcggcagcgcaaaagatg

SEQ ID NO: 44554 - DNA, 103 bp, Artificial Sequence
  Synthetic Polynucleotide
taatacgactcactatagggttggatcgactagtttatctatacatttttaacagaggagaaaaaatatgtagataaacaacctggcggcagcgcaaaagatg

SEQ ID NO: 44555 - DNA, 103 bp, Artificial Sequence
  Synthetic Polynucleotide
taatacgactcactatagggatttattggatcgactagtttatctatacaaacagaggagatgtataatgaaactagtcaacctggcggcagcgcaaaagatg

SEQ ID NO: 44556 - DNA, 103 bp, Artificial Sequence
  Synthetic Polynucleotide
taatacgactcactatagggtgataatttattggatcgactagtttatctaacagaggagaagataaatgagtcgatccaacctggcggcagcgcaaaagatg

SEQ ID NO: 44557 - DNA, 103 bp, Artificial Sequence
  Synthetic Polynucleotide
taatacgactcactataggggtatttgataatttattggatcgactagttaacagaggagaaactagatgatccaataaaacctggcggcagcgcaaaagatg

SEQ ID NO: 44558 - DNA, 103 bp, Artificial Sequence
  Synthetic Polynucleotide
taatacgactcactatagggttgaagtatttgataatttattggatcgacaacagaggagagtcgatatgataaattataacctggcggcagcgcaaaagatg

SEQ ID NO: 44559 - DNA, 103 bp, Artificial Sequence
  Synthetic Polynucleotide
taatacgactcactatagggttagcaacataaataactttaatatattcaaacagaggagatgaataatgtaaagttataacctggcggcagcgcaaaagatg

SEQ ID NO: 44560 - DNA, 103 bp, Artificial Sequence
  Synthetic Polynucleotide
taatacgactcactatagggaaattttgaagtatttgataatttattggaaacagaggagatccaatatgttatcaaataacctggcggcagcgcaaaagatg

SEQ ID NO: 44561 - DNA, 103 bp, Artificial Sequence
  Synthetic Polynucleotide
taatacgactcactatagggcaaataaattttgaagtatttgataatttaaacagaggagataaattatgaaatacttcaacctggcggcagcgcaaaagatg

SEQ ID NO: 44562 - DNA, 103 bp, Artificial Sequence
  Synthetic Polynucleotide
taatacgactcactatagggtttatcaaataaattttgaagtatttgataaacagaggagatatcaaatgcttcaaaataacctggcggcagcgcaaaagatg

SEQ ID NO: 44563 - DNA, 103 bp, Artificial Sequence
  Synthetic Polynucleotide
taatacgactcactatagggcttcctttatcaaataaattttgaagtattaacagaggagaaatactatgaaatttattaacctggcggcagcgcaaaagatg

SEQ ID NO: 44564 - DNA, 103 bp, Artificial Sequence
  Synthetic Polynucleotide
taatacgactcactatagggttccgcttcctttatcaaataaattttgaaaacagaggagattcaaaatgtatttgataaacctggcggcagcgcaaaagatg

SEQ ID NO: 44565 - DNA, 103 bp, Artificial Sequence
  Synthetic Polynucleotide
taatacgactcactatagggtattgttccgcttcctttatcaaataaattaacagaggagaaatttaatggataaaggaaacctggcggcagcgcaaaagatg

SEQ ID NO: 44566 - DNA, 103 bp, Artificial Sequence
  Synthetic Polynucleotide
taatacgactcactatagggttgtttattgttccgcttcctttatcaaataacagaggagaatttgaatgaggaagcggaacctggcggcagcgcaaaagatg

SEQ ID NO: 44567 - DNA, 103 bp, Artificial Sequence
  Synthetic Polynucleotide
taatacgactcactataggggtattttgtttattgttccgcttcctttataacagaggagaataaagatggcggaacaaaacctggcggcagcgcaaaagatg

SEQ ID NO: 44568 - DNA, 103 bp, Artificial Sequence
  Synthetic Polynucleotide
taatacgactcactatagggcctgagtattttgtttattgttccgcttccaacagaggagaggaagcatgacaataaacaacctggcggcagcgcaaaagatg

SEQ ID NO: 44569 - DNA, 103 bp, Artificial Sequence
  Synthetic Polynucleotide
taatacgactcactatagggatcttcctgagtattttgtttattgttccgaacagaggagacggaacatgaaacaaaataacctggcggcagcgcaaaagatg

SEQ ID NO: 44570 - DNA, 103 bp, Artificial Sequence
  Synthetic Polynucleotide
taatacgactcactatagggttacaggcttctcatctctttcagaactgaaacagaggagatcagttatgaaagagatgaacctggcggcagcgcaaaagatg

SEQ ID NO: 44571 - DNA, 103 bp, Artificial Sequence
  Synthetic Polynucleotide
taatacgactcactatagggtggatttagcaacataaataactttaatataacagaggagaatattaatgttatttatgaacctggcggcagcgcaaaagatg

SEQ ID NO: 44572 - DNA, 103 bp, Artificial Sequence
  Synthetic Polynucleotide
taatacgactcactatagggaaaatatcttcctgagtattttgtttattgaacagaggagacaataaatgaaatactcaaacctggcggcagcgcaaaagatg

SEQ ID NO: 44573 - DNA, 103 bp, Artificial Sequence
  Synthetic Polynucleotide
taatacgactcactatagggcgaataaaatatcttcctgagtattttgttaacagaggagaaacaaaatgctcaggaagaacctggcggcagcgcaaaagatg

SEQ ID NO: 44574 - DNA, 103 bp, Artificial Sequence
  Synthetic Polynucleotide
taatacgactcactataggggttaccgaataaaatatcttcctgagtattaacagaggagaaatactatggaagatattaacctggcggcagcgcaaaagatg

SEQ ID NO: 44575 - DNA, 103 bp, Artificial Sequence
  Synthetic Polynucleotide
taatacgactcactatagggcaccggttaccgaataaaatatcttcctgaaacagaggagatcaggaatgtattttattaacctggcggcagcgcaaaagatg

SEQ ID NO: 44576 - DNA, 103 bp, Artificial Sequence
  Synthetic Polynucleotide
taatacgactcactatagggttggccaccggttaccgaataaaatatcttaacagaggagaaagataatgtattcggtaaacctggcggcagcgcaaaagatg

SEQ ID NO: 44577 - DNA, 103 bp, Artificial Sequence
  Synthetic Polynucleotide
taatacgactcactatagggggagtttggccaccggttaccgaataaaataacagaggagaattttaatgggtaaccggaacctggcggcagcgcaaaagatg

SEQ ID NO: 44578 - DNA, 103 bp, Artificial Sequence
  Synthetic Polynucleotide
taatacgactcactatagggattatggagtttggccaccggttaccgaataacagaggagaattcggatgccggtggccaacctggcggcagcgcaaaagatg

SEQ ID NO: 44579 - DNA, 103 bp, Artificial Sequence
  Synthetic Polynucleotide
taatacgactcactatagggagcaaattatggagtttggccaccggttacaacagaggagagtaaccatgggccaaactaacctggcggcagcgcaaaagatg

SEQ ID NO: 44580 - DNA, 103 bp, Artificial Sequence
  Synthetic Polynucleotide
taatacgactcactataggggaaaaagcaaattatggagtttggccaccgaacagaggagacggtggatgaactccataaacctggcggcagcgcaaaagatg

SEQ ID NO: 44581 - DNA, 103 bp, Artificial Sequence
  Synthetic Polynucleotide
taatacgactcactatagggaaatagaaaaagcaaattatggagtttggcaacagaggagagccaaaatgcataatttgaacctggcggcagcgcaaaagatg

SEQ ID NO: 44582 - DNA, 103 bp, Artificial Sequence
  Synthetic Polynucleotide
taatacgactcactataggggccactggatttagcaacataaataactttaacagaggagaaaagttatgtatgttgctaacctggcggcagcgcaaaagatg

SEQ ID NO: 44583 - DNA, 103 bp, Artificial Sequence
  Synthetic Polynucleotide
taatacgactcactatagggatccgaaatagaaaaagcaaattatggagtaacagaggagaactccaatgtttgcttttaacctggcggcagcgcaaaagatg

SEQ ID NO: 44584 - DNA, 103 bp, Artificial Sequence
  Synthetic Polynucleotide
taatacgactcactatagggctaaaatccgaaatagaaaaagcaaattataacagaggagaataattatgtttttctataacctggcggcagcgcaaaagatg

SEQ ID NO: 44585 - DNA, 103 bp, Artificial Sequence
  Synthetic Polynucleotide
taatacgactcactatagggaaattctaaaatccgaaatagaaaaagcaaaacagaggagattgcttatgctatttcggaacctggcggcagcgcaaaagatg

SEQ ID NO: 44586 - DNA, 103 bp, Artificial Sequence
  Synthetic Polynucleotide
taatacgactcactatagggtttggaaattctaaaatccgaaatagaaaaaacagaggagattttctatgtcggattttaacctggcggcagcgcaaaagatg

SEQ ID NO: 44587 - DNA, 103 bp, Artificial Sequence
  Synthetic Polynucleotide
taatacgactcactataggggtgaatttggaaattctaaaatccgaaataaacagaggagatatttcatgttttagaataacctggcggcagcgcaaaagatg

SEQ ID NO: 44588 - DNA, 103 bp, Artificial Sequence
  Synthetic Polynucleotide
taatacgactcactatagggcgctggtgaatttggaaattctaaaatccgaacagaggagacggattatggaatttccaaacctggcggcagcgcaaaagatg

SEQ ID NO: 44589 - DNA, 103 bp, Artificial Sequence
  Synthetic Polynucleotide
taatacgactcactatagggtaaatcgctggtgaatttggaaattctaaaaacagaggagatttagaatgtccaaattcaacctggcggcagcgcaaaagatg

SEQ ID NO: 44590 - DNA, 103 bp, Artificial Sequence
  Synthetic Polynucleotide
taatacgactcactatagggacagataaatcgctggtgaatttggaaattaacagaggagaaatttcatgattcaccagaacctggcggcagcgcaaaagatg

SEQ ID NO: 44591 - DNA, 103 bp, Artificial Sequence
  Synthetic Polynucleotide
taatacgactcactatagggccaaaacagataaatcgctggtgaatttggaacagaggagaccaaatatgccagcgattaacctggcggcagcgcaaaagatg

SEQ ID NO: 44592 - DNA, 103 bp, Artificial Sequence
  Synthetic Polynucleotide
taatacgactcactatagggtttcaccaaaacagataaatcgctggtgaaaacagaggagattcaccatggatttatctaacctggcggcagcgcaaaagatg

SEQ ID NO: 44593 - DNA, 103 bp, Artificial Sequence
  Synthetic Polynucleotide
taatacgactcactatagggtagaagccactggatttagcaacataaataaacagaggagatatttaatgtgctaaatcaacctggcggcagcgcaaaagatg

SEQ ID NO: 44594 - DNA, 103 bp, Artificial Sequence
  Synthetic Polynucleotide
taatacgactcactatagggttggatttcaccaaaacagataaatcgctgaacagaggagacagcgaatgatctgttttaacctggcggcagcgcaaaagatg

SEQ ID NO: 44595 - DNA, 103 bp, Artificial Sequence
  Synthetic Polynucleotide
taatacgactcactatagggaatccttggatttcaccaaaacagataaataacagaggagaatttatatgttttggtgaaacctggcggcagcgcaaaagatg

SEQ ID NO: 44596 - DNA, 103 bp, Artificial Sequence
  Synthetic Polynucleotide
taatacgactcactatagggtaataaatccttggatttcaccaaaacagaaacagaggagatctgttatggtgaaatccaacctggcggcagcgcaaaagatg

SEQ ID NO: 44597 - DNA, 103 bp, Artificial Sequence
  Synthetic Polynucleotide
taatacgactcactataggggacattaataaatccttggatttcaccaaaaacagaggagatttggtatgatccaaggaaacctggcggcagcgcaaaagatg

SEQ ID NO: 44598 - DNA, 103 bp, Artificial Sequence
  Synthetic Polynucleotide
taatacgactcactatagggttgtggacattaataaatccttggatttcaaacagaggagatgaaatatgaggatttataacctggcggcagcgcaaaagatg

SEQ ID NO: 44599 - DNA, 103 bp, Artificial Sequence
  Synthetic Polynucleotide
taatacgactcactatagggggcatttgtggacattaataaatccttggaaacagaggagatccaagatgttattaatgaacctggcggcagcgcaaaagatg

SEQ ID NO: 44600 - DNA, 103 bp, Artificial Sequence
  Synthetic Polynucleotide
taatacgactcactatagggcaaatggcatttgtggacattaataaatccaacagaggagaggatttatgaatgtccacaacctggcggcagcgcaaaagatg

SEQ ID NO: 44601 - DNA, 103 bp, Artificial Sequence
  Synthetic Polynucleotide
taatacgactcactatagggcaaaacaaatggcatttgtggacattaataaacagaggagatattaaatgccacaaatgaacctggcggcagcgcaaaagatg

SEQ ID NO: 44602 - DNA, 103 bp, Artificial Sequence
  Synthetic Polynucleotide
taatacgactcactatagggacagacaaaacaaatggcatttgtggacataacagaggagaatgtccatgaatgccattaacctggcggcagcgcaaaagatg

SEQ ID NO: 44603 - DNA, 103 bp, Artificial Sequence
  Synthetic Polynucleotide
taatacgactcactatagggaatccacagacaaaacaaatggcatttgtgaacagaggagacacaaaatgcatttgtttaacctggcggcagcgcaaaagatg

SEQ ID NO: 44604 - DNA, 103 bp, Artificial Sequence
  Synthetic Polynucleotide
taatacgactcactatagggtctactagaagccactggatttagcaacataacagaggagaatgttgatgaatccagtgaacctggcggcagcgcaaaagatg

SEQ ID NO: 44605 - DNA, 103 bp, Artificial Sequence
  Synthetic Polynucleotide
taatacgactcactatagggaatacaatccacagacaaaacaaatggcataacagaggagaatgccaatggttttgtctaacctggcggcagcgcaaaagatg

SEQ ID NO: 44606 - DNA, 103 bp, Artificial Sequence
  Synthetic Polynucleotide
taatacgactcactatagggtttcaaatacaatccacagacaaaacaaataacagaggagaatttgtatggtctgtggaaacctggcggcagcgcaaaagatg

SEQ ID NO: 44607 - DNA, 103 bp, Artificial Sequence
  Synthetic Polynucleotide
taatacgactcactatagggtccattttcaaatacaatccacagacaaaaaacagaggagattttgtatgtggattgtaaacctggcggcagcgcaaaagatg

SEQ ID NO: 44608 - DNA, 103 bp, Artificial Sequence
  Synthetic Polynucleotide
taatacgactcactatagggtcgtttccattttcaaatacaatccacagaaacagaggagatctgtgatgtgtatttgaaacctggcggcagcgcaaaagatg

SEQ ID NO: 44609 - DNA, 103 bp, Artificial Sequence
  Synthetic Polynucleotide
taatacgactcactatagggctacatcgtttccattttcaaatacaatccaacagaggagaggattgatgttgaaaatgaacctggcggcagcgcaaaagatg

SEQ ID NO: 44610 - DNA, 103 bp, Artificial Sequence
  Synthetic Polynucleotide
taatacgactcactatagggtctaactacatcgtttccattttcaaatacaacagaggagagtatttatgaatggaaacaacctggcggcagcgcaaaagatg

SEQ ID NO: 44611 - DNA, 103 bp, Artificial Sequence
  Synthetic Polynucleotide
taatacgactcactatagggatctatctaactacatcgtttccattttcaaacagaggagatgaaaaatgaaacgatgtaacctggcggcagcgcaaaagatg

SEQ ID NO: 44612 - DNA, 103 bp, Artificial Sequence
  Synthetic Polynucleotide
taatacgactcactatagggagcgcatctatctaactacatcgtttccataacagaggagaatggaaatgatgtagttaaacctggcggcagcgcaaaagatg

SEQ ID NO: 44613 - DNA, 103 bp, Artificial Sequence
  Synthetic Polynucleotide
taatacgactcactatagggtttgcagcgcatctatctaactacatcgttaacagaggagaaacgatatggttagatagaacctggcggcagcgcaaaagatg

SEQ ID NO: 44614 - DNA, 103 bp, Artificial Sequence
  Synthetic Polynucleotide
taatacgactcactataggggaaactttgcagcgcatctatctaactacaaacagaggagatgtagtatgatagatgcgaacctggcggcagcgcaaaagatg

SEQ ID NO: 44615 - DNA, 103 bp, Artificial Sequence
  Synthetic Polynucleotide
taatacgactcactatagggatggctctactagaagccactggatttagcaacagaggagagctaaaatgagtggcttcaacctggcggcagcgcaaaagatg

SEQ ID NO: 44616 - DNA, 103 bp, Artificial Sequence
  Synthetic Polynucleotide
taatacgactcactatagggaataggaaactttgcagcgcatctatctaaaacagaggagattagatatgtgcgctgcaaacctggcggcagcgcaaaagatg

SEQ ID NO: 44617 - DNA, 103 bp, Artificial Sequence
  Synthetic Polynucleotide
taatacgactcactatagggaccctaataggaaactttgcagcgcatctaaacagaggagatagatgatgtgcaaagttaacctggcggcagcgcaaaagatg

SEQ ID NO: 44618 - DNA, 103 bp, Artificial Sequence
  Synthetic Polynucleotide
taatacgactcactataggggcggaaccctaataggaaactttgcagcgcaacagaggagagcgctgatgagtttcctaaacctggcggcagcgcaaaagatg

SEQ ID NO: 44619 - DNA, 103 bp, Artificial Sequence
  Synthetic Polynucleotide
taatacgactcactatagggaaagcgcggaaccctaataggaaactttgcaacagaggagagcaaagatgcctattaggaacctggcggcagcgcaaaagatg

SEQ ID NO: 44620 - DNA, 103 bp, Artificial Sequence
  Synthetic Polynucleotide
taatacgactcactataggggacgtaaagcgcggaaccctaataggaaacaacagaggagagtttccatgtagggttccaacctggcggcagcgcaaaagatg

SEQ ID NO: 44621 - DNA, 103 bp, Artificial Sequence
  Synthetic Polynucleotide
taatacgactcactatagggtaggtgacgtaaagcgcggaaccctaatagaacagaggagactattaatgttccgcgctaacctggcggcagcgcaaaagatg

SEQ ID NO: 44622 - DNA, 103 bp, Artificial Sequence
  Synthetic Polynucleotide
taatacgactcactatagggtatgctaggtgacgtaaagcgcggaaccctaacagaggagaagggttatgcgctttacgaacctggcggcagcgcaaaagatg

SEQ ID NO: 44623 - DNA, 103 bp, Artificial Sequence
  Synthetic Polynucleotide
taatacgactcactatagggtcaagtatgctaggtgacgtaaagcgcggaaacagaggagatccgcgatgtacgtcaccaacctggcggcagcgcaaaagatg

SEQ ID NO: 44624 - DNA, 103 bp, Artificial Sequence
  Synthetic Polynucleotide
taatacgactcactataggggtgattcaagtatgctaggtgacgtaaagcaacagaggagagctttaatgcacctagcaaacctggcggcagcgcaaaagatg

SEQ ID NO: 44625 - DNA, 103 bp, Artificial Sequence
  Synthetic Polynucleotide
taatacgactcactatagggggatggtgattcaagtatgctaggtgacgtaacagaggagaacgtcaatgagcatacttaacctggcggcagcgcaaaagatg

SEQ ID NO: 44626 - DNA, 103 bp, Artificial Sequence
  Synthetic Polynucleotide
taatacgactcactatagggtagcgatggctctactagaagccactggataacagaggagaatccagatgcttctagtaaacctggcggcagcgcaaaagatg

SEQ ID NO: 44627 - DNA, 103 bp, Artificial Sequence
  Synthetic Polynucleotide
taatacgactcactatagggttaaaggatggtgattcaagtatgctaggtaacagaggagaacctagatgacttgaatcaacctggcggcagcgcaaaagatg

SEQ ID NO: 44628 - DNA, 103 bp, Artificial Sequence
  Synthetic Polynucleotide
taatacgactcactatagggtttttttaaaggatggtgattcaagtatgcaacagaggagagcatacatgaatcaccataacctggcggcagcgcaaaagatg

SEQ ID NO: 44629 - DNA, 103 bp, Artificial Sequence
  Synthetic Polynucleotide
taatacgactcactatagggatcattttttttaaaggatggtgattcaagaacagaggagacttgaaatgccatcctttaacctggcggcagcgcaaaagatg

SEQ ID NO: 44630 - DNA, 103 bp, Artificial Sequence
  Synthetic Polynucleotide
taatacgactcactatagggatcttatcattttttttaaaggatggtgataacagaggagaatcaccatgctttaaaaaaacctggcggcagcgcaaaagatg

SEQ ID NO: 44631 - DNA, 103 bp, Artificial Sequence
  Synthetic Polynucleotide
taatacgactcactatagggttgatatcttatcattttttttaaaggatgaacagaggagacatcctatgaaaaaaatgaacctggcggcagcgcaaaagatg

SEQ ID NO: 44632 - DNA, 103 bp, Artificial Sequence
  Synthetic Polynucleotide
taatacgactcactatagggccatgttgatatcttatcattttttttaaaaacagaggagatttaaaatgaatgataagaacctggcggcagcgcaaaagatg

SEQ ID NO: 44633 - DNA, 103 bp, Artificial Sequence
  Synthetic Polynucleotide
taatacgactcactatagggatactccatgttgatatcttatcattttttaacagaggagaaaaaaaatgtaagatatcaacctggcggcagcgcaaaagatg

SEQ ID NO: 44634 - DNA, 103 bp, Artificial Sequence
  Synthetic Polynucleotide
taatacgactcactatagggatgatatactccatgttgatatcttatcataacagaggagaatgataatgtatcaacataacctggcggcagcgcaaaagatg

SEQ ID NO: 44635 - DNA, 103 bp, Artificial Sequence
  Synthetic Polynucleotide
taatacgactcactatagggagagtatgatatactccatgttgatatcttaacagaggagaaagataatgacatggagtaacctggcggcagcgcaaaagatg

SEQ ID NO: 44636 - DNA, 103 bp, Artificial Sequence
  Synthetic Polynucleotide
taatacgactcactatagggaaatcagagtatgatatactccatgttgataacagaggagaatcaacatggagtatatcaacctggcggcagcgcaaaagatg

SEQ ID NO: 44637 - DNA, 103 bp, Artificial Sequence
  Synthetic Polynucleotide
taatacgactcactatagggggatatagcgatggctctactagaagccacaacagaggagagtggctatgagtagagccaacctggcggcagcgcaaaagatg

SEQ ID NO: 44638 - DNA, 103 bp, Artificial Sequence
  Synthetic Polynucleotide
taatacgactcactatagggaattaaaatcagagtatgatatactccatgaacagaggagacatggaatgtatcatactaacctggcggcagcgcaaaagatg

SEQ ID NO: 44639 - DNA, 103 bp, Artificial Sequence
  Synthetic Polynucleotide
taatacgactcactatagggagaagaattaaaatcagagtatgatatactaacagaggagaagtataatgtactctgataacctggcggcagcgcaaaagatg

SEQ ID NO: 44640 - DNA, 103 bp, Artificial Sequence
  Synthetic Polynucleotide
taatacgactcactataggggcagtagaagaattaaaatcagagtatgataacagaggagaatcataatgtgattttaaaacctggcggcagcgcaaaagatg

SEQ ID NO: 44641 - DNA, 103 bp, Artificial Sequence
  Synthetic Polynucleotide
taatacgactcactataggggtgaggcagtagaagaattaaaatcagagtaacagaggagaactctgatgttaattcttaacctggcggcagcgcaaaagatg

SEQ ID NO: 44642 - DNA, 103 bp, Artificial Sequence
  Synthetic Polynucleotide
taatacgactcactatagggtgtcagtgaggcagtagaagaattaaaatcaacagaggagagattttatgtcttctactaacctggcggcagcgcaaaagatg

SEQ ID NO: 44643 - DNA, 103 bp, Artificial Sequence
  Synthetic Polynucleotide
taatacgactcactataggggaaaatgtcagtgaggcagtagaagaattaaacagaggagataattcatgtactgcctcaacctggcggcagcgcaaaagatg

SEQ ID NO: 44644 - DNA, 103 bp, Artificial Sequence
  Synthetic Polynucleotide
taatacgactcactatagggtttgtgaaaatgtcagtgaggcagtagaagaacagaggagacttctaatgcctcactgaaacctggcggcagcgcaaaagatg

SEQ ID NO: 44645 - DNA, 103 bp, Artificial Sequence
  Synthetic Polynucleotide
taatacgactcactatagggtagtatttgtgaaaatgtcagtgaggcagtaacagaggagaactgccatgctgacatttaacctggcggcagcgcaaaagatg

SEQ ID NO: 44646 - DNA, 103 bp, Artificial Sequence
  Synthetic Polynucleotide
taatacgactcactatagggtattgtagtatttgtgaaaatgtcagtgagaacagaggagactcactatgattttcacaaacctggcggcagcgcaaaagatg

SEQ ID NO: 44647 - DNA, 103 bp, Artificial Sequence
  Synthetic Polynucleotide
taatacgactcactatagggaaccgtattgtagtatttgtgaaaatgtcaaacagaggagatgacatatgcacaaatacaacctggcggcagcgcaaaagatg

SEQ ID NO: 44648 - DNA, 103 bp, Artificial Sequence
  Synthetic Polynucleotide
taatacgactcactatagggaataaggatatagcgatggctctactagaaaacagaggagattctagatgagccatcgcaacctggcggcagcgcaaaagatg

SEQ ID NO: 44649 - DNA, 103 bp, Artificial Sequence
  Synthetic Polynucleotide
taatacgactcactatagggcggtaaaccgtattgtagtatttgtgaaaaaacagaggagattttcaatgatactacaaaacctggcggcagcgcaaaagatg

SEQ ID NO: 44650 - DNA, 103 bp, Artificial Sequence
  Synthetic Polynucleotide
taatacgactcactatagggattttcggtaaaccgtattgtagtatttgtaacagaggagaacaaatatgacaatacggaacctggcggcagcgcaaaagatg

SEQ ID NO: 44651 - DNA, 103 bp, Artificial Sequence
  Synthetic Polynucleotide
taatacgactcactatagggtgattattttcggtaaaccgtattgtagtaaacagaggagatactacatgacggtttacaacctggcggcagcgcaaaagatg

SEQ ID NO: 44652 - DNA, 103 bp, Artificial Sequence
  Synthetic Polynucleotide
taatacgactcactatagggcgtactgattattttcggtaaaccgtattgaacagaggagacaatacatgttaccgaaaaacctggcggcagcgcaaaagatg

SEQ ID NO: 44653 - DNA, 103 bp, Artificial Sequence
  Synthetic Polynucleotide
taatacgactcactatagggaagaacgtactgattattttcggtaaaccgaacagaggagacggtttatggaaaataataacctggcggcagcgcaaaagatg

SEQ ID NO: 44654 - DNA, 103 bp, Artificial Sequence
  Synthetic Polynucleotide
taatacgactcactatagggaaatgaagaacgtactgattattttcggtaaacagaggagataccgaatgtaatcagtaaacctggcggcagcgcaaaagatg

SEQ ID NO: 44655 - DNA, 103 bp, Artificial Sequence
  Synthetic Polynucleotide
taatacgactcactatagggcccataaatgaagaacgtactgattattttaacagaggagaaaaataatgagtacgttcaacctggcggcagcgcaaaagatg

SEQ ID NO: 44656 - DNA, 103 bp, Artificial Sequence
  Synthetic Polynucleotide
taatacgactcactatagggtgatacccataaatgaagaacgtactgattaacagaggagaaatcagatggttcttcataacctggcggcagcgcaaaagatg

SEQ ID NO: 44657 - DNA, 103 bp, Artificial Sequence
  Synthetic Polynucleotide
taatacgactcactataggggtttttgatacccataaatgaagaacgtacaacagaggagagtacgtatgtcatttatgaacctggcggcagcgcaaaagatg

SEQ ID NO: 44658 - DNA, 103 bp, Artificial Sequence
  Synthetic Polynucleotide
taatacgactcactatagggtttaagtttttgatacccataaatgaagaaaacagaggagattcttcatgtatgggtataacctggcggcagcgcaaaagatg

SEQ ID NO: 44659 - DNA, 103 bp, Artificial Sequence
  Synthetic Polynucleotide
taatacgactcactatagggaagttaataaggatatagcgatggctctacaacagaggagagtagagatgtcgctatataacctggcggcagcgcaaaagatg

SEQ ID NO: 44660 - DNA, 103 bp, Artificial Sequence
  Synthetic Polynucleotide
taatacgactcactatagggacgattttaagtttttgatacccataaatgaacagaggagacatttaatggtatcaaaaaacctggcggcagcgcaaaagatg

SEQ ID NO: 44661 - DNA, 103 bp, Artificial Sequence
  Synthetic Polynucleotide
taatacgactcactatagggcagtaacgattttaagtttttgatacccataacagaggagaatgggtatgaaaaacttaaacctggcggcagcgcaaaagatg

SEQ ID NO: 44662 - DNA, 103 bp, Artificial Sequence
  Synthetic Polynucleotide
taatacgactcactatagggtccagcagtaacgattttaagtttttgataaacagaggagatatcaaatgcttaaaatcaacctggcggcagcgcaaaagatg

SEQ ID NO: 44663 - DNA, 103 bp, Artificial Sequence
  Synthetic Polynucleotide
taatacgactcactatagggtattttccagcagtaacgattttaagttttaacagaggagaaaaactatgaatcgttacaacctggcggcagcgcaaaagatg

SEQ ID NO: 44664 - DNA, 103 bp, Artificial Sequence
  Synthetic Polynucleotide
taatacgactcactatagggtgatttattttccagcagtaacgattttaaaacagaggagattaaaaatgttactgctgaacctggcggcagcgcaaaagatg

SEQ ID NO: 44665 - DNA, 103 bp, Artificial Sequence
  Synthetic Polynucleotide
taatacgactcactataggggtcagtgatttattttccagcagtaacgataacagaggagaatcgttatggctggaaaaaacctggcggcagcgcaaaagatg

SEQ ID NO: 44666 - DNA, 103 bp, Artificial Sequence
  Synthetic Polynucleotide
taatacgactcactatagggatatcgtcagtgatttattttccagcagtaaacagaggagatactgcatgaaaataaataacctggcggcagcgcaaaagatg

SEQ ID NO: 44667 - DNA, 103 bp, Artificial Sequence
  Synthetic Polynucleotide
taatacgactcactatagggatctaatatcgtcagtgatttattttccagaacagaggagactggaaatgaaatcactgaacctggcggcagcgcaaaagatg

SEQ ID NO: 44668 - DNA, 103 bp, Artificial Sequence
  Synthetic Polynucleotide
taatacgactcactatagggttatcatctaatatcgtcagtgatttatttaacagaggagaaaataaatgactgacgataacctggcggcagcgcaaaagatg

SEQ ID NO: 44669 - DNA, 103 bp, Artificial Sequence
  Synthetic Polynucleotide
taatacgactcactatagggataaattatcatctaatatcgtcagtgattaacagaggagaaatcacatgcgatattagaacctggcggcagcgcaaaagatg

SEQ ID NO: 44670 - DNA, 103 bp, Artificial Sequence
  Synthetic Polynucleotide
taatacgactcactatagggtgttaaagttaataaggatatagcgatggcaacagaggagagccatcatgatatccttaaacctggcggcagcgcaaaagatg

SEQ ID NO: 44671 - DNA, 103 bp, Artificial Sequence
  Synthetic Polynucleotide
taatacgactcactatagggtttgtataaattatcatctaatatcgtcagaacagaggagactgacgatgttagatgataacctggcggcagcgcaaaagatg

SEQ ID NO: 44672 - DNA, 103 bp, Artificial Sequence
  Synthetic Polynucleotide
taatacgactcactatagggtatactttgtataaattatcatctaatatcaacagaggagagatattatgtgataatttaacctggcggcagcgcaaaagatg

SEQ ID NO: 44673 - DNA, 103 bp, Artificial Sequence
  Synthetic Polynucleotide
taatacgactcactatagggcattgtatactttgtataaattatcatctaaacagaggagatagatgatgatttatacaaacctggcggcagcgcaaaagatg

SEQ ID NO: 44674 - DNA, 103 bp, Artificial Sequence
  Synthetic Polynucleotide
taatacgactcactatagggtattccattgtatactttgtataaattatcaacagaggagagataatatgtacaaagtaaacctggcggcagcgcaaaagatg

SEQ ID NO: 44675 - DNA, 103 bp, Artificial Sequence
  Synthetic Polynucleotide
taatacgactcactatagggacaaatattccattgtatactttgtataaaaacagaggagatttataatgagtatacaaaacctggcggcagcgcaaaagatg

SEQ ID NO: 44676 - DNA, 103 bp, Artificial Sequence
  Synthetic Polynucleotide
taatacgactcactatagggtatccacaaatattccattgtatactttgtaacagaggagaacaaagatgacaatggaaaacctggcggcagcgcaaaagatg

SEQ ID NO: 44677 - DNA, 103 bp, Artificial Sequence
  Synthetic Polynucleotide
taatacgactcactatagggcattgtatccacaaatattccattgtatacaacagaggagagtatacatgggaatatttaacctggcggcagcgcaaaagatg

SEQ ID NO: 44678 - DNA, 103 bp, Artificial Sequence
  Synthetic Polynucleotide
taatacgactcactatagggatactcattgtatccacaaatattccattgaacagaggagacaatggatgatttgtggaaacctggcggcagcgcaaaagatg

SEQ ID NO: 44679 - DNA, 103 bp, Artificial Sequence
  Synthetic Polynucleotide
taatacgactcactatagggtataaatactcattgtatccacaaatattcaacagaggagagaatatatgtggatacaaaacctggcggcagcgcaaaagatg

SEQ ID NO: 44680 - DNA, 103 bp, Artificial Sequence
  Synthetic Polynucleotide
taatacgactcactatagggggctatataaatactcattgtatccacaaaaacagaggagatttgtgatgacaatgagtaacctggcggcagcgcaaaagatg

SEQ ID NO: 44681 - DNA, 103 bp, Artificial Sequence
  Synthetic Polynucleotide
taatacgactcactatagggtctctttacaggcttctcatctctttcagaaacagaggagatctgaaatggatgagaagaacctggcggcagcgcaaaagatg

SEQ ID NO: 44682 - DNA, 103 bp, Artificial Sequence
  Synthetic Polynucleotide
taatacgactcactatagggagacatgttaaagttaataaggatatagcgaacagaggagacgctatatgcttattaacaacctggcggcagcgcaaaagatg

SEQ ID NO: 44683 - DNA, 103 bp, Artificial Sequence
  Synthetic Polynucleotide
taatacgactcactataggggcgacggctatataaatactcattgtatccaacagaggagaggatacatggagtatttaaacctggcggcagcgcaaaagatg

SEQ ID NO: 44684 - DNA, 103 bp, Artificial Sequence
  Synthetic Polynucleotide
taatacgactcactatagggaattggcgacggctatataaatactcattgaacagaggagacaatgaatgtttatatagaacctggcggcagcgcaaaagatg

SEQ ID NO: 44685 - DNA, 103 bp, Artificial Sequence
  Synthetic Polynucleotide
taatacgactcactataggggacacaattggcgacggctatataaatactaacagaggagaagtattatgatagccgtcaacctggcggcagcgcaaaagatg

SEQ ID NO: 44686 - DNA, 103 bp, Artificial Sequence
  Synthetic Polynucleotide
taatacgactcactatagggtttcggacacaattggcgacggctatataaaacagaggagattatatatgcgtcgccaaaacctggcggcagcgcaaaagatg

SEQ ID NO: 44687 - DNA, 103 bp, Artificial Sequence
  Synthetic Polynucleotide
taatacgactcactatagggctaagtttcggacacaattggcgacggctaaacagaggagatagccgatgccaattgtgaacctggcggcagcgcaaaagatg

SEQ ID NO: 44688 - DNA, 103 bp, Artificial Sequence
  Synthetic Polynucleotide
taatacgactcactatagggctcttctaagtttcggacacaattggcgacaacagaggagagtcgccatgtgtgtccgaaacctggcggcagcgcaaaagatg

SEQ ID NO: 44689 - DNA, 103 bp, Artificial Sequence
  Synthetic Polynucleotide
taatacgactcactataggggttaactcttctaagtttcggacacaattgaacagaggagacaattgatgccgaaacttaacctggcggcagcgcaaaagatg

SEQ ID NO: 44690 - DNA, 103 bp, Artificial Sequence
  Synthetic Polynucleotide
taatacgactcactatagggccgtagttaactcttctaagtttcggacacaacagaggagagtgtccatgacttagaagaacctggcggcagcgcaaaagatg

SEQ ID NO: 44691 - DNA, 103 bp, Artificial Sequence
  Synthetic Polynucleotide
taatacgactcactataggggaataccgtagttaactcttctaagtttcgaacagaggagacgaaacatggaagagttaaacctggcggcagcgcaaaagatg

SEQ ID NO: 44692 - DNA, 103 bp, Artificial Sequence
  Synthetic Polynucleotide
taatacgactcactatagggtttatgaataccgtagttaactcttctaagaacagaggagacttagaatggttaactacaacctggcggcagcgcaaaagatg

SEQ ID NO: 44693 - DNA, 103 bp, Artificial Sequence
  Synthetic Polynucleotide
taatacgactcactatagggatagtagacatgttaaagttaataaggataaacagaggagatatcctatgtaactttaaaacctggcggcagcgcaaaagatg

SEQ ID NO: 44694 - DNA, 103 bp, Artificial Sequence
  Synthetic Polynucleotide
taatacgactcactatagggcgtattttatgaataccgtagttaactcttaacagaggagaaagagtatgctacggtataacctggcggcagcgcaaaagatg

SEQ ID NO: 44695 - DNA, 103 bp, Artificial Sequence
  Synthetic Polynucleotide
taatacgactcactataggggtttacgtattttatgaataccgtagttaaaacagaggagattaactatggtattcataaacctggcggcagcgcaaaagatg

SEQ ID NO: 44696 - DNA, 103 bp, Artificial Sequence
  Synthetic Polynucleotide
taatacgactcactatagggcatccgtttacgtattttatgaataccgtaaacagaggagatacggtatgcataaaataaacctggcggcagcgcaaaagatg

SEQ ID NO: 44697 - DNA, 103 bp, Artificial Sequence
  Synthetic Polynucleotide
taatacgactcactatagggttacccatccgtttacgtattttatgaataaacagaggagatattcaatgaatacgtaaaacctggcggcagcgcaaaagatg

SEQ ID NO: 44698 - DNA, 103 bp, Artificial Sequence
  Synthetic Polynucleotide
taatacgactcactatagggcttttttacccatccgtttacgtattttataacagaggagaataaaaatggtaaacggaaacctggcggcagcgcaaaagatg

SEQ ID NO: 44699 - DNA, 103 bp, Artificial Sequence
  Synthetic Polynucleotide
taatacgactcactatagggcctcccttttttacccatccgtttacgtataacagaggagaatacgtatgcggatgggtaacctggcggcagcgcaaaagatg

SEQ ID NO: 44700 - DNA, 103 bp, Artificial Sequence
  Synthetic Polynucleotide
taatacgactcactatagggcatgccctcccttttttacccatccgtttaaacagaggagataaacgatggggtaaaaaaacctggcggcagcgcaaaagatg

SEQ ID NO: 44701 - DNA, 103 bp, Artificial Sequence
  Synthetic Polynucleotide
taatacgactcactatagggggttacatgccctcccttttttacccatccaacagaggagaggatggatgaaaaagggaaacctggcggcagcgcaaaagatg

SEQ ID NO: 44702 - DNA, 103 bp, Artificial Sequence
  Synthetic Polynucleotide
taatacgactcactatagggaaaagggttacatgccctcccttttttaccaacagaggagaggtaaaatggggagggcaaacctggcggcagcgcaaaagatg

SEQ ID NO: 44703 - DNA, 103 bp, Artificial Sequence
  Synthetic Polynucleotide
taatacgactcactatagggcgataaaaagggttacatgccctcccttttaacagaggagaaaaaggatgggcatgtaaaacctggcggcagcgcaaaagatg

SEQ ID NO: 44704 - DNA, 103 bp, Artificial Sequence
  Synthetic Polynucleotide
taatacgactcactatagggcacaaatagtagacatgttaaagttaataaaacagaggagattattaatgttaacatgtaacctggcggcagcgcaaaagatg

SEQ ID NO: 44705 - DNA, 103 bp, Artificial Sequence
  Synthetic Polynucleotide
taatacgactcactatagggtctatcgataaaaagggttacatgccctccaacagaggagaggagggatggtaacccttaacctggcggcagcgcaaaagatg

SEQ ID NO: 44706 - DNA, 103 bp, Artificial Sequence
  Synthetic Polynucleotide
taatacgactcactatagggcttcctctatcgataaaaagggttacatgcaacagaggagagcatgtatgcctttttataacctggcggcagcgcaaaagatg

SEQ ID NO: 44707 - DNA, 103 bp, Artificial Sequence
  Synthetic Polynucleotide
taatacgactcactatagggttatacttcctctatcgataaaaagggttaaacagaggagataacccatgttatcgataaacctggcggcagcgcaaaagatg

SEQ ID NO: 44708 - DNA, 103 bp, Artificial Sequence
  Synthetic Polynucleotide
taatacgactcactatagggaatttttatacttcctctatcgataaaaagaacagaggagactttttatggatagaggaaacctggcggcagcgcaaaagatg

SEQ ID NO: 44709 - DNA, 103 bp, Artificial Sequence
  Synthetic Polynucleotide
taatacgactcactatagggtgtttaatttttatacttcctctatcgataaacagaggagatatcgaatgaggaagtataacctggcggcagcgcaaaagatg

SEQ ID NO: 44710 - DNA, 103 bp, Artificial Sequence
  Synthetic Polynucleotide
taatacgactcactatagggcgttttgtttaatttttatacttcctctataacagaggagaatagagatggtataaaaaaacctggcggcagcgcaaaagatg

SEQ ID NO: 44711 - DNA, 103 bp, Artificial Sequence
  Synthetic Polynucleotide
taatacgactcactatagggtctaacgttttgtttaatttttatacttccaacagaggagaggaagtatgaaaattaaaaacctggcggcagcgcaaaagatg

SEQ ID NO: 44712 - DNA, 103 bp, Artificial Sequence
  Synthetic Polynucleotide
taatacgactcactatagggttgtctctaacgttttgtttaatttttataaacagaggagatataaaatgtaaacaaaaaacctggcggcagcgcaaaagatg

SEQ ID NO: 44713 - DNA, 103 bp, Artificial Sequence
  Synthetic Polynucleotide
taatacgactcactataggggtcttttgtctctaacgttttgtttaatttaacagaggagaaaattaatgaaaacgttaaacctggcggcagcgcaaaagatg

SEQ ID NO: 44714 - DNA, 103 bp, Artificial Sequence
  Synthetic Polynucleotide
taatacgactcactatagggtttacgtcttttgtctctaacgttttgtttaacagaggagaaaacaaatggttagagacaacctggcggcagcgcaaaagatg

SEQ ID NO: 44715 - DNA, 103 bp, Artificial Sequence
  Synthetic Polynucleotide
taatacgactcactataggggaatacacaaatagtagacatgttaaagttaacagaggagaaactttatgatgtctactaacctggcggcagcgcaaaagatg

SEQ ID NO: 44716 - DNA, 103 bp, Artificial Sequence
  Synthetic Polynucleotide
taatacgactcactataggggaatatttacgtcttttgtctctaacgtttaacagaggagaaaacgtatgagacaaaagaacctggcggcagcgcaaaagatg

SEQ ID NO: 44717 - DNA, 103 bp, Artificial Sequence
  Synthetic Polynucleotide
taatacgactcactatagggatttagaatatttacgtcttttgtctctaaaacagaggagattagagatgaaagacgtaaacctggcggcagcgcaaaagatg

SEQ ID NO: 44718 - DNA, 103 bp, Artificial Sequence
  Synthetic Polynucleotide
taatacgactcactatagggggttgatttagaatatttacgtcttttgtcaacagaggagagacaaaatgcgtaaatataacctggcggcagcgcaaaagatg

SEQ ID NO: 44719 - DNA, 103 bp, Artificial Sequence
  Synthetic Polynucleotide
taatacgactcactatagggtccttggttgatttagaatatttacgtcttaacagaggagaaagacgatgatattctaaaacctggcggcagcgcaaaagatg

SEQ ID NO: 44720 - DNA, 103 bp, Artificial Sequence
  Synthetic Polynucleotide
taatacgactcactatagggttctgtccttggttgatttagaatatttacaacagaggagagtaaatatgctaaatcaaaacctggcggcagcgcaaaagatg

SEQ ID NO: 44721 - DNA, 103 bp, Artificial Sequence
  Synthetic Polynucleotide
taatacgactcactatagggcatttttctgtccttggttgatttagaataaacagaggagatattctatgtcaaccaagaacctggcggcagcgcaaaagatg

SEQ ID NO: 44722 - DNA, 103 bp, Artificial Sequence
  Synthetic Polynucleotide
taatacgactcactatagggtctaacatttttctgtccttggttgatttaaacagaggagataaatcatgcaaggacagaacctggcggcagcgcaaaagatg

SEQ ID NO: 44723 - DNA, 103 bp, Artificial Sequence
  Synthetic Polynucleotide
taatacgactcactatagggctaattctaacatttttctgtccttggttgaacagaggagacaaccaatgacagaaaaaaacctggcggcagcgcaaaagatg

SEQ ID NO: 44724 - DNA, 103 bp, Artificial Sequence
  Synthetic Polynucleotide
taatacgactcactatagggcttttctaattctaacatttttctgtccttaacagaggagaaaggacatgaaaatgttaaacctggcggcagcgcaaaagatg

SEQ ID NO: 44725 - DNA, 103 bp, Artificial Sequence
  Synthetic Polynucleotide
taatacgactcactataggggtacacttttctaattctaacatttttctgaacagaggagacagaaaatggttagaattaacctggcggcagcgcaaaagatg

SEQ ID NO: 44726 - DNA, 103 bp, Artificial Sequence
  Synthetic Polynucleotide
taatacgactcactatagggtagaagaatacacaaatagtagacatgttaaacagaggagataacatatgtactatttgaacctggcggcagcgcaaaagatg

SEQ ID NO: 44727 - DNA, 103 bp, Artificial Sequence
  Synthetic Polynucleotide
taatacgactcactatagggtggatgtacacttttctaattctaacatttaacagaggagaaaatgtatgaattagaaaaacctggcggcagcgcaaaagatg

SEQ ID NO: 44728 - DNA, 103 bp, Artificial Sequence
  Synthetic Polynucleotide
taatacgactcactatagggtattttggatgtacacttttctaattctaaaacagaggagattagaaatggaaaagtgtaacctggcggcagcgcaaaagatg

SEQ ID NO: 44729 - DNA, 103 bp, Artificial Sequence
  Synthetic Polynucleotide
taatacgactcactatagggttttgtattttggatgtacacttttctaataacagaggagaattagaatggtgtacatcaacctggcggcagcgcaaaagatg

SEQ ID NO: 44730 - DNA, 103 bp, Artificial Sequence
  Synthetic Polynucleotide
taatacgactcactatagggtaacattttgtattttggatgtacacttttaacagaggagaaaaagtatgcatccaaaaaacctggcggcagcgcaaaagatg

SEQ ID NO: 44731 - DNA, 103 bp, Artificial Sequence
  Synthetic Polynucleotide
taatacgactcactatagggtccggtaacattttgtattttggatgtacaaacagaggagatgtacaatgaaaatacaaaacctggcggcagcgcaaaagatg

SEQ ID NO: 44732 - DNA, 103 bp, Artificial Sequence
  Synthetic Polynucleotide
taatacgactcactatagggataaatccggtaacattttgtattttggataacagaggagaatccaaatgacaaaatgtaacctggcggcagcgcaaaagatg

SEQ ID NO: 44733 - DNA, 103 bp, Artificial Sequence
  Synthetic Polynucleotide
taatacgactcactatagggcttccataaatccggtaacattttgtatttaacagaggagaaaatacatgatgttaccgaacctggcggcagcgcaaaagatg

SEQ ID NO: 44734 - DNA, 103 bp, Artificial Sequence
  Synthetic Polynucleotide
taatacgactcactatagggttcttcttccataaatccggtaacattttgaacagaggagacaaaatatgaccggatttaacctggcggcagcgcaaaagatg

SEQ ID NO: 44735 - DNA, 103 bp, Artificial Sequence
  Synthetic Polynucleotide
taatacgactcactatagggtttatttcttcttccataaatccggtaacaaacagaggagatgttacatgatttatggaaacctggcggcagcgcaaaagatg

SEQ ID NO: 44736 - DNA, 103 bp, Artificial Sequence
  Synthetic Polynucleotide
taatacgactcactatagggctgcctttatttcttcttccataaatccggaacagaggagaccggatatgtggaagaagaacctggcggcagcgcaaaagatg

SEQ ID NO: 44737 - DNA, 103 bp, Artificial Sequence
  Synthetic Polynucleotide
taatacgactcactatagggcccattagaagaatacacaaatagtagacaaacagaggagatgtctaatgtttgtgtataacctggcggcagcgcaaaagatg

SEQ ID NO: 44738 - DNA, 103 bp, Artificial Sequence
  Synthetic Polynucleotide
taatacgactcactatagggtatttctgcctttatttcttcttccataaaaacagaggagatttatgatggaagaaataaacctggcggcagcgcaaaagatg

SEQ ID NO: 44739 - DNA, 103 bp, Artificial Sequence
  Synthetic Polynucleotide
taatacgactcactatagggaattgtatttctgcctttatttcttcttccaacagaggagaggaagaatgaataaaggcaacctggcggcagcgcaaaagatg

SEQ ID NO: 44740 - DNA, 103 bp, Artificial Sequence
  Synthetic Polynucleotide
taatacgactcactatagggtttttaattgtatttctgcctttatttcttaacagaggagaaagaaaatgaggcagaaaaacctggcggcagcgcaaaagatg

SEQ ID NO: 44741 - DNA, 103 bp, Artificial Sequence
  Synthetic Polynucleotide
taatacgactcactatagggatcgatttttaattgtatttctgcctttataacagaggagaataaagatggaaatacaaaacctggcggcagcgcaaaagatg

SEQ ID NO: 44742 - DNA, 103 bp, Artificial Sequence
  Synthetic Polynucleotide
taatacgactcactatagggagtttatcgatttttaattgtatttctgccaacagaggagaggcagaatgacaattaaaaacctggcggcagcgcaaaagatg

SEQ ID NO: 44743 - DNA, 103 bp, Artificial Sequence
  Synthetic Polynucleotide
taatacgactcactatagggatgtgagtttatcgatttttaattgtatttaacagaggagaaaatacatgtaaaaatcgaacctggcggcagcgcaaaagatg

SEQ ID NO: 44744 - DNA, 103 bp, Artificial Sequence
  Synthetic Polynucleotide
taatacgactcactatagggttgaaatgtgagtttatcgatttttaattgaacagaggagacaattaatgatcgataaaaacctggcggcagcgcaaaagatg

SEQ ID NO: 44745 - DNA, 103 bp, Artificial Sequence
  Synthetic Polynucleotide
taatacgactcactatagggtatatttgaaatgtgagtttatcgatttttaacagaggagaaaaaatatgtaaactcacaacctggcggcagcgcaaaagatg

SEQ ID NO: 44746 - DNA, 103 bp, Artificial Sequence
  Synthetic Polynucleotide
taatacgactcactatagggataaatatatttgaaatgtgagtttatcgaaacagaggagatcgataatgtcacatttcaacctggcggcagcgcaaaagatg

SEQ ID NO: 44747 - DNA, 103 bp, Artificial Sequence
  Synthetic Polynucleotide
taatacgactcactatagggatcagataaatatatttgaaatgtgagtttaacagaggagaaaactcatgtttcaaataaacctggcggcagcgcaaaagatg

SEQ ID NO: 44748 - DNA, 103 bp, Artificial Sequence
  Synthetic Polynucleotide
taatacgactcactatagggtttaccccattagaagaatacacaaatagtaacagaggagaactattatggtattcttcaacctggcggcagcgcaaaagatg

SEQ ID NO: 44749 - DNA, 103 bp, Artificial Sequence
  Synthetic Polynucleotide
taatacgactcactatagggtcagaatcagataaatatatttgaaatgtgaacagaggagacacattatgaatatatttaacctggcggcagcgcaaaagatg

SEQ ID NO: 44750 - DNA, 103 bp, Artificial Sequence
  Synthetic Polynucleotide
taatacgactcactatagggtgttatcagaatcagataaatatatttgaaaacagaggagattcaaaatgatttatctgaacctggcggcagcgcaaaagatg

SEQ ID NO: 44751 - DNA, 103 bp, Artificial Sequence
  Synthetic Polynucleotide
taatacgactcactatagggttttatgttatcagaatcagataaatatataacagaggagaatatatatgtctgattctaacctggcggcagcgcaaaagatg

SEQ ID NO: 44752 - DNA, 103 bp, Artificial Sequence
  Synthetic Polynucleotide
taatacgactcactataggggatatttttatgttatcagaatcagataaaaacagaggagatttatcatgttctgataaaacctggcggcagcgcaaaagatg

SEQ ID NO: 44753 - DNA, 103 bp, Artificial Sequence
  Synthetic Polynucleotide
taatacgactcactatagggtcaatgatatttttatgttatcagaatcagaacagaggagactgattatgataacataaaacctggcggcagcgcaaaagatg

SEQ ID NO: 44754 - DNA, 103 bp, Artificial Sequence
  Synthetic Polynucleotide
taatacgactcactatagggctcattcaatgatatttttatgttatcagaaacagaggagatctgatatgataaaaataaacctggcggcagcgcaaaagatg

SEQ ID NO: 44755 - DNA, 103 bp, Artificial Sequence
  Synthetic Polynucleotide
taatacgactcactatagggagtatctcattcaatgatatttttatgttaaacagaggagataacatatgaatatcattaacctggcggcagcgcaaaagatg

SEQ ID NO: 44756 - DNA, 103 bp, Artificial Sequence
  Synthetic Polynucleotide
taatacgactcactataggggtgttagtatctcattcaatgatatttttaaacagaggagataaaaaatgcattgaatgaacctggcggcagcgcaaaagatg

SEQ ID NO: 44757 - DNA, 103 bp, Artificial Sequence
  Synthetic Polynucleotide
taatacgactcactataggggaaatgtgttagtatctcattcaatgatataacagaggagaatatcaatgaatgagataaacctggcggcagcgcaaaagatg

SEQ ID NO: 44758 - DNA, 103 bp, Artificial Sequence
  Synthetic Polynucleotide
taatacgactcactatagggttgttgaaatgtgttagtatctcattcaataacagaggagaattgaaatggatactaacaacctggcggcagcgcaaaagatg

SEQ ID NO: 44759 - DNA, 103 bp, Artificial Sequence
  Synthetic Polynucleotide
taatacgactcactataggggacattttaccccattagaagaatacacaaaacagaggagattgtgtatgcttctaatgaacctggcggcagcgcaaaagatg

SEQ ID NO: 44760 - DNA, 103 bp, Artificial Sequence
  Synthetic Polynucleotide
taatacgactcactatagggcattattgttgaaatgtgttagtatctcataacagaggagaatgagaatgtaacacattaacctggcggcagcgcaaaagatg

SEQ ID NO: 44761 - DNA, 103 bp, Artificial Sequence
  Synthetic Polynucleotide
taatacgactcactatagggattctcattattgttgaaatgtgttagtataacagaggagaatactaatgcatttcaacaacctggcggcagcgcaaaagatg

SEQ ID NO: 44762 - DNA, 103 bp, Artificial Sequence
  Synthetic Polynucleotide
taatacgactcactataggggtaacattctcattattgttgaaatgtgttaacagaggagaaacacaatgcaacaataaaacctggcggcagcgcaaaagatg

SEQ ID NO: 44763 - DNA, 103 bp, Artificial Sequence
  Synthetic Polynucleotide
taatacgactcactatagggataatgtaacattctcattattgttgaaataacagaggagaatttcaatgataatgagaaacctggcggcagcgcaaaagatg

SEQ ID NO: 44764 - DNA, 103 bp, Artificial Sequence
  Synthetic Polynucleotide
taatacgactcactatagggataaaataatgtaacattctcattattgttaacagaggagaaacaatatggagaatgttaacctggcggcagcgcaaaagatg

SEQ ID NO: 44765 - DNA, 103 bp, Artificial Sequence
  Synthetic Polynucleotide
taatacgactcactatagggtcacaataaaataatgtaacattctcattaaacagaggagataatgaatgtgttacattaacctggcggcagcgcaaaagatg

SEQ ID NO: 44766 - DNA, 103 bp, Artificial Sequence
  Synthetic Polynucleotide
taatacgactcactataggggttcatcacaataaaataatgtaacattctaacagaggagaagaatgatgcattattttaacctggcggcagcgcaaaagatg

SEQ ID NO: 44767 - DNA, 103 bp, Artificial Sequence
  Synthetic Polynucleotide
taatacgactcactatagggatctcgttcatcacaataaaataatgtaacaacagaggagagttacaatgttttattgtaacctggcggcagcgcaaaagatg

SEQ ID NO: 44768 - DNA, 103 bp, Artificial Sequence
  Synthetic Polynucleotide
taatacgactcactatagggtctgcatctcgttcatcacaataaaataataacagaggagaattattatgttgtgatgaaacctggcggcagcgcaaaagatg

SEQ ID NO: 44769 - DNA, 103 bp, Artificial Sequence
  Synthetic Polynucleotide
taatacgactcactatagggcaaattctgcatctcgttcatcacaataaaaacagaggagatttattatgatgaacgagaacctggcggcagcgcaaaagatg

SEQ ID NO: 44770 - DNA, 103 bp, Artificial Sequence
  Synthetic Polynucleotide
taatacgactcactatagggttggagacattttaccccattagaagaataaacagaggagatattctatgaatggggtaaacctggcggcagcgcaaaagatg

SEQ ID NO: 44771 - DNA, 103 bp, Artificial Sequence
  Synthetic Polynucleotide
taatacgactcactatagggcataacaaattctgcatctcgttcatcacaaacagaggagatgtgatatgcgagatgcaaacctggcggcagcgcaaaagatg

SEQ ID NO: 44772 - DNA, 103 bp, Artificial Sequence
  Synthetic Polynucleotide
taatacgactcactatagggagacacataacaaattctgcatctcgttcaaacagaggagatgaacgatgtgcagaattaacctggcggcagcgcaaaagatg

SEQ ID NO: 44773 - DNA, 103 bp, Artificial Sequence
  Synthetic Polynucleotide
taatacgactcactatagggcctctagacacataacaaattctgcatctcaacagaggagagagatgatgaatttgttaaacctggcggcagcgcaaaagatg

SEQ ID NO: 44774 - DNA, 103 bp, Artificial Sequence
  Synthetic Polynucleotide
taatacgactcactatagggtttagcctctagacacataacaaattctgcaacagaggagagcagaaatggttatgtgtaacctggcggcagcgcaaaagatg

SEQ ID NO: 44775 - DNA, 103 bp, Artificial Sequence
  Synthetic Polynucleotide
taatacgactcactatagggtatgttttagcctctagacacataacaaataacagaggagaatttgtatggtgtctagaaacctggcggcagcgcaaaagatg

SEQ ID NO: 44776 - DNA, 103 bp, Artificial Sequence
  Synthetic Polynucleotide
taatacgactcactatagggagaaatatgttttagcctctagacacataaaacagaggagattatgtatgtagaggctaaacctggcggcagcgcaaaagatg

SEQ ID NO: 44777 - DNA, 103 bp, Artificial Sequence
  Synthetic Polynucleotide
taatacgactcactatagggggtaaagaaatatgttttagcctctagacaaacagaggagatgtctaatggctaaaacaaacctggcggcagcgcaaaagatg

SEQ ID NO: 44778 - DNA, 103 bp, Artificial Sequence
  Synthetic Polynucleotide
taatacgactcactatagggcctgtggtaaagaaatatgttttagcctctaacagaggagaagaggcatgaacatatttaacctggcggcagcgcaaaagatg

SEQ ID NO: 44779 - DNA, 103 bp, Artificial Sequence
  Synthetic Polynucleotide
taatacgactcactatagggattctcctgtggtaaagaaatatgttttagaacagaggagactaaaaatgatttctttaaacctggcggcagcgcaaaagatg

SEQ ID NO: 44780 - DNA, 103 bp, Artificial Sequence
  Synthetic Polynucleotide
taatacgactcactatagggcggccattctcctgtggtaaagaaatatgtaacagaggagaacatatatgtttaccacaaacctggcggcagcgcaaaagatg

SEQ ID NO: 44781 - DNA, 103 bp, Artificial Sequence
  Synthetic Polynucleotide
taatacgactcactatagggaaaaattggagacattttaccccattagaaaacagaggagattctaaatgggtaaaatgaacctggcggcagcgcaaaagatg

SEQ ID NO: 44782 - DNA, 103 bp, Artificial Sequence
  Synthetic Polynucleotide
taatacgactcactatagggatcaacggccattctcctgtggtaaagaaaaacagaggagatttcttatgcacaggagaaacctggcggcagcgcaaaagatg

SEQ ID NO: 44783 - DNA, 103 bp, Artificial Sequence
  Synthetic Polynucleotide
taatacgactcactatagggttattatcaacggccattctcctgtggtaaaacagaggagattaccaatggagaatggcaacctggcggcagcgcaaaagatg

SEQ ID NO: 44784 - DNA, 103 bp, Artificial Sequence
  Synthetic Polynucleotide
taatacgactcactatagggggtacttattatcaacggccattctcctgtaacagaggagaacaggaatgtggccgttgaacctggcggcagcgcaaaagatg

SEQ ID NO: 44785 - DNA, 103 bp, Artificial Sequence
  Synthetic Polynucleotide
taatacgactcactatagggtgatcggtacttattatcaacggccattctaacagaggagaagaatgatggttgataataacctggcggcagcgcaaaagatg

SEQ ID NO: 44786 - DNA, 103 bp, Artificial Sequence
  Synthetic Polynucleotide
taatacgactcactatagggtatcctgatcggtacttattatcaacggccaacagaggagaggccgtatgtaataagtaaacctggcggcagcgcaaaagatg

SEQ ID NO: 44787 - DNA, 103 bp, Artificial Sequence
  Synthetic Polynucleotide
taatacgactcactatagggcatagtatcctgatcggtacttattatcaaaacagaggagattgataatgagtaccgataacctggcggcagcgcaaaagatg

SEQ ID NO: 44788 - DNA, 103 bp, Artificial Sequence
  Synthetic Polynucleotide
taatacgactcactatagggaatagcatagtatcctgatcggtacttattaacagaggagaaataagatgcgatcaggaaacctggcggcagcgcaaaagatg

SEQ ID NO: 44789 - DNA, 103 bp, Artificial Sequence
  Synthetic Polynucleotide
taatacgactcactatagggacgcaaatagcatagtatcctgatcggtacaacagaggagagtaccgatgaggatactaaacctggcggcagcgcaaaagatg

SEQ ID NO: 44790 - DNA, 103 bp, Artificial Sequence
  Synthetic Polynucleotide
taatacgactcactatagggaacagacgcaaatagcatagtatcctgatcaacagaggagagatcagatgactatgctaaacctggcggcagcgcaaaagatg

SEQ ID NO: 44791 - DNA, 103 bp, Artificial Sequence
  Synthetic Polynucleotide
taatacgactcactatagggttatcaacagacgcaaatagcatagtatccaacagaggagaggatacatggctatttgcaacctggcggcagcgcaaaagatg

SEQ ID NO: 44792 - DNA, 103 bp, Artificial Sequence
  Synthetic Polynucleotide
taatacgactcactatagggcagggtctctttacaggcttctcatctcttaacagaggagaaagagaatggaagcctgtaacctggcggcagcgcaaaagatg

SEQ ID NO: 44793 - DNA, 103 bp, Artificial Sequence
  Synthetic Polynucleotide
taatacgactcactatagggtgcacaaaaattggagacattttaccccataacagaggagaatggggatgaatgtctccaacctggcggcagcgcaaaagatg

SEQ ID NO: 44794 - DNA, 103 bp, Artificial Sequence
  Synthetic Polynucleotide
taatacgactcactataggggatgattatcaacagacgcaaatagcatagaacagaggagactatgcatgttgcgtctgaacctggcggcagcgcaaaagatg

SEQ ID NO: 44795 - DNA, 103 bp, Artificial Sequence
  Synthetic Polynucleotide
taatacgactcactatagggcttaggatgattatcaacagacgcaaatagaacagaggagactatttatgtctgttgataacctggcggcagcgcaaaagatg

SEQ ID NO: 44796 - DNA, 103 bp, Artificial Sequence
  Synthetic Polynucleotide
taatacgactcactatagggatcatcttaggatgattatcaacagacgcaaacagaggagatgcgtcatgtgataatcaaacctggcggcagcgcaaaagatg

SEQ ID NO: 44797 - DNA, 103 bp, Artificial Sequence
  Synthetic Polynucleotide
taatacgactcactatagggtttttatcatcttaggatgattatcaacagaacagaggagactgttgatgatcatcctaaacctggcggcagcgcaaaagatg

SEQ ID NO: 44798 - DNA, 103 bp, Artificial Sequence
  Synthetic Polynucleotide
taatacgactcactatagggtaagttttttatcatcttaggatgattatcaacagaggagagataatatgcctaagatgaacctggcggcagcgcaaaagatg

SEQ ID NO: 44799 - DNA, 103 bp, Artificial Sequence
  Synthetic Polynucleotide
taatacgactcactatagggtgagttaagttttttatcatcttaggatgaaacagaggagatcatccatggatgataaaaacctggcggcagcgcaaaagatg

SEQ ID NO: 44800 - DNA, 103 bp, Artificial Sequence
  Synthetic Polynucleotide
taatacgactcactatagggacagttgagttaagttttttatcatcttagaacagaggagactaagaatgtaaaaaactaacctggcggcagcgcaaaagatg

SEQ ID NO: 44801 - DNA, 103 bp, Artificial Sequence
  Synthetic Polynucleotide
taatacgactcactatagggtttaaacagttgagttaagttttttatcataacagaggagaatgataatgaacttaactaacctggcggcagcgcaaaagatg

SEQ ID NO: 44802 - DNA, 103 bp, Artificial Sequence
  Synthetic Polynucleotide
taatacgactcactatagggacaaatttaaacagttgagttaagttttttaacagaggagaaaaaaaatgaactcaactaacctggcggcagcgcaaaagatg

SEQ ID NO: 44803 - DNA, 103 bp, Artificial Sequence
  Synthetic Polynucleotide
taatacgactcactatagggatggaacaaatttaaacagttgagttaagtaacagaggagaacttaaatgaactgtttaaacctggcggcagcgcaaaagatg

SEQ ID NO: 44804 - DNA, 103 bp, Artificial Sequence
  Synthetic Polynucleotide
taatacgactcactatagggtccattgcacaaaaattggagacattttacaacagaggagagtaaaaatgctccaatttaacctggcggcagcgcaaaagatg

SEQ ID NO: 44805 - DNA, 103 bp, Artificial Sequence
  Synthetic Polynucleotide
taatacgactcactatagggtgcagatggaacaaatttaaacagttgagtaacagaggagaactcaaatgtttaaatttaacctggcggcagcgcaaaagatg

SEQ ID NO: 44806 - DNA, 103 bp, Artificial Sequence
  Synthetic Polynucleotide
taatacgactcactatagggtcctctgcagatggaacaaatttaaacagtaacagaggagaactgttatgatttgttccaacctggcggcagcgcaaaagatg

SEQ ID NO: 44807 - DNA, 103 bp, Artificial Sequence
  Synthetic Polynucleotide
taatacgactcactatagggagttatcctctgcagatggaacaaatttaaaacagaggagattaaatatgttccatctgaacctggcggcagcgcaaaagatg

SEQ ID NO: 44808 - DNA, 103 bp, Artificial Sequence
  Synthetic Polynucleotide
taatacgactcactatagggtaaatagttatcctctgcagatggaacaaaaacagaggagatttgttatgtctgcagagaacctggcggcagcgcaaaagatg

SEQ ID NO: 44809 - DNA, 103 bp, Artificial Sequence
  Synthetic Polynucleotide
taatacgactcactatagggtttgctaaatagttatcctctgcagatggaaacagaggagatccatcatgagaggataaaacctggcggcagcgcaaaagatg

SEQ ID NO: 44810 - DNA, 103 bp, Artificial Sequence
  Synthetic Polynucleotide
taatacgactcactatagggttaattttgctaaatagttatcctctgcagaacagaggagactgcagatgataactattaacctggcggcagcgcaaaagatg

SEQ ID NO: 44811 - DNA, 103 bp, Artificial Sequence
  Synthetic Polynucleotide
taatacgactcactatagggcgccgttaattttgctaaatagttatcctcaacagaggagagaggatatgtatttagcaaacctggcggcagcgcaaaagatg

SEQ ID NO: 44812 - DNA, 103 bp, Artificial Sequence
  Synthetic Polynucleotide
taatacgactcactatagggactaacgccgttaattttgctaaatagttaaacagaggagataactaatgagcaaaattaacctggcggcagcgcaaaagatg

SEQ ID NO: 44813 - DNA, 103 bp, Artificial Sequence
  Synthetic Polynucleotide
taatacgactcactatagggcattcactaacgccgttaattttgctaaataacagaggagaatttagatgaattaacggaacctggcggcagcgcaaaagatg

SEQ ID NO: 44814 - DNA, 103 bp, Artificial Sequence
  Synthetic Polynucleotide
taatacgactcactatagggacatccattcactaacgccgttaattttgcaacagaggagagcaaaaatgacggcgttaaacctggcggcagcgcaaaagatg

SEQ ID NO: 44815 - DNA, 103 bp, Artificial Sequence
  Synthetic Polynucleotide
taatacgactcactatagggactaatccattgcacaaaaattggagacataacagaggagaatgtctatgatttttgtgaacctggcggcagcgcaaaagatg

SEQ ID NO: 44816 - DNA, 103 bp, Artificial Sequence
  Synthetic Polynucleotide
taatacgactcactatagggaaatcacatccattcactaacgccgttaataacagaggagaattaacatggttagtgaaaacctggcggcagcgcaaaagatg

SEQ ID NO: 44817 - DNA, 103 bp, Artificial Sequence
  Synthetic Polynucleotide
taatacgactcactataggggaaagaaatcacatccattcactaacgccgaacagaggagacggcgtatgtgaatggataacctggcggcagcgcaaaagatg

SEQ ID NO: 44818 - DNA, 103 bp, Artificial Sequence
  Synthetic Polynucleotide
taatacgactcactatagggtccaggaaagaaatcacatccattcactaaaacagaggagattagtgatgggatgtgataacctggcggcagcgcaaaagatg

SEQ ID NO: 44819 - DNA, 103 bp, Artificial Sequence
  Synthetic Polynucleotide
taatacgactcactatagggtagagtccaggaaagaaatcacatccattcaacagaggagagaatggatgtgatttcttaacctggcggcagcgcaaaagatg

SEQ ID NO: 44820 - DNA, 103 bp, Artificial Sequence
  Synthetic Polynucleotide
taatacgactcactatagggccccatagagtccaggaaagaaatcacatcaacagaggagagatgtgatgtctttcctgaacctggcggcagcgcaaaagatg

SEQ ID NO: 44821 - DNA, 103 bp, Artificial Sequence
  Synthetic Polynucleotide
taatacgactcactatagggagatgccccatagagtccaggaaagaaatcaacagaggagagatttcatgcctggactcaacctggcggcagcgcaaaagatg

SEQ ID NO: 44822 - DNA, 103 bp, Artificial Sequence
  Synthetic Polynucleotide
taatacgactcactataggggttatagatgccccatagagtccaggaaagaacagaggagactttccatgactctatggaacctggcggcagcgcaaaagatg

SEQ ID NO: 44823 - DNA, 103 bp, Artificial Sequence
  Synthetic Polynucleotide
taatacgactcactatagggtgggtgttatagatgccccatagagtccagaacagaggagactggacatgatggggcataacctggcggcagcgcaaaagatg

SEQ ID NO: 44824 - DNA, 103 bp, Artificial Sequence
  Synthetic Polynucleotide
taatacgactcactataggggttggtgggtgttatagatgccccatagagaacagaggagactctatatggcatctataaacctggcggcagcgcaaaagatg

SEQ ID NO: 44825 - DNA, 103 bp, Artificial Sequence
  Synthetic Polynucleotide
taatacgactcactatagggtttaagttggtgggtgttatagatgccccaaacagaggagatggggcatgtataacaccaacctggcggcagcgcaaaagatg

SEQ ID NO: 44826 - DNA, 103 bp, Artificial Sequence
  Synthetic Polynucleotide
taatacgactcactataggggtggcactaatccattgcacaaaaattggaaacagaggagatccaatatgtgtgcaatgaacctggcggcagcgcaaaagatg

SEQ ID NO: 44827 - DNA, 103 bp, Artificial Sequence
  Synthetic Polynucleotide
taatacgactcactatagggttttgtttaagttggtgggtgttatagatgaacagaggagacatctaatgcacccaccaaacctggcggcagcgcaaaagatg

SEQ ID NO: 44828 - DNA, 103 bp, Artificial Sequence
  Synthetic Polynucleotide
taatacgactcactatagggttgtattttgtttaagttggtgggtgttataacagaggagaataacaatgaccaacttaaacctggcggcagcgcaaaagatg

SEQ ID NO: 44829 - DNA, 103 bp, Artificial Sequence
  Synthetic Polynucleotide
taatacgactcactatagggaacaattgtattttgtttaagttggtgggtaacagaggagaacccacatgcttaaacaaaacctggcggcagcgcaaaagatg

SEQ ID NO: 44830 - DNA, 103 bp, Artificial Sequence
  Synthetic Polynucleotide
taatacgactcactatagggcactaaacaattgtattttgtttaagttggaacagaggagaccaactatgacaaaatacaacctggcggcagcgcaaaagatg

SEQ ID NO: 44831 - DNA, 103 bp, Artificial Sequence
  Synthetic Polynucleotide
taatacgactcactatagggaaaatcactaaacaattgtattttgtttaaaacagaggagattaaacatgatacaattgaacctggcggcagcgcaaaagatg

SEQ ID NO: 44832 - DNA, 103 bp, Artificial Sequence
  Synthetic Polynucleotide
taatacgactcactatagggattgtaaaatcactaaacaattgtattttgaacagaggagacaaaatatgattgtttagaacctggcggcagcgcaaaagatg

SEQ ID NO: 44833 - DNA, 103 bp, Artificial Sequence
  Synthetic Polynucleotide
taatacgactcactatagggtattgattgtaaaatcactaaacaattgtaaacagaggagatacaatatgttagtgattaacctggcggcagcgcaaaagatg

SEQ ID NO: 44834 - DNA, 103 bp, Artificial Sequence
  Synthetic Polynucleotide
taatacgactcactatagggtatattattgattgtaaaatcactaaacaaaacagaggagattgtttatggattttacaaacctggcggcagcgcaaaagatg

SEQ ID NO: 44835 - DNA, 103 bp, Artificial Sequence
  Synthetic Polynucleotide
taatacgactcactataggggtgactatattattgattgtaaaatcactaaacagaggagatagtgaatgtacaatcaaaacctggcggcagcgcaaaagatg

SEQ ID NO: 44836 - DNA, 103 bp, Artificial Sequence
  Synthetic Polynucleotide
taatacgactcactatagggaactagtgactatattattgattgtaaaataacagaggagaattttaatgtcaataataaacctggcggcagcgcaaaagatg

SEQ ID NO: 44837 - DNA, 103 bp, Artificial Sequence
  Synthetic Polynucleotide
taatacgactcactatagggagacagtggcactaatccattgcacaaaaaaacagaggagatttttgatgaatggattaaacctggcggcagcgcaaaagatg

SEQ ID NO: 44838 - DNA, 103 bp, Artificial Sequence
  Synthetic Polynucleotide
taatacgactcactatagggtgccaaactagtgactatattattgattgtaacagaggagaacaatcatgaatatagtcaacctggcggcagcgcaaaagatg

SEQ ID NO: 44839 - DNA, 103 bp, Artificial Sequence
  Synthetic Polynucleotide
taatacgactcactatagggttaattgccaaactagtgactatattattgaacagaggagacaataaatgagtcactagaacctggcggcagcgcaaaagatg

SEQ ID NO: 44840 - DNA, 103 bp, Artificial Sequence
  Synthetic Polynucleotide
taatacgactcactatagggaatttttaattgccaaactagtgactatataacagaggagaatatagatgctagtttggaacctggcggcagcgcaaaagatg

SEQ ID NO: 44841 - DNA, 103 bp, Artificial Sequence
  Synthetic Polynucleotide
taatacgactcactatagggataataatttttaattgccaaactagtgacaacagaggagagtcactatgttggcaattaacctggcggcagcgcaaaagatg

SEQ ID NO: 44842 - DNA, 103 bp, Artificial Sequence
  Synthetic Polynucleotide
taatacgactcactatagggtttctataataatttttaattgccaaactaaacagaggagatagtttatgaattaaaaaaacctggcggcagcgcaaaagatg

SEQ ID NO: 44843 - DNA, 103 bp, Artificial Sequence
  Synthetic Polynucleotide
taatacgactcactatagggtagtctttctataataatttttaattgccaaacagaggagatggcaaatgaaaattattaacctggcggcagcgcaaaagatg

SEQ ID NO: 44844 - DNA, 103 bp, Artificial Sequence
  Synthetic Polynucleotide
taatacgactcactatagggagagttagtctttctataataatttttaataacagaggagaattaaaatgtattatagaaacctggcggcagcgcaaaagatg

SEQ ID NO: 44845 - DNA, 103 bp, Artificial Sequence
  Synthetic Polynucleotide
taatacgactcactatagggacggtagagttagtctttctataataatttaacagaggagaaaattaatgtagaaagacaacctggcggcagcgcaaaagatg

SEQ ID NO: 44846 - DNA, 103 bp, Artificial Sequence
  Synthetic Polynucleotide
taatacgactcactatagggcgtctacggtagagttagtctttctataataacagaggagaattataatgagactaactaacctggcggcagcgcaaaagatg

SEQ ID NO: 44847 - DNA, 103 bp, Artificial Sequence
  Synthetic Polynucleotide
taatacgactcactatagggacgcacgtctacggtagagttagtctttctaacagaggagaagaaagatgaactctaccaacctggcggcagcgcaaaagatg

SEQ ID NO: 44848 - DNA, 103 bp, Artificial Sequence
  Synthetic Polynucleotide
taatacgactcactatagggctactagacagtggcactaatccattgcacaacagaggagagtgcaaatgattagtgccaacctggcggcagcgcaaaagatg

SEQ ID NO: 44849 - DNA, 103 bp, Artificial Sequence
  Synthetic Polynucleotide
taatacgactcactatagggatattacgcacgtctacggtagagttagtcaacagaggagagactaaatgtaccgtagaaacctggcggcagcgcaaaagatg

SEQ ID NO: 44850 - DNA, 103 bp, Artificial Sequence
  Synthetic Polynucleotide
taatacgactcactatagggtaacaatattacgcacgtctacggtagagtaacagaggagaactctaatgtagacgtgcaacctggcggcagcgcaaaagatg

SEQ ID NO: 44851 - DNA, 103 bp, Artificial Sequence
  Synthetic Polynucleotide
taatacgactcactatagggaaacgtaacaatattacgcacgtctacggtaacagaggagaaccgtaatggtgcgtaataacctggcggcagcgcaaaagatg

SEQ ID NO: 44852 - DNA, 103 bp, Artificial Sequence
  Synthetic Polynucleotide
taatacgactcactatagggtttataaacgtaacaatattacgcacgtctaacagaggagaagacgtatgtaatattgtaacctggcggcagcgcaaaagatg

SEQ ID NO: 44853 - DNA, 103 bp, Artificial Sequence
  Synthetic Polynucleotide
taatacgactcactatagggaatcgtttataaacgtaacaatattacgcaaacagaggagatgcgtaatgttgttacgtaacctggcggcagcgcaaaagatg

SEQ ID NO: 44854 - DNA, 103 bp, Artificial Sequence
  Synthetic Polynucleotide
taatacgactcactatagggagcgtaatcgtttataaacgtaacaatattaacagaggagaaatattatgacgtttataaacctggcggcagcgcaaaagatg

SEQ ID NO: 44855 - DNA, 103 bp, Artificial Sequence
  Synthetic Polynucleotide
taatacgactcactatagggaaattagcgtaatcgtttataaacgtaacaaacagaggagatgttacatgtataaacgaaacctggcggcagcgcaaaagatg

SEQ ID NO: 44856 - DNA, 103 bp, Artificial Sequence
  Synthetic Polynucleotide
taatacgactcactatagggcgtctaaattagcgtaatcgtttataaacgaacagaggagacgtttaatgacgattacgaacctggcggcagcgcaaaagatg

SEQ ID NO: 44857 - DNA, 103 bp, Artificial Sequence
  Synthetic Polynucleotide
taatacgactcactataggggacatcgtctaaattagcgtaatcgtttataacagaggagaataaacatgtacgctaataacctggcggcagcgcaaaagatg

SEQ ID NO: 44858 - DNA, 103 bp, Artificial Sequence
  Synthetic Polynucleotide
taatacgactcactataggggagtagacatcgtctaaattagcgtaatcgaacagaggagacgattaatgtaatttagaaacctggcggcagcgcaaaagatg

SEQ ID NO: 44859 - DNA, 103 bp, Artificial Sequence
  Synthetic Polynucleotide
taatacgactcactatagggaactactactagacagtggcactaatccataacagaggagaatggatatgtgccactgtaacctggcggcagcgcaaaagatg

SEQ ID NO: 44860 - DNA, 103 bp, Artificial Sequence
  Synthetic Polynucleotide
taatacgactcactatagggtatacgagtagacatcgtctaaattagcgtaacagaggagaacgctaatgtagacgatgaacctggcggcagcgcaaaagatg

SEQ ID NO: 44861 - DNA, 103 bp, Artificial Sequence
  Synthetic Polynucleotide
taatacgactcactatagggaggaatatacgagtagacatcgtctaaattaacagaggagaaatttaatggatgtctacaacctggcggcagcgcaaaagatg

SEQ ID NO: 44862 - DNA, 103 bp, Artificial Sequence
  Synthetic Polynucleotide
taatacgactcactatagggcaaggaggaatatacgagtagacatcgtctaacagaggagaagacgaatgctactcgtaaacctggcggcagcgcaaaagatg

SEQ ID NO: 44863 - DNA, 103 bp, Artificial Sequence
  Synthetic Polynucleotide
taatacgactcactatagggattgacaaggaggaatatacgagtagacataacagaggagaatgtctatgcgtatattcaacctggcggcagcgcaaaagatg

SEQ ID NO: 44864 - DNA, 103 bp, Artificial Sequence
  Synthetic Polynucleotide
taatacgactcactatagggagtgcattgacaaggaggaatatacgagtaaacagaggagatactcgatgattcctcctaacctggcggcagcgcaaaagatg

SEQ ID NO: 44865 - DNA, 103 bp, Artificial Sequence
  Synthetic Polynucleotide
taatacgactcactatagggtgaacagtgcattgacaaggaggaatatacaacagaggagagtatatatgtccttgtcaaacctggcggcagcgcaaaagatg

SEQ ID NO: 44866 - DNA, 103 bp, Artificial Sequence
  Synthetic Polynucleotide
taatacgactcactatagggattcttgaacagtgcattgacaaggaggaaaacagaggagattcctcatggtcaatgcaaacctggcggcagcgcaaaagatg

SEQ ID NO: 44867 - DNA, 103 bp, Artificial Sequence
  Synthetic Polynucleotide
taatacgactcactatagggtataaattcttgaacagtgcattgacaaggaacagaggagaccttgtatgtgcactgttaacctggcggcagcgcaaaagatg

SEQ ID NO: 44868 - DNA, 103 bp, Artificial Sequence
  Synthetic Polynucleotide
taatacgactcactataggggaaaatataaattcttgaacagtgcattgaaacagaggagatcaatgatgtgttcaagaaacctggcggcagcgcaaaagatg

SEQ ID NO: 44869 - DNA, 103 bp, Artificial Sequence
  Synthetic Polynucleotide
taatacgactcactatagggatgcggaaaatataaattcttgaacagtgcaacagaggagagcactgatgaagaatttaaacctggcggcagcgcaaaagatg

SEQ ID NO: 44870 - DNA, 103 bp, Artificial Sequence
  Synthetic Polynucleotide
taatacgactcactatagggcgtcaaactactactagacagtggcactaaaacagaggagattagtgatgctgtctagtaacctggcggcagcgcaaaagatg

SEQ ID NO: 44871 - DNA, 103 bp, Artificial Sequence
  Synthetic Polynucleotide
taatacgactcactatagggatctaatgcggaaaatataaattcttgaacaacagaggagagttcaaatgtttatatttaacctggcggcagcgcaaaagatg

SEQ ID NO: 44872 - DNA, 103 bp, Artificial Sequence
  Synthetic Polynucleotide
taatacgactcactatagggttttcatctaatgcggaaaatataaattctaacagaggagaagaattatgattttccgcaacctggcggcagcgcaaaagatg

SEQ ID NO: 44873 - DNA, 103 bp, Artificial Sequence
  Synthetic Polynucleotide
taatacgactcactatagggtccatttttcatctaatgcggaaaatataaaacagaggagattatatatgccgcattagaacctggcggcagcgcaaaagatg

SEQ ID NO: 44874 - DNA, 103 bp, Artificial Sequence
  Synthetic Polynucleotide
taatacgactcactatagggatcgttccatttttcatctaatgcggaaaaaacagaggagattttccatgttagatgaaaacctggcggcagcgcaaaagatg

SEQ ID NO: 44875 - DNA, 103 bp, Artificial Sequence
  Synthetic Polynucleotide
taatacgactcactatagggttaaaatcgttccatttttcatctaatgcgaacagaggagacgcattatgtgaaaaatgaacctggcggcagcgcaaaagatg

SEQ ID NO: 44876 - DNA, 103 bp, Artificial Sequence
  Synthetic Polynucleotide
taatacgactcactatagggatgatttaaaatcgttccatttttcatctaaacagaggagatagatgatgaatggaacgaacctggcggcagcgcaaaagatg

SEQ ID NO: 44877 - DNA, 103 bp, Artificial Sequence
  Synthetic Polynucleotide
taatacgactcactatagggataagatgatttaaaatcgttccatttttcaacagaggagagaaaaaatgaacgattttaacctggcggcagcgcaaaagatg

SEQ ID NO: 44878 - DNA, 103 bp, Artificial Sequence
  Synthetic Polynucleotide
taatacgactcactatagggtctaaataagatgatttaaaatcgttccataacagaggagaatggaaatgttttaaatcaacctggcggcagcgcaaaagatg

SEQ ID NO: 44879 - DNA, 103 bp, Artificial Sequence
  Synthetic Polynucleotide
taatacgactcactatagggcggtctctaaataagatgatttaaaatcgtaacagaggagaacgattatgaatcatcttaacctggcggcagcgcaaaagatg

SEQ ID NO: 44880 - DNA, 103 bp, Artificial Sequence
  Synthetic Polynucleotide
taatacgactcactatagggcggaacggtctctaaataagatgatttaaaaacagaggagatttaaaatgtcttatttaaacctggcggcagcgcaaaagatg

SEQ ID NO: 44881 - DNA, 103 bp, Artificial Sequence
  Synthetic Polynucleotide
taatacgactcactataggggaggtcgtcaaactactactagacagtggcaacagaggagagccactatgtagtagtagaacctggcggcagcgcaaaagatg

SEQ ID NO: 44882 - DNA, 103 bp, Artificial Sequence
  Synthetic Polynucleotide
taatacgactcactatagggggtaacggaacggtctctaaataagatgataacagaggagaatcatcatgtttagagacaacctggcggcagcgcaaaagatg

SEQ ID NO: 44883 - DNA, 103 bp, Artificial Sequence
  Synthetic Polynucleotide
taatacgactcactataggggacagggtaacggaacggtctctaaataagaacagaggagacttattatgagaccgttcaacctggcggcagcgcaaaagatg

SEQ ID NO: 44884 - DNA, 103 bp, Artificial Sequence
  Synthetic Polynucleotide
taatacgactcactatagggtaattgacagggtaacggaacggtctctaaaacagaggagattagagatggttccgttaaacctggcggcagcgcaaaagatg

SEQ ID NO: 44885 - DNA, 103 bp, Artificial Sequence
  Synthetic Polynucleotide
taatacgactcactatagggtacattaattgacagggtaacggaacggtcaacagaggagagaccgtatggttaccctgaacctggcggcagcgcaaaagatg

SEQ ID NO: 44886 - DNA, 103 bp, Artificial Sequence
  Synthetic Polynucleotide
taatacgactcactatagggacgcgtacattaattgacagggtaacggaaaacagaggagattccgtatgcctgtcaataacctggcggcagcgcaaaagatg

SEQ ID NO: 44887 - DNA, 103 bp, Artificial Sequence
  Synthetic Polynucleotide
taatacgactcactatagggttctaacgcgtacattaattgacagggtaaaacagaggagattacccatgcaattaatgaacctggcggcagcgcaaaagatg

SEQ ID NO: 44888 - DNA, 103 bp, Artificial Sequence
  Synthetic Polynucleotide
taatacgactcactatagggcgtggttctaacgcgtacattaattgacagaacagaggagactgtcaatgaatgtacgcaacctggcggcagcgcaaaagatg

SEQ ID NO: 44889 - DNA, 103 bp, Artificial Sequence
  Synthetic Polynucleotide
taatacgactcactatagggccttacgtggttctaacgcgtacattaattaacagaggagaaattaaatgacgcgttagaacctggcggcagcgcaaaagatg

SEQ ID NO: 44890 - DNA, 103 bp, Artificial Sequence
  Synthetic Polynucleotide
taatacgactcactatagggaatctccttacgtggttctaacgcgtacataacagaggagaatgtacatgttagaaccaaacctggcggcagcgcaaaagatg

SEQ ID NO: 44891 - DNA, 103 bp, Artificial Sequence
  Synthetic Polynucleotide
taatacgactcactatagggacatcaatctccttacgtggttctaacgcgaacagaggagacgcgttatgaccacgtaaaacctggcggcagcgcaaaagatg

SEQ ID NO: 44892 - DNA, 103 bp, Artificial Sequence
  Synthetic Polynucleotide
taatacgactcactatagggatgtcgaggtcgtcaaactactactagacaaacagaggagatgtctaatggtagtttgaaacctggcggcagcgcaaaagatg

SEQ ID NO: 44893 - DNA, 103 bp, Artificial Sequence
  Synthetic Polynucleotide
taatacgactcactatagggctgaaacatcaatctccttacgtggttctaaacagaggagatagaacatggtaaggagaaacctggcggcagcgcaaaagatg

SEQ ID NO: 44894 - DNA, 103 bp, Artificial Sequence
  Synthetic Polynucleotide
taatacgactcactatagggaacttctgaaacatcaatctccttacgtggaacagaggagaccacgtatggagattgataacctggcggcagcgcaaaagatg

SEQ ID NO: 44895 - DNA, 103 bp, Artificial Sequence
  Synthetic Polynucleotide
taatacgactcactataggggttttaacttctgaaacatcaatctccttaaacagaggagataaggaatgtgatgtttcaacctggcggcagcgcaaaagatg

SEQ ID NO: 44896 - DNA, 103 bp, Artificial Sequence
  Synthetic Polynucleotide
taatacgactcactatagggataaagttttaacttctgaaacatcaatctaacagaggagaagattgatgtttcagaagaacctggcggcagcgcaaaagatg

SEQ ID NO: 44897 - DNA, 103 bp, Artificial Sequence
  Synthetic Polynucleotide
taatacgactcactatagggagatgataaagttttaacttctgaaacatcaacagaggagagatgttatggaagttaaaaacctggcggcagcgcaaaagatg

SEQ ID NO: 44898 - DNA, 103 bp, Artificial Sequence
  Synthetic Polynucleotide
taatacgactcactatagggatataagatgataaagttttaacttctgaaaacagaggagattcagaatgtaaaactttaacctggcggcagcgcaaaagatg

SEQ ID NO: 44899 - DNA, 103 bp, Artificial Sequence
  Synthetic Polynucleotide
taatacgactcactatagggaatctatataagatgataaagttttaacttaacagaggagaaagttaatgctttatcataacctggcggcagcgcaaaagatg

SEQ ID NO: 44900 - DNA, 103 bp, Artificial Sequence
  Synthetic Polynucleotide
taatacgactcactatagggttcgaaatctatataagatgataaagttttaacagaggagaaaaactatgtcatcttataacctggcggcagcgcaaaagatg

SEQ ID NO: 44901 - DNA, 103 bp, Artificial Sequence
  Synthetic Polynucleotide
taatacgactcactataggggtattttcgaaatctatataagatgataaaaacagaggagatttatcatgttatatagaaacctggcggcagcgcaaaagatg

SEQ ID NO: 44902 - DNA, 103 bp, Artificial Sequence
  Synthetic Polynucleotide
taatacgactcactatagggatttagtattttcgaaatctatataagatgaacagaggagacatcttatgtagatttcgaacctggcggcagcgcaaaagatg

SEQ ID NO: 44903 - DNA, 103 bp, Artificial Sequence
  Synthetic Polynucleotide
taatacgactcactatagggaagcgcagggtctctttacaggcttctcataacagaggagaatgagaatgctgtaaagaaacctggcggcagcgcaaaagatg

SEQ ID NO: 44904 - DNA, 103 bp, Artificial Sequence
  Synthetic Polynucleotide
taatacgactcactatagggtaataatgtcgaggtcgtcaaactactactaacagaggagaagtagtatgttgacgaccaacctggcggcagcgcaaaagatg

SEQ ID NO: 44905 - DNA, 103 bp, Artificial Sequence
  Synthetic Polynucleotide
taatacgactcactatagggatctgatttagtattttcgaaatctatataaacagaggagatatataatgttcgaaaataacctggcggcagcgcaaaagatg

SEQ ID NO: 44906 - DNA, 103 bp, Artificial Sequence
  Synthetic Polynucleotide
taatacgactcactatagggtcgatatctgatttagtattttcgaaatctaacagaggagaagatttatgaaatactaaaacctggcggcagcgcaaaagatg

SEQ ID NO: 44907 - DNA, 103 bp, Artificial Sequence
  Synthetic Polynucleotide
taatacgactcactatagggtaacatcgatatctgatttagtattttcgaaacagaggagatcgaaaatgctaaatcagaacctggcggcagcgcaaaagatg

SEQ ID NO: 44908 - DNA, 103 bp, Artificial Sequence
  Synthetic Polynucleotide
taatacgactcactatagggttttataacatcgatatctgatttagtattaacagaggagaaatactatgtcagatatcaacctggcggcagcgcaaaagatg

SEQ ID NO: 44909 - DNA, 103 bp, Artificial Sequence
  Synthetic Polynucleotide
taatacgactcactatagggatagattttataacatcgatatctgatttaaacagaggagataaatcatgtatcgatgtaacctggcggcagcgcaaaagatg

SEQ ID NO: 44910 - DNA, 103 bp, Artificial Sequence
  Synthetic Polynucleotide
taatacgactcactatagggaggatatagattttataacatcgatatctgaacagaggagacagataatgatgttataaaacctggcggcagcgcaaaagatg

SEQ ID NO: 44911 - DNA, 103 bp, Artificial Sequence
  Synthetic Polynucleotide
taatacgactcactataggggatcgaggatatagattttataacatcgataacagaggagaatcgatatgataaaatctaacctggcggcagcgcaaaagatg

SEQ ID NO: 44912 - DNA, 103 bp, Artificial Sequence
  Synthetic Polynucleotide
taatacgactcactatagggccaaagatcgaggatatagattttataacaaacagaggagatgttatatgatctatatcaacctggcggcagcgcaaaagatg

SEQ ID NO: 44913 - DNA, 103 bp, Artificial Sequence
  Synthetic Polynucleotide
taatacgactcactatagggaatatccaaagatcgaggatatagattttaaacagaggagataaaatatgtatcctcgaaacctggcggcagcgcaaaagatg

SEQ ID NO: 44914 - DNA, 103 bp, Artificial Sequence
  Synthetic Polynucleotide
taatacgactcactataggggttagaatatccaaagatcgaggatatagaaacagaggagatctataatgtcgatctttaacctggcggcagcgcaaaagatg

SEQ ID NO: 44915 - DNA, 103 bp, Artificial Sequence
  Synthetic Polynucleotide
taatacgactcactatagggcattgtaataatgtcgaggtcgtcaaactaaacagaggagatagtttatggacctcgacaacctggcggcagcgcaaaagatg

SEQ ID NO: 44916 - DNA, 103 bp, Artificial Sequence
  Synthetic Polynucleotide
taatacgactcactatagggttttcgttagaatatccaaagatcgaggataacagaggagaatcctcatgctttggataaacctggcggcagcgcaaaagatg

SEQ ID NO: 44917 - DNA, 103 bp, Artificial Sequence
  Synthetic Polynucleotide
taatacgactcactatagggtacagttttcgttagaatatccaaagatcgaacagaggagacgatctatggatattctaaacctggcggcagcgcaaaagatg

SEQ ID NO: 44918 - DNA, 103 bp, Artificial Sequence
  Synthetic Polynucleotide
taatacgactcactatagggcgtgttacagttttcgttagaatatccaaaaacagaggagatttggaatgtctaacgaaaacctggcggcagcgcaaaagatg

SEQ ID NO: 44919 - DNA, 103 bp, Artificial Sequence
  Synthetic Polynucleotide
taatacgactcactatagggactatcgtgttacagttttcgttagaatataacagaggagaatattcatgcgaaaactgaacctggcggcagcgcaaaagatg

SEQ ID NO: 44920 - DNA, 103 bp, Artificial Sequence
  Synthetic Polynucleotide
taatacgactcactatagggcaaacactatcgtgttacagttttcgttagaacagaggagactaacgatgactgtaacaaacctggcggcagcgcaaaagatg

SEQ ID NO: 44921 - DNA, 103 bp, Artificial Sequence
  Synthetic Polynucleotide
taatacgactcactataggggatgccaaacactatcgtgttacagttttcaacagaggagagaaaacatgaacacgataaacctggcggcagcgcaaaagatg

SEQ ID NO: 44922 - DNA, 103 bp, Artificial Sequence
  Synthetic Polynucleotide
taatacgactcactatagggttatagatgccaaacactatcgtgttacagaacagaggagactgtaaatggatagtgttaacctggcggcagcgcaaaagatg

SEQ ID NO: 44923 - DNA, 103 bp, Artificial Sequence
  Synthetic Polynucleotide
taatacgactcactatagggtatccttatagatgccaaacactatcgtgtaacagaggagaacacgaatgtgtttggcaaacctggcggcagcgcaaaagatg

SEQ ID NO: 44924 - DNA, 103 bp, Artificial Sequence
  Synthetic Polynucleotide
taatacgactcactatagggtaaattatccttatagatgccaaacactataacagaggagaatagtgatgggcatctataacctggcggcagcgcaaaagatg

SEQ ID NO: 44925 - DNA, 103 bp, Artificial Sequence
  Synthetic Polynucleotide
taatacgactcactatagggagtagtaaattatccttatagatgccaaacaacagaggagagtttggatgctataaggaaacctggcggcagcgcaaaagatg

SEQ ID NO: 44926 - DNA, 103 bp, Artificial Sequence
  Synthetic Polynucleotide
taatacgactcactatagggatgagcattgtaataatgtcgaggtcgtcaaacagaggagatgacgaatgcgacattataacctggcggcagcgcaaaagatg

SEQ ID NO: 44927 - DNA, 103 bp, Artificial Sequence
  Synthetic Polynucleotide
taatacgactcactatagggtactcagtagtaaattatccttatagatgcaacagaggagagcatctatgaggataattaacctggcggcagcgcaaaagatg

SEQ ID NO: 44928 - DNA, 103 bp, Artificial Sequence
  Synthetic Polynucleotide
taatacgactcactatagggatttatactcagtagtaaattatccttataaacagaggagatataagatgaatttactaaacctggcggcagcgcaaaagatg

SEQ ID NO: 44929 - DNA, 103 bp, Artificial Sequence
  Synthetic Polynucleotide
taatacgactcactataggggaactatttatactcagtagtaaattatccaacagaggagaggataaatgactactgagaacctggcggcagcgcaaaagatg

SEQ ID NO: 44930 - DNA, 103 bp, Artificial Sequence
  Synthetic Polynucleotide
taatacgactcactatagggaaaatgaactatttatactcagtagtaaataacagaggagaatttacatgtgagtataaaacctggcggcagcgcaaaagatg

SEQ ID NO: 44931 - DNA, 103 bp, Artificial Sequence
  Synthetic Polynucleotide
taatacgactcactatagggaaagtaaaatgaactatttatactcagtagaacagaggagactactgatgataaatagtaacctggcggcagcgcaaaagatg

SEQ ID NO: 44932 - DNA, 103 bp, Artificial Sequence
  Synthetic Polynucleotide
taatacgactcactatagggttgttaaagtaaaatgaactatttatactcaacagaggagagagtatatgtagttcattaacctggcggcagcgcaaaagatg

SEQ ID NO: 44933 - DNA, 103 bp, Artificial Sequence
  Synthetic Polynucleotide
taatacgactcactataggggactattgttaaagtaaaatgaactatttaaacagaggagataaataatgcattttactaacctggcggcagcgcaaaagatg

SEQ ID NO: 44934 - DNA, 103 bp, Artificial Sequence
  Synthetic Polynucleotide
taatacgactcactatagggtaacagactattgttaaagtaaaatgaactaacagaggagaagttcaatgtactttaacaacctggcggcagcgcaaaagatg

SEQ ID NO: 44935 - DNA, 103 bp, Artificial Sequence
  Synthetic Polynucleotide
taatacgactcactataggggttattaacagactattgttaaagtaaaataacagaggagaattttaatgtaacaatagaacctggcggcagcgcaaaagatg

SEQ ID NO: 44936 - DNA, 103 bp, Artificial Sequence
  Synthetic Polynucleotide
taatacgactcactatagggtattggttattaacagactattgttaaagtaacagaggagaactttaatgatagtctgtaacctggcggcagcgcaaaagatg

SEQ ID NO: 44937 - DNA, 103 bp, Artificial Sequence
  Synthetic Polynucleotide
taatacgactcactatagggttttaatgagcattgtaataatgtcgaggtaacagaggagaacctcgatgttattacaaaacctggcggcagcgcaaaagatg

SEQ ID NO: 44938 - DNA, 103 bp, Artificial Sequence
  Synthetic Polynucleotide
taatacgactcactatagggtttagtattggttattaacagactattgttaacagaggagaaacaatatgctgttaataaacctggcggcagcgcaaaagatg

SEQ ID NO: 44939 - DNA, 103 bp, Artificial Sequence
  Synthetic Polynucleotide
taatacgactcactatagggtcacttttagtattggttattaacagactaaacagaggagatagtctatgaataaccaaaacctggcggcagcgcaaaagatg

SEQ ID NO: 44940 - DNA, 103 bp, Artificial Sequence
  Synthetic Polynucleotide
taatacgactcactatagggtattatcacttttagtattggttattaacaaacagaggagatgttaaatgccaatactaaacctggcggcagcgcaaaagatg

SEQ ID NO: 44941 - DNA, 103 bp, Artificial Sequence
  Synthetic Polynucleotide
taatacgactcactatagggtattatattatcacttttagtattggttataacagaggagaataaccatgactaaaagtaacctggcggcagcgcaaaagatg

SEQ ID NO: 44942 - DNA, 103 bp, Artificial Sequence
  Synthetic Polynucleotide
taatacgactcactatagggatatttattatattatcacttttagtattgaacagaggagacaatacatgaagtgataaaacctggcggcagcgcaaaagatg

SEQ ID NO: 44943 - DNA, 103 bp, Artificial Sequence
  Synthetic Polynucleotide
taatacgactcactatagggaacctatatttattatattatcacttttagaacagaggagactaaaaatgataatataaaacctggcggcagcgcaaaagatg

SEQ ID NO: 44944 - DNA, 103 bp, Artificial Sequence
  Synthetic Polynucleotide
taatacgactcactatagggctagtaacctatatttattatattatcactaacagaggagaagtgatatgataataaataacctggcggcagcgcaaaagatg

SEQ ID NO: 44945 - DNA, 103 bp, Artificial Sequence
  Synthetic Polynucleotide
taatacgactcactatagggttaatctagtaacctatatttattatattaaacagaggagataatatatgaaatataggaacctggcggcagcgcaaaagatg

SEQ ID NO: 44946 - DNA, 103 bp, Artificial Sequence
  Synthetic Polynucleotide
taatacgactcactatagggcatttttaatctagtaacctatatttattaaacagaggagataataaatgtaggttactaacctggcggcagcgcaaaagatg

SEQ ID NO: 44947 - DNA, 103 bp, Artificial Sequence
  Synthetic Polynucleotide
taatacgactcactatagggaaaaccatttttaatctagtaacctatattaacagaggagaaatataatgtactagattaacctggcggcagcgcaaaagatg

SEQ ID NO: 44948 - DNA, 103 bp, Artificial Sequence
  Synthetic Polynucleotide
taatacgactcactatagggtacctttttaatgagcattgtaataatgtcaacagaggagagacattatgacaatgctcaacctggcggcagcgcaaaagatg

SEQ ID NO: 44949 - DNA, 103 bp, Artificial Sequence
  Synthetic Polynucleotide
taatacgactcactatagggcttggaaaaccatttttaatctagtaacctaacagaggagaaggttaatggattaaaaaaacctggcggcagcgcaaaagatg

SEQ ID NO: 44950 - DNA, 103 bp, Artificial Sequence
  Synthetic Polynucleotide
taatacgactcactatagggcactacttggaaaaccatttttaatctagtaacagaggagaactagaatgaaaatggttaacctggcggcagcgcaaaagatg

SEQ ID NO: 44951 - DNA, 103 bp, Artificial Sequence
  Synthetic Polynucleotide
taatacgactcactataggggagcacactacttggaaaaccatttttaataacagaggagaattaaaatgggttttccaaacctggcggcagcgcaaaagatg

SEQ ID NO: 44952 - DNA, 103 bp, Artificial Sequence
  Synthetic Polynucleotide
taatacgactcactatagggatgtagagcacactacttggaaaaccatttaacagaggagaaaatggatgtccaagtagaacctggcggcagcgcaaaagatg

SEQ ID NO: 44953 - DNA, 103 bp, Artificial Sequence
  Synthetic Polynucleotide
taatacgactcactatagggaccgcatgtagagcacactacttggaaaacaacagaggagagttttcatggtagtgtgcaacctggcggcagcgcaaaagatg

SEQ ID NO: 44954 - DNA, 103 bp, Artificial Sequence
  Synthetic Polynucleotide
taatacgactcactatagggtctttaccgcatgtagagcacactacttggaacagaggagaccaagtatggtgctctacaacctggcggcagcgcaaaagatg

SEQ ID NO: 44955 - DNA, 103 bp, Artificial Sequence
  Synthetic Polynucleotide
taatacgactcactatagggaaatatctttaccgcatgtagagcacactaaacagaggagatagtgtatgctacatgcgaacctggcggcagcgcaaaagatg

SEQ ID NO: 44956 - DNA, 103 bp, Artificial Sequence
  Synthetic Polynucleotide
taatacgactcactataggggtgagaaatatctttaccgcatgtagagcaaacagaggagatgctctatgtgcggtaaaaacctggcggcagcgcaaaagatg

SEQ ID NO: 44957 - DNA, 103 bp, Artificial Sequence
  Synthetic Polynucleotide
taatacgactcactatagggcgttcgtgagaaatatctttaccgcatgtaaacagaggagatacatgatgtaaagatataacctggcggcagcgcaaaagatg

SEQ ID NO: 44958 - DNA, 103 bp, Artificial Sequence
  Synthetic Polynucleotide
taatacgactcactatagggtatatcgttcgtgagaaatatctttaccgcaacagaggagagcggtaatgatatttctcaacctggcggcagcgcaaaagatg

SEQ ID NO: 44959 - DNA, 103 bp, Artificial Sequence
  Synthetic Polynucleotide
taatacgactcactatagggatgcatacctttttaatgagcattgtaataaacagaggagatattacatggctcattaaaacctggcggcagcgcaaaagatg

SEQ ID NO: 44960 - DNA, 103 bp, Artificial Sequence
  Synthetic Polynucleotide
taatacgactcactatagggcaatttatatcgttcgtgagaaatatctttaacagaggagaaaagatatgtctcacgaaaacctggcggcagcgcaaaagatg

SEQ ID NO: 44961 - DNA, 103 bp, Artificial Sequence
  Synthetic Polynucleotide
taatacgactcactatagggataatcaatttatatcgttcgtgagaaataaacagaggagatatttcatgcgaacgataaacctggcggcagcgcaaaagatg

SEQ ID NO: 44962 - DNA, 103 bp, Artificial Sequence
  Synthetic Polynucleotide
taatacgactcactatagggttcgtataatcaatttatatcgttcgtgagaacagaggagactcacgatggatataaataacctggcggcagcgcaaaagatg

SEQ ID NO: 44963 - DNA, 103 bp, Artificial Sequence
  Synthetic Polynucleotide
taatacgactcactatagggtttttttcgtataatcaatttatatcgttcaacagaggagagaacgaatgaaattgattaacctggcggcagcgcaaaagatg

SEQ ID NO: 44964 - DNA, 103 bp, Artificial Sequence
  Synthetic Polynucleotide
taatacgactcactatagggaatgatttttttcgtataatcaatttatataacagaggagaatataaatggattatacgaacctggcggcagcgcaaaagatg

SEQ ID NO: 44965 - DNA, 103 bp, Artificial Sequence
  Synthetic Polynucleotide
taatacgactcactatagggcctttaatgatttttttcgtataatcaattaacagaggagaaattgaatgtacgaaaaaaacctggcggcagcgcaaaagatg

SEQ ID NO: 44966 - DNA, 103 bp, Artificial Sequence
  Synthetic Polynucleotide
taatacgactcactatagggtacatcctttaatgatttttttcgtataataacagaggagaattataatgaaaaaatcaaacctggcggcagcgcaaaagatg

SEQ ID NO: 44967 - DNA, 103 bp, Artificial Sequence
  Synthetic Polynucleotide
taatacgactcactatagggacgagtacatcctttaatgatttttttcgtaacagaggagaacgaaaatgatcattaaaaacctggcggcagcgcaaaagatg

SEQ ID NO: 44968 - DNA, 103 bp, Artificial Sequence
  Synthetic Polynucleotide
taatacgactcactatagggcactaacgagtacatcctttaatgatttttaacagaggagaaaaaatatgtaaaggatgaacctggcggcagcgcaaaagatg

SEQ ID NO: 44969 - DNA, 103 bp, Artificial Sequence
  Synthetic Polynucleotide
taatacgactcactatagggctttacactaacgagtacatcctttaatgaaacagaggagatcattaatggatgtactcaacctggcggcagcgcaaaagatg

SEQ ID NO: 44970 - DNA, 103 bp, Artificial Sequence
  Synthetic Polynucleotide
taatacgactcactatagggtttacatgcatacctttttaatgagcattgaacagaggagacaatgcatgttaaaaaggaacctggcggcagcgcaaaagatg

SEQ ID NO: 44971 - DNA, 103 bp, Artificial Sequence
  Synthetic Polynucleotide
taatacgactcactatagggttgttctttacactaacgagtacatcctttaacagaggagaaaaggaatgactcgttagaacctggcggcagcgcaaaagatg

SEQ ID NO: 44972 - DNA, 103 bp, Artificial Sequence
  Synthetic Polynucleotide
taatacgactcactatagggaacatttgttctttacactaacgagtacataacagaggagaatgtacatgttagtgtaaaacctggcggcagcgcaaaagatg

SEQ ID NO: 44973 - DNA, 103 bp, Artificial Sequence
  Synthetic Polynucleotide
taatacgactcactatagggcctacaacatttgttctttacactaacgagaacagaggagactcgttatggtaaagaacaacctggcggcagcgcaaaagatg

SEQ ID NO: 44974 - DNA, 103 bp, Artificial Sequence
  Synthetic Polynucleotide
taatacgactcactatagggtttaacctacaacatttgttctttacactaaacagaggagatagtgtatggaacaaatgaacctggcggcagcgcaaaagatg

SEQ ID NO: 44975 - DNA, 103 bp, Artificial Sequence
  Synthetic Polynucleotide
taatacgactcactatagggataattttaacctacaacatttgttctttaaacagaggagataaagaatgaatgttgtaaacctggcggcagcgcaaaagatg

SEQ ID NO: 44976 - DNA, 103 bp, Artificial Sequence
  Synthetic Polynucleotide
taatacgactcactatagggtgtagataattttaacctacaacatttgttaacagaggagaaacaaaatgtgtaggttaaacctggcggcagcgcaaaagatg

SEQ ID NO: 44977 - DNA, 103 bp, Artificial Sequence
  Synthetic Polynucleotide
taatacgactcactatagggatttgtgtagataattttaacctacaacataacagaggagaatgttgatggttaaaattaacctggcggcagcgcaaaagatg

SEQ ID NO: 44978 - DNA, 103 bp, Artificial Sequence
  Synthetic Polynucleotide
taatacgactcactataggggttctatttgtgtagataattttaacctacaacagaggagagtaggtatgaattatctaaacctggcggcagcgcaaaagatg

SEQ ID NO: 44979 - DNA, 103 bp, Artificial Sequence
  Synthetic Polynucleotide
taatacgactcactatagggttgaggttctatttgtgtagataattttaaaacagaggagattaaaaatgtctacacaaaacctggcggcagcgcaaaagatg

SEQ ID NO: 44980 - DNA, 103 bp, Artificial Sequence
  Synthetic Polynucleotide
taatacgactcactatagggttacgttgaggttctatttgtgtagataataacagaggagaattatcatgacaaatagaaacctggcggcagcgcaaaagatg

SEQ ID NO: 44981 - DNA, 103 bp, Artificial Sequence
  Synthetic Polynucleotide
taatacgactcactatagggaatgctttacatgcatacctttttaatgagaacagaggagactcattatgaaggtatgcaacctggcggcagcgcaaaagatg

SEQ ID NO: 44982 - DNA, 103 bp, Artificial Sequence
  Synthetic Polynucleotide
taatacgactcactatagggttaagttacgttgaggttctatttgtgtagaacagaggagactacacatgtagaacctcaacctggcggcagcgcaaaagatg

SEQ ID NO: 44983 - DNA, 103 bp, Artificial Sequence
  Synthetic Polynucleotide
taatacgactcactatagggcactgttaagttacgttgaggttctatttgaacagaggagacaaataatgcctcaacgtaacctggcggcagcgcaaaagatg

SEQ ID NO: 44984 - DNA, 103 bp, Artificial Sequence
  Synthetic Polynucleotide
taatacgactcactatagggggttgcactgttaagttacgttgaggttctaacagaggagaagaaccatgacgtaacttaacctggcggcagcgcaaaagatg

SEQ ID NO: 44985 - DNA, 103 bp, Artificial Sequence
  Synthetic Polynucleotide
taatacgactcactatagggatagaggttgcactgttaagttacgttgagaacagaggagactcaacatgacttaacagaacctggcggcagcgcaaaagatg

SEQ ID NO: 44986 - DNA, 103 bp, Artificial Sequence
  Synthetic Polynucleotide
taatacgactcactatagggatccaatagaggttgcactgttaagttacgaacagaggagacgtaacatgacagtgcaaaacctggcggcagcgcaaaagatg

SEQ ID NO: 44987 - DNA, 103 bp, Artificial Sequence
  Synthetic Polynucleotide
taatacgactcactatagggtttatatccaatagaggttgcactgttaagaacagaggagacttaacatggcaacctctaacctggcggcagcgcaaaagatg

SEQ ID NO: 44988 - DNA, 103 bp, Artificial Sequence
  Synthetic Polynucleotide
taatacgactcactatagggattagtttatatccaatagaggttgcactgaacagaggagacagtgcatgctctattggaacctggcggcagcgcaaaagatg

SEQ ID NO: 44989 - DNA, 103 bp, Artificial Sequence
  Synthetic Polynucleotide
taatacgactcactatagggtccatattagtttatatccaatagaggttgaacagaggagacaacctatgttggatataaacctggcggcagcgcaaaagatg

SEQ ID NO: 44990 - DNA, 103 bp, Artificial Sequence
  Synthetic Polynucleotide
taatacgactcactatagggccggatccatattagtttatatccaatagaaacagaggagatctattatgtataaactaaacctggcggcagcgcaaaagatg

SEQ ID NO: 44991 - DNA, 103 bp, Artificial Sequence
  Synthetic Polynucleotide
taatacgactcactatagggattaaccggatccatattagtttatatccaaacagaggagatggataatgactaatatgaacctggcggcagcgcaaaagatg

SEQ ID NO: 44992 - DNA, 103 bp, Artificial Sequence
  Synthetic Polynucleotide
taatacgactcactatagggagaataatgctttacatgcatacctttttaaacagaggagataaaaaatgatgcatgtaaacctggcggcagcgcaaaagatg

SEQ ID NO: 44993 - DNA, 103 bp, Artificial Sequence
  Synthetic Polynucleotide
taatacgactcactatagggataaaattaaccggatccatattagtttataacagaggagaataaacatgtatggatccaacctggcggcagcgcaaaagatg

SEQ ID NO: 44994 - DNA, 103 bp, Artificial Sequence
  Synthetic Polynucleotide
taatacgactcactatagggtcttgataaaattaaccggatccatattagaacagaggagactaataatgatccggttaaacctggcggcagcgcaaaagatg

SEQ ID NO: 44995 - DNA, 103 bp, Artificial Sequence
  Synthetic Polynucleotide
taatacgactcactatagggatatgtcttgataaaattaaccggatccataacagaggagaatggatatggttaattttaacctggcggcagcgcaaaagatg

SEQ ID NO: 44996 - DNA, 103 bp, Artificial Sequence
  Synthetic Polynucleotide
taatacgactcactatagggggtgcatatgtcttgataaaattaaccggaaacagaggagatccggtatgttttatcaaaacctggcggcagcgcaaaagatg

SEQ ID NO: 44997 - DNA, 103 bp, Artificial Sequence
  Synthetic Polynucleotide
taatacgactcactatagggctctaggtgcatatgtcttgataaaattaaaacagaggagattaattatgtcaagacataacctggcggcagcgcaaaagatg

SEQ ID NO: 44998 - DNA, 103 bp, Artificial Sequence
  Synthetic Polynucleotide
taatacgactcactatagggagaacctctaggtgcatatgtcttgataaaaacagaggagatttatcatgacatatgcaaacctggcggcagcgcaaaagatg

SEQ ID NO: 44999 - DNA, 103 bp, Artificial Sequence
  Synthetic Polynucleotide
taatacgactcactatagggataatagaacctctaggtgcatatgtcttgaacagaggagacaagacatgtgcacctagaacctggcggcagcgcaaaagatg

SEQ ID NO: 45000 - DNA, 103 bp, Artificial Sequence
  Synthetic Polynucleotide
taatacgactcactatagggtaaaaataatagaacctctaggtgcatatgaacagaggagacatatgatgctagaggttaacctggcggcagcgcaaaagatg

SEQ ID NO: 45001 - DNA, 103 bp, Artificial Sequence
  Synthetic Polynucleotide
taatacgactcactatagggattaataaaaataatagaacctctaggtgcaacagaggagagcacctatgggttctattaacctggcggcagcgcaaaagatg

SEQ ID NO: 45002 - DNA, 103 bp, Artificial Sequence
  Synthetic Polynucleotide
taatacgactcactataggggtataattaataaaaataatagaacctctaaacagaggagatagaggatgtattattttaacctggcggcagcgcaaaagatg

SEQ ID NO: 45003 - DNA, 103 bp, Artificial Sequence
  Synthetic Polynucleotide
taatacgactcactatagggattcaagaataatgctttacatgcatacctaacagaggagaaggtatatgtgtaaagcaaacctggcggcagcgcaaaagatg

SEQ ID NO: 45004 - DNA, 103 bp, Artificial Sequence
  Synthetic Polynucleotide
taatacgactcactatagggacatagtataattaataaaaataatagaacaacagaggagagttctaatgtttttattaaacctggcggcagcgcaaaagatg

SEQ ID NO: 45005 - DNA, 103 bp, Artificial Sequence
  Synthetic Polynucleotide
taatacgactcactatagggtaatgacatagtataattaataaaaataataacagaggagaattattatgattaattataacctggcggcagcgcaaaagatg

SEQ ID NO: 45006 - DNA, 103 bp, Artificial Sequence
  Synthetic Polynucleotide
taatacgactcactatagggcttgttaatgacatagtataattaataaaaaacagaggagattttatatgttatactataacctggcggcagcgcaaaagatg

SEQ ID NO: 45007 - DNA, 103 bp, Artificial Sequence
  Synthetic Polynucleotide
taatacgactcactatagggaatgacttgttaatgacatagtataattaaaacagaggagattaattatgctatgtcataacctggcggcagcgcaaaagatg

SEQ ID NO: 45008 - DNA, 103 bp, Artificial Sequence
  Synthetic Polynucleotide
taatacgactcactatagggatttaaatgacttgttaatgacatagtataaacagaggagatatactatgtcattaacaaacctggcggcagcgcaaaagatg

SEQ ID NO: 45009 - DNA, 103 bp, Artificial Sequence
  Synthetic Polynucleotide
taatacgactcactataggggatggatttaaatgacttgttaatgacataaacagaggagatatgtcatgaacaagtcaaacctggcggcagcgcaaaagatg

SEQ ID NO: 45010 - DNA, 103 bp, Artificial Sequence
  Synthetic Polynucleotide
taatacgactcactatagggctatcgatggatttaaatgacttgttaatgaacagaggagacattaaatggtcatttaaaacctggcggcagcgcaaaagatg

SEQ ID NO: 45011 - DNA, 103 bp, Artificial Sequence
  Synthetic Polynucleotide
taatacgactcactatagggtttttctatcgatggatttaaatgacttgtaacagaggagaacaagtatgttaaatccaaacctggcggcagcgcaaaagatg

SEQ ID NO: 45012 - DNA, 103 bp, Artificial Sequence
  Synthetic Polynucleotide
taatacgactcactatagggacatgtttttctatcgatggatttaaatgaaacagaggagatcatttatgtccatcgataacctggcggcagcgcaaaagatg

SEQ ID NO: 45013 - DNA, 103 bp, Artificial Sequence
  Synthetic Polynucleotide
taatacgactcactatagggtacccacatgtttttctatcgatggatttaaacagaggagataaatcatgcgatagaaaaacctggcggcagcgcaaaagatg

SEQ ID NO: 45014 - DNA, 103 bp, Artificial Sequence
  Synthetic Polynucleotide
taatacgactcactatagggagagaaagcgcagggtctctttacaggcttaacagaggagaaagcctatgaagagacccaacctggcggcagcgcaaaagatg

SEQ ID NO: 45015 - DNA, 103 bp, Artificial Sequence
  Synthetic Polynucleotide
taatacgactcactatagggaaccaattcaagaataatgctttacatgcaaacagaggagatgcatgatgagcattattaacctggcggcagcgcaaaagatg

SEQ ID NO: 45016 - DNA, 103 bp, Artificial Sequence
  Synthetic Polynucleotide
taatacgactcactatagggataaatacccacatgtttttctatcgatggaacagaggagaccatcgatggaaaaacataacctggcggcagcgcaaaagatg

SEQ ID NO: 45017 - DNA, 103 bp, Artificial Sequence
  Synthetic Polynucleotide
taatacgactcactatagggccataataaatacccacatgtttttctatcaacagaggagagatagaatgacatgtgggaacctggcggcagcgcaaaagatg

SEQ ID NO: 45018 - DNA, 103 bp, Artificial Sequence
  Synthetic Polynucleotide
taatacgactcactatagggacgtaccataataaatacccacatgtttttaacagaggagaaaaaacatgtgggtatttaacctggcggcagcgcaaaagatg

SEQ ID NO: 45019 - DNA, 103 bp, Artificial Sequence
  Synthetic Polynucleotide
taatacgactcactatagggtaataacgtaccataataaatacccacatgaacagaggagacatgtgatgatttattataacctggcggcagcgcaaaagatg

SEQ ID NO: 45020 - DNA, 103 bp, Artificial Sequence
  Synthetic Polynucleotide
taatacgactcactatagggtccgataataacgtaccataataaatacccaacagaggagagggtatatgttatggtacaacctggcggcagcgcaaaagatg

SEQ ID NO: 45021 - DNA, 103 bp, Artificial Sequence
  Synthetic Polynucleotide
taatacgactcactatagggagtgttccgataataacgtaccataataaaaacagaggagatttattatggtacgttataacctggcggcagcgcaaaagatg

SEQ ID NO: 45022 - DNA, 103 bp, Artificial Sequence
  Synthetic Polynucleotide
taatacgactcactatagggtaccaagtgttccgataataacgtaccataaacagaggagatatggtatgttattatcgaacctggcggcagcgcaaaagatg

SEQ ID NO: 45023 - DNA, 103 bp, Artificial Sequence
  Synthetic Polynucleotide
taatacgactcactatagggtcaactaccaagtgttccgataataacgtaaacagaggagatacgttatgatcggaacaaacctggcggcagcgcaaaagatg

SEQ ID NO: 45024 - DNA, 103 bp, Artificial Sequence
  Synthetic Polynucleotide
taatacgactcactatagggttgattcaactaccaagtgttccgataataaacagaggagatattatatgaacacttggaacctggcggcagcgcaaaagatg

SEQ ID NO: 45025 - DNA, 103 bp, Artificial Sequence
  Synthetic Polynucleotide
taatacgactcactatagggatatgttgattcaactaccaagtgttccgaaacagaggagatcggaaatgttggtagttaacctggcggcagcgcaaaagatg

SEQ ID NO: 45026 - DNA, 103 bp, Artificial Sequence
  Synthetic Polynucleotide
taatacgactcactatagggccaggaaccaattcaagaataatgctttacaacagaggagagtaaagatgtattcttgaaacctggcggcagcgcaaaagatg

SEQ ID NO: 45027 - DNA, 103 bp, Artificial Sequence
  Synthetic Polynucleotide
taatacgactcactatagggtttctatatgttgattcaactaccaagtgtaacagaggagaacacttatgagttgaatcaacctggcggcagcgcaaaagatg

SEQ ID NO: 45028 - DNA, 103 bp, Artificial Sequence
  Synthetic Polynucleotide
taatacgactcactatagggctccttttctatatgttgattcaactaccaaacagaggagatggtagatgaatcaacataacctggcggcagcgcaaaagatg

SEQ ID NO: 45029 - DNA, 103 bp, Artificial Sequence
  Synthetic Polynucleotide
taatacgactcactatagggttgaactccttttctatatgttgattcaacaacagaggagagttgaaatgacatatagaaacctggcggcagcgcaaaagatg

SEQ ID NO: 45030 - DNA, 103 bp, Artificial Sequence
  Synthetic Polynucleotide
taatacgactcactatagggactatttgaactccttttctatatgttgataacagaggagaatcaacatgtagaaaaggaacctggcggcagcgcaaaagatg

SEQ ID NO: 45031 - DNA, 103 bp, Artificial Sequence
  Synthetic Polynucleotide
taatacgactcactatagggatgggactatttgaactccttttctatatgaacagaggagacatataatgaaggagttcaacctggcggcagcgcaaaagatg

SEQ ID NO: 45032 - DNA, 103 bp, Artificial Sequence
  Synthetic Polynucleotide
taatacgactcactatagggatccaatgggactatttgaactccttttctaacagaggagaagaaaaatggttcaaataaacctggcggcagcgcaaaagatg

SEQ ID NO: 45033 - DNA, 103 bp, Artificial Sequence
  Synthetic Polynucleotide
taatacgactcactatagggaaactatccaatgggactatttgaactcctaacagaggagaaggagtatgaatagtcccaacctggcggcagcgcaaaagatg

SEQ ID NO: 45034 - DNA, 103 bp, Artificial Sequence
  Synthetic Polynucleotide
taatacgactcactatagggcaaaaaaactatccaatgggactatttgaaaacagaggagattcaaaatgtcccattggaacctggcggcagcgcaaaagatg

SEQ ID NO: 45035 - DNA, 103 bp, Artificial Sequence
  Synthetic Polynucleotide
taatacgactcactatagggtccttcaaaaaaactatccaatgggactataacagaggagaatagtcatgttggatagtaacctggcggcagcgcaaaagatg

SEQ ID NO: 45036 - DNA, 103 bp, Artificial Sequence
  Synthetic Polynucleotide
taatacgactcactatagggagatatccttcaaaaaaactatccaatgggaacagaggagacccattatgtagttttttaacctggcggcagcgcaaaagatg

SEQ ID NO: 45037 - DNA, 103 bp, Artificial Sequence
  Synthetic Polynucleotide
taatacgactcactatagggtgataccaggaaccaattcaagaataatgcaacagaggagagcattaatgttgaattggaacctggcggcagcgcaaaagatg

SEQ ID NO: 45038 - DNA, 103 bp, Artificial Sequence
  Synthetic Polynucleotide
taatacgactcactatagggcactaagatatccttcaaaaaaactatccaaacagaggagatggataatgtttttgaagaacctggcggcagcgcaaaagatg

SEQ ID NO: 45039 - DNA, 103 bp, Artificial Sequence
  Synthetic Polynucleotide
taatacgactcactatagggttttgcactaagatatccttcaaaaaaactaacagaggagaagttttatggaaggatataacctggcggcagcgcaaaagatg

SEQ ID NO: 45040 - DNA, 103 bp, Artificial Sequence
  Synthetic Polynucleotide
taatacgactcactatagggtatacttttgcactaagatatccttcaaaaaacagaggagattttgaatgatatcttagaacctggcggcagcgcaaaagatg

SEQ ID NO: 45041 - DNA, 103 bp, Artificial Sequence
  Synthetic Polynucleotide
taatacgactcactatagggacatgtatacttttgcactaagatatccttaacagaggagaaaggatatgttagtgcaaaacctggcggcagcgcaaaagatg

SEQ ID NO: 45042 - DNA, 103 bp, Artificial Sequence
  Synthetic Polynucleotide
taatacgactcactatagggctctaacatgtatacttttgcactaagataaacagaggagatatcttatggcaaaagtaaacctggcggcagcgcaaaagatg

SEQ ID NO: 45043 - DNA, 103 bp, Artificial Sequence
  Synthetic Polynucleotide
taatacgactcactatagggatattctctaacatgtatacttttgcactaaacagaggagatagtgcatgagtatacataacctggcggcagcgcaaaagatg

SEQ ID NO: 45044 - DNA, 103 bp, Artificial Sequence
  Synthetic Polynucleotide
taatacgactcactatagggcttgaatattctctaacatgtatacttttgaacagaggagacaaaagatgacatgttagaacctggcggcagcgcaaaagatg

SEQ ID NO: 45045 - DNA, 103 bp, Artificial Sequence
  Synthetic Polynucleotide
taatacgactcactatagggcataacttgaatattctctaacatgtatacaacagaggagagtatacatgttagagaataacctggcggcagcgcaaaagatg

SEQ ID NO: 45046 - DNA, 103 bp, Artificial Sequence
  Synthetic Polynucleotide
taatacgactcactatagggattttcataacttgaatattctctaacatgaacagaggagacatgttatggaatattcaaacctggcggcagcgcaaaagatg

SEQ ID NO: 45047 - DNA, 103 bp, Artificial Sequence
  Synthetic Polynucleotide
taatacgactcactatagggctgctattttcataacttgaatattctctaaacagaggagatagagaatgttcaagttaaacctggcggcagcgcaaaagatg

SEQ ID NO: 45048 - DNA, 103 bp, Artificial Sequence
  Synthetic Polynucleotide
taatacgactcactatagggcctaatgataccaggaaccaattcaagaataacagaggagaattcttatgttggttcctaacctggcggcagcgcaaaagatg

SEQ ID NO: 45049 - DNA, 103 bp, Artificial Sequence
  Synthetic Polynucleotide
taatacgactcactatagggatcagctgctattttcataacttgaatattaacagaggagaaatattatggttatgaaaaacctggcggcagcgcaaaagatg

SEQ ID NO: 45050 - DNA, 103 bp, Artificial Sequence
  Synthetic Polynucleotide
taatacgactcactataggggacgtatcagctgctattttcataacttgaaacagaggagatcaagtatggaaaatagcaacctggcggcagcgcaaaagatg

SEQ ID NO: 45051 - DNA, 103 bp, Artificial Sequence
  Synthetic Polynucleotide
taatacgactcactatagggttaatgacgtatcagctgctattttcataaaacagaggagattatgaatgtagcagctgaacctggcggcagcgcaaaagatg

SEQ ID NO: 45052 - DNA, 103 bp, Artificial Sequence
  Synthetic Polynucleotide
taatacgactcactatagggtaaagttaatgacgtatcagctgctattttaacagaggagaaaaataatggctgatacgaacctggcggcagcgcaaaagatg

SEQ ID NO: 45053 - DNA, 103 bp, Artificial Sequence
  Synthetic Polynucleotide
taatacgactcactatagggcccagtaaagttaatgacgtatcagctgctaacagaggagaagcagcatgtacgtcattaacctggcggcagcgcaaaagatg

SEQ ID NO: 45054 - DNA, 103 bp, Artificial Sequence
  Synthetic Polynucleotide
taatacgactcactataggggaatacccagtaaagttaatgacgtatcagaacagaggagactgataatgcattaacttaacctggcggcagcgcaaaagatg

SEQ ID NO: 45055 - DNA, 103 bp, Artificial Sequence
  Synthetic Polynucleotide
taatacgactcactatagggatatggaatacccagtaaagttaatgacgtaacagaggagaacgtcaatgactttactgaacctggcggcagcgcaaaagatg

SEQ ID NO: 45056 - DNA, 103 bp, Artificial Sequence
  Synthetic Polynucleotide
taatacgactcactatagggaatccatatggaatacccagtaaagttaataacagaggagaattaacatgactgggtataacctggcggcagcgcaaaagatg

SEQ ID NO: 45057 - DNA, 103 bp, Artificial Sequence
  Synthetic Polynucleotide
taatacgactcactataggggaccaaatccatatggaatacccagtaaagaacagaggagactttacatggtattccataacctggcggcagcgcaaaagatg

SEQ ID NO: 45058 - DNA, 103 bp, Artificial Sequence
  Synthetic Polynucleotide
taatacgactcactatagggattatgaccaaatccatatggaatacccagaacagaggagactgggtatgccatatggaaacctggcggcagcgcaaaagatg

SEQ ID NO: 45059 - DNA, 103 bp, Artificial Sequence
  Synthetic Polynucleotide
taatacgactcactataggggagatcctaatgataccaggaaccaattcaaacagaggagatgaattatgtcctggtataacctggcggcagcgcaaaagatg

SEQ ID NO: 45060 - DNA, 103 bp, Artificial Sequence
  Synthetic Polynucleotide
taatacgactcactatagggattctattatgaccaaatccatatggaataaacagaggagatattccatgtggatttggaacctggcggcagcgcaaaagatg

SEQ ID NO: 45061 - DNA, 103 bp, Artificial Sequence
  Synthetic Polynucleotide
taatacgactcactatagggaatacattctattatgaccaaatccatatgaacagaggagacatatgatgttggtcataaacctggcggcagcgcaaaagatg

SEQ ID NO: 45062 - DNA, 103 bp, Artificial Sequence
  Synthetic Polynucleotide
taatacgactcactatagggaaaacaatacattctattatgaccaaatccaacagaggagaggatttatgcataatagaaacctggcggcagcgcaaaagatg

SEQ ID NO: 45063 - DNA, 103 bp, Artificial Sequence
  Synthetic Polynucleotide
taatacgactcactatagggaatttaaaacaatacattctattatgaccaaacagaggagatggtcaatgtagaatgtaaacctggcggcagcgcaaaagatg

SEQ ID NO: 45064 - DNA, 103 bp, Artificial Sequence
  Synthetic Polynucleotide
taatacgactcactatagggctaccaatttaaaacaatacattctattataacagaggagaataataatgtgtattgttaacctggcggcagcgcaaaagatg

SEQ ID NO: 45065 - DNA, 103 bp, Artificial Sequence
  Synthetic Polynucleotide
taatacgactcactatagggttcagctaccaatttaaaacaatacattctaacagaggagaagaatgatgtgttttaaaaacctggcggcagcgcaaaagatg

SEQ ID NO: 45066 - DNA, 103 bp, Artificial Sequence
  Synthetic Polynucleotide
taatacgactcactatagggtaacattcagctaccaatttaaaacaatacaacagaggagagtattgatgtaaattggtaacctggcggcagcgcaaaagatg

SEQ ID NO: 45067 - DNA, 103 bp, Artificial Sequence
  Synthetic Polynucleotide
taatacgactcactatagggttttataacattcagctaccaatttaaaacaacagaggagagttttaatgtggtagctgaacctggcggcagcgcaaaagatg

SEQ ID NO: 45068 - DNA, 103 bp, Artificial Sequence
  Synthetic Polynucleotide
taatacgactcactatagggggcatttttataacattcagctaccaatttaacagaggagaaaattgatggctgaatgtaacctggcggcagcgcaaaagatg

SEQ ID NO: 45069 - DNA, 103 bp, Artificial Sequence
  Synthetic Polynucleotide
taatacgactcactatagggataccggcatttttataacattcagctaccaacagaggagaggtagcatgatgttataaaacctggcggcagcgcaaaagatg

SEQ ID NO: 45070 - DNA, 103 bp, Artificial Sequence
  Synthetic Polynucleotide
taatacgactcactatagggagacagagatcctaatgataccaggaaccaaacagaggagatggttcatggtatcattaaacctggcggcagcgcaaaagatg

SEQ ID NO: 45071 - DNA, 103 bp, Artificial Sequence
  Synthetic Polynucleotide
taatacgactcactatagggtattaataccggcatttttataacattcagaacagaggagactgaatatgataaaaatgaacctggcggcagcgcaaaagatg

SEQ ID NO: 45072 - DNA, 103 bp, Artificial Sequence
  Synthetic Polynucleotide
taatacgactcactatagggtgatgtattaataccggcatttttataacaaacagaggagatgttatatgaatgccggtaacctggcggcagcgcaaaagatg

SEQ ID NO: 45073 - DNA, 103 bp, Artificial Sequence
  Synthetic Polynucleotide
taatacgactcactatagggttagatgatgtattaataccggcatttttaaacagaggagataaaaaatgcggtattaaaacctggcggcagcgcaaaagatg

SEQ ID NO: 45074 - DNA, 103 bp, Artificial Sequence
  Synthetic Polynucleotide
taatacgactcactatagggttcgtttagatgatgtattaataccggcataacagaggagaatgccgatgttaatacataacctggcggcagcgcaaaagatg

SEQ ID NO: 45075 - DNA, 103 bp, Artificial Sequence
  Synthetic Polynucleotide
taatacgactcactatagggcaatattcgtttagatgatgtattaataccaacagaggagaggtattatgacatcatctaacctggcggcagcgcaaaagatg

SEQ ID NO: 45076 - DNA, 103 bp, Artificial Sequence
  Synthetic Polynucleotide
taatacgactcactatagggttgcccaatattcgtttagatgatgtattaaacagaggagataatacatgatctaaacgaacctggcggcagcgcaaaagatg

SEQ ID NO: 45077 - DNA, 103 bp, Artificial Sequence
  Synthetic Polynucleotide
taatacgactcactatagggtatctttgcccaatattcgtttagatgatgaacagaggagacatcatatgaacgaatataacctggcggcagcgcaaaagatg

SEQ ID NO: 45078 - DNA, 103 bp, Artificial Sequence
  Synthetic Polynucleotide
taatacgactcactatagggaaaaatatctttgcccaatattcgtttagaaacagaggagatctaaaatgatattgggcaacctggcggcagcgcaaaagatg

SEQ ID NO: 45079 - DNA, 103 bp, Artificial Sequence
  Synthetic Polynucleotide
taatacgactcactatagggcttagaaaaatatctttgcccaatattcgtaacagaggagaacgaatatggggcaaagaaacctggcggcagcgcaaaagatg

SEQ ID NO: 45080 - DNA, 103 bp, Artificial Sequence
  Synthetic Polynucleotide
taatacgactcactatagggtttggcttagaaaaatatctttgcccaataaacagaggagatattggatgaagatatttaacctggcggcagcgcaaaagatg

SEQ ID NO: 45081 - DNA, 103 bp, Artificial Sequence
  Synthetic Polynucleotide
taatacgactcactatagggttgaaagacagagatcctaatgataccaggaacagaggagacctggtatgattaggatcaacctggcggcagcgcaaaagatg

SEQ ID NO: 45082 - DNA, 103 bp, Artificial Sequence
  Synthetic Polynucleotide
taatacgactcactataggggaagttttggcttagaaaaatatctttgccaacagaggagaggcaaaatgatttttctaaacctggcggcagcgcaaaagatg

SEQ ID NO: 45083 - DNA, 103 bp, Artificial Sequence
  Synthetic Polynucleotide
taatacgactcactatagggtctgtgaagttttggcttagaaaaatatctaacagaggagaagatatatgtctaagccaaacctggcggcagcgcaaaagatg

SEQ ID NO: 45084 - DNA, 103 bp, Artificial Sequence
  Synthetic Polynucleotide
taatacgactcactatagggtatcatctgtgaagttttggcttagaaaaaaacagaggagatttttcatggccaaaactaacctggcggcagcgcaaaagatg

SEQ ID NO: 45085 - DNA, 103 bp, Artificial Sequence
  Synthetic Polynucleotide
taatacgactcactatagggtctattatcatctgtgaagttttggcttagaacagaggagactaagcatgaacttcacaaacctggcggcagcgcaaaagatg

SEQ ID NO: 45086 - DNA, 103 bp, Artificial Sequence
  Synthetic Polynucleotide
taatacgactcactatagggatccatctattatcatctgtgaagttttggaacagaggagaccaaaaatgcacagatgaaacctggcggcagcgcaaaagatg

SEQ ID NO: 45087 - DNA, 103 bp, Artificial Sequence
  Synthetic Polynucleotide
taatacgactcactatagggtctttatccatctattatcatctgtgaagtaacagaggagaacttcaatgatgataataaacctggcggcagcgcaaaagatg

SEQ ID NO: 45088 - DNA, 103 bp, Artificial Sequence
  Synthetic Polynucleotide
taatacgactcactatagggatatatctttatccatctattatcatctgtaacagaggagaacagatatgaatagatggaacctggcggcagcgcaaaagatg

SEQ ID NO: 45089 - DNA, 103 bp, Artificial Sequence
  Synthetic Polynucleotide
taatacgactcactataggggaatcatatatctttatccatctattatcaaacagaggagatgataaatgatggataaaaacctggcggcagcgcaaaagatg

SEQ ID NO: 45090 - DNA, 103 bp, Artificial Sequence
  Synthetic Polynucleotide
taatacgactcactatagggtattagaatcatatatctttatccatctataacagaggagaatagatatgtaaagatataacctggcggcagcgcaaaagatg

SEQ ID NO: 45091 - DNA, 103 bp, Artificial Sequence
  Synthetic Polynucleotide
taatacgactcactatagggtaaattattagaatcatatatctttatccaaacagaggagatggataatgatatatgataacctggcggcagcgcaaaagatg

SEQ ID NO: 45092 - DNA, 103 bp, Artificial Sequence
  Synthetic Polynucleotide
taatacgactcactatagggagatgttgaaagacagagatcctaatgataaacagaggagatatcatatggatctctgtaacctggcggcagcgcaaaagatg

SEQ ID NO: 45093 - DNA, 103 bp, Artificial Sequence
  Synthetic Polynucleotide
taatacgactcactatagggaatgttaaattattagaatcatatatctttaacagaggagaaaagatatgtgattctaaaacctggcggcagcgcaaaagatg

SEQ ID NO: 45094 - DNA, 103 bp, Artificial Sequence
  Synthetic Polynucleotide
taatacgactcactataggggccaaaatgttaaattattagaatcatataaacagaggagatatatgatgctaataattaacctggcggcagcgcaaaagatg

SEQ ID NO: 45095 - DNA, 103 bp, Artificial Sequence
  Synthetic Polynucleotide
taatacgactcactatagggaatttgccaaaatgttaaattattagaatcaacagaggagagattctatgaatttaacaaacctggcggcagcgcaaaagatg

SEQ ID NO: 45096 - DNA, 103 bp, Artificial Sequence
  Synthetic Polynucleotide
taatacgactcactatagggtaatcaatttgccaaaatgttaaattattaaacagaggagataataaatgaacattttgaacctggcggcagcgcaaaagatg

SEQ ID NO: 45097 - DNA, 103 bp, Artificial Sequence
  Synthetic Polynucleotide
taatacgactcactatagggtaaggtaatcaatttgccaaaatgttaaataacagaggagaatttaaatgtttggcaaaaacctggcggcagcgcaaaagatg

SEQ ID NO: 45098 - DNA, 103 bp, Artificial Sequence
  Synthetic Polynucleotide
taatacgactcactatagggccctttaaggtaatcaatttgccaaaatgtaacagaggagaacatttatgcaaattgataacctggcggcagcgcaaaagatg

SEQ ID NO: 45099 - DNA, 103 bp, Artificial Sequence
  Synthetic Polynucleotide
taatacgactcactatagggactcaccctttaaggtaatcaatttgccaaaacagaggagattggcaatgtgattacctaacctggcggcagcgcaaaagatg

SEQ ID NO: 45100 - DNA, 103 bp, Artificial Sequence
  Synthetic Polynucleotide
taatacgactcactatagggtattaactcaccctttaaggtaatcaatttaacagaggagaaaattgatgaccttaaagaacctggcggcagcgcaaaagatg

SEQ ID NO: 45101 - DNA, 103 bp, Artificial Sequence
  Synthetic Polynucleotide
taatacgactcactatagggatgcatattaactcaccctttaaggtaatcaacagaggagagattacatgaaagggtgaaacctggcggcagcgcaaaagatg

SEQ ID NO: 45102 - DNA, 103 bp, Artificial Sequence
  Synthetic Polynucleotide
taatacgactcactatagggtagttatgcatattaactcaccctttaaggaacagaggagaccttaaatggtgagttaaaacctggcggcagcgcaaaagatg

SEQ ID NO: 45103 - DNA, 103 bp, Artificial Sequence
  Synthetic Polynucleotide
taatacgactcactatagggtaaacagatgttgaaagacagagatcctaaaacagaggagattaggaatgctgtctttcaacctggcggcagcgcaaaagatg

SEQ ID NO: 45104 - DNA, 103 bp, Artificial Sequence
  Synthetic Polynucleotide
taatacgactcactatagggaggagtagttatgcatattaactcacccttaacagaggagaaagggtatgttaatatgcaacctggcggcagcgcaaaagatg

SEQ ID NO: 45105 - DNA, 103 bp, Artificial Sequence
  Synthetic Polynucleotide
taatacgactcactatagggaacggaggagtagttatgcatattaactcaaacagaggagatgagttatgatgcataacaacctggcggcagcgcaaaagatg

SEQ ID NO: 45106 - DNA, 103 bp, Artificial Sequence
  Synthetic Polynucleotide
taatacgactcactatagggaaaacaacggaggagtagttatgcatattaaacagaggagataatatatgtaactactcaacctggcggcagcgcaaaagatg

SEQ ID NO: 45107 - DNA, 103 bp, Artificial Sequence
  Synthetic Polynucleotide
taatacgactcactataggggggaaaaaacaacggaggagtagttatgcaaacagaggagatgcataatgactcctccgaacctggcggcagcgcaaaagatg

SEQ ID NO: 45108 - DNA, 103 bp, Artificial Sequence
  Synthetic Polynucleotide
taatacgactcactatagggaacgagggaaaaaacaacggaggagtagttaacagaggagaaactacatgtccgttgttaacctggcggcagcgcaaaagatg

SEQ ID NO: 45109 - DNA, 103 bp, Artificial Sequence
  Synthetic Polynucleotide
taatacgactcactatagggaaaagaacgagggaaaaaacaacggaggagaacagaggagactcctcatgtgttttttcaacctggcggcagcgcaaaagatg

SEQ ID NO: 45110 - DNA, 103 bp, Artificial Sequence
  Synthetic Polynucleotide
taatacgactcactatagggtaagaaaaagaacgagggaaaaaacaacggaacagaggagaccgttgatgtttccctcgaacctggcggcagcgcaaaagatg

SEQ ID NO: 45111 - DNA, 103 bp, Artificial Sequence
  Synthetic Polynucleotide
taatacgactcactatagggaacgttaagaaaaagaacgagggaaaaaacaacagaggagagtttttatgctcgttcttaacctggcggcagcgcaaaagatg

SEQ ID NO: 45112 - DNA, 103 bp, Artificial Sequence
  Synthetic Polynucleotide
taatacgactcactatagggcaaacaacgttaagaaaaagaacgagggaaaacagaggagattccctatgtctttttctaacctggcggcagcgcaaaagatg

SEQ ID NO: 45113 - DNA, 103 bp, Artificial Sequence
  Synthetic Polynucleotide
taatacgactcactataggggatggcaaacaacgttaagaaaaagaacgaaacagaggagatcgttcatgttcttaacgaacctggcggcagcgcaaaagatg

SEQ ID NO: 45114 - DNA, 103 bp, Artificial Sequence
  Synthetic Polynucleotide
taatacgactcactataggggaacttaaacagatgttgaaagacagagataacagaggagaatctctatgtttcaacataacctggcggcagcgcaaaagatg

SEQ ID NO: 45115 - DNA, 103 bp, Artificial Sequence
  Synthetic Polynucleotide
taatacgactcactatagggagagtgatggcaaacaacgttaagaaaaagaacagaggagactttttatgaacgttgttaacctggcggcagcgcaaaagatg

SEQ ID NO: 45116 - DNA, 103 bp, Artificial Sequence
  Synthetic Polynucleotide
taatacgactcactatagggttatgagagtgatggcaaacaacgttaagaaacagaggagatcttaaatgtgtttgccaaacctggcggcagcgcaaaagatg

SEQ ID NO: 45117 - DNA, 103 bp, Artificial Sequence
  Synthetic Polynucleotide
taatacgactcactatagggttacattatgagagtgatggcaaacaacgtaacagaggagaacgttgatggccatcactaacctggcggcagcgcaaaagatg

SEQ ID NO: 45118 - DNA, 103 bp, Artificial Sequence
  Synthetic Polynucleotide
taatacgactcactatagggtatctttacattatgagagtgatggcaaacaacagaggagagtttgcatgcactctcataacctggcggcagcgcaaaagatg

SEQ ID NO: 45119 - DNA, 103 bp, Artificial Sequence
  Synthetic Polynucleotide
taatacgactcactatagggtagaatatctttacattatgagagtgatggaacagaggagaccatcaatgtcataatgtaacctggcggcagcgcaaaagatg

SEQ ID NO: 45120 - DNA, 103 bp, Artificial Sequence
  Synthetic Polynucleotide
taatacgactcactatagggcattttagaatatctttacattatgagagtaacagaggagaactctcatgatgtaaagaaacctggcggcagcgcaaaagatg

SEQ ID NO: 45121 - DNA, 103 bp, Artificial Sequence
  Synthetic Polynucleotide
taatacgactcactatagggtttaccattttagaatatctttacattatgaacagaggagacataatatgaagatattcaacctggcggcagcgcaaaagatg

SEQ ID NO: 45122 - DNA, 103 bp, Artificial Sequence
  Synthetic Polynucleotide
taatacgactcactatagggaaaagtttaccattttagaatatctttacaaacagaggagatgtaaaatgattctaaaaaacctggcggcagcgcaaaagatg

SEQ ID NO: 45123 - DNA, 103 bp, Artificial Sequence
  Synthetic Polynucleotide
taatacgactcactatagggtatgcaaaagtttaccattttagaatatctaacagaggagaagatatatgaaaatggtaaacctggcggcagcgcaaaagatg

SEQ ID NO: 45124 - DNA, 103 bp, Artificial Sequence
  Synthetic Polynucleotide
taatacgactcactatagggtccgatatgcaaaagtttaccattttagaaaacagaggagattctaaatgggtaaacttaacctggcggcagcgcaaaagatg

SEQ ID NO: 45125 - DNA, 103 bp, Artificial Sequence
  Synthetic Polynucleotide
taatacgactcactatagggagtgcattattacgtctacaataaatgcaaaacagaggagattgcatatgttgtagacgaacctggcggcagcgcaaaagatg

SEQ ID NO: 45126 - DNA, 103 bp, Artificial Sequence
  Synthetic Polynucleotide
taatacgactcactatagggcccatagagaaagcgcagggtctctttacaaacagaggagatgtaaaatgaccctgcgcaacctggcggcagcgcaaaagatg

SEQ ID NO: 45127 - DNA, 103 bp, Artificial Sequence
  Synthetic Polynucleotide
taatacgactcactatagggtcgatgaacttaaacagatgttgaaagacaaacagaggagatgtcttatgacatctgttaacctggcggcagcgcaaaagatg

SEQ ID NO: 45128 - DNA, 103 bp, Artificial Sequence
  Synthetic Polynucleotide
taatacgactcactatagggctgcgtccgatatgcaaaagtttaccatttaacagaggagaaaatggatgacttttgcaaacctggcggcagcgcaaaagatg

SEQ ID NO: 45129 - DNA, 103 bp, Artificial Sequence
  Synthetic Polynucleotide
taatacgactcactatagggaatttctgcgtccgatatgcaaaagtttacaacagaggagagtaaacatgtgcatatcgaacctggcggcagcgcaaaagatg

SEQ ID NO: 45130 - DNA, 103 bp, Artificial Sequence
  Synthetic Polynucleotide
taatacgactcactatagggataccaatttctgcgtccgatatgcaaaagaacagaggagacttttgatgatcggacgcaacctggcggcagcgcaaaagatg

SEQ ID NO: 45131 - DNA, 103 bp, Artificial Sequence
  Synthetic Polynucleotide
taatacgactcactatagggcatttataccaatttctgcgtccgatatgcaacagaggagagcatatatgacgcagaaaaacctggcggcagcgcaaaagatg

SEQ ID NO: 45132 - DNA, 103 bp, Artificial Sequence
  Synthetic Polynucleotide
taatacgactcactatagggtacaacatttataccaatttctgcgtccgaaacagaggagatcggacatggaaattggtaacctggcggcagcgcaaaagatg

SEQ ID NO: 45133 - DNA, 103 bp, Artificial Sequence
  Synthetic Polynucleotide
taatacgactcactatagggacaattacaacatttataccaatttctgcgaacagaggagacgcagaatgtggtataaaaacctggcggcagcgcaaaagatg

SEQ ID NO: 45134 - DNA, 103 bp, Artificial Sequence
  Synthetic Polynucleotide
taatacgactcactatagggataatacaattacaacatttataccaatttaacagaggagaaaattgatgtaaatgttgaacctggcggcagcgcaaaagatg

SEQ ID NO: 45135 - DNA, 103 bp, Artificial Sequence
  Synthetic Polynucleotide
taatacgactcactataggggggaaataatacaattacaacatttataccaacagaggagaggtataatggttgtaattaacctggcggcagcgcaaaagatg

SEQ ID NO: 45136 - DNA, 103 bp, Artificial Sequence
  Synthetic Polynucleotide
taatacgactcactatagggttgacgggaaataatacaattacaacatttaacagaggagaaaatgtatgaattgtattaacctggcggcagcgcaaaagatg

SEQ ID NO: 45137 - DNA, 103 bp, Artificial Sequence
  Synthetic Polynucleotide
taatacgactcactataggggtccattgacgggaaataatacaattacaaaacagaggagattgtaaatgtattatttcaacctggcggcagcgcaaaagatg

SEQ ID NO: 45138 - DNA, 103 bp, Artificial Sequence
  Synthetic Polynucleotide
taatacgactcactatagggagctctcgatgaacttaaacagatgttgaaaacagaggagattcaacatgtgtttaagtaacctggcggcagcgcaaaagatg

SEQ ID NO: 45139 - DNA, 103 bp, Artificial Sequence
  Synthetic Polynucleotide
taatacgactcactataggggactagtccattgacgggaaataatacaataacagaggagaattgtaatgtttcccgtcaacctggcggcagcgcaaaagatg

SEQ ID NO: 45140 - DNA, 103 bp, Artificial Sequence
  Synthetic Polynucleotide
taatacgactcactataggggctgtgactagtccattgacgggaaataataacagaggagaattattatgcgtcaatggaacctggcggcagcgcaaaagatg

SEQ ID NO: 45141 - DNA, 103 bp, Artificial Sequence
  Synthetic Polynucleotide
taatacgactcactatagggatggagctgtgactagtccattgacgggaaaacagaggagattcccgatgatggactagaacctggcggcagcgcaaaagatg

SEQ ID NO: 45142 - DNA, 103 bp, Artificial Sequence
  Synthetic Polynucleotide
taatacgactcactatagggaactgatggagctgtgactagtccattgacaacagaggagagtcaatatgctagtcacaaacctggcggcagcgcaaaagatg

SEQ ID NO: 45143 - DNA, 103 bp, Artificial Sequence
  Synthetic Polynucleotide
taatacgactcactatagggtataaaactgatggagctgtgactagtccaaacagaggagatggactatgcacagctccaacctggcggcagcgcaaaagatg

SEQ ID NO: 45144 - DNA, 103 bp, Artificial Sequence
  Synthetic Polynucleotide
taatacgactcactatagggaaggatataaaactgatggagctgtgactaaacagaggagatagtcaatgctccatcagaacctggcggcagcgcaaaagatg

SEQ ID NO: 45145 - DNA, 103 bp, Artificial Sequence
  Synthetic Polynucleotide
taatacgactcactatagggctctaaaggatataaaactgatggagctgtaacagaggagaacagctatgtcagttttaaacctggcggcagcgcaaaagatg

SEQ ID NO: 45146 - DNA, 103 bp, Artificial Sequence
  Synthetic Polynucleotide
taatacgactcactatagggaaatactctaaaggatataaaactgatggaaacagaggagatccatcatgtttatatccaacctggcggcagcgcaaaagatg

SEQ ID NO: 45147 - DNA, 103 bp, Artificial Sequence
  Synthetic Polynucleotide
taatacgactcactataggggtgagaaatactctaaaggatataaaactgaacagaggagacagtttatgatcctttagaacctggcggcagcgcaaaagatg

SEQ ID NO: 45148 - DNA, 103 bp, Artificial Sequence
  Synthetic Polynucleotide
taatacgactcactatagggcactagtgagaaatactctaaaggatataaaacagaggagattatatatgttagagtataacctggcggcagcgcaaaagatg

SEQ ID NO: 45149 - DNA, 103 bp, Artificial Sequence
  Synthetic Polynucleotide
taatacgactcactataggggaggtagctctcgatgaacttaaacagatgaacagaggagacatctgatgaagttcatcaacctggcggcagcgcaaaagatg

SEQ ID NO: 45150 - DNA, 103 bp, Artificial Sequence
  Synthetic Polynucleotide
taatacgactcactatagggctagacactagtgagaaatactctaaaggaaacagaggagatcctttatggtatttctcaacctggcggcagcgcaaaagatg

SEQ ID NO: 45151 - DNA, 103 bp, Artificial Sequence
  Synthetic Polynucleotide
taatacgactcactatagggaaatgctagacactagtgagaaatactctaaacagaggagatagagtatgtctcactagaacctggcggcagcgcaaaagatg

SEQ ID NO: 45152 - DNA, 103 bp, Artificial Sequence
  Synthetic Polynucleotide
taatacgactcactatagggctctaaaatgctagacactagtgagaaataaacagaggagatatttcatgctagtgtctaacctggcggcagcgcaaaagatg

SEQ ID NO: 45153 - DNA, 103 bp, Artificial Sequence
  Synthetic Polynucleotide
taatacgactcactataggggaatgctctaaaatgctagacactagtgagaacagaggagactcactatggtctagcataacctggcggcagcgcaaaagatg

SEQ ID NO: 45154 - DNA, 103 bp, Artificial Sequence
  Synthetic Polynucleotide
taatacgactcactatagggtcatggaatgctctaaaatgctagacactaaacagaggagatagtgtatggcattttagaacctggcggcagcgcaaaagatg

SEQ ID NO: 45155 - DNA, 103 bp, Artificial Sequence
  Synthetic Polynucleotide
taatacgactcactatagggacagatcatggaatgctctaaaatgctagaaacagaggagatctagcatgttagagcataacctggcggcagcgcaaaagatg

SEQ ID NO: 45156 - DNA, 103 bp, Artificial Sequence
  Synthetic Polynucleotide
taatacgactcactataggggataaacagatcatggaatgctctaaaatgaacagaggagacattttatggcattccataacctggcggcagcgcaaaagatg

SEQ ID NO: 45157 - DNA, 103 bp, Artificial Sequence
  Synthetic Polynucleotide
taatacgactcactatagggtcaatgataaacagatcatggaatgctctaaacagaggagatagagcatgccatgatctaacctggcggcagcgcaaaagatg

SEQ ID NO: 45158 - DNA, 103 bp, Artificial Sequence
  Synthetic Polynucleotide
taatacgactcactatagggcaatatcaatgataaacagatcatggaatgaacagaggagacattccatgatctgtttaaacctggcggcagcgcaaaagatg

SEQ ID NO: 45159 - DNA, 103 bp, Artificial Sequence
  Synthetic Polynucleotide
taatacgactcactatagggccggccaatatcaatgataaacagatcatgaacagaggagacatgatatgtttatcattaacctggcggcagcgcaaaagatg

SEQ ID NO: 45160 - DNA, 103 bp, Artificial Sequence
  Synthetic Polynucleotide
taatacgactcactatagggatgaggaggtagctctcgatgaacttaaacaacagaggagagtttaaatgcatcgagagaacctggcggcagcgcaaaagatg

SEQ ID NO: 45161 - DNA, 103 bp, Artificial Sequence
  Synthetic Polynucleotide
taatacgactcactatagggtctttccggccaatatcaatgataaacagaaacagaggagatctgttatgcattgatataacctggcggcagcgcaaaagatg

SEQ ID NO: 45162 - DNA, 103 bp, Artificial Sequence
  Synthetic Polynucleotide
taatacgactcactatagggatctatctttccggccaatatcaatgataaaacagaggagattatcaatgatattggccaacctggcggcagcgcaaaagatg

SEQ ID NO: 45163 - DNA, 103 bp, Artificial Sequence
  Synthetic Polynucleotide
taatacgactcactatagggaaaaaatctatctttccggccaatatcaataacagaggagaattgatatgggccggaaaaacctggcggcagcgcaaaagatg

SEQ ID NO: 45164 - DNA, 103 bp, Artificial Sequence
  Synthetic Polynucleotide
taatacgactcactatagggaaaataaaaaatctatctttccggccaataaacagaggagatattggatggaaagatagaacctggcggcagcgcaaaagatg

SEQ ID NO: 45165 - DNA, 103 bp, Artificial Sequence
  Synthetic Polynucleotide
taatacgactcactatagggaataaaaaataaaaaatctatctttccggcaacagaggagagccggaatgatagattttaacctggcggcagcgcaaaagatg

SEQ ID NO: 45166 - DNA, 103 bp, Artificial Sequence
  Synthetic Polynucleotide
taatacgactcactatagggaatataataaaaaataaaaaatctatctttaacagaggagaaaagatatgttttttattaacctggcggcagcgcaaaagatg

SEQ ID NO: 45167 - DNA, 103 bp, Artificial Sequence
  Synthetic Polynucleotide
taatacgactcactatagggatagtaatataataaaaaataaaaaatctaaacagaggagatagattatgtattttttaaacctggcggcagcgcaaaagatg

SEQ ID NO: 45168 - DNA, 103 bp, Artificial Sequence
  Synthetic Polynucleotide
taatacgactcactatagggtgccaatagtaatataataaaaaataaaaaaacagaggagatttttaatgtttattataaacctggcggcagcgcaaaagatg

SEQ ID NO: 45169 - DNA, 103 bp, Artificial Sequence
  Synthetic Polynucleotide
taatacgactcactatagggacaattgccaatagtaatataataaaaaataacagaggagaatttttatgtatattactaacctggcggcagcgcaaaagatg

SEQ ID NO: 45170 - DNA, 103 bp, Artificial Sequence
  Synthetic Polynucleotide
taatacgactcactatagggtatctacaattgccaatagtaatataataaaacagaggagattattaatgtactattggaacctggcggcagcgcaaaagatg

SEQ ID NO: 45171 - DNA, 103 bp, Artificial Sequence
  Synthetic Polynucleotide
taatacgactcactatagggggaaaatgaggaggtagctctcgatgaactaacagaggagaagttcaatgagagctaccaacctggcggcagcgcaaaagatg

SEQ ID NO: 45172 - DNA, 103 bp, Artificial Sequence
  Synthetic Polynucleotide
taatacgactcactatagggagttatatctacaattgccaatagtaatataacagaggagaatattaatgttggcaattaacctggcggcagcgcaaaagatg

SEQ ID NO: 45173 - DNA, 103 bp, Artificial Sequence
  Synthetic Polynucleotide
taatacgactcactatagggccagaagttatatctacaattgccaatagtaacagaggagaactattatgaattgtagaaacctggcggcagcgcaaaagatg

SEQ ID NO: 45174 - DNA, 103 bp, Artificial Sequence
  Synthetic Polynucleotide
taatacgactcactatagggatttaccagaagttatatctacaattgccaaacagaggagatggcaaatgtagatataaaacctggcggcagcgcaaaagatg

SEQ ID NO: 45175 - DNA, 103 bp, Artificial Sequence
  Synthetic Polynucleotide
taatacgactcactatagggaaaatatttaccagaagttatatctacaataacagaggagaattgtaatgataacttctaacctggcggcagcgcaaaagatg

SEQ ID NO: 45176 - DNA, 103 bp, Artificial Sequence
  Synthetic Polynucleotide
taatacgactcactataggggtagaaaaatatttaccagaagttatatctaacagaggagaagatatatgttctggtaaaacctggcggcagcgcaaaagatg

SEQ ID NO: 45177 - DNA, 103 bp, Artificial Sequence
  Synthetic Polynucleotide
taatacgactcactatagggaaaaggtagaaaaatatttaccagaagttaaacagaggagataacttatggtaaatattaacctggcggcagcgcaaaagatg

SEQ ID NO: 45178 - DNA, 103 bp, Artificial Sequence
  Synthetic Polynucleotide
taatacgactcactataggggattgaaaaggtagaaaaatatttaccagaaacagaggagatctggtatgtatttttctaacctggcggcagcgcaaaagatg

SEQ ID NO: 45179 - DNA, 103 bp, Artificial Sequence
  Synthetic Polynucleotide
taatacgactcactataggggaagagattgaaaaggtagaaaaatatttaaacagaggagataaataatgttctaccttaacctggcggcagcgcaaaagatg

SEQ ID NO: 45180 - DNA, 103 bp, Artificial Sequence
  Synthetic Polynucleotide
taatacgactcactatagggaaatagaagagattgaaaaggtagaaaaataacagaggagaatttttatgccttttcaaaacctggcggcagcgcaaaagatg

SEQ ID NO: 45181 - DNA, 103 bp, Artificial Sequence
  Synthetic Polynucleotide
taatacgactcactatagggcttgaaaatagaagagattgaaaaggtagaaacagaggagatctaccatgtcaatctctaacctggcggcagcgcaaaagatg

SEQ ID NO: 45182 - DNA, 103 bp, Artificial Sequence
  Synthetic Polynucleotide
taatacgactcactatagggtatctggaaaatgaggaggtagctctcgataacagaggagaatcgagatgtacctcctcaacctggcggcagcgcaaaagatg

SEQ ID NO: 45183 - DNA, 103 bp, Artificial Sequence
  Synthetic Polynucleotide
taatacgactcactataggggccggcttgaaaatagaagagattgaaaagaacagaggagacttttcatgctcttctataacctggcggcagcgcaaaagatg

SEQ ID NO: 45184 - DNA, 103 bp, Artificial Sequence
  Synthetic Polynucleotide
taatacgactcactatagggatatagccggcttgaaaatagaagagattgaacagaggagacaatctatgctattttcaaacctggcggcagcgcaaaagatg

SEQ ID NO: 45185 - DNA, 103 bp, Artificial Sequence
  Synthetic Polynucleotide
taatacgactcactatagggagaatatatagccggcttgaaaatagaagaaacagaggagatcttctatgttcaagccgaacctggcggcagcgcaaaagatg

SEQ ID NO: 45186 - DNA, 103 bp, Artificial Sequence
  Synthetic Polynucleotide
taatacgactcactatagggatagcagaatatatagccggcttgaaaataaacagaggagatattttatggccggctataacctggcggcagcgcaaaagatg

SEQ ID NO: 45187 - DNA, 103 bp, Artificial Sequence
  Synthetic Polynucleotide
taatacgactcactatagggataatatagcagaatatatagccggcttgaaacagaggagatcaagcatgctatatattaacctggcggcagcgcaaaagatg

SEQ ID NO: 45188 - DNA, 103 bp, Artificial Sequence
  Synthetic Polynucleotide
taatacgactcactatagggtagcaataatatagcagaatatatagccggaacagaggagaccggctatgtattctgctaacctggcggcagcgcaaaagatg

SEQ ID NO: 45189 - DNA, 103 bp, Artificial Sequence
  Synthetic Polynucleotide
taatacgactcactataggggatactagcaataatatagcagaatatataaacagaggagatatataatgtgctatattaacctggcggcagcgcaaaagatg

SEQ ID NO: 45190 - DNA, 103 bp, Artificial Sequence
  Synthetic Polynucleotide
taatacgactcactataggggtattgatactagcaataatatagcagaataacagaggagaattctgatgtattattgcaacctggcggcagcgcaaaagatg

SEQ ID NO: 45191 - DNA, 103 bp, Artificial Sequence
  Synthetic Polynucleotide
taatacgactcactatagggaaaaggtattgatactagcaataatatagcaacagaggagagctataatgttgctagtaaacctggcggcagcgcaaaagatg

SEQ ID NO: 45192 - DNA, 103 bp, Artificial Sequence
  Synthetic Polynucleotide
taatacgactcactataggggccagaaaaggtattgatactagcaataataacagaggagaattattatgagtatcaataacctggcggcagcgcaaaagatg

SEQ ID NO: 45193 - DNA, 103 bp, Artificial Sequence
  Synthetic Polynucleotide
taatacgactcactatagggttaactatctggaaaatgaggaggtagctcaacagaggagagagctaatgcctcattttaacctggcggcagcgcaaaagatg

SEQ ID NO: 45194 - DNA, 103 bp, Artificial Sequence
  Synthetic Polynucleotide
taatacgactcactatagggtcttagccagaaaaggtattgatactagcaaacagaggagatgctagatgcaataccttaacctggcggcagcgcaaaagatg

SEQ ID NO: 45195 - DNA, 103 bp, Artificial Sequence
  Synthetic Polynucleotide
taatacgactcactatagggtgacttcttagccagaaaaggtattgatacaacagaggagagtatcaatgccttttctgaacctggcggcagcgcaaaagatg

SEQ ID NO: 45196 - DNA, 103 bp, Artificial Sequence
  Synthetic Polynucleotide
taatacgactcactatagggacatatgacttcttagccagaaaaggtattaacagaggagaaataccatgtctggctaaaacctggcggcagcgcaaaagatg

SEQ ID NO: 45197 - DNA, 103 bp, Artificial Sequence
  Synthetic Polynucleotide
taatacgactcactatagggataccacatatgacttcttagccagaaaagaacagaggagacttttcatgctaagaagtaacctggcggcagcgcaaaagatg

SEQ ID NO: 45198 - DNA, 103 bp, Artificial Sequence
  Synthetic Polynucleotide
taatacgactcactatagggagttaataccacatatgacttcttagccagaacagaggagactggctatgaagtcatataacctggcggcagcgcaaaagatg

SEQ ID NO: 45199 - DNA, 103 bp, Artificial Sequence
  Synthetic Polynucleotide
taatacgactcactataggggatatagttaataccacatatgacttcttaaacagaggagataagaaatgatatgtggtaacctggcggcagcgcaaaagatg

SEQ ID NO: 45200 - DNA, 103 bp, Artificial Sequence
  Synthetic Polynucleotide
taatacgactcactatagggaaactgatatagttaataccacatatgactaacagaggagaagtcatatgtggtattaaaacctggcggcagcgcaaaagatg

SEQ ID NO: 45201 - DNA, 103 bp, Artificial Sequence
  Synthetic Polynucleotide
taatacgactcactatagggagttaaaactgatatagttaataccacataaacagaggagatatgtgatgttaactataaacctggcggcagcgcaaaagatg

SEQ ID NO: 45202 - DNA, 103 bp, Artificial Sequence
  Synthetic Polynucleotide
taatacgactcactatagggctaccagttaaaactgatatagttaataccaacagaggagaggtattatgtatatcagtaacctggcggcagcgcaaaagatg

SEQ ID NO: 45203 - DNA, 103 bp, Artificial Sequence
  Synthetic Polynucleotide
taatacgactcactatagggtggaactaccagttaaaactgatatagttaaacagaggagataactaatgcagttttaaaacctggcggcagcgcaaaagatg

SEQ ID NO: 45204 - DNA, 103 bp, Artificial Sequence
  Synthetic Polynucleotide
taatacgactcactatagggaatgtttaactatctggaaaatgaggaggtaacagaggagaacctccatgttttccagaaacctggcggcagcgcaaaagatg

SEQ ID NO: 45205 - DNA, 103 bp, Artificial Sequence
  Synthetic Polynucleotide
taatacgactcactataggggctaatggaactaccagttaaaactgatataacagaggagaatatcaatgttaactggtaacctggcggcagcgcaaaagatg

SEQ ID NO: 45206 - DNA, 103 bp, Artificial Sequence
  Synthetic Polynucleotide
taatacgactcactataggggaaaggctaatggaactaccagttaaaactaacagaggagaagttttatgtggtagttcaacctggcggcagcgcaaaagatg

SEQ ID NO: 45207 - DNA, 103 bp, Artificial Sequence
  Synthetic Polynucleotide
taatacgactcactatagggaagtggaaaggctaatggaactaccagttaaacagaggagataactgatggttccattaaacctggcggcagcgcaaaagatg

SEQ ID NO: 45208 - DNA, 103 bp, Artificial Sequence
  Synthetic Polynucleotide
taatacgactcactatagggtgcagaagtggaaaggctaatggaactaccaacagaggagaggtagtatgattagccttaacctggcggcagcgcaaaagatg

SEQ ID NO: 45209 - DNA, 103 bp, Artificial Sequence
  Synthetic Polynucleotide
taatacgactcactatagggtattctgcagaagtggaaaggctaatggaaaacagaggagattccatatgcctttccacaacctggcggcagcgcaaaagatg

SEQ ID NO: 45210 - DNA, 103 bp, Artificial Sequence
  Synthetic Polynucleotide
taatacgactcactatagggctaattattctgcagaagtggaaaggctaaaacagaggagattagccatgccacttctgaacctggcggcagcgcaaaagatg

SEQ ID NO: 45211 - DNA, 103 bp, Artificial Sequence
  Synthetic Polynucleotide
taatacgactcactatagggaatttctaattattctgcagaagtggaaagaacagaggagactttccatgtctgcagaaaacctggcggcagcgcaaaagatg

SEQ ID NO: 45212 - DNA, 103 bp, Artificial Sequence
  Synthetic Polynucleotide
taatacgactcactataggggaaccaatttctaattattctgcagaagtgaacagaggagacacttcatgagaataattaacctggcggcagcgcaaaagatg

SEQ ID NO: 45213 - DNA, 103 bp, Artificial Sequence
  Synthetic Polynucleotide
taatacgactcactataggggtaaagaaccaatttctaattattctgcagaacagaggagactgcagatgaattagaaaaacctggcggcagcgcaaaagatg

SEQ ID NO: 45214 - DNA, 103 bp, Artificial Sequence
  Synthetic Polynucleotide
taatacgactcactatagggttctggtaaagaaccaatttctaattattcaacagaggagagaataaatggaaattggtaacctggcggcagcgcaaaagatg

SEQ ID NO: 45215 - DNA, 103 bp, Artificial Sequence
  Synthetic Polynucleotide
taatacgactcactataggggtcaaaatgtttaactatctggaaaatgagaacagaggagactcattatgcagatagttaacctggcggcagcgcaaaagatg

SEQ ID NO: 45216 - DNA, 103 bp, Artificial Sequence
  Synthetic Polynucleotide
taatacgactcactatagggggattttctggtaaagaaccaatttctaataacagaggagaattagaatgtggttctttaacctggcggcagcgcaaaagatg

SEQ ID NO: 45217 - DNA, 103 bp, Artificial Sequence
  Synthetic Polynucleotide
taatacgactcactatagggtagctggattttctggtaaagaaccaatttaacagaggagaaaattgatgctttaccagaacctggcggcagcgcaaaagatg

SEQ ID NO: 45218 - DNA, 103 bp, Artificial Sequence
  Synthetic Polynucleotide
taatacgactcactatagggtatagtagctggattttctggtaaagaaccaacagaggagaggttctatgccagaaaataacctggcggcagcgcaaaagatg

SEQ ID NO: 45219 - DNA, 103 bp, Artificial Sequence
  Synthetic Polynucleotide
taatacgactcactatagggcctattatagtagctggattttctggtaaaaacagaggagatttaccatgaaatccagcaacctggcggcagcgcaaaagatg

SEQ ID NO: 45220 - DNA, 103 bp, Artificial Sequence
  Synthetic Polynucleotide
taatacgactcactataggggtgagcctattatagtagctggattttctgaacagaggagacagaaaatgcagctactaaacctggcggcagcgcaaaagatg

SEQ ID NO: 45221 - DNA, 103 bp, Artificial Sequence
  Synthetic Polynucleotide
taatacgactcactatagggcatcggtgagcctattatagtagctggattaacagaggagaaatccaatgactataataaacctggcggcagcgcaaaagatg

SEQ ID NO: 45222 - DNA, 103 bp, Artificial Sequence
  Synthetic Polynucleotide
taatacgactcactatagggatgatcatcggtgagcctattatagtagctaacagaggagaagctacatgaataggctcaacctggcggcagcgcaaaagatg

SEQ ID NO: 45223 - DNA, 103 bp, Artificial Sequence
  Synthetic Polynucleotide
taatacgactcactatagggtgccaatgatcatcggtgagcctattatagaacagaggagactataaatggctcaccgaaacctggcggcagcgcaaaagatg

SEQ ID NO: 45224 - DNA, 103 bp, Artificial Sequence
  Synthetic Polynucleotide
taatacgactcactataggggattttgccaatgatcatcggtgagcctataacagaggagaataggcatgccgatgatcaacctggcggcagcgcaaaagatg

SEQ ID NO: 45225 - DNA, 103 bp, Artificial Sequence
  Synthetic Polynucleotide
taatacgactcactatagggtataggattttgccaatgatcatcggtgagaacagaggagactcaccatggatcattggaacctggcggcagcgcaaaagatg

SEQ ID NO: 45226 - DNA, 103 bp, Artificial Sequence
  Synthetic Polynucleotide
taatacgactcactatagggattcagtcaaaatgtttaactatctggaaaaacagaggagatttccaatgagttaaacaaacctggcggcagcgcaaaagatg

SEQ ID NO: 45227 - DNA, 103 bp, Artificial Sequence
  Synthetic Polynucleotide
taatacgactcactatagggtacaatataggattttgccaatgatcatcgaacagaggagacgatgaatgttggcaaaaaacctggcggcagcgcaaaagatg

SEQ ID NO: 45228 - DNA, 103 bp, Artificial Sequence
  Synthetic Polynucleotide
taatacgactcactatagggtttggtacaatataggattttgccaatgataacagaggagaatcattatgaaaatcctaaacctggcggcagcgcaaaagatg

SEQ ID NO: 45229 - DNA, 103 bp, Artificial Sequence
  Synthetic Polynucleotide
taatacgactcactatagggattaatttggtacaatataggattttgccaaacagaggagatggcaaatgcctatattgaacctggcggcagcgcaaaagatg

SEQ ID NO: 45230 - DNA, 103 bp, Artificial Sequence
  Synthetic Polynucleotide
taatacgactcactatagggctctcattaatttggtacaatataggatttaacagaggagaaaatccatgattgtaccaaacctggcggcagcgcaaaagatg

SEQ ID NO: 45231 - DNA, 103 bp, Artificial Sequence
  Synthetic Polynucleotide
taatacgactcactatagggatatgctctcattaatttggtacaatatagaacagaggagactatatatgaccaaattaaacctggcggcagcgcaaaagatg

SEQ ID NO: 45232 - DNA, 103 bp, Artificial Sequence
  Synthetic Polynucleotide
taatacgactcactatagggatgaaatatgctctcattaatttggtacaaaacagaggagattgtacatgattaatgagaacctggcggcagcgcaaaagatg

SEQ ID NO: 45233 - DNA, 103 bp, Artificial Sequence
  Synthetic Polynucleotide
taatacgactcactatagggtggaaatgaaatatgctctcattaatttggaacagaggagaccaaatatgtgagagcataacctggcggcagcgcaaaagatg

SEQ ID NO: 45234 - DNA, 103 bp, Artificial Sequence
  Synthetic Polynucleotide
taatacgactcactatagggattattggaaatgaaatatgctctcattaaaacagaggagattaatgatggcatatttcaacctggcggcagcgcaaaagatg

SEQ ID NO: 45235 - DNA, 103 bp, Artificial Sequence
  Synthetic Polynucleotide
taatacgactcactataggggcagaattattggaaatgaaatatgctctcaacagaggagagagagcatgtttcatttcaacctggcggcagcgcaaaagatg

SEQ ID NO: 45236 - DNA, 103 bp, Artificial Sequence
  Synthetic Polynucleotide
taatacgactcactatagggaactagcagaattattggaaatgaaatatgaacagaggagacatattatgtttccaataaacctggcggcagcgcaaaagatg

SEQ ID NO: 45237 - DNA, 103 bp, Artificial Sequence
  Synthetic Polynucleotide
taatacgactcactatagggatggacccatagagaaagcgcagggtctctaacagaggagaagagacatggcgctttctaacctggcggcagcgcaaaagatg

SEQ ID NO: 45238 - DNA, 103 bp, Artificial Sequence
  Synthetic Polynucleotide
taatacgactcactatagggcttctattcagtcaaaatgtttaactatctaacagaggagaagatagatgaacattttgaacctggcggcagcgcaaaagatg

SEQ ID NO: 45239 - DNA, 103 bp, Artificial Sequence
  Synthetic Polynucleotide
taatacgactcactatagggtcaagaactagcagaattattggaaatgaaaacagaggagattcattatgaataattctaacctggcggcagcgcaaaagatg

SEQ ID NO: 45240 - DNA, 103 bp, Artificial Sequence
  Synthetic Polynucleotide
taatacgactcactatagggatgtctcaagaactagcagaattattggaaaacagaggagattccaaatgttctgctagaacctggcggcagcgcaaaagatg

SEQ ID NO: 45241 - DNA, 103 bp, Artificial Sequence
  Synthetic Polynucleotide
taatacgactcactatagggaatcaatgtctcaagaactagcagaattataacagaggagaataattatgctagttcttaacctggcggcagcgcaaaagatg

SEQ ID NO: 45242 - DNA, 103 bp, Artificial Sequence
  Synthetic Polynucleotide
taatacgactcactatagggaaataaatcaatgtctcaagaactagcagaaacagaggagatctgctatgtcttgagacaacctggcggcagcgcaaaagatg

SEQ ID NO: 45243 - DNA, 103 bp, Artificial Sequence
  Synthetic Polynucleotide
taatacgactcactatagggtcatcaaataaatcaatgtctcaagaactaaacagaggagatagttcatgagacattgaaacctggcggcagcgcaaaagatg

SEQ ID NO: 45244 - DNA, 103 bp, Artificial Sequence
  Synthetic Polynucleotide
taatacgactcactatagggtagattcatcaaataaatcaatgtctcaagaacagaggagacttgagatgttgatttataacctggcggcagcgcaaaagatg

SEQ ID NO: 45245 - DNA, 103 bp, Artificial Sequence
  Synthetic Polynucleotide
taatacgactcactatagggccaactagattcatcaaataaatcaatgtcaacagaggagagacattatgttatttgataacctggcggcagcgcaaaagatg

SEQ ID NO: 45246 - DNA, 103 bp, Artificial Sequence
  Synthetic Polynucleotide
taatacgactcactataggggagaaccaactagattcatcaaataaatcaaacagaggagatgatttatgtgatgaatcaacctggcggcagcgcaaaagatg

SEQ ID NO: 45247 - DNA, 103 bp, Artificial Sequence
  Synthetic Polynucleotide
taatacgactcactatagggatctagagaaccaactagattcatcaaataaacagaggagatatttgatgaatctagttaacctggcggcagcgcaaaagatg

SEQ ID NO: 45248 - DNA, 103 bp, Artificial Sequence
  Synthetic Polynucleotide
taatacgactcactatagggagagtatctagagaaccaactagattcatcaacagaggagagatgaaatgagttggttcaacctggcggcagcgcaaaagatg

SEQ ID NO: 45249 - DNA, 103 bp, Artificial Sequence
  Synthetic Polynucleotide
taatacgactcactatagggattcacttctattcagtcaaaatgtttaacaacagaggagagttaaaatgtttgactgaaacctggcggcagcgcaaaagatg

SEQ ID NO: 45250 - DNA, 103 bp, Artificial Sequence
  Synthetic Polynucleotide
taatacgactcactatagggatggtagagtatctagagaaccaactagataacagaggagaatctagatggttctctagaacctggcggcagcgcaaaagatg

SEQ ID NO: 45251 - DNA, 103 bp, Artificial Sequence
  Synthetic Polynucleotide
taatacgactcactatagggcagaaatggtagagtatctagagaaccaacaacagaggagagttggtatgctagatactaacctggcggcagcgcaaaagatg

SEQ ID NO: 45252 - DNA, 103 bp, Artificial Sequence
  Synthetic Polynucleotide
taatacgactcactatagggtgcggcagaaatggtagagtatctagagaaaacagaggagattctctatgtactctaccaacctggcggcagcgcaaaagatg

SEQ ID NO: 45253 - DNA, 103 bp, Artificial Sequence
  Synthetic Polynucleotide
taatacgactcactatagggttgtatgcggcagaaatggtagagtatctaaacagaggagatagataatgtaccatttcaacctggcggcagcgcaaaagatg

SEQ ID NO: 45254 - DNA, 103 bp, Artificial Sequence
  Synthetic Polynucleotide
taatacgactcactatagggagttattgtatgcggcagaaatggtagagtaacagaggagaactctaatgtttctgccgaacctggcggcagcgcaaaagatg

SEQ ID NO: 45255 - DNA, 103 bp, Artificial Sequence
  Synthetic Polynucleotide
taatacgactcactatagggtaacaagttattgtatgcggcagaaatggtaacagaggagaaccattatggccgcatacaacctggcggcagcgcaaaagatg

SEQ ID NO: 45256 - DNA, 103 bp, Artificial Sequence
  Synthetic Polynucleotide
taatacgactcactatagggttatctaacaagttattgtatgcggcagaaaacagaggagattctgcatgatacaataaaacctggcggcagcgcaaaagatg

SEQ ID NO: 45257 - DNA, 103 bp, Artificial Sequence
  Synthetic Polynucleotide
taatacgactcactatagggtgattttatctaacaagttattgtatgcggaacagaggagaccgcatatgataacttgtaacctggcggcagcgcaaaagatg

SEQ ID NO: 45258 - DNA, 103 bp, Artificial Sequence
  Synthetic Polynucleotide
taatacgactcactatagggaaccctgattttatctaacaagttattgtaaacagaggagatacaatatgttgttagataacctggcggcagcgcaaaagatg

SEQ ID NO: 45259 - DNA, 103 bp, Artificial Sequence
  Synthetic Polynucleotide
taatacgactcactatagggttgataaccctgattttatctaacaagttaaacagaggagataacttatgagataaaataacctggcggcagcgcaaaagatg

SEQ ID NO: 45260 - DNA, 103 bp, Artificial Sequence
  Synthetic Polynucleotide
taatacgactcactatagggagctcattcacttctattcagtcaaaatgtaacagaggagaacatttatgctgaatagaaacctggcggcagcgcaaaagatg

SEQ ID NO: 45261 - DNA, 103 bp, Artificial Sequence
  Synthetic Polynucleotide
taatacgactcactatagggacactttgataaccctgattttatctaacaaacagaggagatgttagatgaaatcagggaacctggcggcagcgcaaaagatg

SEQ ID NO: 45262 - DNA, 103 bp, Artificial Sequence
  Synthetic Polynucleotide
taatacgactcactataggggctaaacactttgataaccctgattttatcaacagaggagagataaaatgagggttatcaacctggcggcagcgcaaaagatg

SEQ ID NO: 45263 - DNA, 103 bp, Artificial Sequence
  Synthetic Polynucleotide
taatacgactcactataggggccacgctaaacactttgataaccctgattaacagaggagaaatcagatgtatcaaagtaacctggcggcagcgcaaaagatg

SEQ ID NO: 45264 - DNA, 103 bp, Artificial Sequence
  Synthetic Polynucleotide
taatacgactcactatagggttctagccacgctaaacactttgataacccaacagaggagagggttaatgaagtgtttaaacctggcggcagcgcaaaagatg

SEQ ID NO: 45265 - DNA, 103 bp, Artificial Sequence
  Synthetic Polynucleotide
taatacgactcactatagggcactattctagccacgctaaacactttgataacagaggagaatcaaaatgtttagcgtgaacctggcggcagcgcaaaagatg

SEQ ID NO: 45266 - DNA, 103 bp, Artificial Sequence
  Synthetic Polynucleotide
taatacgactcactatagggaagcccactattctagccacgctaaacactaacagaggagaagtgttatgcgtggctagaacctggcggcagcgcaaaagatg

SEQ ID NO: 45267 - DNA, 103 bp, Artificial Sequence
  Synthetic Polynucleotide
taatacgactcactatagggcatgtaagcccactattctagccacgctaaaacagaggagattagcgatgctagaatagaacctggcggcagcgcaaaagatg

SEQ ID NO: 45268 - DNA, 103 bp, Artificial Sequence
  Synthetic Polynucleotide
taatacgactcactatagggtaatacatgtaagcccactattctagccacaacagaggagagtggctatgatagtgggcaacctggcggcagcgcaaaagatg

SEQ ID NO: 45269 - DNA, 103 bp, Artificial Sequence
  Synthetic Polynucleotide
taatacgactcactatagggttctttaatacatgtaagcccactattctaaacagaggagatagaatatggggcttacaaacctggcggcagcgcaaaagatg

SEQ ID NO: 45270 - DNA, 103 bp, Artificial Sequence
  Synthetic Polynucleotide
taatacgactcactatagggccgcattctttaatacatgtaagcccactaaacagaggagatagtggatgtacatgtataacctggcggcagcgcaaaagatg

SEQ ID NO: 45271 - DNA, 103 bp, Artificial Sequence
  Synthetic Polynucleotide
taatacgactcactatagggacagtagctcattcacttctattcagtcaaaacagaggagattgactatgtagaagtgaaacctggcggcagcgcaaaagatg

SEQ ID NO: 45272 - DNA, 103 bp, Artificial Sequence
  Synthetic Polynucleotide
taatacgactcactatagggtactaccgcattctttaatacatgtaagccaacagaggagaggcttaatggtattaaagaacctggcggcagcgcaaaagatg

SEQ ID NO: 45273 - DNA, 103 bp, Artificial Sequence
  Synthetic Polynucleotide
taatacgactcactatagggactcatactaccgcattctttaatacatgtaacagaggagaacatgtatgaaagaatgcaacctggcggcagcgcaaaagatg

SEQ ID NO: 45274 - DNA, 103 bp, Artificial Sequence
  Synthetic Polynucleotide
taatacgactcactatagggggtttactcatactaccgcattctttaataaacagaggagatattaaatgatgcggtagaacctggcggcagcgcaaaagatg

SEQ ID NO: 45275 - DNA, 103 bp, Artificial Sequence
  Synthetic Polynucleotide
taatacgactcactatagggaaaacggtttactcatactaccgcattcttaacagaggagaaagaatatggtagtatgaaacctggcggcagcgcaaaagatg

SEQ ID NO: 45276 - DNA, 103 bp, Artificial Sequence
  Synthetic Polynucleotide
taatacgactcactatagggtcgttaaaacggtttactcatactaccgcaaacagaggagatgcggtatgatgagtaaaaacctggcggcagcgcaaaagatg

SEQ ID NO: 45277 - DNA, 103 bp, Artificial Sequence
  Synthetic Polynucleotide
taatacgactcactatagggataattcgttaaaacggtttactcatactaaacagaggagatagtatatgtaaaccgttaacctggcggcagcgcaaaagatg

SEQ ID NO: 45278 - DNA, 103 bp, Artificial Sequence
  Synthetic Polynucleotide
taatacgactcactatagggactatataattcgttaaaacggtttactcaaacagaggagatgagtaatgcgttttaacaacctggcggcagcgcaaaagatg

SEQ ID NO: 45279 - DNA, 103 bp, Artificial Sequence
  Synthetic Polynucleotide
taatacgactcactatagggtggagactatataattcgttaaaacggtttaacagaggagaaaaccgatgtaacgaattaacctggcggcagcgcaaaagatg

SEQ ID NO: 45280 - DNA, 103 bp, Artificial Sequence
  Synthetic Polynucleotide
taatacgactcactatagggatttctggagactatataattcgttaaaacaacagaggagagttttaatgaattatataaacctggcggcagcgcaaaagatg

SEQ ID NO: 45281 - DNA, 103 bp, Artificial Sequence
  Synthetic Polynucleotide
taatacgactcactatagggcacagatttctggagactatataattcgttaacagaggagaaacgaaatgtatagtctcaacctggcggcagcgcaaaagatg

SEQ ID NO: 45282 - DNA, 103 bp, Artificial Sequence
  Synthetic Polynucleotide
taatacgactcactatagggagttcacagtagctcattcacttctattcaaacagaggagatgaataatggtgaatgagaacctggcggcagcgcaaaagatg

SEQ ID NO: 45283 - DNA, 103 bp, Artificial Sequence
  Synthetic Polynucleotide
taatacgactcactatagggaacgccacagatttctggagactatataataacagaggagaattataatgtctccagaaaacctggcggcagcgcaaaagatg

SEQ ID NO: 45284 - DNA, 103 bp, Artificial Sequence
  Synthetic Polynucleotide
taatacgactcactatagggtatgcaacgccacagatttctggagactataacagaggagaatagtcatgagaaatctgaacctggcggcagcgcaaaagatg

SEQ ID NO: 45285 - DNA, 103 bp, Artificial Sequence
  Synthetic Polynucleotide
taatacgactcactatagggtcatgtatgcaacgccacagatttctggagaacagaggagactccagatgtctgtggcgaacctggcggcagcgcaaaagatg

SEQ ID NO: 45286 - DNA, 103 bp, Artificial Sequence
  Synthetic Polynucleotide
taatacgactcactatagggtcagctcatgtatgcaacgccacagatttcaacagaggagagaaatcatgggcgttgcaaacctggcggcagcgcaaaagatg

SEQ ID NO: 45287 - DNA, 103 bp, Artificial Sequence
  Synthetic Polynucleotide
taatacgactcactataggggtcattcagctcatgtatgcaacgccacagaacagaggagactgtggatgtgcatacataacctggcggcagcgcaaaagatg

SEQ ID NO: 45288 - DNA, 103 bp, Artificial Sequence
  Synthetic Polynucleotide
taatacgactcactatagggtcgatgtcattcagctcatgtatgcaacgcaacagaggagagcgttgatgacatgagctaacctggcggcagcgcaaaagatg

SEQ ID NO: 45289 - DNA, 103 bp, Artificial Sequence
  Synthetic Polynucleotide
taatacgactcactatagggaatcttcgatgtcattcagctcatgtatgcaacagaggagagcatacatgagctgaatgaacctggcggcagcgcaaaagatg

SEQ ID NO: 45290 - DNA, 103 bp, Artificial Sequence
  Synthetic Polynucleotide
taatacgactcactatagggtggacaatcttcgatgtcattcagctcatgaacagaggagacatgagatgaatgacatcaacctggcggcagcgcaaaagatg

SEQ ID NO: 45291 - DNA, 103 bp, Artificial Sequence
  Synthetic Polynucleotide
taatacgactcactatagggaatattggacaatcttcgatgtcattcagcaacagaggagagctgaaatgcatcgaagaaacctggcggcagcgcaaaagatg

SEQ ID NO: 45292 - DNA, 103 bp, Artificial Sequence
  Synthetic Polynucleotide
taatacgactcactatagggttaaaaatattggacaatcttcgatgtcataacagaggagaatgacaatgaagattgtcaacctggcggcagcgcaaaagatg

SEQ ID NO: 45293 - DNA, 103 bp, Artificial Sequence
  Synthetic Polynucleotide
taatacgactcactatagggtacagagttcacagtagctcattcacttctaacagaggagaagaagtatgtgagctactaacctggcggcagcgcaaaagatg

SEQ ID NO: 45294 - DNA, 103 bp, Artificial Sequence
  Synthetic Polynucleotide
taatacgactcactatagggagctattaaaaatattggacaatcttcgataacagaggagaatcgaaatgtgtccaataaacctggcggcagcgcaaaagatg

SEQ ID NO: 45295 - DNA, 103 bp, Artificial Sequence
  Synthetic Polynucleotide
taatacgactcactatagggagagcagctattaaaaatattggacaatctaacagaggagaagattgatgaatatttttaacctggcggcagcgcaaaagatg

SEQ ID NO: 45296 - DNA, 103 bp, Artificial Sequence
  Synthetic Polynucleotide
taatacgactcactataggggacaaagagcagctattaaaaatattggacaacagaggagagtccaaatgttttaatagaacctggcggcagcgcaaaagatg

SEQ ID NO: 45297 - DNA, 103 bp, Artificial Sequence
  Synthetic Polynucleotide
taatacgactcactatagggtaatggacaaagagcagctattaaaaatataacagaggagaatatttatgatagctgctaacctggcggcagcgcaaaagatg

SEQ ID NO: 45298 - DNA, 103 bp, Artificial Sequence
  Synthetic Polynucleotide
taatacgactcactatagggagaaataatggacaaagagcagctattaaaaacagaggagatttaatatgtgctctttgaacctggcggcagcgcaaaagatg

SEQ ID NO: 45299 - DNA, 103 bp, Artificial Sequence
  Synthetic Polynucleotide
taatacgactcactatagggaatatagaaataatggacaaagagcagctaaacagaggagatagctgatgtttgtccataacctggcggcagcgcaaaagatg

SEQ ID NO: 45300 - DNA, 103 bp, Artificial Sequence
  Synthetic Polynucleotide
taatacgactcactatagggagtcaaatatagaaataatggacaaagagcaacagaggagagctcttatgccattatttaacctggcggcagcgcaaaagatg

SEQ ID NO: 45301 - DNA, 103 bp, Artificial Sequence
  Synthetic Polynucleotide
taatacgactcactatagggttgcgagtcaaatatagaaataatggacaaaacagaggagattgtccatgatttctataaacctggcggcagcgcaaaagatg

SEQ ID NO: 45302 - DNA, 103 bp, Artificial Sequence
  Synthetic Polynucleotide
taatacgactcactatagggaattgttgcgagtcaaatatagaaataatgaacagaggagacattatatgtatatttgaaacctggcggcagcgcaaaagatg

SEQ ID NO: 45303 - DNA, 103 bp, Artificial Sequence
  Synthetic Polynucleotide
taatacgactcactatagggtttacaattgttgcgagtcaaatatagaaaaacagaggagatttctaatgttgactcgcaacctggcggcagcgcaaaagatg

SEQ ID NO: 45304 - DNA, 103 bp, Artificial Sequence
  Synthetic Polynucleotide
taatacgactcactataggggggtgtacagagttcacagtagctcattcaaacagaggagatgaatgatgtactgtgaaaacctggcggcagcgcaaaagatg

SEQ ID NO: 45305 - DNA, 103 bp, Artificial Sequence
  Synthetic Polynucleotide
taatacgactcactatagggtggtatttacaattgttgcgagtcaaatataacagaggagaatatttatgtcgcaacaaaacctggcggcagcgcaaaagatg

SEQ ID NO: 45306 - DNA, 103 bp, Artificial Sequence
  Synthetic Polynucleotide
taatacgactcactatagggattaatggtatttacaattgttgcgagtcaaacagaggagatgactcatgacaattgtaaacctggcggcagcgcaaaagatg

SEQ ID NO: 45307 - DNA, 103 bp, Artificial Sequence
  Synthetic Polynucleotide
taatacgactcactatagggcagtgattaatggtatttacaattgttgcgaacagaggagacgcaacatgtgtaaatacaacctggcggcagcgcaaaagatg

SEQ ID NO: 45308 - DNA, 103 bp, Artificial Sequence
  Synthetic Polynucleotide
taatacgactcactatagggggaatcagtgattaatggtatttacaattgaacagaggagacaattgatgataccattaaacctggcggcagcgcaaaagatg

SEQ ID NO: 45309 - DNA, 103 bp, Artificial Sequence
  Synthetic Polynucleotide
taatacgactcactatagggaaaaaggaatcagtgattaatggtatttacaacagaggagagtaaatatgattaatcacaacctggcggcagcgcaaaagatg

SEQ ID NO: 45310 - DNA, 103 bp, Artificial Sequence
  Synthetic Polynucleotide
taatacgactcactatagggcatcaaaaaaggaatcagtgattaatggtaaacagaggagataccatatgtcactgattaacctggcggcagcgcaaaagatg

SEQ ID NO: 45311 - DNA, 103 bp, Artificial Sequence
  Synthetic Polynucleotide
taatacgactcactatagggtccggcatcaaaaaaggaatcagtgattaaaacagaggagattaatcatggattcctttaacctggcggcagcgcaaaagatg

SEQ ID NO: 45312 - DNA, 103 bp, Artificial Sequence
  Synthetic Polynucleotide
taatacgactcactatagggtattgtccggcatcaaaaaaggaatcagtgaacagaggagacactgaatgcttttttgaaacctggcggcagcgcaaaagatg

SEQ ID NO: 45313 - DNA, 103 bp, Artificial Sequence
  Synthetic Polynucleotide
taatacgactcactatagggtgtgctattgtccggcatcaaaaaaggaataacagaggagaattcctatgttgatgccgaacctggcggcagcgcaaaagatg

SEQ ID NO: 45314 - DNA, 103 bp, Artificial Sequence
  Synthetic Polynucleotide
taatacgactcactatagggacaattgtgctattgtccggcatcaaaaaaaacagaggagattttttatggccggacaaaacctggcggcagcgcaaaagatg

SEQ ID NO: 45315 - DNA, 103 bp, Artificial Sequence
  Synthetic Polynucleotide
taatacgactcactatagggtgtgtgggtgtacagagttcacagtagctcaacagaggagagagctaatgtgaactctgaacctggcggcagcgcaaaagatg

SEQ ID NO: 45316 - DNA, 103 bp, Artificial Sequence
  Synthetic Polynucleotide
taatacgactcactataggggctaaacaattgtgctattgtccggcatcaaacagaggagatgatgcatgacaatagcaaacctggcggcagcgcaaaagatg

SEQ ID NO: 45317 - DNA, 103 bp, Artificial Sequence
  Synthetic Polynucleotide
taatacgactcactatagggccaaagctaaacaattgtgctattgtccggaacagaggagaccggacatgagcacaattaacctggcggcagcgcaaaagatg

SEQ ID NO: 45318 - DNA, 103 bp, Artificial Sequence
  Synthetic Polynucleotide
taatacgactcactatagggagagtccaaagctaaacaattgtgctattgaacagaggagacaatagatgaattgtttaaacctggcggcagcgcaaaagatg

SEQ ID NO: 45319 - DNA, 103 bp, Artificial Sequence
  Synthetic Polynucleotide
taatacgactcactatagggtacatagagtccaaagctaaacaattgtgcaacagaggagagcacaaatgtttagctttaacctggcggcagcgcaaaagatg

SEQ ID NO: 45320 - DNA, 103 bp, Artificial Sequence
  Synthetic Polynucleotide
taatacgactcactatagggctgaatacatagagtccaaagctaaacaataacagaggagaattgttatgctttggactaacctggcggcagcgcaaaagatg

SEQ ID NO: 45321 - DNA, 103 bp, Artificial Sequence
  Synthetic Polynucleotide
taatacgactcactatagggtaattctgaatacatagagtccaaagctaaaacagaggagattagctatggactctatgaacctggcggcagcgcaaaagatg

SEQ ID NO: 45322 - DNA, 103 bp, Artificial Sequence
  Synthetic Polynucleotide
taatacgactcactatagggtctattaattctgaatacatagagtccaaaaacagaggagatttggaatgtatgtattcaacctggcggcagcgcaaaagatg

SEQ ID NO: 45323 - DNA, 103 bp, Artificial Sequence
  Synthetic Polynucleotide
taatacgactcactatagggatatatctattaattctgaatacatagagtaacagaggagaactctaatgattcagaataacctggcggcagcgcaaaagatg

SEQ ID NO: 45324 - DNA, 103 bp, Artificial Sequence
  Synthetic Polynucleotide
taatacgactcactataggggagagatatatctattaattctgaatacataacagaggagaatgtatatggaattaataaacctggcggcagcgcaaaagatg

SEQ ID NO: 45325 - DNA, 103 bp, Artificial Sequence
  Synthetic Polynucleotide
taatacgactcactataggggtattgagagatatatctattaattctgaaaacagaggagattcagaatgaatagatataacctggcggcagcgcaaaagatg

SEQ ID NO: 45326 - DNA, 103 bp, Artificial Sequence
  Synthetic Polynucleotide
taatacgactcactatagggttagttgtgtgggtgtacagagttcacagtaacagaggagaactgtgatgtctgtacacaacctggcggcagcgcaaaagatg

SEQ ID NO: 45327 - DNA, 103 bp, Artificial Sequence
  Synthetic Polynucleotide
taatacgactcactatagggaatctgtattgagagatatatctattaattaacagaggagaaattaaatgatatatctcaacctggcggcagcgcaaaagatg

SEQ ID NO: 45328 - DNA, 103 bp, Artificial Sequence
  Synthetic Polynucleotide
taatacgactcactatagggagtacaatctgtattgagagatatatctataacagaggagaatagatatgtctctcaataacctggcggcagcgcaaaagatg

SEQ ID NO: 45329 - DNA, 103 bp, Artificial Sequence
  Synthetic Polynucleotide
taatacgactcactatagggtgtatagtacaatctgtattgagagatataaacagaggagatatatcatgcaatacagaaacctggcggcagcgcaaaagatg

SEQ ID NO: 45330 - DNA, 103 bp, Artificial Sequence
  Synthetic Polynucleotide
taatacgactcactatagggcaaaatgtatagtacaatctgtattgagagaacagaggagactctcaatgcagattgtaaacctggcggcagcgcaaaagatg

SEQ ID NO: 45331 - DNA, 103 bp, Artificial Sequence
  Synthetic Polynucleotide
taatacgactcactatagggagtttcaaaatgtatagtacaatctgtattaacagaggagaaatacaatgtgtactataaacctggcggcagcgcaaaagatg

SEQ ID NO: 45332 - DNA, 103 bp, Artificial Sequence
  Synthetic Polynucleotide
taatacgactcactataggggacatagtttcaaaatgtatagtacaatctaacagaggagaagattgatgtatacatttaacctggcggcagcgcaaaagatg

SEQ ID NO: 45333 - DNA, 103 bp, Artificial Sequence
  Synthetic Polynucleotide
taatacgactcactatagggtttttgacatagtttcaaaatgtatagtacaacagaggagagtactaatgattttgaaaaacctggcggcagcgcaaaagatg

SEQ ID NO: 45334 - DNA, 103 bp, Artificial Sequence
  Synthetic Polynucleotide
taatacgactcactatagggtacaatttttgacatagtttcaaaatgtataacagaggagaatacatatggaaactatgaacctggcggcagcgcaaaagatg

SEQ ID NO: 45335 - DNA, 103 bp, Artificial Sequence
  Synthetic Polynucleotide
taatacgactcactatagggcgttctacaatttttgacatagtttcaaaaaacagaggagattttgaatgtatgtcaaaaacctggcggcagcgcaaaagatg

SEQ ID NO: 45336 - DNA, 103 bp, Artificial Sequence
  Synthetic Polynucleotide
taatacgactcactatagggagcgtcgttctacaatttttgacatagtttaacagaggagaaaactaatgcaaaaattgaacctggcggcagcgcaaaagatg

SEQ ID NO: 45337 - DNA, 103 bp, Artificial Sequence
  Synthetic Polynucleotide
taatacgactcactatagggtaacattagttgtgtgggtgtacagagttcaacagaggagagaactcatgacacccacaaacctggcggcagcgcaaaagatg

SEQ ID NO: 45338 - DNA, 103 bp, Artificial Sequence
  Synthetic Polynucleotide
taatacgactcactatagggagaacagcgtcgttctacaatttttgacataacagaggagaatgtcaatgattgtagaaaacctggcggcagcgcaaaagatg

SEQ ID NO: 45339 - DNA, 103 bp, Artificial Sequence
  Synthetic Polynucleotide
taatacgactcactataggggctgcagaacagcgtcgttctacaatttttaacagaggagaaaaaatatgagaacgacgaacctggcggcagcgcaaaagatg

SEQ ID NO: 45340 - DNA, 103 bp, Artificial Sequence
  Synthetic Polynucleotide
taatacgactcactatagggaaatggctgcagaacagcgtcgttctacaaaacagaggagattgtagatggacgctgttaacctggcggcagcgcaaaagatg

SEQ ID NO: 45341 - DNA, 103 bp, Artificial Sequence
  Synthetic Polynucleotide
taatacgactcactatagggaagttaaatggctgcagaacagcgtcgttcaacagaggagagaacgaatgtgttctgcaaacctggcggcagcgcaaaagatg

SEQ ID NO: 45342 - DNA, 103 bp, Artificial Sequence
  Synthetic Polynucleotide
taatacgactcactatagggatttaaagttaaatggctgcagaacagcgtaacagaggagaacgctgatgtgcagccataacctggcggcagcgcaaaagatg

SEQ ID NO: 45343 - DNA, 103 bp, Artificial Sequence
  Synthetic Polynucleotide
taatacgactcactatagggaaattatttaaagttaaatggctgcagaacaacagaggagagttctgatgccatttaacaacctggcggcagcgcaaaagatg

SEQ ID NO: 45344 - DNA, 103 bp, Artificial Sequence
  Synthetic Polynucleotide
taatacgactcactatagggtttgtaaattatttaaagttaaatggctgcaacagaggagagcagccatgtaactttaaaacctggcggcagcgcaaaagatg

SEQ ID NO: 45345 - DNA, 103 bp, Artificial Sequence
  Synthetic Polynucleotide
taatacgactcactatagggaaatttttgtaaattatttaaagttaaatgaacagaggagacatttaatgttaaataataacctggcggcagcgcaaaagatg

SEQ ID NO: 45346 - DNA, 103 bp, Artificial Sequence
  Synthetic Polynucleotide
taatacgactcactatagggattttaaatttttgtaaattatttaaagttaacagaggagaaactttatgtaatttacaaacctggcggcagcgcaaaagatg

SEQ ID NO: 45347 - DNA, 103 bp, Artificial Sequence
  Synthetic Polynucleotide
taatacgactcactatagggtactcattttaaatttttgtaaattatttaaacagaggagataaataatgtacaaaaataacctggcggcagcgcaaaagatg

SEQ ID NO: 45348 - DNA, 103 bp, Artificial Sequence
  Synthetic Polynucleotide
taatacgactcactatagggcatagatggacccatagagaaagcgcagggaacagaggagaccctgcatgttctctatgaacctggcggcagcgcaaaagatg

SEQ ID NO: 45349 - DNA, 103 bp, Artificial Sequence
  Synthetic Polynucleotide
taatacgactcactatagggtttaataacattagttgtgtgggtgtacagaacagaggagactgtacatgcacacaactaacctggcggcagcgcaaaagatg

SEQ ID NO: 45350 - DNA, 103 bp, Artificial Sequence
  Synthetic Polynucleotide
taatacgactcactatagggacggatactcattttaaatttttgtaaattaacagaggagaaatttaatgaaatttaaaaacctggcggcagcgcaaaagatg

SEQ ID NO: 45351 - DNA, 103 bp, Artificial Sequence
  Synthetic Polynucleotide
taatacgactcactatagggtttatacggatactcattttaaatttttgtaacagaggagaacaaaaatgtaaaatgagaacctggcggcagcgcaaaagatg

SEQ ID NO: 45352 - DNA, 103 bp, Artificial Sequence
  Synthetic Polynucleotide
taatacgactcactatagggcgatttttatacggatactcattttaaattaacagaggagaaatttaatgtgagtatccaacctggcggcagcgcaaaagatg

SEQ ID NO: 45353 - DNA, 103 bp, Artificial Sequence
  Synthetic Polynucleotide
taatacgactcactatagggtttatcgatttttatacggatactcattttaacagaggagaaaaatgatgatccgtataaacctggcggcagcgcaaaagatg

SEQ ID NO: 45354 - DNA, 103 bp, Artificial Sequence
  Synthetic Polynucleotide
taatacgactcactatagggcgcagtttatcgatttttatacggatactcaacagaggagagagtatatgtataaaaataacctggcggcagcgcaaaagatg

SEQ ID NO: 45355 - DNA, 103 bp, Artificial Sequence
  Synthetic Polynucleotide
taatacgactcactatagggtttggcgcagtttatcgatttttatacggaaacagaggagatccgtaatgaaatcgataaacctggcggcagcgcaaaagatg

SEQ ID NO: 45356 - DNA, 103 bp, Artificial Sequence
  Synthetic Polynucleotide
taatacgactcactatagggcacaatttggcgcagtttatcgatttttataacagaggagaataaaaatggataaactgaacctggcggcagcgcaaaagatg

SEQ ID NO: 45357 - DNA, 103 bp, Artificial Sequence
  Synthetic Polynucleotide
taatacgactcactatagggtatgccacaatttggcgcagtttatcgattaacagaggagaaatcgaatgactgcgccaaacctggcggcagcgcaaaagatg

SEQ ID NO: 45358 - DNA, 103 bp, Artificial Sequence
  Synthetic Polynucleotide
taatacgactcactatagggaaaaatatgccacaatttggcgcagtttataacagaggagaataaacatggccaaattgaacctggcggcagcgcaaaagatg

SEQ ID NO: 45359 - DNA, 103 bp, Artificial Sequence
  Synthetic Polynucleotide
taatacgactcactatagggctctgaaaaatatgccacaatttggcgcagaacagaggagactgcgcatgattgtggcaaacctggcggcagcgcaaaagatg

SEQ ID NO: 45360 - DNA, 103 bp, Artificial Sequence
  Synthetic Polynucleotide
taatacgactcactatagggtgatatttaataacattagttgtgtgggtgaacagaggagacacccaatgaactaatgtaacctggcggcagcgcaaaagatg

SEQ ID NO: 45361 - DNA, 103 bp, Artificial Sequence
  Synthetic Polynucleotide
taatacgactcactatagggctgaactctgaaaaatatgccacaatttggaacagaggagaccaaatatgggcatatttaacctggcggcagcgcaaaagatg

SEQ ID NO: 45362 - DNA, 103 bp, Artificial Sequence
  Synthetic Polynucleotide
taatacgactcactatagggcttcactgaactctgaaaaatatgccacaaaacagaggagattgtggatgatttttcagaacctggcggcagcgcaaaagatg

SEQ ID NO: 45363 - DNA, 103 bp, Artificial Sequence
  Synthetic Polynucleotide
taatacgactcactatagggcacttcttcactgaactctgaaaaatatgcaacagaggagagcatatatgtcagagttcaacctggcggcagcgcaaaagatg

SEQ ID NO: 45364 - DNA, 103 bp, Artificial Sequence
  Synthetic Polynucleotide
taatacgactcactatagggatagacacttcttcactgaactctgaaaaaaacagaggagatttttcatggttcagtgaaacctggcggcagcgcaaaagatg

SEQ ID NO: 45365 - DNA, 103 bp, Artificial Sequence
  Synthetic Polynucleotide
taatacgactcactatagggcatttatagacacttcttcactgaactctgaacagaggagacagagtatggtgaagaagaacctggcggcagcgcaaaagatg

SEQ ID NO: 45366 - DNA, 103 bp, Artificial Sequence
  Synthetic Polynucleotide
taatacgactcactataggggtctacatttatagacacttcttcactgaaaacagaggagattcagtatggaagtgtctaacctggcggcagcgcaaaagatg

SEQ ID NO: 45367 - DNA, 103 bp, Artificial Sequence
  Synthetic Polynucleotide
taatacgactcactataggggttgagtctacatttatagacacttcttcaaacagaggagatgaagaatggtctataaaaacctggcggcagcgcaaaagatg

SEQ ID NO: 45368 - DNA, 103 bp, Artificial Sequence
  Synthetic Polynucleotide
taatacgactcactatagggcatccgttgagtctacatttatagacacttaacagaggagaaagtgtatgtaaatgtagaacctggcggcagcgcaaaagatg

SEQ ID NO: 45369 - DNA, 103 bp, Artificial Sequence
  Synthetic Polynucleotide
taatacgactcactatagggtaactcatccgttgagtctacatttatagaaacagaggagatctataatggtagactcaaacctggcggcagcgcaaaagatg

SEQ ID NO: 45370 - DNA, 103 bp, Artificial Sequence
  Synthetic Polynucleotide
taatacgactcactatagggtacattaactcatccgttgagtctacatttaacagaggagaaaatgtatgctcaacggaaacctggcggcagcgcaaaagatg

SEQ ID NO: 45371 - DNA, 103 bp, Artificial Sequence
  Synthetic Polynucleotide
taatacgactcactatagggaaaaatgatatttaataacattagttgtgtaacagaggagaacacaaatgatgttattaaacctggcggcagcgcaaaagatg

SEQ ID NO: 45372 - DNA, 103 bp, Artificial Sequence
  Synthetic Polynucleotide
taatacgactcactatagggaaatatacattaactcatccgttgagtctaaacagaggagatagactatgcggatgagtaacctggcggcagcgcaaaagatg

SEQ ID NO: 45373 - DNA, 103 bp, Artificial Sequence
  Synthetic Polynucleotide
taatacgactcactatagggggcaaaaatatacattaactcatccgttgaaacagaggagatcaacgatggagttaatgaacctggcggcagcgcaaaagatg

SEQ ID NO: 45374 - DNA, 103 bp, Artificial Sequence
  Synthetic Polynucleotide
taatacgactcactatagggaaggcggcaaaaatatacattaactcatccaacagaggagaggatgaatgaatgtatataacctggcggcagcgcaaaagatg

SEQ ID NO: 45375 - DNA, 103 bp, Artificial Sequence
  Synthetic Polynucleotide
taatacgactcactatagggcgcccaaggcggcaaaaatatacattaactaacagaggagaagttaaatgatatttttgaacctggcggcagcgcaaaagatg

SEQ ID NO: 45376 - DNA, 103 bp, Artificial Sequence
  Synthetic Polynucleotide
taatacgactcactatagggagatccgcccaaggcggcaaaaatatacataacagaggagaatgtatatgtttgccgccaacctggcggcagcgcaaaagatg

SEQ ID NO: 45377 - DNA, 103 bp, Artificial Sequence
  Synthetic Polynucleotide
taatacgactcactatagggtttacagatccgcccaaggcggcaaaaataaacagaggagatattttatgcgccttgggaacctggcggcagcgcaaaagatg

SEQ ID NO: 45378 - DNA, 103 bp, Artificial Sequence
  Synthetic Polynucleotide
taatacgactcactatagggaaatgtttacagatccgcccaaggcggcaaaacagaggagattgccgatgtgggcggataacctggcggcagcgcaaaagatg

SEQ ID NO: 45379 - DNA, 103 bp, Artificial Sequence
  Synthetic Polynucleotide
taatacgactcactatagggggcccaaatgtttacagatccgcccaaggcaacagaggagagccttgatgggatctgtaaacctggcggcagcgcaaaagatg

SEQ ID NO: 45380 - DNA, 103 bp, Artificial Sequence
  Synthetic Polynucleotide
taatacgactcactatagggataatggcccaaatgtttacagatccgcccaacagaggagagggcggatgtgtaaacataacctggcggcagcgcaaaagatg

SEQ ID NO: 45381 - DNA, 103 bp, Artificial Sequence
  Synthetic Polynucleotide
taatacgactcactataggggaggtataatggcccaaatgtttacagatcaacagaggagagatctgatgacatttgggaacctggcggcagcgcaaaagatg

SEQ ID NO: 45382 - DNA, 103 bp, Artificial Sequence
  Synthetic Polynucleotide
taatacgactcactatagggattcaaaaaatgatatttaataacattagtaacagaggagaactaatatgattaaatataacctggcggcagcgcaaaagatg

SEQ ID NO: 45383 - DNA, 103 bp, Artificial Sequence
  Synthetic Polynucleotide
taatacgactcactatagggactaagaggtataatggcccaaatgtttacaacagaggagagtaaacatgtgggccattaacctggcggcagcgcaaaagatg

SEQ ID NO: 45384 - DNA, 103 bp, Artificial Sequence
  Synthetic Polynucleotide
taatacgactcactataggggatgcactaagaggtataatggcccaaatgaacagaggagacatttgatgcattataccaacctggcggcagcgcaaaagatg

SEQ ID NO: 45385 - DNA, 103 bp, Artificial Sequence
  Synthetic Polynucleotide
taatacgactcactatagggacactgatgcactaagaggtataatggcccaacagaggagagggccaatgtacctcttaaacctggcggcagcgcaaaagatg

SEQ ID NO: 45386 - DNA, 103 bp, Artificial Sequence
  Synthetic Polynucleotide
taatacgactcactataggggtagaacactgatgcactaagaggtataataacagaggagaattataatgcttagtgcaaacctggcggcagcgcaaaagatg

SEQ ID NO: 45387 - DNA, 103 bp, Artificial Sequence
  Synthetic Polynucleotide
taatacgactcactatagggccgcggtagaacactgatgcactaagaggtaacagaggagaacctctatgtgcatcagtaacctggcggcagcgcaaaagatg

SEQ ID NO: 45388 - DNA, 103 bp, Artificial Sequence
  Synthetic Polynucleotide
taatacgactcactatagggcggctccgcggtagaacactgatgcactaaaacagaggagattagtgatgcagtgttctaacctggcggcagcgcaaaagatg

SEQ ID NO: 45389 - DNA, 103 bp, Artificial Sequence
  Synthetic Polynucleotide
taatacgactcactatagggattttcggctccgcggtagaacactgatgcaacagaggagagcatcaatgttctaccgcaacctggcggcagcgcaaaagatg

SEQ ID NO: 45390 - DNA, 103 bp, Artificial Sequence
  Synthetic Polynucleotide
taatacgactcactatagggacaatattttcggctccgcggtagaacactaacagaggagaagtgttatgccgcggagcaacctggcggcagcgcaaaagatg

SEQ ID NO: 45391 - DNA, 103 bp, Artificial Sequence
  Synthetic Polynucleotide
taatacgactcactatagggtaaacacaatattttcggctccgcggtagaaacagaggagatctaccatggagccgaaaaacctggcggcagcgcaaaagatg

SEQ ID NO: 45392 - DNA, 103 bp, Artificial Sequence
  Synthetic Polynucleotide
taatacgactcactatagggaagattaaacacaatattttcggctccgcgaacagaggagacgcggaatggaaaatattaacctggcggcagcgcaaaagatg

SEQ ID NO: 45393 - DNA, 103 bp, Artificial Sequence
  Synthetic Polynucleotide
taatacgactcactatagggaatatattcaaaaaatgatatttaataacaaacagaggagatgttatatgatatcatttaacctggcggcagcgcaaaagatg

SEQ ID NO: 45394 - DNA, 103 bp, Artificial Sequence
  Synthetic Polynucleotide
taatacgactcactatagggaccggaagattaaacacaatattttcggctaacagaggagaagccgaatgtattgtgttaacctggcggcagcgcaaaagatg

SEQ ID NO: 45395 - DNA, 103 bp, Artificial Sequence
  Synthetic Polynucleotide
taatacgactcactatagggtggacaccggaagattaaacacaatattttaacagaggagaaaaataatgtgtttaatcaacctggcggcagcgcaaaagatg

SEQ ID NO: 45396 - DNA, 103 bp, Artificial Sequence
  Synthetic Polynucleotide
taatacgactcactatagggtaccttggacaccggaagattaaacacaataacagaggagaattgtgatgaatcttccgaacctggcggcagcgcaaaagatg

SEQ ID NO: 45397 - DNA, 103 bp, Artificial Sequence
  Synthetic Polynucleotide
taatacgactcactataggggattttaccttggacaccggaagattaaacaacagaggagagtttaaatgtccggtgtcaacctggcggcagcgcaaaagatg

SEQ ID NO: 45398 - DNA, 103 bp, Artificial Sequence
  Synthetic Polynucleotide
taatacgactcactatagggaacacgattttaccttggacaccggaagataacagaggagaatcttcatgtgtccaaggaacctggcggcagcgcaaaagatg

SEQ ID NO: 45399 - DNA, 103 bp, Artificial Sequence
  Synthetic Polynucleotide
taatacgactcactatagggacacaaacacgattttaccttggacaccggaacagaggagaccggtgatgaaggtaaaaaacctggcggcagcgcaaaagatg

SEQ ID NO: 45400 - DNA, 103 bp, Artificial Sequence
  Synthetic Polynucleotide
taatacgactcactatagggaaactacacaaacacgattttaccttggacaacagaggagagtccaaatgaaaatcgtgaacctggcggcagcgcaaaagatg

SEQ ID NO: 45401 - DNA, 103 bp, Artificial Sequence
  Synthetic Polynucleotide
taatacgactcactatagggtgtgaaaactacacaaacacgattttacctaacagaggagaaggtaaatgcgtgtttgtaacctggcggcagcgcaaaagatg

SEQ ID NO: 45402 - DNA, 103 bp, Artificial Sequence
  Synthetic Polynucleotide
taatacgactcactatagggatcattgtgaaaactacacaaacacgatttaacagaggagaaaatcgatgttgtgtagtaacctggcggcagcgcaaaagatg

SEQ ID NO: 45403 - DNA, 103 bp, Artificial Sequence
  Synthetic Polynucleotide
taatacgactcactatagggatggcatcattgtgaaaactacacaaacacaacagaggagagtgtttatgtagttttcaaacctggcggcagcgcaaaagatg

SEQ ID NO: 45404 - DNA, 103 bp, Artificial Sequence
  Synthetic Polynucleotide
taatacgactcactataggggtataaatatattcaaaaaatgatatttaaaacagaggagattaaatatgattttttgaaacctggcggcagcgcaaaagatg

SEQ ID NO: 45405 - DNA, 103 bp, Artificial Sequence
  Synthetic Polynucleotide
taatacgactcactatagggctatgatggcatcattgtgaaaactacacaaacagaggagatgtgtaatgttcacaatgaacctggcggcagcgcaaaagatg

SEQ ID NO: 45406 - DNA, 103 bp, Artificial Sequence
  Synthetic Polynucleotide
taatacgactcactatagggtatatctatgatggcatcattgtgaaaactaacagaggagaagttttatgaatgatgccaacctggcggcagcgcaaaagatg

SEQ ID NO: 45407 - DNA, 103 bp, Artificial Sequence
  Synthetic Polynucleotide
taatacgactcactatagggggttctatatctatgatggcatcattgtgaaacagaggagatcacaaatgtgccatcataacctggcggcagcgcaaaagatg

SEQ ID NO: 45408 - DNA, 103 bp, Artificial Sequence
  Synthetic Polynucleotide
taatacgactcactataggggatcaggttctatatctatgatggcatcataacagaggagaatgatgatgtcatagataaacctggcggcagcgcaaaagatg

SEQ ID NO: 45409 - DNA, 103 bp, Artificial Sequence
  Synthetic Polynucleotide
taatacgactcactatagggttccagatcaggttctatatctatgatggcaacagaggagagccatcatggatatagaaaacctggcggcagcgcaaaagatg

SEQ ID NO: 45410 - DNA, 103 bp, Artificial Sequence
  Synthetic Polynucleotide
taatacgactcactatagggttattttccagatcaggttctatatctatgaacagaggagacatagaatgagaacctgaaacctggcggcagcgcaaaagatg

SEQ ID NO: 45411 - DNA, 103 bp, Artificial Sequence
  Synthetic Polynucleotide
taatacgactcactatagggctagattattttccagatcaggttctatataacagaggagaatatagatgctgatctggaacctggcggcagcgcaaaagatg

SEQ ID NO: 45412 - DNA, 103 bp, Artificial Sequence
  Synthetic Polynucleotide
taatacgactcactatagggttttactagattattttccagatcaggttcaacagaggagagaacctatgctggaaaataacctggcggcagcgcaaaagatg

SEQ ID NO: 45413 - DNA, 103 bp, Artificial Sequence
  Synthetic Polynucleotide
taatacgactcactataggggaaagttttactagattattttccagatcaaacagaggagatgatctatgaaataatctaacctggcggcagcgcaaaagatg

SEQ ID NO: 45414 - DNA, 103 bp, Artificial Sequence
  Synthetic Polynucleotide
taatacgactcactatagggaactagaaagttttactagattattttccaaacagaggagatggaaaatgatctagtaaaacctggcggcagcgcaaaagatg

SEQ ID NO: 45415 - DNA, 103 bp, Artificial Sequence
  Synthetic Polynucleotide
taatacgactcactatagggacatggtataaatatattcaaaaaatgataaacagaggagatatcatatgttgaatataaacctggcggcagcgcaaaagatg

SEQ ID NO: 45416 - DNA, 103 bp, Artificial Sequence
  Synthetic Polynucleotide
taatacgactcactatagggatgataactagaaagttttactagattattaacagaggagaaataatatggtaaaacttaacctggcggcagcgcaaaagatg

SEQ ID NO: 45417 - DNA, 103 bp, Artificial Sequence
  Synthetic Polynucleotide
taatacgactcactatagggactacatgataactagaaagttttactagaaacagaggagatctagtatgactttctagaacctggcggcagcgcaaaagatg

SEQ ID NO: 45418 - DNA, 103 bp, Artificial Sequence
  Synthetic Polynucleotide
taatacgactcactatagggcacttactacatgataactagaaagttttaaacagaggagataaaacatgctagttatcaacctggcggcagcgcaaaagatg

SEQ ID NO: 45419 - DNA, 103 bp, Artificial Sequence
  Synthetic Polynucleotide
taatacgactcactatagggatcgacacttactacatgataactagaaagaacagaggagactttctatgtatcatgtaaacctggcggcagcgcaaaagatg

SEQ ID NO: 45420 - DNA, 103 bp, Artificial Sequence
  Synthetic Polynucleotide
taatacgactcactatagggttacaatcgacacttactacatgataactaaacagaggagatagttaatgtgtagtaagaacctggcggcagcgcaaaagatg

SEQ ID NO: 45421 - DNA, 103 bp, Artificial Sequence
  Synthetic Polynucleotide
taatacgactcactatagggccttgttacaatcgacacttactacatgataacagaggagaatcatgatgtaagtgtcgaacctggcggcagcgcaaaagatg

SEQ ID NO: 45422 - DNA, 103 bp, Artificial Sequence
  Synthetic Polynucleotide
taatacgactcactatagggcagttccttgttacaatcgacacttactacaacagaggagagtagtaatggtcgattgtaacctggcggcagcgcaaaagatg

SEQ ID NO: 45423 - DNA, 103 bp, Artificial Sequence
  Synthetic Polynucleotide
taatacgactcactatagggggcatcagttccttgttacaatcgacacttaacagaggagaaagtgtatgttgtaacaaaacctggcggcagcgcaaaagatg

SEQ ID NO: 45424 - DNA, 103 bp, Artificial Sequence
  Synthetic Polynucleotide
taatacgactcactatagggtaataggcatcagttccttgttacaatcgaaacagaggagatcgattatgacaaggaacaacctggcggcagcgcaaaagatg

SEQ ID NO: 45425 - DNA, 103 bp, Artificial Sequence
  Synthetic Polynucleotide
taatacgactcactatagggtgtcctaataggcatcagttccttgttacaaacagaggagatgtaacatggaactgatgaacctggcggcagcgcaaaagatg

SEQ ID NO: 45426 - DNA, 103 bp, Artificial Sequence
  Synthetic Polynucleotide
taatacgactcactatagggttttgacatggtataaatatattcaaaaaaaacagaggagattttttatgtatatttataacctggcggcagcgcaaaagatg

SEQ ID NO: 45427 - DNA, 103 bp, Artificial Sequence
  Synthetic Polynucleotide
taatacgactcactataggggtatctgtcctaataggcatcagttccttgaacagaggagacaaggaatggatgcctataacctggcggcagcgcaaaagatg

SEQ ID NO: 45428 - DNA, 103 bp, Artificial Sequence
  Synthetic Polynucleotide
taatacgactcactatagggtagtagtatctgtcctaataggcatcagttaacagaggagaaactgaatgctattaggaaacctggcggcagcgcaaaagatg

SEQ ID NO: 45429 - DNA, 103 bp, Artificial Sequence
  Synthetic Polynucleotide
taatacgactcactatagggacaaatagtagtatctgtcctaataggcataacagaggagaatgcctatgaggacagataacctggcggcagcgcaaaagatg

SEQ ID NO: 45430 - DNA, 103 bp, Artificial Sequence
  Synthetic Polynucleotide
taatacgactcactatagggcttagacaaatagtagtatctgtcctaataaacagaggagatattagatgagatactacaacctggcggcagcgcaaaagatg

SEQ ID NO: 45431 - DNA, 103 bp, Artificial Sequence
  Synthetic Polynucleotide
taatacgactcactatagggctatacttagacaaatagtagtatctgtccaacagaggagaggacagatgctactatttaacctggcggcagcgcaaaagatg

SEQ ID NO: 45432 - DNA, 103 bp, Artificial Sequence
  Synthetic Polynucleotide
taatacgactcactatagggttgatctatacttagacaaatagtagtatcaacagaggagagatactatgatttgtctaaacctggcggcagcgcaaaagatg

SEQ ID NO: 45433 - DNA, 103 bp, Artificial Sequence
  Synthetic Polynucleotide
taatacgactcactatagggttcttttgatctatacttagacaaatagtaaacagaggagatactatatgtctaagtataacctggcggcagcgcaaaagatg

SEQ ID NO: 45434 - DNA, 103 bp, Artificial Sequence
  Synthetic Polynucleotide
taatacgactcactatagggaagatttcttttgatctatacttagacaaaaacagaggagatttgtcatggtatagatcaacctggcggcagcgcaaaagatg

SEQ ID NO: 45435 - DNA, 103 bp, Artificial Sequence
  Synthetic Polynucleotide
taatacgactcactatagggcacgtaagatttcttttgatctatacttagaacagaggagactaagtatggatcaaaagaacctggcggcagcgcaaaagatg

SEQ ID NO: 45436 - DNA, 103 bp, Artificial Sequence
  Synthetic Polynucleotide
taatacgactcactatagggttaaacacgtaagatttcttttgatctataaacagaggagatatagaatgaaagaaatcaacctggcggcagcgcaaaagatg

SEQ ID NO: 45437 - DNA, 103 bp, Artificial Sequence
  Synthetic Polynucleotide
taatacgactcactatagggacaagttttgacatggtataaatatattcaaacagaggagatgaataatgttataccataacctggcggcagcgcaaaagatg

SEQ ID NO: 45438 - DNA, 103 bp, Artificial Sequence
  Synthetic Polynucleotide
taatacgactcactataggggaaaattaaacacgtaagatttcttttgataacagaggagaatcaaaatgaatcttacgaacctggcggcagcgcaaaagatg

SEQ ID NO: 45439 - DNA, 103 bp, Artificial Sequence
  Synthetic Polynucleotide
taatacgactcactatagggcttgtgaaaattaaacacgtaagatttcttaacagaggagaaagaaaatgtacgtgtttaacctggcggcagcgcaaaagatg

SEQ ID NO: 45440 - DNA, 103 bp, Artificial Sequence
  Synthetic Polynucleotide
taatacgactcactatagggtcatacttgtgaaaattaaacacgtaagataacagaggagaatcttaatggtttaatttaacctggcggcagcgcaaaagatg

SEQ ID NO: 45441 - DNA, 103 bp, Artificial Sequence
  Synthetic Polynucleotide
taatacgactcactatagggtttcttcatacttgtgaaaattaaacacgtaacagaggagaacgtgtatgattttcacaaacctggcggcagcgcaaaagatg

SEQ ID NO: 45442 - DNA, 103 bp, Artificial Sequence
  Synthetic Polynucleotide
taatacgactcactatagggacatttttcttcatacttgtgaaaattaaaaacagaggagatttaatatgcacaagtataacctggcggcagcgcaaaagatg

SEQ ID NO: 45443 - DNA, 103 bp, Artificial Sequence
  Synthetic Polynucleotide
taatacgactcactatagggccacaacatttttcttcatacttgtgaaaaaacagaggagattttcaatggtatgaagaaacctggcggcagcgcaaaagatg

SEQ ID NO: 45444 - DNA, 103 bp, Artificial Sequence
  Synthetic Polynucleotide
taatacgactcactatagggttctaccacaacatttttcttcatacttgtaacagaggagaacaagtatgaagaaaaataacctggcggcagcgcaaaagatg

SEQ ID NO: 45445 - DNA, 103 bp, Artificial Sequence
  Synthetic Polynucleotide
taatacgactcactataggggacggttctaccacaacatttttcttcataaacagaggagatatgaaatgaaatgttgtaacctggcggcagcgcaaaagatg

SEQ ID NO: 45446 - DNA, 103 bp, Artificial Sequence
  Synthetic Polynucleotide
taatacgactcactatagggtgaatgacggttctaccacaacatttttctaacagaggagaagaaaaatgttgtggtagaacctggcggcagcgcaaaagatg

SEQ ID NO: 45447 - DNA, 103 bp, Artificial Sequence
  Synthetic Polynucleotide
taatacgactcactatagggctagatgaatgacggttctaccacaacattaacagaggagaaatgttatggtagaaccgaacctggcggcagcgcaaaagatg

SEQ ID NO: 45448 - DNA, 103 bp, Artificial Sequence
  Synthetic Polynucleotide
taatacgactcactatagggattgaacaagttttgacatggtataaatataacagaggagaatatttatgccatgtcaaaacctggcggcagcgcaaaagatg

SEQ ID NO: 45449 - DNA, 103 bp, Artificial Sequence
  Synthetic Polynucleotide
taatacgactcactatagggccattctagatgaatgacggttctaccacaaacagaggagatgtggtatgaccgtcattaacctggcggcagcgcaaaagatg

SEQ ID NO: 45450 - DNA, 103 bp, Artificial Sequence
  Synthetic Polynucleotide
taatacgactcactatagggaacaaccattctagatgaatgacggttctaaacagaggagatagaacatgcattcatctaacctggcggcagcgcaaaagatg

SEQ ID NO: 45451 - DNA, 103 bp, Artificial Sequence
  Synthetic Polynucleotide
taatacgactcactatagggagcccaacaaccattctagatgaatgacggaacagaggagaccgtcaatgatctagaataacctggcggcagcgcaaaagatg

SEQ ID NO: 45452 - DNA, 103 bp, Artificial Sequence
  Synthetic Polynucleotide
taatacgactcactatagggaataaagcccaacaaccattctagatgaataacagaggagaattcatatggaatggttgaacctggcggcagcgcaaaagatg

SEQ ID NO: 45453 - DNA, 103 bp, Artificial Sequence
  Synthetic Polynucleotide
taatacgactcactatagggcacttaataaagcccaacaaccattctagaaacagaggagatctagaatggttgttgggaacctggcggcagcgcaaaagatg

SEQ ID NO: 45454 - DNA, 103 bp, Artificial Sequence
  Synthetic Polynucleotide
taatacgactcactatagggtaatacacttaataaagcccaacaaccattaacagaggagaaatggtatgtgggctttaaacctggcggcagcgcaaaagatg

SEQ ID NO: 45455 - DNA, 103 bp, Artificial Sequence
  Synthetic Polynucleotide
taatacgactcactatagggctgactaatacacttaataaagcccaacaaaacagaggagattgttgatgtttattaagaacctggcggcagcgcaaaagatg

SEQ ID NO: 45456 - DNA, 103 bp, Artificial Sequence
  Synthetic Polynucleotide
taatacgactcactatagggtgatgctgactaatacacttaataaagcccaacagaggagagggcttatgtaagtgtataacctggcggcagcgcaaaagatg

SEQ ID NO: 45457 - DNA, 103 bp, Artificial Sequence
  Synthetic Polynucleotide
taatacgactcactatagggaatgctgatgctgactaatacacttaataaaacagaggagattattaatggtattagtcaacctggcggcagcgcaaaagatg

SEQ ID NO: 45458 - DNA, 103 bp, Artificial Sequence
  Synthetic Polynucleotide
taatacgactcactatagggagtcaaatgctgatgctgactaatacacttaacagaggagaaagtgtatgagtcagcataacctggcggcagcgcaaaagatg

SEQ ID NO: 45459 - DNA, 103 bp, Artificial Sequence
  Synthetic Polynucleotide
taatacgactcactatagggtttctcatagatggacccatagagaaagcgaacagaggagacgctttatgtatgggtccaacctggcggcagcgcaaaagatg

SEQ ID NO: 45460 - DNA, 103 bp, Artificial Sequence
  Synthetic Polynucleotide
taatacgactcactatagggtaataattgaacaagttttgacatggtataaacagaggagatataccatgtcaaaacttaacctggcggcagcgcaaaagatg

SEQ ID NO: 45461 - DNA, 103 bp, Artificial Sequence
  Synthetic Polynucleotide
taatacgactcactatagggataatagtcaaatgctgatgctgactaataaacagaggagatattagatggcatcagcaaacctggcggcagcgcaaaagatg

SEQ ID NO: 45462 - DNA, 103 bp, Artificial Sequence
  Synthetic Polynucleotide
taatacgactcactatagggtaaacataatagtcaaatgctgatgctgacaacagaggagagtcagcatgagcatttgaaacctggcggcagcgcaaaagatg

SEQ ID NO: 45463 - DNA, 103 bp, Artificial Sequence
  Synthetic Polynucleotide
taatacgactcactatagggatctttaaacataatagtcaaatgctgatgaacagaggagacatcagatgttgactattaacctggcggcagcgcaaaagatg

SEQ ID NO: 45464 - DNA, 103 bp, Artificial Sequence
  Synthetic Polynucleotide
taatacgactcactatagggttgtcatctttaaacataatagtcaaatgcaacagaggagagcatttatgtattatgttaacctggcggcagcgcaaaagatg

SEQ ID NO: 45465 - DNA, 103 bp, Artificial Sequence
  Synthetic Polynucleotide
taatacgactcactatagggtaatattgtcatctttaaacataatagtcaaacagaggagatgactaatgtgtttaaagaacctggcggcagcgcaaaagatg

SEQ ID NO: 45466 - DNA, 103 bp, Artificial Sequence
  Synthetic Polynucleotide
taatacgactcactatagggcataataatattgtcatctttaaacataataacagaggagaattatgatgaaagatgacaacctggcggcagcgcaaaagatg

SEQ ID NO: 45467 - DNA, 103 bp, Artificial Sequence
  Synthetic Polynucleotide
taatacgactcactataggggtcttcataataatattgtcatctttaaacaacagaggagagtttaaatgtgacaatataacctggcggcagcgcaaaagatg

SEQ ID NO: 45468 - DNA, 103 bp, Artificial Sequence
  Synthetic Polynucleotide
taatacgactcactatagggcaggagtcttcataataatattgtcatcttaacagaggagaaagatgatgatattattaaacctggcggcagcgcaaaagatg

SEQ ID NO: 45469 - DNA, 103 bp, Artificial Sequence
  Synthetic Polynucleotide
taatacgactcactatagggattaccaggagtcttcataataatattgtcaacagaggagagacaatatgattatgaagaacctggcggcagcgcaaaagatg

SEQ ID NO: 45470 - DNA, 103 bp, Artificial Sequence
  Synthetic Polynucleotide
taatacgactcactatagggtcagtattaccaggagtcttcataataataaacagaggagatattatatggaagactccaacctggcggcagcgcaaaagatg

SEQ ID NO: 45471 - DNA, 103 bp, Artificial Sequence
  Synthetic Polynucleotide
taatacgactcactatagggtttattaataattgaacaagttttgacatgaacagaggagacatgtcatgacttgttcaaacctggcggcagcgcaaaagatg

SEQ ID NO: 45472 - DNA, 103 bp, Artificial Sequence
  Synthetic Polynucleotide
taatacgactcactatagggaagcatcagtattaccaggagtcttcataaaacagaggagattatgaatgctcctggtaaacctggcggcagcgcaaaagatg

SEQ ID NO: 45473 - DNA, 103 bp, Artificial Sequence
  Synthetic Polynucleotide
taatacgactcactatagggggaaaaagcatcagtattaccaggagtcttaacagaggagaaagactatgggtaatactaacctggcggcagcgcaaaagatg

SEQ ID NO: 45474 - DNA, 103 bp, Artificial Sequence
  Synthetic Polynucleotide
taatacgactcactatagggtccctggaaaaagcatcagtattaccaggaaacagaggagatcctggatgtactgatgcaacctggcggcagcgcaaaagatg

SEQ ID NO: 45475 - DNA, 103 bp, Artificial Sequence
  Synthetic Polynucleotide
taatacgactcactatagggaatattccctggaaaaagcatcagtattacaacagaggagagtaataatgatgctttttaacctggcggcagcgcaaaagatg

SEQ ID NO: 45476 - DNA, 103 bp, Artificial Sequence
  Synthetic Polynucleotide
taatacgactcactatagggcatagaatattccctggaaaaagcatcagtaacagaggagaactgatatgttttccaggaacctggcggcagcgcaaaagatg

SEQ ID NO: 45477 - DNA, 103 bp, Artificial Sequence
  Synthetic Polynucleotide
taatacgactcactatagggtcagtcatagaatattccctggaaaaagcaaacagaggagatgctttatgcagggaataaacctggcggcagcgcaaaagatg

SEQ ID NO: 45478 - DNA, 103 bp, Artificial Sequence
  Synthetic Polynucleotide
taatacgactcactatagggaacattcagtcatagaatattccctggaaaaacagaggagatttccaatgaatattctaaacctggcggcagcgcaaaagatg

SEQ ID NO: 45479 - DNA, 103 bp, Artificial Sequence
  Synthetic Polynucleotide
taatacgactcactatagggttgagaacattcagtcatagaatattccctaacagaggagaagggaaatgtctatgactaacctggcggcagcgcaaaagatg

SEQ ID NO: 45480 - DNA, 103 bp, Artificial Sequence
  Synthetic Polynucleotide
taatacgactcactatagggagttcttgagaacattcagtcatagaatataacagaggagaatattcatggactgaatgaacctggcggcagcgcaaaagatg

SEQ ID NO: 45481 - DNA, 103 bp, Artificial Sequence
  Synthetic Polynucleotide
taatacgactcactatagggtttgtagttcttgagaacattcagtcatagaacagaggagactatgaatgaatgttctcaacctggcggcagcgcaaaagatg

SEQ ID NO: 45482 - DNA, 103 bp, Artificial Sequence
  Synthetic Polynucleotide
taatacgactcactatagggttatttttattaataattgaacaagttttgaacagaggagacaaaacatgttcaattataacctggcggcagcgcaaaagatg

SEQ ID NO: 45483 - DNA, 103 bp, Artificial Sequence
  Synthetic Polynucleotide
taatacgactcactatagggaaacttttgtagttcttgagaacattcagtaacagaggagaactgaaatgtctcaagaaaacctggcggcagcgcaaaagatg

SEQ ID NO: 45484 - DNA, 103 bp, Artificial Sequence
  Synthetic Polynucleotide
taatacgactcactatagggaaagaaaacttttgtagttcttgagaacataacagaggagaatgttcatgagaactacaaacctggcggcagcgcaaaagatg

SEQ ID NO: 45485 - DNA, 103 bp, Artificial Sequence
  Synthetic Polynucleotide
taatacgactcactatagggttttgaaagaaaacttttgtagttcttgagaacagaggagactcaagatgtacaaaagtaacctggcggcagcgcaaaagatg

SEQ ID NO: 45486 - DNA, 103 bp, Artificial Sequence
  Synthetic Polynucleotide
taatacgactcactatagggagctattttgaaagaaaacttttgtagttcaacagaggagagaactaatgaagttttctaacctggcggcagcgcaaaagatg

SEQ ID NO: 45487 - DNA, 103 bp, Artificial Sequence
  Synthetic Polynucleotide
taatacgactcactataggggagatagctattttgaaagaaaacttttgtaacagaggagaacaaaaatgttctttcaaaacctggcggcagcgcaaaagatg

SEQ ID NO: 45488 - DNA, 103 bp, Artificial Sequence
  Synthetic Polynucleotide
taatacgactcactataggggagacgagatagctattttgaaagaaaactaacagaggagaagttttatgtcaaaatagaacctggcggcagcgcaaaagatg

SEQ ID NO: 45489 - DNA, 103 bp, Artificial Sequence
  Synthetic Polynucleotide
taatacgactcactataggggttgagagacgagatagctattttgaaagaaacagaggagatctttcatgatagctatcaacctggcggcagcgcaaaagatg

SEQ ID NO: 45490 - DNA, 103 bp, Artificial Sequence
  Synthetic Polynucleotide
taatacgactcactatagggagtttgttgagagacgagatagctattttgaacagaggagacaaaatatgtatctcgtcaacctggcggcagcgcaaaagatg

SEQ ID NO: 45491 - DNA, 103 bp, Artificial Sequence
  Synthetic Polynucleotide
taatacgactcactatagggctcgtagtttgttgagagacgagatagctaaacagaggagatagctaatgcgtctctcaaacctggcggcagcgcaaaagatg

SEQ ID NO: 45492 - DNA, 103 bp, Artificial Sequence
  Synthetic Polynucleotide
taatacgactcactataggggaatcctcgtagtttgttgagagacgagataacagaggagaatctcgatgctcaacaaaaacctggcggcagcgcaaaagatg

SEQ ID NO: 45493 - DNA, 103 bp, Artificial Sequence
  Synthetic Polynucleotide
taatacgactcactatagggctaaattatttttattaataattgaacaagaacagaggagacttgttatgttattaataaacctggcggcagcgcaaaagatg

SEQ ID NO: 45494 - DNA, 103 bp, Artificial Sequence
  Synthetic Polynucleotide
taatacgactcactatagggtttttgaatcctcgtagtttgttgagagacaacagaggagagtctctatgcaaactacgaacctggcggcagcgcaaaagatg

SEQ ID NO: 45495 - DNA, 103 bp, Artificial Sequence
  Synthetic Polynucleotide
taatacgactcactatagggctctctttttgaatcctcgtagtttgttgaaacagaggagatcaacaatgtacgaggataacctggcggcagcgcaaaagatg

SEQ ID NO: 45496 - DNA, 103 bp, Artificial Sequence
  Synthetic Polynucleotide
taatacgactcactatagggattgactctctttttgaatcctcgtagtttaacagaggagaaaactaatgggattcaaaaacctggcggcagcgcaaaagatg

SEQ ID NO: 45497 - DNA, 103 bp, Artificial Sequence
  Synthetic Polynucleotide
taatacgactcactatagggaaaacattgactctctttttgaatcctcgtaacagaggagaacgaggatgcaaaaagagaacctggcggcagcgcaaaagatg

SEQ ID NO: 45498 - DNA, 103 bp, Artificial Sequence
  Synthetic Polynucleotide
taatacgactcactatagggtttcaaaaacattgactctctttttgaatcaacagaggagagattcaatgagagagtcaaacctggcggcagcgcaaaagatg

SEQ ID NO: 45499 - DNA, 103 bp, Artificial Sequence
  Synthetic Polynucleotide
taatacgactcactatagggtctggtttcaaaaacattgactctctttttaacagaggagaaaaaagatggtcaatgttaacctggcggcagcgcaaaagatg

SEQ ID NO: 45500 - DNA, 103 bp, Artificial Sequence
  Synthetic Polynucleotide
taatacgactcactatagggacgattctggtttcaaaaacattgactctcaacagaggagagagagtatgtgtttttgaaacctggcggcagcgcaaaagatg

SEQ ID NO: 45501 - DNA, 103 bp, Artificial Sequence
  Synthetic Polynucleotide
taatacgactcactatagggccattacgattctggtttcaaaaacattgaaacagaggagatcaatgatgttgaaaccaaacctggcggcagcgcaaaagatg

SEQ ID NO: 45502 - DNA, 103 bp, Artificial Sequence
  Synthetic Polynucleotide
taatacgactcactatagggattatccattacgattctggtttcaaaaacaacagaggagagtttttatgaccagaatcaacctggcggcagcgcaaaagatg

SEQ ID NO: 45503 - DNA, 103 bp, Artificial Sequence
  Synthetic Polynucleotide
taatacgactcactatagggtcgtcattatccattacgattctggtttcaaacagaggagatgaaacatgaatcgtaataacctggcggcagcgcaaaagatg

SEQ ID NO: 45504 - DNA, 103 bp, Artificial Sequence
  Synthetic Polynucleotide
taatacgactcactatagggaaacactaaattatttttattaataattgaaacagaggagatcaattatgaataaaaataacctggcggcagcgcaaaagatg

SEQ ID NO: 45505 - DNA, 103 bp, Artificial Sequence
  Synthetic Polynucleotide
taatacgactcactatagggtgttatcgtcattatccattacgattctggaacagaggagaccagaaatgtaatggataaacctggcggcagcgcaaaagatg

SEQ ID NO: 45506 - DNA, 103 bp, Artificial Sequence
  Synthetic Polynucleotide
taatacgactcactatagggtagaatgttatcgtcattatccattacgataacagaggagaatcgtaatggataatgacaacctggcggcagcgcaaaagatg

SEQ ID NO: 45507 - DNA, 103 bp, Artificial Sequence
  Synthetic Polynucleotide
taatacgactcactatagggattcctagaatgttatcgtcattatccattaacagaggagaaatggaatgtgacgataaaacctggcggcagcgcaaaagatg

SEQ ID NO: 45508 - DNA, 103 bp, Artificial Sequence
  Synthetic Polynucleotide
taatacgactcactatagggacaacattcctagaatgttatcgtcattataacagaggagaataatgatgataacattcaacctggcggcagcgcaaaagatg

SEQ ID NO: 45509 - DNA, 103 bp, Artificial Sequence
  Synthetic Polynucleotide
taatacgactcactatagggcgaaaacaacattcctagaatgttatcgtcaacagaggagagacgatatgattctaggaaacctggcggcagcgcaaaagatg

SEQ ID NO: 45510 - DNA, 103 bp, Artificial Sequence
  Synthetic Polynucleotide
taatacgactcactatagggctatccgaaaacaacattcctagaatgttaaacagaggagataacatatgaggaatgttaacctggcggcagcgcaaaagatg

SEQ ID NO: 45511 - DNA, 103 bp, Artificial Sequence
  Synthetic Polynucleotide
taatacgactcactataggggaactctatccgaaaacaacattcctagaaaacagaggagattctagatgtgttgttttaacctggcggcagcgcaaaagatg

SEQ ID NO: 45512 - DNA, 103 bp, Artificial Sequence
  Synthetic Polynucleotide
taatacgactcactatagggggattgaactctatccgaaaacaacattccaacagaggagaggaatgatgttttcggataacctggcggcagcgcaaaagatg

SEQ ID NO: 45513 - DNA, 103 bp, Artificial Sequence
  Synthetic Polynucleotide
taatacgactcactatagggttaaaggattgaactctatccgaaaacaacaacagaggagagttgttatgggatagagtaacctggcggcagcgcaaaagatg

SEQ ID NO: 45514 - DNA, 103 bp, Artificial Sequence
  Synthetic Polynucleotide
taatacgactcactatagggtgatcttaaaggattgaactctatccgaaaaacagaggagatttcggatggagttcaataacctggcggcagcgcaaaagatg

SEQ ID NO: 45515 - DNA, 103 bp, Artificial Sequence
  Synthetic Polynucleotide
taatacgactcactatagggaatttaaacactaaattatttttattaataaacagaggagatattaaatgaaataatttaacctggcggcagcgcaaaagatg

SEQ ID NO: 45516 - DNA, 103 bp, Artificial Sequence
  Synthetic Polynucleotide
taatacgactcactataggggatgttgatcttaaaggattgaactctatcaacagaggagagatagaatgcaatcctttaacctggcggcagcgcaaaagatg

SEQ ID NO: 45517 - DNA, 103 bp, Artificial Sequence
  Synthetic Polynucleotide
taatacgactcactatagggataaagatgttgatcttaaaggattgaactaacagaggagaagttcaatgctttaagataacctggcggcagcgcaaaagatg

SEQ ID NO: 45518 - DNA, 103 bp, Artificial Sequence
  Synthetic Polynucleotide
taatacgactcactatagggacgccataaagatgttgatcttaaaggattaacagaggagaaatcctatgagatcaacaaacctggcggcagcgcaaaagatg

SEQ ID NO: 45519 - DNA, 103 bp, Artificial Sequence
  Synthetic Polynucleotide
taatacgactcactatagggtaaaaacgccataaagatgttgatcttaaaaacagaggagatttaagatgaacatctttaacctggcggcagcgcaaaagatg

SEQ ID NO: 45520 - DNA, 103 bp, Artificial Sequence
  Synthetic Polynucleotide
taatacgactcactatagggtaatctaaaaacgccataaagatgttgatcaacagaggagagatcaaatgctttatggcaacctggcggcagcgcaaaagatg

SEQ ID NO: 45521 - DNA, 103 bp, Artificial Sequence
  Synthetic Polynucleotide
taatacgactcactatagggagtattaatctaaaaacgccataaagatgtaacagaggagaacatctatgtggcgttttaacctggcggcagcgcaaaagatg

SEQ ID NO: 45522 - DNA, 103 bp, Artificial Sequence
  Synthetic Polynucleotide
taatacgactcactatagggttgaaagtattaatctaaaaacgccataaaaacagaggagatttatgatgtttttagataacctggcggcagcgcaaaagatg

SEQ ID NO: 45523 - DNA, 103 bp, Artificial Sequence
  Synthetic Polynucleotide
taatacgactcactatagggtctcattgaaagtattaatctaaaaacgccaacagaggagaggcgttatgagattaataaacctggcggcagcgcaaaagatg

SEQ ID NO: 45524 - DNA, 103 bp, Artificial Sequence
  Synthetic Polynucleotide
taatacgactcactatagggatttatctcattgaaagtattaatctaaaaaacagaggagattttagatgaatactttcaacctggcggcagcgcaaaagatg

SEQ ID NO: 45525 - DNA, 103 bp, Artificial Sequence
  Synthetic Polynucleotide
taatacgactcactatagggcccatatttatctcattgaaagtattaatcaacagaggagagattaaatgtttcaatgaaacctggcggcagcgcaaaagatg

SEQ ID NO: 45526 - DNA, 103 bp, Artificial Sequence
  Synthetic Polynucleotide
taatacgactcactatagggggtaaaatttaaacactaaattatttttataacagaggagaataaaaatgatttagtgtaacctggcggcagcgcaaaagatg

SEQ ID NO: 45527 - DNA, 103 bp, Artificial Sequence
  Synthetic Polynucleotide
taatacgactcactatagggcgccacccatatttatctcattgaaagtataacagaggagaatacttatgatgagataaaacctggcggcagcgcaaaagatg

SEQ ID NO: 45528 - DNA, 103 bp, Artificial Sequence
  Synthetic Polynucleotide
taatacgactcactatagggtactccgccacccatatttatctcattgaaaacagaggagattcaatatgataaatatgaacctggcggcagcgcaaaagatg

SEQ ID NO: 45529 - DNA, 103 bp, Artificial Sequence
  Synthetic Polynucleotide
taatacgactcactatagggacacttactccgccacccatatttatctcaaacagaggagatgagatatgtatgggtggaacctggcggcagcgcaaaagatg

SEQ ID NO: 45530 - DNA, 103 bp, Artificial Sequence
  Synthetic Polynucleotide
taatacgactcactataggggctcaacacttactccgccacccatatttaaacagaggagataaataatggtggcggagaacctggcggcagcgcaaaagatg

SEQ ID NO: 45531 - DNA, 103 bp, Artificial Sequence
  Synthetic Polynucleotide
taatacgactcactatagggagggagctcaacacttactccgccacccataacagaggagaatgggtatgggagtaagtaacctggcggcagcgcaaaagatg

SEQ ID NO: 45532 - DNA, 103 bp, Artificial Sequence
  Synthetic Polynucleotide
taatacgactcactatagggcgtttagggagctcaacacttactccgccaaacagaggagatggcggatgaagtgttgaaacctggcggcagcgcaaaagatg

SEQ ID NO: 45533 - DNA, 103 bp, Artificial Sequence
  Synthetic Polynucleotide
taatacgactcactataggggatcccgtttagggagctcaacacttactcaacagaggagagagtaaatgttgagctccaacctggcggcagcgcaaaagatg

SEQ ID NO: 45534 - DNA, 103 bp, Artificial Sequence
  Synthetic Polynucleotide
taatacgactcactatagggaggcggatcccgtttagggagctcaacactaacagaggagaagtgttatgctccctaaaaacctggcggcagcgcaaaagatg

SEQ ID NO: 45535 - DNA, 103 bp, Artificial Sequence
  Synthetic Polynucleotide
taatacgactcactatagggcccggaggcggatcccgtttagggagctcaaacagaggagatgagctatgtaaacgggaaacctggcggcagcgcaaaagatg

SEQ ID NO: 45536 - DNA, 103 bp, Artificial Sequence
  Synthetic Polynucleotide
taatacgactcactataggggtactcccggaggcggatcccgtttagggaaacagaggagatccctaatggggatccgcaacctggcggcagcgcaaaagatg

SEQ ID NO: 45537 - DNA, 103 bp, Artificial Sequence
  Synthetic Polynucleotide
taatacgactcactataggggaactggtaaaatttaaacactaaattattaacagaggagaaataatatggtgtttaaaaacctggcggcagcgcaaaagatg

SEQ ID NO: 45538 - DNA, 103 bp, Artificial Sequence
  Synthetic Polynucleotide
taatacgactcactatagggagtgggtactcccggaggcggatcccgtttaacagaggagaaaacggatgccgcctccgaacctggcggcagcgcaaaagatg

SEQ ID NO: 45539 - DNA, 103 bp, Artificial Sequence
  Synthetic Polynucleotide
taatacgactcactatagggtcatcagtgggtactcccggaggcggatccaacagaggagaggatccatgtccgggagtaacctggcggcagcgcaaaagatg

SEQ ID NO: 45540 - DNA, 103 bp, Artificial Sequence
  Synthetic Polynucleotide
taatacgactcactatagggacatctcatcagtgggtactcccggaggcgaacagaggagacgcctcatggagtacccaaacctggcggcagcgcaaaagatg

SEQ ID NO: 45541 - DNA, 103 bp, Artificial Sequence
  Synthetic Polynucleotide
taatacgactcactatagggtaataacatctcatcagtgggtactcccggaacagaggagaccgggaatgcccactgataacctggcggcagcgcaaaagatg

SEQ ID NO: 45542 - DNA, 103 bp, Artificial Sequence
  Synthetic Polynucleotide
taatacgactcactatagggacatttaataacatctcatcagtgggtactaacagaggagaagtaccatgtgatgagataacctggcggcagcgcaaaagatg

SEQ ID NO: 45543 - DNA, 103 bp, Artificial Sequence
  Synthetic Polynucleotide
taatacgactcactatagggtatcaacatttaataacatctcatcagtggaacagaggagaccactgatgagatgttataacctggcggcagcgcaaaagatg

SEQ ID NO: 45544 - DNA, 103 bp, Artificial Sequence
  Synthetic Polynucleotide
taatacgactcactatagggcattttatcaacatttaataacatctcatcaacagaggagagatgagatgttattaaataacctggcggcagcgcaaaagatg

SEQ ID NO: 45545 - DNA, 103 bp, Artificial Sequence
  Synthetic Polynucleotide
taatacgactcactatagggtcatgcattttatcaacatttaataacatcaacagaggagagatgttatgaaatgttgaaacctggcggcagcgcaaaagatg

SEQ ID NO: 45546 - DNA, 103 bp, Artificial Sequence
  Synthetic Polynucleotide
taatacgactcactatagggtcacgtcatgcattttatcaacatttaataaacagaggagatattaaatgttgataaaaaacctggcggcagcgcaaaagatg

SEQ ID NO: 45547 - DNA, 103 bp, Artificial Sequence
  Synthetic Polynucleotide
taatacgactcactatagggagctatcacgtcatgcattttatcaacattaacagaggagaaatgttatgaaaatgcataacctggcggcagcgcaaaagatg

SEQ ID NO: 45548 - DNA, 103 bp, Artificial Sequence
  Synthetic Polynucleotide
taatacgactcactatagggatctggaactggtaaaatttaaacactaaaaacagaggagatttagtatgtaaattttaaacctggcggcagcgcaaaagatg

SEQ ID NO: 45549 - DNA, 103 bp, Artificial Sequence
  Synthetic Polynucleotide
taatacgactcactataggggcgggagctatcacgtcatgcattttatcaaacagaggagatgataaatggcatgacgtaacctggcggcagcgcaaaagatg

SEQ ID NO: 45550 - DNA, 103 bp, Artificial Sequence
  Synthetic Polynucleotide
taatacgactcactataggggcttagcgggagctatcacgtcatgcatttaacagaggagaaaatgcatgacgtgatagaacctggcggcagcgcaaaagatg

SEQ ID NO: 45551 - DNA, 103 bp, Artificial Sequence
  Synthetic Polynucleotide
taatacgactcactatagggtaaaagcttagcgggagctatcacgtcatgaacagaggagacatgacatgatagctcccaacctggcggcagcgcaaaagatg

SEQ ID NO: 45552 - DNA, 103 bp, Artificial Sequence
  Synthetic Polynucleotide
taatacgactcactatagggtattctaaaagcttagcgggagctatcacgaacagaggagacgtgatatgtcccgctaaaacctggcggcagcgcaaaagatg

SEQ ID NO: 45553 - DNA, 103 bp, Artificial Sequence
  Synthetic Polynucleotide
taatacgactcactataggggcacatattctaaaagcttagcgggagctaaacagaggagatagctcatgctaagctttaacctggcggcagcgcaaaagatg

SEQ ID NO: 45554 - DNA, 103 bp, Artificial Sequence
  Synthetic Polynucleotide
taatacgactcactatagggtatatgcacatattctaaaagcttagcgggaacagaggagacccgctatgcttttagaaaacctggcggcagcgcaaaagatg

SEQ ID NO: 45555 - DNA, 103 bp, Artificial Sequence
  Synthetic Polynucleotide
taatacgactcactatagggggtcctatatgcacatattctaaaagcttaaacagaggagataagctatgagaatatgtaacctggcggcagcgcaaaagatg

SEQ ID NO: 45556 - DNA, 103 bp, Artificial Sequence
  Synthetic Polynucleotide
taatacgactcactatagggctagtggtcctatatgcacatattctaaaaaacagaggagattttagatgatgtgcataaacctggcggcagcgcaaaagatg

SEQ ID NO: 45557 - DNA, 103 bp, Artificial Sequence
  Synthetic Polynucleotide
taatacgactcactatagggttttgctagtggtcctatatgcacatattcaacagaggagagaatatatgcatataggaaacctggcggcagcgcaaaagatg

SEQ ID NO: 45558 - DNA, 103 bp, Artificial Sequence
  Synthetic Polynucleotide
taatacgactcactatagggttatcttttgctagtggtcctatatgcacaaacagaggagatgtgcaatgaggaccactaacctggcggcagcgcaaaagatg

SEQ ID NO: 45559 - DNA, 103 bp, Artificial Sequence
  Synthetic Polynucleotide
taatacgactcactataggggtgaaatctggaactggtaaaatttaaacaaacagaggagatgtttaatgtttaccagtaacctggcggcagcgcaaaagatg

SEQ ID NO: 45560 - DNA, 103 bp, Artificial Sequence
  Synthetic Polynucleotide
taatacgactcactatagggcctctttatcttttgctagtggtcctatataacagaggagaatatagatgcactagcaaaacctggcggcagcgcaaaagatg

SEQ ID NO: 45561 - DNA, 103 bp, Artificial Sequence
  Synthetic Polynucleotide
taatacgactcactatagggtttatcctctttatcttttgctagtggtccaacagaggagaggaccaatggcaaaagataacctggcggcagcgcaaaagatg

SEQ ID NO: 45562 - DNA, 103 bp, Artificial Sequence
  Synthetic Polynucleotide
taatacgactcactatagggtttactttatcctctttatcttttgctagtaacagaggagaactagcatgagataaagaaacctggcggcagcgcaaaagatg

SEQ ID NO: 45563 - DNA, 103 bp, Artificial Sequence
  Synthetic Polynucleotide
taatacgactcactatagggttttctttactttatcctctttatcttttgaacagaggagacaaaagatgaagaggataaacctggcggcagcgcaaaagatg

SEQ ID NO: 45564 - DNA, 103 bp, Artificial Sequence
  Synthetic Polynucleotide
taatacgactcactatagggatatcttttctttactttatcctctttatcaacagaggagagataaaatggataaagtaaacctggcggcagcgcaaaagatg

SEQ ID NO: 45565 - DNA, 103 bp, Artificial Sequence
  Synthetic Polynucleotide
taatacgactcactatagggtctggatatcttttctttactttatcctctaacagaggagaagaggaatgagtaaagaaaacctggcggcagcgcaaaagatg

SEQ ID NO: 45566 - DNA, 103 bp, Artificial Sequence
  Synthetic Polynucleotide
taatacgactcactatagggtaaactctggatatcttttctttactttataacagaggagaataaagatgagaaaagataacctggcggcagcgcaaaagatg

SEQ ID NO: 45567 - DNA, 103 bp, Artificial Sequence
  Synthetic Polynucleotide
taatacgactcactatagggtaatctaaactctggatatcttttctttacaacagaggagagtaaagatgagatatccaaacctggcggcagcgcaaaagatg

SEQ ID NO: 45568 - DNA, 103 bp, Artificial Sequence
  Synthetic Polynucleotide
taatacgactcactatagggttaactaatctaaactctggatatcttttcaacagaggagagaaaagatgtccagagttaacctggcggcagcgcaaaagatg

SEQ ID NO: 45569 - DNA, 103 bp, Artificial Sequence
  Synthetic Polynucleotide
taatacgactcactatagggctgtattaactaatctaaactctggatatcaacagaggagagatatcatgagtttagataacctggcggcagcgcaaaagatg

SEQ ID NO: 45570 - DNA, 103 bp, Artificial Sequence
  Synthetic Polynucleotide
taatacgactcactataggggtgggtttctcatagatggacccatagagaaacagaggagatctctaatggtccatctaaacctggcggcagcgcaaaagatg

SEQ ID NO: 45571 - DNA, 103 bp, Artificial Sequence
  Synthetic Polynucleotide
taatacgactcactataggggaggtgtgaaatctggaactggtaaaatttaacagaggagaaaatttatgcagttccagaacctggcggcagcgcaaaagatg

SEQ ID NO: 45572 - DNA, 103 bp, Artificial Sequence
  Synthetic Polynucleotide
taatacgactcactataggggggtcctgtattaactaatctaaactctggaacagaggagaccagagatgagattagttaacctggcggcagcgcaaaagatg

SEQ ID NO: 45573 - DNA, 103 bp, Artificial Sequence
  Synthetic Polynucleotide
taatacgactcactatagggccaccgggtcctgtattaactaatctaaacaacagaggagagtttagatgagttaatacaacctggcggcagcgcaaaagatg

SEQ ID NO: 45574 - DNA, 103 bp, Artificial Sequence
  Synthetic Polynucleotide
taatacgactcactatagggaaagaccaccgggtcctgtattaactaatcaacagaggagagattagatgatacaggacaacctggcggcagcgcaaaagatg

SEQ ID NO: 45575 - DNA, 103 bp, Artificial Sequence
  Synthetic Polynucleotide
taatacgactcactatagggtgccgaaagaccaccgggtcctgtattaacaacagaggagagttaatatgggacccggtaacctggcggcagcgcaaaagatg

SEQ ID NO: 45576 - DNA, 103 bp, Artificial Sequence
  Synthetic Polynucleotide
taatacgactcactatagggaataatgccgaaagaccaccgggtcctgtaaacagaggagatacaggatgcggtggtctaacctggcggcagcgcaaaagatg

SEQ ID NO: 45577 - DNA, 103 bp, Artificial Sequence
  Synthetic Polynucleotide
taatacgactcactataggggtcttaataatgccgaaagaccaccgggtcaacagaggagagacccgatggtctttcggaacctggcggcagcgcaaaagatg

SEQ ID NO: 45578 - DNA, 103 bp, Artificial Sequence
  Synthetic Polynucleotide
taatacgactcactatagggcgattgtcttaataatgccgaaagaccaccaacagaggagaggtggtatgtcggcattaaacctggcggcagcgcaaaagatg

SEQ ID NO: 45579 - DNA, 103 bp, Artificial Sequence
  Synthetic Polynucleotide
taatacgactcactatagggttatacgattgtcttaataatgccgaaagaaacagaggagatctttcatgattattaagaacctggcggcagcgcaaaagatg

SEQ ID NO: 45580 - DNA, 103 bp, Artificial Sequence
  Synthetic Polynucleotide
taatacgactcactatagggttccattatacgattgtcttaataatgccgaacagaggagacggcatatgtaagacaataacctggcggcagcgcaaaagatg

SEQ ID NO: 45581 - DNA, 103 bp, Artificial Sequence
  Synthetic Polynucleotide
taatacgactcactatagggtgcggttccattatacgattgtcttaataaaacagaggagattattaatgcaatcgtataacctggcggcagcgcaaaagatg

SEQ ID NO: 45582 - DNA, 103 bp, Artificial Sequence
  Synthetic Polynucleotide
taatacgactcactatagggtaatggaggtgtgaaatctggaactggtaaaacagaggagattaccaatgccagatttcaacctggcggcagcgcaaaagatg

SEQ ID NO: 45583 - DNA, 103 bp, Artificial Sequence
  Synthetic Polynucleotide
taatacgactcactatagggttgggtgcggttccattatacgattgtcttaacagaggagaaagacaatggtataatggaacctggcggcagcgcaaaagatg

SEQ ID NO: 45584 - DNA, 103 bp, Artificial Sequence
  Synthetic Polynucleotide
taatacgactcactatagggagcagttgggtgcggttccattatacgattaacagaggagaaatcgtatgatggaaccgaacctggcggcagcgcaaaagatg

SEQ ID NO: 45585 - DNA, 103 bp, Artificial Sequence
  Synthetic Polynucleotide
taatacgactcactataggggtgacagcagttgggtgcggttccattataaacagaggagatataatatgaccgcacccaacctggcggcagcgcaaaagatg

SEQ ID NO: 45586 - DNA, 103 bp, Artificial Sequence
  Synthetic Polynucleotide
taatacgactcactatagggaaagtgtgacagcagttgggtgcggttccaaacagaggagatggaacatgacccaactgaacctggcggcagcgcaaaagatg

SEQ ID NO: 45587 - DNA, 103 bp, Artificial Sequence
  Synthetic Polynucleotide
taatacgactcactataggggattaaaagtgtgacagcagttgggtgcggaacagaggagaccgcacatgactgctgtcaacctggcggcagcgcaaaagatg

SEQ ID NO: 45588 - DNA, 103 bp, Artificial Sequence
  Synthetic Polynucleotide
taatacgactcactatagggagtacgattaaaagtgtgacagcagttgggaacagaggagacccaacatgtgtcacactaacctggcggcagcgcaaaagatg

SEQ ID NO: 45589 - DNA, 103 bp, Artificial Sequence
  Synthetic Polynucleotide
taatacgactcactatagggtaatgagtacgattaaaagtgtgacagcagaacagaggagactgctgatgcacttttaaaacctggcggcagcgcaaaagatg

SEQ ID NO: 45590 - DNA, 103 bp, Artificial Sequence
  Synthetic Polynucleotide
taatacgactcactatagggtccaataatgagtacgattaaaagtgtgacaacagaggagagtcacaatgttaatcgtaaacctggcggcagcgcaaaagatg

SEQ ID NO: 45591 - DNA, 103 bp, Artificial Sequence
  Synthetic Polynucleotide
taatacgactcactatagggcttcttccaataatgagtacgattaaaagtaacagaggagaacttttatgcgtactcataacctggcggcagcgcaaaagatg

SEQ ID NO: 45592 - DNA, 103 bp, Artificial Sequence
  Synthetic Polynucleotide
taatacgactcactatagggccatccttcttccaataatgagtacgattaaacagaggagataatcgatgtcattattgaacctggcggcagcgcaaaagatg

SEQ ID NO: 45593 - DNA, 103 bp, Artificial Sequence
  Synthetic Polynucleotide
taatacgactcactatagggggggttaatggaggtgtgaaatctggaactaacagaggagaagttccatgtttcacaccaacctggcggcagcgcaaaagatg

SEQ ID NO: 45594 - DNA, 103 bp, Artificial Sequence
  Synthetic Polynucleotide
taatacgactcactatagggtctttccatccttcttccaataatgagtacaacagaggagagtactcatgattggaagaaacctggcggcagcgcaaaagatg

SEQ ID NO: 45595 - DNA, 103 bp, Artificial Sequence
  Synthetic Polynucleotide
taatacgactcactatagggtgatatctttccatccttcttccaataatgaacagaggagacattatatgaagaaggataacctggcggcagcgcaaaagatg

SEQ ID NO: 45596 - DNA, 103 bp, Artificial Sequence
  Synthetic Polynucleotide
taatacgactcactatagggttatctgatatctttccatccttcttccaaaacagaggagattggaaatgggatggaaaaacctggcggcagcgcaaaagatg

SEQ ID NO: 45597 - DNA, 103 bp, Artificial Sequence
  Synthetic Polynucleotide
taatacgactcactatagggcatacttatctgatatctttccatccttctaacagaggagaagaaggatggaaagatataacctggcggcagcgcaaaagatg

SEQ ID NO: 45598 - DNA, 103 bp, Artificial Sequence
  Synthetic Polynucleotide
taatacgactcactatagggctcttcatacttatctgatatctttccatcaacagaggagagatggaatgatatcagataacctggcggcagcgcaaaagatg

SEQ ID NO: 45599 - DNA, 103 bp, Artificial Sequence
  Synthetic Polynucleotide
taatacgactcactataggggcaccctcttcatacttatctgatatctttaacagaggagaaaagatatgagataagtaaacctggcggcagcgcaaaagatg

SEQ ID NO: 45600 - DNA, 103 bp, Artificial Sequence
  Synthetic Polynucleotide
taatacgactcactatagggatactgcaccctcttcatacttatctgataaacagaggagatatcagatgagtatgaagaacctggcggcagcgcaaaagatg

SEQ ID NO: 45601 - DNA, 103 bp, Artificial Sequence
  Synthetic Polynucleotide
taatacgactcactatagggttctaatactgcaccctcttcatacttatcaacagaggagagataagatggaagagggtaacctggcggcagcgcaaaagatg

SEQ ID NO: 45602 - DNA, 103 bp, Artificial Sequence
  Synthetic Polynucleotide
taatacgactcactatagggcacgattctaatactgcaccctcttcatacaacagaggagagtatgaatggggtgcagtaacctggcggcagcgcaaaagatg

SEQ ID NO: 45603 - DNA, 103 bp, Artificial Sequence
  Synthetic Polynucleotide
taatacgactcactataggggccaacacgattctaatactgcaccctcttaacagaggagaaagaggatgcagtattagaacctggcggcagcgcaaaagatg

SEQ ID NO: 45604 - DNA, 103 bp, Artificial Sequence
  Synthetic Polynucleotide
taatacgactcactatagggaaagtggggttaatggaggtgtgaaatctgaacagaggagacagattatgcacctccataacctggcggcagcgcaaaagatg

SEQ ID NO: 45605 - DNA, 103 bp, Artificial Sequence
  Synthetic Polynucleotide
taatacgactcactataggggtctggccaacacgattctaatactgcaccaacagaggagaggtgcaatgttagaatcgaacctggcggcagcgcaaaagatg

SEQ ID NO: 45606 - DNA, 103 bp, Artificial Sequence
  Synthetic Polynucleotide
taatacgactcactatagggtgaacgtctggccaacacgattctaatactaacagaggagaagtattatgatcgtgttgaacctggcggcagcgcaaaagatg

SEQ ID NO: 45607 - DNA, 103 bp, Artificial Sequence
  Synthetic Polynucleotide
taatacgactcactatagggtatcgtgaacgtctggccaacacgattctaaacagaggagatagaatatggttggccagaacctggcggcagcgcaaaagatg

SEQ ID NO: 45608 - DNA, 103 bp, Artificial Sequence
  Synthetic Polynucleotide
taatacgactcactatagggtccggtatcgtgaacgtctggccaacacgaaacagaggagatcgtgtatgccagacgttaacctggcggcagcgcaaaagatg

SEQ ID NO: 45609 - DNA, 103 bp, Artificial Sequence
  Synthetic Polynucleotide
taatacgactcactatagggcattttccggtatcgtgaacgtctggccaaaacagaggagattggccatgcgttcacgaaacctggcggcagcgcaaaagatg

SEQ ID NO: 45610 - DNA, 103 bp, Artificial Sequence
  Synthetic Polynucleotide
taatacgactcactatagggcatcgcattttccggtatcgtgaacgtctgaacagaggagacagacgatgacgataccgaacctggcggcagcgcaaaagatg

SEQ ID NO: 45611 - DNA, 103 bp, Artificial Sequence
  Synthetic Polynucleotide
taatacgactcactatagggattaacatcgcattttccggtatcgtgaacaacagaggagagttcacatgaccggaaaaaacctggcggcagcgcaaaagatg

SEQ ID NO: 45612 - DNA, 103 bp, Artificial Sequence
  Synthetic Polynucleotide
taatacgactcactatagggaataaattaacatcgcattttccggtatcgaacagaggagacgatacatgaaaatgcgaaacctggcggcagcgcaaaagatg

SEQ ID NO: 45613 - DNA, 103 bp, Artificial Sequence
  Synthetic Polynucleotide
taatacgactcactatagggagtcaaataaattaacatcgcattttccggaacagaggagaccggaaatggcgatgttaaacctggcggcagcgcaaaagatg

SEQ ID NO: 45614 - DNA, 103 bp, Artificial Sequence
  Synthetic Polynucleotide
taatacgactcactatagggacaccagtcaaataaattaacatcgcatttaacagaggagaaaatgcatggttaatttaaacctggcggcagcgcaaaagatg

SEQ ID NO: 45615 - DNA, 103 bp, Artificial Sequence
  Synthetic Polynucleotide
taatacgactcactatagggtgtaaaaagtggggttaatggaggtgtgaaaacagaggagattcacaatgccattaaccaacctggcggcagcgcaaaagatg

SEQ ID NO: 45616 - DNA, 103 bp, Artificial Sequence
  Synthetic Polynucleotide
taatacgactcactatagggccctgacaccagtcaaataaattaacatcgaacagaggagacgatgtatgtttatttgaaacctggcggcagcgcaaaagatg

SEQ ID NO: 45617 - DNA, 103 bp, Artificial Sequence
  Synthetic Polynucleotide
taatacgactcactatagggtatccccctgacaccagtcaaataaattaaaacagaggagattaattatgttgactggtaacctggcggcagcgcaaaagatg

SEQ ID NO: 45618 - DNA, 103 bp, Artificial Sequence
  Synthetic Polynucleotide
taatacgactcactataggggaacgtatccccctgacaccagtcaaataaaacagaggagattatttatgtggtgtcagaacctggcggcagcgcaaaagatg

SEQ ID NO: 45619 - DNA, 103 bp, Artificial Sequence
  Synthetic Polynucleotide
taatacgactcactatagggctatcgaacgtatccccctgacaccagtcaaacagaggagatgactgatgtcagggggaaacctggcggcagcgcaaaagatg

SEQ ID NO: 45620 - DNA, 103 bp, Artificial Sequence
  Synthetic Polynucleotide
taatacgactcactatagggtgtttctatcgaacgtatccccctgacaccaacagaggagaggtgtcatggggatacgtaacctggcggcagcgcaaaagatg

SEQ ID NO: 45621 - DNA, 103 bp, Artificial Sequence
  Synthetic Polynucleotide
taatacgactcactataggggcatatgtttctatcgaacgtatccccctgaacagaggagacaggggatgacgttcgataacctggcggcagcgcaaaagatg

SEQ ID NO: 45622 - DNA, 103 bp, Artificial Sequence
  Synthetic Polynucleotide
taatacgactcactatagggtgatggcatatgtttctatcgaacgtatccaacagaggagaggatacatgcgatagaaaaacctggcggcagcgcaaaagatg

SEQ ID NO: 45623 - DNA, 103 bp, Artificial Sequence
  Synthetic Polynucleotide
taatacgactcactatagggtccactgatggcatatgtttctatcgaacgaacagaggagacgttcgatggaaacatataacctggcggcagcgcaaaagatg

SEQ ID NO: 45624 - DNA, 103 bp, Artificial Sequence
  Synthetic Polynucleotide
taatacgactcactatagggaccgatccactgatggcatatgtttctatcaacagaggagagatagaatgatatgccataacctggcggcagcgcaaaagatg

SEQ ID NO: 45625 - DNA, 103 bp, Artificial Sequence
  Synthetic Polynucleotide
taatacgactcactataggggctgaaccgatccactgatggcatatgtttaacagaggagaaaacatatgccatcagtgaacctggcggcagcgcaaaagatg

SEQ ID NO: 45626 - DNA, 103 bp, Artificial Sequence
  Synthetic Polynucleotide
taatacgactcactatagggtgtggtgtaaaaagtggggttaatggaggtaacagaggagaacctccatgaaccccactaacctggcggcagcgcaaaagatg

SEQ ID NO: 45627 - DNA, 103 bp, Artificial Sequence
  Synthetic Polynucleotide
taatacgactcactatagggtaaatgctgaaccgatccactgatggcataaacagaggagatatgccatgagtggatcgaacctggcggcagcgcaaaagatg

SEQ ID NO: 45628 - DNA, 103 bp, Artificial Sequence
  Synthetic Polynucleotide
taatacgactcactatagggcctattaaatgctgaaccgatccactgatgaacagaggagacatcagatgatcggttcaaacctggcggcagcgcaaaagatg

SEQ ID NO: 45629 - DNA, 103 bp, Artificial Sequence
  Synthetic Polynucleotide
taatacgactcactatagggtcactcctattaaatgctgaaccgatccacaacagaggagagtggatatgttcagcattaacctggcggcagcgcaaaagatg

SEQ ID NO: 45630 - DNA, 103 bp, Artificial Sequence
  Synthetic Polynucleotide
taatacgactcactatagggttctatcactcctattaaatgctgaaccgaaacagaggagatcggttatgcatttaataaacctggcggcagcgcaaaagatg

SEQ ID NO: 45631 - DNA, 103 bp, Artificial Sequence
  Synthetic Polynucleotide
taatacgactcactatagggtacagttctatcactcctattaaatgctgaaacagaggagatcagcaatgaataggagtaacctggcggcagcgcaaaagatg

SEQ ID NO: 45632 - DNA, 103 bp, Artificial Sequence
  Synthetic Polynucleotide
taatacgactcactatagggccctctacagttctatcactcctattaaataacagaggagaatttaaatggagtgatagaacctggcggcagcgcaaaagatg

SEQ ID NO: 45633 - DNA, 103 bp, Artificial Sequence
  Synthetic Polynucleotide
taatacgactcactataggggttgaccctctacagttctatcactcctataacagaggagaataggaatgatagaactgaacctggcggcagcgcaaaagatg

SEQ ID NO: 45634 - DNA, 103 bp, Artificial Sequence
  Synthetic Polynucleotide
taatacgactcactatagggcgattgttgaccctctacagttctatcactaacagaggagaagtgatatgactgtagagaacctggcggcagcgcaaaagatg

SEQ ID NO: 45635 - DNA, 103 bp, Artificial Sequence
  Synthetic Polynucleotide
taatacgactcactatagggattaacgattgttgaccctctacagttctaaacagaggagatagaacatgagagggtcaaacctggcggcagcgcaaaagatg

SEQ ID NO: 45636 - DNA, 103 bp, Artificial Sequence
  Synthetic Polynucleotide
taatacgactcactataggggatttattaacgattgttgaccctctacagaacagaggagactgtagatggtcaacaataacctggcggcagcgcaaaagatg

SEQ ID NO: 45637 - DNA, 103 bp, Artificial Sequence
  Synthetic Polynucleotide
taatacgactcactatagggcgtcctgtggtgtaaaaagtggggttaatgaacagaggagacattaaatgcactttttaaacctggcggcagcgcaaaagatg

SEQ ID NO: 45638 - DNA, 103 bp, Artificial Sequence
  Synthetic Polynucleotide
taatacgactcactatagggatacagatttattaacgattgttgaccctcaacagaggagagagggtatgcaatcgttaaacctggcggcagcgcaaaagatg

SEQ ID NO: 45639 - DNA, 103 bp, Artificial Sequence
  Synthetic Polynucleotide
taatacgactcactatagggttattatacagatttattaacgattgttgaaacagaggagatcaacaatggttaataaaaacctggcggcagcgcaaaagatg

SEQ ID NO: 45640 - DNA, 103 bp, Artificial Sequence
  Synthetic Polynucleotide
taatacgactcactataggggcatcttattatacagatttattaacgattaacagaggagaaatcgtatgtaaatctgtaacctggcggcagcgcaaaagatg

SEQ ID NO: 45641 - DNA, 103 bp, Artificial Sequence
  Synthetic Polynucleotide
taatacgactcactatagggtgtttgcatcttattatacagatttattaaaacagaggagattaataatgctgtataataacctggcggcagcgcaaaagatg

SEQ ID NO: 45642 - DNA, 103 bp, Artificial Sequence
  Synthetic Polynucleotide
taatacgactcactatagggcataatgtttgcatcttattatacagatttaacagaggagaaaatctatgtaataagataacctggcggcagcgcaaaagatg

SEQ ID NO: 45643 - DNA, 103 bp, Artificial Sequence
  Synthetic Polynucleotide
taatacgactcactatagggtactacataatgtttgcatcttattatacaaacagaggagatgtataatgagatgcaaaaacctggcggcagcgcaaaagatg

SEQ ID NO: 45644 - DNA, 103 bp, Artificial Sequence
  Synthetic Polynucleotide
taatacgactcactatagggatctttactacataatgtttgcatcttattaacagaggagaaataagatgcaaacattaaacctggcggcagcgcaaaagatg

SEQ ID NO: 45645 - DNA, 103 bp, Artificial Sequence
  Synthetic Polynucleotide
taatacgactcactatagggctagcatctttactacataatgtttgcatcaacagaggagagatgcaatgattatgtagaacctggcggcagcgcaaaagatg

SEQ ID NO: 45646 - DNA, 103 bp, Artificial Sequence
  Synthetic Polynucleotide
taatacgactcactataggggtacactagcatctttactacataatgtttaacagaggagaaaacatatggtagtaaagaacctggcggcagcgcaaaagatg

SEQ ID NO: 45647 - DNA, 103 bp, Artificial Sequence
  Synthetic Polynucleotide
taatacgactcactatagggtattggtacactagcatctttactacataaaacagaggagattatgtatgaaagatgctaacctggcggcagcgcaaaagatg

SEQ ID NO: 45648 - DNA, 103 bp, Artificial Sequence
  Synthetic Polynucleotide
taatacgactcactatagggaggatcgtcctgtggtgtaaaaagtggggtaacagaggagaaccccaatgtttacaccaaacctggcggcagcgcaaaagatg

SEQ ID NO: 45649 - DNA, 103 bp, Artificial Sequence
  Synthetic Polynucleotide
taatacgactcactatagggtcgcatattggtacactagcatctttactaaacagaggagatagtaaatgtgctagtgtaacctggcggcagcgcaaaagatg

SEQ ID NO: 45650 - DNA, 103 bp, Artificial Sequence
  Synthetic Polynucleotide
taatacgactcactatagggatgattcgcatattggtacactagcatcttaacagaggagaaagatgatggtgtaccaaaacctggcggcagcgcaaaagatg

SEQ ID NO: 45651 - DNA, 103 bp, Artificial Sequence
  Synthetic Polynucleotide
taatacgactcactatagggcaaaaatgattcgcatattggtacactagcaacagaggagagctagtatgccaatatgcaacctggcggcagcgcaaaagatg

SEQ ID NO: 45652 - DNA, 103 bp, Artificial Sequence
  Synthetic Polynucleotide
taatacgactcactatagggtgatgcaaaaatgattcgcatattggtacaaacagaggagatgtaccatgatgcgaatcaacctggcggcagcgcaaaagatg

SEQ ID NO: 45653 - DNA, 103 bp, Artificial Sequence
  Synthetic Polynucleotide
taatacgactcactataggggtaaatgatgcaaaaatgattcgcatattgaacagaggagacaatatatgaatcattttaacctggcggcagcgcaaaagatg

SEQ ID NO: 45654 - DNA, 103 bp, Artificial Sequence
  Synthetic Polynucleotide
taatacgactcactatagggtgcgcgtaaatgatgcaaaaatgattcgcaaacagaggagatgcgaaatgtttttgcataacctggcggcagcgcaaaagatg

SEQ ID NO: 45655 - DNA, 103 bp, Artificial Sequence
  Synthetic Polynucleotide
taatacgactcactatagggttgtgtgcgcgtaaatgatgcaaaaatgataacagaggagaatcattatggcatcatttaacctggcggcagcgcaaaagatg

SEQ ID NO: 45656 - DNA, 103 bp, Artificial Sequence
  Synthetic Polynucleotide
taatacgactcactatagggctgtattgtgtgcgcgtaaatgatgcaaaaaacagaggagattttgcatgatttacgcgaacctggcggcagcgcaaaagatg

SEQ ID NO: 45657 - DNA, 103 bp, Artificial Sequence
  Synthetic Polynucleotide
taatacgactcactatagggatcttctgtattgtgtgcgcgtaaatgatgaacagaggagacatcatatgcgcgcacacaacctggcggcagcgcaaaagatg

SEQ ID NO: 45658 - DNA, 103 bp, Artificial Sequence
  Synthetic Polynucleotide
taatacgactcactatagggttgctatcttctgtattgtgtgcgcgtaaaaacagaggagatttacgatgacacaatacaacctggcggcagcgcaaaagatg

SEQ ID NO: 45659 - DNA, 103 bp, Artificial Sequence
  Synthetic Polynucleotide
taatacgactcactatagggtggggaggatcgtcctgtggtgtaaaaagtaacagaggagaacttttatgaccacaggaaacctggcggcagcgcaaaagatg

SEQ ID NO: 45660 - DNA, 103 bp, Artificial Sequence
  Synthetic Polynucleotide
taatacgactcactatagggtctctttgctatcttctgtattgtgtgcgcaacagaggagagcgcacatgatacagaagaacctggcggcagcgcaaaagatg

SEQ ID NO: 45661 - DNA, 103 bp, Artificial Sequence
  Synthetic Polynucleotide
taatacgactcactataggggatcatctctttgctatcttctgtattgtgaacagaggagacacaatatggaagatagcaacctggcggcagcgcaaaagatg

SEQ ID NO: 45662 - DNA, 103 bp, Artificial Sequence
  Synthetic Polynucleotide
taatacgactcactatagggtaatcgatcatctctttgctatcttctgtaaacagaggagatacagaatgtagcaaagaaacctggcggcagcgcaaaagatg

SEQ ID NO: 45663 - DNA, 103 bp, Artificial Sequence
  Synthetic Polynucleotide
taatacgactcactataggggaatataatcgatcatctctttgctatcttaacagaggagaaagataatgaagagatgaaacctggcggcagcgcaaaagatg

SEQ ID NO: 45664 - DNA, 103 bp, Artificial Sequence
  Synthetic Polynucleotide
taatacgactcactatagggtcttagaatataatcgatcatctctttgctaacagaggagaagcaaaatgatgatcgataacctggcggcagcgcaaaagatg

SEQ ID NO: 45665 - DNA, 103 bp, Artificial Sequence
  Synthetic Polynucleotide
taatacgactcactatagggtgttgtcttagaatataatcgatcatctctaacagaggagaagagatatgcgattatataacctggcggcagcgcaaaagatg

SEQ ID NO: 45666 - DNA, 103 bp, Artificial Sequence
  Synthetic Polynucleotide
taatacgactcactatagggcagactgttgtcttagaatataatcgatcaaacagaggagatgatcgatgatattctaaaacctggcggcagcgcaaaagatg

SEQ ID NO: 45667 - DNA, 103 bp, Artificial Sequence
  Synthetic Polynucleotide
taatacgactcactataggggttcgcagactgttgtcttagaatataatcaacagaggagagattatatgctaagacaaaacctggcggcagcgcaaaagatg

SEQ ID NO: 45668 - DNA, 103 bp, Artificial Sequence
  Synthetic Polynucleotide
taatacgactcactatagggttaaagttcgcagactgttgtcttagaataaacagaggagatattctatgacaacagtcaacctggcggcagcgcaaaagatg

SEQ ID NO: 45669 - DNA, 103 bp, Artificial Sequence
  Synthetic Polynucleotide
taatacgactcactatagggtctgtttaaagttcgcagactgttgtcttaaacagaggagataagacatgagtctgcgaaacctggcggcagcgcaaaagatg

SEQ ID NO: 45670 - DNA, 103 bp, Artificial Sequence
  Synthetic Polynucleotide
taatacgactcactatagggaaatgtggggaggatcgtcctgtggtgtaaaacagaggagattacacatgaggacgatcaacctggcggcagcgcaaaagatg

SEQ ID NO: 45671 - DNA, 103 bp, Artificial Sequence
  Synthetic Polynucleotide
taatacgactcactatagggatatttctgtttaaagttcgcagactgttgaacagaggagacaacagatggcgaactttaacctggcggcagcgcaaaagatg

SEQ ID NO: 45672 - DNA, 103 bp, Artificial Sequence
  Synthetic Polynucleotide
taatacgactcactatagggctcatatatttctgtttaaagttcgcagacaacagaggagagtctgcatgctttaaacaaacctggcggcagcgcaaaagatg

SEQ ID NO: 45673 - DNA, 103 bp, Artificial Sequence
  Synthetic Polynucleotide
taatacgactcactatagggtacatctcatatatttctgtttaaagttcgaacagaggagacgaactatgaacagaaataacctggcggcagcgcaaaagatg

SEQ ID NO: 45674 - DNA, 103 bp, Artificial Sequence
  Synthetic Polynucleotide
taatacgactcactatagggataactacatctcatatatttctgtttaaaaacagaggagatttaaaatgaaatatatgaacctggcggcagcgcaaaagatg

SEQ ID NO: 45675 - DNA, 103 bp, Artificial Sequence
  Synthetic Polynucleotide
taatacgactcactataggggtgggataactacatctcatatatttctgtaacagaggagaacagaaatgtatgagatgaacctggcggcagcgcaaaagatg

SEQ ID NO: 45676 - DNA, 103 bp, Artificial Sequence
  Synthetic Polynucleotide
taatacgactcactatagggctctagtgggataactacatctcatatattaacagaggagaaatataatggatgtagttaacctggcggcagcgcaaaagatg

SEQ ID NO: 45677 - DNA, 103 bp, Artificial Sequence
  Synthetic Polynucleotide
taatacgactcactatagggcttatctctagtgggataactacatctcataacagaggagaatgagaatgagttatcccaacctggcggcagcgcaaaagatg

SEQ ID NO: 45678 - DNA, 103 bp, Artificial Sequence
  Synthetic Polynucleotide
taatacgactcactatagggtctaacttatctctagtgggataactacataacagaggagaatgtagatgtcccactagaacctggcggcagcgcaaaagatg

SEQ ID NO: 45679 - DNA, 103 bp, Artificial Sequence
  Synthetic Polynucleotide
taatacgactcactatagggactcttctaacttatctctagtgggataacaacagaggagagttatcatgctagagataaacctggcggcagcgcaaaagatg

SEQ ID NO: 45680 - DNA, 103 bp, Artificial Sequence
  Synthetic Polynucleotide
taatacgactcactatagggtaatgactcttctaacttatctctagtgggaacagaggagacccactatggataagttaaacctggcggcagcgcaaaagatg

SEQ ID NO: 45681 - DNA, 103 bp, Artificial Sequence
  Synthetic Polynucleotide
taatacgactcactatagggatcctgtgggtttctcatagatggacccataacagaggagaatgggtatgtctatgagaaacctggcggcagcgcaaaagatg

SEQ ID NO: 45682 - DNA, 103 bp, Artificial Sequence
  Synthetic Polynucleotide
taatacgactcactatagggcggtgaaatgtggggaggatcgtcctgtggaacagaggagaccacagatggatcctcccaacctggcggcagcgcaaaagatg

SEQ ID NO: 45683 - DNA, 103 bp, Artificial Sequence
  Synthetic Polynucleotide
taatacgactcactatagggtattttaatgactcttctaacttatctctaaacagaggagatagagaatggttagaagaaacctggcggcagcgcaaaagatg

SEQ ID NO: 45684 - DNA, 103 bp, Artificial Sequence
  Synthetic Polynucleotide
taatacgactcactatagggccgcatattttaatgactcttctaacttataacagaggagaataagtatgaagagtcataacctggcggcagcgcaaaagatg

SEQ ID NO: 45685 - DNA, 103 bp, Artificial Sequence
  Synthetic Polynucleotide
taatacgactcactatagggaggttccgcatattttaatgactcttctaaaacagaggagattagaaatgtcattaaaaaacctggcggcagcgcaaaagatg

SEQ ID NO: 45686 - DNA, 103 bp, Artificial Sequence
  Synthetic Polynucleotide
taatacgactcactatagggtctcgaggttccgcatattttaatgactctaacagaggagaagagtcatgaaaatatgcaacctggcggcagcgcaaaagatg

SEQ ID NO: 45687 - DNA, 103 bp, Artificial Sequence
  Synthetic Polynucleotide
taatacgactcactatagggaacattctcgaggttccgcatattttaatgaacagaggagacattaaatgatgcggaacaacctggcggcagcgcaaaagatg

SEQ ID NO: 45688 - DNA, 103 bp, Artificial Sequence
  Synthetic Polynucleotide
taatacgactcactatagggatcccaacattctcgaggttccgcatatttaacagaggagaaaatatatggaacctcgaaacctggcggcagcgcaaaagatg

SEQ ID NO: 45689 - DNA, 103 bp, Artificial Sequence
  Synthetic Polynucleotide
taatacgactcactatagggtctggatcccaacattctcgaggttccgcaaacagaggagatgcggaatgtcgagaatgaacctggcggcagcgcaaaagatg

SEQ ID NO: 45690 - DNA, 103 bp, Artificial Sequence
  Synthetic Polynucleotide
taatacgactcactatagggaacactctggatcccaacattctcgaggttaacagaggagaaacctcatgaatgttgggaacctggcggcagcgcaaaagatg

SEQ ID NO: 45691 - DNA, 103 bp, Artificial Sequence
  Synthetic Polynucleotide
taatacgactcactatagggattcgaacactctggatcccaacattctcgaacagaggagacgagaaatgtgggatccaaacctggcggcagcgcaaaagatg

SEQ ID NO: 45692 - DNA, 103 bp, Artificial Sequence
  Synthetic Polynucleotide
taatacgactcactatagggttggcattcgaacactctggatcccaacataacagaggagaatgttgatgtccagagtgaacctggcggcagcgcaaaagatg

SEQ ID NO: 45693 - DNA, 103 bp, Artificial Sequence
  Synthetic Polynucleotide
taatacgactcactatagggggtggcggtgaaatgtggggaggatcgtccaacagaggagaggacgaatgtccccacataacctggcggcagcgcaaaagatg

SEQ ID NO: 45694 - DNA, 103 bp, Artificial Sequence
  Synthetic Polynucleotide
taatacgactcactatagggtaacattggcattcgaacactctggatcccaacagaggagagggatcatgagtgttcgaaacctggcggcagcgcaaaagatg

SEQ ID NO: 45695 - DNA, 103 bp, Artificial Sequence
  Synthetic Polynucleotide
taatacgactcactataggggaaattaacattggcattcgaacactctggaacagaggagaccagagatgtcgaatgccaacctggcggcagcgcaaaagatg

SEQ ID NO: 45696 - DNA, 103 bp, Artificial Sequence
  Synthetic Polynucleotide
taatacgactcactatagggagtaagaaattaacattggcattcgaacacaacagaggagagtgttcatgtgccaatgtaacctggcggcagcgcaaaagatg

SEQ ID NO: 45697 - DNA, 103 bp, Artificial Sequence
  Synthetic Polynucleotide
taatacgactcactataggggtgttagtaagaaattaacattggcattcgaacagaggagacgaatgatgatgttaattaacctggcggcagcgcaaaagatg

SEQ ID NO: 45698 - DNA, 103 bp, Artificial Sequence
  Synthetic Polynucleotide
taatacgactcactatagggattacgtgttagtaagaaattaacattggcaacagaggagagccaatatgaatttcttaaacctggcggcagcgcaaaagatg

SEQ ID NO: 45699 - DNA, 103 bp, Artificial Sequence
  Synthetic Polynucleotide
taatacgactcactatagggttataattacgtgttagtaagaaattaacaaacagaggagatgttaaatgcttactaacaacctggcggcagcgcaaaagatg

SEQ ID NO: 45700 - DNA, 103 bp, Artificial Sequence
  Synthetic Polynucleotide
taatacgactcactatagggaattattataattacgtgttagtaagaaataacagaggagaatttctatgtaacacgtaaacctggcggcagcgcaaaagatg

SEQ ID NO: 45701 - DNA, 103 bp, Artificial Sequence
  Synthetic Polynucleotide
taatacgactcactatagggtcctaaattattataattacgtgttagtaaaacagaggagattactaatgcgtaattataacctggcggcagcgcaaaagatg

SEQ ID NO: 45702 - DNA, 103 bp, Artificial Sequence
  Synthetic Polynucleotide
taatacgactcactatagggcaaagtcctaaattattataattacgtgttaacagaggagaaacacgatgttataataaaacctggcggcagcgcaaaagatg

SEQ ID NO: 45703 - DNA, 103 bp, Artificial Sequence
  Synthetic Polynucleotide
taatacgactcactatagggtattacaaagtcctaaattattataattacaacagaggagagtaattatgataatttagaacctggcggcagcgcaaaagatg

SEQ ID NO: 45704 - DNA, 103 bp, Artificial Sequence
  Synthetic Polynucleotide
taatacgactcactatagggcatctggtggcggtgaaatgtggggaggataacagaggagaatcctcatgacatttcacaacctggcggcagcgcaaaagatg

SEQ ID NO: 45705 - DNA, 103 bp, Artificial Sequence
  Synthetic Polynucleotide
taatacgactcactatagggtacaatattacaaagtcctaaattattataaacagaggagatataatatgttaggacttaacctggcggcagcgcaaaagatg

SEQ ID NO: 45706 - DNA, 103 bp, Artificial Sequence
  Synthetic Polynucleotide
taatacgactcactatagggcatcgtacaatattacaaagtcctaaattaaacagaggagataatttatgactttgtaaaacctggcggcagcgcaaaagatg

SEQ ID NO: 45707 - DNA, 103 bp, Artificial Sequence
  Synthetic Polynucleotide
taatacgactcactatagggtattacatcgtacaatattacaaagtcctaaacagaggagataggacatggtaatattgaacctggcggcagcgcaaaagatg

SEQ ID NO: 45708 - DNA, 103 bp, Artificial Sequence
  Synthetic Polynucleotide
taatacgactcactataggggctggtattacatcgtacaatattacaaagaacagaggagactttgtatgattgtacgaaacctggcggcagcgcaaaagatg

SEQ ID NO: 45709 - DNA, 103 bp, Artificial Sequence
  Synthetic Polynucleotide
taatacgactcactatagggttcacgctggtattacatcgtacaatattaaacagaggagataatatatgacgatgtaaaacctggcggcagcgcaaaagatg

SEQ ID NO: 45710 - DNA, 103 bp, Artificial Sequence
  Synthetic Polynucleotide
taatacgactcactatagggagttgttcacgctggtattacatcgtacaaaacagaggagattgtacatggtaataccaaacctggcggcagcgcaaaagatg

SEQ ID NO: 45711 - DNA, 103 bp, Artificial Sequence
  Synthetic Polynucleotide
taatacgactcactatagggctgtaagttgttcacgctggtattacatcgaacagaggagacgatgtatgaccagcgtgaacctggcggcagcgcaaaagatg

SEQ ID NO: 45712 - DNA, 103 bp, Artificial Sequence
  Synthetic Polynucleotide
taatacgactcactatagggtccatctgtaagttgttcacgctggtattaaacagaggagataatacatgcgtgaacaaaacctggcggcagcgcaaaagatg

SEQ ID NO: 45713 - DNA, 103 bp, Artificial Sequence
  Synthetic Polynucleotide
taatacgactcactatagggttttatccatctgtaagttgttcacgctggaacagaggagaccagcgatgacaacttacaacctggcggcagcgcaaaagatg

SEQ ID NO: 45714 - DNA, 103 bp, Artificial Sequence
  Synthetic Polynucleotide
taatacgactcactatagggggaagttttatccatctgtaagttgttcacaacagaggagagtgaacatgttacagatgaacctggcggcagcgcaaaagatg

SEQ ID NO: 45715 - DNA, 103 bp, Artificial Sequence
  Synthetic Polynucleotide
taatacgactcactatagggttatacatctggtggcggtgaaatgtggggaacagaggagaccccacatgtcaccgccaaacctggcggcagcgcaaaagatg

SEQ ID NO: 45716 - DNA, 103 bp, Artificial Sequence
  Synthetic Polynucleotide
taatacgactcactatagggaatgaggaagttttatccatctgtaagttgaacagaggagacaacttatggatggataaaacctggcggcagcgcaaaagatg

SEQ ID NO: 45717 - DNA, 103 bp, Artificial Sequence
  Synthetic Polynucleotide
taatacgactcactatagggatcttaatgaggaagttttatccatctgtaaacagaggagatacagaatgataaaacttaacctggcggcagcgcaaaagatg

SEQ ID NO: 45718 - DNA, 103 bp, Artificial Sequence
  Synthetic Polynucleotide
taatacgactcactatagggtgacaatcttaatgaggaagttttatccataacagaggagaatggatatgacttcctcaaacctggcggcagcgcaaaagatg

SEQ ID NO: 45719 - DNA, 103 bp, Artificial Sequence
  Synthetic Polynucleotide
taatacgactcactatagggccacatgacaatcttaatgaggaagttttaaacagaggagataaaacatgctcattaagaacctggcggcagcgcaaaagatg

SEQ ID NO: 45720 - DNA, 103 bp, Artificial Sequence
  Synthetic Polynucleotide
taatacgactcactatagggttaatccacatgacaatcttaatgaggaagaacagaggagacttcctatgtaagattgtaacctggcggcagcgcaaaagatg

SEQ ID NO: 45721 - DNA, 103 bp, Artificial Sequence
  Synthetic Polynucleotide
taatacgactcactatagggattgcttaatccacatgacaatcttaatgaaacagaggagatcattaatgttgtcatgtaacctggcggcagcgcaaaagatg

SEQ ID NO: 45722 - DNA, 103 bp, Artificial Sequence
  Synthetic Polynucleotide
taatacgactcactatagggtcactattgcttaatccacatgacaatcttaacagaggagaaagattatgatgtggattaacctggcggcagcgcaaaagatg

SEQ ID NO: 45723 - DNA, 103 bp, Artificial Sequence
  Synthetic Polynucleotide
taatacgactcactatagggatctatcactattgcttaatccacatgacaaacagaggagatgtcatatggattaagcaaacctggcggcagcgcaaaagatg

SEQ ID NO: 45724 - DNA, 103 bp, Artificial Sequence
  Synthetic Polynucleotide
taatacgactcactatagggagaaaatctatcactattgcttaatccacaaacagaggagatgtggaatgagcaatagtaacctggcggcagcgcaaaagatg

SEQ ID NO: 45725 - DNA, 103 bp, Artificial Sequence
  Synthetic Polynucleotide
taatacgactcactatagggacagtagaaaatctatcactattgcttaataacagaggagaattaagatgtagtgatagaacctggcggcagcgcaaaagatg

SEQ ID NO: 45726 - DNA, 103 bp, Artificial Sequence
  Synthetic Polynucleotide
taatacgactcactatagggaaaacttatacatctggtggcggtgaaatgaacagaggagacatttcatggccaccagaaacctggcggcagcgcaaaagatg

SEQ ID NO: 45727 - DNA, 103 bp, Artificial Sequence
  Synthetic Polynucleotide
taatacgactcactatagggcgggaacagtagaaaatctatcactattgcaacagaggagagcaataatgatagattttaacctggcggcagcgcaaaagatg

SEQ ID NO: 45728 - DNA, 103 bp, Artificial Sequence
  Synthetic Polynucleotide
taatacgactcactatagggattgacgggaacagtagaaaatctatcactaacagaggagaagtgatatgttttctactaacctggcggcagcgcaaaagatg

SEQ ID NO: 45729 - DNA, 103 bp, Artificial Sequence
  Synthetic Polynucleotide
taatacgactcactataggggctctattgacgggaacagtagaaaatctaaacagaggagatagattatgtactgttccaacctggcggcagcgcaaaagatg

SEQ ID NO: 45730 - DNA, 103 bp, Artificial Sequence
  Synthetic Polynucleotide
taatacgactcactatagggcttttgctctattgacgggaacagtagaaaaacagaggagatttctaatgttcccgtcaaacctggcggcagcgcaaaagatg

SEQ ID NO: 45731 - DNA, 103 bp, Artificial Sequence
  Synthetic Polynucleotide
taatacgactcactatagggaactacttttgctctattgacgggaacagtaacagaggagaactgttatggtcaatagaaacctggcggcagcgcaaaagatg

SEQ ID NO: 45732 - DNA, 103 bp, Artificial Sequence
  Synthetic Polynucleotide
taatacgactcactatagggtgttgaactacttttgctctattgacgggaaacagaggagatcccgtatgtagagcaaaaacctggcggcagcgcaaaagatg

SEQ ID NO: 45733 - DNA, 103 bp, Artificial Sequence
  Synthetic Polynucleotide
taatacgactcactatagggtattatgttgaactacttttgctctattgaaacagaggagatcaataatgcaaaagtagaacctggcggcagcgcaaaagatg

SEQ ID NO: 45734 - DNA, 103 bp, Artificial Sequence
  Synthetic Polynucleotide
taatacgactcactatagggtttaatattatgttgaactacttttgctctaacagaggagaagagcaatggtagttcaaaacctggcggcagcgcaaaagatg

SEQ ID NO: 45735 - DNA, 103 bp, Artificial Sequence
  Synthetic Polynucleotide
taatacgactcactataggggagtgtttaatattatgttgaactacttttaacagaggagaaaaagtatgtcaacataaaacctggcggcagcgcaaaagatg

SEQ ID NO: 45736 - DNA, 103 bp, Artificial Sequence
  Synthetic Polynucleotide
taatacgactcactatagggcgaacgagtgtttaatattatgttgaactaaacagaggagatagttcatgataatattaaacctggcggcagcgcaaaagatg

SEQ ID NO: 45737 - DNA, 103 bp, Artificial Sequence
  Synthetic Polynucleotide
taatacgactcactataggggatctaaaacttatacatctggtggcggtgaacagaggagacaccgcatgcagatgtataacctggcggcagcgcaaaagatg

SEQ ID NO: 45738 - DNA, 103 bp, Artificial Sequence
  Synthetic Polynucleotide
taatacgactcactatagggtagatcgaacgagtgtttaatattatgttgaacagaggagacaacatatgattaaacacaacctggcggcagcgcaaaagatg

SEQ ID NO: 45739 - DNA, 103 bp, Artificial Sequence
  Synthetic Polynucleotide
taatacgactcactatagggaattttagatcgaacgagtgtttaatattaaacagaggagataatatatgacactcgttaacctggcggcagcgcaaaagatg

SEQ ID NO: 45740 - DNA, 103 bp, Artificial Sequence
  Synthetic Polynucleotide
taatacgactcactatagggaatgcaattttagatcgaacgagtgtttaaaacagaggagattaaacatgcgttcgatcaacctggcggcagcgcaaaagatg

SEQ ID NO: 45741 - DNA, 103 bp, Artificial Sequence
  Synthetic Polynucleotide
taatacgactcactatagggaatcaaatgcaattttagatcgaacgagtgaacagaggagacactcgatggatctaaaaaacctggcggcagcgcaaaagatg

SEQ ID NO: 45742 - DNA, 103 bp, Artificial Sequence
  Synthetic Polynucleotide
taatacgactcactatagggaaactaatcaaatgcaattttagatcgaacaacagaggagagttcgaatgaaaattgcaaacctggcggcagcgcaaaagatg

SEQ ID NO: 45743 - DNA, 103 bp, Artificial Sequence
  Synthetic Polynucleotide
taatacgactcactatagggataataaactaatcaaatgcaattttagataacagaggagaatctaaatgtgcatttgaaacctggcggcagcgcaaaagatg

SEQ ID NO: 45744 - DNA, 103 bp, Artificial Sequence
  Synthetic Polynucleotide
taatacgactcactataggggagagataataaactaatcaaatgcaatttaacagaggagaaaattgatgttgattagtaacctggcggcagcgcaaaagatg

SEQ ID NO: 45745 - DNA, 103 bp, Artificial Sequence
  Synthetic Polynucleotide
taatacgactcactatagggaccaagagagataataaactaatcaaatgcaacagaggagagcatttatgtagtttattaacctggcggcagcgcaaaagatg

SEQ ID NO: 45746 - DNA, 103 bp, Artificial Sequence
  Synthetic Polynucleotide
taatacgactcactatagggatattaccaagagagataataaactaatcaaacagaggagatgattaatgtattatctcaacctggcggcagcgcaaaagatg

SEQ ID NO: 45747 - DNA, 103 bp, Artificial Sequence
  Synthetic Polynucleotide
taatacgactcactatagggtatccatattaccaagagagataataaactaacagaggagaagtttaatgtctctcttgaacctggcggcagcgcaaaagatg

SEQ ID NO: 45748 - DNA, 103 bp, Artificial Sequence
  Synthetic Polynucleotide
taatacgactcactatagggtaaaggatctaaaacttatacatctggtggaacagaggagaccaccaatggtataagttaacctggcggcagcgcaaaagatg

SEQ ID NO: 45749 - DNA, 103 bp, Artificial Sequence
  Synthetic Polynucleotide
taatacgactcactatagggattagtatccatattaccaagagagataataacagaggagaattatcatgcttggtaataacctggcggcagcgcaaaagatg

SEQ ID NO: 45750 - DNA, 103 bp, Artificial Sequence
  Synthetic Polynucleotide
taatacgactcactatagggctacaattagtatccatattaccaagagagaacagaggagactctctatgtaatatggaaacctggcggcagcgcaaaagatg

SEQ ID NO: 45751 - DNA, 103 bp, Artificial Sequence
  Synthetic Polynucleotide
taatacgactcactatagggaatagctacaattagtatccatattaccaaaacagaggagattggtaatgtggatactaaacctggcggcagcgcaaaagatg

SEQ ID NO: 45752 - DNA, 103 bp, Artificial Sequence
  Synthetic Polynucleotide
taatacgactcactatagggatttaaatagctacaattagtatccatattaacagaggagaaatatgatgactaattgtaacctggcggcagcgcaaaagatg

SEQ ID NO: 45753 - DNA, 103 bp, Artificial Sequence
  Synthetic Polynucleotide
taatacgactcactatagggcacccatttaaatagctacaattagtatccaacagaggagaggatacatgttgtagctaaacctggcggcagcgcaaaagatg

SEQ ID NO: 45754 - DNA, 103 bp, Artificial Sequence
  Synthetic Polynucleotide
taatacgactcactatagggcgcggcacccatttaaatagctacaattagaacagaggagactaattatggctatttaaaacctggcggcagcgcaaaagatg

SEQ ID NO: 45755 - DNA, 103 bp, Artificial Sequence
  Synthetic Polynucleotide
taatacgactcactatagggcttgccgcggcacccatttaaatagctacaaacagaggagatgtagcatgttaaatgggaacctggcggcagcgcaaaagatg

SEQ ID NO: 45756 - DNA, 103 bp, Artificial Sequence
  Synthetic Polynucleotide
taatacgactcactataggggtatgcttgccgcggcacccatttaaatagaacagaggagactatttatgtgggtgccgaacctggcggcagcgcaaaagatg

SEQ ID NO: 45757 - DNA, 103 bp, Artificial Sequence
  Synthetic Polynucleotide
taatacgactcactatagggcgtctgtatgcttgccgcggcacccatttaaacagaggagataaatgatggccgcggcaaacctggcggcagcgcaaaagatg

SEQ ID NO: 45758 - DNA, 103 bp, Artificial Sequence
  Synthetic Polynucleotide
taatacgactcactatagggaccgtcgtctgtatgcttgccgcggcacccaacagaggagagggtgcatgggcaagcataacctggcggcagcgcaaaagatg

SEQ ID NO: 45759 - DNA, 103 bp, Artificial Sequence
  Synthetic Polynucleotide
taatacgactcactatagggagtaataaaggatctaaaacttatacatctaacagaggagaagatgtatgagttttagaaacctggcggcagcgcaaaagatg

SEQ ID NO: 45760 - DNA, 103 bp, Artificial Sequence
  Synthetic Polynucleotide
taatacgactcactatagggtattcaccgtcgtctgtatgcttgccgcggaacagaggagaccgcggatggcatacagaaacctggcggcagcgcaaaagatg

SEQ ID NO: 45761 - DNA, 103 bp, Artificial Sequence
  Synthetic Polynucleotide
taatacgactcactataggggagtgtattcaccgtcgtctgtatgcttgcaacagaggagagcaagcatgcagacgacgaacctggcggcagcgcaaaagatg

SEQ ID NO: 45762 - DNA, 103 bp, Artificial Sequence
  Synthetic Polynucleotide
taatacgactcactatagggtcgctgagtgtattcaccgtcgtctgtatgaacagaggagacatacaatggacggtgaaaacctggcggcagcgcaaaagatg

SEQ ID NO: 45763 - DNA, 103 bp, Artificial Sequence
  Synthetic Polynucleotide
taatacgactcactatagggtacgttcgctgagtgtattcaccgtcgtctaacagaggagaagacgaatgtgaatacacaacctggcggcagcgcaaaagatg

SEQ ID NO: 45764 - DNA, 103 bp, Artificial Sequence
  Synthetic Polynucleotide
taatacgactcactatagggcgagatacgttcgctgagtgtattcaccgtaacagaggagaacggtgatgacactcagcaacctggcggcagcgcaaaagatg

SEQ ID NO: 45765 - DNA, 103 bp, Artificial Sequence
  Synthetic Polynucleotide
taatacgactcactatagggttagacgagatacgttcgctgagtgtattcaacagaggagagaatacatgcagcgaacgaacctggcggcagcgcaaaagatg

SEQ ID NO: 45766 - DNA, 103 bp, Artificial Sequence
  Synthetic Polynucleotide
taatacgactcactatagggctaatttagacgagatacgttcgctgagtgaacagaggagacactcaatgaacgtatctaacctggcggcagcgcaaaagatg

SEQ ID NO: 45767 - DNA, 103 bp, Artificial Sequence
  Synthetic Polynucleotide
taatacgactcactatagggttgttctaatttagacgagatacgttcgctaacagaggagaagcgaaatgatctcgtctaacctggcggcagcgcaaaagatg

SEQ ID NO: 45768 - DNA, 103 bp, Artificial Sequence
  Synthetic Polynucleotide
taatacgactcactataggggcttcttgttctaatttagacgagatacgtaacagaggagaacgtatatggtctaaattaacctggcggcagcgcaaaagatg

SEQ ID NO: 45769 - DNA, 103 bp, Artificial Sequence
  Synthetic Polynucleotide
taatacgactcactatagggcattcgcttcttgttctaatttagacgagaaacagaggagatctcgtatgaattagaacaacctggcggcagcgcaaaagatg

SEQ ID NO: 45770 - DNA, 103 bp, Artificial Sequence
  Synthetic Polynucleotide
taatacgactcactatagggatggtagtaataaaggatctaaaacttataaacagaggagatataagatgtagatccttaacctggcggcagcgcaaaagatg

SEQ ID NO: 45771 - DNA, 103 bp, Artificial Sequence
  Synthetic Polynucleotide
taatacgactcactatagggactagcattcgcttcttgttctaatttagaaacagaggagatctaaaatggaacaagaaaacctggcggcagcgcaaaagatg

SEQ ID NO: 45772 - DNA, 103 bp, Artificial Sequence
  Synthetic Polynucleotide
taatacgactcactatagggtgagcactagcattcgcttcttgttctaataacagaggagaattagaatgagaagcgaaaacctggcggcagcgcaaaagatg

SEQ ID NO: 45773 - DNA, 103 bp, Artificial Sequence
  Synthetic Polynucleotide
taatacgactcactatagggttgtttgagcactagcattcgcttcttgttaacagaggagaaacaagatgcgaatgctaaacctggcggcagcgcaaaagatg

SEQ ID NO: 45774 - DNA, 103 bp, Artificial Sequence
  Synthetic Polynucleotide
taatacgactcactatagggacattttgtttgagcactagcattcgcttcaacagaggagagaagcgatggctagtgctaacctggcggcagcgcaaaagatg

SEQ ID NO: 45775 - DNA, 103 bp, Artificial Sequence
  Synthetic Polynucleotide
taatacgactcactatagggatatcacattttgtttgagcactagcattcaacagaggagagaatgcatgtgctcaaacaacctggcggcagcgcaaaagatg

SEQ ID NO: 45776 - DNA, 103 bp, Artificial Sequence
  Synthetic Polynucleotide
taatacgactcactatagggtttctatatcacattttgtttgagcactagaacagaggagactagtgatgaaacaaaataacctggcggcagcgcaaaagatg

SEQ ID NO: 45777 - DNA, 103 bp, Artificial Sequence
  Synthetic Polynucleotide
taatacgactcactatagggtccgatttctatatcacattttgtttgagcaacagaggagagctcaaatgaaatgtgataacctggcggcagcgcaaaagatg

SEQ ID NO: 45778 - DNA, 103 bp, Artificial Sequence
  Synthetic Polynucleotide
taatacgactcactatagggaaatttccgatttctatatcacattttgttaacagaggagaaacaaaatgtgatatagaaacctggcggcagcgcaaaagatg

SEQ ID NO: 45779 - DNA, 103 bp, Artificial Sequence
  Synthetic Polynucleotide
taatacgactcactatagggtataaaaatttccgatttctatatcacattaacagaggagaaatgtgatgtagaaatcgaacctggcggcagcgcaaaagatg

SEQ ID NO: 45780 - DNA, 103 bp, Artificial Sequence
  Synthetic Polynucleotide
taatacgactcactatagggtcggatataaaaatttccgatttctatatcaacagaggagagatataatgatcggaaataacctggcggcagcgcaaaagatg

SEQ ID NO: 45781 - DNA, 103 bp, Artificial Sequence
  Synthetic Polynucleotide
taatacgactcactatagggacatgatggtagtaataaaggatctaaaacaacagaggagagttttaatgcctttattaaacctggcggcagcgcaaaagatg

SEQ ID NO: 45782 - DNA, 103 bp, Artificial Sequence
  Synthetic Polynucleotide
taatacgactcactatagggttttgtcggatataaaaatttccgatttctaacagaggagaagaaatatgaaatttttaaacctggcggcagcgcaaaagatg

SEQ ID NO: 45783 - DNA, 103 bp, Artificial Sequence
  Synthetic Polynucleotide
taatacgactcactatagggcatggttttgtcggatataaaaatttccgaaacagaggagatcggaaatgtttatatccaacctggcggcagcgcaaaagatg

SEQ ID NO: 45784 - DNA, 103 bp, Artificial Sequence
  Synthetic Polynucleotide
taatacgactcactatagggacatccatggttttgtcggatataaaaattaacagaggagaaattttatgatccgacaaaacctggcggcagcgcaaaagatg

SEQ ID NO: 45785 - DNA, 103 bp, Artificial Sequence
  Synthetic Polynucleotide
taatacgactcactatagggaggttacatccatggttttgtcggatataaaacagaggagattatatatgacaaaaccaaacctggcggcagcgcaaaagatg

SEQ ID NO: 45786 - DNA, 103 bp, Artificial Sequence
  Synthetic Polynucleotide
taatacgactcactatagggcagtgaggttacatccatggttttgtcggaaacagaggagatccgacatgaccatggataacctggcggcagcgcaaaagatg

SEQ ID NO: 45787 - DNA, 103 bp, Artificial Sequence
  Synthetic Polynucleotide
taatacgactcactatagggtttaacagtgaggttacatccatggttttgaacagaggagacaaaacatgggatgtaacaacctggcggcagcgcaaaagatg

SEQ ID NO: 45788 - DNA, 103 bp, Artificial Sequence
  Synthetic Polynucleotide
taatacgactcactatagggatatttttaacagtgaggttacatccatggaacagaggagaccatggatgtaacctcacaacctggcggcagcgcaaaagatg

SEQ ID NO: 45789 - DNA, 103 bp, Artificial Sequence
  Synthetic Polynucleotide
taatacgactcactatagggagcacatatttttaacagtgaggttacatcaacagaggagagatgtaatgtcactgttaaacctggcggcagcgcaaaagatg

SEQ ID NO: 45790 - DNA, 103 bp, Artificial Sequence
  Synthetic Polynucleotide
taatacgactcactatagggtgcagagcacatatttttaacagtgaggttaacagaggagaaacctcatggttaaaaataacctggcggcagcgcaaaagatg

SEQ ID NO: 45791 - DNA, 103 bp, Artificial Sequence
  Synthetic Polynucleotide
taatacgactcactataggggcatctgcagagcacatatttttaacagtgaacagaggagacactgtatgaaatatgtgaacctggcggcagcgcaaaagatg

SEQ ID NO: 45792 - DNA, 103 bp, Artificial Sequence
  Synthetic Polynucleotide
taatacgactcactatagggaatacatcctgtgggtttctcatagatggaaacagaggagatccatcatggagaaacccaacctggcggcagcgcaaaagatg

SEQ ID NO: 45793 - DNA, 103 bp, Artificial Sequence
  Synthetic Polynucleotide
taatacgactcactatagggcatggacatgatggtagtaataaaggatctaacagaggagaagatccatgattactaccaacctggcggcagcgcaaaagatg

SEQ ID NO: 45794 - DNA, 103 bp, Artificial Sequence
  Synthetic Polynucleotide
taatacgactcactatagggcatccgcatctgcagagcacatatttttaaaacagaggagattaaaaatgtgtgctctgaacctggcggcagcgcaaaagatg

SEQ ID NO: 45795 - DNA, 103 bp, Artificial Sequence
  Synthetic Polynucleotide
taatacgactcactatagggctgagcatccgcatctgcagagcacatattaacagaggagaaatatgatgtctgcagataacctggcggcagcgcaaaagatg

SEQ ID NO: 45796 - DNA, 103 bp, Artificial Sequence
  Synthetic Polynucleotide
taatacgactcactatagggtccaactgagcatccgcatctgcagagcacaacagaggagagtgctcatgagatgcggaaacctggcggcagcgcaaaagatg

SEQ ID NO: 45797 - DNA, 103 bp, Artificial Sequence
  Synthetic Polynucleotide
taatacgactcactatagggcagcatccaactgagcatccgcatctgcagaacagaggagactgcagatgcggatgctcaacctggcggcagcgcaaaagatg

SEQ ID NO: 45798 - DNA, 103 bp, Artificial Sequence
  Synthetic Polynucleotide
taatacgactcactatagggtaacacagcatccaactgagcatccgcatcaacagaggagagatgcgatggctcagttgaacctggcggcagcgcaaaagatg

SEQ ID NO: 45799 - DNA, 103 bp, Artificial Sequence
  Synthetic Polynucleotide
taatacgactcactataggggctgataacacagcatccaactgagcatccaacagaggagaggatgcatggttggatgcaacctggcggcagcgcaaaagatg

SEQ ID NO: 45800 - DNA, 103 bp, Artificial Sequence
  Synthetic Polynucleotide
taatacgactcactatagggtagcggctgataacacagcatccaactgagaacagaggagactcagtatgatgctgtgtaacctggcggcagcgcaaaagatg

SEQ ID NO: 45801 - DNA, 103 bp, Artificial Sequence
  Synthetic Polynucleotide
taatacgactcactatagggttctgtagcggctgataacacagcatccaaaacagaggagattggatatggtgttatcaaacctggcggcagcgcaaaagatg

SEQ ID NO: 45802 - DNA, 103 bp, Artificial Sequence
  Synthetic Polynucleotide
taatacgactcactatagggtatgtttctgtagcggctgataacacagcaaacagaggagatgctgtatgatcagccgcaacctggcggcagcgcaaaagatg

SEQ ID NO: 45803 - DNA, 103 bp, Artificial Sequence
  Synthetic Polynucleotide
taatacgactcactatagggcactatatgtttctgtagcggctgataacaaacagaggagatgttatatgccgctacagaacctggcggcagcgcaaaagatg

SEQ ID NO: 45804 - DNA, 103 bp, Artificial Sequence
  Synthetic Polynucleotide
taatacgactcactatagggttatccatggacatgatggtagtaataaagaacagaggagactttatatgtaccatcataacctggcggcagcgcaaaagatg

SEQ ID NO: 45805 - DNA, 103 bp, Artificial Sequence
  Synthetic Polynucleotide
taatacgactcactatagggtaatccactatatgtttctgtagcggctgaaacagaggagatcagccatgacagaaacaaacctggcggcagcgcaaaagatg

SEQ ID NO: 45806 - DNA, 103 bp, Artificial Sequence
  Synthetic Polynucleotide
taatacgactcactatagggggtgttaatccactatatgtttctgtagcgaacagaggagacgctacatgaacatatagaacctggcggcagcgcaaaagatg

SEQ ID NO: 45807 - DNA, 103 bp, Artificial Sequence
  Synthetic Polynucleotide
taatacgactcactataggggttccggtgttaatccactatatgtttctgaacagaggagacagaaaatgatagtggataacctggcggcagcgcaaaagatg

SEQ ID NO: 45808 - DNA, 103 bp, Artificial Sequence
  Synthetic Polynucleotide
taatacgactcactatagggtttttgttccggtgttaatccactatatgtaacagaggagaacatatatgggattaacaaacctggcggcagcgcaaaagatg

SEQ ID NO: 45809 - DNA, 103 bp, Artificial Sequence
  Synthetic Polynucleotide
taatacgactcactatagggtatgctttttgttccggtgttaatccactaaacagaggagatagtggatgaacaccggaaacctggcggcagcgcaaaagatg

SEQ ID NO: 45810 - DNA, 103 bp, Artificial Sequence
  Synthetic Polynucleotide
taatacgactcactataggggtacgtatgctttttgttccggtgttaatcaacagaggagagattaaatgcggaacaaaaacctggcggcagcgcaaaagatg

SEQ ID NO: 45811 - DNA, 103 bp, Artificial Sequence
  Synthetic Polynucleotide
taatacgactcactatagggagctggtacgtatgctttttgttccggtgtaacagaggagaacaccgatgcaaaaagcaaacctggcggcagcgcaaaagatg

SEQ ID NO: 45812 - DNA, 103 bp, Artificial Sequence
  Synthetic Polynucleotide
taatacgactcactatagggaacatagctggtacgtatgctttttgttccaacagaggagaggaacaatgagcatacgtaacctggcggcagcgcaaaagatg

SEQ ID NO: 45813 - DNA, 103 bp, Artificial Sequence
  Synthetic Polynucleotide
taatacgactcactatagggccgtaaacatagctggtacgtatgctttttaacagaggagaaaaaagatgacgtaccagaacctggcggcagcgcaaaagatg

SEQ ID NO: 45814 - DNA, 103 bp, Artificial Sequence
  Synthetic Polynucleotide
taatacgactcactatagggcgcagccgtaaacatagctggtacgtatgcaacagaggagagcatacatgccagctatgaacctggcggcagcgcaaaagatg

SEQ ID NO: 45815 - DNA, 103 bp, Artificial Sequence
  Synthetic Polynucleotide
taatacgactcactatagggtgtctttatccatggacatgatggtagtaaaacagaggagattactaatgtcatgtccaaacctggcggcagcgcaaaagatg

SEQ ID NO: 45816 - DNA, 103 bp, Artificial Sequence
  Synthetic Polynucleotide
taatacgactcactatagggtttaacgcagccgtaaacatagctggtacgaacagaggagacgtaccatgtatgtttacaacctggcggcagcgcaaaagatg

SEQ ID NO: 45817 - DNA, 103 bp, Artificial Sequence
  Synthetic Polynucleotide
taatacgactcactataggggaatgtttaacgcagccgtaaacatagctgaacagaggagacagctaatgttacggctgaacctggcggcagcgcaaaagatg

SEQ ID NO: 45818 - DNA, 103 bp, Artificial Sequence
  Synthetic Polynucleotide
taatacgactcactatagggcgtctgaatgtttaacgcagccgtaaacataacagaggagaatgtttatggctgcgttaaacctggcggcagcgcaaaagatg

SEQ ID NO: 45819 - DNA, 103 bp, Artificial Sequence
  Synthetic Polynucleotide
taatacgactcactatagggacactcgtctgaatgtttaacgcagccgtaaacagaggagatacggcatggttaaacataacctggcggcagcgcaaaagatg

SEQ ID NO: 45820 - DNA, 103 bp, Artificial Sequence
  Synthetic Polynucleotide
taatacgactcactatagggtgtttacactcgtctgaatgtttaacgcagaacagaggagactgcgtatgacattcagaaacctggcggcagcgcaaaagatg

SEQ ID NO: 45821 - DNA, 103 bp, Artificial Sequence
  Synthetic Polynucleotide
taatacgactcactatagggaacagtgtttacactcgtctgaatgtttaaaacagaggagattaaacatgcagacgagtaacctggcggcagcgcaaaagatg

SEQ ID NO: 45822 - DNA, 103 bp, Artificial Sequence
  Synthetic Polynucleotide
taatacgactcactatagggctaacaacagtgtttacactcgtctgaatgaacagaggagacattcaatggagtgtaaaaacctggcggcagcgcaaaagatg

SEQ ID NO: 45823 - DNA, 103 bp, Artificial Sequence
  Synthetic Polynucleotide
taatacgactcactatagggaatctctaacaacagtgtttacactcgtctaacagaggagaagacgaatgtaaacactgaacctggcggcagcgcaaaagatg

SEQ ID NO: 45824 - DNA, 103 bp, Artificial Sequence
  Synthetic Polynucleotide
taatacgactcactatagggttcaaaatctctaacaacagtgtttacactaacagaggagaagtgtaatgactgttgttaacctggcggcagcgcaaaagatg

SEQ ID NO: 45825 - DNA, 103 bp, Artificial Sequence
  Synthetic Polynucleotide
taatacgactcactatagggtaattttcaaaatctctaacaacagtgtttaacagaggagaaaacacatgtgttagagaaacctggcggcagcgcaaaagatg

SEQ ID NO: 45826 - DNA, 103 bp, Artificial Sequence
  Synthetic Polynucleotide
taatacgactcactatagggtggagtgtctttatccatggacatgatggtaacagaggagaaccatcatgtccatggataacctggcggcagcgcaaaagatg

SEQ ID NO: 45827 - DNA, 103 bp, Artificial Sequence
  Synthetic Polynucleotide
taatacgactcactatagggtcacataattttcaaaatctctaacaacagaacagaggagactgttgatggagattttgaacctggcggcagcgcaaaagatg

SEQ ID NO: 45828 - DNA, 103 bp, Artificial Sequence
  Synthetic Polynucleotide
taatacgactcactatagggctgtttcacataattttcaaaatctctaacaacagaggagagttagaatgtttgaaaataacctggcggcagcgcaaaagatg

SEQ ID NO: 45829 - DNA, 103 bp, Artificial Sequence
  Synthetic Polynucleotide
taatacgactcactatagggcaagtctgtttcacataattttcaaaatctaacagaggagaagatttatgaaattatgtaacctggcggcagcgcaaaagatg

SEQ ID NO: 45830 - DNA, 103 bp, Artificial Sequence
  Synthetic Polynucleotide
taatacgactcactatagggaattacaagtctgtttcacataattttcaaaacagaggagattgaaaatgatgtgaaacaacctggcggcagcgcaaaagatg

SEQ ID NO: 45831 - DNA, 103 bp, Artificial Sequence
  Synthetic Polynucleotide
taatacgactcactataggggctagaattacaagtctgtttcacataattaacagaggagaaattatatgaaacagactaacctggcggcagcgcaaaagatg

SEQ ID NO: 45832 - DNA, 103 bp, Artificial Sequence
  Synthetic Polynucleotide
taatacgactcactatagggaccgcgctagaattacaagtctgtttcacaaacagaggagatgtgaaatggacttgtaaaacctggcggcagcgcaaaagatg

SEQ ID NO: 45833 - DNA, 103 bp, Artificial Sequence
  Synthetic Polynucleotide
taatacgactcactatagggcgacgaccgcgctagaattacaagtctgttaacagaggagaaacagaatggtaattctaaacctggcggcagcgcaaaagatg

SEQ ID NO: 45834 - DNA, 103 bp, Artificial Sequence
  Synthetic Polynucleotide
taatacgactcactataggggttatcgacgaccgcgctagaattacaagtaacagaggagaacttgtatgtctagcgcgaacctggcggcagcgcaaaagatg

SEQ ID NO: 45835 - DNA, 103 bp, Artificial Sequence
  Synthetic Polynucleotide
taatacgactcactatagggaatttgttatcgacgaccgcgctagaattaaacagaggagataattcatgcgcggtcgtaacctggcggcagcgcaaaagatg

SEQ ID NO: 45836 - DNA, 103 bp, Artificial Sequence
  Synthetic Polynucleotide
taatacgactcactatagggtctttaatttgttatcgacgaccgcgctagaacagaggagactagcgatgtcgtcgataaacctggcggcagcgcaaaagatg

SEQ ID NO: 45837 - DNA, 103 bp, Artificial Sequence
  Synthetic Polynucleotide
taatacgactcactataggggcatgtggagtgtctttatccatggacatgaacagaggagacatgtcatgggataaagaaacctggcggcagcgcaaaagatg

SEQ ID NO: 45838 - DNA, 103 bp, Artificial Sequence
  Synthetic Polynucleotide
taatacgactcactatagggttgtatctttaatttgttatcgacgaccgcaacagaggagagcggtcatggataacaaaaacctggcggcagcgcaaaagatg

SEQ ID NO: 45839 - DNA, 103 bp, Artificial Sequence
  Synthetic Polynucleotide
taatacgactcactatagggacgttttgtatctttaatttgttatcgacgaacagaggagacgtcgaatgcaaattaaaaacctggcggcagcgcaaaagatg

SEQ ID NO: 45840 - DNA, 103 bp, Artificial Sequence
  Synthetic Polynucleotide
taatacgactcactatagggtaattacgttttgtatctttaatttgttataacagaggagaataacaatgtaaagatacaacctggcggcagcgcaaaagatg

SEQ ID NO: 45841 - DNA, 103 bp, Artificial Sequence
  Synthetic Polynucleotide
taatacgactcactatagggatctataattacgttttgtatctttaatttaacagaggagaaaattaatgatacaaaacaacctggcggcagcgcaaaagatg

SEQ ID NO: 45842 - DNA, 103 bp, Artificial Sequence
  Synthetic Polynucleotide
taatacgactcactatagggcattcatctataattacgttttgtatctttaacagaggagaaaagatatgaaacgtaataacctggcggcagcgcaaaagatg

SEQ ID NO: 45843 - DNA, 103 bp, Artificial Sequence
  Synthetic Polynucleotide
taatacgactcactatagggcgtaacattcatctataattacgttttgtaaacagaggagatacaaaatgtaattatagaacctggcggcagcgcaaaagatg

SEQ ID NO: 45844 - DNA, 103 bp, Artificial Sequence
  Synthetic Polynucleotide
taatacgactcactatagggggctccgtaacattcatctataattacgttaacagaggagaaacgtaatgatagatgaaaacctggcggcagcgcaaaagatg

SEQ ID NO: 45845 - DNA, 103 bp, Artificial Sequence
  Synthetic Polynucleotide
taatacgactcactatagggcctggggctccgtaacattcatctataattaacagaggagaaattatatgtgaatgttaaacctggcggcagcgcaaaagatg

SEQ ID NO: 45846 - DNA, 103 bp, Artificial Sequence
  Synthetic Polynucleotide
taatacgactcactataggggagatcctggggctccgtaacattcatctaaacagaggagatagatgatggttacggagaacctggcggcagcgcaaaagatg

SEQ ID NO: 45847 - DNA, 103 bp, Artificial Sequence
  Synthetic Polynucleotide
taatacgactcactatagggtgttggagatcctggggctccgtaacattcaacagaggagagaatgtatgggagccccaaacctggcggcagcgcaaaagatg

SEQ ID NO: 45848 - DNA, 103 bp, Artificial Sequence
  Synthetic Polynucleotide
taatacgactcactatagggtggcggcatgtggagtgtctttatccatggaacagaggagaccatggatgaagacactcaacctggcggcagcgcaaaagatg

SEQ ID NO: 45849 - DNA, 103 bp, Artificial Sequence
  Synthetic Polynucleotide
taatacgactcactatagggaaatttgttggagatcctggggctccgtaaaacagaggagattacggatgcccaggatcaacctggcggcagcgcaaaagatg

SEQ ID NO: 45850 - DNA, 103 bp, Artificial Sequence
  Synthetic Polynucleotide
taatacgactcactatagggattccaaatttgttggagatcctggggctcaacagaggagagagcccatggatctccaaaacctggcggcagcgcaaaagatg

SEQ ID NO: 45851 - DNA, 103 bp, Artificial Sequence
  Synthetic Polynucleotide
taatacgactcactatagggaataaattccaaatttgttggagatcctggaacagaggagaccaggaatgccaacaaataacctggcggcagcgcaaaagatg

SEQ ID NO: 45852 - DNA, 103 bp, Artificial Sequence
  Synthetic Polynucleotide
taatacgactcactataggggtattaataaattccaaatttgttggagataacagaggagaatctccatgaaatttggaaacctggcggcagcgcaaaagatg

SEQ ID NO: 45853 - DNA, 103 bp, Artificial Sequence
  Synthetic Polynucleotide
taatacgactcactatagggatcctgtattaataaattccaaatttgttgaacagaggagacaacaaatgtggaatttaaacctggcggcagcgcaaaagatg

SEQ ID NO: 45854 - DNA, 103 bp, Artificial Sequence
  Synthetic Polynucleotide
taatacgactcactataggggctagatcctgtattaataaattccaaattaacagaggagaaatttgatgtttattaataacctggcggcagcgcaaaagatg

SEQ ID NO: 45855 - DNA, 103 bp, Artificial Sequence
  Synthetic Polynucleotide
taatacgactcactatagggcctttgctagatcctgtattaataaattccaacagaggagaggaattatgtaatacaggaacctggcggcagcgcaaaagatg

SEQ ID NO: 45856 - DNA, 103 bp, Artificial Sequence
  Synthetic Polynucleotide
taatacgactcactatagggaatttcctttgctagatcctgtattaataaaacagaggagattattaatgcaggatctaaacctggcggcagcgcaaaagatg

SEQ ID NO: 45857 - DNA, 103 bp, Artificial Sequence
  Synthetic Polynucleotide
taatacgactcactatagggggcacaatttcctttgctagatcctgtattaacagaggagaaatacaatgtctagcaaaaacctggcggcagcgcaaaagatg

SEQ ID NO: 45858 - DNA, 103 bp, Artificial Sequence
  Synthetic Polynucleotide
taatacgactcactatagggttaatggcacaatttcctttgctagatcctaacagaggagaaggatcatgcaaaggaaaaacctggcggcagcgcaaaagatg

SEQ ID NO: 45859 - DNA, 103 bp, Artificial Sequence
  Synthetic Polynucleotide
taatacgactcactatagggggtagtggcggcatgtggagtgtctttatcaacagaggagagataaaatgactccacataacctggcggcagcgcaaaagatg

SEQ ID NO: 45860 - DNA, 103 bp, Artificial Sequence
  Synthetic Polynucleotide
taatacgactcactatagggacgccttaatggcacaatttcctttgctagaacagaggagactagcaatggaaattgtgaacctggcggcagcgcaaaagatg

SEQ ID NO: 45861 - DNA, 103 bp, Artificial Sequence
  Synthetic Polynucleotide
taatacgactcactatagggcatcaacgccttaatggcacaatttcctttaacagaggagaaaaggaatgtgtgccattaacctggcggcagcgcaaaagatg

SEQ ID NO: 45862 - DNA, 103 bp, Artificial Sequence
  Synthetic Polynucleotide
taatacgactcactatagggaattgcatcaacgccttaatggcacaatttaacagaggagaaaattgatgcattaaggcaacctggcggcagcgcaaaagatg

SEQ ID NO: 45863 - DNA, 103 bp, Artificial Sequence
  Synthetic Polynucleotide
taatacgactcactatagggtcgtcaattgcatcaacgccttaatggcacaacagaggagagtgccaatgaggcgttgaaacctggcggcagcgcaaaagatg

SEQ ID NO: 45864 - DNA, 103 bp, Artificial Sequence
  Synthetic Polynucleotide
taatacgactcactatagggcttagtcgtcaattgcatcaacgccttaataacagaggagaattaagatgttgatgcaaaacctggcggcagcgcaaaagatg

SEQ ID NO: 45865 - DNA, 103 bp, Artificial Sequence
  Synthetic Polynucleotide
taatacgactcactataggggtggccttagtcgtcaattgcatcaacgccaacagaggagaggcgttatggcaattgacaacctggcggcagcgcaaaagatg

SEQ ID NO: 45866 - DNA, 103 bp, Artificial Sequence
  Synthetic Polynucleotide
taatacgactcactataggggagtagtggccttagtcgtcaattgcatcaaacagaggagatgatgcatgtgacgactaaacctggcggcagcgcaaaagatg

SEQ ID NO: 45867 - DNA, 103 bp, Artificial Sequence
  Synthetic Polynucleotide
taatacgactcactatagggtatttgagtagtggccttagtcgtcaattgaacagaggagacaattgatgactaaggccaacctggcggcagcgcaaaagatg

SEQ ID NO: 45868 - DNA, 103 bp, Artificial Sequence
  Synthetic Polynucleotide
taatacgactcactatagggggtgctatttgagtagtggccttagtcgtcaacagaggagagacgacatgggccactacaacctggcggcagcgcaaaagatg

SEQ ID NO: 45869 - DNA, 103 bp, Artificial Sequence
  Synthetic Polynucleotide
taatacgactcactataggggtctaggtgctatttgagtagtggccttagaacagaggagactaaggatgctactcaaaaacctggcggcagcgcaaaagatg

SEQ ID NO: 45870 - DNA, 103 bp, Artificial Sequence
  Synthetic Polynucleotide
taatacgactcactatagggaaggaggtagtggcggcatgtggagtgtctaacagaggagaagacacatgacatgccgcaacctggcggcagcgcaaaagatg

SEQ ID NO: 45871 - DNA, 103 bp, Artificial Sequence
  Synthetic Polynucleotide
taatacgactcactatagggaacttgtctaggtgctatttgagtagtggcaacagaggagagccactatgcaaatagcaaacctggcggcagcgcaaaagatg

SEQ ID NO: 45872 - DNA, 103 bp, Artificial Sequence
  Synthetic Polynucleotide
taatacgactcactatagggccagcaacttgtctaggtgctatttgagtaaacagaggagatactcaatgagcacctagaacctggcggcagcgcaaaagatg

SEQ ID NO: 45873 - DNA, 103 bp, Artificial Sequence
  Synthetic Polynucleotide
taatacgactcactatagggctgtaccagcaacttgtctaggtgctatttaacagaggagaaaatagatgctagacaagaacctggcggcagcgcaaaagatg

SEQ ID NO: 45874 - DNA, 103 bp, Artificial Sequence
  Synthetic Polynucleotide
taatacgactcactatagggaactcctgtaccagcaacttgtctaggtgcaacagaggagagcacctatgcaagttgctaacctggcggcagcgcaaaagatg

SEQ ID NO: 45875 - DNA, 103 bp, Artificial Sequence
  Synthetic Polynucleotide
taatacgactcactatagggaactgaactcctgtaccagcaacttgtctaaacagaggagatagacaatgtgctggtacaacctggcggcagcgcaaaagatg

SEQ ID NO: 45876 - DNA, 103 bp, Artificial Sequence
  Synthetic Polynucleotide
taatacgactcactatagggtataaaactgaactcctgtaccagcaacttaacagaggagaaagttgatggtacaggagaacctggcggcagcgcaaaagatg

SEQ ID NO: 45877 - DNA, 103 bp, Artificial Sequence
  Synthetic Polynucleotide
taatacgactcactatagggaatcatataaaactgaactcctgtaccagcaacagaggagagctggtatgggagttcagaacctggcggcagcgcaaaagatg

SEQ ID NO: 45878 - DNA, 103 bp, Artificial Sequence
  Synthetic Polynucleotide
taatacgactcactatagggataacaatcatataaaactgaactcctgtaaacagaggagatacaggatgtcagttttaaacctggcggcagcgcaaaagatg

SEQ ID NO: 45879 - DNA, 103 bp, Artificial Sequence
  Synthetic Polynucleotide
taatacgactcactatagggcaccgataacaatcatataaaactgaactcaacagaggagagagttcatgtttatatgaaacctggcggcagcgcaaaagatg

SEQ ID NO: 45880 - DNA, 103 bp, Artificial Sequence
  Synthetic Polynucleotide
taatacgactcactatagggtataacaccgataacaatcatataaaactgaacagaggagacagtttatgatgattgttaacctggcggcagcgcaaaagatg

SEQ ID NO: 45881 - DNA, 103 bp, Artificial Sequence
  Synthetic Polynucleotide
taatacgactcactatagggttctaaaggaggtagtggcggcatgtggagaacagaggagactccacatgccgccactaaacctggcggcagcgcaaaagatg

SEQ ID NO: 45882 - DNA, 103 bp, Artificial Sequence
  Synthetic Polynucleotide
taatacgactcactatagggaatattataacaccgataacaatcatataaaacagaggagattatatatgtgttatcggaacctggcggcagcgcaaaagatg

SEQ ID NO: 45883 - DNA, 103 bp, Artificial Sequence
  Synthetic Polynucleotide
taatacgactcactatagggctgccaatattataacaccgataacaatcaaacagaggagatgattgatgtcggtgttaaacctggcggcagcgcaaaagatg

SEQ ID NO: 45884 - DNA, 103 bp, Artificial Sequence
  Synthetic Polynucleotide
taatacgactcactatagggcaacgctgccaatattataacaccgataacaacagaggagagttatcatggttataataaacctggcggcagcgcaaaagatg

SEQ ID NO: 45885 - DNA, 103 bp, Artificial Sequence
  Synthetic Polynucleotide
taatacgactcactatagggataaacaacgctgccaatattataacaccgaacagaggagacggtgtatgaatattggcaacctggcggcagcgcaaaagatg

SEQ ID NO: 45886 - DNA, 103 bp, Artificial Sequence
  Synthetic Polynucleotide
taatacgactcactatagggagtacataaacaacgctgccaatattataaaacagaggagattataaatgtggcagcgtaacctggcggcagcgcaaaagatg

SEQ ID NO: 45887 - DNA, 103 bp, Artificial Sequence
  Synthetic Polynucleotide
taatacgactcactatagggggcatagtacataaacaacgctgccaatataacagaggagaatattgatggcgttgtttaacctggcggcagcgcaaaagatg

SEQ ID NO: 45888 - DNA, 103 bp, Artificial Sequence
  Synthetic Polynucleotide
taatacgactcactatagggcgcttggcatagtacataaacaacgctgccaacagaggagaggcagcatggtttatgtaaacctggcggcagcgcaaaagatg

SEQ ID NO: 45889 - DNA, 103 bp, Artificial Sequence
  Synthetic Polynucleotide
taatacgactcactataggggcatacgcttggcatagtacataaacaacgaacagaggagacgttgtatgtgtactatgaacctggcggcagcgcaaaagatg

SEQ ID NO: 45890 - DNA, 103 bp, Artificial Sequence
  Synthetic Polynucleotide
taatacgactcactataggggaacagcatacgcttggcatagtacataaaaacagaggagatttatgatgtatgccaagaacctggcggcagcgcaaaagatg

SEQ ID NO: 45891 - DNA, 103 bp, Artificial Sequence
  Synthetic Polynucleotide
taatacgactcactataggggacgtgaacagcatacgcttggcatagtacaacagaggagagtactaatgcaagcgtataacctggcggcagcgcaaaagatg

SEQ ID NO: 45892 - DNA, 103 bp, Artificial Sequence
  Synthetic Polynucleotide
taatacgactcactatagggatgtcttctaaaggaggtagtggcggcatgaacagaggagacatgccatgactacctccaacctggcggcagcgcaaaagatg

SEQ ID NO: 45893 - DNA, 103 bp, Artificial Sequence
  Synthetic Polynucleotide
taatacgactcactatagggtggtggacgtgaacagcatacgcttggcataacagaggagaatgccaatggtatgctgtaacctggcggcagcgcaaaagatg

SEQ ID NO: 45894 - DNA, 103 bp, Artificial Sequence
  Synthetic Polynucleotide
taatacgactcactatagggatcattggtggacgtgaacagcatacgcttaacagaggagaaagcgtatgctgttcacgaacctggcggcagcgcaaaagatg

SEQ ID NO: 45895 - DNA, 103 bp, Artificial Sequence
  Synthetic Polynucleotide
taatacgactcactatagggattttatcattggtggacgtgaacagcataaacagaggagatatgctatgcacgtccacaacctggcggcagcgcaaaagatg

SEQ ID NO: 45896 - DNA, 103 bp, Artificial Sequence
  Synthetic Polynucleotide
taatacgactcactataggggtttgattttatcattggtggacgtgaacaaacagaggagatgttcaatgccaccaatgaacctggcggcagcgcaaaagatg

SEQ ID NO: 45897 - DNA, 103 bp, Artificial Sequence
  Synthetic Polynucleotide
taatacgactcactatagggaataagtttgattttatcattggtggacgtaacagaggagaacgtccatgaatgataaaaacctggcggcagcgcaaaagatg

SEQ ID NO: 45898 - DNA, 103 bp, Artificial Sequence
  Synthetic Polynucleotide
taatacgactcactataggggctaaaataagtttgattttatcattggtgaacagaggagacaccaaatgtaaaatcaaaacctggcggcagcgcaaaagatg

SEQ ID NO: 45899 - DNA, 103 bp, Artificial Sequence
  Synthetic Polynucleotide
taatacgactcactatagggtattggctaaaataagtttgattttatcataacagaggagaatgataatgtcaaacttaaacctggcggcagcgcaaaagatg

SEQ ID NO: 45900 - DNA, 103 bp, Artificial Sequence
  Synthetic Polynucleotide
taatacgactcactatagggttccttattggctaaaataagtttgattttaacagaggagaaaaatcatgcttattttaaacctggcggcagcgcaaaagatg

SEQ ID NO: 45901 - DNA, 103 bp, Artificial Sequence
  Synthetic Polynucleotide
taatacgactcactatagggacgttttccttattggctaaaataagtttgaacagaggagacaaactatgtttagccaaaacctggcggcagcgcaaaagatg

SEQ ID NO: 45902 - DNA, 103 bp, Artificial Sequence
  Synthetic Polynucleotide
taatacgactcactatagggaatggacgttttccttattggctaaaataaaacagaggagattatttatgccaataaggaacctggcggcagcgcaaaagatg

SEQ ID NO: 45903 - DNA, 103 bp, Artificial Sequence
  Synthetic Polynucleotide
taatacgactcactataggggactgaatacatcctgtgggtttctcatagaacagaggagactatgaatgacccacaggaacctggcggcagcgcaaaagatg

SEQ ID NO: 45904 - DNA, 103 bp, Artificial Sequence
  Synthetic Polynucleotide
taatacgactcactatagggttaatatgtcttctaaaggaggtagtggcgaacagaggagacgccacatgctcctttagaacctggcggcagcgcaaaagatg

SEQ ID NO: 45905 - DNA, 103 bp, Artificial Sequence
  Synthetic Polynucleotide
taatacgactcactatagggagtccaatggacgttttccttattggctaaaacagaggagattagccatgaaggaaaacaacctggcggcagcgcaaaagatg

SEQ ID NO: 45906 - DNA, 103 bp, Artificial Sequence
  Synthetic Polynucleotide
taatacgactcactatagggtaagtagtccaatggacgttttccttattgaacagaggagacaataaatgaaacgtccaaacctggcggcagcgcaaaagatg

SEQ ID NO: 45907 - DNA, 103 bp, Artificial Sequence
  Synthetic Polynucleotide
taatacgactcactatagggccatgtaagtagtccaatggacgttttcctaacagaggagaaggaaaatgtccattggaaacctggcggcagcgcaaaagatg

SEQ ID NO: 45908 - DNA, 103 bp, Artificial Sequence
  Synthetic Polynucleotide
taatacgactcactatagggtgtgtccatgtaagtagtccaatggacgttaacagaggagaaacgtcatgtggactactaacctggcggcagcgcaaaagatg

SEQ ID NO: 45909 - DNA, 103 bp, Artificial Sequence
  Synthetic Polynucleotide
taatacgactcactatagggaagaatgtgtccatgtaagtagtccaatggaacagaggagaccattgatgtacttacataacctggcggcagcgcaaaagatg

SEQ ID NO: 45910 - DNA, 103 bp, Artificial Sequence
  Synthetic Polynucleotide
taatacgactcactatagggttctaaagaatgtgtccatgtaagtagtccaacagaggagaggactaatgacatggacaaacctggcggcagcgcaaaagatg

SEQ ID NO: 45911 - DNA, 103 bp, Artificial Sequence
  Synthetic Polynucleotide
taatacgactcactatagggagaagttctaaagaatgtgtccatgtaagtaacagaggagaacttacatggacacattcaacctggcggcagcgcaaaagatg

SEQ ID NO: 45912 - DNA, 103 bp, Artificial Sequence
  Synthetic Polynucleotide
taatacgactcactatagggattggagaagttctaaagaatgtgtccatgaacagaggagacatggaatgattctttagaacctggcggcagcgcaaaagatg

SEQ ID NO: 45913 - DNA, 103 bp, Artificial Sequence
  Synthetic Polynucleotide
taatacgactcactatagggtaaccattggagaagttctaaagaatgtgtaacagaggagaacacatatgttagaacttaacctggcggcagcgcaaaagatg

SEQ ID NO: 45914 - DNA, 103 bp, Artificial Sequence
  Synthetic Polynucleotide
taatacgactcactatagggagcaataaccattggagaagttctaaagaaaacagaggagattctttatgacttctccaaacctggcggcagcgcaaaagatg

SEQ ID NO: 45915 - DNA, 103 bp, Artificial Sequence
  Synthetic Polynucleotide
taatacgactcactatagggtcttattaatatgtcttctaaaggaggtagaacagaggagactacctatgttagaagacaacctggcggcagcgcaaaagatg

SEQ ID NO: 45916 - DNA, 103 bp, Artificial Sequence
  Synthetic Polynucleotide
taatacgactcactataggggtggtagcaataaccattggagaagttctaaacagaggagatagaacatgtccaatggtaacctggcggcagcgcaaaagatg

SEQ ID NO: 45917 - DNA, 103 bp, Artificial Sequence
  Synthetic Polynucleotide
taatacgactcactatagggtatccgtggtagcaataaccattggagaagaacagaggagacttctcatgtggttattgaacctggcggcagcgcaaaagatg

SEQ ID NO: 45918 - DNA, 103 bp, Artificial Sequence
  Synthetic Polynucleotide
taatacgactcactatagggttgtatatccgtggtagcaataaccattggaacagaggagaccaatgatgattgctaccaacctggcggcagcgcaaaagatg

SEQ ID NO: 45919 - DNA, 103 bp, Artificial Sequence
  Synthetic Polynucleotide
taatacgactcactatagggcagttttgtatatccgtggtagcaataaccaacagaggagaggttatatgtaccacggaaacctggcggcagcgcaaaagatg

SEQ ID NO: 45920 - DNA, 103 bp, Artificial Sequence
  Synthetic Polynucleotide
taatacgactcactatagggattttcagttttgtatatccgtggtagcaaaacagaggagattgctaatgcggatatacaacctggcggcagcgcaaaagatg

SEQ ID NO: 45921 - DNA, 103 bp, Artificial Sequence
  Synthetic Polynucleotide
taatacgactcactatagggaatatattttcagttttgtatatccgtggtaacagaggagaaccacgatgatacaaaacaacctggcggcagcgcaaaagatg

SEQ ID NO: 45922 - DNA, 103 bp, Artificial Sequence
  Synthetic Polynucleotide
taatacgactcactatagggttatcaatatattttcagttttgtatatccaacagaggagaggatatatgaaactgaaaaacctggcggcagcgcaaaagatg

SEQ ID NO: 45923 - DNA, 103 bp, Artificial Sequence
  Synthetic Polynucleotide
taatacgactcactatagggaaatattatcaatatattttcagttttgtaaacagaggagatacaaaatggaaaatataaacctggcggcagcgcaaaagatg

SEQ ID NO: 45924 - DNA, 103 bp, Artificial Sequence
  Synthetic Polynucleotide
taatacgactcactatagggtattaaaatattatcaatatattttcagttaacagaggagaaactgaatgtatattgataacctggcggcagcgcaaaagatg

SEQ ID NO: 45925 - DNA, 103 bp, Artificial Sequence
  Synthetic Polynucleotide
taatacgactcactatagggtaatctattaaaatattatcaatatattttaacagaggagaaaaataatgtgataatataacctggcggcagcgcaaaagatg

SEQ ID NO: 45926 - DNA, 103 bp, Artificial Sequence
  Synthetic Polynucleotide
taatacgactcactatagggttaagtcttattaatatgtcttctaaaggaaacagaggagatcctttatgagacatattaacctggcggcagcgcaaaagatg

SEQ ID NO: 45927 - DNA, 103 bp, Artificial Sequence
  Synthetic Polynucleotide
taatacgactcactatagggcatgttaatctattaaaatattatcaatataacagaggagaatattgatgatattttaaaacctggcggcagcgcaaaagatg

SEQ ID NO: 45928 - DNA, 103 bp, Artificial Sequence
  Synthetic Polynucleotide
taatacgactcactatagggacttccatgttaatctattaaaatattatcaacagaggagagataatatgttaatagataacctggcggcagcgcaaaagatg

SEQ ID NO: 45929 - DNA, 103 bp, Artificial Sequence
  Synthetic Polynucleotide
taatacgactcactatagggcgataacttccatgttaatctattaaaataaacagaggagatattttatgagattaacaaacctggcggcagcgcaaaagatg

SEQ ID NO: 45930 - DNA, 103 bp, Artificial Sequence
  Synthetic Polynucleotide
taatacgactcactatagggatcagcgataacttccatgttaatctattaaacagaggagataatagatgaacatggaaaacctggcggcagcgcaaaagatg

SEQ ID NO: 45931 - DNA, 103 bp, Artificial Sequence
  Synthetic Polynucleotide
taatacgactcactatagggagacgatcagcgataacttccatgttaatcaacagaggagagattaaatgggaagttataacctggcggcagcgcaaaagatg

SEQ ID NO: 45932 - DNA, 103 bp, Artificial Sequence
  Synthetic Polynucleotide
taatacgactcactatagggcatctagacgatcagcgataacttccatgtaacagaggagaacatggatgttatcgctgaacctggcggcagcgcaaaagatg

SEQ ID NO: 45933 - DNA, 103 bp, Artificial Sequence
  Synthetic Polynucleotide
taatacgactcactatagggtatatcatctagacgatcagcgataacttcaacagaggagagaagttatggctgatcgtaacctggcggcagcgcaaaagatg

SEQ ID NO: 45934 - DNA, 103 bp, Artificial Sequence
  Synthetic Polynucleotide
taatacgactcactatagggttcactatatcatctagacgatcagcgataaacagaggagatatcgcatgtcgtctagaaacctggcggcagcgcaaaagatg

SEQ ID NO: 45935 - DNA, 103 bp, Artificial Sequence
  Synthetic Polynucleotide
taatacgactcactatagggtttgtttcactatatcatctagacgatcagaacagaggagactgatcatgtagatgataaacctggcggcagcgcaaaagatg

SEQ ID NO: 45936 - DNA, 103 bp, Artificial Sequence
  Synthetic Polynucleotide
taatacgactcactatagggtatattttgtttcactatatcatctagacgaacagaggagacgtctaatggatatagtgaacctggcggcagcgcaaaagatg

SEQ ID NO: 45937 - DNA, 103 bp, Artificial Sequence
  Synthetic Polynucleotide
taatacgactcactatagggttgtcttaagtcttattaatatgtcttctaaacagaggagatagaagatgtattaataaaacctggcggcagcgcaaaagatg

SEQ ID NO: 45938 - DNA, 103 bp, Artificial Sequence
  Synthetic Polynucleotide
taatacgactcactatagggtccgctatattttgtttcactatatcatctaacagaggagaagatgaatgagtgaaacaaacctggcggcagcgcaaaagatg

SEQ ID NO: 45939 - DNA, 103 bp, Artificial Sequence
  Synthetic Polynucleotide
taatacgactcactatagggtttcatccgctatattttgtttcactatataacagaggagaatatagatgaacaaaataaacctggcggcagcgcaaaagatg

SEQ ID NO: 45940 - DNA, 103 bp, Artificial Sequence
  Synthetic Polynucleotide
taatacgactcactatagggaaatttttcatccgctatattttgtttcacaacagaggagagtgaaaatgaatatagcgaacctggcggcagcgcaaaagatg

SEQ ID NO: 45941 - DNA, 103 bp, Artificial Sequence
  Synthetic Polynucleotide
taatacgactcactatagggtctacaaatttttcatccgctatattttgtaacagaggagaacaaaaatgagcggatgaaacctggcggcagcgcaaaagatg

SEQ ID NO: 45942 - DNA, 103 bp, Artificial Sequence
  Synthetic Polynucleotide
taatacgactcactatagggcaaaatctacaaatttttcatccgctatataacagaggagaatatagatgatgaaaaataacctggcggcagcgcaaaagatg

SEQ ID NO: 45943 - DNA, 103 bp, Artificial Sequence
  Synthetic Polynucleotide
taatacgactcactatagggtataacaaaatctacaaatttttcatccgcaacagaggagagcggatatgaaatttgtaaacctggcggcagcgcaaaagatg

SEQ ID NO: 45944 - DNA, 103 bp, Artificial Sequence
  Synthetic Polynucleotide
taatacgactcactatagggccgtgtataacaaaatctacaaatttttcaaacagaggagatgaaaaatgtgtagatttaacctggcggcagcgcaaaagatg

SEQ ID NO: 45945 - DNA, 103 bp, Artificial Sequence
  Synthetic Polynucleotide
taatacgactcactatagggctagaccgtgtataacaaaatctacaaattaacagaggagaaatttgatgattttgttaaacctggcggcagcgcaaaagatg

SEQ ID NO: 45946 - DNA, 103 bp, Artificial Sequence
  Synthetic Polynucleotide
taatacgactcactatagggatgctctagaccgtgtataacaaaatctacaacagaggagagtagatatggttatacacaacctggcggcagcgcaaaagatg

SEQ ID NO: 45947 - DNA, 103 bp, Artificial Sequence
  Synthetic Polynucleotide
taatacgactcactatagggcattgatgctctagaccgtgtataacaaaaaacagaggagattttgtatgacacggtctaacctggcggcagcgcaaaagatg

SEQ ID NO: 45948 - DNA, 103 bp, Artificial Sequence
  Synthetic Polynucleotide
taatacgactcactatagggtaaacttgtcttaagtcttattaatatgtcaacagaggagagacataatgataagacttaacctggcggcagcgcaaaagatg

SEQ ID NO: 45949 - DNA, 103 bp, Artificial Sequence
  Synthetic Polynucleotide
taatacgactcactatagggcaggacattgatgctctagaccgtgtataaaacagaggagattatacatggtctagagcaacctggcggcagcgcaaaagatg

SEQ ID NO: 45950 - DNA, 103 bp, Artificial Sequence
  Synthetic Polynucleotide
taatacgactcactatagggtatagcaggacattgatgctctagaccgtgaacagaggagacacggtatggagcatcaaaacctggcggcagcgcaaaagatg

SEQ ID NO: 45951 - DNA, 103 bp, Artificial Sequence
  Synthetic Polynucleotide
taatacgactcactatagggcgaagtatagcaggacattgatgctctagaaacagaggagatctagaatgtcaatgtccaacctggcggcagcgcaaaagatg

SEQ ID NO: 45952 - DNA, 103 bp, Artificial Sequence
  Synthetic Polynucleotide
taatacgactcactatagggatggccgaagtatagcaggacattgatgctaacagaggagaagcatcatggtcctgctaaacctggcggcagcgcaaaagatg

SEQ ID NO: 45953 - DNA, 103 bp, Artificial Sequence
  Synthetic Polynucleotide
taatacgactcactatagggaattaatggccgaagtatagcaggacattgaacagaggagacaatgtatggctatacttaacctggcggcagcgcaaaagatg

SEQ ID NO: 45954 - DNA, 103 bp, Artificial Sequence
  Synthetic Polynucleotide
taatacgactcactatagggaacctaattaatggccgaagtatagcaggaaacagaggagatcctgcatgacttcggccaacctggcggcagcgcaaaagatg

SEQ ID NO: 45955 - DNA, 103 bp, Artificial Sequence
  Synthetic Polynucleotide
taatacgactcactatagggtaaacaacctaattaatggccgaagtatagaacagaggagactatacatgggccattaaaacctggcggcagcgcaaaagatg

SEQ ID NO: 45956 - DNA, 103 bp, Artificial Sequence
  Synthetic Polynucleotide
taatacgactcactatagggatcaataaacaacctaattaatggccgaagaacagaggagacttcggatgttaattaggaacctggcggcagcgcaaaagatg

SEQ ID NO: 45957 - DNA, 103 bp, Artificial Sequence
  Synthetic Polynucleotide
taatacgactcactatagggagtatatcaataaacaacctaattaatggcaacagaggagagccattatgtaggttgttaacctggcggcagcgcaaaagatg

SEQ ID NO: 45958 - DNA, 103 bp, Artificial Sequence
  Synthetic Polynucleotide
taatacgactcactatagggataatagtatatcaataaacaacctaattaaacagaggagataattaatgtgtttattgaacctggcggcagcgcaaaagatg

SEQ ID NO: 45959 - DNA, 103 bp, Artificial Sequence
  Synthetic Polynucleotide
taatacgactcactatagggattgttaaacttgtcttaagtcttattaataacagaggagaattaatatgacttaagacaacctggcggcagcgcaaaagatg

SEQ ID NO: 45960 - DNA, 103 bp, Artificial Sequence
  Synthetic Polynucleotide
taatacgactcactatagggaacaaataatagtatatcaataaacaacctaacagaggagaaggttgatgattgatataaacctggcggcagcgcaaaagatg

SEQ ID NO: 45961 - DNA, 103 bp, Artificial Sequence
  Synthetic Polynucleotide
taatacgactcactatagggactataacaaataatagtatatcaataaacaacagaggagagtttatatgtatactattaacctggcggcagcgcaaaagatg

SEQ ID NO: 45962 - DNA, 103 bp, Artificial Sequence
  Synthetic Polynucleotide
taatacgactcactatagggaaattactataacaaataatagtatatcaaaacagaggagattgataatgtattatttgaacctggcggcagcgcaaaagatg

SEQ ID NO: 45963 - DNA, 103 bp, Artificial Sequence
  Synthetic Polynucleotide
taatacgactcactatagggaatataaattactataacaaataatagtataacagaggagaatactaatgtttgttataaacctggcggcagcgcaaaagatg

SEQ ID NO: 45964 - DNA, 103 bp, Artificial Sequence
  Synthetic Polynucleotide
taatacgactcactataggggtaaaaatataaattactataacaaataataacagaggagaattattatgtatagtaataacctggcggcagcgcaaaagatg

SEQ ID NO: 45965 - DNA, 103 bp, Artificial Sequence
  Synthetic Polynucleotide
taatacgactcactataggggtaccgtaaaaatataaattactataacaaaacagaggagattgttaatgtaatttataaacctggcggcagcgcaaaagatg

SEQ ID NO: 45966 - DNA, 103 bp, Artificial Sequence
  Synthetic Polynucleotide
taatacgactcactatagggtagacgtaccgtaaaaatataaattactataacagaggagaatagtaatgtatatttttaacctggcggcagcgcaaaagatg

SEQ ID NO: 45967 - DNA, 103 bp, Artificial Sequence
  Synthetic Polynucleotide
taatacgactcactatagggcttactagacgtaccgtaaaaatataaattaacagaggagaaatttaatgttttacggtaacctggcggcagcgcaaaagatg

SEQ ID NO: 45968 - DNA, 103 bp, Artificial Sequence
  Synthetic Polynucleotide
taatacgactcactatagggttctacttactagacgtaccgtaaaaatataacagaggagaatatttatgcggtacgtcaacctggcggcagcgcaaaagatg

SEQ ID NO: 45969 - DNA, 103 bp, Artificial Sequence
  Synthetic Polynucleotide
taatacgactcactatagggataatttctacttactagacgtaccgtaaaaacagaggagatttacgatgcgtctagtaaacctggcggcagcgcaaaagatg

SEQ ID NO: 45970 - DNA, 103 bp, Artificial Sequence
  Synthetic Polynucleotide
taatacgactcactatagggattttattgttaaacttgtcttaagtcttaaacagaggagataagacatgagacaagttaacctggcggcagcgcaaaagatg

SEQ ID NO: 45971 - DNA, 103 bp, Artificial Sequence
  Synthetic Polynucleotide
taatacgactcactatagggatttgataatttctacttactagacgtaccaacagaggagaggtacgatgagtaagtagaacctggcggcagcgcaaaagatg

SEQ ID NO: 45972 - DNA, 103 bp, Artificial Sequence
  Synthetic Polynucleotide
taatacgactcactatagggacaacatttgataatttctacttactagacaacagaggagagtctagatggtagaaattaacctggcggcagcgcaaaagatg

SEQ ID NO: 45973 - DNA, 103 bp, Artificial Sequence
  Synthetic Polynucleotide
taatacgactcactatagggcgccaacaacatttgataatttctacttacaacagaggagagtaagtatgaattatcaaaacctggcggcagcgcaaaagatg

SEQ ID NO: 45974 - DNA, 103 bp, Artificial Sequence
  Synthetic Polynucleotide
taatacgactcactatagggaataacgccaacaacatttgataatttctaaacagaggagatagaaaatgtcaaatgttaacctggcggcagcgcaaaagatg

SEQ ID NO: 45975 - DNA, 103 bp, Artificial Sequence
  Synthetic Polynucleotide
taatacgactcactataggggcgccaataacgccaacaacatttgataataacagaggagaattatcatgtgttgttggaacctggcggcagcgcaaaagatg

SEQ ID NO: 45976 - DNA, 103 bp, Artificial Sequence
  Synthetic Polynucleotide
taatacgactcactataggggactagcgccaataacgccaacaacatttgaacagaggagacaaatgatgttggcgttaaacctggcggcagcgcaaaagatg

SEQ ID NO: 45977 - DNA, 103 bp, Artificial Sequence
  Synthetic Polynucleotide
taatacgactcactataggggagatgactagcgccaataacgccaacaacaacagaggagagttgttatggttattggcaacctggcggcagcgcaaaagatg

SEQ ID NO: 45978 - DNA, 103 bp, Artificial Sequence
  Synthetic Polynucleotide
taatacgactcactatagggttaatgagatgactagcgccaataacgccaaacagaggagatggcgtatgtggcgctagaacctggcggcagcgcaaaagatg

SEQ ID NO: 45979 - DNA, 103 bp, Artificial Sequence
  Synthetic Polynucleotide
taatacgactcactatagggaatagttaatgagatgactagcgccaataaaacagaggagattattgatgctagtcatcaacctggcggcagcgcaaaagatg

SEQ ID NO: 45980 - DNA, 103 bp, Artificial Sequence
  Synthetic Polynucleotide
taatacgactcactatagggtaaaaaatagttaatgagatgactagcgccaacagaggagaggcgctatgcatctcattaacctggcggcagcgcaaaagatg

SEQ ID NO: 45981 - DNA, 103 bp, Artificial Sequence
  Synthetic Polynucleotide
taatacgactcactataggggattaattttattgttaaacttgtcttaagaacagaggagacttaagatgagtttaacaaacctggcggcagcgcaaaagatg

SEQ ID NO: 45982 - DNA, 103 bp, Artificial Sequence
  Synthetic Polynucleotide
taatacgactcactatagggagtaataaaaaatagttaatgagatgactaaacagaggagatagtcaatgcattaactaaacctggcggcagcgcaaaagatg

SEQ ID NO: 45983 - DNA, 103 bp, Artificial Sequence
  Synthetic Polynucleotide
taatacgactcactatagggtataaagtaataaaaaatagttaatgagataacagaggagaatctcaatgactatttttaacctggcggcagcgcaaaagatg

SEQ ID NO: 45984 - DNA, 103 bp, Artificial Sequence
  Synthetic Polynucleotide
taatacgactcactatagggtatagtataaagtaataaaaaatagttaataacagaggagaattaacatgtttttattaaacctggcggcagcgcaaaagatg

SEQ ID NO: 45985 - DNA, 103 bp, Artificial Sequence
  Synthetic Polynucleotide
taatacgactcactatagggactattatagtataaagtaataaaaaatagaacagaggagactatttatgattactttaaacctggcggcagcgcaaaagatg

SEQ ID NO: 45986 - DNA, 103 bp, Artificial Sequence
  Synthetic Polynucleotide
taatacgactcactatagggctagtactattatagtataaagtaataaaaaacagaggagattttatatgtttatactaaacctggcggcagcgcaaaagatg

SEQ ID NO: 45987 - DNA, 103 bp, Artificial Sequence
  Synthetic Polynucleotide
taatacgactcactatagggtcagtctagtactattatagtataaagtaaaacagaggagattacttatgactataataaacctggcggcagcgcaaaagatg

SEQ ID NO: 45988 - DNA, 103 bp, Artificial Sequence
  Synthetic Polynucleotide
taatacgactcactatagggagaagtcagtctagtactattatagtataaaacagaggagattatacatgaatagtactaacctggcggcagcgcaaaagatg

SEQ ID NO: 45989 - DNA, 103 bp, Artificial Sequence
  Synthetic Polynucleotide
taatacgactcactatagggttgttagaagtcagtctagtactattatagaacagaggagactataaatgtactagactaacctggcggcagcgcaaaagatg

SEQ ID NO: 45990 - DNA, 103 bp, Artificial Sequence
  Synthetic Polynucleotide
taatacgactcactataggggatgtttgttagaagtcagtctagtactataacagaggagaatagtaatggactgacttaacctggcggcagcgcaaaagatg

SEQ ID NO: 45991 - DNA, 103 bp, Artificial Sequence
  Synthetic Polynucleotide
taatacgactcactatagggggtgagatgtttgttagaagtcagtctagtaacagaggagaactagaatgacttctaacaacctggcggcagcgcaaaagatg

SEQ ID NO: 45992 - DNA, 103 bp, Artificial Sequence
  Synthetic Polynucleotide
taatacgactcactatagggctcgtgattaattttattgttaaacttgtcaacagaggagagacaagatgaacaataaaaacctggcggcagcgcaaaagatg

SEQ ID NO: 45993 - DNA, 103 bp, Artificial Sequence
  Synthetic Polynucleotide
taatacgactcactatagggtggcaggtgagatgtttgttagaagtcagtaacagaggagaactgacatgtaacaaacaaacctggcggcagcgcaaaagatg

SEQ ID NO: 45994 - DNA, 103 bp, Artificial Sequence
  Synthetic Polynucleotide
taatacgactcactatagggatttatggcaggtgagatgtttgttagaagaacagaggagacttctaatgaacatctcaaacctggcggcagcgcaaaagatg

SEQ ID NO: 45995 - DNA, 103 bp, Artificial Sequence
  Synthetic Polynucleotide
taatacgactcactatagggcatttatttatggcaggtgagatgtttgttaacagaggagaaacaaaatgctcacctgcaacctggcggcagcgcaaaagatg

SEQ ID NO: 45996 - DNA, 103 bp, Artificial Sequence
  Synthetic Polynucleotide
taatacgactcactatagggtcaagcatttatttatggcaggtgagatgtaacagaggagaacatctatgctgccataaaacctggcggcagcgcaaaagatg

SEQ ID NO: 45997 - DNA, 103 bp, Artificial Sequence
  Synthetic Polynucleotide
taatacgactcactatagggtaatatcaagcatttatttatggcaggtgaaacagaggagatcacctatgataaataaaaacctggcggcagcgcaaaagatg

SEQ ID NO: 45998 - DNA, 103 bp, Artificial Sequence
  Synthetic Polynucleotide
taatacgactcactataggggactttaatatcaagcatttatttatggcaaacagaggagatgccatatgtaaatgcttaacctggcggcagcgcaaaagatg

SEQ ID NO: 45999 - DNA, 103 bp, Artificial Sequence
  Synthetic Polynucleotide
taatacgactcactatagggtagaagactttaatatcaagcatttatttaaacagaggagataaataatggcttgatataacctggcggcagcgcaaaagatg

SEQ ID NO: 46000 - DNA, 103 bp, Artificial Sequence
  Synthetic Polynucleotide
taatacgactcactatagggagaaatagaagactttaatatcaagcatttaacagaggagaaaatgcatgatattaaagaacctggcggcagcgcaaaagatg

SEQ ID NO: 46001 - DNA, 103 bp, Artificial Sequence
  Synthetic Polynucleotide
taatacgactcactataggggtgttagaaatagaagactttaatatcaagaacagaggagacttgatatgaaagtcttcaacctggcggcagcgcaaaagatg

SEQ ID NO: 46002 - DNA, 103 bp, Artificial Sequence
  Synthetic Polynucleotide
taatacgactcactataggggaatagtgttagaaatagaagactttaataaacagaggagatattaaatgcttctatttaacctggcggcagcgcaaaagatg

SEQ ID NO: 46003 - DNA, 103 bp, Artificial Sequence
  Synthetic Polynucleotide
taatacgactcactataggggggtactcgtgattaattttattgttaaacaacagaggagagtttaaatgtaaaattaaaacctggcggcagcgcaaaagatg

SEQ ID NO: 46004 - DNA, 103 bp, Artificial Sequence
  Synthetic Polynucleotide
taatacgactcactatagggagatggaatagtgttagaaatagaagacttaacagaggagaaagtctatgatttctaacaacctggcggcagcgcaaaagatg

SEQ ID NO: 46005 - DNA, 103 bp, Artificial Sequence
  Synthetic Polynucleotide
taatacgactcactatagggtccacagatggaatagtgttagaaatagaaaacagaggagattctatatgtaacactataacctggcggcagcgcaaaagatg

SEQ ID NO: 46006 - DNA, 103 bp, Artificial Sequence
  Synthetic Polynucleotide
taatacgactcactatagggtattttccacagatggaatagtgttagaaaaacagaggagatttctaatgctattccataacctggcggcagcgcaaaagatg

SEQ ID NO: 46007 - DNA, 103 bp, Artificial Sequence
  Synthetic Polynucleotide
taatacgactcactatagggagtattattttccacagatggaatagtgttaacagaggagaaacactatgccatctgtgaacctggcggcagcgcaaaagatg

SEQ ID NO: 46008 - DNA, 103 bp, Artificial Sequence
  Synthetic Polynucleotide
taatacgactcactataggggtcagagtattattttccacagatggaataaacagaggagatattccatgtgtggaaaaaacctggcggcagcgcaaaagatg

SEQ ID NO: 46009 - DNA, 103 bp, Artificial Sequence
  Synthetic Polynucleotide
taatacgactcactatagggataatgtcagagtattattttccacagatgaacagaggagacatctgatgaaaataataaacctggcggcagcgcaaaagatg

SEQ ID NO: 46010 - DNA, 103 bp, Artificial Sequence
  Synthetic Polynucleotide
taatacgactcactatagggtagcgataatgtcagagtattattttccacaacagaggagagtggaaatgaatactctgaacctggcggcagcgcaaaagatg

SEQ ID NO: 46011 - DNA, 103 bp, Artificial Sequence
  Synthetic Polynucleotide
taatacgactcactatagggtcaattagcgataatgtcagagtattatttaacagaggagaaaataaatgtctgacattaacctggcggcagcgcaaaagatg

SEQ ID NO: 46012 - DNA, 103 bp, Artificial Sequence
  Synthetic Polynucleotide
taatacgactcactatagggatgtgtcaattagcgataatgtcagagtataacagaggagaatactcatgcattatcgcaacctggcggcagcgcaaaagatg

SEQ ID NO: 46013 - DNA, 103 bp, Artificial Sequence
  Synthetic Polynucleotide
taatacgactcactatagggcaccgatgtgtcaattagcgataatgtcagaacagaggagactgacaatgtcgctaattaacctggcggcagcgcaaaagatg

SEQ ID NO: 46014 - DNA, 103 bp, Artificial Sequence
  Synthetic Polynucleotide
taatacgactcactatagggtgtctgactgaatacatcctgtgggtttctaacagaggagaagaaacatgcaggatgtaaacctggcggcagcgcaaaagatg

SEQ ID NO: 46015 - DNA, 103 bp, Artificial Sequence
  Synthetic Polynucleotide
taatacgactcactatagggtagtagggtactcgtgattaattttattgtaacagaggagaacaataatgttaatcacgaacctggcggcagcgcaaaagatg

SEQ ID NO: 46016 - DNA, 103 bp, Artificial Sequence
  Synthetic Polynucleotide
taatacgactcactatagggtcactcaccgatgtgtcaattagcgataataacagaggagaattatcatgaattgacacaacctggcggcagcgcaaaagatg

SEQ ID NO: 46017 - DNA, 103 bp, Artificial Sequence
  Synthetic Polynucleotide
taatacgactcactataggggcatatcactcaccgatgtgtcaattagcgaacagaggagacgctaaatgacacatcggaacctggcggcagcgcaaaagatg

SEQ ID NO: 46018 - DNA, 103 bp, Artificial Sequence
  Synthetic Polynucleotide
taatacgactcactatagggtataggcatatcactcaccgatgtgtcaataacagaggagaattgacatgtcggtgagtaacctggcggcagcgcaaaagatg

SEQ ID NO: 46019 - DNA, 103 bp, Artificial Sequence
  Synthetic Polynucleotide
taatacgactcactatagggtactttataggcatatcactcaccgatgtgaacagaggagacacatcatggagtgatataacctggcggcagcgcaaaagatg

SEQ ID NO: 46020 - DNA, 103 bp, Artificial Sequence
  Synthetic Polynucleotide
taatacgactcactatagggattattactttataggcatatcactcaccgaacagaggagacggtgaatgatatgcctaaacctggcggcagcgcaaaagatg

SEQ ID NO: 46021 - DNA, 103 bp, Artificial Sequence
  Synthetic Polynucleotide
taatacgactcactatagggagaagattattactttataggcatatcactaacagaggagaagtgatatgcctataaagaacctggcggcagcgcaaaagatg

SEQ ID NO: 46022 - DNA, 103 bp, Artificial Sequence
  Synthetic Polynucleotide
taatacgactcactatagggcccaaagaagattattactttataggcataaacagaggagatatgccatgaaagtaataaacctggcggcagcgcaaaagatg

SEQ ID NO: 46023 - DNA, 103 bp, Artificial Sequence
  Synthetic Polynucleotide
taatacgactcactatagggatgtgcccaaagaagattattactttatagaacagaggagactataaatgaataatcttaacctggcggcagcgcaaaagatg

SEQ ID NO: 46024 - DNA, 103 bp, Artificial Sequence
  Synthetic Polynucleotide
taatacgactcactatagggggtatatgtgcccaaagaagattattacttaacagaggagaaagtaaatgtcttctttgaacctggcggcagcgcaaaagatg

SEQ ID NO: 46025 - DNA, 103 bp, Artificial Sequence
  Synthetic Polynucleotide
taatacgactcactatagggacactggtatatgtgcccaaagaagattataacagaggagaataatcatgtttgggcacaacctggcggcagcgcaaaagatg

SEQ ID NO: 46026 - DNA, 103 bp, Artificial Sequence
  Synthetic Polynucleotide
taatacgactcactataggggttggtagtagggtactcgtgattaattttaacagaggagaaaaattatgcacgagtacaacctggcggcagcgcaaaagatg

SEQ ID NO: 46027 - DNA, 103 bp, Artificial Sequence
  Synthetic Polynucleotide
taatacgactcactatagggctggtacactggtatatgtgcccaaagaagaacagaggagacttcttatggcacatataaacctggcggcagcgcaaaagatg

SEQ ID NO: 46028 - DNA, 103 bp, Artificial Sequence
  Synthetic Polynucleotide
taatacgactcactatagggagaacctggtacactggtatatgtgcccaaaacagaggagattgggcatgtataccagtaacctggcggcagcgcaaaagatg

SEQ ID NO: 46029 - DNA, 103 bp, Artificial Sequence
  Synthetic Polynucleotide
taatacgactcactatagggttgttagaacctggtacactggtatatgtgaacagaggagacacataatgcagtgtaccaacctggcggcagcgcaaaagatg

SEQ ID NO: 46030 - DNA, 103 bp, Artificial Sequence
  Synthetic Polynucleotide
taatacgactcactatagggataggttgttagaacctggtacactggtataacagaggagaataccaatgtaccaggttaacctggcggcagcgcaaaagatg

SEQ ID NO: 46031 - DNA, 103 bp, Artificial Sequence
  Synthetic Polynucleotide
taatacgactcactatagggagtaaataggttgttagaacctggtacactaacagaggagaagtgtaatgggttctaacaacctggcggcagcgcaaaagatg

SEQ ID NO: 46032 - DNA, 103 bp, Artificial Sequence
  Synthetic Polynucleotide
taatacgactcactataggggcaccagtaaataggttgttagaacctggtaacagaggagaaccaggatgtaacaacctaacctggcggcagcgcaaaagatg

SEQ ID NO: 46033 - DNA, 103 bp, Artificial Sequence
  Synthetic Polynucleotide
taatacgactcactatagggcaggagcaccagtaaataggttgttagaacaacagaggagagttctaatgacctatttaaacctggcggcagcgcaaaagatg

SEQ ID NO: 46034 - DNA, 103 bp, Artificial Sequence
  Synthetic Polynucleotide
taatacgactcactatagggtgctacaggagcaccagtaaataggttgttaacagaggagaaacaacatgtttactggtaacctggcggcagcgcaaaagatg

SEQ ID NO: 46035 - DNA, 103 bp, Artificial Sequence
  Synthetic Polynucleotide
taatacgactcactatagggaagtatgctacaggagcaccagtaaataggaacagaggagacctattatgtggtgctccaacctggcggcagcgcaaaagatg

SEQ ID NO: 46036 - DNA, 103 bp, Artificial Sequence
  Synthetic Polynucleotide
taatacgactcactatagggagaaaaagtatgctacaggagcaccagtaaaacagaggagattactgatgctcctgtagaacctggcggcagcgcaaaagatg

SEQ ID NO: 46037 - DNA, 103 bp, Artificial Sequence
  Synthetic Polynucleotide
taatacgactcactatagggtgtaggttggtagtagggtactcgtgattaaacagaggagataatcaatggtaccctacaacctggcggcagcgcaaaagatg

SEQ ID NO: 46038 - DNA, 103 bp, Artificial Sequence
  Synthetic Polynucleotide
taatacgactcactatagggggtaaagaaaaagtatgctacaggagcaccaacagaggagaggtgctatggtagcatacaacctggcggcagcgcaaaagatg

SEQ ID NO: 46039 - DNA, 103 bp, Artificial Sequence
  Synthetic Polynucleotide
taatacgactcactatagggcttaaggtaaagaaaaagtatgctacaggaaacagaggagatcctgtatgatactttttaacctggcggcagcgcaaaagatg

SEQ ID NO: 46040 - DNA, 103 bp, Artificial Sequence
  Synthetic Polynucleotide
taatacgactcactatagggatattcttaaggtaaagaaaaagtatgctaaacagaggagatagcatatgttttctttaaacctggcggcagcgcaaaagatg

SEQ ID NO: 46041 - DNA, 103 bp, Artificial Sequence
  Synthetic Polynucleotide
taatacgactcactataggggatggatattcttaaggtaaagaaaaagtaaacagaggagatactttatgtttaccttaaacctggcggcagcgcaaaagatg

SEQ ID NO: 46042 - DNA, 103 bp, Artificial Sequence
  Synthetic Polynucleotide
taatacgactcactatagggcaaacgatggatattcttaaggtaaagaaaaacagaggagatttcttatgcttaagaataacctggcggcagcgcaaaagatg

SEQ ID NO: 46043 - DNA, 103 bp, Artificial Sequence
  Synthetic Polynucleotide
taatacgactcactatagggccaagcaaacgatggatattcttaaggtaaaacagaggagattacctatggaatatccaaacctggcggcagcgcaaaagatg

SEQ ID NO: 46044 - DNA, 103 bp, Artificial Sequence
  Synthetic Polynucleotide
taatacgactcactatagggattgaccaagcaaacgatggatattcttaaaacagaggagattaagaatgtccatcgttaacctggcggcagcgcaaaagatg

SEQ ID NO: 46045 - DNA, 103 bp, Artificial Sequence
  Synthetic Polynucleotide
taatacgactcactatagggtcgctattgaccaagcaaacgatggatattaacagaggagaaatatcatgcgtttgcttaacctggcggcagcgcaaaagatg

SEQ ID NO: 46046 - DNA, 103 bp, Artificial Sequence
  Synthetic Polynucleotide
taatacgactcactatagggacctgtcgctattgaccaagcaaacgatggaacagaggagaccatcgatggcttggtcaaacctggcggcagcgcaaaagatg

SEQ ID NO: 46047 - DNA, 103 bp, Artificial Sequence
  Synthetic Polynucleotide
taatacgactcactatagggaaatcacctgtcgctattgaccaagcaaacaacagaggagagtttgcatggtcaatagcaacctggcggcagcgcaaaagatg

SEQ ID NO: 46048 - DNA, 103 bp, Artificial Sequence
  Synthetic Polynucleotide
taatacgactcactatagggaatagtgtaggttggtagtagggtactcgtaacagaggagaacgagtatgctactaccaaacctggcggcagcgcaaaagatg

SEQ ID NO: 46049 - DNA, 103 bp, Artificial Sequence
  Synthetic Polynucleotide
taatacgactcactatagggataaaaaatcacctgtcgctattgaccaagaacagaggagacttggtatgtagcgacagaacctggcggcagcgcaaaagatg

SEQ ID NO: 46050 - DNA, 103 bp, Artificial Sequence
  Synthetic Polynucleotide
taatacgactcactatagggggttgataaaaaatcacctgtcgctattgaaacagaggagatcaataatgacaggtgataacctggcggcagcgcaaaagatg

SEQ ID NO: 46051 - DNA, 103 bp, Artificial Sequence
  Synthetic Polynucleotide
taatacgactcactatagggtgaatggttgataaaaaatcacctgtcgctaacagaggagaagcgacatgtgattttttaacctggcggcagcgcaaaagatg

SEQ ID NO: 46052 - DNA, 103 bp, Artificial Sequence
  Synthetic Polynucleotide
taatacgactcactatagggttttttgaatggttgataaaaaatcacctgaacagaggagacaggtgatgttttatcaaaacctggcggcagcgcaaaagatg

SEQ ID NO: 46053 - DNA, 103 bp, Artificial Sequence
  Synthetic Polynucleotide
taatacgactcactatagggattacttttttgaatggttgataaaaaatcaacagaggagagattttatgtcaaccattaacctggcggcagcgcaaaagatg

SEQ ID NO: 46054 - DNA, 103 bp, Artificial Sequence
  Synthetic Polynucleotide
taatacgactcactatagggctccaattacttttttgaatggttgataaaaacagaggagatttatcatgcattcaaaaaacctggcggcagcgcaaaagatg

SEQ ID NO: 46055 - DNA, 103 bp, Artificial Sequence
  Synthetic Polynucleotide
taatacgactcactataggggaacactccaattacttttttgaatggttgaacagaggagacaaccaatgaaaaaagtaaacctggcggcagcgcaaaagatg

SEQ ID NO: 46056 - DNA, 103 bp, Artificial Sequence
  Synthetic Polynucleotide
taatacgactcactataggggatatgaacactccaattacttttttgaataacagaggagaattcaaatgagtaattggaacctggcggcagcgcaaaagatg

SEQ ID NO: 46057 - DNA, 103 bp, Artificial Sequence
  Synthetic Polynucleotide
taatacgactcactatagggtagaggatatgaacactccaattactttttaacagaggagaaaaaagatgttggagtgtaacctggcggcagcgcaaaagatg

SEQ ID NO: 46058 - DNA, 103 bp, Artificial Sequence
  Synthetic Polynucleotide
taatacgactcactataggggcctgtagaggatatgaacactccaattacaacagaggagagtaattatggtgttcataaacctggcggcagcgcaaaagatg

SEQ ID NO: 46059 - DNA, 103 bp, Artificial Sequence
  Synthetic Polynucleotide
taatacgactcactatagggcatataatagtgtaggttggtagtagggtaaacagaggagataccctatgaccaacctaaacctggcggcagcgcaaaagatg

SEQ ID NO: 46060 - DNA, 103 bp, Artificial Sequence
  Synthetic Polynucleotide
taatacgactcactatagggcaatagcctgtagaggatatgaacactccaaacagaggagatggagtatgcatatcctcaacctggcggcagcgcaaaagatg

SEQ ID NO: 46061 - DNA, 103 bp, Artificial Sequence
  Synthetic Polynucleotide
taatacgactcactatagggtgagacaatagcctgtagaggatatgaacaaacagaggagatgttcaatgcctctacagaacctggcggcagcgcaaaagatg

SEQ ID NO: 46062 - DNA, 103 bp, Artificial Sequence
  Synthetic Polynucleotide
taatacgactcactatagggggtcatgagacaatagcctgtagaggatataacagaggagaatatccatgacaggctataacctggcggcagcgcaaaagatg

SEQ ID NO: 46063 - DNA, 103 bp, Artificial Sequence
  Synthetic Polynucleotide
taatacgactcactatagggtacacggtcatgagacaatagcctgtagagaacagaggagactctacatgctattgtctaacctggcggcagcgcaaaagatg

SEQ ID NO: 46064 - DNA, 103 bp, Artificial Sequence
  Synthetic Polynucleotide
taatacgactcactatagggtttcatacacggtcatgagacaatagcctgaacagaggagacaggctatggtctcatgaaacctggcggcagcgcaaaagatg

SEQ ID NO: 46065 - DNA, 103 bp, Artificial Sequence
  Synthetic Polynucleotide
taatacgactcactatagggttaaatttcatacacggtcatgagacaataaacagaggagatattgtatgatgaccgtgaacctggcggcagcgcaaaagatg

SEQ ID NO: 46066 - DNA, 103 bp, Artificial Sequence
  Synthetic Polynucleotide
taatacgactcactataggggttacttaaatttcatacacggtcatgagaaacagaggagatctcatatgcgtgtatgaaacctggcggcagcgcaaaagatg

SEQ ID NO: 46067 - DNA, 103 bp, Artificial Sequence
  Synthetic Polynucleotide
taatacgactcactataggggtcgtgttacttaaatttcatacacggtcaaacagaggagatgaccgatgatgaaatttaacctggcggcagcgcaaaagatg

SEQ ID NO: 46068 - DNA, 103 bp, Artificial Sequence
  Synthetic Polynucleotide
taatacgactcactatagggccacagtcgtgttacttaaatttcatacacaacagaggagagtgtatatgatttaagtaaacctggcggcagcgcaaaagatg

SEQ ID NO: 46069 - DNA, 103 bp, Artificial Sequence
  Synthetic Polynucleotide
taatacgactcactatagggatctaccacagtcgtgttacttaaatttcaaacagaggagatgaaatatgagtaacacgaacctggcggcagcgcaaaagatg

SEQ ID NO: 46070 - DNA, 103 bp, Artificial Sequence
  Synthetic Polynucleotide
taatacgactcactatagggataatcatataatagtgtaggttggtagtaaacagaggagatactacatgcctacactaaacctggcggcagcgcaaaagatg

SEQ ID NO: 46071 - DNA, 103 bp, Artificial Sequence
  Synthetic Polynucleotide
taatacgactcactatagggaacaaatctaccacagtcgtgttacttaaaaacagaggagatttaagatgcacgactgtaacctggcggcagcgcaaaagatg

SEQ ID NO: 46072 - DNA, 103 bp, Artificial Sequence
  Synthetic Polynucleotide
taatacgactcactatagggtatagaacaaatctaccacagtcgtgttacaacagaggagagtaacaatgctgtggtagaacctggcggcagcgcaaaagatg

SEQ ID NO: 46073 - DNA, 103 bp, Artificial Sequence
  Synthetic Polynucleotide
taatacgactcactatagggggctctatagaacaaatctaccacagtcgtaacagaggagaacgactatggtagatttgaacctggcggcagcgcaaaagatg

SEQ ID NO: 46074 - DNA, 103 bp, Artificial Sequence
  Synthetic Polynucleotide
taatacgactcactatagggcaaccggctctatagaacaaatctaccacaaacagaggagatgtggtatgtttgttctaaacctggcggcagcgcaaaagatg

SEQ ID NO: 46075 - DNA, 103 bp, Artificial Sequence
  Synthetic Polynucleotide
taatacgactcactatagggtgcggcaaccggctctatagaacaaatctaaacagaggagatagattatgtctatagagaacctggcggcagcgcaaaagatg

SEQ ID NO: 46076 - DNA, 103 bp, Artificial Sequence
  Synthetic Polynucleotide
taatacgactcactatagggctatttgcggcaaccggctctatagaacaaaacagaggagattgttcatgagagccggtaacctggcggcagcgcaaaagatg

SEQ ID NO: 46077 - DNA, 103 bp, Artificial Sequence
  Synthetic Polynucleotide
taatacgactcactatagggtctatctatttgcggcaaccggctctatagaacagaggagactatagatgcggttgccgaacctggcggcagcgcaaaagatg

SEQ ID NO: 46078 - DNA, 103 bp, Artificial Sequence
  Synthetic Polynucleotide
taatacgactcactataggggtagttctatctatttgcggcaaccggctcaacagaggagagagccgatggccgcaaataacctggcggcagcgcaaaagatg

SEQ ID NO: 46079 - DNA, 103 bp, Artificial Sequence
  Synthetic Polynucleotide
taatacgactcactatagggtattggtagttctatctatttgcggcaaccaacagaggagaggttgcatgaaatagataaacctggcggcagcgcaaaagatg

SEQ ID NO: 46080 - DNA, 103 bp, Artificial Sequence
  Synthetic Polynucleotide
taatacgactcactatagggagacatattggtagttctatctatttgcggaacagaggagaccgcaaatggatagaactaacctggcggcagcgcaaaagatg

SEQ ID NO: 46081 - DNA, 103 bp, Artificial Sequence
  Synthetic Polynucleotide
taatacgactcactatagggaaactataatcatataatagtgtaggttggaacagaggagaccaaccatgactattataaacctggcggcagcgcaaaagatg

SEQ ID NO: 46082 - DNA, 103 bp, Artificial Sequence
  Synthetic Polynucleotide
taatacgactcactatagggtgtacagacatattggtagttctatctattaacagaggagaaatagaatgaactaccaaaacctggcggcagcgcaaaagatg

SEQ ID NO: 46083 - DNA, 103 bp, Artificial Sequence
  Synthetic Polynucleotide
taatacgactcactatagggacatttgtacagacatattggtagttctataacagaggagaatagaaatgccaatatgtaacctggcggcagcgcaaaagatg

SEQ ID NO: 46084 - DNA, 103 bp, Artificial Sequence
  Synthetic Polynucleotide
taatacgactcactataggggtttaacatttgtacagacatattggtagtaacagaggagaactaccatgatgtctgtaaacctggcggcagcgcaaaagatg

SEQ ID NO: 46085 - DNA, 103 bp, Artificial Sequence
  Synthetic Polynucleotide
taatacgactcactatagggttaatgtttaacatttgtacagacatattgaacagaggagacaatatatgtgtacaaataacctggcggcagcgcaaaagatg

SEQ ID NO: 46086 - DNA, 103 bp, Artificial Sequence
  Synthetic Polynucleotide
taatacgactcactatagggatcaattaatgtttaacatttgtacagacaaacagaggagatgtctgatgaaatgttaaaacctggcggcagcgcaaaagatg

SEQ ID NO: 46087 - DNA, 103 bp, Artificial Sequence
  Synthetic Polynucleotide
taatacgactcactatagggtgttaatcaattaatgtttaacatttgtacaacagaggagagtacaaatgttaaacattaacctggcggcagcgcaaaagatg

SEQ ID NO: 46088 - DNA, 103 bp, Artificial Sequence
  Synthetic Polynucleotide
taatacgactcactatagggttttctgttaatcaattaatgtttaacattaacagaggagaaatgttatgcattaattgaacctggcggcagcgcaaaagatg

SEQ ID NO: 46089 - DNA, 103 bp, Artificial Sequence
  Synthetic Polynucleotide
taatacgactcactatagggttgttttttctgttaatcaattaatgtttaaacagaggagataaacaatgattgattaaaacctggcggcagcgcaaaagatg

SEQ ID NO: 46090 - DNA, 103 bp, Artificial Sequence
  Synthetic Polynucleotide
taatacgactcactataggggaacattgttttttctgttaatcaattaataacagaggagaattaatatgttaacagaaaacctggcggcagcgcaaaagatg

SEQ ID NO: 46091 - DNA, 103 bp, Artificial Sequence
  Synthetic Polynucleotide
taatacgactcactatagggagaacgaacattgttttttctgttaatcaaaacagaggagattgattatgagaaaaaacaacctggcggcagcgcaaaagatg

SEQ ID NO: 46092 - DNA, 103 bp, Artificial Sequence
  Synthetic Polynucleotide
taatacgactcactatagggaatagaaactataatcatataatagtgtagaacagaggagactacacatgtatatgattaacctggcggcagcgcaaaagatg

SEQ ID NO: 46093 - DNA, 103 bp, Artificial Sequence
  Synthetic Polynucleotide
taatacgactcactatagggttcccagaacgaacattgttttttctgttaaacagaggagataacagatgaaacaatgtaacctggcggcagcgcaaaagatg

SEQ ID NO: 46094 - DNA, 103 bp, Artificial Sequence
  Synthetic Polynucleotide
taatacgactcactatagggttctattcccagaacgaacattgttttttcaacagaggagagaaaaaatgatgttcgttaacctggcggcagcgcaaaagatg

SEQ ID NO: 46095 - DNA, 103 bp, Artificial Sequence
  Synthetic Polynucleotide
taatacgactcactatagggttggtttctattcccagaacgaacattgttaacagaggagaaacaatatgcgttctgggaacctggcggcagcgcaaaagatg

SEQ ID NO: 46096 - DNA, 103 bp, Artificial Sequence
  Synthetic Polynucleotide
taatacgactcactatagggttgatttggtttctattcccagaacgaacaaacagaggagatgttcgatgtgggaatagaacctggcggcagcgcaaaagatg

SEQ ID NO: 46097 - DNA, 103 bp, Artificial Sequence
  Synthetic Polynucleotide
taatacgactcactatagggttgttttgatttggtttctattcccagaacaacagaggagagttctgatgatagaaaccaacctggcggcagcgcaaaagatg

SEQ ID NO: 46098 - DNA, 103 bp, Artificial Sequence
  Synthetic Polynucleotide
taatacgactcactataggggaattttgttttgatttggtttctattcccaacagaggagagggaatatgaaccaaatcaacctggcggcagcgcaaaagatg

SEQ ID NO: 46099 - DNA, 103 bp, Artificial Sequence
  Synthetic Polynucleotide
taatacgactcactatagggctaatgaattttgttttgatttggtttctaaacagaggagatagaaaatgaatcaaaacaacctggcggcagcgcaaaagatg

SEQ ID NO: 46100 - DNA, 103 bp, Artificial Sequence
  Synthetic Polynucleotide
taatacgactcactatagggatattctaatgaattttgttttgatttggtaacagaggagaaccaaaatgaaacaaaataacctggcggcagcgcaaaagatg

SEQ ID NO: 46101 - DNA, 103 bp, Artificial Sequence
  Synthetic Polynucleotide
taatacgactcactataggggacatatattctaatgaattttgttttgataacagaggagaatcaaaatgaaattcattaacctggcggcagcgcaaaagatg

SEQ ID NO: 46102 - DNA, 103 bp, Artificial Sequence
  Synthetic Polynucleotide
taatacgactcactatagggaacgtgacatatattctaatgaattttgttaacagaggagaaacaaaatgcattagaataacctggcggcagcgcaaaagatg

SEQ ID NO: 46103 - DNA, 103 bp, Artificial Sequence
  Synthetic Polynucleotide
taatacgactcactataggggtaaaaatagaaactataatcatataatagaacagaggagactattaatggattatagtaacctggcggcagcgcaaaagatg

SEQ ID NO: 46104 - DNA, 103 bp, Artificial Sequence
  Synthetic Polynucleotide
taatacgactcactataggggtataaacgtgacatatattctaatgaattaacagaggagaaattcaatggaatatatgaacctggcggcagcgcaaaagatg

SEQ ID NO: 46105 - DNA, 103 bp, Artificial Sequence
  Synthetic Polynucleotide
taatacgactcactatagggtcgatgtataaacgtgacatatattctaataacagaggagaattagaatgtatgtcacgaacctggcggcagcgcaaaagatg

SEQ ID NO: 46106 - DNA, 103 bp, Artificial Sequence
  Synthetic Polynucleotide
taatacgactcactatagggtatattcgatgtataaacgtgacatatattaacagaggagaaatataatgcacgtttataacctggcggcagcgcaaaagatg

SEQ ID NO: 46107 - DNA, 103 bp, Artificial Sequence
  Synthetic Polynucleotide
taatacgactcactatagggtattttatattcgatgtataaacgtgacataacagaggagaatgtcaatgttatacatcaacctggcggcagcgcaaaagatg

SEQ ID NO: 46108 - DNA, 103 bp, Artificial Sequence
  Synthetic Polynucleotide
taatacgactcactataggggtagttattttatattcgatgtataaacgtaacagaggagaacgtttatgcatcgaataaacctggcggcagcgcaaaagatg

SEQ ID NO: 46109 - DNA, 103 bp, Artificial Sequence
  Synthetic Polynucleotide
taatacgactcactatagggaaactgtagttattttatattcgatgtataaacagaggagatatacaatgaatataaaaaacctggcggcagcgcaaaagatg

SEQ ID NO: 46110 - DNA, 103 bp, Artificial Sequence
  Synthetic Polynucleotide
taatacgactcactatagggttttcaaactgtagttattttatattcgataacagaggagaatcgaaatgaaaataactaacctggcggcagcgcaaaagatg

SEQ ID NO: 46111 - DNA, 103 bp, Artificial Sequence
  Synthetic Polynucleotide
taatacgactcactataggggttatttttcaaactgtagttattttatataacagaggagaatataaatgaactacagtaacctggcggcagcgcaaaagatg

SEQ ID NO: 46112 - DNA, 103 bp, Artificial Sequence
  Synthetic Polynucleotide
taatacgactcactatagggatactgttatttttcaaactgtagttatttaacagaggagaaaataaatgcagtttgaaaacctggcggcagcgcaaaagatg

SEQ ID NO: 46113 - DNA, 103 bp, Artificial Sequence
  Synthetic Polynucleotide
taatacgactcactatagggaaatgatactgttatttttcaaactgtagtaacagaggagaactacaatgtgaaaaataaacctggcggcagcgcaaaagatg

SEQ ID NO: 46114 - DNA, 103 bp, Artificial Sequence
  Synthetic Polynucleotide
taatacgactcactataggggtactgtaaaaatagaaactataatcatataacagaggagaatatgaatgtagtttctaaacctggcggcagcgcaaaagatg

SEQ ID NO: 46115 - DNA, 103 bp, Artificial Sequence
  Synthetic Polynucleotide
taatacgactcactatagggtgtttaaatgatactgttatttttcaaactaacagaggagaagtttgatgaataacagtaacctggcggcagcgcaaaagatg

SEQ ID NO: 46116 - DNA, 103 bp, Artificial Sequence
  Synthetic Polynucleotide
taatacgactcactatagggttaaatgtttaaatgatactgttatttttcaacagaggagagaaaaaatgcagtatcataacctggcggcagcgcaaaagatg

SEQ ID NO: 46117 - DNA, 103 bp, Artificial Sequence
  Synthetic Polynucleotide
taatacgactcactataggggcaagttaaatgtttaaatgatactgttataacagaggagaataacaatgtcatttaaaaacctggcggcagcgcaaaagatg

SEQ ID NO: 46118 - DNA, 103 bp, Artificial Sequence
  Synthetic Polynucleotide
taatacgactcactatagggaccccgcaagttaaatgtttaaatgatactaacagaggagaagtatcatgtaaacatttaacctggcggcagcgcaaaagatg

SEQ ID NO: 46119 - DNA, 103 bp, Artificial Sequence
  Synthetic Polynucleotide
taatacgactcactataggggattaaccccgcaagttaaatgtttaaatgaacagaggagacatttaatgatttaacttaacctggcggcagcgcaaaagatg

SEQ ID NO: 46120 - DNA, 103 bp, Artificial Sequence
  Synthetic Polynucleotide
taatacgactcactatagggtgtgagattaaccccgcaagttaaatgtttaacagaggagaaaacatatgacttgcgggaacctggcggcagcgcaaaagatg

SEQ ID NO: 46121 - DNA, 103 bp, Artificial Sequence
  Synthetic Polynucleotide
taatacgactcactatagggaaagttgtgagattaaccccgcaagttaaaaacagaggagatttaacatgcggggttaaaacctggcggcagcgcaaaagatg

SEQ ID NO: 46122 - DNA, 103 bp, Artificial Sequence
  Synthetic Polynucleotide
taatacgactcactatagggacagtaaagttgtgagattaaccccgcaagaacagaggagacttgcgatgttaatctcaaacctggcggcagcgcaaaagatg

SEQ ID NO: 46123 - DNA, 103 bp, Artificial Sequence
  Synthetic Polynucleotide
taatacgactcactatagggcaaaaacagtaaagttgtgagattaaccccaacagaggagaggggttatgctcacaactaacctggcggcagcgcaaaagatg

SEQ ID NO: 46124 - DNA, 103 bp, Artificial Sequence
  Synthetic Polynucleotide
taatacgactcactatagggcagttcaaaaacagtaaagttgtgagattaaacagaggagataatctatgaactttactaacctggcggcagcgcaaaagatg

SEQ ID NO: 46125 - DNA, 103 bp, Artificial Sequence
  Synthetic Polynucleotide
taatacgactcactataggggacattgtctgactgaatacatcctgtgggaacagaggagacccacaatgtgtattcagaacctggcggcagcgcaaaagatg

SEQ ID NO: 46126 - DNA, 103 bp, Artificial Sequence
  Synthetic Polynucleotide
taatacgactcactatagggtcaaggtactgtaaaaatagaaactataataacagaggagaattataatgtctatttttaacctggcggcagcgcaaaagatg

SEQ ID NO: 46127 - DNA, 103 bp, Artificial Sequence
  Synthetic Polynucleotide
taatacgactcactatagggttgaacagttcaaaaacagtaaagttgtgaaacagaggagatcacaaatgtactgttttaacctggcggcagcgcaaaagatg

SEQ ID NO: 46128 - DNA, 103 bp, Artificial Sequence
  Synthetic Polynucleotide
taatacgactcactatagggatattttgaacagttcaaaaacagtaaagtaacagaggagaactttaatgtttttgaacaacctggcggcagcgcaaaagatg

SEQ ID NO: 46129 - DNA, 103 bp, Artificial Sequence
  Synthetic Polynucleotide
taatacgactcactatagggatgctatattttgaacagttcaaaaacagtaacagaggagaactgttatggaactgttcaacctggcggcagcgcaaaagatg

SEQ ID NO: 46130 - DNA, 103 bp, Artificial Sequence
  Synthetic Polynucleotide
taatacgactcactataggggatctatgctatattttgaacagttcaaaaaacagaggagattttgaatggttcaaaataacctggcggcagcgcaaaagatg

SEQ ID NO: 46131 - DNA, 103 bp, Artificial Sequence
  Synthetic Polynucleotide
taatacgactcactatagggtcacggatctatgctatattttgaacagttaacagaggagaaactgtatgaaatatagcaacctggcggcagcgcaaaagatg

SEQ ID NO: 46132 - DNA, 103 bp, Artificial Sequence
  Synthetic Polynucleotide
taatacgactcactatagggatttctcacggatctatgctatattttgaaaacagaggagattcaaaatgtagcatagaaacctggcggcagcgcaaaagatg

SEQ ID NO: 46133 - DNA, 103 bp, Artificial Sequence
  Synthetic Polynucleotide
taatacgactcactatagggaacgtatttctcacggatctatgctatattaacagaggagaaatataatgtagatccgtaacctggcggcagcgcaaaagatg

SEQ ID NO: 46134 - DNA, 103 bp, Artificial Sequence
  Synthetic Polynucleotide
taatacgactcactatagggggctaaacgtatttctcacggatctatgctaacagaggagaagcataatgccgtgagaaaacctggcggcagcgcaaaagatg

SEQ ID NO: 46135 - DNA, 103 bp, Artificial Sequence
  Synthetic Polynucleotide
taatacgactcactatagggaaggcggctaaacgtatttctcacggatctaacagaggagaagatccatgagaaatacgaacctggcggcagcgcaaaagatg

SEQ ID NO: 46136 - DNA, 103 bp, Artificial Sequence
  Synthetic Polynucleotide
taatacgactcactatagggtattaaaggcggctaaacgtatttctcacgaacagaggagacgtgagatgtacgtttagaacctggcggcagcgcaaaagatg

SEQ ID NO: 46137 - DNA, 103 bp, Artificial Sequence
  Synthetic Polynucleotide
taatacgactcactatagggtttagtcaaggtactgtaaaaatagaaactaacagaggagaagtttcatgttttacagtaacctggcggcagcgcaaaagatg

SEQ ID NO: 46138 - DNA, 103 bp, Artificial Sequence
  Synthetic Polynucleotide
taatacgactcactatagggtcctctattaaaggcggctaaacgtatttcaacagaggagagaaataatgttagccgccaacctggcggcagcgcaaaagatg

SEQ ID NO: 46139 - DNA, 103 bp, Artificial Sequence
  Synthetic Polynucleotide
taatacgactcactatagggggatttcctctattaaaggcggctaaacgtaacagaggagaacgtttatgcgcctttaaaacctggcggcagcgcaaaagatg

SEQ ID NO: 46140 - DNA, 103 bp, Artificial Sequence
  Synthetic Polynucleotide
taatacgactcactatagggcggtgggatttcctctattaaaggcggctaaacagaggagatagccgatgttaatagagaacctggcggcagcgcaaaagatg

SEQ ID NO: 46141 - DNA, 103 bp, Artificial Sequence
  Synthetic Polynucleotide
taatacgactcactatagggaaaggcggtgggatttcctctattaaaggcaacagaggagagcctttatgagaggaaataacctggcggcagcgcaaaagatg

SEQ ID NO: 46142 - DNA, 103 bp, Artificial Sequence
  Synthetic Polynucleotide
taatacgactcactatagggtccaaaaaggcggtgggatttcctctattaaacagaggagataatagatgaaatcccacaacctggcggcagcgcaaaagatg

SEQ ID NO: 46143 - DNA, 103 bp, Artificial Sequence
  Synthetic Polynucleotide
taatacgactcactatagggtaagatccaaaaaggcggtgggatttcctcaacagaggagagaggaaatgccaccgcctaacctggcggcagcgcaaaagatg

SEQ ID NO: 46144 - DNA, 103 bp, Artificial Sequence
  Synthetic Polynucleotide
taatacgactcactataggggttggtaagatccaaaaaggcggtgggattaacagaggagaaatcccatggcctttttgaacctggcggcagcgcaaaagatg

SEQ ID NO: 46145 - DNA, 103 bp, Artificial Sequence
  Synthetic Polynucleotide
taatacgactcactatagggtcgtcgttggtaagatccaaaaaggcggtgaacagaggagacaccgcatgtttggatctaacctggcggcagcgcaaaagatg

SEQ ID NO: 46146 - DNA, 103 bp, Artificial Sequence
  Synthetic Polynucleotide
taatacgactcactatagggaactatcgtcgttggtaagatccaaaaaggaacagaggagaccttttatgatcttaccaaacctggcggcagcgcaaaagatg

SEQ ID NO: 46147 - DNA, 103 bp, Artificial Sequence
  Synthetic Polynucleotide
taatacgactcactataggggtcagaactatcgtcgttggtaagatccaaaacagaggagattggatatgaccaacgacaacctggcggcagcgcaaaagatg

SEQ ID NO: 46148 - DNA, 103 bp, Artificial Sequence
  Synthetic Polynucleotide
taatacgactcactatagggaagactttagtcaaggtactgtaaaaatagaacagaggagactatttatgcagtaccttaacctggcggcagcgcaaaagatg

SEQ ID NO: 46149 - DNA, 103 bp, Artificial Sequence
  Synthetic Polynucleotide
taatacgactcactatagggtgctggtcagaactatcgtcgttggtaagaaacagaggagatcttacatgcgacgatagaacctggcggcagcgcaaaagatg

SEQ ID NO: 46150 - DNA, 103 bp, Artificial Sequence
  Synthetic Polynucleotide
taatacgactcactatagggtgagttgctggtcagaactatcgtcgttggaacagaggagaccaacgatgatagttctgaacctggcggcagcgcaaaagatg

SEQ ID NO: 46151 - DNA, 103 bp, Artificial Sequence
  Synthetic Polynucleotide
taatacgactcactatagggagaaatgagttgctggtcagaactatcgtcaacagaggagagacgatatgtctgaccagaacctggcggcagcgcaaaagatg

SEQ ID NO: 46152 - DNA, 103 bp, Artificial Sequence
  Synthetic Polynucleotide
taatacgactcactataggggatgaagaaatgagttgctggtcagaactaaacagaggagatagttcatgccagcaactaacctggcggcagcgcaaaagatg

SEQ ID NO: 46153 - DNA, 103 bp, Artificial Sequence
  Synthetic Polynucleotide
taatacgactcactatagggtggatgatgaagaaatgagttgctggtcagaacagaggagactgaccatgaactcatttaacctggcggcagcgcaaaagatg

SEQ ID NO: 46154 - DNA, 103 bp, Artificial Sequence
  Synthetic Polynucleotide
taatacgactcactatagggacaggtggatgatgaagaaatgagttgctgaacagaggagacagcaaatgatttcttcaaacctggcggcagcgcaaaagatg

SEQ ID NO: 46155 - DNA, 103 bp, Artificial Sequence
  Synthetic Polynucleotide
taatacgactcactatagggttaaaacaggtggatgatgaagaaatgagtaacagaggagaactcatatgttcatcatcaacctggcggcagcgcaaaagatg

SEQ ID NO: 46156 - DNA, 103 bp, Artificial Sequence
  Synthetic Polynucleotide
taatacgactcactatagggatatgttaaaacaggtggatgatgaagaaaaacagaggagatttcttatgcatccacctaacctggcggcagcgcaaaagatg

SEQ ID NO: 46157 - DNA, 103 bp, Artificial Sequence
  Synthetic Polynucleotide
taatacgactcactatagggctattatatgttaaaacaggtggatgatgaaacagaggagatcatcaatgacctgttttaacctggcggcagcgcaaaagatg

SEQ ID NO: 46158 - DNA, 103 bp, Artificial Sequence
  Synthetic Polynucleotide
taatacgactcactatagggcctgcctattatatgttaaaacaggtggataacagaggagaatccacatgttttaacataacctggcggcagcgcaaaagatg

SEQ ID NO: 46159 - DNA, 103 bp, Artificial Sequence
  Synthetic Polynucleotide
taatacgactcactataggggactaaagactttagtcaaggtactgtaaaaacagaggagatttacaatgccttgactaaacctggcggcagcgcaaaagatg

SEQ ID NO: 46160 - DNA, 103 bp, Artificial Sequence
  Synthetic Polynucleotide
taatacgactcactatagggtatctcctgcctattatatgttaaaacaggaacagaggagacctgttatgacatataataacctggcggcagcgcaaaagatg

SEQ ID NO: 46161 - DNA, 103 bp, Artificial Sequence
  Synthetic Polynucleotide
taatacgactcactatagggatatctatctcctgcctattatatgttaaaaacagaggagatttaacatgtaataggcaaacctggcggcagcgcaaaagatg

SEQ ID NO: 46162 - DNA, 103 bp, Artificial Sequence
  Synthetic Polynucleotide
taatacgactcactataggggacggatatctatctcctgcctattatatgaacagaggagacatataatgggcaggagaaacctggcggcagcgcaaaagatg

SEQ ID NO: 46163 - DNA, 103 bp, Artificial Sequence
  Synthetic Polynucleotide
taatacgactcactataggggcaatgacggatatctatctcctgcctattaacagaggagaaataggatggagatagataacctggcggcagcgcaaaagatg

SEQ ID NO: 46164 - DNA, 103 bp, Artificial Sequence
  Synthetic Polynucleotide
taatacgactcactatagggatattgcaatgacggatatctatctcctgcaacagaggagagcaggaatgagatatccgaacctggcggcagcgcaaaagatg

SEQ ID NO: 46165 - DNA, 103 bp, Artificial Sequence
  Synthetic Polynucleotide
taatacgactcactatagggaaggaatattgcaatgacggatatctatctaacagaggagaagatagatgtccgtcattaacctggcggcagcgcaaaagatg

SEQ ID NO: 46166 - DNA, 103 bp, Artificial Sequence
  Synthetic Polynucleotide
taatacgactcactatagggacgagaaggaatattgcaatgacggatatcaacagaggagagatatcatgcattgcaataacctggcggcagcgcaaaagatg

SEQ ID NO: 46167 - DNA, 103 bp, Artificial Sequence
  Synthetic Polynucleotide
taatacgactcactatagggtgcctacgagaaggaatattgcaatgacggaacagaggagaccgtcaatgcaatattccaacctggcggcagcgcaaaagatg

SEQ ID NO: 46168 - DNA, 103 bp, Artificial Sequence
  Synthetic Polynucleotide
taatacgactcactatagggttgtgtgcctacgagaaggaatattgcaataacagaggagaattgcaatgttccttctcaacctggcggcagcgcaaaagatg

SEQ ID NO: 46169 - DNA, 103 bp, Artificial Sequence
  Synthetic Polynucleotide
taatacgactcactatagggttcgattgtgtgcctacgagaaggaatattaacagaggagaaatattatgtctcgtaggaacctggcggcagcgcaaaagatg

SEQ ID NO: 46170 - DNA, 103 bp, Artificial Sequence
  Synthetic Polynucleotide
taatacgactcactatagggtgtgtgactaaagactttagtcaaggtactaacagaggagaagtaccatgactaaagtcaacctggcggcagcgcaaaagatg

SEQ ID NO: 46171 - DNA, 103 bp, Artificial Sequence
  Synthetic Polynucleotide
taatacgactcactatagggcaatattcgattgtgtgcctacgagaaggaaacagaggagatccttcatgtaggcacacaacctggcggcagcgcaaaagatg

SEQ ID NO: 46172 - DNA, 103 bp, Artificial Sequence
  Synthetic Polynucleotide
taatacgactcactatagggtttatcaatattcgattgtgtgcctacgagaacagaggagactcgtaatgacacaatcgaacctggcggcagcgcaaaagatg

SEQ ID NO: 46173 - DNA, 103 bp, Artificial Sequence
  Synthetic Polynucleotide
taatacgactcactataggggagattttatcaatattcgattgtgtgcctaacagaggagaaggcacatgatcgaatataacctggcggcagcgcaaaagatg

SEQ ID NO: 46174 - DNA, 103 bp, Artificial Sequence
  Synthetic Polynucleotide
taatacgactcactataggggaatggagattttatcaatattcgattgtgaacagaggagacacaatatgatattgataaacctggcggcagcgcaaaagatg

SEQ ID NO: 46175 - DNA, 103 bp, Artificial Sequence
  Synthetic Polynucleotide
taatacgactcactataggggaagagaatggagattttatcaatattcgaaacagaggagatcgaatatggataaaatcaacctggcggcagcgcaaaagatg

SEQ ID NO: 46176 - DNA, 103 bp, Artificial Sequence
  Synthetic Polynucleotide
taatacgactcactataggggcagagaagagaatggagattttatcaataaacagaggagatattgaatgaatctccataacctggcggcagcgcaaaagatg

SEQ ID NO: 46177 - DNA, 103 bp, Artificial Sequence
  Synthetic Polynucleotide
taatacgactcactatagggtaaatgcagagaagagaatggagattttataacagaggagaataaaaatgccattctctaacctggcggcagcgcaaaagatg

SEQ ID NO: 46178 - DNA, 103 bp, Artificial Sequence
  Synthetic Polynucleotide
taatacgactcactataggggataataaatgcagagaagagaatggagataacagaggagaatctccatgctcttctctaacctggcggcagcgcaaaagatg

SEQ ID NO: 46179 - DNA, 103 bp, Artificial Sequence
  Synthetic Polynucleotide
taatacgactcactataggggacaagataataaatgcagagaagagaatgaacagaggagacattctatgctctgcattaacctggcggcagcgcaaaagatg

SEQ ID NO: 46180 - DNA, 103 bp, Artificial Sequence
  Synthetic Polynucleotide
taatacgactcactatagggaccaagacaagataataaatgcagagaagaaacagaggagatcttctatgcatttattaaacctggcggcagcgcaaaagatg

SEQ ID NO: 46181 - DNA, 103 bp, Artificial Sequence
  Synthetic Polynucleotide
taatacgactcactatagggagtattgtgtgactaaagactttagtcaagaacagaggagacttgacatgagtctttagaacctggcggcagcgcaaaagatg

SEQ ID NO: 46182 - DNA, 103 bp, Artificial Sequence
  Synthetic Polynucleotide
taatacgactcactatagggccaccaccaagacaagataataaatgcagaaacagaggagatctgcaatgattatcttgaacctggcggcagcgcaaaagatg

SEQ ID NO: 46183 - DNA, 103 bp, Artificial Sequence
  Synthetic Polynucleotide
taatacgactcactatagggctagcccaccaccaagacaagataataaataacagaggagaatttatatgcttgtcttgaacctggcggcagcgcaaaagatg

SEQ ID NO: 46184 - DNA, 103 bp, Artificial Sequence
  Synthetic Polynucleotide
taatacgactcactatagggacagcctagcccaccaccaagacaagataaaacagaggagattatctatgcttggtggtaacctggcggcagcgcaaaagatg

SEQ ID NO: 46185 - DNA, 103 bp, Artificial Sequence
  Synthetic Polynucleotide
taatacgactcactatagggagactacagcctagcccaccaccaagacaaaacagaggagattgtctatgtggtgggctaacctggcggcagcgcaaaagatg

SEQ ID NO: 46186 - DNA, 103 bp, Artificial Sequence
  Synthetic Polynucleotide
taatacgactcactataggggaccaagactacagcctagcccaccaccaaaacagaggagattggtgatgggctaggctaacctggcggcagcgcaaaagatg

SEQ ID NO: 46187 - DNA, 103 bp, Artificial Sequence
  Synthetic Polynucleotide
taatacgactcactatagggtaatagaccaagactacagcctagcccaccaacagaggagaggtgggatgggctgtagtaacctggcggcagcgcaaaagatg

SEQ ID NO: 46188 - DNA, 103 bp, Artificial Sequence
  Synthetic Polynucleotide
taatacgactcactatagggggtaataatagaccaagactacagcctagcaacagaggagagctaggatgtagtcttggaacctggcggcagcgcaaaagatg

SEQ ID NO: 46189 - DNA, 103 bp, Artificial Sequence
  Synthetic Polynucleotide
taatacgactcactatagggacgatggtaataatagaccaagactacagcaacagaggagagctgtaatgttggtctataacctggcggcagcgcaaaagatg

SEQ ID NO: 46190 - DNA, 103 bp, Artificial Sequence
  Synthetic Polynucleotide
taatacgactcactatagggcaacaacgatggtaataatagaccaagactaacagaggagaagtcttatgctattattaaacctggcggcagcgcaaaagatg

SEQ ID NO: 46191 - DNA, 103 bp, Artificial Sequence
  Synthetic Polynucleotide
taatacgactcactatagggagattcaacaacgatggtaataatagaccaaacagaggagatggtctatgattaccatcaacctggcggcagcgcaaaagatg

SEQ ID NO: 46192 - DNA, 103 bp, Artificial Sequence
  Synthetic Polynucleotide
taatacgactcactatagggttggtagtattgtgtgactaaagactttagaacagaggagactaaagatgttagtcacaaacctggcggcagcgcaaaagatg

SEQ ID NO: 46193 - DNA, 103 bp, Artificial Sequence
  Synthetic Polynucleotide
taatacgactcactataggggaaatagattcaacaacgatggtaataataaacagaggagatattatatgcatcgttgtaacctggcggcagcgcaaaagatg

SEQ ID NO: 46194 - DNA, 103 bp, Artificial Sequence
  Synthetic Polynucleotide
taatacgactcactatagggtgacagaaatagattcaacaacgatggtaaaacagaggagattaccaatgttgttgaataacctggcggcagcgcaaaagatg

SEQ ID NO: 46195 - DNA, 103 bp, Artificial Sequence
  Synthetic Polynucleotide
taatacgactcactatagggtttaatgacagaaatagattcaacaacgataacagaggagaatcgttatggaatctattaacctggcggcagcgcaaaagatg

SEQ ID NO: 46196 - DNA, 103 bp, Artificial Sequence
  Synthetic Polynucleotide
taatacgactcactatagggaaagatttaatgacagaaatagattcaacaaacagaggagatgttgaatgtatttctgtaacctggcggcagcgcaaaagatg

SEQ ID NO: 46197 - DNA, 103 bp, Artificial Sequence
  Synthetic Polynucleotide
taatacgactcactatagggaaatgaaagatttaatgacagaaatagattaacagaggagaaatctaatgctgtcattaaacctggcggcagcgcaaaagatg

SEQ ID NO: 46198 - DNA, 103 bp, Artificial Sequence
  Synthetic Polynucleotide
taatacgactcactatagggggaagaaatgaaagatttaatgacagaaataacagaggagaatttctatgattaaatctaacctggcggcagcgcaaaagatg

SEQ ID NO: 46199 - DNA, 103 bp, Artificial Sequence
  Synthetic Polynucleotide
taatacgactcactatagggtaccaggaagaaatgaaagatttaatgacaaacagaggagatgtcatatgatctttcataacctggcggcagcgcaaaagatg

SEQ ID NO: 46200 - DNA, 103 bp, Artificial Sequence
  Synthetic Polynucleotide
taatacgactcactatagggaaatataccaggaagaaatgaaagatttaaaacagaggagattaaatatgtcatttcttaacctggcggcagcgcaaaagatg

SEQ ID NO: 46201 - DNA, 103 bp, Artificial Sequence
  Synthetic Polynucleotide
taatacgactcactatagggaataaaaatataccaggaagaaatgaaagaaacagaggagatctttcatgtcttcctggaacctggcggcagcgcaaaagatg

SEQ ID NO: 46202 - DNA, 103 bp, Artificial Sequence
  Synthetic Polynucleotide
taatacgactcactataggggaggtaataaaaatataccaggaagaaatgaacagaggagacatttcatgctggtatataacctggcggcagcgcaaaagatg

SEQ ID NO: 46203 - DNA, 103 bp, Artificial Sequence
  Synthetic Polynucleotide
taatacgactcactataggggtaggttggtagtattgtgtgactaaagacaacagaggagagtctttatgcacacaataaacctggcggcagcgcaaaagatg

SEQ ID NO: 46204 - DNA, 103 bp, Artificial Sequence
  Synthetic Polynucleotide
taatacgactcactatagggcaagcgaggtaataaaaatataccaggaagaacagaggagacttcctatgatatttttaaacctggcggcagcgcaaaagatg

SEQ ID NO: 46205 - DNA, 103 bp, Artificial Sequence
  Synthetic Polynucleotide
taatacgactcactatagggccaaccaagcgaggtaataaaaatataccaaacagaggagatggtatatgtttattaccaacctggcggcagcgcaaaagatg

SEQ ID NO: 46206 - DNA, 103 bp, Artificial Sequence
  Synthetic Polynucleotide
taatacgactcactatagggaaaatccaaccaagcgaggtaataaaaataaacagaggagatattttatgtacctcgctaacctggcggcagcgcaaaagatg

SEQ ID NO: 46207 - DNA, 103 bp, Artificial Sequence
  Synthetic Polynucleotide
taatacgactcactatagggagacaaaaatccaaccaagcgaggtaataaaacagaggagattattaatgcgcttggttaacctggcggcagcgcaaaagatg

SEQ ID NO: 46208 - DNA, 103 bp, Artificial Sequence
  Synthetic Polynucleotide
taatacgactcactatagggaatatagacaaaaatccaaccaagcgaggtaacagaggagaacctcgatgggttggattaacctggcggcagcgcaaaagatg

SEQ ID NO: 46209 - DNA, 103 bp, Artificial Sequence
  Synthetic Polynucleotide
taatacgactcactatagggacgataatatagacaaaaatccaaccaagcaacagaggagagcttggatggatttttgtaacctggcggcagcgcaaaagatg

SEQ ID NO: 46210 - DNA, 103 bp, Artificial Sequence
  Synthetic Polynucleotide
taatacgactcactatagggtacaaacgataatatagacaaaaatccaacaacagaggagagttggaatgttgtctataaacctggcggcagcgcaaaagatg

SEQ ID NO: 46211 - DNA, 103 bp, Artificial Sequence
  Synthetic Polynucleotide
taatacgactcactataggggatgttacaaacgataatatagacaaaaataacagaggagaatttttatgtatattatcaacctggcggcagcgcaaaagatg

SEQ ID NO: 46212 - DNA, 103 bp, Artificial Sequence
  Synthetic Polynucleotide
taatacgactcactataggggtaccgatgttacaaacgataatatagacaaacagaggagatgtctaatgtatcgtttgaacctggcggcagcgcaaaagatg

SEQ ID NO: 46213 - DNA, 103 bp, Artificial Sequence
  Synthetic Polynucleotide
taatacgactcactatagggtacccgtaccgatgttacaaacgataatataacagaggagaatattaatgtttgtaacaaacctggcggcagcgcaaaagatg

SEQ ID NO: 46214 - DNA, 103 bp, Artificial Sequence
  Synthetic Polynucleotide
taatacgactcactatagggatagtgtaggttggtagtattgtgtgactaaacagaggagatagtcaatgaatactaccaacctggcggcagcgcaaaagatg

SEQ ID NO: 46215 - DNA, 103 bp, Artificial Sequence
  Synthetic Polynucleotide
taatacgactcactatagggatgaatacccgtaccgatgttacaaacgataacagaggagaatcgttatgaacatcggtaacctggcggcagcgcaaaagatg

SEQ ID NO: 46216 - DNA, 103 bp, Artificial Sequence
  Synthetic Polynucleotide
taatacgactcactataggggataaatgaatacccgtaccgatgttacaaaacagaggagattgtaaatgcggtacgggaacctggcggcagcgcaaaagatg

SEQ ID NO: 46217 - DNA, 103 bp, Artificial Sequence
  Synthetic Polynucleotide
taatacgactcactatagggtttgtgataaatgaatacccgtaccgatgtaacagaggagaacatcgatgcgggtattcaacctggcggcagcgcaaaagatg

SEQ ID NO: 46218 - DNA, 103 bp, Artificial Sequence
  Synthetic Polynucleotide
taatacgactcactatagggttttttttgtgataaatgaatacccgtaccaacagaggagaggtacgatgattcatttaaacctggcggcagcgcaaaagatg

SEQ ID NO: 46219 - DNA, 103 bp, Artificial Sequence
  Synthetic Polynucleotide
taatacgactcactatagggagaagttttttttgtgataaatgaatacccaacagaggagagggtatatgtttatcacaaacctggcggcagcgcaaaagatg

SEQ ID NO: 46220 - DNA, 103 bp, Artificial Sequence
  Synthetic Polynucleotide
taatacgactcactatagggtttagagaagttttttttgtgataaatgaaaacagaggagattcattatgcacaaaaaaaacctggcggcagcgcaaaagatg

SEQ ID NO: 46221 - DNA, 103 bp, Artificial Sequence
  Synthetic Polynucleotide
taatacgactcactatagggactcatttagagaagttttttttgtgataaaacagaggagattatcaatgaaaaaacttaacctggcggcagcgcaaaagatg

SEQ ID NO: 46222 - DNA, 103 bp, Artificial Sequence
  Synthetic Polynucleotide
taatacgactcactatagggagtagactcatttagagaagttttttttgtaacagaggagaacaaaaatgacttctctaaacctggcggcagcgcaaaagatg

SEQ ID NO: 46223 - DNA, 103 bp, Artificial Sequence
  Synthetic Polynucleotide
taatacgactcactatagggctagcagtagactcatttagagaagtttttaacagaggagaaaaaacatgtctaaatgaaacctggcggcagcgcaaaagatg

SEQ ID NO: 46224 - DNA, 103 bp, Artificial Sequence
  Synthetic Polynucleotide
taatacgactcactataggggttttctagcagtagactcatttagagaagaacagaggagacttctcatgatgagtctaaacctggcggcagcgcaaaagatg

SEQ ID NO: 46225 - DNA, 103 bp, Artificial Sequence
  Synthetic Polynucleotide
taatacgactcactatagggatataatagtgtaggttggtagtattgtgtaacagaggagaacacaaatgtaccaacctaacctggcggcagcgcaaaagatg

SEQ ID NO: 46226 - DNA, 103 bp, Artificial Sequence
  Synthetic Polynucleotide
taatacgactcactatagggatgaggttttctagcagtagactcatttagaacagaggagactaaatatgtctactgctaacctggcggcagcgcaaaagatg

SEQ ID NO: 46227 - DNA, 103 bp, Artificial Sequence
  Synthetic Polynucleotide
taatacgactcactatagggcttcgatgaggttttctagcagtagactcaaacagaggagatgagtcatgtgctagaaaaacctggcggcagcgcaaaagatg

SEQ ID NO: 46228 - DNA, 103 bp, Artificial Sequence
  Synthetic Polynucleotide
taatacgactcactatagggatcttcttcgatgaggttttctagcagtagaacagaggagactactgatggaaaacctcaacctggcggcagcgcaaaagatg

SEQ ID NO: 46229 - DNA, 103 bp, Artificial Sequence
  Synthetic Polynucleotide
taatacgactcactatagggatggtatcttcttcgatgaggttttctagcaacagaggagagctagaatgcctcatcgaaacctggcggcagcgcaaaagatg

SEQ ID NO: 46230 - DNA, 103 bp, Artificial Sequence
  Synthetic Polynucleotide
taatacgactcactatagggaaaatatggtatcttcttcgatgaggttttaacagaggagaaaaaccatgtcgaagaagaacctggcggcagcgcaaaagatg

SEQ ID NO: 46231 - DNA, 103 bp, Artificial Sequence
  Synthetic Polynucleotide
taatacgactcactatagggtgcaaaaaatatggtatcttcttcgatgagaacagaggagactcatcatggaagataccaacctggcggcagcgcaaaagatg

SEQ ID NO: 46232 - DNA, 103 bp, Artificial Sequence
  Synthetic Polynucleotide
taatacgactcactatagggcttcctgcaaaaaatatggtatcttcttcgaacagaggagacgaagaatgtaccatattaacctggcggcagcgcaaaagatg

SEQ ID NO: 46233 - DNA, 103 bp, Artificial Sequence
  Synthetic Polynucleotide
taatacgactcactatagggatatacttcctgcaaaaaatatggtatcttaacagaggagaaagataatgtattttttgaacctggcggcagcgcaaaagatg

SEQ ID NO: 46234 - DNA, 103 bp, Artificial Sequence
  Synthetic Polynucleotide
taatacgactcactatagggctcagatatacttcctgcaaaaaatatggtaacagaggagaaccataatgtttgcaggaaacctggcggcagcgcaaaagatg

SEQ ID NO: 46235 - DNA, 103 bp, Artificial Sequence
  Synthetic Polynucleotide
taatacgactcactatagggtcatactcagatatacttcctgcaaaaaataacagaggagaatttttatgaggaagtataacctggcggcagcgcaaaagatg

SEQ ID NO: 46236 - DNA, 103 bp, Artificial Sequence
  Synthetic Polynucleotide
taatacgactcactatagggaatgtagtgcattattacgtctacaataaaaacagaggagatttattatggacgtaataaacctggcggcagcgcaaaagatg

SEQ ID NO: 46237 - DNA, 103 bp, Artificial Sequence
  Synthetic Polynucleotide
taatacgactcactatagggcgtcagacattgtctgactgaatacatcctaacagaggagaaggatgatgtcagtcagaaacctggcggcagcgcaaaagatg

SEQ ID NO: 46238 - DNA, 103 bp, Artificial Sequence
  Synthetic Polynucleotide
taatacgactcactatagggtaatcatataatagtgtaggttggtagtataacagaggagaatactaatgacctacactaacctggcggcagcgcaaaagatg

SEQ ID NO: 46239 - DNA, 103 bp, Artificial Sequence
  Synthetic Polynucleotide
taatacgactcactatagggaatcatcatactcagatatacttcctgcaaaacagaggagattgcagatggtatatctgaacctggcggcagcgcaaaagatg

SEQ ID NO: 46240 - DNA, 103 bp, Artificial Sequence
  Synthetic Polynucleotide
taatacgactcactatagggttgtaaatcatcatactcagatatacttccaacagaggagaggaagtatgtctgagtataacctggcggcagcgcaaaagatg

SEQ ID NO: 46241 - DNA, 103 bp, Artificial Sequence
  Synthetic Polynucleotide
taatacgactcactatagggaccatttgtaaatcatcatactcagatataaacagaggagatatatcatggtatgatgaaacctggcggcagcgcaaaagatg

SEQ ID NO: 46242 - DNA, 103 bp, Artificial Sequence
  Synthetic Polynucleotide
taatacgactcactatagggcaataaccatttgtaaatcatcatactcagaacagaggagactgagtatgatgatttacaacctggcggcagcgcaaaagatg

SEQ ID NO: 46243 - DNA, 103 bp, Artificial Sequence
  Synthetic Polynucleotide
taatacgactcactatagggaccggcaataaccatttgtaaatcatcataaacagaggagatatgatatgttacaaatgaacctggcggcagcgcaaaagatg

SEQ ID NO: 46244 - DNA, 103 bp, Artificial Sequence
  Synthetic Polynucleotide
taatacgactcactatagggtttgcaccggcaataaccatttgtaaatcaaacagaggagatgatttatgaatggttataacctggcggcagcgcaaaagatg

SEQ ID NO: 46245 - DNA, 103 bp, Artificial Sequence
  Synthetic Polynucleotide
taatacgactcactatagggtggattttgcaccggcaataaccatttgtaaacagaggagatacaaaatgttattgccgaacctggcggcagcgcaaaagatg

SEQ ID NO: 46246 - DNA, 103 bp, Artificial Sequence
  Synthetic Polynucleotide
taatacgactcactatagggaaatttggattttgcaccggcaataaccataacagaggagaatggttatggccggtgcaaacctggcggcagcgcaaaagatg

SEQ ID NO: 46247 - DNA, 103 bp, Artificial Sequence
  Synthetic Polynucleotide
taatacgactcactatagggcttggaaatttggattttgcaccggcaataaacagaggagatattgcatgtgcaaaatcaacctggcggcagcgcaaaagatg

SEQ ID NO: 46248 - DNA, 103 bp, Artificial Sequence
  Synthetic Polynucleotide
taatacgactcactatagggtagatcttggaaatttggattttgcaccggaacagaggagaccggtgatgaatccaaataacctggcggcagcgcaaaagatg

SEQ ID NO: 46249 - DNA, 103 bp, Artificial Sequence
  Synthetic Polynucleotide
taatacgactcactatagggaactataatcatataatagtgtaggttggtaacagaggagaaccaacatgcactattataacctggcggcagcgcaaaagatg

SEQ ID NO: 46250 - DNA, 103 bp, Artificial Sequence
  Synthetic Polynucleotide
taatacgactcactatagggaagcatagatcttggaaatttggattttgcaacagaggagagcaaaaatgaaatttccaaacctggcggcagcgcaaaagatg

SEQ ID NO: 46251 - DNA, 103 bp, Artificial Sequence
  Synthetic Polynucleotide
taatacgactcactatagggatagaaagcatagatcttggaaatttggataacagaggagaatccaaatgtccaagatcaacctggcggcagcgcaaaagatg

SEQ ID NO: 46252 - DNA, 103 bp, Artificial Sequence
  Synthetic Polynucleotide
taatacgactcactatagggtaaaaatagaaagcatagatcttggaaattaacagaggagaaatttcatggatctatgcaacctggcggcagcgcaaaagatg

SEQ ID NO: 46253 - DNA, 103 bp, Artificial Sequence
  Synthetic Polynucleotide
taatacgactcactatagggtatattaaaaatagaaagcatagatcttggaacagaggagaccaagaatgatgctttctaacctggcggcagcgcaaaagatg

SEQ ID NO: 46254 - DNA, 103 bp, Artificial Sequence
  Synthetic Polynucleotide
taatacgactcactatagggggtactatattaaaaatagaaagcatagataacagaggagaatctatatgttctattttaacctggcggcagcgcaaaagatg

SEQ ID NO: 46255 - DNA, 103 bp, Artificial Sequence
  Synthetic Polynucleotide
taatacgactcactatagggttctaggtactatattaaaaatagaaagcaaacagaggagatgctttatgtttttaataaacctggcggcagcgcaaaagatg

SEQ ID NO: 46256 - DNA, 103 bp, Artificial Sequence
  Synthetic Polynucleotide
taatacgactcactatagggcattgttctaggtactatattaaaaatagaaacagaggagatctattatgaatatagtaaacctggcggcagcgcaaaagatg

SEQ ID NO: 46257 - DNA, 103 bp, Artificial Sequence
  Synthetic Polynucleotide
taatacgactcactatagggtttgacattgttctaggtactatattaaaaaacagaggagattttaaatgagtacctagaacctggcggcagcgcaaaagatg

SEQ ID NO: 46258 - DNA, 103 bp, Artificial Sequence
  Synthetic Polynucleotide
taatacgactcactatagggcatattttgacattgttctaggtactatataacagaggagaatatagatgctagaacaaaacctggcggcagcgcaaaagatg

SEQ ID NO: 46259 - DNA, 103 bp, Artificial Sequence
  Synthetic Polynucleotide
taatacgactcactatagggcaactcatattttgacattgttctaggtacaacagaggagagtacctatgacaatgtcaaacctggcggcagcgcaaaagatg

SEQ ID NO: 46260 - DNA, 103 bp, Artificial Sequence
  Synthetic Polynucleotide
taatacgactcactatagggatagaaactataatcatataatagtgtaggaacagaggagacctacaatgttatatgataacctggcggcagcgcaaaagatg

SEQ ID NO: 46261 - DNA, 103 bp, Artificial Sequence
  Synthetic Polynucleotide
taatacgactcactatagggaactccaactcatattttgacattgttctaaacagaggagatagaacatggtcaaaataaacctggcggcagcgcaaaagatg

SEQ ID NO: 46262 - DNA, 103 bp, Artificial Sequence
  Synthetic Polynucleotide
taatacgactcactataggggaattaactccaactcatattttgacattgaacagaggagacaatgtatgaatatgagtaacctggcggcagcgcaaaagatg

SEQ ID NO: 46263 - DNA, 103 bp, Artificial Sequence
  Synthetic Polynucleotide
taatacgactcactataggggttatgaattaactccaactcatattttgaaacagaggagatcaaaaatggagttggagaacctggcggcagcgcaaaagatg

SEQ ID NO: 46264 - DNA, 103 bp, Artificial Sequence
  Synthetic Polynucleotide
taatacgactcactatagggttctcgttatgaattaactccaactcatataacagaggagaatatgaatgggagttaataacctggcggcagcgcaaaagatg

SEQ ID NO: 46265 - DNA, 103 bp, Artificial Sequence
  Synthetic Polynucleotide
taatacgactcactatagggtgatattctcgttatgaattaactccaactaacagaggagaagttggatgtaattcataaacctggcggcagcgcaaaagatg

SEQ ID NO: 46266 - DNA, 103 bp, Artificial Sequence
  Synthetic Polynucleotide
taatacgactcactatagggccctgtgatattctcgttatgaattaactcaacagaggagagagttaatgcataacgagaacctggcggcagcgcaaaagatg

SEQ ID NO: 46267 - DNA, 103 bp, Artificial Sequence
  Synthetic Polynucleotide
taatacgactcactatagggattgcccctgtgatattctcgttatgaattaacagaggagaaattcaatgcgagaatataacctggcggcagcgcaaaagatg

SEQ ID NO: 46268 - DNA, 103 bp, Artificial Sequence
  Synthetic Polynucleotide
taatacgactcactatagggtaaacattgcccctgtgatattctcgttataacagaggagaataacgatgatatcacagaacctggcggcagcgcaaaagatg

SEQ ID NO: 46269 - DNA, 103 bp, Artificial Sequence
  Synthetic Polynucleotide
taatacgactcactatagggtgtggtaaacattgcccctgtgatattctcaacagaggagagagaatatgacaggggcaaacctggcggcagcgcaaaagatg

SEQ ID NO: 46270 - DNA, 103 bp, Artificial Sequence
  Synthetic Polynucleotide
taatacgactcactatagggtacattgtggtaaacattgcccctgtgataaacagaggagatatcacatgggcaatgttaacctggcggcagcgcaaaagatg

SEQ ID NO: 46271 - DNA, 103 bp, Artificial Sequence
  Synthetic Polynucleotide
taatacgactcactatagggtaaaaatagaaactataatcatataatagtaacagaggagaactattatgtgattatagaacctggcggcagcgcaaaagatg

SEQ ID NO: 46272 - DNA, 103 bp, Artificial Sequence
  Synthetic Polynucleotide
taatacgactcactatagggtattatacattgtggtaaacattgcccctgaacagaggagacaggggatgtgtttaccaaacctggcggcagcgcaaaagatg

SEQ ID NO: 46273 - DNA, 103 bp, Artificial Sequence
  Synthetic Polynucleotide
taatacgactcactatagggtcttatattatacattgtggtaaacattgcaacagaggagagcaatgatgaccacaatgaacctggcggcagcgcaaaagatg

SEQ ID NO: 46274 - DNA, 103 bp, Artificial Sequence
  Synthetic Polynucleotide
taatacgactcactatagggttgtttcttatattatacattgtggtaaacaacagaggagagtttacatgaatgtataaaacctggcggcagcgcaaaagatg

SEQ ID NO: 46275 - DNA, 103 bp, Artificial Sequence
  Synthetic Polynucleotide
taatacgactcactatagggccaaattgtttcttatattatacattgtggaacagaggagaccacaaatgataatataaaacctggcggcagcgcaaaagatg

SEQ ID NO: 46276 - DNA, 103 bp, Artificial Sequence
  Synthetic Polynucleotide
taatacgactcactatagggtaaacccaaattgtttcttatattatacataacagaggagaatgtatatgataagaaacaacctggcggcagcgcaaaagatg

SEQ ID NO: 46277 - DNA, 103 bp, Artificial Sequence
  Synthetic Polynucleotide
taatacgactcactatagggtcacctaaacccaaattgtttcttatattaaacagaggagataatatatgaaacaatttaacctggcggcagcgcaaaagatg

SEQ ID NO: 46278 - DNA, 103 bp, Artificial Sequence
  Synthetic Polynucleotide
taatacgactcactatagggtatcatcacctaaacccaaattgtttcttaaacagaggagataagaaatgatttgggttaacctggcggcagcgcaaaagatg

SEQ ID NO: 46279 - DNA, 103 bp, Artificial Sequence
  Synthetic Polynucleotide
taatacgactcactatagggtagtttatcatcacctaaacccaaattgttaacagaggagaaacaatatgggtttaggtaacctggcggcagcgcaaaagatg

SEQ ID NO: 46280 - DNA, 103 bp, Artificial Sequence
  Synthetic Polynucleotide
taatacgactcactatagggatagttagtttatcatcacctaaacccaaaaacagaggagatttgggatgaggtgatgaaacctggcggcagcgcaaaagatg

SEQ ID NO: 46281 - DNA, 103 bp, Artificial Sequence
  Synthetic Polynucleotide
taatacgactcactatagggcttcaatagttagtttatcatcacctaaacaacagaggagagtttagatgatgataaacaacctggcggcagcgcaaaagatg

SEQ ID NO: 46282 - DNA, 103 bp, Artificial Sequence
  Synthetic Polynucleotide
taatacgactcactatagggtcctataaaaatagaaactataatcatataaacagaggagatatatgatgatagtttctaacctggcggcagcgcaaaagatg

SEQ ID NO: 46283 - DNA, 103 bp, Artificial Sequence
  Synthetic Polynucleotide
taatacgactcactatagggaatggcttcaatagttagtttatcatcaccaacagaggagaggtgatatgaaactaactaacctggcggcagcgcaaaagatg

SEQ ID NO: 46284 - DNA, 103 bp, Artificial Sequence
  Synthetic Polynucleotide
taatacgactcactatagggttttcaatggcttcaatagttagtttatcaaacagaggagatgataaatgaactattgaaacctggcggcagcgcaaaagatg

SEQ ID NO: 46285 - DNA, 103 bp, Artificial Sequence
  Synthetic Polynucleotide
taatacgactcactatagggaatagttttcaatggcttcaatagttagttaacagaggagaaactaaatgttgaagccaaacctggcggcagcgcaaaagatg

SEQ ID NO: 46286 - DNA, 103 bp, Artificial Sequence
  Synthetic Polynucleotide
taatacgactcactatagggcaagaaatagttttcaatggcttcaatagtaacagaggagaactattatggccattgaaaacctggcggcagcgcaaaagatg

SEQ ID NO: 46287 - DNA, 103 bp, Artificial Sequence
  Synthetic Polynucleotide
taatacgactcactatagggggatccaagaaatagttttcaatggcttcaaacagaggagatgaagcatgtgaaaactaaacctggcggcagcgcaaaagatg

SEQ ID NO: 46288 - DNA, 103 bp, Artificial Sequence
  Synthetic Polynucleotide
taatacgactcactatagggtgttaggatccaagaaatagttttcaatggaacagaggagaccattgatgactatttctaacctggcggcagcgcaaaagatg

SEQ ID NO: 46289 - DNA, 103 bp, Artificial Sequence
  Synthetic Polynucleotide
taatacgactcactatagggctcattgttaggatccaagaaatagttttcaacagaggagagaaaacatgttcttggataacctggcggcagcgcaaaagatg

SEQ ID NO: 46290 - DNA, 103 bp, Artificial Sequence
  Synthetic Polynucleotide
taatacgactcactatagggataacctcattgttaggatccaagaaatagaacagaggagactatttatgggatcctaaaacctggcggcagcgcaaaagatg

SEQ ID NO: 46291 - DNA, 103 bp, Artificial Sequence
  Synthetic Polynucleotide
taatacgactcactataggggaggcataacctcattgttaggatccaagaaacagaggagatcttggatgctaacaatgaacctggcggcagcgcaaaagatg

SEQ ID NO: 46292 - DNA, 103 bp, Artificial Sequence
  Synthetic Polynucleotide
taatacgactcactatagggaataagaggcataacctcattgttaggatcaacagaggagagatcctatgaatgaggttaacctggcggcagcgcaaaagatg

SEQ ID NO: 46293 - DNA, 103 bp, Artificial Sequence
  Synthetic Polynucleotide
taatacgactcactatagggcgtgttcctataaaaatagaaactataatcaacagaggagagattatatgttctattttaacctggcggcagcgcaaaagatg

SEQ ID NO: 46294 - DNA, 103 bp, Artificial Sequence
  Synthetic Polynucleotide
taatacgactcactatagggttaataataagaggcataacctcattgttaaacagaggagataacaaatgggttatgccaacctggcggcagcgcaaaagatg

SEQ ID NO: 46295 - DNA, 103 bp, Artificial Sequence
  Synthetic Polynucleotide
taatacgactcactatagggtattattaataataagaggcataacctcataacagaggagaatgaggatgtgcctcttaaacctggcggcagcgcaaaagatg

SEQ ID NO: 46296 - DNA, 103 bp, Artificial Sequence
  Synthetic Polynucleotide
taatacgactcactatagggatccgtattattaataataagaggcataacaacagaggagagttatgatgcttattattaacctggcggcagcgcaaaagatg

SEQ ID NO: 46297 - DNA, 103 bp, Artificial Sequence
  Synthetic Polynucleotide
taatacgactcactataggggtcatatccgtattattaataataagaggcaacagaggagagcctctatgtattaataaaacctggcggcagcgcaaaagatg

SEQ ID NO: 46298 - DNA, 103 bp, Artificial Sequence
  Synthetic Polynucleotide
taatacgactcactatagggcggccgtcatatccgtattattaataataaaacagaggagattattaatgataatacggaacctggcggcagcgcaaaagatg

SEQ ID NO: 46299 - DNA, 103 bp, Artificial Sequence
  Synthetic Polynucleotide
taatacgactcactatagggaatgacggccgtcatatccgtattattaataacagaggagaattaatatgacggatatgaacctggcggcagcgcaaaagatg

SEQ ID NO: 46300 - DNA, 103 bp, Artificial Sequence
  Synthetic Polynucleotide
taatacgactcactatagggttaggaatgacggccgtcatatccgtattaaacagaggagataatacatgtatgacggcaacctggcggcagcgcaaaagatg

SEQ ID NO: 46301 - DNA, 103 bp, Artificial Sequence
  Synthetic Polynucleotide
taatacgactcactatagggtttttttaggaatgacggccgtcatatccgaacagaggagacggataatgcggccgtcaaacctggcggcagcgcaaaagatg

SEQ ID NO: 46302 - DNA, 103 bp, Artificial Sequence
  Synthetic Polynucleotide
taatacgactcactatagggaccactttttttaggaatgacggccgtcataacagaggagaatgacgatggtcattcctaacctggcggcagcgcaaaagatg

SEQ ID NO: 46303 - DNA, 103 bp, Artificial Sequence
  Synthetic Polynucleotide
taatacgactcactatagggctcctaccactttttttaggaatgacggccaacagaggagaggccgtatgtcctaaaaaaacctggcggcagcgcaaaagatg

SEQ ID NO: 46304 - DNA, 103 bp, Artificial Sequence
  Synthetic Polynucleotide
taatacgactcactatagggtcgtacgtgttcctataaaaatagaaactaaacagaggagatagtttatgtttttatagaacctggcggcagcgcaaaagatg

SEQ ID NO: 46305 - DNA, 103 bp, Artificial Sequence
  Synthetic Polynucleotide
taatacgactcactatagggtctttctcctaccactttttttaggaatgaaacagaggagatcattcatgaaaaaagtgaacctggcggcagcgcaaaagatg

SEQ ID NO: 46306 - DNA, 103 bp, Artificial Sequence
  Synthetic Polynucleotide
taatacgactcactatagggcttattctttctcctaccactttttttaggaacagaggagacctaaaatgagtggtaggaacctggcggcagcgcaaaagatg

SEQ ID NO: 46307 - DNA, 103 bp, Artificial Sequence
  Synthetic Polynucleotide
taatacgactcactatagggatgttcttattctttctcctaccactttttaacagaggagaaaaaagatgtaggagaaaaacctggcggcagcgcaaaagatg

SEQ ID NO: 46308 - DNA, 103 bp, Artificial Sequence
  Synthetic Polynucleotide
taatacgactcactatagggtaaccatgttcttattctttctcctaccacaacagaggagagtggtaatggaaagaataaacctggcggcagcgcaaaagatg

SEQ ID NO: 46309 - DNA, 103 bp, Artificial Sequence
  Synthetic Polynucleotide
taatacgactcactataggggaagataaccatgttcttattctttctcctaacagaggagaaggagaatgaataagaacaacctggcggcagcgcaaaagatg

SEQ ID NO: 46310 - DNA, 103 bp, Artificial Sequence
  Synthetic Polynucleotide
taatacgactcactatagggtgacggaagataaccatgttcttattctttaacagaggagaaaagaaatggaacatggtaacctggcggcagcgcaaaagatg

SEQ ID NO: 46311 - DNA, 103 bp, Artificial Sequence
  Synthetic Polynucleotide
taatacgactcactatagggatccttgacggaagataaccatgttcttataacagaggagaataagaatgtggttatctaacctggcggcagcgcaaaagatg

SEQ ID NO: 46312 - DNA, 103 bp, Artificial Sequence
  Synthetic Polynucleotide
taatacgactcactatagggtgatgatccttgacggaagataaccatgttaacagaggagaaacatgatgatcttccgtaacctggcggcagcgcaaaagatg

SEQ ID NO: 46313 - DNA, 103 bp, Artificial Sequence
  Synthetic Polynucleotide
taatacgactcactatagggataggtgatgatccttgacggaagataaccaacagaggagaggttatatgccgtcaaggaacctggcggcagcgcaaaagatg

SEQ ID NO: 46314 - DNA, 103 bp, Artificial Sequence
  Synthetic Polynucleotide
taatacgactcactatagggacaagataggtgatgatccttgacggaagaaacagaggagatcttccatgaaggatcataacctggcggcagcgcaaaagatg

SEQ ID NO: 46315 - DNA, 103 bp, Artificial Sequence
  Synthetic Polynucleotide
taatacgactcactatagggttttctcgtacgtgttcctataaaaatagaaacagaggagatctattatgataggaacaaacctggcggcagcgcaaaagatg

SEQ ID NO: 46316 - DNA, 103 bp, Artificial Sequence
  Synthetic Polynucleotide
taatacgactcactatagggaatacacaagataggtgatgatccttgacgaacagaggagacgtcaaatgtcatcacctaacctggcggcagcgcaaaagatg

SEQ ID NO: 46317 - DNA, 103 bp, Artificial Sequence
  Synthetic Polynucleotide
taatacgactcactatagggtcgaaaatacacaagataggtgatgatcctaacagaggagaaggatcatgacctatcttaacctggcggcagcgcaaaagatg

SEQ ID NO: 46318 - DNA, 103 bp, Artificial Sequence
  Synthetic Polynucleotide
taatacgactcactataggggagtttcgaaaatacacaagataggtgatgaacagaggagacatcacatgtcttgtgtaaacctggcggcagcgcaaaagatg

SEQ ID NO: 46319 - DNA, 103 bp, Artificial Sequence
  Synthetic Polynucleotide
taatacgactcactatagggtttacgagtttcgaaaatacacaagataggaacagaggagacctatcatgtgtattttcaacctggcggcagcgcaaaagatg

SEQ ID NO: 46320 - DNA, 103 bp, Artificial Sequence
  Synthetic Polynucleotide
taatacgactcactatagggatctttttacgagtttcgaaaatacacaagaacagaggagacttgtgatgtttcgaaacaacctggcggcagcgcaaaagatg

SEQ ID NO: 46321 - DNA, 103 bp, Artificial Sequence
  Synthetic Polynucleotide
taatacgactcactatagggtattaatctttttacgagtttcgaaaatacaacagaggagagtatttatgaaactcgtaaacctggcggcagcgcaaaagatg

SEQ ID NO: 46322 - DNA, 103 bp, Artificial Sequence
  Synthetic Polynucleotide
taatacgactcactatagggataaatattaatctttttacgagtttcgaaaacagaggagattcgaaatgcgtaaaaagaacctggcggcagcgcaaaagatg

SEQ ID NO: 46323 - DNA, 103 bp, Artificial Sequence
  Synthetic Polynucleotide
taatacgactcactatagggtctttataaatattaatctttttacgagttaacagaggagaaactcgatgaaagattaaaacctggcggcagcgcaaaagatg

SEQ ID NO: 46324 - DNA, 103 bp, Artificial Sequence
  Synthetic Polynucleotide
taatacgactcactatagggtattttctttataaatattaatctttttacaacagaggagagtaaaaatgttaatatttaacctggcggcagcgcaaaagatg

SEQ ID NO: 46325 - DNA, 103 bp, Artificial Sequence
  Synthetic Polynucleotide
taatacgactcactatagggttccatattttctttataaatattaatcttaacagaggagaaagattatgatttataaaaacctggcggcagcgcaaaagatg

SEQ ID NO: 46326 - DNA, 103 bp, Artificial Sequence
  Synthetic Polynucleotide
taatacgactcactatagggtttgattttctcgtacgtgttcctataaaaaacagaggagattttatatgaacacgtacaacctggcggcagcgcaaaagatg

SEQ ID NO: 46327 - DNA, 103 bp, Artificial Sequence
  Synthetic Polynucleotide
taatacgactcactataggggcggattccatattttctttataaatattaaacagaggagataatatatgtaaagaaaaaacctggcggcagcgcaaaagatg

SEQ ID NO: 46328 - DNA, 103 bp, Artificial Sequence
  Synthetic Polynucleotide
taatacgactcactatagggtcgatgcggattccatattttctttataaaaacagaggagatttataatgaaaatatggaacctggcggcagcgcaaaagatg

SEQ ID NO: 46329 - DNA, 103 bp, Artificial Sequence
  Synthetic Polynucleotide
taatacgactcactatagggctcagtcgatgcggattccatattttctttaacagaggagaaaagaaatgatggaatccaacctggcggcagcgcaaaagatg

SEQ ID NO: 46330 - DNA, 103 bp, Artificial Sequence
  Synthetic Polynucleotide
taatacgactcactataggggtatactcagtcgatgcggattccatatttaacagaggagaaaatatatgatccgcatcaacctggcggcagcgcaaaagatg

SEQ ID NO: 46331 - DNA, 103 bp, Artificial Sequence
  Synthetic Polynucleotide
taatacgactcactatagggtaggtgtatactcagtcgatgcggattccaaacagaggagatggaatatgcatcgactgaacctggcggcagcgcaaaagatg

SEQ ID NO: 46332 - DNA, 103 bp, Artificial Sequence
  Synthetic Polynucleotide
taatacgactcactatagggtccgataggtgtatactcagtcgatgcggaaacagaggagatccgcaatgactgagtataacctggcggcagcgcaaaagatg

SEQ ID NO: 46333 - DNA, 103 bp, Artificial Sequence
  Synthetic Polynucleotide
taatacgactcactatagggttgtctccgataggtgtatactcagtcgataacagaggagaatcgacatggtatacaccaacctggcggcagcgcaaaagatg

SEQ ID NO: 46334 - DNA, 103 bp, Artificial Sequence
  Synthetic Polynucleotide
taatacgactcactatagggccttgttgtctccgataggtgtatactcagaacagaggagactgagtatgcacctatcgaacctggcggcagcgcaaaagatg

SEQ ID NO: 46335 - DNA, 103 bp, Artificial Sequence
  Synthetic Polynucleotide
taatacgactcactatagggtaaagccttgttgtctccgataggtgtataaacagaggagatatacaatgatcggagacaacctggcggcagcgcaaaagatg

SEQ ID NO: 46336 - DNA, 103 bp, Artificial Sequence
  Synthetic Polynucleotide
taatacgactcactataggggatattaaagccttgttgtctccgataggtaacagaggagaacctatatgagacaacaaaacctggcggcagcgcaaaagatg

SEQ ID NO: 46337 - DNA, 103 bp, Artificial Sequence
  Synthetic Polynucleotide
taatacgactcactatagggagacatttgattttctcgtacgtgttcctaaacagaggagataggaaatggtacgagaaaacctggcggcagcgcaaaagatg

SEQ ID NO: 46338 - DNA, 103 bp, Artificial Sequence
  Synthetic Polynucleotide
taatacgactcactatagggatttagatattaaagccttgttgtctccgaaacagaggagatcggagatgacaaggcttaacctggcggcagcgcaaaagatg

SEQ ID NO: 46339 - DNA, 103 bp, Artificial Sequence
  Synthetic Polynucleotide
taatacgactcactatagggcgcatatttagatattaaagccttgttgtcaacagaggagagacaacatggctttaataaacctggcggcagcgcaaaagatg

SEQ ID NO: 46340 - DNA, 103 bp, Artificial Sequence
  Synthetic Polynucleotide
taatacgactcactatagggattcccgcatatttagatattaaagccttgaacagaggagacaaggcatgaatatctaaaacctggcggcagcgcaaaagatg

SEQ ID NO: 46341 - DNA, 103 bp, Artificial Sequence
  Synthetic Polynucleotide
taatacgactcactatagggcattaattcccgcatatttagatattaaagaacagaggagactttaaatgctaaatatgaacctggcggcagcgcaaaagatg

SEQ ID NO: 46342 - DNA, 103 bp, Artificial Sequence
  Synthetic Polynucleotide
taatacgactcactatagggcaggacattaattcccgcatatttagatataacagaggagaatatctatgtatgcgggaaacctggcggcagcgcaaaagatg

SEQ ID NO: 46343 - DNA, 103 bp, Artificial Sequence
  Synthetic Polynucleotide
taatacgactcactatagggacattcaggacattaattcccgcatatttaaacagaggagataaataatggggaattaaaacctggcggcagcgcaaaagatg

SEQ ID NO: 46344 - DNA, 103 bp, Artificial Sequence
  Synthetic Polynucleotide
taatacgactcactatagggaatacacattcaggacattaattcccgcataacagaggagaatgcggatgttaatgtccaacctggcggcagcgcaaaagatg

SEQ ID NO: 46345 - DNA, 103 bp, Artificial Sequence
  Synthetic Polynucleotide
taatacgactcactatagggaggagaatacacattcaggacattaattccaacagaggagaggaattatggtcctgaataacctggcggcagcgcaaaagatg

SEQ ID NO: 46346 - DNA, 103 bp, Artificial Sequence
  Synthetic Polynucleotide
taatacgactcactataggggtggaaggagaatacacattcaggacattaaacagaggagataatgtatggaatgtgtaaacctggcggcagcgcaaaagatg

SEQ ID NO: 46347 - DNA, 103 bp, Artificial Sequence
  Synthetic Polynucleotide
taatacgactcactatagggtggatgtggaaggagaatacacattcaggaaacagaggagatcctgaatgtgtattctcaacctggcggcagcgcaaaagatg

SEQ ID NO: 46348 - DNA, 103 bp, Artificial Sequence
  Synthetic Polynucleotide
taatacgactcactataggggcagacgtcagacattgtctgactgaatacaacagaggagagtattcatgcagacaatgaacctggcggcagcgcaaaagatg

SEQ ID NO: 46349 - DNA, 103 bp, Artificial Sequence
  Synthetic Polynucleotide
taatacgactcactatagggaacttagacatttgattttctcgtacgtgtaacagaggagaacacgtatgagaaaatcaaacctggcggcagcgcaaaagatg

SEQ ID NO: 46350 - DNA, 103 bp, Artificial Sequence
  Synthetic Polynucleotide
taatacgactcactatagggtctcatggatgtggaaggagaatacacattaacagaggagaaatgtgatgtctccttccaacctggcggcagcgcaaaagatg

SEQ ID NO: 46351 - DNA, 103 bp, Artificial Sequence
  Synthetic Polynucleotide
taatacgactcactatagggttcaatctcatggatgtggaaggagaatacaacagaggagagtattcatgttccacatcaacctggcggcagcgcaaaagatg

SEQ ID NO: 46352 - DNA, 103 bp, Artificial Sequence
  Synthetic Polynucleotide
taatacgactcactatagggtggcattcaatctcatggatgtggaaggagaacagaggagactccttatgcatccatgaaacctggcggcagcgcaaaagatg

SEQ ID NO: 46353 - DNA, 103 bp, Artificial Sequence
  Synthetic Polynucleotide
taatacgactcactataggggtaaatggcattcaatctcatggatgtggaaacagaggagatccacaatgatgagattgaacctggcggcagcgcaaaagatg

SEQ ID NO: 46354 - DNA, 103 bp, Artificial Sequence
  Synthetic Polynucleotide
taatacgactcactatagggaatccgtaaatggcattcaatctcatggataacagaggagaatccatatgattgaatgcaacctggcggcagcgcaaaagatg

SEQ ID NO: 46355 - DNA, 103 bp, Artificial Sequence
  Synthetic Polynucleotide
taatacgactcactatagggtggtgaatccgtaaatggcattcaatctcaaacagaggagatgagatatgatgccatttaacctggcggcagcgcaaaagatg

SEQ ID NO: 46356 - DNA, 103 bp, Artificial Sequence
  Synthetic Polynucleotide
taatacgactcactatagggtttattggtgaatccgtaaatggcattcaaaacagaggagattgaatatgatttacggaaacctggcggcagcgcaaaagatg

SEQ ID NO: 46357 - DNA, 103 bp, Artificial Sequence
  Synthetic Polynucleotide
taatacgactcactatagggttatttttattggtgaatccgtaaatggcaaacagaggagatgccatatgcggattcacaacctggcggcagcgcaaaagatg

SEQ ID NO: 46358 - DNA, 103 bp, Artificial Sequence
  Synthetic Polynucleotide
taatacgactcactatagggctagtttatttttattggtgaatccgtaaaaacagaggagatttacgatgtcaccaataaacctggcggcagcgcaaaagatg

SEQ ID NO: 46359 - DNA, 103 bp, Artificial Sequence
  Synthetic Polynucleotide
taatacgactcactatagggtttttctagtttatttttattggtgaatccaacagaggagaggattcatgaataaaaataacctggcggcagcgcaaaagatg

SEQ ID NO: 46360 - DNA, 103 bp, Artificial Sequence
  Synthetic Polynucleotide
taatacgactcactataggggttagaacttagacatttgattttctcgtaaacagaggagatacgagatgatcaaatgtaacctggcggcagcgcaaaagatg

SEQ ID NO: 46361 - DNA, 103 bp, Artificial Sequence
  Synthetic Polynucleotide
taatacgactcactatagggctaagtttttctagtttatttttattggtgaacagaggagacaccaaatgaaataaactaacctggcggcagcgcaaaagatg

SEQ ID NO: 46362 - DNA, 103 bp, Artificial Sequence
  Synthetic Polynucleotide
taatacgactcactatagggtagtactaagtttttctagtttatttttataacagaggagaataaaaatgaactagaaaaacctggcggcagcgcaaaagatg

SEQ ID NO: 46363 - DNA, 103 bp, Artificial Sequence
  Synthetic Polynucleotide
taatacgactcactatagggcttattagtactaagtttttctagtttattaacagaggagaaataaaatggaaaaacttaacctggcggcagcgcaaaagatg

SEQ ID NO: 46364 - DNA, 103 bp, Artificial Sequence
  Synthetic Polynucleotide
taatacgactcactatagggagttccttattagtactaagtttttctagtaacagaggagaactagaatgacttagtacaacctggcggcagcgcaaaagatg

SEQ ID NO: 46365 - DNA, 103 bp, Artificial Sequence
  Synthetic Polynucleotide
taatacgactcactatagggattctagttccttattagtactaagtttttaacagaggagaaaaaacatggtactaataaacctggcggcagcgcaaaagatg

SEQ ID NO: 46366 - DNA, 103 bp, Artificial Sequence
  Synthetic Polynucleotide
taatacgactcactatagggatacaattctagttccttattagtactaagaacagaggagacttagtatgaataaggaaaacctggcggcagcgcaaaagatg

SEQ ID NO: 46367 - DNA, 103 bp, Artificial Sequence
  Synthetic Polynucleotide
taatacgactcactataggggaactatacaattctagttccttattagtaaacagaggagatactaaatgggaactagaaacctggcggcagcgcaaaagatg

SEQ ID NO: 46368 - DNA, 103 bp, Artificial Sequence
  Synthetic Polynucleotide
taatacgactcactatagggggctagaactatacaattctagttccttataacagaggagaataaggatgtagaattgtaacctggcggcagcgcaaaagatg

SEQ ID NO: 46369 - DNA, 103 bp, Artificial Sequence
  Synthetic Polynucleotide
taatacgactcactatagggaagagggctagaactatacaattctagttcaacagaggagagaactaatgttgtatagtaacctggcggcagcgcaaaagatg

SEQ ID NO: 46370 - DNA, 103 bp, Artificial Sequence
  Synthetic Polynucleotide
taatacgactcactatagggtcttgaagagggctagaactatacaattctaacagaggagaagaattatgtagttctagaacctggcggcagcgcaaaagatg

SEQ ID NO: 46371 - DNA, 103 bp, Artificial Sequence
  Synthetic Polynucleotide
taatacgactcactatagggctaccgttagaacttagacatttgattttcaacagaggagagaaaatatgatgtctaagaacctggcggcagcgcaaaagatg

SEQ ID NO: 46372 - DNA, 103 bp, Artificial Sequence
  Synthetic Polynucleotide
taatacgactcactatagggtgggttcttgaagagggctagaactatacaaacagaggagatgtataatgctagccctcaacctggcggcagcgcaaaagatg

SEQ ID NO: 46373 - DNA, 103 bp, Artificial Sequence
  Synthetic Polynucleotide
taatacgactcactatagggcctaatgggttcttgaagagggctagaactaacagaggagaagttctatgcctcttcaaaacctggcggcagcgcaaaagatg

SEQ ID NO: 46374 - DNA, 103 bp, Artificial Sequence
  Synthetic Polynucleotide
taatacgactcactatagggtttaacctaatgggttcttgaagagggctaaacagaggagatagcccatgtcaagaaccaacctggcggcagcgcaaaagatg

SEQ ID NO: 46375 - DNA, 103 bp, Artificial Sequence
  Synthetic Polynucleotide
taatacgactcactatagggaatcatttaacctaatgggttcttgaagagaacagaggagactcttcatgaacccattaaacctggcggcagcgcaaaagatg

SEQ ID NO: 46376 - DNA, 103 bp, Artificial Sequence
  Synthetic Polynucleotide
taatacgactcactatagggcagaaaatcatttaacctaatgggttcttgaacagaggagacaagaaatgattaggttaaacctggcggcagcgcaaaagatg

SEQ ID NO: 46377 - DNA, 103 bp, Artificial Sequence
  Synthetic Polynucleotide
taatacgactcactatagggagtcccagaaaatcatttaacctaatgggtaacagaggagaacccatatggttaaatgaaacctggcggcagcgcaaaagatg

SEQ ID NO: 46378 - DNA, 103 bp, Artificial Sequence
  Synthetic Polynucleotide
taatacgactcactatagggccaatagtcccagaaaatcatttaacctaaaacagaggagattaggtatgatgattttcaacctggcggcagcgcaaaagatg

SEQ ID NO: 46379 - DNA, 103 bp, Artificial Sequence
  Synthetic Polynucleotide
taatacgactcactatagggacattccaatagtcccagaaaatcatttaaaacagaggagattaaatatgtttctgggaaacctggcggcagcgcaaaagatg

SEQ ID NO: 46380 - DNA, 103 bp, Artificial Sequence
  Synthetic Polynucleotide
taatacgactcactatagggttaacacattccaatagtcccagaaaatcaaacagaggagatgatttatggggactattaacctggcggcagcgcaaaagatg

SEQ ID NO: 46381 - DNA, 103 bp, Artificial Sequence
  Synthetic Polynucleotide
taatacgactcactatagggtctttttaacacattccaatagtcccagaaaacagaggagattctggatgtattggaataacctggcggcagcgcaaaagatg

SEQ ID NO: 46382 - DNA, 103 bp, Artificial Sequence
  Synthetic Polynucleotide
taatacgactcactatagggcaacactaccgttagaacttagacatttgaaacagaggagatcaaatatgtaagttctaaacctggcggcagcgcaaaagatg

SEQ ID NO: 46383 - DNA, 103 bp, Artificial Sequence
  Synthetic Polynucleotide
taatacgactcactatagggaatattctttttaacacattccaatagtccaacagaggagaggactaatggaatgtgttaacctggcggcagcgcaaaagatg

SEQ ID NO: 46384 - DNA, 103 bp, Artificial Sequence
  Synthetic Polynucleotide
taatacgactcactatagggagaggaatattctttttaacacattccaataacagaggagaattggaatgtgttaaaaaaacctggcggcagcgcaaaagatg

SEQ ID NO: 46385 - DNA, 103 bp, Artificial Sequence
  Synthetic Polynucleotide
taatacgactcactatagggctgttagaggaatattctttttaacacattaacagaggagaaatgtgatgaaaagaataaacctggcggcagcgcaaaagatg

SEQ ID NO: 46386 - DNA, 103 bp, Artificial Sequence
  Synthetic Polynucleotide
taatacgactcactatagggaatatctgttagaggaatattctttttaacaacagaggagagttaaaatgaatattcctaacctggcggcagcgcaaaagatg

SEQ ID NO: 46387 - DNA, 103 bp, Artificial Sequence
  Synthetic Polynucleotide
taatacgactcactataggggtcggaatatctgttagaggaatattctttaacagaggagaaaagaaatgtcctctaacaacctggcggcagcgcaaaagatg

SEQ ID NO: 46388 - DNA, 103 bp, Artificial Sequence
  Synthetic Polynucleotide
taatacgactcactatagggcctttgtcggaatatctgttagaggaatataacagaggagaatattcatgtaacagataaacctggcggcagcgcaaaagatg

SEQ ID NO: 46389 - DNA, 103 bp, Artificial Sequence
  Synthetic Polynucleotide
taatacgactcactatagggtcaatcctttgtcggaatatctgttagaggaacagaggagacctctaatggatattccgaacctggcggcagcgcaaaagatg

SEQ ID NO: 46390 - DNA, 103 bp, Artificial Sequence
  Synthetic Polynucleotide
taatacgactcactatagggagtaatcaatcctttgtcggaatatctgttaacagaggagaaacagaatgtccgacaaaaacctggcggcagcgcaaaagatg

SEQ ID NO: 46391 - DNA, 103 bp, Artificial Sequence
  Synthetic Polynucleotide
taatacgactcactatagggtttatagtaatcaatcctttgtcggaatataacagaggagaatattcatgcaaaggattaacctggcggcagcgcaaaagatg

SEQ ID NO: 46392 - DNA, 103 bp, Artificial Sequence
  Synthetic Polynucleotide
taatacgactcactatagggctccatttatagtaatcaatcctttgtcggaacagaggagaccgacaatggattgattaaacctggcggcagcgcaaaagatg

SEQ ID NO: 46393 - DNA, 103 bp, Artificial Sequence
  Synthetic Polynucleotide
taatacgactcactatagggtttatcaacactaccgttagaacttagacaaacagaggagatgtctaatgtctaacggtaacctggcggcagcgcaaaagatg

SEQ ID NO: 46394 - DNA, 103 bp, Artificial Sequence
  Synthetic Polynucleotide
taatacgactcactatagggacattctccatttatagtaatcaatcctttaacagaggagaaaaggaatgattactataaacctggcggcagcgcaaaagatg

SEQ ID NO: 46395 - DNA, 103 bp, Artificial Sequence
  Synthetic Polynucleotide
taatacgactcactatagggtaggaacattctccatttatagtaatcaataacagaggagaattgatatgtataaatggaacctggcggcagcgcaaaagatg

SEQ ID NO: 46396 - DNA, 103 bp, Artificial Sequence
  Synthetic Polynucleotide
taatacgactcactatagggtacattaggaacattctccatttatagtaaaacagaggagattactaatgatggagaataacctggcggcagcgcaaaagatg

SEQ ID NO: 46397 - DNA, 103 bp, Artificial Sequence
  Synthetic Polynucleotide
taatacgactcactatagggaagtatacattaggaacattctccatttataacagaggagaataaatatggaatgttccaacctggcggcagcgcaaaagatg

SEQ ID NO: 46398 - DNA, 103 bp, Artificial Sequence
  Synthetic Polynucleotide
taatacgactcactataggggattaaagtatacattaggaacattctccaaacagaggagatggagaatgttcctaatgaacctggcggcagcgcaaaagatg

SEQ ID NO: 46399 - DNA, 103 bp, Artificial Sequence
  Synthetic Polynucleotide
taatacgactcactatagggcacaggattaaagtatacattaggaacattaacagaggagaaatgttatgaatgtatacaacctggcggcagcgcaaaagatg

SEQ ID NO: 46400 - DNA, 103 bp, Artificial Sequence
  Synthetic Polynucleotide
taatacgactcactatagggataaacacaggattaaagtatacattaggaaacagaggagatcctaaatgatactttaaaacctggcggcagcgcaaaagatg

SEQ ID NO: 46401 - DNA, 103 bp, Artificial Sequence
  Synthetic Polynucleotide
taatacgactcactataggggctctataaacacaggattaaagtatacataacagaggagaatgtatatgttaatcctgaacctggcggcagcgcaaaagatg

SEQ ID NO: 46402 - DNA, 103 bp, Artificial Sequence
  Synthetic Polynucleotide
taatacgactcactatagggcgtgggctctataaacacaggattaaagtaaacagaggagatactttatgcctgtgtttaacctggcggcagcgcaaaagatg

SEQ ID NO: 46403 - DNA, 103 bp, Artificial Sequence
  Synthetic Polynucleotide
taatacgactcactatagggttaaacgtgggctctataaacacaggattaaacagaggagataatccatggtttatagaaacctggcggcagcgcaaaagatg

SEQ ID NO: 46404 - DNA, 103 bp, Artificial Sequence
  Synthetic Polynucleotide
taatacgactcactatagggaatcgtttatcaacactaccgttagaacttaacagaggagaaagttcatgcggtagtgtaacctggcggcagcgcaaaagatg

SEQ ID NO: 46405 - DNA, 103 bp, Artificial Sequence
  Synthetic Polynucleotide
taatacgactcactatagggaatgtttaaacgtgggctctataaacacagaacagaggagactgtgtatgtagagcccaaacctggcggcagcgcaaaagatg

SEQ ID NO: 46406 - DNA, 103 bp, Artificial Sequence
  Synthetic Polynucleotide
taatacgactcactatagggtaaagaatgtttaaacgtgggctctataaaaacagaggagatttataatgcccacgtttaacctggcggcagcgcaaaagatg

SEQ ID NO: 46407 - DNA, 103 bp, Artificial Sequence
  Synthetic Polynucleotide
taatacgactcactatagggcttaataaagaatgtttaaacgtgggctctaacagaggagaagagccatggtttaaacaaacctggcggcagcgcaaaagatg

SEQ ID NO: 46408 - DNA, 103 bp, Artificial Sequence
  Synthetic Polynucleotide
taatacgactcactatagggaaacacttaataaagaatgtttaaacgtggaacagaggagaccacgtatgaacattcttaacctggcggcagcgcaaaagatg

SEQ ID NO: 46409 - DNA, 103 bp, Artificial Sequence
  Synthetic Polynucleotide
taatacgactcactatagggtttataaacacttaataaagaatgtttaaaaacagaggagatttaaaatgtctttattaaacctggcggcagcgcaaaagatg

SEQ ID NO: 46410 - DNA, 103 bp, Artificial Sequence
  Synthetic Polynucleotide
taatacgactcactatagggctgtgtttataaacacttaataaagaatgtaacagaggagaacattcatgattaagtgtaacctggcggcagcgcaaaagatg

SEQ ID NO: 46411 - DNA, 103 bp, Artificial Sequence
  Synthetic Polynucleotide
taatacgactcactatagggttaatctgtgtttataaacacttaataaagaacagaggagactttatatggtgtttataaacctggcggcagcgcaaaagatg

SEQ ID NO: 46412 - DNA, 103 bp, Artificial Sequence
  Synthetic Polynucleotide
taatacgactcactatagggaactattaatctgtgtttataaacacttaaaacagaggagattaagtatgtataaacacaacctggcggcagcgcaaaagatg

SEQ ID NO: 46413 - DNA, 103 bp, Artificial Sequence
  Synthetic Polynucleotide
taatacgactcactatagggaataaaactattaatctgtgtttataaacaaacagaggagatgtttaatgacacagattaacctggcggcagcgcaaaagatg

SEQ ID NO: 46414 - DNA, 103 bp, Artificial Sequence
  Synthetic Polynucleotide
taatacgactcactatagggcttcaaataaaactattaatctgtgtttataacagaggagaataaacatggattaatagaacctggcggcagcgcaaaagatg

SEQ ID NO: 46415 - DNA, 103 bp, Artificial Sequence
  Synthetic Polynucleotide
taatacgactcactatagggataacaatcgtttatcaacactaccgttagaacagaggagactaacgatggtgttgataaacctggcggcagcgcaaaagatg

SEQ ID NO: 46416 - DNA, 103 bp, Artificial Sequence
  Synthetic Polynucleotide
taatacgactcactatagggaaatacttcaaataaaactattaatctgtgaacagaggagacacagaatgatagttttaaacctggcggcagcgcaaaagatg

SEQ ID NO: 46417 - DNA, 103 bp, Artificial Sequence
  Synthetic Polynucleotide
taatacgactcactatagggacaacaaatacttcaaataaaactattaataacagaggagaattaatatgtttatttgaaacctggcggcagcgcaaaagatg

SEQ ID NO: 46418 - DNA, 103 bp, Artificial Sequence
  Synthetic Polynucleotide
taatacgactcactatagggtgaatacaacaaatacttcaaataaaactaaacagaggagatagtttatgttgaagtataacctggcggcagcgcaaaagatg

SEQ ID NO: 46419 - DNA, 103 bp, Artificial Sequence
  Synthetic Polynucleotide
taatacgactcactatagggtagaatgaatacaacaaatacttcaaataaaacagaggagattatttatggtatttgttaacctggcggcagcgcaaaagatg

SEQ ID NO: 46420 - DNA, 103 bp, Artificial Sequence
  Synthetic Polynucleotide
taatacgactcactatagggtatattagaatgaatacaacaaatacttcaaacagaggagatgaagtatgtgttgtattaacctggcggcagcgcaaaagatg

SEQ ID NO: 46421 - DNA, 103 bp, Artificial Sequence
  Synthetic Polynucleotide
taatacgactcactatagggatacatatattagaatgaatacaacaaataaacagaggagatatttgatgtattcattcaacctggcggcagcgcaaaagatg

SEQ ID NO: 46422 - DNA, 103 bp, Artificial Sequence
  Synthetic Polynucleotide
taatacgactcactatagggaaaaaatacatatattagaatgaatacaacaacagaggagagttgtaatgattctaataaacctggcggcagcgcaaaagatg

SEQ ID NO: 46423 - DNA, 103 bp, Artificial Sequence
  Synthetic Polynucleotide
taatacgactcactataggggatctaaaaaatacatatattagaatgaataacagaggagaattcatatgaatatatgtaacctggcggcagcgcaaaagatg

SEQ ID NO: 46424 - DNA, 103 bp, Artificial Sequence
  Synthetic Polynucleotide
taatacgactcactatagggattcagatctaaaaaatacatatattagaaaacagaggagattctaaatgatgtattttaacctggcggcagcgcaaaagatg

SEQ ID NO: 46425 - DNA, 103 bp, Artificial Sequence
  Synthetic Polynucleotide
taatacgactcactatagggatttaattcagatctaaaaaatacatatataacagaggagaatatatatgttttttagaaacctggcggcagcgcaaaagatg

SEQ ID NO: 46426 - DNA, 103 bp, Artificial Sequence
  Synthetic Polynucleotide
taatacgactcactatagggcgtggataacaatcgtttatcaacactaccaacagaggagaggtagtatggataaacgaaacctggcggcagcgcaaaagatg

SEQ ID NO: 46427 - DNA, 103 bp, Artificial Sequence
  Synthetic Polynucleotide
taatacgactcactatagggaacatatttaattcagatctaaaaaatacaaacagaggagatgtattatgtagatctgaaacctggcggcagcgcaaaagatg

SEQ ID NO: 46428 - DNA, 103 bp, Artificial Sequence
  Synthetic Polynucleotide
taatacgactcactatagggtgaagaacatatttaattcagatctaaaaaaacagaggagatttttaatgctgaattaaaacctggcggcagcgcaaaagatg

SEQ ID NO: 46429 - DNA, 103 bp, Artificial Sequence
  Synthetic Polynucleotide
taatacgactcactatagggatgcatgaagaacatatttaattcagatctaacagaggagaagatctatgttaaatatgaacctggcggcagcgcaaaagatg

SEQ ID NO: 46430 - DNA, 103 bp, Artificial Sequence
  Synthetic Polynucleotide
taatacgactcactatagggcgtttatgcatgaagaacatatttaattcaaacagaggagatgaattatgtatgttcttaacctggcggcagcgcaaaagatg

SEQ ID NO: 46431 - DNA, 103 bp, Artificial Sequence
  Synthetic Polynucleotide
taatacgactcactatagggtttttcgtttatgcatgaagaacatatttaaacagaggagataaataatgtcttcatgcaacctggcggcagcgcaaaagatg

SEQ ID NO: 46432 - DNA, 103 bp, Artificial Sequence
  Synthetic Polynucleotide
taatacgactcactataggggggtatttttcgtttatgcatgaagaacataacagaggagaatgttcatgatgcataaaaacctggcggcagcgcaaaagatg

SEQ ID NO: 46433 - DNA, 103 bp, Artificial Sequence
  Synthetic Polynucleotide
taatacgactcactatagggggatcgggtatttttcgtttatgcatgaagaacagaggagacttcatatgtaaacgaaaaacctggcggcagcgcaaaagatg

SEQ ID NO: 46434 - DNA, 103 bp, Artificial Sequence
  Synthetic Polynucleotide
taatacgactcactatagggcaataggatcgggtatttttcgtttatgcaaacagaggagatgcataatggaaaaatacaacctggcggcagcgcaaaagatg

SEQ ID NO: 46435 - DNA, 103 bp, Artificial Sequence
  Synthetic Polynucleotide
taatacgactcactatagggtctatcaataggatcgggtatttttcgtttaacagaggagaaaacgaatgatacccgataacctggcggcagcgcaaaagatg

SEQ ID NO: 46436 - DNA, 103 bp, Artificial Sequence
  Synthetic Polynucleotide
taatacgactcactatagggcgtaatctatcaataggatcgggtatttttaacagaggagaaaaaatatgcgatcctataacctggcggcagcgcaaaagatg

SEQ ID NO: 46437 - DNA, 103 bp, Artificial Sequence
  Synthetic Polynucleotide
taatacgactcactataggggtatccgtggataacaatcgtttatcaacaaacagaggagatgttgaatgacgattgttaacctggcggcagcgcaaaagatg

SEQ ID NO: 46438 - DNA, 103 bp, Artificial Sequence
  Synthetic Polynucleotide
taatacgactcactatagggcacgtcgtaatctatcaataggatcgggtaaacagaggagatacccgatgctattgataaacctggcggcagcgcaaaagatg

SEQ ID NO: 46439 - DNA, 103 bp, Artificial Sequence
  Synthetic Polynucleotide
taatacgactcactatagggattagcacgtcgtaatctatcaataggatcaacagaggagagatcctatggatagattaaacctggcggcagcgcaaaagatg

SEQ ID NO: 46440 - DNA, 103 bp, Artificial Sequence
  Synthetic Polynucleotide
taatacgactcactataggggctagattagcacgtcgtaatctatcaataaacagaggagatattgaatgattacgacgaacctggcggcagcgcaaaagatg

SEQ ID NO: 46441 - DNA, 103 bp, Artificial Sequence
  Synthetic Polynucleotide
taatacgactcactatagggcacacgctagattagcacgtcgtaatctataacagaggagaatagatatggacgtgctaaacctggcggcagcgcaaaagatg

SEQ ID NO: 46442 - DNA, 103 bp, Artificial Sequence
  Synthetic Polynucleotide
taatacgactcactataggggtcttcacacgctagattagcacgtcgtaaaacagaggagattacgaatggctaatctaaacctggcggcagcgcaaaagatg

SEQ ID NO: 46443 - DNA, 103 bp, Artificial Sequence
  Synthetic Polynucleotide
taatacgactcactatagggttatcgtcttcacacgctagattagcacgtaacagaggagaacgtgcatgtctagcgtgaacctggcggcagcgcaaaagatg

SEQ ID NO: 46444 - DNA, 103 bp, Artificial Sequence
  Synthetic Polynucleotide
taatacgactcactatagggttaatttatcgtcttcacacgctagattagaacagaggagactaatcatgcgtgtgaagaacctggcggcagcgcaaaagatg

SEQ ID NO: 46445 - DNA, 103 bp, Artificial Sequence
  Synthetic Polynucleotide
taatacgactcactataggggatcattaatttatcgtcttcacacgctagaacagaggagactagcgatggaagacgataacctggcggcagcgcaaaagatg

SEQ ID NO: 46446 - DNA, 103 bp, Artificial Sequence
  Synthetic Polynucleotide
taatacgactcactatagggccatagatcattaatttatcgtcttcacacaacagaggagagtgtgaatgcgataaattaacctggcggcagcgcaaaagatg

SEQ ID NO: 46447 - DNA, 103 bp, Artificial Sequence
  Synthetic Polynucleotide
taatacgactcactataggggtaatccatagatcattaatttatcgtcttaacagaggagaaagacgatgaattaatgaaacctggcggcagcgcaaaagatg

SEQ ID NO: 46448 - DNA, 103 bp, Artificial Sequence
  Synthetic Polynucleotide
taatacgactcactatagggatgaggtatccgtggataacaatcgtttataacagaggagaataaacatgtgttatccaaacctggcggcagcgcaaaagatg

SEQ ID NO: 46449 - DNA, 103 bp, Artificial Sequence
  Synthetic Polynucleotide
taatacgactcactatagggccatggtaatccatagatcattaatttatcaacagaggagagataaaatgatgatctataacctggcggcagcgcaaaagatg

SEQ ID NO: 46450 - DNA, 103 bp, Artificial Sequence
  Synthetic Polynucleotide
taatacgactcactataggggttatccatggtaatccatagatcattaataacagaggagaattaatatgctatggattaacctggcggcagcgcaaaagatg

SEQ ID NO: 46451 - DNA, 103 bp, Artificial Sequence
  Synthetic Polynucleotide
taatacgactcactataggggagttgttatccatggtaatccatagatcaaacagaggagatgatctatggattaccataacctggcggcagcgcaaaagatg

SEQ ID NO: 46452 - DNA, 103 bp, Artificial Sequence
  Synthetic Polynucleotide
taatacgactcactatagggtgtttgagttgttatccatggtaatccataaacagaggagatatggaatgccatggataaacctggcggcagcgcaaaagatg

SEQ ID NO: 46453 - DNA, 103 bp, Artificial Sequence
  Synthetic Polynucleotide
taatacgactcactataggggcagatgtttgagttgttatccatggtaataacagaggagaattaccatggataacaacaacctggcggcagcgcaaaagatg

SEQ ID NO: 46454 - DNA, 103 bp, Artificial Sequence
  Synthetic Polynucleotide
taatacgactcactatagggataatgcagatgtttgagttgttatccatgaacagaggagacatggaatgcaactcaaaaacctggcggcagcgcaaaagatg

SEQ ID NO: 46455 - DNA, 103 bp, Artificial Sequence
  Synthetic Polynucleotide
taatacgactcactatagggtattgataatgcagatgtttgagttgttataacagaggagaataacaatgcaaacatctaacctggcggcagcgcaaaagatg

SEQ ID NO: 46456 - DNA, 103 bp, Artificial Sequence
  Synthetic Polynucleotide
taatacgactcactatagggctatttattgataatgcagatgtttgagttaacagaggagaaactcaatgatctgcattaacctggcggcagcgcaaaagatg

SEQ ID NO: 46457 - DNA, 103 bp, Artificial Sequence
  Synthetic Polynucleotide
taatacgactcactataggggtttactatttattgataatgcagatgtttaacagaggagaaaacatatgcattatcaaaacctggcggcagcgcaaaagatg

SEQ ID NO: 46458 - DNA, 103 bp, Artificial Sequence
  Synthetic Polynucleotide
taatacgactcactatagggtatcggtttactatttattgataatgcagaaacagaggagatctgcaatgtcaataaataacctggcggcagcgcaaaagatg

SEQ ID NO: 46459 - DNA, 103 bp, Artificial Sequence
  Synthetic Polynucleotide
taatacgactcactatagggccgtggcagacgtcagacattgtctgactgaacagaggagacagtcaatgaatgtctgaaacctggcggcagcgcaaaagatg

SEQ ID NO: 46460 - DNA, 103 bp, Artificial Sequence
  Synthetic Polynucleotide
taatacgactcactataggggataaatgaggtatccgtggataacaatcgaacagaggagacgattgatgtccacggataacctggcggcagcgcaaaagatg

SEQ ID NO: 46461 - DNA, 103 bp, Artificial Sequence
  Synthetic Polynucleotide
taatacgactcactatagggtacactatcggtttactatttattgataataacagaggagaattatcatgaaatagtaaaacctggcggcagcgcaaaagatg

SEQ ID NO: 46462 - DNA, 103 bp, Artificial Sequence
  Synthetic Polynucleotide
taatacgactcactatagggctttatacactatcggtttactatttattgaacagaggagacaataaatggtaaaccgaaacctggcggcagcgcaaaagatg

SEQ ID NO: 46463 - DNA, 103 bp, Artificial Sequence
  Synthetic Polynucleotide
taatacgactcactatagggacaatctttatacactatcggtttactattaacagaggagaaatagtatgccgatagtgaacctggcggcagcgcaaaagatg

SEQ ID NO: 46464 - DNA, 103 bp, Artificial Sequence
  Synthetic Polynucleotide
taatacgactcactatagggtttgcacaatctttatacactatcggtttaaacagaggagataaaccatgagtgtataaaacctggcggcagcgcaaaagatg

SEQ ID NO: 46465 - DNA, 103 bp, Artificial Sequence
  Synthetic Polynucleotide
taatacgactcactatagggaaagctttgcacaatctttatacactatcgaacagaggagacgatagatgataaagattaacctggcggcagcgcaaaagatg

SEQ ID NO: 46466 - DNA, 103 bp, Artificial Sequence
  Synthetic Polynucleotide
taatacgactcactatagggtcgcaaaagctttgcacaatctttatacacaacagaggagagtgtatatggattgtgcaaacctggcggcagcgcaaaagatg

SEQ ID NO: 46467 - DNA, 103 bp, Artificial Sequence
  Synthetic Polynucleotide
taatacgactcactatagggattgatcgcaaaagctttgcacaatctttaaacagaggagataaagaatgtgcaaagctaacctggcggcagcgcaaaagatg

SEQ ID NO: 46468 - DNA, 103 bp, Artificial Sequence
  Synthetic Polynucleotide
taatacgactcactatagggcatttattgatcgcaaaagctttgcacaataacagaggagaattgtgatgagcttttgcaacctggcggcagcgcaaaagatg

SEQ ID NO: 46469 - DNA, 103 bp, Artificial Sequence
  Synthetic Polynucleotide
taatacgactcactatagggtgatccatttattgatcgcaaaagctttgcaacagaggagagcaaagatgttgcgatcaaacctggcggcagcgcaaaagatg

SEQ ID NO: 46470 - DNA, 103 bp, Artificial Sequence
  Synthetic Polynucleotide
taatacgactcactatagggggttgtgatccatttattgatcgcaaaagcaacagaggagagcttttatgatcaataaaaacctggcggcagcgcaaaagatg

SEQ ID NO: 46471 - DNA, 103 bp, Artificial Sequence
  Synthetic Polynucleotide
taatacgactcactatagggaacatgataaatgaggtatccgtggataacaacagaggagagttatcatgggatacctcaacctggcggcagcgcaaaagatg

SEQ ID NO: 46472 - DNA, 103 bp, Artificial Sequence
  Synthetic Polynucleotide
taatacgactcactatagggatactggttgtgatccatttattgatcgcaaacagaggagatgcgatatgtaaatggataacctggcggcagcgcaaaagatg

SEQ ID NO: 46473 - DNA, 103 bp, Artificial Sequence
  Synthetic Polynucleotide
taatacgactcactatagggaagagatactggttgtgatccatttattgaaacagaggagatcaataatgggatcacaaaacctggcggcagcgcaaaagatg

SEQ ID NO: 46474 - DNA, 103 bp, Artificial Sequence
  Synthetic Polynucleotide
taatacgactcactatagggtcgttaagagatactggttgtgatccatttaacagaggagaaaatggatgacaaccagtaacctggcggcagcgcaaaagatg

SEQ ID NO: 46475 - DNA, 103 bp, Artificial Sequence
  Synthetic Polynucleotide
taatacgactcactataggggaacatcgttaagagatactggttgtgatcaacagaggagagatcacatgcagtatctcaacctggcggcagcgcaaaagatg

SEQ ID NO: 46476 - DNA, 103 bp, Artificial Sequence
  Synthetic Polynucleotide
taatacgactcactataggggcgaagaacatcgttaagagatactggttgaacagaggagacaaccaatgtctcttaacaacctggcggcagcgcaaaagatg

SEQ ID NO: 46477 - DNA, 103 bp, Artificial Sequence
  Synthetic Polynucleotide
taatacgactcactatagggcatctgcgaagaacatcgttaagagatactaacagaggagaagtatcatgtaacgatgtaacctggcggcagcgcaaaagatg

SEQ ID NO: 46478 - DNA, 103 bp, Artificial Sequence
  Synthetic Polynucleotide
taatacgactcactatagggatcatcatctgcgaagaacatcgttaagagaacagaggagactcttaatgatgttcttcaacctggcggcagcgcaaaagatg

SEQ ID NO: 46479 - DNA, 103 bp, Artificial Sequence
  Synthetic Polynucleotide
taatacgactcactatagggaatgaatcatcatctgcgaagaacatcgttaacagaggagaaacgatatgcttcgcagaaacctggcggcagcgcaaaagatg

SEQ ID NO: 46480 - DNA, 103 bp, Artificial Sequence
  Synthetic Polynucleotide
taatacgactcactatagggtaaaaaatgaatcatcatctgcgaagaacaaacagaggagatgttctatgcagatgatgaacctggcggcagcgcaaaagatg

SEQ ID NO: 46481 - DNA, 103 bp, Artificial Sequence
  Synthetic Polynucleotide
taatacgactcactatagggatacttaaaaaatgaatcatcatctgcgaaaacagaggagattcgcaatggatgattcaaacctggcggcagcgcaaaagatg

SEQ ID NO: 46482 - DNA, 103 bp, Artificial Sequence
  Synthetic Polynucleotide
taatacgactcactatagggtagacaacatgataaatgaggtatccgtggaacagaggagaccacggatgcctcatttaaacctggcggcagcgcaaaagatg

SEQ ID NO: 46483 - DNA, 103 bp, Artificial Sequence
  Synthetic Polynucleotide
taatacgactcactataggggccaaatacttaaaaaatgaatcatcatctaacagaggagaagatgaatgttcatttttaacctggcggcagcgcaaaagatg

SEQ ID NO: 46484 - DNA, 103 bp, Artificial Sequence
  Synthetic Polynucleotide
taatacgactcactataggggactagccaaatacttaaaaaatgaatcataacagaggagaatgattatgtttttaagtaacctggcggcagcgcaaaagatg

SEQ ID NO: 46485 - DNA, 103 bp, Artificial Sequence
  Synthetic Polynucleotide
taatacgactcactatagggatcttgactagccaaatacttaaaaaatgaaacagaggagatcatttatgaagtatttgaacctggcggcagcgcaaaagatg

SEQ ID NO: 46486 - DNA, 103 bp, Artificial Sequence
  Synthetic Polynucleotide
taatacgactcactatagggtcatcatcttgactagccaaatacttaaaaaacagaggagattttaaatgtttggctagaacctggcggcagcgcaaaagatg

SEQ ID NO: 46487 - DNA, 103 bp, Artificial Sequence
  Synthetic Polynucleotide
taatacgactcactatagggaagattcatcatcttgactagccaaatactaacagaggagaagtattatgctagtcaagaacctggcggcagcgcaaaagatg

SEQ ID NO: 46488 - DNA, 103 bp, Artificial Sequence
  Synthetic Polynucleotide
taatacgactcactatagggtaatgaagattcatcatcttgactagccaaaacagaggagattggctatgcaagatgataacctggcggcagcgcaaaagatg

SEQ ID NO: 46489 - DNA, 103 bp, Artificial Sequence
  Synthetic Polynucleotide
taatacgactcactatagggtcagataatgaagattcatcatcttgactaaacagaggagatagtcaatgtgatgaatcaacctggcggcagcgcaaaagatg

SEQ ID NO: 46490 - DNA, 103 bp, Artificial Sequence
  Synthetic Polynucleotide
taatacgactcactatagggatatatcagataatgaagattcatcatcttaacagaggagaaagatgatgaatcttcataacctggcggcagcgcaaaagatg

SEQ ID NO: 46491 - DNA, 103 bp, Artificial Sequence
  Synthetic Polynucleotide
taatacgactcactatagggttgcaatatatcagataatgaagattcatcaacagaggagagatgaaatgtcattatctaacctggcggcagcgcaaaagatg

SEQ ID NO: 46492 - DNA, 103 bp, Artificial Sequence
  Synthetic Polynucleotide
taatacgactcactataggggtgatttgcaatatatcagataatgaagataacagaggagaatcttcatgatctgatataacctggcggcagcgcaaaagatg

SEQ ID NO: 46493 - DNA, 103 bp, Artificial Sequence
  Synthetic Polynucleotide
taatacgactcactataggggaaaatagacaacatgataaatgaggtatcaacagaggagagataccatgtttatcatgaacctggcggcagcgcaaaagatg

SEQ ID NO: 46494 - DNA, 103 bp, Artificial Sequence
  Synthetic Polynucleotide
taatacgactcactatagggattgagtgatttgcaatatatcagataatgaacagaggagacattatatgatatattgcaacctggcggcagcgcaaaagatg

SEQ ID NO: 46495 - DNA, 103 bp, Artificial Sequence
  Synthetic Polynucleotide
taatacgactcactatagggtagatattgagtgatttgcaatatatcagaaacagaggagatctgatatgttgcaaatcaacctggcggcagcgcaaaagatg

SEQ ID NO: 46496 - DNA, 103 bp, Artificial Sequence
  Synthetic Polynucleotide
taatacgactcactatagggaagtctagatattgagtgatttgcaatataaacagaggagatatattatgaatcactcaaacctggcggcagcgcaaaagatg

SEQ ID NO: 46497 - DNA, 103 bp, Artificial Sequence
  Synthetic Polynucleotide
taatacgactcactatagggacagaaagtctagatattgagtgatttgcaaacagaggagatgcaaaatgctcaatatcaacctggcggcagcgcaaaagatg

SEQ ID NO: 46498 - DNA, 103 bp, Artificial Sequence
  Synthetic Polynucleotide
taatacgactcactatagggtaataacagaaagtctagatattgagtgataacagaggagaatcactatgtatctagacaacctggcggcagcgcaaaagatg

SEQ ID NO: 46499 - DNA, 103 bp, Artificial Sequence
  Synthetic Polynucleotide
taatacgactcactatagggaataataataacagaaagtctagatattgaaacagaggagatcaataatgagactttctaacctggcggcagcgcaaaagatg

SEQ ID NO: 46500 - DNA, 103 bp, Artificial Sequence
  Synthetic Polynucleotide
taatacgactcactatagggggatcaataataataacagaaagtctagataacagaggagaatctagatgttctgttataacctggcggcagcgcaaaagatg

SEQ ID NO: 46501 - DNA, 103 bp, Artificial Sequence
  Synthetic Polynucleotide
taatacgactcactatagggtgattggatcaataataataacagaaagtcaacagaggagagactttatgttattattaaacctggcggcagcgcaaaagatg

SEQ ID NO: 46502 - DNA, 103 bp, Artificial Sequence
  Synthetic Polynucleotide
taatacgactcactatagggttttttgattggatcaataataataacagaaacagaggagatctgttatgattattgataacctggcggcagcgcaaaagatg

SEQ ID NO: 46503 - DNA, 103 bp, Artificial Sequence
  Synthetic Polynucleotide
taatacgactcactatagggatttattttttgattggatcaataataataaacagaggagatattatatgtgatccaataacctggcggcagcgcaaaagatg

SEQ ID NO: 46504 - DNA, 103 bp, Artificial Sequence
  Synthetic Polynucleotide
taatacgactcactatagggagtaagaaaatagacaacatgataaatgagaacagaggagactcattatgcatgttgtcaacctggcggcagcgcaaaagatg

SEQ ID NO: 46505 - DNA, 103 bp, Artificial Sequence
  Synthetic Polynucleotide
taatacgactcactatagggttctaatttattttttgattggatcaataaaacagaggagattattgatgcaatcaaaaaacctggcggcagcgcaaaagatg

SEQ ID NO: 46506 - DNA, 103 bp, Artificial Sequence
  Synthetic Polynucleotide
taatacgactcactatagggacagcttctaatttattttttgattggatcaacagaggagagatccaatgaaaaaataaaacctggcggcagcgcaaaagatg

SEQ ID NO: 46507 - DNA, 103 bp, Artificial Sequence
  Synthetic Polynucleotide
taatacgactcactataggggaccaacagcttctaatttattttttgattaacagaggagaaatcaaatgataaattagaacctggcggcagcgcaaaagatg

SEQ ID NO: 46508 - DNA, 103 bp, Artificial Sequence
  Synthetic Polynucleotide
taatacgactcactatagggacaatgaccaacagcttctaatttatttttaacagaggagaaaaaatatgttagaagctaacctggcggcagcgcaaaagatg

SEQ ID NO: 46509 - DNA, 103 bp, Artificial Sequence
  Synthetic Polynucleotide
taatacgactcactatagggtcataacaatgaccaacagcttctaatttaaacagaggagataaattatgagctgttggaacctggcggcagcgcaaaagatg

SEQ ID NO: 46510 - DNA, 103 bp, Artificial Sequence
  Synthetic Polynucleotide
taatacgactcactataggggagattcataacaatgaccaacagcttctaaacagaggagatagaagatgttggtcattaacctggcggcagcgcaaaagatg

SEQ ID NO: 46511 - DNA, 103 bp, Artificial Sequence
  Synthetic Polynucleotide
taatacgactcactatagggtgaaagagattcataacaatgaccaacagcaacagaggagagctgttatgcattgttataacctggcggcagcgcaaaagatg

SEQ ID NO: 46512 - DNA, 103 bp, Artificial Sequence
  Synthetic Polynucleotide
taatacgactcactatagggtcctctgaaagagattcataacaatgaccaaacagaggagatggtcaatgttatgaatcaacctggcggcagcgcaaaagatg

SEQ ID NO: 46513 - DNA, 103 bp, Artificial Sequence
  Synthetic Polynucleotide
taatacgactcactatagggtgtattcctctgaaagagattcataacaataacagaggagaattgttatgaatctctttaacctggcggcagcgcaaaagatg

SEQ ID NO: 46514 - DNA, 103 bp, Artificial Sequence
  Synthetic Polynucleotide
taatacgactcactatagggttgtctgtattcctctgaaagagattcataaacagaggagatatgaaatgctttcagagaacctggcggcagcgcaaaagatg

SEQ ID NO: 46515 - DNA, 103 bp, Artificial Sequence
  Synthetic Polynucleotide
taatacgactcactatagggaacaaagtaagaaaatagacaacatgataaaacagaggagattatcaatgtgtctatttaacctggcggcagcgcaaaagatg

SEQ ID NO: 46516 - DNA, 103 bp, Artificial Sequence
  Synthetic Polynucleotide
taatacgactcactataggggtcaattgtctgtattcctctgaaagagataacagaggagaatctctatgagaggaataaacctggcggcagcgcaaaagatg

SEQ ID NO: 46517 - DNA, 103 bp, Artificial Sequence
  Synthetic Polynucleotide
taatacgactcactatagggattttgtcaattgtctgtattcctctgaaaaacagaggagatttcagatgaatacagacaacctggcggcagcgcaaaagatg

SEQ ID NO: 46518 - DNA, 103 bp, Artificial Sequence
  Synthetic Polynucleotide
taatacgactcactatagggtgtgaattttgtcaattgtctgtattcctcaacagaggagagaggaaatgagacaattgaacctggcggcagcgcaaaagatg

SEQ ID NO: 46519 - DNA, 103 bp, Artificial Sequence
  Synthetic Polynucleotide
taatacgactcactataggggagtctgtgaattttgtcaattgtctgtataacagaggagaatacagatgattgacaaaaacctggcggcagcgcaaaagatg

SEQ ID NO: 46520 - DNA, 103 bp, Artificial Sequence
  Synthetic Polynucleotide
taatacgactcactatagggcttgagagtctgtgaattttgtcaattgtcaacagaggagagacaatatgcaaaattcaaacctggcggcagcgcaaaagatg

SEQ ID NO: 46521 - DNA, 103 bp, Artificial Sequence
  Synthetic Polynucleotide
taatacgactcactatagggaaaatcttgagagtctgtgaattttgtcaaaacagaggagattgacaatgttcacagacaacctggcggcagcgcaaaagatg

SEQ ID NO: 46522 - DNA, 103 bp, Artificial Sequence
  Synthetic Polynucleotide
taatacgactcactatagggtttttaaaatcttgagagtctgtgaattttaacagaggagaaaaattatgagactctcaaacctggcggcagcgcaaaagatg

SEQ ID NO: 46523 - DNA, 103 bp, Artificial Sequence
  Synthetic Polynucleotide
taatacgactcactatagggacagttttttaaaatcttgagagtctgtgaaacagaggagatcacagatgctcaagattaacctggcggcagcgcaaaagatg

SEQ ID NO: 46524 - DNA, 103 bp, Artificial Sequence
  Synthetic Polynucleotide
taatacgactcactataggggttaaacagttttttaaaatcttgagagtcaacagaggagagactctatggattttaaaaacctggcggcagcgcaaaagatg

SEQ ID NO: 46525 - DNA, 103 bp, Artificial Sequence
  Synthetic Polynucleotide
taatacgactcactatagggaccttgttaaacagttttttaaaatcttgaaacagaggagatcaagaatgtaaaaaactaacctggcggcagcgcaaaagatg

SEQ ID NO: 46526 - DNA, 103 bp, Artificial Sequence
  Synthetic Polynucleotide
taatacgactcactatagggaatagaacaaagtaagaaaatagacaacataacagaggagaatgttgatgattttcttaaacctggcggcagcgcaaaagatg

SEQ ID NO: 46527 - DNA, 103 bp, Artificial Sequence
  Synthetic Polynucleotide
taatacgactcactatagggtagggaccttgttaaacagttttttaaaataacagaggagaattttaatgaactgtttaaacctggcggcagcgcaaaagatg

SEQ ID NO: 46528 - DNA, 103 bp, Artificial Sequence
  Synthetic Polynucleotide
taatacgactcactatagggaacaatagggaccttgttaaacagttttttaacagaggagaaaaaaaatgtttaacaagaacctggcggcagcgcaaaagatg

SEQ ID NO: 46529 - DNA, 103 bp, Artificial Sequence
  Synthetic Polynucleotide
taatacgactcactatagggtctgtaacaatagggaccttgttaaacagtaacagaggagaactgttatgcaaggtcccaacctggcggcagcgcaaaagatg

SEQ ID NO: 46530 - DNA, 103 bp, Artificial Sequence
  Synthetic Polynucleotide
taatacgactcactatagggttccatctgtaacaatagggaccttgttaaaacagaggagattaacaatgtccctattgaacctggcggcagcgcaaaagatg

SEQ ID NO: 46531 - DNA, 103 bp, Artificial Sequence
  Synthetic Polynucleotide
taatacgactcactataggggacccttccatctgtaacaatagggaccttaacagaggagaaaggtcatgattgttacaaacctggcggcagcgcaaaagatg

SEQ ID NO: 46532 - DNA, 103 bp, Artificial Sequence
  Synthetic Polynucleotide
taatacgactcactatagggagtttgacccttccatctgtaacaatagggaacagaggagaccctatatgtacagatggaacctggcggcagcgcaaaagatg

SEQ ID NO: 46533 - DNA, 103 bp, Artificial Sequence
  Synthetic Polynucleotide
taatacgactcactatagggtattaagtttgacccttccatctgtaacaaaacagaggagattgttaatgatggaagggaacctggcggcagcgcaaaagatg

SEQ ID NO: 46534 - DNA, 103 bp, Artificial Sequence
  Synthetic Polynucleotide
taatacgactcactatagggtcctttattaagtttgacccttccatctgtaacagaggagaacagatatgagggtcaaaaacctggcggcagcgcaaaagatg

SEQ ID NO: 46535 - DNA, 103 bp, Artificial Sequence
  Synthetic Polynucleotide
taatacgactcactatagggaaatatcctttattaagtttgacccttccaaacagaggagatggaagatgcaaacttaaaacctggcggcagcgcaaaagatg

SEQ ID NO: 46536 - DNA, 103 bp, Artificial Sequence
  Synthetic Polynucleotide
taatacgactcactatagggcgaacaaatatcctttattaagtttgacccaacagaggagagggtcaatgttaataaagaacctggcggcagcgcaaaagatg

SEQ ID NO: 46537 - DNA, 103 bp, Artificial Sequence
  Synthetic Polynucleotide
taatacgactcactatagggaagttaatagaacaaagtaagaaaatagacaacagaggagagtctatatgcttactttgaacctggcggcagcgcaaaagatg

SEQ ID NO: 46538 - DNA, 103 bp, Artificial Sequence
  Synthetic Polynucleotide
taatacgactcactatagggaaagtcgaacaaatatcctttattaagtttaacagaggagaaaacttatgaaaggatataacctggcggcagcgcaaaagatg

SEQ ID NO: 46539 - DNA, 103 bp, Artificial Sequence
  Synthetic Polynucleotide
taatacgactcactatagggatcacaaagtcgaacaaatatcctttattaaacagaggagataataaatgatatttgttaacctggcggcagcgcaaaagatg

SEQ ID NO: 46540 - DNA, 103 bp, Artificial Sequence
  Synthetic Polynucleotide
taatacgactcactatagggaactaatcacaaagtcgaacaaatatccttaacagaggagaaaggatatgtgttcgactaacctggcggcagcgcaaaagatg

SEQ ID NO: 46541 - DNA, 103 bp, Artificial Sequence
  Synthetic Polynucleotide
taatacgactcactatagggcatcaaactaatcacaaagtcgaacaaataaacagaggagatatttgatggactttgtgaacctggcggcagcgcaaaagatg

SEQ ID NO: 46542 - DNA, 103 bp, Artificial Sequence
  Synthetic Polynucleotide
taatacgactcactatagggaatcgcatcaaactaatcacaaagtcgaacaacagaggagagttcgaatgtgtgattagaacctggcggcagcgcaaaagatg

SEQ ID NO: 46543 - DNA, 103 bp, Artificial Sequence
  Synthetic Polynucleotide
taatacgactcactatagggttttgaatcgcatcaaactaatcacaaagtaacagaggagaactttgatgttagtttgaaacctggcggcagcgcaaaagatg

SEQ ID NO: 46544 - DNA, 103 bp, Artificial Sequence
  Synthetic Polynucleotide
taatacgactcactatagggttcttttttgaatcgcatcaaactaatcacaacagaggagagtgattatgttgatgcgaaacctggcggcagcgcaaaagatg

SEQ ID NO: 46545 - DNA, 103 bp, Artificial Sequence
  Synthetic Polynucleotide
taatacgactcactataggggctgattcttttttgaatcgcatcaaactaaacagaggagatagtttatggcgattcaaaacctggcggcagcgcaaaagatg

SEQ ID NO: 46546 - DNA, 103 bp, Artificial Sequence
  Synthetic Polynucleotide
taatacgactcactatagggctagagctgattcttttttgaatcgcatcaaacagaggagatgatgcatgtcaaaaaagaacctggcggcagcgcaaaagatg

SEQ ID NO: 46547 - DNA, 103 bp, Artificial Sequence
  Synthetic Polynucleotide
taatacgactcactatagggggtagctagagctgattcttttttgaatcgaacagaggagacgattcatgaaagaatcaaacctggcggcagcgcaaaagatg

SEQ ID NO: 46548 - DNA, 103 bp, Artificial Sequence
  Synthetic Polynucleotide
taatacgactcactatagggctaataagttaatagaacaaagtaagaaaaaacagaggagattttctatgtttgttctaaacctggcggcagcgcaaaagatg

SEQ ID NO: 46549 - DNA, 103 bp, Artificial Sequence
  Synthetic Polynucleotide
taatacgactcactataggggcggtggtagctagagctgattcttttttgaacagaggagacaaaaaatgatcagctctaacctggcggcagcgcaaaagatg

SEQ ID NO: 46550 - DNA, 103 bp, Artificial Sequence
  Synthetic Polynucleotide
taatacgactcactatagggctattgcggtggtagctagagctgattcttaacagaggagaaagaatatgctctagctaaacctggcggcagcgcaaaagatg

SEQ ID NO: 46551 - DNA, 103 bp, Artificial Sequence
  Synthetic Polynucleotide
taatacgactcactatagggaggatctattgcggtggtagctagagctgaaacagaggagatcagctatggctaccaccaacctggcggcagcgcaaaagatg

SEQ ID NO: 46552 - DNA, 103 bp, Artificial Sequence
  Synthetic Polynucleotide
taatacgactcactatagggctaacaggatctattgcggtggtagctagaaacagaggagatctagcatgcaccgcaataacctggcggcagcgcaaaagatg

SEQ ID NO: 46553 - DNA, 103 bp, Artificial Sequence
  Synthetic Polynucleotide
taatacgactcactatagggtgtatctaacaggatctattgcggtggtagaacagaggagactaccaatgcaatagatcaacctggcggcagcgcaaaagatg

SEQ ID NO: 46554 - DNA, 103 bp, Artificial Sequence
  Synthetic Polynucleotide
taatacgactcactatagggatctatgtatctaacaggatctattgcggtaacagaggagaaccgcaatggatcctgttaacctggcggcagcgcaaaagatg

SEQ ID NO: 46555 - DNA, 103 bp, Artificial Sequence
  Synthetic Polynucleotide
taatacgactcactatagggcgaggatctatgtatctaacaggatctattaacagaggagaaatagaatgtgttagataaacctggcggcagcgcaaaagatg

SEQ ID NO: 46556 - DNA, 103 bp, Artificial Sequence
  Synthetic Polynucleotide
taatacgactcactatagggcgcgacgaggatctatgtatctaacaggataacagaggagaatcctgatggatacatagaacctggcggcagcgcaaaagatg

SEQ ID NO: 46557 - DNA, 103 bp, Artificial Sequence
  Synthetic Polynucleotide
taatacgactcactataggggatatcgcgacgaggatctatgtatctaacaacagaggagagttagaatgatagatcctaacctggcggcagcgcaaaagatg

SEQ ID NO: 46558 - DNA, 103 bp, Artificial Sequence
  Synthetic Polynucleotide
taatacgactcactatagggaatgcgatatcgcgacgaggatctatgtataacagaggagaatacatatgtcctcgtcgaacctggcggcagcgcaaaagatg

SEQ ID NO: 46559 - DNA, 103 bp, Artificial Sequence
  Synthetic Polynucleotide
taatacgactcactatagggcaacgctaataagttaatagaacaaagtaaaacagaggagattacttatgtctattaacaacctggcggcagcgcaaaagatg

SEQ ID NO: 46560 - DNA, 103 bp, Artificial Sequence
  Synthetic Polynucleotide
taatacgactcactatagggtagaaaatgcgatatcgcgacgaggatctaaacagaggagatagatcatggtcgcgataaacctggcggcagcgcaaaagatg

SEQ ID NO: 46561 - DNA, 103 bp, Artificial Sequence
  Synthetic Polynucleotide
taatacgactcactatagggcacgttagaaaatgcgatatcgcgacgaggaacagaggagacctcgtatggatatcgcaaacctggcggcagcgcaaaagatg

SEQ ID NO: 46562 - DNA, 103 bp, Artificial Sequence
  Synthetic Polynucleotide
taatacgactcactatagggtccatcacgttagaaaatgcgatatcgcgaaacagaggagatcgcgaatgcgcattttcaacctggcggcagcgcaaaagatg

SEQ ID NO: 46563 - DNA, 103 bp, Artificial Sequence
  Synthetic Polynucleotide
taatacgactcactatagggatatatccatcacgttagaaaatgcgatataacagaggagaatatcgatgtttctaacgaacctggcggcagcgcaaaagatg

SEQ ID NO: 46564 - DNA, 103 bp, Artificial Sequence
  Synthetic Polynucleotide
taatacgactcactatagggctttaatatatccatcacgttagaaaatgcaacagaggagagcatttatgaacgtgatgaacctggcggcagcgcaaaagatg

SEQ ID NO: 46565 - DNA, 103 bp, Artificial Sequence
  Synthetic Polynucleotide
taatacgactcactatagggtttgactttaatatatccatcacgttagaaaacagaggagattctaaatggatggatataacctggcggcagcgcaaaagatg

SEQ ID NO: 46566 - DNA, 103 bp, Artificial Sequence
  Synthetic Polynucleotide
taatacgactcactatagggctttatttgactttaatatatccatcacgtaacagaggagaacgtgaatgatatattaaaacctggcggcagcgcaaaagatg

SEQ ID NO: 46567 - DNA, 103 bp, Artificial Sequence
  Synthetic Polynucleotide
taatacgactcactatagggtttcgctttatttgactttaatatatccataacagaggagaatggatatgttaaagtcaaacctggcggcagcgcaaaagatg

SEQ ID NO: 46568 - DNA, 103 bp, Artificial Sequence
  Synthetic Polynucleotide
taatacgactcactatagggttatttttcgctttatttgactttaatataaacagaggagatatattatggtcaaataaaacctggcggcagcgcaaaagatg

SEQ ID NO: 46569 - DNA, 103 bp, Artificial Sequence
  Synthetic Polynucleotide
taatacgactcactatagggaataattatttttcgctttatttgactttaaacagaggagataaagtatgataaagcgaaacctggcggcagcgcaaaagatg

SEQ ID NO: 46570 - DNA, 103 bp, Artificial Sequence
  Synthetic Polynucleotide
taatacgactcactataggggaataccgtggcagacgtcagacattgtctaacagaggagaagacaaatgctgacgtctaacctggcggcagcgcaaaagatg

SEQ ID NO: 46571 - DNA, 103 bp, Artificial Sequence
  Synthetic Polynucleotide
taatacgactcactatagggatatacaacgctaataagttaatagaacaaaacagaggagattgttcatgtaacttattaacctggcggcagcgcaaaagatg

SEQ ID NO: 46572 - DNA, 103 bp, Artificial Sequence
  Synthetic Polynucleotide
taatacgactcactatagggtaaagaataattatttttcgctttatttgaaacagaggagatcaaatatggcgaaaaataacctggcggcagcgcaaaagatg

SEQ ID NO: 46573 - DNA, 103 bp, Artificial Sequence
  Synthetic Polynucleotide
taatacgactcactataggggacaataaagaataattatttttcgctttaaacagaggagataaagcatgaaataattaaacctggcggcagcgcaaaagatg

SEQ ID NO: 46574 - DNA, 103 bp, Artificial Sequence
  Synthetic Polynucleotide
taatacgactcactatagggatgatgacaataaagaataattatttttcgaacagaggagacgaaaaatgattattcttaacctggcggcagcgcaaaagatg

SEQ ID NO: 46575 - DNA, 103 bp, Artificial Sequence
  Synthetic Polynucleotide
taatacgactcactatagggcgttcatgatgacaataaagaataattattaacagaggagaaataatatgtctttattgaacctggcggcagcgcaaaagatg

SEQ ID NO: 46576 - DNA, 103 bp, Artificial Sequence
  Synthetic Polynucleotide
taatacgactcactatagggcccgccgttcatgatgacaataaagaataaaacagaggagattattcatgattgtcatcaacctggcggcagcgcaaaagatg

SEQ ID NO: 46577 - DNA, 103 bp, Artificial Sequence
  Synthetic Polynucleotide
taatacgactcactatagggatatgcccgccgttcatgatgacaataaagaacagaggagactttatatgcatcatgaaaacctggcggcagcgcaaaagatg

SEQ ID NO: 46578 - DNA, 103 bp, Artificial Sequence
  Synthetic Polynucleotide
taatacgactcactatagggactgaatatgcccgccgttcatgatgacaaaacagaggagattgtcaatgtgaacggcgaacctggcggcagcgcaaaagatg

SEQ ID NO: 46579 - DNA, 103 bp, Artificial Sequence
  Synthetic Polynucleotide
taatacgactcactatagggtatcaactgaatatgcccgccgttcatgataacagaggagaatcatgatgggcgggcataacctggcggcagcgcaaaagatg

SEQ ID NO: 46580 - DNA, 103 bp, Artificial Sequence
  Synthetic Polynucleotide
taatacgactcactatagggccaattatcaactgaatatgcccgccgttcaacagaggagagaacggatggcatattcaaacctggcggcagcgcaaaagatg

SEQ ID NO: 46581 - DNA, 103 bp, Artificial Sequence
  Synthetic Polynucleotide
taatacgactcactatagggtggggccaattatcaactgaatatgcccgcaacagaggagagcgggcatgttcagttgaaacctggcggcagcgcaaaagatg

SEQ ID NO: 46582 - DNA, 103 bp, Artificial Sequence
  Synthetic Polynucleotide
taatacgactcactatagggaaataatatacaacgctaataagttaatagaacagaggagactattaatgtattagcgtaacctggcggcagcgcaaaagatg

SEQ ID NO: 46583 - DNA, 103 bp, Artificial Sequence
  Synthetic Polynucleotide
taatacgactcactatagggaaacatggggccaattatcaactgaatatgaacagaggagacatattatgttgataattaacctggcggcagcgcaaaagatg

SEQ ID NO: 46584 - DNA, 103 bp, Artificial Sequence
  Synthetic Polynucleotide
taatacgactcactatagggcctgaaaacatggggccaattatcaactgaaacagaggagatcagttatgaattggcccaacctggcggcagcgcaaaagatg

SEQ ID NO: 46585 - DNA, 103 bp, Artificial Sequence
  Synthetic Polynucleotide
taatacgactcactatagggttttacctgaaaacatggggccaattatcaaacagaggagatgataaatggccccatgtaacctggcggcagcgcaaaagatg

SEQ ID NO: 46586 - DNA, 103 bp, Artificial Sequence
  Synthetic Polynucleotide
taatacgactcactatagggtgtacttttacctgaaaacatggggccaataacagaggagaattggcatgatgttttcaaacctggcggcagcgcaaaagatg

SEQ ID NO: 46587 - DNA, 103 bp, Artificial Sequence
  Synthetic Polynucleotide
taatacgactcactatagggaattctgtacttttacctgaaaacatggggaacagaggagaccccatatgttcaggtaaaacctggcggcagcgcaaaagatg

SEQ ID NO: 46588 - DNA, 103 bp, Artificial Sequence
  Synthetic Polynucleotide
taatacgactcactatagggtaattaattctgtacttttacctgaaaacaaacagaggagatgttttatggtaaaagtaaacctggcggcagcgcaaaagatg

SEQ ID NO: 46589 - DNA, 103 bp, Artificial Sequence
  Synthetic Polynucleotide
taatacgactcactatagggtcgtctaattaattctgtacttttacctgaaacagaggagatcaggtatgagtacagaaaacctggcggcagcgcaaaagatg

SEQ ID NO: 46590 - DNA, 103 bp, Artificial Sequence
  Synthetic Polynucleotide
taatacgactcactatagggctaactcgtctaattaattctgtacttttaaacagaggagataaaagatgagaattaataacctggcggcagcgcaaaagatg

SEQ ID NO: 46591 - DNA, 103 bp, Artificial Sequence
  Synthetic Polynucleotide
taatacgactcactatagggaacgtctaactcgtctaattaattctgtacaacagaggagagtacagatgtaattagacaacctggcggcagcgcaaaagatg

SEQ ID NO: 46592 - DNA, 103 bp, Artificial Sequence
  Synthetic Polynucleotide
taatacgactcactatagggttgataacgtctaactcgtctaattaattcaacagaggagagaattaatgagacgagttaacctggcggcagcgcaaaagatg

SEQ ID NO: 46593 - DNA, 103 bp, Artificial Sequence
  Synthetic Polynucleotide
taatacgactcactatagggtaatcaaataatatacaacgctaataagttaacagaggagaaacttaatggcgttgtataacctggcggcagcgcaaaagatg

SEQ ID NO: 46594 - DNA, 103 bp, Artificial Sequence
  Synthetic Polynucleotide
taatacgactcactataggggctatttgataacgtctaactcgtctaattaacagaggagaaattagatgagttagacgaacctggcggcagcgcaaaagatg

SEQ ID NO: 46595 - DNA, 103 bp, Artificial Sequence
  Synthetic Polynucleotide
taatacgactcactatagggattgagctatttgataacgtctaactcgtcaacagaggagagacgagatggacgttatcaacctggcggcagcgcaaaagatg

SEQ ID NO: 46596 - DNA, 103 bp, Artificial Sequence
  Synthetic Polynucleotide
taatacgactcactatagggtttatattgagctatttgataacgtctaacaacagaggagagttagaatgtatcaaataaacctggcggcagcgcaaaagatg

SEQ ID NO: 46597 - DNA, 103 bp, Artificial Sequence
  Synthetic Polynucleotide
taatacgactcactatagggacgcatttatattgagctatttgataacgtaacagaggagaacgttaatgaatagctcaaacctggcggcagcgcaaaagatg

SEQ ID NO: 46598 - DNA, 103 bp, Artificial Sequence
  Synthetic Polynucleotide
taatacgactcactatagggtagtcacgcatttatattgagctatttgataacagaggagaatcaaaatgctcaatataaacctggcggcagcgcaaaagatg

SEQ ID NO: 46599 - DNA, 103 bp, Artificial Sequence
  Synthetic Polynucleotide
taatacgactcactatagggttttatagtcacgcatttatattgagctataacagaggagaatagctatgtataaatgcaacctggcggcagcgcaaaagatg

SEQ ID NO: 46600 - DNA, 103 bp, Artificial Sequence
  Synthetic Polynucleotide
taatacgactcactataggggaatattttatagtcacgcatttatattgaaacagaggagatcaataatgatgcgtgacaacctggcggcagcgcaaaagatg

SEQ ID NO: 46601 - DNA, 103 bp, Artificial Sequence
  Synthetic Polynucleotide
taatacgactcactatagggcgttagaatattttatagtcacgcatttataacagaggagaataaatatgtgactataaaacctggcggcagcgcaaaagatg

SEQ ID NO: 46602 - DNA, 103 bp, Artificial Sequence
  Synthetic Polynucleotide
taatacgactcactatagggattatcgttagaatattttatagtcacgcaaacagaggagatgcgtgatgataaaatataacctggcggcagcgcaaaagatg

SEQ ID NO: 46603 - DNA, 103 bp, Artificial Sequence
  Synthetic Polynucleotide
taatacgactcactatagggtatctattatcgttagaatattttatagtcaacagaggagagactatatgatattctaaaacctggcggcagcgcaaaagatg

SEQ ID NO: 46604 - DNA, 103 bp, Artificial Sequence
  Synthetic Polynucleotide
taatacgactcactatagggttttataatcaaataatatacaacgctaataacagaggagaattagcatggtatattataacctggcggcagcgcaaaagatg

SEQ ID NO: 46605 - DNA, 103 bp, Artificial Sequence
  Synthetic Polynucleotide
taatacgactcactatagggttccgtatctattatcgttagaatattttaaacagaggagataaaatatgctaacgataaacctggcggcagcgcaaaagatg

SEQ ID NO: 46606 - DNA, 103 bp, Artificial Sequence
  Synthetic Polynucleotide
taatacgactcactatagggtcccgttccgtatctattatcgttagaataaacagaggagatattctatggataatagaaacctggcggcagcgcaaaagatg

SEQ ID NO: 46607 - DNA, 103 bp, Artificial Sequence
  Synthetic Polynucleotide
taatacgactcactatagggcatagtcccgttccgtatctattatcgttaaacagaggagataacgaatgtagatacggaacctggcggcagcgcaaaagatg

SEQ ID NO: 46608 - DNA, 103 bp, Artificial Sequence
  Synthetic Polynucleotide
taatacgactcactataggggcgtccatagtcccgttccgtatctattataacagaggagaataataatgacggaacggaacctggcggcagcgcaaaagatg

SEQ ID NO: 46609 - DNA, 103 bp, Artificial Sequence
  Synthetic Polynucleotide
taatacgactcactatagggatcatgcgtccatagtcccgttccgtatctaacagaggagaagatacatgacgggactaaacctggcggcagcgcaaaagatg

SEQ ID NO: 46610 - DNA, 103 bp, Artificial Sequence
  Synthetic Polynucleotide
taatacgactcactatagggttcttatcatgcgtccatagtcccgttccgaacagaggagacggaacatgactatggacaacctggcggcagcgcaaaagatg

SEQ ID NO: 46611 - DNA, 103 bp, Artificial Sequence
  Synthetic Polynucleotide
taatacgactcactatagggaattattcttatcatgcgtccatagtcccgaacagaggagacgggacatgggacgcatgaacctggcggcagcgcaaaagatg

SEQ ID NO: 46612 - DNA, 103 bp, Artificial Sequence
  Synthetic Polynucleotide
taatacgactcactatagggttcaaaattattcttatcatgcgtccatagaacagaggagactatggatgcatgataagaacctggcggcagcgcaaaagatg

SEQ ID NO: 46613 - DNA, 103 bp, Artificial Sequence
  Synthetic Polynucleotide
taatacgactcactatagggaatgcttcaaaattattcttatcatgcgtcaacagaggagagacgcaatgtaagaataaaacctggcggcagcgcaaaagatg

SEQ ID NO: 46614 - DNA, 103 bp, Artificial Sequence
  Synthetic Polynucleotide
taatacgactcactatagggcttccaatgcttcaaaattattcttatcataacagaggagaatgataatgataattttgaacctggcggcagcgcaaaagatg

SEQ ID NO: 46615 - DNA, 103 bp, Artificial Sequence
  Synthetic Polynucleotide
taatacgactcactatagggataagttttataatcaaataatatacaacgaacagaggagacgttgtatgttatttgataacctggcggcagcgcaaaagatg

SEQ ID NO: 46616 - DNA, 103 bp, Artificial Sequence
  Synthetic Polynucleotide
taatacgactcactatagggagttgcttccaatgcttcaaaattattcttaacagaggagaaagaatatgtttgaagcaaacctggcggcagcgcaaaagatg

SEQ ID NO: 46617 - DNA, 103 bp, Artificial Sequence
  Synthetic Polynucleotide
taatacgactcactatagggagtttagttgcttccaatgcttcaaaattaaacagaggagataatttatgagcattggaaacctggcggcagcgcaaaagatg

SEQ ID NO: 46618 - DNA, 103 bp, Artificial Sequence
  Synthetic Polynucleotide
taatacgactcactatagggcgcatagtttagttgcttccaatgcttcaaaacagaggagattgaagatgtggaagcaaaacctggcggcagcgcaaaagatg

SEQ ID NO: 46619 - DNA, 103 bp, Artificial Sequence
  Synthetic Polynucleotide
taatacgactcactataggggacatcgcatagtttagttgcttccaatgcaacagaggagagcattgatggcaactaaaaacctggcggcagcgcaaaagatg

SEQ ID NO: 46620 - DNA, 103 bp, Artificial Sequence
  Synthetic Polynucleotide
taatacgactcactatagggtccaagacatcgcatagtttagttgcttccaacagaggagaggaagcatgtaaactatgaacctggcggcagcgcaaaagatg

SEQ ID NO: 46621 - DNA, 103 bp, Artificial Sequence
  Synthetic Polynucleotide
taatacgactcactatagggttgcttccaagacatcgcatagtttagttgaacagaggagacaactaatgtatgcgatgaacctggcggcagcgcaaaagatg

SEQ ID NO: 46622 - DNA, 103 bp, Artificial Sequence
  Synthetic Polynucleotide
taatacgactcactatagggtgtaattgcttccaagacatcgcatagtttaacagaggagaaaactaatggatgtcttgaacctggcggcagcgcaaaagatg

SEQ ID NO: 46623 - DNA, 103 bp, Artificial Sequence
  Synthetic Polynucleotide
taatacgactcactatagggaaatctgtaattgcttccaagacatcgcataacagaggagaatgcgaatgcttggaagcaacctggcggcagcgcaaaagatg

SEQ ID NO: 46624 - DNA, 103 bp, Artificial Sequence
  Synthetic Polynucleotide
taatacgactcactatagggcggagaaatctgtaattgcttccaagacataacagaggagaatgtctatgaagcaattaaacctggcggcagcgcaaaagatg

SEQ ID NO: 46625 - DNA, 103 bp, Artificial Sequence
  Synthetic Polynucleotide
taatacgactcactatagggtatcacggagaaatctgtaattgcttccaaaacagaggagattggaaatgattacagataacctggcggcagcgcaaaagatg

SEQ ID NO: 46626 - DNA, 103 bp, Artificial Sequence
  Synthetic Polynucleotide
taatacgactcactataggggcaatataagttttataatcaaataatataaacagaggagatatattatgtgattataaaacctggcggcagcgcaaaagatg

SEQ ID NO: 46627 - DNA, 103 bp, Artificial Sequence
  Synthetic Polynucleotide
taatacgactcactatagggatacctatcacggagaaatctgtaattgctaacagaggagaagcaatatgagatttctcaacctggcggcagcgcaaaagatg

SEQ ID NO: 46628 - DNA, 103 bp, Artificial Sequence
  Synthetic Polynucleotide
taatacgactcactatagggcatcaatacctatcacggagaaatctgtaaaacagaggagattacagatgtctccgtgaaacctggcggcagcgcaaaagatg

SEQ ID NO: 46629 - DNA, 103 bp, Artificial Sequence
  Synthetic Polynucleotide
taatacgactcactatagggtccttcatcaatacctatcacggagaaatcaacagaggagagatttcatggtgataggtaacctggcggcagcgcaaaagatg

SEQ ID NO: 46630 - DNA, 103 bp, Artificial Sequence
  Synthetic Polynucleotide
taatacgactcactatagggaactgtccttcatcaatacctatcacggagaacagaggagactccgtatgaggtattgaaacctggcggcagcgcaaaagatg

SEQ ID NO: 46631 - DNA, 103 bp, Artificial Sequence
  Synthetic Polynucleotide
taatacgactcactataggggaaagaactgtccttcatcaatacctatcaaacagaggagatgatagatgttgatgaagaacctggcggcagcgcaaaagatg

SEQ ID NO: 46632 - DNA, 103 bp, Artificial Sequence
  Synthetic Polynucleotide
taatacgactcactataggggtctggaaagaactgtccttcatcaataccaacagaggagaggtattatggaaggacagaacctggcggcagcgcaaaagatg

SEQ ID NO: 46633 - DNA, 103 bp, Artificial Sequence
  Synthetic Polynucleotide
taatacgactcactatagggacaatgtctggaaagaactgtccttcatcaaacagaggagatgatgaatgacagttcttaacctggcggcagcgcaaaagatg

SEQ ID NO: 46634 - DNA, 103 bp, Artificial Sequence
  Synthetic Polynucleotide
taatacgactcactatagggattcaacaatgtctggaaagaactgtccttaacagaggagaaaggacatgtctttccagaacctggcggcagcgcaaaagatg

SEQ ID NO: 46635 - DNA, 103 bp, Artificial Sequence
  Synthetic Polynucleotide
taatacgactcactatagggacagaattcaacaatgtctggaaagaactgaacagaggagacagttcatgccagacattaacctggcggcagcgcaaaagatg

SEQ ID NO: 46636 - DNA, 103 bp, Artificial Sequence
  Synthetic Polynucleotide
taatacgactcactatagggcgctcacagaattcaacaatgtctggaaagaacagaggagactttccatgcattgttgaaacctggcggcagcgcaaaagatg

SEQ ID NO: 46637 - DNA, 103 bp, Artificial Sequence
  Synthetic Polynucleotide
taatacgactcactatagggaaacagcaatataagttttataatcaaataaacagaggagatatttgatgataaaacttaacctggcggcagcgcaaaagatg

SEQ ID NO: 46638 - DNA, 103 bp, Artificial Sequence
  Synthetic Polynucleotide
taatacgactcactatagggccatacgctcacagaattcaacaatgtctgaacagaggagacagacaatgttgaattctaacctggcggcagcgcaaaagatg

SEQ ID NO: 46639 - DNA, 103 bp, Artificial Sequence
  Synthetic Polynucleotide
taatacgactcactataggggtttgccatacgctcacagaattcaacaataacagaggagaattgttatgttctgtgagaacctggcggcagcgcaaaagatg

SEQ ID NO: 46640 - DNA, 103 bp, Artificial Sequence
  Synthetic Polynucleotide
taatacgactcactatagggccttcgtttgccatacgctcacagaattcaaacagaggagatgaattatgtgagcgtataacctggcggcagcgcaaaagatg

SEQ ID NO: 46641 - DNA, 103 bp, Artificial Sequence
  Synthetic Polynucleotide
taatacgactcactatagggtttttccttcgtttgccatacgctcacagaaacagaggagatctgtgatggtatggcaaaacctggcggcagcgcaaaagatg

SEQ ID NO: 46642 - DNA, 103 bp, Artificial Sequence
  Synthetic Polynucleotide
taatacgactcactatagggaactatttttccttcgtttgccatacgctcaacagaggagagagcgtatggcaaacgaaaacctggcggcagcgcaaaagatg

SEQ ID NO: 46643 - DNA, 103 bp, Artificial Sequence
  Synthetic Polynucleotide
taatacgactcactatagggactataactatttttccttcgtttgccataaacagaggagatatggcatgcgaaggaaaaacctggcggcagcgcaaaagatg

SEQ ID NO: 46644 - DNA, 103 bp, Artificial Sequence
  Synthetic Polynucleotide
taatacgactcactatagggcggctactataactatttttccttcgtttgaacagaggagacaaacgatggaaaaatagaacctggcggcagcgcaaaagatg

SEQ ID NO: 46645 - DNA, 103 bp, Artificial Sequence
  Synthetic Polynucleotide
taatacgactcactataggggagtgcggctactataactatttttccttcaacagaggagagaaggaatgatagttataaacctggcggcagcgcaaaagatg

SEQ ID NO: 46646 - DNA, 103 bp, Artificial Sequence
  Synthetic Polynucleotide
taatacgactcactatagggccatcgagtgcggctactataactatttttaacagaggagaaaaaatatgtatagtagcaacctggcggcagcgcaaaagatg

SEQ ID NO: 46647 - DNA, 103 bp, Artificial Sequence
  Synthetic Polynucleotide
taatacgactcactatagggatgtcccatcgagtgcggctactataactaaacagaggagatagttaatgtagccgcacaacctggcggcagcgcaaaagatg

SEQ ID NO: 46648 - DNA, 103 bp, Artificial Sequence
  Synthetic Polynucleotide
taatacgactcactatagggggactaaacagcaatataagttttataatcaacagaggagagattatatgacttatattaacctggcggcagcgcaaaagatg

SEQ ID NO: 46649 - DNA, 103 bp, Artificial Sequence
  Synthetic Polynucleotide
taatacgactcactatagggttgaaatgtcccatcgagtgcggctactataacagaggagaatagtaatggcactcgataacctggcggcagcgcaaaagatg

SEQ ID NO: 46650 - DNA, 103 bp, Artificial Sequence
  Synthetic Polynucleotide
taatacgactcactatagggttacgttgaaatgtcccatcgagtgcggctaacagaggagaagccgcatgcgatgggacaacctggcggcagcgcaaaagatg

SEQ ID NO: 46651 - DNA, 103 bp, Artificial Sequence
  Synthetic Polynucleotide
taatacgactcactatagggacggtttacgttgaaatgtcccatcgagtgaacagaggagacactcgatgggacatttcaacctggcggcagcgcaaaagatg

SEQ ID NO: 46652 - DNA, 103 bp, Artificial Sequence
  Synthetic Polynucleotide
taatacgactcactatagggattaaacggtttacgttgaaatgtcccatcaacagaggagagatgggatgtttcaacgtaacctggcggcagcgcaaaagatg

SEQ ID NO: 46653 - DNA, 103 bp, Artificial Sequence
  Synthetic Polynucleotide
taatacgactcactatagggatattattaaacggtttacgttgaaatgtcaacagaggagagacattatgacgtaaaccaacctggcggcagcgcaaaagatg

SEQ ID NO: 46654 - DNA, 103 bp, Artificial Sequence
  Synthetic Polynucleotide
taatacgactcactatagggccaagatattattaaacggtttacgttgaaaacagaggagattcaacatgaaccgtttaaacctggcggcagcgcaaaagatg

SEQ ID NO: 46655 - DNA, 103 bp, Artificial Sequence
  Synthetic Polynucleotide
taatacgactcactatagggaagatccaagatattattaaacggtttacgaacagaggagacgtaaaatgtttaataataacctggcggcagcgcaaaagatg

SEQ ID NO: 46656 - DNA, 103 bp, Artificial Sequence
  Synthetic Polynucleotide
taatacgactcactatagggggaataagatccaagatattattaaacggtaacagaggagaaccgttatgtaatatcttaacctggcggcagcgcaaaagatg

SEQ ID NO: 46657 - DNA, 103 bp, Artificial Sequence
  Synthetic Polynucleotide
taatacgactcactatagggataatggaataagatccaagatattattaaaacagaggagattaataatgtcttggatcaacctggcggcagcgcaaaagatg

SEQ ID NO: 46658 - DNA, 103 bp, Artificial Sequence
  Synthetic Polynucleotide
taatacgactcactatagggttcagataatggaataagatccaagatattaacagaggagaaatatcatggatcttattaacctggcggcagcgcaaaagatg

SEQ ID NO: 46659 - DNA, 103 bp, Artificial Sequence
  Synthetic Polynucleotide
taatacgactcactatagggagagtggactaaacagcaatataagttttaaacagaggagataaaacatgtattgctgtaacctggcggcagcgcaaaagatg

SEQ ID NO: 46660 - DNA, 103 bp, Artificial Sequence
  Synthetic Polynucleotide
taatacgactcactatagggaccatttcagataatggaataagatccaagaacagaggagacttggaatgtattccattaacctggcggcagcgcaaaagatg

SEQ ID NO: 46661 - DNA, 103 bp, Artificial Sequence
  Synthetic Polynucleotide
taatacgactcactatagggttaccaccatttcagataatggaataagataacagaggagaatcttaatgcattatctgaacctggcggcagcgcaaaagatg

SEQ ID NO: 46662 - DNA, 103 bp, Artificial Sequence
  Synthetic Polynucleotide
taatacgactcactatagggtagttttaccaccatttcagataatggaataacagaggagaattccaatgtctgaaatgaacctggcggcagcgcaaaagatg

SEQ ID NO: 46663 - DNA, 103 bp, Artificial Sequence
  Synthetic Polynucleotide
taatacgactcactataggggcagttagttttaccaccatttcagataataacagaggagaattatcatgaatggtggtaacctggcggcagcgcaaaagatg

SEQ ID NO: 46664 - DNA, 103 bp, Artificial Sequence
  Synthetic Polynucleotide
taatacgactcactatagggacactgcagttagttttaccaccatttcagaacagaggagactgaaaatgtggtaaaacaacctggcggcagcgcaaaagatg

SEQ ID NO: 46665 - DNA, 103 bp, Artificial Sequence
  Synthetic Polynucleotide
taatacgactcactatagggcatacacactgcagttagttttaccaccataacagaggagaatggtgatgaaactaactaacctggcggcagcgcaaaagatg

SEQ ID NO: 46666 - DNA, 103 bp, Artificial Sequence
  Synthetic Polynucleotide
taatacgactcactatagggcatttcatacacactgcagttagttttaccaacagaggagaggtaaaatgaactgcagtaacctggcggcagcgcaaaagatg

SEQ ID NO: 46667 - DNA, 103 bp, Artificial Sequence
  Synthetic Polynucleotide
taatacgactcactatagggtaaagcatttcatacacactgcagttagttaacagaggagaaactaaatgcagtgtgtaaacctggcggcagcgcaaaagatg

SEQ ID NO: 46668 - DNA, 103 bp, Artificial Sequence
  Synthetic Polynucleotide
taatacgactcactatagggctccttaaagcatttcatacacactgcagtaacagaggagaactgcaatgtgtatgaaaaacctggcggcagcgcaaaagatg

SEQ ID NO: 46669 - DNA, 103 bp, Artificial Sequence
  Synthetic Polynucleotide
taatacgactcactataggggacgcctccttaaagcatttcatacacactaacagaggagaagtgtgatggaaatgcttaacctggcggcagcgcaaaagatg

SEQ ID NO: 46670 - DNA, 103 bp, Artificial Sequence
  Synthetic Polynucleotide
taatacgactcactatagggtttatagagtggactaaacagcaatataagaacagaggagacttataatgctgtttagtaacctggcggcagcgcaaaagatg

SEQ ID NO: 46671 - DNA, 103 bp, Artificial Sequence
  Synthetic Polynucleotide
taatacgactcactatagggaaaaggacgcctccttaaagcatttcatacaacagaggagagtatgaatggctttaaggaacctggcggcagcgcaaaagatg

SEQ ID NO: 46672 - DNA, 103 bp, Artificial Sequence
  Synthetic Polynucleotide
taatacgactcactatagggtttagaaaaggacgcctccttaaagcatttaacagaggagaaaatgcatgaaggaggcgaacctggcggcagcgcaaaagatg

SEQ ID NO: 46673 - DNA, 103 bp, Artificial Sequence
  Synthetic Polynucleotide
taatacgactcactatagggaatcgtttagaaaaggacgcctccttaaagaacagaggagactttaaatgggcgtccttaacctggcggcagcgcaaaagatg

SEQ ID NO: 46674 - DNA, 103 bp, Artificial Sequence
  Synthetic Polynucleotide
taatacgactcactatagggtacctaatcgtttagaaaaggacgcctcctaacagaggagaaggaggatgccttttctaaacctggcggcagcgcaaaagatg

SEQ ID NO: 46675 - DNA, 103 bp, Artificial Sequence
  Synthetic Polynucleotide
taatacgactcactatagggttctgtacctaatcgtttagaaaaggacgcaacagaggagagcgtccatgtctaaacgaaacctggcggcagcgcaaaagatg

SEQ ID NO: 46676 - DNA, 103 bp, Artificial Sequence
  Synthetic Polynucleotide
taatacgactcactatagggttggtttctgtacctaatcgtttagaaaagaacagaggagacttttcatgacgattaggaacctggcggcagcgcaaaagatg

SEQ ID NO: 46677 - DNA, 103 bp, Artificial Sequence
  Synthetic Polynucleotide
taatacgactcactatagggctatcttggtttctgtacctaatcgtttagaacagaggagactaaacatgtaggtacagaacctggcggcagcgcaaaagatg

SEQ ID NO: 46678 - DNA, 103 bp, Artificial Sequence
  Synthetic Polynucleotide
taatacgactcactatagggtatttctatcttggtttctgtacctaatcgaacagaggagacgattaatgacagaaaccaacctggcggcagcgcaaaagatg

SEQ ID NO: 46679 - DNA, 103 bp, Artificial Sequence
  Synthetic Polynucleotide
taatacgactcactatagggcctattatttctatcttggtttctgtacctaacagaggagaaggtacatgaaccaagataacctggcggcagcgcaaaagatg

SEQ ID NO: 46680 - DNA, 103 bp, Artificial Sequence
  Synthetic Polynucleotide
taatacgactcactatagggttcctcctattatttctatcttggtttctgaacagaggagacagaaaatgagatagaaaaacctggcggcagcgcaaaagatg

SEQ ID NO: 46681 - DNA, 103 bp, Artificial Sequence
  Synthetic Polynucleotide
taatacgactcactatagggtccctgaataccgtggcagacgtcagacataacagaggagaatgtctatggtctgccacaacctggcggcagcgcaaaagatg

SEQ ID NO: 46682 - DNA, 103 bp, Artificial Sequence
  Synthetic Polynucleotide
taatacgactcactatagggcgatatttatagagtggactaaacagcaataacagaggagaattgctatgtagtccactaacctggcggcagcgcaaaagatg

SEQ ID NO: 46683 - DNA, 103 bp, Artificial Sequence
  Synthetic Polynucleotide
taatacgactcactatagggatcaattcctcctattatttctatcttggtaacagaggagaaccaagatggaaataataaacctggcggcagcgcaaaagatg

SEQ ID NO: 46684 - DNA, 103 bp, Artificial Sequence
  Synthetic Polynucleotide
taatacgactcactatagggtacatatcaattcctcctattatttctatcaacagaggagagatagaatgaataggaggaacctggcggcagcgcaaaagatg

SEQ ID NO: 46685 - DNA, 103 bp, Artificial Sequence
  Synthetic Polynucleotide
taatacgactcactatagggattgatacatatcaattcctcctattatttaacagaggagaaaataaatggaggaattgaacctggcggcagcgcaaaagatg

SEQ ID NO: 46686 - DNA, 103 bp, Artificial Sequence
  Synthetic Polynucleotide
taatacgactcactatagggcaccgattgatacatatcaattcctcctataacagaggagaataggaatgattgatatgaacctggcggcagcgcaaaagatg

SEQ ID NO: 46687 - DNA, 103 bp, Artificial Sequence
  Synthetic Polynucleotide
taatacgactcactatagggctacacaccgattgatacatatcaattcctaacagaggagaaggaatatgtatgtatcaaacctggcggcagcgcaaaagatg

SEQ ID NO: 46688 - DNA, 103 bp, Artificial Sequence
  Synthetic Polynucleotide
taatacgactcactatagggactttctacacaccgattgatacatatcaaaacagaggagattgataatgatcaatcggaacctggcggcagcgcaaaagatg

SEQ ID NO: 46689 - DNA, 103 bp, Artificial Sequence
  Synthetic Polynucleotide
taatacgactcactataggggtaacactttctacacaccgattgatacataacagaggagaatgtatatgtcggtgtgtaacctggcggcagcgcaaaagatg

SEQ ID NO: 46690 - DNA, 103 bp, Artificial Sequence
  Synthetic Polynucleotide
taatacgactcactatagggtcgatgtaacactttctacacaccgattgaaacagaggagatcaatcatggtgtagaaaaacctggcggcagcgcaaaagatg

SEQ ID NO: 46691 - DNA, 103 bp, Artificial Sequence
  Synthetic Polynucleotide
taatacgactcactatagggatgagtcgatgtaacactttctacacaccgaacagaggagacggtgtatggaaagtgttaacctggcggcagcgcaaaagatg

SEQ ID NO: 46692 - DNA, 103 bp, Artificial Sequence
  Synthetic Polynucleotide
taatacgactcactatagggatattatgagtcgatgtaacactttctacaaacagaggagatgtagaatgtgttacatcaacctggcggcagcgcaaaagatg

SEQ ID NO: 46693 - DNA, 103 bp, Artificial Sequence
  Synthetic Polynucleotide
taatacgactcactatagggtaatccgatatttatagagtggactaaacaaacagaggagatgtttaatgcactctataaacctggcggcagcgcaaaagatg

SEQ ID NO: 46694 - DNA, 103 bp, Artificial Sequence
  Synthetic Polynucleotide
taatacgactcactatagggatataatattatgagtcgatgtaacactttaacagaggagaaaagtgatgcatcgactcaacctggcggcagcgcaaaagatg

SEQ ID NO: 46695 - DNA, 103 bp, Artificial Sequence
  Synthetic Polynucleotide
taatacgactcactatagggaaaaaatataatattatgagtcgatgtaacaacagaggagagttacaatgactcataataacctggcggcagcgcaaaagatg

SEQ ID NO: 46696 - DNA, 103 bp, Artificial Sequence
  Synthetic Polynucleotide
taatacgactcactatagggtagataaaaaatataatattatgagtcgataacagaggagaatcgacatgtaatattataacctggcggcagcgcaaaagatg

SEQ ID NO: 46697 - DNA, 103 bp, Artificial Sequence
  Synthetic Polynucleotide
taatacgactcactatagggttttttagataaaaaatataatattatgagaacagaggagactcataatgttatattttaacctggcggcagcgcaaaagatg

SEQ ID NO: 46698 - DNA, 103 bp, Artificial Sequence
  Synthetic Polynucleotide
taatacgactcactatagggtttagttttttagataaaaaatataatattaacagaggagaaatattatgttttttatcaacctggcggcagcgcaaaagatg

SEQ ID NO: 46699 - DNA, 103 bp, Artificial Sequence
  Synthetic Polynucleotide
taatacgactcactatagggttatttttagttttttagataaaaaatataaacagaggagatatattatgtatctaaaaaacctggcggcagcgcaaaagatg

SEQ ID NO: 46700 - DNA, 103 bp, Artificial Sequence
  Synthetic Polynucleotide
taatacgactcactatagggaatgtttatttttagttttttagataaaaaaacagaggagatttttaatgaaaaaactaaacctggcggcagcgcaaaagatg

SEQ ID NO: 46701 - DNA, 103 bp, Artificial Sequence
  Synthetic Polynucleotide
taatacgactcactatagggtaatcaatgtttatttttagttttttagataacagaggagaatctaaatgactaaaaataacctggcggcagcgcaaaagatg

SEQ ID NO: 46702 - DNA, 103 bp, Artificial Sequence
  Synthetic Polynucleotide
taatacgactcactatagggaaatttaatcaatgtttatttttagtttttaacagaggagaaaaaacatgaaataaacaaacctggcggcagcgcaaaagatg

SEQ ID NO: 46703 - DNA, 103 bp, Artificial Sequence
  Synthetic Polynucleotide
taatacgactcactatagggtattaaaatttaatcaatgtttatttttagaacagaggagactaaaaatgaacattgataacctggcggcagcgcaaaagatg

SEQ ID NO: 46704 - DNA, 103 bp, Artificial Sequence
  Synthetic Polynucleotide
taatacgactcactataggggtgaataatccgatatttatagagtggactaacagaggagaagtccaatgtataaatataacctggcggcagcgcaaaagatg

SEQ ID NO: 46705 - DNA, 103 bp, Artificial Sequence
  Synthetic Polynucleotide
taatacgactcactatagggtattatattaaaatttaatcaatgtttattaacagaggagaaataaaatgtgattaaataacctggcggcagcgcaaaagatg

SEQ ID NO: 46706 - DNA, 103 bp, Artificial Sequence
  Synthetic Polynucleotide
taatacgactcactatagggttaagtattatattaaaatttaatcaatgtaacagaggagaacattgatgaaattttaaaacctggcggcagcgcaaaagatg

SEQ ID NO: 46707 - DNA, 103 bp, Artificial Sequence
  Synthetic Polynucleotide
taatacgactcactatagggcatttttaagtattatattaaaatttaatcaacagaggagagattaaatgttaatataaaacctggcggcagcgcaaaagatg

SEQ ID NO: 46708 - DNA, 103 bp, Artificial Sequence
  Synthetic Polynucleotide
taatacgactcactatagggacatccatttttaagtattatattaaaattaacagaggagaaattttatgataatacttaacctggcggcagcgcaaaagatg

SEQ ID NO: 46709 - DNA, 103 bp, Artificial Sequence
  Synthetic Polynucleotide
taatacgactcactatagggacacaacatccatttttaagtattatattaaacagaggagataatatatgacttaaaaaaacctggcggcagcgcaaaagatg

SEQ ID NO: 46710 - DNA, 103 bp, Artificial Sequence
  Synthetic Polynucleotide
taatacgactcactatagggtaacgacacaacatccatttttaagtattaaacagaggagataatacatgaaaatggataacctggcggcagcgcaaaagatg

SEQ ID NO: 46711 - DNA, 103 bp, Artificial Sequence
  Synthetic Polynucleotide
taatacgactcactatagggttatctaacgacacaacatccatttttaagaacagaggagacttaaaatgggatgttgtaacctggcggcagcgcaaaagatg

SEQ ID NO: 46712 - DNA, 103 bp, Artificial Sequence
  Synthetic Polynucleotide
taatacgactcactatagggacggtttatctaacgacacaacatccatttaacagaggagaaaatggatgttgtgtcgtaacctggcggcagcgcaaaagatg

SEQ ID NO: 46713 - DNA, 103 bp, Artificial Sequence
  Synthetic Polynucleotide
taatacgactcactatagggcataaacggtttatctaacgacacaacatcaacagaggagagatgttatgtcgttagataacctggcggcagcgcaaaagatg

SEQ ID NO: 46714 - DNA, 103 bp, Artificial Sequence
  Synthetic Polynucleotide
taatacgactcactatagggaaatacataaacggtttatctaacgacacaaacagaggagatgtgtcatgagataaaccaacctggcggcagcgcaaaagatg

SEQ ID NO: 46715 - DNA, 103 bp, Artificial Sequence
  Synthetic Polynucleotide
taatacgactcactataggggatatgtgaataatccgatatttatagagtaacagaggagaactctaatgatatcggataacctggcggcagcgcaaaagatg

SEQ ID NO: 46716 - DNA, 103 bp, Artificial Sequence
  Synthetic Polynucleotide
taatacgactcactatagggcctcaaaatacataaacggtttatctaacgaacagaggagacgttagatgaaccgtttaaacctggcggcagcgcaaaagatg

SEQ ID NO: 46717 - DNA, 103 bp, Artificial Sequence
  Synthetic Polynucleotide
taatacgactcactatagggaatttcctcaaaatacataaacggtttatcaacagaggagagataaaatgtttatgtataacctggcggcagcgcaaaagatg

SEQ ID NO: 46718 - DNA, 103 bp, Artificial Sequence
  Synthetic Polynucleotide
taatacgactcactatagggttatcaatttcctcaaaatacataaacggtaacagaggagaaccgttatggtattttgaaacctggcggcagcgcaaaagatg

SEQ ID NO: 46719 - DNA, 103 bp, Artificial Sequence
  Synthetic Polynucleotide
taatacgactcactatagggactcattatcaatttcctcaaaatacataaaacagaggagattatgtatgttgaggaaaaacctggcggcagcgcaaaagatg

SEQ ID NO: 46720 - DNA, 103 bp, Artificial Sequence
  Synthetic Polynucleotide
taatacgactcactatagggatctaactcattatcaatttcctcaaaataaacagaggagatattttatggaaattgataacctggcggcagcgcaaaagatg

SEQ ID NO: 46721 - DNA, 103 bp, Artificial Sequence
  Synthetic Polynucleotide
taatacgactcactatagggtcgtaatctaactcattatcaatttcctcaaacagaggagatgaggaatgtgataatgaaacctggcggcagcgcaaaagatg

SEQ ID NO: 46722 - DNA, 103 bp, Artificial Sequence
  Synthetic Polynucleotide
taatacgactcactatagggctggttcgtaatctaactcattatcaatttaacagaggagaaaattgatgatgagttagaacctggcggcagcgcaaaagatg

SEQ ID NO: 46723 - DNA, 103 bp, Artificial Sequence
  Synthetic Polynucleotide
taatacgactcactatagggactttctggttcgtaatctaactcattatcaacagaggagagataatatgttagattacaacctggcggcagcgcaaaagatg

SEQ ID NO: 46724 - DNA, 103 bp, Artificial Sequence
  Synthetic Polynucleotide
taatacgactcactatagggtttgcactttctggttcgtaatctaactcaaacagaggagatgagttatgttacgaaccaacctggcggcagcgcaaaagatg

SEQ ID NO: 46725 - DNA, 103 bp, Artificial Sequence
  Synthetic Polynucleotide
taatacgactcactatagggcctcatttgcactttctggttcgtaatctaaacagaggagatagattatgaaccagaaaaacctggcggcagcgcaaaagatg

SEQ ID NO: 46726 - DNA, 103 bp, Artificial Sequence
  Synthetic Polynucleotide
taatacgactcactataggggaaacgatatgtgaataatccgatatttataacagaggagaataaatatgggattattcaacctggcggcagcgcaaaagatg

SEQ ID NO: 46727 - DNA, 103 bp, Artificial Sequence
  Synthetic Polynucleotide
taatacgactcactatagggtgctacctcatttgcactttctggttcgtaaacagaggagatacgaaatggaaagtgcaaacctggcggcagcgcaaaagatg

SEQ ID NO: 46728 - DNA, 103 bp, Artificial Sequence
  Synthetic Polynucleotide
taatacgactcactatagggttttttgctacctcatttgcactttctggtaacagaggagaaccagaatgtgcaaatgaaacctggcggcagcgcaaaagatg

SEQ ID NO: 46729 - DNA, 103 bp, Artificial Sequence
  Synthetic Polynucleotide
taatacgactcactataggggcagtttttttgctacctcatttgcactttaacagaggagaaaagtgatgatgaggtagaacctggcggcagcgcaaaagatg

SEQ ID NO: 46730 - DNA, 103 bp, Artificial Sequence
  Synthetic Polynucleotide
taatacgactcactatagggatacggcagtttttttgctacctcatttgcaacagaggagagcaaatatggtagcaaaaaacctggcggcagcgcaaaagatg

SEQ ID NO: 46731 - DNA, 103 bp, Artificial Sequence
  Synthetic Polynucleotide
taatacgactcactatagggccttgatacggcagtttttttgctacctcaaacagaggagatgaggtatgaaaaaaactaacctggcggcagcgcaaaagatg

SEQ ID NO: 46732 - DNA, 103 bp, Artificial Sequence
  Synthetic Polynucleotide
taatacgactcactatagggactgtccttgatacggcagtttttttgctaaacagaggagatagcaaatgaactgccgtaacctggcggcagcgcaaaagatg

SEQ ID NO: 46733 - DNA, 103 bp, Artificial Sequence
  Synthetic Polynucleotide
taatacgactcactatagggttttaactgtccttgatacggcagttttttaacagaggagaaaaaaaatgccgtatcaaaacctggcggcagcgcaaaagatg

SEQ ID NO: 46734 - DNA, 103 bp, Artificial Sequence
  Synthetic Polynucleotide
taatacgactcactatagggaatagttttaactgtccttgatacggcagtaacagaggagaactgccatgtcaaggacaaacctggcggcagcgcaaaagatg

SEQ ID NO: 46735 - DNA, 103 bp, Artificial Sequence
  Synthetic Polynucleotide
taatacgactcactatagggctagtaatagttttaactgtccttgatacgaacagaggagacgtatcatggacagttaaaacctggcggcagcgcaaaagatg

SEQ ID NO: 46736 - DNA, 103 bp, Artificial Sequence
  Synthetic Polynucleotide
taatacgactcactatagggttctcctagtaatagttttaactgtccttgaacagaggagacaaggaatgttaaaactaaacctggcggcagcgcaaaagatg

SEQ ID NO: 46737 - DNA, 103 bp, Artificial Sequence
  Synthetic Polynucleotide
taatacgactcactatagggacaaagaaacgatatgtgaataatccgataaacagaggagatatcggatgattcacataaacctggcggcagcgcaaaagatg

SEQ ID NO: 46738 - DNA, 103 bp, Artificial Sequence
  Synthetic Polynucleotide
taatacgactcactatagggaataattctcctagtaatagttttaactgtaacagaggagaacagttatgactattactaacctggcggcagcgcaaaagatg

SEQ ID NO: 46739 - DNA, 103 bp, Artificial Sequence
  Synthetic Polynucleotide
taatacgactcactataggggaaaaaataattctcctagtaatagttttaaacagaggagataaaacatgtactaggagaacctggcggcagcgcaaaagatg

SEQ ID NO: 46740 - DNA, 103 bp, Artificial Sequence
  Synthetic Polynucleotide
taatacgactcactatagggactaagaaaaaataattctcctagtaatagaacagaggagactattaatgggagaattaaacctggcggcagcgcaaaagatg

SEQ ID NO: 46741 - DNA, 103 bp, Artificial Sequence
  Synthetic Polynucleotide
taatacgactcactatagggaacttactaagaaaaaataattctcctagtaacagaggagaactaggatgattatttttaacctggcggcagcgcaaaagatg

SEQ ID NO: 46742 - DNA, 103 bp, Artificial Sequence
  Synthetic Polynucleotide
taatacgactcactataggggctgtaacttactaagaaaaaataattctcaacagaggagagagaatatgtttttcttaaacctggcggcagcgcaaaagatg

SEQ ID NO: 46743 - DNA, 103 bp, Artificial Sequence
  Synthetic Polynucleotide
taatacgactcactataggggtgtcgctgtaacttactaagaaaaaataaaacagaggagattatttatgcttagtaagaacctggcggcagcgcaaaagatg

SEQ ID NO: 46744 - DNA, 103 bp, Artificial Sequence
  Synthetic Polynucleotide
taatacgactcactatagggataccgtgtcgctgtaacttactaagaaaaaacagaggagattttctatgtaagttacaaacctggcggcagcgcaaaagatg

SEQ ID NO: 46745 - DNA, 103 bp, Artificial Sequence
  Synthetic Polynucleotide
taatacgactcactatagggctaatataccgtgtcgctgtaacttactaaaacagaggagattagtaatgtacagcgacaacctggcggcagcgcaaaagatg

SEQ ID NO: 46746 - DNA, 103 bp, Artificial Sequence
  Synthetic Polynucleotide
taatacgactcactatagggaccatctaatataccgtgtcgctgtaacttaacagaggagaaagttaatgcgacacggtaacctggcggcagcgcaaaagatg

SEQ ID NO: 46747 - DNA, 103 bp, Artificial Sequence
  Synthetic Polynucleotide
taatacgactcactataggggtggcaccatctaatataccgtgtcgctgtaacagaggagaacagcgatgcggtatattaacctggcggcagcgcaaaagatg

SEQ ID NO: 46748 - DNA, 103 bp, Artificial Sequence
  Synthetic Polynucleotide
taatacgactcactatagggaacctacaaagaaacgatatgtgaataatcaacagaggagagattatatgcatatcgttaacctggcggcagcgcaaaagatg

SEQ ID NO: 46749 - DNA, 103 bp, Artificial Sequence
  Synthetic Polynucleotide
taatacgactcactatagggctacggtggcaccatctaatataccgtgtcaacagaggagagacacgatgtattagatgaacctggcggcagcgcaaaagatg

SEQ ID NO: 46750 - DNA, 103 bp, Artificial Sequence
  Synthetic Polynucleotide
taatacgactcactatagggatacactacggtggcaccatctaatataccaacagaggagaggtataatggatggtgccaacctggcggcagcgcaaaagatg

SEQ ID NO: 46751 - DNA, 103 bp, Artificial Sequence
  Synthetic Polynucleotide
taatacgactcactatagggcctatatacactacggtggcaccatctaataacagaggagaattagaatgtgccaccgtaacctggcggcagcgcaaaagatg

SEQ ID NO: 46752 - DNA, 103 bp, Artificial Sequence
  Synthetic Polynucleotide
taatacgactcactatagggcagatcctatatacactacggtggcaccataacagaggagaatggtgatgccgtagtgtaacctggcggcagcgcaaaagatg

SEQ ID NO: 46753 - DNA, 103 bp, Artificial Sequence
  Synthetic Polynucleotide
taatacgactcactataggggggagcagatcctatatacactacggtggcaacagaggagagccaccatggtgtatataaacctggcggcagcgcaaaagatg

SEQ ID NO: 46754 - DNA, 103 bp, Artificial Sequence
  Synthetic Polynucleotide
taatacgactcactataggggtaccgggagcagatcctatatacactacgaacagaggagacgtagtatgtataggatcaacctggcggcagcgcaaaagatg

SEQ ID NO: 46755 - DNA, 103 bp, Artificial Sequence
  Synthetic Polynucleotide
taatacgactcactatagggtatgtgtaccgggagcagatcctatatacaaacagaggagatgtataatggatctgctcaacctggcggcagcgcaaaagatg

SEQ ID NO: 46756 - DNA, 103 bp, Artificial Sequence
  Synthetic Polynucleotide
taatacgactcactatagggacgtatatgtgtaccgggagcagatcctataacagaggagaataggaatggctcccggtaacctggcggcagcgcaaaagatg

SEQ ID NO: 46757 - DNA, 103 bp, Artificial Sequence
  Synthetic Polynucleotide
taatacgactcactatagggaaataacgtatatgtgtaccgggagcagataacagaggagaatctgcatgcggtacacaaacctggcggcagcgcaaaagatg

SEQ ID NO: 46758 - DNA, 103 bp, Artificial Sequence
  Synthetic Polynucleotide
taatacgactcactatagggctctcaaataacgtatatgtgtaccgggagaacagaggagactcccgatgcacatatacaacctggcggcagcgcaaaagatg

SEQ ID NO: 46759 - DNA, 103 bp, Artificial Sequence
  Synthetic Polynucleotide
taatacgactcactatagggaaataaacctacaaagaaacgatatgtgaaaacagaggagattcacaatgcgtttctttaacctggcggcagcgcaaaagatg

SEQ ID NO: 46760 - DNA, 103 bp, Artificial Sequence
  Synthetic Polynucleotide
taatacgactcactatagggatgatctctcaaataacgtatatgtgtaccaacagaggagaggtacaatgatacgttataacctggcggcagcgcaaaagatg

SEQ ID NO: 46761 - DNA, 103 bp, Artificial Sequence
  Synthetic Polynucleotide
taatacgactcactatagggtagaaatgatctctcaaataacgtatatgtaacagaggagaacatatatgttatttgagaacctggcggcagcgcaaaagatg

SEQ ID NO: 46762 - DNA, 103 bp, Artificial Sequence
  Synthetic Polynucleotide
taatacgactcactatagggaattatagaaatgatctctcaaataacgtaaacagaggagatacgttatgtgagagatcaacctggcggcagcgcaaaagatg

SEQ ID NO: 46763 - DNA, 103 bp, Artificial Sequence
  Synthetic Polynucleotide
taatacgactcactatagggtcctaaattatagaaatgatctctcaaataaacagaggagatatttgatggatcatttcaacctggcggcagcgcaaaagatg

SEQ ID NO: 46764 - DNA, 103 bp, Artificial Sequence
  Synthetic Polynucleotide
taatacgactcactatagggatcactcctaaattatagaaatgatctctcaacagaggagagagagaatgtttctataaaacctggcggcagcgcaaaagatg

SEQ ID NO: 46765 - DNA, 103 bp, Artificial Sequence
  Synthetic Polynucleotide
taatacgactcactatagggtgatgatcactcctaaattatagaaatgataacagaggagaatcattatgataatttagaacctggcggcagcgcaaaagatg

SEQ ID NO: 46766 - DNA, 103 bp, Artificial Sequence
  Synthetic Polynucleotide
taatacgactcactatagggccatttgatgatcactcctaaattatagaaaacagaggagattctatatgttaggagtgaacctggcggcagcgcaaaagatg

SEQ ID NO: 46767 - DNA, 103 bp, Artificial Sequence
  Synthetic Polynucleotide
taatacgactcactatagggagcatccatttgatgatcactcctaaattaaacagaggagataatttatgagtgatcataacctggcggcagcgcaaaagatg

SEQ ID NO: 46768 - DNA, 103 bp, Artificial Sequence
  Synthetic Polynucleotide
taatacgactcactatagggcaattagcatccatttgatgatcactcctaaacagaggagataggagatgtcatcaaataacctggcggcagcgcaaaagatg

SEQ ID NO: 46769 - DNA, 103 bp, Artificial Sequence
  Synthetic Polynucleotide
taatacgactcactataggggccgtcaattagcatccatttgatgatcacaacagaggagagtgatcatgaaatggatgaacctggcggcagcgcaaaagatg

SEQ ID NO: 46770 - DNA, 103 bp, Artificial Sequence
  Synthetic Polynucleotide
taatacgactcactatagggaagttaaataaacctacaaagaaacgatataacagaggagaatatcgatgctttgtaggaacctggcggcagcgcaaaagatg

SEQ ID NO: 46771 - DNA, 103 bp, Artificial Sequence
  Synthetic Polynucleotide
taatacgactcactatagggtgacggccgtcaattagcatccatttgatgaacagaggagacatcaaatggatgctaataacctggcggcagcgcaaaagatg

SEQ ID NO: 46772 - DNA, 103 bp, Artificial Sequence
  Synthetic Polynucleotide
taatacgactcactatagggcatgatgacggccgtcaattagcatccattaacagaggagaaatggaatgtaattgacgaacctggcggcagcgcaaaagatg

SEQ ID NO: 46773 - DNA, 103 bp, Artificial Sequence
  Synthetic Polynucleotide
taatacgactcactatagggaggatcatgatgacggccgtcaattagcataacagaggagaatgctaatggacggccgtaacctggcggcagcgcaaaagatg

SEQ ID NO: 46774 - DNA, 103 bp, Artificial Sequence
  Synthetic Polynucleotide
taatacgactcactatagggagaataggatcatgatgacggccgtcaattaacagaggagaaattgaatgccgtcatcaaacctggcggcagcgcaaaagatg

SEQ ID NO: 46775 - DNA, 103 bp, Artificial Sequence
  Synthetic Polynucleotide
taatacgactcactatagggcatttagaataggatcatgatgacggccgtaacagaggagaacggccatgatcatgatcaacctggcggcagcgcaaaagatg

SEQ ID NO: 46776 - DNA, 103 bp, Artificial Sequence
  Synthetic Polynucleotide
taatacgactcactatagggtaatccatttagaataggatcatgatgacgaacagaggagacgtcatatggatcctattaacctggcggcagcgcaaaagatg

SEQ ID NO: 46777 - DNA, 103 bp, Artificial Sequence
  Synthetic Polynucleotide
taatacgactcactatagggtcacgtaatccatttagaataggatcatgaaacagaggagatcatgaatgtattctaaaaacctggcggcagcgcaaaagatg

SEQ ID NO: 46778 - DNA, 103 bp, Artificial Sequence
  Synthetic Polynucleotide
taatacgactcactatagggtcacatcacgtaatccatttagaataggataacagaggagaatcctaatgtaaatggataacctggcggcagcgcaaaagatg

SEQ ID NO: 46779 - DNA, 103 bp, Artificial Sequence
  Synthetic Polynucleotide
taatacgactcactatagggtagagtcacatcacgtaatccatttagaataacagaggagaattctaatgggattacgtaacctggcggcagcgcaaaagatg

SEQ ID NO: 46780 - DNA, 103 bp, Artificial Sequence
  Synthetic Polynucleotide
taatacgactcactataggggttactagagtcacatcacgtaatccatttaacagaggagaaaatggatgacgtgatgtaacctggcggcagcgcaaaagatg

SEQ ID NO: 46781 - DNA, 103 bp, Artificial Sequence
  Synthetic Polynucleotide
taatacgactcactatagggtgtacaagttaaataaacctacaaagaaacaacagaggagagtttctatgtaggtttataacctggcggcagcgcaaaagatg

SEQ ID NO: 46782 - DNA, 103 bp, Artificial Sequence
  Synthetic Polynucleotide
taatacgactcactatagggaccgagttactagagtcacatcacgtaatcaacagaggagagattacatgatgtgactcaacctggcggcagcgcaaaagatg

SEQ ID NO: 46783 - DNA, 103 bp, Artificial Sequence
  Synthetic Polynucleotide
taatacgactcactatagggaacgaaccgagttactagagtcacatcacgaacagaggagacgtgatatgactctagtaaacctggcggcagcgcaaaagatg

SEQ ID NO: 46784 - DNA, 103 bp, Artificial Sequence
  Synthetic Polynucleotide
taatacgactcactatagggtcatcaacgaaccgagttactagagtcacaaacagaggagatgtgacatgagtaactcgaacctggcggcagcgcaaaagatg

SEQ ID NO: 46785 - DNA, 103 bp, Artificial Sequence
  Synthetic Polynucleotide
taatacgactcactatagggattcctcatcaacgaaccgagttactagagaacagaggagactctagatgctcggttcgaacctggcggcagcgcaaaagatg

SEQ ID NO: 46786 - DNA, 103 bp, Artificial Sequence
  Synthetic Polynucleotide
taatacgactcactatagggtagatattcctcatcaacgaaccgagttacaacagaggagagtaactatgttcgttgataacctggcggcagcgcaaaagatg

SEQ ID NO: 46787 - DNA, 103 bp, Artificial Sequence
  Synthetic Polynucleotide
taatacgactcactataggggatcgtagatattcctcatcaacgaaccgaaacagaggagatcggttatgtgatgaggaaacctggcggcagcgcaaaagatg

SEQ ID NO: 46788 - DNA, 103 bp, Artificial Sequence
  Synthetic Polynucleotide
taatacgactcactatagggtgatggatcgtagatattcctcatcaacgaaacagaggagatcgttgatgaggaatatcaacctggcggcagcgcaaaagatg

SEQ ID NO: 46789 - DNA, 103 bp, Artificial Sequence
  Synthetic Polynucleotide
taatacgactcactatagggttttttgatggatcgtagatattcctcatcaacagaggagagatgagatgtatctacgaaacctggcggcagcgcaaaagatg

SEQ ID NO: 46790 - DNA, 103 bp, Artificial Sequence
  Synthetic Polynucleotide
taatacgactcactatagggagttgttttttgatggatcgtagatattccaacagaggagaggaataatgacgatccataacctggcggcagcgcaaaagatg

SEQ ID NO: 46791 - DNA, 103 bp, Artificial Sequence
  Synthetic Polynucleotide
taatacgactcactataggggatgcagttgttttttgatggatcgtagataacagaggagaatctacatgccatcaaaaaacctggcggcagcgcaaaagatg

SEQ ID NO: 46792 - DNA, 103 bp, Artificial Sequence
  Synthetic Polynucleotide
taatacgactcactatagggaggactccctgaataccgtggcagacgtcaaacagaggagatgacgtatgccacggtataacctggcggcagcgcaaaagatg

SEQ ID NO: 46793 - DNA, 103 bp, Artificial Sequence
  Synthetic Polynucleotide
taatacgactcactatagggagtgatgtacaagttaaataaacctacaaaaacagaggagatttgtaatgttatttaacaacctggcggcagcgcaaaagatg

SEQ ID NO: 46794 - DNA, 103 bp, Artificial Sequence
  Synthetic Polynucleotide
taatacgactcactatagggagaaggatgcagttgttttttgatggatcgaacagaggagacgatccatgaaaaaacaaaacctggcggcagcgcaaaagatg

SEQ ID NO: 46795 - DNA, 103 bp, Artificial Sequence
  Synthetic Polynucleotide
taatacgactcactatagggatcttagaaggatgcagttgttttttgatgaacagaggagacatcaaatgacaactgcaaacctggcggcagcgcaaaagatg

SEQ ID NO: 46796 - DNA, 103 bp, Artificial Sequence
  Synthetic Polynucleotide
taatacgactcactatagggaaataatcttagaaggatgcagttgtttttaacagaggagaaaaaacatgtgcatccttaacctggcggcagcgcaaaagatg

SEQ ID NO: 46797 - DNA, 103 bp, Artificial Sequence
  Synthetic Polynucleotide
taatacgactcactatagggaattaaaataatcttagaaggatgcagttgaacagaggagacaactgatgccttctaagaacctggcggcagcgcaaaagatg

SEQ ID NO: 46798 - DNA, 103 bp, Artificial Sequence
  Synthetic Polynucleotide
taatacgactcactatagggtcagaaattaaaataatcttagaaggatgcaacagaggagagcatccatgtaagattataacctggcggcagcgcaaaagatg

SEQ ID NO: 46799 - DNA, 103 bp, Artificial Sequence
  Synthetic Polynucleotide
taatacgactcactataggggcacatcagaaattaaaataatcttagaagaacagaggagacttctaatgttattttaaaacctggcggcagcgcaaaagatg

SEQ ID NO: 46800 - DNA, 103 bp, Artificial Sequence
  Synthetic Polynucleotide
taatacgactcactatagggggatcgcacatcagaaattaaaataatcttaacagaggagaaagattatgttaatttctaacctggcggcagcgcaaaagatg

SEQ ID NO: 46801 - DNA, 103 bp, Artificial Sequence
  Synthetic Polynucleotide
taatacgactcactatagggcgtttggatcgcacatcagaaattaaaataaacagaggagatattttatgttctgatgtaacctggcggcagcgcaaaagatg

SEQ ID NO: 46802 - DNA, 103 bp, Artificial Sequence
  Synthetic Polynucleotide
taatacgactcactatagggctcctcgtttggatcgcacatcagaaattaaacagaggagataatttatgatgtgcgataacctggcggcagcgcaaaagatg

SEQ ID NO: 46803 - DNA, 103 bp, Artificial Sequence
  Synthetic Polynucleotide
taatacgactcactatagggatttcctcctcgtttggatcgcacatcagaaacagaggagatctgatatgcgatccaaaaacctggcggcagcgcaaaagatg

SEQ ID NO: 46804 - DNA, 103 bp, Artificial Sequence
  Synthetic Polynucleotide
taatacgactcactatagggcttacagtgatgtacaagttaaataaacctaacagaggagaaggtttatgtaacttgtaaacctggcggcagcgcaaaagatg

SEQ ID NO: 46805 - DNA, 103 bp, Artificial Sequence
  Synthetic Polynucleotide
taatacgactcactatagggggttcatttcctcctcgtttggatcgcacaaacagaggagatgtgcgatgcaaacgaggaacctggcggcagcgcaaaagatg

SEQ ID NO: 46806 - DNA, 103 bp, Artificial Sequence
  Synthetic Polynucleotide
taatacgactcactatagggtactaggttcatttcctcctcgtttggatcaacagaggagagatccaatggaggaggaaaacctggcggcagcgcaaaagatg

SEQ ID NO: 46807 - DNA, 103 bp, Artificial Sequence
  Synthetic Polynucleotide
taatacgactcactatagggctcagtactaggttcatttcctcctcgtttaacagaggagaaaacgaatgggaaatgaaaacctggcggcagcgcaaaagatg

SEQ ID NO: 46808 - DNA, 103 bp, Artificial Sequence
  Synthetic Polynucleotide
taatacgactcactatagggaaatcctcagtactaggttcatttcctcctaacagaggagaaggaggatgtgaacctagaacctggcggcagcgcaaaagatg

SEQ ID NO: 46809 - DNA, 103 bp, Artificial Sequence
  Synthetic Polynucleotide
taatacgactcactatagggttagtaaatcctcagtactaggttcatttcaacagaggagagaaatgatgctagtactgaacctggcggcagcgcaaaagatg

SEQ ID NO: 46810 - DNA, 103 bp, Artificial Sequence
  Synthetic Polynucleotide
taatacgactcactatagggattacttagtaaatcctcagtactaggttcaacagaggagagaacctatgactgaggataacctggcggcagcgcaaaagatg

SEQ ID NO: 46811 - DNA, 103 bp, Artificial Sequence
  Synthetic Polynucleotide
taatacgactcactataggggcgtaattacttagtaaatcctcagtactaaacagaggagatagtacatgggatttactaacctggcggcagcgcaaaagatg

SEQ ID NO: 46812 - DNA, 103 bp, Artificial Sequence
  Synthetic Polynucleotide
taatacgactcactataggggtagagcgtaattacttagtaaatcctcagaacagaggagactgaggatgtactaagtaaacctggcggcagcgcaaaagatg

SEQ ID NO: 46813 - DNA, 103 bp, Artificial Sequence
  Synthetic Polynucleotide
taatacgactcactatagggattttgtagagcgtaattacttagtaaatcaacagaggagagatttaatgagtaattacaacctggcggcagcgcaaaagatg

SEQ ID NO: 46814 - DNA, 103 bp, Artificial Sequence
  Synthetic Polynucleotide
taatacgactcactatagggatgacattttgtagagcgtaattacttagtaacagaggagaactaagatgttacgctctaacctggcggcagcgcaaaagatg

SEQ ID NO: 46815 - DNA, 103 bp, Artificial Sequence
  Synthetic Polynucleotide
taatacgactcactatagggacatgcttacagtgatgtacaagttaaataaacagaggagatatttaatgtgtacatcaaacctggcggcagcgcaaaagatg

SEQ ID NO: 46816 - DNA, 103 bp, Artificial Sequence
  Synthetic Polynucleotide
taatacgactcactatagggtaatcatgacattttgtagagcgtaattacaacagaggagagtaattatgctctacaaaaacctggcggcagcgcaaaagatg

SEQ ID NO: 46817 - DNA, 103 bp, Artificial Sequence
  Synthetic Polynucleotide
taatacgactcactatagggaatactaatcatgacattttgtagagcgtaaacagaggagatacgctatgcaaaatgtcaacctggcggcagcgcaaaagatg

SEQ ID NO: 46818 - DNA, 103 bp, Artificial Sequence
  Synthetic Polynucleotide
taatacgactcactatagggtttaaaatactaatcatgacattttgtagaaacagaggagatctacaatgtgtcatgataacctggcggcagcgcaaaagatg

SEQ ID NO: 46819 - DNA, 103 bp, Artificial Sequence
  Synthetic Polynucleotide
taatacgactcactatagggcggggtttaaaatactaatcatgacattttaacagaggagaaaaatgatgtgattagtaaacctggcggcagcgcaaaagatg

SEQ ID NO: 46820 - DNA, 103 bp, Artificial Sequence
  Synthetic Polynucleotide
taatacgactcactatagggcgctacggggtttaaaatactaatcatgacaacagaggagagtcatgatgagtattttaaacctggcggcagcgcaaaagatg

SEQ ID NO: 46821 - DNA, 103 bp, Artificial Sequence
  Synthetic Polynucleotide
taatacgactcactatagggctagacgctacggggtttaaaatactaatcaacagaggagagattagatgtttaaacccaacctggcggcagcgcaaaagatg

SEQ ID NO: 46822 - DNA, 103 bp, Artificial Sequence
  Synthetic Polynucleotide
taatacgactcactatagggtaagactagacgctacggggtttaaaatacaacagaggagagtatttatgaccccgtagaacctggcggcagcgcaaaagatg

SEQ ID NO: 46823 - DNA, 103 bp, Artificial Sequence
  Synthetic Polynucleotide
taatacgactcactatagggccatttaagactagacgctacggggtttaaaacagaggagattaaacatggtagcgtctaacctggcggcagcgcaaaagatg

SEQ ID NO: 46824 - DNA, 103 bp, Artificial Sequence
  Synthetic Polynucleotide
taatacgactcactatagggcatctccatttaagactagacgctacggggaacagaggagaccccgtatggtctagtctaacctggcggcagcgcaaaagatg

SEQ ID NO: 46825 - DNA, 103 bp, Artificial Sequence
  Synthetic Polynucleotide
taatacgactcactatagggacgggcatctccatttaagactagacgctaaacagaggagatagcgtatggtcttaaataacctggcggcagcgcaaaagatg

SEQ ID NO: 46826 - DNA, 103 bp, Artificial Sequence
  Synthetic Polynucleotide
taatacgactcactatagggtacggacatgcttacagtgatgtacaagttaacagaggagaaacttgatgatcactgtaaacctggcggcagcgcaaaagatg

SEQ ID NO: 46827 - DNA, 103 bp, Artificial Sequence
  Synthetic Polynucleotide
taatacgactcactatagggtggaaacgggcatctccatttaagactagaaacagaggagatctagtatgaaatggagaaacctggcggcagcgcaaaagatg

SEQ ID NO: 46828 - DNA, 103 bp, Artificial Sequence
  Synthetic Polynucleotide
taatacgactcactatagggtgatctggaaacgggcatctccatttaagaaacagaggagatcttaaatggagatgcccaacctggcggcagcgcaaaagatg

SEQ ID NO: 46829 - DNA, 103 bp, Artificial Sequence
  Synthetic Polynucleotide
taatacgactcactatagggtccattgatctggaaacgggcatctccattaacagaggagaaatggaatggcccgtttcaacctggcggcagcgcaaaagatg

SEQ ID NO: 46830 - DNA, 103 bp, Artificial Sequence
  Synthetic Polynucleotide
taatacgactcactatagggcttaatccattgatctggaaacgggcatctaacagaggagaagatgcatgtttccagataacctggcggcagcgcaaaagatg

SEQ ID NO: 46831 - DNA, 103 bp, Artificial Sequence
  Synthetic Polynucleotide
taatacgactcactatagggaagtccttaatccattgatctggaaacgggaacagaggagacccgttatgagatcaatgaacctggcggcagcgcaaaagatg

SEQ ID NO: 46832 - DNA, 103 bp, Artificial Sequence
  Synthetic Polynucleotide
taatacgactcactatagggtataaaagtccttaatccattgatctggaaaacagaggagattccagatgaatggattaaacctggcggcagcgcaaaagatg

SEQ ID NO: 46833 - DNA, 103 bp, Artificial Sequence
  Synthetic Polynucleotide
taatacgactcactatagggtgggatataaaagtccttaatccattgatcaacagaggagagatcaaatgattaaggacaacctggcggcagcgcaaaagatg

SEQ ID NO: 46834 - DNA, 103 bp, Artificial Sequence
  Synthetic Polynucleotide
taatacgactcactatagggccgtgtgggatataaaagtccttaatccataacagaggagaatggatatgggacttttaaacctggcggcagcgcaaaagatg

SEQ ID NO: 46835 - DNA, 103 bp, Artificial Sequence
  Synthetic Polynucleotide
taatacgactcactatagggtattaccgtgtgggatataaaagtccttaaaacagaggagattaaggatgtttatatccaacctggcggcagcgcaaaagatg

SEQ ID NO: 46836 - DNA, 103 bp, Artificial Sequence
  Synthetic Polynucleotide
taatacgactcactatagggcattttattaccgtgtgggatataaaagtcaacagaggagagactttatgatcccacacaacctggcggcagcgcaaaagatg

SEQ ID NO: 46837 - DNA, 103 bp, Artificial Sequence
  Synthetic Polynucleotide
taatacgactcactatagggaatggtacggacatgcttacagtgatgtacaacagaggagagtacatatgtgtaagcataacctggcggcagcgcaaaagatg

SEQ ID NO: 46838 - DNA, 103 bp, Artificial Sequence
  Synthetic Polynucleotide
taatacgactcactatagggtgtgacattttattaccgtgtgggatataaaacagaggagattatatatgacacggtaaaacctggcggcagcgcaaaagatg

SEQ ID NO: 46839 - DNA, 103 bp, Artificial Sequence
  Synthetic Polynucleotide
taatacgactcactatagggaaggttgtgacattttattaccgtgtgggaaacagaggagatcccacatggtaataaaaaacctggcggcagcgcaaaagatg

SEQ ID NO: 46840 - DNA, 103 bp, Artificial Sequence
  Synthetic Polynucleotide
taatacgactcactatagggagcaaaaggttgtgacattttattaccgtgaacagaggagacacggtatgaaaatgtcaaacctggcggcagcgcaaaagatg

SEQ ID NO: 46841 - DNA, 103 bp, Artificial Sequence
  Synthetic Polynucleotide
taatacgactcactataggggaaggagcaaaaggttgtgacattttattaaacagaggagataataaatggtcacaaccaacctggcggcagcgcaaaagatg

SEQ ID NO: 46842 - DNA, 103 bp, Artificial Sequence
  Synthetic Polynucleotide
taatacgactcactatagggaatatgaaggagcaaaaggttgtgacatttaacagaggagaaaatgtatgaaccttttgaacctggcggcagcgcaaaagatg

SEQ ID NO: 46843 - DNA, 103 bp, Artificial Sequence
  Synthetic Polynucleotide
taatacgactcactatagggagctgaatatgaaggagcaaaaggttgtgaaacagaggagatcacaaatgtttgctcctaacctggcggcagcgcaaaagatg

SEQ ID NO: 46844 - DNA, 103 bp, Artificial Sequence
  Synthetic Polynucleotide
taatacgactcactatagggatttcagctgaatatgaaggagcaaaaggtaacagaggagaacctttatgtccttcataaacctggcggcagcgcaaaagatg

SEQ ID NO: 46845 - DNA, 103 bp, Artificial Sequence
  Synthetic Polynucleotide
taatacgactcactatagggatctcatttcagctgaatatgaaggagcaaaacagaggagattgctcatgcatattcagaacctggcggcagcgcaaaagatg

SEQ ID NO: 46846 - DNA, 103 bp, Artificial Sequence
  Synthetic Polynucleotide
taatacgactcactatagggtaataatctcatttcagctgaatatgaaggaacagaggagaccttcaatgtcagctgaaaacctggcggcagcgcaaaagatg

SEQ ID NO: 46847 - DNA, 103 bp, Artificial Sequence
  Synthetic Polynucleotide
taatacgactcactatagggatacttaataatctcatttcagctgaatataacagaggagaatattcatgtgaaatgagaacctggcggcagcgcaaaagatg

SEQ ID NO: 46848 - DNA, 103 bp, Artificial Sequence
  Synthetic Polynucleotide
taatacgactcactatagggaaataaatggtacggacatgcttacagtgaaacagaggagatcactgatggcatgtccgaacctggcggcagcgcaaaagatg

SEQ ID NO: 46849 - DNA, 103 bp, Artificial Sequence
  Synthetic Polynucleotide
taatacgactcactatagggtataaatacttaataatctcatttcagctgaacagaggagacagctgatgtgagattataacctggcggcagcgcaaaagatg

SEQ ID NO: 46850 - DNA, 103 bp, Artificial Sequence
  Synthetic Polynucleotide
taatacgactcactatagggaccggtataaatacttaataatctcatttcaacagaggagagaaatgatgttattaagtaacctggcggcagcgcaaaagatg

SEQ ID NO: 46851 - DNA, 103 bp, Artificial Sequence
  Synthetic Polynucleotide
taatacgactcactatagggttctcaccggtataaatacttaataatctcaacagaggagagagattatgaagtatttaaacctggcggcagcgcaaaagatg

SEQ ID NO: 46852 - DNA, 103 bp, Artificial Sequence
  Synthetic Polynucleotide
taatacgactcactatagggtcatgttctcaccggtataaatacttaataaacagaggagatattaaatgtttataccgaacctggcggcagcgcaaaagatg

SEQ ID NO: 46853 - DNA, 103 bp, Artificial Sequence
  Synthetic Polynucleotide
taatacgactcactatagggaagtctcatgttctcaccggtataaatactaacagaggagaagtattatgaccggtgagaacctggcggcagcgcaaaagatg

SEQ ID NO: 46854 - DNA, 103 bp, Artificial Sequence
  Synthetic Polynucleotide
taatacgactcactatagggcgagtaagtctcatgttctcaccggtataaaacagaggagattatacatgtgagaacataacctggcggcagcgcaaaagatg

SEQ ID NO: 46855 - DNA, 103 bp, Artificial Sequence
  Synthetic Polynucleotide
taatacgactcactatagggtaactcgagtaagtctcatgttctcaccggaacagaggagaccggtgatgacatgagacaacctggcggcagcgcaaaagatg

SEQ ID NO: 46856 - DNA, 103 bp, Artificial Sequence
  Synthetic Polynucleotide
taatacgactcactatagggtttggtaactcgagtaagtctcatgttctcaacagaggagagagaacatgagacttactaacctggcggcagcgcaaaagatg

SEQ ID NO: 46857 - DNA, 103 bp, Artificial Sequence
  Synthetic Polynucleotide
taatacgactcactatagggtctgatttggtaactcgagtaagtctcatgaacagaggagacatgagatgtactcgagtaacctggcggcagcgcaaaagatg

SEQ ID NO: 46858 - DNA, 103 bp, Artificial Sequence
  Synthetic Polynucleotide
taatacgactcactatagggcagcatctgatttggtaactcgagtaagtcaacagaggagagacttaatggagttaccaaacctggcggcagcgcaaaagatg

SEQ ID NO: 46859 - DNA, 103 bp, Artificial Sequence
  Synthetic Polynucleotide
taatacgactcactatagggaattaaaataaatggtacggacatgcttacaacagaggagagtaagcatgtccgtaccaaacctggcggcagcgcaaaagatg

SEQ ID NO: 46860 - DNA, 103 bp, Artificial Sequence
  Synthetic Polynucleotide
taatacgactcactatagggatttacagcatctgatttggtaactcgagtaacagaggagaactcgaatgaccaaatcaaacctggcggcagcgcaaaagatg

SEQ ID NO: 46861 - DNA, 103 bp, Artificial Sequence
  Synthetic Polynucleotide
taatacgactcactatagggtcataatttacagcatctgatttggtaactaacagaggagaagttacatgatcagatgcaacctggcggcagcgcaaaagatg

SEQ ID NO: 46862 - DNA, 103 bp, Artificial Sequence
  Synthetic Polynucleotide
taatacgactcactatagggttttttcataatttacagcatctgatttggaacagaggagaccaaatatgatgctgtaaaacctggcggcagcgcaaaagatg

SEQ ID NO: 46863 - DNA, 103 bp, Artificial Sequence
  Synthetic Polynucleotide
taatacgactcactatagggcatctttttttcataatttacagcatctgaaacagaggagatcagatatggtaaattataacctggcggcagcgcaaaagatg

SEQ ID NO: 46864 - DNA, 103 bp, Artificial Sequence
  Synthetic Polynucleotide
taatacgactcactatagggtaatacatctttttttcataatttacagcaaacagaggagatgctgtatgttatgaaaaaacctggcggcagcgcaaaagatg

SEQ ID NO: 46865 - DNA, 103 bp, Artificial Sequence
  Synthetic Polynucleotide
taatacgactcactatagggtaaggtaatacatctttttttcataatttaaacagaggagataaattatgaaaaaaagaaacctggcggcagcgcaaaagatg

SEQ ID NO: 46866 - DNA, 103 bp, Artificial Sequence
  Synthetic Polynucleotide
taatacgactcactatagggcttattaaggtaatacatctttttttcataaacagaggagatatgaaatgaagatgtataacctggcggcagcgcaaaagatg

SEQ ID NO: 46867 - DNA, 103 bp, Artificial Sequence
  Synthetic Polynucleotide
taatacgactcactatagggactatcttattaaggtaatacatcttttttaacagaggagaaaaaaaatggtattacctaacctggcggcagcgcaaaagatg

SEQ ID NO: 46868 - DNA, 103 bp, Artificial Sequence
  Synthetic Polynucleotide
taatacgactcactatagggtgcgaactatcttattaaggtaatacatctaacagaggagaagatgtatgaccttaataaacctggcggcagcgcaaaagatg

SEQ ID NO: 46869 - DNA, 103 bp, Artificial Sequence
  Synthetic Polynucleotide
taatacgactcactatagggtttgttgcgaactatcttattaaggtaataaacagaggagatattacatgaataagataaacctggcggcagcgcaaaagatg

SEQ ID NO: 46870 - DNA, 103 bp, Artificial Sequence
  Synthetic Polynucleotide
taatacgactcactatagggtgtcaaattaaaataaatggtacggacatgaacagaggagacatgtcatgaccatttataacctggcggcagcgcaaaagatg

SEQ ID NO: 46871 - DNA, 103 bp, Artificial Sequence
  Synthetic Polynucleotide
taatacgactcactatagggactactttgttgcgaactatcttattaaggaacagaggagaccttaaatggatagttcgaacctggcggcagcgcaaaagatg

SEQ ID NO: 46872 - DNA, 103 bp, Artificial Sequence
  Synthetic Polynucleotide
taatacgactcactatagggtaacaactactttgttgcgaactatcttataacagaggagaataagaatgttcgcaacaaacctggcggcagcgcaaaagatg

SEQ ID NO: 46873 - DNA, 103 bp, Artificial Sequence
  Synthetic Polynucleotide
taatacgactcactatagggaaagttaacaactactttgttgcgaactataacagaggagaatagttatgaacaaagtaaacctggcggcagcgcaaaagatg

SEQ ID NO: 46874 - DNA, 103 bp, Artificial Sequence
  Synthetic Polynucleotide
taatacgactcactatagggtaatcaaagttaacaactactttgttgcgaaacagaggagatcgcaaatgagtagttgtaacctggcggcagcgcaaaagatg

SEQ ID NO: 46875 - DNA, 103 bp, Artificial Sequence
  Synthetic Polynucleotide
taatacgactcactatagggtaggataatcaaagttaacaactactttgtaacagaggagaacaaagatgttgttaactaacctggcggcagcgcaaaagatg

SEQ ID NO: 46876 - DNA, 103 bp, Artificial Sequence
  Synthetic Polynucleotide
taatacgactcactatagggctgattaggataatcaaagttaacaactacaacagaggagagtagttatgaactttgataacctggcggcagcgcaaaagatg

SEQ ID NO: 46877 - DNA, 103 bp, Artificial Sequence
  Synthetic Polynucleotide
taatacgactcactatagggtattcctgattaggataatcaaagttaacaaacagaggagatgttaaatgtgattatccaacctggcggcagcgcaaaagatg

SEQ ID NO: 46878 - DNA, 103 bp, Artificial Sequence
  Synthetic Polynucleotide
taatacgactcactatagggagtcatattcctgattaggataatcaaagtaacagaggagaactttgatgatcctaatcaacctggcggcagcgcaaaagatg

SEQ ID NO: 46879 - DNA, 103 bp, Artificial Sequence
  Synthetic Polynucleotide
taatacgactcactatagggaaaatagtcatattcctgattaggataatcaacagaggagagattatatgaatcaggaaaacctggcggcagcgcaaaagatg

SEQ ID NO: 46880 - DNA, 103 bp, Artificial Sequence
  Synthetic Polynucleotide
taatacgactcactatagggatgtgaaaatagtcatattcctgattaggaaacagaggagatcctaaatgggaatatgaaacctggcggcagcgcaaaagatg

SEQ ID NO: 46881 - DNA, 103 bp, Artificial Sequence
  Synthetic Polynucleotide
taatacgactcactatagggatatgtgtcaaattaaaataaatggtacggaacagaggagaccgtacatgttattttaaaacctggcggcagcgcaaaagatg

SEQ ID NO: 46882 - DNA, 103 bp, Artificial Sequence
  Synthetic Polynucleotide
taatacgactcactatagggagtacatgtgaaaatagtcatattcctgataacagaggagaatcaggatgatgactattaacctggcggcagcgcaaaagatg

SEQ ID NO: 46883 - DNA, 103 bp, Artificial Sequence
  Synthetic Polynucleotide
taatacgactcactatagggcataaagtacatgtgaaaatagtcatattcaacagaggagagaatatatgtattttcacaacctggcggcagcgcaaaagatg

SEQ ID NO: 46884 - DNA, 103 bp, Artificial Sequence
  Synthetic Polynucleotide
taatacgactcactatagggctcaacataaagtacatgtgaaaatagtcaaacagaggagatgactaatgtcacatgtaaacctggcggcagcgcaaaagatg

SEQ ID NO: 46885 - DNA, 103 bp, Artificial Sequence
  Synthetic Polynucleotide
taatacgactcactatagggcggtcctcaacataaagtacatgtgaaaataacagaggagaattttcatgtgtactttaaacctggcggcagcgcaaaagatg

SEQ ID NO: 46886 - DNA, 103 bp, Artificial Sequence
  Synthetic Polynucleotide
taatacgactcactataggggtatacggtcctcaacataaagtacatgtgaacagaggagacacatgatgtttatgttgaacctggcggcagcgcaaaagatg

SEQ ID NO: 46887 - DNA, 103 bp, Artificial Sequence
  Synthetic Polynucleotide
taatacgactcactatagggttgcagtatacggtcctcaacataaagtacaacagaggagagtacttatggttgaggacaacctggcggcagcgcaaaagatg

SEQ ID NO: 46888 - DNA, 103 bp, Artificial Sequence
  Synthetic Polynucleotide
taatacgactcactatagggttttattgcagtatacggtcctcaacataaaacagaggagattatgtatgggaccgtataacctggcggcagcgcaaaagatg

SEQ ID NO: 46889 - DNA, 103 bp, Artificial Sequence
  Synthetic Polynucleotide
taatacgactcactatagggaaatgttttattgcagtatacggtcctcaaaacagaggagattgaggatggtatactgcaacctggcggcagcgcaaaagatg

SEQ ID NO: 46890 - DNA, 103 bp, Artificial Sequence
  Synthetic Polynucleotide
taatacgactcactataggggtaggaaatgttttattgcagtatacggtcaacagaggagagaccgtatgctgcaataaaacctggcggcagcgcaaaagatg

SEQ ID NO: 46891 - DNA, 103 bp, Artificial Sequence
  Synthetic Polynucleotide
taatacgactcactatagggtagtagtaggaaatgttttattgcagtataaacagaggagatatactatgataaaacataacctggcggcagcgcaaaagatg

SEQ ID NO: 46892 - DNA, 103 bp, Artificial Sequence
  Synthetic Polynucleotide
taatacgactcactatagggtgctgatatgtgtcaaattaaaataaatggaacagaggagaccatttatgttaatttgaaacctggcggcagcgcaaaagatg

SEQ ID NO: 46893 - DNA, 103 bp, Artificial Sequence
  Synthetic Polynucleotide
taatacgactcactatagggtgctttagtagtaggaaatgttttattgcaaacagaggagatgcaatatgacatttcctaacctggcggcagcgcaaaagatg

SEQ ID NO: 46894 - DNA, 103 bp, Artificial Sequence
  Synthetic Polynucleotide
taatacgactcactatagggacctttgctttagtagtaggaaatgttttaaacagaggagataaaacatgtcctactacaacctggcggcagcgcaaaagatg

SEQ ID NO: 46895 - DNA, 103 bp, Artificial Sequence
  Synthetic Polynucleotide
taatacgactcactatagggatagtacctttgctttagtagtaggaaatgaacagaggagacatttcatgctactaaagaacctggcggcagcgcaaaagatg

SEQ ID NO: 46896 - DNA, 103 bp, Artificial Sequence
  Synthetic Polynucleotide
taatacgactcactatagggtagaaatagtacctttgctttagtagtaggaacagaggagacctactatgaaagcaaagaacctggcggcagcgcaaaagatg

SEQ ID NO: 46897 - DNA, 103 bp, Artificial Sequence
  Synthetic Polynucleotide
taatacgactcactatagggtgttgtagaaatagtacctttgctttagtaaacagaggagatactaaatgaaaggtactaacctggcggcagcgcaaaagatg

SEQ ID NO: 46898 - DNA, 103 bp, Artificial Sequence
  Synthetic Polynucleotide
taatacgactcactatagggtagattgttgtagaaatagtacctttgcttaacagaggagaaagcaaatgtactatttcaacctggcggcagcgcaaaagatg

SEQ ID NO: 46899 - DNA, 103 bp, Artificial Sequence
  Synthetic Polynucleotide
taatacgactcactatagggaaatatagattgttgtagaaatagtaccttaacagaggagaaaggtaatgtttctacaaaacctggcggcagcgcaaaagatg

SEQ ID NO: 46900 - DNA, 103 bp, Artificial Sequence
  Synthetic Polynucleotide
taatacgactcactatagggaaacgaaatatagattgttgtagaaatagtaacagaggagaactattatgacaacaatcaacctggcggcagcgcaaaagatg

SEQ ID NO: 46901 - DNA, 103 bp, Artificial Sequence
  Synthetic Polynucleotide
taatacgactcactatagggttaagaaacgaaatatagattgttgtagaaaacagaggagattctacatgaatctatataacctggcggcagcgcaaaagatg

SEQ ID NO: 46902 - DNA, 103 bp, Artificial Sequence
  Synthetic Polynucleotide
taatacgactcactatagggaatatttaagaaacgaaatatagattgttgaacagaggagacaacaaatgatatttcgtaacctggcggcagcgcaaaagatg

SEQ ID NO: 46903 - DNA, 103 bp, Artificial Sequence
  Synthetic Polynucleotide
taatacgactcactatagggtactaaggactccctgaataccgtggcagaaacagaggagatctgccatggtattcaggaacctggcggcagcgcaaaagatg

SEQ ID NO: 46904 - DNA, 103 bp, Artificial Sequence
  Synthetic Polynucleotide
taatacgactcactataggggaaattgctgatatgtgtcaaattaaaataaacagaggagatattttatgttgacacataacctggcggcagcgcaaaagatg

SEQ ID NO: 46905 - DNA, 103 bp, Artificial Sequence
  Synthetic Polynucleotide
taatacgactcactataggggttggaatatttaagaaacgaaatatagataacagaggagaatctatatgtcgtttcttaacctggcggcagcgcaaaagatg

SEQ ID NO: 46906 - DNA, 103 bp, Artificial Sequence
  Synthetic Polynucleotide
taatacgactcactatagggatgttgttggaatatttaagaaacgaaataaacagaggagatatttcatgtcttaaataaacctggcggcagcgcaaaagatg

SEQ ID NO: 46907 - DNA, 103 bp, Artificial Sequence
  Synthetic Polynucleotide
taatacgactcactatagggagttgatgttgttggaatatttaagaaacgaacagaggagacgtttcatgaatattccaaacctggcggcagcgcaaaagatg

SEQ ID NO: 46908 - DNA, 103 bp, Artificial Sequence
  Synthetic Polynucleotide
taatacgactcactatagggttttcagttgatgttgttggaatatttaagaacagaggagacttaaaatgtccaacaacaacctggcggcagcgcaaaagatg

SEQ ID NO: 46909 - DNA, 103 bp, Artificial Sequence
  Synthetic Polynucleotide
taatacgactcactatagggtaactttttcagttgatgttgttggaatataacagaggagaatattcatgcaacatcaaaacctggcggcagcgcaaaagatg

SEQ ID NO: 46910 - DNA, 103 bp, Artificial Sequence
  Synthetic Polynucleotide
taatacgactcactatagggatgactaactttttcagttgatgttgttggaacagaggagaccaacaatgtcaactgaaaacctggcggcagcgcaaaagatg

SEQ ID NO: 46911 - DNA, 103 bp, Artificial Sequence
  Synthetic Polynucleotide
taatacgactcactatagggggttcatgactaactttttcagttgatgttaacagaggagaaacatcatgtgaaaaagtaacctggcggcagcgcaaaagatg

SEQ ID NO: 46912 - DNA, 103 bp, Artificial Sequence
  Synthetic Polynucleotide
taatacgactcactataggggtattggttcatgactaactttttcagttgaacagaggagacaactgatgaagttagtcaacctggcggcagcgcaaaagatg

SEQ ID NO: 46913 - DNA, 103 bp, Artificial Sequence
  Synthetic Polynucleotide
taatacgactcactatagggacattgtattggttcatgactaactttttcaacagaggagagaaaaaatgagtcatgaaaacctggcggcagcgcaaaagatg

SEQ ID NO: 46914 - DNA, 103 bp, Artificial Sequence
  Synthetic Polynucleotide
taatacgactcactatagggactttacattgtattggttcatgactaactaacagaggagaagttagatgtgaaccaataacctggcggcagcgcaaaagatg

SEQ ID NO: 46915 - DNA, 103 bp, Artificial Sequence
  Synthetic Polynucleotide
taatacgactcactatagggaaaaagaaattgctgatatgtgtcaaattaaacagaggagataatttatgacatatcagaacctggcggcagcgcaaaagatg

SEQ ID NO: 46916 - DNA, 103 bp, Artificial Sequence
  Synthetic Polynucleotide
taatacgactcactatagggtagatactttacattgtattggttcatgacaacagaggagagtcatgatgcaatacaataacctggcggcagcgcaaaagatg

SEQ ID NO: 46917 - DNA, 103 bp, Artificial Sequence
  Synthetic Polynucleotide
taatacgactcactatagggtttgctagatactttacattgtattggttcaacagaggagagaaccaatgcaatgtaaaaacctggcggcagcgcaaaagatg

SEQ ID NO: 46918 - DNA, 103 bp, Artificial Sequence
  Synthetic Polynucleotide
taatacgactcactataggggaatctttgctagatactttacattgtattaacagaggagaaatacaatgtaaagtatcaacctggcggcagcgcaaaagatg

SEQ ID NO: 46919 - DNA, 103 bp, Artificial Sequence
  Synthetic Polynucleotide
taatacgactcactatagggacacagaatctttgctagatactttacattaacagaggagaaatgtaatgtatctagcaaacctggcggcagcgcaaaagatg

SEQ ID NO: 46920 - DNA, 103 bp, Artificial Sequence
  Synthetic Polynucleotide
taatacgactcactatagggtttatacacagaatctttgctagatactttaacagaggagaaaagtaatgagcaaagataacctggcggcagcgcaaaagatg

SEQ ID NO: 46921 - DNA, 103 bp, Artificial Sequence
  Synthetic Polynucleotide
taatacgactcactatagggctgtttttatacacagaatctttgctagataacagaggagaatctagatgagattctgtaacctggcggcagcgcaaaagatg

SEQ ID NO: 46922 - DNA, 103 bp, Artificial Sequence
  Synthetic Polynucleotide
taatacgactcactatagggtatttctgtttttatacacagaatctttgcaacagaggagagcaaagatgctgtgtataaacctggcggcagcgcaaaagatg

SEQ ID NO: 46923 - DNA, 103 bp, Artificial Sequence
  Synthetic Polynucleotide
taatacgactcactatagggcttgctatttctgtttttatacacagaatcaacagaggagagattctatgtataaaaacaacctggcggcagcgcaaaagatg

SEQ ID NO: 46924 - DNA, 103 bp, Artificial Sequence
  Synthetic Polynucleotide
taatacgactcactataggggatctcttgctatttctgtttttatacacaaacagaggagatgtgtaatgaaacagaaaaacctggcggcagcgcaaaagatg

SEQ ID NO: 46925 - DNA, 103 bp, Artificial Sequence
  Synthetic Polynucleotide
taatacgactcactataggggtacggatctcttgctatttctgtttttataacagaggagaataaaaatggaaatagcaaacctggcggcagcgcaaaagatg

SEQ ID NO: 46926 - DNA, 103 bp, Artificial Sequence
  Synthetic Polynucleotide
taatacgactcactatagggatgcaaaaaagaaattgctgatatgtgtcaaacagaggagatgacacatgtcagcaattaacctggcggcagcgcaaaagatg

SEQ ID NO: 46927 - DNA, 103 bp, Artificial Sequence
  Synthetic Polynucleotide
taatacgactcactatagggaccgcgtacggatctcttgctatttctgttaacagaggagaaacagaatgagcaagagaaacctggcggcagcgcaaaagatg

SEQ ID NO: 46928 - DNA, 103 bp, Artificial Sequence
  Synthetic Polynucleotide
taatacgactcactatagggttattaccgcgtacggatctcttgctatttaacagaggagaaaatagatggagatccgtaacctggcggcagcgcaaaagatg

SEQ ID NO: 46929 - DNA, 103 bp, Artificial Sequence
  Synthetic Polynucleotide
taatacgactcactatagggtctatttattaccgcgtacggatctcttgcaacagaggagagcaagaatgccgtacgcgaacctggcggcagcgcaaaagatg

SEQ ID NO: 46930 - DNA, 103 bp, Artificial Sequence
  Synthetic Polynucleotide
taatacgactcactatagggacatttctatttattaccgcgtacggatctaacagaggagaagatccatgcgcggtaataacctggcggcagcgcaaaagatg

SEQ ID NO: 46931 - DNA, 103 bp, Artificial Sequence
  Synthetic Polynucleotide
taatacgactcactataggggtagcacatttctatttattaccgcgtacgaacagaggagacgtacgatgtaataaataaacctggcggcagcgcaaaagatg

SEQ ID NO: 46932 - DNA, 103 bp, Artificial Sequence
  Synthetic Polynucleotide
taatacgactcactatagggtcttagtagcacatttctatttattaccgcaacagaggagagcggtaatgaatagaaataacctggcggcagcgcaaaagatg

SEQ ID NO: 46933 - DNA, 103 bp, Artificial Sequence
  Synthetic Polynucleotide
taatacgactcactataggggtatatcttagtagcacatttctatttattaacagaggagaaataaaatgaaatgtgctaacctggcggcagcgcaaaagatg

SEQ ID NO: 46934 - DNA, 103 bp, Artificial Sequence
  Synthetic Polynucleotide
taatacgactcactatagggcggtagtatatcttagtagcacatttctataacagaggagaatagaaatgtgctactaaaacctggcggcagcgcaaaagatg

SEQ ID NO: 46935 - DNA, 103 bp, Artificial Sequence
  Synthetic Polynucleotide
taatacgactcactatagggtatatcggtagtatatcttagtagcacattaacagaggagaaatgtgatgctaagatataacctggcggcagcgcaaaagatg

SEQ ID NO: 46936 - DNA, 103 bp, Artificial Sequence
  Synthetic Polynucleotide
taatacgactcactatagggtactgtatatcggtagtatatcttagtagcaacagaggagagctactatgatatactacaacctggcggcagcgcaaaagatg

SEQ ID NO: 46937 - DNA, 103 bp, Artificial Sequence
  Synthetic Polynucleotide
taatacgactcactatagggaccgaatgcaaaaaagaaattgctgatatgaacagaggagacatatcatgaatttctttaacctggcggcagcgcaaaagatg

SEQ ID NO: 46938 - DNA, 103 bp, Artificial Sequence
  Synthetic Polynucleotide
taatacgactcactatagggcattatactgtatatcggtagtatatcttaaacagaggagataagatatgctaccgataaacctggcggcagcgcaaaagatg

SEQ ID NO: 46939 - DNA, 103 bp, Artificial Sequence
  Synthetic Polynucleotide
taatacgactcactatagggtaaatcattatactgtatatcggtagtataaacagaggagatatactatggatatacagaacctggcggcagcgcaaaagatg

SEQ ID NO: 46940 - DNA, 103 bp, Artificial Sequence
  Synthetic Polynucleotide
taatacgactcactataggggtaactaaatcattatactgtatatcggtaaacagaggagataccgaatgacagtataaaacctggcggcagcgcaaaagatg

SEQ ID NO: 46941 - DNA, 103 bp, Artificial Sequence
  Synthetic Polynucleotide
taatacgactcactatagggttaaagtaactaaatcattatactgtatataacagaggagaatatacatgataatgattaacctggcggcagcgcaaaagatg

SEQ ID NO: 46942 - DNA, 103 bp, Artificial Sequence
  Synthetic Polynucleotide
taatacgactcactatagggggttattaaagtaactaaatcattatactgaacagaggagacagtatatggatttagttaacctggcggcagcgcaaaagatg

SEQ ID NO: 46943 - DNA, 103 bp, Artificial Sequence
  Synthetic Polynucleotide
taatacgactcactatagggctaacggttattaaagtaactaaatcattaaacagaggagataatgaatgagttactttaacctggcggcagcgcaaaagatg

SEQ ID NO: 46944 - DNA, 103 bp, Artificial Sequence
  Synthetic Polynucleotide
taatacgactcactatagggtatgtctaacggttattaaagtaactaaataacagaggagaatttagatgctttaataaaacctggcggcagcgcaaaagatg

SEQ ID NO: 46945 - DNA, 103 bp, Artificial Sequence
  Synthetic Polynucleotide
taatacgactcactatagggaattttatgtctaacggttattaaagtaacaacagaggagagttactatgataaccgttaacctggcggcagcgcaaaagatg

SEQ ID NO: 46946 - DNA, 103 bp, Artificial Sequence
  Synthetic Polynucleotide
taatacgactcactataggggaatcaattttatgtctaacggttattaaaaacagaggagatttaatatgcgttagacaaacctggcggcagcgcaaaagatg

SEQ ID NO: 46947 - DNA, 103 bp, Artificial Sequence
  Synthetic Polynucleotide
taatacgactcactatagggtcatagaatcaattttatgtctaacggttaaacagaggagataaccgatggacataaaaaacctggcggcagcgcaaaagatg

SEQ ID NO: 46948 - DNA, 103 bp, Artificial Sequence
  Synthetic Polynucleotide
taatacgactcactataggggtagaaccgaatgcaaaaaagaaattgctgaacagaggagacagcaaatgcttttttgcaacctggcggcagcgcaaaagatg

SEQ ID NO: 46949 - DNA, 103 bp, Artificial Sequence
  Synthetic Polynucleotide
taatacgactcactatagggagttttcatagaatcaattttatgtctaacaacagaggagagttagaatgaaaattgataacctggcggcagcgcaaaagatg

SEQ ID NO: 46950 - DNA, 103 bp, Artificial Sequence
  Synthetic Polynucleotide
taatacgactcactatagggaacacagttttcatagaatcaattttatgtaacagaggagaacataaatgtgattctataacctggcggcagcgcaaaagatg

SEQ ID NO: 46951 - DNA, 103 bp, Artificial Sequence
  Synthetic Polynucleotide
taatacgactcactatagggcctgaaacacagttttcatagaatcaatttaacagaggagaaaattgatgctatgaaaaaacctggcggcagcgcaaaagatg

SEQ ID NO: 46952 - DNA, 103 bp, Artificial Sequence
  Synthetic Polynucleotide
taatacgactcactatagggaaatacctgaaacacagttttcatagaatcaacagaggagagattctatgaaaactgtgaacctggcggcagcgcaaaagatg

SEQ ID NO: 46953 - DNA, 103 bp, Artificial Sequence
  Synthetic Polynucleotide
taatacgactcactatagggtcgttaaatacctgaaacacagttttcataaacagaggagatatgaaatgtgtgtttcaaacctggcggcagcgcaaaagatg

SEQ ID NO: 46954 - DNA, 103 bp, Artificial Sequence
  Synthetic Polynucleotide
taatacgactcactatagggatgattcgttaaatacctgaaacacagtttaacagaggagaaaactgatgttcaggtataacctggcggcagcgcaaaagatg

SEQ ID NO: 46955 - DNA, 103 bp, Artificial Sequence
  Synthetic Polynucleotide
taatacgactcactatagggtatggatgattcgttaaatacctgaaacacaacagaggagagtgtttatggtatttaacaacctggcggcagcgcaaaagatg

SEQ ID NO: 46956 - DNA, 103 bp, Artificial Sequence
  Synthetic Polynucleotide
taatacgactcactatagggtaatttatggatgattcgttaaatacctgaaacagaggagatcaggtatgtaacgaatcaacctggcggcagcgcaaaagatg

SEQ ID NO: 46957 - DNA, 103 bp, Artificial Sequence
  Synthetic Polynucleotide
taatacgactcactataggggagtataatttatggatgattcgttaaataaacagaggagatatttaatgaatcatccaaacctggcggcagcgcaaaagatg

SEQ ID NO: 46958 - DNA, 103 bp, Artificial Sequence
  Synthetic Polynucleotide
taatacgactcactataggggaccggagtataatttatggatgattcgttaacagaggagaaacgaaatgtccataaataacctggcggcagcgcaaaagatg

SEQ ID NO: 46959 - DNA, 103 bp, Artificial Sequence
  Synthetic Polynucleotide
taatacgactcactatagggcgttggtagaaccgaatgcaaaaaagaaataacagaggagaatttctatgttgcattcgaacctggcggcagcgcaaaagatg

SEQ ID NO: 46960 - DNA, 103 bp, Artificial Sequence
  Synthetic Polynucleotide
taatacgactcactatagggtcatcgaccggagtataatttatggatgataacagaggagaatcatcatgaaattatacaacctggcggcagcgcaaaagatg

SEQ ID NO: 46961 - DNA, 103 bp, Artificial Sequence
  Synthetic Polynucleotide
taatacgactcactatagggaatcatcatcgaccggagtataatttatggaacagaggagaccataaatgatactccggaacctggcggcagcgcaaaagatg

SEQ ID NO: 46962 - DNA, 103 bp, Artificial Sequence
  Synthetic Polynucleotide
taatacgactcactatagggtccgtaatcatcatcgaccggagtataattaacagaggagaaattatatgccggtcgataacctggcggcagcgcaaaagatg

SEQ ID NO: 46963 - DNA, 103 bp, Artificial Sequence
  Synthetic Polynucleotide
taatacgactcactatagggggttctccgtaatcatcatcgaccggagtaaacagaggagatactccatgcgatgatgaaacctggcggcagcgcaaaagatg

SEQ ID NO: 46964 - DNA, 103 bp, Artificial Sequence
  Synthetic Polynucleotide
taatacgactcactatagggtgattggttctccgtaatcatcatcgaccgaacagaggagacggtcgatgatgattacgaacctggcggcagcgcaaaagatg

SEQ ID NO: 46965 - DNA, 103 bp, Artificial Sequence
  Synthetic Polynucleotide
taatacgactcactatagggtataatgattggttctccgtaatcatcatcaacagaggagagatgatatgtacggagaaaacctggcggcagcgcaaaagatg

SEQ ID NO: 46966 - DNA, 103 bp, Artificial Sequence
  Synthetic Polynucleotide
taatacgactcactataggggatgttataatgattggttctccgtaatcaaacagaggagatgattaatgagaaccaataacctggcggcagcgcaaaagatg

SEQ ID NO: 46967 - DNA, 103 bp, Artificial Sequence
  Synthetic Polynucleotide
taatacgactcactataggggatacgatgttataatgattggttctccgtaacagaggagaacggagatgcaatcattaaacctggcggcagcgcaaaagatg

SEQ ID NO: 46968 - DNA, 103 bp, Artificial Sequence
  Synthetic Polynucleotide
taatacgactcactatagggttgaagatacgatgttataatgattggttcaacagaggagagaaccaatgattataacaaacctggcggcagcgcaaaagatg

SEQ ID NO: 46969 - DNA, 103 bp, Artificial Sequence
  Synthetic Polynucleotide
taatacgactcactatagggcctttttgaagatacgatgttataatgattaacagaggagaaatcatatgaacatcgtaaacctggcggcagcgcaaaagatg

SEQ ID NO: 46970 - DNA, 103 bp, Artificial Sequence
  Synthetic Polynucleotide
taatacgactcactatagggtattacgttggtagaaccgaatgcaaaaaaaacagaggagattttttatgttcggttctaacctggcggcagcgcaaaagatg

SEQ ID NO: 46971 - DNA, 103 bp, Artificial Sequence
  Synthetic Polynucleotide
taatacgactcactatagggtatgacctttttgaagatacgatgttataaaacagaggagattataaatgcgtatcttcaacctggcggcagcgcaaaagatg

SEQ ID NO: 46972 - DNA, 103 bp, Artificial Sequence
  Synthetic Polynucleotide
taatacgactcactatagggcttgttatgacctttttgaagatacgatgtaacagaggagaacatcgatgcttcaaaaaaacctggcggcagcgcaaaagatg

SEQ ID NO: 46973 - DNA, 103 bp, Artificial Sequence
  Synthetic Polynucleotide
taatacgactcactatagggggaaacttgttatgacctttttgaagatacaacagaggagagtatctatgaaaaggtcaaacctggcggcagcgcaaaagatg

SEQ ID NO: 46974 - DNA, 103 bp, Artificial Sequence
  Synthetic Polynucleotide
taatacgactcactatagggttacaggaaacttgttatgacctttttgaaaacagaggagattcaaaatggtcataacaaacctggcggcagcgcaaaagatg

SEQ ID NO: 46975 - DNA, 103 bp, Artificial Sequence
  Synthetic Polynucleotide
taatacgactcactatagggaaaatttacaggaaacttgttatgacctttaacagaggagaaaaggtatgaacaagtttaacctggcggcagcgcaaaagatg

SEQ ID NO: 46976 - DNA, 103 bp, Artificial Sequence
  Synthetic Polynucleotide
taatacgactcactatagggtatagaaaatttacaggaaacttgttatgaaacagaggagatcataaatggtttcctgtaacctggcggcagcgcaaaagatg

SEQ ID NO: 46977 - DNA, 103 bp, Artificial Sequence
  Synthetic Polynucleotide
taatacgactcactatagggctatgtatagaaaatttacaggaaacttgtaacagaggagaacaagtatgctgtaaattaacctggcggcagcgcaaaagatg

SEQ ID NO: 46978 - DNA, 103 bp, Artificial Sequence
  Synthetic Polynucleotide
taatacgactcactatagggtacatctatgtatagaaaatttacaggaaaaacagaggagatttcctatgaattttctaaacctggcggcagcgcaaaagatg

SEQ ID NO: 46979 - DNA, 103 bp, Artificial Sequence
  Synthetic Polynucleotide
taatacgactcactatagggattactacatctatgtatagaaaatttacaaacagaggagatgtaaaatgtctatacataacctggcggcagcgcaaaagatg

SEQ ID NO: 46980 - DNA, 103 bp, Artificial Sequence
  Synthetic Polynucleotide
taatacgactcactatagggcagatattactacatctatgtatagaaaataacagaggagaattttcatgacatagatgaacctggcggcagcgcaaaagatg

SEQ ID NO: 46981 - DNA, 103 bp, Artificial Sequence
  Synthetic Polynucleotide
taatacgactcactatagggttcattattacgttggtagaaccgaatgcaaacagaggagatgcattatgttctaccaaaacctggcggcagcgcaaaagatg

SEQ ID NO: 46982 - DNA, 103 bp, Artificial Sequence
  Synthetic Polynucleotide
taatacgactcactatagggtaaatcagatattactacatctatgtatagaacagaggagactatacatggatgtagtaaacctggcggcagcgcaaaagatg

SEQ ID NO: 46983 - DNA, 103 bp, Artificial Sequence
  Synthetic Polynucleotide
taatacgactcactatagggggaaataaatcagatattactacatctatgaacagaggagacatagaatgagtaatatcaacctggcggcagcgcaaaagatg

SEQ ID NO: 46984 - DNA, 103 bp, Artificial Sequence
  Synthetic Polynucleotide
taatacgactcactatagggagctaggaaataaatcagatattactacataacagaggagaatgtagatgtatctgattaacctggcggcagcgcaaaagatg

SEQ ID NO: 46985 - DNA, 103 bp, Artificial Sequence
  Synthetic Polynucleotide
taatacgactcactatagggaacaaagctaggaaataaatcagatattacaacagaggagagtaataatggatttatttaacctggcggcagcgcaaaagatg

SEQ ID NO: 46986 - DNA, 103 bp, Artificial Sequence
  Synthetic Polynucleotide
taatacgactcactatagggagtctaacaaagctaggaaataaatcagataacagaggagaatctgaatgatttcctagaacctggcggcagcgcaaaagatg

SEQ ID NO: 46987 - DNA, 103 bp, Artificial Sequence
  Synthetic Polynucleotide
taatacgactcactatagggtatttagtctaacaaagctaggaaataaataacagaggagaatttatatgctagctttgaacctggcggcagcgcaaaagatg

SEQ ID NO: 46988 - DNA, 103 bp, Artificial Sequence
  Synthetic Polynucleotide
taatacgactcactatagggtgtagtatttagtctaacaaagctaggaaaaacagaggagatttcctatgtttgttagaaacctggcggcagcgcaaaagatg

SEQ ID NO: 46989 - DNA, 103 bp, Artificial Sequence
  Synthetic Polynucleotide
taatacgactcactataggggtttctgtagtatttagtctaacaaagctaaacagaggagatagcttatgtagactaaaaacctggcggcagcgcaaaagatg

SEQ ID NO: 46990 - DNA, 103 bp, Artificial Sequence
  Synthetic Polynucleotide
taatacgactcactatagggtattagtttctgtagtatttagtctaacaaaacagaggagattgttaatgtaaatactaaacctggcggcagcgcaaaagatg

SEQ ID NO: 46991 - DNA, 103 bp, Artificial Sequence
  Synthetic Polynucleotide
taatacgactcactatagggaactatattagtttctgtagtatttagtctaacagaggagaagactaatgactacagaaaacctggcggcagcgcaaaagatg

SEQ ID NO: 46992 - DNA, 103 bp, Artificial Sequence
  Synthetic Polynucleotide
taatacgactcactatagggcacacttcattattacgttggtagaaccgaaacagaggagatcggttatgccaacgtaaaacctggcggcagcgcaaaagatg

SEQ ID NO: 46993 - DNA, 103 bp, Artificial Sequence
  Synthetic Polynucleotide
taatacgactcactatagggctattaactatattagtttctgtagtatttaacagaggagaaaatacatgagaaactaaaacctggcggcagcgcaaaagatg

SEQ ID NO: 46994 - DNA, 103 bp, Artificial Sequence
  Synthetic Polynucleotide
taatacgactcactataggggtacactattaactatattagtttctgtagaacagaggagactacagatgctaatatagaacctggcggcagcgcaaaagatg

SEQ ID NO: 46995 - DNA, 103 bp, Artificial Sequence
  Synthetic Polynucleotide
taatacgactcactatagggttgtagtacactattaactatattagtttcaacagaggagagaaactatgatagttaataacctggcggcagcgcaaaagatg

SEQ ID NO: 46996 - DNA, 103 bp, Artificial Sequence
  Synthetic Polynucleotide
taatacgactcactatagggcctgtttgtagtacactattaactatattaaacagaggagataatatatgtaatagtgtaacctggcggcagcgcaaaagatg

SEQ ID NO: 46997 - DNA, 103 bp, Artificial Sequence
  Synthetic Polynucleotide
taatacgactcactatagggcatcgcctgtttgtagtacactattaactaaacagaggagatagttaatggtgtactacaacctggcggcagcgcaaaagatg

SEQ ID NO: 46998 - DNA, 103 bp, Artificial Sequence
  Synthetic Polynucleotide
taatacgactcactatagggtttaccatcgcctgtttgtagtacactattaacagaggagaaatagtatgctacaaacaaacctggcggcagcgcaaaagatg

SEQ ID NO: 46999 - DNA, 103 bp, Artificial Sequence
  Synthetic Polynucleotide
taatacgactcactataggggtctttttaccatcgcctgtttgtagtacaaacagaggagatgtactatgaacaggcgaaacctggcggcagcgcaaaagatg

SEQ ID NO: 47000 - DNA, 103 bp, Artificial Sequence
  Synthetic Polynucleotide
taatacgactcactataggggaagagtctttttaccatcgcctgtttgtaaacagaggagatacaaaatggcgatggtaaacctggcggcagcgcaaaagatg

SEQ ID NO: 47001 - DNA, 103 bp, Artificial Sequence
  Synthetic Polynucleotide
taatacgactcactatagggaagacgaagagtctttttaccatcgcctgtaacagaggagaacaggcatgggtaaaaagaacctggcggcagcgcaaaagatg

SEQ ID NO: 47002 - DNA, 103 bp, Artificial Sequence
  Synthetic Polynucleotide
taatacgactcactatagggttgggaagacgaagagtctttttaccatcgaacagaggagacgatggatgaaagactctaacctggcggcagcgcaaaagatg

SEQ ID NO: 47003 - DNA, 103 bp, Artificial Sequence
  Synthetic Polynucleotide
taatacgactcactatagggtataccacacttcattattacgttggtagaaacagaggagatctaccatggtaataatgaacctggcggcagcgcaaaagatg

SEQ ID NO: 47004 - DNA, 103 bp, Artificial Sequence
  Synthetic Polynucleotide
taatacgactcactatagggacattttgggaagacgaagagtctttttacaacagaggagagtaaaaatgctcttcgtcaacctggcggcagcgcaaaagatg

SEQ ID NO: 47005 - DNA, 103 bp, Artificial Sequence
  Synthetic Polynucleotide
taatacgactcactatagggctctaacattttgggaagacgaagagtcttaacagaggagaaagactatgcgtcttcccaacctggcggcagcgcaaaagatg

SEQ ID NO: 47006 - DNA, 103 bp, Artificial Sequence
  Synthetic Polynucleotide
taatacgactcactatagggtccgtctctaacattttgggaagacgaagaaacagaggagatcttcgatgtcccaaaataacctggcggcagcgcaaaagatg

SEQ ID NO: 47007 - DNA, 103 bp, Artificial Sequence
  Synthetic Polynucleotide
taatacgactcactatagggctatttccgtctctaacattttgggaagacaacagaggagagtcttcatgaaatgttagaacctggcggcagcgcaaaagatg

SEQ ID NO: 47008 - DNA, 103 bp, Artificial Sequence
  Synthetic Polynucleotide
taatacgactcactataggggacaactatttccgtctctaacattttgggaacagaggagacccaaaatgttagagacgaacctggcggcagcgcaaaagatg

SEQ ID NO: 47009 - DNA, 103 bp, Artificial Sequence
  Synthetic Polynucleotide
taatacgactcactatagggatcttgacaactatttccgtctctaacattaacagaggagaaatgttatggacggaaataacctggcggcagcgcaaaagatg

SEQ ID NO: 47010 - DNA, 103 bp, Artificial Sequence
  Synthetic Polynucleotide
taatacgactcactatagggagagaatcttgacaactatttccgtctctaaacagaggagatagagaatgaaatagttgaacctggcggcagcgcaaaagatg

SEQ ID NO: 47011 - DNA, 103 bp, Artificial Sequence
  Synthetic Polynucleotide
taatacgactcactatagggacgatagagaatcttgacaactatttccgtaacagaggagaacggaaatggttgtcaagaacctggcggcagcgcaaaagatg

SEQ ID NO: 47012 - DNA, 103 bp, Artificial Sequence
  Synthetic Polynucleotide
taatacgactcactatagggttaggacgatagagaatcttgacaactattaacagaggagaaatagtatgcaagattctaacctggcggcagcgcaaaagatg

SEQ ID NO: 47013 - DNA, 103 bp, Artificial Sequence
  Synthetic Polynucleotide
taatacgactcactataggggtatattaggacgatagagaatcttgacaaaacagaggagattgtcaatgttctctatcaacctggcggcagcgcaaaagatg

SEQ ID NO: 47014 - DNA, 103 bp, Artificial Sequence
  Synthetic Polynucleotide
taatacgactcactatagggcatgctactaaggactccctgaataccgtgaacagaggagacacggtatgcagggagtcaacctggcggcagcgcaaaagatg

SEQ ID NO: 47015 - DNA, 103 bp, Artificial Sequence
  Synthetic Polynucleotide
taatacgactcactataggggatcatataccacacttcattattacgttgaacagaggagacaacgtatgaatgaagtgaacctggcggcagcgcaaaagatg

SEQ ID NO: 47016 - DNA, 103 bp, Artificial Sequence
  Synthetic Polynucleotide
taatacgactcactatagggtaatggtatattaggacgatagagaatcttaacagaggagaaagattatgtatcgtcctaacctggcggcagcgcaaaagatg

SEQ ID NO: 47017 - DNA, 103 bp, Artificial Sequence
  Synthetic Polynucleotide
taatacgactcactatagggatttttaatggtatattaggacgatagagaaacagaggagatctctaatgtcctaatataacctggcggcagcgcaaaagatg

SEQ ID NO: 47018 - DNA, 103 bp, Artificial Sequence
  Synthetic Polynucleotide
taatacgactcactatagggtaacaatttttaatggtatattaggacgataacagaggagaatcgtcatgatataccataacctggcggcagcgcaaaagatg

SEQ ID NO: 47019 - DNA, 103 bp, Artificial Sequence
  Synthetic Polynucleotide
taatacgactcactatagggaaatctaacaatttttaatggtatattaggaacagaggagacctaatatgccattaaaaaacctggcggcagcgcaaaagatg

SEQ ID NO: 47020 - DNA, 103 bp, Artificial Sequence
  Synthetic Polynucleotide
taatacgactcactatagggcggaaaaatctaacaatttttaatggtataaacagaggagatataccatgaaaaattgtaacctggcggcagcgcaaaagatg

SEQ ID NO: 47021 - DNA, 103 bp, Artificial Sequence
  Synthetic Polynucleotide
taatacgactcactatagggtattgcggaaaaatctaacaatttttaatgaacagaggagacattaaatgttgttagataacctggcggcagcgcaaaagatg

SEQ ID NO: 47022 - DNA, 103 bp, Artificial Sequence
  Synthetic Polynucleotide
taatacgactcactatagggcatgttattgcggaaaaatctaacaattttaacagaggagaaaaattatgagatttttcaacctggcggcagcgcaaaagatg

SEQ ID NO: 47023 - DNA, 103 bp, Artificial Sequence
  Synthetic Polynucleotide
taatacgactcactataggggttatcatgttattgcggaaaaatctaacaaacagaggagatgttagatgtttccgcaaaacctggcggcagcgcaaaagatg

SEQ ID NO: 47024 - DNA, 103 bp, Artificial Sequence
  Synthetic Polynucleotide
taatacgactcactatagggcaccagttatcatgttattgcggaaaaatcaacagaggagagattttatggcaataacaaacctggcggcagcgcaaaagatg

SEQ ID NO: 47025 - DNA, 103 bp, Artificial Sequence
  Synthetic Polynucleotide
taatacgactcactatagggctctacaccagttatcatgttattgcggaaaacagaggagattccgcatgaacatgataaacctggcggcagcgcaaaagatg

SEQ ID NO: 47026 - DNA, 103 bp, Artificial Sequence
  Synthetic Polynucleotide
taatacgactcactatagggttatagatcatataccacacttcattattaaacagaggagataataaatgagtgtggtaaacctggcggcagcgcaaaagatg

SEQ ID NO: 47027 - DNA, 103 bp, Artificial Sequence
  Synthetic Polynucleotide
taatacgactcactataggggctatctctacaccagttatcatgttattgaacagaggagacaataaatggataactggaacctggcggcagcgcaaaagatg

SEQ ID NO: 47028 - DNA, 103 bp, Artificial Sequence
  Synthetic Polynucleotide
taatacgactcactatagggtatcggctatctctacaccagttatcatgtaacagaggagaacatgaatgctggtgtagaacctggcggcagcgcaaaagatg

SEQ ID NO: 47029 - DNA, 103 bp, Artificial Sequence
  Synthetic Polynucleotide
taatacgactcactatagggagatctatcggctatctctacaccagttataacagaggagaataactatggtagagataaacctggcggcagcgcaaaagatg

SEQ ID NO: 47030 - DNA, 103 bp, Artificial Sequence
  Synthetic Polynucleotide
taatacgactcactatagggataacagatctatcggctatctctacaccaaacagaggagatggtgtatggatagccgaaacctggcggcagcgcaaaagatg

SEQ ID NO: 47031 - DNA, 103 bp, Artificial Sequence
  Synthetic Polynucleotide
taatacgactcactatagggctgaaataacagatctatcggctatctctaaacagaggagatagagaatgccgatagataacctggcggcagcgcaaaagatg

SEQ ID NO: 47032 - DNA, 103 bp, Artificial Sequence
  Synthetic Polynucleotide
taatacgactcactatagggagcgactgaaataacagatctatcggctataacagaggagaatagccatgagatctgttaacctggcggcagcgcaaaagatg

SEQ ID NO: 47033 - DNA, 103 bp, Artificial Sequence
  Synthetic Polynucleotide
taatacgactcactatagggtaatcagcgactgaaataacagatctatcgaacagaggagacgatagatgtgttatttcaacctggcggcagcgcaaaagatg

SEQ ID NO: 47034 - DNA, 103 bp, Artificial Sequence
  Synthetic Polynucleotide
taatacgactcactatagggttgattaatcagcgactgaaataacagatcaacagaggagagatctgatgtttcagtcgaacctggcggcagcgcaaaagatg

SEQ ID NO: 47035 - DNA, 103 bp, Artificial Sequence
  Synthetic Polynucleotide
taatacgactcactatagggactaattgattaatcagcgactgaaataacaacagaggagagttattatggtcgctgataacctggcggcagcgcaaaagatg

SEQ ID NO: 47036 - DNA, 103 bp, Artificial Sequence
  Synthetic Polynucleotide
taatacgactcactatagggtctctactaattgattaatcagcgactgaaaacagaggagattcagtatgtgattaatcaacctggcggcagcgcaaaagatg

SEQ ID NO: 47037 - DNA, 103 bp, Artificial Sequence
  Synthetic Polynucleotide
taatacgactcactatagggtatacttatagatcatataccacacttcataacagaggagaatgaagatgggtatatgaaacctggcggcagcgcaaaagatg

SEQ ID NO: 47038 - DNA, 103 bp, Artificial Sequence
  Synthetic Polynucleotide
taatacgactcactatagggtctcatctctactaattgattaatcagcgaaacagaggagatcgctgatgaatcaattaaacctggcggcagcgcaaaagatg

SEQ ID NO: 47039 - DNA, 103 bp, Artificial Sequence
  Synthetic Polynucleotide
taatacgactcactatagggtcttatctcatctctactaattgattaatcaacagaggagagattaaatgattagtagaaacctggcggcagcgcaaaagatg

SEQ ID NO: 47040 - DNA, 103 bp, Artificial Sequence
  Synthetic Polynucleotide
taatacgactcactatagggtatgttcttatctcatctctactaattgataacagaggagaatcaatatgtagagatgaaacctggcggcagcgcaaaagatg

SEQ ID NO: 47041 - DNA, 103 bp, Artificial Sequence
  Synthetic Polynucleotide
taatacgactcactatagggattattatgttcttatctcatctctactaaaacagaggagattagtaatgatgagataaaacctggcggcagcgcaaaagatg

SEQ ID NO: 47042 - DNA, 103 bp, Artificial Sequence
  Synthetic Polynucleotide
taatacgactcactataggggatatattattatgttcttatctcatctctaacagaggagaagagatatgataagaacaaacctggcggcagcgcaaaagatg

SEQ ID NO: 47043 - DNA, 103 bp, Artificial Sequence
  Synthetic Polynucleotide
taatacgactcactatagggtataagatatattattatgttcttatctcaaacagaggagatgagatatgaacataataaacctggcggcagcgcaaaagatg

SEQ ID NO: 47044 - DNA, 103 bp, Artificial Sequence
  Synthetic Polynucleotide
taatacgactcactatagggcgagatataagatatattattatgttcttaaacagaggagataagaaatgaataatataaacctggcggcagcgcaaaagatg

SEQ ID NO: 47045 - DNA, 103 bp, Artificial Sequence
  Synthetic Polynucleotide
taatacgactcactatagggctaaacgagatataagatatattattatgtaacagaggagaacataaatgtatatcttaaacctggcggcagcgcaaaagatg

SEQ ID NO: 47046 - DNA, 103 bp, Artificial Sequence
  Synthetic Polynucleotide
taatacgactcactatagggtttttctaaacgagatataagatatattataacagaggagaataataatgcttatatctaacctggcggcagcgcaaaagatg

SEQ ID NO: 47047 - DNA, 103 bp, Artificial Sequence
  Synthetic Polynucleotide
taatacgactcactatagggtagcatttttctaaacgagatataagatataacagaggagaatatctatgatctcgtttaacctggcggcagcgcaaaagatg

SEQ ID NO: 47048 - DNA, 103 bp, Artificial Sequence
  Synthetic Polynucleotide
taatacgactcactatagggtatattatacttatagatcatataccacacaacagaggagagtgtggatgatgatctataacctggcggcagcgcaaaagatg

SEQ ID NO: 47049 - DNA, 103 bp, Artificial Sequence
  Synthetic Polynucleotide
taatacgactcactatagggaatattagcatttttctaaacgagatataaaacagaggagattatatatggtttagaaaaacctggcggcagcgcaaaagatg

SEQ ID NO: 47050 - DNA, 103 bp, Artificial Sequence
  Synthetic Polynucleotide
taatacgactcactatagggattttaatattagcatttttctaaacgagaaacagaggagatctcgtatggaaaaatgcaacctggcggcagcgcaaaagatg

SEQ ID NO: 47051 - DNA, 103 bp, Artificial Sequence
  Synthetic Polynucleotide
taatacgactcactatagggtagctattttaatattagcatttttctaaaaacagaggagatttagaatgatgctaataaacctggcggcagcgcaaaagatg

SEQ ID NO: 47052 - DNA, 103 bp, Artificial Sequence
  Synthetic Polynucleotide
taatacgactcactatagggagcgttagctattttaatattagcatttttaacagaggagaaaaaatatgaatattaaaaacctggcggcagcgcaaaagatg

SEQ ID NO: 47053 - DNA, 103 bp, Artificial Sequence
  Synthetic Polynucleotide
taatacgactcactatagggttactagcgttagctattttaatattagcaaacagaggagatgctaaatgtaaaatagcaacctggcggcagcgcaaaagatg

SEQ ID NO: 47054 - DNA, 103 bp, Artificial Sequence
  Synthetic Polynucleotide
taatacgactcactatagggttggattactagcgttagctattttaatataacagaggagaatattaatgtagctaacgaacctggcggcagcgcaaaagatg

SEQ ID NO: 47055 - DNA, 103 bp, Artificial Sequence
  Synthetic Polynucleotide
taatacgactcactatagggtccgattggattactagcgttagctattttaacagaggagaaaaataatgaacgctagtaacctggcggcagcgcaaaagatg

SEQ ID NO: 47056 - DNA, 103 bp, Artificial Sequence
  Synthetic Polynucleotide
taatacgactcactatagggtggcttccgattggattactagcgttagctaacagaggagaagctaaatgtagtaatccaacctggcggcagcgcaaaagatg

SEQ ID NO: 47057 - DNA, 103 bp, Artificial Sequence
  Synthetic Polynucleotide
taatacgactcactatagggtcaaatggcttccgattggattactagcgtaacagaggagaacgctaatgatccaatcgaacctggcggcagcgcaaaagatg

SEQ ID NO: 47058 - DNA, 103 bp, Artificial Sequence
  Synthetic Polynucleotide
taatacgactcactatagggagatatcaaatggcttccgattggattactaacagaggagaagtaatatgatcggaagcaacctggcggcagcgcaaaagatg

SEQ ID NO: 47059 - DNA, 103 bp, Artificial Sequence
  Synthetic Polynucleotide
taatacgactcactataggggatactatattatacttatagatcatatacaacagaggagagtatatatgctataagtaaacctggcggcagcgcaaaagatg

SEQ ID NO: 47060 - DNA, 103 bp, Artificial Sequence
  Synthetic Polynucleotide
taatacgactcactatagggattatagatatcaaatggcttccgattggaaacagaggagatccaatatgaagccatttaacctggcggcagcgcaaaagatg

SEQ ID NO: 47061 - DNA, 103 bp, Artificial Sequence
  Synthetic Polynucleotide
taatacgactcactatagggaccctattatagatatcaaatggcttccgaaacagaggagatcggaaatgatttgatataacctggcggcagcgcaaaagatg

SEQ ID NO: 47062 - DNA, 103 bp, Artificial Sequence
  Synthetic Polynucleotide
taatacgactcactatagggtagataccctattatagatatcaaatggctaacagaggagaagccatatgatatctataaacctggcggcagcgcaaaagatg

SEQ ID NO: 47063 - DNA, 103 bp, Artificial Sequence
  Synthetic Polynucleotide
taatacgactcactataggggaaattagataccctattatagatatcaaaaacagaggagatttgatatgtataataggaacctggcggcagcgcaaaagatg

SEQ ID NO: 47064 - DNA, 103 bp, Artificial Sequence
  Synthetic Polynucleotide
taatacgactcactatagggatcaggaaattagataccctattatagataaacagaggagatatctaatgtagggtatcaacctggcggcagcgcaaaagatg

SEQ ID NO: 47065 - DNA, 103 bp, Artificial Sequence
  Synthetic Polynucleotide
taatacgactcactatagggtctgaatcaggaaattagataccctattataacagaggagaataataatgtatctaattaacctggcggcagcgcaaaagatg

SEQ ID NO: 47066 - DNA, 103 bp, Artificial Sequence
  Synthetic Polynucleotide
taatacgactcactatagggcgctatctgaatcaggaaattagataccctaacagaggagaagggtaatgaatttcctgaacctggcggcagcgcaaaagatg

SEQ ID NO: 47067 - DNA, 103 bp, Artificial Sequence
  Synthetic Polynucleotide
taatacgactcactatagggctgtccgctatctgaatcaggaaattagataacagaggagaatctaaatgcctgattcaaacctggcggcagcgcaaaagatg

SEQ ID NO: 47068 - DNA, 103 bp, Artificial Sequence
  Synthetic Polynucleotide
taatacgactcactatagggtatagctgtccgctatctgaatcaggaaataacagaggagaatttccatgttcagatagaacctggcggcagcgcaaaagatg

SEQ ID NO: 47069 - DNA, 103 bp, Artificial Sequence
  Synthetic Polynucleotide
taatacgactcactataggggagaatatagctgtccgctatctgaatcagaacagaggagactgattatgatagcggacaacctggcggcagcgcaaaagatg

SEQ ID NO: 47070 - DNA, 103 bp, Artificial Sequence
  Synthetic Polynucleotide
taatacgactcactatagggaaagagatactatattatacttatagatcaaacagaggagatgatctatgagtataataaacctggcggcagcgcaaaagatg

SEQ ID NO: 47071 - DNA, 103 bp, Artificial Sequence
  Synthetic Polynucleotide
taatacgactcactatagggctacagagaatatagctgtccgctatctgaaacagaggagatcagatatgggacagctaaacctggcggcagcgcaaaagatg

SEQ ID NO: 47072 - DNA, 103 bp, Artificial Sequence
  Synthetic Polynucleotide
taatacgactcactatagggagtagctacagagaatatagctgtccgctaaacagaggagatagcggatggctatattcaacctggcggcagcgcaaaagatg

SEQ ID NO: 47073 - DNA, 103 bp, Artificial Sequence
  Synthetic Polynucleotide
taatacgactcactatagggaaacgagtagctacagagaatatagctgtcaacagaggagagacagcatgattctctgtaacctggcggcagcgcaaaagatg

SEQ ID NO: 47074 - DNA, 103 bp, Artificial Sequence
  Synthetic Polynucleotide
taatacgactcactatagggattccaaacgagtagctacagagaatatagaacagaggagactatatatgctgtagctaaacctggcggcagcgcaaaagatg

SEQ ID NO: 47075 - DNA, 103 bp, Artificial Sequence
  Synthetic Polynucleotide
taatacgactcactatagggttgtgattccaaacgagtagctacagagaaaacagaggagattctctatggctactcgtaacctggcggcagcgcaaaagatg

SEQ ID NO: 47076 - DNA, 103 bp, Artificial Sequence
  Synthetic Polynucleotide
taatacgactcactatagggaatgtttgtgattccaaacgagtagctacaaacagaggagatgtagcatgtcgtttggaaacctggcggcagcgcaaaagatg

SEQ ID NO: 47077 - DNA, 103 bp, Artificial Sequence
  Synthetic Polynucleotide
taatacgactcactatagggtaaataatgtttgtgattccaaacgagtagaacagaggagactactcatgtggaatcacaacctggcggcagcgcaaaagatg

SEQ ID NO: 47078 - DNA, 103 bp, Artificial Sequence
  Synthetic Polynucleotide
taatacgactcactatagggagatgtaaataatgtttgtgattccaaacgaacagaggagacgtttgatgtcacaaacaaacctggcggcagcgcaaaagatg

SEQ ID NO: 47079 - DNA, 103 bp, Artificial Sequence
  Synthetic Polynucleotide
taatacgactcactatagggaaattagatgtaaataatgtttgtgattccaacagaggagaggaatcatgaacattattaacctggcggcagcgcaaaagatg

SEQ ID NO: 47080 - DNA, 103 bp, Artificial Sequence
  Synthetic Polynucleotide
taatacgactcactatagggatagtaaattagatgtaaataatgtttgtgaacagaggagacacaaaatgtatttacataacctggcggcagcgcaaaagatg

SEQ ID NO: 47081 - DNA, 103 bp, Artificial Sequence
  Synthetic Polynucleotide
taatacgactcactatagggcgaaaaaagagatactatattatacttataaacagaggagatataagatgaatatagtaaacctggcggcagcgcaaaagatg

SEQ ID NO: 47082 - DNA, 103 bp, Artificial Sequence
  Synthetic Polynucleotide
taatacgactcactatagggtacagatagtaaattagatgtaaataatgtaacagaggagaacattaatgacatctaataacctggcggcagcgcaaaagatg

SEQ ID NO: 47083 - DNA, 103 bp, Artificial Sequence
  Synthetic Polynucleotide
taatacgactcactatagggtccattacagatagtaaattagatgtaaataacagaggagaatttacatgtaatttactaacctggcggcagcgcaaaagatg

SEQ ID NO: 47084 - DNA, 103 bp, Artificial Sequence
  Synthetic Polynucleotide
taatacgactcactatagggacgtttccattacagatagtaaattagatgaacagaggagacatctaatgtactatctgaacctggcggcagcgcaaaagatg

SEQ ID NO: 47085 - DNA, 103 bp, Artificial Sequence
  Synthetic Polynucleotide
taatacgactcactataggggggaaacgtttccattacagatagtaaattaacagaggagaaatttaatgtctgtaatgaacctggcggcagcgcaaaagatg

SEQ ID NO: 47086 - DNA, 103 bp, Artificial Sequence
  Synthetic Polynucleotide
taatacgactcactatagggtcattgggaaacgtttccattacagatagtaacagaggagaactatcatgaatggaaacaacctggcggcagcgcaaaagatg

SEQ ID NO: 47087 - DNA, 103 bp, Artificial Sequence
  Synthetic Polynucleotide
taatacgactcactatagggccatttcattgggaaacgtttccattacagaacagaggagactgtaaatgaaacgtttcaacctggcggcagcgcaaaagatg

SEQ ID NO: 47088 - DNA, 103 bp, Artificial Sequence
  Synthetic Polynucleotide
taatacgactcactatagggttgtaccatttcattgggaaacgtttccataacagaggagaatggaaatgtttcccaataacctggcggcagcgcaaaagatg

SEQ ID NO: 47089 - DNA, 103 bp, Artificial Sequence
  Synthetic Polynucleotide
taatacgactcactatagggtctgattgtaccatttcattgggaaacgttaacagaggagaaacgttatgcaatgaaataacctggcggcagcgcaaaagatg

SEQ ID NO: 47090 - DNA, 103 bp, Artificial Sequence
  Synthetic Polynucleotide
taatacgactcactatagggatgtatctgattgtaccatttcattgggaaaacagaggagattcccaatgaaatggtacaacctggcggcagcgcaaaagatg

SEQ ID NO: 47091 - DNA, 103 bp, Artificial Sequence
  Synthetic Polynucleotide
taatacgactcactatagggatgtaatgtatctgattgtaccatttcattaacagaggagaaatgaaatggtacaatcaaacctggcggcagcgcaaaagatg

SEQ ID NO: 47092 - DNA, 103 bp, Artificial Sequence
  Synthetic Polynucleotide
taatacgactcactatagggtcttacgaaaaaagagatactatattatacaacagaggagagtataaatgagtatctctaacctggcggcagcgcaaaagatg

SEQ ID NO: 47093 - DNA, 103 bp, Artificial Sequence
  Synthetic Polynucleotide
taatacgactcactatagggtcaagatgtaatgtatctgattgtaccattaacagaggagaaatggtatgatcagatacaacctggcggcagcgcaaaagatg

SEQ ID NO: 47094 - DNA, 103 bp, Artificial Sequence
  Synthetic Polynucleotide
taatacgactcactatagggatatatcaagatgtaatgtatctgattgtaaacagaggagatacaatatgatacattacaacctggcggcagcgcaaaagatg

SEQ ID NO: 47095 - DNA, 103 bp, Artificial Sequence
  Synthetic Polynucleotide
taatacgactcactatagggaaaaaatatatcaagatgtaatgtatctgaaacagaggagatcagatatgttacatcttaacctggcggcagcgcaaaagatg

SEQ ID NO: 47096 - DNA, 103 bp, Artificial Sequence
  Synthetic Polynucleotide
taatacgactcactatagggttaaaaaaaaatatatcaagatgtaatgtaaacagaggagatacattatgtcttgatataacctggcggcagcgcaaaagatg

SEQ ID NO: 47097 - DNA, 103 bp, Artificial Sequence
  Synthetic Polynucleotide
taatacgactcactatagggcctctttaaaaaaaaatatatcaagatgtaaacagaggagatacatcatgatatattttaacctggcggcagcgcaaaagatg

SEQ ID NO: 47098 - DNA, 103 bp, Artificial Sequence
  Synthetic Polynucleotide
taatacgactcactatagggaccagcctctttaaaaaaaaatatatcaagaacagaggagacttgatatgtttttttttaacctggcggcagcgcaaaagatg

SEQ ID NO: 47099 - DNA, 103 bp, Artificial Sequence
  Synthetic Polynucleotide
taatacgactcactatagggttgttaccagcctctttaaaaaaaaatataaacagaggagatatattatgttttaaagaaacctggcggcagcgcaaaagatg

SEQ ID NO: 47100 - DNA, 103 bp, Artificial Sequence
  Synthetic Polynucleotide
taatacgactcactatagggatgcgttgttaccagcctctttaaaaaaaaaacagaggagattttttatgaagaggctgaacctggcggcagcgcaaaagatg

SEQ ID NO: 47101 - DNA, 103 bp, Artificial Sequence
  Synthetic Polynucleotide
taatacgactcactatagggaagcgatgcgttgttaccagcctctttaaaaacagaggagatttaaaatggctggtaacaacctggcggcagcgcaaaagatg

SEQ ID NO: 47102 - DNA, 103 bp, Artificial Sequence
  Synthetic Polynucleotide
taatacgactcactatagggaaacgaagcgatgcgttgttaccagcctctaacagaggagaagaggcatgtaacaacgcaacctggcggcagcgcaaaagatg

SEQ ID NO: 47103 - DNA, 103 bp, Artificial Sequence
  Synthetic Polynucleotide
taatacgactcactatagggtaatatcttacgaaaaaagagatactatataacagaggagaatatagatgctcttttttaacctggcggcagcgcaaaagatg

SEQ ID NO: 47104 - DNA, 103 bp, Artificial Sequence
  Synthetic Polynucleotide
taatacgactcactatagggcatgtaaacgaagcgatgcgttgttaccagaacagaggagactggtaatgacgcatcgcaacctggcggcagcgcaaaagatg

SEQ ID NO: 47105 - DNA, 103 bp, Artificial Sequence
  Synthetic Polynucleotide
taatacgactcactatagggcgagccatgtaaacgaagcgatgcgttgttaacagaggagaaacaacatgtcgcttcgtaacctggcggcagcgcaaaagatg

SEQ ID NO: 47106 - DNA, 103 bp, Artificial Sequence
  Synthetic Polynucleotide
taatacgactcactatagggtggtacgagccatgtaaacgaagcgatgcgaacagaggagacgcatcatgtcgtttacaaacctggcggcagcgcaaaagatg

SEQ ID NO: 47107 - DNA, 103 bp, Artificial Sequence
  Synthetic Polynucleotide
taatacgactcactatagggactgttggtacgagccatgtaaacgaagcgaacagaggagacgcttcatgtacatggctaacctggcggcagcgcaaaagatg

SEQ ID NO: 47108 - DNA, 103 bp, Artificial Sequence
  Synthetic Polynucleotide
taatacgactcactatagggctattactgttggtacgagccatgtaaacgaacagaggagacgtttaatgggctcgtacaacctggcggcagcgcaaaagatg

SEQ ID NO: 47109 - DNA, 103 bp, Artificial Sequence
  Synthetic Polynucleotide
taatacgactcactatagggttaccctattactgttggtacgagccatgtaacagaggagaacatggatggtaccaacaaacctggcggcagcgcaaaagatg

SEQ ID NO: 47110 - DNA, 103 bp, Artificial Sequence
  Synthetic Polynucleotide
taatacgactcactatagggcaagattaccctattactgttggtacgagcaacagaggagagctcgtatgaacagtaataacctggcggcagcgcaaaagatg

SEQ ID NO: 47111 - DNA, 103 bp, Artificial Sequence
  Synthetic Polynucleotide
taatacgactcactatagggagatacaagattaccctattactgttggtaaacagaggagataccaaatgtaatagggtaacctggcggcagcgcaaaagatg

SEQ ID NO: 47112 - DNA, 103 bp, Artificial Sequence
  Synthetic Polynucleotide
taatacgactcactatagggggaatagatacaagattaccctattactgtaacagaggagaacagtaatggggtaatctaacctggcggcagcgcaaaagatg

SEQ ID NO: 47113 - DNA, 103 bp, Artificial Sequence
  Synthetic Polynucleotide
taatacgactcactatagggggataggaatagatacaagattaccctattaacagaggagaaataggatgatcttgtataacctggcggcagcgcaaaagatg

SEQ ID NO: 47114 - DNA, 103 bp, Artificial Sequence
  Synthetic Polynucleotide
taatacgactcactatagggctgtttaatatcttacgaaaaaagagatacaacagaggagagtatctatgttttcgtaaaacctggcggcagcgcaaaagatg

SEQ ID NO: 47115 - DNA, 103 bp, Artificial Sequence
  Synthetic Polynucleotide
taatacgactcactatagggagtacggataggaatagatacaagattaccaacagaggagaggtaatatggtatctattaacctggcggcagcgcaaaagatg

SEQ ID NO: 47116 - DNA, 103 bp, Artificial Sequence
  Synthetic Polynucleotide
taatacgactcactatagggagcatagtacggataggaatagatacaagaaacagaggagatcttgtatgtattcctataacctggcggcagcgcaaaagatg

SEQ ID NO: 47117 - DNA, 103 bp, Artificial Sequence
  Synthetic Polynucleotide
taatacgactcactatagggataaaagcatagtacggataggaatagataaacagaggagatatctaatgctatccgtaaacctggcggcagcgcaaaagatg

SEQ ID NO: 47118 - DNA, 103 bp, Artificial Sequence
  Synthetic Polynucleotide
taatacgactcactatagggtcctgataaaagcatagtacggataggaataacagaggagaattcctatgcgtactatgaacctggcggcagcgcaaaagatg

SEQ ID NO: 47119 - DNA, 103 bp, Artificial Sequence
  Synthetic Polynucleotide
taatacgactcactatagggatttatcctgataaaagcatagtacggataaacagaggagatatccgatgtatgcttttaacctggcggcagcgcaaaagatg

SEQ ID NO: 47120 - DNA, 103 bp, Artificial Sequence
  Synthetic Polynucleotide
taatacgactcactatagggaatgtatttatcctgataaaagcatagtacaacagaggagagtactaatgttttatcagaacctggcggcagcgcaaaagatg

SEQ ID NO: 47121 - DNA, 103 bp, Artificial Sequence
  Synthetic Polynucleotide
taatacgactcactatagggatgtaaatgtatttatcctgataaaagcataacagaggagaatgcttatgtcaggataaaacctggcggcagcgcaaaagatg

SEQ ID NO: 47122 - DNA, 103 bp, Artificial Sequence
  Synthetic Polynucleotide
taatacgactcactatagggatacgatgtaaatgtatttatcctgataaaaacagaggagatttatcatgataaatacaaacctggcggcagcgcaaaagatg

SEQ ID NO: 47123 - DNA, 103 bp, Artificial Sequence
  Synthetic Polynucleotide
taatacgactcactatagggacgatatacgatgtaaatgtatttatcctgaacagaggagacaggatatgtacatttacaacctggcggcagcgcaaaagatg

SEQ ID NO: 47124 - DNA, 103 bp, Artificial Sequence
  Synthetic Polynucleotide
taatacgactcactatagggcaaagacgatatacgatgtaaatgtatttaaacagaggagataaataatgttacatcgtaacctggcggcagcgcaaaagatg

SEQ ID NO: 47125 - DNA, 103 bp, Artificial Sequence
  Synthetic Polynucleotide
taatacgactcactatagggattgccatgctactaaggactccctgaataaacagaggagatattcaatgagtccttagaacctggcggcagcgcaaaagatg

SEQ ID NO: 47126 - DNA, 103 bp, Artificial Sequence
  Synthetic Polynucleotide
taatacgactcactatagggataaactgtttaatatcttacgaaaaaagaaacagaggagatcttttatggtaagatataacctggcggcagcgcaaaagatg

SEQ ID NO: 47127 - DNA, 103 bp, Artificial Sequence
  Synthetic Polynucleotide
taatacgactcactataggggctaacaaagacgatatacgatgtaaatgtaacagaggagaacatttatgtcgtatatcaacctggcggcagcgcaaaagatg

SEQ ID NO: 47128 - DNA, 103 bp, Artificial Sequence
  Synthetic Polynucleotide
taatacgactcactataggggtgatgctaacaaagacgatatacgatgtaaacagaggagatacatcatgtatcgtcttaacctggcggcagcgcaaaagatg

SEQ ID NO: 47129 - DNA, 103 bp, Artificial Sequence
  Synthetic Polynucleotide
taatacgactcactatagggattctgtgatgctaacaaagacgatatacgaacagaggagacgtataatgtctttgttaaacctggcggcagcgcaaaagatg

SEQ ID NO: 47130 - DNA, 103 bp, Artificial Sequence
  Synthetic Polynucleotide
taatacgactcactatagggtatgcattctgtgatgctaacaaagacgataacagaggagaatcgtcatggttagcatcaacctggcggcagcgcaaaagatg

SEQ ID NO: 47131 - DNA, 103 bp, Artificial Sequence
  Synthetic Polynucleotide
taatacgactcactatagggaaatttatgcattctgtgatgctaacaaagaacagaggagactttgtatgcatcacagaaacctggcggcagcgcaaaagatg

SEQ ID NO: 47132 - DNA, 103 bp, Artificial Sequence
  Synthetic Polynucleotide
taatacgactcactatagggcgaacaaatttatgcattctgtgatgctaaaacagaggagattagcaatgcagaatgcaaacctggcggcagcgcaaaagatg

SEQ ID NO: 47133 - DNA, 103 bp, Artificial Sequence
  Synthetic Polynucleotide
taatacgactcactatagggacagacgaacaaatttatgcattctgtgataacagaggagaatcacaatgtgcataaataacctggcggcagcgcaaaagatg

SEQ ID NO: 47134 - DNA, 103 bp, Artificial Sequence
  Synthetic Polynucleotide
taatacgactcactatagggtcatgacagacgaacaaatttatgcattctaacagaggagaagaatgatgaaatttgttaacctggcggcagcgcaaaagatg

SEQ ID NO: 47135 - DNA, 103 bp, Artificial Sequence
  Synthetic Polynucleotide
taatacgactcactatagggttttatcatgacagacgaacaaatttatgcaacagaggagagcataaatgtgttcgtctaacctggcggcagcgcaaaagatg

SEQ ID NO: 47136 - DNA, 103 bp, Artificial Sequence
  Synthetic Polynucleotide
taatacgactcactatagggtaaatttttatcatgacagacgaacaaattaacagaggagaaatttgatggtctgtcataacctggcggcagcgcaaaagatg

SEQ ID NO: 47137 - DNA, 103 bp, Artificial Sequence
  Synthetic Polynucleotide
taatacgactcactatagggatgtgataaactgtttaatatcttacgaaaaacagaggagatttcgtatgatattaaacaacctggcggcagcgcaaaagatg

SEQ ID NO: 47138 - DNA, 103 bp, Artificial Sequence
  Synthetic Polynucleotide
taatacgactcactatagggcactttaaatttttatcatgacagacgaacaacagaggagagttcgtatgtcatgataaaacctggcggcagcgcaaaagatg

SEQ ID NO: 47139 - DNA, 103 bp, Artificial Sequence
  Synthetic Polynucleotide
taatacgactcactatagggatttacactttaaatttttatcatgacagaaacagaggagatctgtcatgataaaaattaacctggcggcagcgcaaaagatg

SEQ ID NO: 47140 - DNA, 103 bp, Artificial Sequence
  Synthetic Polynucleotide
taatacgactcactataggggttatatttacactttaaatttttatcatgaacagaggagacatgatatgaatttaaagaacctggcggcagcgcaaaagatg

SEQ ID NO: 47141 - DNA, 103 bp, Artificial Sequence
  Synthetic Polynucleotide
taatacgactcactatagggtaatagttatatttacactttaaatttttaaacagaggagataaaaaatgaaagtgtaaaacctggcggcagcgcaaaagatg

SEQ ID NO: 47142 - DNA, 103 bp, Artificial Sequence
  Synthetic Polynucleotide
taatacgactcactatagggaaaaataatagttatatttacactttaaataacagaggagaatttaaatggtaaatataaacctggcggcagcgcaaaagatg

SEQ ID NO: 47143 - DNA, 103 bp, Artificial Sequence
  Synthetic Polynucleotide
taatacgactcactatagggactataaaaataatagttatatttacacttaacagaggagaaagtgtatgtataactataacctggcggcagcgcaaaagatg

SEQ ID NO: 47144 - DNA, 103 bp, Artificial Sequence
  Synthetic Polynucleotide
taatacgactcactatagggttacaactataaaaataatagttatatttaaacagaggagataaataatgctattatttaacctggcggcagcgcaaaagatg

SEQ ID NO: 47145 - DNA, 103 bp, Artificial Sequence
  Synthetic Polynucleotide
taatacgactcactatagggttttattacaactataaaaataatagttataacagaggagaataactatgatttttataaacctggcggcagcgcaaaagatg

SEQ ID NO: 47146 - DNA, 103 bp, Artificial Sequence
  Synthetic Polynucleotide
taatacgactcactatagggtccctttttattacaactataaaaataataaacagaggagatattatatgtatagttgtaacctggcggcagcgcaaaagatg

SEQ ID NO: 47147 - DNA, 103 bp, Artificial Sequence
  Synthetic Polynucleotide
taatacgactcactatagggaaatttccctttttattacaactataaaaaaacagaggagatttttaatgttgtaataaaacctggcggcagcgcaaaagatg

SEQ ID NO: 47148 - DNA, 103 bp, Artificial Sequence
  Synthetic Polynucleotide
taatacgactcactatagggtctagatgtgataaactgtttaatatcttaaacagaggagataagatatgaaacagtttaacctggcggcagcgcaaaagatg

SEQ ID NO: 47149 - DNA, 103 bp, Artificial Sequence
  Synthetic Polynucleotide
taatacgactcactatagggcaattaaatttccctttttattacaactataacagaggagaatagttatgataaaaaggaacctggcggcagcgcaaaagatg

SEQ ID NO: 47150 - DNA, 103 bp, Artificial Sequence
  Synthetic Polynucleotide
taatacgactcactataggggtatacaattaaatttccctttttattacaaacagaggagatgtaatatgaagggaaataacctggcggcagcgcaaaagatg

SEQ ID NO: 47151 - DNA, 103 bp, Artificial Sequence
  Synthetic Polynucleotide
taatacgactcactatagggcaaaggtatacaattaaatttccctttttaaacagaggagataaaaaatgaaatttaataacctggcggcagcgcaaaagatg

SEQ ID NO: 47152 - DNA, 103 bp, Artificial Sequence
  Synthetic Polynucleotide
taatacgactcactatagggagaaccaaaggtatacaattaaatttccctaacagaggagaagggaaatgtaattgtataacctggcggcagcgcaaaagatg

SEQ ID NO: 47153 - DNA, 103 bp, Artificial Sequence
  Synthetic Polynucleotide
taatacgactcactatagggtttaaagaaccaaaggtatacaattaaattaacagaggagaaatttaatggtataccttaacctggcggcagcgcaaaagatg

SEQ ID NO: 47154 - DNA, 103 bp, Artificial Sequence
  Synthetic Polynucleotide
taatacgactcactatagggtttcttttaaagaaccaaaggtatacaattaacagaggagaaattgtatgcctttggttaacctggcggcagcgcaaaagatg

SEQ ID NO: 47155 - DNA, 103 bp, Artificial Sequence
  Synthetic Polynucleotide
taatacgactcactataggggtcagtttcttttaaagaaccaaaggtataaacagaggagatataccatgggttctttaaacctggcggcagcgcaaaagatg

SEQ ID NO: 47156 - DNA, 103 bp, Artificial Sequence
  Synthetic Polynucleotide
taatacgactcactatagggatcaagtcagtttcttttaaagaaccaaagaacagaggagactttggatgtttaaaagaaacctggcggcagcgcaaaagatg

SEQ ID NO: 47157 - DNA, 103 bp, Artificial Sequence
  Synthetic Polynucleotide
taatacgactcactatagggtttttatcaagtcagtttcttttaaagaacaacagaggagagttcttatgaagaaactgaacctggcggcagcgcaaaagatg

SEQ ID NO: 47158 - DNA, 103 bp, Artificial Sequence
  Synthetic Polynucleotide
taatacgactcactatagggagccatttttatcaagtcagtttcttttaaaacagaggagattaaaaatgactgacttgaacctggcggcagcgcaaaagatg

SEQ ID NO: 47159 - DNA, 103 bp, Artificial Sequence
  Synthetic Polynucleotide
taatacgactcactatagggttatctctagatgtgataaactgtttaataaacagaggagatattaaatggtttatcacaacctggcggcagcgcaaaagatg

SEQ ID NO: 47160 - DNA, 103 bp, Artificial Sequence
  Synthetic Polynucleotide
taatacgactcactatagggattacagccatttttatcaagtcagtttctaacagaggagaagaaacatgcttgataaaaacctggcggcagcgcaaaagatg

SEQ ID NO: 47161 - DNA, 103 bp, Artificial Sequence
  Synthetic Polynucleotide
taatacgactcactatagggtagagattacagccatttttatcaagtcagaacagaggagactgactatgtaaaaatggaacctggcggcagcgcaaaagatg

SEQ ID NO: 47162 - DNA, 103 bp, Artificial Sequence
  Synthetic Polynucleotide
taatacgactcactatagggaaccttagagattacagccatttttatcaaaacagaggagattgataatgatggctgtaaacctggcggcagcgcaaaagatg

SEQ ID NO: 47163 - DNA, 103 bp, Artificial Sequence
  Synthetic Polynucleotide
taatacgactcactatagggtacgtaaccttagagattacagccatttttaacagaggagaaaaaatatgtgtaatctcaacctggcggcagcgcaaaagatg

SEQ ID NO: 47164 - DNA, 103 bp, Artificial Sequence
  Synthetic Polynucleotide
taatacgactcactataggggactatacgtaaccttagagattacagccaaacagaggagatggctgatgtctctaaggaacctggcggcagcgcaaaagatg

SEQ ID NO: 47165 - DNA, 103 bp, Artificial Sequence
  Synthetic Polynucleotide
taatacgactcactatagggatatagactatacgtaaccttagagattacaacagaggagagtaatcatgaaggttacgaacctggcggcagcgcaaaagatg

SEQ ID NO: 47166 - DNA, 103 bp, Artificial Sequence
  Synthetic Polynucleotide
taatacgactcactatagggtgatcatatagactatacgtaaccttagagaacagaggagactctaaatgtacgtatagaacctggcggcagcgcaaaagatg

SEQ ID NO: 47167 - DNA, 103 bp, Artificial Sequence
  Synthetic Polynucleotide
taatacgactcactatagggctttttgatcatatagactatacgtaacctaacagaggagaaggttaatgatagtctataacctggcggcagcgcaaaagatg

SEQ ID NO: 47168 - DNA, 103 bp, Artificial Sequence
  Synthetic Polynucleotide
taatacgactcactatagggaatctctttttgatcatatagactatacgtaacagaggagaacgtatatgctatatgataacctggcggcagcgcaaaagatg

SEQ ID NO: 47169 - DNA, 103 bp, Artificial Sequence
  Synthetic Polynucleotide
taatacgactcactataggggcattaatctctttttgatcatatagactaaacagaggagatagtctatgtgatcaaaaaacctggcggcagcgcaaaagatg

SEQ ID NO: 47170 - DNA, 103 bp, Artificial Sequence
  Synthetic Polynucleotide
taatacgactcactatagggataaattatctctagatgtgataaactgttaacagaggagaaacagtatgtcacatctaaacctggcggcagcgcaaaagatg

SEQ ID NO: 47171 - DNA, 103 bp, Artificial Sequence
  Synthetic Polynucleotide
taatacgactcactatagggctgtagcattaatctctttttgatcatataaacagaggagatatatgatgaaaaagagaaacctggcggcagcgcaaaagatg

SEQ ID NO: 47172 - DNA, 103 bp, Artificial Sequence
  Synthetic Polynucleotide
taatacgactcactatagggaatatctgtagcattaatctctttttgatcaacagaggagagatcaaatggagattaataacctggcggcagcgcaaaagatg

SEQ ID NO: 47173 - DNA, 103 bp, Artificial Sequence
  Synthetic Polynucleotide
taatacgactcactatagggatgataatatctgtagcattaatctcttttaacagaggagaaaaagaatgtaatgctacaacctggcggcagcgcaaaagatg

SEQ ID NO: 47174 - DNA, 103 bp, Artificial Sequence
  Synthetic Polynucleotide
taatacgactcactataggggactaatgataatatctgtagcattaatctaacagaggagaagattaatgctacagataaacctggcggcagcgcaaaagatg

SEQ ID NO: 47175 - DNA, 103 bp, Artificial Sequence
  Synthetic Polynucleotide
taatacgactcactatagggaacatgactaatgataatatctgtagcattaacagaggagaaatgctatggatattatcaacctggcggcagcgcaaaagatg

SEQ ID NO: 47176 - DNA, 103 bp, Artificial Sequence
  Synthetic Polynucleotide
taatacgactcactatagggtttttaacatgactaatgataatatctgtaaacagaggagatacagaatgtatcattagaacctggcggcagcgcaaaagatg

SEQ ID NO: 47177 - DNA, 103 bp, Artificial Sequence
  Synthetic Polynucleotide
taatacgactcactatagggcgtcatttttaacatgactaatgataatataacagaggagaatattaatgttagtcatgaacctggcggcagcgcaaaagatg

SEQ ID NO: 47178 - DNA, 103 bp, Artificial Sequence
  Synthetic Polynucleotide
taatacgactcactatagggatcgtcgtcatttttaacatgactaatgataacagaggagaatcattatgcatgttaaaaacctggcggcagcgcaaaagatg

SEQ ID NO: 47179 - DNA, 103 bp, Artificial Sequence
  Synthetic Polynucleotide
taatacgactcactatagggccgatatcgtcgtcatttttaacatgactaaacagaggagatagtcaatgtaaaaatgaaacctggcggcagcgcaaaagatg

SEQ ID NO: 47180 - DNA, 103 bp, Artificial Sequence
  Synthetic Polynucleotide
taatacgactcactatagggcggtaccgatatcgtcgtcatttttaacataacagaggagaatgttaatgatgacgacgaacctggcggcagcgcaaaagatg

SEQ ID NO: 47181 - DNA, 103 bp, Artificial Sequence
  Synthetic Polynucleotide
taatacgactcactatagggacgagataaattatctctagatgtgataaaaacagaggagatttatcatgtctagagataacctggcggcagcgcaaaagatg

SEQ ID NO: 47182 - DNA, 103 bp, Artificial Sequence
  Synthetic Polynucleotide
taatacgactcactatagggtttaacggtaccgatatcgtcgtcatttttaacagaggagaaaaaatatggacgatatcaacctggcggcagcgcaaaagatg

SEQ ID NO: 47183 - DNA, 103 bp, Artificial Sequence
  Synthetic Polynucleotide
taatacgactcactatagggccatctttaacggtaccgatatcgtcgtcaaacagaggagatgacgaatgtatcggtacaacctggcggcagcgcaaaagatg

SEQ ID NO: 47184 - DNA, 103 bp, Artificial Sequence
  Synthetic Polynucleotide
taatacgactcactataggggtctaccatctttaacggtaccgatatcgtaacagaggagaacgataatggtaccgttaaacctggcggcagcgcaaaagatg

SEQ ID NO: 47185 - DNA, 103 bp, Artificial Sequence
  Synthetic Polynucleotide
taatacgactcactatagggacctagtctaccatctttaacggtaccgataacagaggagaatcggtatggttaaagataacctggcggcagcgcaaaagatg

SEQ ID NO: 47186 - DNA, 103 bp, Artificial Sequence
  Synthetic Polynucleotide
taatacgactcactatagggatagcacctagtctaccatctttaacggtaaacagaggagataccgtatgagatggtagaacctggcggcagcgcaaaagatg

SEQ ID NO: 47187 - DNA, 103 bp, Artificial Sequence
  Synthetic Polynucleotide
taatacgactcactatagggcatccatagcacctagtctaccatctttaaaacagaggagattaaagatggtagactagaacctggcggcagcgcaaaagatg

SEQ ID NO: 47188 - DNA, 103 bp, Artificial Sequence
  Synthetic Polynucleotide
taatacgactcactatagggtgccccatccatagcacctagtctaccatcaacagaggagagatggtatgctaggtgctaacctggcggcagcgcaaaagatg

SEQ ID NO: 47189 - DNA, 103 bp, Artificial Sequence
  Synthetic Polynucleotide
taatacgactcactatagggcataatgccccatccatagcacctagtctaaacagaggagatagactatgtgctatggaaacctggcggcagcgcaaaagatg

SEQ ID NO: 47190 - DNA, 103 bp, Artificial Sequence
  Synthetic Polynucleotide
taatacgactcactatagggtcttacataatgccccatccatagcacctaaacagaggagataggtgatgtggatggggaacctggcggcagcgcaaaagatg

SEQ ID NO: 47191 - DNA, 103 bp, Artificial Sequence
  Synthetic Polynucleotide
taatacgactcactatagggacaagtcttacataatgccccatccatagcaacagaggagagctatgatgggggcattaaacctggcggcagcgcaaaagatg

SEQ ID NO: 47192 - DNA, 103 bp, Artificial Sequence
  Synthetic Polynucleotide
taatacgactcactatagggttatcacgagataaattatctctagatgtgaacagaggagacacatcatgagataatttaacctggcggcagcgcaaaagatg

SEQ ID NO: 47193 - DNA, 103 bp, Artificial Sequence
  Synthetic Polynucleotide
taatacgactcactatagggttcccacaagtcttacataatgccccatccaacagaggagaggatggatgattatgtaaaacctggcggcagcgcaaaagatg

SEQ ID NO: 47194 - DNA, 103 bp, Artificial Sequence
  Synthetic Polynucleotide
taatacgactcactatagggccgttttcccacaagtcttacataatgcccaacagaggagagggcatatggtaagacttaacctggcggcagcgcaaaagatg

SEQ ID NO: 47195 - DNA, 103 bp, Artificial Sequence
  Synthetic Polynucleotide
taatacgactcactatagggcaattccgttttcccacaagtcttacataaaacagaggagattatgtatgacttgtgggaacctggcggcagcgcaaaagatg

SEQ ID NO: 47196 - DNA, 103 bp, Artificial Sequence
  Synthetic Polynucleotide
taatacgactcactatagggcattccaattccgttttcccacaagtcttaaacagaggagataagacatgtgggaaaacaacctggcggcagcgcaaaagatg

SEQ ID NO: 47197 - DNA, 103 bp, Artificial Sequence
  Synthetic Polynucleotide
taatacgactcactatagggcgaaacattccaattccgttttcccacaagaacagaggagacttgtgatgaaacggaataacctggcggcagcgcaaaagatg

SEQ ID NO: 47198 - DNA, 103 bp, Artificial Sequence
  Synthetic Polynucleotide
taatacgactcactataggggtgaccgaaacattccaattccgttttcccaacagaggagagggaaaatggaattggaaaacctggcggcagcgcaaaagatg

SEQ ID NO: 47199 - DNA, 103 bp, Artificial Sequence
  Synthetic Polynucleotide
taatacgactcactatagggccccagtgaccgaaacattccaattccgttaacagaggagaaacggaatgggaatgtttaacctggcggcagcgcaaaagatg

SEQ ID NO: 47200 - DNA, 103 bp, Artificial Sequence
  Synthetic Polynucleotide
taatacgactcactatagggctttaccccagtgaccgaaacattccaattaacagaggagaaattggatggtttcggtcaacctggcggcagcgcaaaagatg

SEQ ID NO: 47201 - DNA, 103 bp, Artificial Sequence
  Synthetic Polynucleotide
taatacgactcactatagggacttactttaccccagtgaccgaaacattcaacagaggagagaatgtatgggtcactggaacctggcggcagcgcaaaagatg

SEQ ID NO: 47202 - DNA, 103 bp, Artificial Sequence
  Synthetic Polynucleotide
taatacgactcactatagggtagatacttactttaccccagtgaccgaaaaacagaggagatttcggatgctggggtaaaacctggcggcagcgcaaaagatg

SEQ ID NO: 47203 - DNA, 103 bp, Artificial Sequence
  Synthetic Polynucleotide
taatacgactcactatagggttatattatcacgagataaattatctctagaacagaggagactagagatgatttatctcaacctggcggcagcgcaaaagatg

SEQ ID NO: 47204 - DNA, 103 bp, Artificial Sequence
  Synthetic Polynucleotide
taatacgactcactatagggttttatagatacttactttaccccagtgacaacagaggagagtcactatggtaaagtaaaacctggcggcagcgcaaaagatg

SEQ ID NO: 47205 - DNA, 103 bp, Artificial Sequence
  Synthetic Polynucleotide
taatacgactcactatagggatgagttttatagatacttactttaccccaaacagaggagatggggtatggtaagtatcaacctggcggcagcgcaaaagatg

SEQ ID NO: 47206 - DNA, 103 bp, Artificial Sequence
  Synthetic Polynucleotide
taatacgactcactatagggactatatgagttttatagatacttactttaaacagaggagataaagtatgtatctataaaacctggcggcagcgcaaaagatg

SEQ ID NO: 47207 - DNA, 103 bp, Artificial Sequence
  Synthetic Polynucleotide
taatacgactcactataggggcttaactatatgagttttatagatacttaaacagaggagataagtaatgataaaactcaacctggcggcagcgcaaaagatg

SEQ ID NO: 47208 - DNA, 103 bp, Artificial Sequence
  Synthetic Polynucleotide
taatacgactcactatagggttcaggcttaactatatgagttttatagataacagaggagaatctatatgactcatataaacctggcggcagcgcaaaagatg

SEQ ID NO: 47209 - DNA, 103 bp, Artificial Sequence
  Synthetic Polynucleotide
taatacgactcactatagggataaattcaggcttaactatatgagttttaaacagaggagataaaacatgtatagttaaaacctggcggcagcgcaaaagatg

SEQ ID NO: 47210 - DNA, 103 bp, Artificial Sequence
  Synthetic Polynucleotide
taatacgactcactatagggctgaaataaattcaggcttaactatatgagaacagaggagactcataatgttaagcctgaacctggcggcagcgcaaaagatg

SEQ ID NO: 47211 - DNA, 103 bp, Artificial Sequence
  Synthetic Polynucleotide
taatacgactcactatagggaatttctgaaataaattcaggcttaactataacagaggagaatagttatgcctgaatttaacctggcggcagcgcaaaagatg

SEQ ID NO: 47212 - DNA, 103 bp, Artificial Sequence
  Synthetic Polynucleotide
taatacgactcactatagggcgaataatttctgaaataaattcaggcttaaacagaggagataagccatgatttatttcaacctggcggcagcgcaaaagatg

SEQ ID NO: 47213 - DNA, 103 bp, Artificial Sequence
  Synthetic Polynucleotide
taatacgactcactataggggtaaacgaataatttctgaaataaattcagaacagaggagactgaatatgtttcagaaaaacctggcggcagcgcaaaagatg

SEQ ID NO: 47214 - DNA, 103 bp, Artificial Sequence
  Synthetic Polynucleotide
taatacgactcactatagggtattattatattatcacgagataaattatcaacagaggagagataatatgtctcgtgataacctggcggcagcgcaaaagatg

SEQ ID NO: 47215 - DNA, 103 bp, Artificial Sequence
  Synthetic Polynucleotide
taatacgactcactatagggattcagtaaacgaataatttctgaaataaaaacagaggagatttattatggaaattattaacctggcggcagcgcaaaagatg

SEQ ID NO: 47216 - DNA, 103 bp, Artificial Sequence
  Synthetic Polynucleotide
taatacgactcactatagggatatgattcagtaaacgaataatttctgaaaacagaggagattcagaatgtattcgtttaacctggcggcagcgcaaaagatg

SEQ ID NO: 47217 - DNA, 103 bp, Artificial Sequence
  Synthetic Polynucleotide
taatacgactcactatagggtacatatatgattcagtaaacgaataatttaacagaggagaaaattaatggtttactgaaacctggcggcagcgcaaaagatg

SEQ ID NO: 47218 - DNA, 103 bp, Artificial Sequence
  Synthetic Polynucleotide
taatacgactcactataggggtgaatacatatatgattcagtaaacgaataacagaggagaattcgtatgctgaatcataacctggcggcagcgcaaaagatg

SEQ ID NO: 47219 - DNA, 103 bp, Artificial Sequence
  Synthetic Polynucleotide
taatacgactcactatagggccgcagtgaatacatatatgattcagtaaaaacagaggagatttactatgtcatatatgaacctggcggcagcgcaaaagatg

SEQ ID NO: 47220 - DNA, 103 bp, Artificial Sequence
  Synthetic Polynucleotide
taatacgactcactatagggataatccgcagtgaatacatatatgattcaaacagaggagatgaatcatgtatgtattcaacctggcggcagcgcaaaagatg

SEQ ID NO: 47221 - DNA, 103 bp, Artificial Sequence
  Synthetic Polynucleotide
taatacgactcactatagggacgcaataatccgcagtgaatacatatatgaacagaggagacatataatgattcactgcaacctggcggcagcgcaaaagatg

SEQ ID NO: 47222 - DNA, 103 bp, Artificial Sequence
  Synthetic Polynucleotide
taatacgactcactatagggcgtgaacgcaataatccgcagtgaatacataacagaggagaatgtatatgctgcggattaacctggcggcagcgcaaaagatg

SEQ ID NO: 47223 - DNA, 103 bp, Artificial Sequence
  Synthetic Polynucleotide
taatacgactcactataggggttctcgtgaacgcaataatccgcagtgaaaacagaggagattcactatggattattgcaacctggcggcagcgcaaaagatg

SEQ ID NO: 47224 - DNA, 103 bp, Artificial Sequence
  Synthetic Polynucleotide
taatacgactcactatagggatacggttctcgtgaacgcaataatccgcaaacagaggagatgcggaatgttgcgttcaaacctggcggcagcgcaaaagatg

SEQ ID NO: 47225 - DNA, 103 bp, Artificial Sequence
  Synthetic Polynucleotide
taatacgactcactatagggcactctattattatattatcacgagataaaaacagaggagatttatcatgtgataatataacctggcggcagcgcaaaagatg

SEQ ID NO: 47226 - DNA, 103 bp, Artificial Sequence
  Synthetic Polynucleotide
taatacgactcactatagggttggaatacggttctcgtgaacgcaataataacagaggagaattattatgttcacgagaaacctggcggcagcgcaaaagatg

SEQ ID NO: 47227 - DNA, 103 bp, Artificial Sequence
  Synthetic Polynucleotide
taatacgactcactatagggtatcgttggaatacggttctcgtgaacgcaaacagaggagatgcgttatggagaaccgtaacctggcggcagcgcaaaagatg

SEQ ID NO: 47228 - DNA, 103 bp, Artificial Sequence
  Synthetic Polynucleotide
taatacgactcactataggggttaatatcgttggaatacggttctcgtgaaacagaggagatcacgaatgccgtattccaacctggcggcagcgcaaaagatg

SEQ ID NO: 47229 - DNA, 103 bp, Artificial Sequence
  Synthetic Polynucleotide
taatacgactcactatagggtttaggttaatatcgttggaatacggttctaacagaggagaagaaccatgttccaacgaaacctggcggcagcgcaaaagatg

SEQ ID NO: 47230 - DNA, 103 bp, Artificial Sequence
  Synthetic Polynucleotide
taatacgactcactatagggactcttttaggttaatatcgttggaatacgaacagaggagacgtattatgacgatattaaacctggcggcagcgcaaaagatg

SEQ ID NO: 47231 - DNA, 103 bp, Artificial Sequence
  Synthetic Polynucleotide
taatacgactcactatagggcgataactcttttaggttaatatcgttggaaacagaggagatccaacatgattaacctaaacctggcggcagcgcaaaagatg

SEQ ID NO: 47232 - DNA, 103 bp, Artificial Sequence
  Synthetic Polynucleotide
taatacgactcactatagggtgtcccgataactcttttaggttaatatcgaacagaggagacgatatatgcctaaaagaaacctggcggcagcgcaaaagatg

SEQ ID NO: 47233 - DNA, 103 bp, Artificial Sequence
  Synthetic Polynucleotide
taatacgactcactataggggagcgtgtcccgataactcttttaggttaaaacagaggagattaaccatgaagagttataacctggcggcagcgcaaaagatg

SEQ ID NO: 47234 - DNA, 103 bp, Artificial Sequence
  Synthetic Polynucleotide
taatacgactcactatagggcctaagagcgtgtcccgataactcttttagaacagaggagactaaaaatgttatcgggaaacctggcggcagcgcaaaagatg

SEQ ID NO: 47235 - DNA, 103 bp, Artificial Sequence
  Synthetic Polynucleotide
taatacgactcactatagggaatctcctaagagcgtgtcccgataactctaacagaggagaagagttatggggacacgcaacctggcggcagcgcaaaagatg

SEQ ID NO: 47236 - DNA, 103 bp, Artificial Sequence
  Synthetic Polynucleotide
taatacgactcactatagggctgtcattgccatgctactaaggactccctaacagaggagaagggagatgttagtagcaaacctggcggcagcgcaaaagatg

SEQ ID NO: 47237 - DNA, 103 bp, Artificial Sequence
  Synthetic Polynucleotide
taatacgactcactatagggaaccgcactctattattatattatcacgagaacagaggagactcgtgatgatataataaaacctggcggcagcgcaaaagatg

SEQ ID NO: 47238 - DNA, 103 bp, Artificial Sequence
  Synthetic Polynucleotide
taatacgactcactatagggcctttaatctcctaagagcgtgtcccgataaacagaggagatatcggatgacgctcttaaacctggcggcagcgcaaaagatg

SEQ ID NO: 47239 - DNA, 103 bp, Artificial Sequence
  Synthetic Polynucleotide
taatacgactcactatagggtttatcctttaatctcctaagagcgtgtccaacagaggagaggacacatgcttaggagaaacctggcggcagcgcaaaagatg

SEQ ID NO: 47240 - DNA, 103 bp, Artificial Sequence
  Synthetic Polynucleotide
taatacgactcactatagggaatattttatcctttaatctcctaagagcgaacagaggagacgctctatggagattaaaaacctggcggcagcgcaaaagatg

SEQ ID NO: 47241 - DNA, 103 bp, Artificial Sequence
  Synthetic Polynucleotide
taatacgactcactatagggtggataatattttatcctttaatctcctaaaacagaggagattaggaatgtaaaggataaacctggcggcagcgcaaaagatg

SEQ ID NO: 47242 - DNA, 103 bp, Artificial Sequence
  Synthetic Polynucleotide
taatacgactcactatagggtttcttggataatattttatcctttaatctaacagaggagaagattaatggataaaataaacctggcggcagcgcaaaagatg

SEQ ID NO: 47243 - DNA, 103 bp, Artificial Sequence
  Synthetic Polynucleotide
taatacgactcactataggggactttttcttggataatattttatcctttaacagaggagaaaaggaatgaatattatcaacctggcggcagcgcaaaagatg

SEQ ID NO: 47244 - DNA, 103 bp, Artificial Sequence
  Synthetic Polynucleotide
taatacgactcactatagggaacatgactttttcttggataatattttataacagaggagaataaaaatgtatccaagaaacctggcggcagcgcaaaagatg

SEQ ID NO: 47245 - DNA, 103 bp, Artificial Sequence
  Synthetic Polynucleotide
taatacgactcactatagggattccaacatgactttttcttggataatataacagaggagaatattaatgaagaaaaagaacctggcggcagcgcaaaagatg

SEQ ID NO: 47246 - DNA, 103 bp, Artificial Sequence
  Synthetic Polynucleotide
taatacgactcactatagggtcgctattccaacatgactttttcttggataacagaggagaatccaaatgaaagtcatgaacctggcggcagcgcaaaagatg

SEQ ID NO: 47247 - DNA, 103 bp, Artificial Sequence
  Synthetic Polynucleotide
taatacgactcactatagggtacattcgctattccaacatgactttttctaacagaggagaagaaaaatgcatgttggaaacctggcggcagcgcaaaagatg

SEQ ID NO: 47248 - DNA, 103 bp, Artificial Sequence
  Synthetic Polynucleotide
taatacgactcactatagggggtaaaaccgcactctattattatattatcaacagaggagagataatatgataatagagaacctggcggcagcgcaaaagatg

SEQ ID NO: 47249 - DNA, 103 bp, Artificial Sequence
  Synthetic Polynucleotide
taatacgactcactatagggttgcatacattcgctattccaacatgacttaacagaggagaaagtcaatgtggaatagcaacctggcggcagcgcaaaagatg

SEQ ID NO: 47250 - DNA, 103 bp, Artificial Sequence
  Synthetic Polynucleotide
taatacgactcactatagggtacggttgcatacattcgctattccaacataacagaggagaatgttgatgtagcgaatgaacctggcggcagcgcaaaagatg

SEQ ID NO: 47251 - DNA, 103 bp, Artificial Sequence
  Synthetic Polynucleotide
taatacgactcactatagggtttgatacggttgcatacattcgctattccaacagaggagaggaataatgaatgtatgcaacctggcggcagcgcaaaagatg

SEQ ID NO: 47252 - DNA, 103 bp, Artificial Sequence
  Synthetic Polynucleotide
taatacgactcactatagggaattttttgatacggttgcatacattcgctaacagaggagaagcgaaatgatgcaaccgaacctggcggcagcgcaaaagatg

SEQ ID NO: 47253 - DNA, 103 bp, Artificial Sequence
  Synthetic Polynucleotide
taatacgactcactatagggaaagaaattttttgatacggttgcatacataacagaggagaatgtatatgaccgtatcaaacctggcggcagcgcaaaagatg

SEQ ID NO: 47254 - DNA, 103 bp, Artificial Sequence
  Synthetic Polynucleotide
taatacgactcactatagggttgaaaaagaaattttttgatacggttgcaaacagaggagatgcaacatgatcaaaaaaaacctggcggcagcgcaaaagatg

SEQ ID NO: 47255 - DNA, 103 bp, Artificial Sequence
  Synthetic Polynucleotide
taatacgactcactatagggtttctttgaaaaagaaattttttgatacggaacagaggagaccgtatatgaaaatttctaacctggcggcagcgcaaaagatg

SEQ ID NO: 47256 - DNA, 103 bp, Artificial Sequence
  Synthetic Polynucleotide
taatacgactcactatagggacctttttctttgaaaaagaaattttttgaaacagaggagatcaaaaatgttctttttcaacctggcggcagcgcaaaagatg

SEQ ID NO: 47257 - DNA, 103 bp, Artificial Sequence
  Synthetic Polynucleotide
taatacgactcactatagggaacaaacctttttctttgaaaaagaaatttaacagaggagaaaatttatgtttcaaagaaacctggcggcagcgcaaaagatg

SEQ ID NO: 47258 - DNA, 103 bp, Artificial Sequence
  Synthetic Polynucleotide
taatacgactcactataggggacgaaacaaacctttttctttgaaaaagaaacagaggagatcttttatgaagaaaaagaacctggcggcagcgcaaaagatg

SEQ ID NO: 47259 - DNA, 103 bp, Artificial Sequence
  Synthetic Polynucleotide
taatacgactcactatagggaaataggtaaaaccgcactctattattataaacagaggagatataatatgagagtgcggaacctggcggcagcgcaaaagatg

SEQ ID NO: 47260 - DNA, 103 bp, Artificial Sequence
  Synthetic Polynucleotide
taatacgactcactatagggttgttgacgaaacaaacctttttctttgaaaacagaggagattcaaaatgaaaggtttgaacctggcggcagcgcaaaagatg

SEQ ID NO: 47261 - DNA, 103 bp, Artificial Sequence
  Synthetic Polynucleotide
taatacgactcactatagggccaacttgttgacgaaacaaacctttttctaacagaggagaagaaaaatgtttgtttcgaacctggcggcagcgcaaaagatg

SEQ ID NO: 47262 - DNA, 103 bp, Artificial Sequence
  Synthetic Polynucleotide
taatacgactcactatagggatcatccaacttgttgacgaaacaaaccttaacagaggagaaaggttatgttcgtcaacaacctggcggcagcgcaaaagatg

SEQ ID NO: 47263 - DNA, 103 bp, Artificial Sequence
  Synthetic Polynucleotide
taatacgactcactatagggttaatatcatccaacttgttgacgaaacaaaacagaggagattgtttatgcaacaagttaacctggcggcagcgcaaaagatg

SEQ ID NO: 47264 - DNA, 103 bp, Artificial Sequence
  Synthetic Polynucleotide
taatacgactcactataggggaacgttaatatcatccaacttgttgacgaaacagaggagatcgtcaatgagttggatgaacctggcggcagcgcaaaagatg

SEQ ID NO: 47265 - DNA, 103 bp, Artificial Sequence
  Synthetic Polynucleotide
taatacgactcactatagggattaggaacgttaatatcatccaacttgttaacagaggagaaacaagatggatgatattaacctggcggcagcgcaaaagatg

SEQ ID NO: 47266 - DNA, 103 bp, Artificial Sequence
  Synthetic Polynucleotide
taatacgactcactatagggagagaattaggaacgttaatatcatccaacaacagaggagagttggaatgtattaacgtaacctggcggcagcgcaaaagatg

SEQ ID NO: 47267 - DNA, 103 bp, Artificial Sequence
  Synthetic Polynucleotide
taatacgactcactatagggaaatgagagaattaggaacgttaatatcataacagaggagaatgataatgacgttcctaaacctggcggcagcgcaaaagatg

SEQ ID NO: 47268 - DNA, 103 bp, Artificial Sequence
  Synthetic Polynucleotide
taatacgactcactatagggttgataaatgagagaattaggaacgttaataacagaggagaattaacatgcctaattctaacctggcggcagcgcaaaagatg

SEQ ID NO: 47269 - DNA, 103 bp, Artificial Sequence
  Synthetic Polynucleotide
taatacgactcactatagggaacttttgataaatgagagaattaggaacgaacagaggagacgttccatgttctctcataacctggcggcagcgcaaaagatg

SEQ ID NO: 47270 - DNA, 103 bp, Artificial Sequence
  Synthetic Polynucleotide
taatacgactcactatagggtgataaaataggtaaaaccgcactctattaaacagaggagataatagatggcggttttaaacctggcggcagcgcaaaagatg

SEQ ID NO: 47271 - DNA, 103 bp, Artificial Sequence
  Synthetic Polynucleotide
taatacgactcactatagggaaattaacttttgataaatgagagaattagaacagaggagactaattatgtcatttatcaacctggcggcagcgcaaaagatg

SEQ ID NO: 47272 - DNA, 103 bp, Artificial Sequence
  Synthetic Polynucleotide
taatacgactcactatagggaatagaaattaacttttgataaatgagagaaacagaggagatctctcatgtatcaaaagaacctggcggcagcgcaaaagatg

SEQ ID NO: 47273 - DNA, 103 bp, Artificial Sequence
  Synthetic Polynucleotide
taatacgactcactatagggtcatgaatagaaattaacttttgataaatgaacagaggagacatttaatgaaagttaataacctggcggcagcgcaaaagatg

SEQ ID NO: 47274 - DNA, 103 bp, Artificial Sequence
  Synthetic Polynucleotide
taatacgactcactatagggacttttcatgaatagaaattaacttttgataacagaggagaatcaaaatgtaatttctaaacctggcggcagcgcaaaagatg

SEQ ID NO: 47275 - DNA, 103 bp, Artificial Sequence
  Synthetic Polynucleotide
taatacgactcactatagggccaaaacttttcatgaatagaaattaacttaacagaggagaaagttaatgtctattcataacctggcggcagcgcaaaagatg

SEQ ID NO: 47276 - DNA, 103 bp, Artificial Sequence
  Synthetic Polynucleotide
taatacgactcactatagggaatggccaaaacttttcatgaatagaaattaacagaggagaaatttcatgtcatgaaaaaacctggcggcagcgcaaaagatg

SEQ ID NO: 47277 - DNA, 103 bp, Artificial Sequence
  Synthetic Polynucleotide
taatacgactcactatagggctaataatggccaaaacttttcatgaatagaacagaggagactattcatgaaaagttttaacctggcggcagcgcaaaagatg

SEQ ID NO: 47278 - DNA, 103 bp, Artificial Sequence
  Synthetic Polynucleotide
taatacgactcactatagggaatttctaataatggccaaaacttttcatgaacagaggagacatgaaatgttttggccaaacctggcggcagcgcaaaagatg

SEQ ID NO: 47279 - DNA, 103 bp, Artificial Sequence
  Synthetic Polynucleotide
taatacgactcactatagggtgataaatttctaataatggccaaaactttaacagaggagaaaagttatggccattattaacctggcggcagcgcaaaagatg

SEQ ID NO: 47280 - DNA, 103 bp, Artificial Sequence
  Synthetic Polynucleotide
taatacgactcactataggggatattgataaatttctaataatggccaaaaacagaggagatttggcatgtattagaaaaacctggcggcagcgcaaaagatg

SEQ ID NO: 47281 - DNA, 103 bp, Artificial Sequence
  Synthetic Polynucleotide
taatacgactcactatagggatagatgataaaataggtaaaaccgcactcaacagaggagagagtgcatgtttacctataacctggcggcagcgcaaaagatg

SEQ ID NO: 47282 - DNA, 103 bp, Artificial Sequence
  Synthetic Polynucleotide
taatacgactcactatagggagctggatattgataaatttctaataatggaacagaggagaccattaatggaaatttataacctggcggcagcgcaaaagatg

SEQ ID NO: 47283 - DNA, 103 bp, Artificial Sequence
  Synthetic Polynucleotide
taatacgactcactatagggaagttagctggatattgataaatttctaataacagaggagaattagaatgttatcaataaacctggcggcagcgcaaaagatg

SEQ ID NO: 47284 - DNA, 103 bp, Artificial Sequence
  Synthetic Polynucleotide
taatacgactcactatagggaaaataagttagctggatattgataaatttaacagaggagaaaatttatgaatatccagaacctggcggcagcgcaaaagatg

SEQ ID NO: 47285 - DNA, 103 bp, Artificial Sequence
  Synthetic Polynucleotide
taatacgactcactatagggtgtataaaataagttagctggatattgataaacagaggagatatcaaatgccagctaacaacctggcggcagcgcaaaagatg

SEQ ID NO: 47286 - DNA, 103 bp, Artificial Sequence
  Synthetic Polynucleotide
taatacgactcactatagggtagtctgtataaaataagttagctggatataacagaggagaatatccatgtaacttattaacctggcggcagcgcaaaagatg

SEQ ID NO: 47287 - DNA, 103 bp, Artificial Sequence
  Synthetic Polynucleotide
taatacgactcactataggggaaagtagtctgtataaaataagttagctgaacagaggagacagctaatgtattttataaacctggcggcagcgcaaaagatg

SEQ ID NO: 47288 - DNA, 103 bp, Artificial Sequence
  Synthetic Polynucleotide
taatacgactcactataggggataggaaagtagtctgtataaaataagttaacagaggagaaacttaatgtatacagacaacctggcggcagcgcaaaagatg

SEQ ID NO: 47289 - DNA, 103 bp, Artificial Sequence
  Synthetic Polynucleotide
taatacgactcactatagggggagggataggaaagtagtctgtataaaataacagaggagaattttaatgagactacttaacctggcggcagcgcaaaagatg

SEQ ID NO: 47290 - DNA, 103 bp, Artificial Sequence
  Synthetic Polynucleotide
taatacgactcactatagggtcaacggagggataggaaagtagtctgtataacagaggagaatacagatgactttcctaaacctggcggcagcgcaaaagatg

SEQ ID NO: 47291 - DNA, 103 bp, Artificial Sequence
  Synthetic Polynucleotide
taatacgactcactatagggaataatcaacggagggataggaaagtagtcaacagaggagagactacatgcctatccctaacctggcggcagcgcaaaagatg

SEQ ID NO: 47292 - DNA, 103 bp, Artificial Sequence
  Synthetic Polynucleotide
taatacgactcactatagggattatatagatgataaaataggtaaaaccgaacagaggagacggtttatgctattttataacctggcggcagcgcaaaagatg

SEQ ID NO: 47293 - DNA, 103 bp, Artificial Sequence
  Synthetic Polynucleotide
taatacgactcactatagggggtctaataatcaacggagggataggaaagaacagaggagactttccatgccctccgttaacctggcggcagcgcaaaagatg

SEQ ID NO: 47294 - DNA, 103 bp, Artificial Sequence
  Synthetic Polynucleotide
taatacgactcactatagggtagccggtctaataatcaacggagggatagaacagaggagactatccatgcgttgattaaacctggcggcagcgcaaaagatg

SEQ ID NO: 47295 - DNA, 103 bp, Artificial Sequence
  Synthetic Polynucleotide
taatacgactcactatagggactaatagccggtctaataatcaacggaggaacagaggagacctccgatgattattagaaacctggcggcagcgcaaaagatg

SEQ ID NO: 47296 - DNA, 103 bp, Artificial Sequence
  Synthetic Polynucleotide
taatacgactcactatagggcaaaaactaatagccggtctaataatcaacaacagaggagagttgatatgtagaccggcaacctggcggcagcgcaaaagatg

SEQ ID NO: 47297 - DNA, 103 bp, Artificial Sequence
  Synthetic Polynucleotide
taatacgactcactatagggctatccaaaaactaatagccggtctaataaaacagaggagattattaatgcggctattaaacctggcggcagcgcaaaagatg

SEQ ID NO: 47298 - DNA, 103 bp, Artificial Sequence
  Synthetic Polynucleotide
taatacgactcactatagggactatctatccaaaaactaatagccggtctaacagaggagaagaccgatgattagttttaacctggcggcagcgcaaaagatg

SEQ ID NO: 47299 - DNA, 103 bp, Artificial Sequence
  Synthetic Polynucleotide
taatacgactcactatagggggtatactatctatccaaaaactaatagccaacagaggagaggctatatgtttttggataacctggcggcagcgcaaaagatg

SEQ ID NO: 47300 - DNA, 103 bp, Artificial Sequence
  Synthetic Polynucleotide
taatacgactcactatagggctttgggtatactatctatccaaaaactaaaacagaggagattagttatgggatagataaacctggcggcagcgcaaaagatg

SEQ ID NO: 47301 - DNA, 103 bp, Artificial Sequence
  Synthetic Polynucleotide
taatacgactcactatagggggtctctttgggtatactatctatccaaaaaacagaggagattttggatggatagtataaacctggcggcagcgcaaaagatg

SEQ ID NO: 47302 - DNA, 103 bp, Artificial Sequence
  Synthetic Polynucleotide
taatacgactcactatagggtcattggtctctttgggtatactatctatcaacagaggagagatagaatgtatacccaaaacctggcggcagcgcaaaagatg

SEQ ID NO: 47303 - DNA, 103 bp, Artificial Sequence
  Synthetic Polynucleotide
taatacgactcactatagggttattattatatagatgataaaataggtaaaacagaggagattacctatgttatcatctaacctggcggcagcgcaaaagatg

SEQ ID NO: 47304 - DNA, 103 bp, Artificial Sequence
  Synthetic Polynucleotide
taatacgactcactatagggttaattcattggtctctttgggtatactataacagaggagaatagtaatgccaaagagaaacctggcggcagcgcaaaagatg

SEQ ID NO: 47305 - DNA, 103 bp, Artificial Sequence
  Synthetic Polynucleotide
taatacgactcactataggggtaagttaattcattggtctctttgggtataacagaggagaatacccatggagaccaataacctggcggcagcgcaaaagatg

SEQ ID NO: 47306 - DNA, 103 bp, Artificial Sequence
  Synthetic Polynucleotide
taatacgactcactatagggaataagtaagttaattcattggtctctttgaacagaggagacaaagaatgcaatgaattaacctggcggcagcgcaaaagatg

SEQ ID NO: 47307 - DNA, 103 bp, Artificial Sequence
  Synthetic Polynucleotide
taatacgactcactatagggtacctaataagtaagttaattcattggtctaacagaggagaagaccaatgaattaacttaacctggcggcagcgcaaaagatg

SEQ ID NO: 47308 - DNA, 103 bp, Artificial Sequence
  Synthetic Polynucleotide
taatacgactcactataggggatcatacctaataagtaagttaattcattaacagaggagaaatgaaatgacttacttaaacctggcggcagcgcaaaagatg

SEQ ID NO: 47309 - DNA, 103 bp, Artificial Sequence
  Synthetic Polynucleotide
taatacgactcactatagggttaacgatcatacctaataagtaagttaataacagaggagaattaacatgcttattaggaacctggcggcagcgcaaaagatg

SEQ ID NO: 47310 - DNA, 103 bp, Artificial Sequence
  Synthetic Polynucleotide
taatacgactcactatagggaattcttaacgatcatacctaataagtaagaacagaggagacttactatgtaggtatgaaacctggcggcagcgcaaaagatg

SEQ ID NO: 47311 - DNA, 103 bp, Artificial Sequence
  Synthetic Polynucleotide
taatacgactcactataggggttacaattcttaacgatcatacctaataaaacagaggagattattaatgatgatcgttaacctggcggcagcgcaaaagatg

SEQ ID NO: 47312 - DNA, 103 bp, Artificial Sequence
  Synthetic Polynucleotide
taatacgactcactatagggttcaagttacaattcttaacgatcatacctaacagaggagaaggtatatgcgttaagaaaacctggcggcagcgcaaaagatg

SEQ ID NO: 47313 - DNA, 103 bp, Artificial Sequence
  Synthetic Polynucleotide
taatacgactcactatagggcagcattcaagttacaattcttaacgatcaaacagaggagatgatcgatgagaattgtaaacctggcggcagcgcaaaagatg

SEQ ID NO: 47314 - DNA, 103 bp, Artificial Sequence
  Synthetic Polynucleotide
taatacgactcactatagggttatattattattatatagatgataaaataaacagaggagatattttatgatctatataaacctggcggcagcgcaaaagatg

SEQ ID NO: 47315 - DNA, 103 bp, Artificial Sequence
  Synthetic Polynucleotide
taatacgactcactatagggttcatcagcattcaagttacaattcttaacaacagaggagagttaagatgtgtaacttgaacctggcggcagcgcaaaagatg

SEQ ID NO: 47316 - DNA, 103 bp, Artificial Sequence
  Synthetic Polynucleotide
taatacgactcactatagggacctgttcatcagcattcaagttacaattcaacagaggagagaattgatgcttgaatgcaacctggcggcagcgcaaaagatg

SEQ ID NO: 47317 - DNA, 103 bp, Artificial Sequence
  Synthetic Polynucleotide
taatacgactcactatagggggataacctgttcatcagcattcaagttacaacagaggagagtaactatgatgctgatgaacctggcggcagcgcaaaagatg

SEQ ID NO: 47318 - DNA, 103 bp, Artificial Sequence
  Synthetic Polynucleotide
taatacgactcactatagggcttttggataacctgttcatcagcattcaaaacagaggagattgaatatggatgaacagaacctggcggcagcgcaaaagatg

SEQ ID NO: 47319 - DNA, 103 bp, Artificial Sequence
  Synthetic Polynucleotide
taatacgactcactatagggaccgccttttggataacctgttcatcagcaaacagaggagatgctgaatgacaggttataacctggcggcagcgcaaaagatg

SEQ ID NO: 47320 - DNA, 103 bp, Artificial Sequence
  Synthetic Polynucleotide
taatacgactcactatagggctattaccgccttttggataacctgttcataacagaggagaatgaacatgttatccaaaaacctggcggcagcgcaaaagatg

SEQ ID NO: 47321 - DNA, 103 bp, Artificial Sequence
  Synthetic Polynucleotide
taatacgactcactataggggtattctattaccgccttttggataacctgaacagaggagacaggttatgcaaaaggcgaacctggcggcagcgcaaaagatg

SEQ ID NO: 47322 - DNA, 103 bp, Artificial Sequence
  Synthetic Polynucleotide
taatacgactcactatagggtcatcgtattctattaccgccttttggataaacagaggagatatccaatgggcggtaataacctggcggcagcgcaaaagatg

SEQ ID NO: 47323 - DNA, 103 bp, Artificial Sequence
  Synthetic Polynucleotide
taatacgactcactatagggtaatatcatcgtattctattaccgccttttaacagaggagaaaaaggatgtaatagaataacctggcggcagcgcaaaagatg

SEQ ID NO: 47324 - DNA, 103 bp, Artificial Sequence
  Synthetic Polynucleotide
taatacgactcactatagggaattttaatatcatcgtattctattaccgcaacagaggagagcggtaatggaatacgataacctggcggcagcgcaaaagatg

SEQ ID NO: 47325 - DNA, 103 bp, Artificial Sequence
  Synthetic Polynucleotide
taatacgactcactatagggtagtattatattattattatatagatgataaacagaggagatatcatatgtataataataacctggcggcagcgcaaaagatg

SEQ ID NO: 47326 - DNA, 103 bp, Artificial Sequence
  Synthetic Polynucleotide
taatacgactcactataggggaaataattttaatatcatcgtattctattaacagaggagaaatagaatgcgatgatataacctggcggcagcgcaaaagatg

SEQ ID NO: 47327 - DNA, 103 bp, Artificial Sequence
  Synthetic Polynucleotide
taatacgactcactatagggtattagaaataattttaatatcatcgtattaacagaggagaaatacgatgatattaaaaaacctggcggcagcgcaaaagatg

SEQ ID NO: 47328 - DNA, 103 bp, Artificial Sequence
  Synthetic Polynucleotide
taatacgactcactatagggagtgttattagaaataattttaatatcatcaacagaggagagatgatatgaaaattattaacctggcggcagcgcaaaagatg

SEQ ID NO: 47329 - DNA, 103 bp, Artificial Sequence
  Synthetic Polynucleotide
taatacgactcactatagggctggtagtgttattagaaataattttaataaacagaggagatattaaatgtatttctaaaacctggcggcagcgcaaaagatg

SEQ ID NO: 47330 - DNA, 103 bp, Artificial Sequence
  Synthetic Polynucleotide
taatacgactcactatagggtgatactggtagtgttattagaaataatttaacagaggagaaaattaatgctaataacaaacctggcggcagcgcaaaagatg

SEQ ID NO: 47331 - DNA, 103 bp, Artificial Sequence
  Synthetic Polynucleotide
taatacgactcactatagggtaaattgatactggtagtgttattagaaataacagaggagaatttctatgaacactaccaacctggcggcagcgcaaaagatg

SEQ ID NO: 47332 - DNA, 103 bp, Artificial Sequence
  Synthetic Polynucleotide
taatacgactcactatagggtatgataaattgatactggtagtgttattaaacagaggagataataaatgtaccagtataacctggcggcagcgcaaaagatg

SEQ ID NO: 47333 - DNA, 103 bp, Artificial Sequence
  Synthetic Polynucleotide
taatacgactcactatagggtgatatatgataaattgatactggtagtgtaacagaggagaacactaatggtatcaattaacctggcggcagcgcaaaagatg

SEQ ID NO: 47334 - DNA, 103 bp, Artificial Sequence
  Synthetic Polynucleotide
taatacgactcactatagggggatgtgatatatgataaattgatactggtaacagaggagaaccagtatgaatttatcaaacctggcggcagcgcaaaagatg

SEQ ID NO: 47335 - DNA, 103 bp, Artificial Sequence
  Synthetic Polynucleotide
taatacgactcactatagggttgccggatgtgatatatgataaattgataaacagaggagatatcaaatgatcatatataacctggcggcagcgcaaaagatg

SEQ ID NO: 47336 - DNA, 103 bp, Artificial Sequence
  Synthetic Polynucleotide
taatacgactcactatagggactattagtattatattattattatatagaaacagaggagatctataatgtaataatataacctggcggcagcgcaaaagatg

SEQ ID NO: 47337 - DNA, 103 bp, Artificial Sequence
  Synthetic Polynucleotide
taatacgactcactatagggtatttttgccggatgtgatatatgataaataacagaggagaatttatatgatatcacataacctggcggcagcgcaaaagatg

SEQ ID NO: 47338 - DNA, 103 bp, Artificial Sequence
  Synthetic Polynucleotide
taatacgactcactatagggcatattatttttgccggatgtgatatatgaaacagaggagatcatatatgacatccggcaacctggcggcagcgcaaaagatg

SEQ ID NO: 47339 - DNA, 103 bp, Artificial Sequence
  Synthetic Polynucleotide
taatacgactcactatagggctaatcatattatttttgccggatgtgataaacagaggagatatcacatgcggcaaaaaaacctggcggcagcgcaaaagatg

SEQ ID NO: 47340 - DNA, 103 bp, Artificial Sequence
  Synthetic Polynucleotide
taatacgactcactatagggaacttctaatcatattatttttgccggatgaacagaggagacatccgatgaaaataataaacctggcggcagcgcaaaagatg

SEQ ID NO: 47341 - DNA, 103 bp, Artificial Sequence
  Synthetic Polynucleotide
taatacgactcactataggggatataacttctaatcatattatttttgccaacagaggagaggcaaaatgaatatgattaacctggcggcagcgcaaaagatg

SEQ ID NO: 47342 - DNA, 103 bp, Artificial Sequence
  Synthetic Polynucleotide
taatacgactcactataggggcgacgatataacttctaatcatattatttaacagaggagaaaataaatggattagaagaacctggcggcagcgcaaaagatg

SEQ ID NO: 47343 - DNA, 103 bp, Artificial Sequence
  Synthetic Polynucleotide
taatacgactcactataggggccgggcgacgatataacttctaatcatataacagaggagaatatgaatggaagttataaacctggcggcagcgcaaaagatg

SEQ ID NO: 47344 - DNA, 103 bp, Artificial Sequence
  Synthetic Polynucleotide
taatacgactcactatagggttttcgccgggcgacgatataacttctaataacagaggagaattagaatgtatatcgtcaacctggcggcagcgcaaaagatg

SEQ ID NO: 47345 - DNA, 103 bp, Artificial Sequence
  Synthetic Polynucleotide
taatacgactcactatagggtgatcttttcgccgggcgacgatataacttaacagaggagaaagttaatgcgtcgcccgaacctggcggcagcgcaaaagatg

SEQ ID NO: 47346 - DNA, 103 bp, Artificial Sequence
  Synthetic Polynucleotide
taatacgactcactatagggcggtctgatcttttcgccgggcgacgatataacagaggagaatatcgatgcccggcgaaaacctggcggcagcgcaaaagatg

SEQ ID NO: 47347 - DNA, 103 bp, Artificial Sequence
  Synthetic Polynucleotide
taatacgactcactataggggaaacaatgtagtgcattattacgtctacaaacagaggagatgtagaatgaataatgcaaacctggcggcagcgcaaaagatg

SEQ ID NO: 47348 - DNA, 103 bp, Artificial Sequence
  Synthetic Polynucleotide
taatacgactcactatagggagtccctgtcattgccatgctactaaggacaacagaggagagtccttatgagcatggcaaacctggcggcagcgcaaaagatg

SEQ ID NO: 47349 - DNA, 103 bp, Artificial Sequence
  Synthetic Polynucleotide
taatacgactcactatagggcgattactattagtattatattattattataacagaggagaataataatgatataatacaacctggcggcagcgcaaaagatg

SEQ ID NO: 47350 - DNA, 103 bp, Artificial Sequence
  Synthetic Polynucleotide
taatacgactcactatagggtctagcggtctgatcttttcgccgggcgacaacagaggagagtcgccatgcgaaaagataacctggcggcagcgcaaaagatg

SEQ ID NO: 47351 - DNA, 103 bp, Artificial Sequence
  Synthetic Polynucleotide
taatacgactcactatagggacagatctagcggtctgatcttttcgccggaacagaggagaccggcgatgagatcagacaacctggcggcagcgcaaaagatg

SEQ ID NO: 47352 - DNA, 103 bp, Artificial Sequence
  Synthetic Polynucleotide
taatacgactcactatagggcaattacagatctagcggtctgatcttttcaacagaggagagaaaagatgagaccgctaaacctggcggcagcgcaaaagatg

SEQ ID NO: 47353 - DNA, 103 bp, Artificial Sequence
  Synthetic Polynucleotide
taatacgactcactataggggggaccaattacagatctagcggtctgatcaacagaggagagatcagatggctagatctaacctggcggcagcgcaaaagatg

SEQ ID NO: 47354 - DNA, 103 bp, Artificial Sequence
  Synthetic Polynucleotide
taatacgactcactataggggtactgggaccaattacagatctagcggtcaacagaggagagaccgcatgatctgtaataacctggcggcagcgcaaaagatg

SEQ ID NO: 47355 - DNA, 103 bp, Artificial Sequence
  Synthetic Polynucleotide
taatacgactcactatagggtagatgtactgggaccaattacagatctagaacagaggagactagatatgtaattggtcaacctggcggcagcgcaaaagatg

SEQ ID NO: 47356 - DNA, 103 bp, Artificial Sequence
  Synthetic Polynucleotide
taatacgactcactatagggtgtgatagatgtactgggaccaattacagaaacagaggagatctgtaatgggtcccagtaacctggcggcagcgcaaaagatg

SEQ ID NO: 47357 - DNA, 103 bp, Artificial Sequence
  Synthetic Polynucleotide
taatacgactcactatagggttaactgtgatagatgtactgggaccaattaacagaggagaaattggatgcagtacatcaacctggcggcagcgcaaaagatg

SEQ ID NO: 47358 - DNA, 103 bp, Artificial Sequence
  Synthetic Polynucleotide
taatacgactcactatagggcctcattaactgtgatagatgtactgggacaacagaggagagtcccaatgcatctatcaaacctggcggcagcgcaaaagatg

SEQ ID NO: 47359 - DNA, 103 bp, Artificial Sequence
  Synthetic Polynucleotide
taatacgactcactatagggtcctacctcattaactgtgatagatgtactaacagaggagaagtacaatgatcacagttaacctggcggcagcgcaaaagatg

SEQ ID NO: 47360 - DNA, 103 bp, Artificial Sequence
  Synthetic Polynucleotide
taatacgactcactataggggataacgattactattagtattatattattaacagaggagaaataatatgatactaataaacctggcggcagcgcaaaagatg

SEQ ID NO: 47361 - DNA, 103 bp, Artificial Sequence
  Synthetic Polynucleotide
taatacgactcactatagggggcattcctacctcattaactgtgatagataacagaggagaatctatatgagttaatgaaacctggcggcagcgcaaaagatg

SEQ ID NO: 47362 - DNA, 103 bp, Artificial Sequence
  Synthetic Polynucleotide
taatacgactcactatagggatgcgggcattcctacctcattaactgtgaaacagaggagatcacagatgatgaggtagaacctggcggcagcgcaaaagatg

SEQ ID NO: 47363 - DNA, 103 bp, Artificial Sequence
  Synthetic Polynucleotide
taatacgactcactatagggaatatatgcgggcattcctacctcattaacaacagaggagagttaatatggtaggaatgaacctggcggcagcgcaaaagatg

SEQ ID NO: 47364 - DNA, 103 bp, Artificial Sequence
  Synthetic Polynucleotide
taatacgactcactatagggtttctaatatatgcgggcattcctacctcaaacagaggagatgaggtatgaatgcccgcaacctggcggcagcgcaaaagatg

SEQ ID NO: 47365 - DNA, 103 bp, Artificial Sequence
  Synthetic Polynucleotide
taatacgactcactataggggtgtatttctaatatatgcgggcattcctaaacagaggagataggaaatgccgcatataaacctggcggcagcgcaaaagatg

SEQ ID NO: 47366 - DNA, 103 bp, Artificial Sequence
  Synthetic Polynucleotide
taatacgactcactatagggtgtaagtgtatttctaatatatgcgggcataacagaggagaatgcccatgtatattagaaacctggcggcagcgcaaaagatg

SEQ ID NO: 47367 - DNA, 103 bp, Artificial Sequence
  Synthetic Polynucleotide
taatacgactcactatagggttttctgtaagtgtatttctaatatatgcgaacagaggagacgcataatgtagaaatacaacctggcggcagcgcaaaagatg

SEQ ID NO: 47368 - DNA, 103 bp, Artificial Sequence
  Synthetic Polynucleotide
taatacgactcactatagggatatcttttctgtaagtgtatttctaatataacagaggagaatattaatgatacacttaaacctggcggcagcgcaaaagatg

SEQ ID NO: 47369 - DNA, 103 bp, Artificial Sequence
  Synthetic Polynucleotide
taatacgactcactatagggaacaaatatcttttctgtaagtgtatttctaacagaggagaagaaatatgcttacagaaaacctggcggcagcgcaaaagatg

SEQ ID NO: 47370 - DNA, 103 bp, Artificial Sequence
  Synthetic Polynucleotide
taatacgactcactataggggcattaacaaatatcttttctgtaagtgtaaacagaggagatacactatgagaaaagataacctggcggcagcgcaaaagatg

SEQ ID NO: 47371 - DNA, 103 bp, Artificial Sequence
  Synthetic Polynucleotide
taatacgactcactatagggacaatgataacgattactattagtattataaacagaggagatataatatgaatagtaataacctggcggcagcgcaaaagatg

SEQ ID NO: 47372 - DNA, 103 bp, Artificial Sequence
  Synthetic Polynucleotide
taatacgactcactatagggtaaaggcattaacaaatatcttttctgtaaaacagaggagattacagatgagatatttgaacctggcggcagcgcaaaagatg

SEQ ID NO: 47373 - DNA, 103 bp, Artificial Sequence
  Synthetic Polynucleotide
taatacgactcactatagggcactgtaaaggcattaacaaatatcttttcaacagaggagagaaaagatgtttgttaataacctggcggcagcgcaaaagatg

SEQ ID NO: 47374 - DNA, 103 bp, Artificial Sequence
  Synthetic Polynucleotide
taatacgactcactatagggttattcactgtaaaggcattaacaaatatcaacagaggagagatattatgtaatgccttaacctggcggcagcgcaaaagatg

SEQ ID NO: 47375 - DNA, 103 bp, Artificial Sequence
  Synthetic Polynucleotide
taatacgactcactatagggtaactttattcactgtaaaggcattaacaaaacagaggagattgttaatgcctttacagaacctggcggcagcgcaaaagatg

SEQ ID NO: 47376 - DNA, 103 bp, Artificial Sequence
  Synthetic Polynucleotide
taatacgactcactatagggttgtttaactttattcactgtaaaggcattaacagaggagaaatgccatgacagtgaataacctggcggcagcgcaaaagatg

SEQ ID NO: 47377 - DNA, 103 bp, Artificial Sequence
  Synthetic Polynucleotide
taatacgactcactatagggaatagttgtttaactttattcactgtaaagaacagaggagactttacatggaataaagtaacctggcggcagcgcaaaagatg

SEQ ID NO: 47378 - DNA, 103 bp, Artificial Sequence
  Synthetic Polynucleotide
taatacgactcactatagggacgctaatagttgtttaactttattcactgaacagaggagacagtgaatgaagttaaacaacctggcggcagcgcaaaagatg

SEQ ID NO: 47379 - DNA, 103 bp, Artificial Sequence
  Synthetic Polynucleotide
taatacgactcactataggggtttgacgctaatagttgtttaactttattaacagaggagaaataaaatgaaacaactaaacctggcggcagcgcaaaagatg

SEQ ID NO: 47380 - DNA, 103 bp, Artificial Sequence
  Synthetic Polynucleotide
taatacgactcactatagggacttggtttgacgctaatagttgtttaactaacagaggagaagttaaatgactattagcaacctggcggcagcgcaaaagatg

SEQ ID NO: 47381 - DNA, 103 bp, Artificial Sequence
  Synthetic Polynucleotide
taatacgactcactatagggatttaacttggtttgacgctaatagttgttaacagaggagaaacaacatgtagcgtcaaaacctggcggcagcgcaaaagatg

SEQ ID NO: 47382 - DNA, 103 bp, Artificial Sequence
  Synthetic Polynucleotide
taatacgactcactatagggtgggtacaatgataacgattactattagtaaacagaggagatactaaatgtaatcgttaaacctggcggcagcgcaaaagatg

SEQ ID NO: 47383 - DNA, 103 bp, Artificial Sequence
  Synthetic Polynucleotide
taatacgactcactataggggtaaaatttaacttggtttgacgctaatagaacagaggagactattaatgtcaaaccaaaacctggcggcagcgcaaaagatg

SEQ ID NO: 47384 - DNA, 103 bp, Artificial Sequence
  Synthetic Polynucleotide
taatacgactcactatagggttaaagtaaaatttaacttggtttgacgctaacagaggagaagcgtcatgccaagttaaaacctggcggcagcgcaaaagatg

SEQ ID NO: 47385 - DNA, 103 bp, Artificial Sequence
  Synthetic Polynucleotide
taatacgactcactataggggtttattaaagtaaaatttaacttggtttgaacagaggagacaaaccatgttaaattttaacctggcggcagcgcaaaagatg

SEQ ID NO: 47386 - DNA, 103 bp, Artificial Sequence
  Synthetic Polynucleotide
taatacgactcactatagggtaatcgtttattaaagtaaaatttaacttgaacagaggagacaagttatgttttactttaacctggcggcagcgcaaaagatg

SEQ ID NO: 47387 - DNA, 103 bp, Artificial Sequence
  Synthetic Polynucleotide
taatacgactcactatagggtggtttaatcgtttattaaagtaaaatttaaacagaggagataaattatgctttaataaaacctggcggcagcgcaaaagatg

SEQ ID NO: 47388 - DNA, 103 bp, Artificial Sequence
  Synthetic Polynucleotide
taatacgactcactatagggttaattggtttaatcgtttattaaagtaaaaacagaggagatttactatgataaacgataacctggcggcagcgcaaaagatg

SEQ ID NO: 47389 - DNA, 103 bp, Artificial Sequence
  Synthetic Polynucleotide
taatacgactcactatagggtcttgttaattggtttaatcgtttattaaaaacagaggagatttaatatgcgattaaacaacctggcggcagcgcaaaagatg

SEQ ID NO: 47390 - DNA, 103 bp, Artificial Sequence
  Synthetic Polynucleotide
taatacgactcactatagggcgtattcttgttaattggtttaatcgtttaaacagaggagataaacgatgaaaccaattaacctggcggcagcgcaaaagatg

SEQ ID NO: 47391 - DNA, 103 bp, Artificial Sequence
  Synthetic Polynucleotide
taatacgactcactatagggcttgacgtattcttgttaattggtttaatcaacagaggagagattaaatgaattaacaaaacctggcggcagcgcaaaagatg

SEQ ID NO: 47392 - DNA, 103 bp, Artificial Sequence
  Synthetic Polynucleotide
taatacgactcactatagggctttccttgacgtattcttgttaattggttaacagaggagaaaccaaatgacaagaataaacctggcggcagcgcaaaagatg

SEQ ID NO: 47393 - DNA, 103 bp, Artificial Sequence
  Synthetic Polynucleotide
taatacgactcactatagggtcaagtgggtacaatgataacgattactataacagaggagaatagtaatggttatcattaacctggcggcagcgcaaaagatg

SEQ ID NO: 47394 - DNA, 103 bp, Artificial Sequence
  Synthetic Polynucleotide
taatacgactcactatagggataaactttccttgacgtattcttgttaataacagaggagaattaacatgaatacgtcaaacctggcggcagcgcaaaagatg

SEQ ID NO: 47395 - DNA, 103 bp, Artificial Sequence
  Synthetic Polynucleotide
taatacgactcactatagggttttgataaactttccttgacgtattcttgaacagaggagacaagaaatggtcaaggaaaacctggcggcagcgcaaaagatg

SEQ ID NO: 47396 - DNA, 103 bp, Artificial Sequence
  Synthetic Polynucleotide
taatacgactcactatagggtttatttttgataaactttccttgacgtataacagaggagaatacgtatgggaaagtttaacctggcggcagcgcaaaagatg

SEQ ID NO: 47397 - DNA, 103 bp, Artificial Sequence
  Synthetic Polynucleotide
taatacgactcactatagggtgtattttatttttgataaactttccttgaaacagaggagatcaaggatggtttatcaaaacctggcggcagcgcaaaagatg

SEQ ID NO: 47398 - DNA, 103 bp, Artificial Sequence
  Synthetic Polynucleotide
taatacgactcactatagggataaatgtattttatttttgataaactttcaacagaggagagaaagtatgtcaaaaataaacctggcggcagcgcaaaagatg

SEQ ID NO: 47399 - DNA, 103 bp, Artificial Sequence
  Synthetic Polynucleotide
taatacgactcactatagggaggcaataaatgtattttatttttgataaaaacagaggagatttatcatgaataaaataaacctggcggcagcgcaaaagatg

SEQ ID NO: 47400 - DNA, 103 bp, Artificial Sequence
  Synthetic Polynucleotide
taatacgactcactatagggtcaccaggcaataaatgtattttatttttgaacagaggagacaaaaaatgaatacatttaacctggcggcagcgcaaaagatg

SEQ ID NO: 47401 - DNA, 103 bp, Artificial Sequence
  Synthetic Polynucleotide
taatacgactcactatagggcccaatcaccaggcaataaatgtattttataacagaggagaataaaaatgatttattgcaacctggcggcagcgcaaaagatg

SEQ ID NO: 47402 - DNA, 103 bp, Artificial Sequence
  Synthetic Polynucleotide
taatacgactcactatagggttctacccaatcaccaggcaataaatgtataacagaggagaatacatatgttgcctggtaacctggcggcagcgcaaaagatg

SEQ ID NO: 47403 - DNA, 103 bp, Artificial Sequence
  Synthetic Polynucleotide
taatacgactcactataggggctacttctacccaatcaccaggcaataaaaacagaggagatttattatgtggtgattgaacctggcggcagcgcaaaagatg

SEQ ID NO: 47404 - DNA, 103 bp, Artificial Sequence
  Synthetic Polynucleotide
taatacgactcactatagggacttctcaagtgggtacaatgataacgattaacagaggagaaatcgtatgcattgtaccaacctggcggcagcgcaaaagatg

SEQ ID NO: 47405 - DNA, 103 bp, Artificial Sequence
  Synthetic Polynucleotide
taatacgactcactataggggaacagctacttctacccaatcaccaggcaaacagaggagatgcctgatgattgggtagaacctggcggcagcgcaaaagatg

SEQ ID NO: 47406 - DNA, 103 bp, Artificial Sequence
  Synthetic Polynucleotide
taatacgactcactatagggttcttgaacagctacttctacccaatcaccaacagaggagaggtgatatggtagaagtaaacctggcggcagcgcaaaagatg

SEQ ID NO: 47407 - DNA, 103 bp, Artificial Sequence
  Synthetic Polynucleotide
taatacgactcactataggggtatattcttgaacagctacttctacccaaaacagaggagattgggtatgagtagctgtaacctggcggcagcgcaaaagatg

SEQ ID NO: 47408 - DNA, 103 bp, Artificial Sequence
  Synthetic Polynucleotide
taatacgactcactatagggtacttgtatattcttgaacagctacttctaaacagaggagatagaagatgctgttcaagaacctggcggcagcgcaaaagatg

SEQ ID NO: 47409 - DNA, 103 bp, Artificial Sequence
  Synthetic Polynucleotide
taatacgactcactatagggaataatacttgtatattcttgaacagctacaacagaggagagtagctatgcaagaatataacctggcggcagcgcaaaagatg

SEQ ID NO: 47410 - DNA, 103 bp, Artificial Sequence
  Synthetic Polynucleotide
taatacgactcactatagggccaaaaataatacttgtatattcttgaacaaacagaggagatgttcaatgatatacaagaacctggcggcagcgcaaaagatg

SEQ ID NO: 47411 - DNA, 103 bp, Artificial Sequence
  Synthetic Polynucleotide
taatacgactcactataggggtcttccaaaaataatacttgtatattcttaacagaggagaaagaatatgcaagtattaaacctggcggcagcgcaaaagatg

SEQ ID NO: 47412 - DNA, 103 bp, Artificial Sequence
  Synthetic Polynucleotide
taatacgactcactatagggcggctgtcttccaaaaataatacttgtataaacagaggagatatacaatgattatttttaacctggcggcagcgcaaaagatg

SEQ ID NO: 47413 - DNA, 103 bp, Artificial Sequence
  Synthetic Polynucleotide
taatacgactcactatagggagcgacggctgtcttccaaaaataatacttaacagaggagaaagtatatgttttggaagaacctggcggcagcgcaaaagatg

SEQ ID NO: 47414 - DNA, 103 bp, Artificial Sequence
  Synthetic Polynucleotide
taatacgactcactatagggtatgtagcgacggctgtcttccaaaaataaaacagaggagattatttatggaagacagcaacctggcggcagcgcaaaagatg

SEQ ID NO: 47415 - DNA, 103 bp, Artificial Sequence
  Synthetic Polynucleotide
taatacgactcactatagggtactaacttctcaagtgggtacaatgataaaacagaggagattatcaatgtacccacttaacctggcggcagcgcaaaagatg

SEQ ID NO: 47416 - DNA, 103 bp, Artificial Sequence
  Synthetic Polynucleotide
taatacgactcactataggggtatctatgtagcgacggctgtcttccaaaaacagaggagatttggaatgcagccgtcgaacctggcggcagcgcaaaagatg

SEQ ID NO: 47417 - DNA, 103 bp, Artificial Sequence
  Synthetic Polynucleotide
taatacgactcactatagggacgttgtatctatgtagcgacggctgtcttaacagaggagaaagacaatggtcgctacaaacctggcggcagcgcaaaagatg

SEQ ID NO: 47418 - DNA, 103 bp, Artificial Sequence
  Synthetic Polynucleotide
taatacgactcactatagggcgatgacgttgtatctatgtagcgacggctaacagaggagaagccgtatgtacatagataacctggcggcagcgcaaaagatg

SEQ ID NO: 47419 - DNA, 103 bp, Artificial Sequence
  Synthetic Polynucleotide
taatacgactcactatagggtgaagcgatgacgttgtatctatgtagcgaaacagaggagatcgctaatgagatacaacaacctggcggcagcgcaaaagatg

SEQ ID NO: 47420 - DNA, 103 bp, Artificial Sequence
  Synthetic Polynucleotide
taatacgactcactatagggatagatgaagcgatgacgttgtatctatgtaacagaggagaacatagatgcaacgtcataacctggcggcagcgcaaaagatg

SEQ ID NO: 47421 - DNA, 103 bp, Artificial Sequence
  Synthetic Polynucleotide
taatacgactcactatagggctctgatagatgaagcgatgacgttgtatcaacagaggagagatacaatgtcatcgcttaacctggcggcagcgcaaaagatg

SEQ ID NO: 47422 - DNA, 103 bp, Artificial Sequence
  Synthetic Polynucleotide
taatacgactcactatagggggtagctctgatagatgaagcgatgacgttaacagaggagaaacgtcatggcttcatctaacctggcggcagcgcaaaagatg

SEQ ID NO: 47423 - DNA, 103 bp, Artificial Sequence
  Synthetic Polynucleotide
taatacgactcactatagggccttcggtagctctgatagatgaagcgatgaacagaggagacatcgcatgatctatcagaacctggcggcagcgcaaaagatg

SEQ ID NO: 47424 - DNA, 103 bp, Artificial Sequence
  Synthetic Polynucleotide
taatacgactcactatagggtatctccttcggtagctctgatagatgaagaacagaggagacttcatatgtcagagctaaacctggcggcagcgcaaaagatg

SEQ ID NO: 47425 - DNA, 103 bp, Artificial Sequence
  Synthetic Polynucleotide
taatacgactcactataggggatagtatctccttcggtagctctgatagaaacagaggagatctatcatggctaccgaaaacctggcggcagcgcaaaagatg

SEQ ID NO: 47426 - DNA, 103 bp, Artificial Sequence
  Synthetic Polynucleotide
taatacgactcactatagggaaagttactaacttctcaagtgggtacaataacagaggagaattgtaatgacttgagaaaacctggcggcagcgcaaaagatg

SEQ ID NO: 47427 - DNA, 103 bp, Artificial Sequence
  Synthetic Polynucleotide
taatacgactcactatagggattttgatagtatctccttcggtagctctgaacagaggagacagagcatgcgaaggagaaacctggcggcagcgcaaaagatg

SEQ ID NO: 47428 - DNA, 103 bp, Artificial Sequence
  Synthetic Polynucleotide
taatacgactcactataggggagatattttgatagtatctccttcggtagaacagaggagactaccgatggagatactaaacctggcggcagcgcaaaagatg

SEQ ID NO: 47429 - DNA, 103 bp, Artificial Sequence
  Synthetic Polynucleotide
taatacgactcactatagggtccgggagatattttgatagtatctccttcaacagaggagagaaggaatgactatcaaaaacctggcggcagcgcaaaagatg

SEQ ID NO: 47430 - DNA, 103 bp, Artificial Sequence
  Synthetic Polynucleotide
taatacgactcactataggggcaattccgggagatattttgatagtatctaacagaggagaagatacatgcaaaatatcaacctggcggcagcgcaaaagatg

SEQ ID NO: 47431 - DNA, 103 bp, Artificial Sequence
  Synthetic Polynucleotide
taatacgactcactatagggagttggcaattccgggagatattttgatagaacagaggagactatcaatgtatctcccgaacctggcggcagcgcaaaagatg

SEQ ID NO: 47432 - DNA, 103 bp, Artificial Sequence
  Synthetic Polynucleotide
taatacgactcactatagggttgagagttggcaattccgggagatattttaacagaggagaaaaataatgcccggaattaacctggcggcagcgcaaaagatg

SEQ ID NO: 47433 - DNA, 103 bp, Artificial Sequence
  Synthetic Polynucleotide
taatacgactcactataggggcattttgagagttggcaattccgggagataacagaggagaatctccatgaattgccaaaacctggcggcagcgcaaaagatg

SEQ ID NO: 47434 - DNA, 103 bp, Artificial Sequence
  Synthetic Polynucleotide
taatacgactcactatagggaatcagcattttgagagttggcaattccggaacagaggagaccggaaatgccaactctcaacctggcggcagcgcaaaagatg

SEQ ID NO: 47435 - DNA, 103 bp, Artificial Sequence
  Synthetic Polynucleotide
taatacgactcactataggggtcgaaatcagcattttgagagttggcaataacagaggagaattgccatgtctcaaaataacctggcggcagcgcaaaagatg

SEQ ID NO: 47436 - DNA, 103 bp, Artificial Sequence
  Synthetic Polynucleotide
taatacgactcactatagggtctccgtcgaaatcagcattttgagagttgaacagaggagacaactcatgaaatgctgaaacctggcggcagcgcaaaagatg

SEQ ID NO: 47437 - DNA, 103 bp, Artificial Sequence
  Synthetic Polynucleotide
taatacgactcactataggggaaaaaaagttactaacttctcaagtgggtaacagaggagaacccacatgagaagttagaacctggcggcagcgcaaaagatg

SEQ ID NO: 47438 - DNA, 103 bp, Artificial Sequence
  Synthetic Polynucleotide
taatacgactcactatagggcttcatctccgtcgaaatcagcattttgagaacagaggagactcaaaatgctgatttcgaacctggcggcagcgcaaaagatg

SEQ ID NO: 47439 - DNA, 103 bp, Artificial Sequence
  Synthetic Polynucleotide
taatacgactcactatagggccattcttcatctccgtcgaaatcagcattaacagaggagaaatgctatgttcgacggaaacctggcggcagcgcaaaagatg

SEQ ID NO: 47440 - DNA, 103 bp, Artificial Sequence
  Synthetic Polynucleotide
taatacgactcactatagggatcatccattcttcatctccgtcgaaatcaaacagaggagatgatttatgcggagatgaaacctggcggcagcgcaaaagatg

SEQ ID NO: 47441 - DNA, 103 bp, Artificial Sequence
  Synthetic Polynucleotide
taatacgactcactatagggccaatatcatccattcttcatctccgtcgaaacagaggagatcgacgatgatgaagaataacctggcggcagcgcaaaagatg

SEQ ID NO: 47442 - DNA, 103 bp, Artificial Sequence
  Synthetic Polynucleotide
taatacgactcactatagggttgctccaatatcatccattcttcatctccaacagaggagaggagatatggaatggatgaacctggcggcagcgcaaaagatg

SEQ ID NO: 47443 - DNA, 103 bp, Artificial Sequence
  Synthetic Polynucleotide
taatacgactcactatagggggattttgctccaatatcatccattcttcaaacagaggagatgaagaatggatgatattaacctggcggcagcgcaaaagatg

SEQ ID NO: 47444 - DNA, 103 bp, Artificial Sequence
  Synthetic Polynucleotide
taatacgactcactatagggctttaggattttgctccaatatcatccattaacagaggagaaatggaatgtattggagcaacctggcggcagcgcaaaagatg

SEQ ID NO: 47445 - DNA, 103 bp, Artificial Sequence
  Synthetic Polynucleotide
taatacgactcactatagggtacggctttaggattttgctccaatatcataacagaggagaatgataatggagcaaaataacctggcggcagcgcaaaagatg

SEQ ID NO: 47446 - DNA, 103 bp, Artificial Sequence
  Synthetic Polynucleotide
taatacgactcactatagggtcaactacggctttaggattttgctccaataacagaggagaattggaatgaaatcctaaaacctggcggcagcgcaaaagatg

SEQ ID NO: 47447 - DNA, 103 bp, Artificial Sequence
  Synthetic Polynucleotide
taatacgactcactatagggtctgttcaactacggctttaggattttgctaacagaggagaagcaaaatgctaaagccgaacctggcggcagcgcaaaagatg

SEQ ID NO: 47448 - DNA, 103 bp, Artificial Sequence
  Synthetic Polynucleotide
taatacgactcactatagggtaatagaaaaaaagttactaacttctcaagaacagaggagacttgagatgttagtaactaacctggcggcagcgcaaaagatg

SEQ ID NO: 47449 - DNA, 103 bp, Artificial Sequence
  Synthetic Polynucleotide
taatacgactcactatagggaatactctgttcaactacggctttaggattaacagaggagaaatcctatggccgtagttaacctggcggcagcgcaaaagatg

SEQ ID NO: 47450 - DNA, 103 bp, Artificial Sequence
  Synthetic Polynucleotide
taatacgactcactatagggataagaatactctgttcaactacggctttaaacagaggagataaagcatgagttgaacaaacctggcggcagcgcaaaagatg

SEQ ID NO: 47451 - DNA, 103 bp, Artificial Sequence
  Synthetic Polynucleotide
taatacgactcactataggggatacataagaatactctgttcaactacggaacagaggagaccgtagatgaacagagtaaacctggcggcagcgcaaaagatg

SEQ ID NO: 47452 - DNA, 103 bp, Artificial Sequence
  Synthetic Polynucleotide
taatacgactcactatagggtgtcggatacataagaatactctgttcaacaacagaggagagttgaaatgagtattcttaacctggcggcagcgcaaaagatg

SEQ ID NO: 47453 - DNA, 103 bp, Artificial Sequence
  Synthetic Polynucleotide
taatacgactcactatagggaacgttgtcggatacataagaatactctgtaacagaggagaacagagatgtcttatgtaaacctggcggcagcgcaaaagatg

SEQ ID NO: 47454 - DNA, 103 bp, Artificial Sequence
  Synthetic Polynucleotide
taatacgactcactatagggtgagtaacgttgtcggatacataagaatacaacagaggagagtattcatgtgtatccgaaacctggcggcagcgcaaaagatg

SEQ ID NO: 47455 - DNA, 103 bp, Artificial Sequence
  Synthetic Polynucleotide
taatacgactcactataggggtgtttgagtaacgttgtcggatacataagaacagaggagacttatgatgccgacaacgaacctggcggcagcgcaaaagatg

SEQ ID NO: 47456 - DNA, 103 bp, Artificial Sequence
  Synthetic Polynucleotide
taatacgactcactatagggatatcgtgtttgagtaacgttgtcggatacaacagaggagagtatccatgaacgttactaacctggcggcagcgcaaaagatg

SEQ ID NO: 47457 - DNA, 103 bp, Artificial Sequence
  Synthetic Polynucleotide
taatacgactcactatagggcatgaatatcgtgtttgagtaacgttgtcgaacagaggagacgacaaatgtactcaaacaacctggcggcagcgcaaaagatg

SEQ ID NO: 47458 - DNA, 103 bp, Artificial Sequence
  Synthetic Polynucleotide
taatacgactcactatagggggctccatgaatatcgtgtttgagtaacgtaacagaggagaacgttaatgaaacacgataacctggcggcagcgcaaaagatg

SEQ ID NO: 47459 - DNA, 103 bp, Artificial Sequence
  Synthetic Polynucleotide
taatacgactcactatagggagttcagtccctgtcattgccatgctactaaacagaggagatagtagatgggcaatgacaacctggcggcagcgcaaaagatg

SEQ ID NO: 47460 - DNA, 103 bp, Artificial Sequence
  Synthetic Polynucleotide
taatacgactcactataggggattataatagaaaaaaagttactaacttcaacagaggagagaagttatgaacttttttaacctggcggcagcgcaaaagatg

SEQ ID NO: 47461 - DNA, 103 bp, Artificial Sequence
  Synthetic Polynucleotide
taatacgactcactatagggacgggggctccatgaatatcgtgtttgagtaacagaggagaactcaaatgcgatattcaaacctggcggcagcgcaaaagatg

SEQ ID NO: 47462 - DNA, 103 bp, Artificial Sequence
  Synthetic Polynucleotide
taatacgactcactatagggcataaacgggggctccatgaatatcgtgttaacagaggagaaacacgatgttcatggagaacctggcggcagcgcaaaagatg

SEQ ID NO: 47463 - DNA, 103 bp, Artificial Sequence
  Synthetic Polynucleotide
taatacgactcactatagggagatccataaacgggggctccatgaatatcaacagaggagagatattatgggagcccccaacctggcggcagcgcaaaagatg

SEQ ID NO: 47464 - DNA, 103 bp, Artificial Sequence
  Synthetic Polynucleotide
taatacgactcactatagggtgaatagatccataaacgggggctccatgaaacagaggagatcatggatgccccgtttaaacctggcggcagcgcaaaagatg

SEQ ID NO: 47465 - DNA, 103 bp, Artificial Sequence
  Synthetic Polynucleotide
taatacgactcactatagggcatcttgaatagatccataaacgggggctcaacagaggagagagcccatgtttatggataacctggcggcagcgcaaaagatg

SEQ ID NO: 47466 - DNA, 103 bp, Artificial Sequence
  Synthetic Polynucleotide
taatacgactcactataggggatttcatcttgaatagatccataaacgggaacagaggagacccgttatgggatctattaacctggcggcagcgcaaaagatg

SEQ ID NO: 47467 - DNA, 103 bp, Artificial Sequence
  Synthetic Polynucleotide
taatacgactcactataggggctacgatttcatcttgaatagatccataaaacagaggagattatggatgtattcaagaaacctggcggcagcgcaaaagatg

SEQ ID NO: 47468 - DNA, 103 bp, Artificial Sequence
  Synthetic Polynucleotide
taatacgactcactatagggatgctgctacgatttcatcttgaatagatcaacagaggagagatctaatgaagatgaaaaacctggcggcagcgcaaaagatg

SEQ ID NO: 47469 - DNA, 103 bp, Artificial Sequence
  Synthetic Polynucleotide
taatacgactcactatagggtgaatatgctgctacgatttcatcttgaataacagaggagaattcaaatggaaatcgtaaacctggcggcagcgcaaaagatg

SEQ ID NO: 47470 - DNA, 103 bp, Artificial Sequence
  Synthetic Polynucleotide
taatacgactcactatagggaacaatgaatatgctgctacgatttcatctaacagaggagaagatgaatgcgtagcagcaacctggcggcagcgcaaaagatg

SEQ ID NO: 47471 - DNA, 103 bp, Artificial Sequence
  Synthetic Polynucleotide
taatacgactcactatagggtacaagattataatagaaaaaaagttactaaacagaggagatagtaaatgtttttctataacctggcggcagcgcaaaagatg

SEQ ID NO: 47472 - DNA, 103 bp, Artificial Sequence
  Synthetic Polynucleotide
taatacgactcactatagggtcctaaacaatgaatatgctgctacgatttaacagaggagaaaatcgatgcagcatattaacctggcggcagcgcaaaagatg

SEQ ID NO: 47473 - DNA, 103 bp, Artificial Sequence
  Synthetic Polynucleotide
taatacgactcactatagggttgtatcctaaacaatgaatatgctgctacaacagaggagagtagcaatgtattcattgaacctggcggcagcgcaaaagatg

SEQ ID NO: 47474 - DNA, 103 bp, Artificial Sequence
  Synthetic Polynucleotide
taatacgactcactatagggagatcttgtatcctaaacaatgaatatgctaacagaggagaagcataatgattgtttagaacctggcggcagcgcaaaagatg

SEQ ID NO: 47475 - DNA, 103 bp, Artificial Sequence
  Synthetic Polynucleotide
taatacgactcactatagggaacaaagatcttgtatcctaaacaatgaataacagaggagaattcatatgttaggatacaacctggcggcagcgcaaaagatg

SEQ ID NO: 47476 - DNA, 103 bp, Artificial Sequence
  Synthetic Polynucleotide
taatacgactcactatagggatctaaacaaagatcttgtatcctaaacaaaacagaggagattgtttatgatacaagataacctggcggcagcgcaaaagatg

SEQ ID NO: 47477 - DNA, 103 bp, Artificial Sequence
  Synthetic Polynucleotide
taatacgactcactatagggacttcatctaaacaaagatcttgtatcctaaacagaggagataggatatgagatctttgaacctggcggcagcgcaaaagatg

SEQ ID NO: 47478 - DNA, 103 bp, Artificial Sequence
  Synthetic Polynucleotide
taatacgactcactatagggtcaatacttcatctaaacaaagatcttgtaaacagaggagatacaagatgtttgtttagaacctggcggcagcgcaaaagatg

SEQ ID NO: 47479 - DNA, 103 bp, Artificial Sequence
  Synthetic Polynucleotide
taatacgactcactataggggatgttcaatacttcatctaaacaaagatcaacagaggagagatcttatgttagatgaaaacctggcggcagcgcaaaagatg

SEQ ID NO: 47480 - DNA, 103 bp, Artificial Sequence
  Synthetic Polynucleotide
taatacgactcactatagggcccaagatgttcaatacttcatctaaacaaaacagaggagattgtttatgtgaagtattaacctggcggcagcgcaaaagatg

SEQ ID NO: 47481 - DNA, 103 bp, Artificial Sequence
  Synthetic Polynucleotide
taatacgactcactatagggatttccccaagatgttcaatacttcatctaaacagaggagatagatgatgtattgaacaaacctggcggcagcgcaaaagatg

SEQ ID NO: 47482 - DNA, 103 bp, Artificial Sequence
  Synthetic Polynucleotide
taatacgactcactatagggacggatacaagattataatagaaaaaaagtaacagaggagaacttttatgctattataaaacctggcggcagcgcaaaagatg

SEQ ID NO: 47483 - DNA, 103 bp, Artificial Sequence
  Synthetic Polynucleotide
taatacgactcactatagggtccatatttccccaagatgttcaatacttcaacagaggagagaagtaatgaacatcttgaacctggcggcagcgcaaaagatg

SEQ ID NO: 47484 - DNA, 103 bp, Artificial Sequence
  Synthetic Polynucleotide
taatacgactcactatagggtctcttccatatttccccaagatgttcaataacagaggagaattgaaatgcttggggaaaacctggcggcagcgcaaaagatg

SEQ ID NO: 47485 - DNA, 103 bp, Artificial Sequence
  Synthetic Polynucleotide
taatacgactcactatagggcgaactctcttccatatttccccaagatgtaacagaggagaacatctatgggaaatatgaacctggcggcagcgcaaaagatg

SEQ ID NO: 47486 - DNA, 103 bp, Artificial Sequence
  Synthetic Polynucleotide
taatacgactcactatagggaggatcgaactctcttccatatttccccaaaacagaggagattggggatgtatggaagaaacctggcggcagcgcaaaagatg

SEQ ID NO: 47487 - DNA, 103 bp, Artificial Sequence
  Synthetic Polynucleotide
taatacgactcactatagggcctttaggatcgaactctcttccatatttcaacagaggagagaaataatgaagagagttaacctggcggcagcgcaaaagatg

SEQ ID NO: 47488 - DNA, 103 bp, Artificial Sequence
  Synthetic Polynucleotide
taatacgactcactatagggatttacctttaggatcgaactctcttccataacagaggagaatggaaatgagttcgatcaacctggcggcagcgcaaaagatg

SEQ ID NO: 47489 - DNA, 103 bp, Artificial Sequence
  Synthetic Polynucleotide
taatacgactcactatagggtttacatttacctttaggatcgaactctctaacagaggagaagagagatggatcctaaaaacctggcggcagcgcaaaagatg

SEQ ID NO: 47490 - DNA, 103 bp, Artificial Sequence
  Synthetic Polynucleotide
taatacgactcactatagggctgaatttacatttacctttaggatcgaacaacagaggagagttcgaatgtaaaggtaaaacctggcggcagcgcaaaagatg

SEQ ID NO: 47491 - DNA, 103 bp, Artificial Sequence
  Synthetic Polynucleotide
taatacgactcactatagggtaccactgaatttacatttacctttaggataacagaggagaatcctaatggtaaatgtaaacctggcggcagcgcaaaagatg

SEQ ID NO: 47492 - DNA, 103 bp, Artificial Sequence
  Synthetic Polynucleotide
taatacgactcactatagggatctttaccactgaatttacatttacctttaacagaggagaaaaggtatgtgtaaattcaacctggcggcagcgcaaaagatg

SEQ ID NO: 47493 - DNA, 103 bp, Artificial Sequence
  Synthetic Polynucleotide
taatacgactcactatagggatcttacggatacaagattataatagaaaaaacagaggagattttctatgataatcttgaacctggcggcagcgcaaaagatg

SEQ ID NO: 47494 - DNA, 103 bp, Artificial Sequence
  Synthetic Polynucleotide
taatacgactcactatagggtagatatctttaccactgaatttacatttaaacagaggagataaatgatgattcagtggaacctggcggcagcgcaaaagatg

SEQ ID NO: 47495 - DNA, 103 bp, Artificial Sequence
  Synthetic Polynucleotide
taatacgactcactatagggaagtatagatatctttaccactgaatttacaacagaggagagtaaatatggtggtaaagaacctggcggcagcgcaaaagatg

SEQ ID NO: 47496 - DNA, 103 bp, Artificial Sequence
  Synthetic Polynucleotide
taatacgactcactatagggtaagtaagtatagatatctttaccactgaaaacagaggagattcagtatgaaagatatcaacctggcggcagcgcaaaagatg

SEQ ID NO: 47497 - DNA, 103 bp, Artificial Sequence
  Synthetic Polynucleotide
taatacgactcactatagggcctattaagtaagtatagatatctttaccaaacagaggagatggtaaatgtatctatacaacctggcggcagcgcaaaagatg

SEQ ID NO: 47498 - DNA, 103 bp, Artificial Sequence
  Synthetic Polynucleotide
taatacgactcactatagggtttcacctattaagtaagtatagatatcttaacagaggagaaagataatgatacttactaacctggcggcagcgcaaaagatg

SEQ ID NO: 47499 - DNA, 103 bp, Artificial Sequence
  Synthetic Polynucleotide
taatacgactcactatagggaatcttttcacctattaagtaagtatagataacagaggagaatctatatgtacttaataaacctggcggcagcgcaaaagatg

SEQ ID NO: 47500 - DNA, 103 bp, Artificial Sequence
  Synthetic Polynucleotide
taatacgactcactatagggtaattaatcttttcacctattaagtaagtaaacagaggagatacttaatgaataggtgaaacctggcggcagcgcaaaagatg

SEQ ID NO: 47501 - DNA, 103 bp, Artificial Sequence
  Synthetic Polynucleotide
taatacgactcactatagggccggataattaatcttttcacctattaagtaacagaggagaacttaaatggtgaaaagaaacctggcggcagcgcaaaagatg

SEQ ID NO: 47502 - DNA, 103 bp, Artificial Sequence
  Synthetic Polynucleotide
taatacgactcactataggggagacccggataattaatcttttcacctataacagaggagaataggtatgaagattaataacctggcggcagcgcaaaagatg

SEQ ID NO: 47503 - DNA, 103 bp, Artificial Sequence
  Synthetic Polynucleotide
taatacgactcactatagggtttaagagacccggataattaatcttttcaaacagaggagatgaaaaatgtaattatccaacctggcggcagcgcaaaagatg

SEQ ID NO: 47504 - DNA, 103 bp, Artificial Sequence
  Synthetic Polynucleotide
taatacgactcactatagggaatgtatcttacggatacaagattataataaacagaggagatattatatgcttgtatccaacctggcggcagcgcaaaagatg

SEQ ID NO: 47505 - DNA, 103 bp, Artificial Sequence
  Synthetic Polynucleotide
taatacgactcactatagggcatcctttaagagacccggataattaatctaacagaggagaagattaatgatccgggtcaacctggcggcagcgcaaaagatg

SEQ ID NO: 47506 - DNA, 103 bp, Artificial Sequence
  Synthetic Polynucleotide
taatacgactcactatagggttcgccatcctttaagagacccggataattaacagaggagaaattatatgggtctcttaaacctggcggcagcgcaaaagatg

SEQ ID NO: 47507 - DNA, 103 bp, Artificial Sequence
  Synthetic Polynucleotide
taatacgactcactatagggataatttcgccatcctttaagagacccggaaacagaggagatccgggatgcttaaaggaaacctggcggcagcgcaaaagatg

SEQ ID NO: 47508 - DNA, 103 bp, Artificial Sequence
  Synthetic Polynucleotide
taatacgactcactatagggttgcaataatttcgccatcctttaagagacaacagaggagagtctctatgaggatggcgaacctggcggcagcgcaaaagatg

SEQ ID NO: 47509 - DNA, 103 bp, Artificial Sequence
  Synthetic Polynucleotide
taatacgactcactatagggatcgtttgcaataatttcgccatcctttaaaacagaggagattaaagatgggcgaaattaacctggcggcagcgcaaaagatg

SEQ ID NO: 47510 - DNA, 103 bp, Artificial Sequence
  Synthetic Polynucleotide
taatacgactcactatagggtctacatcgtttgcaataatttcgccatccaacagaggagaggatggatgaattattgcaacctggcggcagcgcaaaagatg

SEQ ID NO: 47511 - DNA, 103 bp, Artificial Sequence
  Synthetic Polynucleotide
taatacgactcactatagggtactatctacatcgtttgcaataatttcgcaacagaggagagcgaaaatgttgcaaacgaacctggcggcagcgcaaaagatg

SEQ ID NO: 47512 - DNA, 103 bp, Artificial Sequence
  Synthetic Polynucleotide
taatacgactcactatagggaaaattactatctacatcgtttgcaataataacagaggagaattattatgaacgatgtaaacctggcggcagcgcaaaagatg

SEQ ID NO: 47513 - DNA, 103 bp, Artificial Sequence
  Synthetic Polynucleotide
taatacgactcactatagggacaacaaaattactatctacatcgtttgcaaacagaggagatgcaaaatgtgtagatagaacctggcggcagcgcaaaagatg

SEQ ID NO: 47514 - DNA, 103 bp, Artificial Sequence
  Synthetic Polynucleotide
taatacgactcactatagggtagccacaacaaaattactatctacatcgtaacagaggagaacgatgatgatagtaattaacctggcggcagcgcaaaagatg

SEQ ID NO: 47515 - DNA, 103 bp, Artificial Sequence
  Synthetic Polynucleotide
taatacgactcactataggggtagtaatgtatcttacggatacaagattaaacagaggagataatctatgatccgtaagaacctggcggcagcgcaaaagatg

SEQ ID NO: 47516 - DNA, 103 bp, Artificial Sequence
  Synthetic Polynucleotide
taatacgactcactatagggcctcatagccacaacaaaattactatctacaacagaggagagtagatatgaattttgttaacctggcggcagcgcaaaagatg

SEQ ID NO: 47517 - DNA, 103 bp, Artificial Sequence
  Synthetic Polynucleotide
taatacgactcactatagggagatgcctcatagccacaacaaaattactaaacagaggagatagtaaatgtgttgtggcaacctggcggcagcgcaaaagatg

SEQ ID NO: 47518 - DNA, 103 bp, Artificial Sequence
  Synthetic Polynucleotide
taatacgactcactatagggatgacagatgcctcatagccacaacaaaataacagaggagaattttgatgtggctatgaaacctggcggcagcgcaaaagatg

SEQ ID NO: 47519 - DNA, 103 bp, Artificial Sequence
  Synthetic Polynucleotide
taatacgactcactatagggagccaatgacagatgcctcatagccacaacaacagaggagagttgtgatgatgaggcataacctggcggcagcgcaaaagatg

SEQ ID NO: 47520 - DNA, 103 bp, Artificial Sequence
  Synthetic Polynucleotide
taatacgactcactatagggagtccagccaatgacagatgcctcatagccaacagaggagaggctatatggcatctgtcaacctggcggcagcgcaaaagatg

SEQ ID NO: 47521 - DNA, 103 bp, Artificial Sequence
  Synthetic Polynucleotide
taatacgactcactatagggataagagtccagccaatgacagatgcctcaaacagaggagatgaggcatgtgtcattggaacctggcggcagcgcaaaagatg

SEQ ID NO: 47522 - DNA, 103 bp, Artificial Sequence
  Synthetic Polynucleotide
taatacgactcactatagggatcggataagagtccagccaatgacagatgaacagaggagacatctgatgttggctggaaacctggcggcagcgcaaaagatg

SEQ ID NO: 47523 - DNA, 103 bp, Artificial Sequence
  Synthetic Polynucleotide
taatacgactcactatagggttatgatcggataagagtccagccaatgacaacagaggagagtcattatgtggactcttaacctggcggcagcgcaaaagatg

SEQ ID NO: 47524 - DNA, 103 bp, Artificial Sequence
  Synthetic Polynucleotide
taatacgactcactatagggtcgacttatgatcggataagagtccagccaaacagaggagatggctgatgtcttatccgaacctggcggcagcgcaaaagatg

SEQ ID NO: 47525 - DNA, 103 bp, Artificial Sequence
  Synthetic Polynucleotide
taatacgactcactatagggcacgttcgacttatgatcggataagagtccaacagaggagaggactcatgtccgatcataacctggcggcagcgcaaaagatg

SEQ ID NO: 47526 - DNA, 103 bp, Artificial Sequence
  Synthetic Polynucleotide
taatacgactcactatagggtatgtgtagtaatgtatcttacggatacaaaacagaggagattgtatatgtaagatacaaacctggcggcagcgcaaaagatg

SEQ ID NO: 47527 - DNA, 103 bp, Artificial Sequence
  Synthetic Polynucleotide
taatacgactcactatagggccttccacgttcgacttatgatcggataagaacagaggagacttatcatgtcataagtcaacctggcggcagcgcaaaagatg

SEQ ID NO: 47528 - DNA, 103 bp, Artificial Sequence
  Synthetic Polynucleotide
taatacgactcactatagggtgataccttccacgttcgacttatgatcggaacagaggagaccgatcatgagtcgaacgaacctggcggcagcgcaaaagatg

SEQ ID NO: 47529 - DNA, 103 bp, Artificial Sequence
  Synthetic Polynucleotide
taatacgactcactatagggaaagttgataccttccacgttcgacttatgaacagaggagacataagatgaacgtggaaaacctggcggcagcgcaaaagatg

SEQ ID NO: 47530 - DNA, 103 bp, Artificial Sequence
  Synthetic Polynucleotide
taatacgactcactatagggataataaagttgataccttccacgttcgacaacagaggagagtcgaaatgggaaggtataacctggcggcagcgcaaaagatg

SEQ ID NO: 47531 - DNA, 103 bp, Artificial Sequence
  Synthetic Polynucleotide
taatacgactcactatagggacttgataataaagttgataccttccacgtaacagaggagaacgtggatggtatcaactaacctggcggcagcgcaaaagatg

SEQ ID NO: 47532 - DNA, 103 bp, Artificial Sequence
  Synthetic Polynucleotide
taatacgactcactatagggagatgacttgataataaagttgataccttcaacagaggagagaaggtatgaactttattaacctggcggcagcgcaaaagatg

SEQ ID NO: 47533 - DNA, 103 bp, Artificial Sequence
  Synthetic Polynucleotide
taatacgactcactatagggacataagatgacttgataataaagttgataaacagaggagatatcaaatgtattatcaaaacctggcggcagcgcaaaagatg

SEQ ID NO: 47534 - DNA, 103 bp, Artificial Sequence
  Synthetic Polynucleotide
taatacgactcactatagggtaaaaacataagatgacttgataataaagtaacagaggagaactttaatgtcaagtcataacctggcggcagcgcaaaagatg

SEQ ID NO: 47535 - DNA, 103 bp, Artificial Sequence
  Synthetic Polynucleotide
taatacgactcactatagggtctcttaaaaacataagatgacttgataataacagaggagaattatcatgtcatcttataacctggcggcagcgcaaaagatg

SEQ ID NO: 47536 - DNA, 103 bp, Artificial Sequence
  Synthetic Polynucleotide
taatacgactcactatagggagatatctcttaaaaacataagatgacttgaacagaggagacaagtcatgttatgttttaacctggcggcagcgcaaaagatg

SEQ ID NO: 47537 - DNA, 103 bp, Artificial Sequence
  Synthetic Polynucleotide
taatacgactcactatagggattcctatgtgtagtaatgtatcttacggaaacagaggagatccgtaatgtacattactaacctggcggcagcgcaaaagatg

SEQ ID NO: 47538 - DNA, 103 bp, Artificial Sequence
  Synthetic Polynucleotide
taatacgactcactatagggtagatagatatctcttaaaaacataagatgaacagaggagacatcttatgtttttaagaaacctggcggcagcgcaaaagatg

SEQ ID NO: 47539 - DNA, 103 bp, Artificial Sequence
  Synthetic Polynucleotide
taatacgactcactataggggtaaatagatagatatctcttaaaaacataaacagaggagatatgttatgaagagatataacctggcggcagcgcaaaagatg

SEQ ID NO: 47540 - DNA, 103 bp, Artificial Sequence
  Synthetic Polynucleotide
taatacgactcactatagggaaaccgtaaatagatagatatctcttaaaaaacagaggagattttaaatgatatctatcaacctggcggcagcgcaaaagatg

SEQ ID NO: 47541 - DNA, 103 bp, Artificial Sequence
  Synthetic Polynucleotide
taatacgactcactatagggccccaaaaccgtaaatagatagatatctctaacagaggagaagagatatgtatctatttaacctggcggcagcgcaaaagatg

SEQ ID NO: 47542 - DNA, 103 bp, Artificial Sequence
  Synthetic Polynucleotide
taatacgactcactatagggtgtcaccccaaaaccgtaaatagatagataaacagaggagatatctaatgatttacggtaacctggcggcagcgcaaaagatg

SEQ ID NO: 47543 - DNA, 103 bp, Artificial Sequence
  Synthetic Polynucleotide
taatacgactcactatagggttgaatgtcaccccaaaaccgtaaatagataacagaggagaatctatatgcggttttggaacctggcggcagcgcaaaagatg

SEQ ID NO: 47544 - DNA, 103 bp, Artificial Sequence
  Synthetic Polynucleotide
taatacgactcactatagggaatctttgaatgtcaccccaaaaccgtaaaaacagaggagatttacgatgttggggtgaaacctggcggcagcgcaaaagatg

SEQ ID NO: 47545 - DNA, 103 bp, Artificial Sequence
  Synthetic Polynucleotide
taatacgactcactatagggtctcaaatctttgaatgtcaccccaaaaccaacagaggagaggttttatggtgacattcaacctggcggcagcgcaaaagatg

SEQ ID NO: 47546 - DNA, 103 bp, Artificial Sequence
  Synthetic Polynucleotide
taatacgactcactatagggtttggtctcaaatctttgaatgtcaccccaaacagaggagatggggtatgattcaaagaaacctggcggcagcgcaaaagatg

SEQ ID NO: 47547 - DNA, 103 bp, Artificial Sequence
  Synthetic Polynucleotide
taatacgactcactatagggtcgaatttggtctcaaatctttgaatgtcaaacagaggagatgacatatgaagatttgaaacctggcggcagcgcaaaagatg

SEQ ID NO: 47548 - DNA, 103 bp, Artificial Sequence
  Synthetic Polynucleotide
taatacgactcactatagggagggaattcctatgtgtagtaatgtatcttaacagaggagaaagataatgtactacacaaacctggcggcagcgcaaaagatg

SEQ ID NO: 47549 - DNA, 103 bp, Artificial Sequence
  Synthetic Polynucleotide
taatacgactcactataggggaacgtcgaatttggtctcaaatctttgaaaacagaggagattcaaaatgttgagaccaaacctggcggcagcgcaaaagatg

SEQ ID NO: 47550 - DNA, 103 bp, Artificial Sequence
  Synthetic Polynucleotide
taatacgactcactatagggttagtgaacgtcgaatttggtctcaaatctaacagaggagaagatttatgaccaaattcaacctggcggcagcgcaaaagatg

SEQ ID NO: 47551 - DNA, 103 bp, Artificial Sequence
  Synthetic Polynucleotide
taatacgactcactatagggatttattagtgaacgtcgaatttggtctcaaacagaggagatgagacatgattcgacgtaacctggcggcagcgcaaaagatg

SEQ ID NO: 47552 - DNA, 103 bp, Artificial Sequence
  Synthetic Polynucleotide
taatacgactcactatagggctccaatttattagtgaacgtcgaatttggaacagaggagaccaaatatgacgttcactaacctggcggcagcgcaaaagatg

SEQ ID NO: 47553 - DNA, 103 bp, Artificial Sequence
  Synthetic Polynucleotide
taatacgactcactatagggatggcctccaatttattagtgaacgtcgaaaacagaggagattcgacatgcactaataaaacctggcggcagcgcaaaagatg

SEQ ID NO: 47554 - DNA, 103 bp, Artificial Sequence
  Synthetic Polynucleotide
taatacgactcactatagggcgttgatggcctccaatttattagtgaacgaacagaggagacgttcaatgataaattggaacctggcggcagcgcaaaagatg

SEQ ID NO: 47555 - DNA, 103 bp, Artificial Sequence
  Synthetic Polynucleotide
taatacgactcactatagggttctacgttgatggcctccaatttattagtaacagaggagaactaatatgttggaggccaacctggcggcagcgcaaaagatg

SEQ ID NO: 47556 - DNA, 103 bp, Artificial Sequence
  Synthetic Polynucleotide
taatacgactcactatagggattttttctacgttgatggcctccaatttaaacagaggagataaattatgggccatcaaaacctggcggcagcgcaaaagatg

SEQ ID NO: 47557 - DNA, 103 bp, Artificial Sequence
  Synthetic Polynucleotide
taatacgactcactataggggttctattttttctacgttgatggcctccaaacagaggagatggaggatgtcaacgtagaacctggcggcagcgcaaaagatg

SEQ ID NO: 47558 - DNA, 103 bp, Artificial Sequence
  Synthetic Polynucleotide
taatacgactcactataggggataagttctattttttctacgttgatggcaacagaggagagccatcatggtagaaaaaaacctggcggcagcgcaaaagatg

SEQ ID NO: 47559 - DNA, 103 bp, Artificial Sequence
  Synthetic Polynucleotide
taatacgactcactatagggcgatcagggaattcctatgtgtagtaatgtaacagaggagaacattaatgcacataggaaacctggcggcagcgcaaaagatg

SEQ ID NO: 47560 - DNA, 103 bp, Artificial Sequence
  Synthetic Polynucleotide
taatacgactcactatagggtctttgataagttctattttttctacgttgaacagaggagacaacgtatgaaaaatagaaacctggcggcagcgcaaaagatg

SEQ ID NO: 47561 - DNA, 103 bp, Artificial Sequence
  Synthetic Polynucleotide
taatacgactcactatagggatgcttctttgataagttctattttttctaaacagaggagatagaaaatgtagaacttaaacctggcggcagcgcaaaagatg

SEQ ID NO: 47562 - DNA, 103 bp, Artificial Sequence
  Synthetic Polynucleotide
taatacgactcactatagggggcgtatgcttctttgataagttctattttaacagaggagaaaaataatgcttatcaaaaacctggcggcagcgcaaaagatg

SEQ ID NO: 47563 - DNA, 103 bp, Artificial Sequence
  Synthetic Polynucleotide
taatacgactcactatagggtatttggcgtatgcttctttgataagttctaacagaggagaagaactatgcaaagaagcaacctggcggcagcgcaaaagatg

SEQ ID NO: 47564 - DNA, 103 bp, Artificial Sequence
  Synthetic Polynucleotide
taatacgactcactatagggtgagatatttggcgtatgcttctttgataaaacagaggagattatcaatgaagcatacgaacctggcggcagcgcaaaagatg

SEQ ID NO: 47565 - DNA, 103 bp, Artificial Sequence
  Synthetic Polynucleotide
taatacgactcactatagggatctttgagatatttggcgtatgcttctttaacagaggagaaaagaaatgtacgccaaaaacctggcggcagcgcaaaagatg

SEQ ID NO: 47566 - DNA, 103 bp, Artificial Sequence
  Synthetic Polynucleotide
taatacgactcactatagggcttacatctttgagatatttggcgtatgctaacagaggagaagcataatgcaaatatctaacctggcggcagcgcaaaagatg

SEQ ID NO: 47567 - DNA, 103 bp, Artificial Sequence
  Synthetic Polynucleotide
taatacgactcactatagggcgtctcttacatctttgagatatttggcgtaacagaggagaacgccaatgatctcaaagaacctggcggcagcgcaaaagatg

SEQ ID NO: 47568 - DNA, 103 bp, Artificial Sequence
  Synthetic Polynucleotide
taatacgactcactatagggttttccgtctcttacatctttgagatatttaacagaggagaaaatatatgaaagatgtaaacctggcggcagcgcaaaagatg

SEQ ID NO: 47569 - DNA, 103 bp, Artificial Sequence
  Synthetic Polynucleotide
taatacgactcactatagggactatttttccgtctcttacatctttgagaaacagaggagatctcaaatgtgtaagagaaacctggcggcagcgcaaaagatg

SEQ ID NO: 47570 - DNA, 103 bp, Artificial Sequence
  Synthetic Polynucleotide
taatacgactcactatagggtgcccagttcagtccctgtcattgccatgcaacagaggagagcatggatgtgacagggaaacctggcggcagcgcaaaagatg

SEQ ID NO: 47571 - DNA, 103 bp, Artificial Sequence
  Synthetic Polynucleotide
taatacgactcactatagggttgctcgatcagggaattcctatgtgtagtaacagaggagaactacaatgaggaattccaacctggcggcagcgcaaaagatg

SEQ ID NO: 47572 - DNA, 103 bp, Artificial Sequence
  Synthetic Polynucleotide
taatacgactcactatagggatggaactatttttccgtctcttacatcttaacagaggagaaagatgatggagacggaaaacctggcggcagcgcaaaagatg

SEQ ID NO: 47573 - DNA, 103 bp, Artificial Sequence
  Synthetic Polynucleotide
taatacgactcactatagggagataatggaactatttttccgtctcttacaacagaggagagtaagaatgggaaaaataaacctggcggcagcgcaaaagatg

SEQ ID NO: 47574 - DNA, 103 bp, Artificial Sequence
  Synthetic Polynucleotide
taatacgactcactataggggctttagataatggaactatttttccgtctaacagaggagaagacggatgaatagttccaacctggcggcagcgcaaaagatg

SEQ ID NO: 47575 - DNA, 103 bp, Artificial Sequence
  Synthetic Polynucleotide
taatacgactcactatagggctaaagctttagataatggaactatttttcaacagaggagagaaaaaatgttccattataacctggcggcagcgcaaaagatg

SEQ ID NO: 47576 - DNA, 103 bp, Artificial Sequence
  Synthetic Polynucleotide
taatacgactcactatagggcgcctctaaagctttagataatggaactataacagaggagaatagttatgttatctaaaaacctggcggcagcgcaaaagatg

SEQ ID NO: 47577 - DNA, 103 bp, Artificial Sequence
  Synthetic Polynucleotide
taatacgactcactatagggtagtccgcctctaaagctttagataatggaaacagaggagatccattatgtaaagctttaacctggcggcagcgcaaaagatg

SEQ ID NO: 47578 - DNA, 103 bp, Artificial Sequence
  Synthetic Polynucleotide
taatacgactcactatagggccacatagtccgcctctaaagctttagataaacagaggagatatctaatgctttagaggaacctggcggcagcgcaaaagatg

SEQ ID NO: 47579 - DNA, 103 bp, Artificial Sequence
  Synthetic Polynucleotide
taatacgactcactatagggggattccacatagtccgcctctaaagctttaacagaggagaaaagctatggaggcggacaacctggcggcagcgcaaaagatg

SEQ ID NO: 47580 - DNA, 103 bp, Artificial Sequence
  Synthetic Polynucleotide
taatacgactcactatagggaacatggattccacatagtccgcctctaaaaacagaggagatttagaatgggactatgtaacctggcggcagcgcaaaagatg

SEQ ID NO: 47581 - DNA, 103 bp, Artificial Sequence
  Synthetic Polynucleotide
taatacgactcactatagggtggataacatggattccacatagtccgcctaacagaggagaaggcggatgatgtggaataacctggcggcagcgcaaaagatg

SEQ ID NO: 47582 - DNA, 103 bp, Artificial Sequence
  Synthetic Polynucleotide
taatacgactcactatagggaactattgctcgatcagggaattcctatgtaacagaggagaacatagatgttccctgataacctggcggcagcgcaaaagatg

SEQ ID NO: 47583 - DNA, 103 bp, Artificial Sequence
  Synthetic Polynucleotide
taatacgactcactatagggtaagttggataacatggattccacatagtcaacagaggagagactatatggaatccatgaacctggcggcagcgcaaaagatg

SEQ ID NO: 47584 - DNA, 103 bp, Artificial Sequence
  Synthetic Polynucleotide
taatacgactcactatagggtttgttaagttggataacatggattccacaaacagaggagatgtggaatgcatgttatcaacctggcggcagcgcaaaagatg

SEQ ID NO: 47585 - DNA, 103 bp, Artificial Sequence
  Synthetic Polynucleotide
taatacgactcactatagggtaagatttgttaagttggataacatggattaacagaggagaaatccaatgtatccaactaacctggcggcagcgcaaaagatg

SEQ ID NO: 47586 - DNA, 103 bp, Artificial Sequence
  Synthetic Polynucleotide
taatacgactcactataggggatattaagatttgttaagttggataacataacagaggagaatgttaatgaacttaacaaacctggcggcagcgcaaaagatg

SEQ ID NO: 47587 - DNA, 103 bp, Artificial Sequence
  Synthetic Polynucleotide
taatacgactcactatagggtctctgatattaagatttgttaagttggataacagaggagaatccaaatgaacaaatctaacctggcggcagcgcaaaagatg

SEQ ID NO: 47588 - DNA, 103 bp, Artificial Sequence
  Synthetic Polynucleotide
taatacgactcactatagggctatctctctgatattaagatttgttaagtaacagaggagaacttaaatgatcttaataaacctggcggcagcgcaaaagatg

SEQ ID NO: 47589 - DNA, 103 bp, Artificial Sequence
  Synthetic Polynucleotide
taatacgactcactatagggttcttctatctctctgatattaagatttgtaacagaggagaacaaatatgaatatcagaaacctggcggcagcgcaaaagatg

SEQ ID NO: 47590 - DNA, 103 bp, Artificial Sequence
  Synthetic Polynucleotide
taatacgactcactatagggatatgttcttctatctctctgatattaagaaacagaggagatcttaaatgcagagagataacctggcggcagcgcaaaagatg

SEQ ID NO: 47591 - DNA, 103 bp, Artificial Sequence
  Synthetic Polynucleotide
taatacgactcactataggggtctcatatgttcttctatctctctgatataacagaggagaatatcaatgagatagaagaacctggcggcagcgcaaaagatg

SEQ ID NO: 47592 - DNA, 103 bp, Artificial Sequence
  Synthetic Polynucleotide
taatacgactcactatagggcgtttgtctcatatgttcttctatctctctaacagaggagaagagagatggaagaacataacctggcggcagcgcaaaagatg

SEQ ID NO: 47593 - DNA, 103 bp, Artificial Sequence
  Synthetic Polynucleotide
taatacgactcactatagggatttaaactattgctcgatcagggaattccaacagaggagaggaattatgtgatcgagcaacctggcggcagcgcaaaagatg

SEQ ID NO: 47594 - DNA, 103 bp, Artificial Sequence
  Synthetic Polynucleotide
taatacgactcactatagggatcagcgtttgtctcatatgttcttctatcaacagaggagagatagaatgacatatgagaacctggcggcagcgcaaaagatg

SEQ ID NO: 47595 - DNA, 103 bp, Artificial Sequence
  Synthetic Polynucleotide
taatacgactcactatagggtatctatcagcgtttgtctcatatgttcttaacagaggagaaagaacatgtgagacaaaaacctggcggcagcgcaaaagatg

SEQ ID NO: 47596 - DNA, 103 bp, Artificial Sequence
  Synthetic Polynucleotide
taatacgactcactatagggtggattatctatcagcgtttgtctcatatgaacagaggagacatatgatgcaaacgctgaacctggcggcagcgcaaaagatg

SEQ ID NO: 47597 - DNA, 103 bp, Artificial Sequence
  Synthetic Polynucleotide
taatacgactcactatagggttatctggattatctatcagcgtttgtctcaacagaggagagagacaatggctgatagaaacctggcggcagcgcaaaagatg

SEQ ID NO: 47598 - DNA, 103 bp, Artificial Sequence
  Synthetic Polynucleotide
taatacgactcactatagggggttattatctggattatctatcagcgtttaacagaggagaaaacgcatgtagataatcaacctggcggcagcgcaaaagatg

SEQ ID NO: 47599 - DNA, 103 bp, Artificial Sequence
  Synthetic Polynucleotide
taatacgactcactatagggcaggaggttattatctggattatctatcagaacagaggagactgataatgaatccagataacctggcggcagcgcaaaagatg

SEQ ID NO: 47600 - DNA, 103 bp, Artificial Sequence
  Synthetic Polynucleotide
taatacgactcactatagggattttcaggaggttattatctggattatctaacagaggagaagataaatgagataataaaacctggcggcagcgcaaaagatg

SEQ ID NO: 47601 - DNA, 103 bp, Artificial Sequence
  Synthetic Polynucleotide
taatacgactcactatagggtggccattttcaggaggttattatctggataacagaggagaatccagatgataacctccaacctggcggcagcgcaaaagatg

SEQ ID NO: 47602 - DNA, 103 bp, Artificial Sequence
  Synthetic Polynucleotide
taatacgactcactatagggcgctttggccattttcaggaggttattatcaacagaggagagataatatgctcctgaaaaacctggcggcagcgcaaaagatg

SEQ ID NO: 47603 - DNA, 103 bp, Artificial Sequence
  Synthetic Polynucleotide
taatacgactcactatagggtaacccgctttggccattttcaggaggttaaacagaggagataacctatggaaaatggcaacctggcggcagcgcaaaagatg

SEQ ID NO: 47604 - DNA, 103 bp, Artificial Sequence
  Synthetic Polynucleotide
taatacgactcactataggggatgtatttaaactattgctcgatcagggaaacagaggagatccctgatggagcaatagaacctggcggcagcgcaaaagatg

SEQ ID NO: 47605 - DNA, 103 bp, Artificial Sequence
  Synthetic Polynucleotide
taatacgactcactatagggctttataacccgctttggccattttcaggaaacagaggagatcctgaatgtggccaaagaacctggcggcagcgcaaaagatg

SEQ ID NO: 47606 - DNA, 103 bp, Artificial Sequence
  Synthetic Polynucleotide
taatacgactcactatagggatttactttataacccgctttggccattttaacagaggagaaaaatgatgaaagcgggtaacctggcggcagcgcaaaagatg

SEQ ID NO: 47607 - DNA, 103 bp, Artificial Sequence
  Synthetic Polynucleotide
taatacgactcactataggggtgggatttactttataacccgctttggccaacagaggagaggccaaatggggttataaaacctggcggcagcgcaaaagatg

SEQ ID NO: 47608 - DNA, 103 bp, Artificial Sequence
  Synthetic Polynucleotide
taatacgactcactataggggttctgtgggatttactttataacccgcttaacagaggagaaagcggatgataaagtaaaacctggcggcagcgcaaaagatg

SEQ ID NO: 47609 - DNA, 103 bp, Artificial Sequence
  Synthetic Polynucleotide
taatacgactcactatagggcattagttctgtgggatttactttataaccaacagaggagaggttatatggtaaatcccaacctggcggcagcgcaaaagatg

SEQ ID NO: 47610 - DNA, 103 bp, Artificial Sequence
  Synthetic Polynucleotide
taatacgactcactatagggatatacattagttctgtgggatttactttaaacagaggagataaagtatgtcccacagaaacctggcggcagcgcaaaagatg

SEQ ID NO: 47611 - DNA, 103 bp, Artificial Sequence
  Synthetic Polynucleotide
taatacgactcactatagggctaaaatatacattagttctgtgggatttaaacagaggagataaatcatgcagaactaaaacctggcggcagcgcaaaagatg

SEQ ID NO: 47612 - DNA, 103 bp, Artificial Sequence
  Synthetic Polynucleotide
taatacgactcactatagggagtacctaaaatatacattagttctgtgggaacagaggagacccacaatgctaatgtataacctggcggcagcgcaaaagatg

SEQ ID NO: 47613 - DNA, 103 bp, Artificial Sequence
  Synthetic Polynucleotide
taatacgactcactatagggccataagtacctaaaatatacattagttctaacagaggagaagaactatggtatattttaacctggcggcagcgcaaaagatg

SEQ ID NO: 47614 - DNA, 103 bp, Artificial Sequence
  Synthetic Polynucleotide
taatacgactcactataggggttgtccataagtacctaaaatatacattaaacagaggagataatgtatgttttaggtaaacctggcggcagcgcaaaagatg

SEQ ID NO: 47615 - DNA, 103 bp, Artificial Sequence
  Synthetic Polynucleotide
taatacgactcactatagggatgtagatgtatttaaactattgctcgatcaacagaggagagatcgaatgatagtttaaaacctggcggcagcgcaaaagatg

SEQ ID NO: 47616 - DNA, 103 bp, Artificial Sequence
  Synthetic Polynucleotide
taatacgactcactatagggcctctgttgtccataagtacctaaaatataaacagaggagatatattatgggtacttataacctggcggcagcgcaaaagatg

SEQ ID NO: 47617 - DNA, 103 bp, Artificial Sequence
  Synthetic Polynucleotide
taatacgactcactatagggtctatcctctgttgtccataagtacctaaaaacagaggagatttaggatgttatggacaaacctggcggcagcgcaaaagatg

SEQ ID NO: 47618 - DNA, 103 bp, Artificial Sequence
  Synthetic Polynucleotide
taatacgactcactatagggcgccatctatcctctgttgtccataagtacaacagaggagagtacttatggacaacagaaacctggcggcagcgcaaaagatg

SEQ ID NO: 47619 - DNA, 103 bp, Artificial Sequence
  Synthetic Polynucleotide
taatacgactcactatagggtggttcgccatctatcctctgttgtccataaacagaggagatatggaatgcagaggataaacctggcggcagcgcaaaagatg

SEQ ID NO: 47620 - DNA, 103 bp, Artificial Sequence
  Synthetic Polynucleotide
taatacgactcactatagggtctgctggttcgccatctatcctctgttgtaacagaggagaacaacaatggatagatggaacctggcggcagcgcaaaagatg

SEQ ID NO: 47621 - DNA, 103 bp, Artificial Sequence
  Synthetic Polynucleotide
taatacgactcactataggggagtctctgctggttcgccatctatcctctaacagaggagaagaggaatgatggcgaacaacctggcggcagcgcaaaagatg

SEQ ID NO: 47622 - DNA, 103 bp, Artificial Sequence
  Synthetic Polynucleotide
taatacgactcactatagggtactcgagtctctgctggttcgccatctataacagaggagaatagatatggaaccagcaaacctggcggcagcgcaaaagatg

SEQ ID NO: 47623 - DNA, 103 bp, Artificial Sequence
  Synthetic Polynucleotide
taatacgactcactatagggcccaatactcgagtctctgctggttcgccaaacagaggagatggcgaatgagcagagacaacctggcggcagcgcaaaagatg

SEQ ID NO: 47624 - DNA, 103 bp, Artificial Sequence
  Synthetic Polynucleotide
taatacgactcactatagggctctacccaatactcgagtctctgctggttaacagaggagaaaccagatgagactcgagaacctggcggcagcgcaaaagatg

SEQ ID NO: 47625 - DNA, 103 bp, Artificial Sequence
  Synthetic Polynucleotide
taatacgactcactatagggtaagactctacccaatactcgagtctctgcaacagaggagagcagagatgcgagtattgaacctggcggcagcgcaaaagatg

SEQ ID NO: 47626 - DNA, 103 bp, Artificial Sequence
  Synthetic Polynucleotide
taatacgactcactatagggtccaaatgtagatgtatttaaactattgctaacagaggagaagcaatatgttaaatacaaacctggcggcagcgcaaaagatg

SEQ ID NO: 47627 - DNA, 103 bp, Artificial Sequence
  Synthetic Polynucleotide
taatacgactcactatagggtaaggtaagactctacccaatactcgagtcaacagaggagagactcgatgattgggtagaacctggcggcagcgcaaaagatg

SEQ ID NO: 47628 - DNA, 103 bp, Artificial Sequence
  Synthetic Polynucleotide
taatacgactcactataggggatagtaaggtaagactctacccaatactcaacagaggagagagtatatggtagagtctaacctggcggcagcgcaaaagatg

SEQ ID NO: 47629 - DNA, 103 bp, Artificial Sequence
  Synthetic Polynucleotide
taatacgactcactatagggtggaagatagtaaggtaagactctacccaaaacagaggagattgggtatggtcttacctaacctggcggcagcgcaaaagatg

SEQ ID NO: 47630 - DNA, 103 bp, Artificial Sequence
  Synthetic Polynucleotide
taatacgactcactataggggagtctggaagatagtaaggtaagactctaaacagaggagatagagtatgaccttactaaacctggcggcagcgcaaaagatg

SEQ ID NO: 47631 - DNA, 103 bp, Artificial Sequence
  Synthetic Polynucleotide
taatacgactcactatagggccttagagtctggaagatagtaaggtaagaaacagaggagatcttacatgactatcttcaacctggcggcagcgcaaaagatg

SEQ ID NO: 47632 - DNA, 103 bp, Artificial Sequence
  Synthetic Polynucleotide
taatacgactcactatagggtggatccttagagtctggaagatagtaaggaacagaggagaccttacatgcttccagacaacctggcggcagcgcaaaagatg

SEQ ID NO: 47633 - DNA, 103 bp, Artificial Sequence
  Synthetic Polynucleotide
taatacgactcactatagggccttctggatccttagagtctggaagatagaacagaggagactatctatgagactctaaaacctggcggcagcgcaaaagatg

SEQ ID NO: 47634 - DNA, 103 bp, Artificial Sequence
  Synthetic Polynucleotide
taatacgactcactatagggctcttccttctggatccttagagtctggaaaacagaggagattccagatgctaaggatcaacctggcggcagcgcaaaagatg

SEQ ID NO: 47635 - DNA, 103 bp, Artificial Sequence
  Synthetic Polynucleotide
taatacgactcactatagggataacctcttccttctggatccttagagtcaacagaggagagactctatggatccagaaaacctggcggcagcgcaaaagatg

SEQ ID NO: 47636 - DNA, 103 bp, Artificial Sequence
  Synthetic Polynucleotide
taatacgactcactatagggagaatataacctcttccttctggatccttaaacagaggagataaggaatgagaaggaagaacctggcggcagcgcaaaagatg

SEQ ID NO: 47637 - DNA, 103 bp, Artificial Sequence
  Synthetic Polynucleotide
taatacgactcactatagggtcaaatccaaatgtagatgtatttaaactaaacagaggagatagtttatgtacatctacaacctggcggcagcgcaaaagatg

SEQ ID NO: 47638 - DNA, 103 bp, Artificial Sequence
  Synthetic Polynucleotide
taatacgactcactatagggaattaagaatataacctcttccttctggataacagaggagaatccagatggaagaggttaacctggcggcagcgcaaaagatg

SEQ ID NO: 47639 - DNA, 103 bp, Artificial Sequence
  Synthetic Polynucleotide
taatacgactcactatagggtaaagaattaagaatataacctcttccttcaacagaggagagaaggaatgggttatattaacctggcggcagcgcaaaagatg

SEQ ID NO: 47640 - DNA, 103 bp, Artificial Sequence
  Synthetic Polynucleotide
taatacgactcactatagggtttgttaaagaattaagaatataacctcttaacagaggagaaagaggatgtattcttaaaacctggcggcagcgcaaaagatg

SEQ ID NO: 47641 - DNA, 103 bp, Artificial Sequence
  Synthetic Polynucleotide
taatacgactcactatagggatccttttgttaaagaattaagaatataacaacagaggagagttataatgttaattcttaacctggcggcagcgcaaaagatg

SEQ ID NO: 47642 - DNA, 103 bp, Artificial Sequence
  Synthetic Polynucleotide
taatacgactcactatagggcgttaatccttttgttaaagaattaagaataacagaggagaattcttatgtctttaacaaacctggcggcagcgcaaaagatg

SEQ ID NO: 47643 - DNA, 103 bp, Artificial Sequence
  Synthetic Polynucleotide
taatacgactcactataggggaacccgttaatccttttgttaaagaattaaacagaggagataattcatgaacaaaaggaacctggcggcagcgcaaaagatg

SEQ ID NO: 47644 - DNA, 103 bp, Artificial Sequence
  Synthetic Polynucleotide
taatacgactcactatagggattgagaacccgttaatccttttgttaaagaacagaggagactttaaatgaaggattaaaacctggcggcagcgcaaaagatg

SEQ ID NO: 47645 - DNA, 103 bp, Artificial Sequence
  Synthetic Polynucleotide
taatacgactcactataggggtaatattgagaacccgttaatccttttgtaacagaggagaacaaaaatgttaacgggtaacctggcggcagcgcaaaagatg

SEQ ID NO: 47646 - DNA, 103 bp, Artificial Sequence
  Synthetic Polynucleotide
taatacgactcactataggggaaaagtaatattgagaacccgttaatcctaacagaggagaaggattatggggttctcaaacctggcggcagcgcaaaagatg

SEQ ID NO: 47647 - DNA, 103 bp, Artificial Sequence
  Synthetic Polynucleotide
taatacgactcactataggggcattgaaaagtaatattgagaacccgttaaacagaggagataacggatgctcaatattaacctggcggcagcgcaaaagatg

SEQ ID NO: 47648 - DNA, 103 bp, Artificial Sequence
  Synthetic Polynucleotide
taatacgactcactatagggctacatcaaatccaaatgtagatgtatttaaacagaggagataaataatgctacatttgaacctggcggcagcgcaaaagatg

SEQ ID NO: 47649 - DNA, 103 bp, Artificial Sequence
  Synthetic Polynucleotide
taatacgactcactatagggaaccagcattgaaaagtaatattgagaaccaacagaggagaggttctatgtattactttaacctggcggcagcgcaaaagatg

SEQ ID NO: 47650 - DNA, 103 bp, Artificial Sequence
  Synthetic Polynucleotide
taatacgactcactatagggcttgcaaccagcattgaaaagtaatattgaaacagaggagatcaataatgcttttcaataacctggcggcagcgcaaaagatg

SEQ ID NO: 47651 - DNA, 103 bp, Artificial Sequence
  Synthetic Polynucleotide
taatacgactcactataggggagatcttgcaaccagcattgaaaagtaataacagaggagaattactatgcaatgctggaacctggcggcagcgcaaaagatg

SEQ ID NO: 47652 - DNA, 103 bp, Artificial Sequence
  Synthetic Polynucleotide
taatacgactcactatagggagattgagatcttgcaaccagcattgaaaaaacagaggagattttcaatgctggttgcaaacctggcggcagcgcaaaagatg

SEQ ID NO: 47653 - DNA, 103 bp, Artificial Sequence
  Synthetic Polynucleotide
taatacgactcactatagggtcagtagattgagatcttgcaaccagcattaacagaggagaaatgctatgtgcaagatcaacctggcggcagcgcaaaagatg

SEQ ID NO: 47654 - DNA, 103 bp, Artificial Sequence
  Synthetic Polynucleotide
taatacgactcactatagggcaatatcagtagattgagatcttgcaaccaaacagaggagatggttgatggatctcaataacctggcggcagcgcaaaagatg

SEQ ID NO: 47655 - DNA, 103 bp, Artificial Sequence
  Synthetic Polynucleotide
taatacgactcactatagggacagacaatatcagtagattgagatcttgcaacagaggagagcaagaatgcaatctactaacctggcggcagcgcaaaagatg

SEQ ID NO: 47656 - DNA, 103 bp, Artificial Sequence
  Synthetic Polynucleotide
taatacgactcactataggggtttcacagacaatatcagtagattgagataacagaggagaatctcaatgtactgatataacctggcggcagcgcaaaagatg

SEQ ID NO: 47657 - DNA, 103 bp, Artificial Sequence
  Synthetic Polynucleotide
taatacgactcactataggggcgatgtttcacagacaatatcagtagattaacagaggagaaatctaatgatattgtctaacctggcggcagcgcaaaagatg

SEQ ID NO: 47658 - DNA, 103 bp, Artificial Sequence
  Synthetic Polynucleotide
taatacgactcactatagggggtacgcgatgtttcacagacaatatcagtaacagaggagaactgatatggtctgtgaaaacctggcggcagcgcaaaagatg

SEQ ID NO: 47659 - DNA, 103 bp, Artificial Sequence
  Synthetic Polynucleotide
taatacgactcactatagggcgcaactacatcaaatccaaatgtagatgtaacagaggagaacatctatgtttggatttaacctggcggcagcgcaaaagatg

SEQ ID NO: 47660 - DNA, 103 bp, Artificial Sequence
  Synthetic Polynucleotide
taatacgactcactataggggttccggtacgcgatgtttcacagacaataaacagaggagatattgtatgtgaaacatcaacctggcggcagcgcaaaagatg

SEQ ID NO: 47661 - DNA, 103 bp, Artificial Sequence
  Synthetic Polynucleotide
taatacgactcactatagggccagtgttccggtacgcgatgtttcacagaaacagaggagatctgtgatgcatcgcgtaaacctggcggcagcgcaaaagatg

SEQ ID NO: 47662 - DNA, 103 bp, Artificial Sequence
  Synthetic Polynucleotide
taatacgactcactatagggtctagccagtgttccggtacgcgatgtttcaacagaggagagaaacaatgcgtaccggaaacctggcggcagcgcaaaagatg

SEQ ID NO: 47663 - DNA, 103 bp, Artificial Sequence
  Synthetic Polynucleotide
taatacgactcactatagggatttttctagccagtgttccggtacgcgataacagaggagaatcgcgatgcggaacactaacctggcggcagcgcaaaagatg

SEQ ID NO: 47664 - DNA, 103 bp, Artificial Sequence
  Synthetic Polynucleotide
taatacgactcactatagggtaatgatttttctagccagtgttccggtacaacagaggagagtaccgatgcactggctaaacctggcggcagcgcaaaagatg

SEQ ID NO: 47665 - DNA, 103 bp, Artificial Sequence
  Synthetic Polynucleotide
taatacgactcactatagggctttttaatgatttttctagccagtgttccaacagaggagaggaacaatggctagaaaaaacctggcggcagcgcaaaagatg

SEQ ID NO: 47666 - DNA, 103 bp, Artificial Sequence
  Synthetic Polynucleotide
taatacgactcactatagggtccatctttttaatgatttttctagccagtaacagaggagaactggcatgaaaaatcataacctggcggcagcgcaaaagatg

SEQ ID NO: 47667 - DNA, 103 bp, Artificial Sequence
  Synthetic Polynucleotide
taatacgactcactatagggtatcctccatctttttaatgatttttctagaacagaggagactagaaatgtcattaaaaaacctggcggcagcgcaaaagatg

SEQ ID NO: 47668 - DNA, 103 bp, Artificial Sequence
  Synthetic Polynucleotide
taatacgactcactatagggcaccatatcctccatctttttaatgattttaacagaggagaaaaatcatgaaaaagatgaacctggcggcagcgcaaaagatg

SEQ ID NO: 47669 - DNA, 103 bp, Artificial Sequence
  Synthetic Polynucleotide
taatacgactcactatagggtcgaccaccatatcctccatctttttaatgaacagaggagacattaaatggatggaggaaacctggcggcagcgcaaaagatg

SEQ ID NO: 47670 - DNA, 103 bp, Artificial Sequence
  Synthetic Polynucleotide
taatacgactcactatagggaaatacgcaactacatcaaatccaaatgtaaacagaggagatacattatgatttgatgtaacctggcggcagcgcaaaagatg

SEQ ID NO: 47671 - DNA, 103 bp, Artificial Sequence
  Synthetic Polynucleotide
taatacgactcactatagggatccgtcgaccaccatatcctccatcttttaacagaggagaaaaagaatgaggatatggaacctggcggcagcgcaaaagatg

SEQ ID NO: 47672 - DNA, 103 bp, Artificial Sequence
  Synthetic Polynucleotide
taatacgactcactatagggtccgtatccgtcgaccaccatatcctccataacagaggagaatggagatgatggtggtcaacctggcggcagcgcaaaagatg

SEQ ID NO: 47673 - DNA, 103 bp, Artificial Sequence
  Synthetic Polynucleotide
taatacgactcactatagggacttgtccgtatccgtcgaccaccatatccaacagaggagaggatatatgggtcgacggaacctggcggcagcgcaaaagatg

SEQ ID NO: 47674 - DNA, 103 bp, Artificial Sequence
  Synthetic Polynucleotide
taatacgactcactatagggtaactacttgtccgtatccgtcgaccaccaaacagaggagatggtggatgacggatacgaacctggcggcagcgcaaaagatg

SEQ ID NO: 47675 - DNA, 103 bp, Artificial Sequence
  Synthetic Polynucleotide
taatacgactcactatagggacctataactacttgtccgtatccgtcgacaacagaggagagtcgacatgtacggacaaaacctggcggcagcgcaaaagatg

SEQ ID NO: 47676 - DNA, 103 bp, Artificial Sequence
  Synthetic Polynucleotide
taatacgactcactataggggtattacctataactacttgtccgtatccgaacagaggagacggataatgacaagtagtaacctggcggcagcgcaaaagatg

SEQ ID NO: 47677 - DNA, 103 bp, Artificial Sequence
  Synthetic Polynucleotide
taatacgactcactatagggtgagcgtattacctataactacttgtccgtaacagaggagaacggacatgtagttatagaacctggcggcagcgcaaaagatg

SEQ ID NO: 47678 - DNA, 103 bp, Artificial Sequence
  Synthetic Polynucleotide
taatacgactcactatagggcttgatgagcgtattacctataactacttgaacagaggagacaagtaatgataggtaataacctggcggcagcgcaaaagatg

SEQ ID NO: 47679 - DNA, 103 bp, Artificial Sequence
  Synthetic Polynucleotide
taatacgactcactataggggcgtacttgatgagcgtattacctataactaacagaggagaagttatatgtaatacgctaacctggcggcagcgcaaaagatg

SEQ ID NO: 47680 - DNA, 103 bp, Artificial Sequence
  Synthetic Polynucleotide
taatacgactcactatagggtggcggcgtacttgatgagcgtattacctaaacagaggagataggtaatgcgctcatcaaacctggcggcagcgcaaaagatg

SEQ ID NO: 47681 - DNA, 103 bp, Artificial Sequence
  Synthetic Polynucleotide
taatacgactcactatagggtcttgtgcccagttcagtccctgtcattgcaacagaggagagcaatgatggggactgaaaacctggcggcagcgcaaaagatg

SEQ ID NO: 47682 - DNA, 103 bp, Artificial Sequence
  Synthetic Polynucleotide
taatacgactcactatagggtagagaaatacgcaactacatcaaatccaaaacagaggagattggatatgatgtagttgaacctggcggcagcgcaaaagatg

SEQ ID NO: 47683 - DNA, 103 bp, Artificial Sequence
  Synthetic Polynucleotide
taatacgactcactatagggataattggcggcgtacttgatgagcgtattaacagaggagaaatacgatgatcaagtacaacctggcggcagcgcaaaagatg

SEQ ID NO: 47684 - DNA, 103 bp, Artificial Sequence
  Synthetic Polynucleotide
taatacgactcactatagggttggtataattggcggcgtacttgatgagcaacagaggagagctcatatggtacgccgcaacctggcggcagcgcaaaagatg

SEQ ID NO: 47685 - DNA, 103 bp, Artificial Sequence
  Synthetic Polynucleotide
taatacgactcactataggggaattttggtataattggcggcgtacttgaaacagaggagatcaagtatgccgccaattaacctggcggcagcgcaaaagatg

SEQ ID NO: 47686 - DNA, 103 bp, Artificial Sequence
  Synthetic Polynucleotide
taatacgactcactataggggcctagaattttggtataattggcggcgtaaacagaggagatacgccatgaattataccaacctggcggcagcgcaaaagatg

SEQ ID NO: 47687 - DNA, 103 bp, Artificial Sequence
  Synthetic Polynucleotide
taatacgactcactatagggactgagcctagaattttggtataattggcgaacagaggagacgccaaatgtaccaaaataacctggcggcagcgcaaaagatg

SEQ ID NO: 47688 - DNA, 103 bp, Artificial Sequence
  Synthetic Polynucleotide
taatacgactcactatagggtacatactgagcctagaattttggtataataacagaggagaattataatgaaattctagaacctggcggcagcgcaaaagatg

SEQ ID NO: 47689 - DNA, 103 bp, Artificial Sequence
  Synthetic Polynucleotide
taatacgactcactatagggaggtttacatactgagcctagaattttggtaacagaggagaaccaaaatgctaggctcaaacctggcggcagcgcaaaagatg

SEQ ID NO: 47690 - DNA, 103 bp, Artificial Sequence
  Synthetic Polynucleotide
taatacgactcactatagggtctacaggtttacatactgagcctagaattaacagaggagaaattctatgctcagtatgaacctggcggcagcgcaaaagatg

SEQ ID NO: 47691 - DNA, 103 bp, Artificial Sequence
  Synthetic Polynucleotide
taatacgactcactatagggtaagatctacaggtttacatactgagcctaaacagaggagataggctatgtatgtaaacaacctggcggcagcgcaaaagatg

SEQ ID NO: 47692 - DNA, 103 bp, Artificial Sequence
  Synthetic Polynucleotide
taatacgactcactatagggatagataagatctacaggtttacatactgaaacagaggagatcagtaatgaaacctgtaaacctggcggcagcgcaaaagatg

SEQ ID NO: 47693 - DNA, 103 bp, Artificial Sequence
  Synthetic Polynucleotide
taatacgactcactatagggtattgtagagaaatacgcaactacatcaaaaacagaggagatttgatatggttgcgtataacctggcggcagcgcaaaagatg

SEQ ID NO: 47694 - DNA, 103 bp, Artificial Sequence
  Synthetic Polynucleotide
taatacgactcactatagggtctggatagataagatctacaggtttacataacagaggagaatgtaaatgtgtagatctaacctggcggcagcgcaaaagatg

SEQ ID NO: 47695 - DNA, 103 bp, Artificial Sequence
  Synthetic Polynucleotide
taatacgactcactatagggactcatctggatagataagatctacaggttaacagaggagaaacctgatgatcttatctaacctggcggcagcgcaaaagatg

SEQ ID NO: 47696 - DNA, 103 bp, Artificial Sequence
  Synthetic Polynucleotide
taatacgactcactatagggcatggactcatctggatagataagatctacaacagaggagagtagatatgatctatccaaacctggcggcagcgcaaaagatg

SEQ ID NO: 47697 - DNA, 103 bp, Artificial Sequence
  Synthetic Polynucleotide
taatacgactcactatagggcaagtcatggactcatctggatagataagaaacagaggagatcttatatgtccagatgaaacctggcggcagcgcaaaagatg

SEQ ID NO: 47698 - DNA, 103 bp, Artificial Sequence
  Synthetic Polynucleotide
taatacgactcactatagggaataccaagtcatggactcatctggatagaaacagaggagatctatcatgatgagtccaaacctggcggcagcgcaaaagatg

SEQ ID NO: 47699 - DNA, 103 bp, Artificial Sequence
  Synthetic Polynucleotide
taatacgactcactatagggttccaaataccaagtcatggactcatctggaacagaggagaccagatatgtccatgactaacctggcggcagcgcaaaagatg

SEQ ID NO: 47700 - DNA, 103 bp, Artificial Sequence
  Synthetic Polynucleotide
taatacgactcactatagggctaatttccaaataccaagtcatggactcaaacagaggagatgagtcatggacttggtaaacctggcggcagcgcaaaagatg

SEQ ID NO: 47701 - DNA, 103 bp, Artificial Sequence
  Synthetic Polynucleotide
taatacgactcactataggggagcactaatttccaaataccaagtcatggaacagaggagaccatgaatgggtatttggaacctggcggcagcgcaaaagatg

SEQ ID NO: 47702 - DNA, 103 bp, Artificial Sequence
  Synthetic Polynucleotide
taatacgactcactatagggccacagagcactaatttccaaataccaagtaacagaggagaacttggatgttggaaattaacctggcggcagcgcaaaagatg

SEQ ID NO: 47703 - DNA, 103 bp, Artificial Sequence
  Synthetic Polynucleotide
taatacgactcactatagggttattccacagagcactaatttccaaatacaacagaggagagtatttatgaattagtgcaacctggcggcagcgcaaaagatg

SEQ ID NO: 47704 - DNA, 103 bp, Artificial Sequence
  Synthetic Polynucleotide
taatacgactcactatagggattaatattgtagagaaatacgcaactacaaacagaggagatgtagtatggtatttctcaacctggcggcagcgcaaaagatg

SEQ ID NO: 47705 - DNA, 103 bp, Artificial Sequence
  Synthetic Polynucleotide
taatacgactcactatagggttattttattccacagagcactaatttccaaacagaggagatggaaaatggtgctctgtaacctggcggcagcgcaaaagatg

SEQ ID NO: 47706 - DNA, 103 bp, Artificial Sequence
  Synthetic Polynucleotide
taatacgactcactatagggttgttttattttattccacagagcactaataacagaggagaattagtatgctgtggaataacctggcggcagcgcaaaagatg

SEQ ID NO: 47707 - DNA, 103 bp, Artificial Sequence
  Synthetic Polynucleotide
taatacgactcactatagggaatccttgttttattttattccacagagcaaacagaggagatgctctatggaataaaataacctggcggcagcgcaaaagatg

SEQ ID NO: 47708 - DNA, 103 bp, Artificial Sequence
  Synthetic Polynucleotide
taatacgactcactatagggaaacgaatccttgttttattttattccacaaacagaggagatgtggaatgaaataaaacaacctggcggcagcgcaaaagatg

SEQ ID NO: 47709 - DNA, 103 bp, Artificial Sequence
  Synthetic Polynucleotide
taatacgactcactatagggagagtaaacgaatccttgttttattttattaacagaggagaaataaaatgaaacaaggaaacctggcggcagcgcaaaagatg

SEQ ID NO: 47710 - DNA, 103 bp, Artificial Sequence
  Synthetic Polynucleotide
taatacgactcactatagggttctgagagtaaacgaatccttgttttattaacagaggagaaataaaatgaggattcgtaacctggcggcagcgcaaaagatg

SEQ ID NO: 47711 - DNA, 103 bp, Artificial Sequence
  Synthetic Polynucleotide
taatacgactcactatagggtctgtttctgagagtaaacgaatccttgttaacagaggagaaacaagatgtcgtttactaacctggcggcagcgcaaaagatg

SEQ ID NO: 47712 - DNA, 103 bp, Artificial Sequence
  Synthetic Polynucleotide
taatacgactcactatagggaagtttctgtttctgagagtaaacgaatccaacagaggagaggattcatgtactctcagaacctggcggcagcgcaaaagatg

SEQ ID NO: 47713 - DNA, 103 bp, Artificial Sequence
  Synthetic Polynucleotide
taatacgactcactatagggtttgcaagtttctgtttctgagagtaaacgaacagaggagacgtttaatgtcagaaacaaacctggcggcagcgcaaaagatg

SEQ ID NO: 47714 - DNA, 103 bp, Artificial Sequence
  Synthetic Polynucleotide
taatacgactcactatagggtcttctttgcaagtttctgtttctgagagtaacagaggagaactctcatgaacagaaacaacctggcggcagcgcaaaagatg

SEQ ID NO: 47715 - DNA, 103 bp, Artificial Sequence
  Synthetic Polynucleotide
taatacgactcactatagggatggtattaatattgtagagaaatacgcaaaacagaggagattgcgtatgtctctacaaaacctggcggcagcgcaaaagatg

SEQ ID NO: 47716 - DNA, 103 bp, Artificial Sequence
  Synthetic Polynucleotide
taatacgactcactatagggcaatgtcttctttgcaagtttctgtttctgaacagaggagacagaaaatgaaacttgcaaacctggcggcagcgcaaaagatg

SEQ ID NO: 47717 - DNA, 103 bp, Artificial Sequence
  Synthetic Polynucleotide
taatacgactcactatagggggcgccaatgtcttctttgcaagtttctgtaacagaggagaacagaaatgtgcaaagaaaacctggcggcagcgcaaaagatg

SEQ ID NO: 47718 - DNA, 103 bp, Artificial Sequence
  Synthetic Polynucleotide
taatacgactcactatagggtaaacggcgccaatgtcttctttgcaagttaacagaggagaaacttgatgagaagacataacctggcggcagcgcaaaagatg

SEQ ID NO: 47719 - DNA, 103 bp, Artificial Sequence
  Synthetic Polynucleotide
taatacgactcactataggggaaattaaacggcgccaatgtcttctttgcaacagaggagagcaaagatgacattggcgaacctggcggcagcgcaaaagatg

SEQ ID NO: 47720 - DNA, 103 bp, Artificial Sequence
  Synthetic Polynucleotide
taatacgactcactatagggactaggaaattaaacggcgccaatgtcttcaacagaggagagaagacatgggcgccgttaacctggcggcagcgcaaaagatg

SEQ ID NO: 47721 - DNA, 103 bp, Artificial Sequence
  Synthetic Polynucleotide
taatacgactcactatagggcaaatactaggaaattaaacggcgccaatgaacagaggagacattggatgcgtttaattaacctggcggcagcgcaaaagatg

SEQ ID NO: 47722 - DNA, 103 bp, Artificial Sequence
  Synthetic Polynucleotide
taatacgactcactatagggtttgacaaatactaggaaattaaacggcgcaacagaggagagcgccgatgaatttcctaaacctggcggcagcgcaaaagatg

SEQ ID NO: 47723 - DNA, 103 bp, Artificial Sequence
  Synthetic Polynucleotide
taatacgactcactataggggtgggtttgacaaatactaggaaattaaacaacagaggagagtttaaatgcctagtattaacctggcggcagcgcaaaagatg

SEQ ID NO: 47724 - DNA, 103 bp, Artificial Sequence
  Synthetic Polynucleotide
taatacgactcactatagggcagtggtgggtttgacaaatactaggaaataacagaggagaatttccatgtatttgtcaaacctggcggcagcgcaaaagatg

SEQ ID NO: 47725 - DNA, 103 bp, Artificial Sequence
  Synthetic Polynucleotide
taatacgactcactatagggatcctcagtggtgggtttgacaaatactagaacagaggagactagtaatggtcaaacccaacctggcggcagcgcaaaagatg

SEQ ID NO: 47726 - DNA, 103 bp, Artificial Sequence
  Synthetic Polynucleotide
taatacgactcactatagggcaaaaatggtattaatattgtagagaaataaacagaggagatatttcatgacaatattaaacctggcggcagcgcaaaagatg

SEQ ID NO: 47727 - DNA, 103 bp, Artificial Sequence
  Synthetic Polynucleotide
taatacgactcactataggggcattatcctcagtggtgggtttgacaaataacagaggagaatttgtatgacccaccacaacctggcggcagcgcaaaagatg

SEQ ID NO: 47728 - DNA, 103 bp, Artificial Sequence
  Synthetic Polynucleotide
taatacgactcactatagggtaatagcattatcctcagtggtgggtttgaaacagaggagatcaaacatgccactgaggaacctggcggcagcgcaaaagatg

SEQ ID NO: 47729 - DNA, 103 bp, Artificial Sequence
  Synthetic Polynucleotide
taatacgactcactatagggaaccttaatagcattatcctcagtggtgggaacagaggagacccaccatggaggataataacctggcggcagcgcaaaagatg

SEQ ID NO: 47730 - DNA, 103 bp, Artificial Sequence
  Synthetic Polynucleotide
taatacgactcactatagggtccttaaccttaatagcattatcctcagtgaacagaggagacactgaatgtaatgctataacctggcggcagcgcaaaagatg

SEQ ID NO: 47731 - DNA, 103 bp, Artificial Sequence
  Synthetic Polynucleotide
taatacgactcactatagggacagatccttaaccttaatagcattatcctaacagaggagaaggataatgctattaaggaacctggcggcagcgcaaaagatg

SEQ ID NO: 47732 - DNA, 103 bp, Artificial Sequence
  Synthetic Polynucleotide
taatacgactcactatagggatcgtacagatccttaaccttaatagcattaacagaggagaaatgctatgaaggttaagaacctggcggcagcgcaaaagatg

SEQ ID NO: 47733 - DNA, 103 bp, Artificial Sequence
  Synthetic Polynucleotide
taatacgactcactatagggatcatatcgtacagatccttaaccttaataaacagaggagatattaaatgtaaggatctaacctggcggcagcgcaaaagatg

SEQ ID NO: 47734 - DNA, 103 bp, Artificial Sequence
  Synthetic Polynucleotide
taatacgactcactatagggtatgaatcatatcgtacagatccttaacctaacagaggagaaggttaatgatctgtacgaacctggcggcagcgcaaaagatg

SEQ ID NO: 47735 - DNA, 103 bp, Artificial Sequence
  Synthetic Polynucleotide
taatacgactcactataggggacgttatgaatcatatcgtacagatccttaacagaggagaaaggatatgtacgatatgaacctggcggcagcgcaaaagatg

SEQ ID NO: 47736 - DNA, 103 bp, Artificial Sequence
  Synthetic Polynucleotide
taatacgactcactatagggtcaatgacgttatgaatcatatcgtacagaaacagaggagatctgtaatgtatgattcaaacctggcggcagcgcaaaagatg

SEQ ID NO: 47737 - DNA, 103 bp, Artificial Sequence
  Synthetic Polynucleotide
taatacgactcactatagggagttgcaaaaatggtattaatattgtagagaacagaggagactctacatgattaataccaacctggcggcagcgcaaaagatg

SEQ ID NO: 47738 - DNA, 103 bp, Artificial Sequence
  Synthetic Polynucleotide
taatacgactcactatagggcatcatcaatgacgttatgaatcatatcgtaacagaggagaacgataatgttcataacgaacctggcggcagcgcaaaagatg

SEQ ID NO: 47739 - DNA, 103 bp, Artificial Sequence
  Synthetic Polynucleotide
taatacgactcactatagggtctcacatcatcaatgacgttatgaatcataacagaggagaatgattatgaacgtcattaacctggcggcagcgcaaaagatg

SEQ ID NO: 47740 - DNA, 103 bp, Artificial Sequence
  Synthetic Polynucleotide
taatacgactcactatagggttctctctcacatcatcaatgacgttatgaaacagaggagatcataaatgcattgatgaaacctggcggcagcgcaaaagatg

SEQ ID NO: 47741 - DNA, 103 bp, Artificial Sequence
  Synthetic Polynucleotide
taatacgactcactatagggagtatttctctctcacatcatcaatgacgtaacagaggagaacgtcaatgatgatgtgaaacctggcggcagcgcaaaagatg

SEQ ID NO: 47742 - DNA, 103 bp, Artificial Sequence
  Synthetic Polynucleotide
taatacgactcactatagggaaagaagtatttctctctcacatcatcaataacagaggagaattgatatggtgagagagaacctggcggcagcgcaaaagatg

SEQ ID NO: 47743 - DNA, 103 bp, Artificial Sequence
  Synthetic Polynucleotide
taatacgactcactatagggaccgtaaagaagtatttctctctcacatcaaacagaggagatgatgtatgagagaaataaacctggcggcagcgcaaaagatg

SEQ ID NO: 47744 - DNA, 103 bp, Artificial Sequence
  Synthetic Polynucleotide
taatacgactcactatagggtagataccgtaaagaagtatttctctctcaaacagaggagatgagagatgaatacttctaacctggcggcagcgcaaaagatg

SEQ ID NO: 47745 - DNA, 103 bp, Artificial Sequence
  Synthetic Polynucleotide
taatacgactcactatagggtatattagataccgtaaagaagtatttctcaacagaggagagagaaaatgttctttacgaacctggcggcagcgcaaaagatg

SEQ ID NO: 47746 - DNA, 103 bp, Artificial Sequence
  Synthetic Polynucleotide
taatacgactcactatagggaaatctatattagataccgtaaagaagtataacagaggagaatacttatgtacggtatcaacctggcggcagcgcaaaagatg

SEQ ID NO: 47747 - DNA, 103 bp, Artificial Sequence
  Synthetic Polynucleotide
taatacgactcactatagggccataaaatctatattagataccgtaaagaaacagaggagatctttaatgtatctaataaacctggcggcagcgcaaaagatg

SEQ ID NO: 47748 - DNA, 103 bp, Artificial Sequence
  Synthetic Polynucleotide
taatacgactcactatagggtaaatagttgcaaaaatggtattaatattgaacagaggagacaatatatgtaccattttaacctggcggcagcgcaaaagatg

SEQ ID NO: 47749 - DNA, 103 bp, Artificial Sequence
  Synthetic Polynucleotide
taatacgactcactatagggatactccataaaatctatattagataccgtaacagaggagaacggtaatgaatatagataacctggcggcagcgcaaaagatg

SEQ ID NO: 47750 - DNA, 103 bp, Artificial Sequence
  Synthetic Polynucleotide
taatacgactcactatagggaatatatactccataaaatctatattagataacagaggagaatctaaatgagattttataacctggcggcagcgcaaaagatg

SEQ ID NO: 47751 - DNA, 103 bp, Artificial Sequence
  Synthetic Polynucleotide
taatacgactcactatagggtcaagaatatatactccataaaatctatataacagaggagaatatagatgttatggagtaacctggcggcagcgcaaaagatg

SEQ ID NO: 47752 - DNA, 103 bp, Artificial Sequence
  Synthetic Polynucleotide
taatacgactcactatagggatgcgtcaagaatatatactccataaaatcaacagaggagagattttatggagtatataaacctggcggcagcgcaaaagatg

SEQ ID NO: 47753 - DNA, 103 bp, Artificial Sequence
  Synthetic Polynucleotide
taatacgactcactatagggttaagatgcgtcaagaatatatactccataaacagaggagatatggaatgtatattcttaacctggcggcagcgcaaaagatg

SEQ ID NO: 47754 - DNA, 103 bp, Artificial Sequence
  Synthetic Polynucleotide
taatacgactcactatagggaaggattaagatgcgtcaagaatatatactaacagaggagaagtataatgtcttgacgcaacctggcggcagcgcaaaagatg

SEQ ID NO: 47755 - DNA, 103 bp, Artificial Sequence
  Synthetic Polynucleotide
taatacgactcactatagggtctagaaggattaagatgcgtcaagaatataacagaggagaatattcatgacgcatcttaacctggcggcagcgcaaaagatg

SEQ ID NO: 47756 - DNA, 103 bp, Artificial Sequence
  Synthetic Polynucleotide
taatacgactcactatagggctaattctagaaggattaagatgcgtcaagaacagaggagacttgacatgtcttaatccaacctggcggcagcgcaaaagatg

SEQ ID NO: 47757 - DNA, 103 bp, Artificial Sequence
  Synthetic Polynucleotide
taatacgactcactatagggtaattctaattctagaaggattaagatgcgaacagaggagacgcatcatgatccttctaaacctggcggcagcgcaaaagatg

SEQ ID NO: 47758 - DNA, 103 bp, Artificial Sequence
  Synthetic Polynucleotide
taatacgactcactatagggttttgtaattctaattctagaaggattaagaacagaggagacttaatatgtctagaattaacctggcggcagcgcaaaagatg

SEQ ID NO: 47759 - DNA, 103 bp, Artificial Sequence
  Synthetic Polynucleotide
taatacgactcactatagggagaaataaatagttgcaaaaatggtattaaaacagaggagattaataatgtttttgcaaaacctggcggcagcgcaaaagatg

SEQ ID NO: 47760 - DNA, 103 bp, Artificial Sequence
  Synthetic Polynucleotide
taatacgactcactataggggtttcttttgtaattctaattctagaaggaaacagaggagatccttcatgaattagaataacctggcggcagcgcaaaagatg

SEQ ID NO: 47761 - DNA, 103 bp, Artificial Sequence
  Synthetic Polynucleotide
taatacgactcactatagggtagccgtttcttttgtaattctaattctagaacagaggagactagaaatggaattacaaaacctggcggcagcgcaaaagatg

SEQ ID NO: 47762 - DNA, 103 bp, Artificial Sequence
  Synthetic Polynucleotide
taatacgactcactatagggagtgatagccgtttcttttgtaattctaataacagaggagaattagaatgacaaaagaaaacctggcggcagcgcaaaagatg

SEQ ID NO: 47763 - DNA, 103 bp, Artificial Sequence
  Synthetic Polynucleotide
taatacgactcactatagggaagatagtgatagccgtttcttttgtaattaacagaggagaaattacatgagaaacggcaacctggcggcagcgcaaaagatg

SEQ ID NO: 47764 - DNA, 103 bp, Artificial Sequence
  Synthetic Polynucleotide
taatacgactcactatagggtttcaaagatagtgatagccgtttcttttgaacagaggagacaaaagatgcggctatcaaacctggcggcagcgcaaaagatg

SEQ ID NO: 47765 - DNA, 103 bp, Artificial Sequence
  Synthetic Polynucleotide
taatacgactcactataggggaacttttcaaagatagtgatagccgtttcaacagaggagagaaacgatgatcactatcaacctggcggcagcgcaaaagatg

SEQ ID NO: 47766 - DNA, 103 bp, Artificial Sequence
  Synthetic Polynucleotide
taatacgactcactatagggtcatagaacttttcaaagatagtgatagccaacagaggagaggctatatgtatctttgaaacctggcggcagcgcaaaagatg

SEQ ID NO: 47767 - DNA, 103 bp, Artificial Sequence
  Synthetic Polynucleotide
taatacgactcactataggggtttttcatagaacttttcaaagatagtgaaacagaggagatcactaatgttgaaaagtaacctggcggcagcgcaaaagatg

SEQ ID NO: 47768 - DNA, 103 bp, Artificial Sequence
  Synthetic Polynucleotide
taatacgactcactatagggattgagtttttcatagaacttttcaaagataacagaggagaatctttatgaagttctataacctggcggcagcgcaaaagatg

SEQ ID NO: 47769 - DNA, 103 bp, Artificial Sequence
  Synthetic Polynucleotide
taatacgactcactataggggtataattgagtttttcatagaacttttcaaacagaggagatgaaaaatgctatgaaaaaacctggcggcagcgcaaaagatg

SEQ ID NO: 47770 - DNA, 103 bp, Artificial Sequence
  Synthetic Polynucleotide
taatacgactcactatagggggtctagaaataaatagttgcaaaaatggtaacagaggagaaccattatggcaactattaacctggcggcagcgcaaaagatg

SEQ ID NO: 47771 - DNA, 103 bp, Artificial Sequence
  Synthetic Polynucleotide
taatacgactcactatagggctagagtataattgagtttttcatagaactaacagaggagaagttctatgaaaaactcaaacctggcggcagcgcaaaagatg

SEQ ID NO: 47772 - DNA, 103 bp, Artificial Sequence
  Synthetic Polynucleotide
taatacgactcactatagggaccacctagagtataattgagtttttcataaacagaggagatatgaaatgctcaattataacctggcggcagcgcaaaagatg

SEQ ID NO: 47773 - DNA, 103 bp, Artificial Sequence
  Synthetic Polynucleotide
taatacgactcactataggggttccaccacctagagtataattgagttttaacagaggagaaaaactatgttatactctaacctggcggcagcgcaaaagatg

SEQ ID NO: 47774 - DNA, 103 bp, Artificial Sequence
  Synthetic Polynucleotide
taatacgactcactatagggtaggagttccaccacctagagtataattgaaacagaggagatcaattatgctctaggtgaacctggcggcagcgcaaaagatg

SEQ ID NO: 47775 - DNA, 103 bp, Artificial Sequence
  Synthetic Polynucleotide
taatacgactcactatagggtccaataggagttccaccacctagagtataaacagaggagatatactatgggtggtggaaacctggcggcagcgcaaaagatg

SEQ ID NO: 47776 - DNA, 103 bp, Artificial Sequence
  Synthetic Polynucleotide
taatacgactcactatagggataattccaataggagttccaccacctagaaacagaggagatctaggatgtggaactccaacctggcggcagcgcaaaagatg

SEQ ID NO: 47777 - DNA, 103 bp, Artificial Sequence
  Synthetic Polynucleotide
taatacgactcactatagggcagaaataattccaataggagttccaccacaacagaggagagtggtgatgctcctattgaacctggcggcagcgcaaaagatg

SEQ ID NO: 47778 - DNA, 103 bp, Artificial Sequence
  Synthetic Polynucleotide
taatacgactcactatagggctgtgcagaaataattccaataggagttccaacagaggagaggaactatgattggaattaacctggcggcagcgcaaaagatg

SEQ ID NO: 47779 - DNA, 103 bp, Artificial Sequence
  Synthetic Polynucleotide
taatacgactcactatagggaatacctgtgcagaaataattccaataggaaacagaggagatcctatatgaattatttcaacctggcggcagcgcaaaagatg

SEQ ID NO: 47780 - DNA, 103 bp, Artificial Sequence
  Synthetic Polynucleotide
taatacgactcactatagggcagacaatacctgtgcagaaataattccaaaacagaggagattggaaatgtttctgcacaacctggcggcagcgcaaaagatg

SEQ ID NO: 47781 - DNA, 103 bp, Artificial Sequence
  Synthetic Polynucleotide
taatacgactcactatagggcaaaaggtctagaaataaatagttgcaaaaaacagaggagattttgcatgtatttatttaacctggcggcagcgcaaaagatg

SEQ ID NO: 47782 - DNA, 103 bp, Artificial Sequence
  Synthetic Polynucleotide
taatacgactcactatagggcttctcagacaatacctgtgcagaaataataacagaggagaattattatggcacaggtaaacctggcggcagcgcaaaagatg

SEQ ID NO: 47783 - DNA, 103 bp, Artificial Sequence
  Synthetic Polynucleotide
taatacgactcactataggggtaaacttctcagacaatacctgtgcagaaaacagaggagattctgcatgggtattgtcaacctggcggcagcgcaaaagatg

SEQ ID NO: 47784 - DNA, 103 bp, Artificial Sequence
  Synthetic Polynucleotide
taatacgactcactataggggttgtgtaaacttctcagacaatacctgtgaacagaggagacacaggatgtgtctgagaaacctggcggcagcgcaaaagatg

SEQ ID NO: 47785 - DNA, 103 bp, Artificial Sequence
  Synthetic Polynucleotide
taatacgactcactatagggggcttgttgtgtaaacttctcagacaatacaacagaggagagtattgatggagaagtttaacctggcggcagcgcaaaagatg

SEQ ID NO: 47786 - DNA, 103 bp, Artificial Sequence
  Synthetic Polynucleotide
taatacgactcactataggggacagggcttgttgtgtaaacttctcagacaacagaggagagtctgaatggtttacacaaacctggcggcagcgcaaaagatg

SEQ ID NO: 47787 - DNA, 103 bp, Artificial Sequence
  Synthetic Polynucleotide
taatacgactcactatagggaactggacagggcttgttgtgtaaacttctaacagaggagaagaagtatgcacaacaagaacctggcggcagcgcaaaagatg

SEQ ID NO: 47788 - DNA, 103 bp, Artificial Sequence
  Synthetic Polynucleotide
taatacgactcactataggggtgaaaactggacagggcttgttgtgtaaaaacagaggagatttacaatgcaagccctgaacctggcggcagcgcaaaagatg

SEQ ID NO: 47789 - DNA, 103 bp, Artificial Sequence
  Synthetic Polynucleotide
taatacgactcactataggggtagtgtgaaaactggacagggcttgttgtaacagaggagaacaacaatgcctgtccagaacctggcggcagcgcaaaagatg

SEQ ID NO: 47790 - DNA, 103 bp, Artificial Sequence
  Synthetic Polynucleotide
taatacgactcactatagggtttcagtagtgtgaaaactggacagggcttaacagaggagaaagcccatgccagttttcaacctggcggcagcgcaaaagatg

SEQ ID NO: 47791 - DNA, 103 bp, Artificial Sequence
  Synthetic Polynucleotide
taatacgactcactataggggcttttttcagtagtgtgaaaactggacagaacagaggagactgtccatgtttcacactaacctggcggcagcgcaaaagatg

SEQ ID NO: 47792 - DNA, 103 bp, Artificial Sequence
  Synthetic Polynucleotide
taatacgactcactatagggcctcttcttgtgcccagttcagtccctgtcaacagaggagagacaggatgtgaactgggaacctggcggcagcgcaaaagatg

SEQ ID NO: 47793 - DNA, 103 bp, Artificial Sequence
  Synthetic Polynucleotide
taatacgactcactatagggaatcacaaaaggtctagaaataaatagttgaacagaggagacaactaatgatttctagaaacctggcggcagcgcaaaagatg

SEQ ID NO: 47794 - DNA, 103 bp, Artificial Sequence
  Synthetic Polynucleotide
taatacgactcactataggggcaccgcttttttcagtagtgtgaaaactgaacagaggagacagtttatgcactactgaaacctggcggcagcgcaaaagatg

SEQ ID NO: 47795 - DNA, 103 bp, Artificial Sequence
  Synthetic Polynucleotide
taatacgactcactatagggtgacagcaccgcttttttcagtagtgtgaaaacagaggagattcacaatgctgaaaaaaaacctggcggcagcgcaaaagatg

SEQ ID NO: 47796 - DNA, 103 bp, Artificial Sequence
  Synthetic Polynucleotide
taatacgactcactatagggttgtttgacagcaccgcttttttcagtagtaacagaggagaactactatgaaaagcggtaacctggcggcagcgcaaaagatg

SEQ ID NO: 47797 - DNA, 103 bp, Artificial Sequence
  Synthetic Polynucleotide
taatacgactcactatagggagtttttgtttgacagcaccgcttttttcaaacagaggagatgaaaaatgcggtgctgtaacctggcggcagcgcaaaagatg

SEQ ID NO: 47798 - DNA, 103 bp, Artificial Sequence
  Synthetic Polynucleotide
taatacgactcactatagggaaccaagtttttgtttgacagcaccgctttaacagaggagaaaagcgatgctgtcaaacaacctggcggcagcgcaaaagatg

SEQ ID NO: 47799 - DNA, 103 bp, Artificial Sequence
  Synthetic Polynucleotide
taatacgactcactatagggattgaaaccaagtttttgtttgacagcaccaacagaggagaggtgctatgaaacaaaaaaacctggcggcagcgcaaaagatg

SEQ ID NO: 47800 - DNA, 103 bp, Artificial Sequence
  Synthetic Polynucleotide
taatacgactcactatagggaactcattgaaaccaagtttttgtttgacaaacagaggagatgtcaaatgaaaacttggaacctggcggcagcgcaaaagatg

SEQ ID NO: 47801 - DNA, 103 bp, Artificial Sequence
  Synthetic Polynucleotide
taatacgactcactatagggtattaaactcattgaaaccaagtttttgttaacagaggagaaacaaaatgttggtttcaaacctggcggcagcgcaaaagatg

SEQ ID NO: 47802 - DNA, 103 bp, Artificial Sequence
  Synthetic Polynucleotide
taatacgactcactatagggcaagttattaaactcattgaaaccaagtttaacagaggagaaaacttatgttcaatgagaacctggcggcagcgcaaaagatg

SEQ ID NO: 47803 - DNA, 103 bp, Artificial Sequence
  Synthetic Polynucleotide
taatacgactcactatagggttagtcaagttattaaactcattgaaaccaaacagaggagatggtttatgtgagtttaaaacctggcggcagcgcaaaagatg

SEQ ID NO: 47804 - DNA, 103 bp, Artificial Sequence
  Synthetic Polynucleotide
taatacgactcactatagggttactaatcacaaaaggtctagaaataaataacagaggagaatttatatgtagacctttaacctggcggcagcgcaaaagatg

SEQ ID NO: 47805 - DNA, 103 bp, Artificial Sequence
  Synthetic Polynucleotide
taatacgactcactatagggtcaaattagtcaagttattaaactcattgaaacagaggagatcaatgatgttaataactaacctggcggcagcgcaaaagatg

SEQ ID NO: 47806 - DNA, 103 bp, Artificial Sequence
  Synthetic Polynucleotide
taatacgactcactatagggcttactcaaattagtcaagttattaaactcaacagaggagagagtttatgaacttgactaacctggcggcagcgcaaaagatg

SEQ ID NO: 47807 - DNA, 103 bp, Artificial Sequence
  Synthetic Polynucleotide
taatacgactcactatagggttattcttactcaaattagtcaagttattaaacagaggagataataaatggactaatttaacctggcggcagcgcaaaagatg

SEQ ID NO: 47808 - DNA, 103 bp, Artificial Sequence
  Synthetic Polynucleotide
taatacgactcactatagggcggtcttattcttactcaaattagtcaagtaacagaggagaacttgaatgatttgagtaaacctggcggcagcgcaaaagatg

SEQ ID NO: 47809 - DNA, 103 bp, Artificial Sequence
  Synthetic Polynucleotide
taatacgactcactatagggaatttcggtcttattcttactcaaattagtaacagaggagaactaatatgagtaagaataacctggcggcagcgcaaaagatg

SEQ ID NO: 47810 - DNA, 103 bp, Artificial Sequence
  Synthetic Polynucleotide
taatacgactcactataggggtgataatttcggtcttattcttactcaaaaacagaggagatttgagatggaataagacaacctggcggcagcgcaaaagatg

SEQ ID NO: 47811 - DNA, 103 bp, Artificial Sequence
  Synthetic Polynucleotide
taatacgactcactatagggccagagtgataatttcggtcttattcttacaacagaggagagtaagaatgagaccgaaaaacctggcggcagcgcaaaagatg

SEQ ID NO: 47812 - DNA, 103 bp, Artificial Sequence
  Synthetic Polynucleotide
taatacgactcactatagggggataccagagtgataatttcggtcttattaacagaggagaaataagatggaaattatcaacctggcggcagcgcaaaagatg

SEQ ID NO: 47813 - DNA, 103 bp, Artificial Sequence
  Synthetic Polynucleotide
taatacgactcactatagggtcatcggataccagagtgataatttcggtcaacagaggagagaccgaatgtatcactctaacctggcggcagcgcaaaagatg

SEQ ID NO: 47814 - DNA, 103 bp, Artificial Sequence
  Synthetic Polynucleotide
taatacgactcactatagggagatatcatcggataccagagtgataatttaacagaggagaaaattaatgctctggtataacctggcggcagcgcaaaagatg

SEQ ID NO: 47815 - DNA, 103 bp, Artificial Sequence
  Synthetic Polynucleotide
taatacgactcactatagggtgagattactaatcacaaaaggtctagaaaaacagaggagatttctaatgcttttgtgaaacctggcggcagcgcaaaagatg

SEQ ID NO: 47816 - DNA, 103 bp, Artificial Sequence
  Synthetic Polynucleotide
taatacgactcactatagggtttagagatatcatcggataccagagtgataacagaggagaatcactatggtatccgataacctggcggcagcgcaaaagatg

SEQ ID NO: 47817 - DNA, 103 bp, Artificial Sequence
  Synthetic Polynucleotide
taatacgactcactatagggtgaagtttagagatatcatcggataccagaaacagaggagatctggtatgcgatgatataacctggcggcagcgcaaaagatg

SEQ ID NO: 47818 - DNA, 103 bp, Artificial Sequence
  Synthetic Polynucleotide
taatacgactcactatagggcagattgaagtttagagatatcatcggataaacagaggagatatccgatgatatctctaaacctggcggcagcgcaaaagatg

SEQ ID NO: 47819 - DNA, 103 bp, Artificial Sequence
  Synthetic Polynucleotide
taatacgactcactatagggcttaacagattgaagtttagagatatcatcaacagaggagagatgatatgtctaaacttaacctggcggcagcgcaaaagatg

SEQ ID NO: 47820 - DNA, 103 bp, Artificial Sequence
  Synthetic Polynucleotide
taatacgactcactatagggttaatcttaacagattgaagtttagagataaacagaggagatatctcatgacttcaatcaacctggcggcagcgcaaaagatg

SEQ ID NO: 47821 - DNA, 103 bp, Artificial Sequence
  Synthetic Polynucleotide
taatacgactcactatagggcaaaattaatcttaacagattgaagtttagaacagaggagactaaacatgaatctgttaaacctggcggcagcgcaaaagatg

SEQ ID NO: 47822 - DNA, 103 bp, Artificial Sequence
  Synthetic Polynucleotide
taatacgactcactatagggaaattcaaaattaatcttaacagattgaagaacagaggagacttcaaatggttaagattaacctggcggcagcgcaaaagatg

SEQ ID NO: 47823 - DNA, 103 bp, Artificial Sequence
  Synthetic Polynucleotide
taatacgactcactatagggcatacaaattcaaaattaatcttaacagataacagaggagaatctgtatggattaatttaacctggcggcagcgcaaaagatg

SEQ ID NO: 47824 - DNA, 103 bp, Artificial Sequence
  Synthetic Polynucleotide
taatacgactcactatagggccaaacatacaaattcaaaattaatcttaaaacagaggagattaagaatgattttgaataacctggcggcagcgcaaaagatg

SEQ ID NO: 47825 - DNA, 103 bp, Artificial Sequence
  Synthetic Polynucleotide
taatacgactcactatagggttctcccaaacatacaaattcaaaattaataacagaggagaattaatatggaatttgtaaacctggcggcagcgcaaaagatg

SEQ ID NO: 47826 - DNA, 103 bp, Artificial Sequence
  Synthetic Polynucleotide
taatacgactcactatagggattattgagattactaatcacaaaaggtctaacagaggagaagacctatggtgattagtaacctggcggcagcgcaaaagatg

SEQ ID NO: 47827 - DNA, 103 bp, Artificial Sequence
  Synthetic Polynucleotide
taatacgactcactatagggtttaattctcccaaacatacaaattcaaaaaacagaggagattttgaatgtgtatgtttaacctggcggcagcgcaaaagatg

SEQ ID NO: 47828 - DNA, 103 bp, Artificial Sequence
  Synthetic Polynucleotide
taatacgactcactatagggttggatttaattctcccaaacatacaaattaacagaggagaaatttgatggtttgggagaacctggcggcagcgcaaaagatg

SEQ ID NO: 47829 - DNA, 103 bp, Artificial Sequence
  Synthetic Polynucleotide
taatacgactcactataggggatgtttggatttaattctcccaaacatacaacagaggagagtatgtatgggagaattaaacctggcggcagcgcaaaagatg

SEQ ID NO: 47830 - DNA, 103 bp, Artificial Sequence
  Synthetic Polynucleotide
taatacgactcactatagggagagtgatgtttggatttaattctcccaaaaacagaggagatttgggatgattaaatccaacctggcggcagcgcaaaagatg

SEQ ID NO: 47831 - DNA, 103 bp, Artificial Sequence
  Synthetic Polynucleotide
taatacgactcactatagggttcgaagagtgatgtttggatttaattctcaacagaggagagagaatatgatccaaacaaacctggcggcagcgcaaaagatg

SEQ ID NO: 47832 - DNA, 103 bp, Artificial Sequence
  Synthetic Polynucleotide
taatacgactcactatagggttcttttcgaagagtgatgtttggatttaaaacagaggagattaaatatgaacatcactaacctggcggcagcgcaaaagatg

SEQ ID NO: 47833 - DNA, 103 bp, Artificial Sequence
  Synthetic Polynucleotide
taatacgactcactatagggtctgtttcttttcgaagagtgatgtttggaaacagaggagatccaaaatgcactcttcgaacctggcggcagcgcaaaagatg

SEQ ID NO: 47834 - DNA, 103 bp, Artificial Sequence
  Synthetic Polynucleotide
taatacgactcactatagggatctatctgtttcttttcgaagagtgatgtaacagaggagaacatcaatgttcgaaaagaacctggcggcagcgcaaaagatg

SEQ ID NO: 47835 - DNA, 103 bp, Artificial Sequence
  Synthetic Polynucleotide
taatacgactcactatagggtacatatctatctgtttcttttcgaagagtaacagaggagaactcttatgaaagaaacaaacctggcggcagcgcaaaagatg

SEQ ID NO: 47836 - DNA, 103 bp, Artificial Sequence
  Synthetic Polynucleotide
taatacgactcactatagggtctactacatatctatctgtttcttttcgaaacagaggagatcgaaaatgaacagatagaacctggcggcagcgcaaaagatg

SEQ ID NO: 47837 - DNA, 103 bp, Artificial Sequence
  Synthetic Polynucleotide
taatacgactcactataggggtagaattattgagattactaatcacaaaaaacagaggagattttgtatgtagtaatctaacctggcggcagcgcaaaagatg

SEQ ID NO: 47838 - DNA, 103 bp, Artificial Sequence
  Synthetic Polynucleotide
taatacgactcactatagggttatgtctactacatatctatctgtttcttaacagaggagaaagaaaatgatagatatgaacctggcggcagcgcaaaagatg

SEQ ID NO: 47839 - DNA, 103 bp, Artificial Sequence
  Synthetic Polynucleotide
taatacgactcactataggggactattatgtctactacatatctatctgtaacagaggagaacagatatgtatgtagtaaacctggcggcagcgcaaaagatg

SEQ ID NO: 47840 - DNA, 103 bp, Artificial Sequence
  Synthetic Polynucleotide
taatacgactcactatagggctattgactattatgtctactacatatctaaacagaggagatagataatgagtagacataacctggcggcagcgcaaaagatg

SEQ ID NO: 47841 - DNA, 103 bp, Artificial Sequence
  Synthetic Polynucleotide
taatacgactcactatagggataatctattgactattatgtctactacataacagaggagaatgtagatgacataatagaacctggcggcagcgcaaaagatg

SEQ ID NO: 47842 - DNA, 103 bp, Artificial Sequence
  Synthetic Polynucleotide
taatacgactcactataggggatgtataatctattgactattatgtctacaacagaggagagtagacatgatagtcaataacctggcggcagcgcaaaagatg

SEQ ID NO: 47843 - DNA, 103 bp, Artificial Sequence
  Synthetic Polynucleotide
taatacgactcactatagggctcttgatgtataatctattgactattatgaacagaggagacataatatgcaatagattaacctggcggcagcgcaaaagatg

SEQ ID NO: 47844 - DNA, 103 bp, Artificial Sequence
  Synthetic Polynucleotide
taatacgactcactatagggctgctctcttgatgtataatctattgactaaacagaggagatagtcaatggattatacaaacctggcggcagcgcaaaagatg

SEQ ID NO: 47845 - DNA, 103 bp, Artificial Sequence
  Synthetic Polynucleotide
taatacgactcactatagggtatttctgctctcttgatgtataatctattaacagaggagaaatagaatgtacatcaagaacctggcggcagcgcaaaagatg

SEQ ID NO: 47846 - DNA, 103 bp, Artificial Sequence
  Synthetic Polynucleotide
taatacgactcactatagggtcggttatttctgctctcttgatgtataataacagaggagaattataatgcaagagagcaacctggcggcagcgcaaaagatg

SEQ ID NO: 47847 - DNA, 103 bp, Artificial Sequence
  Synthetic Polynucleotide
taatacgactcactatagggctaattcggttatttctgctctcttgatgtaacagaggagaacatcaatggagcagaaaaacctggcggcagcgcaaaagatg

SEQ ID NO: 47848 - DNA, 103 bp, Artificial Sequence
  Synthetic Polynucleotide
taatacgactcactatagggttgacgtagaattattgagattactaatcaaacagaggagatgattaatgatctcaataaacctggcggcagcgcaaaagatg

SEQ ID NO: 47849 - DNA, 103 bp, Artificial Sequence
  Synthetic Polynucleotide
taatacgactcactataggggacgactaattcggttatttctgctctcttaacagaggagaaagagaatggaaataaccaacctggcggcagcgcaaaagatg

SEQ ID NO: 47850 - DNA, 103 bp, Artificial Sequence
  Synthetic Polynucleotide
taatacgactcactatagggtattcgacgactaattcggttatttctgctaacagaggagaagcagaatgaaccgaattaacctggcggcagcgcaaaagatg

SEQ ID NO: 47851 - DNA, 103 bp, Artificial Sequence
  Synthetic Polynucleotide
taatacgactcactatagggtcatatattcgacgactaattcggttatttaacagaggagaaaataaatgaattagtcgaacctggcggcagcgcaaaagatg

SEQ ID NO: 47852 - DNA, 103 bp, Artificial Sequence
  Synthetic Polynucleotide
taatacgactcactatagggttcaatcatatattcgacgactaattcggtaacagaggagaaccgaaatggtcgtcgaaaacctggcggcagcgcaaaagatg

SEQ ID NO: 47853 - DNA, 103 bp, Artificial Sequence
  Synthetic Polynucleotide
taatacgactcactatagggaatcgttcaatcatatattcgacgactaataacagaggagaattagtatgcgaatatataacctggcggcagcgcaaaagatg

SEQ ID NO: 47854 - DNA, 103 bp, Artificial Sequence
  Synthetic Polynucleotide
taatacgactcactatagggagataaatcgttcaatcatatattcgacgaaacagaggagatcgtcgatgatatgattgaacctggcggcagcgcaaaagatg

SEQ ID NO: 47855 - DNA, 103 bp, Artificial Sequence
  Synthetic Polynucleotide
taatacgactcactatagggaaaggagataaatcgttcaatcatatattcaacagaggagagaatatatgattgaacgaaacctggcggcagcgcaaaagatg

SEQ ID NO: 47856 - DNA, 103 bp, Artificial Sequence
  Synthetic Polynucleotide
taatacgactcactatagggacgctaaaggagataaatcgttcaatcataaacagaggagatatgatatgacgatttataacctggcggcagcgcaaaagatg

SEQ ID NO: 47857 - DNA, 103 bp, Artificial Sequence
  Synthetic Polynucleotide
taatacgactcactatagggcaatgacgctaaaggagataaatcgttcaaaacagaggagattgaacatgttatctcctaacctggcggcagcgcaaaagatg

SEQ ID NO: 47858 - DNA, 103 bp, Artificial Sequence
  Synthetic Polynucleotide
taatacgactcactatagggctttacaatgacgctaaaggagataaatcgaacagaggagacgatttatgtcctttagcaacctggcggcagcgcaaaagatg

SEQ ID NO: 47859 - DNA, 103 bp, Artificial Sequence
  Synthetic Polynucleotide
taatacgactcactatagggtaatattgacgtagaattattgagattactaacagaggagaagtaatatgaataattctaacctggcggcagcgcaaaagatg

SEQ ID NO: 47860 - DNA, 103 bp, Artificial Sequence
  Synthetic Polynucleotide
taatacgactcactatagggcattcctttacaatgacgctaaaggagataaacagaggagatatctcatgtagcgtcataacctggcggcagcgcaaaagatg

SEQ ID NO: 47861 - DNA, 103 bp, Artificial Sequence
  Synthetic Polynucleotide
taatacgactcactatagggtaccccattcctttacaatgacgctaaaggaacagaggagacctttaatgtcattgtaaaacctggcggcagcgcaaaagatg

SEQ ID NO: 47862 - DNA, 103 bp, Artificial Sequence
  Synthetic Polynucleotide
taatacgactcactatagggctccataccccattcctttacaatgacgctaacagaggagaagcgtcatggtaaaggaaaacctggcggcagcgcaaaagatg

SEQ ID NO: 47863 - DNA, 103 bp, Artificial Sequence
  Synthetic Polynucleotide
taatacgactcactatagggaatgtctccataccccattcctttacaatgaacagaggagacattgtatgggaatggggaacctggcggcagcgcaaaagatg

SEQ ID NO: 47864 - DNA, 103 bp, Artificial Sequence
  Synthetic Polynucleotide
taatacgactcactatagggcaatgaatgtctccataccccattcctttaaacagaggagataaaggatgggggtatggaacctggcggcagcgcaaaagatg

SEQ ID NO: 47865 - DNA, 103 bp, Artificial Sequence
  Synthetic Polynucleotide
taatacgactcactataggggtcctcaatgaatgtctccataccccattcaacagaggagagaatggatgatggagacaaacctggcggcagcgcaaaagatg

SEQ ID NO: 47866 - DNA, 103 bp, Artificial Sequence
  Synthetic Polynucleotide
taatacgactcactatagggtcctcgtcctcaatgaatgtctccatacccaacagaggagagggtatatggacattcataacctggcggcagcgcaaaagatg

SEQ ID NO: 47867 - DNA, 103 bp, Artificial Sequence
  Synthetic Polynucleotide
taatacgactcactatagggtattatcctcgtcctcaatgaatgtctccaaacagaggagatggagaatgtcattgaggaacctggcggcagcgcaaaagatg

SEQ ID NO: 47868 - DNA, 103 bp, Artificial Sequence
  Synthetic Polynucleotide
taatacgactcactatagggtctaatattatcctcgtcctcaatgaatgtaacagaggagaacattcatggaggacgagaacctggcggcagcgcaaaagatg

SEQ ID NO: 47869 - DNA, 103 bp, Artificial Sequence
  Synthetic Polynucleotide
taatacgactcactataggggtaaatctaatattatcctcgtcctcaatgaacagaggagacattgaatgcgaggataaaacctggcggcagcgcaaaagatg

SEQ ID NO: 47870 - DNA, 103 bp, Artificial Sequence
  Synthetic Polynucleotide
taatacgactcactatagggtctgataatattgacgtagaattattgagaaacagaggagatctcaaatgttctacgtcaacctggcggcagcgcaaaagatg

SEQ ID NO: 47871 - DNA, 103 bp, Artificial Sequence
  Synthetic Polynucleotide
taatacgactcactatagggaaacagtaaatctaatattatcctcgtcctaacagaggagaaggacgatgataatattaaacctggcggcagcgcaaaagatg

SEQ ID NO: 47872 - DNA, 103 bp, Artificial Sequence
  Synthetic Polynucleotide
taatacgactcactatagggtagataaacagtaaatctaatattatcctcaacagaggagagaggatatgattagatttaacctggcggcagcgcaaaagatg

SEQ ID NO: 47873 - DNA, 103 bp, Artificial Sequence
  Synthetic Polynucleotide
taatacgactcactatagggaaatttagataaacagtaaatctaatattaaacagaggagataatatatgatttactgtaacctggcggcagcgcaaaagatg

SEQ ID NO: 47874 - DNA, 103 bp, Artificial Sequence
  Synthetic Polynucleotide
taatacgactcactatagggcaacgaaatttagataaacagtaaatctaaaacagaggagattagatatgctgtttatcaacctggcggcagcgcaaaagatg

SEQ ID NO: 47875 - DNA, 103 bp, Artificial Sequence
  Synthetic Polynucleotide
taatacgactcactatagggtggttcaacgaaatttagataaacagtaaaaacagaggagatttactatgtatctaaataacctggcggcagcgcaaaagatg

SEQ ID NO: 47876 - DNA, 103 bp, Artificial Sequence
  Synthetic Polynucleotide
taatacgactcactatagggtcctctggttcaacgaaatttagataaacaaacagaggagatgtttaatgaaatttcgtaacctggcggcagcgcaaaagatg

SEQ ID NO: 47877 - DNA, 103 bp, Artificial Sequence
  Synthetic Polynucleotide
taatacgactcactatagggtcaattcctctggttcaacgaaatttagataacagaggagaatctaaatgtcgttgaacaacctggcggcagcgcaaaagatg

SEQ ID NO: 47878 - DNA, 103 bp, Artificial Sequence
  Synthetic Polynucleotide
taatacgactcactatagggaagattcaattcctctggttcaacgaaattaacagaggagaaatttcatggaaccagagaacctggcggcagcgcaaaagatg

SEQ ID NO: 47879 - DNA, 103 bp, Artificial Sequence
  Synthetic Polynucleotide
taatacgactcactatagggttactaagattcaattcctctggttcaacgaacagaggagacgttgaatgagaggaattaacctggcggcagcgcaaaagatg

SEQ ID NO: 47880 - DNA, 103 bp, Artificial Sequence
  Synthetic Polynucleotide
taatacgactcactatagggtaaacttactaagattcaattcctctggttaacagaggagaaaccagatgaattgaatcaacctggcggcagcgcaaaagatg

SEQ ID NO: 47881 - DNA, 103 bp, Artificial Sequence
  Synthetic Polynucleotide
taatacgactcactatagggtagaatctgataatattgacgtagaattataacagaggagaataattatgcgtcaatataacctggcggcagcgcaaaagatg

SEQ ID NO: 47882 - DNA, 103 bp, Artificial Sequence
  Synthetic Polynucleotide
taatacgactcactatagggcatcataaacttactaagattcaattcctcaacagaggagagaggaaatgaatcttagtaacctggcggcagcgcaaaagatg

SEQ ID NO: 47883 - DNA, 103 bp, Artificial Sequence
  Synthetic Polynucleotide
taatacgactcactatagggagaaccatcataaacttactaagattcaataacagaggagaattgaaatgtagtaagttaacctggcggcagcgcaaaagatg

SEQ ID NO: 47884 - DNA, 103 bp, Artificial Sequence
  Synthetic Polynucleotide
taatacgactcactatagggccggaagaaccatcataaacttactaagataacagaggagaatcttaatgagtttatgaaacctggcggcagcgcaaaagatg

SEQ ID NO: 47885 - DNA, 103 bp, Artificial Sequence
  Synthetic Polynucleotide
taatacgactcactatagggggcacccggaagaaccatcataaacttactaacagaggagaagtaagatgatgatggttaacctggcggcagcgcaaaagatg

SEQ ID NO: 47886 - DNA, 103 bp, Artificial Sequence
  Synthetic Polynucleotide
taatacgactcactatagggttggcggcacccggaagaaccatcataaacaacagaggagagtttatatgggttcttccaacctggcggcagcgcaaaagatg

SEQ ID NO: 47887 - DNA, 103 bp, Artificial Sequence
  Synthetic Polynucleotide
taatacgactcactatagggccttgttggcggcacccggaagaaccatcaaacagaggagatgatggatgttccgggtgaacctggcggcagcgcaaaagatg

SEQ ID NO: 47888 - DNA, 103 bp, Artificial Sequence
  Synthetic Polynucleotide
taatacgactcactatagggcttgcccttgttggcggcacccggaagaacaacagaggagagttcttatgggtgccgccaacctggcggcagcgcaaaagatg

SEQ ID NO: 47889 - DNA, 103 bp, Artificial Sequence
  Synthetic Polynucleotide
taatacgactcactatagggctaatcttgcccttgttggcggcacccggaaacagaggagatccgggatgcgccaacaaaacctggcggcagcgcaaaagatg

SEQ ID NO: 47890 - DNA, 103 bp, Artificial Sequence
  Synthetic Polynucleotide
taatacgactcactatagggatttactaatcttgcccttgttggcggcacaacagaggagagtgccgatgacaagggcaaacctggcggcagcgcaaaagatg

SEQ ID NO: 47891 - DNA, 103 bp, Artificial Sequence
  Synthetic Polynucleotide
taatacgactcactatagggcttgaatttactaatcttgcccttgttggcaacagaggagagccaacatgggcaagattaacctggcggcagcgcaaaagatg

SEQ ID NO: 47892 - DNA, 103 bp, Artificial Sequence
  Synthetic Polynucleotide
taatacgactcactatagggatatatagaatctgataatattgacgtagaaacagaggagatctacgatgatattatcaaacctggcggcagcgcaaaagatg

SEQ ID NO: 47893 - DNA, 103 bp, Artificial Sequence
  Synthetic Polynucleotide
taatacgactcactatagggggaatcttgaatttactaatcttgcccttgaacagaggagacaagggatggattagtaaaacctggcggcagcgcaaaagatg

SEQ ID NO: 47894 - DNA, 103 bp, Artificial Sequence
  Synthetic Polynucleotide
taatacgactcactatagggagataggaatcttgaatttactaatcttgcaacagaggagagcaagaatggtaaattcaaacctggcggcagcgcaaaagatg

SEQ ID NO: 47895 - DNA, 103 bp, Artificial Sequence
  Synthetic Polynucleotide
taatacgactcactatagggatcagagataggaatcttgaatttactaataacagaggagaattagtatgttcaagattaacctggcggcagcgcaaaagatg

SEQ ID NO: 47896 - DNA, 103 bp, Artificial Sequence
  Synthetic Polynucleotide
taatacgactcactataggggtataatcagagataggaatcttgaatttaaacagaggagataaattatggattcctataacctggcggcagcgcaaaagatg

SEQ ID NO: 47897 - DNA, 103 bp, Artificial Sequence
  Synthetic Polynucleotide
taatacgactcactatagggaacctgtataatcagagataggaatcttgaaacagaggagatcaagaatgctatctctgaacctggcggcagcgcaaaagatg

SEQ ID NO: 47898 - DNA, 103 bp, Artificial Sequence
  Synthetic Polynucleotide
taatacgactcactataggggtcataacctgtataatcagagataggaataacagaggagaattcctatgtctgattataacctggcggcagcgcaaaagatg

SEQ ID NO: 47899 - DNA, 103 bp, Artificial Sequence
  Synthetic Polynucleotide
taatacgactcactatagggaaatcgtcataacctgtataatcagagataaacagaggagatatctcatgttatacaggaacctggcggcagcgcaaaagatg

SEQ ID NO: 47900 - DNA, 103 bp, Artificial Sequence
  Synthetic Polynucleotide
taatacgactcactataggggattgaaatcgtcataacctgtataatcagaacagaggagactgattatgcaggttatgaacctggcggcagcgcaaaagatg

SEQ ID NO: 47901 - DNA, 103 bp, Artificial Sequence
  Synthetic Polynucleotide
taatacgactcactatagggtgtttgattgaaatcgtcataacctgtataaacagaggagatatacaatgtatgacgataacctggcggcagcgcaaaagatg

SEQ ID NO: 47902 - DNA, 103 bp, Artificial Sequence
  Synthetic Polynucleotide
taatacgactcactatagggttttttgtttgattgaaatcgtcataacctaacagaggagaaggttaatgcgatttcaaaacctggcggcagcgcaaaagatg

SEQ ID NO: 47903 - DNA, 103 bp, Artificial Sequence
  Synthetic Polynucleotide
taatacgactcactatagggaatggcctcttcttgtgcccagttcagtccaacagaggagaggactgatgtgggcacaaaacctggcggcagcgcaaaagatg

SEQ ID NO: 47904 - DNA, 103 bp, Artificial Sequence
  Synthetic Polynucleotide
taatacgactcactatagggttcgaatatatagaatctgataatattgacaacagaggagagtcaatatgatcagattcaacctggcggcagcgcaaaagatg

SEQ ID NO: 47905 - DNA, 103 bp, Artificial Sequence
  Synthetic Polynucleotide
taatacgactcactatagggtgagcttttttgtttgattgaaatcgtcataacagaggagaatgacgatgtcaatcaaaaacctggcggcagcgcaaaagatg

SEQ ID NO: 47906 - DNA, 103 bp, Artificial Sequence
  Synthetic Polynucleotide
taatacgactcactatagggcttattgagcttttttgtttgattgaaatcaacagaggagagatttcatgcaaacaaaaaacctggcggcagcgcaaaagatg

SEQ ID NO: 47907 - DNA, 103 bp, Artificial Sequence
  Synthetic Polynucleotide
taatacgactcactataggggtcatcttattgagcttttttgtttgattgaacagaggagacaatcaatgaaaaaagctaacctggcggcagcgcaaaagatg

SEQ ID NO: 47908 - DNA, 103 bp, Artificial Sequence
  Synthetic Polynucleotide
taatacgactcactatagggctacagtcatcttattgagcttttttgtttaacagaggagaaaacaaatgagctcaataaacctggcggcagcgcaaaagatg

SEQ ID NO: 47909 - DNA, 103 bp, Artificial Sequence
  Synthetic Polynucleotide
taatacgactcactataggggagttctacagtcatcttattgagctttttaacagaggagaaaaaagatgaataagatgaacctggcggcagcgcaaaagatg

SEQ ID NO: 47910 - DNA, 103 bp, Artificial Sequence
  Synthetic Polynucleotide
taatacgactcactatagggttcatgagttctacagtcatcttattgagcaacagaggagagctcaaatggatgactgtaacctggcggcagcgcaaaagatg

SEQ ID NO: 47911 - DNA, 103 bp, Artificial Sequence
  Synthetic Polynucleotide
taatacgactcactatagggttagattcatgagttctacagtcatcttataacagaggagaataagaatgctgtagaacaacctggcggcagcgcaaaagatg

SEQ ID NO: 47912 - DNA, 103 bp, Artificial Sequence
  Synthetic Polynucleotide
taatacgactcactatagggttcttttagattcatgagttctacagtcataacagaggagaatgactatggaactcatgaacctggcggcagcgcaaaagatg

SEQ ID NO: 47913 - DNA, 103 bp, Artificial Sequence
  Synthetic Polynucleotide
taatacgactcactatagggcccaattcttttagattcatgagttctacaaacagaggagatgtagaatgcatgaatctaacctggcggcagcgcaaaagatg

SEQ ID NO: 47914 - DNA, 103 bp, Artificial Sequence
  Synthetic Polynucleotide
taatacgactcactatagggaagaacccaattcttttagattcatgagttaacagaggagaaactcaatgatctaaaagaacctggcggcagcgcaaaagatg

SEQ ID NO: 47915 - DNA, 103 bp, Artificial Sequence
  Synthetic Polynucleotide
taatacgactcactatagggatatattcgaatatatagaatctgataataaacagaggagatattatatgattctatataacctggcggcagcgcaaaagatg

SEQ ID NO: 47916 - DNA, 103 bp, Artificial Sequence
  Synthetic Polynucleotide
taatacgactcactatagggatcgaaagaacccaattcttttagattcataacagaggagaatgaatatgaaagaattgaacctggcggcagcgcaaaagatg

SEQ ID NO: 47917 - DNA, 103 bp, Artificial Sequence
  Synthetic Polynucleotide
taatacgactcactatagggtccaaatcgaaagaacccaattcttttagaaacagaggagatctaaaatgattgggttcaacctggcggcagcgcaaaagatg

SEQ ID NO: 47918 - DNA, 103 bp, Artificial Sequence
  Synthetic Polynucleotide
taatacgactcactatagggcgttctccaaatcgaaagaacccaattcttaacagaggagaaagaatatggttctttcgaacctggcggcagcgcaaaagatg

SEQ ID NO: 47919 - DNA, 103 bp, Artificial Sequence
  Synthetic Polynucleotide
taatacgactcactataggggttaacgttctccaaatcgaaagaacccaaaacagaggagattgggtatgttcgatttgaacctggcggcagcgcaaaagatg

SEQ ID NO: 47920 - DNA, 103 bp, Artificial Sequence
  Synthetic Polynucleotide
taatacgactcactatagggtacacgttaacgttctccaaatcgaaagaaaacagaggagattctttatgtttggagaaaacctggcggcagcgcaaaagatg

SEQ ID NO: 47921 - DNA, 103 bp, Artificial Sequence
  Synthetic Polynucleotide
taatacgactcactatagggcaggatacacgttaacgttctccaaatcgaaacagaggagatcgattatgagaacgttaaacctggcggcagcgcaaaagatg

SEQ ID NO: 47922 - DNA, 103 bp, Artificial Sequence
  Synthetic Polynucleotide
taatacgactcactatagggtactccaggatacacgttaacgttctccaaaacagaggagattggagatggttaacgtgaacctggcggcagcgcaaaagatg

SEQ ID NO: 47923 - DNA, 103 bp, Artificial Sequence
  Synthetic Polynucleotide
taatacgactcactatagggttccatactccaggatacacgttaacgttcaacagaggagagaacgtatgcgtgtatccaacctggcggcagcgcaaaagatg

SEQ ID NO: 47924 - DNA, 103 bp, Artificial Sequence
  Synthetic Polynucleotide
taatacgactcactatagggatgtattccatactccaggatacacgttaaaacagaggagattaacgatgatcctggagaacctggcggcagcgcaaaagatg

SEQ ID NO: 47925 - DNA, 103 bp, Artificial Sequence
  Synthetic Polynucleotide
taatacgactcactatagggatcgtatgtattccatactccaggatacacaacagaggagagtgtatatgggagtatggaacctggcggcagcgcaaaagatg

SEQ ID NO: 47926 - DNA, 103 bp, Artificial Sequence
  Synthetic Polynucleotide
taatacgactcactatagggctttgatatattcgaatatatagaatctgaaacagaggagatcagatatgatatattcgaacctggcggcagcgcaaaagatg

SEQ ID NO: 47927 - DNA, 103 bp, Artificial Sequence
  Synthetic Polynucleotide
taatacgactcactatagggaagatatcgtatgtattccatactccaggaaacagaggagatcctggatgatggaatacaacctggcggcagcgcaaaagatg

SEQ ID NO: 47928 - DNA, 103 bp, Artificial Sequence
  Synthetic Polynucleotide
taatacgactcactatagggtaccgaagatatcgtatgtattccatactcaacagaggagagagtatatgatacatacgaacctggcggcagcgcaaaagatg

SEQ ID NO: 47929 - DNA, 103 bp, Artificial Sequence
  Synthetic Polynucleotide
taatacgactcactatagggctcgataccgaagatatcgtatgtattccaaacagaggagatggaatatgtacgatatcaacctggcggcagcgcaaaagatg

SEQ ID NO: 47930 - DNA, 103 bp, Artificial Sequence
  Synthetic Polynucleotide
taatacgactcactataggggcggcctcgataccgaagatatcgtatgtaaacagaggagatacataatgtatcttcggaacctggcggcagcgcaaaagatg

SEQ ID NO: 47931 - DNA, 103 bp, Artificial Sequence
  Synthetic Polynucleotide
taatacgactcactatagggcacgagcggcctcgataccgaagatatcgtaacagaggagaacgataatgtcggtatcgaacctggcggcagcgcaaaagatg

SEQ ID NO: 47932 - DNA, 103 bp, Artificial Sequence
  Synthetic Polynucleotide
taatacgactcactataggggtatccacgagcggcctcgataccgaagataacagaggagaatcttcatgatcgaggccaacctggcggcagcgcaaaagatg

SEQ ID NO: 47933 - DNA, 103 bp, Artificial Sequence
  Synthetic Polynucleotide
taatacgactcactatagggcataagtatccacgagcggcctcgataccgaacagaggagacggtatatgggccgctcgaacctggcggcagcgcaaaagatg

SEQ ID NO: 47934 - DNA, 103 bp, Artificial Sequence
  Synthetic Polynucleotide
taatacgactcactatagggcttcgcataagtatccacgagcggcctcgaaacagaggagatcgaggatgctcgtggataacctggcggcagcgcaaaagatg

SEQ ID NO: 47935 - DNA, 103 bp, Artificial Sequence
  Synthetic Polynucleotide
taatacgactcactatagggcatggcttcgcataagtatccacgagcggcaacagaggagagccgctatgggatacttaaacctggcggcagcgcaaaagatg

SEQ ID NO: 47936 - DNA, 103 bp, Artificial Sequence
  Synthetic Polynucleotide
taatacgactcactatagggtttaacatggcttcgcataagtatccacgaaacagaggagatcgtggatgcttatgcgaaacctggcggcagcgcaaaagatg

SEQ ID NO: 47937 - DNA, 103 bp, Artificial Sequence
  Synthetic Polynucleotide
taatacgactcactatagggaatgactttgatatattcgaatatatagaaaacagaggagattctatatgttcgaatataacctggcggcagcgcaaaagatg

SEQ ID NO: 47938 - DNA, 103 bp, Artificial Sequence
  Synthetic Polynucleotide
taatacgactcactatagggaggtgtttaacatggcttcgcataagtatcaacagaggagagatactatggcgaagccaaacctggcggcagcgcaaaagatg

SEQ ID NO: 47939 - DNA, 103 bp, Artificial Sequence
  Synthetic Polynucleotide
taatacgactcactatagggtccataggtgtttaacatggcttcgcataaaacagaggagattatgcatggccatgttaaacctggcggcagcgcaaaagatg

SEQ ID NO: 47940 - DNA, 103 bp, Artificial Sequence
  Synthetic Polynucleotide
taatacgactcactatagggccttctccataggtgtttaacatggcttcgaacagaggagacgaagcatggttaaacacaacctggcggcagcgcaaaagatg

SEQ ID NO: 47941 - DNA, 103 bp, Artificial Sequence
  Synthetic Polynucleotide
taatacgactcactatagggcgaaaccttctccataggtgtttaacatggaacagaggagaccatgtatgacacctatgaacctggcggcagcgcaaaagatg

SEQ ID NO: 47942 - DNA, 103 bp, Artificial Sequence
  Synthetic Polynucleotide
taatacgactcactatagggataatcgaaaccttctccataggtgtttaaaacagaggagattaaacatgtatggagaaaacctggcggcagcgcaaaagatg

SEQ ID NO: 47943 - DNA, 103 bp, Artificial Sequence
  Synthetic Polynucleotide
taatacgactcactatagggtacagataatcgaaaccttctccataggtgaacagaggagacacctaatgagaaggtttaacctggcggcagcgcaaaagatg

SEQ ID NO: 47944 - DNA, 103 bp, Artificial Sequence
  Synthetic Polynucleotide
taatacgactcactataggggctgatacagataatcgaaaccttctccataacagaggagaatggagatggtttcgattaacctggcggcagcgcaaaagatg

SEQ ID NO: 47945 - DNA, 103 bp, Artificial Sequence
  Synthetic Polynucleotide
taatacgactcactatagggacaaggctgatacagataatcgaaaccttcaacagaggagagaaggtatggattatctgaacctggcggcagcgcaaaagatg

SEQ ID NO: 47946 - DNA, 103 bp, Artificial Sequence
  Synthetic Polynucleotide
taatacgactcactatagggagatcacaaggctgatacagataatcgaaaaacagaggagatttcgaatgtctgtatcaaacctggcggcagcgcaaaagatg

SEQ ID NO: 47947 - DNA, 103 bp, Artificial Sequence
  Synthetic Polynucleotide
taatacgactcactatagggcgagaagatcacaaggctgatacagataataacagaggagaattatcatgatcagccttaacctggcggcagcgcaaaagatg

SEQ ID NO: 47948 - DNA, 103 bp, Artificial Sequence
  Synthetic Polynucleotide
taatacgactcactatagggatatcaatgactttgatatattcgaatataaacagaggagatatattatgatatatcaaaacctggcggcagcgcaaaagatg

SEQ ID NO: 47949 - DNA, 103 bp, Artificial Sequence
  Synthetic Polynucleotide
taatacgactcactatagggactagcgagaagatcacaaggctgatacagaacagaggagactgtatatgccttgtgataacctggcggcagcgcaaaagatg

SEQ ID NO: 47950 - DNA, 103 bp, Artificial Sequence
  Synthetic Polynucleotide
taatacgactcactatagggagtaaactagcgagaagatcacaaggctgaaacagaggagatcagccatgtgatcttctaacctggcggcagcgcaaaagatg

SEQ ID NO: 47951 - DNA, 103 bp, Artificial Sequence
  Synthetic Polynucleotide
taatacgactcactatagggcacatagtaaactagcgagaagatcacaagaacagaggagacttgtgatgttctcgctaaacctggcggcagcgcaaaagatg

SEQ ID NO: 47952 - DNA, 103 bp, Artificial Sequence
  Synthetic Polynucleotide
taatacgactcactatagggactagcacatagtaaactagcgagaagatcaacagaggagagatcttatggctagtttaaacctggcggcagcgcaaaagatg

SEQ ID NO: 47953 - DNA, 103 bp, Artificial Sequence
  Synthetic Polynucleotide
taatacgactcactatagggtcgtaactagcacatagtaaactagcgagaaacagaggagatctcgcatgtttactatgaacctggcggcagcgcaaaagatg

SEQ ID NO: 47954 - DNA, 103 bp, Artificial Sequence
  Synthetic Polynucleotide
taatacgactcactatagggctggttcgtaactagcacatagtaaactagaacagaggagactagttatgtatgtgctaaacctggcggcagcgcaaaagatg

SEQ ID NO: 47955 - DNA, 103 bp, Artificial Sequence
  Synthetic Polynucleotide
taatacgactcactatagggtgattctggttcgtaactagcacatagtaaaacagaggagattactaatggctagttacaacctggcggcagcgcaaaagatg

SEQ ID NO: 47956 - DNA, 103 bp, Artificial Sequence
  Synthetic Polynucleotide
taatacgactcactatagggttaactgattctggttcgtaactagcacataacagaggagaatgtgcatgttacgaaccaacctggcggcagcgcaaaagatg

SEQ ID NO: 47957 - DNA, 103 bp, Artificial Sequence
  Synthetic Polynucleotide
taatacgactcactatagggatttattaactgattctggttcgtaactagaacagaggagactagttatgaaccagaataacctggcggcagcgcaaaagatg

SEQ ID NO: 47958 - DNA, 103 bp, Artificial Sequence
  Synthetic Polynucleotide
taatacgactcactatagggcttgaatttattaactgattctggttcgtaaacagaggagatacgaaatggaatcagttaacctggcggcagcgcaaaagatg

SEQ ID NO: 47959 - DNA, 103 bp, Artificial Sequence
  Synthetic Polynucleotide
taatacgactcactatagggtaaaaatatcaatgactttgatatattcgaaacagaggagatcgaatatgtcaaagtcaaacctggcggcagcgcaaaagatg

SEQ ID NO: 47960 - DNA, 103 bp, Artificial Sequence
  Synthetic Polynucleotide
taatacgactcactatagggccgaacttgaatttattaactgattctggtaacagaggagaaccagaatgagttaataaaacctggcggcagcgcaaaagatg

SEQ ID NO: 47961 - DNA, 103 bp, Artificial Sequence
  Synthetic Polynucleotide
taatacgactcactatagggctgcgccgaacttgaatttattaactgattaacagaggagaaatcagatgataaattcaaacctggcggcagcgcaaaagatg

SEQ ID NO: 47962 - DNA, 103 bp, Artificial Sequence
  Synthetic Polynucleotide
taatacgactcactatagggactagctgcgccgaacttgaatttattaacaacagaggagagttaatatgttcaagttcaacctggcggcagcgcaaaagatg

SEQ ID NO: 47963 - DNA, 103 bp, Artificial Sequence
  Synthetic Polynucleotide
taatacgactcactatagggagagtactagctgcgccgaacttgaatttaaacagaggagataaattatggttcggcgcaacctggcggcagcgcaaaagatg

SEQ ID NO: 47964 - DNA, 103 bp, Artificial Sequence
  Synthetic Polynucleotide
taatacgactcactatagggtcttaagagtactagctgcgccgaacttgaaacagaggagatcaagtatggcgcagctaaacctggcggcagcgcaaaagatg

SEQ ID NO: 47965 - DNA, 103 bp, Artificial Sequence
  Synthetic Polynucleotide
taatacgactcactatagggagctctcttaagagtactagctgcgccgaaaacagaggagattcggcatggctagtactaacctggcggcagcgcaaaagatg

SEQ ID NO: 47966 - DNA, 103 bp, Artificial Sequence
  Synthetic Polynucleotide
taatacgactcactatagggaacgtagctctcttaagagtactagctgcgaacagaggagacgcagcatgtactcttaaaacctggcggcagcgcaaaagatg

SEQ ID NO: 47967 - DNA, 103 bp, Artificial Sequence
  Synthetic Polynucleotide
taatacgactcactatagggctccaaacgtagctctcttaagagtactagaacagaggagactagtaatgttaagagagaacctggcggcagcgcaaaagatg

SEQ ID NO: 47968 - DNA, 103 bp, Artificial Sequence
  Synthetic Polynucleotide
taatacgactcactatagggattgtctccaaacgtagctctcttaagagtaacagaggagaactcttatgagagctacgaacctggcggcagcgcaaaagatg

SEQ ID NO: 47969 - DNA, 103 bp, Artificial Sequence
  Synthetic Polynucleotide
taatacgactcactataggggctttattgtctccaaacgtagctctcttaaacagaggagataagagatgtacgtttggaacctggcggcagcgcaaaagatg

SEQ ID NO: 47970 - DNA, 103 bp, Artificial Sequence
  Synthetic Polynucleotide
taatacgactcactatagggaattataaaaatatcaatgactttgatataaacagaggagatatatcatggtcattgataacctggcggcagcgcaaaagatg

SEQ ID NO: 47971 - DNA, 103 bp, Artificial Sequence
  Synthetic Polynucleotide
taatacgactcactatagggacaatgctttattgtctccaaacgtagctcaacagaggagagagctaatgttggagacaaacctggcggcagcgcaaaagatg

SEQ ID NO: 47972 - DNA, 103 bp, Artificial Sequence
  Synthetic Polynucleotide
taatacgactcactataggggtttaacaatgctttattgtctccaaacgtaacagaggagaacgtttatggacaataaaaacctggcggcagcgcaaaagatg

SEQ ID NO: 47973 - DNA, 103 bp, Artificial Sequence
  Synthetic Polynucleotide
taatacgactcactataggggccgcgtttaacaatgctttattgtctccaaacagaggagatggagaatgtaaagcattaacctggcggcagcgcaaaagatg

SEQ ID NO: 47974 - DNA, 103 bp, Artificial Sequence
  Synthetic Polynucleotide
taatacgactcactataggggaagagccgcgtttaacaatgctttattgtaacagaggagaacaataatgcattgttaaaacctggcggcagcgcaaaagatg

SEQ ID NO: 47975 - DNA, 103 bp, Artificial Sequence
  Synthetic Polynucleotide
taatacgactcactatagggtttatgaagagccgcgtttaacaatgctttaacagaggagaaaagcaatgttaaacgcgaacctggcggcagcgcaaaagatg

SEQ ID NO: 47976 - DNA, 103 bp, Artificial Sequence
  Synthetic Polynucleotide
taatacgactcactataggggactttttatgaagagccgcgtttaacaataacagaggagaattgttatgcgcggctctaacctggcggcagcgcaaaagatg

SEQ ID NO: 47977 - DNA, 103 bp, Artificial Sequence
  Synthetic Polynucleotide
taatacgactcactataggggttctgactttttatgaagagccgcgtttaaacagaggagataaacgatgctcttcataaacctggcggcagcgcaaaagatg

SEQ ID NO: 47978 - DNA, 103 bp, Artificial Sequence
  Synthetic Polynucleotide
taatacgactcactatagggaataggttctgactttttatgaagagccgcaacagaggagagcggctatgcataaaaagaacctggcggcagcgcaaaagatg

SEQ ID NO: 47979 - DNA, 103 bp, Artificial Sequence
  Synthetic Polynucleotide
taatacgactcactatagggtcgttaataggttctgactttttatgaagaaacagaggagatcttcaatgaaagtcagaaacctggcggcagcgcaaaagatg

SEQ ID NO: 47980 - DNA, 103 bp, Artificial Sequence
  Synthetic Polynucleotide
taatacgactcactatagggtattatcgttaataggttctgactttttataacagaggagaataaaaatgcagaacctaaacctggcggcagcgcaaaagatg

SEQ ID NO: 47981 - DNA, 103 bp, Artificial Sequence
  Synthetic Polynucleotide
taatacgactcactatagggctaccaattataaaaatatcaatgactttgaacagaggagacaaagtatgtgatattttaacctggcggcagcgcaaaagatg

SEQ ID NO: 47982 - DNA, 103 bp, Artificial Sequence
  Synthetic Polynucleotide
taatacgactcactataggggctactattatcgttaataggttctgacttaacagaggagaaagtcaatgcctattaacaacctggcggcagcgcaaaagatg

SEQ ID NO: 47983 - DNA, 103 bp, Artificial Sequence
  Synthetic Polynucleotide
taatacgactcactatagggtggcagctactattatcgttaataggttctaacagaggagaagaaccatgtaacgataaaacctggcggcagcgcaaaagatg

SEQ ID NO: 47984 - DNA, 103 bp, Artificial Sequence
  Synthetic Polynucleotide
taatacgactcactatagggaaaagtggcagctactattatcgttaatagaacagaggagactattaatgataatagtaaacctggcggcagcgcaaaagatg

SEQ ID NO: 47985 - DNA, 103 bp, Artificial Sequence
  Synthetic Polynucleotide
taatacgactcactataggggctaaaaaagtggcagctactattatcgttaacagaggagaaacgatatgagtagctgcaacctggcggcagcgcaaaagatg

SEQ ID NO: 47986 - DNA, 103 bp, Artificial Sequence
  Synthetic Polynucleotide
taatacgactcactatagggaccttgctaaaaaagtggcagctactattaaacagaggagataatagatgctgccacttaacctggcggcagcgcaaaagatg

SEQ ID NO: 47987 - DNA, 103 bp, Artificial Sequence
  Synthetic Polynucleotide
taatacgactcactatagggtagggaccttgctaaaaaagtggcagctacaacagaggagagtagctatgacttttttaaacctggcggcagcgcaaaagatg

SEQ ID NO: 47988 - DNA, 103 bp, Artificial Sequence
  Synthetic Polynucleotide
taatacgactcactatagggtatattagggaccttgctaaaaaagtggcaaacagaggagatgccacatgtttagcaagaacctggcggcagcgcaaaagatg

SEQ ID NO: 47989 - DNA, 103 bp, Artificial Sequence
  Synthetic Polynucleotide
taatacgactcactataggggttcctatattagggaccttgctaaaaaagaacagaggagactttttatgcaaggtcccaacctggcggcagcgcaaaagatg

SEQ ID NO: 47990 - DNA, 103 bp, Artificial Sequence
  Synthetic Polynucleotide
taatacgactcactatagggatccagttcctatattagggaccttgctaaaacagaggagattagcaatgtccctaataaacctggcggcagcgcaaaagatg

SEQ ID NO: 47991 - DNA, 103 bp, Artificial Sequence
  Synthetic Polynucleotide
taatacgactcactataggggtaatatccagttcctatattagggaccttaacagaggagaaaggtcatgaatataggaaacctggcggcagcgcaaaagatg

SEQ ID NO: 47992 - DNA, 103 bp, Artificial Sequence
  Synthetic Polynucleotide
taatacgactcactataggggtcttctaccaattataaaaatatcaatgaaacagaggagatcattgatgtttttataaaacctggcggcagcgcaaaagatg

SEQ ID NO: 47993 - DNA, 103 bp, Artificial Sequence
  Synthetic Polynucleotide
taatacgactcactatagggtatttgtaatatccagttcctatattagggaacagaggagaccctaaatgaggaactggaacctggcggcagcgcaaaagatg

SEQ ID NO: 47994 - DNA, 103 bp, Artificial Sequence
  Synthetic Polynucleotide
taatacgactcactatagggtaaagtatttgtaatatccagttcctatataacagaggagaatatagatgctggatattaacctggcggcagcgcaaaagatg

SEQ ID NO: 47995 - DNA, 103 bp, Artificial Sequence
  Synthetic Polynucleotide
taatacgactcactataggggtcgataaagtatttgtaatatccagttccaacagaggagaggaactatgtattacaaaaacctggcggcagcgcaaaagatg

SEQ ID NO: 47996 - DNA, 103 bp, Artificial Sequence
  Synthetic Polynucleotide
taatacgactcactatagggcccaagtcgataaagtatttgtaatatccaaacagaggagatggataatgcaaatacttaacctggcggcagcgcaaaagatg

SEQ ID NO: 47997 - DNA, 103 bp, Artificial Sequence
  Synthetic Polynucleotide
taatacgactcactataggggaagacccaagtcgataaagtatttgtaataacagaggagaattacaatgactttatcgaacctggcggcagcgcaaaagatg

SEQ ID NO: 47998 - DNA, 103 bp, Artificial Sequence
  Synthetic Polynucleotide
taatacgactcactatagggcatgagaagacccaagtcgataaagtatttaacagaggagaaaatacatgatcgacttgaacctggcggcagcgcaaaagatg

SEQ ID NO: 47999 - DNA, 103 bp, Artificial Sequence
  Synthetic Polynucleotide
taatacgactcactatagggattctcatgagaagacccaagtcgataaagaacagaggagactttatatgcttgggtctaacctggcggcagcgcaaaagatg

SEQ ID NO: 48000 - DNA, 103 bp, Artificial Sequence
  Synthetic Polynucleotide
taatacgactcactatagggtttccattctcatgagaagacccaagtcgaaacagaggagatcgactatggtcttctcaaacctggcggcagcgcaaaagatg

SEQ ID NO: 48001 - DNA, 103 bp, Artificial Sequence
  Synthetic Polynucleotide
taatacgactcactatagggtttcctttccattctcatgagaagacccaaaacagaggagattgggtatgctcatgagaaacctggcggcagcgcaaaagatg

SEQ ID NO: 48002 - DNA, 103 bp, Artificial Sequence
  Synthetic Polynucleotide
taatacgactcactataggggatagtttcctttccattctcatgagaagaaacagaggagatcttctatggagaatggaaacctggcggcagcgcaaaagatg

SEQ ID NO: 48003 - DNA, 103 bp, Artificial Sequence
  Synthetic Polynucleotide
taatacgactcactatagggttattgtcttctaccaattataaaaatatcaacagaggagagatattatgataattggtaacctggcggcagcgcaaaagatg

SEQ ID NO: 48004 - DNA, 103 bp, Artificial Sequence
  Synthetic Polynucleotide
taatacgactcactatagggtatcagatagtttcctttccattctcatgaaacagaggagatcatgaatgtggaaaggaaacctggcggcagcgcaaaagatg

SEQ ID NO: 48005 - DNA, 103 bp, Artificial Sequence
  Synthetic Polynucleotide
taatacgactcactatagggtatcttatcagatagtttcctttccattctaacagaggagaagaatgatgaggaaactaaacctggcggcagcgcaaaagatg

SEQ ID NO: 48006 - DNA, 103 bp, Artificial Sequence
  Synthetic Polynucleotide
taatacgactcactataggggaagatatcttatcagatagtttcctttccaacagaggagaggaaagatgactatctgaaacctggcggcagcgcaaaagatg

SEQ ID NO: 48007 - DNA, 103 bp, Artificial Sequence
  Synthetic Polynucleotide
taatacgactcactatagggtttgagaagatatcttatcagatagtttccaacagaggagaggaaacatgctgataagaaacctggcggcagcgcaaaagatg

SEQ ID NO: 48008 - DNA, 103 bp, Artificial Sequence
  Synthetic Polynucleotide
taatacgactcactatagggaatcttttgagaagatatcttatcagatagaacagaggagactatctatgaagatatctaacctggcggcagcgcaaaagatg

SEQ ID NO: 48009 - DNA, 103 bp, Artificial Sequence
  Synthetic Polynucleotide
taatacgactcactatagggtccttaatcttttgagaagatatcttatcaaacagaggagatgataaatgatcttctcaaacctggcggcagcgcaaaagatg

SEQ ID NO: 48010 - DNA, 103 bp, Artificial Sequence
  Synthetic Polynucleotide
taatacgactcactatagggccatctccttaatcttttgagaagatatctaacagaggagaagatatatgctcaaaagaaacctggcggcagcgcaaaagatg

SEQ ID NO: 48011 - DNA, 103 bp, Artificial Sequence
  Synthetic Polynucleotide
taatacgactcactatagggttcttccatctccttaatcttttgagaagaaacagaggagatcttctatgaagattaagaacctggcggcagcgcaaaagatg

SEQ ID NO: 48012 - DNA, 103 bp, Artificial Sequence
  Synthetic Polynucleotide
taatacgactcactatagggtctgtttcttccatctccttaatcttttgaaacagaggagatcaaaaatgtaaggagataacctggcggcagcgcaaaagatg

SEQ ID NO: 48013 - DNA, 103 bp, Artificial Sequence
  Synthetic Polynucleotide
taatacgactcactatagggagtcttctgtttcttccatctccttaatctaacagaggagaagattaatgagatggaagaacctggcggcagcgcaaaagatg

SEQ ID NO: 48014 - DNA, 103 bp, Artificial Sequence
  Synthetic Polynucleotide
taatacgactcactatagggttcacaatggcctcttcttgtgcccagttcaacagaggagagaactgatgacaagaagaaacctggcggcagcgcaaaagatg

SEQ ID NO: 48015 - DNA, 103 bp, Artificial Sequence
  Synthetic Polynucleotide
taatacgactcactatagggtgtcattattgtcttctaccaattataaaaaacagaggagattttatatgtggtagaagaacctggcggcagcgcaaaagatg

SEQ ID NO: 48016 - DNA, 103 bp, Artificial Sequence
  Synthetic Polynucleotide
taatacgactcactatagggttaaaagtcttctgtttcttccatctccttaacagaggagaaaggagatggaagaaacaaacctggcggcagcgcaaaagatg

SEQ ID NO: 48017 - DNA, 103 bp, Artificial Sequence
  Synthetic Polynucleotide
taatacgactcactatagggaagaattaaaagtcttctgtttcttccatcaacagaggagagatggaatgaacagaagaaacctggcggcagcgcaaaagatg

SEQ ID NO: 48018 - DNA, 103 bp, Artificial Sequence
  Synthetic Polynucleotide
taatacgactcactatagggttgataagaattaaaagtcttctgtttcttaacagaggagaaagaaaatgaagacttttaacctggcggcagcgcaaaagatg

SEQ ID NO: 48019 - DNA, 103 bp, Artificial Sequence
  Synthetic Polynucleotide
taatacgactcactatagggtgttattgataagaattaaaagtcttctgtaacagaggagaacagaaatgttttaattcaacctggcggcagcgcaaaagatg

SEQ ID NO: 48020 - DNA, 103 bp, Artificial Sequence
  Synthetic Polynucleotide
taatacgactcactatagggaaatatgttattgataagaattaaaagtctaacagaggagaagacttatgattcttatcaacctggcggcagcgcaaaagatg

SEQ ID NO: 48021 - DNA, 103 bp, Artificial Sequence
  Synthetic Polynucleotide
taatacgactcactatagggtagaaaaatatgttattgataagaattaaaaacagaggagatttaatatgtatcaataaaacctggcggcagcgcaaaagatg

SEQ ID NO: 48022 - DNA, 103 bp, Artificial Sequence
  Synthetic Polynucleotide
taatacgactcactataggggatcatagaaaaatatgttattgataagaaaacagaggagattcttaatgataacatataacctggcggcagcgcaaaagatg

SEQ ID NO: 48023 - DNA, 103 bp, Artificial Sequence
  Synthetic Polynucleotide
taatacgactcactatagggagacagatcatagaaaaatatgttattgataacagaggagaatcaatatgatatttttcaacctggcggcagcgcaaaagatg

SEQ ID NO: 48024 - DNA, 103 bp, Artificial Sequence
  Synthetic Polynucleotide
taatacgactcactatagggttaaaagacagatcatagaaaaatatgttaaacagaggagataacatatgtttctatgaaacctggcggcagcgcaaaagatg

SEQ ID NO: 48025 - DNA, 103 bp, Artificial Sequence
  Synthetic Polynucleotide
taatacgactcactatagggatcgtttaaaagacagatcatagaaaaataaacagaggagatattttatgatgatctgtaacctggcggcagcgcaaaagatg

SEQ ID NO: 48026 - DNA, 103 bp, Artificial Sequence
  Synthetic Polynucleotide
taatacgactcactatagggtgtggtgtcattattgtcttctaccaattaaacagaggagataattgatggaagacaataacctggcggcagcgcaaaagatg

SEQ ID NO: 48027 - DNA, 103 bp, Artificial Sequence
  Synthetic Polynucleotide
taatacgactcactatagggaatccatcgtttaaaagacagatcatagaaaacagaggagattctatatgctgtcttttaacctggcggcagcgcaaaagatg

SEQ ID NO: 48028 - DNA, 103 bp, Artificial Sequence
  Synthetic Polynucleotide
taatacgactcactatagggtggaaaatccatcgtttaaaagacagatcaaacagaggagatgatctatgttttaaacgaacctggcggcagcgcaaaagatg

SEQ ID NO: 48029 - DNA, 103 bp, Artificial Sequence
  Synthetic Polynucleotide
taatacgactcactatagggatttgtggaaaatccatcgtttaaaagacaaacagaggagatgtcttatgaacgatggaaacctggcggcagcgcaaaagatg

SEQ ID NO: 48030 - DNA, 103 bp, Artificial Sequence
  Synthetic Polynucleotide
taatacgactcactatagggggcgcatttgtggaaaatccatcgtttaaaaacagaggagatttaaaatgtggattttcaacctggcggcagcgcaaaagatg

SEQ ID NO: 48031 - DNA, 103 bp, Artificial Sequence
  Synthetic Polynucleotide
taatacgactcactatagggtgagaggcgcatttgtggaaaatccatcgtaacagaggagaacgatgatgtttccacaaaacctggcggcagcgcaaaagatg

SEQ ID NO: 48032 - DNA, 103 bp, Artificial Sequence
  Synthetic Polynucleotide
taatacgactcactatagggggacttgagaggcgcatttgtggaaaatccaacagaggagaggatttatgacaaatgcgaacctggcggcagcgcaaaagatg

SEQ ID NO: 48033 - DNA, 103 bp, Artificial Sequence
  Synthetic Polynucleotide
taatacgactcactatagggatgagggacttgagaggcgcatttgtggaaaacagaggagattccacatgtgcgcctctaacctggcggcagcgcaaaagatg

SEQ ID NO: 48034 - DNA, 103 bp, Artificial Sequence
  Synthetic Polynucleotide
taatacgactcactatagggattctatgagggacttgagaggcgcatttgaacagaggagacaaatgatgctctcaagtaacctggcggcagcgcaaaagatg

SEQ ID NO: 48035 - DNA, 103 bp, Artificial Sequence
  Synthetic Polynucleotide
taatacgactcactataggggtatcattctatgagggacttgagaggcgcaacagaggagagcgcctatgaagtccctcaacctggcggcagcgcaaaagatg

SEQ ID NO: 48036 - DNA, 103 bp, Artificial Sequence
  Synthetic Polynucleotide
taatacgactcactatagggtacgtgtatcattctatgagggacttgagaaacagaggagatctcaaatgcctcatagaaacctggcggcagcgcaaaagatg

SEQ ID NO: 48037 - DNA, 103 bp, Artificial Sequence
  Synthetic Polynucleotide
taatacgactcactataggggatgttgtggtgtcattattgtcttctaccaacagaggagaggtagaatgcaataatgaaacctggcggcagcgcaaaagatg

SEQ ID NO: 48038 - DNA, 103 bp, Artificial Sequence
  Synthetic Polynucleotide
taatacgactcactatagggttttatacgtgtatcattctatgagggactaacagaggagaagtcccatgtagaatgataacctggcggcagcgcaaaagatg

SEQ ID NO: 48039 - DNA, 103 bp, Artificial Sequence
  Synthetic Polynucleotide
taatacgactcactatagggatattttttatacgtgtatcattctatgagaacagaggagactcataatgtgatacacgaacctggcggcagcgcaaaagatg

SEQ ID NO: 48040 - DNA, 103 bp, Artificial Sequence
  Synthetic Polynucleotide
taatacgactcactatagggatgttatattttttatacgtgtatcattctaacagaggagaagaatgatgcacgtataaaacctggcggcagcgcaaaagatg

SEQ ID NO: 48041 - DNA, 103 bp, Artificial Sequence
  Synthetic Polynucleotide
taatacgactcactatagggcacctatgttatattttttatacgtgtatcaacagaggagagatacaatgataaaaaataacctggcggcagcgcaaaagatg

SEQ ID NO: 48042 - DNA, 103 bp, Artificial Sequence
  Synthetic Polynucleotide
taatacgactcactataggggtcatcacctatgttatattttttatacgtaacagaggagaacgtatatgaaatataacaacctggcggcagcgcaaaagatg

SEQ ID NO: 48043 - DNA, 103 bp, Artificial Sequence
  Synthetic Polynucleotide
taatacgactcactatagggaaggagtcatcacctatgttatattttttaaacagaggagataaaaaatgtaacataggaacctggcggcagcgcaaaagatg

SEQ ID NO: 48044 - DNA, 103 bp, Artificial Sequence
  Synthetic Polynucleotide
taatacgactcactatagggaaaataaggagtcatcacctatgttatattaacagaggagaaatataatgtaggtgatgaacctggcggcagcgcaaaagatg

SEQ ID NO: 48045 - DNA, 103 bp, Artificial Sequence
  Synthetic Polynucleotide
taatacgactcactataggggtctaaaaataaggagtcatcacctatgttaacagaggagaaacataatggatgactccaacctggcggcagcgcaaaagatg

SEQ ID NO: 48046 - DNA, 103 bp, Artificial Sequence
  Synthetic Polynucleotide
taatacgactcactatagggctaatgtctaaaaataaggagtcatcacctaacagaggagaaggtgaatgctccttattaacctggcggcagcgcaaaagatg

SEQ ID NO: 48047 - DNA, 103 bp, Artificial Sequence
  Synthetic Polynucleotide
taatacgactcactatagggcatatctaatgtctaaaaataaggagtcataacagaggagaatgactatgtatttttagaacctggcggcagcgcaaaagatg

SEQ ID NO: 48048 - DNA, 103 bp, Artificial Sequence
  Synthetic Polynucleotide
taatacgactcactatagggaaactgatgttgtggtgtcattattgtcttaacagaggagaaagacaatgatgacaccaaacctggcggcagcgcaaaagatg

SEQ ID NO: 48049 - DNA, 103 bp, Artificial Sequence
  Synthetic Polynucleotide
taatacgactcactatagggtttggcatatctaatgtctaaaaataaggaaacagaggagatccttaatgttagacattaacctggcggcagcgcaaaagatg

SEQ ID NO: 48050 - DNA, 103 bp, Artificial Sequence
  Synthetic Polynucleotide
taatacgactcactatagggatgattttggcatatctaatgtctaaaaataacagaggagaatttttatgcattagataaacctggcggcagcgcaaaagatg

SEQ ID NO: 48051 - DNA, 103 bp, Artificial Sequence
  Synthetic Polynucleotide
taatacgactcactataggggggctatgattttggcatatctaatgtctaaacagaggagatagacaatggatatgccaaacctggcggcagcgcaaaagatg

SEQ ID NO: 48052 - DNA, 103 bp, Artificial Sequence
  Synthetic Polynucleotide
taatacgactcactatagggaagcggggctatgattttggcatatctaataacagaggagaattagaatggccaaaatcaacctggcggcagcgcaaaagatg

SEQ ID NO: 48053 - DNA, 103 bp, Artificial Sequence
  Synthetic Polynucleotide
taatacgactcactatagggaatagaagcggggctatgattttggcatataacagaggagaatatgcatgaatcatagcaacctggcggcagcgcaaaagatg

SEQ ID NO: 48054 - DNA, 103 bp, Artificial Sequence
  Synthetic Polynucleotide
taatacgactcactataggggagtaaatagaagcggggctatgattttggaacagaggagaccaaaaatgtagccccgcaacctggcggcagcgcaaaagatg

SEQ ID NO: 48055 - DNA, 103 bp, Artificial Sequence
  Synthetic Polynucleotide
taatacgactcactatagggtgcgggagtaaatagaagcggggctatgataacagaggagaatcataatgccgcttctaaacctggcggcagcgcaaaagatg

SEQ ID NO: 48056 - DNA, 103 bp, Artificial Sequence
  Synthetic Polynucleotide
taatacgactcactatagggtgtgttgcgggagtaaatagaagcggggctaacagaggagaagccccatgtctatttacaacctggcggcagcgcaaaagatg

SEQ ID NO: 48057 - DNA, 103 bp, Artificial Sequence
  Synthetic Polynucleotide
taatacgactcactatagggttcattgtgttgcgggagtaaatagaagcgaacagaggagacgcttcatgttactcccgaacctggcggcagcgcaaaagatg

SEQ ID NO: 48058 - DNA, 103 bp, Artificial Sequence
  Synthetic Polynucleotide
taatacgactcactataggggttggttcattgtgttgcgggagtaaatagaacagaggagactatttatgcccgcaacaaacctggcggcagcgcaaaagatg

SEQ ID NO: 48059 - DNA, 103 bp, Artificial Sequence
  Synthetic Polynucleotide
taatacgactcactatagggtatcaaaactgatgttgtggtgtcattattaacagaggagaaataatatgaccacaacaaacctggcggcagcgcaaaagatg

SEQ ID NO: 48060 - DNA, 103 bp, Artificial Sequence
  Synthetic Polynucleotide
taatacgactcactatagggcccgtgttggttcattgtgttgcgggagtaaacagaggagatactccatgaacacaatgaacctggcggcagcgcaaaagatg

SEQ ID NO: 48061 - DNA, 103 bp, Artificial Sequence
  Synthetic Polynucleotide
taatacgactcactatagggacgagcccgtgttggttcattgtgttgcggaacagaggagaccgcaaatgaatgaaccaaacctggcggcagcgcaaaagatg

SEQ ID NO: 48062 - DNA, 103 bp, Artificial Sequence
  Synthetic Polynucleotide
taatacgactcactatagggacgaaacgagcccgtgttggttcattgtgtaacagaggagaacacaaatgaccaacacgaacctggcggcagcgcaaaagatg

SEQ ID NO: 48063 - DNA, 103 bp, Artificial Sequence
  Synthetic Polynucleotide
taatacgactcactataggggatcaacgaaacgagcccgtgttggttcataacagaggagaatgaacatgcacgggctcaacctggcggcagcgcaaaagatg

SEQ ID NO: 48064 - DNA, 103 bp, Artificial Sequence
  Synthetic Polynucleotide
taatacgactcactatagggaatgtgatcaacgaaacgagcccgtgttggaacagaggagaccaacaatggctcgtttcaacctggcggcagcgcaaaagatg

SEQ ID NO: 48065 - DNA, 103 bp, Artificial Sequence
  Synthetic Polynucleotide
taatacgactcactatagggatctaaatgtgatcaacgaaacgagcccgtaacagaggagaacgggcatgtttcgttgaaacctggcggcagcgcaaaagatg

SEQ ID NO: 48066 - DNA, 103 bp, Artificial Sequence
  Synthetic Polynucleotide
taatacgactcactatagggttcttatctaaatgtgatcaacgaaacgagaacagaggagactcgttatgttgatcacaaacctggcggcagcgcaaaagatg

SEQ ID NO: 48067 - DNA, 103 bp, Artificial Sequence
  Synthetic Polynucleotide
taatacgactcactatagggccgccttcttatctaaatgtgatcaacgaaaacagaggagattcgttatgcacatttagaacctggcggcagcgcaaaagatg

SEQ ID NO: 48068 - DNA, 103 bp, Artificial Sequence
  Synthetic Polynucleotide
taatacgactcactatagggcgtaaccgccttcttatctaaatgtgatcaaacagaggagatgatcaatgttagataagaacctggcggcagcgcaaaagatg

SEQ ID NO: 48069 - DNA, 103 bp, Artificial Sequence
  Synthetic Polynucleotide
taatacgactcactataggggacgacgtaaccgccttcttatctaaatgtaacagaggagaacatttatgtaagaaggcaacctggcggcagcgcaaaagatg

SEQ ID NO: 48070 - DNA, 103 bp, Artificial Sequence
  Synthetic Polynucleotide
taatacgactcactatagggaagaatatcaaaactgatgttgtggtgtcaaacagaggagatgacacatgaacatcagtaacctggcggcagcgcaaaagatg

SEQ ID NO: 48071 - DNA, 103 bp, Artificial Sequence
  Synthetic Polynucleotide
taatacgactcactatagggattttgacgacgtaaccgccttcttatctaaacagaggagatagataatgaggcggttaaacctggcggcagcgcaaaagatg

SEQ ID NO: 48072 - DNA, 103 bp, Artificial Sequence
  Synthetic Polynucleotide
taatacgactcactatagggtaaatattttgacgacgtaaccgccttcttaacagaggagaaagaagatggttacgtcgaacctggcggcagcgcaaaagatg

SEQ ID NO: 48073 - DNA, 103 bp, Artificial Sequence
  Synthetic Polynucleotide
taatacgactcactatagggattagtaaatattttgacgacgtaaccgccaacagaggagaggcggtatggtcgtcaaaaacctggcggcagcgcaaaagatg

SEQ ID NO: 48074 - DNA, 103 bp, Artificial Sequence
  Synthetic Polynucleotide
taatacgactcactatagggccgatattagtaaatattttgacgacgtaaaacagaggagattacgtatgcaaaatattaacctggcggcagcgcaaaagatg

SEQ ID NO: 48075 - DNA, 103 bp, Artificial Sequence
  Synthetic Polynucleotide
taatacgactcactatagggaactaccgatattagtaaatattttgacgaaacagaggagatcgtcaatgtatttactaaacctggcggcagcgcaaaagatg

SEQ ID NO: 48076 - DNA, 103 bp, Artificial Sequence
  Synthetic Polynucleotide
taatacgactcactataggggatacaactaccgatattagtaaatattttaacagaggagaaaaataatgactaatatcaacctggcggcagcgcaaaagatg

SEQ ID NO: 48077 - DNA, 103 bp, Artificial Sequence
  Synthetic Polynucleotide
taatacgactcactatagggtagatgatacaactaccgatattagtaaataacagaggagaatttacatgtatcggtagaacctggcggcagcgcaaaagatg

SEQ ID NO: 48078 - DNA, 103 bp, Artificial Sequence
  Synthetic Polynucleotide
taatacgactcactataggggttggtagatgatacaactaccgatattagaacagaggagactaataatggtagttgtaaacctggcggcagcgcaaaagatg

SEQ ID NO: 48079 - DNA, 103 bp, Artificial Sequence
  Synthetic Polynucleotide
taatacgactcactatagggataccgttggtagatgatacaactaccgataacagaggagaatcggtatgtgtatcatcaacctggcggcagcgcaaaagatg

SEQ ID NO: 48080 - DNA, 103 bp, Artificial Sequence
  Synthetic Polynucleotide
taatacgactcactatagggttcatataccgttggtagatgatacaactaaacagaggagatagttgatgcatctaccaaacctggcggcagcgcaaaagatg

SEQ ID NO: 48081 - DNA, 103 bp, Artificial Sequence
  Synthetic Polynucleotide
taatacgactcactatagggaaaataagaatatcaaaactgatgttgtggaacagaggagaccacaaatgcagttttgaaacctggcggcagcgcaaaagatg

SEQ ID NO: 48082 - DNA, 103 bp, Artificial Sequence
  Synthetic Polynucleotide
taatacgactcactatagggtattattcatataccgttggtagatgatacaacagaggagagtatcaatgaccaacggtaacctggcggcagcgcaaaagatg

SEQ ID NO: 48083 - DNA, 103 bp, Artificial Sequence
  Synthetic Polynucleotide
taatacgactcactatagggattaatattattcatataccgttggtagataacagaggagaatctacatgcggtatatgaacctggcggcagcgcaaaagatg

SEQ ID NO: 48084 - DNA, 103 bp, Artificial Sequence
  Synthetic Polynucleotide
taatacgactcactatagggctaatattaatattattcatataccgttggaacagaggagaccaacgatgtatgaataaaacctggcggcagcgcaaaagatg

SEQ ID NO: 48085 - DNA, 103 bp, Artificial Sequence
  Synthetic Polynucleotide
taatacgactcactatagggtaactctaatattaatattattcatataccaacagaggagaggtataatgataatattaaacctggcggcagcgcaaaagatg

SEQ ID NO: 48086 - DNA, 103 bp, Artificial Sequence
  Synthetic Polynucleotide
taatacgactcactatagggttacctaactctaatattaatattattcataacagaggagaatgaatatgattaatattaacctggcggcagcgcaaaagatg

SEQ ID NO: 48087 - DNA, 103 bp, Artificial Sequence
  Synthetic Polynucleotide
taatacgactcactatagggatacattacctaactctaatattaatattaaacagaggagataatatatgtattagagtaacctggcggcagcgcaaaagatg

SEQ ID NO: 48088 - DNA, 103 bp, Artificial Sequence
  Synthetic Polynucleotide
taatacgactcactatagggtaaatatacattacctaactctaatattaaaacagaggagattaataatggagttaggtaacctggcggcagcgcaaaagatg

SEQ ID NO: 48089 - DNA, 103 bp, Artificial Sequence
  Synthetic Polynucleotide
taatacgactcactatagggatggataaatatacattacctaactctaataacagaggagaattagaatgaggtaatgtaacctggcggcagcgcaaaagatg

SEQ ID NO: 48090 - DNA, 103 bp, Artificial Sequence
  Synthetic Polynucleotide
taatacgactcactatagggtgacgatggataaatatacattacctaactaacagaggagaagttagatgatgtatattaacctggcggcagcgcaaaagatg

SEQ ID NO: 48091 - DNA, 103 bp, Artificial Sequence
  Synthetic Polynucleotide
taatacgactcactatagggaaatttgacgatggataaatatacattaccaacagaggagaggtaatatgtatttatccaacctggcggcagcgcaaaagatg

SEQ ID NO: 48092 - DNA, 103 bp, Artificial Sequence
  Synthetic Polynucleotide
taatacgactcactatagggcaagaaaaataagaatatcaaaactgatgtaacagaggagaacatcaatgttgatattcaacctggcggcagcgcaaaagatg

SEQ ID NO: 48093 - DNA, 103 bp, Artificial Sequence
  Synthetic Polynucleotide
taatacgactcactataggggttttaaatttgacgatggataaatatacaaacagaggagatgtataatgatccatcgtaacctggcggcagcgcaaaagatg

SEQ ID NO: 48094 - DNA, 103 bp, Artificial Sequence
  Synthetic Polynucleotide
taatacgactcactatagggaatatgttttaaatttgacgatggataaataacagaggagaatttatatgtcgtcaaataacctggcggcagcgcaaaagatg

SEQ ID NO: 48095 - DNA, 103 bp, Artificial Sequence
  Synthetic Polynucleotide
taatacgactcactataggggttcaaatatgttttaaatttgacgatggaaacagaggagatccatcatgaaatttaaaaacctggcggcagcgcaaaagatg

SEQ ID NO: 48096 - DNA, 103 bp, Artificial Sequence
  Synthetic Polynucleotide
taatacgactcactataggggttaagttcaaatatgttttaaatttgacgaacagaggagacgtcaaatgtaaaacataaacctggcggcagcgcaaaagatg

SEQ ID NO: 48097 - DNA, 103 bp, Artificial Sequence
  Synthetic Polynucleotide
taatacgactcactatagggctgaagttaagttcaaatatgttttaaattaacagaggagaaatttaatgcatatttgaaacctggcggcagcgcaaaagatg

SEQ ID NO: 48098 - DNA, 103 bp, Artificial Sequence
  Synthetic Polynucleotide
taatacgactcactatagggatcatctgaagttaagttcaaatatgttttaacagaggagaaaaacaatgttgaacttaaacctggcggcagcgcaaaagatg

SEQ ID NO: 48099 - DNA, 103 bp, Artificial Sequence
  Synthetic Polynucleotide
taatacgactcactataggggcaccatcatctgaagttaagttcaaatataacagaggagaatatttatgcttaacttcaacctggcggcagcgcaaaagatg

SEQ ID NO: 48100 - DNA, 103 bp, Artificial Sequence
  Synthetic Polynucleotide
taatacgactcactatagggtgaatgcaccatcatctgaagttaagttcaaacagaggagatgaactatgcttcagatgaacctggcggcagcgcaaaagatg

SEQ ID NO: 48101 - DNA, 103 bp, Artificial Sequence
  Synthetic Polynucleotide
taatacgactcactatagggtgctatgaatgcaccatcatctgaagttaaaacagaggagattaactatggatgatggtaacctggcggcagcgcaaaagatg

SEQ ID NO: 48102 - DNA, 103 bp, Artificial Sequence
  Synthetic Polynucleotide
taatacgactcactatagggaaaaatgctatgaatgcaccatcatctgaaaacagaggagattcagaatgtggtgcattaacctggcggcagcgcaaaagatg

SEQ ID NO: 48103 - DNA, 103 bp, Artificial Sequence
  Synthetic Polynucleotide
taatacgactcactataggggttaccaagaaaaataagaatatcaaaactaacagaggagaagttttatgattcttattaacctggcggcagcgcaaaagatg

SEQ ID NO: 48104 - DNA, 103 bp, Artificial Sequence
  Synthetic Polynucleotide
taatacgactcactatagggattataaaaatgctatgaatgcaccatcataacagaggagaatgatgatgcattcatagaacctggcggcagcgcaaaagatg

SEQ ID NO: 48105 - DNA, 103 bp, Artificial Sequence
  Synthetic Polynucleotide
taatacgactcactataggggggaaattataaaaatgctatgaatgcaccaacagaggagaggtgcaatgatagcatttaacctggcggcagcgcaaaagatg

SEQ ID NO: 48106 - DNA, 103 bp, Artificial Sequence
  Synthetic Polynucleotide
taatacgactcactatagggtatttgggaaattataaaaatgctatgaataacagaggagaattcatatgatttttataaacctggcggcagcgcaaaagatg

SEQ ID NO: 48107 - DNA, 103 bp, Artificial Sequence
  Synthetic Polynucleotide
taatacgactcactatagggatgtgtatttgggaaattataaaaatgctaaacagaggagatagcatatgtataatttcaacctggcggcagcgcaaaagatg

SEQ ID NO: 48108 - DNA, 103 bp, Artificial Sequence
  Synthetic Polynucleotide
taatacgactcactatagggcaataatgtgtatttgggaaattataaaaaaacagaggagatttttaatgtttcccaaaaacctggcggcagcgcaaaagatg

SEQ ID NO: 48109 - DNA, 103 bp, Artificial Sequence
  Synthetic Polynucleotide
taatacgactcactataggggtaaccaataatgtgtatttgggaaattataacagaggagaataattatgcaaatacacaacctggcggcagcgcaaaagatg

SEQ ID NO: 48110 - DNA, 103 bp, Artificial Sequence
  Synthetic Polynucleotide
taatacgactcactatagggcaagagtaaccaataatgtgtatttgggaaaacagaggagattcccaatgacacattataacctggcggcagcgcaaaagatg

SEQ ID NO: 48111 - DNA, 103 bp, Artificial Sequence
  Synthetic Polynucleotide
taatacgactcactatagggaatgacaagagtaaccaataatgtgtatttaacagaggagaaaatacatgttattggttaacctggcggcagcgcaaaagatg

SEQ ID NO: 48112 - DNA, 103 bp, Artificial Sequence
  Synthetic Polynucleotide
taatacgactcactatagggactataatgacaagagtaaccaataatgtgaacagaggagacacattatgggttactctaacctggcggcagcgcaaaagatg

SEQ ID NO: 48113 - DNA, 103 bp, Artificial Sequence
  Synthetic Polynucleotide
taatacgactcactatagggctcccactataatgacaagagtaaccaataaacagaggagatattggatgctcttgtcaaacctggcggcagcgcaaaagatg

SEQ ID NO: 48114 - DNA, 103 bp, Artificial Sequence
  Synthetic Polynucleotide
taatacgactcactatagggtatacgttaccaagaaaaataagaatatcaaacagaggagatgatatatgtatttttctaacctggcggcagcgcaaaagatg

SEQ ID NO: 48115 - DNA, 103 bp, Artificial Sequence
  Synthetic Polynucleotide
taatacgactcactatagggcaaatctcccactataatgacaagagtaacaacagaggagagttactatggtcattataaacctggcggcagcgcaaaagatg

SEQ ID NO: 48116 - DNA, 103 bp, Artificial Sequence
  Synthetic Polynucleotide
taatacgactcactatagggagagccaaatctcccactataatgacaagaaacagaggagatcttgtatgtatagtgggaacctggcggcagcgcaaaagatg

SEQ ID NO: 48117 - DNA, 103 bp, Artificial Sequence
  Synthetic Polynucleotide
taatacgactcactatagggtgcgcagagccaaatctcccactataatgaaacagaggagatcattaatgtgggagattaacctggcggcagcgcaaaagatg

SEQ ID NO: 48118 - DNA, 103 bp, Artificial Sequence
  Synthetic Polynucleotide
taatacgactcactatagggagatatgcgcagagccaaatctcccactataacagaggagaatagtgatggatttggctaacctggcggcagcgcaaaagatg

SEQ ID NO: 48119 - DNA, 103 bp, Artificial Sequence
  Synthetic Polynucleotide
taatacgactcactatagggactggagatatgcgcagagccaaatctcccaacagaggagagggagaatgggctctgcgaacctggcggcagcgcaaaagatg

SEQ ID NO: 48120 - DNA, 103 bp, Artificial Sequence
  Synthetic Polynucleotide
taatacgactcactataggggttcaactggagatatgcgcagagccaaataacagaggagaatttggatgtgcgcatataacctggcggcagcgcaaaagatg

SEQ ID NO: 48121 - DNA, 103 bp, Artificial Sequence
  Synthetic Polynucleotide
taatacgactcactatagggactacgttcaactggagatatgcgcagagcaacagaggagagctctgatgatatctccaaacctggcggcagcgcaaaagatg

SEQ ID NO: 48122 - DNA, 103 bp, Artificial Sequence
  Synthetic Polynucleotide
taatacgactcactatagggttactactacgttcaactggagatatgcgcaacagaggagagcgcatatgtccagttgaaacctggcggcagcgcaaaagatg

SEQ ID NO: 48123 - DNA, 103 bp, Artificial Sequence
  Synthetic Polynucleotide
taatacgactcactatagggaatacttactactacgttcaactggagataaacagaggagatatctcatgttgaacgtaaacctggcggcagcgcaaaagatg

SEQ ID NO: 48124 - DNA, 103 bp, Artificial Sequence
  Synthetic Polynucleotide
taatacgactcactataggggtataaatacttactactacgttcaactggaacagaggagaccagttatgcgtagtagtaacctggcggcagcgcaaaagatg

SEQ ID NO: 48125 - DNA, 103 bp, Artificial Sequence
  Synthetic Polynucleotide
taatacgactcactatagggctaccttcacaatggcctcttcttgtgcccaacagaggagagggcacatgaagaggccaaacctggcggcagcgcaaaagatg

SEQ ID NO: 48126 - DNA, 103 bp, Artificial Sequence
  Synthetic Polynucleotide
taatacgactcactatagggaaatgtatacgttaccaagaaaaataagaaaacagaggagattcttaatgttcttggtaaacctggcggcagcgcaaaagatg

SEQ ID NO: 48127 - DNA, 103 bp, Artificial Sequence
  Synthetic Polynucleotide
taatacgactcactatagggagtttgtataaatacttactactacgttcaaacagaggagatgaacgatgtagtaagtaaacctggcggcagcgcaaaagatg

SEQ ID NO: 48128 - DNA, 103 bp, Artificial Sequence
  Synthetic Polynucleotide
taatacgactcactatagggagaaaagtttgtataaatacttactactacaacagaggagagtagtaatgagtatttataacctggcggcagcgcaaaagatg

SEQ ID NO: 48129 - DNA, 103 bp, Artificial Sequence
  Synthetic Polynucleotide
taatacgactcactatagggggataagaaaagtttgtataaatacttactaacagaggagaagtaagatgttatacaaaaacctggcggcagcgcaaaagatg

SEQ ID NO: 48130 - DNA, 103 bp, Artificial Sequence
  Synthetic Polynucleotide
taatacgactcactatagggtaaatggataagaaaagtttgtataaatacaacagaggagagtatttatgcaaacttttaacctggcggcagcgcaaaagatg

SEQ ID NO: 48131 - DNA, 103 bp, Artificial Sequence
  Synthetic Polynucleotide
taatacgactcactatagggcgttataaatggataagaaaagtttgtataaacagaggagatatacaatgttttcttataacctggcggcagcgcaaaagatg

SEQ ID NO: 48132 - DNA, 103 bp, Artificial Sequence
  Synthetic Polynucleotide
taatacgactcactatagggttgtacgttataaatggataagaaaagtttaacagaggagaaaacttatgttatccattaacctggcggcagcgcaaaagatg

SEQ ID NO: 48133 - DNA, 103 bp, Artificial Sequence
  Synthetic Polynucleotide
taatacgactcactatagggtccatttgtacgttataaatggataagaaaaacagaggagatttcttatgcatttataaaacctggcggcagcgcaaaagatg

SEQ ID NO: 48134 - DNA, 103 bp, Artificial Sequence
  Synthetic Polynucleotide
taatacgactcactatagggttttatccatttgtacgttataaatggataaacagaggagatatccaatgataacgtacaacctggcggcagcgcaaaagatg

SEQ ID NO: 48135 - DNA, 103 bp, Artificial Sequence
  Synthetic Polynucleotide
taatacgactcactatagggagtagttttatccatttgtacgttataaataacagaggagaatttatatggtacaaatgaacctggcggcagcgcaaaagatg

SEQ ID NO: 48136 - DNA, 103 bp, Artificial Sequence
  Synthetic Polynucleotide
taatacgactcactataggggataaagtagttttatccatttgtacgttaaacagaggagataacgtatgaatggataaaacctggcggcagcgcaaaagatg

SEQ ID NO: 48137 - DNA, 103 bp, Artificial Sequence
  Synthetic Polynucleotide
taatacgactcactatagggtcattaaatgtatacgttaccaagaaaaataacagaggagaatttttatgggtaacgtaaacctggcggcagcgcaaaagatg

SEQ ID NO: 48138 - DNA, 103 bp, Artificial Sequence
  Synthetic Polynucleotide
taatacgactcactatagggttactgataaagtagttttatccatttgtaaacagaggagatacaaaatgataaaactaaacctggcggcagcgcaaaagatg

SEQ ID NO: 48139 - DNA, 103 bp, Artificial Sequence
  Synthetic Polynucleotide
taatacgactcactatagggcgcgtttactgataaagtagttttatccataacagaggagaatggatatgactactttaaacctggcggcagcgcaaaagatg

SEQ ID NO: 48140 - DNA, 103 bp, Artificial Sequence
  Synthetic Polynucleotide
taatacgactcactatagggttacacgcgtttactgataaagtagttttaaacagaggagataaaacatgtttatcagtaacctggcggcagcgcaaaagatg

SEQ ID NO: 48141 - DNA, 103 bp, Artificial Sequence
  Synthetic Polynucleotide
taatacgactcactatagggctaaattacacgcgtttactgataaagtagaacagaggagactacttatgcagtaaacgaacctggcggcagcgcaaaagatg

SEQ ID NO: 48142 - DNA, 103 bp, Artificial Sequence
  Synthetic Polynucleotide
taatacgactcactataggggtattctaaattacacgcgtttactgataaaacagaggagattatcaatgaacgcgtgtaacctggcggcagcgcaaaagatg

SEQ ID NO: 48143 - DNA, 103 bp, Artificial Sequence
  Synthetic Polynucleotide
taatacgactcactatagggctaacgtattctaaattacacgcgtttactaacagaggagaagtaaaatggtgtaatttaacctggcggcagcgcaaaagatg

SEQ ID NO: 48144 - DNA, 103 bp, Artificial Sequence
  Synthetic Polynucleotide
taatacgactcactatagggtttctctaacgtattctaaattacacgcgtaacagaggagaacgcgtatgatttagaataacctggcggcagcgcaaaagatg

SEQ ID NO: 48145 - DNA, 103 bp, Artificial Sequence
  Synthetic Polynucleotide
taatacgactcactatagggagccttttctctaacgtattctaaattacaaacagaggagatgtaatatggaatacgttaacctggcggcagcgcaaaagatg

SEQ ID NO: 48146 - DNA, 103 bp, Artificial Sequence
  Synthetic Polynucleotide
taatacgactcactatagggactatagccttttctctaacgtattctaaaaacagaggagatttagaatgcgttagagaaacctggcggcagcgcaaaagatg

SEQ ID NO: 48147 - DNA, 103 bp, Artificial Sequence
  Synthetic Polynucleotide
taatacgactcactatagggcgcctactatagccttttctctaacgtattaacagaggagaaatacgatggagaaaaggaacctggcggcagcgcaaaagatg

SEQ ID NO: 48148 - DNA, 103 bp, Artificial Sequence
  Synthetic Polynucleotide
taatacgactcactatagggaaaattcattaaatgtatacgttaccaagaaacagaggagatcttggatgcgtatacataacctggcggcagcgcaaaagatg

SEQ ID NO: 48149 - DNA, 103 bp, Artificial Sequence
  Synthetic Polynucleotide
taatacgactcactatagggttgtacgcctactatagccttttctctaacaacagaggagagttagaatgaaggctataaacctggcggcagcgcaaaagatg

SEQ ID NO: 48150 - DNA, 103 bp, Artificial Sequence
  Synthetic Polynucleotide
taatacgactcactataggggctgcttgtacgcctactatagccttttctaacagaggagaagaaaaatgtatagtaggaacctggcggcagcgcaaaagatg

SEQ ID NO: 48151 - DNA, 103 bp, Artificial Sequence
  Synthetic Polynucleotide
taatacgactcactatagggtcttggctgcttgtacgcctactatagcctaacagaggagaaggctaatgtaggcgtacaacctggcggcagcgcaaaagatg

SEQ ID NO: 48152 - DNA, 103 bp, Artificial Sequence
  Synthetic Polynucleotide
taatacgactcactatagggtgatgtcttggctgcttgtacgcctactataacagaggagaatagtaatggtacaagcaaacctggcggcagcgcaaaagatg

SEQ ID NO: 48153 - DNA, 103 bp, Artificial Sequence
  Synthetic Polynucleotide
taatacgactcactatagggagtgttgatgtcttggctgcttgtacgcctaacagaggagaaggcgtatgagcagccaaaacctggcggcagcgcaaaagatg

SEQ ID NO: 48154 - DNA, 103 bp, Artificial Sequence
  Synthetic Polynucleotide
taatacgactcactatagggatataagtgttgatgtcttggctgcttgtaaacagaggagatacaagatgccaagacataacctggcggcagcgcaaaagatg

SEQ ID NO: 48155 - DNA, 103 bp, Artificial Sequence
  Synthetic Polynucleotide
taatacgactcactatagggaaagaatataagtgttgatgtcttggctgcaacagaggagagcagccatgacatcaacaaacctggcggcagcgcaaaagatg

SEQ ID NO: 48156 - DNA, 103 bp, Artificial Sequence
  Synthetic Polynucleotide
taatacgactcactatagggataacaaagaatataagtgttgatgtcttgaacagaggagacaagacatgaacacttataacctggcggcagcgcaaaagatg

SEQ ID NO: 48157 - DNA, 103 bp, Artificial Sequence
  Synthetic Polynucleotide
taatacgactcactatagggatataataacaaagaatataagtgttgatgaacagaggagacatcaaatgttatattctaacctggcggcagcgcaaaagatg

SEQ ID NO: 48158 - DNA, 103 bp, Artificial Sequence
  Synthetic Polynucleotide
taatacgactcactatagggtgccaatataataacaaagaatataagtgtaacagaggagaacacttatgttctttgttaacctggcggcagcgcaaaagatg

SEQ ID NO: 48159 - DNA, 103 bp, Artificial Sequence
  Synthetic Polynucleotide
taatacgactcactatagggtaatgaaaattcattaaatgtatacgttacaacagaggagagtaacgatgacatttaataacctggcggcagcgcaaaagatg

SEQ ID NO: 48160 - DNA, 103 bp, Artificial Sequence
  Synthetic Polynucleotide
taatacgactcactatagggctaattgccaatataataacaaagaatataaacagaggagatatattatgtgttattataacctggcggcagcgcaaaagatg

SEQ ID NO: 48161 - DNA, 103 bp, Artificial Sequence
  Synthetic Polynucleotide
taatacgactcactataggggcgcactaattgccaatataataacaaagaaacagaggagatctttgatgttatattggaacctggcggcagcgcaaaagatg

SEQ ID NO: 48162 - DNA, 103 bp, Artificial Sequence
  Synthetic Polynucleotide
taatacgactcactatagggtaatagcgcactaattgccaatataataacaacagaggagagttattatgttggcaattaacctggcggcagcgcaaaagatg

SEQ ID NO: 48163 - DNA, 103 bp, Artificial Sequence
  Synthetic Polynucleotide
taatacgactcactatagggcagagtaatagcgcactaattgccaatataaacagaggagatatattatgaattagtgcaacctggcggcagcgcaaaagatg

SEQ ID NO: 48164 - DNA, 103 bp, Artificial Sequence
  Synthetic Polynucleotide
taatacgactcactataggggaaaccagagtaatagcgcactaattgccaaacagaggagatggcaaatggtgcgctataacctggcggcagcgcaaaagatg

SEQ ID NO: 48165 - DNA, 103 bp, Artificial Sequence
  Synthetic Polynucleotide
taatacgactcactatagggcgtctgaaaccagagtaatagcgcactaataacagaggagaattagtatgctattactcaacctggcggcagcgcaaaagatg

SEQ ID NO: 48166 - DNA, 103 bp, Artificial Sequence
  Synthetic Polynucleotide
taatacgactcactatagggtcagacgtctgaaaccagagtaatagcgcaaacagaggagatgcgctatgactctggttaacctggcggcagcgcaaaagatg

SEQ ID NO: 48167 - DNA, 103 bp, Artificial Sequence
  Synthetic Polynucleotide
taatacgactcactataggggattatcagacgtctgaaaccagagtaataaacagaggagatattacatgggtttcagaaacctggcggcagcgcaaaagatg

SEQ ID NO: 48168 - DNA, 103 bp, Artificial Sequence
  Synthetic Polynucleotide
taatacgactcactataggggactggattatcagacgtctgaaaccagagaacagaggagactctggatgcagacgtctaacctggcggcagcgcaaaagatg

SEQ ID NO: 48169 - DNA, 103 bp, Artificial Sequence
  Synthetic Polynucleotide
taatacgactcactatagggttaaagactggattatcagacgtctgaaacaacagaggagagtttcaatggtctgataaaacctggcggcagcgcaaaagatg

SEQ ID NO: 48170 - DNA, 103 bp, Artificial Sequence
  Synthetic Polynucleotide
taatacgactcactataggggaacgtaatgaaaattcattaaatgtatacaacagaggagagtatacatgtaatgaattaacctggcggcagcgcaaaagatg

SEQ ID NO: 48171 - DNA, 103 bp, Artificial Sequence
  Synthetic Polynucleotide
taatacgactcactatagggattcattaaagactggattatcagacgtctaacagaggagaagacgtatgataatccagaacctggcggcagcgcaaaagatg

SEQ ID NO: 48172 - DNA, 103 bp, Artificial Sequence
  Synthetic Polynucleotide
taatacgactcactatagggcgttaattcattaaagactggattatcagaaacagaggagatctgatatgccagtctttaacctggcggcagcgcaaaagatg

SEQ ID NO: 48173 - DNA, 103 bp, Artificial Sequence
  Synthetic Polynucleotide
taatacgactcactatagggtatctcgttaattcattaaagactggattaaacagaggagataatccatgctttaatgaaacctggcggcagcgcaaaagatg

SEQ ID NO: 48174 - DNA, 103 bp, Artificial Sequence
  Synthetic Polynucleotide
taatacgactcactataggggcatatatctcgttaattcattaaagactgaacagaggagacagtctatgatgaattaaaacctggcggcagcgcaaaagatg

SEQ ID NO: 48175 - DNA, 103 bp, Artificial Sequence
  Synthetic Polynucleotide
taatacgactcactatagggaattcgcatatatctcgttaattcattaaaaacagaggagatttaatatgttaacgagaaacctggcggcagcgcaaaagatg

SEQ ID NO: 48176 - DNA, 103 bp, Artificial Sequence
  Synthetic Polynucleotide
taatacgactcactatagggtttttaattcgcatatatctcgttaattcaaacagaggagatgaattatggagatatataacctggcggcagcgcaaaagatg

SEQ ID NO: 48177 - DNA, 103 bp, Artificial Sequence
  Synthetic Polynucleotide
taatacgactcactatagggccgtatttttaattcgcatatatctcgttaaacagaggagataacgaatgatatgcgaaaacctggcggcagcgcaaaagatg

SEQ ID NO: 48178 - DNA, 103 bp, Artificial Sequence
  Synthetic Polynucleotide
taatacgactcactataggggttaaccgtatttttaattcgcatatatctaacagaggagaagatatatgcgaattaaaaacctggcggcagcgcaaaagatg

SEQ ID NO: 48179 - DNA, 103 bp, Artificial Sequence
  Synthetic Polynucleotide
taatacgactcactatagggcaatcgttaaccgtatttttaattcgcataaacagaggagatatgcgatgtaaaaatacaacctggcggcagcgcaaaagatg

SEQ ID NO: 48180 - DNA, 103 bp, Artificial Sequence
  Synthetic Polynucleotide
taatacgactcactatagggatttccaatcgttaaccgtatttttaattcaacagaggagagaattaatgatacggttaaacctggcggcagcgcaaaagatg

SEQ ID NO: 48181 - DNA, 103 bp, Artificial Sequence
  Synthetic Polynucleotide
taatacgactcactatagggtggtagaacgtaatgaaaattcattaaatgaacagaggagacatttaatgaattttcataacctggcggcagcgcaaaagatg

SEQ ID NO: 48182 - DNA, 103 bp, Artificial Sequence
  Synthetic Polynucleotide
taatacgactcactatagggtaatgatttccaatcgttaaccgtatttttaacagaggagaaaaaatatggttaacgataacctggcggcagcgcaaaagatg

SEQ ID NO: 48183 - DNA, 103 bp, Artificial Sequence
  Synthetic Polynucleotide
taatacgactcactatagggtccgttaatgatttccaatcgttaaccgtaaacagaggagatacggtatgcgattggaaaacctggcggcagcgcaaaagatg

SEQ ID NO: 48184 - DNA, 103 bp, Artificial Sequence
  Synthetic Polynucleotide
taatacgactcactatagggtactatccgttaatgatttccaatcgttaaaacagaggagattaacgatgggaaatcataacctggcggcagcgcaaaagatg

SEQ ID NO: 48185 - DNA, 103 bp, Artificial Sequence
  Synthetic Polynucleotide
taatacgactcactatagggtgttttactatccgttaatgatttccaatcaacagaggagagattggatgtcattaacgaacctggcggcagcgcaaaagatg

SEQ ID NO: 48186 - DNA, 103 bp, Artificial Sequence
  Synthetic Polynucleotide
taatacgactcactatagggaattttgttttactatccgttaatgatttcaacagaggagagaaatcatgaacggatagaacctggcggcagcgcaaaagatg

SEQ ID NO: 48187 - DNA, 103 bp, Artificial Sequence
  Synthetic Polynucleotide
taatacgactcactatagggtttctaattttgttttactatccgttaatgaacagaggagacattaaatgatagtaaaaaacctggcggcagcgcaaaagatg

SEQ ID NO: 48188 - DNA, 103 bp, Artificial Sequence
  Synthetic Polynucleotide
taatacgactcactatagggatcactttctaattttgttttactatccgtaacagaggagaacggatatgaaaacaaaaaacctggcggcagcgcaaaagatg

SEQ ID NO: 48189 - DNA, 103 bp, Artificial Sequence
  Synthetic Polynucleotide
taatacgactcactatagggcctctatcactttctaattttgttttactaaacagaggagatagtaaatgaaaattagaaacctggcggcagcgcaaaagatg

SEQ ID NO: 48190 - DNA, 103 bp, Artificial Sequence
  Synthetic Polynucleotide
taatacgactcactataggggtctacctctatcactttctaattttgtttaacagaggagaaaacaaatgtagaaagtgaacctggcggcagcgcaaaagatg

SEQ ID NO: 48191 - DNA, 103 bp, Artificial Sequence
  Synthetic Polynucleotide
taatacgactcactatagggtagaagtctacctctatcactttctaatttaacagaggagaaaattaatgagtgatagaaacctggcggcagcgcaaaagatg

SEQ ID NO: 48192 - DNA, 103 bp, Artificial Sequence
  Synthetic Polynucleotide
taatacgactcactatagggatcattggtagaacgtaatgaaaattcattaacagaggagaaatgaaatgtcattacgtaacctggcggcagcgcaaaagatg

SEQ ID NO: 48193 - DNA, 103 bp, Artificial Sequence
  Synthetic Polynucleotide
taatacgactcactataggggcggctagaagtctacctctatcactttctaacagaggagaagaaagatgtagaggtagaacctggcggcagcgcaaaagatg

SEQ ID NO: 48194 - DNA, 103 bp, Artificial Sequence
  Synthetic Polynucleotide
taatacgactcactatagggtaccagcggctagaagtctacctctatcacaacagaggagagtgataatggtagacttcaacctggcggcagcgcaaaagatg

SEQ ID NO: 48195 - DNA, 103 bp, Artificial Sequence
  Synthetic Polynucleotide
taatacgactcactatagggatccttaccagcggctagaagtctacctctaacagaggagaagaggtatgcttctagccaacctggcggcagcgcaaaagatg

SEQ ID NO: 48196 - DNA, 103 bp, Artificial Sequence
  Synthetic Polynucleotide
taatacgactcactatagggatatcatccttaccagcggctagaagtctaaacagaggagatagactatgagccgctggaacctggcggcagcgcaaaagatg

SEQ ID NO: 48197 - DNA, 103 bp, Artificial Sequence
  Synthetic Polynucleotide
taatacgactcactatagggcgaatatatcatccttaccagcggctagaaaacagaggagattctagatgctggtaaggaacctggcggcagcgcaaaagatg

SEQ ID NO: 48198 - DNA, 103 bp, Artificial Sequence
  Synthetic Polynucleotide
taatacgactcactataggggaattcgaatatatcatccttaccagcggcaacagaggagagccgctatgaaggatgataacctggcggcagcgcaaaagatg

SEQ ID NO: 48199 - DNA, 103 bp, Artificial Sequence
  Synthetic Polynucleotide
taatacgactcactatagggcatttgaattcgaatatatcatccttaccaaacagaggagatggtaaatgtgatatattaacctggcggcagcgcaaaagatg

SEQ ID NO: 48200 - DNA, 103 bp, Artificial Sequence
  Synthetic Polynucleotide
taatacgactcactatagggccacacatttgaattcgaatatatcatcctaacagaggagaaggatgatgtattcgaataacctggcggcagcgcaaaagatg

SEQ ID NO: 48201 - DNA, 103 bp, Artificial Sequence
  Synthetic Polynucleotide
taatacgactcactatagggaaaatccacacatttgaattcgaatatatcaacagaggagagatataatggaattcaaaaacctggcggcagcgcaaaagatg

SEQ ID NO: 48202 - DNA, 103 bp, Artificial Sequence
  Synthetic Polynucleotide
taatacgactcactataggggcaccaaaatccacacatttgaattcgaataacagaggagaattcgaatgcaaatgtgtaacctggcggcagcgcaaaagatg

SEQ ID NO: 48203 - DNA, 103 bp, Artificial Sequence
  Synthetic Polynucleotide
taatacgactcactataggggcacaatcattggtagaacgtaatgaaaataacagaggagaattttcatgacgttctacaacctggcggcagcgcaaaagatg

SEQ ID NO: 48204 - DNA, 103 bp, Artificial Sequence
  Synthetic Polynucleotide
taatacgactcactatagggaataggcaccaaaatccacacatttgaattaacagaggagaaattcaatggtgtggattaacctggcggcagcgcaaaagatg

SEQ ID NO: 48205 - DNA, 103 bp, Artificial Sequence
  Synthetic Polynucleotide
taatacgactcactatagggtataaaataggcaccaaaatccacacatttaacagaggagaaaatgtatggattttggtaacctggcggcagcgcaaaagatg

SEQ ID NO: 48206 - DNA, 103 bp, Artificial Sequence
  Synthetic Polynucleotide
taatacgactcactatagggatagctataaaataggcaccaaaatccacaaacagaggagatgtggaatgtggtgcctaaacctggcggcagcgcaaaagatg

SEQ ID NO: 48207 - DNA, 103 bp, Artificial Sequence
  Synthetic Polynucleotide
taatacgactcactatagggatcgcatagctataaaataggcaccaaaataacagaggagaattttgatgcctattttaaacctggcggcagcgcaaaagatg

SEQ ID NO: 48208 - DNA, 103 bp, Artificial Sequence
  Synthetic Polynucleotide
taatacgactcactatagggatccaatcgcatagctataaaataggcaccaacagaggagaggtgccatgtttatagctaacctggcggcagcgcaaaagatg

SEQ ID NO: 48209 - DNA, 103 bp, Artificial Sequence
  Synthetic Polynucleotide
taatacgactcactatagggttcttatccaatcgcatagctataaaatagaacagaggagactatttatgagctatgcgaacctggcggcagcgcaaaagatg

SEQ ID NO: 48210 - DNA, 103 bp, Artificial Sequence
  Synthetic Polynucleotide
taatacgactcactatagggatgttttcttatccaatcgcatagctataaaacagaggagattatagatgtgcgattggaacctggcggcagcgcaaaagatg

SEQ ID NO: 48211 - DNA, 103 bp, Artificial Sequence
  Synthetic Polynucleotide
taatacgactcactatagggtagatatgttttcttatccaatcgcatagcaacagaggagagctatgatgttggataagaacctggcggcagcgcaaaagatg

SEQ ID NO: 48212 - DNA, 103 bp, Artificial Sequence
  Synthetic Polynucleotide
taatacgactcactatagggtgcggtagatatgttttcttatccaatcgcaacagaggagagcgattatgtaagaaaacaacctggcggcagcgcaaaagatg

SEQ ID NO: 48213 - DNA, 103 bp, Artificial Sequence
  Synthetic Polynucleotide
taatacgactcactatagggtagcttgcggtagatatgttttcttatccaaacagaggagatggataatgaaacatatcaacctggcggcagcgcaaaagatg

SEQ ID NO: 48214 - DNA, 103 bp, Artificial Sequence
  Synthetic Polynucleotide
taatacgactcactataggggcagtgcacaatcattggtagaacgtaatgaacagaggagacattacatgctaccaatgaacctggcggcagcgcaaaagatg

SEQ ID NO: 48215 - DNA, 103 bp, Artificial Sequence
  Synthetic Polynucleotide
taatacgactcactatagggcctaatagcttgcggtagatatgttttcttaacagaggagaaagaaaatgtatctaccgaacctggcggcagcgcaaaagatg

SEQ ID NO: 48216 - DNA, 103 bp, Artificial Sequence
  Synthetic Polynucleotide
taatacgactcactatagggcctcgcctaatagcttgcggtagatatgttaacagaggagaaacataatgaccgcaagcaacctggcggcagcgcaaaagatg

SEQ ID NO: 48217 - DNA, 103 bp, Artificial Sequence
  Synthetic Polynucleotide
taatacgactcactatagggcagtacctcgcctaatagcttgcggtagataacagaggagaatctacatgaagctattaaacctggcggcagcgcaaaagatg

SEQ ID NO: 48218 - DNA, 103 bp, Artificial Sequence
  Synthetic Polynucleotide
taatacgactcactataggggtctccagtacctcgcctaatagcttgcggaacagaggagaccgcaaatgattaggcgaaacctggcggcagcgcaaaagatg

SEQ ID NO: 48219 - DNA, 103 bp, Artificial Sequence
  Synthetic Polynucleotide
taatacgactcactatagggcacgcgtctccagtacctcgcctaatagctaacagaggagaagctatatggcgaggtacaacctggcggcagcgcaaaagatg

SEQ ID NO: 48220 - DNA, 103 bp, Artificial Sequence
  Synthetic Polynucleotide
taatacgactcactatagggccatccacgcgtctccagtacctcgcctaaaacagaggagattaggcatggtactggagaacctggcggcagcgcaaaagatg

SEQ ID NO: 48221 - DNA, 103 bp, Artificial Sequence
  Synthetic Polynucleotide
taatacgactcactatagggtttaaccatccacgcgtctccagtacctcgaacagaggagacgaggtatgggagacgcgaacctggcggcagcgcaaaagatg

SEQ ID NO: 48222 - DNA, 103 bp, Artificial Sequence
  Synthetic Polynucleotide
taatacgactcactataggggcctttttaaccatccacgcgtctccagtaaacagaggagatactggatgcgcgtggataacctggcggcagcgcaaaagatg

SEQ ID NO: 48223 - DNA, 103 bp, Artificial Sequence
  Synthetic Polynucleotide
taatacgactcactatagggttgccgcctttttaaccatccacgcgtctcaacagaggagagagacgatgggatggttaaacctggcggcagcgcaaaagatg

SEQ ID NO: 48224 - DNA, 103 bp, Artificial Sequence
  Synthetic Polynucleotide
taatacgactcactatagggaacctttgccgcctttttaaccatccacgcaacagaggagagcgtggatggttaaaaagaacctggcggcagcgcaaaagatg

SEQ ID NO: 48225 - DNA, 103 bp, Artificial Sequence
  Synthetic Polynucleotide
taatacgactcactatagggtgcctgcagtgcacaatcattggtagaacgaacagaggagacgttctatgaatgattgtaacctggcggcagcgcaaaagatg

SEQ ID NO: 48226 - DNA, 103 bp, Artificial Sequence
  Synthetic Polynucleotide
taatacgactcactatagggggatcaacctttgccgcctttttaaccatcaacagaggagagatggtatgaaaggcggcaacctggcggcagcgcaaaagatg

SEQ ID NO: 48227 - DNA, 103 bp, Artificial Sequence
  Synthetic Polynucleotide
taatacgactcactatagggcagatggatcaacctttgccgcctttttaaaacagaggagattaaaaatgcggcaaaggaacctggcggcagcgcaaaagatg

SEQ ID NO: 48228 - DNA, 103 bp, Artificial Sequence
  Synthetic Polynucleotide
taatacgactcactatagggttgagcagatggatcaacctttgccgccttaacagaggagaaaggcgatgaaggttgataacctggcggcagcgcaaaagatg

SEQ ID NO: 48229 - DNA, 103 bp, Artificial Sequence
  Synthetic Polynucleotide
taatacgactcactatagggaattgttgagcagatggatcaacctttgccaacagaggagaggcaaaatgtgatccatcaacctggcggcagcgcaaaagatg

SEQ ID NO: 48230 - DNA, 103 bp, Artificial Sequence
  Synthetic Polynucleotide
taatacgactcactataggggacaaaattgttgagcagatggatcaacctaacagaggagaaggttgatgcatctgctcaacctggcggcagcgcaaaagatg

SEQ ID NO: 48231 - DNA, 103 bp, Artificial Sequence
  Synthetic Polynucleotide
taatacgactcactatagggatactgacaaaattgttgagcagatggatcaacagaggagagatccaatggctcaacaaaacctggcggcagcgcaaaagatg

SEQ ID NO: 48232 - DNA, 103 bp, Artificial Sequence
  Synthetic Polynucleotide
taatacgactcactatagggatcaaatactgacaaaattgttgagcagataacagaggagaatctgcatgacaattttgaacctggcggcagcgcaaaagatg

SEQ ID NO: 48233 - DNA, 103 bp, Artificial Sequence
  Synthetic Polynucleotide
taatacgactcactataggggttttatcaaatactgacaaaattgttgagaacagaggagactcaacatgtttgtcagtaacctggcggcagcgcaaaagatg

SEQ ID NO: 48234 - DNA, 103 bp, Artificial Sequence
  Synthetic Polynucleotide
taatacgactcactatagggcttgtgttttatcaaatactgacaaaattgaacagaggagacaatttatgcagtatttgaacctggcggcagcgcaaaagatg

SEQ ID NO: 48235 - DNA, 103 bp, Artificial Sequence
  Synthetic Polynucleotide
taatacgactcactatagggttagacttgtgttttatcaaatactgacaaaacagaggagattgtcaatgtttgataaaaacctggcggcagcgcaaaagatg

SEQ ID NO: 48236 - DNA, 103 bp, Artificial Sequence
  Synthetic Polynucleotide
taatacgactcactatagggttcgtctaccttcacaatggcctcttcttgaacagaggagacaagaaatggccattgtgaacctggcggcagcgcaaaagatg

SEQ ID NO: 48237 - DNA, 103 bp, Artificial Sequence
  Synthetic Polynucleotide
taatacgactcactatagggtttgatgcctgcagtgcacaatcattggtaaacagaggagataccaaatgttgtgcactaacctggcggcagcgcaaaagatg

SEQ ID NO: 48238 - DNA, 103 bp, Artificial Sequence
  Synthetic Polynucleotide
taatacgactcactatagggcattattagacttgtgttttatcaaatactaacagaggagaagtattatgtaaaacacaaacctggcggcagcgcaaaagatg

SEQ ID NO: 48239 - DNA, 103 bp, Artificial Sequence
  Synthetic Polynucleotide
taatacgactcactatagggaataacattattagacttgtgttttatcaaaacagaggagattgataatgcacaagtctaacctggcggcagcgcaaaagatg

SEQ ID NO: 48240 - DNA, 103 bp, Artificial Sequence
  Synthetic Polynucleotide
taatacgactcactatagggcaagtaataacattattagacttgtgttttaacagaggagaaaaacaatggtctaataaaacctggcggcagcgcaaaagatg

SEQ ID NO: 48241 - DNA, 103 bp, Artificial Sequence
  Synthetic Polynucleotide
taatacgactcactatagggtaccacaagtaataacattattagacttgtaacagaggagaacaagtatgataatgttaaacctggcggcagcgcaaaagatg

SEQ ID NO: 48242 - DNA, 103 bp, Artificial Sequence
  Synthetic Polynucleotide
taatacgactcactatagggctcattaccacaagtaataacattattagaaacagaggagatctaatatggttattactaacctggcggcagcgcaaaagatg

SEQ ID NO: 48243 - DNA, 103 bp, Artificial Sequence
  Synthetic Polynucleotide
taatacgactcactatagggaacatctcattaccacaagtaataacattaaacagaggagataatgtatgtacttgtggaacctggcggcagcgcaaaagatg

SEQ ID NO: 48244 - DNA, 103 bp, Artificial Sequence
  Synthetic Polynucleotide
taatacgactcactatagggcatttaacatctcattaccacaagtaataaaacagaggagattattaatggtggtaatgaacctggcggcagcgcaaaagatg

SEQ ID NO: 48245 - DNA, 103 bp, Artificial Sequence
  Synthetic Polynucleotide
taatacgactcactatagggtaattcatttaacatctcattaccacaagtaacagaggagaacttgtatgaatgagatgaacctggcggcagcgcaaaagatg

SEQ ID NO: 48246 - DNA, 103 bp, Artificial Sequence
  Synthetic Polynucleotide
taatacgactcactatagggtaacctaattcatttaacatctcattaccaaacagaggagatggtaaatggatgttaaaaacctggcggcagcgcaaaagatg

SEQ ID NO: 48247 - DNA, 103 bp, Artificial Sequence
  Synthetic Polynucleotide
taatacgactcactatagggcgctataacctaattcatttaacatctcataacagaggagaatgagaatgtaaatgaataacctggcggcagcgcaaaagatg

SEQ ID NO: 48248 - DNA, 103 bp, Artificial Sequence
  Synthetic Polynucleotide
taatacgactcactatagggaaacttttgatgcctgcagtgcacaatcataacagaggagaatgattatgcactgcaggaacctggcggcagcgcaaaagatg

SEQ ID NO: 48249 - DNA, 103 bp, Artificial Sequence
  Synthetic Polynucleotide
taatacgactcactatagggataaccgctataacctaattcatttaacataacagaggagaatgttaatggaattaggtaacctggcggcagcgcaaaagatg

SEQ ID NO: 48250 - DNA, 103 bp, Artificial Sequence
  Synthetic Polynucleotide
taatacgactcactatagggataaaataaccgctataacctaattcatttaacagaggagaaaatgaatgaggttatagaacctggcggcagcgcaaaagatg

SEQ ID NO: 48251 - DNA, 103 bp, Artificial Sequence
  Synthetic Polynucleotide
taatacgactcactataggggcgacataaaataaccgctataacctaattaacagaggagaaattagatgatagcggttaacctggcggcagcgcaaaagatg

SEQ ID NO: 48252 - DNA, 103 bp, Artificial Sequence
  Synthetic Polynucleotide
taatacgactcactatagggatgtggcgacataaaataaccgctataaccaacagaggagaggttatatgggttattttaacctggcggcagcgcaaaagatg

SEQ ID NO: 48253 - DNA, 103 bp, Artificial Sequence
  Synthetic Polynucleotide
taatacgactcactatagggcaccaatgtggcgacataaaataaccgctaaacagaggagatagcggatgttttatgtcaacctggcggcagcgcaaaagatg

SEQ ID NO: 48254 - DNA, 103 bp, Artificial Sequence
  Synthetic Polynucleotide
taatacgactcactatagggcggaacaccaatgtggcgacataaaataacaacagaggagagttattatgtgtcgccacaacctggcggcagcgcaaaagatg

SEQ ID NO: 48255 - DNA, 103 bp, Artificial Sequence
  Synthetic Polynucleotide
taatacgactcactatagggaagatcggaacaccaatgtggcgacataaaaacagaggagatttatgatgccacattggaacctggcggcagcgcaaaagatg

SEQ ID NO: 48256 - DNA, 103 bp, Artificial Sequence
  Synthetic Polynucleotide
taatacgactcactatagggttactaagatcggaacaccaatgtggcgacaacagaggagagtcgccatgttggtgttcaacctggcggcagcgcaaaagatg

SEQ ID NO: 48257 - DNA, 103 bp, Artificial Sequence
  Synthetic Polynucleotide
taatacgactcactatagggccatattactaagatcggaacaccaatgtgaacagaggagacacattatggttccgatcaacctggcggcagcgcaaaagatg

SEQ ID NO: 48258 - DNA, 103 bp, Artificial Sequence
  Synthetic Polynucleotide
taatacgactcactatagggctattccatattactaagatcggaacaccaaacagaggagatggtgtatggatcttagtaacctggcggcagcgcaaaagatg

SEQ ID NO: 48259 - DNA, 103 bp, Artificial Sequence
  Synthetic Polynucleotide
taatacgactcactatagggttgtaaaacttttgatgcctgcagtgcacaaacagaggagatgtgcaatgcaggcatcaaacctggcggcagcgcaaaagatg

SEQ ID NO: 48260 - DNA, 103 bp, Artificial Sequence
  Synthetic Polynucleotide
taatacgactcactatagggtaacactattccatattactaagatcggaaaacagaggagattccgaatgtagtaatataacctggcggcagcgcaaaagatg

SEQ ID NO: 48261 - DNA, 103 bp, Artificial Sequence
  Synthetic Polynucleotide
taatacgactcactatagggttatctaacactattccatattactaagataacagaggagaatcttaatgatatggaataacctggcggcagcgcaaaagatg

SEQ ID NO: 48262 - DNA, 103 bp, Artificial Sequence
  Synthetic Polynucleotide
taatacgactcactatagggcgcatttatctaacactattccatattactaacagaggagaagtaatatggaatagtgtaacctggcggcagcgcaaaagatg

SEQ ID NO: 48263 - DNA, 103 bp, Artificial Sequence
  Synthetic Polynucleotide
taatacgactcactataggggttaccgcatttatctaacactattccataaacagaggagatatggaatggtgttagataacctggcggcagcgcaaaagatg

SEQ ID NO: 48264 - DNA, 103 bp, Artificial Sequence
  Synthetic Polynucleotide
taatacgactcactatagggcatttgttaccgcatttatctaacactattaacagaggagaaatagtatgagataaatgaacctggcggcagcgcaaaagatg

SEQ ID NO: 48265 - DNA, 103 bp, Artificial Sequence
  Synthetic Polynucleotide
taatacgactcactatagggaggaacatttgttaccgcatttatctaacaaacagaggagatgttagatgaatgcggtaaacctggcggcagcgcaaaagatg

SEQ ID NO: 48266 - DNA, 103 bp, Artificial Sequence
  Synthetic Polynucleotide
taatacgactcactatagggcttacaggaacatttgttaccgcatttatcaacagaggagagataaaatgggtaacaaaaacctggcggcagcgcaaaagatg

SEQ ID NO: 48267 - DNA, 103 bp, Artificial Sequence
  Synthetic Polynucleotide
taatacgactcactatagggggttccttacaggaacatttgttaccgcataacagaggagaatgcggatgcaaatgttcaacctggcggcagcgcaaaagatg

SEQ ID NO: 48268 - DNA, 103 bp, Artificial Sequence
  Synthetic Polynucleotide
taatacgactcactataggggttatggttccttacaggaacatttgttacaacagaggagagtaacaatggttcctgtaaacctggcggcagcgcaaaagatg

SEQ ID NO: 48269 - DNA, 103 bp, Artificial Sequence
  Synthetic Polynucleotide
taatacgactcactatagggaagctgttatggttccttacaggaacatttaacagaggagaaaatgtatgtgtaaggaaaacctggcggcagcgcaaaagatg

SEQ ID NO: 48270 - DNA, 103 bp, Artificial Sequence
  Synthetic Polynucleotide
taatacgactcactataggggatagttgtaaaacttttgatgcctgcagtaacagaggagaactgcaatgatcaaaagtaacctggcggcagcgcaaaagatg

SEQ ID NO: 48271 - DNA, 103 bp, Artificial Sequence
  Synthetic Polynucleotide
taatacgactcactatagggaatctaagctgttatggttccttacaggaaaacagaggagattcctgatgggaaccataaacctggcggcagcgcaaaagatg

SEQ ID NO: 48272 - DNA, 103 bp, Artificial Sequence
  Synthetic Polynucleotide
taatacgactcactatagggcgttaaatctaagctgttatggttccttacaacagaggagagtaaggatgcataacagcaacctggcggcagcgcaaaagatg

SEQ ID NO: 48273 - DNA, 103 bp, Artificial Sequence
  Synthetic Polynucleotide
taatacgactcactatagggtttaacgttaaatctaagctgttatggttcaacagaggagagaaccaatgcagcttagaaacctggcggcagcgcaaaagatg

SEQ ID NO: 48274 - DNA, 103 bp, Artificial Sequence
  Synthetic Polynucleotide
taatacgactcactatagggtcatctttaacgttaaatctaagctgttataacagaggagaataacaatgtagatttaaaacctggcggcagcgcaaaagatg

SEQ ID NO: 48275 - DNA, 103 bp, Artificial Sequence
  Synthetic Polynucleotide
taatacgactcactatagggtatgctcatctttaacgttaaatctaagctaacagaggagaagcttaatgttaacgttaaacctggcggcagcgcaaaagatg

SEQ ID NO: 48276 - DNA, 103 bp, Artificial Sequence
  Synthetic Polynucleotide
taatacgactcactatagggatgtttatgctcatctttaacgttaaatctaacagaggagaagatttatggttaaagataacctggcggcagcgcaaaagatg

SEQ ID NO: 48277 - DNA, 103 bp, Artificial Sequence
  Synthetic Polynucleotide
taatacgactcactatagggttattatgtttatgctcatctttaacgttaaacagaggagataacgtatgagatgagcaaacctggcggcagcgcaaaagatg

SEQ ID NO: 48278 - DNA, 103 bp, Artificial Sequence
  Synthetic Polynucleotide
taatacgactcactatagggtttgtttattatgtttatgctcatctttaaaacagaggagattaaagatgagcataaacaacctggcggcagcgcaaaagatg

SEQ ID NO: 48279 - DNA, 103 bp, Artificial Sequence
  Synthetic Polynucleotide
taatacgactcactataggggtaattttgtttattatgtttatgctcatcaacagaggagagatgagatgaaacataataacctggcggcagcgcaaaagatg

SEQ ID NO: 48280 - DNA, 103 bp, Artificial Sequence
  Synthetic Polynucleotide
taatacgactcactatagggtgattgtaattttgtttattatgtttatgcaacagaggagagcataaatgtaataaacaaacctggcggcagcgcaaaagatg

SEQ ID NO: 48281 - DNA, 103 bp, Artificial Sequence
  Synthetic Polynucleotide
taatacgactcactatagggtttatgatagttgtaaaacttttgatgcctaacagaggagaaggcatatgaagttttacaacctggcggcagcgcaaaagatg

SEQ ID NO: 48282 - DNA, 103 bp, Artificial Sequence
  Synthetic Polynucleotide
taatacgactcactatagggaggtttgattgtaattttgtttattatgttaacagaggagaaacataatgaacaaaattaacctggcggcagcgcaaaagatg

SEQ ID NO: 48283 - DNA, 103 bp, Artificial Sequence
  Synthetic Polynucleotide
taatacgactcactataggggttataggtttgattgtaattttgtttattaacagaggagaaataaaatgaattacaataacctggcggcagcgcaaaagatg

SEQ ID NO: 48284 - DNA, 103 bp, Artificial Sequence
  Synthetic Polynucleotide
taatacgactcactatagggttaatgttataggtttgattgtaattttgtaacagaggagaacaaaaatgcaatcaaacaacctggcggcagcgcaaaagatg

SEQ ID NO: 48285 - DNA, 103 bp, Artificial Sequence
  Synthetic Polynucleotide
taatacgactcactatagggtgatattaatgttataggtttgattgtaataacagaggagaattacaatgaaacctataaacctggcggcagcgcaaaagatg

SEQ ID NO: 48286 - DNA, 103 bp, Artificial Sequence
  Synthetic Polynucleotide
taatacgactcactatagggttgtttgatattaatgttataggtttgattaacagaggagaaatcaaatgtataacattaacctggcggcagcgcaaaagatg

SEQ ID NO: 48287 - DNA, 103 bp, Artificial Sequence
  Synthetic Polynucleotide
taatacgactcactatagggttggattgtttgatattaatgttataggttaacagaggagaaacctaatgcattaatataacctggcggcagcgcaaaagatg

SEQ ID NO: 48288 - DNA, 103 bp, Artificial Sequence
  Synthetic Polynucleotide
taatacgactcactatagggattttttggattgtttgatattaatgttataacagaggagaataacaatgatatcaaacaacctggcggcagcgcaaaagatg

SEQ ID NO: 48289 - DNA, 103 bp, Artificial Sequence
  Synthetic Polynucleotide
taatacgactcactatagggatttcattttttggattgtttgatattaataacagaggagaattaatatgaaacaatccaacctggcggcagcgcaaaagatg

SEQ ID NO: 48290 - DNA, 103 bp, Artificial Sequence
  Synthetic Polynucleotide
taatacgactcactatagggcactgatttcattttttggattgtttgataaacagaggagatatcaaatgatccaaaaaaacctggcggcagcgcaaaagatg

SEQ ID NO: 48291 - DNA, 103 bp, Artificial Sequence
  Synthetic Polynucleotide
taatacgactcactatagggtactccactgatttcattttttggattgttaacagaggagaaacaatatgaaaaatgaaaacctggcggcagcgcaaaagatg

SEQ ID NO: 48292 - DNA, 103 bp, Artificial Sequence
  Synthetic Polynucleotide
taatacgactcactatagggtatgctttatgatagttgtaaaacttttgaaacagaggagatcaaaaatgttacaactaaacctggcggcagcgcaaaagatg

SEQ ID NO: 48293 - DNA, 103 bp, Artificial Sequence
  Synthetic Polynucleotide
taatacgactcactatagggtttactactccactgatttcattttttggaaacagaggagatccaaaatgtgaaatcagaacctggcggcagcgcaaaagatg

SEQ ID NO: 48294 - DNA, 103 bp, Artificial Sequence
  Synthetic Polynucleotide
taatacgactcactatagggacgcatttactactccactgatttcattttaacagaggagaaaaatgatgtcagtggagaacctggcggcagcgcaaaagatg

SEQ ID NO: 48295 - DNA, 103 bp, Artificial Sequence
  Synthetic Polynucleotide
taatacgactcactatagggtatgtacgcatttactactccactgatttcaacagaggagagaaatcatgggagtagtaaacctggcggcagcgcaaaagatg

SEQ ID NO: 48296 - DNA, 103 bp, Artificial Sequence
  Synthetic Polynucleotide
taatacgactcactatagggggagttatgtacgcatttactactccactgaacagaggagacagtggatgagtaaatgcaacctggcggcagcgcaaaagatg

SEQ ID NO: 48297 - DNA, 103 bp, Artificial Sequence
  Synthetic Polynucleotide
taatacgactcactatagggatccaggagttatgtacgcatttactactcaacagaggagagagtagatgatgcgtacaaacctggcggcagcgcaaaagatg

SEQ ID NO: 48298 - DNA, 103 bp, Artificial Sequence
  Synthetic Polynucleotide
taatacgactcactatagggacgttatccaggagttatgtacgcatttacaacagaggagagtaaatatgtacataactaacctggcggcagcgcaaaagatg

SEQ ID NO: 48299 - DNA, 103 bp, Artificial Sequence
  Synthetic Polynucleotide
taatacgactcactataggggttaaacgttatccaggagttatgtacgcaaacagaggagatgcgtaatgaactcctggaacctggcggcagcgcaaaagatg

SEQ ID NO: 48300 - DNA, 103 bp, Artificial Sequence
  Synthetic Polynucleotide
taatacgactcactatagggcagctgttaaacgttatccaggagttatgtaacagaggagaacataaatgctggataacaacctggcggcagcgcaaaagatg

SEQ ID NO: 48301 - DNA, 103 bp, Artificial Sequence
  Synthetic Polynucleotide
taatacgactcactatagggaacggcagctgttaaacgttatccaggagtaacagaggagaactcctatgtaacgtttaaacctggcggcagcgcaaaagatg

SEQ ID NO: 48302 - DNA, 103 bp, Artificial Sequence
  Synthetic Polynucleotide
taatacgactcactatagggataggaacggcagctgttaaacgttatccaaacagaggagatggataatgtttaacagcaacctggcggcagcgcaaaagatg

SEQ ID NO: 48303 - DNA, 103 bp, Artificial Sequence
  Synthetic Polynucleotide
taatacgactcactataggggatagtatgctttatgatagttgtaaaactaacagaggagaagttttatgactatcataaacctggcggcagcgcaaaagatg

SEQ ID NO: 48304 - DNA, 103 bp, Artificial Sequence
  Synthetic Polynucleotide
taatacgactcactatagggctagaataggaacggcagctgttaaacgttaacagaggagaaacgttatgcagctgccgaacctggcggcagcgcaaaagatg

SEQ ID NO: 48305 - DNA, 103 bp, Artificial Sequence
  Synthetic Polynucleotide
taatacgactcactatagggttggtctagaataggaacggcagctgttaaaacagaggagattaacaatggccgttcctaacctggcggcagcgcaaaagatg

SEQ ID NO: 48306 - DNA, 103 bp, Artificial Sequence
  Synthetic Polynucleotide
taatacgactcactatagggaatttttggtctagaataggaacggcagctaacagaggagaagctgcatgtcctattctaacctggcggcagcgcaaaagatg

SEQ ID NO: 48307 - DNA, 103 bp, Artificial Sequence
  Synthetic Polynucleotide
taatacgactcactatagggaaccaaatttttggtctagaataggaacggaacagaggagaccgttcatgttctagaccaacctggcggcagcgcaaaagatg

SEQ ID NO: 48308 - DNA, 103 bp, Artificial Sequence
  Synthetic Polynucleotide
taatacgactcactatagggcatgaaaccaaatttttggtctagaataggaacagaggagacctattatggaccaaaaaaacctggcggcagcgcaaaagatg

SEQ ID NO: 48309 - DNA, 103 bp, Artificial Sequence
  Synthetic Polynucleotide
taatacgactcactataggggaaaacatgaaaccaaatttttggtctagaaacagaggagatctagaatgaaaatttggaacctggcggcagcgcaaaagatg

SEQ ID NO: 48310 - DNA, 103 bp, Artificial Sequence
  Synthetic Polynucleotide
taatacgactcactataggggctttgaaaacatgaaaccaaatttttggtaacagaggagaaccaaaatgttggtttcaaacctggcggcagcgcaaaagatg

SEQ ID NO: 48311 - DNA, 103 bp, Artificial Sequence
  Synthetic Polynucleotide
taatacgactcactatagggacaccgctttgaaaacatgaaaccaaatttaacagaggagaaaatttatgttcatgtttaacctggcggcagcgcaaaagatg

SEQ ID NO: 48312 - DNA, 103 bp, Artificial Sequence
  Synthetic Polynucleotide
taatacgactcactataggggcagaacaccgctttgaaaacatgaaaccaaacagaggagatggtttatggttttcaaaaacctggcggcagcgcaaaagatg

SEQ ID NO: 48313 - DNA, 103 bp, Artificial Sequence
  Synthetic Polynucleotide
taatacgactcactatagggttgttgcagaacaccgctttgaaaacatgaaacagaggagatcatgtatgcaaagcggtaacctggcggcagcgcaaaagatg

SEQ ID NO: 48314 - DNA, 103 bp, Artificial Sequence
  Synthetic Polynucleotide
taatacgactcactataggggataggatagtatgctttatgatagttgtaaacagaggagatacaacatgcataaagcaaacctggcggcagcgcaaaagatg

SEQ ID NO: 48315 - DNA, 103 bp, Artificial Sequence
  Synthetic Polynucleotide
taatacgactcactatagggtcgtcttgttgcagaacaccgctttgaaaaaacagaggagattttcaatgcggtgttctaacctggcggcagcgcaaaagatg

SEQ ID NO: 48316 - DNA, 103 bp, Artificial Sequence
  Synthetic Polynucleotide
taatacgactcactataggggatcctcgtcttgttgcagaacaccgctttaacagaggagaaaagcgatgttctgcaacaacctggcggcagcgcaaaagatg

SEQ ID NO: 48317 - DNA, 103 bp, Artificial Sequence
  Synthetic Polynucleotide
taatacgactcactatagggaacacgatcctcgtcttgttgcagaacaccaacagaggagaggtgttatgcaacaagacaacctggcggcagcgcaaaagatg

SEQ ID NO: 48318 - DNA, 103 bp, Artificial Sequence
  Synthetic Polynucleotide
taatacgactcactatagggcgtagaacacgatcctcgtcttgttgcagaaacagaggagatctgcaatgagacgaggaaacctggcggcagcgcaaaagatg

SEQ ID NO: 48319 - DNA, 103 bp, Artificial Sequence
  Synthetic Polynucleotide
taatacgactcactatagggaaatacgtagaacacgatcctcgtcttgttaacagaggagaaacaagatgaggatcgtgaacctggcggcagcgcaaaagatg

SEQ ID NO: 48320 - DNA, 103 bp, Artificial Sequence
  Synthetic Polynucleotide
taatacgactcactatagggctgccaaatacgtagaacacgatcctcgtcaacagaggagagacgagatgcgtgttctaaacctggcggcagcgcaaaagatg

SEQ ID NO: 48321 - DNA, 103 bp, Artificial Sequence
  Synthetic Polynucleotide
taatacgactcactatagggtaactctgccaaatacgtagaacacgatccaacagaggagaggatcgatgtctacgtataacctggcggcagcgcaaaagatg

SEQ ID NO: 48322 - DNA, 103 bp, Artificial Sequence
  Synthetic Polynucleotide
taatacgactcactatagggatggataactctgccaaatacgtagaacacaacagaggagagtgttcatggtatttggcaacctggcggcagcgcaaaagatg

SEQ ID NO: 48323 - DNA, 103 bp, Artificial Sequence
  Synthetic Polynucleotide
taatacgactcactatagggaaataatggataactctgccaaatacgtagaacagaggagactacgtatgtggcagagtaacctggcggcagcgcaaaagatg

SEQ ID NO: 48324 - DNA, 103 bp, Artificial Sequence
  Synthetic Polynucleotide
taatacgactcactatagggcaggcaaataatggataactctgccaaataaacagaggagatatttgatggagttatccaacctggcggcagcgcaaaagatg

SEQ ID NO: 48325 - DNA, 103 bp, Artificial Sequence
  Synthetic Polynucleotide
taatacgactcactatagggggttggataggatagtatgctttatgatagaacagaggagactatcaatgagcatactaaacctggcggcagcgcaaaagatg

SEQ ID NO: 48326 - DNA, 103 bp, Artificial Sequence
  Synthetic Polynucleotide
taatacgactcactatagggattaacaggcaaataatggataactctgccaacagaggagaggcagaatgatccattataacctggcggcagcgcaaaagatg

SEQ ID NO: 48327 - DNA, 103 bp, Artificial Sequence
  Synthetic Polynucleotide
taatacgactcactatagggtaaagattaacaggcaaataatggataactaacagaggagaagttatatgttatttgccaacctggcggcagcgcaaaagatg

SEQ ID NO: 48328 - DNA, 103 bp, Artificial Sequence
  Synthetic Polynucleotide
taatacgactcactatagggcgaaataaagattaacaggcaaataatggaaacagaggagatccattatgtgcctgttaaacctggcggcagcgcaaaagatg

SEQ ID NO: 48329 - DNA, 103 bp, Artificial Sequence
  Synthetic Polynucleotide
taatacgactcactataggggaaaacgaaataaagattaacaggcaaataaacagaggagatatttgatggttaatcttaacctggcggcagcgcaaaagatg

SEQ ID NO: 48330 - DNA, 103 bp, Artificial Sequence
  Synthetic Polynucleotide
taatacgactcactataggggaatcgaaaacgaaataaagattaacaggcaacagaggagagcctgtatgtctttatttaacctggcggcagcgcaaaagatg

SEQ ID NO: 48331 - DNA, 103 bp, Artificial Sequence
  Synthetic Polynucleotide
taatacgactcactatagggagccagaatcgaaaacgaaataaagattaaaacagaggagattaatcatgatttcgtttaacctggcggcagcgcaaaagatg

SEQ ID NO: 48332 - DNA, 103 bp, Artificial Sequence
  Synthetic Polynucleotide
taatacgactcactataggggaaatagccagaatcgaaaacgaaataaagaacagaggagactttatatggttttcgataacctggcggcagcgcaaaagatg

SEQ ID NO: 48333 - DNA, 103 bp, Artificial Sequence
  Synthetic Polynucleotide
taatacgactcactatagggattttgaaatagccagaatcgaaaacgaaaaacagaggagatttcgtatgcgattctggaacctggcggcagcgcaaaagatg

SEQ ID NO: 48334 - DNA, 103 bp, Artificial Sequence
  Synthetic Polynucleotide
taatacgactcactatagggattttattttgaaatagccagaatcgaaaaaacagaggagattttcgatgctggctattaacctggcggcagcgcaaaagatg

SEQ ID NO: 48335 - DNA, 103 bp, Artificial Sequence
  Synthetic Polynucleotide
taatacgactcactatagggtcgggattttattttgaaatagccagaatcaacagaggagagattctatgtatttcaaaaacctggcggcagcgcaaaagatg

SEQ ID NO: 48336 - DNA, 103 bp, Artificial Sequence
  Synthetic Polynucleotide
taatacgactcactatagggataatggttggataggatagtatgctttataacagaggagaataaagatgactatcctaaacctggcggcagcgcaaaagatg

SEQ ID NO: 48337 - DNA, 103 bp, Artificial Sequence
  Synthetic Polynucleotide
taatacgactcactatagggtatcatcgggattttattttgaaatagccaaacagaggagatggctaatgcaaaataaaaacctggcggcagcgcaaaagatg

SEQ ID NO: 48338 - DNA, 103 bp, Artificial Sequence
  Synthetic Polynucleotide
taatacgactcactatagggaggtctatcatcgggattttattttgaaataacagaggagaatttcaatgtaaaatcccaacctggcggcagcgcaaaagatg

SEQ ID NO: 48339 - DNA, 103 bp, Artificial Sequence
  Synthetic Polynucleotide
taatacgactcactatagggtctggaggtctatcatcgggattttattttaacagaggagaaaaataatgtcccgatgaaacctggcggcagcgcaaaagatg

SEQ ID NO: 48340 - DNA, 103 bp, Artificial Sequence
  Synthetic Polynucleotide
taatacgactcactatagggtaaagtctggaggtctatcatcgggattttaacagaggagaaaaatcatgatgatagacaacctggcggcagcgcaaaagatg

SEQ ID NO: 48341 - DNA, 103 bp, Artificial Sequence
  Synthetic Polynucleotide
taatacgactcactatagggaattataaagtctggaggtctatcatcgggaacagaggagacccgatatgagacctccaaacctggcggcagcgcaaaagatg

SEQ ID NO: 48342 - DNA, 103 bp, Artificial Sequence
  Synthetic Polynucleotide
taatacgactcactataggggatgaaattataaagtctggaggtctatcaaacagaggagatgatagatgtccagacttaacctggcggcagcgcaaaagatg

SEQ ID NO: 48343 - DNA, 103 bp, Artificial Sequence
  Synthetic Polynucleotide
taatacgactcactatagggttgtagatgaaattataaagtctggaggtcaacagaggagagacctcatgactttataaaacctggcggcagcgcaaaagatg

SEQ ID NO: 48344 - DNA, 103 bp, Artificial Sequence
  Synthetic Polynucleotide
taatacgactcactataggggaacattgtagatgaaattataaagtctggaacagaggagaccagacatgataatttcaaacctggcggcagcgcaaaagatg

SEQ ID NO: 48345 - DNA, 103 bp, Artificial Sequence
  Synthetic Polynucleotide
taatacgactcactataggggcgctgaacattgtagatgaaattataaagaacagaggagactttatatgttcatctacaacctggcggcagcgcaaaagatg

SEQ ID NO: 48346 - DNA, 103 bp, Artificial Sequence
  Synthetic Polynucleotide
taatacgactcactatagggctacggcgctgaacattgtagatgaaattaaacagaggagataatttatgctacaatgtaacctggcggcagcgcaaaagatg

SEQ ID NO: 48347 - DNA, 103 bp, Artificial Sequence
  Synthetic Polynucleotide
taatacgactcactatagggtaaccttcgtctaccttcacaatggcctctaacagaggagaagaggcatgtgtgaaggtaacctggcggcagcgcaaaagatg

SEQ ID NO: 48348 - DNA, 103 bp, Artificial Sequence
  Synthetic Polynucleotide
taatacgactcactatagggataccataatggttggataggatagtatgcaacagaggagagcatacatgcctatccaaaacctggcggcagcgcaaaagatg

SEQ ID NO: 48349 - DNA, 103 bp, Artificial Sequence
  Synthetic Polynucleotide
taatacgactcactatagggagttactacggcgctgaacattgtagatgaaacagaggagatcatctatgatgttcagcaacctggcggcagcgcaaaagatg

SEQ ID NO: 48350 - DNA, 103 bp, Artificial Sequence
  Synthetic Polynucleotide
taatacgactcactatagggattagagttactacggcgctgaacattgtaaacagaggagatacaatatgcagcgccgtaacctggcggcagcgcaaaagatg

SEQ ID NO: 48351 - DNA, 103 bp, Artificial Sequence
  Synthetic Polynucleotide
taatacgactcactatagggatattattagagttactacggcgctgaacaaacagaggagatgttcaatgccgtagtaaaacctggcggcagcgcaaaagatg

SEQ ID NO: 48352 - DNA, 103 bp, Artificial Sequence
  Synthetic Polynucleotide
taatacgactcactatagggagcctatattattagagttactacggcgctaacagaggagaagcgccatggtaactctaaacctggcggcagcgcaaaagatg

SEQ ID NO: 48353 - DNA, 103 bp, Artificial Sequence
  Synthetic Polynucleotide
taatacgactcactatagggttgtcagcctatattattagagttactacgaacagaggagacgtagtatgtctaataataacctggcggcagcgcaaaagatg

SEQ ID NO: 48354 - DNA, 103 bp, Artificial Sequence
  Synthetic Polynucleotide
taatacgactcactatagggttagcttgtcagcctatattattagagttaaacagaggagataactcatgtaatataggaacctggcggcagcgcaaaagatg

SEQ ID NO: 48355 - DNA, 103 bp, Artificial Sequence
  Synthetic Polynucleotide
taatacgactcactatagggtgatgttagcttgtcagcctatattattagaacagaggagactaataatgtaggctgacaacctggcggcagcgcaaaagatg

SEQ ID NO: 48356 - DNA, 103 bp, Artificial Sequence
  Synthetic Polynucleotide
taatacgactcactataggggggtatgatgttagcttgtcagcctatattaacagaggagaaatataatgtgacaagctaacctggcggcagcgcaaaagatg

SEQ ID NO: 48357 - DNA, 103 bp, Artificial Sequence
  Synthetic Polynucleotide
taatacgactcactatagggcaggagggtatgatgttagcttgtcagcctaacagaggagaaggctgatgagctaacataacctggcggcagcgcaaaagatg

SEQ ID NO: 48358 - DNA, 103 bp, Artificial Sequence
  Synthetic Polynucleotide
taatacgactcactatagggatatacaggagggtatgatgttagcttgtcaacagaggagagacaagatgacatcatacaacctggcggcagcgcaaaagatg

SEQ ID NO: 48359 - DNA, 103 bp, Artificial Sequence
  Synthetic Polynucleotide
taatacgactcactatagggcatcaataccataatggttggataggatagaacagaggagactatccatgccaaccattaacctggcggcagcgcaaaagatg

SEQ ID NO: 48360 - DNA, 103 bp, Artificial Sequence
  Synthetic Polynucleotide
taatacgactcactatagggttcacatatacaggagggtatgatgttagcaacagaggagagctaacatgataccctccaacctggcggcagcgcaaaagatg

SEQ ID NO: 48361 - DNA, 103 bp, Artificial Sequence
  Synthetic Polynucleotide
taatacgactcactatagggtcatattcacatatacaggagggtatgatgaacagaggagacatcatatgctcctgtataacctggcggcagcgcaaaagatg

SEQ ID NO: 48362 - DNA, 103 bp, Artificial Sequence
  Synthetic Polynucleotide
taatacgactcactatagggtcatgtcatattcacatatacaggagggtaaacagaggagataccctatggtatatgtgaacctggcggcagcgcaaaagatg

SEQ ID NO: 48363 - DNA, 103 bp, Artificial Sequence
  Synthetic Polynucleotide
taatacgactcactatagggaaaaatcatgtcatattcacatatacaggaaacagaggagatcctgtatgtgtgaatataacctggcggcagcgcaaaagatg

SEQ ID NO: 48364 - DNA, 103 bp, Artificial Sequence
  Synthetic Polynucleotide
taatacgactcactatagggtggacaaaaatcatgtcatattcacatataaacagaggagatatatgatgatatgacataacctggcggcagcgcaaaagatg

SEQ ID NO: 48365 - DNA, 103 bp, Artificial Sequence
  Synthetic Polynucleotide
taatacgactcactatagggagtaatggacaaaaatcatgtcatattcacaacagaggagagtgaatatgacatgatttaacctggcggcagcgcaaaagatg

SEQ ID NO: 48366 - DNA, 103 bp, Artificial Sequence
  Synthetic Polynucleotide
taatacgactcactataggggagctagtaatggacaaaaatcatgtcataaacagaggagatatgacatgatttttgtcaacctggcggcagcgcaaaagatg

SEQ ID NO: 48367 - DNA, 103 bp, Artificial Sequence
  Synthetic Polynucleotide
taatacgactcactatagggaaaccgagctagtaatggacaaaaatcatgaacagaggagacatgatatgtgtccattaaacctggcggcagcgcaaaagatg

SEQ ID NO: 48368 - DNA, 103 bp, Artificial Sequence
  Synthetic Polynucleotide
taatacgactcactatagggagttaaaaccgagctagtaatggacaaaaaaacagaggagatttttgatgattactagcaacctggcggcagcgcaaaagatg

SEQ ID NO: 48369 - DNA, 103 bp, Artificial Sequence
  Synthetic Polynucleotide
taatacgactcactatagggaataaagttaaaaccgagctagtaatggacaacagaggagagtccatatgtagctcggtaacctggcggcagcgcaaaagatg

SEQ ID NO: 48370 - DNA, 103 bp, Artificial Sequence
  Synthetic Polynucleotide
taatacgactcactatagggtatagcatcaataccataatggttggatagaacagaggagactatccatgcattatggtaacctggcggcagcgcaaaagatg

SEQ ID NO: 48371 - DNA, 103 bp, Artificial Sequence
  Synthetic Polynucleotide
taatacgactcactatagggcaggcaataaagttaaaaccgagctagtaaaacagaggagattactaatgcggttttaaaacctggcggcagcgcaaaagatg

SEQ ID NO: 48372 - DNA, 103 bp, Artificial Sequence
  Synthetic Polynucleotide
taatacgactcactatagggtattacaggcaataaagttaaaaccgagctaacagaggagaagctcgatgttaactttaaacctggcggcagcgcaaaagatg

SEQ ID NO: 48373 - DNA, 103 bp, Artificial Sequence
  Synthetic Polynucleotide
taatacgactcactataggggaaattattacaggcaataaagttaaaaccaacagaggagaggttttatgtttattgccaacctggcggcagcgcaaaagatg

SEQ ID NO: 48374 - DNA, 103 bp, Artificial Sequence
  Synthetic Polynucleotide
taatacgactcactatagggtgagagaaattattacaggcaataaagttaaacagaggagataacttatgtgcctgtaaaacctggcggcagcgcaaaagatg

SEQ ID NO: 48375 - DNA, 103 bp, Artificial Sequence
  Synthetic Polynucleotide
taatacgactcactatagggacagatgagagaaattattacaggcaataaaacagaggagattattgatggtaataattaacctggcggcagcgcaaaagatg

SEQ ID NO: 48376 - DNA, 103 bp, Artificial Sequence
  Synthetic Polynucleotide
taatacgactcactatagggatcctacagatgagagaaattattacaggcaacagaggagagcctgtatgaatttctctaacctggcggcagcgcaaaagatg

SEQ ID NO: 48377 - DNA, 103 bp, Artificial Sequence
  Synthetic Polynucleotide
taatacgactcactatagggtagatatcctacagatgagagaaattattaaacagaggagataataaatgctctcatctaacctggcggcagcgcaaaagatg

SEQ ID NO: 48378 - DNA, 103 bp, Artificial Sequence
  Synthetic Polynucleotide
taatacgactcactataggggaaaatagatatcctacagatgagagaaataacagaggagaatttctatgatctgtaggaacctggcggcagcgcaaaagatg

SEQ ID NO: 48379 - DNA, 103 bp, Artificial Sequence
  Synthetic Polynucleotide
taatacgactcactataggggacaagaaaatagatatcctacagatgagaaacagaggagatctcatatgtaggatatcaacctggcggcagcgcaaaagatg

SEQ ID NO: 48380 - DNA, 103 bp, Artificial Sequence
  Synthetic Polynucleotide
taatacgactcactatagggtgcatgacaagaaaatagatatcctacagaaacagaggagatctgtaatgtatctatttaacctggcggcagcgcaaaagatg

SEQ ID NO: 48381 - DNA, 103 bp, Artificial Sequence
  Synthetic Polynucleotide
taatacgactcactatagggtatactatagcatcaataccataatggttgaacagaggagacaaccaatgtggtattgaaacctggcggcagcgcaaaagatg

SEQ ID NO: 48382 - DNA, 103 bp, Artificial Sequence
  Synthetic Polynucleotide
taatacgactcactatagggggcaatgcatgacaagaaaatagatatcctaacagaggagaaggataatgattttcttgaacctggcggcagcgcaaaagatg

SEQ ID NO: 48383 - DNA, 103 bp, Artificial Sequence
  Synthetic Polynucleotide
taatacgactcactatagggttaaaggcaatgcatgacaagaaaatagataacagaggagaatctatatgcttgtcatgaacctggcggcagcgcaaaagatg

SEQ ID NO: 48384 - DNA, 103 bp, Artificial Sequence
  Synthetic Polynucleotide
taatacgactcactatagggcagtcttaaaggcaatgcatgacaagaaaaaacagaggagattttctatgcatgcattgaacctggcggcagcgcaaaagatg

SEQ ID NO: 48385 - DNA, 103 bp, Artificial Sequence
  Synthetic Polynucleotide
taatacgactcactatagggtcgtccagtcttaaaggcaatgcatgacaaaacagaggagattgtcaatgattgcctttaacctggcggcagcgcaaaagatg

SEQ ID NO: 48386 - DNA, 103 bp, Artificial Sequence
  Synthetic Polynucleotide
taatacgactcactatagggtttcttcgtccagtcttaaaggcaatgcataacagaggagaatgcatatgctttaagacaacctggcggcagcgcaaaagatg

SEQ ID NO: 48387 - DNA, 103 bp, Artificial Sequence
  Synthetic Polynucleotide
taatacgactcactatagggttacgtttcttcgtccagtcttaaaggcaaaacagaggagattgcctatgagactggacaacctggcggcagcgcaaaagatg

SEQ ID NO: 48388 - DNA, 103 bp, Artificial Sequence
  Synthetic Polynucleotide
taatacgactcactatagggggatattacgtttcttcgtccagtcttaaaaacagaggagatttaagatgggacgaagaaacctggcggcagcgcaaaagatg

SEQ ID NO: 48389 - DNA, 103 bp, Artificial Sequence
  Synthetic Polynucleotide
taatacgactcactatagggattgaggatattacgtttcttcgtccagtcaacagaggagagactggatgaagaaacgtaacctggcggcagcgcaaaagatg

SEQ ID NO: 48390 - DNA, 103 bp, Artificial Sequence
  Synthetic Polynucleotide
taatacgactcactatagggacgttattgaggatattacgtttcttcgtcaacagaggagagacgaaatgacgtaatataacctggcggcagcgcaaaagatg

SEQ ID NO: 48391 - DNA, 103 bp, Artificial Sequence
  Synthetic Polynucleotide
taatacgactcactatagggtgataacgttattgaggatattacgtttctaacagaggagaagaaacatgatatcctcaaacctggcggcagcgcaaaagatg

SEQ ID NO: 48392 - DNA, 103 bp, Artificial Sequence
  Synthetic Polynucleotide
taatacgactcactatagggtaaaatatactatagcatcaataccataataacagaggagaattatgatgttgatgctaaacctggcggcagcgcaaaagatg

SEQ ID NO: 48393 - DNA, 103 bp, Artificial Sequence
  Synthetic Polynucleotide
taatacgactcactataggggaaaatgataacgttattgaggatattacgaacagaggagacgtaatatgctcaataacaacctggcggcagcgcaaaagatg

SEQ ID NO: 48394 - DNA, 103 bp, Artificial Sequence
  Synthetic Polynucleotide
taatacgactcactatagggttgtagaaaatgataacgttattgaggataaacagaggagatatcctatgtaacgttataacctggcggcagcgcaaaagatg

SEQ ID NO: 48395 - DNA, 103 bp, Artificial Sequence
  Synthetic Polynucleotide
taatacgactcactatagggagttattgtagaaaatgataacgttattgaaacagaggagatcaataatgttatcatttaacctggcggcagcgcaaaagatg

SEQ ID NO: 48396 - DNA, 103 bp, Artificial Sequence
  Synthetic Polynucleotide
taatacgactcactatagggtatgtagttattgtagaaaatgataacgttaacagaggagaaacgttatgattttctacaacctggcggcagcgcaaaagatg

SEQ ID NO: 48397 - DNA, 103 bp, Artificial Sequence
  Synthetic Polynucleotide
taatacgactcactatagggtagaatatgtagttattgtagaaaatgataaacagaggagatatcatatgctacaataaaacctggcggcagcgcaaaagatg

SEQ ID NO: 48398 - DNA, 103 bp, Artificial Sequence
  Synthetic Polynucleotide
taatacgactcactatagggaaaggtagaatatgtagttattgtagaaaaaacagaggagattttctatgataactacaaacctggcggcagcgcaaaagatg

SEQ ID NO: 48399 - DNA, 103 bp, Artificial Sequence
  Synthetic Polynucleotide
taatacgactcactatagggaataaaaaggtagaatatgtagttattgtaaacagaggagatacaatatgtacatattcaacctggcggcagcgcaaaagatg

SEQ ID NO: 48400 - DNA, 103 bp, Artificial Sequence
  Synthetic Polynucleotide
taatacgactcactatagggtagaaaataaaaaggtagaatatgtagttaaacagaggagataactaatgattctacctaacctggcggcagcgcaaaagatg

SEQ ID NO: 48401 - DNA, 103 bp, Artificial Sequence
  Synthetic Polynucleotide
taatacgactcactatagggcgagttagaaaataaaaaggtagaatatgtaacagaggagaacatatatgacctttttaaacctggcggcagcgcaaaagatg

SEQ ID NO: 48402 - DNA, 103 bp, Artificial Sequence
  Synthetic Polynucleotide
taatacgactcactatagggtttaccgagttagaaaataaaaaggtagaaaacagaggagattctacatgtttattttcaacctggcggcagcgcaaaagatg

SEQ ID NO: 48403 - DNA, 103 bp, Artificial Sequence
  Synthetic Polynucleotide
taatacgactcactatagggtgaattaaaatatactatagcatcaataccaacagaggagaggtattatggctatagtaaacctggcggcagcgcaaaagatg

SEQ ID NO: 48404 - DNA, 103 bp, Artificial Sequence
  Synthetic Polynucleotide
taatacgactcactatagggaattttttaccgagttagaaaataaaaaggaacagaggagaccttttatgtttctaactaacctggcggcagcgcaaaagatg

SEQ ID NO: 48405 - DNA, 103 bp, Artificial Sequence
  Synthetic Polynucleotide
taatacgactcactatagggttctaaattttttaccgagttagaaaataaaacagaggagattatttatgaactcggtaaacctggcggcagcgcaaaagatg

SEQ ID NO: 48406 - DNA, 103 bp, Artificial Sequence
  Synthetic Polynucleotide
taatacgactcactatagggtgggattctaaattttttaccgagttagaaaacagaggagattctaaatgggtaaaaaaaacctggcggcagcgcaaaagatg

SEQ ID NO: 48407 - DNA, 103 bp, Artificial Sequence
  Synthetic Polynucleotide
taatacgactcactatagggccctatgggattctaaattttttaccgagtaacagaggagaactcggatgaaaatttagaacctggcggcagcgcaaaagatg

SEQ ID NO: 48408 - DNA, 103 bp, Artificial Sequence
  Synthetic Polynucleotide
taatacgactcactatagggtttagccctatgggattctaaattttttacaacagaggagagtaaaaatgttagaatccaacctggcggcagcgcaaaagatg

SEQ ID NO: 48409 - DNA, 103 bp, Artificial Sequence
  Synthetic Polynucleotide
taatacgactcactatagggagacatttagccctatgggattctaaatttaacagaggagaaaatttatgatcccatagaacctggcggcagcgcaaaagatg

SEQ ID NO: 48410 - DNA, 103 bp, Artificial Sequence
  Synthetic Polynucleotide
taatacgactcactatagggtcgctagacatttagccctatgggattctaaacagaggagatagaatatgatagggctaaacctggcggcagcgcaaaagatg

SEQ ID NO: 48411 - DNA, 103 bp, Artificial Sequence
  Synthetic Polynucleotide
taatacgactcactatagggaaatatcgctagacatttagccctatgggaaacagaggagatcccatatggctaaatgtaacctggcggcagcgcaaaagatg

SEQ ID NO: 48412 - DNA, 103 bp, Artificial Sequence
  Synthetic Polynucleotide
taatacgactcactatagggaaaagaaatatcgctagacatttagccctaaacagaggagatagggcatgatgtctagcaacctggcggcagcgcaaaagatg

SEQ ID NO: 48413 - DNA, 103 bp, Artificial Sequence
  Synthetic Polynucleotide
taatacgactcactatagggaaacgaaaagaaatatcgctagacatttagaacagaggagactaaatatgtagcgatataacctggcggcagcgcaaaagatg

SEQ ID NO: 48414 - DNA, 103 bp, Artificial Sequence
  Synthetic Polynucleotide
taatacgactcactatagggtgaaatgaattaaaatatactatagcatcaaacagaggagatgatgcatgagtatatttaacctggcggcagcgcaaaagatg

SEQ ID NO: 48415 - DNA, 103 bp, Artificial Sequence
  Synthetic Polynucleotide
taatacgactcactatagggagaggaaacgaaaagaaatatcgctagacaaacagaggagatgtctaatgatatttcttaacctggcggcagcgcaaaagatg

SEQ ID NO: 48416 - DNA, 103 bp, Artificial Sequence
  Synthetic Polynucleotide
taatacgactcactatagggtgtacagaggaaacgaaaagaaatatcgctaacagaggagaagcgatatgtcttttcgtaacctggcggcagcgcaaaagatg

SEQ ID NO: 48417 - DNA, 103 bp, Artificial Sequence
  Synthetic Polynucleotide
taatacgactcactatagggccatgtgtacagaggaaacgaaaagaaataaacagaggagatatttcatgtcgtttcctaacctggcggcagcgcaaaagatg

SEQ ID NO: 48418 - DNA, 103 bp, Artificial Sequence
  Synthetic Polynucleotide
taatacgactcactatagggtaacaccatgtgtacagaggaaacgaaaagaacagaggagacttttcatgtcctctgtaaacctggcggcagcgcaaaagatg

SEQ ID NO: 48419 - DNA, 103 bp, Artificial Sequence
  Synthetic Polynucleotide
taatacgactcactatagggttttgtaacaccatgtgtacagaggaaacgaacagaggagacgtttcatgtgtacacataacctggcggcagcgcaaaagatg

SEQ ID NO: 48420 - DNA, 103 bp, Artificial Sequence
  Synthetic Polynucleotide
taatacgactcactatagggcagggttttgtaacaccatgtgtacagaggaacagaggagacctctgatgacatggtgtaacctggcggcagcgcaaaagatg

SEQ ID NO: 48421 - DNA, 103 bp, Artificial Sequence
  Synthetic Polynucleotide
taatacgactcactatagggcttttcagggttttgtaacaccatgtgtacaacagaggagagtacacatggtgttacaaaacctggcggcagcgcaaaagatg

SEQ ID NO: 48422 - DNA, 103 bp, Artificial Sequence
  Synthetic Polynucleotide
taatacgactcactatagggcacttcttttcagggttttgtaacaccatgaacagaggagacatggtatgacaaaacccaacctggcggcagcgcaaaagatg

SEQ ID NO: 48423 - DNA, 103 bp, Artificial Sequence
  Synthetic Polynucleotide
taatacgactcactatagggatactcacttcttttcagggttttgtaacaaacagaggagatgttacatgaccctgaaaaacctggcggcagcgcaaaagatg

SEQ ID NO: 48424 - DNA, 103 bp, Artificial Sequence
  Synthetic Polynucleotide
taatacgactcactatagggcaagtatactcacttcttttcagggttttgaacagaggagacaaaacatggaaaagaagaacctggcggcagcgcaaaagatg

SEQ ID NO: 48425 - DNA, 103 bp, Artificial Sequence
  Synthetic Polynucleotide
taatacgactcactatagggataaatgaaatgaattaaaatatactatagaacagaggagactatagatgattttaattaacctggcggcagcgcaaaagatg

SEQ ID NO: 48426 - DNA, 103 bp, Artificial Sequence
  Synthetic Polynucleotide
taatacgactcactataggggatgacaagtatactcacttcttttcagggaacagaggagaccctgaatggaagtgagtaacctggcggcagcgcaaaagatg

SEQ ID NO: 48427 - DNA, 103 bp, Artificial Sequence
  Synthetic Polynucleotide
taatacgactcactataggggaaatgatgacaagtatactcacttcttttaacagaggagaaaaagaatggagtatactaacctggcggcagcgcaaaagatg

SEQ ID NO: 48428 - DNA, 103 bp, Artificial Sequence
  Synthetic Polynucleotide
taatacgactcactatagggcattagaaatgatgacaagtatactcacttaacagaggagaaagtgaatgtacttgtcaaacctggcggcagcgcaaaagatg

SEQ ID NO: 48429 - DNA, 103 bp, Artificial Sequence
  Synthetic Polynucleotide
taatacgactcactatagggggaaacattagaaatgatgacaagtatactaacagaggagaagtataatggtcatcattaacctggcggcagcgcaaaagatg

SEQ ID NO: 48430 - DNA, 103 bp, Artificial Sequence
  Synthetic Polynucleotide
taatacgactcactatagggctggaggaaacattagaaatgatgacaagtaacagaggagaacttgtatgcatttctaaaacctggcggcagcgcaaaagatg

SEQ ID NO: 48431 - DNA, 103 bp, Artificial Sequence
  Synthetic Polynucleotide
taatacgactcactatagggctggactggaggaaacattagaaatgatgaaacagaggagatcatcaatgctaatgtttaacctggcggcagcgcaaaagatg

SEQ ID NO: 48432 - DNA, 103 bp, Artificial Sequence
  Synthetic Polynucleotide
taatacgactcactatagggatacactggactggaggaaacattagaaataacagaggagaatttctatggtttcctccaacctggcggcagcgcaaaagatg

SEQ ID NO: 48433 - DNA, 103 bp, Artificial Sequence
  Synthetic Polynucleotide
taatacgactcactatagggcgtttatacactggactggaggaaacattaaacagaggagataatgtatgctccagtccaacctggcggcagcgcaaaagatg

SEQ ID NO: 48434 - DNA, 103 bp, Artificial Sequence
  Synthetic Polynucleotide
taatacgactcactatagggttatgcgtttatacactggactggaggaaaaacagaggagatttcctatggtccagtgtaacctggcggcagcgcaaaagatg

SEQ ID NO: 48435 - DNA, 103 bp, Artificial Sequence
  Synthetic Polynucleotide
taatacgactcactatagggaaggattatgcgtttatacactggactggaaacagaggagatccagtatggtgtataaaaacctggcggcagcgcaaaagatg

SEQ ID NO: 48436 - DNA, 103 bp, Artificial Sequence
  Synthetic Polynucleotide
taatacgactcactatagggtacacataaatgaaatgaattaaaatatacaacagaggagagtatatatgaattcatttaacctggcggcagcgcaaaagatg

SEQ ID NO: 48437 - DNA, 103 bp, Artificial Sequence
  Synthetic Polynucleotide
taatacgactcactatagggattacaaggattatgcgtttatacactggaaacagaggagatccagtatgtaaacgcataacctggcggcagcgcaaaagatg

SEQ ID NO: 48438 - DNA, 103 bp, Artificial Sequence
  Synthetic Polynucleotide
taatacgactcactatagggagatcattacaaggattatgcgtttatacaaacagaggagatgtataatggcataatccaacctggcggcagcgcaaaagatg

SEQ ID NO: 48439 - DNA, 103 bp, Artificial Sequence
  Synthetic Polynucleotide
taatacgactcactataggggatccagatcattacaaggattatgcgtttaacagaggagaaaacgcatgatccttgtaaacctggcggcagcgcaaaagatg

SEQ ID NO: 48440 - DNA, 103 bp, Artificial Sequence
  Synthetic Polynucleotide
taatacgactcactatagggaggatgatccagatcattacaaggattatgaacagaggagacataatatgtgtaatgataacctggcggcagcgcaaaagatg

SEQ ID NO: 48441 - DNA, 103 bp, Artificial Sequence
  Synthetic Polynucleotide
taatacgactcactatagggagtcaaggatgatccagatcattacaaggaaacagaggagatccttgatgtgatctggaaacctggcggcagcgcaaaagatg

SEQ ID NO: 48442 - DNA, 103 bp, Artificial Sequence
  Synthetic Polynucleotide
taatacgactcactataggggtgatagtcaaggatgatccagatcattacaacagaggagagtaatgatgtggatcatcaacctggcggcagcgcaaaagatg

SEQ ID NO: 48443 - DNA, 103 bp, Artificial Sequence
  Synthetic Polynucleotide
taatacgactcactatagggatgttgtgatagtcaaggatgatccagatcaacagaggagagatctgatgcatccttgaaacctggcggcagcgcaaaagatg

SEQ ID NO: 48444 - DNA, 103 bp, Artificial Sequence
  Synthetic Polynucleotide
taatacgactcactatagggaagaaatgttgtgatagtcaaggatgatccaacagaggagaggatcaatgttgactatcaacctggcggcagcgcaaaagatg

SEQ ID NO: 48445 - DNA, 103 bp, Artificial Sequence
  Synthetic Polynucleotide
taatacgactcactataggggaaaaaagaaatgttgtgatagtcaaggataacagaggagaatccttatgtatcacaacaacctggcggcagcgcaaaagatg

SEQ ID NO: 48446 - DNA, 103 bp, Artificial Sequence
  Synthetic Polynucleotide
taatacgactcactatagggtgccagaaaaaagaaatgttgtgatagtcaaacagaggagatgactaatgcaacatttcaacctggcggcagcgcaaaagatg

SEQ ID NO: 48447 - DNA, 103 bp, Artificial Sequence
  Synthetic Polynucleotide
taatacgactcactatagggccaaatacacataaatgaaatgaattaaaaaacagaggagattttaaatgatttcatttaacctggcggcagcgcaaaagatg

SEQ ID NO: 48448 - DNA, 103 bp, Artificial Sequence
  Synthetic Polynucleotide
taatacgactcactatagggagttatgccagaaaaaagaaatgttgtgataacagaggagaatcacaatgtttctttttaacctggcggcagcgcaaaagatg

SEQ ID NO: 48449 - DNA, 103 bp, Artificial Sequence
  Synthetic Polynucleotide
taatacgactcactatagggaacgaagttatgccagaaaaaagaaatgttaacagaggagaaacattatgtttttctggaacctggcggcagcgcaaaagatg

SEQ ID NO: 48450 - DNA, 103 bp, Artificial Sequence
  Synthetic Polynucleotide
taatacgactcactatagggaggacaacgaagttatgccagaaaaaagaaaacagaggagattctttatgctggcataaaacctggcggcagcgcaaaagatg

SEQ ID NO: 48451 - DNA, 103 bp, Artificial Sequence
  Synthetic Polynucleotide
taatacgactcactatagggtgtgaaggacaacgaagttatgccagaaaaaacagaggagattttctatgataacttcgaacctggcggcagcgcaaaagatg

SEQ ID NO: 48452 - DNA, 103 bp, Artificial Sequence
  Synthetic Polynucleotide
taatacgactcactataggggatgatgtgaaggacaacgaagttatgccaaacagaggagatggcatatgttcgttgtcaacctggcggcagcgcaaaagatg

SEQ ID NO: 48453 - DNA, 103 bp, Artificial Sequence
  Synthetic Polynucleotide
taatacgactcactatagggagttcgatgatgtgaaggacaacgaagttaaacagaggagataacttatgtgtccttcaaacctggcggcagcgcaaaagatg

SEQ ID NO: 48454 - DNA, 103 bp, Artificial Sequence
  Synthetic Polynucleotide
taatacgactcactatagggtcagaagttcgatgatgtgaaggacaacgaaacagaggagatcgttgatgttcacatcaaacctggcggcagcgcaaaagatg

SEQ ID NO: 48455 - DNA, 103 bp, Artificial Sequence
  Synthetic Polynucleotide
taatacgactcactatagggaatgatcagaagttcgatgatgtgaaggacaacagaggagagtccttatgatcatcgaaaacctggcggcagcgcaaaagatg

SEQ ID NO: 48456 - DNA, 103 bp, Artificial Sequence
  Synthetic Polynucleotide
taatacgactcactatagggatattaatgatcagaagttcgatgatgtgaaacagaggagatcacatatgcgaacttctaacctggcggcagcgcaaaagatg

SEQ ID NO: 48457 - DNA, 103 bp, Artificial Sequence
  Synthetic Polynucleotide
taatacgactcactatagggtgagcatattaatgatcagaagttcgatgaaacagaggagatcatcgatgttctgatcaaacctggcggcagcgcaaaagatg

SEQ ID NO: 48458 - DNA, 103 bp, Artificial Sequence
  Synthetic Polynucleotide
taatacgactcactatagggacgaggaaacaatgtagtgcattattacgtaacagaggagaacgtaaatgtgcactacaaacctggcggcagcgcaaaagatg

SEQ ID NO: 48459 - DNA, 103 bp, Artificial Sequence
  Synthetic Polynucleotide
taatacgactcactatagggcgggttaaccttcgtctaccttcacaatggaacagaggagaccattgatgaggtagacgaacctggcggcagcgcaaaagatg

SEQ ID NO: 48460 - DNA, 103 bp, Artificial Sequence
  Synthetic Polynucleotide
taatacgactcactatagggtcgtaccaaatacacataaatgaaatgaataacagaggagaattcatatgatttatgtgaacctggcggcagcgcaaaagatg

SEQ ID NO: 48461 - DNA, 103 bp, Artificial Sequence
  Synthetic Polynucleotide
taatacgactcactatagggcttcatgagcatattaatgatcagaagttcaacagaggagagaacttatgatcattaataacctggcggcagcgcaaaagatg

SEQ ID NO: 48462 - DNA, 103 bp, Artificial Sequence
  Synthetic Polynucleotide
taatacgactcactatagggctaatcttcatgagcatattaatgatcagaaacagaggagatctgatatgtaatatgctaacctggcggcagcgcaaaagatg

SEQ ID NO: 48463 - DNA, 103 bp, Artificial Sequence
  Synthetic Polynucleotide
taatacgactcactatagggatttcctaatcttcatgagcatattaatgaaacagaggagatcattaatgtgctcatgaaacctggcggcagcgcaaaagatg

SEQ ID NO: 48464 - DNA, 103 bp, Artificial Sequence
  Synthetic Polynucleotide
taatacgactcactataggggaaacatttcctaatcttcatgagcatattaacagaggagaaatatgatgatgaagattaacctggcggcagcgcaaaagatg

SEQ ID NO: 48465 - DNA, 103 bp, Artificial Sequence
  Synthetic Polynucleotide
taatacgactcactatagggcatcagaaacatttcctaatcttcatgagcaacagaggagagctcatatggattaggaaaacctggcggcagcgcaaaagatg

SEQ ID NO: 48466 - DNA, 103 bp, Artificial Sequence
  Synthetic Polynucleotide
taatacgactcactatagggacctccatcagaaacatttcctaatcttcaaacagaggagatgaagaatgggaaatgttaacctggcggcagcgcaaaagatg

SEQ ID NO: 48467 - DNA, 103 bp, Artificial Sequence
  Synthetic Polynucleotide
taatacgactcactataggggatagacctccatcagaaacatttcctaataacagaggagaattaggatgtgtttctgaaacctggcggcagcgcaaaagatg

SEQ ID NO: 48468 - DNA, 103 bp, Artificial Sequence
  Synthetic Polynucleotide
taatacgactcactatagggttattgatagacctccatcagaaacatttcaacagaggagagaaatgatgctgatggagaacctggcggcagcgcaaaagatg

SEQ ID NO: 48469 - DNA, 103 bp, Artificial Sequence
  Synthetic Polynucleotide
taatacgactcactataggggccagttattgatagacctccatcagaaacaacagaggagagtttctatgggaggtctaaacctggcggcagcgcaaaagatg

SEQ ID NO: 48470 - DNA, 103 bp, Artificial Sequence
  Synthetic Polynucleotide
taatacgactcactataggggttgtgccagttattgatagacctccatcaaacagaggagatgatggatgtctatcaataacctggcggcagcgcaaaagatg

SEQ ID NO: 48471 - DNA, 103 bp, Artificial Sequence
  Synthetic Polynucleotide
taatacgactcactatagggtctgctcgtaccaaatacacataaatgaaaaacagaggagatttcatatgtgtgtatttaacctggcggcagcgcaaaagatg

SEQ ID NO: 48472 - DNA, 103 bp, Artificial Sequence
  Synthetic Polynucleotide
taatacgactcactatagggttattgttgtgccagttattgatagacctcaacagaggagagaggtcatgcaataactgaacctggcggcagcgcaaaagatg

SEQ ID NO: 48473 - DNA, 103 bp, Artificial Sequence
  Synthetic Polynucleotide
taatacgactcactatagggtcctgttattgttgtgccagttattgatagaacagaggagactatcaatgactggcacaaacctggcggcagcgcaaaagatg

SEQ ID NO: 48474 - DNA, 103 bp, Artificial Sequence
  Synthetic Polynucleotide
taatacgactcactatagggaaaactcctgttattgttgtgccagttattaacagaggagaaataacatgcacaacaataacctggcggcagcgcaaaagatg

SEQ ID NO: 48475 - DNA, 103 bp, Artificial Sequence
  Synthetic Polynucleotide
taatacgactcactatagggtgaataaaactcctgttattgttgtgccagaacagaggagactggcaatgcaataacagaacctggcggcagcgcaaaagatg

SEQ ID NO: 48476 - DNA, 103 bp, Artificial Sequence
  Synthetic Polynucleotide
taatacgactcactataggggactgtgaataaaactcctgttattgttgtaacagaggagaacaacaatgacaggagttaacctggcggcagcgcaaaagatg

SEQ ID NO: 48477 - DNA, 103 bp, Artificial Sequence
  Synthetic Polynucleotide
taatacgactcactatagggatggcgactgtgaataaaactcctgttattaacagaggagaaataacatgagttttattaacctggcggcagcgcaaaagatg

SEQ ID NO: 48478 - DNA, 103 bp, Artificial Sequence
  Synthetic Polynucleotide
taatacgactcactatagggactaaatggcgactgtgaataaaactcctgaacagaggagacaggagatgtattcacagaacctggcggcagcgcaaaagatg

SEQ ID NO: 48479 - DNA, 103 bp, Artificial Sequence
  Synthetic Polynucleotide
taatacgactcactatagggcaataactaaatggcgactgtgaataaaacaacagaggagagttttaatgacagtcgccaacctggcggcagcgcaaaagatg

SEQ ID NO: 48480 - DNA, 103 bp, Artificial Sequence
  Synthetic Polynucleotide
taatacgactcactatagggaatttcaataactaaatggcgactgtgaataacagaggagaattcacatgcgccatttaaacctggcggcagcgcaaaagatg

SEQ ID NO: 48481 - DNA, 103 bp, Artificial Sequence
  Synthetic Polynucleotide
taatacgactcactatagggtgattaatttcaataactaaatggcgactgaacagaggagacagtcgatgtttagttataacctggcggcagcgcaaaagatg

SEQ ID NO: 48482 - DNA, 103 bp, Artificial Sequence
  Synthetic Polynucleotide
taatacgactcactatagggtgctgtctgctcgtaccaaatacacataaaaacagaggagatttatgatgatttggtacaacctggcggcagcgcaaaagatg

SEQ ID NO: 48483 - DNA, 103 bp, Artificial Sequence
  Synthetic Polynucleotide
taatacgactcactataggggtatatgattaatttcaataactaaatggcaacagaggagagccattatgttattgaaaaacctggcggcagcgcaaaagatg

SEQ ID NO: 48484 - DNA, 103 bp, Artificial Sequence
  Synthetic Polynucleotide
taatacgactcactataggggagttgtatatgattaatttcaataactaaaacagaggagattagttatggaaattaataacctggcggcagcgcaaaagatg

SEQ ID NO: 48485 - DNA, 103 bp, Artificial Sequence
  Synthetic Polynucleotide
taatacgactcactatagggttagagagttgtatatgattaatttcaataaacagaggagatattgaatgtaatcatataacctggcggcagcgcaaaagatg

SEQ ID NO: 48486 - DNA, 103 bp, Artificial Sequence
  Synthetic Polynucleotide
taatacgactcactatagggtcgtattagagagttgtatatgattaatttaacagaggagaaaattaatgatatacaacaacctggcggcagcgcaaaagatg

SEQ ID NO: 48487 - DNA, 103 bp, Artificial Sequence
  Synthetic Polynucleotide
taatacgactcactatagggataactcgtattagagagttgtatatgattaacagaggagaaatcatatgcaactctctaacctggcggcagcgcaaaagatg

SEQ ID NO: 48488 - DNA, 103 bp, Artificial Sequence
  Synthetic Polynucleotide
taatacgactcactatagggaaaatataactcgtattagagagttgtataaacagaggagatatacaatgctctaatacaacctggcggcagcgcaaaagatg

SEQ ID NO: 48489 - DNA, 103 bp, Artificial Sequence
  Synthetic Polynucleotide
taatacgactcactatagggagacgaaaatataactcgtattagagagttaacagaggagaaactctatgatacgagttaacctggcggcagcgcaaaagatg

SEQ ID NO: 48490 - DNA, 103 bp, Artificial Sequence
  Synthetic Polynucleotide
taatacgactcactatagggtggatagacgaaaatataactcgtattagaaacagaggagatctaatatgagttatattaacctggcggcagcgcaaaagatg

SEQ ID NO: 48491 - DNA, 103 bp, Artificial Sequence
  Synthetic Polynucleotide
taatacgactcactatagggaacaatggatagacgaaaatataactcgtaaacagaggagatacgagatgtattttcgtaacctggcggcagcgcaaaagatg

SEQ ID NO: 48492 - DNA, 103 bp, Artificial Sequence
  Synthetic Polynucleotide
taatacgactcactatagggtgtgaaacaatggatagacgaaaatataacaacagaggagagttataatgtcgtctatcaacctggcggcagcgcaaaagatg

SEQ ID NO: 48493 - DNA, 103 bp, Artificial Sequence
  Synthetic Polynucleotide
taatacgactcactatagggtctcatgctgtctgctcgtaccaaatacacaacagaggagagtgtatatggtacgagcaaacctggcggcagcgcaaaagatg

SEQ ID NO: 48494 - DNA, 103 bp, Artificial Sequence
  Synthetic Polynucleotide
taatacgactcactataggggtcaatgtgaaacaatggatagacgaaaataacagaggagaattttcatgtatccattgaacctggcggcagcgcaaaagatg

SEQ ID NO: 48495 - DNA, 103 bp, Artificial Sequence
  Synthetic Polynucleotide
taatacgactcactatagggaatatgtcaatgtgaaacaatggatagacgaacagaggagacgtctaatgattgtttcaaacctggcggcagcgcaaaagatg

SEQ ID NO: 48496 - DNA, 103 bp, Artificial Sequence
  Synthetic Polynucleotide
taatacgactcactataggggtcgaaatatgtcaatgtgaaacaatggataacagaggagaatccatatgttcacattgaacctggcggcagcgcaaaagatg

SEQ ID NO: 48497 - DNA, 103 bp, Artificial Sequence
  Synthetic Polynucleotide
taatacgactcactatagggtttttgtcgaaatatgtcaatgtgaaacaaaacagaggagattgtttatgattgacataaacctggcggcagcgcaaaagatg

SEQ ID NO: 48498 - DNA, 103 bp, Artificial Sequence
  Synthetic Polynucleotide
taatacgactcactatagggatatctttttgtcgaaatatgtcaatgtgaaacagaggagatcacatatgcatatttcgaacctggcggcagcgcaaaagatg

SEQ ID NO: 48499 - DNA, 103 bp, Artificial Sequence
  Synthetic Polynucleotide
taatacgactcactatagggattttatatctttttgtcgaaatatgtcaaaacagaggagattgacaatgttcgacaaaaacctggcggcagcgcaaaagatg

SEQ ID NO: 48500 - DNA, 103 bp, Artificial Sequence
  Synthetic Polynucleotide
taatacgactcactatagggtacgcattttatatctttttgtcgaaatataacagaggagaatatttatgcaaaaagataacctggcggcagcgcaaaagatg

SEQ ID NO: 48501 - DNA, 103 bp, Artificial Sequence
  Synthetic Polynucleotide
taatacgactcactatagggtggaatacgcattttatatctttttgtcgaaacagaggagatcgacaatgagatataaaaacctggcggcagcgcaaaagatg

SEQ ID NO: 48502 - DNA, 103 bp, Artificial Sequence
  Synthetic Polynucleotide
taatacgactcactatagggagcattggaatacgcattttatatctttttaacagaggagaaaaaagatgtaaaatgcgaacctggcggcagcgcaaaagatg

SEQ ID NO: 48503 - DNA, 103 bp, Artificial Sequence
  Synthetic Polynucleotide
taatacgactcactatagggagagaagcattggaatacgcattttatatcaacagaggagagatataatgtgcgtattcaacctggcggcagcgcaaaagatg

SEQ ID NO: 48504 - DNA, 103 bp, Artificial Sequence
  Synthetic Polynucleotide
taatacgactcactatagggtacgatctcatgctgtctgctcgtaccaaaaacagaggagatttggtatgagcagacagaacctggcggcagcgcaaaagatg

SEQ ID NO: 48505 - DNA, 103 bp, Artificial Sequence
  Synthetic Polynucleotide
taatacgactcactatagggtaaacagagaagcattggaatacgcattttaacagaggagaaaaatgatgattccaatgaacctggcggcagcgcaaaagatg

SEQ ID NO: 48506 - DNA, 103 bp, Artificial Sequence
  Synthetic Polynucleotide
taatacgactcactatagggttcattaaacagagaagcattggaatacgcaacagaggagagcgtatatgaatgcttctaacctggcggcagcgcaaaagatg

SEQ ID NO: 48507 - DNA, 103 bp, Artificial Sequence
  Synthetic Polynucleotide
taatacgactcactatagggagtaattcattaaacagagaagcattggaaaacagaggagattccaaatgttctctgttaacctggcggcagcgcaaaagatg

SEQ ID NO: 48508 - DNA, 103 bp, Artificial Sequence
  Synthetic Polynucleotide
taatacgactcactatagggattttagtaattcattaaacagagaagcataacagaggagaatgcttatgtgtttaatgaacctggcggcagcgcaaaagatg

SEQ ID NO: 48509 - DNA, 103 bp, Artificial Sequence
  Synthetic Polynucleotide
taatacgactcactatagggtgtatattttagtaattcattaaacagagaaacagaggagatctctgatgaatgaattaaacctggcggcagcgcaaaagatg

SEQ ID NO: 48510 - DNA, 103 bp, Artificial Sequence
  Synthetic Polynucleotide
taatacgactcactataggggtgtttgtatattttagtaattcattaaacaacagaggagagtttaaatgattactaaaaacctggcggcagcgcaaaagatg

SEQ ID NO: 48511 - DNA, 103 bp, Artificial Sequence
  Synthetic Polynucleotide
taatacgactcactataggggtgacgtgtttgtatattttagtaattcataacagaggagaatgaatatgtaaaatataaacctggcggcagcgcaaaagatg

SEQ ID NO: 48512 - DNA, 103 bp, Artificial Sequence
  Synthetic Polynucleotide
taatacgactcactatagggagacagtgacgtgtttgtatattttagtaaaacagaggagattactaatgtatacaaacaacctggcggcagcgcaaaagatg

SEQ ID NO: 48513 - DNA, 103 bp, Artificial Sequence
  Synthetic Polynucleotide
taatacgactcactatagggttgccagacagtgacgtgtttgtatattttaacagaggagaaaaataatgaaacacgtcaacctggcggcagcgcaaaagatg

SEQ ID NO: 48514 - DNA, 103 bp, Artificial Sequence
  Synthetic Polynucleotide
taatacgactcactatagggatttattgccagacagtgacgtgtttgtataacagaggagaatacaaatgcgtcactgtaacctggcggcagcgcaaaagatg

SEQ ID NO: 48515 - DNA, 103 bp, Artificial Sequence
  Synthetic Polynucleotide
taatacgactcactatagggaatcatacgatctcatgctgtctgctcgtaaacagaggagatacgagatgacagcatgaaacctggcggcagcgcaaaagatg

SEQ ID NO: 48516 - DNA, 103 bp, Artificial Sequence
  Synthetic Polynucleotide
taatacgactcactatagggatatcatttattgccagacagtgacgtgttaacagaggagaaacacgatgctgtctggcaacctggcggcagcgcaaaagatg

SEQ ID NO: 48517 - DNA, 103 bp, Artificial Sequence
  Synthetic Polynucleotide
taatacgactcactatagggctaagatatcatttattgccagacagtgacaacagaggagagtcactatgtggcaataaaacctggcggcagcgcaaaagatg

SEQ ID NO: 48518 - DNA, 103 bp, Artificial Sequence
  Synthetic Polynucleotide
taatacgactcactatagggatattctaagatatcatttattgccagacaaacagaggagatgtctgatgataaatgataacctggcggcagcgcaaaagatg

SEQ ID NO: 48519 - DNA, 103 bp, Artificial Sequence
  Synthetic Polynucleotide
taatacgactcactatagggttacaatattctaagatatcatttattgccaacagaggagaggcaatatgtgatatcttaacctggcggcagcgcaaaagatg

SEQ ID NO: 48520 - DNA, 103 bp, Artificial Sequence
  Synthetic Polynucleotide
taatacgactcactatagggaattgttacaatattctaagatatcatttaaacagaggagataaatgatgtcttagaataacctggcggcagcgcaaaagatg

SEQ ID NO: 48521 - DNA, 103 bp, Artificial Sequence
  Synthetic Polynucleotide
taatacgactcactatagggaaataaattgttacaatattctaagatatcaacagaggagagatatcatggaatattgtaacctggcggcagcgcaaaagatg

SEQ ID NO: 48522 - DNA, 103 bp, Artificial Sequence
  Synthetic Polynucleotide
taatacgactcactatagggatacaaaataaattgttacaatattctaagaacagaggagacttagaatgttgtaacaaaacctggcggcagcgcaaaagatg

SEQ ID NO: 48523 - DNA, 103 bp, Artificial Sequence
  Synthetic Polynucleotide
taatacgactcactataggggcgcaatacaaaataaattgttacaatattaacagaggagaaatattatgacaatttataacctggcggcagcgcaaaagatg

SEQ ID NO: 48524 - DNA, 103 bp, Artificial Sequence
  Synthetic Polynucleotide
taatacgactcactatagggaacatgcgcaatacaaaataaattgttacaaacagaggagatgtaacatgttattttgtaacctggcggcagcgcaaaagatg

SEQ ID NO: 48525 - DNA, 103 bp, Artificial Sequence
  Synthetic Polynucleotide
taatacgactcactatagggtcacgaacatgcgcaatacaaaataaattgaacagaggagacaatttatgttgtattgcaacctggcggcagcgcaaaagatg

SEQ ID NO: 48526 - DNA, 103 bp, Artificial Sequence
  Synthetic Polynucleotide
taatacgactcactatagggactgaaatcatacgatctcatgctgtctgcaacagaggagagcagacatgatgagatcgaacctggcggcagcgcaaaagatg

SEQ ID NO: 48527 - DNA, 103 bp, Artificial Sequence
  Synthetic Polynucleotide
taatacgactcactatagggatagatcacgaacatgcgcaatacaaaataaacagaggagatattttatgttgcgcatgaacctggcggcagcgcaaaagatg

SEQ ID NO: 48528 - DNA, 103 bp, Artificial Sequence
  Synthetic Polynucleotide
taatacgactcactatagggaactcatagatcacgaacatgcgcaatacaaacagaggagatgtattatgcatgttcgtaacctggcggcagcgcaaaagatg

SEQ ID NO: 48529 - DNA, 103 bp, Artificial Sequence
  Synthetic Polynucleotide
taatacgactcactatagggagaagaactcatagatcacgaacatgcgcaaacagaggagatgcgcaatgtcgtgatctaacctggcggcagcgcaaaagatg

SEQ ID NO: 48530 - DNA, 103 bp, Artificial Sequence
  Synthetic Polynucleotide
taatacgactcactatagggttcgaagaagaactcatagatcacgaacataacagaggagaatgttcatgatctatgagaacctggcggcagcgcaaaagatg

SEQ ID NO: 48531 - DNA, 103 bp, Artificial Sequence
  Synthetic Polynucleotide
taatacgactcactatagggtgccattcgaagaagaactcatagatcacgaacagaggagacgtgatatgtgagttcttaacctggcggcagcgcaaaagatg

SEQ ID NO: 48532 - DNA, 103 bp, Artificial Sequence
  Synthetic Polynucleotide
taatacgactcactatagggtcctatgccattcgaagaagaactcatagaaacagaggagatctatgatgtcttcttcgaacctggcggcagcgcaaaagatg

SEQ ID NO: 48533 - DNA, 103 bp, Artificial Sequence
  Synthetic Polynucleotide
taatacgactcactatagggggagatcctatgccattcgaagaagaactcaacagaggagagagttcatgttcgaatggaacctggcggcagcgcaaaagatg

SEQ ID NO: 48534 - DNA, 103 bp, Artificial Sequence
  Synthetic Polynucleotide
taatacgactcactataggggattcggagatcctatgccattcgaagaagaacagaggagacttcttatgatggcatagaacctggcggcagcgcaaaagatg

SEQ ID NO: 48535 - DNA, 103 bp, Artificial Sequence
  Synthetic Polynucleotide
taatacgactcactatagggtttcagattcggagatcctatgccattcgaaacagaggagatcgaatatgataggatctaacctggcggcagcgcaaaagatg

SEQ ID NO: 48536 - DNA, 103 bp, Artificial Sequence
  Synthetic Polynucleotide
taatacgactcactatagggtacattttcagattcggagatcctatgccaaacagaggagatggcatatgatctccgaaaacctggcggcagcgcaaaagatg

SEQ ID NO: 48537 - DNA, 103 bp, Artificial Sequence
  Synthetic Polynucleotide
taatacgactcactatagggacggtactgaaatcatacgatctcatgctgaacagaggagacagcatatgatcgtatgaaacctggcggcagcgcaaaagatg

SEQ ID NO: 48538 - DNA, 103 bp, Artificial Sequence
  Synthetic Polynucleotide
taatacgactcactatagggatttatacattttcagattcggagatcctaaacagaggagataggatatgcgaatctgaaacctggcggcagcgcaaaagatg

SEQ ID NO: 48539 - DNA, 103 bp, Artificial Sequence
  Synthetic Polynucleotide
taatacgactcactatagggctcctatttatacattttcagattcggagaaacagaggagatctccgatgctgaaaatgaacctggcggcagcgcaaaagatg

SEQ ID NO: 48540 - DNA, 103 bp, Artificial Sequence
  Synthetic Polynucleotide
taatacgactcactatagggtctaactcctatttatacattttcagattcaacagaggagagaatctatgaatgtataaaacctggcggcagcgcaaaagatg

SEQ ID NO: 48541 - DNA, 103 bp, Artificial Sequence
  Synthetic Polynucleotide
taatacgactcactatagggattattctaactcctatttatacattttcaaacagaggagatgaaaaatgataaataggaacctggcggcagcgcaaaagatg

SEQ ID NO: 48542 - DNA, 103 bp, Artificial Sequence
  Synthetic Polynucleotide
taatacgactcactatagggatattattattctaactcctatttatacataacagaggagaatgtatatgtaggagttaaacctggcggcagcgcaaaagatg

SEQ ID NO: 48543 - DNA, 103 bp, Artificial Sequence
  Synthetic Polynucleotide
taatacgactcactatagggctcaaatattattattctaactcctatttaaacagaggagataaataatggttagaataaacctggcggcagcgcaaaagatg

SEQ ID NO: 48544 - DNA, 103 bp, Artificial Sequence
  Synthetic Polynucleotide
taatacgactcactatagggatactctcaaatattattattctaactcctaacagaggagaaggagtatgaataataataacctggcggcagcgcaaaagatg

SEQ ID NO: 48545 - DNA, 103 bp, Artificial Sequence
  Synthetic Polynucleotide
taatacgactcactatagggtaccaatactctcaaatattattattctaaaacagaggagattagaaatgtaatatttgaacctggcggcagcgcaaaagatg

SEQ ID NO: 48546 - DNA, 103 bp, Artificial Sequence
  Synthetic Polynucleotide
taatacgactcactatagggtacattaccaatactctcaaatattattataacagaggagaataataatgtttgagagtaacctggcggcagcgcaaaagatg

SEQ ID NO: 48547 - DNA, 103 bp, Artificial Sequence
  Synthetic Polynucleotide
taatacgactcactataggggtttgtacattaccaatactctcaaatattaacagaggagaaatattatggagtattggaacctggcggcagcgcaaaagatg

SEQ ID NO: 48548 - DNA, 103 bp, Artificial Sequence
  Synthetic Polynucleotide
taatacgactcactatagggtcactacggtactgaaatcatacgatctcaaacagaggagatgagatatgatgatttcaaacctggcggcagcgcaaaagatg

SEQ ID NO: 48549 - DNA, 103 bp, Artificial Sequence
  Synthetic Polynucleotide
taatacgactcactatagggaaagagtttgtacattaccaatactctcaaaacagaggagattgagaatgttggtaatgaacctggcggcagcgcaaaagatg

SEQ ID NO: 48550 - DNA, 103 bp, Artificial Sequence
  Synthetic Polynucleotide
taatacgactcactatagggccgctaaagagtttgtacattaccaatactaacagaggagaagtattatgaatgtacaaaacctggcggcagcgcaaaagatg

SEQ ID NO: 48551 - DNA, 103 bp, Artificial Sequence
  Synthetic Polynucleotide
taatacgactcactatagggttataccgctaaagagtttgtacattaccaaacagaggagatggtaaatgacaaactctaacctggcggcagcgcaaaagatg

SEQ ID NO: 48552 - DNA, 103 bp, Artificial Sequence
  Synthetic Polynucleotide
taatacgactcactatagggactaattataccgctaaagagtttgtacataacagaggagaatgtacatgctctttagcaacctggcggcagcgcaaaagatg

SEQ ID NO: 48553 - DNA, 103 bp, Artificial Sequence
  Synthetic Polynucleotide
taatacgactcactatagggaaaaaactaattataccgctaaagagtttgaacagaggagacaaactatgtagcggtataacctggcggcagcgcaaaagatg

SEQ ID NO: 48554 - DNA, 103 bp, Artificial Sequence
  Synthetic Polynucleotide
taatacgactcactatagggagagaaaaaaactaattataccgctaaagaaacagaggagatctttaatggtataattaaacctggcggcagcgcaaaagatg

SEQ ID NO: 48555 - DNA, 103 bp, Artificial Sequence
  Synthetic Polynucleotide
taatacgactcactatagggaatcgagagaaaaaaactaattataccgctaacagaggagaagcggtatgattagttttaacctggcggcagcgcaaaagatg

SEQ ID NO: 48556 - DNA, 103 bp, Artificial Sequence
  Synthetic Polynucleotide
taatacgactcactatagggatagaaatcgagagaaaaaaactaattataaacagaggagatataatatgtttttttctaacctggcggcagcgcaaaagatg

SEQ ID NO: 48557 - DNA, 103 bp, Artificial Sequence
  Synthetic Polynucleotide
taatacgactcactatagggtaaaaatagaaatcgagagaaaaaaactaaaacagaggagattagttatgttctctcgaaacctggcggcagcgcaaaagatg

SEQ ID NO: 48558 - DNA, 103 bp, Artificial Sequence
  Synthetic Polynucleotide
taatacgactcactatagggacatctaaaaatagaaatcgagagaaaaaaaacagaggagattttttatgtcgatttctaacctggcggcagcgcaaaagatg

SEQ ID NO: 48559 - DNA, 103 bp, Artificial Sequence
  Synthetic Polynucleotide
taatacgactcactatagggtattgtcactacggtactgaaatcatacgaaacagaggagatcgtatatgttcagtaccaacctggcggcagcgcaaaagatg

SEQ ID NO: 48560 - DNA, 103 bp, Artificial Sequence
  Synthetic Polynucleotide
taatacgactcactatagggccatcacatctaaaaatagaaatcgagagaaacagaggagatctctcatgttctattttaacctggcggcagcgcaaaagatg

SEQ ID NO: 48561 - DNA, 103 bp, Artificial Sequence
  Synthetic Polynucleotide
taatacgactcactatagggtttttccatcacatctaaaaatagaaatcgaacagaggagacgatttatgtttttagataacctggcggcagcgcaaaagatg

SEQ ID NO: 48562 - DNA, 103 bp, Artificial Sequence
  Synthetic Polynucleotide
taatacgactcactatagggagtcatttttccatcacatctaaaaatagaaacagaggagatctattatgagatgtgataacctggcggcagcgcaaaagatg

SEQ ID NO: 48563 - DNA, 103 bp, Artificial Sequence
  Synthetic Polynucleotide
taatacgactcactatagggaaattagtcatttttccatcacatctaaaaaacagaggagattttagatgtgatggaaaaacctggcggcagcgcaaaagatg

SEQ ID NO: 48564 - DNA, 103 bp, Artificial Sequence
  Synthetic Polynucleotide
taatacgactcactatagggctacaaaattagtcatttttccatcacatcaacagaggagagatgtgatggaaaaatgaaacctggcggcagcgcaaaagatg

SEQ ID NO: 48565 - DNA, 103 bp, Artificial Sequence
  Synthetic Polynucleotide
taatacgactcactatagggtaatgctacaaaattagtcatttttccatcaacagaggagagatggaatgatgactaataacctggcggcagcgcaaaagatg

SEQ ID NO: 48566 - DNA, 103 bp, Artificial Sequence
  Synthetic Polynucleotide
taatacgactcactataggggatactaatgctacaaaattagtcatttttaacagaggagaaaaaatatgtaattttgtaacctggcggcagcgcaaaagatg

SEQ ID NO: 48567 - DNA, 103 bp, Artificial Sequence
  Synthetic Polynucleotide
taatacgactcactatagggttcatgatactaatgctacaaaattagtcaaacagaggagatgactaatgttgtagcataacctggcggcagcgcaaaagatg

SEQ ID NO: 48568 - DNA, 103 bp, Artificial Sequence
  Synthetic Polynucleotide
taatacgactcactatagggtagagttcatgatactaatgctacaaaattaacagaggagaaattttatggcattagtaaacctggcggcagcgcaaaagatg

SEQ ID NO: 48569 - DNA, 103 bp, Artificial Sequence
  Synthetic Polynucleotide
taatacgactcactatagggttgattagagttcatgatactaatgctacaaacagaggagatgtagcatgagtatcatgaacctggcggcagcgcaaaagatg

SEQ ID NO: 48570 - DNA, 103 bp, Artificial Sequence
  Synthetic Polynucleotide
taatacgactcactatagggaccatcgggttaaccttcgtctaccttcacaacagaggagagtgaagatggacgaaggtaacctggcggcagcgcaaaagatg

SEQ ID NO: 48571 - DNA, 103 bp, Artificial Sequence
  Synthetic Polynucleotide
taatacgactcactatagggaatagtattgtcactacggtactgaaatcaaacagaggagatgatttatgtaccgtagtaacctggcggcagcgcaaaagatg

SEQ ID NO: 48572 - DNA, 103 bp, Artificial Sequence
  Synthetic Polynucleotide
taatacgactcactatagggagattttgattagagttcatgatactaatgaacagaggagacattagatgcatgaactcaacctggcggcagcgcaaaagatg

SEQ ID NO: 48573 - DNA, 103 bp, Artificial Sequence
  Synthetic Polynucleotide
taatacgactcactatagggtattaagattttgattagagttcatgatacaacagaggagagtatcaatgactctaatcaacctggcggcagcgcaaaagatg

SEQ ID NO: 48574 - DNA, 103 bp, Artificial Sequence
  Synthetic Polynucleotide
taatacgactcactataggggaagatattaagattttgattagagttcataacagaggagaatgaacatgaatcaaaataacctggcggcagcgcaaaagatg

SEQ ID NO: 48575 - DNA, 103 bp, Artificial Sequence
  Synthetic Polynucleotide
taatacgactcactataggggtgacgaagatattaagattttgattagagaacagaggagactctaaatgaaatcttaaaacctggcggcagcgcaaaagatg

SEQ ID NO: 48576 - DNA, 103 bp, Artificial Sequence
  Synthetic Polynucleotide
taatacgactcactatagggaacgtgtgacgaagatattaagattttgataacagaggagaatcaaaatgttaatatctaacctggcggcagcgcaaaagatg

SEQ ID NO: 48577 - DNA, 103 bp, Artificial Sequence
  Synthetic Polynucleotide
taatacgactcactataggggagctaacgtgtgacgaagatattaagattaacagaggagaaatcttatgatcttcgtcaacctggcggcagcgcaaaagatg

SEQ ID NO: 48578 - DNA, 103 bp, Artificial Sequence
  Synthetic Polynucleotide
taatacgactcactatagggtcaaagagctaacgtgtgacgaagatattaaacagaggagataatatatgcgtcacacgaacctggcggcagcgcaaaagatg

SEQ ID NO: 48579 - DNA, 103 bp, Artificial Sequence
  Synthetic Polynucleotide
taatacgactcactatagggacagttcaaagagctaacgtgtgacgaagaaacagaggagatcttcgatgcacgttagcaacctggcggcagcgcaaaagatg

SEQ ID NO: 48580 - DNA, 103 bp, Artificial Sequence
  Synthetic Polynucleotide
taatacgactcactatagggcttaaacagttcaaagagctaacgtgtgacaacagaggagagtcacaatgtagctctttaacctggcggcagcgcaaaagatg

SEQ ID NO: 48581 - DNA, 103 bp, Artificial Sequence
  Synthetic Polynucleotide
taatacgactcactatagggcatctcttaaacagttcaaagagctaacgtaacagaggagaacgttaatgctttgaactaacctggcggcagcgcaaaagatg

SEQ ID NO: 48582 - DNA, 103 bp, Artificial Sequence
  Synthetic Polynucleotide
taatacgactcactatagggaaactaatagtattgtcactacggtactgaaacagaggagatcagtaatgtagtgacaaaacctggcggcagcgcaaaagatg

SEQ ID NO: 48583 - DNA, 103 bp, Artificial Sequence
  Synthetic Polynucleotide
taatacgactcactatagggtgatgcatctcttaaacagttcaaagagctaacagaggagaagctctatgaactgtttaaacctggcggcagcgcaaaagatg

SEQ ID NO: 48584 - DNA, 103 bp, Artificial Sequence
  Synthetic Polynucleotide
taatacgactcactatagggccaactgatgcatctcttaaacagttcaaaaacagaggagatttgaaatgtttaagagaaacctggcggcagcgcaaaagatg

SEQ ID NO: 48585 - DNA, 103 bp, Artificial Sequence
  Synthetic Polynucleotide
taatacgactcactatagggtggaaccaactgatgcatctcttaaacagtaacagaggagaactgttatggagatgcataacctggcggcagcgcaaaagatg

SEQ ID NO: 48586 - DNA, 103 bp, Artificial Sequence
  Synthetic Polynucleotide
taatacgactcactatagggatccgtggaaccaactgatgcatctcttaaaacagaggagattaagaatggcatcagttaacctggcggcagcgcaaaagatg

SEQ ID NO: 48587 - DNA, 103 bp, Artificial Sequence
  Synthetic Polynucleotide
taatacgactcactatagggactccatccgtggaaccaactgatgcatctaacagaggagaagatgcatgagttggttcaacctggcggcagcgcaaaagatg

SEQ ID NO: 48588 - DNA, 103 bp, Artificial Sequence
  Synthetic Polynucleotide
taatacgactcactatagggcacctactccatccgtggaaccaactgatgaacagaggagacatcagatggttccacggaacctggcggcagcgcaaaagatg

SEQ ID NO: 48589 - DNA, 103 bp, Artificial Sequence
  Synthetic Polynucleotide
taatacgactcactatagggtgttgcacctactccatccgtggaaccaacaacagaggagagttggtatgacggatggaaacctggcggcagcgcaaaagatg

SEQ ID NO: 48590 - DNA, 103 bp, Artificial Sequence
  Synthetic Polynucleotide
taatacgactcactatagggaaaattgttgcacctactccatccgtggaaaacagaggagattccacatgtggagtaggaacctggcggcagcgcaaaagatg

SEQ ID NO: 48591 - DNA, 103 bp, Artificial Sequence
  Synthetic Polynucleotide
taatacgactcactatagggaacaaaaaattgttgcacctactccatccgaacagaggagacggatgatgtaggtgcaaaacctggcggcagcgcaaaagatg

SEQ ID NO: 48592 - DNA, 103 bp, Artificial Sequence
  Synthetic Polynucleotide
taatacgactcactatagggtgtcgaacaaaaaattgttgcacctactccaacagaggagaggagtaatggcaacaattaacctggcggcagcgcaaaagatg

SEQ ID NO: 48593 - DNA, 103 bp, Artificial Sequence
  Synthetic Polynucleotide
taatacgactcactatagggtattgaaactaatagtattgtcactacggtaacagaggagaaccgtaatgacaatactaaacctggcggcagcgcaaaagatg

SEQ ID NO: 48594 - DNA, 103 bp, Artificial Sequence
  Synthetic Polynucleotide
taatacgactcactatagggacatatgtcgaacaaaaaattgttgcacctaacagaggagaaggtgcatgaattttttgaacctggcggcagcgcaaaagatg

SEQ ID NO: 48595 - DNA, 103 bp, Artificial Sequence
  Synthetic Polynucleotide
taatacgactcactatagggtacatacatatgtcgaacaaaaaattgttgaacagaggagacaacaaatgtttgttcgaaacctggcggcagcgcaaaagatg

SEQ ID NO: 48596 - DNA, 103 bp, Artificial Sequence
  Synthetic Polynucleotide
taatacgactcactatagggtccagtacatacatatgtcgaacaaaaaataacagaggagaatttttatgtcgacatataacctggcggcagcgcaaaagatg

SEQ ID NO: 48597 - DNA, 103 bp, Artificial Sequence
  Synthetic Polynucleotide
taatacgactcactatagggatggctccagtacatacatatgtcgaacaaaacagaggagattgttcatgatatgtatgaacctggcggcagcgcaaaagatg

SEQ ID NO: 48598 - DNA, 103 bp, Artificial Sequence
  Synthetic Polynucleotide
taatacgactcactatagggagacaatggctccagtacatacatatgtcgaacagaggagacgacatatgtatgtactgaacctggcggcagcgcaaaagatg

SEQ ID NO: 48599 - DNA, 103 bp, Artificial Sequence
  Synthetic Polynucleotide
taatacgactcactatagggagttaagacaatggctccagtacatacataaacagaggagatatgtaatgactggagccaacctggcggcagcgcaaaagatg

SEQ ID NO: 48600 - DNA, 103 bp, Artificial Sequence
  Synthetic Polynucleotide
taatacgactcactatagggattatagttaagacaatggctccagtacataacagaggagaatgtacatgagccattgtaacctggcggcagcgcaaaagatg

SEQ ID NO: 48601 - DNA, 103 bp, Artificial Sequence
  Synthetic Polynucleotide
taatacgactcactataggggcaccattatagttaagacaatggctccagaacagaggagactggagatgttgtcttaaaacctggcggcagcgcaaaagatg

SEQ ID NO: 48602 - DNA, 103 bp, Artificial Sequence
  Synthetic Polynucleotide
taatacgactcactatagggtacaagcaccattatagttaagacaatggcaacagaggagagccattatgttaactataaacctggcggcagcgcaaaagatg

SEQ ID NO: 48603 - DNA, 103 bp, Artificial Sequence
  Synthetic Polynucleotide
taatacgactcactatagggttcgatacaagcaccattatagttaagacaaacagaggagatgtcttatgtataatggtaacctggcggcagcgcaaaagatg

SEQ ID NO: 48604 - DNA, 103 bp, Artificial Sequence
  Synthetic Polynucleotide
taatacgactcactataggggatcttattgaaactaatagtattgtcactaacagaggagaagtgacatgactattagtaacctggcggcagcgcaaaagatg

SEQ ID NO: 48605 - DNA, 103 bp, Artificial Sequence
  Synthetic Polynucleotide
taatacgactcactatagggagtttttcgatacaagcaccattatagttaaacagaggagataactaatgtggtgcttgaacctggcggcagcgcaaaagatg

SEQ ID NO: 48606 - DNA, 103 bp, Artificial Sequence
  Synthetic Polynucleotide
taatacgactcactatagggattaaagtttttcgatacaagcaccattataacagaggagaataatgatgcttgtatcgaacctggcggcagcgcaaaagatg

SEQ ID NO: 48607 - DNA, 103 bp, Artificial Sequence
  Synthetic Polynucleotide
taatacgactcactatagggtctacattaaagtttttcgatacaagcaccaacagaggagaggtgctatgatcgaaaaaaacctggcggcagcgcaaaagatg

SEQ ID NO: 48608 - DNA, 103 bp, Artificial Sequence
  Synthetic Polynucleotide
taatacgactcactatagggcgctatctacattaaagtttttcgatacaaaacagaggagattgtatatgaaaactttaaacctggcggcagcgcaaaagatg

SEQ ID NO: 48609 - DNA, 103 bp, Artificial Sequence
  Synthetic Polynucleotide
taatacgactcactataggggcttccgctatctacattaaagtttttcgaaacagaggagatcgaaaatgtttaatgtaaacctggcggcagcgcaaaagatg

SEQ ID NO: 48610 - DNA, 103 bp, Artificial Sequence
  Synthetic Polynucleotide
taatacgactcactataggggaagagcttccgctatctacattaaagtttaacagaggagaaaacttatgtgtagatagaacctggcggcagcgcaaaagatg

SEQ ID NO: 48611 - DNA, 103 bp, Artificial Sequence
  Synthetic Polynucleotide
taatacgactcactataggggcggcgaagagcttccgctatctacattaaaacagaggagattaatgatgatagcggaaaacctggcggcagcgcaaaagatg

SEQ ID NO: 48612 - DNA, 103 bp, Artificial Sequence
  Synthetic Polynucleotide
taatacgactcactatagggaagtcgcggcgaagagcttccgctatctacaacagaggagagtagatatgggaagctctaacctggcggcagcgcaaaagatg

SEQ ID NO: 48613 - DNA, 103 bp, Artificial Sequence
  Synthetic Polynucleotide
taatacgactcactataggggtagaaagtcgcggcgaagagcttccgctaaacagaggagatagcggatgctcttcgccaacctggcggcagcgcaaaagatg

SEQ ID NO: 48614 - DNA, 103 bp, Artificial Sequence
  Synthetic Polynucleotide
taatacgactcactatagggacgacgtagaaagtcgcggcgaagagcttcaacagaggagagaagctatgcgccgcgacaacctggcggcagcgcaaaagatg

SEQ ID NO: 48615 - DNA, 103 bp, Artificial Sequence
  Synthetic Polynucleotide
taatacgactcactatagggagattgatcttattgaaactaatagtattgaacagaggagacaatacatgtagtttcaaaacctggcggcagcgcaaaagatg

SEQ ID NO: 48616 - DNA, 103 bp, Artificial Sequence
  Synthetic Polynucleotide
taatacgactcactatagggtaattacgacgtagaaagtcgcggcgaagaaacagaggagatcttcgatgcgactttctaacctggcggcagcgcaaaagatg

SEQ ID NO: 48617 - DNA, 103 bp, Artificial Sequence
  Synthetic Polynucleotide
taatacgactcactataggggaacctaattacgacgtagaaagtcgcggcaacagaggagagccgcgatgttctacgtcaacctggcggcagcgcaaaagatg

SEQ ID NO: 48618 - DNA, 103 bp, Artificial Sequence
  Synthetic Polynucleotide
taatacgactcactatagggcattagaacctaattacgacgtagaaagtcaacagaggagagactttatgcgtcgtaataacctggcggcagcgcaaaagatg

SEQ ID NO: 48619 - DNA, 103 bp, Artificial Sequence
  Synthetic Polynucleotide
taatacgactcactatagggatcggcattagaacctaattacgacgtagaaacagaggagatctacgatgtaattaggtaacctggcggcagcgcaaaagatg

SEQ ID NO: 48620 - DNA, 103 bp, Artificial Sequence
  Synthetic Polynucleotide
taatacgactcactatagggcaaagatcggcattagaacctaattacgacaacagaggagagtcgtaatgaggttctaaaacctggcggcagcgcaaaagatg

SEQ ID NO: 48621 - DNA, 103 bp, Artificial Sequence
  Synthetic Polynucleotide
taatacgactcactatagggccattcaaagatcggcattagaacctaattaacagaggagaaattagatgctaatgccgaacctggcggcagcgcaaaagatg

SEQ ID NO: 48622 - DNA, 103 bp, Artificial Sequence
  Synthetic Polynucleotide
taatacgactcactatagggagtatccattcaaagatcggcattagaaccaacagaggagaggttctatggccgatcttaacctggcggcagcgcaaaagatg

SEQ ID NO: 48623 - DNA, 103 bp, Artificial Sequence
  Synthetic Polynucleotide
taatacgactcactatagggaaactagtatccattcaaagatcggcattaaacagaggagataatgcatgtctttgaataacctggcggcagcgcaaaagatg

SEQ ID NO: 48624 - DNA, 103 bp, Artificial Sequence
  Synthetic Polynucleotide
taatacgactcactatagggttagaaaactagtatccattcaaagatcggaacagaggagaccgatcatggaatggataaacctggcggcagcgcaaaagatg

SEQ ID NO: 48625 - DNA, 103 bp, Artificial Sequence
  Synthetic Polynucleotide
taatacgactcactatagggagaacttagaaaactagtatccattcaaagaacagaggagactttgaatggatactagtaacctggcggcagcgcaaaagatg

SEQ ID NO: 48626 - DNA, 103 bp, Artificial Sequence
  Synthetic Polynucleotide
taatacgactcactatagggtctagagattgatcttattgaaactaatagaacagaggagactattaatgtcaataagaaacctggcggcagcgcaaaagatg

SEQ ID NO: 48627 - DNA, 103 bp, Artificial Sequence
  Synthetic Polynucleotide
taatacgactcactatagggacattagaacttagaaaactagtatccattaacagaggagaaatggaatgtagttttctaacctggcggcagcgcaaaagatg

SEQ ID NO: 48628 - DNA, 103 bp, Artificial Sequence
  Synthetic Polynucleotide
taatacgactcactataggggaatcacattagaacttagaaaactagtataacagaggagaatactaatgttctaagttaacctggcggcagcgcaaaagatg

SEQ ID NO: 48629 - DNA, 103 bp, Artificial Sequence
  Synthetic Polynucleotide
taatacgactcactatagggtcagagaatcacattagaacttagaaaactaacagaggagaagttttatgagttctaataacctggcggcagcgcaaaagatg

SEQ ID NO: 48630 - DNA, 103 bp, Artificial Sequence
  Synthetic Polynucleotide
taatacgactcactatagggcattttcagagaatcacattagaacttagaaacagaggagatctaagatgtaatgtgataacctggcggcagcgcaaaagatg

SEQ ID NO: 48631 - DNA, 103 bp, Artificial Sequence
  Synthetic Polynucleotide
taatacgactcactatagggatttacattttcagagaatcacattagaacaacagaggagagttctaatgtgattctctaacctggcggcagcgcaaaagatg

SEQ ID NO: 48632 - DNA, 103 bp, Artificial Sequence
  Synthetic Polynucleotide
taatacgactcactatagggattggatttacattttcagagaatcacattaacagaggagaaatgtgatgctctgaaaaaacctggcggcagcgcaaaagatg

SEQ ID NO: 48633 - DNA, 103 bp, Artificial Sequence
  Synthetic Polynucleotide
taatacgactcactataggggaggaattggatttacattttcagagaatcaacagaggagagattctatgaaaatgtaaaacctggcggcagcgcaaaagatg

SEQ ID NO: 48634 - DNA, 103 bp, Artificial Sequence
  Synthetic Polynucleotide
taatacgactcactatagggtgccggaggaattggatttacattttcagaaacagaggagatctgaaatggtaaatccaaacctggcggcagcgcaaaagatg

SEQ ID NO: 48635 - DNA, 103 bp, Artificial Sequence
  Synthetic Polynucleotide
taatacgactcactatagggtataatgccggaggaattggatttacatttaacagaggagaaaatgtatgtccaattccaacctggcggcagcgcaaaagatg

SEQ ID NO: 48636 - DNA, 103 bp, Artificial Sequence
  Synthetic Polynucleotide
taatacgactcactatagggacatctataatgccggaggaattggatttaaacagaggagataaatcatgttcctccggaacctggcggcagcgcaaaagatg

SEQ ID NO: 48637 - DNA, 103 bp, Artificial Sequence
  Synthetic Polynucleotide
taatacgactcactatagggatagatctagagattgatcttattgaaactaacagaggagaagtttcatgaagatcaataacctggcggcagcgcaaaagatg

SEQ ID NO: 48638 - DNA, 103 bp, Artificial Sequence
  Synthetic Polynucleotide
taatacgactcactatagggtatacacatctataatgccggaggaattggaacagaggagaccaattatgccggcattaaacctggcggcagcgcaaaagatg

SEQ ID NO: 48639 - DNA, 103 bp, Artificial Sequence
  Synthetic Polynucleotide
taatacgactcactatagggcgatgtatacacatctataatgccggaggaaacagaggagatcctccatgattatagataacctggcggcagcgcaaaagatg

SEQ ID NO: 48640 - DNA, 103 bp, Artificial Sequence
  Synthetic Polynucleotide
taatacgactcactatagggtttaccgatgtatacacatctataatgccgaacagaggagacggcatatgagatgtgtaaacctggcggcagcgcaaaagatg

SEQ ID NO: 48641 - DNA, 103 bp, Artificial Sequence
  Synthetic Polynucleotide
taatacgactcactatagggttttatttaccgatgtatacacatctataaaacagaggagattatagatgtgtatacataacctggcggcagcgcaaaagatg

SEQ ID NO: 48642 - DNA, 103 bp, Artificial Sequence
  Synthetic Polynucleotide
taatacgactcactatagggtatagttttatttaccgatgtatacacatcaacagaggagagatgtgatgacatcggtaaacctggcggcagcgcaaaagatg

SEQ ID NO: 48643 - DNA, 103 bp, Artificial Sequence
  Synthetic Polynucleotide
taatacgactcactataggggatactatagttttatttaccgatgtatacaacagaggagagtatacatgggtaaataaaacctggcggcagcgcaaaagatg

SEQ ID NO: 48644 - DNA, 103 bp, Artificial Sequence
  Synthetic Polynucleotide
taatacgactcactatagggcgttggatactatagttttatttaccgatgaacagaggagacatcggatgataaaactaaacctggcggcagcgcaaaagatg

SEQ ID NO: 48645 - DNA, 103 bp, Artificial Sequence
  Synthetic Polynucleotide
taatacgactcactataggggggatcgttggatactatagttttatttacaacagaggagagtaaatatgactatagtaaacctggcggcagcgcaaaagatg

SEQ ID NO: 48646 - DNA, 103 bp, Artificial Sequence
  Synthetic Polynucleotide
taatacgactcactataggggagaagggatcgttggatactatagttttaaacagaggagataaaacatgagtatccaaaacctggcggcagcgcaaaagatg

SEQ ID NO: 48647 - DNA, 103 bp, Artificial Sequence
  Synthetic Polynucleotide
taatacgactcactatagggtttgcgagaagggatcgttggatactatagaacagaggagactatagatgccaacgatcaacctggcggcagcgcaaaagatg

SEQ ID NO: 48648 - DNA, 103 bp, Artificial Sequence
  Synthetic Polynucleotide
taatacgactcactatagggattctatagatctagagattgatcttattgaacagaggagacaataaatgcaatctctaaacctggcggcagcgcaaaagatg

SEQ ID NO: 48649 - DNA, 103 bp, Artificial Sequence
  Synthetic Polynucleotide
taatacgactcactatagggtagaatttgcgagaagggatcgttggatacaacagaggagagtatccatggatcccttcaacctggcggcagcgcaaaagatg

SEQ ID NO: 48650 - DNA, 103 bp, Artificial Sequence
  Synthetic Polynucleotide
taatacgactcactatagggaagactagaatttgcgagaagggatcgttgaacagaggagacaacgaatgcttctcgcaaacctggcggcagcgcaaaagatg

SEQ ID NO: 48651 - DNA, 103 bp, Artificial Sequence
  Synthetic Polynucleotide
taatacgactcactatagggtggttaagactagaatttgcgagaagggataacagaggagaatccctatgcgcaaattcaacctggcggcagcgcaaaagatg

SEQ ID NO: 48652 - DNA, 103 bp, Artificial Sequence
  Synthetic Polynucleotide
taatacgactcactatagggtttcttggttaagactagaatttgcgagaaaacagaggagattctcgatgattctagtcaacctggcggcagcgcaaaagatg

SEQ ID NO: 48653 - DNA, 103 bp, Artificial Sequence
  Synthetic Polynucleotide
taatacgactcactatagggtacgatttcttggttaagactagaatttgcaacagaggagagcaaatatgagtcttaacaacctggcggcagcgcaaaagatg

SEQ ID NO: 48654 - DNA, 103 bp, Artificial Sequence
  Synthetic Polynucleotide
taatacgactcactatagggttatatacgatttcttggttaagactagaaaacagaggagattctagatgtaaccaagaaacctggcggcagcgcaaaagatg

SEQ ID NO: 48655 - DNA, 103 bp, Artificial Sequence
  Synthetic Polynucleotide
taatacgactcactatagggcgtagttatatacgatttcttggttaagacaacagaggagagtcttaatgaagaaatcgaacctggcggcagcgcaaaagatg

SEQ ID NO: 48656 - DNA, 103 bp, Artificial Sequence
  Synthetic Polynucleotide
taatacgactcactatagggatttccgtagttatatacgatttcttggttaacagaggagaaaccaaatgatcgtatataacctggcggcagcgcaaaagatg

SEQ ID NO: 48657 - DNA, 103 bp, Artificial Sequence
  Synthetic Polynucleotide
taatacgactcactatagggacgccatttccgtagttatatacgatttctaacagaggagaagaaatatgatataactaaacctggcggcagcgcaaaagatg

SEQ ID NO: 48658 - DNA, 103 bp, Artificial Sequence
  Synthetic Polynucleotide
taatacgactcactatagggtaaatacgccatttccgtagttatatacgaaacagaggagatcgtatatgactacggaaaacctggcggcagcgcaaaagatg

SEQ ID NO: 48659 - DNA, 103 bp, Artificial Sequence
  Synthetic Polynucleotide
taatacgactcactatagggttttgattctatagatctagagattgatctaacagaggagaagatcaatgtctagatctaacctggcggcagcgcaaaagatg

SEQ ID NO: 48660 - DNA, 103 bp, Artificial Sequence
  Synthetic Polynucleotide
taatacgactcactatagggactcttaaatacgccatttccgtagttataaacagaggagatataacatgggaaatggcaacctggcggcagcgcaaaagatg

SEQ ID NO: 48661 - DNA, 103 bp, Artificial Sequence
  Synthetic Polynucleotide
taatacgactcactatagggaatccactcttaaatacgccatttccgtagaacagaggagactacggatgtggcgtattaacctggcggcagcgcaaaagatg

SEQ ID NO: 48662 - DNA, 103 bp, Artificial Sequence
  Synthetic Polynucleotide
taatacgactcactatagggagaagaatccactcttaaatacgccatttcaacagaggagagaaatgatgtatttaagaaacctggcggcagcgcaaaagatg

SEQ ID NO: 48663 - DNA, 103 bp, Artificial Sequence
  Synthetic Polynucleotide
taatacgactcactatagggacggtagaagaatccactcttaaatacgccaacagaggagaggcgtaatgaagagtggaaacctggcggcagcgcaaaagatg

SEQ ID NO: 48664 - DNA, 103 bp, Artificial Sequence
  Synthetic Polynucleotide
taatacgactcactatagggacaaaacggtagaagaatccactcttaaataacagaggagaatttaaatgtggattcttaacctggcggcagcgcaaaagatg

SEQ ID NO: 48665 - DNA, 103 bp, Artificial Sequence
  Synthetic Polynucleotide
taatacgactcactatagggcaagaacaaaacggtagaagaatccactctaacagaggagaagagtgatgtcttctaccaacctggcggcagcgcaaaagatg

SEQ ID NO: 48666 - DNA, 103 bp, Artificial Sequence
  Synthetic Polynucleotide
taatacgactcactatagggaaatccaagaacaaaacggtagaagaatccaacagaggagaggattcatgtaccgttttaacctggcggcagcgcaaaagatg

SEQ ID NO: 48667 - DNA, 103 bp, Artificial Sequence
  Synthetic Polynucleotide
taatacgactcactatagggatatgaaatccaagaacaaaacggtagaagaacagaggagacttctaatgttttgttctaacctggcggcagcgcaaaagatg

SEQ ID NO: 48668 - DNA, 103 bp, Artificial Sequence
  Synthetic Polynucleotide
taatacgactcactatagggttcttatatgaaatccaagaacaaaacggtaacagaggagaaccgttatgttcttggataacctggcggcagcgcaaaagatg

SEQ ID NO: 48669 - DNA, 103 bp, Artificial Sequence
  Synthetic Polynucleotide
taatacgactcactatagggatagtttcttatatgaaatccaagaacaaaaacagaggagatttgttatgggatttcataacctggcggcagcgcaaaagatg

SEQ ID NO: 48670 - DNA, 103 bp, Artificial Sequence
  Synthetic Polynucleotide
taatacgactcactatagggtcatgttttgattctatagatctagagattaacagaggagaaatctcatgatctatagaaacctggcggcagcgcaaaagatg

SEQ ID NO: 48671 - DNA, 103 bp, Artificial Sequence
  Synthetic Polynucleotide
taatacgactcactatagggactttatagtttcttatatgaaatccaagaaacagaggagatcttggatgtcatataagaacctggcggcagcgcaaaagatg

SEQ ID NO: 48672 - DNA, 103 bp, Artificial Sequence
  Synthetic Polynucleotide
taatacgactcactatagggtgcggactttatagtttcttatatgaaatcaacagaggagagatttcatgtaagaaactaacctggcggcagcgcaaaagatg

SEQ ID NO: 48673 - DNA, 103 bp, Artificial Sequence
  Synthetic Polynucleotide
taatacgactcactatagggagtagtgcggactttatagtttcttatatgaacagaggagacatataatgaactataaaaacctggcggcagcgcaaaagatg

SEQ ID NO: 48674 - DNA, 103 bp, Artificial Sequence
  Synthetic Polynucleotide
taatacgactcactatagggttaacagtagtgcggactttatagtttcttaacagaggagaaagaaaatgtaaagtccgaacctggcggcagcgcaaaagatg

SEQ ID NO: 48675 - DNA, 103 bp, Artificial Sequence
  Synthetic Polynucleotide
taatacgactcactatagggcattcttaacagtagtgcggactttatagtaacagaggagaactataatgtccgcactaaacctggcggcagcgcaaaagatg

SEQ ID NO: 48676 - DNA, 103 bp, Artificial Sequence
  Synthetic Polynucleotide
taatacgactcactataggggtaatcattcttaacagtagtgcggactttaacagaggagaaaagtcatgactactgttaacctggcggcagcgcaaaagatg

SEQ ID NO: 48677 - DNA, 103 bp, Artificial Sequence
  Synthetic Polynucleotide
taatacgactcactatagggcgttagtaatcattcttaacagtagtgcggaacagaggagaccgcacatgtgttaagaaaacctggcggcagcgcaaaagatg

SEQ ID NO: 48678 - DNA, 103 bp, Artificial Sequence
  Synthetic Polynucleotide
taatacgactcactatagggagttgcgttagtaatcattcttaacagtagaacagaggagactactgatgagaatgattaacctggcggcagcgcaaaagatg

SEQ ID NO: 48679 - DNA, 103 bp, Artificial Sequence
  Synthetic Polynucleotide
taatacgactcactatagggtatatagttgcgttagtaatcattcttaacaacagaggagagttaagatggattactaaaacctggcggcagcgcaaaagatg

SEQ ID NO: 48680 - DNA, 103 bp, Artificial Sequence
  Synthetic Polynucleotide
taatacgactcactatagggtaaactatatagttgcgttagtaatcattcaacagaggagagaatgaatgctaacgcaaaacctggcggcagcgcaaaagatg

SEQ ID NO: 48681 - DNA, 103 bp, Artificial Sequence
  Synthetic Polynucleotide
taatacgactcactatagggggttaaccatcgggttaaccttcgtctaccaacagaggagaggtagaatgaggttaaccaacctggcggcagcgcaaaagatg

SEQ ID NO: 48682 - DNA, 103 bp, Artificial Sequence
  Synthetic Polynucleotide
taatacgactcactatagggacctatcatgttttgattctatagatctagaacagaggagactagatatgtagaatcaaaacctggcggcagcgcaaaagatg

SEQ ID NO: 48683 - DNA, 103 bp, Artificial Sequence
  Synthetic Polynucleotide
taatacgactcactatagggtaatttaaactatatagttgcgttagtaataacagaggagaattactatggcaactataaacctggcggcagcgcaaaagatg

SEQ ID NO: 48684 - DNA, 103 bp, Artificial Sequence
  Synthetic Polynucleotide
taatacgactcactatagggatgcttaatttaaactatatagttgcgttaaacagaggagataacgcatgtatatagttaacctggcggcagcgcaaaagatg

SEQ ID NO: 48685 - DNA, 103 bp, Artificial Sequence
  Synthetic Polynucleotide
taatacgactcactatagggccaagatgcttaatttaaactatatagttgaacagaggagacaactaatgagtttaaataacctggcggcagcgcaaaagatg

SEQ ID NO: 48686 - DNA, 103 bp, Artificial Sequence
  Synthetic Polynucleotide
taatacgactcactatagggtgtttccaagatgcttaatttaaactatataacagaggagaatatagatgaaattaagcaacctggcggcagcgcaaaagatg

SEQ ID NO: 48687 - DNA, 103 bp, Artificial Sequence
  Synthetic Polynucleotide
taatacgactcactatagggttttatgtttccaagatgcttaatttaaacaacagaggagagtttaaatgaagcatcttaacctggcggcagcgcaaaagatg

SEQ ID NO: 48688 - DNA, 103 bp, Artificial Sequence
  Synthetic Polynucleotide
taatacgactcactatagggagttattttatgtttccaagatgcttaattaacagaggagaaattaaatgtcttggaaaaacctggcggcagcgcaaaagatg

SEQ ID NO: 48689 - DNA, 103 bp, Artificial Sequence
  Synthetic Polynucleotide
taatacgactcactatagggtacagagttattttatgtttccaagatgctaacagaggagaagcatcatggaaacataaaacctggcggcagcgcaaaagatg

SEQ ID NO: 48690 - DNA, 103 bp, Artificial Sequence
  Synthetic Polynucleotide
taatacgactcactatagggtcgtctacagagttattttatgtttccaagaacagaggagacttggaatgataaaataaaacctggcggcagcgcaaaagatg

SEQ ID NO: 48691 - DNA, 103 bp, Artificial Sequence
  Synthetic Polynucleotide
taatacgactcactatagggaagtatcgtctacagagttattttatgtttaacagaggagaaaacatatgataactctgaacctggcggcagcgcaaaagatg

SEQ ID NO: 48692 - DNA, 103 bp, Artificial Sequence
  Synthetic Polynucleotide
taatacgactcactatagggaagtcaagtatcgtctacagagttattttaaacagaggagataaaatatgtctgtagacaacctggcggcagcgcaaaagatg

SEQ ID NO: 48693 - DNA, 103 bp, Artificial Sequence
  Synthetic Polynucleotide
taatacgactcactatagggttctaacctatcatgttttgattctatagaaacagaggagatctataatgtcaaaacataacctggcggcagcgcaaaagatg

SEQ ID NO: 48694 - DNA, 103 bp, Artificial Sequence
  Synthetic Polynucleotide
taatacgactcactatagggttcgaaagtcaagtatcgtctacagagttaaacagaggagataactcatgagacgatacaacctggcggcagcgcaaaagatg

SEQ ID NO: 48695 - DNA, 103 bp, Artificial Sequence
  Synthetic Polynucleotide
taatacgactcactatagggacttattcgaaagtcaagtatcgtctacagaacagaggagactgtagatgatacttgacaacctggcggcagcgcaaaagatg

SEQ ID NO: 48696 - DNA, 103 bp, Artificial Sequence
  Synthetic Polynucleotide
taatacgactcactatagggtgcaaacttattcgaaagtcaagtatcgtcaacagaggagagacgatatgtgactttcgaacctggcggcagcgcaaaagatg

SEQ ID NO: 48697 - DNA, 103 bp, Artificial Sequence
  Synthetic Polynucleotide
taatacgactcactatagggttgtctgcaaacttattcgaaagtcaagtaaacagaggagatacttgatgttcgaataaaacctggcggcagcgcaaaagatg

SEQ ID NO: 48698 - DNA, 103 bp, Artificial Sequence
  Synthetic Polynucleotide
taatacgactcactatagggttcgtttgtctgcaaacttattcgaaagtcaacagaggagagactttatgataagtttgaacctggcggcagcgcaaaagatg

SEQ ID NO: 48699 - DNA, 103 bp, Artificial Sequence
  Synthetic Polynucleotide
taatacgactcactatagggctttcttcgtttgtctgcaaacttattcgaaacagaggagatcgaatatgtttgcagacaacctggcggcagcgcaaaagatg

SEQ ID NO: 48700 - DNA, 103 bp, Artificial Sequence
  Synthetic Polynucleotide
taatacgactcactatagggctgttctttcttcgtttgtctgcaaacttaaacagaggagataagttatgagacaaacgaacctggcggcagcgcaaaagatg

SEQ ID NO: 48701 - DNA, 103 bp, Artificial Sequence
  Synthetic Polynucleotide
taatacgactcactataggggaggtctgttctttcttcgtttgtctgcaaaacagaggagattgcagatgaacgaagaaaacctggcggcagcgcaaaagatg

SEQ ID NO: 48702 - DNA, 103 bp, Artificial Sequence
  Synthetic Polynucleotide
taatacgactcactatagggtaagagaggtctgttctttcttcgtttgtcaacagaggagagacaaaatgagaaagaacaacctggcggcagcgcaaaagatg

SEQ ID NO: 48703 - DNA, 103 bp, Artificial Sequence
  Synthetic Polynucleotide
taatacgactcactataggggaaattaagagaggtctgttctttcttcgtaacagaggagaacgaagatggaacagaccaacctggcggcagcgcaaaagatg

SEQ ID NO: 48704 - DNA, 103 bp, Artificial Sequence
  Synthetic Polynucleotide
taatacgactcactatagggttatcttctaacctatcatgttttgattctaacagaggagaagaatcatgacatgatagaacctggcggcagcgcaaaagatg

SEQ ID NO: 48705 - DNA, 103 bp, Artificial Sequence
  Synthetic Polynucleotide
taatacgactcactatagggcttctgaaattaagagaggtctgttctttcaacagaggagagaaagaatggacctctctaacctggcggcagcgcaaaagatg

SEQ ID NO: 48706 - DNA, 103 bp, Artificial Sequence
  Synthetic Polynucleotide
taatacgactcactataggggttttcttctgaaattaagagaggtctgttaacagaggagaaacagaatgctcttaattaacctggcggcagcgcaaaagatg

SEQ ID NO: 48707 - DNA, 103 bp, Artificial Sequence
  Synthetic Polynucleotide
taatacgactcactatagggaaaaagttttcttctgaaattaagagaggtaacagaggagaacctctatgaatttcagaaacctggcggcagcgcaaaagatg

SEQ ID NO: 48708 - DNA, 103 bp, Artificial Sequence
  Synthetic Polynucleotide
taatacgactcactatagggacgaaaaaaagttttcttctgaaattaagaaacagaggagatcttaaatgcagaagaaaaacctggcggcagcgcaaaagatg

SEQ ID NO: 48709 - DNA, 103 bp, Artificial Sequence
  Synthetic Polynucleotide
taatacgactcactatagggggaatacgaaaaaaagttttcttctgaaataacagaggagaatttcaatggaaaactttaacctggcggcagcgcaaaagatg

SEQ ID NO: 48710 - DNA, 103 bp, Artificial Sequence
  Synthetic Polynucleotide
taatacgactcactatagggcgtcaggaatacgaaaaaaagttttcttctaacagaggagaagaagaatgctttttttcaacctggcggcagcgcaaaagatg

SEQ ID NO: 48711 - DNA, 103 bp, Artificial Sequence
  Synthetic Polynucleotide
taatacgactcactatagggctagacgtcaggaatacgaaaaaaagttttaacagaggagaaaaactatgtttcgtattaacctggcggcagcgcaaaagatg

SEQ ID NO: 48712 - DNA, 103 bp, Artificial Sequence
  Synthetic Polynucleotide
taatacgactcactatagggaaactctagacgtcaggaatacgaaaaaaaaacagaggagattttttatgtattcctgaaacctggcggcagcgcaaaagatg

SEQ ID NO: 48713 - DNA, 103 bp, Artificial Sequence
  Synthetic Polynucleotide
taatacgactcactataggggatataaactctagacgtcaggaatacgaaaacagaggagattcgtaatgctgacgtctaacctggcggcagcgcaaaagatg

SEQ ID NO: 48714 - DNA, 103 bp, Artificial Sequence
  Synthetic Polynucleotide
taatacgactcactatagggttattgatataaactctagacgtcaggaataacagaggagaattcctatggtctagagtaacctggcggcagcgcaaaagatg

SEQ ID NO: 48715 - DNA, 103 bp, Artificial Sequence
  Synthetic Polynucleotide
taatacgactcactatagggattcattatcttctaacctatcatgttttgaacagaggagacaaaacatgataggttagaacctggcggcagcgcaaaagatg

SEQ ID NO: 48716 - DNA, 103 bp, Artificial Sequence
  Synthetic Polynucleotide
taatacgactcactatagggcttttttattgatataaactctagacgtcaaacagaggagatgacgtatggagtttataaacctggcggcagcgcaaaagatg

SEQ ID NO: 48717 - DNA, 103 bp, Artificial Sequence
  Synthetic Polynucleotide
taatacgactcactatagggcttaacttttttattgatataaactctagaaacagaggagatctagaatgtatatcaataacctggcggcagcgcaaaagatg

SEQ ID NO: 48718 - DNA, 103 bp, Artificial Sequence
  Synthetic Polynucleotide
taatacgactcactatagggtaattcttaacttttttattgatataaactaacagaggagaagtttaatgcaataaaaaaacctggcggcagcgcaaaagatg

SEQ ID NO: 48719 - DNA, 103 bp, Artificial Sequence
  Synthetic Polynucleotide
taatacgactcactatagggccgactaattcttaacttttttattgatataacagaggagaatatcaatgaaaaagttaaacctggcggcagcgcaaaagatg

SEQ ID NO: 48720 - DNA, 103 bp, Artificial Sequence
  Synthetic Polynucleotide
taatacgactcactatagggattaaccgactaattcttaacttttttattaacagaggagaaataaaatggttaagaataacctggcggcagcgcaaaagatg

SEQ ID NO: 48721 - DNA, 103 bp, Artificial Sequence
  Synthetic Polynucleotide
taatacgactcactatagggacaacattaaccgactaattcttaacttttaacagaggagaaaaagtatggaattagtcaacctggcggcagcgcaaaagatg

SEQ ID NO: 48722 - DNA, 103 bp, Artificial Sequence
  Synthetic Polynucleotide
taatacgactcactataggggaaatacaacattaaccgactaattcttaaaacagaggagattaagaatgagtcggttaaacctggcggcagcgcaaaagatg

SEQ ID NO: 48723 - DNA, 103 bp, Artificial Sequence
  Synthetic Polynucleotide
taatacgactcactataggggtaatgaaatacaacattaaccgactaattaacagaggagaaattagatggttaatgttaacctggcggcagcgcaaaagatg

SEQ ID NO: 48724 - DNA, 103 bp, Artificial Sequence
  Synthetic Polynucleotide
taatacgactcactatagggcttgggtaatgaaatacaacattaaccgacaacagaggagagtcggtatgtgttgtattaacctggcggcagcgcaaaagatg

SEQ ID NO: 48725 - DNA, 103 bp, Artificial Sequence
  Synthetic Polynucleotide
taatacgactcactatagggtcaaacttgggtaatgaaatacaacattaaaacagaggagattaatgatgtatttcattaacctggcggcagcgcaaaagatg

SEQ ID NO: 48726 - DNA, 103 bp, Artificial Sequence
  Synthetic Polynucleotide
taatacgactcactatagggcagatattcattatcttctaacctatcatgaacagaggagacatgatatgttagaagataacctggcggcagcgcaaaagatg

SEQ ID NO: 48727 - DNA, 103 bp, Artificial Sequence
  Synthetic Polynucleotide
taatacgactcactatagggaaatctcaaacttgggtaatgaaatacaacaacagaggagagttgtaatgcattacccaaacctggcggcagcgcaaaagatg

SEQ ID NO: 48728 - DNA, 103 bp, Artificial Sequence
  Synthetic Polynucleotide
taatacgactcactatagggttatgaaatctcaaacttgggtaatgaaataacagaggagaatttcaatgcccaagtttaacctggcggcagcgcaaaagatg

SEQ ID NO: 48729 - DNA, 103 bp, Artificial Sequence
  Synthetic Polynucleotide
taatacgactcactatagggtaatattatgaaatctcaaacttgggtaataacagaggagaattaccatggtttgagataacctggcggcagcgcaaaagatg

SEQ ID NO: 48730 - DNA, 103 bp, Artificial Sequence
  Synthetic Polynucleotide
taatacgactcactatagggtttgataatattatgaaatctcaaacttggaacagaggagaccaagtatgagatttcataacctggcggcagcgcaaaagatg

SEQ ID NO: 48731 - DNA, 103 bp, Artificial Sequence
  Synthetic Polynucleotide
taatacgactcactatagggtgtcttttgataatattatgaaatctcaaaaacagaggagatttgagatgtcataatataacctggcggcagcgcaaaagatg

SEQ ID NO: 48732 - DNA, 103 bp, Artificial Sequence
  Synthetic Polynucleotide
taatacgactcactatagggtatcatgtcttttgataatattatgaaatcaacagaggagagatttcatgatattatcaaacctggcggcagcgcaaaagatg

SEQ ID NO: 48733 - DNA, 103 bp, Artificial Sequence
  Synthetic Polynucleotide
taatacgactcactatagggaatattatcatgtcttttgataatattatgaacagaggagacataatatgatcaaaagaaacctggcggcagcgcaaaagatg

SEQ ID NO: 48734 - DNA, 103 bp, Artificial Sequence
  Synthetic Polynucleotide
taatacgactcactatagggtctttaatattatcatgtcttttgataataaacagaggagatattatatgaagacatgaaacctggcggcagcgcaaaagatg

SEQ ID NO: 48735 - DNA, 103 bp, Artificial Sequence
  Synthetic Polynucleotide
taatacgactcactatagggctttatctttaatattatcatgtcttttgaaacagaggagatcaaaaatgatgataataaacctggcggcagcgcaaaagatg

SEQ ID NO: 48736 - DNA, 103 bp, Artificial Sequence
  Synthetic Polynucleotide
taatacgactcactatagggcagcgctttatctttaatattatcatgtctaacagaggagaagacatatgaatattaaaaacctggcggcagcgcaaaagatg

SEQ ID NO: 48737 - DNA, 103 bp, Artificial Sequence
  Synthetic Polynucleotide
taatacgactcactataggggcctacagatattcattatcttctaacctaaacagaggagataggttatgagataatgaaacctggcggcagcgcaaaagatg

SEQ ID NO: 48738 - DNA, 103 bp, Artificial Sequence
  Synthetic Polynucleotide
taatacgactcactatagggatagtcagcgctttatctttaatattatcaaacagaggagatgataaatgtaaagataaaacctggcggcagcgcaaaagatg

SEQ ID NO: 48739 - DNA, 103 bp, Artificial Sequence
  Synthetic Polynucleotide
taatacgactcactatagggcgtgcatagtcagcgctttatctttaatataacagaggagaatattaatgataaagcgcaacctggcggcagcgcaaaagatg

SEQ ID NO: 48740 - DNA, 103 bp, Artificial Sequence
  Synthetic Polynucleotide
taatacgactcactatagggtatttcgtgcatagtcagcgctttatctttaacagaggagaaaagatatggcgctgactaacctggcggcagcgcaaaagatg

SEQ ID NO: 48741 - DNA, 103 bp, Artificial Sequence
  Synthetic Polynucleotide
taatacgactcactatagggatagctatttcgtgcatagtcagcgctttaaacagaggagataaagcatggactatgcaaacctggcggcagcgcaaaagatg

SEQ ID NO: 48742 - DNA, 103 bp, Artificial Sequence
  Synthetic Polynucleotide
taatacgactcactatagggaccatatagctatttcgtgcatagtcagcgaacagaggagacgctgaatgtgcacgaaaaacctggcggcagcgcaaaagatg

SEQ ID NO: 48743 - DNA, 103 bp, Artificial Sequence
  Synthetic Polynucleotide
taatacgactcactatagggagcgaaccatatagctatttcgtgcatagtaacagaggagaactatgatggaaatagctaacctggcggcagcgcaaaagatg

SEQ ID NO: 48744 - DNA, 103 bp, Artificial Sequence
  Synthetic Polynucleotide
taatacgactcactatagggtcttgagcgaaccatatagctatttcgtgcaacagaggagagcacgaatgagctatatgaacctggcggcagcgcaaaagatg

SEQ ID NO: 48745 - DNA, 103 bp, Artificial Sequence
  Synthetic Polynucleotide
taatacgactcactatagggtatattcttgagcgaaccatatagctatttaacagaggagaaaatagatgtatggttcgaacctggcggcagcgcaaaagatg

SEQ ID NO: 48746 - DNA, 103 bp, Artificial Sequence
  Synthetic Polynucleotide
taatacgactcactatagggaagactatattcttgagcgaaccatatagcaacagaggagagctataatgttcgctcaaaacctggcggcagcgcaaaagatg

SEQ ID NO: 48747 - DNA, 103 bp, Artificial Sequence
  Synthetic Polynucleotide
taatacgactcactatagggttaacaagactatattcttgagcgaaccataacagaggagaatggttatgtcaagaataaacctggcggcagcgcaaaagatg

SEQ ID NO: 48748 - DNA, 103 bp, Artificial Sequence
  Synthetic Polynucleotide
taatacgactcactatagggaagaagcctacagatattcattatcttctaaacagaggagatagaagatgatgaatatcaacctggcggcagcgcaaaagatg

SEQ ID NO: 48749 - DNA, 103 bp, Artificial Sequence
  Synthetic Polynucleotide
taatacgactcactatagggcacgtttaacaagactatattcttgagcgaaacagaggagatcgctcatgaatatagtcaacctggcggcagcgcaaaagatg

SEQ ID NO: 48750 - DNA, 103 bp, Artificial Sequence
  Synthetic Polynucleotide
taatacgactcactataggggtttccacgtttaacaagactatattcttgaacagaggagacaagaaatgagtcttgttaacctggcggcagcgcaaaagatg

SEQ ID NO: 48751 - DNA, 103 bp, Artificial Sequence
  Synthetic Polynucleotide
taatacgactcactatagggttatcgtttccacgtttaacaagactatataacagaggagaatatagatgtgttaaacgaacctggcggcagcgcaaaagatg

SEQ ID NO: 48752 - DNA, 103 bp, Artificial Sequence
  Synthetic Polynucleotide
taatacgactcactatagggtacagttatcgtttccacgtttaacaagacaacagaggagagtcttgatgaacgtggaaaacctggcggcagcgcaaaagatg

SEQ ID NO: 48753 - DNA, 103 bp, Artificial Sequence
  Synthetic Polynucleotide
taatacgactcactatagggaaaaatacagttatcgtttccacgtttaacaacagaggagagttaaaatgggaaacgataacctggcggcagcgcaaaagatg

SEQ ID NO: 48754 - DNA, 103 bp, Artificial Sequence
  Synthetic Polynucleotide
taatacgactcactatagggtaattaaaaatacagttatcgtttccacgtaacagaggagaacgtggatgcgataactgaacctggcggcagcgcaaaagatg

SEQ ID NO: 48755 - DNA, 103 bp, Artificial Sequence
  Synthetic Polynucleotide
taatacgactcactatagggtgacgtaattaaaaatacagttatcgtttcaacagaggagagaaacgatgactgtatttaacctggcggcagcgcaaaagatg

SEQ ID NO: 48756 - DNA, 103 bp, Artificial Sequence
  Synthetic Polynucleotide
taatacgactcactataggggcagctgacgtaattaaaaatacagttatcaacagaggagagataacatgatttttaataacctggcggcagcgcaaaagatg

SEQ ID NO: 48757 - DNA, 103 bp, Artificial Sequence
  Synthetic Polynucleotide
taatacgactcactatagggtagatgcagctgacgtaattaaaaatacagaacagaggagactgtatatgtaattacgtaacctggcggcagcgcaaaagatg

SEQ ID NO: 48758 - DNA, 103 bp, Artificial Sequence
  Synthetic Polynucleotide
taatacgactcactatagggtaatttagatgcagctgacgtaattaaaaaaacagaggagatttttaatgacgtcagctaacctggcggcagcgcaaaagatg

SEQ ID NO: 48759 - DNA, 103 bp, Artificial Sequence
  Synthetic Polynucleotide
taatacgactcactataggggcaacaagaagcctacagatattcattatcaacagaggagagataatatgtatctgtagaacctggcggcagcgcaaaagatg

SEQ ID NO: 48760 - DNA, 103 bp, Artificial Sequence
  Synthetic Polynucleotide
taatacgactcactatagggatatttaatttagatgcagctgacgtaattaacagaggagaaattacatgagctgcatcaacctggcggcagcgcaaaagatg

SEQ ID NO: 48761 - DNA, 103 bp, Artificial Sequence
  Synthetic Polynucleotide
taatacgactcactatagggtacctatatttaatttagatgcagctgacgaacagaggagacgtcagatgcatctaaataacctggcggcagcgcaaaagatg

SEQ ID NO: 48762 - DNA, 103 bp, Artificial Sequence
  Synthetic Polynucleotide
taatacgactcactatagggaaatatacctatatttaatttagatgcagcaacagaggagagctgcaatgaaattaaataacctggcggcagcgcaaaagatg

SEQ ID NO: 48763 - DNA, 103 bp, Artificial Sequence
  Synthetic Polynucleotide
taatacgactcactatagggggaataaatatacctatatttaatttagataacagaggagaatctaaatgaaatataggaacctggcggcagcgcaaaagatg

SEQ ID NO: 48764 - DNA, 103 bp, Artificial Sequence
  Synthetic Polynucleotide
taatacgactcactatagggtgtgtggaataaatatacctatatttaattaacagaggagaaattaaatgtaggtatataacctggcggcagcgcaaaagatg

SEQ ID NO: 48765 - DNA, 103 bp, Artificial Sequence
  Synthetic Polynucleotide
taatacgactcactatagggtagagtgtgtggaataaatatacctatattaacagaggagaaatataatgatatttattaacctggcggcagcgcaaaagatg

SEQ ID NO: 48766 - DNA, 103 bp, Artificial Sequence
  Synthetic Polynucleotide
taatacgactcactatagggtattgtagagtgtgtggaataaatatacctaacagaggagaaggtatatgtattccacaaacctggcggcagcgcaaaagatg

SEQ ID NO: 48767 - DNA, 103 bp, Artificial Sequence
  Synthetic Polynucleotide
taatacgactcactatagggtggcatattgtagagtgtgtggaataaataaacagaggagatatttaatgcacacactcaacctggcggcagcgcaaaagatg

SEQ ID NO: 48768 - DNA, 103 bp, Artificial Sequence
  Synthetic Polynucleotide
taatacgactcactatagggtggtgtggcatattgtagagtgtgtggaataacagaggagaattccaatgactctacaaaacctggcggcagcgcaaaagatg

SEQ ID NO: 48769 - DNA, 103 bp, Artificial Sequence
  Synthetic Polynucleotide
taatacgactcactataggggaagatggtgtggcatattgtagagtgtgtaacagaggagaacacacatgacaatatgcaacctggcggcagcgcaaaagatg

SEQ ID NO: 48770 - DNA, 103 bp, Artificial Sequence
  Synthetic Polynucleotide
taatacgactcactatagggacagtgcaacaagaagcctacagatattcaaacagaggagatgaataatggtaggcttcaacctggcggcagcgcaaaagatg

SEQ ID NO: 48771 - DNA, 103 bp, Artificial Sequence
  Synthetic Polynucleotide
taatacgactcactatagggattatgaagatggtgtggcatattgtagagaacagaggagactctacatgatgccacacaacctggcggcagcgcaaaagatg

SEQ ID NO: 48772 - DNA, 103 bp, Artificial Sequence
  Synthetic Polynucleotide
taatacgactcactatagggtatttattatgaagatggtgtggcatattgaacagaggagacaatatatgacaccatctaacctggcggcagcgcaaaagatg

SEQ ID NO: 48773 - DNA, 103 bp, Artificial Sequence
  Synthetic Polynucleotide
taatacgactcactataggggaatttatttattatgaagatggtgtggcaaacagaggagatgccacatgatcttcataaacctggcggcagcgcaaaagatg

SEQ ID NO: 48774 - DNA, 103 bp, Artificial Sequence
  Synthetic Polynucleotide
taatacgactcactatagggctaatgaatttatttattatgaagatggtgaacagaggagacaccatatgcataataaaaacctggcggcagcgcaaaagatg

SEQ ID NO: 48775 - DNA, 103 bp, Artificial Sequence
  Synthetic Polynucleotide
taatacgactcactatagggctttgctaatgaatttatttattatgaagaaacagaggagatcttcaatgtaaataaataacctggcggcagcgcaaaagatg

SEQ ID NO: 48776 - DNA, 103 bp, Artificial Sequence
  Synthetic Polynucleotide
taatacgactcactatagggaataactttgctaatgaatttatttattataacagaggagaataataatgaaattcattaacctggcggcagcgcaaaagatg

SEQ ID NO: 48777 - DNA, 103 bp, Artificial Sequence
  Synthetic Polynucleotide
taatacgactcactatagggaaattaataactttgctaatgaatttatttaacagaggagaaaataaatgcattagcaaaacctggcggcagcgcaaaagatg

SEQ ID NO: 48778 - DNA, 103 bp, Artificial Sequence
  Synthetic Polynucleotide
taatacgactcactatagggcactaaaattaataactttgctaatgaattaacagaggagaaattcaatggcaaagttaaacctggcggcagcgcaaaagatg

SEQ ID NO: 48779 - DNA, 103 bp, Artificial Sequence
  Synthetic Polynucleotide
taatacgactcactatagggtatttcactaaaattaataactttgctaataacagaggagaattagcatggttattaataacctggcggcagcgcaaaagatg

SEQ ID NO: 48780 - DNA, 103 bp, Artificial Sequence
  Synthetic Polynucleotide
taatacgactcactatagggctaactatttcactaaaattaataactttgaacagaggagacaaagtatgtaattttagaacctggcggcagcgcaaaagatg

SEQ ID NO: 48781 - DNA, 103 bp, Artificial Sequence
  Synthetic Polynucleotide
taatacgactcactatagggaagttacagtgcaacaagaagcctacagataacagaggagaatctgtatgcttcttgttaacctggcggcagcgcaaaagatg

SEQ ID NO: 48782 - DNA, 103 bp, Artificial Sequence
  Synthetic Polynucleotide
taatacgactcactatagggtgacgctaactatttcactaaaattaataaaacagaggagattattaatgttagtgaaaaacctggcggcagcgcaaaagatg

SEQ ID NO: 48783 - DNA, 103 bp, Artificial Sequence
  Synthetic Polynucleotide
taatacgactcactatagggaaagttgacgctaactatttcactaaaattaacagaggagaaattttatggaaatagttaacctggcggcagcgcaaaagatg

SEQ ID NO: 48784 - DNA, 103 bp, Artificial Sequence
  Synthetic Polynucleotide
taatacgactcactatagggctatgaaagttgacgctaactatttcactaaacagaggagatagtgaatgagttagcgtaacctggcggcagcgcaaaagatg

SEQ ID NO: 48785 - DNA, 103 bp, Artificial Sequence
  Synthetic Polynucleotide
taatacgactcactatagggggaagctatgaaagttgacgctaactatttaacagaggagaaaatagatggcgtcaactaacctggcggcagcgcaaaagatg

SEQ ID NO: 48786 - DNA, 103 bp, Artificial Sequence
  Synthetic Polynucleotide
taatacgactcactatagggttgaaggaagctatgaaagttgacgctaacaacagaggagagttagcatgaactttcataacctggcggcagcgcaaaagatg

SEQ ID NO: 48787 - DNA, 103 bp, Artificial Sequence
  Synthetic Polynucleotide
taatacgactcactatagggttagattgaaggaagctatgaaagttgacgaacagaggagacgtcaaatgtcatagcttaacctggcggcagcgcaaaagatg

SEQ ID NO: 48788 - DNA, 103 bp, Artificial Sequence
  Synthetic Polynucleotide
taatacgactcactatagggtcaaattagattgaaggaagctatgaaagtaacagaggagaactttcatggcttccttcaacctggcggcagcgcaaaagatg

SEQ ID NO: 48789 - DNA, 103 bp, Artificial Sequence
  Synthetic Polynucleotide
taatacgactcactataggggagcatcaaattagattgaaggaagctatgaacagaggagacatagcatgcttcaatctaacctggcggcagcgcaaaagatg

SEQ ID NO: 48790 - DNA, 103 bp, Artificial Sequence
  Synthetic Polynucleotide
taatacgactcactatagggcgtgtgagcatcaaattagattgaaggaagaacagaggagacttcctatgatctaatttaacctggcggcagcgcaaaagatg

SEQ ID NO: 48791 - DNA, 103 bp, Artificial Sequence
  Synthetic Polynucleotide
taatacgactcactatagggcgcaccgtgtgagcatcaaattagattgaaaacagaggagattcaatatgatttgatgcaacctggcggcagcgcaaaagatg

SEQ ID NO: 48792 - DNA, 103 bp, Artificial Sequence
  Synthetic Polynucleotide
taatacgactcactataggggctacggttaaccatcgggttaaccttcgtaacagaggagaacgaagatgaacccgatgaacctggcggcagcgcaaaagatg

SEQ ID NO: 48793 - DNA, 103 bp, Artificial Sequence
  Synthetic Polynucleotide
taatacgactcactatagggacgagaagttacagtgcaacaagaagcctaaacagaggagataggctatgtgttgcactaacctggcggcagcgcaaaagatg

SEQ ID NO: 48794 - DNA, 103 bp, Artificial Sequence
  Synthetic Polynucleotide
taatacgactcactataggggaattcgcaccgtgtgagcatcaaattagaaacagaggagatctaatatgatgctcacaaacctggcggcagcgcaaaagatg

SEQ ID NO: 48795 - DNA, 103 bp, Artificial Sequence
  Synthetic Polynucleotide
taatacgactcactatagggaagtggaattcgcaccgtgtgagcatcaaaaacagaggagatttgatatgcacacggtgaacctggcggcagcgcaaaagatg

SEQ ID NO: 48796 - DNA, 103 bp, Artificial Sequence
  Synthetic Polynucleotide
taatacgactcactatagggtgttaaagtggaattcgcaccgtgtgagcaaacagaggagatgctcaatgggtgcgaataacctggcggcagcgcaaaagatg

SEQ ID NO: 48797 - DNA, 103 bp, Artificial Sequence
  Synthetic Polynucleotide
taatacgactcactatagggagagatgttaaagtggaattcgcaccgtgtaacagaggagaacacggatggaattccacaacctggcggcagcgcaaaagatg

SEQ ID NO: 48798 - DNA, 103 bp, Artificial Sequence
  Synthetic Polynucleotide
taatacgactcactatagggggaaaagagatgttaaagtggaattcgcacaacagaggagagtgcgaatgccactttaaaacctggcggcagcgcaaaagatg

SEQ ID NO: 48799 - DNA, 103 bp, Artificial Sequence
  Synthetic Polynucleotide
taatacgactcactatagggggcatggaaaagagatgttaaagtggaattaacagaggagaaattccatgttaacatctaacctggcggcagcgcaaaagatg

SEQ ID NO: 48800 - DNA, 103 bp, Artificial Sequence
  Synthetic Polynucleotide
taatacgactcactatagggcctgaggcatggaaaagagatgttaaagtgaacagaggagacactttatgatctcttttaacctggcggcagcgcaaaagatg

SEQ ID NO: 48801 - DNA, 103 bp, Artificial Sequence
  Synthetic Polynucleotide
taatacgactcactatagggatgaacctgaggcatggaaaagagatgttaaacagaggagataacatatgttttccatgaacctggcggcagcgcaaaagatg

SEQ ID NO: 48802 - DNA, 103 bp, Artificial Sequence
  Synthetic Polynucleotide
taatacgactcactataggggatcgatgaacctgaggcatggaaaagagaaacagaggagatctcttatgcatgcctcaaacctggcggcagcgcaaaagatg

SEQ ID NO: 48803 - DNA, 103 bp, Artificial Sequence
  Synthetic Polynucleotide
taatacgactcactatagggatagagatcgatgaacctgaggcatggaaaaacagaggagatttccaatgctcaggttcaacctggcggcagcgcaaaagatg

SEQ ID NO: 48804 - DNA, 103 bp, Artificial Sequence
  Synthetic Polynucleotide
taatacgactcactatagggacaaaacgagaagttacagtgcaacaagaaaacagaggagattcttgatgcactgtaacaacctggcggcagcgcaaaagatg

SEQ ID NO: 48805 - DNA, 103 bp, Artificial Sequence
  Synthetic Polynucleotide
taatacgactcactatagggatattatagagatcgatgaacctgaggcataacagaggagaatgcctatggttcatcgaaacctggcggcagcgcaaaagatg

SEQ ID NO: 48806 - DNA, 103 bp, Artificial Sequence
  Synthetic Polynucleotide
taatacgactcactatagggactagatattatagagatcgatgaacctgaaacagaggagatcaggtatgtcgatctctaacctggcggcagcgcaaaagatg

SEQ ID NO: 48807 - DNA, 103 bp, Artificial Sequence
  Synthetic Polynucleotide
taatacgactcactatagggaagaaactagatattatagagatcgatgaaaacagaggagattcatcatgctctataataacctggcggcagcgcaaaagatg

SEQ ID NO: 48808 - DNA, 103 bp, Artificial Sequence
  Synthetic Polynucleotide
taatacgactcactatagggaacgcaagaaactagatattatagagatcgaacagaggagacgatctatgtaatatctaaacctggcggcagcgcaaaagatg

SEQ ID NO: 48809 - DNA, 103 bp, Artificial Sequence
  Synthetic Polynucleotide
taatacgactcactatagggtattaaacgcaagaaactagatattatagaaacagaggagatctataatgtctagtttcaacctggcggcagcgcaaaagatg

SEQ ID NO: 48810 - DNA, 103 bp, Artificial Sequence
  Synthetic Polynucleotide
taatacgactcactataggggtgtttattaaacgcaagaaactagatattaacagaggagaaatatcatgtttcttgcgaacctggcggcagcgcaaaagatg

SEQ ID NO: 48811 - DNA, 103 bp, Artificial Sequence
  Synthetic Polynucleotide
taatacgactcactatagggaacccgtgtttattaaacgcaagaaactagaacagaggagactagttatgtgcgtttaaaacctggcggcagcgcaaaagatg

SEQ ID NO: 48812 - DNA, 103 bp, Artificial Sequence
  Synthetic Polynucleotide
taatacgactcactatagggagacgaacccgtgtttattaaacgcaagaaaacagaggagattcttgatgttaataaacaacctggcggcagcgcaaaagatg

SEQ ID NO: 48813 - DNA, 103 bp, Artificial Sequence
  Synthetic Polynucleotide
taatacgactcactataggggcgaaagacgaacccgtgtttattaaacgcaacagaggagagcgtttatgaaacacgggaacctggcggcagcgcaaaagatg

SEQ ID NO: 48814 - DNA, 103 bp, Artificial Sequence
  Synthetic Polynucleotide
taatacgactcactatagggtcattgcgaaagacgaacccgtgtttattaaacagaggagataataaatgcgggttcgtaacctggcggcagcgcaaaagatg

SEQ ID NO: 48815 - DNA, 103 bp, Artificial Sequence
  Synthetic Polynucleotide
taatacgactcactatagggatctaacaaaacgagaagttacagtgcaacaacagaggagagttgcaatgtaacttctcaacctggcggcagcgcaaaagatg

SEQ ID NO: 48816 - DNA, 103 bp, Artificial Sequence
  Synthetic Polynucleotide
taatacgactcactatagggagacctcattgcgaaagacgaacccgtgttaacagaggagaaacacgatgtcgtctttcaacctggcggcagcgcaaaagatg

SEQ ID NO: 48817 - DNA, 103 bp, Artificial Sequence
  Synthetic Polynucleotide
taatacgactcactatagggtatacagacctcattgcgaaagacgaacccaacagaggagagggttcatgtttcgcaataacctggcggcagcgcaaaagatg

SEQ ID NO: 48818 - DNA, 103 bp, Artificial Sequence
  Synthetic Polynucleotide
taatacgactcactataggggttactatacagacctcattgcgaaagacgaacagaggagacgtcttatgcaatgaggtaacctggcggcagcgcaaaagatg

SEQ ID NO: 48819 - DNA, 103 bp, Artificial Sequence
  Synthetic Polynucleotide
taatacgactcactatagggacatagttactatacagacctcattgcgaaaacagaggagattcgcaatgaggtctgtaaacctggcggcagcgcaaaagatg

SEQ ID NO: 48820 - DNA, 103 bp, Artificial Sequence
  Synthetic Polynucleotide
taatacgactcactatagggcatttacatagttactatacagacctcattaacagaggagaaatgagatgtgtatagtaaacctggcggcagcgcaaaagatg

SEQ ID NO: 48821 - DNA, 103 bp, Artificial Sequence
  Synthetic Polynucleotide
taatacgactcactataggggttatcatttacatagttactatacagaccaacagaggagaggtctgatgagtaactataacctggcggcagcgcaaaagatg

SEQ ID NO: 48822 - DNA, 103 bp, Artificial Sequence
  Synthetic Polynucleotide
taatacgactcactatagggatctagttatcatttacatagttactatacaacagaggagagtatagatgctatgtaaaaacctggcggcagcgcaaaagatg

SEQ ID NO: 48823 - DNA, 103 bp, Artificial Sequence
  Synthetic Polynucleotide
taatacgactcactatagggtttctatctagttatcatttacatagttacaacagaggagagtaactatgtaaatgataaacctggcggcagcgcaaaagatg

SEQ ID NO: 48824 - DNA, 103 bp, Artificial Sequence
  Synthetic Polynucleotide
taatacgactcactatagggacatctttctatctagttatcatttacataaacagaggagatatgtaatggataactagaacctggcggcagcgcaaaagatg

SEQ ID NO: 48825 - DNA, 103 bp, Artificial Sequence
  Synthetic Polynucleotide
taatacgactcactatagggtagctacatctttctatctagttatcatttaacagaggagaaaatgaatgctagatagaaacctggcggcagcgcaaaagatg

SEQ ID NO: 48826 - DNA, 103 bp, Artificial Sequence
  Synthetic Polynucleotide
taatacgactcactatagggcaaacatctaacaaaacgagaagttacagtaacagaggagaactgtaatgtctcgttttaacctggcggcagcgcaaaagatg

SEQ ID NO: 48827 - DNA, 103 bp, Artificial Sequence
  Synthetic Polynucleotide
taatacgactcactatagggctatatagctacatctttctatctagttataacagaggagaataactatgtagaaagataacctggcggcagcgcaaaagatg

SEQ ID NO: 48828 - DNA, 103 bp, Artificial Sequence
  Synthetic Polynucleotide
taatacgactcactataggggtcatctatatagctacatctttctatctaaacagaggagatagataatgagatgtagcaacctggcggcagcgcaaaagatg

SEQ ID NO: 48829 - DNA, 103 bp, Artificial Sequence
  Synthetic Polynucleotide
taatacgactcactatagggggatcgtcatctatatagctacatctttctaacagaggagaagaaagatgtagctatataacctggcggcagcgcaaaagatg

SEQ ID NO: 48830 - DNA, 103 bp, Artificial Sequence
  Synthetic Polynucleotide
taatacgactcactatagggttaaaggatcgtcatctatatagctacatcaacagaggagagatgtaatgatatagatgaacctggcggcagcgcaaaagatg

SEQ ID NO: 48831 - DNA, 103 bp, Artificial Sequence
  Synthetic Polynucleotide
taatacgactcactatagggctctcttaaaggatcgtcatctatatagctaacagaggagaagctatatggatgacgataacctggcggcagcgcaaaagatg

SEQ ID NO: 48832 - DNA, 103 bp, Artificial Sequence
  Synthetic Polynucleotide
taatacgactcactatagggcatacctctcttaaaggatcgtcatctataaacagaggagatatagaatgcgatcctttaacctggcggcagcgcaaaagatg

SEQ ID NO: 48833 - DNA, 103 bp, Artificial Sequence
  Synthetic Polynucleotide
taatacgactcactataggggttatcatacctctcttaaaggatcgtcataacagaggagaatgacgatgctttaagagaacctggcggcagcgcaaaagatg

SEQ ID NO: 48834 - DNA, 103 bp, Artificial Sequence
  Synthetic Polynucleotide
taatacgactcactataggggtaaagttatcatacctctcttaaaggatcaacagaggagagatcctatgagagaggtaaacctggcggcagcgcaaaagatg

SEQ ID NO: 48835 - DNA, 103 bp, Artificial Sequence
  Synthetic Polynucleotide
taatacgactcactatagggttggggtaaagttatcatacctctcttaaaaacagaggagatttaagatgggtatgataaacctggcggcagcgcaaaagatg

SEQ ID NO: 48836 - DNA, 103 bp, Artificial Sequence
  Synthetic Polynucleotide
taatacgactcactatagggtctgattggggtaaagttatcatacctctcaacagaggagagagaggatggataactttaacctggcggcagcgcaaaagatg

SEQ ID NO: 48837 - DNA, 103 bp, Artificial Sequence
  Synthetic Polynucleotide
taatacgactcactatagggtgatacaaacatctaacaaaacgagaagttaacagaggagaaacttcatgttttgttagaacctggcggcagcgcaaaagatg

SEQ ID NO: 48838 - DNA, 103 bp, Artificial Sequence
  Synthetic Polynucleotide
taatacgactcactataggggtttatctgattggggtaaagttatcatacaacagaggagagtatgaatgctttaccccaacctggcggcagcgcaaaagatg

SEQ ID NO: 48839 - DNA, 103 bp, Artificial Sequence
  Synthetic Polynucleotide
taatacgactcactatagggcaatagtttatctgattggggtaaagttataacagaggagaataactatgccccaatcaaacctggcggcagcgcaaaagatg

SEQ ID NO: 48840 - DNA, 103 bp, Artificial Sequence
  Synthetic Polynucleotide
taatacgactcactatagggcataacaatagtttatctgattggggtaaaaacagaggagatttaccatgatcagataaaacctggcggcagcgcaaaagatg

SEQ ID NO: 48841 - DNA, 103 bp, Artificial Sequence
  Synthetic Polynucleotide
taatacgactcactatagggaagaccataacaatagtttatctgattgggaacagaggagacccaatatgataaactataacctggcggcagcgcaaaagatg

SEQ ID NO: 48842 - DNA, 103 bp, Artificial Sequence
  Synthetic Polynucleotide
taatacgactcactatagggttccgaagaccataacaatagtttatctgaaacagaggagatcagatatgctattgttaaacctggcggcagcgcaaaagatg

SEQ ID NO: 48843 - DNA, 103 bp, Artificial Sequence
  Synthetic Polynucleotide
taatacgactcactatagggtctttttccgaagaccataacaatagtttaaacagaggagataaactatggttatggtcaacctggcggcagcgcaaaagatg

SEQ ID NO: 48844 - DNA, 103 bp, Artificial Sequence
  Synthetic Polynucleotide
taatacgactcactatagggaaaattctttttccgaagaccataacaataaacagaggagatattgtatgggtcttcggaacctggcggcagcgcaaaagatg

SEQ ID NO: 48845 - DNA, 103 bp, Artificial Sequence
  Synthetic Polynucleotide
taatacgactcactatagggttataaaaattctttttccgaagaccataaaacagaggagattatggatgtcggaaaaaaacctggcggcagcgcaaaagatg

SEQ ID NO: 48846 - DNA, 103 bp, Artificial Sequence
  Synthetic Polynucleotide
taatacgactcactatagggaaaatttataaaaattctttttccgaagacaacagaggagagtcttcatgaaaagaattaacctggcggcagcgcaaaagatg

SEQ ID NO: 48847 - DNA, 103 bp, Artificial Sequence
  Synthetic Polynucleotide
taatacgactcactatagggctggaaaaatttataaaaattctttttccgaacagaggagacggaaaatgaatttttataacctggcggcagcgcaaaagatg

SEQ ID NO: 48848 - DNA, 103 bp, Artificial Sequence
  Synthetic Polynucleotide
taatacgactcactatagggaagcatgatacaaacatctaacaaaacgagaacagaggagactcgttatgttagatgttaacctggcggcagcgcaaaagatg

SEQ ID NO: 48849 - DNA, 103 bp, Artificial Sequence
  Synthetic Polynucleotide
taatacgactcactatagggaaatactggaaaaatttataaaaattctttaacagaggagaaaagaaatgttataaattaacctggcggcagcgcaaaagatg

SEQ ID NO: 48850 - DNA, 103 bp, Artificial Sequence
  Synthetic Polynucleotide
taatacgactcactatagggttggaaaatactggaaaaatttataaaaataacagaggagaatttttatgaatttttccaacctggcggcagcgcaaaagatg

SEQ ID NO: 48851 - DNA, 103 bp, Artificial Sequence
  Synthetic Polynucleotide
taatacgactcactatagggtatatttggaaaatactggaaaaatttataaacagaggagatataaaatgttccagtataacctggcggcagcgcaaaagatg

SEQ ID NO: 48852 - DNA, 103 bp, Artificial Sequence
  Synthetic Polynucleotide
taatacgactcactataggggtacgtatatttggaaaatactggaaaaataacagaggagaatttttatggtattttccaacctggcggcagcgcaaaagatg

SEQ ID NO: 48853 - DNA, 103 bp, Artificial Sequence
  Synthetic Polynucleotide
taatacgactcactataggggtcaagtacgtatatttggaaaatactggaaacagaggagatccagtatgttccaaataaacctggcggcagcgcaaaagatg

SEQ ID NO: 48854 - DNA, 103 bp, Artificial Sequence
  Synthetic Polynucleotide
taatacgactcactatagggtagatgtcaagtacgtatatttggaaaataaacagaggagatattttatgaatatacgtaacctggcggcagcgcaaaagatg

SEQ ID NO: 48855 - DNA, 103 bp, Artificial Sequence
  Synthetic Polynucleotide
taatacgactcactatagggttttttagatgtcaagtacgtatatttggaaacagaggagatccaaaatgacgtacttgaacctggcggcagcgcaaaagatg

SEQ ID NO: 48856 - DNA, 103 bp, Artificial Sequence
  Synthetic Polynucleotide
taatacgactcactatagggaaggattttttagatgtcaagtacgtatataacagaggagaatatacatgcttgacatcaacctggcggcagcgcaaaagatg

SEQ ID NO: 48857 - DNA, 103 bp, Artificial Sequence
  Synthetic Polynucleotide
taatacgactcactatagggtcattaaggattttttagatgtcaagtacgaacagaggagacgtactatgcatctaaaaaacctggcggcagcgcaaaagatg

SEQ ID NO: 48858 - DNA, 103 bp, Artificial Sequence
  Synthetic Polynucleotide
taatacgactcactatagggtattatcattaaggattttttagatgtcaaaacagaggagattgacaatgaaaaaatccaacctggcggcagcgcaaaagatg

SEQ ID NO: 48859 - DNA, 103 bp, Artificial Sequence
  Synthetic Polynucleotide
taatacgactcactatagggtgttaaagcatgatacaaacatctaacaaaaacagaggagatttgttatgtgtttgtataacctggcggcagcgcaaaagatg

SEQ ID NO: 48860 - DNA, 103 bp, Artificial Sequence
  Synthetic Polynucleotide
taatacgactcactatagggattcctattatcattaaggattttttagataacagaggagaatctaaatgatccttaataacctggcggcagcgcaaaagatg

SEQ ID NO: 48861 - DNA, 103 bp, Artificial Sequence
  Synthetic Polynucleotide
taatacgactcactatagggtatccattcctattatcattaaggatttttaacagaggagaaaaaatatgtaatgataaaacctggcggcagcgcaaaagatg

SEQ ID NO: 48862 - DNA, 103 bp, Artificial Sequence
  Synthetic Polynucleotide
taatacgactcactatagggcggattatccattcctattatcattaaggaaacagaggagatccttaatgataataggaaacctggcggcagcgcaaaagatg

SEQ ID NO: 48863 - DNA, 103 bp, Artificial Sequence
  Synthetic Polynucleotide
taatacgactcactatagggatagacggattatccattcctattatcattaacagaggagaaatgatatgaggaatggaaacctggcggcagcgcaaaagatg

SEQ ID NO: 48864 - DNA, 103 bp, Artificial Sequence
  Synthetic Polynucleotide
taatacgactcactatagggataaaatagacggattatccattcctattaaacagaggagataatagatgtggataatcaacctggcggcagcgcaaaagatg

SEQ ID NO: 48865 - DNA, 103 bp, Artificial Sequence
  Synthetic Polynucleotide
taatacgactcactatagggtctttataaaatagacggattatccattccaacagaggagaggaatgatgaatccgtctaacctggcggcagcgcaaaagatg

SEQ ID NO: 48866 - DNA, 103 bp, Artificial Sequence
  Synthetic Polynucleotide
taatacgactcactataggggtatttctttataaaatagacggattatccaacagaggagaggataaatggtctattttaacctggcggcagcgcaaaagatg

SEQ ID NO: 48867 - DNA, 103 bp, Artificial Sequence
  Synthetic Polynucleotide
taatacgactcactataggggatatgtatttctttataaaatagacggataacagaggagaatccgtatgttttataaaaacctggcggcagcgcaaaagatg

SEQ ID NO: 48868 - DNA, 103 bp, Artificial Sequence
  Synthetic Polynucleotide
taatacgactcactatagggtgtgcgatatgtatttctttataaaatagaaacagaggagatctattatgtaaagaaataacctggcggcagcgcaaaagatg

SEQ ID NO: 48869 - DNA, 103 bp, Artificial Sequence
  Synthetic Polynucleotide
taatacgactcactatagggtataatgtgcgatatgtatttctttataaaaacagaggagatttataatgaaatacataaacctggcggcagcgcaaaagatg

SEQ ID NO: 48870 - DNA, 103 bp, Artificial Sequence
  Synthetic Polynucleotide
taatacgactcactatagggattaatgttaaagcatgatacaaacatctaaacagaggagatagatgatggtatcatgcaacctggcggcagcgcaaaagatg

SEQ ID NO: 48871 - DNA, 103 bp, Artificial Sequence
  Synthetic Polynucleotide
taatacgactcactatagggaaaagtataatgtgcgatatgtatttctttaacagaggagaaaagaaatgcatatcgcaaacctggcggcagcgcaaaagatg

SEQ ID NO: 48872 - DNA, 103 bp, Artificial Sequence
  Synthetic Polynucleotide
taatacgactcactatagggcaaaaaaaagtataatgtgcgatatgtattaacagaggagaaatacaatgcgcacattaaacctggcggcagcgcaaaagatg

SEQ ID NO: 48873 - DNA, 103 bp, Artificial Sequence
  Synthetic Polynucleotide
taatacgactcactatagggatttccaaaaaaaagtataatgtgcgatataacagaggagaatatcgatgattatacttaacctggcggcagcgcaaaagatg

SEQ ID NO: 48874 - DNA, 103 bp, Artificial Sequence
  Synthetic Polynucleotide
taatacgactcactatagggttcccatttccaaaaaaaagtataatgtgcaacagaggagagcacatatgactttttttaacctggcggcagcgcaaaagatg

SEQ ID NO: 48875 - DNA, 103 bp, Artificial Sequence
  Synthetic Polynucleotide
taatacgactcactatagggcggtattcccatttccaaaaaaaagtataaaacagaggagattatacatgtttttggaaaacctggcggcagcgcaaaagatg

SEQ ID NO: 48876 - DNA, 103 bp, Artificial Sequence
  Synthetic Polynucleotide
taatacgactcactatagggcacatcggtattcccatttccaaaaaaaagaacagaggagactttttatgggaaatgggaacctggcggcagcgcaaaagatg

SEQ ID NO: 48877 - DNA, 103 bp, Artificial Sequence
  Synthetic Polynucleotide
taatacgactcactataggggtagacacatcggtattcccatttccaaaaaacagaggagattttggatgtgggaatacaacctggcggcagcgcaaaagatg

SEQ ID NO: 48878 - DNA, 103 bp, Artificial Sequence
  Synthetic Polynucleotide
taatacgactcactatagggtttatgtagacacatcggtattcccatttcaacagaggagagaaatgatgataccgatgaacctggcggcagcgcaaaagatg

SEQ ID NO: 48879 - DNA, 103 bp, Artificial Sequence
  Synthetic Polynucleotide
taatacgactcactataggggcatatttatgtagacacatcggtattcccaacagaggagagggaatatggatgtgtctaacctggcggcagcgcaaaagatg

SEQ ID NO: 48880 - DNA, 103 bp, Artificial Sequence
  Synthetic Polynucleotide
taatacgactcactatagggactttgcatatttatgtagacacatcggtaaacagaggagataccgaatggtctacataaacctggcggcagcgcaaaagatg

SEQ ID NO: 48881 - DNA, 103 bp, Artificial Sequence
  Synthetic Polynucleotide
taatacgactcactataggggtaccattaatgttaaagcatgatacaaacaacagaggagagtttgtatgatgctttaaaacctggcggcagcgcaaaagatg

SEQ ID NO: 48882 - DNA, 103 bp, Artificial Sequence
  Synthetic Polynucleotide
taatacgactcactatagggtttagactttgcatatttatgtagacacataacagaggagaatgtgtatgcataaatataacctggcggcagcgcaaaagatg

SEQ ID NO: 48883 - DNA, 103 bp, Artificial Sequence
  Synthetic Polynucleotide
taatacgactcactatagggaaatatttagactttgcatatttatgtagaaacagaggagatctacaatgatatgcaaaaacctggcggcagcgcaaaagatg

SEQ ID NO: 48884 - DNA, 103 bp, Artificial Sequence
  Synthetic Polynucleotide
taatacgactcactatagggctaaaaaatatttagactttgcatatttataacagaggagaataaatatgcaaagtctaaacctggcggcagcgcaaaagatg

SEQ ID NO: 48885 - DNA, 103 bp, Artificial Sequence
  Synthetic Polynucleotide
taatacgactcactatagggattctctaaaaaatatttagactttgcataaacagaggagatatgcaatgtctaaatataacctggcggcagcgcaaaagatg

SEQ ID NO: 48886 - DNA, 103 bp, Artificial Sequence
  Synthetic Polynucleotide
taatacgactcactatagggttaagattctctaaaaaatatttagactttaacagaggagaaaagtcatgatattttttaacctggcggcagcgcaaaagatg

SEQ ID NO: 48887 - DNA, 103 bp, Artificial Sequence
  Synthetic Polynucleotide
taatacgactcactatagggaccaattaagattctctaaaaaatatttagaacagaggagactaaatatgttttagagaaacctggcggcagcgcaaaagatg

SEQ ID NO: 48888 - DNA, 103 bp, Artificial Sequence
  Synthetic Polynucleotide
taatacgactcactatagggtttggaccaattaagattctctaaaaaataaacagaggagatattttatggagaatcttaacctggcggcagcgcaaaagatg

SEQ ID NO: 48889 - DNA, 103 bp, Artificial Sequence
  Synthetic Polynucleotide
taatacgactcactatagggaagaatttggaccaattaagattctctaaaaacagaggagatttagaatgtcttaattgaacctggcggcagcgcaaaagatg

SEQ ID NO: 48890 - DNA, 103 bp, Artificial Sequence
  Synthetic Polynucleotide
taatacgactcactatagggtggaaaagaatttggaccaattaagattctaacagaggagaagaatcatgattggtccaaacctggcggcagcgcaaaagatg

SEQ ID NO: 48891 - DNA, 103 bp, Artificial Sequence
  Synthetic Polynucleotide
taatacgactcactataggggtacttggaaaagaatttggaccaattaagaacagaggagacttaatatgtccaaattcaacctggcggcagcgcaaaagatg

SEQ ID NO: 48892 - DNA, 103 bp, Artificial Sequence
  Synthetic Polynucleotide
taatacgactcactatagggaatttgtaccattaatgttaaagcatgataaacagaggagatatcatatgttaacattaaacctggcggcagcgcaaaagatg

SEQ ID NO: 48893 - DNA, 103 bp, Artificial Sequence
  Synthetic Polynucleotide
taatacgactcactatagggttaccgtacttggaaaagaatttggaccaaaacagaggagattggtcatgattcttttcaacctggcggcagcgcaaaagatg

SEQ ID NO: 48894 - DNA, 103 bp, Artificial Sequence
  Synthetic Polynucleotide
taatacgactcactatagggatctattaccgtacttggaaaagaatttggaacagaggagaccaaatatgtttccaagtaacctggcggcagcgcaaaagatg

SEQ ID NO: 48895 - DNA, 103 bp, Artificial Sequence
  Synthetic Polynucleotide
taatacgactcactataggggaaaaatctattaccgtacttggaaaagaaaacagaggagattctttatgaagtacggtaacctggcggcagcgcaaaagatg

SEQ ID NO: 48896 - DNA, 103 bp, Artificial Sequence
  Synthetic Polynucleotide
taatacgactcactatagggaatatgaaaaatctattaccgtacttggaaaacagaggagattccaaatgcggtaatagaacctggcggcagcgcaaaagatg

SEQ ID NO: 48897 - DNA, 103 bp, Artificial Sequence
  Synthetic Polynucleotide
taatacgactcactatagggcgttcaatatgaaaaatctattaccgtactaacagaggagaagtacgatgatagattttaacctggcggcagcgcaaaagatg

SEQ ID NO: 48898 - DNA, 103 bp, Artificial Sequence
  Synthetic Polynucleotide
taatacgactcactataggggataccgttcaatatgaaaaatctattaccaacagaggagaggtaatatgtttttcataaacctggcggcagcgcaaaagatg

SEQ ID NO: 48899 - DNA, 103 bp, Artificial Sequence
  Synthetic Polynucleotide
taatacgactcactatagggaagaagataccgttcaatatgaaaaatctaaacagaggagatagattatgcatattgaaaacctggcggcagcgcaaaagatg

SEQ ID NO: 48900 - DNA, 103 bp, Artificial Sequence
  Synthetic Polynucleotide
taatacgactcactatagggaaatcaagaagataccgttcaatatgaaaaaacagaggagattttcaatgtgaacggtaaacctggcggcagcgcaaaagatg

SEQ ID NO: 48901 - DNA, 103 bp, Artificial Sequence
  Synthetic Polynucleotide
taatacgactcactatagggaccagaaatcaagaagataccgttcaatataacagaggagaatattgatgggtatcttcaacctggcggcagcgcaaaagatg

SEQ ID NO: 48902 - DNA, 103 bp, Artificial Sequence
  Synthetic Polynucleotide
taatacgactcactatagggttagaaccagaaatcaagaagataccgttcaacagaggagagaacggatgcttcttgataacctggcggcagcgcaaaagatg

SEQ ID NO: 48903 - DNA, 103 bp, Artificial Sequence
  Synthetic Polynucleotide
taatacgactcactatagggagacggctacggttaaccatcgggttaaccaacagaggagaggttaaatggatggttaaaacctggcggcagcgcaaaagatg

SEQ ID NO: 48904 - DNA, 103 bp, Artificial Sequence
  Synthetic Polynucleotide
taatacgactcactataggggataaaatttgtaccattaatgttaaagcaaacagaggagatgctttatgattaatggtaacctggcggcagcgcaaaagatg

SEQ ID NO: 48905 - DNA, 103 bp, Artificial Sequence
  Synthetic Polynucleotide
taatacgactcactatagggcggaattagaaccagaaatcaagaagatacaacagaggagagtatctatgtgatttctgaacctggcggcagcgcaaaagatg

SEQ ID NO: 48906 - DNA, 103 bp, Artificial Sequence
  Synthetic Polynucleotide
taatacgactcactatagggtaatgcggaattagaaccagaaatcaagaaaacagaggagattcttgatgtctggttctaacctggcggcagcgcaaaagatg

SEQ ID NO: 48907 - DNA, 103 bp, Artificial Sequence
  Synthetic Polynucleotide
taatacgactcactatagggtcatttaatgcggaattagaaccagaaatcaacagaggagagatttcatgttctaattcaacctggcggcagcgcaaaagatg

SEQ ID NO: 48908 - DNA, 103 bp, Artificial Sequence
  Synthetic Polynucleotide
taatacgactcactatagggtttcatcatttaatgcggaattagaaccagaacagaggagactggttatgattccgcataacctggcggcagcgcaaaagatg

SEQ ID NO: 48909 - DNA, 103 bp, Artificial Sequence
  Synthetic Polynucleotide
taatacgactcactatagggcttagtttcatcatttaatgcggaattagaaacagaggagatctaatatggcattaaataacctggcggcagcgcaaaagatg

SEQ ID NO: 48910 - DNA, 103 bp, Artificial Sequence
  Synthetic Polynucleotide
taatacgactcactatagggagcgacttagtttcatcatttaatgcggaaaacagaggagattccgcatgaaatgatgaaacctggcggcagcgcaaaagatg

SEQ ID NO: 48911 - DNA, 103 bp, Artificial Sequence
  Synthetic Polynucleotide
taatacgactcactatagggaaaatagcgacttagtttcatcatttaatgaacagaggagacattaaatgatgaaactaaacctggcggcagcgcaaaagatg

SEQ ID NO: 48912 - DNA, 103 bp, Artificial Sequence
  Synthetic Polynucleotide
taatacgactcactatagggttataaaaatagcgacttagtttcatcattaacagaggagaaatgatatgactaagtcgaacctggcggcagcgcaaaagatg

SEQ ID NO: 48913 - DNA, 103 bp, Artificial Sequence
  Synthetic Polynucleotide
taatacgactcactataggggttagttataaaaatagcgacttagtttcaaacagaggagatgaaacatggtcgctattaacctggcggcagcgcaaaagatg

SEQ ID NO: 48914 - DNA, 103 bp, Artificial Sequence
  Synthetic Polynucleotide
taatacgactcactatagggtaatcgttagttataaaaatagcgacttagaacagaggagactaagtatgtatttttataacctggcggcagcgcaaaagatg

SEQ ID NO: 48915 - DNA, 103 bp, Artificial Sequence
  Synthetic Polynucleotide
taatacgactcactataggggcgaggataaaatttgtaccattaatgttaaacagaggagataacatatgtggtacaaaaacctggcggcagcgcaaaagatg

SEQ ID NO: 48916 - DNA, 103 bp, Artificial Sequence
  Synthetic Polynucleotide
taatacgactcactatagggtgatgtaatcgttagttataaaaatagcgaaacagaggagatcgctaatgttataactaaacctggcggcagcgcaaaagatg

SEQ ID NO: 48917 - DNA, 103 bp, Artificial Sequence
  Synthetic Polynucleotide
taatacgactcactatagggagaggtgatgtaatcgttagttataaaaataacagaggagaatttttatgactaacgataacctggcggcagcgcaaaagatg

SEQ ID NO: 48918 - DNA, 103 bp, Artificial Sequence
  Synthetic Polynucleotide
taatacgactcactatagggatgttagaggtgatgtaatcgttagttataaacagaggagatataacatgcgattacataacctggcggcagcgcaaaagatg

SEQ ID NO: 48919 - DNA, 103 bp, Artificial Sequence
  Synthetic Polynucleotide
taatacgactcactatagggtgatgatgttagaggtgatgtaatcgttagaacagaggagactaacgatgacatcacctaacctggcggcagcgcaaaagatg

SEQ ID NO: 48920 - DNA, 103 bp, Artificial Sequence
  Synthetic Polynucleotide
taatacgactcactataggggtaaatgatgatgttagaggtgatgtaatcaacagaggagagattacatgacctctaacaacctggcggcagcgcaaaagatg

SEQ ID NO: 48921 - DNA, 103 bp, Artificial Sequence
  Synthetic Polynucleotide
taatacgactcactatagggtcctggtaaatgatgatgttagaggtgatgaacagaggagacatcacatgtaacatcataacctggcggcagcgcaaaagatg

SEQ ID NO: 48922 - DNA, 103 bp, Artificial Sequence
  Synthetic Polynucleotide
taatacgactcactatagggcagtatcctggtaaatgatgatgttagaggaacagaggagacctctaatgtcatcatttaacctggcggcagcgcaaaagatg

SEQ ID NO: 48923 - DNA, 103 bp, Artificial Sequence
  Synthetic Polynucleotide
taatacgactcactatagggaagatcagtatcctggtaaatgatgatgttaacagaggagaaacatcatgatttaccagaacctggcggcagcgcaaaagatg

SEQ ID NO: 48924 - DNA, 103 bp, Artificial Sequence
  Synthetic Polynucleotide
taatacgactcactatagggaaaagaagatcagtatcctggtaaatgatgaacagaggagacatcatatgccaggatacaacctggcggcagcgcaaaagatg

SEQ ID NO: 48925 - DNA, 103 bp, Artificial Sequence
  Synthetic Polynucleotide
taatacgactcactatagggacgacaaaagaagatcagtatcctggtaaaaacagaggagatttaccatgatactgatcaacctggcggcagcgcaaaagatg

SEQ ID NO: 48926 - DNA, 103 bp, Artificial Sequence
  Synthetic Polynucleotide
taatacgactcactatagggacaaagcgaggataaaatttgtaccattaaaacagaggagattaatgatgcaaattttaaacctggcggcagcgcaaaagatg

SEQ ID NO: 48927 - DNA, 103 bp, Artificial Sequence
  Synthetic Polynucleotide
taatacgactcactatagggtatttacgacaaaagaagatcagtatcctgaacagaggagacaggatatggatcttcttaacctggcggcagcgcaaaagatg

SEQ ID NO: 48928 - DNA, 103 bp, Artificial Sequence
  Synthetic Polynucleotide
taatacgactcactatagggacatgtatttacgacaaaagaagatcagtaaacagaggagatactgaatgtcttttgtcaacctggcggcagcgcaaaagatg

SEQ ID NO: 48929 - DNA, 103 bp, Artificial Sequence
  Synthetic Polynucleotide
taatacgactcactatagggattagacatgtatttacgacaaaagaagataacagaggagaatcttcatgtgtcgtaaaaacctggcggcagcgcaaaagatg

SEQ ID NO: 48930 - DNA, 103 bp, Artificial Sequence
  Synthetic Polynucleotide
taatacgactcactatagggaacacattagacatgtatttacgacaaaagaacagaggagacttttgatgtaaatacataacctggcggcagcgcaaaagatg

SEQ ID NO: 48931 - DNA, 103 bp, Artificial Sequence
  Synthetic Polynucleotide
taatacgactcactatagggtttttaacacattagacatgtatttacgacaacagaggagagtcgtaatgacatgtctaaacctggcggcagcgcaaaagatg

SEQ ID NO: 48932 - DNA, 103 bp, Artificial Sequence
  Synthetic Polynucleotide
taatacgactcactatagggtcttttttttaacacattagacatgtatttaacagaggagaaaatacatgtctaatgtgaacctggcggcagcgcaaaagatg

SEQ ID NO: 48933 - DNA, 103 bp, Artificial Sequence
  Synthetic Polynucleotide
taatacgactcactatagggtatgatcttttttttaacacattagacatgaacagaggagacatgtcatgtgtgttaaaaacctggcggcagcgcaaaagatg

SEQ ID NO: 48934 - DNA, 103 bp, Artificial Sequence
  Synthetic Polynucleotide
taatacgactcactatagggacttgtatgatcttttttttaacacattagaacagaggagactaatgatgtaaaaaaaaaacctggcggcagcgcaaaagatg

SEQ ID NO: 48935 - DNA, 103 bp, Artificial Sequence
  Synthetic Polynucleotide
taatacgactcactataggggtataacttgtatgatcttttttttaacacaacagaggagagtgttaatgaaaagatcaaacctggcggcagcgcaaaagatg

SEQ ID NO: 48936 - DNA, 103 bp, Artificial Sequence
  Synthetic Polynucleotide
taatacgactcactatagggatgacgtataacttgtatgatcttttttttaacagaggagaaaaaaaatgatcatacaaaacctggcggcagcgcaaaagatg

SEQ ID NO: 48937 - DNA, 103 bp, Artificial Sequence
  Synthetic Polynucleotide
taatacgactcactataggggatacacaaagcgaggataaaatttgtaccaacagaggagaggtacaatgtttatcctcaacctggcggcagcgcaaaagatg

SEQ ID NO: 48938 - DNA, 103 bp, Artificial Sequence
  Synthetic Polynucleotide
taatacgactcactatagggatgaaatgacgtataacttgtatgatctttaacagaggagaaaagatatgacaagttataacctggcggcagcgcaaaagatg

SEQ ID NO: 48939 - DNA, 103 bp, Artificial Sequence
  Synthetic Polynucleotide
taatacgactcactatagggtacagatgaaatgacgtataacttgtatgaaacagaggagatcatacatgttatacgtcaacctggcggcagcgcaaaagatg

SEQ ID NO: 48940 - DNA, 103 bp, Artificial Sequence
  Synthetic Polynucleotide
taatacgactcactatagggaatactacagatgaaatgacgtataacttgaacagaggagacaagttatgcgtcatttcaacctggcggcagcgcaaaagatg

SEQ ID NO: 48941 - DNA, 103 bp, Artificial Sequence
  Synthetic Polynucleotide
taatacgactcactatagggacaagaatactacagatgaaatgacgtataaacagaggagatatacgatgtttcatctgaacctggcggcagcgcaaaagatg

SEQ ID NO: 48942 - DNA, 103 bp, Artificial Sequence
  Synthetic Polynucleotide
taatacgactcactatagggcaatgacaagaatactacagatgaaatgacaacagaggagagtcattatgtctgtagtaaacctggcggcagcgcaaaagatg

SEQ ID NO: 48943 - DNA, 103 bp, Artificial Sequence
  Synthetic Polynucleotide
taatacgactcactatagggtcactcaatgacaagaatactacagatgaaaacagaggagattcatcatgagtattcttaacctggcggcagcgcaaaagatg

SEQ ID NO: 48944 - DNA, 103 bp, Artificial Sequence
  Synthetic Polynucleotide
taatacgactcactataggggtttatcactcaatgacaagaatactacagaacagaggagactgtagatgtcttgtcataacctggcggcagcgcaaaagatg

SEQ ID NO: 48945 - DNA, 103 bp, Artificial Sequence
  Synthetic Polynucleotide
taatacgactcactatagggcacaagtttatcactcaatgacaagaatacaacagaggagagtattcatgtcattgagtaacctggcggcagcgcaaaagatg

SEQ ID NO: 48946 - DNA, 103 bp, Artificial Sequence
  Synthetic Polynucleotide
taatacgactcactatagggattagcacaagtttatcactcaatgacaagaacagaggagacttgtcatggagtgataaaacctggcggcagcgcaaaagatg

SEQ ID NO: 48947 - DNA, 103 bp, Artificial Sequence
  Synthetic Polynucleotide
taatacgactcactatagggaagagattagcacaagtttatcactcaatgaacagaggagacattgaatgataaacttgaacctggcggcagcgcaaaagatg

SEQ ID NO: 48948 - DNA, 103 bp, Artificial Sequence
  Synthetic Polynucleotide
taatacgactcactatagggaatatgatacacaaagcgaggataaaatttaacagaggagaaaatttatgcctcgctttaacctggcggcagcgcaaaagatg

SEQ ID NO: 48949 - DNA, 103 bp, Artificial Sequence
  Synthetic Polynucleotide
taatacgactcactatagggtaaagaagagattagcacaagtttatcactaacagaggagaagtgatatgcttgtgctaaacctggcggcagcgcaaaagatg

SEQ ID NO: 48950 - DNA, 103 bp, Artificial Sequence
  Synthetic Polynucleotide
taatacgactcactatagggactgttaaagaagagattagcacaagtttaaacagaggagataaactatggctaatctcaacctggcggcagcgcaaaagatg

SEQ ID NO: 48951 - DNA, 103 bp, Artificial Sequence
  Synthetic Polynucleotide
taatacgactcactatagggaacagactgttaaagaagagattagcacaaaacagaggagattgtgcatgtctcttcttaacctggcggcagcgcaaaagatg

SEQ ID NO: 48952 - DNA, 103 bp, Artificial Sequence
  Synthetic Polynucleotide
taatacgactcactatagggatttgaacagactgttaaagaagagattagaacagaggagactaatcatgtctttaacaaacctggcggcagcgcaaaagatg

SEQ ID NO: 48953 - DNA, 103 bp, Artificial Sequence
  Synthetic Polynucleotide
taatacgactcactatagggtataaatttgaacagactgttaaagaagagaacagaggagactcttcatgaacagtctgaacctggcggcagcgcaaaagatg

SEQ ID NO: 48954 - DNA, 103 bp, Artificial Sequence
  Synthetic Polynucleotide
taatacgactcactatagggtaggatataaatttgaacagactgttaaagaacagaggagactttaaatgtctgttcaaaacctggcggcagcgcaaaagatg

SEQ ID NO: 48955 - DNA, 103 bp, Artificial Sequence
  Synthetic Polynucleotide
taatacgactcactataggggtatataggatataaatttgaacagactgtaacagaggagaacagtcatgtcaaatttaaacctggcggcagcgcaaaagatg

SEQ ID NO: 48956 - DNA, 103 bp, Artificial Sequence
  Synthetic Polynucleotide
taatacgactcactatagggttttcgtatataggatataaatttgaacagaacagaggagactgttcatgtttatatccaacctggcggcagcgcaaaagatg

SEQ ID NO: 48957 - DNA, 103 bp, Artificial Sequence
  Synthetic Polynucleotide
taatacgactcactatagggctattttttcgtatataggatataaatttgaacagaggagacaaattatgatcctatataacctggcggcagcgcaaaagatg

SEQ ID NO: 48958 - DNA, 103 bp, Artificial Sequence
  Synthetic Polynucleotide
taatacgactcactatagggggttgctattttttcgtatataggatataaaacagaggagattatatatgatatacgaaaacctggcggcagcgcaaaagatg

SEQ ID NO: 48959 - DNA, 103 bp, Artificial Sequence
  Synthetic Polynucleotide
taatacgactcactatagggggacgaatatgatacacaaagcgaggataaaacagaggagattatccatgctttgtgtaaacctggcggcagcgcaaaagatg

SEQ ID NO: 48960 - DNA, 103 bp, Artificial Sequence
  Synthetic Polynucleotide
taatacgactcactatagggacattggttgctattttttcgtatataggaaacagaggagatcctatatgcgaaaaaataacctggcggcagcgcaaaagatg

SEQ ID NO: 48961 - DNA, 103 bp, Artificial Sequence
  Synthetic Polynucleotide
taatacgactcactatagggatcaaacattggttgctattttttcgtataaacagaggagatatacgatgaaatagcaaaacctggcggcagcgcaaaagatg

SEQ ID NO: 48962 - DNA, 103 bp, Artificial Sequence
  Synthetic Polynucleotide
taatacgactcactataggggaatgatcaaacattggttgctattttttcaacagaggagagaaaaaatggcaaccaataacctggcggcagcgcaaaagatg

SEQ ID NO: 48963 - DNA, 103 bp, Artificial Sequence
  Synthetic Polynucleotide
taatacgactcactataggggacgcgaatgatcaaacattggttgctattaacagaggagaaatagcatgcaatgtttgaacctggcggcagcgcaaaagatg

SEQ ID NO: 48964 - DNA, 103 bp, Artificial Sequence
  Synthetic Polynucleotide
taatacgactcactatagggatattgacgcgaatgatcaaacattggttgaacagaggagacaaccaatgtttgatcataacctggcggcagcgcaaaagatg

SEQ ID NO: 48965 - DNA, 103 bp, Artificial Sequence
  Synthetic Polynucleotide
taatacgactcactatagggacagaatattgacgcgaatgatcaaacattaacagaggagaaatgttatgtcattcgcgaacctggcggcagcgcaaaagatg

SEQ ID NO: 48966 - DNA, 103 bp, Artificial Sequence
  Synthetic Polynucleotide
taatacgactcactatagggatagaacagaatattgacgcgaatgatcaaaacagaggagattgatcatgcgcgtcaataacctggcggcagcgcaaaagatg

SEQ ID NO: 48967 - DNA, 103 bp, Artificial Sequence
  Synthetic Polynucleotide
taatacgactcactatagggctacaatagaacagaatattgacgcgaatgaacagaggagacattcgatgcaatattctaacctggcggcagcgcaaaagatg

SEQ ID NO: 48968 - DNA, 103 bp, Artificial Sequence
  Synthetic Polynucleotide
taatacgactcactatagggatacactacaatagaacagaatattgacgcaacagaggagagcgtcaatgttctgttctaacctggcggcagcgcaaaagatg

SEQ ID NO: 48969 - DNA, 103 bp, Artificial Sequence
  Synthetic Polynucleotide
taatacgactcactatagggttgttatacactacaatagaacagaatattaacagaggagaaatattatgttctattgtaacctggcggcagcgcaaaagatg

SEQ ID NO: 48970 - DNA, 103 bp, Artificial Sequence
  Synthetic Polynucleotide
taatacgactcactatagggagtagggacgaatatgatacacaaagcgagaacagaggagactcgctatgtgtatcataaacctggcggcagcgcaaaagatg

SEQ ID NO: 48971 - DNA, 103 bp, Artificial Sequence
  Synthetic Polynucleotide
taatacgactcactatagggtaagattgttatacactacaatagaacagaaacagaggagatctgttatgttgtagtgtaacctggcggcagcgcaaaagatg

SEQ ID NO: 48972 - DNA, 103 bp, Artificial Sequence
  Synthetic Polynucleotide
taatacgactcactatagggagatataagattgttatacactacaatagaaacagaggagatctattatggtgtataacaacctggcggcagcgcaaaagatg

SEQ ID NO: 48973 - DNA, 103 bp, Artificial Sequence
  Synthetic Polynucleotide
taatacgactcactataggggaagaagatataagattgttatacactacaaacagaggagatgtagtatgtaacaatctaacctggcggcagcgcaaaagatg

SEQ ID NO: 48974 - DNA, 103 bp, Artificial Sequence
  Synthetic Polynucleotide
taatacgactcactatagggtcacggaagaagatataagattgttatacaaacagaggagatgtataatgatcttatataacctggcggcagcgcaaaagatg

SEQ ID NO: 48975 - DNA, 103 bp, Artificial Sequence
  Synthetic Polynucleotide
taatacgactcactatagggagctatcacggaagaagatataagattgttaacagaggagaaacaatatgatatcttctaacctggcggcagcgcaaaagatg

SEQ ID NO: 48976 - DNA, 103 bp, Artificial Sequence
  Synthetic Polynucleotide
taatacgactcactataggggtatcagctatcacggaagaagatataagaaacagaggagatcttatatgttcttccgtaacctggcggcagcgcaaaagatg

SEQ ID NO: 48977 - DNA, 103 bp, Artificial Sequence
  Synthetic Polynucleotide
taatacgactcactatagggataacgtatcagctatcacggaagaagataaacagaggagatatcttatgccgtgatagaacctggcggcagcgcaaaagatg

SEQ ID NO: 48978 - DNA, 103 bp, Artificial Sequence
  Synthetic Polynucleotide
taatacgactcactatagggcctttataacgtatcagctatcacggaagaaacagaggagatcttccatgatagctgataacctggcggcagcgcaaaagatg

SEQ ID NO: 48979 - DNA, 103 bp, Artificial Sequence
  Synthetic Polynucleotide
taatacgactcactatagggatcaacctttataacgtatcagctatcacgaacagaggagacgtgatatgtgatacgttaacctggcggcagcgcaaaagatg

SEQ ID NO: 48980 - DNA, 103 bp, Artificial Sequence
  Synthetic Polynucleotide
taatacgactcactatagggtcgttatcaacctttataacgtatcagctaaacagaggagatagctgatgcgttataaaaacctggcggcagcgcaaaagatg

SEQ ID NO: 48981 - DNA, 103 bp, Artificial Sequence
  Synthetic Polynucleotide
taatacgactcactatagggtttatagtagggacgaatatgatacacaaaaacagaggagatttgtgatgcatattcgtaacctggcggcagcgcaaaagatg

SEQ ID NO: 48982 - DNA, 103 bp, Artificial Sequence
  Synthetic Polynucleotide
taatacgactcactatagggtattttcgttatcaacctttataacgtatcaacagaggagagatacgatgtaaaggttgaacctggcggcagcgcaaaagatg

SEQ ID NO: 48983 - DNA, 103 bp, Artificial Sequence
  Synthetic Polynucleotide
taatacgactcactatagggaaaaatattttcgttatcaacctttataacaacagaggagagttataatggttgataacaacctggcggcagcgcaaaagatg

SEQ ID NO: 48984 - DNA, 103 bp, Artificial Sequence
  Synthetic Polynucleotide
taatacgactcactataggggaaataaaaatattttcgttatcaacctttaacagaggagaaaaggtatgtaacgaaaaaacctggcggcagcgcaaaagatg

SEQ ID NO: 48985 - DNA, 103 bp, Artificial Sequence
  Synthetic Polynucleotide
taatacgactcactatagggctcacgaaataaaaatattttcgttatcaaaacagaggagattgataatgaaaatatttaacctggcggcagcgcaaaagatg

SEQ ID NO: 48986 - DNA, 103 bp, Artificial Sequence
  Synthetic Polynucleotide
taatacgactcactatagggtttatctcacgaaataaaaatattttcgttaacagaggagaaacgaaatgatttttattaacctggcggcagcgcaaaagatg

SEQ ID NO: 48987 - DNA, 103 bp, Artificial Sequence
  Synthetic Polynucleotide
taatacgactcactatagggatgactttatctcacgaaataaaaatatttaacagaggagaaaatatatgtatttcgtgaacctggcggcagcgcaaaagatg

SEQ ID NO: 48988 - DNA, 103 bp, Artificial Sequence
  Synthetic Polynucleotide
taatacgactcactatagggctacgatgactttatctcacgaaataaaaaaacagaggagatttttaatgcgtgagataaacctggcggcagcgcaaaagatg

SEQ ID NO: 48989 - DNA, 103 bp, Artificial Sequence
  Synthetic Polynucleotide
taatacgactcactatagggaaatcctacgatgactttatctcacgaaataacagaggagaatttcgatggataaagtcaacctggcggcagcgcaaaagatg

SEQ ID NO: 48990 - DNA, 103 bp, Artificial Sequence
  Synthetic Polynucleotide
taatacgactcactataggggtccaaaatcctacgatgactttatctcacaacagaggagagtgagaatgagtcatcgtaacctggcggcagcgcaaaagatg

SEQ ID NO: 48991 - DNA, 103 bp, Artificial Sequence
  Synthetic Polynucleotide
taatacgactcactatagggtataagtccaaaatcctacgatgactttataacagaggagaataaagatgtcgtaggataacctggcggcagcgcaaaagatg

SEQ ID NO: 48992 - DNA, 103 bp, Artificial Sequence
  Synthetic Polynucleotide
taatacgactcactatagggacaattttatagtagggacgaatatgatacaacagaggagagtatcaatgtcgtccctaaacctggcggcagcgcaaaagatg

SEQ ID NO: 48993 - DNA, 103 bp, Artificial Sequence
  Synthetic Polynucleotide
taatacgactcactataggggcgaatataagtccaaaatcctacgatgacaacagaggagagtcatcatgggattttggaacctggcggcagcgcaaaagatg

SEQ ID NO: 48994 - DNA, 103 bp, Artificial Sequence
  Synthetic Polynucleotide
taatacgactcactatagggtagacgcgaatataagtccaaaatcctacgaacagaggagacgtaggatgttggacttaaacctggcggcagcgcaaaagatg

SEQ ID NO: 48995 - DNA, 103 bp, Artificial Sequence
  Synthetic Polynucleotide
taatacgactcactatagggtctactagacgcgaatataagtccaaaatcaacagaggagagattttatgcttatattcaacctggcggcagcgcaaaagatg

SEQ ID NO: 48996 - DNA, 103 bp, Artificial Sequence
  Synthetic Polynucleotide
taatacgactcactataggggcatatctactagacgcgaatataagtccaaacagaggagatggactatgattcgcgtcaacctggcggcagcgcaaaagatg

SEQ ID NO: 48997 - DNA, 103 bp, Artificial Sequence
  Synthetic Polynucleotide
taatacgactcactatagggtaaaagcatatctactagacgcgaatataaaacagaggagattatatatgcgtctagtaaacctggcggcagcgcaaaagatg

SEQ ID NO: 48998 - DNA, 103 bp, Artificial Sequence
  Synthetic Polynucleotide
taatacgactcactatagggaaaaataaaagcatatctactagacgcgaaaacagaggagattcgcgatgagtagatataacctggcggcagcgcaaaagatg

SEQ ID NO: 48999 - DNA, 103 bp, Artificial Sequence
  Synthetic Polynucleotide
taatacgactcactatagggattccaaaaataaaagcatatctactagacaacagaggagagtctagatgatatgctttaacctggcggcagcgcaaaagatg

SEQ ID NO: 49000 - DNA, 103 bp, Artificial Sequence
  Synthetic Polynucleotide
taatacgactcactatagggagattattccaaaaataaaagcatatctacaacagaggagagtagatatgcttttatttaacctggcggcagcgcaaaagatg

SEQ ID NO: 49001 - DNA, 103 bp, Artificial Sequence
  Synthetic Polynucleotide
taatacgactcactatagggaattgagattattccaaaaataaaagcataaacagaggagatatgctatgatttttggaaacctggcggcagcgcaaaagatg

SEQ ID NO: 49002 - DNA, 103 bp, Artificial Sequence
  Synthetic Polynucleotide
taatacgactcactatagggattctaattgagattattccaaaaataaaaaacagaggagattttatatgtggaataataacctggcggcagcgcaaaagatg

SEQ ID NO: 49003 - DNA, 103 bp, Artificial Sequence
  Synthetic Polynucleotide
taatacgactcactatagggaatatacaattttatagtagggacgaatataacagaggagaatattcatgcctactataaacctggcggcagcgcaaaagatg

SEQ ID NO: 49004 - DNA, 103 bp, Artificial Sequence
  Synthetic Polynucleotide
taatacgactcactatagggagactattctaattgagattattccaaaaaaacagaggagatttttgatgtaatctcaaaacctggcggcagcgcaaaagatg

SEQ ID NO: 49005 - DNA, 103 bp, Artificial Sequence
  Synthetic Polynucleotide
taatacgactcactatagggtaaagagactattctaattgagattattccaacagaggagaggaataatgtcaattagaaacctggcggcagcgcaaaagatg

SEQ ID NO: 49006 - DNA, 103 bp, Artificial Sequence
  Synthetic Polynucleotide
taatacgactcactataggggactctaaagagactattctaattgagattaacagaggagaaatctcatgtagaatagtaacctggcggcagcgcaaaagatg

SEQ ID NO: 49007 - DNA, 103 bp, Artificial Sequence
  Synthetic Polynucleotide
taatacgactcactatagggaaatggactctaaagagactattctaattgaacagaggagacaattaatgtagtctcttaacctggcggcagcgcaaaagatg

SEQ ID NO: 49008 - DNA, 103 bp, Artificial Sequence
  Synthetic Polynucleotide
taatacgactcactatagggactttaaatggactctaaagagactattctaacagaggagaagaataatgtctttagagaacctggcggcagcgcaaaagatg

SEQ ID NO: 49009 - DNA, 103 bp, Artificial Sequence
  Synthetic Polynucleotide
taatacgactcactatagggttgtaactttaaatggactctaaagagactaacagaggagaagtctcatgagagtccataacctggcggcagcgcaaaagatg

SEQ ID NO: 49010 - DNA, 103 bp, Artificial Sequence
  Synthetic Polynucleotide
taatacgactcactataggggttgtttgtaactttaaatggactctaaagaacagaggagactttagatgccatttaaaaacctggcggcagcgcaaaagatg

SEQ ID NO: 49011 - DNA, 103 bp, Artificial Sequence
  Synthetic Polynucleotide
taatacgactcactatagggtcctagttgtttgtaactttaaatggactcaacagaggagagagtccatgtaaagttacaacctggcggcagcgcaaaagatg

SEQ ID NO: 49012 - DNA, 103 bp, Artificial Sequence
  Synthetic Polynucleotide
taatacgactcactatagggcaatttcctagttgtttgtaactttaaatgaacagaggagacatttaatgttacaaacaaacctggcggcagcgcaaaagatg

SEQ ID NO: 49013 - DNA, 103 bp, Artificial Sequence
  Synthetic Polynucleotide
taatacgactcactatagggtaaaccaatttcctagttgtttgtaactttaacagaggagaaaagttatgaacaactagaacctggcggcagcgcaaaagatg

SEQ ID NO: 49014 - DNA, 103 bp, Artificial Sequence
  Synthetic Polynucleotide
taatacgactcactatagggagcacagacggctacggttaaccatcgggtaacagaggagaacccgaatgttaaccgtaaacctggcggcagcgcaaaagatg

SEQ ID NO: 49015 - DNA, 103 bp, Artificial Sequence
  Synthetic Polynucleotide
taatacgactcactatagggatctgaatatacaattttatagtagggacgaacagaggagacgtcccatgtataaaattaacctggcggcagcgcaaaagatg

SEQ ID NO: 49016 - DNA, 103 bp, Artificial Sequence
  Synthetic Polynucleotide
taatacgactcactatagggcattataaaccaatttcctagttgtttgtaaacagaggagatacaaaatgctaggaaataacctggcggcagcgcaaaagatg

SEQ ID NO: 49017 - DNA, 103 bp, Artificial Sequence
  Synthetic Polynucleotide
taatacgactcactatagggttatacattataaaccaatttcctagttgtaacagaggagaacaactatgaaattggttaacctggcggcagcgcaaaagatg

SEQ ID NO: 49018 - DNA, 103 bp, Artificial Sequence
  Synthetic Polynucleotide
taatacgactcactatagggaaaaattatacattataaaccaatttcctaaacagaggagataggaaatgggtttataaaacctggcggcagcgcaaaagatg

SEQ ID NO: 49019 - DNA, 103 bp, Artificial Sequence
  Synthetic Polynucleotide
taatacgactcactatagggactaaaaaaattatacattataaaccaattaacagaggagaaattggatgataatgtataacctggcggcagcgcaaaagatg

SEQ ID NO: 49020 - DNA, 103 bp, Artificial Sequence
  Synthetic Polynucleotide
taatacgactcactatagggtaaaaactaaaaaaattatacattataaacaacagaggagagtttatatggtataatttaacctggcggcagcgcaaaagatg

SEQ ID NO: 49021 - DNA, 103 bp, Artificial Sequence
  Synthetic Polynucleotide
taatacgactcactatagggatctataaaaactaaaaaaattatacattaaacagaggagataatgtatgatttttttaaacctggcggcagcgcaaaagatg

SEQ ID NO: 49022 - DNA, 103 bp, Artificial Sequence
  Synthetic Polynucleotide
taatacgactcactatagggaaagaatctataaaaactaaaaaaattataaacagaggagatataatatgtttagttttaacctggcggcagcgcaaaagatg

SEQ ID NO: 49023 - DNA, 103 bp, Artificial Sequence
  Synthetic Polynucleotide
taatacgactcactatagggagaataaagaatctataaaaactaaaaaaaaacagaggagattttttatgtttttatagaacctggcggcagcgcaaaagatg

SEQ ID NO: 49024 - DNA, 103 bp, Artificial Sequence
  Synthetic Polynucleotide
taatacgactcactatagggagtatagaataaagaatctataaaaactaaaacagaggagattagttatgatagattctaacctggcggcagcgcaaaagatg

SEQ ID NO: 49025 - DNA, 103 bp, Artificial Sequence
  Synthetic Polynucleotide
taatacgactcactatagggttttaagtatagaataaagaatctataaaaaacagaggagattttatatgttctttattaacctggcggcagcgcaaaagatg

SEQ ID NO: 49026 - DNA, 103 bp, Artificial Sequence
  Synthetic Polynucleotide
taatacgactcactatagggtgataatctgaatatacaattttatagtagaacagaggagactactaatgaattgtataaacctggcggcagcgcaaaagatg

SEQ ID NO: 49027 - DNA, 103 bp, Artificial Sequence
  Synthetic Polynucleotide
taatacgactcactatagggtcattttttaagtatagaataaagaatctaaacagaggagatagattatgtattctataaacctggcggcagcgcaaaagatg

SEQ ID NO: 49028 - DNA, 103 bp, Artificial Sequence
  Synthetic Polynucleotide
taatacgactcactatagggtattttcattttttaagtatagaataaagaaacagaggagatctttaatgtatacttaaaacctggcggcagcgcaaaagatg

SEQ ID NO: 49029 - DNA, 103 bp, Artificial Sequence
  Synthetic Polynucleotide
taatacgactcactataggggtatttattttcattttttaagtatagaataacagaggagaattctaatgttaaaaaataacctggcggcagcgcaaaagatg

SEQ ID NO: 49030 - DNA, 103 bp, Artificial Sequence
  Synthetic Polynucleotide
taatacgactcactatagggcctttgtatttattttcattttttaagtataacagaggagaatacttatgaaatgaaaaaacctggcggcagcgcaaaagatg

SEQ ID NO: 49031 - DNA, 103 bp, Artificial Sequence
  Synthetic Polynucleotide
taatacgactcactatagggaagaacctttgtatttattttcattttttaaacagaggagataaaaaatgaaaataaataacctggcggcagcgcaaaagatg

SEQ ID NO: 49032 - DNA, 103 bp, Artificial Sequence
  Synthetic Polynucleotide
taatacgactcactatagggccctcaagaacctttgtatttattttcattaacagaggagaaatgaaatgaaatacaaaaacctggcggcagcgcaaaagatg

SEQ ID NO: 49033 - DNA, 103 bp, Artificial Sequence
  Synthetic Polynucleotide
taatacgactcactatagggcacaaccctcaagaacctttgtatttatttaacagaggagaaaataaatgcaaaggttcaacctggcggcagcgcaaaagatg

SEQ ID NO: 49034 - DNA, 103 bp, Artificial Sequence
  Synthetic Polynucleotide
taatacgactcactatagggtttaacacaaccctcaagaacctttgtattaacagaggagaaatacaatggttcttgagaacctggcggcagcgcaaaagatg

SEQ ID NO: 49035 - DNA, 103 bp, Artificial Sequence
  Synthetic Polynucleotide
taatacgactcactatagggttcaatttaacacaaccctcaagaacctttaacagaggagaaaaggtatgtgagggttgaacctggcggcagcgcaaaagatg

SEQ ID NO: 49036 - DNA, 103 bp, Artificial Sequence
  Synthetic Polynucleotide
taatacgactcactatagggtcgctttcaatttaacacaaccctcaagaaaacagaggagattcttgatggttgtgttaaacctggcggcagcgcaaaagatg

SEQ ID NO: 49037 - DNA, 103 bp, Artificial Sequence
  Synthetic Polynucleotide
taatacgactcactatagggtctcatgataatctgaatatacaattttataacagaggagaataaaaatgtatattcagaacctggcggcagcgcaaaagatg

SEQ ID NO: 49038 - DNA, 103 bp, Artificial Sequence
  Synthetic Polynucleotide
taatacgactcactatagggatttctcgctttcaatttaacacaaccctcaacagaggagagagggtatggttaaattgaacctggcggcagcgcaaaagatg

SEQ ID NO: 49039 - DNA, 103 bp, Artificial Sequence
  Synthetic Polynucleotide
taatacgactcactatagggtgattatttctcgctttcaatttaacacaaaacagaggagattgtgtatgattgaaagcaacctggcggcagcgcaaaagatg

SEQ ID NO: 49040 - DNA, 103 bp, Artificial Sequence
  Synthetic Polynucleotide
taatacgactcactatagggatttatgattatttctcgctttcaatttaaaacagaggagattaaatatgaagcgagaaaacctggcggcagcgcaaaagatg

SEQ ID NO: 49041 - DNA, 103 bp, Artificial Sequence
  Synthetic Polynucleotide
taatacgactcactatagggaaataatttatgattatttctcgctttcaaaacagaggagattgaaaatgagaaataataacctggcggcagcgcaaaagatg

SEQ ID NO: 49042 - DNA, 103 bp, Artificial Sequence
  Synthetic Polynucleotide
taatacgactcactatagggtaatgaaataatttatgattatttctcgctaacagaggagaagcgagatgtaatcataaaacctggcggcagcgcaaaagatg

SEQ ID NO: 49043 - DNA, 103 bp, Artificial Sequence
  Synthetic Polynucleotide
taatacgactcactatagggcgcgataatgaaataatttatgattatttcaacagaggagagaaataatgataaattataacctggcggcagcgcaaaagatg

SEQ ID NO: 49044 - DNA, 103 bp, Artificial Sequence
  Synthetic Polynucleotide
taatacgactcactataggggatatcgcgataatgaaataatttatgattaacagaggagaaatcatatgttatttcataacctggcggcagcgcaaaagatg

SEQ ID NO: 49045 - DNA, 103 bp, Artificial Sequence
  Synthetic Polynucleotide
taatacgactcactatagggtaacggatatcgcgataatgaaataatttaaacagaggagataaattatgtcattatcgaacctggcggcagcgcaaaagatg

SEQ ID NO: 49046 - DNA, 103 bp, Artificial Sequence
  Synthetic Polynucleotide
taatacgactcactatagggaaacttaacggatatcgcgataatgaaataaacagaggagatatttcatgatcgcgataaacctggcggcagcgcaaaagatg

SEQ ID NO: 49047 - DNA, 103 bp, Artificial Sequence
  Synthetic Polynucleotide
taatacgactcactatagggaatacaaacttaacggatatcgcgataatgaacagaggagacattatatggatatccgtaacctggcggcagcgcaaaagatg

SEQ ID NO: 49048 - DNA, 103 bp, Artificial Sequence
  Synthetic Polynucleotide
taatacgactcactatagggacacatctcatgataatctgaatatacaataacagaggagaattgtaatgtcagattataacctggcggcagcgcaaaagatg

SEQ ID NO: 49049 - DNA, 103 bp, Artificial Sequence
  Synthetic Polynucleotide
taatacgactcactatagggattacaatacaaacttaacggatatcgcgaaacagaggagatcgcgaatgccgttaagtaacctggcggcagcgcaaaagatg

SEQ ID NO: 49050 - DNA, 103 bp, Artificial Sequence
  Synthetic Polynucleotide
taatacgactcactatagggacgccattacaatacaaacttaacggatataacagaggagaatatccatgaagtttgtaaacctggcggcagcgcaaaagatg

SEQ ID NO: 49051 - DNA, 103 bp, Artificial Sequence
  Synthetic Polynucleotide
taatacgactcactatagggtgaccacgccattacaatacaaacttaacgaacagaggagacgttaaatgtgtattgtaaacctggcggcagcgcaaaagatg

SEQ ID NO: 49052 - DNA, 103 bp, Artificial Sequence
  Synthetic Polynucleotide
taatacgactcactataggggtaattgaccacgccattacaatacaaactaacagaggagaagtttgatgtgtaatggcaacctggcggcagcgcaaaagatg

SEQ ID NO: 49053 - DNA, 103 bp, Artificial Sequence
  Synthetic Polynucleotide
taatacgactcactatagggtattcgtaattgaccacgccattacaatacaacagaggagagtattgatgtggcgtggtaacctggcggcagcgcaaaagatg

SEQ ID NO: 49054 - DNA, 103 bp, Artificial Sequence
  Synthetic Polynucleotide
taatacgactcactatagggcgctttattcgtaattgaccacgccattacaacagaggagagtaatgatgtggtcaattaacctggcggcagcgcaaaagatg

SEQ ID NO: 49055 - DNA, 103 bp, Artificial Sequence
  Synthetic Polynucleotide
taatacgactcactataggggtatccgctttattcgtaattgaccacgccaacagaggagaggcgtgatgaattacgaaaacctggcggcagcgcaaaagatg

SEQ ID NO: 49056 - DNA, 103 bp, Artificial Sequence
  Synthetic Polynucleotide
taatacgactcactatagggtactagtatccgctttattcgtaattgaccaacagaggagaggtcaaatgcgaataaagaacctggcggcagcgcaaaagatg

SEQ ID NO: 49057 - DNA, 103 bp, Artificial Sequence
  Synthetic Polynucleotide
taatacgactcactataggggaaactactagtatccgctttattcgtaataacagaggagaattacgatgaaagcggataacctggcggcagcgcaaaagatg

SEQ ID NO: 49058 - DNA, 103 bp, Artificial Sequence
  Synthetic Polynucleotide
taatacgactcactatagggtttgtgaaactactagtatccgctttattcaacagaggagagaataaatgggatactagaacctggcggcagcgcaaaagatg

SEQ ID NO: 49059 - DNA, 103 bp, Artificial Sequence
  Synthetic Polynucleotide
taatacgactcactatagggtgtaaacacatctcatgataatctgaatataacagaggagaatattcatgttatcatgaaacctggcggcagcgcaaaagatg

SEQ ID NO: 49060 - DNA, 103 bp, Artificial Sequence
  Synthetic Polynucleotide
taatacgactcactatagggccatctttgtgaaactactagtatccgcttaacagaggagaaagcggatgctagtagttaacctggcggcagcgcaaaagatg

SEQ ID NO: 49061 - DNA, 103 bp, Artificial Sequence
  Synthetic Polynucleotide
taatacgactcactatagggttcagccatctttgtgaaactactagtatcaacagaggagagatactatgagtttcacaaacctggcggcagcgcaaaagatg

SEQ ID NO: 49062 - DNA, 103 bp, Artificial Sequence
  Synthetic Polynucleotide
taatacgactcactatagggctaatttcagccatctttgtgaaactactaaacagaggagatagtagatgcacaaagataacctggcggcagcgcaaaagatg

SEQ ID NO: 49063 - DNA, 103 bp, Artificial Sequence
  Synthetic Polynucleotide
taatacgactcactataggggagctctaatttcagccatctttgtgaaacaacagaggagagtttcaatgagatggctgaacctggcggcagcgcaaaagatg

SEQ ID NO: 49064 - DNA, 103 bp, Artificial Sequence
  Synthetic Polynucleotide
taatacgactcactatagggtagatgagctctaatttcagccatctttgtaacagaggagaacaaagatggctgaaattaacctggcggcagcgcaaaagatg

SEQ ID NO: 49065 - DNA, 103 bp, Artificial Sequence
  Synthetic Polynucleotide
taatacgactcactatagggtttcttagatgagctctaatttcagccatcaacagaggagagatggcatgaattagagcaacctggcggcagcgcaaaagatg

SEQ ID NO: 49066 - DNA, 103 bp, Artificial Sequence
  Synthetic Polynucleotide
taatacgactcactatagggcgctatttcttagatgagctctaatttcagaacagaggagactgaaaatggagctcatcaacctggcggcagcgcaaaagatg

SEQ ID NO: 49067 - DNA, 103 bp, Artificial Sequence
  Synthetic Polynucleotide
taatacgactcactatagggttcagcgctatttcttagatgagctctaataacagaggagaattagaatgcatctaagaaacctggcggcagcgcaaaagatg

SEQ ID NO: 49068 - DNA, 103 bp, Artificial Sequence
  Synthetic Polynucleotide
taatacgactcactatagggttattttcagcgctatttcttagatgagctaacagaggagaagctcaatgaagaaatagaacctggcggcagcgcaaaagatg

SEQ ID NO: 49069 - DNA, 103 bp, Artificial Sequence
  Synthetic Polynucleotide
taatacgactcactatagggtatctttattttcagcgctatttcttagataacagaggagaatctaaatgatagcgctgaacctggcggcagcgcaaaagatg

SEQ ID NO: 49070 - DNA, 103 bp, Artificial Sequence
  Synthetic Polynucleotide
taatacgactcactataggggttagtgtaaacacatctcatgataatctgaacagaggagacagattatgatgagatgtaacctggcggcagcgcaaaagatg

SEQ ID NO: 49071 - DNA, 103 bp, Artificial Sequence
  Synthetic Polynucleotide
taatacgactcactataggggtttttatctttattttcagcgctatttctaacagaggagaagaaatatggctgaaaataacctggcggcagcgcaaaagatg

SEQ ID NO: 49072 - DNA, 103 bp, Artificial Sequence
  Synthetic Polynucleotide
taatacgactcactatagggtcatcgtttttatctttattttcagcgctaaacagaggagatagcgcatgaaataaagaaacctggcggcagcgcaaaagatg

SEQ ID NO: 49073 - DNA, 103 bp, Artificial Sequence
  Synthetic Polynucleotide
taatacgactcactatagggaaatatcatcgtttttatctttattttcagaacagaggagactgaaaatgaagataaaaaacctggcggcagcgcaaaagatg

SEQ ID NO: 49074 - DNA, 103 bp, Artificial Sequence
  Synthetic Polynucleotide
taatacgactcactatagggcgggaaaatatcatcgtttttatctttattaacagaggagaaataaaatgaaaaacgataacctggcggcagcgcaaaagatg

SEQ ID NO: 49075 - DNA, 103 bp, Artificial Sequence
  Synthetic Polynucleotide
taatacgactcactatagggtcttccgggaaaatatcatcgtttttatctaacagaggagaagataaatgcgatgatataacctggcggcagcgcaaaagatg

SEQ ID NO: 49076 - DNA, 103 bp, Artificial Sequence
  Synthetic Polynucleotide
taatacgactcactatagggttacatcttccgggaaaatatcatcgttttaacagaggagaaaaacgatgatattttccaacctggcggcagcgcaaaagatg

SEQ ID NO: 49077 - DNA, 103 bp, Artificial Sequence
  Synthetic Polynucleotide
taatacgactcactatagggaattattacatcttccgggaaaatatcatcaacagaggagagatgatatgttcccggaaaacctggcggcagcgcaaaagatg

SEQ ID NO: 49078 - DNA, 103 bp, Artificial Sequence
  Synthetic Polynucleotide
taatacgactcactataggggatggaattattacatcttccgggaaaataaacagaggagatattttatgggaagatgtaacctggcggcagcgcaaaagatg

SEQ ID NO: 49079 - DNA, 103 bp, Artificial Sequence
  Synthetic Polynucleotide
taatacgactcactatagggtagtagatggaattattacatcttccgggaaacagaggagatcccggatgatgtaataaaacctggcggcagcgcaaaagatg

SEQ ID NO: 49080 - DNA, 103 bp, Artificial Sequence
  Synthetic Polynucleotide
taatacgactcactataggggggcttagtagatggaattattacatcttcaacagaggagagaagatatgataattccaaacctggcggcagcgcaaaagatg

SEQ ID NO: 49081 - DNA, 103 bp, Artificial Sequence
  Synthetic Polynucleotide
taatacgactcactatagggatacagttagtgtaaacacatctcatgataaacagaggagatatcatatgatgtgtttaaacctggcggcagcgcaaaagatg

SEQ ID NO: 49082 - DNA, 103 bp, Artificial Sequence
  Synthetic Polynucleotide
taatacgactcactataggggttttgggcttagtagatggaattattacaaacagaggagatgtaatatgtccatctacaacctggcggcagcgcaaaagatg

SEQ ID NO: 49083 - DNA, 103 bp, Artificial Sequence
  Synthetic Polynucleotide
taatacgactcactataggggtttggttttgggcttagtagatggaattaaacagaggagataattcatgctactaagcaacctggcggcagcgcaaaagatg

SEQ ID NO: 49084 - DNA, 103 bp, Artificial Sequence
  Synthetic Polynucleotide
taatacgactcactatagggggctcgtttggttttgggcttagtagatggaacagaggagaccatctatgaagcccaaaaacctggcggcagcgcaaaagatg

SEQ ID NO: 49085 - DNA, 103 bp, Artificial Sequence
  Synthetic Polynucleotide
taatacgactcactataggggtagtggctcgtttggttttgggcttagtaaacagaggagatactaaatgcaaaaccaaaacctggcggcagcgcaaaagatg

SEQ ID NO: 49086 - DNA, 103 bp, Artificial Sequence
  Synthetic Polynucleotide
taatacgactcactataggggaggagtagtggctcgtttggttttgggctaacagaggagaagcccaatgccaaacgagaacctggcggcagcgcaaaagatg

SEQ ID NO: 49087 - DNA, 103 bp, Artificial Sequence
  Synthetic Polynucleotide
taatacgactcactatagggtttacgaggagtagtggctcgtttggttttaacagaggagaaaaaccatgcgagccactaacctggcggcagcgcaaaagatg

SEQ ID NO: 49088 - DNA, 103 bp, Artificial Sequence
  Synthetic Polynucleotide
taatacgactcactataggggctggtttacgaggagtagtggctcgtttgaacagaggagacaaacgatgcactactccaacctggcggcagcgcaaaagatg

SEQ ID NO: 49089 - DNA, 103 bp, Artificial Sequence
  Synthetic Polynucleotide
taatacgactcactatagggtagccgctggtttacgaggagtagtggctcaacagaggagagagccaatgctcctcgtaaacctggcggcagcgcaaaagatg

SEQ ID NO: 49090 - DNA, 103 bp, Artificial Sequence
  Synthetic Polynucleotide
taatacgactcactatagggtttagtagccgctggtttacgaggagtagtaacagaggagaactactatgcgtaaaccaaacctggcggcagcgcaaaagatg

SEQ ID NO: 49091 - DNA, 103 bp, Artificial Sequence
  Synthetic Polynucleotide
taatacgactcactataggggatcgtttagtagccgctggtttacgaggaaacagaggagatcctcgatgaccagcggcaacctggcggcagcgcaaaagatg

SEQ ID NO: 49092 - DNA, 103 bp, Artificial Sequence
  Synthetic Polynucleotide
taatacgactcactatagggtattgatacagttagtgtaaacacatctcaaacagaggagatgagatatgtttacactaaacctggcggcagcgcaaaagatg

SEQ ID NO: 49093 - DNA, 103 bp, Artificial Sequence
  Synthetic Polynucleotide
taatacgactcactatagggtggttgatcgtttagtagccgctggtttacaacagaggagagtaaacatgcggctactaaacctggcggcagcgcaaaagatg

SEQ ID NO: 49094 - DNA, 103 bp, Artificial Sequence
  Synthetic Polynucleotide
taatacgactcactatagggctttttggttgatcgtttagtagccgctggaacagaggagaccagcgatgactaaacgaaacctggcggcagcgcaaaagatg

SEQ ID NO: 49095 - DNA, 103 bp, Artificial Sequence
  Synthetic Polynucleotide
taatacgactcactatagggttatcctttttggttgatcgtttagtagccaacagaggagaggctacatgacgatcaacaacctggcggcagcgcaaaagatg

SEQ ID NO: 49096 - DNA, 103 bp, Artificial Sequence
  Synthetic Polynucleotide
taatacgactcactatagggtttctttatcctttttggttgatcgtttagaacagaggagactaaacatgcaaccaaaaaacctggcggcagcgcaaaagatg

SEQ ID NO: 49097 - DNA, 103 bp, Artificial Sequence
  Synthetic Polynucleotide
taatacgactcactatagggctccttttctttatcctttttggttgatcgaacagaggagacgatcaatgaaaaaggataacctggcggcagcgcaaaagatg

SEQ ID NO: 49098 - DNA, 103 bp, Artificial Sequence
  Synthetic Polynucleotide
taatacgactcactatagggacttcctccttttctttatcctttttggttaacagaggagaaaccaaatgggataaagaaacctggcggcagcgcaaaagatg

SEQ ID NO: 49099 - DNA, 103 bp, Artificial Sequence
  Synthetic Polynucleotide
taatacgactcactatagggcttccacttcctccttttctttatccttttaacagaggagaaaaaggatgaagaaaaggaacctggcggcagcgcaaaagatg

SEQ ID NO: 49100 - DNA, 103 bp, Artificial Sequence
  Synthetic Polynucleotide
taatacgactcactatagggttcttcttccacttcctccttttctttatcaacagaggagagataaaatgaaggaggaaaacctggcggcagcgcaaaagatg

SEQ ID NO: 49101 - DNA, 103 bp, Artificial Sequence
  Synthetic Polynucleotide
taatacgactcactatagggacttcttcttcttccacttcctccttttctaacagaggagaagaaaaatgggaagtggaaacctggcggcagcgcaaaagatg

SEQ ID NO: 49102 - DNA, 103 bp, Artificial Sequence
  Synthetic Polynucleotide
taatacgactcactatagggtaactacttcttcttcttccacttcctcctaacagaggagaaggaggatgtggaagaagaacctggcggcagcgcaaaagatg

SEQ ID NO: 49103 - DNA, 103 bp, Artificial Sequence
  Synthetic Polynucleotide
taatacgactcactatagggccgtttattgatacagttagtgtaaacacaaacagaggagatgtgttatgactaactgtaacctggcggcagcgcaaaagatg

SEQ ID NO: 49104 - DNA, 103 bp, Artificial Sequence
  Synthetic Polynucleotide
taatacgactcactatagggctctataactacttcttcttcttccacttcaacagaggagagaagtgatggaagaagaaaacctggcggcagcgcaaaagatg

SEQ ID NO: 49105 - DNA, 103 bp, Artificial Sequence
  Synthetic Polynucleotide
taatacgactcactatagggtattcctctataactacttcttcttcttccaacagaggagaggaagaatgagaagtagtaacctggcggcagcgcaaaagatg

SEQ ID NO: 49106 - DNA, 103 bp, Artificial Sequence
  Synthetic Polynucleotide
taatacgactcactataggggatgatattcctctataactacttcttcttaacagaggagaaagaagatgtagttatagaacctggcggcagcgcaaaagatg

SEQ ID NO: 49107 - DNA, 103 bp, Artificial Sequence
  Synthetic Polynucleotide
taatacgactcactatagggtgtttgatgatattcctctataactacttcaacagaggagagaagtaatgatagaggaaaacctggcggcagcgcaaaagatg

SEQ ID NO: 49108 - DNA, 103 bp, Artificial Sequence
  Synthetic Polynucleotide
taatacgactcactatagggtcagttgtttgatgatattcctctataactaacagaggagaagttatatgggaatatcaaacctggcggcagcgcaaaagatg

SEQ ID NO: 49109 - DNA, 103 bp, Artificial Sequence
  Synthetic Polynucleotide
taatacgactcactatagggtttcttcagttgtttgatgatattcctctaaacagaggagatagaggatgatcatcaaaaacctggcggcagcgcaaaagatg

SEQ ID NO: 49110 - DNA, 103 bp, Artificial Sequence
  Synthetic Polynucleotide
taatacgactcactatagggagaattttcttcagttgtttgatgatattcaacagaggagagaatatatgcaaacaactaacctggcggcagcgcaaaagatg

SEQ ID NO: 49111 - DNA, 103 bp, Artificial Sequence
  Synthetic Polynucleotide
taatacgactcactatagggggtggagaattttcttcagttgtttgatgaaacagaggagatcatcaatgaactgaagaaacctggcggcagcgcaaaagatg

SEQ ID NO: 49112 - DNA, 103 bp, Artificial Sequence
  Synthetic Polynucleotide
taatacgactcactatagggacggaggtggagaattttcttcagttgtttaacagaggagaaaacaaatgaagaaaattaacctggcggcagcgcaaaagatg

SEQ ID NO: 49113 - DNA, 103 bp, Artificial Sequence
  Synthetic Polynucleotide
taatacgactcactatagggtgatgacggaggtggagaattttcttcagtaacagaggagaactgaaatgaattctccaaacctggcggcagcgcaaaagatg

SEQ ID NO: 49114 - DNA, 103 bp, Artificial Sequence
  Synthetic Polynucleotide
taatacgactcactataggggtgtgccgtttattgatacagttagtgtaaaacagaggagattacacatgctgtatcaaaacctggcggcagcgcaaaagatg

SEQ ID NO: 49115 - DNA, 103 bp, Artificial Sequence
  Synthetic Polynucleotide
taatacgactcactatagggggagatgatgacggaggtggagaattttctaacagaggagaagaaaaatgtccacctccaacctggcggcagcgcaaaagatg

SEQ ID NO: 49116 - DNA, 103 bp, Artificial Sequence
  Synthetic Polynucleotide
taatacgactcactatagggctccaggagatgatgacggaggtggagaataacagaggagaattctcatgctccgtcataacctggcggcagcgcaaaagatg

SEQ ID NO: 49117 - DNA, 103 bp, Artificial Sequence
  Synthetic Polynucleotide
taatacgactcactataggggccgactccaggagatgatgacggaggtggaacagaggagaccacctatgtcatcatctaacctggcggcagcgcaaaagatg

SEQ ID NO: 49118 - DNA, 103 bp, Artificial Sequence
  Synthetic Polynucleotide
taatacgactcactatagggatgttgccgactccaggagatgatgacggaaacagaggagatccgtcatgatctcctggaacctggcggcagcgcaaaagatg

SEQ ID NO: 49119 - DNA, 103 bp, Artificial Sequence
  Synthetic Polynucleotide
taatacgactcactatagggctacaatgttgccgactccaggagatgatgaacagaggagacatcatatgctggagtcgaacctggcggcagcgcaaaagatg

SEQ ID NO: 49120 - DNA, 103 bp, Artificial Sequence
  Synthetic Polynucleotide
taatacgactcactataggggctttctacaatgttgccgactccaggagaaacagaggagatctcctatggtcggcaacaacctggcggcagcgcaaaagatg

SEQ ID NO: 49121 - DNA, 103 bp, Artificial Sequence
  Synthetic Polynucleotide
taatacgactcactataggggtcacgctttctacaatgttgccgactccaaacagaggagatggagtatgcaacattgtaacctggcggcagcgcaaaagatg

SEQ ID NO: 49122 - DNA, 103 bp, Artificial Sequence
  Synthetic Polynucleotide
taatacgactcactatagggcagcggtcacgctttctacaatgttgccgaaacagaggagatcggcaatgttgtagaaaaacctggcggcagcgcaaaagatg

SEQ ID NO: 49123 - DNA, 103 bp, Artificial Sequence
  Synthetic Polynucleotide
taatacgactcactatagggctctacagcggtcacgctttctacaatgttaacagaggagaaacattatggaaagcgtgaacctggcggcagcgcaaaagatg

SEQ ID NO: 49124 - DNA, 103 bp, Artificial Sequence
  Synthetic Polynucleotide
taatacgactcactatagggtcaagctctacagcggtcacgctttctacaaacagaggagatgtagaatgcgtgaccgcaacctggcggcagcgcaaaagatg

SEQ ID NO: 49125 - DNA, 103 bp, Artificial Sequence
  Synthetic Polynucleotide
taatacgactcactatagggctattagcacagacggctacggttaaccataacagaggagaatggttatgcgtagccgtaacctggcggcagcgcaaaagatg

SEQ ID NO: 49126 - DNA, 103 bp, Artificial Sequence
  Synthetic Polynucleotide
taatacgactcactatagggaaatggtgtgccgtttattgatacagttagaacagaggagactaactatgtcaataaacaacctggcggcagcgcaaaagatg

SEQ ID NO: 49127 - DNA, 103 bp, Artificial Sequence
  Synthetic Polynucleotide
taatacgactcactatagggtatcatcaagctctacagcggtcacgctttaacagaggagaaaagcgatgccgctgtagaacctggcggcagcgcaaaagatg

SEQ ID NO: 49128 - DNA, 103 bp, Artificial Sequence
  Synthetic Polynucleotide
taatacgactcactataggggttgctatcatcaagctctacagcggtcacaacagaggagagtgaccatggtagagcttaacctggcggcagcgcaaaagatg

SEQ ID NO: 49129 - DNA, 103 bp, Artificial Sequence
  Synthetic Polynucleotide
taatacgactcactatagggtccccgttgctatcatcaagctctacagcgaacagaggagacgctgtatggcttgatgaaacctggcggcagcgcaaaagatg

SEQ ID NO: 49130 - DNA, 103 bp, Artificial Sequence
  Synthetic Polynucleotide
taatacgactcactatagggcatcatccccgttgctatcatcaagctctaaacagaggagatagagcatgatgatagcaaacctggcggcagcgcaaaagatg

SEQ ID NO: 49131 - DNA, 103 bp, Artificial Sequence
  Synthetic Polynucleotide
taatacgactcactatagggattatcatcatccccgttgctatcatcaagaacagaggagacttgatatgagcaacgggaacctggcggcagcgcaaaagatg

SEQ ID NO: 49132 - DNA, 103 bp, Artificial Sequence
  Synthetic Polynucleotide
taatacgactcactatagggttatcattatcatcatccccgttgctatcaaacagaggagatgatagatgcggggatgaaacctggcggcagcgcaaaagatg

SEQ ID NO: 49133 - DNA, 103 bp, Artificial Sequence
  Synthetic Polynucleotide
taatacgactcactatagggtatcattatcattatcatcatccccgttgcaacagaggagagcaacgatgatgatgataaacctggcggcagcgcaaaagatg

SEQ ID NO: 49134 - DNA, 103 bp, Artificial Sequence
  Synthetic Polynucleotide
taatacgactcactataggggtcattatcattatcattatcatcatccccaacagaggagaggggatatggataatgataacctggcggcagcgcaaaagatg

SEQ ID NO: 49135 - DNA, 103 bp, Artificial Sequence
  Synthetic Polynucleotide
taatacgactcactatagggttatcgtcattatcattatcattatcatcaaacagaggagatgatgaatgtgataatgaaacctggcggcagcgcaaaagatg

SEQ ID NO: 49136 - DNA, 103 bp, Artificial Sequence
  Synthetic Polynucleotide
taatacgactcactataggggttcattatcgtcattatcattatcattataacagaggagaataatgatgatgataatgaacctggcggcagcgcaaaagatg

SEQ ID NO: 49137 - DNA, 103 bp, Artificial Sequence
  Synthetic Polynucleotide
taatacgactcactatagggtgactaaatggtgtgccgtttattgatacaaacagaggagatgtatcatgaaacggcacaacctggcggcagcgcaaaagatg

SEQ ID NO: 49138 - DNA, 103 bp, Artificial Sequence
  Synthetic Polynucleotide
taatacgactcactatagggcataggttcattatcgtcattatcattatcaacagaggagagataatatgaatgacgataacctggcggcagcgcaaaagatg

SEQ ID NO: 49139 - DNA, 103 bp, Artificial Sequence
  Synthetic Polynucleotide
taatacgactcactatagggtgtaccataggttcattatcgtcattatcaaacagaggagatgataaatgcgataatgaaacctggcggcagcgcaaaagatg

SEQ ID NO: 49140 - DNA, 103 bp, Artificial Sequence
  Synthetic Polynucleotide
taatacgactcactatagggcaacttgtaccataggttcattatcgtcataacagaggagaatgacgatgatgaacctaaacctggcggcagcgcaaaagatg

SEQ ID NO: 49141 - DNA, 103 bp, Artificial Sequence
  Synthetic Polynucleotide
taatacgactcactatagggagcttcaacttgtaccataggttcattatcaacagaggagagataatatgcctatggtaaacctggcggcagcgcaaaagatg

SEQ ID NO: 49142 - DNA, 103 bp, Artificial Sequence
  Synthetic Polynucleotide
taatacgactcactatagggttaccagcttcaacttgtaccataggttcaaacagaggagatgaaccatgggtacaagtaacctggcggcagcgcaaaagatg

SEQ ID NO: 49143 - DNA, 103 bp, Artificial Sequence
  Synthetic Polynucleotide
taatacgactcactatagggttactttaccagcttcaacttgtaccatagaacagaggagactatggatgaagttgaagaacctggcggcagcgcaaaagatg

SEQ ID NO: 49144 - DNA, 103 bp, Artificial Sequence
  Synthetic Polynucleotide
taatacgactcactatagggatgatttactttaccagcttcaacttgtacaacagaggagagtacaaatggaagctggtaacctggcggcagcgcaaaagatg

SEQ ID NO: 49145 - DNA, 103 bp, Artificial Sequence
  Synthetic Polynucleotide
taatacgactcactataggggcactatgatttactttaccagcttcaactaacagaggagaagttgaatgtggtaaagtaacctggcggcagcgcaaaagatg

SEQ ID NO: 49146 - DNA, 103 bp, Artificial Sequence
  Synthetic Polynucleotide
taatacgactcactatagggttctagcactatgatttactttaccagcttaacagaggagaaagctgatgaagtaaatcaacctggcggcagcgcaaaagatg

SEQ ID NO: 49147 - DNA, 103 bp, Artificial Sequence
  Synthetic Polynucleotide
taatacgactcactatagggatcgcttctagcactatgatttactttaccaacagaggagaggtaaaatgaatcatagtaacctggcggcagcgcaaaagatg

SEQ ID NO: 49148 - DNA, 103 bp, Artificial Sequence
  Synthetic Polynucleotide
taatacgactcactatagggggttatgactaaatggtgtgccgtttattgaacagaggagacaataaatggcacaccataacctggcggcagcgcaaaagatg

SEQ ID NO: 49149 - DNA, 103 bp, Artificial Sequence
  Synthetic Polynucleotide
taatacgactcactataggggagagatcgcttctagcactatgatttactaacagaggagaagtaaaatgtagtgctagaacctggcggcagcgcaaaagatg

SEQ ID NO: 49150 - DNA, 103 bp, Artificial Sequence
  Synthetic Polynucleotide
taatacgactcactatagggggtcagagagatcgcttctagcactatgataacagaggagaatcataatgctagaagcgaacctggcggcagcgcaaaagatg

SEQ ID NO: 49151 - DNA, 103 bp, Artificial Sequence
  Synthetic Polynucleotide
taatacgactcactatagggctttaggtcagagagatcgcttctagcactaacagaggagaagtgctatgagcgatctcaacctggcggcagcgcaaaagatg

SEQ ID NO: 49152 - DNA, 103 bp, Artificial Sequence
  Synthetic Polynucleotide
taatacgactcactataggggccacctttaggtcagagagatcgcttctaaacagaggagatagaagatgtctctctgaaacctggcggcagcgcaaaagatg

SEQ ID NO: 49153 - DNA, 103 bp, Artificial Sequence
  Synthetic Polynucleotide
taatacgactcactatagggcggtagccacctttaggtcagagagatcgcaacagaggagagcgatcatgctgacctaaaacctggcggcagcgcaaaagatg

SEQ ID NO: 49154 - DNA, 103 bp, Artificial Sequence
  Synthetic Polynucleotide
taatacgactcactatagggattgtcggtagccacctttaggtcagagagaacagaggagactctctatgctaaaggtgaacctggcggcagcgcaaaagatg

SEQ ID NO: 49155 - DNA, 103 bp, Artificial Sequence
  Synthetic Polynucleotide
taatacgactcactatagggacaatattgtcggtagccacctttaggtcaaacagaggagatgacctatgggtggctacaacctggcggcagcgcaaaagatg

SEQ ID NO: 49156 - DNA, 103 bp, Artificial Sequence
  Synthetic Polynucleotide
taatacgactcactatagggctttaacaatattgtcggtagccacctttaaacagaggagataaaggatgctaccgacaaacctggcggcagcgcaaaagatg

SEQ ID NO: 49157 - DNA, 103 bp, Artificial Sequence
  Synthetic Polynucleotide
taatacgactcactatagggaagatctttaacaatattgtcggtagccacaacagaggagagtggctatggacaatattaacctggcggcagcgcaaaagatg

SEQ ID NO: 49158 - DNA, 103 bp, Artificial Sequence
  Synthetic Polynucleotide
taatacgactcactatagggttcttaagatctttaacaatattgtcggtaaacagaggagataccgaatgtattgttaaaacctggcggcagcgcaaaagatg

SEQ ID NO: 49159 - DNA, 103 bp, Artificial Sequence
  Synthetic Polynucleotide
taatacgactcactatagggattacggttatgactaaatggtgtgccgttaacagaggagaaacggcatgccatttagtaacctggcggcagcgcaaaagatg

SEQ ID NO: 49160 - DNA, 103 bp, Artificial Sequence
  Synthetic Polynucleotide
taatacgactcactatagggtaattttcttaagatctttaacaatattgtaacagaggagaacaataatgttaaagatcaacctggcggcagcgcaaaagatg

SEQ ID NO: 49161 - DNA, 103 bp, Artificial Sequence
  Synthetic Polynucleotide
taatacgactcactatagggagtaataattttcttaagatctttaacaataacagaggagaattgttatggatcttaagaacctggcggcagcgcaaaagatg

SEQ ID NO: 49162 - DNA, 103 bp, Artificial Sequence
  Synthetic Polynucleotide
taatacgactcactatagggattctagtaataattttcttaagatctttaaacagaggagataaagaatgtaagaaaataacctggcggcagcgcaaaagatg

SEQ ID NO: 49163 - DNA, 103 bp, Artificial Sequence
  Synthetic Polynucleotide
taatacgactcactatagggcagagattctagtaataattttcttaagataacagaggagaatcttaatgaaattattaaacctggcggcagcgcaaaagatg

SEQ ID NO: 49164 - DNA, 103 bp, Artificial Sequence
  Synthetic Polynucleotide
taatacgactcactatagggtactgcagagattctagtaataattttcttaacagaggagaaagaaaatgattactagaaacctggcggcagcgcaaaagatg

SEQ ID NO: 49165 - DNA, 103 bp, Artificial Sequence
  Synthetic Polynucleotide
taatacgactcactataggggtcgatactgcagagattctagtaataattaacagaggagaaattatatgtagaatctcaacctggcggcagcgcaaaagatg

SEQ ID NO: 49166 - DNA, 103 bp, Artificial Sequence
  Synthetic Polynucleotide
taatacgactcactataggggaacagtcgatactgcagagattctagtaaaacagaggagattactaatgtctctgcagaacctggcggcagcgcaaaagatg

SEQ ID NO: 49167 - DNA, 103 bp, Artificial Sequence
  Synthetic Polynucleotide
taatacgactcactatagggctctagaacagtcgatactgcagagattctaacagaggagaagaatcatggcagtatcgaacctggcggcagcgcaaaagatg

SEQ ID NO: 49168 - DNA, 103 bp, Artificial Sequence
  Synthetic Polynucleotide
taatacgactcactatagggacatcctctagaacagtcgatactgcagagaacagaggagactctgcatgatcgactgtaacctggcggcagcgcaaaagatg

SEQ ID NO: 49169 - DNA, 103 bp, Artificial Sequence
  Synthetic Polynucleotide
taatacgactcactatagggcttgaacatcctctagaacagtcgatactgaacagaggagacagtatatgctgttctagaacctggcggcagcgcaaaagatg

SEQ ID NO: 49170 - DNA, 103 bp, Artificial Sequence
  Synthetic Polynucleotide
taatacgactcactatagggtttggattacggttatgactaaatggtgtgaacagaggagacacaccatgtagtcataaaacctggcggcagcgcaaaagatg

SEQ ID NO: 49171 - DNA, 103 bp, Artificial Sequence
  Synthetic Polynucleotide
taatacgactcactatagggagctgcttgaacatcctctagaacagtcgaaacagaggagatcgactatgctagaggataacctggcggcagcgcaaaagatg

SEQ ID NO: 49172 - DNA, 103 bp, Artificial Sequence
  Synthetic Polynucleotide
taatacgactcactatagggataccagctgcttgaacatcctctagaacaaacagaggagatgttctatgggatgttcaaacctggcggcagcgcaaaagatg

SEQ ID NO: 49173 - DNA, 103 bp, Artificial Sequence
  Synthetic Polynucleotide
taatacgactcactatagggtagagataccagctgcttgaacatcctctaaacagaggagatagaggatgttcaagcagaacctggcggcagcgcaaaagatg

SEQ ID NO: 49174 - DNA, 103 bp, Artificial Sequence
  Synthetic Polynucleotide
taatacgactcactatagggttgtctagagataccagctgcttgaacatcaacagaggagagatgttatggcagctggtaacctggcggcagcgcaaaagatg

SEQ ID NO: 49175 - DNA, 103 bp, Artificial Sequence
  Synthetic Polynucleotide
taatacgactcactataggggtaaattgtctagagataccagctgcttgaaacagaggagatcaagcatgtggtatctcaacctggcggcagcgcaaaagatg

SEQ ID NO: 49176 - DNA, 103 bp, Artificial Sequence
  Synthetic Polynucleotide
taatacgactcactatagggtagaagtaaattgtctagagataccagctgaacagaggagacagctgatgtctctagacaacctggcggcagcgcaaaagatg

SEQ ID NO: 49177 - DNA, 103 bp, Artificial Sequence
  Synthetic Polynucleotide
taatacgactcactatagggagtcatagaagtaaattgtctagagataccaacagaggagaggtatcatgagacaatttaacctggcggcagcgcaaaagatg

SEQ ID NO: 49178 - DNA, 103 bp, Artificial Sequence
  Synthetic Polynucleotide
taatacgactcactataggggatttagtcatagaagtaaattgtctagagaacagaggagactctagatgatttacttcaacctggcggcagcgcaaaagatg

SEQ ID NO: 49179 - DNA, 103 bp, Artificial Sequence
  Synthetic Polynucleotide
taatacgactcactatagggtaatagatttagtcatagaagtaaattgtcaacagaggagagacaatatgcttctatgaaacctggcggcagcgcaaaagatg

SEQ ID NO: 49180 - DNA, 103 bp, Artificial Sequence
  Synthetic Polynucleotide
taatacgactcactatagggtgttgtaatagatttagtcatagaagtaaaaacagaggagatttactatgatgactaaaaacctggcggcagcgcaaaagatg

SEQ ID NO: 49181 - DNA, 103 bp, Artificial Sequence
  Synthetic Polynucleotide
taatacgactcactatagggaaatttttggattacggttatgactaaatgaacagaggagacatttaatgataaccgtaaacctggcggcagcgcaaaagatg

SEQ ID NO: 49182 - DNA, 103 bp, Artificial Sequence
  Synthetic Polynucleotide
taatacgactcactataggggatagtgttgtaatagatttagtcatagaaaacagaggagattctatatgtaaatctataacctggcggcagcgcaaaagatg

SEQ ID NO: 49183 - DNA, 103 bp, Artificial Sequence
  Synthetic Polynucleotide
taatacgactcactataggggatcagatagtgttgtaatagatttagtcaaacagaggagatgactaatgctattacaaaacctggcggcagcgcaaaagatg

SEQ ID NO: 49184 - DNA, 103 bp, Artificial Sequence
  Synthetic Polynucleotide
taatacgactcactataggggactagatcagatagtgttgtaatagatttaacagaggagaaaatctatgacaacactaaacctggcggcagcgcaaaagatg

SEQ ID NO: 49185 - DNA, 103 bp, Artificial Sequence
  Synthetic Polynucleotide
taatacgactcactatagggtcggtgactagatcagatagtgttgtaataaacagaggagatattacatgactatctgaaacctggcggcagcgcaaaagatg

SEQ ID NO: 49186 - DNA, 103 bp, Artificial Sequence
  Synthetic Polynucleotide
taatacgactcactatagggttccctcggtgactagatcagatagtgttgaacagaggagacaacacatgctgatctagaacctggcggcagcgcaaaagatg

SEQ ID NO: 49187 - DNA, 103 bp, Artificial Sequence
  Synthetic Polynucleotide
taatacgactcactatagggagattttccctcggtgactagatcagatagaacagaggagactatctatgctagtcaccaacctggcggcagcgcaaaagatg

SEQ ID NO: 49188 - DNA, 103 bp, Artificial Sequence
  Synthetic Polynucleotide
taatacgactcactatagggactttagattttccctcggtgactagatcaaacagaggagatgatctatgcaccgagggaacctggcggcagcgcaaaagatg

SEQ ID NO: 49189 - DNA, 103 bp, Artificial Sequence
  Synthetic Polynucleotide
taatacgactcactataggggaacaactttagattttccctcggtgactaaacagaggagatagtcaatgagggaaaataacctggcggcagcgcaaaagatg

SEQ ID NO: 49190 - DNA, 103 bp, Artificial Sequence
  Synthetic Polynucleotide
taatacgactcactatagggtttacgaacaactttagattttccctcggtaacagaggagaaccgagatgaaatctaaaaacctggcggcagcgcaaaagatg

SEQ ID NO: 49191 - DNA, 103 bp, Artificial Sequence
  Synthetic Polynucleotide
taatacgactcactatagggacttttttacgaacaactttagattttcccaacagaggagagggaaaatgtaaagttgtaacctggcggcagcgcaaaagatg

SEQ ID NO: 49192 - DNA, 103 bp, Artificial Sequence
  Synthetic Polynucleotide
taatacgactcactatagggtttaaaaatttttggattacggttatgactaacagaggagaagtcatatgcgtaatccaaacctggcggcagcgcaaaagatg

SEQ ID NO: 49193 - DNA, 103 bp, Artificial Sequence
  Synthetic Polynucleotide
taatacgactcactatagggttttaacttttttacgaacaactttagattaacagaggagaaatctaatgttgttcgtaaacctggcggcagcgcaaaagatg

SEQ ID NO: 49194 - DNA, 103 bp, Artificial Sequence
  Synthetic Polynucleotide
taatacgactcactatagggacaagttttaacttttttacgaacaactttaacagaggagaaaagttatgcgtaaaaaaaacctggcggcagcgcaaaagatg

SEQ ID NO: 49195 - DNA, 103 bp, Artificial Sequence
  Synthetic Polynucleotide
taatacgactcactatagggttcttacaagttttaacttttttacgaacaaacagaggagatgttcgatgaaaagttaaaacctggcggcagcgcaaaagatg

SEQ ID NO: 49196 - DNA, 103 bp, Artificial Sequence
  Synthetic Polynucleotide
taatacgactcactatagggtttacttcttacaagttttaacttttttacaacagaggagagtaaaaatgttaaaacttaacctggcggcagcgcaaaagatg

SEQ ID NO: 49197 - DNA, 103 bp, Artificial Sequence
  Synthetic Polynucleotide
taatacgactcactatagggacgcatttacttcttacaagttttaactttaacagaggagaaaagttatgacttgtaagaacctggcggcagcgcaaaagatg

SEQ ID NO: 49198 - DNA, 103 bp, Artificial Sequence
  Synthetic Polynucleotide
taatacgactcactatagggagtgcacgcatttacttcttacaagttttaaacagaggagataaaacatgtaagaagtaaacctggcggcagcgcaaaagatg

SEQ ID NO: 49199 - DNA, 103 bp, Artificial Sequence
  Synthetic Polynucleotide
taatacgactcactatagggaaaaaagtgcacgcatttacttcttacaagaacagaggagacttgtaatgagtaaatgcaacctggcggcagcgcaaaagatg

SEQ ID NO: 49200 - DNA, 103 bp, Artificial Sequence
  Synthetic Polynucleotide
taatacgactcactatagggtttataaaaaagtgcacgcatttacttcttaacagaggagaaagaagatgatgcgtgcaaacctggcggcagcgcaaaagatg

SEQ ID NO: 49201 - DNA, 103 bp, Artificial Sequence
  Synthetic Polynucleotide
taatacgactcactatagggccatctttataaaaaagtgcacgcatttacaacagaggagagtaaatatgtgcacttttaacctggcggcagcgcaaaagatg

SEQ ID NO: 49202 - DNA, 103 bp, Artificial Sequence
  Synthetic Polynucleotide
taatacgactcactataggggtttaccatctttataaaaaagtgcacgcaaacagaggagatgcgtgatgttttttataaacctggcggcagcgcaaaagatg

SEQ ID NO: 49203 - DNA, 103 bp, Artificial Sequence
  Synthetic Polynucleotide
taatacgactcactatagggtatactttaaaaatttttggattacggttaaacagaggagataaccgatgtccaaaaataacctggcggcagcgcaaaagatg

SEQ ID NO: 49204 - DNA, 103 bp, Artificial Sequence
  Synthetic Polynucleotide
taatacgactcactatagggaaacagtttaccatctttataaaaaagtgcaacagaggagagcacttatgtataaagataacctggcggcagcgcaaaagatg

SEQ ID NO: 49205 - DNA, 103 bp, Artificial Sequence
  Synthetic Polynucleotide
taatacgactcactatagggtcggtaaacagtttaccatctttataaaaaaacagaggagatttttaatgagatggtaaaacctggcggcagcgcaaaagatg

SEQ ID NO: 49206 - DNA, 103 bp, Artificial Sequence
  Synthetic Polynucleotide
taatacgactcactatagggtattatcggtaaacagtttaccatctttataacagaggagaataaagatggtaaactgtaacctggcggcagcgcaaaagatg

SEQ ID NO: 49207 - DNA, 103 bp, Artificial Sequence
  Synthetic Polynucleotide
taatacgactcactatagggaaaattattatcggtaaacagtttaccatcaacagaggagagatggtatgctgtttaccaacctggcggcagcgcaaaagatg

SEQ ID NO: 49208 - DNA, 103 bp, Artificial Sequence
  Synthetic Polynucleotide
taatacgactcactatagggtttaaaaaattattatcggtaaacagtttaaacagaggagataaactatgtaccgataaaacctggcggcagcgcaaaagatg

SEQ ID NO: 49209 - DNA, 103 bp, Artificial Sequence
  Synthetic Polynucleotide
taatacgactcactatagggcaggatttaaaaaattattatcggtaaacaaacagaggagatgtttaatgataataattaacctggcggcagcgcaaaagatg

SEQ ID NO: 49210 - DNA, 103 bp, Artificial Sequence
  Synthetic Polynucleotide
taatacgactcactatagggtgatacaggatttaaaaaattattatcggtaacagaggagaaccgatatgaattttttaaacctggcggcagcgcaaaagatg

SEQ ID NO: 49211 - DNA, 103 bp, Artificial Sequence
  Synthetic Polynucleotide
taatacgactcactatagggttgtctgatacaggatttaaaaaattattaaacagaggagataataaatgtttaaatccaacctggcggcagcgcaaaagatg

SEQ ID NO: 49212 - DNA, 103 bp, Artificial Sequence
  Synthetic Polynucleotide
taatacgactcactataggggattattgtctgatacaggatttaaaaaataacagaggagaatttttatgatcctgtataacctggcggcagcgcaaaagatg

SEQ ID NO: 49213 - DNA, 103 bp, Artificial Sequence
  Synthetic Polynucleotide
taatacgactcactatagggcgctggattattgtctgatacaggatttaaaacagaggagattaaatatggtatcagacaacctggcggcagcgcaaaagatg

SEQ ID NO: 49214 - DNA, 103 bp, Artificial Sequence
  Synthetic Polynucleotide
taatacgactcactatagggtaagatatactttaaaaatttttggattacaacagaggagagtaatcatgaaatttttaaacctggcggcagcgcaaaagatg

SEQ ID NO: 49215 - DNA, 103 bp, Artificial Sequence
  Synthetic Polynucleotide
taatacgactcactatagggtcatacgctggattattgtctgatacaggaaacagaggagatcctgtatgagacaataaaacctggcggcagcgcaaaagatg

SEQ ID NO: 49216 - DNA, 103 bp, Artificial Sequence
  Synthetic Polynucleotide
taatacgactcactatagggaaacctcatacgctggattattgtctgataaacagaggagatatcagatgataatccagaacctggcggcagcgcaaaagatg

SEQ ID NO: 49217 - DNA, 103 bp, Artificial Sequence
  Synthetic Polynucleotide
taatacgactcactatagggttgcaaaacctcatacgctggattattgtcaacagaggagagacaatatgccagcgtataacctggcggcagcgcaaaagatg

SEQ ID NO: 49218 - DNA, 103 bp, Artificial Sequence
  Synthetic Polynucleotide
taatacgactcactatagggacatgttgcaaaacctcatacgctggattaaacagaggagataatccatggtatgaggtaacctggcggcagcgcaaaagatg

SEQ ID NO: 49219 - DNA, 103 bp, Artificial Sequence
  Synthetic Polynucleotide
taatacgactcactatagggttttaacatgttgcaaaacctcatacgctgaacagaggagacagcgtatgaggttttgcaacctggcggcagcgcaaaagatg

SEQ ID NO: 49220 - DNA, 103 bp, Artificial Sequence
  Synthetic Polynucleotide
taatacgactcactatagggaggaattttaacatgttgcaaaacctcataaacagaggagatatgagatgttgcaacataacctggcggcagcgcaaaagatg

SEQ ID NO: 49221 - DNA, 103 bp, Artificial Sequence
  Synthetic Polynucleotide
taatacgactcactatagggtgagtaggaattttaacatgttgcaaaaccaacagaggagaggttttatgacatgttaaaacctggcggcagcgcaaaagatg

SEQ ID NO: 49222 - DNA, 103 bp, Artificial Sequence
  Synthetic Polynucleotide
taatacgactcactatagggttaaatgagtaggaattttaacatgttgcaaacagaggagatgcaacatgttaaaattcaacctggcggcagcgcaaaagatg

SEQ ID NO: 49223 - DNA, 103 bp, Artificial Sequence
  Synthetic Polynucleotide
taatacgactcactatagggatctgttaaatgagtaggaattttaacatgaacagaggagacatgttatgattcctactaacctggcggcagcgcaaaagatg

SEQ ID NO: 49224 - DNA, 103 bp, Artificial Sequence
  Synthetic Polynucleotide
taatacgactcactatagggactacatctgttaaatgagtaggaattttaaacagaggagataaaatatgtactcatttaacctggcggcagcgcaaaagatg

SEQ ID NO: 49225 - DNA, 103 bp, Artificial Sequence
  Synthetic Polynucleotide
taatacgactcactatagggttcgttaagatatactttaaaaatttttggaacagaggagaccaaaaatgtttaaagtaaacctggcggcagcgcaaaagatg

SEQ ID NO: 49226 - DNA, 103 bp, Artificial Sequence
  Synthetic Polynucleotide
taatacgactcactatagggatactactacatctgttaaatgagtaggaaaacagaggagattcctaatgatttaacagaacctggcggcagcgcaaaagatg

SEQ ID NO: 49227 - DNA, 103 bp, Artificial Sequence
  Synthetic Polynucleotide
taatacgactcactatagggtccatatactactacatctgttaaatgagtaacagaggagaactcatatgacagatgtaaacctggcggcagcgcaaaagatg

SEQ ID NO: 49228 - DNA, 103 bp, Artificial Sequence
  Synthetic Polynucleotide
taatacgactcactataggggtttgtccatatactactacatctgttaaaaacagaggagatttaacatgtgtagtagtaacctggcggcagcgcaaaagatg

SEQ ID NO: 49229 - DNA, 103 bp, Artificial Sequence
  Synthetic Polynucleotide
taatacgactcactatagggcccacgtttgtccatatactactacatctgaacagaggagacagatgatgtagtatatgaacctggcggcagcgcaaaagatg

SEQ ID NO: 49230 - DNA, 103 bp, Artificial Sequence
  Synthetic Polynucleotide
taatacgactcactatagggctcctcccacgtttgtccatatactactacaacagaggagagtagtaatgtatggacaaaacctggcggcagcgcaaaagatg

SEQ ID NO: 49231 - DNA, 103 bp, Artificial Sequence
  Synthetic Polynucleotide
taatacgactcactatagggaacgcctcctcccacgtttgtccatatactaacagaggagaagtataatgacaaacgtgaacctggcggcagcgcaaaagatg

SEQ ID NO: 49232 - DNA, 103 bp, Artificial Sequence
  Synthetic Polynucleotide
taatacgactcactatagggtagttaacgcctcctcccacgtttgtccataacagaggagaatggacatgcgtgggaggaacctggcggcagcgcaaaagatg

SEQ ID NO: 49233 - DNA, 103 bp, Artificial Sequence
  Synthetic Polynucleotide
taatacgactcactatagggtaatctagttaacgcctcctcccacgtttgaacagaggagacaaacgatggaggaggcgaacctggcggcagcgcaaaagatg

SEQ ID NO: 49234 - DNA, 103 bp, Artificial Sequence
  Synthetic Polynucleotide
taatacgactcactatagggaaaattaatctagttaacgcctcctcccacaacagaggagagtgggaatgggcgttaacaacctggcggcagcgcaaaagatg

SEQ ID NO: 49235 - DNA, 103 bp, Artificial Sequence
  Synthetic Polynucleotide
taatacgactcactatagggccacaaaaattaatctagttaacgcctcctaacagaggagaaggaggatgtaactagataacctggcggcagcgcaaaagatg

SEQ ID NO: 49236 - DNA, 103 bp, Artificial Sequence
  Synthetic Polynucleotide
taatacgactcactataggggccgtctattagcacagacggctacggttaaacagaggagataaccgatgccgtctgtgaacctggcggcagcgcaaaagatg

SEQ ID NO: 49237 - DNA, 103 bp, Artificial Sequence
  Synthetic Polynucleotide
taatacgactcactatagggcttctttcgttaagatatactttaaaaattaacagaggagaaattttatgagtatatctaacctggcggcagcgcaaaagatg

SEQ ID NO: 49238 - DNA, 103 bp, Artificial Sequence
  Synthetic Polynucleotide
taatacgactcactatagggacttcccacaaaaattaatctagttaacgcaacagaggagagcgttaatgagattaattaacctggcggcagcgcaaaagatg

SEQ ID NO: 49239 - DNA, 103 bp, Artificial Sequence
  Synthetic Polynucleotide
taatacgactcactataggggaatcacttcccacaaaaattaatctagttaacagaggagaaactagatgaatttttgtaacctggcggcagcgcaaaagatg

SEQ ID NO: 49240 - DNA, 103 bp, Artificial Sequence
  Synthetic Polynucleotide
taatacgactcactatagggcttttgaatcacttcccacaaaaattaatcaacagaggagagattaaatgttgtgggaaaacctggcggcagcgcaaaagatg

SEQ ID NO: 49241 - DNA, 103 bp, Artificial Sequence
  Synthetic Polynucleotide
taatacgactcactatagggacgtccttttgaatcacttcccacaaaaataacagaggagaatttttatgggaagtgataacctggcggcagcgcaaaagatg

SEQ ID NO: 49242 - DNA, 103 bp, Artificial Sequence
  Synthetic Polynucleotide
taatacgactcactatagggtgtctacgtccttttgaatcacttcccacaaacagaggagatgtgggatgtgattcaaaaacctggcggcagcgcaaaagatg

SEQ ID NO: 49243 - DNA, 103 bp, Artificial Sequence
  Synthetic Polynucleotide
taatacgactcactatagggagtattgtctacgtccttttgaatcacttcaacagaggagagaagtgatgcaaaaggacaacctggcggcagcgcaaaagatg

SEQ ID NO: 49244 - DNA, 103 bp, Artificial Sequence
  Synthetic Polynucleotide
taatacgactcactataggggtaaaagtattgtctacgtccttttgaatcaacagaggagagattcaatgggacgtagaaacctggcggcagcgcaaaagatg

SEQ ID NO: 49245 - DNA, 103 bp, Artificial Sequence
  Synthetic Polynucleotide
taatacgactcactatagggtttccgtaaaagtattgtctacgtccttttaacagaggagaaaaaggatgtagacaataaacctggcggcagcgcaaaagatg

SEQ ID NO: 49246 - DNA, 103 bp, Artificial Sequence
  Synthetic Polynucleotide
taatacgactcactataggggcatttttccgtaaaagtattgtctacgtcaacagaggagagacgtaatgaatacttttaacctggcggcagcgcaaaagatg

SEQ ID NO: 49247 - DNA, 103 bp, Artificial Sequence
  Synthetic Polynucleotide
taatacgactcactatagggtacatgcatttttccgtaaaagtattgtctaacagaggagaagacaaatgttttacggaaacctggcggcagcgcaaaagatg

SEQ ID NO: 49248 - DNA, 103 bp, Artificial Sequence
  Synthetic Polynucleotide
taatacgactcactatagggtacaacttctttcgttaagatatactttaaaacagaggagattaaagatgatcttaacgaacctggcggcagcgcaaaagatg

SEQ ID NO: 49249 - DNA, 103 bp, Artificial Sequence
  Synthetic Polynucleotide
taatacgactcactatagggttctgtacatgcatttttccgtaaaagtataacagaggagaatacttatgcggaaaaataacctggcggcagcgcaaaagatg

SEQ ID NO: 49250 - DNA, 103 bp, Artificial Sequence
  Synthetic Polynucleotide
taatacgactcactatagggtgcgattctgtacatgcatttttccgtaaaaacagaggagatttacgatgaaatgcatgaacctggcggcagcgcaaaagatg

SEQ ID NO: 49251 - DNA, 103 bp, Artificial Sequence
  Synthetic Polynucleotide
taatacgactcactatagggagcgttgcgattctgtacatgcatttttccaacagaggagaggaaaaatgcatgtacagaacctggcggcagcgcaaaagatg

SEQ ID NO: 49252 - DNA, 103 bp, Artificial Sequence
  Synthetic Polynucleotide
taatacgactcactatagggcttttagcgttgcgattctgtacatgcattaacagaggagaaatgcaatgacagaatcgaacctggcggcagcgcaaaagatg

SEQ ID NO: 49253 - DNA, 103 bp, Artificial Sequence
  Synthetic Polynucleotide
taatacgactcactataggggatctcttttagcgttgcgattctgtacataacagaggagaatgtacatgatcgcaacgaacctggcggcagcgcaaaagatg

SEQ ID NO: 49254 - DNA, 103 bp, Artificial Sequence
  Synthetic Polynucleotide
taatacgactcactatagggaatacgatctcttttagcgttgcgattctgaacagaggagacagaatatgaacgctaaaaacctggcggcagcgcaaaagatg

SEQ ID NO: 49255 - DNA, 103 bp, Artificial Sequence
  Synthetic Polynucleotide
taatacgactcactatagggacaaaaatacgatctcttttagcgttgcgaaacagaggagatcgcaaatgtaaaagagaaacctggcggcagcgcaaaagatg

SEQ ID NO: 49256 - DNA, 103 bp, Artificial Sequence
  Synthetic Polynucleotide
taatacgactcactatagggctctaacaaaaatacgatctcttttagcgtaacagaggagaacgctaatggagatcgtaaacctggcggcagcgcaaaagatg

SEQ ID NO: 49257 - DNA, 103 bp, Artificial Sequence
  Synthetic Polynucleotide
taatacgactcactatagggatatactctaacaaaaatacgatctcttttaacagaggagaaaaagaatgcgtatttttaacctggcggcagcgcaaaagatg

SEQ ID NO: 49258 - DNA, 103 bp, Artificial Sequence
  Synthetic Polynucleotide
taatacgactcactatagggacgttatatactctaacaaaaatacgatctaacagaggagaagatcgatgttttgttagaacctggcggcagcgcaaaagatg

SEQ ID NO: 49259 - DNA, 103 bp, Artificial Sequence
  Synthetic Polynucleotide
taatacgactcactataggggatgatacaacttctttcgttaagatatacaacagaggagagtatatatgaacgaaagaaacctggcggcagcgcaaaagatg

SEQ ID NO: 49260 - DNA, 103 bp, Artificial Sequence
  Synthetic Polynucleotide
taatacgactcactatagggtcataacgttatatactctaacaaaaatacaacagaggagagtatttatgttagagtataacctggcggcagcgcaaaagatg

SEQ ID NO: 49261 - DNA, 103 bp, Artificial Sequence
  Synthetic Polynucleotide
taatacgactcactatagggtcgtttcataacgttatatactctaacaaaaacagaggagatttgttatggtatataacaacctggcggcagcgcaaaagatg

SEQ ID NO: 49262 - DNA, 103 bp, Artificial Sequence
  Synthetic Polynucleotide
taatacgactcactatagggttaattcgtttcataacgttatatactctaaacagaggagatagagtatgtaacgttataacctggcggcagcgcaaaagatg

SEQ ID NO: 49263 - DNA, 103 bp, Artificial Sequence
  Synthetic Polynucleotide
taatacgactcactatagggaacaattaattcgtttcataacgttatataaacagaggagatatataatgttatgaaacaacctggcggcagcgcaaaagatg

SEQ ID NO: 49264 - DNA, 103 bp, Artificial Sequence
  Synthetic Polynucleotide
taatacgactcactatagggtataaaacaattaattcgtttcataacgttaacagaggagaaacgttatgaaacgaattaacctggcggcagcgcaaaagatg

SEQ ID NO: 49265 - DNA, 103 bp, Artificial Sequence
  Synthetic Polynucleotide
taatacgactcactatagggttgtttataaaacaattaattcgtttcataaacagaggagatatgaaatgaattaattgaacctggcggcagcgcaaaagatg

SEQ ID NO: 49266 - DNA, 103 bp, Artificial Sequence
  Synthetic Polynucleotide
taatacgactcactatagggtatttttgtttataaaacaattaattcgttaacagaggagaaacgaaatgattgttttaaacctggcggcagcgcaaaagatg

SEQ ID NO: 49267 - DNA, 103 bp, Artificial Sequence
  Synthetic Polynucleotide
taatacgactcactatagggctttatatttttgtttataaaacaattaataacagaggagaattaatatgtttataaacaacctggcggcagcgcaaaagatg

SEQ ID NO: 49268 - DNA, 103 bp, Artificial Sequence
  Synthetic Polynucleotide
taatacgactcactataggggatttctttatatttttgtttataaaacaaaacagaggagattgtttatgaaacaaaaaaacctggcggcagcgcaaaagatg

SEQ ID NO: 49269 - DNA, 103 bp, Artificial Sequence
  Synthetic Polynucleotide
taatacgactcactatagggtggatgatttctttatatttttgtttataaaacagaggagattataaatgaaaatataaaacctggcggcagcgcaaaagatg

SEQ ID NO: 49270 - DNA, 103 bp, Artificial Sequence
  Synthetic Polynucleotide
taatacgactcactatagggctaacgatgatacaacttctttcgttaagaaacagaggagatcttaaatgaagaagttgaacctggcggcagcgcaaaagatg

SEQ ID NO: 49271 - DNA, 103 bp, Artificial Sequence
  Synthetic Polynucleotide
taatacgactcactatagggatctgtggatgatttctttatatttttgttaacagaggagaaacaaaatgataaagaaaaacctggcggcagcgcaaaagatg

SEQ ID NO: 49272 - DNA, 103 bp, Artificial Sequence
  Synthetic Polynucleotide
taatacgactcactatagggttggaatctgtggatgatttctttatatttaacagaggagaaaatatatggaaatcatcaacctggcggcagcgcaaaagatg

SEQ ID NO: 49273 - DNA, 103 bp, Artificial Sequence
  Synthetic Polynucleotide
taatacgactcactataggggataattggaatctgtggatgatttctttaaacagaggagataaagaatgcatccacagaacctggcggcagcgcaaaagatg

SEQ ID NO: 49274 - DNA, 103 bp, Artificial Sequence
  Synthetic Polynucleotide
taatacgactcactatagggcaactgataattggaatctgtggatgatttaacagaggagaaaatcaatgacagattccaacctggcggcagcgcaaaagatg

SEQ ID NO: 49275 - DNA, 103 bp, Artificial Sequence
  Synthetic Polynucleotide
taatacgactcactatagggactgccaactgataattggaatctgtggataacagaggagaatccacatgttccaattaaacctggcggcagcgcaaaagatg

SEQ ID NO: 49276 - DNA, 103 bp, Artificial Sequence
  Synthetic Polynucleotide
taatacgactcactatagggtaaaaactgccaactgataattggaatctgaacagaggagacagattatgattatcagtaacctggcggcagcgcaaaagatg

SEQ ID NO: 49277 - DNA, 103 bp, Artificial Sequence
  Synthetic Polynucleotide
taatacgactcactatagggtaacataaaaactgccaactgataattggaaacagaggagatccaatatgcagttggcaaacctggcggcagcgcaaaagatg

SEQ ID NO: 49278 - DNA, 103 bp, Artificial Sequence
  Synthetic Polynucleotide
taatacgactcactatagggtccattaacataaaaactgccaactgataaaacagaggagattatcaatgggcagttttaacctggcggcagcgcaaaagatg

SEQ ID NO: 49279 - DNA, 103 bp, Artificial Sequence
  Synthetic Polynucleotide
taatacgactcactatagggtagtttccattaacataaaaactgccaactaacagaggagaagttggatgtttttatgtaacctggcggcagcgcaaaagatg

SEQ ID NO: 49280 - DNA, 103 bp, Artificial Sequence
  Synthetic Polynucleotide
taatacgactcactatagggaaacatagtttccattaacataaaaactgcaacagaggagagcagttatgatgttaatgaacctggcggcagcgcaaaagatg

SEQ ID NO: 49281 - DNA, 103 bp, Artificial Sequence
  Synthetic Polynucleotide
taatacgactcactatagggaaatcctaacgatgatacaacttctttcgtaacagaggagaacgaaaatggttgtatcaaacctggcggcagcgcaaaagatg

SEQ ID NO: 49282 - DNA, 103 bp, Artificial Sequence
  Synthetic Polynucleotide
taatacgactcactatagggataaaaaacatagtttccattaacataaaaaacagaggagattttatatgaatggaaacaacctggcggcagcgcaaaagatg

SEQ ID NO: 49283 - DNA, 103 bp, Artificial Sequence
  Synthetic Polynucleotide
taatacgactcactatagggatctaataaaaaacatagtttccattaacaaacagaggagatgttaaatgaaactatgtaacctggcggcagcgcaaaagatg

SEQ ID NO: 49284 - DNA, 103 bp, Artificial Sequence
  Synthetic Polynucleotide
taatacgactcactatagggaccaaatctaataaaaaacatagtttccataacagaggagaatggaaatgatgttttttaacctggcggcagcgcaaaagatg

SEQ ID NO: 49285 - DNA, 103 bp, Artificial Sequence
  Synthetic Polynucleotide
taatacgactcactatagggattttaccaaatctaataaaaaacatagttaacagaggagaaactatatgttttattagaacctggcggcagcgcaaaagatg

SEQ ID NO: 49286 - DNA, 103 bp, Artificial Sequence
  Synthetic Polynucleotide
taatacgactcactatagggatttcattttaccaaatctaataaaaaacaaacagaggagatgttttatgttagatttgaacctggcggcagcgcaaaagatg

SEQ ID NO: 49287 - DNA, 103 bp, Artificial Sequence
  Synthetic Polynucleotide
taatacgactcactatagggaagatatttcattttaccaaatctaataaaaacagaggagatttattatgtttggtaaaaacctggcggcagcgcaaaagatg

SEQ ID NO: 49288 - DNA, 103 bp, Artificial Sequence
  Synthetic Polynucleotide
taatacgactcactatagggtccttaagatatttcattttaccaaatctaaacagaggagatagattatgtaaaatgaaaacctggcggcagcgcaaaagatg

SEQ ID NO: 49289 - DNA, 103 bp, Artificial Sequence
  Synthetic Polynucleotide
taatacgactcactatagggcattctccttaagatatttcattttaccaaaacagaggagattggtaatgtgaaatatcaacctggcggcagcgcaaaagatg

SEQ ID NO: 49290 - DNA, 103 bp, Artificial Sequence
  Synthetic Polynucleotide
taatacgactcactatagggtgtttcattctccttaagatatttcattttaacagaggagaaaaatgatgtatcttaagaacctggcggcagcgcaaaagatg

SEQ ID NO: 49291 - DNA, 103 bp, Artificial Sequence
  Synthetic Polynucleotide
taatacgactcactatagggcctactgtttcattctccttaagatatttcaacagaggagagaaataatgtaaggagaaaacctggcggcagcgcaaaagatg

SEQ ID NO: 49292 - DNA, 103 bp, Artificial Sequence
  Synthetic Polynucleotide
taatacgactcactatagggttaccaaatcctaacgatgatacaacttctaacagaggagaagaagtatgatcatcgttaacctggcggcagcgcaaaagatg

SEQ ID NO: 49293 - DNA, 103 bp, Artificial Sequence
  Synthetic Polynucleotide
taatacgactcactatagggataaccctactgtttcattctccttaagataacagaggagaatcttaatgagaatgaaaaacctggcggcagcgcaaaagatg

SEQ ID NO: 49294 - DNA, 103 bp, Artificial Sequence
  Synthetic Polynucleotide
taatacgactcactatagggtgttaataaccctactgtttcattctccttaacagaggagaaaggagatggaaacagtaaacctggcggcagcgcaaaagatg

SEQ ID NO: 49295 - DNA, 103 bp, Artificial Sequence
  Synthetic Polynucleotide
taatacgactcactatagggtttagtgttaataaccctactgtttcattcaacagaggagagaatgaatgagtagggttaacctggcggcagcgcaaaagatg

SEQ ID NO: 49296 - DNA, 103 bp, Artificial Sequence
  Synthetic Polynucleotide
taatacgactcactatagggtattttttagtgttaataaccctactgtttaacagaggagaaaacagatgggttattaaaacctggcggcagcgcaaaagatg

SEQ ID NO: 49297 - DNA, 103 bp, Artificial Sequence
  Synthetic Polynucleotide
taatacgactcactataggggtgtttattttttagtgttaataaccctacaacagaggagagtagggatgttaacactaaacctggcggcagcgcaaaagatg

SEQ ID NO: 49298 - DNA, 103 bp, Artificial Sequence
  Synthetic Polynucleotide
taatacgactcactatagggtctatgtgtttattttttagtgttaataacaacagaggagagttattatgactaaaaaaaacctggcggcagcgcaaaagatg

SEQ ID NO: 49299 - DNA, 103 bp, Artificial Sequence
  Synthetic Polynucleotide
taatacgactcactatagggttatttctatgtgtttattttttagtgttaaacagaggagataacacatgaaaataaacaacctggcggcagcgcaaaagatg

SEQ ID NO: 49300 - DNA, 103 bp, Artificial Sequence
  Synthetic Polynucleotide
taatacgactcactataggggggacttatttctatgtgtttattttttagaacagaggagactaaaaatgaaacacataaacctggcggcagcgcaaaagatg

SEQ ID NO: 49301 - DNA, 103 bp, Artificial Sequence
  Synthetic Polynucleotide
taatacgactcactatagggttatcgggacttatttctatgtgtttatttaacagaggagaaaataaatgcatagaaataacctggcggcagcgcaaaagatg

SEQ ID NO: 49302 - DNA, 103 bp, Artificial Sequence
  Synthetic Polynucleotide
taatacgactcactatagggctattttatcgggacttatttctatgtgttaacagaggagaaacacaatgaaataagtcaacctggcggcagcgcaaaagatg

SEQ ID NO: 49303 - DNA, 103 bp, Artificial Sequence
  Synthetic Polynucleotide
taatacgactcactatagggataatttaccaaatcctaacgatgatacaaaacagaggagattgtatatgcgttaggataacctggcggcagcgcaaaagatg

SEQ ID NO: 49304 - DNA, 103 bp, Artificial Sequence
  Synthetic Polynucleotide
taatacgactcactataggggataactattttatcgggacttatttctataacagaggagaatagaaatgagtcccgataacctggcggcagcgcaaaagatg

SEQ ID NO: 49305 - DNA, 103 bp, Artificial Sequence
  Synthetic Polynucleotide
taatacgactcactatagggaacttgataactattttatcgggacttattaacagaggagaaataagatgcgataaaataacctggcggcagcgcaaaagatg

SEQ ID NO: 49306 - DNA, 103 bp, Artificial Sequence
  Synthetic Polynucleotide
taatacgactcactatagggctacaaacttgataactattttatcgggacaacagaggagagtcccgatgaaatagttaaacctggcggcagcgcaaaagatg

SEQ ID NO: 49307 - DNA, 103 bp, Artificial Sequence
  Synthetic Polynucleotide
taatacgactcactatagggctttcctacaaacttgataactattttatcaacagaggagagataaaatggttatcaagaacctggcggcagcgcaaaagatg

SEQ ID NO: 49308 - DNA, 103 bp, Artificial Sequence
  Synthetic Polynucleotide
taatacgactcactatagggttgtcctttcctacaaacttgataactattaacagaggagaaatagtatgcaagtttgtaacctggcggcagcgcaaaagatg

SEQ ID NO: 49309 - DNA, 103 bp, Artificial Sequence
  Synthetic Polynucleotide
taatacgactcactatagggaaactttgtcctttcctacaaacttgataaaacagaggagattatcaatgttgtaggaaaacctggcggcagcgcaaaagatg

SEQ ID NO: 49310 - DNA, 103 bp, Artificial Sequence
  Synthetic Polynucleotide
taatacgactcactatagggatgtgaaactttgtcctttcctacaaacttaacagaggagaaagtttatgggaaaggacaacctggcggcagcgcaaaagatg

SEQ ID NO: 49311 - DNA, 103 bp, Artificial Sequence
  Synthetic Polynucleotide
taatacgactcactatagggaattcatgtgaaactttgtcctttcctacaaacagaggagatgtaggatgggacaaagtaacctggcggcagcgcaaaagatg

SEQ ID NO: 49312 - DNA, 103 bp, Artificial Sequence
  Synthetic Polynucleotide
taatacgactcactatagggcaacaaattcatgtgaaactttgtcctttcaacagaggagagaaaggatgaagtttcacaacctggcggcagcgcaaaagatg

SEQ ID NO: 49313 - DNA, 103 bp, Artificial Sequence
  Synthetic Polynucleotide
taatacgactcactatagggatgaacaacaaattcatgtgaaactttgtcaacagaggagagacaaaatgtcacatgaaaacctggcggcagcgcaaaagatg

SEQ ID NO: 49314 - DNA, 103 bp, Artificial Sequence
  Synthetic Polynucleotide
taatacgactcactatagggagataataatttaccaaatcctaacgatgaaacagaggagatcatcgatgggatttggtaacctggcggcagcgcaaaagatg

SEQ ID NO: 49315 - DNA, 103 bp, Artificial Sequence
  Synthetic Polynucleotide
taatacgactcactataggggacttatgaacaacaaattcatgtgaaactaacagaggagaagtttcatgtgaatttgtaacctggcggcagcgcaaaagatg

SEQ ID NO: 49316 - DNA, 103 bp, Artificial Sequence
  Synthetic Polynucleotide
taatacgactcactatagggtattagacttatgaacaacaaattcatgtgaacagaggagacacatgatgttgttgttcaacctggcggcagcgcaaaagatg

SEQ ID NO: 49317 - DNA, 103 bp, Artificial Sequence
  Synthetic Polynucleotide
taatacgactcactatagggtagtctattagacttatgaacaacaaattcaacagaggagagaatttatggttcataagaacctggcggcagcgcaaaagatg

SEQ ID NO: 49318 - DNA, 103 bp, Artificial Sequence
  Synthetic Polynucleotide
taatacgactcactatagggttatatagtctattagacttatgaacaacaaacagaggagatgttgtatgtaagtctaaaacctggcggcagcgcaaaagatg

SEQ ID NO: 49319 - DNA, 103 bp, Artificial Sequence
  Synthetic Polynucleotide
taatacgactcactataggggcggtttatatagtctattagacttatgaaaacagaggagattcataatgctaatagacaacctggcggcagcgcaaaagatg

SEQ ID NO: 49320 - DNA, 103 bp, Artificial Sequence
  Synthetic Polynucleotide
taatacgactcactatagggcaatagcggtttatatagtctattagacttaacagaggagaaagtctatgagactatataacctggcggcagcgcaaaagatg

SEQ ID NO: 49321 - DNA, 103 bp, Artificial Sequence
  Synthetic Polynucleotide
taatacgactcactatagggagtttcaatagcggtttatatagtctattaaacagaggagataatagatgatataaaccaacctggcggcagcgcaaaagatg

SEQ ID NO: 49322 - DNA, 103 bp, Artificial Sequence
  Synthetic Polynucleotide
taatacgactcactatagggccgtcagtttcaatagcggtttatatagtcaacagaggagagactatatgaaccgctataacctggcggcagcgcaaaagatg

SEQ ID NO: 49323 - DNA, 103 bp, Artificial Sequence
  Synthetic Polynucleotide
taatacgactcactatagggatcatccgtcagtttcaatagcggtttataaacagaggagatataaaatgctattgaaaaacctggcggcagcgcaaaagatg

SEQ ID NO: 49324 - DNA, 103 bp, Artificial Sequence
  Synthetic Polynucleotide
taatacgactcactatagggctagaatcatccgtcagtttcaatagcggtaacagaggagaaccgctatggaaactgacaacctggcggcagcgcaaaagatg

SEQ ID NO: 49325 - DNA, 103 bp, Artificial Sequence
  Synthetic Polynucleotide
taatacgactcactatagggactgtagataataatttaccaaatcctaacaacagaggagagttaggatgtggtaaattaacctggcggcagcgcaaaagatg

SEQ ID NO: 49326 - DNA, 103 bp, Artificial Sequence
  Synthetic Polynucleotide
taatacgactcactatagggcgggactagaatcatccgtcagtttcaataaacagaggagatattgaatgtgacggatgaacctggcggcagcgcaaaagatg

SEQ ID NO: 49327 - DNA, 103 bp, Artificial Sequence
  Synthetic Polynucleotide
taatacgactcactatagggttcttcgggactagaatcatccgtcagtttaacagaggagaaaactgatggatgattctaacctggcggcagcgcaaaagatg

SEQ ID NO: 49328 - DNA, 103 bp, Artificial Sequence
  Synthetic Polynucleotide
taatacgactcactatagggagaaattcttcgggactagaatcatccgtcaacagaggagagacggaatgttctagtccaacctggcggcagcgcaaaagatg

SEQ ID NO: 49329 - DNA, 103 bp, Artificial Sequence
  Synthetic Polynucleotide
taatacgactcactatagggtgaacagaaattcttcgggactagaatcataacagaggagaatgattatggtcccgaagaacctggcggcagcgcaaaagatg

SEQ ID NO: 49330 - DNA, 103 bp, Artificial Sequence
  Synthetic Polynucleotide
taatacgactcactatagggtttgttgaacagaaattcttcgggactagaaacagaggagatctagtatggaagaatttaacctggcggcagcgcaaaagatg

SEQ ID NO: 49331 - DNA, 103 bp, Artificial Sequence
  Synthetic Polynucleotide
taatacgactcactatagggcttagtttgttgaacagaaattcttcgggaaacagaggagatcccgaatgatttctgttaacctggcggcagcgcaaaagatg

SEQ ID NO: 49332 - DNA, 103 bp, Artificial Sequence
  Synthetic Polynucleotide
taatacgactcactataggggttcacttagtttgttgaacagaaattcttaacagaggagaaagaatatgtgttcaacaaacctggcggcagcgcaaaagatg

SEQ ID NO: 49333 - DNA, 103 bp, Artificial Sequence
  Synthetic Polynucleotide
taatacgactcactatagggctttcgttcacttagtttgttgaacagaaaaacagaggagatttctgatgaacaaactaaacctggcggcagcgcaaaagatg

SEQ ID NO: 49334 - DNA, 103 bp, Artificial Sequence
  Synthetic Polynucleotide
taatacgactcactatagggtatacctttcgttcacttagtttgttgaacaacagaggagagttcaaatgactaagtgaaacctggcggcagcgcaaaagatg

SEQ ID NO: 49335 - DNA, 103 bp, Artificial Sequence
  Synthetic Polynucleotide
taatacgactcactatagggattcgtatacctttcgttcacttagtttgtaacagaggagaacaaacatggtgaacgaaaacctggcggcagcgcaaaagatg

SEQ ID NO: 49336 - DNA, 103 bp, Artificial Sequence
  Synthetic Polynucleotide
taatacgactcactatagggcatacactgtagataataatttaccaaatcaacagaggagagatttgatgaattattataacctggcggcagcgcaaaagatg

SEQ ID NO: 49337 - DNA, 103 bp, Artificial Sequence
  Synthetic Polynucleotide
taatacgactcactataggggatacattcgtatacctttcgttcacttagaacagaggagactaagtatgcgaaaggtaaacctggcggcagcgcaaaagatg

SEQ ID NO: 49338 - DNA, 103 bp, Artificial Sequence
  Synthetic Polynucleotide
taatacgactcactatagggtgtttgatacattcgtatacctttcgttcaaacagaggagatgaacgatgggtatacgaaacctggcggcagcgcaaaagatg

SEQ ID NO: 49339 - DNA, 103 bp, Artificial Sequence
  Synthetic Polynucleotide
taatacgactcactatagggcaaactgtttgatacattcgtatacctttcaacagaggagagaaaggatgacgaatgtaaacctggcggcagcgcaaaagatg

SEQ ID NO: 49340 - DNA, 103 bp, Artificial Sequence
  Synthetic Polynucleotide
taatacgactcactatagggaataccaaactgtttgatacattcgtatacaacagaggagagtatacatgtgtatcaaaaacctggcggcagcgcaaaagatg

SEQ ID NO: 49341 - DNA, 103 bp, Artificial Sequence
  Synthetic Polynucleotide
taatacgactcactatagggattctaataccaaactgtttgatacattcgaacagaggagacgaatgatgcaaacagttaacctggcggcagcgcaaaagatg

SEQ ID NO: 49342 - DNA, 103 bp, Artificial Sequence
  Synthetic Polynucleotide
taatacgactcactatagggccttgattctaataccaaactgtttgatacaacagaggagagtatcaatgagtttggtaaacctggcggcagcgcaaaagatg

SEQ ID NO: 49343 - DNA, 103 bp, Artificial Sequence
  Synthetic Polynucleotide
taatacgactcactataggggagatccttgattctaataccaaactgtttaacagaggagaaaacagatgggtattagaaacctggcggcagcgcaaaagatg

SEQ ID NO: 49344 - DNA, 103 bp, Artificial Sequence
  Synthetic Polynucleotide
taatacgactcactataggggttcggagatccttgattctaataccaaacaacagaggagagtttggatgtagaatcaaaacctggcggcagcgcaaaagatg

SEQ ID NO: 49345 - DNA, 103 bp, Artificial Sequence
  Synthetic Polynucleotide
taatacgactcactatagggcatacgttcggagatccttgattctaatacaacagaggagagtattaatgtcaaggatcaacctggcggcagcgcaaaagatg

SEQ ID NO: 49346 - DNA, 103 bp, Artificial Sequence
  Synthetic Polynucleotide
taatacgactcactataggggactccatacgttcggagatccttgattctaacagaggagaagaatcatggatctccgaaacctggcggcagcgcaaaagatg

SEQ ID NO: 49347 - DNA, 103 bp, Artificial Sequence
  Synthetic Polynucleotide
taatacgactcactatagggttaatgccgtctattagcacagacggctacaacagaggagagtagccatgtgtgctaataacctggcggcagcgcaaaagatg

SEQ ID NO: 49348 - DNA, 103 bp, Artificial Sequence
  Synthetic Polynucleotide
taatacgactcactatagggagtaccatacactgtagataataatttaccaacagaggagaggtaaaatgttatctacaaacctggcggcagcgcaaaagatg

SEQ ID NO: 49349 - DNA, 103 bp, Artificial Sequence
  Synthetic Polynucleotide
taatacgactcactatagggtaattgactccatacgttcggagatccttgaacagaggagacaaggaatgccgaacgtaaacctggcggcagcgcaaaagatg

SEQ ID NO: 49350 - DNA, 103 bp, Artificial Sequence
  Synthetic Polynucleotide
taatacgactcactatagggacgtataattgactccatacgttcggagataacagaggagaatctccatgcgtatggagaacctggcggcagcgcaaaagatg

SEQ ID NO: 49351 - DNA, 103 bp, Artificial Sequence
  Synthetic Polynucleotide
taatacgactcactatagggtaaaaacgtataattgactccatacgttcgaacagaggagacgaacgatgggagtcaataacctggcggcagcgcaaaagatg

SEQ ID NO: 49352 - DNA, 103 bp, Artificial Sequence
  Synthetic Polynucleotide
taatacgactcactatagggttatataaaaacgtataattgactccatacaacagaggagagtatggatgcaattatacaacctggcggcagcgcaaaagatg

SEQ ID NO: 49353 - DNA, 103 bp, Artificial Sequence
  Synthetic Polynucleotide
taatacgactcactatagggaaaaattatataaaaacgtataattgactcaacagaggagagagtcaatgatacgttttaacctggcggcagcgcaaaagatg

SEQ ID NO: 49354 - DNA, 103 bp, Artificial Sequence
  Synthetic Polynucleotide
taatacgactcactatagggtgtccaaaaattatataaaaacgtataattaacagaggagaaattatatgtttttatataacctggcggcagcgcaaaagatg

SEQ ID NO: 49355 - DNA, 103 bp, Artificial Sequence
  Synthetic Polynucleotide
taatacgactcactatagggacatttgtccaaaaattatataaaaacgtaaacagaggagatacgttatgatataatttaacctggcggcagcgcaaaagatg

SEQ ID NO: 49356 - DNA, 103 bp, Artificial Sequence
  Synthetic Polynucleotide
taatacgactcactatagggactttacatttgtccaaaaattatataaaaaacagaggagattttatatgatttttggaaacctggcggcagcgcaaaagatg

SEQ ID NO: 49357 - DNA, 103 bp, Artificial Sequence
  Synthetic Polynucleotide
taatacgactcactatagggtatggactttacatttgtccaaaaattataaacagaggagatataatatgtggacaaataacctggcggcagcgcaaaagatg

SEQ ID NO: 49358 - DNA, 103 bp, Artificial Sequence
  Synthetic Polynucleotide
taatacgactcactatagggggagatatggactttacatttgtccaaaaaaacagaggagatttttgatgaaatgtaaaaacctggcggcagcgcaaaagatg

SEQ ID NO: 49359 - DNA, 103 bp, Artificial Sequence
  Synthetic Polynucleotide
taatacgactcactataggggatttagtaccatacactgtagataataataacagaggagaattattatgtacagtgtaaacctggcggcagcgcaaaagatg

SEQ ID NO: 49360 - DNA, 103 bp, Artificial Sequence
  Synthetic Polynucleotide
taatacgactcactataggggaagaggagatatggactttacatttgtccaacagaggagaggacaaatgtaaagtccaaacctggcggcagcgcaaaagatg

SEQ ID NO: 49361 - DNA, 103 bp, Artificial Sequence
  Synthetic Polynucleotide
taatacgactcactatagggtgatggaagaggagatatggactttacattaacagaggagaaatgtaatgtccatatctaacctggcggcagcgcaaaagatg

SEQ ID NO: 49362 - DNA, 103 bp, Artificial Sequence
  Synthetic Polynucleotide
taatacgactcactatagggtttggtgatggaagaggagatatggactttaacagaggagaaaagtcatgatctcctctaacctggcggcagcgcaaaagatg

SEQ ID NO: 49363 - DNA, 103 bp, Artificial Sequence
  Synthetic Polynucleotide
taatacgactcactatagggacttttttggtgatggaagaggagatatggaacagaggagaccatatatgctcttccataacctggcggcagcgcaaaagatg

SEQ ID NO: 49364 - DNA, 103 bp, Artificial Sequence
  Synthetic Polynucleotide
taatacgactcactatagggtattaacttttttggtgatggaagaggagaaacagaggagatctcctatgccatcaccaaacctggcggcagcgcaaaagatg

SEQ ID NO: 49365 - DNA, 103 bp, Artificial Sequence
  Synthetic Polynucleotide
taatacgactcactatagggaacgctattaacttttttggtgatggaagaaacagaggagatcttccatgaccaaaaaaaacctggcggcagcgcaaaagatg

SEQ ID NO: 49366 - DNA, 103 bp, Artificial Sequence
  Synthetic Polynucleotide
taatacgactcactatagggtagttaacgctattaacttttttggtgatgaacagaggagacatcacatgaaaagttaaaacctggcggcagcgcaaaagatg

SEQ ID NO: 49367 - DNA, 103 bp, Artificial Sequence
  Synthetic Polynucleotide
taatacgactcactatagggtttgatagttaacgctattaacttttttggaacagaggagaccaaaaatgttaatagcgaacctggcggcagcgcaaaagatg

SEQ ID NO: 49368 - DNA, 103 bp, Artificial Sequence
  Synthetic Polynucleotide
taatacgactcactataggggtttgtttgatagttaacgctattaactttaacagaggagaaaagttatgagcgttaacaacctggcggcagcgcaaaagatg

SEQ ID NO: 49369 - DNA, 103 bp, Artificial Sequence
  Synthetic Polynucleotide
taatacgactcactatagggcagcagtttgtttgatagttaacgctattaaacagaggagataatagatgtaactatcaaacctggcggcagcgcaaaagatg

SEQ ID NO: 49370 - DNA, 103 bp, Artificial Sequence
  Synthetic Polynucleotide
taatacgactcactatagggatgaggatttagtaccatacactgtagataaacagaggagatatctaatgtgtatggtaaacctggcggcagcgcaaaagatg

SEQ ID NO: 49371 - DNA, 103 bp, Artificial Sequence
  Synthetic Polynucleotide
taatacgactcactatagggcacttcagcagtttgtttgatagttaacgcaacagaggagagcgttaatgatcaaacaaaacctggcggcagcgcaaaagatg

SEQ ID NO: 49372 - DNA, 103 bp, Artificial Sequence
  Synthetic Polynucleotide
taatacgactcactatagggcctaccacttcagcagtttgtttgatagttaacagaggagaaactatatgacaaactgcaacctggcggcagcgcaaaagatg

SEQ ID NO: 49373 - DNA, 103 bp, Artificial Sequence
  Synthetic Polynucleotide
taatacgactcactatagggtatgacctaccacttcagcagtttgtttgaaacagaggagatcaaacatgctgctgaagaacctggcggcagcgcaaaagatg

SEQ ID NO: 49374 - DNA, 103 bp, Artificial Sequence
  Synthetic Polynucleotide
taatacgactcactatagggtggagtatgacctaccacttcagcagtttgaacagaggagacaaactatggaagtggtaaacctggcggcagcgcaaaagatg

SEQ ID NO: 49375 - DNA, 103 bp, Artificial Sequence
  Synthetic Polynucleotide
taatacgactcactatagggattgatggagtatgacctaccacttcagcaaacagaggagatgctgaatgggtaggtcaaacctggcggcagcgcaaaagatg

SEQ ID NO: 49376 - DNA, 103 bp, Artificial Sequence
  Synthetic Polynucleotide
taatacgactcactatagggttgaaattgatggagtatgacctaccacttaacagaggagaaagtggatggtcatactcaacctggcggcagcgcaaaagatg

SEQ ID NO: 49377 - DNA, 103 bp, Artificial Sequence
  Synthetic Polynucleotide
taatacgactcactatagggtctttttgaaattgatggagtatgacctacaacagaggagagtaggtatgactccatcaaacctggcggcagcgcaaaagatg

SEQ ID NO: 49378 - DNA, 103 bp, Artificial Sequence
  Synthetic Polynucleotide
taatacgactcactatagggtaagctctttttgaaattgatggagtatgaaacagaggagatcatacatgatcaatttcaacctggcggcagcgcaaaagatg

SEQ ID NO: 49379 - DNA, 103 bp, Artificial Sequence
  Synthetic Polynucleotide
taatacgactcactatagggccatataagctctttttgaaattgatggagaacagaggagactccatatgtttcaaaaaaacctggcggcagcgcaaaagatg

SEQ ID NO: 49380 - DNA, 103 bp, Artificial Sequence
  Synthetic Polynucleotide
taatacgactcactatagggcgttgccatataagctctttttgaaattgaaacagaggagatcaattatgaaaagagctaacctggcggcagcgcaaaagatg

SEQ ID NO: 49381 - DNA, 103 bp, Artificial Sequence
  Synthetic Polynucleotide
taatacgactcactatagggcacttatgaggatttagtaccatacactgtaacagaggagaacagtgatgggtactaaaaacctggcggcagcgcaaaagatg

SEQ ID NO: 49382 - DNA, 103 bp, Artificial Sequence
  Synthetic Polynucleotide
taatacgactcactatagggatagtcgttgccatataagctctttttgaaaacagaggagattcaaaatgagcttatataacctggcggcagcgcaaaagatg

SEQ ID NO: 49383 - DNA, 103 bp, Artificial Sequence
  Synthetic Polynucleotide
taatacgactcactatagggctaaaatagtcgttgccatataagctctttaacagaggagaaaagagatgatatggcaaaacctggcggcagcgcaaaagatg

SEQ ID NO: 49384 - DNA, 103 bp, Artificial Sequence
  Synthetic Polynucleotide
taatacgactcactatagggcatttctaaaatagtcgttgccatataagcaacagaggagagcttatatggcaacgactaacctggcggcagcgcaaaagatg

SEQ ID NO: 49385 - DNA, 103 bp, Artificial Sequence
  Synthetic Polynucleotide
taatacgactcactatagggtttaccatttctaaaatagtcgttgccataaacagaggagatatggcatggactattttaacctggcggcagcgcaaaagatg

SEQ ID NO: 49386 - DNA, 103 bp, Artificial Sequence
  Synthetic Polynucleotide
taatacgactcactatagggtatcctttaccatttctaaaatagtcgttgaacagaggagacaacgaatgttttagaaaaacctggcggcagcgcaaaagatg

SEQ ID NO: 49387 - DNA, 103 bp, Artificial Sequence
  Synthetic Polynucleotide
taatacgactcactatagggatttttatcctttaccatttctaaaatagtaacagaggagaactattatggaaatggtaaacctggcggcagcgcaaaagatg

SEQ ID NO: 49388 - DNA, 103 bp, Artificial Sequence
  Synthetic Polynucleotide
taatacgactcactatagggaaaaaatttttatcctttaccatttctaaaaacagaggagatttagaatgggtaaaggaaacctggcggcagcgcaaaagatg

SEQ ID NO: 49389 - DNA, 103 bp, Artificial Sequence
  Synthetic Polynucleotide
taatacgactcactatagggcatctaaaaaatttttatcctttaccatttaacagaggagaaaatggatgaggataaaaaacctggcggcagcgcaaaagatg

SEQ ID NO: 49390 - DNA, 103 bp, Artificial Sequence
  Synthetic Polynucleotide
taatacgactcactatagggtactacatctaaaaaatttttatcctttacaacagaggagagtaaagatgaaaaattttaacctggcggcagcgcaaaagatg

SEQ ID NO: 49391 - DNA, 103 bp, Artificial Sequence
  Synthetic Polynucleotide
taatacgactcactatagggttagatactacatctaaaaaatttttatccaacagaggagaggataaatgttttttagaaacctggcggcagcgcaaaagatg

SEQ ID NO: 49392 - DNA, 103 bp, Artificial Sequence
  Synthetic Polynucleotide
taatacgactcactatagggatatacacttatgaggatttagtaccatacaacagaggagagtatggatgtaaatcctcaacctggcggcagcgcaaaagatg

SEQ ID NO: 49393 - DNA, 103 bp, Artificial Sequence
  Synthetic Polynucleotide
taatacgactcactatagggtagttttagatactacatctaaaaaattttaacagaggagaaaaattatgtagatgtagaacctggcggcagcgcaaaagatg

SEQ ID NO: 49394 - DNA, 103 bp, Artificial Sequence
  Synthetic Polynucleotide
taatacgactcactataggggaacgtagttttagatactacatctaaaaaaacagaggagatttttaatggtagtatctaacctggcggcagcgcaaaagatg

SEQ ID NO: 49395 - DNA, 103 bp, Artificial Sequence
  Synthetic Polynucleotide
taatacgactcactatagggtcatcgaacgtagttttagatactacatctaacagaggagaagatgtatgatctaaaacaacctggcggcagcgcaaaagatg

SEQ ID NO: 49396 - DNA, 103 bp, Artificial Sequence
  Synthetic Polynucleotide
taatacgactcactatagggggaattcatcgaacgtagttttagatactaaacagaggagatagtatatgaaactacgtaacctggcggcagcgcaaaagatg

SEQ ID NO: 49397 - DNA, 103 bp, Artificial Sequence
  Synthetic Polynucleotide
taatacgactcactatagggagataggaattcatcgaacgtagttttagaaacagaggagatctaaaatgacgttcgataacctggcggcagcgcaaaagatg

SEQ ID NO: 49398 - DNA, 103 bp, Artificial Sequence
  Synthetic Polynucleotide
taatacgactcactatagggactatagataggaattcatcgaacgtagttaacagaggagaaactacatgcgatgaattaacctggcggcagcgcaaaagatg

SEQ ID NO: 49399 - DNA, 103 bp, Artificial Sequence
  Synthetic Polynucleotide
taatacgactcactatagggctacgactatagataggaattcatcgaacgaacagaggagacgttcgatgaattcctataacctggcggcagcgcaaaagatg

SEQ ID NO: 49400 - DNA, 103 bp, Artificial Sequence
  Synthetic Polynucleotide
taatacgactcactataggggtgatctacgactatagataggaattcatcaacagaggagagatgaaatgctatctataaacctggcggcagcgcaaaagatg

SEQ ID NO: 49401 - DNA, 103 bp, Artificial Sequence
  Synthetic Polynucleotide
taatacgactcactatagggttaacgtgatctacgactatagataggaataacagaggagaattcctatgtatagtcgtaacctggcggcagcgcaaaagatg

SEQ ID NO: 49402 - DNA, 103 bp, Artificial Sequence
  Synthetic Polynucleotide
taatacgactcactatagggatgatttaacgtgatctacgactatagataaacagaggagatatctaatgtcgtagatcaacctggcggcagcgcaaaagatg

SEQ ID NO: 49403 - DNA, 103 bp, Artificial Sequence
  Synthetic Polynucleotide
taatacgactcactatagggtagatatatacacttatgaggatttagtacaacagaggagagtactaatgcctcataagaacctggcggcagcgcaaaagatg

SEQ ID NO: 49404 - DNA, 103 bp, Artificial Sequence
  Synthetic Polynucleotide
taatacgactcactatagggcgtagatgatttaacgtgatctacgactataacagaggagaatagtcatggatcacgttaacctggcggcagcgcaaaagatg

SEQ ID NO: 49405 - DNA, 103 bp, Artificial Sequence
  Synthetic Polynucleotide
taatacgactcactatagggccatccgtagatgatttaacgtgatctacgaacagaggagacgtagaatgcgttaaatcaacctggcggcagcgcaaaagatg

SEQ ID NO: 49406 - DNA, 103 bp, Artificial Sequence
  Synthetic Polynucleotide
taatacgactcactatagggatcatccatccgtagatgatttaacgtgataacagaggagaatcacgatgaatcatctaaacctggcggcagcgcaaaagatg

SEQ ID NO: 49407 - DNA, 103 bp, Artificial Sequence
  Synthetic Polynucleotide
taatacgactcactatagggtctatatcatccatccgtagatgatttaacaacagaggagagttaaaatgtctacggataacctggcggcagcgcaaaagatg

SEQ ID NO: 49408 - DNA, 103 bp, Artificial Sequence
  Synthetic Polynucleotide
taatacgactcactatagggaaggatctatatcatccatccgtagatgataacagaggagaatcatcatgggatggatgaacctggcggcagcgcaaaagatg

SEQ ID NO: 49409 - DNA, 103 bp, Artificial Sequence
  Synthetic Polynucleotide
taatacgactcactatagggtgtgtaaggatctatatcatccatccgtagaacagaggagactacggatggatgatataaacctggcggcagcgcaaaagatg

SEQ ID NO: 49410 - DNA, 103 bp, Artificial Sequence
  Synthetic Polynucleotide
taatacgactcactatagggttatttgtgtaaggatctatatcatccatcaacagaggagagatggaatgtatagatccaacctggcggcagcgcaaaagatg

SEQ ID NO: 49411 - DNA, 103 bp, Artificial Sequence
  Synthetic Polynucleotide
taatacgactcactatagggtgtaattatttgtgtaaggatctatatcataacagaggagaatgataatgatccttacaaacctggcggcagcgcaaaagatg

SEQ ID NO: 49412 - DNA, 103 bp, Artificial Sequence
  Synthetic Polynucleotide
taatacgactcactatagggggttttgtaattatttgtgtaaggatctataacagaggagaatagatatgtacacaaataacctggcggcagcgcaaaagatg

SEQ ID NO: 49413 - DNA, 103 bp, Artificial Sequence
  Synthetic Polynucleotide
taatacgactcactatagggttatcggttttgtaattatttgtgtaaggaaacagaggagatccttaatgaaataattaaacctggcggcagcgcaaaagatg

SEQ ID NO: 49414 - DNA, 103 bp, Artificial Sequence
  Synthetic Polynucleotide
taatacgactcactatagggtactctagatatatacacttatgaggatttaacagaggagaaaatccatgtaagtgtataacctggcggcagcgcaaaagatg

SEQ ID NO: 49415 - DNA, 103 bp, Artificial Sequence
  Synthetic Polynucleotide
taatacgactcactatagggtccatttatcggttttgtaattatttgtgtaacagaggagaacacaaatgattacaaaaaacctggcggcagcgcaaaagatg

SEQ ID NO: 49416 - DNA, 103 bp, Artificial Sequence
  Synthetic Polynucleotide
taatacgactcactatagggccatttccatttatcggttttgtaattattaacagaggagaaataatatgaaaaccgataacctggcggcagcgcaaaagatg

SEQ ID NO: 49417 - DNA, 103 bp, Artificial Sequence
  Synthetic Polynucleotide
taatacgactcactatagggcttatccatttccatttatcggttttgtaaaacagaggagattacaaatgcgataaatgaacctggcggcagcgcaaaagatg

SEQ ID NO: 49418 - DNA, 103 bp, Artificial Sequence
  Synthetic Polynucleotide
taatacgactcactatagggatacgcttatccatttccatttatcggtttaacagaggagaaaaccgatgaatggaaataacctggcggcagcgcaaaagatg

SEQ ID NO: 49419 - DNA, 103 bp, Artificial Sequence
  Synthetic Polynucleotide
taatacgactcactatagggatttcatacgcttatccatttccatttatcaacagaggagagataaaatgaaatggataaacctggcggcagcgcaaaagatg

SEQ ID NO: 49420 - DNA, 103 bp, Artificial Sequence
  Synthetic Polynucleotide
taatacgactcactataggggagagatttcatacgcttatccatttccataacagaggagaatggaaatggataagcgtaacctggcggcagcgcaaaagatg

SEQ ID NO: 49421 - DNA, 103 bp, Artificial Sequence
  Synthetic Polynucleotide
taatacgactcactatagggattgcgagagatttcatacgcttatccattaacagaggagaaatggaatggcgtatgaaaacctggcggcagcgcaaaagatg

SEQ ID NO: 49422 - DNA, 103 bp, Artificial Sequence
  Synthetic Polynucleotide
taatacgactcactatagggcggtcattgcgagagatttcatacgcttataacagaggagaataagcatgtgaaatctcaacctggcggcagcgcaaaagatg

SEQ ID NO: 49423 - DNA, 103 bp, Artificial Sequence
  Synthetic Polynucleotide
taatacgactcactataggggaaagcggtcattgcgagagatttcatacgaacagaggagacgtatgatgtctctcgcaaacctggcggcagcgcaaaagatg

SEQ ID NO: 49424 - DNA, 103 bp, Artificial Sequence
  Synthetic Polynucleotide
taatacgactcactatagggccaaagaaagcggtcattgcgagagatttcaacagaggagagaaatcatgcgcaatgacaacctggcggcagcgcaaaagatg

SEQ ID NO: 49425 - DNA, 103 bp, Artificial Sequence
  Synthetic Polynucleotide
taatacgactcactatagggaacattactctagatatatacacttatgagaacagaggagactcataatggtatatatcaacctggcggcagcgcaaaagatg

SEQ ID NO: 49426 - DNA, 103 bp, Artificial Sequence
  Synthetic Polynucleotide
taatacgactcactataggggctctccaaagaaagcggtcattgcgagagaacagaggagactctcgatgtgaccgcttaacctggcggcagcgcaaaagatg

SEQ ID NO: 49427 - DNA, 103 bp, Artificial Sequence
  Synthetic Polynucleotide
taatacgactcactatagggggttagctctccaaagaaagcggtcattgcaacagaggagagcaatgatggctttctttaacctggcggcagcgcaaaagatg

SEQ ID NO: 49428 - DNA, 103 bp, Artificial Sequence
  Synthetic Polynucleotide
taatacgactcactatagggaatgtggttagctctccaaagaaagcggtcaacagaggagagaccgcatgctttggagaaacctggcggcagcgcaaaagatg

SEQ ID NO: 49429 - DNA, 103 bp, Artificial Sequence
  Synthetic Polynucleotide
taatacgactcactatagggtatctaatgtggttagctctccaaagaaagaacagaggagactttctatggagagctaaaacctggcggcagcgcaaaagatg

SEQ ID NO: 49430 - DNA, 103 bp, Artificial Sequence
  Synthetic Polynucleotide
taatacgactcactatagggcataatatctaatgtggttagctctccaaaaacagaggagatttggaatgctaaccacaaacctggcggcagcgcaaaagatg

SEQ ID NO: 49431 - DNA, 103 bp, Artificial Sequence
  Synthetic Polynucleotide
taatacgactcactatagggaatgccataatatctaatgtggttagctctaacagaggagaagagctatgcacattagaaacctggcggcagcgcaaaagatg

SEQ ID NO: 49432 - DNA, 103 bp, Artificial Sequence
  Synthetic Polynucleotide
taatacgactcactatagggttattaatgccataatatctaatgtggttaaacagaggagataaccaatgtagatattaaacctggcggcagcgcaaaagatg

SEQ ID NO: 49433 - DNA, 103 bp, Artificial Sequence
  Synthetic Polynucleotide
taatacgactcactatagggagacattattaatgccataatatctaatgtaacagaggagaacattaatgattatggcaaacctggcggcagcgcaaaagatg

SEQ ID NO: 49434 - DNA, 103 bp, Artificial Sequence
  Synthetic Polynucleotide
taatacgactcactatagggaatatagacattattaatgccataatatctaacagaggagaagatatatgggcattaataacctggcggcagcgcaaaagatg

SEQ ID NO: 49435 - DNA, 103 bp, Artificial Sequence
  Synthetic Polynucleotide
taatacgactcactataggggtttaaatatagacattattaatgccataaaacagaggagattatggatgtaataatgtaacctggcggcagcgcaaaagatg

SEQ ID NO: 49436 - DNA, 103 bp, Artificial Sequence
  Synthetic Polynucleotide
taatacgactcactatagggaattaaacattactctagatatatacacttaacagaggagaaagtgtatgtatctagagaacctggcggcagcgcaaaagatg

SEQ ID NO: 49437 - DNA, 103 bp, Artificial Sequence
  Synthetic Polynucleotide
taatacgactcactatagggatggcgtttaaatatagacattattaatgcaacagaggagagcattaatgatgtctataaacctggcggcagcgcaaaagatg

SEQ ID NO: 49438 - DNA, 103 bp, Artificial Sequence
  Synthetic Polynucleotide
taatacgactcactatagggtttggatggcgtttaaatatagacattattaacagaggagaaataatatgtatatttaaaacctggcggcagcgcaaaagatg

SEQ ID NO: 49439 - DNA, 103 bp, Artificial Sequence
  Synthetic Polynucleotide
taatacgactcactatagggtattgtttggatggcgtttaaatatagacaaacagaggagatgtctaatgttaaacgccaacctggcggcagcgcaaaagatg

SEQ ID NO: 49440 - DNA, 103 bp, Artificial Sequence
  Synthetic Polynucleotide
taatacgactcactatagggaatggtattgtttggatggcgtttaaatataacagaggagaatatttatgcgccatccaaacctggcggcagcgcaaaagatg

SEQ ID NO: 49441 - DNA, 103 bp, Artificial Sequence
  Synthetic Polynucleotide
taatacgactcactataggggaaaaaatggtattgtttggatggcgtttaaacagaggagataaacgatgtccaaacaaaacctggcggcagcgcaaaagatg

SEQ ID NO: 49442 - DNA, 103 bp, Artificial Sequence
  Synthetic Polynucleotide
taatacgactcactatagggccactgaaaaaatggtattgtttggatggcaacagaggagagccatcatgacaataccaaacctggcggcagcgcaaaagatg

SEQ ID NO: 49443 - DNA, 103 bp, Artificial Sequence
  Synthetic Polynucleotide
taatacgactcactatagggcttatccactgaaaaaatggtattgtttggaacagaggagaccaaacatgaccatttttaacctggcggcagcgcaaaagatg

SEQ ID NO: 49444 - DNA, 103 bp, Artificial Sequence
  Synthetic Polynucleotide
taatacgactcactatagggccatccttatccactgaaaaaatggtattgaacagaggagacaatacatgtttttcagtaacctggcggcagcgcaaaagatg

SEQ ID NO: 49445 - DNA, 103 bp, Artificial Sequence
  Synthetic Polynucleotide
taatacgactcactatagggactgaccatccttatccactgaaaaaatggaacagaggagaccatttatgcagtggataaacctggcggcagcgcaaaagatg

SEQ ID NO: 49446 - DNA, 103 bp, Artificial Sequence
  Synthetic Polynucleotide
taatacgactcactatagggcataaactgaccatccttatccactgaaaaaacagaggagattttcaatggataaggataacctggcggcagcgcaaaagatg

SEQ ID NO: 49447 - DNA, 103 bp, Artificial Sequence
  Synthetic Polynucleotide
taatacgactcactatagggtgataaattaaacattactctagatatataaacagaggagatatataatgagagtaatgaacctggcggcagcgcaaaagatg

SEQ ID NO: 49448 - DNA, 103 bp, Artificial Sequence
  Synthetic Polynucleotide
taatacgactcactatagggtcaatcataaactgaccatccttatccactaacagaggagaagtggaatgggatggtcaaacctggcggcagcgcaaaagatg

SEQ ID NO: 49449 - DNA, 103 bp, Artificial Sequence
  Synthetic Polynucleotide
taatacgactcactatagggcgaaatcaatcataaactgaccatccttataacagaggagaataaggatggtcagtttaaacctggcggcagcgcaaaagatg

SEQ ID NO: 49450 - DNA, 103 bp, Artificial Sequence
  Synthetic Polynucleotide
taatacgactcactataggggtattcgaaatcaatcataaactgaccatcaacagaggagagatggtatgtttatgattaacctggcggcagcgcaaaagatg

SEQ ID NO: 49451 - DNA, 103 bp, Artificial Sequence
  Synthetic Polynucleotide
taatacgactcactataggggtatcgtattcgaaatcaatcataaactgaaacagaggagatcagttatggattgatttaacctggcggcagcgcaaaagatg

SEQ ID NO: 49452 - DNA, 103 bp, Artificial Sequence
  Synthetic Polynucleotide
taatacgactcactatagggtataagtatcgtattcgaaatcaatcataaaacagaggagattatgaatgatttcgaataacctggcggcagcgcaaaagatg

SEQ ID NO: 49453 - DNA, 103 bp, Artificial Sequence
  Synthetic Polynucleotide
taatacgactcactatagggagccttataagtatcgtattcgaaatcaataacagaggagaattgatatggaatacgataacctggcggcagcgcaaaagatg

SEQ ID NO: 49454 - DNA, 103 bp, Artificial Sequence
  Synthetic Polynucleotide
taatacgactcactatagggtgagaagccttataagtatcgtattcgaaaaacagaggagatttcgaatgcgatacttaaacctggcggcagcgcaaaagatg

SEQ ID NO: 49455 - DNA, 103 bp, Artificial Sequence
  Synthetic Polynucleotide
taatacgactcactatagggaatattgagaagccttataagtatcgtattaacagaggagaaatacgatgcttataaggaacctggcggcagcgcaaaagatg

SEQ ID NO: 49456 - DNA, 103 bp, Artificial Sequence
  Synthetic Polynucleotide
taatacgactcactatagggatccaaatattgagaagccttataagtatcaacagaggagagatactatgaaggcttctaacctggcggcagcgcaaaagatg

SEQ ID NO: 49457 - DNA, 103 bp, Artificial Sequence
  Synthetic Polynucleotide
taatacgactcactatagggggcaaatccaaatattgagaagccttataaaacagaggagattataaatgttctcaataaacctggcggcagcgcaaaagatg

SEQ ID NO: 49458 - DNA, 103 bp, Artificial Sequence
  Synthetic Polynucleotide
taatacgactcactatagggggaaattaatgccgtctattagcacagacgaacagaggagacgtctgatgtaatagacgaacctggcggcagcgcaaaagatg

SEQ ID NO: 49459 - DNA, 103 bp, Artificial Sequence
  Synthetic Polynucleotide
taatacgactcactatagggccatttgataaattaaacattactctagataacagaggagaatctagatgaatgtttaaaacctggcggcagcgcaaaagatg

SEQ ID NO: 49460 - DNA, 103 bp, Artificial Sequence
  Synthetic Polynucleotide
taatacgactcactatagggtaaggggcaaatccaaatattgagaagcctaacagaggagaaggcttatgaatatttggaacctggcggcagcgcaaaagatg

SEQ ID NO: 49461 - DNA, 103 bp, Artificial Sequence
  Synthetic Polynucleotide
taatacgactcactatagggcggagtaaggggcaaatccaaatattgagaaacagaggagatctcaaatgttggatttgaacctggcggcagcgcaaaagatg

SEQ ID NO: 49462 - DNA, 103 bp, Artificial Sequence
  Synthetic Polynucleotide
taatacgactcactataggggatatcggagtaaggggcaaatccaaatataacagaggagaatatttatgtttgcccctaacctggcggcagcgcaaaagatg

SEQ ID NO: 49463 - DNA, 103 bp, Artificial Sequence
  Synthetic Polynucleotide
taatacgactcactatagggctccagatatcggagtaaggggcaaatccaaacagaggagatggattatgcccttactcaacctggcggcagcgcaaaagatg

SEQ ID NO: 49464 - DNA, 103 bp, Artificial Sequence
  Synthetic Polynucleotide
taatacgactcactatagggttcatctccagatatcggagtaaggggcaaaacagaggagattgcccatgactccgataaacctggcggcagcgcaaaagatg

SEQ ID NO: 49465 - DNA, 103 bp, Artificial Sequence
  Synthetic Polynucleotide
taatacgactcactatagggttgcattcatctccagatatcggagtaaggaacagaggagaccttacatggatatctggaacctggcggcagcgcaaaagatg

SEQ ID NO: 49466 - DNA, 103 bp, Artificial Sequence
  Synthetic Polynucleotide
taatacgactcactataggggagtcttgcattcatctccagatatcggagaacagaggagactccgaatgctggagatgaacctggcggcagcgcaaaagatg

SEQ ID NO: 49467 - DNA, 103 bp, Artificial Sequence
  Synthetic Polynucleotide
taatacgactcactatagggtgcgtgagtcttgcattcatctccagatataacagaggagaatatctatggatgaatgcaacctggcggcagcgcaaaagatg

SEQ ID NO: 49468 - DNA, 103 bp, Artificial Sequence
  Synthetic Polynucleotide
taatacgactcactatagggctcgatgcgtgagtcttgcattcatctccaaacagaggagatggagaatgatgcaagacaacctggcggcagcgcaaaagatg

SEQ ID NO: 49469 - DNA, 103 bp, Artificial Sequence
  Synthetic Polynucleotide
taatacgactcactatagggctatactcgatgcgtgagtcttgcattcataacagaggagaatgaatatgagactcacgaacctggcggcagcgcaaaagatg

SEQ ID NO: 49470 - DNA, 103 bp, Artificial Sequence
  Synthetic Polynucleotide
taatacgactcactatagggatgaaccatttgataaattaaacattactcaacagaggagagagtaaatgttaatttataacctggcggcagcgcaaaagatg

SEQ ID NO: 49471 - DNA, 103 bp, Artificial Sequence
  Synthetic Polynucleotide
taatacgactcactatagggtttggctatactcgatgcgtgagtcttgcaaacagaggagatgcaagatgcacgcatcgaacctggcggcagcgcaaaagatg

SEQ ID NO: 49472 - DNA, 103 bp, Artificial Sequence
  Synthetic Polynucleotide
taatacgactcactatagggaattgtttggctatactcgatgcgtgagtcaacagaggagagactcaatgatcgagtataacctggcggcagcgcaaaagatg

SEQ ID NO: 49473 - DNA, 103 bp, Artificial Sequence
  Synthetic Polynucleotide
taatacgactcactatagggacgccaattgtttggctatactcgatgcgtaacagaggagaacgcatatggtatagccaaacctggcggcagcgcaaaagatg

SEQ ID NO: 49474 - DNA, 103 bp, Artificial Sequence
  Synthetic Polynucleotide
taatacgactcactatagggcacacacgccaattgtttggctatactcgaaacagaggagatcgagtatggccaaacaaaacctggcggcagcgcaaaagatg

SEQ ID NO: 49475 - DNA, 103 bp, Artificial Sequence
  Synthetic Polynucleotide
taatacgactcactatagggatgtccacacacgccaattgtttggctataaacagaggagatatagcatgacaattggcaacctggcggcagcgcaaaagatg

SEQ ID NO: 49476 - DNA, 103 bp, Artificial Sequence
  Synthetic Polynucleotide
taatacgactcactatagggtaataatgtccacacacgccaattgtttggaacagaggagaccaaacatgtggcgtgtgaacctggcggcagcgcaaaagatg

SEQ ID NO: 49477 - DNA, 103 bp, Artificial Sequence
  Synthetic Polynucleotide
taatacgactcactatagggctctttaataatgtccacacacgccaattgaacagaggagacaattgatgtgtgtggacaacctggcggcagcgcaaaagatg

SEQ ID NO: 49478 - DNA, 103 bp, Artificial Sequence
  Synthetic Polynucleotide
taatacgactcactatagggatatcctctttaataatgtccacacacgccaacagaggagaggcgtgatgggacattataacctggcggcagcgcaaaagatg

SEQ ID NO: 49479 - DNA, 103 bp, Artificial Sequence
  Synthetic Polynucleotide
taatacgactcactatagggcgctaatatcctctttaataatgtccacacaacagaggagagtgtggatgttattaaagaacctggcggcagcgcaaaagatg

SEQ ID NO: 49480 - DNA, 103 bp, Artificial Sequence
  Synthetic Polynucleotide
taatacgactcactatagggatattcgctaatatcctctttaataatgtcaacagaggagagacattatgaaagaggataacctggcggcagcgcaaaagatg

SEQ ID NO: 49481 - DNA, 103 bp, Artificial Sequence
  Synthetic Polynucleotide
taatacgactcactatagggatattatgaaccatttgataaattaaacataacagaggagaatgtttatgttatcaaataacctggcggcagcgcaaaagatg

SEQ ID NO: 49482 - DNA, 103 bp, Artificial Sequence
  Synthetic Polynucleotide
taatacgactcactatagggttgatatattcgctaatatcctctttaataaacagaggagatattaaatgggatattagaacctggcggcagcgcaaaagatg

SEQ ID NO: 49483 - DNA, 103 bp, Artificial Sequence
  Synthetic Polynucleotide
taatacgactcactatagggtagttttgatatattcgctaatatcctcttaacagaggagaaagaggatgttagcgaataacctggcggcagcgcaaaagatg

SEQ ID NO: 49484 - DNA, 103 bp, Artificial Sequence
  Synthetic Polynucleotide
taatacgactcactataggggggtgtagttttgatatattcgctaatatcaacagaggagagatattatggaatatatcaacctggcggcagcgcaaaagatg

SEQ ID NO: 49485 - DNA, 103 bp, Artificial Sequence
  Synthetic Polynucleotide
taatacgactcactatagggagacggggtgtagttttgatatattcgctaaacagaggagatagcgaatgtatcaaaacaacctggcggcagcgcaaaagatg

SEQ ID NO: 49486 - DNA, 103 bp, Artificial Sequence
  Synthetic Polynucleotide
taatacgactcactataggggtttaagacggggtgtagttttgatatattaacagaggagaaatataatgaaactacacaacctggcggcagcgcaaaagatg

SEQ ID NO: 49487 - DNA, 103 bp, Artificial Sequence
  Synthetic Polynucleotide
taatacgactcactatagggaaatcgtttaagacggggtgtagttttgataacagaggagaatcaaaatgacaccccgtaacctggcggcagcgcaaaagatg

SEQ ID NO: 49488 - DNA, 103 bp, Artificial Sequence
  Synthetic Polynucleotide
taatacgactcactatagggtttataaatcgtttaagacggggtgtagttaacagaggagaaactacatgccgtcttaaaacctggcggcagcgcaaaagatg

SEQ ID NO: 49489 - DNA, 103 bp, Artificial Sequence
  Synthetic Polynucleotide
taatacgactcactatagggatttttttataaatcgtttaagacggggtgaacagaggagacaccccatgttaaacgataacctggcggcagcgcaaaagatg

SEQ ID NO: 49490 - DNA, 103 bp, Artificial Sequence
  Synthetic Polynucleotide
taatacgactcactataggggcggtatttttttataaatcgtttaagacgaacagaggagacgtcttatgcgatttataaacctggcggcagcgcaaaagatg

SEQ ID NO: 49491 - DNA, 103 bp, Artificial Sequence
  Synthetic Polynucleotide
taatacgactcactatagggctattgcggtatttttttataaatcgtttaaacagaggagataaacgatgtataaaaaaaacctggcggcagcgcaaaagatg

SEQ ID NO: 49492 - DNA, 103 bp, Artificial Sequence
  Synthetic Polynucleotide
taatacgactcactataggggatccatattatgaaccatttgataaattaaacagaggagataatttatgaaatggttcaacctggcggcagcgcaaaagatg

SEQ ID NO: 49493 - DNA, 103 bp, Artificial Sequence
  Synthetic Polynucleotide
taatacgactcactatagggctgatctattgcggtatttttttataaatcaacagaggagagatttaatgaaaaataccaacctggcggcagcgcaaaagatg

SEQ ID NO: 49494 - DNA, 103 bp, Artificial Sequence
  Synthetic Polynucleotide
taatacgactcactatagggagtatctgatctattgcggtatttttttataacagaggagaataaaaatgtaccgcaataacctggcggcagcgcaaaagatg

SEQ ID NO: 49495 - DNA, 103 bp, Artificial Sequence
  Synthetic Polynucleotide
taatacgactcactatagggatacgagtatctgatctattgcggtattttaacagaggagaaaaataatgcaatagatcaacctggcggcagcgcaaaagatg

SEQ ID NO: 49496 - DNA, 103 bp, Artificial Sequence
  Synthetic Polynucleotide
taatacgactcactataggggactgatacgagtatctgatctattgcggtaacagaggagaaccgcaatggatcagataaacctggcggcagcgcaaaagatg

SEQ ID NO: 49497 - DNA, 103 bp, Artificial Sequence
  Synthetic Polynucleotide
taatacgactcactatagggatcttgactgatacgagtatctgatctattaacagaggagaaatagaatggatactcgtaacctggcggcagcgcaaaagatg

SEQ ID NO: 49498 - DNA, 103 bp, Artificial Sequence
  Synthetic Polynucleotide
taatacgactcactatagggtctgtatcttgactgatacgagtatctgataacagaggagaatcagaatgtcgtatcagaacctggcggcagcgcaaaagatg

SEQ ID NO: 49499 - DNA, 103 bp, Artificial Sequence
  Synthetic Polynucleotide
taatacgactcactataggggcttttctgtatcttgactgatacgagtataacagaggagaatactcatgtcagtcaagaacctggcggcagcgcaaaagatg

SEQ ID NO: 49500 - DNA, 103 bp, Artificial Sequence
  Synthetic Polynucleotide
taatacgactcactatagggtttaagcttttctgtatcttgactgatacgaacagaggagacgtatcatgcaagatacaaacctggcggcagcgcaaaagatg

SEQ ID NO: 49501 - DNA, 103 bp, Artificial Sequence
  Synthetic Polynucleotide
taatacgactcactataggggctattttaagcttttctgtatcttgactgaacagaggagacagtcaatgtacagaaaaaacctggcggcagcgcaaaagatg

SEQ ID NO: 49502 - DNA, 103 bp, Artificial Sequence
  Synthetic Polynucleotide
taatacgactcactatagggctagagctattttaagcttttctgtatcttaacagaggagaaagataatgaaaagcttaaacctggcggcagcgcaaaagatg

SEQ ID NO: 49503 - DNA, 103 bp, Artificial Sequence
  Synthetic Polynucleotide
taatacgactcactatagggatgaggatccatattatgaaccatttgataaacagaggagatatcaaatggttcataataacctggcggcagcgcaaaagatg

SEQ ID NO: 49504 - DNA, 103 bp, Artificial Sequence
  Synthetic Polynucleotide
taatacgactcactatagggtttagctagagctattttaagcttttctgtaacagaggagaacagaaatgcttaaaataaacctggcggcagcgcaaaagatg

SEQ ID NO: 49505 - DNA, 103 bp, Artificial Sequence
  Synthetic Polynucleotide
taatacgactcactatagggatgcctttagctagagctattttaagctttaacagaggagaaaagctatgaatagctctaacctggcggcagcgcaaaagatg

SEQ ID NO: 49506 - DNA, 103 bp, Artificial Sequence
  Synthetic Polynucleotide
taatacgactcactatagggaatctatgcctttagctagagctattttaaaacagaggagattaaaaatgctctagctaaacctggcggcagcgcaaaagatg

SEQ ID NO: 49507 - DNA, 103 bp, Artificial Sequence
  Synthetic Polynucleotide
taatacgactcactatagggttcgtaatctatgcctttagctagagctataacagaggagaatagctatggctaaaggcaacctggcggcagcgcaaaagatg

SEQ ID NO: 49508 - DNA, 103 bp, Artificial Sequence
  Synthetic Polynucleotide
taatacgactcactatagggatatattcgtaatctatgcctttagctagaaacagaggagatctagcatgaggcatagaaacctggcggcagcgcaaaagatg

SEQ ID NO: 49509 - DNA, 103 bp, Artificial Sequence
  Synthetic Polynucleotide
taatacgactcactatagggcttttatatattcgtaatctatgcctttagaacagaggagactaaagatgtagattacgaacctggcggcagcgcaaaagatg

SEQ ID NO: 49510 - DNA, 103 bp, Artificial Sequence
  Synthetic Polynucleotide
taatacgactcactatagggagcgtcttttatatattcgtaatctatgccaacagaggagaggcataatgtacgaatataacctggcggcagcgcaaaagatg

SEQ ID NO: 49511 - DNA, 103 bp, Artificial Sequence
  Synthetic Polynucleotide
taatacgactcactatagggtaacaagcgtcttttatatattcgtaatctaacagaggagaagattaatgatatataaaaacctggcggcagcgcaaaagatg

SEQ ID NO: 49512 - DNA, 103 bp, Artificial Sequence
  Synthetic Polynucleotide
taatacgactcactatagggcttattaacaagcgtcttttatatattcgtaacagaggagaacgaatatgtaaaagacgaacctggcggcagcgcaaaagatg

SEQ ID NO: 49513 - DNA, 103 bp, Artificial Sequence
  Synthetic Polynucleotide
taatacgactcactatagggatttacttattaacaagcgtcttttatataaacagaggagatatataatggacgcttgtaacctggcggcagcgcaaaagatg

SEQ ID NO: 49514 - DNA, 103 bp, Artificial Sequence
  Synthetic Polynucleotide
taatacgactcactatagggttgtcatgaggatccatattatgaaccattaacagaggagaaatggtatgtaatatggaaacctggcggcagcgcaaaagatg

SEQ ID NO: 49515 - DNA, 103 bp, Artificial Sequence
  Synthetic Polynucleotide
taatacgactcactatagggttttcatttacttattaacaagcgtcttttaacagaggagaaaaagaatgttgttaataaacctggcggcagcgcaaaagatg

SEQ ID NO: 49516 - DNA, 103 bp, Artificial Sequence
  Synthetic Polynucleotide
taatacgactcactataggggttttttttcatttacttattaacaagcgtaacagaggagaacgcttatgaataagtaaaacctggcggcagcgcaaaagatg

SEQ ID NO: 49517 - DNA, 103 bp, Artificial Sequence
  Synthetic Polynucleotide
taatacgactcactataggggactagttttttttcatttacttattaacaaacagaggagatgttaaatggtaaatgaaaacctggcggcagcgcaaaagatg

SEQ ID NO: 49518 - DNA, 103 bp, Artificial Sequence
  Synthetic Polynucleotide
taatacgactcactatagggtaaacgactagttttttttcatttacttataacagaggagaataagtatgtgaaaaaaaaacctggcggcagcgcaaaagatg

SEQ ID NO: 49519 - DNA, 103 bp, Artificial Sequence
  Synthetic Polynucleotide
taatacgactcactatagggtattataaacgactagttttttttcatttaaacagaggagataaatgatgaaaaactagaacctggcggcagcgcaaaagatg

SEQ ID NO: 49520 - DNA, 103 bp, Artificial Sequence
  Synthetic Polynucleotide
taatacgactcactatagggtgttttattataaacgactagttttttttcaacagaggagagaaaaaatgctagtcgttaacctggcggcagcgcaaaagatg

SEQ ID NO: 49521 - DNA, 103 bp, Artificial Sequence
  Synthetic Polynucleotide
taatacgactcactatagggtatcgtgttttattataaacgactagttttaacagaggagaaaaactatgcgtttataaaacctggcggcagcgcaaaagatg

SEQ ID NO: 49522 - DNA, 103 bp, Artificial Sequence
  Synthetic Polynucleotide
taatacgactcactatagggatccatatcgtgttttattataaacgactaaacagaggagatagtcgatgataataaaaaacctggcggcagcgcaaaagatg

SEQ ID NO: 49523 - DNA, 103 bp, Artificial Sequence
  Synthetic Polynucleotide
taatacgactcactatagggttggcatccatatcgtgttttattataaacaacagaggagagtttatatgaaaacacgaaacctggcggcagcgcaaaagatg

SEQ ID NO: 49524 - DNA, 103 bp, Artificial Sequence
  Synthetic Polynucleotide
taatacgactcactatagggctacgttggcatccatatcgtgttttattaaacagaggagataataaatgacgatatggaacctggcggcagcgcaaaagatg

SEQ ID NO: 49525 - DNA, 103 bp, Artificial Sequence
  Synthetic Polynucleotide
taatacgactcactatagggggaaattgtcatgaggatccatattatgaaaacagaggagattcataatgtggatcctcaacctggcggcagcgcaaaagatg

SEQ ID NO: 49526 - DNA, 103 bp, Artificial Sequence
  Synthetic Polynucleotide
taatacgactcactatagggtgatactacgttggcatccatatcgtgtttaacagaggagaaaacacatgatggatgccaacctggcggcagcgcaaaagatg

SEQ ID NO: 49527 - DNA, 103 bp, Artificial Sequence
  Synthetic Polynucleotide
taatacgactcactataggggaagatgatactacgttggcatccatatcgaacagaggagacgatatatgtgccaacgtaacctggcggcagcgcaaaagatg

SEQ ID NO: 49528 - DNA, 103 bp, Artificial Sequence
  Synthetic Polynucleotide
taatacgactcactatagggtagtggaagatgatactacgttggcatccaaacagaggagatggatgatgacgtagtataacctggcggcagcgcaaaagatg

SEQ ID NO: 49529 - DNA, 103 bp, Artificial Sequence
  Synthetic Polynucleotide
taatacgactcactatagggcgcgatagtggaagatgatactacgttggcaacagaggagagccaacatggtatcatctaacctggcggcagcgcaaaagatg

SEQ ID NO: 49530 - DNA, 103 bp, Artificial Sequence
  Synthetic Polynucleotide
taatacgactcactatagggtatgtcgcgatagtggaagatgatactacgaacagaggagacgtagtatgatcttccacaacctggcggcagcgcaaaagatg

SEQ ID NO: 49531 - DNA, 103 bp, Artificial Sequence
  Synthetic Polynucleotide
taatacgactcactatagggctatatatgtcgcgatagtggaagatgataaacagaggagatatcatatgccactatcgaacctggcggcagcgcaaaagatg

SEQ ID NO: 49532 - DNA, 103 bp, Artificial Sequence
  Synthetic Polynucleotide
taatacgactcactatagggagcgtctatatatgtcgcgatagtggaagaaacagaggagatcttccatgatcgcgacaaacctggcggcagcgcaaaagatg

SEQ ID NO: 49533 - DNA, 103 bp, Artificial Sequence
  Synthetic Polynucleotide
taatacgactcactataggggctaaagcgtctatatatgtcgcgatagtgaacagaggagacactatatggacatatataacctggcggcagcgcaaaagatg

SEQ ID NO: 49534 - DNA, 103 bp, Artificial Sequence
  Synthetic Polynucleotide
taatacgactcactatagggtctttgctaaagcgtctatatatgtcgcgaaacagaggagatcgcgaatgatatagacgaacctggcggcagcgcaaaagatg

SEQ ID NO: 49535 - DNA, 103 bp, Artificial Sequence
  Synthetic Polynucleotide
taatacgactcactatagggagcattctttgctaaagcgtctatatatgtaacagaggagaacatatatggacgctttaaacctggcggcagcgcaaaagatg

SEQ ID NO: 49536 - DNA, 103 bp, Artificial Sequence
  Synthetic Polynucleotide
taatacgactcactatagggtcttcggaaattgtcatgaggatccatattaacagaggagaaatatgatgcctcatgacaacctggcggcagcgcaaaagatg

SEQ ID NO: 49537 - DNA, 103 bp, Artificial Sequence
  Synthetic Polynucleotide
taatacgactcactatagggtccgaagcattctttgctaaagcgtctataaacagaggagatatagaatgtttagcaaaaacctggcggcagcgcaaaagatg

SEQ ID NO: 49538 - DNA, 103 bp, Artificial Sequence
  Synthetic Polynucleotide
taatacgactcactatagggctaattccgaagcattctttgctaaagcgtaacagaggagaacgcttatgcaaagaatgaacctggcggcagcgcaaaagatg

SEQ ID NO: 49539 - DNA, 103 bp, Artificial Sequence
  Synthetic Polynucleotide
taatacgactcactatagggctgttctaattccgaagcattctttgctaaaacagaggagattagcaatgaatgcttcgaacctggcggcagcgcaaaagatg

SEQ ID NO: 49540 - DNA, 103 bp, Artificial Sequence
  Synthetic Polynucleotide
taatacgactcactataggggaaccctgttctaattccgaagcattctttaacagaggagaaaagaaatgttcggaattaacctggcggcagcgcaaaagatg

SEQ ID NO: 49541 - DNA, 103 bp, Artificial Sequence
  Synthetic Polynucleotide
taatacgactcactatagggcggtagaaccctgttctaattccgaagcataacagaggagaatgcttatgaattagaacaacctggcggcagcgcaaaagatg

SEQ ID NO: 49542 - DNA, 103 bp, Artificial Sequence
  Synthetic Polynucleotide
taatacgactcactataggggtatgcggtagaaccctgttctaattccgaaacagaggagatcggaaatggaacagggtaacctggcggcagcgcaaaagatg

SEQ ID NO: 49543 - DNA, 103 bp, Artificial Sequence
  Synthetic Polynucleotide
taatacgactcactatagggatttcgtatgcggtagaaccctgttctaataacagaggagaattagaatggggttctacaacctggcggcagcgcaaaagatg

SEQ ID NO: 49544 - DNA, 103 bp, Artificial Sequence
  Synthetic Polynucleotide
taatacgactcactatagggtatttatttcgtatgcggtagaaccctgttaacagaggagaaacaggatgctaccgcataacctggcggcagcgcaaaagatg

SEQ ID NO: 49545 - DNA, 103 bp, Artificial Sequence
  Synthetic Polynucleotide
taatacgactcactatagggttcattatttatttcgtatgcggtagaaccaacagaggagaggttctatggcatacgaaaacctggcggcagcgcaaaagatg

SEQ ID NO: 49546 - DNA, 103 bp, Artificial Sequence
  Synthetic Polynucleotide
taatacgactcactatagggtccaattcattatttatttcgtatgcggtaaacagaggagataccgcatgcgaaataaaaacctggcggcagcgcaaaagatg

SEQ ID NO: 49547 - DNA, 103 bp, Artificial Sequence
  Synthetic Polynucleotide
taatacgactcactatagggtttcgtcttcggaaattgtcatgaggatccaacagaggagaggatccatgtgacaatttaacctggcggcagcgcaaaagatg

SEQ ID NO: 49548 - DNA, 103 bp, Artificial Sequence
  Synthetic Polynucleotide
taatacgactcactatagggctagttccaattcattatttatttcgtatgaacagaggagacatacgatgtaaataatgaacctggcggcagcgcaaaagatg

SEQ ID NO: 49549 - DNA, 103 bp, Artificial Sequence
  Synthetic Polynucleotide
taatacgactcactatagggaaatactagttccaattcattatttatttcaacagaggagagaaataatgaatgaattgaacctggcggcagcgcaaaagatg

SEQ ID NO: 49550 - DNA, 103 bp, Artificial Sequence
  Synthetic Polynucleotide
taatacgactcactatagggttaataaatactagttccaattcattatttaacagaggagaaaataaatgattggaactaacctggcggcagcgcaaaagatg

SEQ ID NO: 49551 - DNA, 103 bp, Artificial Sequence
  Synthetic Polynucleotide
taatacgactcactataggggcggcttaataaatactagttccaattcataacagaggagaatgaatatgaactagtataacctggcggcagcgcaaaagatg

SEQ ID NO: 49552 - DNA, 103 bp, Artificial Sequence
  Synthetic Polynucleotide
taatacgactcactatagggcaatggcggcttaataaatactagttccaaaacagaggagattggaaatggtatttattaacctggcggcagcgcaaaagatg

SEQ ID NO: 49553 - DNA, 103 bp, Artificial Sequence
  Synthetic Polynucleotide
taatacgactcactataggggtaatcaatggcggcttaataaatactagtaacagaggagaactagtatgtattaagccaacctggcggcagcgcaaaagatg

SEQ ID NO: 49554 - DNA, 103 bp, Artificial Sequence
  Synthetic Polynucleotide
taatacgactcactatagggtcaaagtaatcaatggcggcttaataaataaacagaggagatatttaatgagccgccataacctggcggcagcgcaaaagatg

SEQ ID NO: 49555 - DNA, 103 bp, Artificial Sequence
  Synthetic Polynucleotide
taatacgactcactatagggatttgtcaaagtaatcaatggcggcttaataacagaggagaattaagatgccattgattaacctggcggcagcgcaaaagatg

SEQ ID NO: 49556 - DNA, 103 bp, Artificial Sequence
  Synthetic Polynucleotide
taatacgactcactatagggactacatttgtcaaagtaatcaatggcggcaacagaggagagccgccatggattactttaacctggcggcagcgcaaaagatg

SEQ ID NO: 49557 - DNA, 103 bp, Artificial Sequence
  Synthetic Polynucleotide
taatacgactcactatagggtatttactacatttgtcaaagtaatcaatgaacagaggagacattgaatgctttgacaaaacctggcggcagcgcaaaagatg

SEQ ID NO: 49558 - DNA, 103 bp, Artificial Sequence
  Synthetic Polynucleotide
taatacgactcactatagggctcattttcgtcttcggaaattgtcatgagaacagaggagactcatgatgatttccgaaaacctggcggcagcgcaaaagatg

SEQ ID NO: 49559 - DNA, 103 bp, Artificial Sequence
  Synthetic Polynucleotide
taatacgactcactatagggggagatatttactacatttgtcaaagtaataacagaggagaattactatgacaaatgtaaacctggcggcagcgcaaaagatg

SEQ ID NO: 49560 - DNA, 103 bp, Artificial Sequence
  Synthetic Polynucleotide
taatacgactcactatagggatcgtggagatatttactacatttgtcaaaaacagaggagatttgacatgtgtagtaaaaacctggcggcagcgcaaaagatg

SEQ ID NO: 49561 - DNA, 103 bp, Artificial Sequence
  Synthetic Polynucleotide
taatacgactcactatagggcctgaatcgtggagatatttactacatttgaacagaggagacaaatgatgtaaatatctaacctggcggcagcgcaaaagatg

SEQ ID NO: 49562 - DNA, 103 bp, Artificial Sequence
  Synthetic Polynucleotide
taatacgactcactatagggcgattcctgaatcgtggagatatttactacaacagaggagagtagtaatgatctccacgaacctggcggcagcgcaaaagatg

SEQ ID NO: 49563 - DNA, 103 bp, Artificial Sequence
  Synthetic Polynucleotide
taatacgactcactatagggataaacgattcctgaatcgtggagatatttaacagaggagaaaatatatgcacgattcaaacctggcggcagcgcaaaagatg

SEQ ID NO: 49564 - DNA, 103 bp, Artificial Sequence
  Synthetic Polynucleotide
taatacgactcactatagggatcggataaacgattcctgaatcgtggagaaacagaggagatctccaatgttcaggaataacctggcggcagcgcaaaagatg

SEQ ID NO: 49565 - DNA, 103 bp, Artificial Sequence
  Synthetic Polynucleotide
taatacgactcactatagggggtaaatcggataaacgattcctgaatcgtaacagaggagaacgattatggaatcgtttaacctggcggcagcgcaaaagatg

SEQ ID NO: 49566 - DNA, 103 bp, Artificial Sequence
  Synthetic Polynucleotide
taatacgactcactataggggtaacggtaaatcggataaacgattcctgaaacagaggagatcaggaatggtttatccgaacctggcggcagcgcaaaagatg

SEQ ID NO: 49567 - DNA, 103 bp, Artificial Sequence
  Synthetic Polynucleotide
taatacgactcactatagggtattagtaacggtaaatcggataaacgattaacagaggagaaatcgtatgtccgatttaaacctggcggcagcgcaaaagatg

SEQ ID NO: 49568 - DNA, 103 bp, Artificial Sequence
  Synthetic Polynucleotide
taatacgactcactatagggttccttattagtaacggtaaatcggataaaaacagaggagatttatcatgtttaccgttaacctggcggcagcgcaaaagatg

SEQ ID NO: 49569 - DNA, 103 bp, Artificial Sequence
  Synthetic Polynucleotide
taatacgactcactataggggatagacgaggaaacaatgtagtgcattataacagaggagaataatgatgtacattgttaacctggcggcagcgcaaaagatg

SEQ ID NO: 49570 - DNA, 103 bp, Artificial Sequence
  Synthetic Polynucleotide
taatacgactcactatagggaaaatggaaattaatgccgtctattagcacaacagaggagagtgctaatggacggcattaacctggcggcagcgcaaaagatg

SEQ ID NO: 49571 - DNA, 103 bp, Artificial Sequence
  Synthetic Polynucleotide
taatacgactcactatagggtatatctcattttcgtcttcggaaattgtcaacagaggagagacaatatgcgaagacgaaacctggcggcagcgcaaaagatg

SEQ ID NO: 49572 - DNA, 103 bp, Artificial Sequence
  Synthetic Polynucleotide
taatacgactcactatagggacgccttccttattagtaacggtaaatcggaacagaggagaccgattatgcgttactaaaacctggcggcagcgcaaaagatg

SEQ ID NO: 49573 - DNA, 103 bp, Artificial Sequence
  Synthetic Polynucleotide
taatacgactcactatagggttttgacgccttccttattagtaacggtaaaacagaggagattaccgatgctaataaggaacctggcggcagcgcaaaagatg

SEQ ID NO: 49574 - DNA, 103 bp, Artificial Sequence
  Synthetic Polynucleotide
taatacgactcactatagggtctaattttgacgccttccttattagtaacaacagaggagagttactatgaaggaaggcaacctggcggcagcgcaaaagatg

SEQ ID NO: 49575 - DNA, 103 bp, Artificial Sequence
  Synthetic Polynucleotide
taatacgactcactatagggttagttctaattttgacgccttccttattaaacagaggagataataaatgaggcgtcaaaacctggcggcagcgcaaaagatg

SEQ ID NO: 49576 - DNA, 103 bp, Artificial Sequence
  Synthetic Polynucleotide
taatacgactcactataggggaatcttagttctaattttgacgccttcctaacagaggagaaggaagatgtcaaaattaaacctggcggcagcgcaaaagatg

SEQ ID NO: 49577 - DNA, 103 bp, Artificial Sequence
  Synthetic Polynucleotide
taatacgactcactatagggtaatggaatcttagttctaattttgacgccaacagaggagaggcgtcatgattagaactaacctggcggcagcgcaaaagatg

SEQ ID NO: 49578 - DNA, 103 bp, Artificial Sequence
  Synthetic Polynucleotide
taatacgactcactatagggttagataatggaatcttagttctaattttgaacagaggagacaaaatatgaactaagataacctggcggcagcgcaaaagatg

SEQ ID NO: 49579 - DNA, 103 bp, Artificial Sequence
  Synthetic Polynucleotide
taatacgactcactataggggtaccttagataatggaatcttagttctaaaacagaggagattagaaatgagattccataacctggcggcagcgcaaaagatg

SEQ ID NO: 49580 - DNA, 103 bp, Artificial Sequence
  Synthetic Polynucleotide
taatacgactcactatagggaccatgtaccttagataatggaatcttagtaacagaggagaactaagatgccattatctaacctggcggcagcgcaaaagatg

SEQ ID NO: 49581 - DNA, 103 bp, Artificial Sequence
  Synthetic Polynucleotide
taatacgactcactatagggtctagaccatgtaccttagataatggaatcaacagaggagagattccatgatctaaggtaacctggcggcagcgcaaaagatg

SEQ ID NO: 49582 - DNA, 103 bp, Artificial Sequence
  Synthetic Polynucleotide
taatacgactcactatagggatgtctatatctcattttcgtcttcggaaaaacagaggagatttccgatgacgaaaatgaacctggcggcagcgcaaaagatg

SEQ ID NO: 49583 - DNA, 103 bp, Artificial Sequence
  Synthetic Polynucleotide
taatacgactcactatagggttacatctagaccatgtaccttagataatgaacagaggagacattatatgaggtacatgaacctggcggcagcgcaaaagatg

SEQ ID NO: 49584 - DNA, 103 bp, Artificial Sequence
  Synthetic Polynucleotide
taatacgactcactatagggattttttacatctagaccatgtaccttagaaacagaggagatctaagatgcatggtctaaacctggcggcagcgcaaaagatg

SEQ ID NO: 49585 - DNA, 103 bp, Artificial Sequence
  Synthetic Polynucleotide
taatacgactcactatagggtgtacattttttacatctagaccatgtaccaacagaggagaggtacaatgtctagatgtaacctggcggcagcgcaaaagatg

SEQ ID NO: 49586 - DNA, 103 bp, Artificial Sequence
  Synthetic Polynucleotide
taatacgactcactatagggctaactgtacattttttacatctagaccataacagaggagaatggtcatgatgtaaaaaaacctggcggcagcgcaaaagatg

SEQ ID NO: 49587 - DNA, 103 bp, Artificial Sequence
  Synthetic Polynucleotide
taatacgactcactatagggatctactaactgtacattttttacatctagaacagaggagactagatatgaaaaatgtaaacctggcggcagcgcaaaagatg

SEQ ID NO: 49588 - DNA, 103 bp, Artificial Sequence
  Synthetic Polynucleotide
taatacgactcactatagggatagcatctactaactgtacattttttacaaacagaggagatgtaaaatgtgtacagttaacctggcggcagcgcaaaagatg

SEQ ID NO: 49589 - DNA, 103 bp, Artificial Sequence
  Synthetic Polynucleotide
taatacgactcactatagggtatctatagcatctactaactgtacattttaacagaggagaaaaatgatgagttagtagaacctggcggcagcgcaaaagatg

SEQ ID NO: 49590 - DNA, 103 bp, Artificial Sequence
  Synthetic Polynucleotide
taatacgactcactatagggtatgttatctatagcatctactaactgtacaacagaggagagtacagatggtagatgctaacctggcggcagcgcaaaagatg

SEQ ID NO: 49591 - DNA, 103 bp, Artificial Sequence
  Synthetic Polynucleotide
taatacgactcactatagggcaaactatgttatctatagcatctactaacaacagaggagagttagtatgtgctatagaaacctggcggcagcgcaaaagatg

SEQ ID NO: 49592 - DNA, 103 bp, Artificial Sequence
  Synthetic Polynucleotide
taatacgactcactatagggtttcccaaactatgttatctatagcatctaaacagaggagatagatgatgtagataacaaacctggcggcagcgcaaaagatg

SEQ ID NO: 49593 - DNA, 103 bp, Artificial Sequence
  Synthetic Polynucleotide
taatacgactcactatagggtaaccatgtctatatctcattttcgtcttcaacagaggagagaagacatgaatgagataaacctggcggcagcgcaaaagatg

SEQ ID NO: 49594 - DNA, 103 bp, Artificial Sequence
  Synthetic Polynucleotide
taatacgactcactatagggtttcttttcccaaactatgttatctatagcaacagaggagagctataatgaacatagttaacctggcggcagcgcaaaagatg

SEQ ID NO: 49595 - DNA, 103 bp, Artificial Sequence
  Synthetic Polynucleotide
taatacgactcactatagggaatgatttcttttcccaaactatgttatctaacagaggagaagataaatgagtttgggaaacctggcggcagcgcaaaagatg

SEQ ID NO: 49596 - DNA, 103 bp, Artificial Sequence
  Synthetic Polynucleotide
taatacgactcactatagggtcactaatgatttcttttcccaaactatgtaacagaggagaacatagatggggaaaagaaacctggcggcagcgcaaaagatg

SEQ ID NO: 49597 - DNA, 103 bp, Artificial Sequence
  Synthetic Polynucleotide
taatacgactcactatagggttccgtcactaatgatttcttttcccaaacaacagaggagagtttggatgaagaaatcaaacctggcggcagcgcaaaagatg

SEQ ID NO: 49598 - DNA, 103 bp, Artificial Sequence
  Synthetic Polynucleotide
taatacgactcactatagggcgattttccgtcactaatgatttcttttccaacagaggagaggaaaaatgatcattagtaacctggcggcagcgcaaaagatg

SEQ ID NO: 49599 - DNA, 103 bp, Artificial Sequence
  Synthetic Polynucleotide
taatacgactcactataggggaagacgattttccgtcactaatgatttctaacagaggagaagaaatatgtagtgacggaacctggcggcagcgcaaaagatg

SEQ ID NO: 49600 - DNA, 103 bp, Artificial Sequence
  Synthetic Polynucleotide
taatacgactcactatagggtttatgaagacgattttccgtcactaatgaaacagaggagatcattaatgacggaaaataacctggcggcagcgcaaaagatg

SEQ ID NO: 49601 - DNA, 103 bp, Artificial Sequence
  Synthetic Polynucleotide
taatacgactcactatagggcatgctttatgaagacgattttccgtcactaacagaggagaagtgacatgaaatcgtctaacctggcggcagcgcaaaagatg

SEQ ID NO: 49602 - DNA, 103 bp, Artificial Sequence
  Synthetic Polynucleotide
taatacgactcactatagggacaagcatgctttatgaagacgattttccgaacagaggagacggaaaatggtcttcataaacctggcggcagcgcaaaagatg

SEQ ID NO: 49603 - DNA, 103 bp, Artificial Sequence
  Synthetic Polynucleotide
taatacgactcactatagggtctcaacaagcatgctttatgaagacgattaacagaggagaaatcgtatgcataaagcaaacctggcggcagcgcaaaagatg

SEQ ID NO: 49604 - DNA, 103 bp, Artificial Sequence
  Synthetic Polynucleotide
taatacgactcactatagggaggagtaaccatgtctatatctcattttcgaacagaggagacgaaaaatggatatagacaacctggcggcagcgcaaaagatg

SEQ ID NO: 49605 - DNA, 103 bp, Artificial Sequence
  Synthetic Polynucleotide
taatacgactcactataggggatagtctcaacaagcatgctttatgaagaaacagaggagatcttcaatgagcatgcttaacctggcggcagcgcaaaagatg

SEQ ID NO: 49606 - DNA, 103 bp, Artificial Sequence
  Synthetic Polynucleotide
taatacgactcactatagggctgttgatagtctcaacaagcatgctttataacagaggagaataaagatggcttgttgaaacctggcggcagcgcaaaagatg

SEQ ID NO: 49607 - DNA, 103 bp, Artificial Sequence
  Synthetic Polynucleotide
taatacgactcactatagggttcctctgttgatagtctcaacaagcatgcaacagaggagagcatgcatgttgagactaaacctggcggcagcgcaaaagatg

SEQ ID NO: 49608 - DNA, 103 bp, Artificial Sequence
  Synthetic Polynucleotide
taatacgactcactatagggtggcgttcctctgttgatagtctcaacaagaacagaggagacttgttatgactatcaacaacctggcggcagcgcaaaagatg

SEQ ID NO: 49609 - DNA, 103 bp, Artificial Sequence
  Synthetic Polynucleotide
taatacgactcactatagggatatatggcgttcctctgttgatagtctcaaacagaggagatgagacatgcaacagaggaacctggcggcagcgcaaaagatg

SEQ ID NO: 49610 - DNA, 103 bp, Artificial Sequence
  Synthetic Polynucleotide
taatacgactcactatagggcaaaaatatatggcgttcctctgttgatagaacagaggagactatcaatggaggaacgcaacctggcggcagcgcaaaagatg

SEQ ID NO: 49611 - DNA, 103 bp, Artificial Sequence
  Synthetic Polynucleotide
taatacgactcactatagggtaatccaaaaatatatggcgttcctctgttaacagaggagaaacagaatgacgccatataacctggcggcagcgcaaaagatg

SEQ ID NO: 49612 - DNA, 103 bp, Artificial Sequence
  Synthetic Polynucleotide
taatacgactcactatagggtcttgtaatccaaaaatatatggcgttcctaacagaggagaaggaacatgatatattttaacctggcggcagcgcaaaagatg

SEQ ID NO: 49613 - DNA, 103 bp, Artificial Sequence
  Synthetic Polynucleotide
taatacgactcactatagggatatttcttgtaatccaaaaatatatggcgaacagaggagacgccatatgtttttggataacctggcggcagcgcaaaagatg

SEQ ID NO: 49614 - DNA, 103 bp, Artificial Sequence
  Synthetic Polynucleotide
taatacgactcactataggggatccatatttcttgtaatccaaaaatataaacagaggagatatattatgggattacaaaacctggcggcagcgcaaaagatg

SEQ ID NO: 49615 - DNA, 103 bp, Artificial Sequence
  Synthetic Polynucleotide
taatacgactcactatagggttttaaggagtaaccatgtctatatctcataacagaggagaatgagaatgagacatggtaacctggcggcagcgcaaaagatg

SEQ ID NO: 49616 - DNA, 103 bp, Artificial Sequence
  Synthetic Polynucleotide
taatacgactcactatagggtagaggatccatatttcttgtaatccaaaaaacagaggagattttggatgacaagaaataacctggcggcagcgcaaaagatg

SEQ ID NO: 49617 - DNA, 103 bp, Artificial Sequence
  Synthetic Polynucleotide
taatacgactcactatagggtcggatagaggatccatatttcttgtaatcaacagaggagagattacatgaaatatggaaacctggcggcagcgcaaaagatg

SEQ ID NO: 49618 - DNA, 103 bp, Artificial Sequence
  Synthetic Polynucleotide
taatacgactcactatagggtctagtcggatagaggatccatatttcttgaacagaggagacaagaaatgtggatcctcaacctggcggcagcgcaaaagatg

SEQ ID NO: 49619 - DNA, 103 bp, Artificial Sequence
  Synthetic Polynucleotide
taatacgactcactatagggctaattctagtcggatagaggatccatattaacagaggagaaatatgatgcctctatccaacctggcggcagcgcaaaagatg

SEQ ID NO: 49620 - DNA, 103 bp, Artificial Sequence
  Synthetic Polynucleotide
taatacgactcactatagggattaactaattctagtcggatagaggatccaacagaggagaggatccatgatccgactaaacctggcggcagcgcaaaagatg

SEQ ID NO: 49621 - DNA, 103 bp, Artificial Sequence
  Synthetic Polynucleotide
taatacgactcactatagggataagattaactaattctagtcggatagagaacagaggagactctatatgactagaattaacctggcggcagcgcaaaagatg

SEQ ID NO: 49622 - DNA, 103 bp, Artificial Sequence
  Synthetic Polynucleotide
taatacgactcactatagggcttgaataagattaactaattctagtcggaaacagaggagatccgacatgaattagttaaacctggcggcagcgcaaaagatg

SEQ ID NO: 49623 - DNA, 103 bp, Artificial Sequence
  Synthetic Polynucleotide
taatacgactcactatagggttttgcttgaataagattaactaattctagaacagaggagactagaaatggttaatcttaacctggcggcagcgcaaaagatg

SEQ ID NO: 49624 - DNA, 103 bp, Artificial Sequence
  Synthetic Polynucleotide
taatacgactcactatagggtttgtttttgcttgaataagattaactaataacagaggagaattagtatgtcttattcaaacctggcggcagcgcaaaagatg

SEQ ID NO: 49625 - DNA, 103 bp, Artificial Sequence
  Synthetic Polynucleotide
taatacgactcactatagggagttttttgtttttgcttgaataagattaaaacagaggagattaatcatgttcaagcaaaacctggcggcagcgcaaaagatg

SEQ ID NO: 49626 - DNA, 103 bp, Artificial Sequence
  Synthetic Polynucleotide
taatacgactcactatagggtatttttttaaggagtaaccatgtctatataacagaggagaatatagatgtggttactcaacctggcggcagcgcaaaagatg

SEQ ID NO: 49627 - DNA, 103 bp, Artificial Sequence
  Synthetic Polynucleotide
taatacgactcactatagggcgtaaagttttttgtttttgcttgaataagaacagaggagacttattatggcaaaaacaaacctggcggcagcgcaaaagatg

SEQ ID NO: 49628 - DNA, 103 bp, Artificial Sequence
  Synthetic Polynucleotide
taatacgactcactatagggtctatcgtaaagttttttgtttttgcttgaaacagaggagatcaagcatgaacaaaaaaaacctggcggcagcgcaaaagatg

SEQ ID NO: 49629 - DNA, 103 bp, Artificial Sequence
  Synthetic Polynucleotide
taatacgactcactatagggtaaagtctatcgtaaagttttttgtttttgaacagaggagacaaaaaatgaaaactttaaacctggcggcagcgcaaaagatg

SEQ ID NO: 49630 - DNA, 103 bp, Artificial Sequence
  Synthetic Polynucleotide
taatacgactcactatagggtagcttaaagtctatcgtaaagttttttgtaacagaggagaacaaaaatgtttacgataaacctggcggcagcgcaaaagatg

SEQ ID NO: 49631 - DNA, 103 bp, Artificial Sequence
  Synthetic Polynucleotide
taatacgactcactatagggtattttagcttaaagtctatcgtaaagtttaacagaggagaaaacttatggatagacttaacctggcggcagcgcaaaagatg

SEQ ID NO: 49632 - DNA, 103 bp, Artificial Sequence
  Synthetic Polynucleotide
taatacgactcactataggggaaaatattttagcttaaagtctatcgtaaaacagaggagattacgaatgactttaagcaacctggcggcagcgcaaaagatg

SEQ ID NO: 49633 - DNA, 103 bp, Artificial Sequence
  Synthetic Polynucleotide
taatacgactcactatagggtcctagaaaatattttagcttaaagtctataacagaggagaatagacatgaagctaaaaaacctggcggcagcgcaaaagatg

SEQ ID NO: 49634 - DNA, 103 bp, Artificial Sequence
  Synthetic Polynucleotide
taatacgactcactatagggccggatcctagaaaatattttagcttaaagaacagaggagactttaaatgaaaatatttaacctggcggcagcgcaaaagatg

SEQ ID NO: 49635 - DNA, 103 bp, Artificial Sequence
  Synthetic Polynucleotide
taatacgactcactataggggcgcaccggatcctagaaaatattttagctaacagaggagaagctaaatgattttctagaacctggcggcagcgcaaaagatg

SEQ ID NO: 49636 - DNA, 103 bp, Artificial Sequence
  Synthetic Polynucleotide
taatacgactcactatagggagactgcgcaccggatcctagaaaatatttaacagaggagaaaatatatgctaggatccaacctggcggcagcgcaaaagatg

SEQ ID NO: 49637 - DNA, 103 bp, Artificial Sequence
  Synthetic Polynucleotide
taatacgactcactatagggattcgtatttttttaaggagtaaccatgtcaacagaggagagacatgatgactccttaaaacctggcggcagcgcaaaagatg

SEQ ID NO: 49638 - DNA, 103 bp, Artificial Sequence
  Synthetic Polynucleotide
taatacgactcactatagggcttttagactgcgcaccggatcctagaaaaaacagaggagattttctatgatccggtgcaacctggcggcagcgcaaaagatg

SEQ ID NO: 49639 - DNA, 103 bp, Artificial Sequence
  Synthetic Polynucleotide
taatacgactcactatagggaagaacttttagactgcgcaccggatcctaaacagaggagataggatatggtgcgcagtaacctggcggcagcgcaaaagatg

SEQ ID NO: 49640 - DNA, 103 bp, Artificial Sequence
  Synthetic Polynucleotide
taatacgactcactatagggcaataaagaacttttagactgcgcaccggaaacagaggagatccggtatgcagtctaaaaacctggcggcagcgcaaaagatg

SEQ ID NO: 49641 - DNA, 103 bp, Artificial Sequence
  Synthetic Polynucleotide
taatacgactcactataggggcgtgcaataaagaacttttagactgcgcaaacagaggagatgcgcaatgtaaaagttcaacctggcggcagcgcaaaagatg

SEQ ID NO: 49642 - DNA, 103 bp, Artificial Sequence
  Synthetic Polynucleotide
taatacgactcactatagggtaatagcgtgcaataaagaacttttagactaacagaggagaagtctaatggttctttataacctggcggcagcgcaaaagatg

SEQ ID NO: 49643 - DNA, 103 bp, Artificial Sequence
  Synthetic Polynucleotide
taatacgactcactatagggatgattaatagcgtgcaataaagaacttttaacagaggagaaaaagtatgttattgcacaacctggcggcagcgcaaaagatg

SEQ ID NO: 49644 - DNA, 103 bp, Artificial Sequence
  Synthetic Polynucleotide
taatacgactcactatagggtttggatgattaatagcgtgcaataaagaaaacagaggagattctttatggcacgctataacctggcggcagcgcaaaagatg

SEQ ID NO: 49645 - DNA, 103 bp, Artificial Sequence
  Synthetic Polynucleotide
taatacgactcactatagggttgactttggatgattaatagcgtgcaataaacagaggagatattgcatgctattaatcaacctggcggcagcgcaaaagatg

SEQ ID NO: 49646 - DNA, 103 bp, Artificial Sequence
  Synthetic Polynucleotide
taatacgactcactatagggaggccttgactttggatgattaatagcgtgaacagaggagacacgctatgaatcatccaaacctggcggcagcgcaaaagatg

SEQ ID NO: 49647 - DNA, 103 bp, Artificial Sequence
  Synthetic Polynucleotide
taatacgactcactataggggtattaggccttgactttggatgattaataaacagaggagatattaaatgtccaaagtcaacctggcggcagcgcaaaagatg

SEQ ID NO: 49648 - DNA, 103 bp, Artificial Sequence
  Synthetic Polynucleotide
taatacgactcactatagggcgattattcgtatttttttaaggagtaaccaacagaggagaggttacatgttaaaaaaaaacctggcggcagcgcaaaagatg

SEQ ID NO: 49649 - DNA, 103 bp, Artificial Sequence
  Synthetic Polynucleotide
taatacgactcactataggggagatgtattaggccttgactttggatgataacagaggagaatcatcatgagtcaaggcaacctggcggcagcgcaaaagatg

SEQ ID NO: 49650 - DNA, 103 bp, Artificial Sequence
  Synthetic Polynucleotide
taatacgactcactatagggttccagagatgtattaggccttgactttggaacagaggagaccaaagatgaggcctaataacctggcggcagcgcaaaagatg

SEQ ID NO: 49651 - DNA, 103 bp, Artificial Sequence
  Synthetic Polynucleotide
taatacgactcactatagggtctatttccagagatgtattaggccttgacaacagaggagagtcaagatgtaatacatcaacctggcggcagcgcaaaagatg

SEQ ID NO: 49652 - DNA, 103 bp, Artificial Sequence
  Synthetic Polynucleotide
taatacgactcactatagggtgaattctatttccagagatgtattaggccaacagaggagaggcctaatgcatctctggaacctggcggcagcgcaaaagatg

SEQ ID NO: 49653 - DNA, 103 bp, Artificial Sequence
  Synthetic Polynucleotide
taatacgactcactatagggaggtgtgaattctatttccagagatgtattaacagaggagaaatacaatgctggaaataaacctggcggcagcgcaaaagatg

SEQ ID NO: 49654 - DNA, 103 bp, Artificial Sequence
  Synthetic Polynucleotide
taatacgactcactatagggtctctaggtgtgaattctatttccagagataacagaggagaatctctatgaatagaattaacctggcggcagcgcaaaagatg

SEQ ID NO: 49655 - DNA, 103 bp, Artificial Sequence
  Synthetic Polynucleotide
taatacgactcactatagggcattgtctctaggtgtgaattctatttccaaacagaggagatggaaaatgaattcacacaacctggcggcagcgcaaaagatg

SEQ ID NO: 49656 - DNA, 103 bp, Artificial Sequence
  Synthetic Polynucleotide
taatacgactcactatagggtgtttcattgtctctaggtgtgaattctataacagaggagaatagaaatgacacctagaaacctggcggcagcgcaaaagatg

SEQ ID NO: 49657 - DNA, 103 bp, Artificial Sequence
  Synthetic Polynucleotide
taatacgactcactatagggggaactgtttcattgtctctaggtgtgaataacagaggagaattcacatgtagagacaaaacctggcggcagcgcaaaagatg

SEQ ID NO: 49658 - DNA, 103 bp, Artificial Sequence
  Synthetic Polynucleotide
taatacgactcactatagggcatatggaactgtttcattgtctctaggtgaacagaggagacacctaatgacaatgaaaaacctggcggcagcgcaaaagatg

SEQ ID NO: 49659 - DNA, 103 bp, Artificial Sequence
  Synthetic Polynucleotide
taatacgactcactatagggcaaggcgattattcgtatttttttaaggagaacagaggagactccttatgaaaatacgaaacctggcggcagcgcaaaagatg

SEQ ID NO: 49660 - DNA, 103 bp, Artificial Sequence
  Synthetic Polynucleotide
taatacgactcactatagggttcatcatatggaactgtttcattgtctctaacagaggagaagagacatggaaacagttaacctggcggcagcgcaaaagatg

SEQ ID NO: 49661 - DNA, 103 bp, Artificial Sequence
  Synthetic Polynucleotide
taatacgactcactatagggattagttcatcatatggaactgtttcattgaacagaggagacaatgaatgagttccataaacctggcggcagcgcaaaagatg

SEQ ID NO: 49662 - DNA, 103 bp, Artificial Sequence
  Synthetic Polynucleotide
taatacgactcactatagggcctttattagttcatcatatggaactgtttaacagaggagaaaacagatgcatatgatgaacctggcggcagcgcaaaagatg

SEQ ID NO: 49663 - DNA, 103 bp, Artificial Sequence
  Synthetic Polynucleotide
taatacgactcactatagggcaattcctttattagttcatcatatggaacaacagaggagagttccaatggatgaactaaacctggcggcagcgcaaaagatg

SEQ ID NO: 49664 - DNA, 103 bp, Artificial Sequence
  Synthetic Polynucleotide
taatacgactcactataggggtcgtcaattcctttattagttcatcatataacagaggagaatatgaatgactaataaaaacctggcggcagcgcaaaagatg

SEQ ID NO: 49665 - DNA, 103 bp, Artificial Sequence
  Synthetic Polynucleotide
taatacgactcactatagggagaaagtcgtcaattcctttattagttcataacagaggagaatgaacatgtaaaggaataacctggcggcagcgcaaaagatg

SEQ ID NO: 49666 - DNA, 103 bp, Artificial Sequence
  Synthetic Polynucleotide
taatacgactcactatagggacgcgagaaagtcgtcaattcctttattagaacagaggagactaataatggaattgacgaacctggcggcagcgcaaaagatg

SEQ ID NO: 49667 - DNA, 103 bp, Artificial Sequence
  Synthetic Polynucleotide
taatacgactcactatagggatatgacgcgagaaagtcgtcaattcctttaacagaggagaaaaggaatggacgactttaacctggcggcagcgcaaaagatg

SEQ ID NO: 49668 - DNA, 103 bp, Artificial Sequence
  Synthetic Polynucleotide
taatacgactcactatagggtaaatatatgacgcgagaaagtcgtcaattaacagaggagaaattgaatgctttctcgcaacctggcggcagcgcaaaagatg

SEQ ID NO: 49669 - DNA, 103 bp, Artificial Sequence
  Synthetic Polynucleotide
taatacgactcactatagggagccataaatatatgacgcgagaaagtcgtaacagaggagaacgactatgtcgcgtcataacctggcggcagcgcaaaagatg

SEQ ID NO: 49670 - DNA, 103 bp, Artificial Sequence
  Synthetic Polynucleotide
taatacgactcactatagggatagccaaggcgattattcgtatttttttaaacagaggagataaaaaatgacgaataataacctggcggcagcgcaaaagatg

SEQ ID NO: 49671 - DNA, 103 bp, Artificial Sequence
  Synthetic Polynucleotide
taatacgactcactatagggggagaagccataaatatatgacgcgagaaaaacagaggagatttctcatgtcatatattaacctggcggcagcgcaaaagatg

SEQ ID NO: 49672 - DNA, 103 bp, Artificial Sequence
  Synthetic Polynucleotide
taatacgactcactatagggtctctggagaagccataaatatatgacgcgaacagaggagacgcgtcatgtatttatggaacctggcggcagcgcaaaagatg

SEQ ID NO: 49673 - DNA, 103 bp, Artificial Sequence
  Synthetic Polynucleotide
taatacgactcactatagggtacattctctggagaagccataaatatatgaacagaggagacatataatgatggcttctaacctggcggcagcgcaaaagatg

SEQ ID NO: 49674 - DNA, 103 bp, Artificial Sequence
  Synthetic Polynucleotide
taatacgactcactatagggagaattacattctctggagaagccataaataacagaggagaatttatatgttctccagaaacctggcggcagcgcaaaagatg

SEQ ID NO: 49675 - DNA, 103 bp, Artificial Sequence
  Synthetic Polynucleotide
taatacgactcactataggggagaaagaattacattctctggagaagccaaacagaggagatggcttatgcagagaatgaacctggcggcagcgcaaaagatg

SEQ ID NO: 49676 - DNA, 103 bp, Artificial Sequence
  Synthetic Polynucleotide
taatacgactcactatagggaggtggagaaagaattacattctctggagaaacagaggagatctccaatgaatgtaattaacctggcggcagcgcaaaagatg

SEQ ID NO: 49677 - DNA, 103 bp, Artificial Sequence
  Synthetic Polynucleotide
taatacgactcactatagggttaataggtggagaaagaattacattctctaacagaggagaagagaaatgaattctttcaacctggcggcagcgcaaaagatg

SEQ ID NO: 49678 - DNA, 103 bp, Artificial Sequence
  Synthetic Polynucleotide
taatacgactcactataggggtgcgttaataggtggagaaagaattacataacagaggagaatgtaaatgtttctccacaacctggcggcagcgcaaaagatg

SEQ ID NO: 49679 - DNA, 103 bp, Artificial Sequence
  Synthetic Polynucleotide
taatacgactcactatagggtataggtgcgttaataggtggagaaagaataacagaggagaattcttatgccacctattaacctggcggcagcgcaaaagatg

SEQ ID NO: 49680 - DNA, 103 bp, Artificial Sequence
  Synthetic Polynucleotide
taatacgactcactataggggtctttataggtgcgttaataggtggagaaaacagaggagattctccatgtattaacgcaacctggcggcagcgcaaaagatg

SEQ ID NO: 49681 - DNA, 103 bp, Artificial Sequence
  Synthetic Polynucleotide
taatacgactcactatagggattaaaaaatggaaattaatgccgtctattaacagaggagaaatagaatgcattaatttaacctggcggcagcgcaaaagatg

SEQ ID NO: 49682 - DNA, 103 bp, Artificial Sequence
  Synthetic Polynucleotide
taatacgactcactatagggactaaatagccaaggcgattattcgtatttaacagaggagaaaatacatgtaatcgcctaacctggcggcagcgcaaaagatg

SEQ ID NO: 49683 - DNA, 103 bp, Artificial Sequence
  Synthetic Polynucleotide
taatacgactcactatagggtaaaagtctttataggtgcgttaataggtgaacagaggagacacctaatgacgcacctaaacctggcggcagcgcaaaagatg

SEQ ID NO: 49684 - DNA, 103 bp, Artificial Sequence
  Synthetic Polynucleotide
taatacgactcactatagggcaacataaaagtctttataggtgcgttaataacagaggagaattaacatgcctataaagaacctggcggcagcgcaaaagatg

SEQ ID NO: 49685 - DNA, 103 bp, Artificial Sequence
  Synthetic Polynucleotide
taatacgactcactatagggttaggcaacataaaagtctttataggtgcgaacagaggagacgcaccatgaaagactttaacctggcggcagcgcaaaagatg

SEQ ID NO: 49686 - DNA, 103 bp, Artificial Sequence
  Synthetic Polynucleotide
taatacgactcactatagggcttgtttaggcaacataaaagtctttatagaacagaggagactataaatgcttttatgtaacctggcggcagcgcaaaagatg

SEQ ID NO: 49687 - DNA, 103 bp, Artificial Sequence
  Synthetic Polynucleotide
taatacgactcactatagggtatatcttgtttaggcaacataaaagtcttaacagaggagaaagactatgatgttgcctaacctggcggcagcgcaaaagatg

SEQ ID NO: 49688 - DNA, 103 bp, Artificial Sequence
  Synthetic Polynucleotide
taatacgactcactatagggcctactatatcttgtttaggcaacataaaaaacagaggagattttatatggcctaaacaaacctggcggcagcgcaaaagatg

SEQ ID NO: 49689 - DNA, 103 bp, Artificial Sequence
  Synthetic Polynucleotide
taatacgactcactatagggccatacctactatatcttgtttaggcaacaaacagaggagatgttgcatgaacaagataaacctggcggcagcgcaaaagatg

SEQ ID NO: 49690 - DNA, 103 bp, Artificial Sequence
  Synthetic Polynucleotide
taatacgactcactatagggcagatccatacctactatatcttgtttaggaacagaggagacctaaaatggatatagtaaacctggcggcagcgcaaaagatg

SEQ ID NO: 49691 - DNA, 103 bp, Artificial Sequence
  Synthetic Polynucleotide
taatacgactcactatagggttttccagatccatacctactatatcttgtaacagaggagaacaagaatgagtaggtataacctggcggcagcgcaaaagatg

SEQ ID NO: 49692 - DNA, 103 bp, Artificial Sequence
  Synthetic Polynucleotide
taatacgactcactatagggatagattttccagatccatacctactatataacagaggagaatatagatggtatggatcaacctggcggcagcgcaaaagatg

SEQ ID NO: 49693 - DNA, 103 bp, Artificial Sequence
  Synthetic Polynucleotide
taatacgactcactatagggcacttactaaatagccaaggcgattattcgaacagaggagacgaataatggccttggctaacctggcggcagcgcaaaagatg

SEQ ID NO: 49694 - DNA, 103 bp, Artificial Sequence
  Synthetic Polynucleotide
taatacgactcactatagggggcatatagattttccagatccatacctacaacagaggagagtaggtatggatctggaaaacctggcggcagcgcaaaagatg

SEQ ID NO: 49695 - DNA, 103 bp, Artificial Sequence
  Synthetic Polynucleotide
taatacgactcactataggggttacggcatatagattttccagatccataaacagaggagatatggaatgggaaaatctaacctggcggcagcgcaaaagatg

SEQ ID NO: 49696 - DNA, 103 bp, Artificial Sequence
  Synthetic Polynucleotide
taatacgactcactatagggtcttagttacggcatatagattttccagataacagaggagaatctggatgatctatatgaacctggcggcagcgcaaaagatg

SEQ ID NO: 49697 - DNA, 103 bp, Artificial Sequence
  Synthetic Polynucleotide
taatacgactcactataggggtcagtcttagttacggcatatagattttcaacagaggagagaaaatatgtatgccgtaaacctggcggcagcgcaaaagatg

SEQ ID NO: 49698 - DNA, 103 bp, Artificial Sequence
  Synthetic Polynucleotide
taatacgactcactatagggatgccgtcagtcttagttacggcatatagaaacagaggagatctataatgcgtaactaaaacctggcggcagcgcaaaagatg

SEQ ID NO: 49699 - DNA, 103 bp, Artificial Sequence
  Synthetic Polynucleotide
taatacgactcactatagggtaggaatgccgtcagtcttagttacggcataacagaggagaatgccgatgctaagactgaacctggcggcagcgcaaaagatg

SEQ ID NO: 49700 - DNA, 103 bp, Artificial Sequence
  Synthetic Polynucleotide
taatacgactcactatagggagttataggaatgccgtcagtcttagttacaacagaggagagtaactatgactgacggcaacctggcggcagcgcaaaagatg

SEQ ID NO: 49701 - DNA, 103 bp, Artificial Sequence
  Synthetic Polynucleotide
taatacgactcactatagggctgatagttataggaatgccgtcagtcttaaacagaggagataagacatgcggcattccaacctggcggcagcgcaaaagatg

SEQ ID NO: 49702 - DNA, 103 bp, Artificial Sequence
  Synthetic Polynucleotide
taatacgactcactatagggtaactctgatagttataggaatgccgtcagaacagaggagactgacgatgttcctataaaacctggcggcagcgcaaaagatg

SEQ ID NO: 49703 - DNA, 103 bp, Artificial Sequence
  Synthetic Polynucleotide
taatacgactcactatagggtgatgtaactctgatagttataggaatgccaacagaggagaggcattatgataactatcaacctggcggcagcgcaaaagatg

SEQ ID NO: 49704 - DNA, 103 bp, Artificial Sequence
  Synthetic Polynucleotide
taatacgactcactatagggaatgacacttactaaatagccaaggcgattaacagaggagaaatcgcatgggctatttaaacctggcggcagcgcaaaagatg

SEQ ID NO: 49705 - DNA, 103 bp, Artificial Sequence
  Synthetic Polynucleotide
taatacgactcactatagggccctttgatgtaactctgatagttataggaaacagaggagatcctatatgtatcagagtaacctggcggcagcgcaaaagatg

SEQ ID NO: 49706 - DNA, 103 bp, Artificial Sequence
  Synthetic Polynucleotide
taatacgactcactatagggacaacccctttgatgtaactctgatagttaaacagaggagataactaatggagttacataacctggcggcagcgcaaaagatg

SEQ ID NO: 49707 - DNA, 103 bp, Artificial Sequence
  Synthetic Polynucleotide
taatacgactcactatagggacaatacaacccctttgatgtaactctgataacagaggagaatcagaatgacatcaaagaacctggcggcagcgcaaaagatg

SEQ ID NO: 49708 - DNA, 103 bp, Artificial Sequence
  Synthetic Polynucleotide
taatacgactcactatagggaaataacaatacaacccctttgatgtaactaacagaggagaagttacatgaaaggggttaacctggcggcagcgcaaaagatg

SEQ ID NO: 49709 - DNA, 103 bp, Artificial Sequence
  Synthetic Polynucleotide
taatacgactcactataggggtgtaaaataacaatacaacccctttgatgaacagaggagacatcaaatgggttgtattaacctggcggcagcgcaaaagatg

SEQ ID NO: 49710 - DNA, 103 bp, Artificial Sequence
  Synthetic Polynucleotide
taatacgactcactatagggaagatgtgtaaaataacaatacaaccccttaacagaggagaaaggggatgtattgttataacctggcggcagcgcaaaagatg

SEQ ID NO: 49711 - DNA, 103 bp, Artificial Sequence
  Synthetic Polynucleotide
taatacgactcactatagggtaaccaagatgtgtaaaataacaatacaacaacagaggagagttgtaatgttattttacaacctggcggcagcgcaaaagatg

SEQ ID NO: 49712 - DNA, 103 bp, Artificial Sequence
  Synthetic Polynucleotide
taatacgactcactatagggtaatataaccaagatgtgtaaaataacaataacagaggagaattgttatgttacacatcaacctggcggcagcgcaaaagatg

SEQ ID NO: 49713 - DNA, 103 bp, Artificial Sequence
  Synthetic Polynucleotide
taatacgactcactatagggtctaataatataaccaagatgtgtaaaataaacagaggagatattttatgcatcttggtaacctggcggcagcgcaaaagatg

SEQ ID NO: 49714 - DNA, 103 bp, Artificial Sequence
  Synthetic Polynucleotide
taatacgactcactatagggggatatctaataatataaccaagatgtgtaaacagaggagatacacaatgtggttatataacctggcggcagcgcaaaagatg

SEQ ID NO: 49715 - DNA, 103 bp, Artificial Sequence
  Synthetic Polynucleotide
taatacgactcactatagggtgttaaatgacacttactaaatagccaaggaacagaggagaccttggatgtttagtaagaacctggcggcagcgcaaaagatg

SEQ ID NO: 49716 - DNA, 103 bp, Artificial Sequence
  Synthetic Polynucleotide
taatacgactcactatagggtaactggatatctaataatataaccaagataacagaggagaatcttgatgatattattaaacctggcggcagcgcaaaagatg

SEQ ID NO: 49717 - DNA, 103 bp, Artificial Sequence
  Synthetic Polynucleotide
taatacgactcactatagggtctcttaactggatatctaataatataaccaacagaggagaggttatatgattagatataacctggcggcagcgcaaaagatg

SEQ ID NO: 49718 - DNA, 103 bp, Artificial Sequence
  Synthetic Polynucleotide
taatacgactcactatagggattattctcttaactggatatctaataataaacagaggagatattatatgatatccagtaacctggcggcagcgcaaaagatg

SEQ ID NO: 49719 - DNA, 103 bp, Artificial Sequence
  Synthetic Polynucleotide
taatacgactcactatagggaatctattattctcttaactggatatctaaaacagaggagattagatatgcagttaagaaacctggcggcagcgcaaaagatg

SEQ ID NO: 49720 - DNA, 103 bp, Artificial Sequence
  Synthetic Polynucleotide
taatacgactcactatagggttcagaatctattattctcttaactggataaacagaggagatatccaatgaagagaataaacctggcggcagcgcaaaagatg

SEQ ID NO: 49721 - DNA, 103 bp, Artificial Sequence
  Synthetic Polynucleotide
taatacgactcactatagggactacttcagaatctattattctcttaactaacagaggagaagttaaatgaataatagaaacctggcggcagcgcaaaagatg

SEQ ID NO: 49722 - DNA, 103 bp, Artificial Sequence
  Synthetic Polynucleotide
taatacgactcactatagggagactactacttcagaatctattattctctaacagaggagaagagaaatgtagattctgaacctggcggcagcgcaaaagatg

SEQ ID NO: 49723 - DNA, 103 bp, Artificial Sequence
  Synthetic Polynucleotide
taatacgactcactatagggaccaaagactactacttcagaatctattataacagaggagaataataatgtctgaagtaaacctggcggcagcgcaaaagatg

SEQ ID NO: 49724 - DNA, 103 bp, Artificial Sequence
  Synthetic Polynucleotide
taatacgactcactataggggcctcaccaaagactactacttcagaatctaacagaggagaagattcatgagtagtagtaacctggcggcagcgcaaaagatg

SEQ ID NO: 49725 - DNA, 103 bp, Artificial Sequence
  Synthetic Polynucleotide
taatacgactcactatagggtaactgcctcaccaaagactactacttcagaacagaggagactgaagatgtagtctttgaacctggcggcagcgcaaaagatg

SEQ ID NO: 49726 - DNA, 103 bp, Artificial Sequence
  Synthetic Polynucleotide
taatacgactcactatagggtatagtgttaaatgacacttactaaatagcaacagaggagagctattatgtaagtgtcaaacctggcggcagcgcaaaagatg

SEQ ID NO: 49727 - DNA, 103 bp, Artificial Sequence
  Synthetic Polynucleotide
taatacgactcactatagggatccttaactgcctcaccaaagactactacaacagaggagagtagtaatgtttggtgagaacctggcggcagcgcaaaagatg

SEQ ID NO: 49728 - DNA, 103 bp, Artificial Sequence
  Synthetic Polynucleotide
taatacgactcactatagggttcttatccttaactgcctcaccaaagactaacagaggagaagtcttatgtgaggcagtaacctggcggcagcgcaaaagatg

SEQ ID NO: 49729 - DNA, 103 bp, Artificial Sequence
  Synthetic Polynucleotide
taatacgactcactatagggtccagttcttatccttaactgcctcaccaaaacagaggagattggtgatgcagttaaggaacctggcggcagcgcaaaagatg

SEQ ID NO: 49730 - DNA, 103 bp, Artificial Sequence
  Synthetic Polynucleotide
taatacgactcactatagggtacagtccagttcttatccttaactgcctcaacagaggagagaggcaatgaaggataagaacctggcggcagcgcaaaagatg

SEQ ID NO: 49731 - DNA, 103 bp, Artificial Sequence
  Synthetic Polynucleotide
taatacgactcactatagggagatatacagtccagttcttatccttaactaacagaggagaagttaaatgtaagaactgaacctggcggcagcgcaaaagatg

SEQ ID NO: 49732 - DNA, 103 bp, Artificial Sequence
  Synthetic Polynucleotide
taatacgactcactatagggtaatgagatatacagtccagttcttatcctaacagaggagaaggataatgactggactgaacctggcggcagcgcaaaagatg

SEQ ID NO: 49733 - DNA, 103 bp, Artificial Sequence
  Synthetic Polynucleotide
taatacgactcactatagggtagcttaatgagatatacagtccagttcttaacagaggagaaagaacatgactgtatataacctggcggcagcgcaaaagatg

SEQ ID NO: 49734 - DNA, 103 bp, Artificial Sequence
  Synthetic Polynucleotide
taatacgactcactatagggtctattagcttaatgagatatacagtccagaacagaggagactggacatgatatctcataacctggcggcagcgcaaaagatg

SEQ ID NO: 49735 - DNA, 103 bp, Artificial Sequence
  Synthetic Polynucleotide
taatacgactcactatagggcgggctctattagcttaatgagatatacagaacagaggagactgtatatgtcattaagcaacctggcggcagcgcaaaagatg

SEQ ID NO: 49736 - DNA, 103 bp, Artificial Sequence
  Synthetic Polynucleotide
taatacgactcactatagggatttacgggctctattagcttaatgagataaacagaggagatatctcatgaagctaataaacctggcggcagcgcaaaagatg

SEQ ID NO: 49737 - DNA, 103 bp, Artificial Sequence
  Synthetic Polynucleotide
taatacgactcactatagggataagtatagtgttaaatgacacttactaaaacagaggagattagtaatggtcatttaaaacctggcggcagcgcaaaagatg

SEQ ID NO: 49738 - DNA, 103 bp, Artificial Sequence
  Synthetic Polynucleotide
taatacgactcactatagggattgcatttacgggctctattagcttaatgaacagaggagacattaaatgaatagagccaacctggcggcagcgcaaaagatg

SEQ ID NO: 49739 - DNA, 103 bp, Artificial Sequence
  Synthetic Polynucleotide
taatacgactcactatagggcactgattgcatttacgggctctattagctaacagaggagaagctaaatgagcccgtaaaacctggcggcagcgcaaaagatg

SEQ ID NO: 49740 - DNA, 103 bp, Artificial Sequence
  Synthetic Polynucleotide
taatacgactcactatagggtctatcactgattgcatttacgggctctataacagaggagaatagagatggtaaatgcaaacctggcggcagcgcaaaagatg

SEQ ID NO: 49741 - DNA, 103 bp, Artificial Sequence
  Synthetic Polynucleotide
taatacgactcactatagggtctagtctatcactgattgcatttacgggcaacagaggagagcccgtatgtgcaatcagaacctggcggcagcgcaaaagatg

SEQ ID NO: 49742 - DNA, 103 bp, Artificial Sequence
  Synthetic Polynucleotide
taatacgactcactatagggtttcttctagtctatcactgattgcatttaaacagaggagataaatgatgtcagtgataaacctggcggcagcgcaaaagatg

SEQ ID NO: 49743 - DNA, 103 bp, Artificial Sequence
  Synthetic Polynucleotide
taatacgactcactatagggcttactttcttctagtctatcactgattgcaacagaggagagcaatcatggatagactaaacctggcggcagcgcaaaagatg

SEQ ID NO: 49744 - DNA, 103 bp, Artificial Sequence
  Synthetic Polynucleotide
taatacgactcactatagggacatacttactttcttctagtctatcactgaacagaggagacagtgaatgactagaagaaacctggcggcagcgcaaaagatg

SEQ ID NO: 49745 - DNA, 103 bp, Artificial Sequence
  Synthetic Polynucleotide
taatacgactcactatagggattcgacatacttactttcttctagtctataacagaggagaatagacatgaagaaagtaaacctggcggcagcgcaaaagatg

SEQ ID NO: 49746 - DNA, 103 bp, Artificial Sequence
  Synthetic Polynucleotide
taatacgactcactatagggtttagattcgacatacttactttcttctagaacagaggagactagaaatgagtaagtataacctggcggcagcgcaaaagatg

SEQ ID NO: 49747 - DNA, 103 bp, Artificial Sequence
  Synthetic Polynucleotide
taatacgactcactatagggactagtttagattcgacatacttactttctaacagaggagaagaaagatggtatgtcgaaacctggcggcagcgcaaaagatg

SEQ ID NO: 49748 - DNA, 103 bp, Artificial Sequence
  Synthetic Polynucleotide
taatacgactcactatagggttaatataagtatagtgttaaatgacacttaacagaggagaaagtgtatgttaacactaaacctggcggcagcgcaaaagatg

SEQ ID NO: 49749 - DNA, 103 bp, Artificial Sequence
  Synthetic Polynucleotide
taatacgactcactatagggtatccactagtttagattcgacatacttacaacagaggagagtaagtatgtcgaatctaaacctggcggcagcgcaaaagatg

SEQ ID NO: 49750 - DNA, 103 bp, Artificial Sequence
  Synthetic Polynucleotide
taatacgactcactatagggacaaatatccactagtttagattcgacataaacagaggagatatgtcatgtctaaactaaacctggcggcagcgcaaaagatg

SEQ ID NO: 49751 - DNA, 103 bp, Artificial Sequence
  Synthetic Polynucleotide
taatacgactcactatagggcgatcacaaatatccactagtttagattcgaacagaggagacgaatcatgactagtggaaacctggcggcagcgcaaaagatg

SEQ ID NO: 49752 - DNA, 103 bp, Artificial Sequence
  Synthetic Polynucleotide
taatacgactcactatagggctatccgatcacaaatatccactagtttagaacagaggagactaaacatgtggatatttaacctggcggcagcgcaaaagatg

SEQ ID NO: 49753 - DNA, 103 bp, Artificial Sequence
  Synthetic Polynucleotide
taatacgactcactataggggaatactatccgatcacaaatatccactagaacagaggagactagtgatgatttgtgataacctggcggcagcgcaaaagatg

SEQ ID NO: 49754 - DNA, 103 bp, Artificial Sequence
  Synthetic Polynucleotide
taatacgactcactataggggacttgaatactatccgatcacaaatatccaacagaggagaggatatatgtgatcggataacctggcggcagcgcaaaagatg

SEQ ID NO: 49755 - DNA, 103 bp, Artificial Sequence
  Synthetic Polynucleotide
taatacgactcactatagggtctttgacttgaatactatccgatcacaaaaacagaggagatttgtgatgggatagtataacctggcggcagcgcaaaagatg

SEQ ID NO: 49756 - DNA, 103 bp, Artificial Sequence
  Synthetic Polynucleotide
taatacgactcactataggggtatttctttgacttgaatactatccgatcaacagaggagagatcggatggtattcaagaacctggcggcagcgcaaaagatg

SEQ ID NO: 49757 - DNA, 103 bp, Artificial Sequence
  Synthetic Polynucleotide
taatacgactcactatagggccttcgtatttctttgacttgaatactatcaacagaggagagatagtatgcaagtcaaaaacctggcggcagcgcaaaagatg

SEQ ID NO: 49758 - DNA, 103 bp, Artificial Sequence
  Synthetic Polynucleotide
taatacgactcactatagggaaggaccttcgtatttctttgacttgaataaacagaggagatattcaatgcaaagaaataacctggcggcagcgcaaaagatg

SEQ ID NO: 49759 - DNA, 103 bp, Artificial Sequence
  Synthetic Polynucleotide
taatacgactcactatagggatggattaatataagtatagtgttaaatgaaacagaggagatcatttatgactatacttaacctggcggcagcgcaaaagatg

SEQ ID NO: 49760 - DNA, 103 bp, Artificial Sequence
  Synthetic Polynucleotide
taatacgactcactatagggagtaaaaggaccttcgtatttctttgacttaacagaggagaaagtcaatgaaatacgaaaacctggcggcagcgcaaaagatg

SEQ ID NO: 49761 - DNA, 103 bp, Artificial Sequence
  Synthetic Polynucleotide
taatacgactcactataggggttgtagtaaaaggaccttcgtatttctttaacagaggagaaaagaaatgcgaaggtccaacctggcggcagcgcaaaagatg

SEQ ID NO: 49762 - DNA, 103 bp, Artificial Sequence
  Synthetic Polynucleotide
taatacgactcactatagggcactagttgtagtaaaaggaccttcgtattaacagaggagaaatacgatggtccttttaaacctggcggcagcgcaaaagatg

SEQ ID NO: 49763 - DNA, 103 bp, Artificial Sequence
  Synthetic Polynucleotide
taatacgactcactataggggacttcactagttgtagtaaaaggaccttcaacagaggagagaaggtatgtttactacaaacctggcggcagcgcaaaagatg

SEQ ID NO: 49764 - DNA, 103 bp, Artificial Sequence
  Synthetic Polynucleotide
taatacgactcactatagggtcaacgacttcactagttgtagtaaaaggaaacagaggagatcctttatgtacaactagaacctggcggcagcgcaaaagatg

SEQ ID NO: 49765 - DNA, 103 bp, Artificial Sequence
  Synthetic Polynucleotide
taatacgactcactatagggacatatcaacgacttcactagttgtagtaaaacagaggagattactaatgctagtgaagaacctggcggcagcgcaaaagatg

SEQ ID NO: 49766 - DNA, 103 bp, Artificial Sequence
  Synthetic Polynucleotide
taatacgactcactatagggagataacatatcaacgacttcactagttgtaacagaggagaacaactatggaagtcgttaacctggcggcagcgcaaaagatg

SEQ ID NO: 49767 - DNA, 103 bp, Artificial Sequence
  Synthetic Polynucleotide
taatacgactcactatagggtatgtagataacatatcaacgacttcactaaacagaggagatagtgaatgcgttgatataacctggcggcagcgcaaaagatg

SEQ ID NO: 49768 - DNA, 103 bp, Artificial Sequence
  Synthetic Polynucleotide
taatacgactcactataggggtaaatatgtagataacatatcaacgacttaacagaggagaaagtcgatgatatgttataacctggcggcagcgcaaaagatg

SEQ ID NO: 49769 - DNA, 103 bp, Artificial Sequence
  Synthetic Polynucleotide
taatacgactcactatagggctttggtaaatatgtagataacatatcaacaacagaggagagttgatatgttatctacaaacctggcggcagcgcaaaagatg

SEQ ID NO: 49770 - DNA, 103 bp, Artificial Sequence
  Synthetic Polynucleotide
taatacgactcactatagggagtccatggattaatataagtatagtgttaaacagaggagataacacatgacttatattaacctggcggcagcgcaaaagatg

SEQ ID NO: 49771 - DNA, 103 bp, Artificial Sequence
  Synthetic Polynucleotide
taatacgactcactatagggggttgctttggtaaatatgtagataacataaacagaggagatatgttatgtacatatttaacctggcggcagcgcaaaagatg

SEQ ID NO: 49772 - DNA, 103 bp, Artificial Sequence
  Synthetic Polynucleotide
taatacgactcactatagggcttctggttgctttggtaaatatgtagataaacagaggagatatctaatgatttaccaaaacctggcggcagcgcaaaagatg

SEQ ID NO: 49773 - DNA, 103 bp, Artificial Sequence
  Synthetic Polynucleotide
taatacgactcactatagggaacaccttctggttgctttggtaaatatgtaacagaggagaacatatatgccaaagcaaaacctggcggcagcgcaaaagatg

SEQ ID NO: 49774 - DNA, 103 bp, Artificial Sequence
  Synthetic Polynucleotide
taatacgactcactatagggaaaataacaccttctggttgctttggtaaaaacagaggagatttaccatggcaaccagaaacctggcggcagcgcaaaagatg

SEQ ID NO: 49775 - DNA, 103 bp, Artificial Sequence
  Synthetic Polynucleotide
taatacgactcactatagggaaaacaaaataacaccttctggttgctttgaacagaggagacaaagcatgcagaaggtgaacctggcggcagcgcaaaagatg

SEQ ID NO: 49776 - DNA, 103 bp, Artificial Sequence
  Synthetic Polynucleotide
taatacgactcactatagggtgaataaaacaaaataacaccttctggttgaacagaggagacaaccaatgggtgttattaacctggcggcagcgcaaaagatg

SEQ ID NO: 49777 - DNA, 103 bp, Artificial Sequence
  Synthetic Polynucleotide
taatacgactcactatagggccctttgaataaaacaaaataacaccttctaacagaggagaagaaggatgtattttgttaacctggcggcagcgcaaaagatg

SEQ ID NO: 49778 - DNA, 103 bp, Artificial Sequence
  Synthetic Polynucleotide
taatacgactcactatagggtaggtccctttgaataaaacaaaataacacaacagaggagagtgttaatgtgttttattaacctggcggcagcgcaaaagatg

SEQ ID NO: 49779 - DNA, 103 bp, Artificial Sequence
  Synthetic Polynucleotide
taatacgactcactatagggagatttaggtccctttgaataaaacaaaataacagaggagaattttgatgtattcaaagaacctggcggcagcgcaaaagatg

SEQ ID NO: 49780 - DNA, 103 bp, Artificial Sequence
  Synthetic Polynucleotide
taatacgactcactatagggatgttagatttaggtccctttgaataaaacaacagaggagagttttaatgaaagggaccaacctggcggcagcgcaaaagatg

SEQ ID NO: 49781 - DNA, 103 bp, Artificial Sequence
  Synthetic Polynucleotide
taatacgactcactatagggttatgagtccatggattaatataagtatagaacagaggagactatacatgtattaatccaacctggcggcagcgcaaaagatg

SEQ ID NO: 49782 - DNA, 103 bp, Artificial Sequence
  Synthetic Polynucleotide
taatacgactcactatagggaatcaatgttagatttaggtccctttgaataacagaggagaattcaaatggacctaaataacctggcggcagcgcaaaagatg

SEQ ID NO: 49783 - DNA, 103 bp, Artificial Sequence
  Synthetic Polynucleotide
taatacgactcactatagggtttaaaatcaatgttagatttaggtcccttaacagaggagaaagggaatgaaatctaacaacctggcggcagcgcaaaagatg

SEQ ID NO: 49784 - DNA, 103 bp, Artificial Sequence
  Synthetic Polynucleotide
taatacgactcactatagggttgattttaaaatcaatgttagatttaggtaacagaggagaacctaaatgtaacattgaaacctggcggcagcgcaaaagatg

SEQ ID NO: 49785 - DNA, 103 bp, Artificial Sequence
  Synthetic Polynucleotide
taatacgactcactatagggcctttttgattttaaaatcaatgttagattaacagaggagaaatctaatgttgattttaaacctggcggcagcgcaaaagatg

SEQ ID NO: 49786 - DNA, 103 bp, Artificial Sequence
  Synthetic Polynucleotide
taatacgactcactatagggattctcctttttgattttaaaatcaatgttaacagaggagaaacattatgtttaaaatcaacctggcggcagcgcaaaagatg

SEQ ID NO: 49787 - DNA, 103 bp, Artificial Sequence
  Synthetic Polynucleotide
taatacgactcactatagggatagtattctcctttttgattttaaaatcaaacagaggagatgatttatgaatcaaaaaaacctggcggcagcgcaaaagatg

SEQ ID NO: 49788 - DNA, 103 bp, Artificial Sequence
  Synthetic Polynucleotide
taatacgactcactatagggggtctatagtattctcctttttgattttaaaacagaggagattaaaaatgaaaaggagaaacctggcggcagcgcaaaagatg

SEQ ID NO: 49789 - DNA, 103 bp, Artificial Sequence
  Synthetic Polynucleotide
taatacgactcactatagggagtttggtctatagtattctcctttttgataacagaggagaatcaaaatggagaatactaacctggcggcagcgcaaaagatg

SEQ ID NO: 49790 - DNA, 103 bp, Artificial Sequence
  Synthetic Polynucleotide
taatacgactcactatagggtttacagtttggtctatagtattctcctttaacagaggagaaaaggaatgtactatagaaacctggcggcagcgcaaaagatg

SEQ ID NO: 49791 - DNA, 103 bp, Artificial Sequence
  Synthetic Polynucleotide
taatacgactcactatagggctacatttacagtttggtctatagtattctaacagaggagaagaataatgtagaccaaaaacctggcggcagcgcaaaagatg

SEQ ID NO: 49792 - DNA, 103 bp, Artificial Sequence
  Synthetic Polynucleotide
taatacgactcactatagggaccccattaaaaaatggaaattaatgccgtaacagaggagaacggcaatgatttccattaacctggcggcagcgcaaaagatg

SEQ ID NO: 49793 - DNA, 103 bp, Artificial Sequence
  Synthetic Polynucleotide
taatacgactcactatagggagagattatgagtccatggattaatataagaacagaggagacttataatgatccatggaaacctggcggcagcgcaaaagatg

SEQ ID NO: 49794 - DNA, 103 bp, Artificial Sequence
  Synthetic Polynucleotide
taatacgactcactatagggaaatactacatttacagtttggtctatagtaacagaggagaactataatgcaaactgtaaacctggcggcagcgcaaaagatg

SEQ ID NO: 49795 - DNA, 103 bp, Artificial Sequence
  Synthetic Polynucleotide
taatacgactcactatagggtacctaaatactacatttacagtttggtctaacagaggagaagaccaatgtgtaaatgtaacctggcggcagcgcaaaagatg

SEQ ID NO: 49796 - DNA, 103 bp, Artificial Sequence
  Synthetic Polynucleotide
taatacgactcactatagggacatgtacctaaatactacatttacagtttaacagaggagaaaactgatgatgtagtataacctggcggcagcgcaaaagatg

SEQ ID NO: 49797 - DNA, 103 bp, Artificial Sequence
  Synthetic Polynucleotide
taatacgactcactatagggactggacatgtacctaaatactacatttacaacagaggagagtaaatatggtatttaggaacctggcggcagcgcaaaagatg

SEQ ID NO: 49798 - DNA, 103 bp, Artificial Sequence
  Synthetic Polynucleotide
taatacgactcactatagggggttcactggacatgtacctaaatactacaaacagaggagatgtagtatgtaggtacataacctggcggcagcgcaaaagatg

SEQ ID NO: 49799 - DNA, 103 bp, Artificial Sequence
  Synthetic Polynucleotide
taatacgactcactatagggtaattggttcactggacatgtacctaaataaacagaggagatatttaatgacatgtccaaacctggcggcagcgcaaaagatg

SEQ ID NO: 49800 - DNA, 103 bp, Artificial Sequence
  Synthetic Polynucleotide
taatacgactcactatagggaaagataattggttcactggacatgtacctaacagaggagaaggtacatgtccagtgaaaacctggcggcagcgcaaaagatg

SEQ ID NO: 49801 - DNA, 103 bp, Artificial Sequence
  Synthetic Polynucleotide
taatacgactcactatagggtctccaaagataattggttcactggacatgaacagaggagacatgtcatgtgaaccaataacctggcggcagcgcaaaagatg

SEQ ID NO: 49802 - DNA, 103 bp, Artificial Sequence
  Synthetic Polynucleotide
taatacgactcactatagggatgattctccaaagataattggttcactggaacagaggagaccagtgatgcaattatctaacctggcggcagcgcaaaagatg

SEQ ID NO: 49803 - DNA, 103 bp, Artificial Sequence
  Synthetic Polynucleotide
taatacgactcactataggggatagatgattctccaaagataattggttcaacagaggagagaaccaatgatctttggaaacctggcggcagcgcaaaagatg

SEQ ID NO: 49804 - DNA, 103 bp, Artificial Sequence
  Synthetic Polynucleotide
taatacgactcactatagggcgtatagagattatgagtccatggattaataacagaggagaattaatatgtggactcataacctggcggcagcgcaaaagatg

SEQ ID NO: 49805 - DNA, 103 bp, Artificial Sequence
  Synthetic Polynucleotide
taatacgactcactatagggataaagatagatgattctccaaagataattaacagaggagaaattatatgtggagaatcaacctggcggcagcgcaaaagatg

SEQ ID NO: 49806 - DNA, 103 bp, Artificial Sequence
  Synthetic Polynucleotide
taatacgactcactatagggactctataaagatagatgattctccaaagaaacagaggagatctttgatgaatcatctaaacctggcggcagcgcaaaagatg

SEQ ID NO: 49807 - DNA, 103 bp, Artificial Sequence
  Synthetic Polynucleotide
taatacgactcactatagggcttatactctataaagatagatgattctccaacagaggagaggagaaatgtctatctttaacctggcggcagcgcaaaagatg

SEQ ID NO: 49808 - DNA, 103 bp, Artificial Sequence
  Synthetic Polynucleotide
taatacgactcactatagggaatttcttatactctataaagatagatgataacagaggagaatcatcatgctttatagaaacctggcggcagcgcaaaagatg

SEQ ID NO: 49809 - DNA, 103 bp, Artificial Sequence
  Synthetic Polynucleotide
taatacgactcactatagggtggtaaatttcttatactctataaagatagaacagaggagactatctatgtagagtataaacctggcggcagcgcaaaagatg

SEQ ID NO: 49810 - DNA, 103 bp, Artificial Sequence
  Synthetic Polynucleotide
taatacgactcactatagggatcgttggtaaatttcttatactctataaaaacagaggagatttataatgtataagaaaaacctggcggcagcgcaaaagatg

SEQ ID NO: 49811 - DNA, 103 bp, Artificial Sequence
  Synthetic Polynucleotide
taatacgactcactatagggcctttatcgttggtaaatttcttatactctaacagaggagaagagtaatggaaatttacaacctggcggcagcgcaaaagatg

SEQ ID NO: 49812 - DNA, 103 bp, Artificial Sequence
  Synthetic Polynucleotide
taatacgactcactataggggaaagcctttatcgttggtaaatttcttataacagaggagaataagaatgttaccaacgaacctggcggcagcgcaaaagatg

SEQ ID NO: 49813 - DNA, 103 bp, Artificial Sequence
  Synthetic Polynucleotide
taatacgactcactatagggtttaggaaagcctttatcgttggtaaatttaacagaggagaaaatttatgaacgataaaaacctggcggcagcgcaaaagatg

SEQ ID NO: 49814 - DNA, 103 bp, Artificial Sequence
  Synthetic Polynucleotide
taatacgactcactatagggtattctttaggaaagcctttatcgttggtaaacagaggagataccaaatgtaaaggcttaacctggcggcagcgcaaaagatg

SEQ ID NO: 49815 - DNA, 103 bp, Artificial Sequence
  Synthetic Polynucleotide
taatacgactcactatagggaatcccgtatagagattatgagtccatggaaacagaggagatccatgatgtcataatctaacctggcggcagcgcaaaagatg

SEQ ID NO: 49816 - DNA, 103 bp, Artificial Sequence
  Synthetic Polynucleotide
taatacgactcactatagggaaccatattctttaggaaagcctttatcgtaacagaggagaacgataatggctttcctaaacctggcggcagcgcaaaagatg

SEQ ID NO: 49817 - DNA, 103 bp, Artificial Sequence
  Synthetic Polynucleotide
taatacgactcactatagggaccagaaccatattctttaggaaagcctttaacagaggagaaaaggcatgcctaaagaaaacctggcggcagcgcaaaagatg

SEQ ID NO: 49818 - DNA, 103 bp, Artificial Sequence
  Synthetic Polynucleotide
taatacgactcactatagggattttaccagaaccatattctttaggaaagaacagaggagactttccatgagaatatggaacctggcggcagcgcaaaagatg

SEQ ID NO: 49819 - DNA, 103 bp, Artificial Sequence
  Synthetic Polynucleotide
taatacgactcactatagggacacaattttaccagaaccatattctttagaacagaggagactaaagatgatggttctgaacctggcggcagcgcaaaagatg

SEQ ID NO: 49820 - DNA, 103 bp, Artificial Sequence
  Synthetic Polynucleotide
taatacgactcactataggggtataacacaattttaccagaaccatattcaacagaggagagaatatatgtctggtaaaaacctggcggcagcgcaaaagatg

SEQ ID NO: 49821 - DNA, 103 bp, Artificial Sequence
  Synthetic Polynucleotide
taatacgactcactatagggccgttgtataacacaattttaccagaaccaaacagaggagatggttcatgtaaaattgtaacctggcggcagcgcaaaagatg

SEQ ID NO: 49822 - DNA, 103 bp, Artificial Sequence
  Synthetic Polynucleotide
taatacgactcactatagggtaacgccgttgtataacacaattttaccagaacagaggagactggtaatgttgtgttataacctggcggcagcgcaaaagatg

SEQ ID NO: 49823 - DNA, 103 bp, Artificial Sequence
  Synthetic Polynucleotide
taatacgactcactatagggataattaacgccgttgtataacacaattttaacagaggagaaaaattatgttatacaacaacctggcggcagcgcaaaagatg

SEQ ID NO: 49824 - DNA, 103 bp, Artificial Sequence
  Synthetic Polynucleotide
taatacgactcactatagggtttagataattaacgccgttgtataacacaaacagaggagatgtgttatgcaacggcgtaacctggcggcagcgcaaaagatg

SEQ ID NO: 49825 - DNA, 103 bp, Artificial Sequence
  Synthetic Polynucleotide
taatacgactcactatagggtattatttagataattaacgccgttgtataaacagaggagatatacaatggcgttaattaacctggcggcagcgcaaaagatg

SEQ ID NO: 49826 - DNA, 103 bp, Artificial Sequence
  Synthetic Polynucleotide
taatacgactcactatagggccgttaatcccgtatagagattatgagtccaacagaggagaggactcatgatctctataaacctggcggcagcgcaaaagatg

SEQ ID NO: 49827 - DNA, 103 bp, Artificial Sequence
  Synthetic Polynucleotide
taatacgactcactatagggatagatattatttagataattaacgccgttaacagaggagaaacggcatgaattatctaaacctggcggcagcgcaaaagatg

SEQ ID NO: 49828 - DNA, 103 bp, Artificial Sequence
  Synthetic Polynucleotide
taatacgactcactatagggaaacaatagatattatttagataattaacgaacagaggagacgttaaatgtctaaataaaacctggcggcagcgcaaaagatg

SEQ ID NO: 49829 - DNA, 103 bp, Artificial Sequence
  Synthetic Polynucleotide
taatacgactcactatagggattccaaacaatagatattatttagataataacagaggagaattatcatgataatatctaacctggcggcagcgcaaaagatg

SEQ ID NO: 49830 - DNA, 103 bp, Artificial Sequence
  Synthetic Polynucleotide
taatacgactcactatagggaatatattccaaacaatagatattatttagaacagaggagactaaatatgatctattgtaacctggcggcagcgcaaaagatg

SEQ ID NO: 49831 - DNA, 103 bp, Artificial Sequence
  Synthetic Polynucleotide
taatacgactcactataggggtattaatatattccaaacaatagatattaaacagaggagataatatatgttgtttggaaacctggcggcagcgcaaaagatg

SEQ ID NO: 49832 - DNA, 103 bp, Artificial Sequence
  Synthetic Polynucleotide
taatacgactcactatagggtatgtgtattaatatattccaaacaatagaaacagaggagatctattatgtggaatataaacctggcggcagcgcaaaagatg

SEQ ID NO: 49833 - DNA, 103 bp, Artificial Sequence
  Synthetic Polynucleotide
taatacgactcactatagggttcattatgtgtattaatatattccaaacaaacagaggagatgtttgatgtatattaataacctggcggcagcgcaaaagatg

SEQ ID NO: 49834 - DNA, 103 bp, Artificial Sequence
  Synthetic Polynucleotide
taatacgactcactatagggcccacttcattatgtgtattaatatattccaacagaggagaggaataatgtaatacacaaacctggcggcagcgcaaaagatg

SEQ ID NO: 49835 - DNA, 103 bp, Artificial Sequence
  Synthetic Polynucleotide
taatacgactcactatagggtaatacccacttcattatgtgtattaatataacagaggagaatattaatgcacataatgaacctggcggcagcgcaaaagatg

SEQ ID NO: 49836 - DNA, 103 bp, Artificial Sequence
  Synthetic Polynucleotide
taatacgactcactatagggggacttaatacccacttcattatgtgtattaacagaggagaaatacaatgaatgaagtgaacctggcggcagcgcaaaagatg

SEQ ID NO: 49837 - DNA, 103 bp, Artificial Sequence
  Synthetic Polynucleotide
taatacgactcactatagggaacatccgttaatcccgtatagagattatgaacagaggagacataatatgtatacgggaaacctggcggcagcgcaaaagatg

SEQ ID NO: 49838 - DNA, 103 bp, Artificial Sequence
  Synthetic Polynucleotide
taatacgactcactatagggaccacggacttaatacccacttcattatgtaacagaggagaacataaatgagtgggtataacctggcggcagcgcaaaagatg

SEQ ID NO: 49839 - DNA, 103 bp, Artificial Sequence
  Synthetic Polynucleotide
taatacgactcactataggggtacaaccacggacttaatacccacttcataacagaggagaatgaagatggtattaagtaacctggcggcagcgcaaaagatg

SEQ ID NO: 49840 - DNA, 103 bp, Artificial Sequence
  Synthetic Polynucleotide
taatacgactcactatagggaataggtacaaccacggacttaatacccacaacagaggagagtgggtatgaagtccgtgaacctggcggcagcgcaaaagatg

SEQ ID NO: 49841 - DNA, 103 bp, Artificial Sequence
  Synthetic Polynucleotide
taatacgactcactatagggaacttaataggtacaaccacggacttaataaacagaggagatattaaatgcgtggttgtaacctggcggcagcgcaaaagatg

SEQ ID NO: 49842 - DNA, 103 bp, Artificial Sequence
  Synthetic Polynucleotide
taatacgactcactatagggctataaacttaataggtacaaccacggactaacagaggagaagtccgatgttgtacctaaacctggcggcagcgcaaaagatg

SEQ ID NO: 49843 - DNA, 103 bp, Artificial Sequence
  Synthetic Polynucleotide
taatacgactcactatagggttctgctataaacttaataggtacaaccacaacagaggagagtggttatgcctattaagaacctggcggcagcgcaaaagatg

SEQ ID NO: 49844 - DNA, 103 bp, Artificial Sequence
  Synthetic Polynucleotide
taatacgactcactatagggaagaattctgctataaacttaataggtacaaacagaggagatgtaccatgtaagtttataacctggcggcagcgcaaaagatg

SEQ ID NO: 49845 - DNA, 103 bp, Artificial Sequence
  Synthetic Polynucleotide
taatacgactcactatagggtgactaagaattctgctataaacttaatagaacagaggagactattaatgttatagcagaacctggcggcagcgcaaaagatg

SEQ ID NO: 49846 - DNA, 103 bp, Artificial Sequence
  Synthetic Polynucleotide
taatacgactcactatagggtccattgactaagaattctgctataaacttaacagaggagaaagtttatggcagaattcaacctggcggcagcgcaaaagatg

SEQ ID NO: 49847 - DNA, 103 bp, Artificial Sequence
  Synthetic Polynucleotide
taatacgactcactatagggatttctccattgactaagaattctgctataaacagaggagatatagcatgattcttagtaacctggcggcagcgcaaaagatg

SEQ ID NO: 49848 - DNA, 103 bp, Artificial Sequence
  Synthetic Polynucleotide
taatacgactcactatagggtatagaacatccgttaatcccgtatagagaaacagaggagatctctaatggggattaacaacctggcggcagcgcaaaagatg

SEQ ID NO: 49849 - DNA, 103 bp, Artificial Sequence
  Synthetic Polynucleotide
taatacgactcactatagggtaagtatttctccattgactaagaattctgaacagaggagacagaatatgtagtcaatgaacctggcggcagcgcaaaagatg

SEQ ID NO: 49850 - DNA, 103 bp, Artificial Sequence
  Synthetic Polynucleotide
taatacgactcactatagggaggtttaagtatttctccattgactaagaaaacagaggagattcttaatgaatggagaaaacctggcggcagcgcaaaagatg

SEQ ID NO: 49851 - DNA, 103 bp, Artificial Sequence
  Synthetic Polynucleotide
taatacgactcactatagggattctaggtttaagtatttctccattgactaacagaggagaagtcaaatgagaaatactaacctggcggcagcgcaaaagatg

SEQ ID NO: 49852 - DNA, 103 bp, Artificial Sequence
  Synthetic Polynucleotide
taatacgactcactatagggtatcgattctaggtttaagtatttctccataacagaggagaatggagatgtacttaaacaacctggcggcagcgcaaaagatg

SEQ ID NO: 49853 - DNA, 103 bp, Artificial Sequence
  Synthetic Polynucleotide
taatacgactcactatagggggttttatcgattctaggtttaagtatttcaacagaggagagaaataatgaaacctagaaacctggcggcagcgcaaaagatg

SEQ ID NO: 49854 - DNA, 103 bp, Artificial Sequence
  Synthetic Polynucleotide
taatacgactcactatagggttcatggttttatcgattctaggtttaagtaacagaggagaacttaaatgtagaatcgaaacctggcggcagcgcaaaagatg

SEQ ID NO: 49855 - DNA, 103 bp, Artificial Sequence
  Synthetic Polynucleotide
taatacgactcactatagggtatatttcatggttttatcgattctaggttaacagaggagaaacctaatgtcgataaaaaacctggcggcagcgcaaaagatg

SEQ ID NO: 49856 - DNA, 103 bp, Artificial Sequence
  Synthetic Polynucleotide
taatacgactcactataggggttaatatatttcatggttttatcgattctaacagaggagaagaatcatgaaaaccatgaacctggcggcagcgcaaaagatg

SEQ ID NO: 49857 - DNA, 103 bp, Artificial Sequence
  Synthetic Polynucleotide
taatacgactcactatagggtctgagttaatatatttcatggttttatcgaacagaggagacgataaatgcatgaaataaacctggcggcagcgcaaaagatg

SEQ ID NO: 49858 - DNA, 103 bp, Artificial Sequence
  Synthetic Polynucleotide
taatacgactcactatagggagtcttctgagttaatatatttcatggtttaacagaggagaaaaccaatgaatatattaaacctggcggcagcgcaaaagatg

SEQ ID NO: 49859 - DNA, 103 bp, Artificial Sequence
  Synthetic Polynucleotide
taatacgactcactatagggccgtatatagaacatccgttaatcccgtataacagaggagaatacggatgtaacggatgaacctggcggcagcgcaaaagatg

SEQ ID NO: 49860 - DNA, 103 bp, Artificial Sequence
  Synthetic Polynucleotide
taatacgactcactatagggataatagtcttctgagttaatatatttcataacagaggagaatgaaaatgattaactcaaacctggcggcagcgcaaaagatg

SEQ ID NO: 49861 - DNA, 103 bp, Artificial Sequence
  Synthetic Polynucleotide
taatacgactcactatagggtttccataatagtcttctgagttaatatataacagaggagaatatatatgctcagaagaaacctggcggcagcgcaaaagatg

SEQ ID NO: 49862 - DNA, 103 bp, Artificial Sequence
  Synthetic Polynucleotide
taatacgactcactataggggttgatttccataatagtcttctgagttaaaacagaggagattaactatgaagactattaacctggcggcagcgcaaaagatg

SEQ ID NO: 49863 - DNA, 103 bp, Artificial Sequence
  Synthetic Polynucleotide
taatacgactcactatagggattatgttgatttccataatagtcttctgaaacagaggagatcagaaatgtattatggaaacctggcggcagcgcaaaagatg

SEQ ID NO: 49864 - DNA, 103 bp, Artificial Sequence
  Synthetic Polynucleotide
taatacgactcactatagggatgacattatgttgatttccataatagtctaacagaggagaagactaatgtggaaatcaaacctggcggcagcgcaaaagatg

SEQ ID NO: 49865 - DNA, 103 bp, Artificial Sequence
  Synthetic Polynucleotide
taatacgactcactatagggcaactatgacattatgttgatttccataataacagaggagaattatgatgatcaacataaacctggcggcagcgcaaaagatg

SEQ ID NO: 49866 - DNA, 103 bp, Artificial Sequence
  Synthetic Polynucleotide
taatacgactcactatagggatgttcaactatgacattatgttgatttccaacagaggagaggaaatatgcataatgtcaacctggcggcagcgcaaaagatg

SEQ ID NO: 49867 - DNA, 103 bp, Artificial Sequence
  Synthetic Polynucleotide
taatacgactcactatagggcttaaatgttcaactatgacattatgttgaaacagaggagatcaacaatgtgtcatagtaacctggcggcagcgcaaaagatg

SEQ ID NO: 49868 - DNA, 103 bp, Artificial Sequence
  Synthetic Polynucleotide
taatacgactcactataggggatctcttaaatgttcaactatgacattataacagaggagaataatgatgtagttgaacaacctggcggcagcgcaaaagatg

SEQ ID NO: 49869 - DNA, 103 bp, Artificial Sequence
  Synthetic Polynucleotide
taatacgactcactataggggctttgatctcttaaatgttcaactatgacaacagaggagagtcataatggaacatttaaacctggcggcagcgcaaaagatg

SEQ ID NO: 49870 - DNA, 103 bp, Artificial Sequence
  Synthetic Polynucleotide
taatacgactcactatagggcatccccgtatatagaacatccgttaatccaacagaggagaggattaatggatgttctaaacctggcggcagcgcaaaagatg

SEQ ID NO: 49871 - DNA, 103 bp, Artificial Sequence
  Synthetic Polynucleotide
taatacgactcactatagggttgatgctttgatctcttaaatgttcaactaacagaggagaagttgaatgtttaagagaaacctggcggcagcgcaaaagatg

SEQ ID NO: 49872 - DNA, 103 bp, Artificial Sequence
  Synthetic Polynucleotide
taatacgactcactatagggctattttgatgctttgatctcttaaatgttaacagaggagaaacattatggagatcaaaaacctggcggcagcgcaaaagatg

SEQ ID NO: 49873 - DNA, 103 bp, Artificial Sequence
  Synthetic Polynucleotide
taatacgactcactatagggatctcctattttgatgctttgatctcttaaaacagaggagattaagaatgcaaagcatcaacctggcggcagcgcaaaagatg

SEQ ID NO: 49874 - DNA, 103 bp, Artificial Sequence
  Synthetic Polynucleotide
taatacgactcactatagggaagacatctcctattttgatgctttgatctaacagaggagaagatcaatgcatcaaaataacctggcggcagcgcaaaagatg

SEQ ID NO: 49875 - DNA, 103 bp, Artificial Sequence
  Synthetic Polynucleotide
taatacgactcactatagggcgttaaagacatctcctattttgatgctttaacagaggagaaaagcaatgaaataggagaacctggcggcagcgcaaaagatg

SEQ ID NO: 49876 - DNA, 103 bp, Artificial Sequence
  Synthetic Polynucleotide
taatacgactcactataggggtcctcgttaaagacatctcctattttgataacagaggagaatcaaaatgggagatgtcaacctggcggcagcgcaaaagatg

SEQ ID NO: 49877 - DNA, 103 bp, Artificial Sequence
  Synthetic Polynucleotide
taatacgactcactatagggagtttgtcctcgttaaagacatctcctattaacagaggagaaataggatgtgtctttaaaacctggcggcagcgcaaaagatg

SEQ ID NO: 49878 - DNA, 103 bp, Artificial Sequence
  Synthetic Polynucleotide
taatacgactcactatagggcagatagtttgtcctcgttaaagacatctcaacagaggagagagatgatgttaacgaggaacctggcggcagcgcaaaagatg

SEQ ID NO: 49879 - DNA, 103 bp, Artificial Sequence
  Synthetic Polynucleotide
taatacgactcactatagggtacatcagatagtttgtcctcgttaaagacaacagaggagagtctttatggaggacaaaaacctggcggcagcgcaaaagatg

SEQ ID NO: 49880 - DNA, 103 bp, Artificial Sequence
  Synthetic Polynucleotide
taatacgactcactatagggtgtcctacatcagatagtttgtcctcgttaaacagaggagataacgaatgcaaactatcaacctggcggcagcgcaaaagatg

SEQ ID NO: 49881 - DNA, 103 bp, Artificial Sequence
  Synthetic Polynucleotide
taatacgactcactatagggctactcatccccgtatatagaacatccgttaacagaggagaaacggaatgtctatatacaacctggcggcagcgcaaaagatg

SEQ ID NO: 49882 - DNA, 103 bp, Artificial Sequence
  Synthetic Polynucleotide
taatacgactcactatagggattgatgtcctacatcagatagtttgtcctaacagaggagaaggacaatgtatctgatgaacctggcggcagcgcaaaagatg

SEQ ID NO: 49883 - DNA, 103 bp, Artificial Sequence
  Synthetic Polynucleotide
taatacgactcactatagggggcatattgatgtcctacatcagatagtttaacagaggagaaaactaatggatgtaggaaacctggcggcagcgcaaaagatg

SEQ ID NO: 49884 - DNA, 103 bp, Artificial Sequence
  Synthetic Polynucleotide
taatacgactcactatagggttattggcatattgatgtcctacatcagataacagaggagaatctgaatgaggacatcaaacctggcggcagcgcaaaagatg

SEQ ID NO: 49885 - DNA, 103 bp, Artificial Sequence
  Synthetic Polynucleotide
taatacgactcactatagggtatcattattggcatattgatgtcctacataacagaggagaatgtagatgatcaatatgaacctggcggcagcgcaaaagatg

SEQ ID NO: 49886 - DNA, 103 bp, Artificial Sequence
  Synthetic Polynucleotide
taatacgactcactatagggaaatttatcattattggcatattgatgtccaacagaggagaggacatatgtatgccaataacctggcggcagcgcaaaagatg

SEQ ID NO: 49887 - DNA, 103 bp, Artificial Sequence
  Synthetic Polynucleotide
taatacgactcactatagggaatctaaatttatcattattggcatattgaaacagaggagatcaataatgcaataatgaaacctggcggcagcgcaaaagatg

SEQ ID NO: 49888 - DNA, 103 bp, Artificial Sequence
  Synthetic Polynucleotide
taatacgactcactataggggatttaatctaaatttatcattattggcataacagaggagaatgccaatgatgataaataacctggcggcagcgcaaaagatg

SEQ ID NO: 49889 - DNA, 103 bp, Artificial Sequence
  Synthetic Polynucleotide
taatacgactcactatagggttctggatttaatctaaatttatcattattaacagaggagaaataatatgaaatttagaaacctggcggcagcgcaaaagatg

SEQ ID NO: 49890 - DNA, 103 bp, Artificial Sequence
  Synthetic Polynucleotide
taatacgactcactatagggctaacttctggatttaatctaaatttatcaaacagaggagatgataaatgtagattaaaaacctggcggcagcgcaaaagatg

SEQ ID NO: 49891 - DNA, 103 bp, Artificial Sequence
  Synthetic Polynucleotide
taatacgactcactatagggaataactaacttctggatttaatctaaattaacagaggagaaatttaatgtaaatccagaacctggcggcagcgcaaaagatg

SEQ ID NO: 49892 - DNA, 103 bp, Artificial Sequence
  Synthetic Polynucleotide
taatacgactcactataggggagaactactcatccccgtatatagaacataacagaggagaatgttcatgatacggggaaacctggcggcagcgcaaaagatg

SEQ ID NO: 49893 - DNA, 103 bp, Artificial Sequence
  Synthetic Polynucleotide
taatacgactcactatagggcgtaaaataactaacttctggatttaatctaacagaggagaagattaatgccagaagttaacctggcggcagcgcaaaagatg

SEQ ID NO: 49894 - DNA, 103 bp, Artificial Sequence
  Synthetic Polynucleotide
taatacgactcactatagggttattcgtaaaataactaacttctggatttaacagaggagaaaatccatgagttagttaaacctggcggcagcgcaaaagatg

SEQ ID NO: 49895 - DNA, 103 bp, Artificial Sequence
  Synthetic Polynucleotide
taatacgactcactatagggttcttttattcgtaaaataactaacttctgaacagaggagacagaagatggttattttaaacctggcggcagcgcaaaagatg

SEQ ID NO: 49896 - DNA, 103 bp, Artificial Sequence
  Synthetic Polynucleotide
taatacgactcactatagggtctagttcttttattcgtaaaataactaacaacagaggagagttagtatgtttacgaataacctggcggcagcgcaaaagatg

SEQ ID NO: 49897 - DNA, 103 bp, Artificial Sequence
  Synthetic Polynucleotide
taatacgactcactatagggggtcctctagttcttttattcgtaaaataaaacagaggagattatttatggaataaaagaacctggcggcagcgcaaaagatg

SEQ ID NO: 49898 - DNA, 103 bp, Artificial Sequence
  Synthetic Polynucleotide
taatacgactcactatagggccaacggtcctctagttcttttattcgtaaaacagaggagattacgaatgaaagaactaaacctggcggcagcgcaaaagatg

SEQ ID NO: 49899 - DNA, 103 bp, Artificial Sequence
  Synthetic Polynucleotide
taatacgactcactatagggaattcccaacggtcctctagttcttttattaacagaggagaaataaaatgactagaggaaacctggcggcagcgcaaaagatg

SEQ ID NO: 49900 - DNA, 103 bp, Artificial Sequence
  Synthetic Polynucleotide
taatacgactcactataggggataaaattcccaacggtcctctagttcttaacagaggagaaagaacatgaggaccgttaacctggcggcagcgcaaaagatg

SEQ ID NO: 49901 - DNA, 103 bp, Artificial Sequence
  Synthetic Polynucleotide
taatacgactcactatagggagttcgataaaattcccaacggtcctctagaacagaggagactagagatgcgttgggaaaacctggcggcagcgcaaaagatg

SEQ ID NO: 49902 - DNA, 103 bp, Artificial Sequence
  Synthetic Polynucleotide
taatacgactcactataggggacgtagttcgataaaattcccaacggtccaacagaggagaggaccgatgggaattttaaacctggcggcagcgcaaaagatg

SEQ ID NO: 49903 - DNA, 103 bp, Artificial Sequence
  Synthetic Polynucleotide
taatacgactcactatagggccacaaccccattaaaaaatggaaattaataacagaggagaattaatatgcattttttaaacctggcggcagcgcaaaagatg

SEQ ID NO: 49904 - DNA, 103 bp, Artificial Sequence
  Synthetic Polynucleotide
taatacgactcactatagggaagaagagaactactcatccccgtatatagaacagaggagactatatatggggatgagtaacctggcggcagcgcaaaagatg

SEQ ID NO: 49905 - DNA, 103 bp, Artificial Sequence
  Synthetic Polynucleotide
taatacgactcactataggggtcttgacgtagttcgataaaattcccaacaacagaggagagttgggatgtttatcgaaaacctggcggcagcgcaaaagatg

SEQ ID NO: 49906 - DNA, 103 bp, Artificial Sequence
  Synthetic Polynucleotide
taatacgactcactataggggaagagtcttgacgtagttcgataaaattcaacagaggagagaatttatgcgaactacgaacctggcggcagcgcaaaagatg

SEQ ID NO: 49907 - DNA, 103 bp, Artificial Sequence
  Synthetic Polynucleotide
taatacgactcactatagggaataagaagagtcttgacgtagttcgataaaacagaggagattatcgatgtacgtcaagaacctggcggcagcgcaaaagatg

SEQ ID NO: 49908 - DNA, 103 bp, Artificial Sequence
  Synthetic Polynucleotide
taatacgactcactatagggatagaaataagaagagtcttgacgtagttcaacagaggagagaactaatgcaagactctaacctggcggcagcgcaaaagatg

SEQ ID NO: 49909 - DNA, 103 bp, Artificial Sequence
  Synthetic Polynucleotide
taatacgactcactatagggaatacatagaaataagaagagtcttgacgtaacagaggagaacgtcaatgctcttcttaaacctggcggcagcgcaaaagatg

SEQ ID NO: 49910 - DNA, 103 bp, Artificial Sequence
  Synthetic Polynucleotide
taatacgactcactatagggggaacaatacatagaaataagaagagtcttaacagaggagaaagactatgcttatttctaacctggcggcagcgcaaaagatg

SEQ ID NO: 49911 - DNA, 103 bp, Artificial Sequence
  Synthetic Polynucleotide
taatacgactcactataggggttttggaacaatacatagaaataagaagaaacagaggagatcttctatgttctatgtaaacctggcggcagcgcaaaagatg

SEQ ID NO: 49912 - DNA, 103 bp, Artificial Sequence
  Synthetic Polynucleotide
taatacgactcactatagggaaaatgttttggaacaatacatagaaataaaacagaggagattatttatgtgtattgttaacctggcggcagcgcaaaagatg

SEQ ID NO: 49913 - DNA, 103 bp, Artificial Sequence
  Synthetic Polynucleotide
taatacgactcactataggggtctaaaaatgttttggaacaatacatagaaacagaggagatctatgatgtgttccaaaaacctggcggcagcgcaaaagatg

SEQ ID NO: 49914 - DNA, 103 bp, Artificial Sequence
  Synthetic Polynucleotide
taatacgactcactataggggaatcgtctaaaaatgttttggaacaatacaacagaggagagtattgatgcaaaacattaacctggcggcagcgcaaaagatg

SEQ ID NO: 49915 - DNA, 103 bp, Artificial Sequence
  Synthetic Polynucleotide
taatacgactcactatagggagttaaagaagagaactactcatccccgtaaacagaggagatacgggatggagtagttcaacctggcggcagcgcaaaagatg

SEQ ID NO: 49916 - DNA, 103 bp, Artificial Sequence
  Synthetic Polynucleotide
taatacgactcactatagggtgttggaatcgtctaaaaatgttttggaacaacagaggagagttccaatgcatttttagaacctggcggcagcgcaaaagatg

SEQ ID NO: 49917 - DNA, 103 bp, Artificial Sequence
  Synthetic Polynucleotide
taatacgactcactatagggtcgtttgttggaatcgtctaaaaatgttttaacagaggagaaaaacaatgttagacgataacctggcggcagcgcaaaagatg

SEQ ID NO: 49918 - DNA, 103 bp, Artificial Sequence
  Synthetic Polynucleotide
taatacgactcactatagggacctttcgtttgttggaatcgtctaaaaataacagaggagaatttttatgcgattccaaaacctggcggcagcgcaaaagatg

SEQ ID NO: 49919 - DNA, 103 bp, Artificial Sequence
  Synthetic Polynucleotide
taatacgactcactatagggccaatacctttcgtttgttggaatcgtctaaacagaggagatagacgatgccaacaaacaacctggcggcagcgcaaaagatg

SEQ ID NO: 49920 - DNA, 103 bp, Artificial Sequence
  Synthetic Polynucleotide
taatacgactcactatagggaatcgccaatacctttcgtttgttggaatcaacagaggagagattccatgaaacgaaagaacctggcggcagcgcaaaagatg

SEQ ID NO: 49921 - DNA, 103 bp, Artificial Sequence
  Synthetic Polynucleotide
taatacgactcactatagggaaatcaatcgccaatacctttcgtttgttgaacagaggagacaacaaatgaaaggtattaacctggcggcagcgcaaaagatg

SEQ ID NO: 49922 - DNA, 103 bp, Artificial Sequence
  Synthetic Polynucleotide
taatacgactcactatagggtttcaaaatcaatcgccaatacctttcgttaacagaggagaaacgaaatgtattggcgaaacctggcggcagcgcaaaagatg

SEQ ID NO: 49923 - DNA, 103 bp, Artificial Sequence
  Synthetic Polynucleotide
taatacgactcactatagggaccgttttcaaaatcaatcgccaataccttaacagaggagaaaggtaatggcgattgataacctggcggcagcgcaaaagatg

SEQ ID NO: 49924 - DNA, 103 bp, Artificial Sequence
  Synthetic Polynucleotide
taatacgactcactatagggtcagcaccgttttcaaaatcaatcgccaataacagaggagaattggcatgtgattttgaaacctggcggcagcgcaaaagatg

SEQ ID NO: 49925 - DNA, 103 bp, Artificial Sequence
  Synthetic Polynucleotide
taatacgactcactatagggccaggtcagcaccgttttcaaaatcaatcgaacagaggagacgattgatgttgaaaacgaacctggcggcagcgcaaaagatg

SEQ ID NO: 49926 - DNA, 103 bp, Artificial Sequence
  Synthetic Polynucleotide
taatacgactcactatagggtataaagttaaagaagagaactactcatccaacagaggagaggatgaatggttctcttcaacctggcggcagcgcaaaagatg

SEQ ID NO: 49927 - DNA, 103 bp, Artificial Sequence
  Synthetic Polynucleotide
taatacgactcactatagggtttttccaggtcagcaccgttttcaaaatcaacagaggagagattttatgaacggtgctaacctggcggcagcgcaaaagatg

SEQ ID NO: 49928 - DNA, 103 bp, Artificial Sequence
  Synthetic Polynucleotide
taatacgactcactatagggaagtatttttccaggtcagcaccgttttcaaacagaggagatgaaaaatgtgctgacctaacctggcggcagcgcaaaagatg

SEQ ID NO: 49929 - DNA, 103 bp, Artificial Sequence
  Synthetic Polynucleotide
taatacgactcactatagggcataaaagtatttttccaggtcagcaccgtaacagaggagaacggtgatgacctggaaaaacctggcggcagcgcaaaagatg

SEQ ID NO: 49930 - DNA, 103 bp, Artificial Sequence
  Synthetic Polynucleotide
taatacgactcactatagggctctccataaaagtatttttccaggtcagcaacagaggagagctgacatggaaaaatacaacctggcggcagcgcaaaagatg

SEQ ID NO: 49931 - DNA, 103 bp, Artificial Sequence
  Synthetic Polynucleotide
taatacgactcactataggggcaatctctccataaaagtatttttccaggaacagaggagacctggaatgatacttttaaacctggcggcagcgcaaaagatg

SEQ ID NO: 49932 - DNA, 103 bp, Artificial Sequence
  Synthetic Polynucleotide
taatacgactcactatagggataacgcaatctctccataaaagtatttttaacagaggagaaaaaatatgtttatggagaacctggcggcagcgcaaaagatg

SEQ ID NO: 49933 - DNA, 103 bp, Artificial Sequence
  Synthetic Polynucleotide
taatacgactcactatagggtaccaataacgcaatctctccataaaagtaaacagaggagatactttatgggagagattaacctggcggcagcgcaaaagatg

SEQ ID NO: 49934 - DNA, 103 bp, Artificial Sequence
  Synthetic Polynucleotide
taatacgactcactataggggtcgctaccaataacgcaatctctccataaaacagaggagattatggatggattgcgttaacctggcggcagcgcaaaagatg

SEQ ID NO: 49935 - DNA, 103 bp, Artificial Sequence
  Synthetic Polynucleotide
taatacgactcactataggggatccgtcgctaccaataacgcaatctctcaacagaggagagagagaatgcgttattggaacctggcggcagcgcaaaagatg

SEQ ID NO: 49936 - DNA, 103 bp, Artificial Sequence
  Synthetic Polynucleotide
taatacgactcactatagggatctggatccgtcgctaccaataacgcaataacagaggagaattgcgatgttggtagcgaacctggcggcagcgcaaaagatg

SEQ ID NO: 49937 - DNA, 103 bp, Artificial Sequence
  Synthetic Polynucleotide
taatacgactcactatagggaaaagtataaagttaaagaagagaactactaacagaggagaagtagtatgcttctttaaaacctggcggcagcgcaaaagatg

SEQ ID NO: 49938 - DNA, 103 bp, Artificial Sequence
  Synthetic Polynucleotide
taatacgactcactatagggtcagcatctggatccgtcgctaccaataacaacagaggagagttattatgagcgacggaaacctggcggcagcgcaaaagatg

SEQ ID NO: 49939 - DNA, 103 bp, Artificial Sequence
  Synthetic Polynucleotide
taatacgactcactatagggtagcatcagcatctggatccgtcgctaccaaacagaggagatggtagatgcggatccagaacctggcggcagcgcaaaagatg

SEQ ID NO: 49940 - DNA, 103 bp, Artificial Sequence
  Synthetic Polynucleotide
taatacgactcactatagggagctatagcatcagcatctggatccgtcgcaacagaggagagcgacgatgccagatgctaacctggcggcagcgcaaaagatg

SEQ ID NO: 49941 - DNA, 103 bp, Artificial Sequence
  Synthetic Polynucleotide
taatacgactcactatagggcctctagctatagcatcagcatctggatccaacagaggagaggatccatgtgctgatgcaacctggcggcagcgcaaaagatg

SEQ ID NO: 49942 - DNA, 103 bp, Artificial Sequence
  Synthetic Polynucleotide
taatacgactcactatagggcatttcctctagctatagcatcagcatctgaacagaggagacagatgatgatgctatagaacctggcggcagcgcaaaagatg

SEQ ID NO: 49943 - DNA, 103 bp, Artificial Sequence
  Synthetic Polynucleotide
taatacgactcactatagggtctttcatttcctctagctatagcatcagcaacagaggagagctgatatgatagctagaaacctggcggcagcgcaaaagatg

SEQ ID NO: 49944 - DNA, 103 bp, Artificial Sequence
  Synthetic Polynucleotide
taatacgactcactatagggttgtatctttcatttcctctagctatagcaaacagaggagatgctatatgtagaggaaaaacctggcggcagcgcaaaagatg

SEQ ID NO: 49945 - DNA, 103 bp, Artificial Sequence
  Synthetic Polynucleotide
taatacgactcactatagggatttgttgtatctttcatttcctctagctaaacagaggagatagctaatggaaatgaaaaacctggcggcagcgcaaaagatg

SEQ ID NO: 49946 - DNA, 103 bp, Artificial Sequence
  Synthetic Polynucleotide
taatacgactcactatagggatttaatttgttgtatctttcatttcctctaacagaggagaagaggaatggaaagatacaacctggcggcagcgcaaaagatg

SEQ ID NO: 49947 - DNA, 103 bp, Artificial Sequence
  Synthetic Polynucleotide
taatacgactcactatagggccagaatttaatttgttgtatctttcatttaacagaggagaaaatgaatgatacaacaaaacctggcggcagcgcaaaagatg

SEQ ID NO: 49948 - DNA, 103 bp, Artificial Sequence
  Synthetic Polynucleotide
taatacgactcactatagggtagtaaaaagtataaagttaaagaagagaaaacagaggagattctctatgttaactttaaacctggcggcagcgcaaaagatg

SEQ ID NO: 49949 - DNA, 103 bp, Artificial Sequence
  Synthetic Polynucleotide
taatacgactcactatagggtaattccagaatttaatttgttgtatctttaacagaggagaaaagatatgacaaattaaaacctggcggcagcgcaaaagatg

SEQ ID NO: 49950 - DNA, 103 bp, Artificial Sequence
  Synthetic Polynucleotide
taatacgactcactatagggggttttaattccagaatttaatttgttgtaaacagaggagatacaacatgttaaattctaacctggcggcagcgcaaaagatg

SEQ ID NO: 49951 - DNA, 103 bp, Artificial Sequence
  Synthetic Polynucleotide
taatacgactcactatagggtacttggttttaattccagaatttaatttgaacagaggagacaaattatgttctggaataacctggcggcagcgcaaaagatg

SEQ ID NO: 49952 - DNA, 103 bp, Artificial Sequence
  Synthetic Polynucleotide
taatacgactcactatagggtgtagtacttggttttaattccagaatttaaacagaggagataaattatggaattaaaaaacctggcggcagcgcaaaagatg

SEQ ID NO: 49953 - DNA, 103 bp, Artificial Sequence
  Synthetic Polynucleotide
taatacgactcactatagggaaatttgtagtacttggttttaattccagaaacagaggagatctggaatgaaaaccaagaacctggcggcagcgcaaaagatg

SEQ ID NO: 49954 - DNA, 103 bp, Artificial Sequence
  Synthetic Polynucleotide
taatacgactcactatagggtagtcaaatttgtagtacttggttttaattaacagaggagaaattaaatgcaagtactaaacctggcggcagcgcaaaagatg

SEQ ID NO: 49955 - DNA, 103 bp, Artificial Sequence
  Synthetic Polynucleotide
taatacgactcactataggggaatgtagtcaaatttgtagtacttggtttaacagaggagaaaaccaatgactacaaataacctggcggcagcgcaaaagatg

SEQ ID NO: 49956 - DNA, 103 bp, Artificial Sequence
  Synthetic Polynucleotide
taatacgactcactatagggttcctgaatgtagtcaaatttgtagtacttaacagaggagaaagtacatgaaatttgacaacctggcggcagcgcaaaagatg

SEQ ID NO: 49957 - DNA, 103 bp, Artificial Sequence
  Synthetic Polynucleotide
taatacgactcactatagggatagtttcctgaatgtagtcaaatttgtagaacagaggagactacaaatgtgactacataacctggcggcagcgcaaaagatg

SEQ ID NO: 49958 - DNA, 103 bp, Artificial Sequence
  Synthetic Polynucleotide
taatacgactcactatagggatcgaatagtttcctgaatgtagtcaaattaacagaggagaaatttgatgacattcaggaacctggcggcagcgcaaaagatg

SEQ ID NO: 49959 - DNA, 103 bp, Artificial Sequence
  Synthetic Polynucleotide
taatacgactcactatagggatgattagtaaaaagtataaagttaaagaaaacagaggagattctttatgtttatacttaacctggcggcagcgcaaaagatg

SEQ ID NO: 49960 - DNA, 103 bp, Artificial Sequence
  Synthetic Polynucleotide
taatacgactcactatagggattggatcgaatagtttcctgaatgtagtcaacagaggagagactacatgcaggaaactaacctggcggcagcgcaaaagatg

SEQ ID NO: 49961 - DNA, 103 bp, Artificial Sequence
  Synthetic Polynucleotide
taatacgactcactatagggaatgtattggatcgaatagtttcctgaatgaacagaggagacattcaatgaactattcgaacctggcggcagcgcaaaagatg

SEQ ID NO: 49962 - DNA, 103 bp, Artificial Sequence
  Synthetic Polynucleotide
taatacgactcactatagggatacaaatgtattggatcgaatagtttcctaacagaggagaaggaaaatgttcgatccaaacctggcggcagcgcaaaagatg

SEQ ID NO: 49963 - DNA, 103 bp, Artificial Sequence
  Synthetic Polynucleotide
taatacgactcactatagggactagatacaaatgtattggatcgaatagtaacagaggagaactattatgtccaatacaaacctggcggcagcgcaaaagatg

SEQ ID NO: 49964 - DNA, 103 bp, Artificial Sequence
  Synthetic Polynucleotide
taatacgactcactatagggctgacactagatacaaatgtattggatcgaaacagaggagatcgatcatgtacatttgtaacctggcggcagcgcaaaagatg

SEQ ID NO: 49965 - DNA, 103 bp, Artificial Sequence
  Synthetic Polynucleotide
taatacgactcactatagggcttctctgacactagatacaaatgtattggaacagaggagaccaataatgttgtatctaaacctggcggcagcgcaaaagatg

SEQ ID NO: 49966 - DNA, 103 bp, Artificial Sequence
  Synthetic Polynucleotide
taatacgactcactatagggaaatacttctctgacactagatacaaatgtaacagaggagaacatttatgtctagtgtcaacctggcggcagcgcaaaagatg

SEQ ID NO: 49967 - DNA, 103 bp, Artificial Sequence
  Synthetic Polynucleotide
taatacgactcactatagggaaataaaatacttctctgacactagatacaaacagaggagatgtatcatgtgtcagagaaacctggcggcagcgcaaaagatg

SEQ ID NO: 49968 - DNA, 103 bp, Artificial Sequence
  Synthetic Polynucleotide
taatacgactcactatagggttccaaaataaaatacttctctgacactagaacagaggagactagtgatggagaagtataacctggcggcagcgcaaaagatg

SEQ ID NO: 49969 - DNA, 103 bp, Artificial Sequence
  Synthetic Polynucleotide
taatacgactcactatagggaaactttccaaaataaaatacttctctgacaacagaggagagtcagaatggtattttataacctggcggcagcgcaaaagatg

SEQ ID NO: 49970 - DNA, 103 bp, Artificial Sequence
  Synthetic Polynucleotide
taatacgactcactatagggtaaatatgattagtaaaaagtataaagttaaacagaggagataacttatgactttttacaacctggcggcagcgcaaaagatg

SEQ ID NO: 49971 - DNA, 103 bp, Artificial Sequence
  Synthetic Polynucleotide
taatacgactcactatagggatattaaactttccaaaataaaatacttctaacagaggagaagaagtatgttattttggaacctggcggcagcgcaaaagatg

SEQ ID NO: 49972 - DNA, 103 bp, Artificial Sequence
  Synthetic Polynucleotide
taatacgactcactatagggcgatgatattaaactttccaaaataaaataaacagaggagatattttatgttggaaagtaacctggcggcagcgcaaaagatg

SEQ ID NO: 49973 - DNA, 103 bp, Artificial Sequence
  Synthetic Polynucleotide
taatacgactcactatagggccagtcgatgatattaaactttccaaaataaacagaggagatattttatgaagtttaataacctggcggcagcgcaaaagatg

SEQ ID NO: 49974 - DNA, 103 bp, Artificial Sequence
  Synthetic Polynucleotide
taatacgactcactatagggaactgccagtcgatgatattaaactttccaaacagaggagatggaaaatgtaatatcataacctggcggcagcgcaaaagatg

SEQ ID NO: 49975 - DNA, 103 bp, Artificial Sequence
  Synthetic Polynucleotide
taatacgactcactatagggtagcaaactgccagtcgatgatattaaactaacagaggagaagtttaatgtcatcgactaacctggcggcagcgcaaaagatg

SEQ ID NO: 49976 - DNA, 103 bp, Artificial Sequence
  Synthetic Polynucleotide
taatacgactcactatagggatggatagcaaactgccagtcgatgatattaacagaggagaaatatcatggactggcagaacctggcggcagcgcaaaagatg

SEQ ID NO: 49977 - DNA, 103 bp, Artificial Sequence
  Synthetic Polynucleotide
taatacgactcactataggggaataatggatagcaaactgccagtcgatgaacagaggagacatcgaatggcagtttgcaacctggcggcagcgcaaaagatg

SEQ ID NO: 49978 - DNA, 103 bp, Artificial Sequence
  Synthetic Polynucleotide
taatacgactcactatagggggaaagaataatggatagcaaactgccagtaacagaggagaactggcatgttgctatccaacctggcggcagcgcaaaagatg

SEQ ID NO: 49979 - DNA, 103 bp, Artificial Sequence
  Synthetic Polynucleotide
taatacgactcactatagggcggatggaaagaataatggatagcaaactgaacagaggagacagtttatgatccattataacctggcggcagcgcaaaagatg

SEQ ID NO: 49980 - DNA, 103 bp, Artificial Sequence
  Synthetic Polynucleotide
taatacgactcactatagggtgtctcggatggaaagaataatggatagcaaacagaggagatgctatatgttattctttaacctggcggcagcgcaaaagatg

SEQ ID NO: 49981 - DNA, 103 bp, Artificial Sequence
  Synthetic Polynucleotide
taatacgactcactatagggtagtctaaatatgattagtaaaaagtataaaacagaggagattatacatgttactaatcaacctggcggcagcgcaaaagatg

SEQ ID NO: 49982 - DNA, 103 bp, Artificial Sequence
  Synthetic Polynucleotide
taatacgactcactatagggcataatgtctcggatggaaagaataatggaaacagaggagatccattatgctttccatcaacctggcggcagcgcaaaagatg

SEQ ID NO: 49983 - DNA, 103 bp, Artificial Sequence
  Synthetic Polynucleotide
taatacgactcactatagggggtagcataatgtctcggatggaaagaataaacagaggagatattctatgcatccgagaaacctggcggcagcgcaaaagatg

SEQ ID NO: 49984 - DNA, 103 bp, Artificial Sequence
  Synthetic Polynucleotide
taatacgactcactatagggatgatggtagcataatgtctcggatggaaaaacagaggagatttccaatggagacattaaacctggcggcagcgcaaaagatg

SEQ ID NO: 49985 - DNA, 103 bp, Artificial Sequence
  Synthetic Polynucleotide
taatacgactcactatagggtattcatgatggtagcataatgtctcggataacagaggagaatccgaatgattatgctaaacctggcggcagcgcaaaagatg

SEQ ID NO: 49986 - DNA, 103 bp, Artificial Sequence
  Synthetic Polynucleotide
taatacgactcactatagggtaagttattcatgatggtagcataatgtctaacagaggagaagacatatggctaccatcaacctggcggcagcgcaaaagatg

SEQ ID NO: 49987 - DNA, 103 bp, Artificial Sequence
  Synthetic Polynucleotide
taatacgactcactatagggtcggataagttattcatgatggtagcataaaacagaggagattatgcatgcatcatgaaaacctggcggcagcgcaaaagatg

SEQ ID NO: 49988 - DNA, 103 bp, Artificial Sequence
  Synthetic Polynucleotide
taatacgactcactatagggttagttcggataagttattcatgatggtagaacagaggagactaccaatgtgaataactaacctggcggcagcgcaaaagatg

SEQ ID NO: 49989 - DNA, 103 bp, Artificial Sequence
  Synthetic Polynucleotide
taatacgactcactatagggagcagttagttcggataagttattcatgataacagaggagaatcatgatgaacttatccaacctggcggcagcgcaaaagatg

SEQ ID NO: 49990 - DNA, 103 bp, Artificial Sequence
  Synthetic Polynucleotide
taatacgactcactatagggccagaagcagttagttcggataagttattcaacagaggagagaataaatgatccgaactaacctggcggcagcgcaaaagatg

SEQ ID NO: 49991 - DNA, 103 bp, Artificial Sequence
  Synthetic Polynucleotide
taatacgactcactatagggtgcctccagaagcagttagttcggataagtaacagaggagaacttatatgaactaactgaacctggcggcagcgcaaaagatg

SEQ ID NO: 49992 - DNA, 103 bp, Artificial Sequence
  Synthetic Polynucleotide
taatacgactcactatagggtacattagtctaaatatgattagtaaaaagaacagaggagactttttatgaatcatattaacctggcggcagcgcaaaagatg

SEQ ID NO: 49993 - DNA, 103 bp, Artificial Sequence
  Synthetic Polynucleotide
taatacgactcactatagggtaccttgcctccagaagcagttagttcggaaacagaggagatccgaaatgactgcttctaacctggcggcagcgcaaaagatg

SEQ ID NO: 49994 - DNA, 103 bp, Artificial Sequence
  Synthetic Polynucleotide
taatacgactcactatagggattaataccttgcctccagaagcagttagtaacagaggagaactaacatgttctggaggaacctggcggcagcgcaaaagatg

SEQ ID NO: 49995 - DNA, 103 bp, Artificial Sequence
  Synthetic Polynucleotide
taatacgactcactatagggtagtaattaataccttgcctccagaagcagaacagaggagactgcttatggaggcaaggaacctggcggcagcgcaaaagatg

SEQ ID NO: 49996 - DNA, 103 bp, Artificial Sequence
  Synthetic Polynucleotide
taatacgactcactatagggcatggtagtaattaataccttgcctccagaaacagaggagatctggaatgaaggtattaaacctggcggcagcgcaaaagatg

SEQ ID NO: 49997 - DNA, 103 bp, Artificial Sequence
  Synthetic Polynucleotide
taatacgactcactatagggccgtccatggtagtaattaataccttgcctaacagaggagaaggcaaatgattaattacaacctggcggcagcgcaaaagatg

SEQ ID NO: 49998 - DNA, 103 bp, Artificial Sequence
  Synthetic Polynucleotide
taatacgactcactatagggtgtctccgtccatggtagtaattaatacctaacagaggagaaggtatatgttactaccaaacctggcggcagcgcaaaagatg

SEQ ID NO: 49999 - DNA, 103 bp, Artificial Sequence
  Synthetic Polynucleotide
taatacgactcactatagggtaatttgtctccgtccatggtagtaattaaaacagaggagattaattatgaccatggacaacctggcggcagcgcaaaagatg

SEQ ID NO: 50000 - DNA, 103 bp, Artificial Sequence
  Synthetic Polynucleotide
taatacgactcactatagggtttgataatttgtctccgtccatggtagtaaacagaggagatactacatgggacggagaaacctggcggcagcgcaaaagatg

SEQ ID NO: 50001 - DNA, 103 bp, Artificial Sequence
  Synthetic Polynucleotide
taatacgactcactatagggttaattttgataatttgtctccgtccatggaacagaggagaccatggatggagacaaataacctggcggcagcgcaaaagatg

SEQ ID NO: 50002 - DNA, 103 bp, Artificial Sequence
  Synthetic Polynucleotide
taatacgactcactatagggatcggttaattttgataatttgtctccgtcaacagaggagagacggaatgaaattatcaaacctggcggcagcgcaaaagatg

SEQ ID NO: 50003 - DNA, 103 bp, Artificial Sequence
  Synthetic Polynucleotide
taatacgactcactatagggacccatacattagtctaaatatgattagtaaacagaggagatactaaatgtatttagacaacctggcggcagcgcaaaagatg

SEQ ID NO: 50004 - DNA, 103 bp, Artificial Sequence
  Synthetic Polynucleotide
taatacgactcactatagggtttttatcggttaattttgataatttgtctaacagaggagaagacaaatgatcaaaattaacctggcggcagcgcaaaagatg

SEQ ID NO: 50005 - DNA, 103 bp, Artificial Sequence
  Synthetic Polynucleotide
taatacgactcactatagggaagtctttttatcggttaattttgataattaacagaggagaaattatatgaattaaccgaacctggcggcagcgcaaaagatg

SEQ ID NO: 50006 - DNA, 103 bp, Artificial Sequence
  Synthetic Polynucleotide
taatacgactcactatagggtataaaagtctttttatcggttaattttgaaacagaggagatcaaaaatgaccgataaaaacctggcggcagcgcaaaagatg

SEQ ID NO: 50007 - DNA, 103 bp, Artificial Sequence
  Synthetic Polynucleotide
taatacgactcactatagggtgaattataaaagtctttttatcggttaataacagaggagaattaacatgtaaaaagacaacctggcggcagcgcaaaagatg

SEQ ID NO: 50008 - DNA, 103 bp, Artificial Sequence
  Synthetic Polynucleotide
taatacgactcactatagggtcttatgaattataaaagtctttttatcggaacagaggagaccgataatgagacttttaaacctggcggcagcgcaaaagatg

SEQ ID NO: 50009 - DNA, 103 bp, Artificial Sequence
  Synthetic Polynucleotide
taatacgactcactatagggtagattcttatgaattataaaagtctttttaacagaggagaaaaaagatgtttataattaacctggcggcagcgcaaaagatg

SEQ ID NO: 50010 - DNA, 103 bp, Artificial Sequence
  Synthetic Polynucleotide
taatacgactcactatagggctaggtagattcttatgaattataaaagtcaacagaggagagactttatgaattcataaaacctggcggcagcgcaaaagatg

SEQ ID NO: 50011 - DNA, 103 bp, Artificial Sequence
  Synthetic Polynucleotide
taatacgactcactatagggcgctactaggtagattcttatgaattataaaacagaggagattataaatgataagaatcaacctggcggcagcgcaaaagatg

SEQ ID NO: 50012 - DNA, 103 bp, Artificial Sequence
  Synthetic Polynucleotide
taatacgactcactataggggttttcgctactaggtagattcttatgaataacagaggagaattcatatgaatctacctaacctggcggcagcgcaaaagatg

SEQ ID NO: 50013 - DNA, 103 bp, Artificial Sequence
  Synthetic Polynucleotide
taatacgactcactatagggatatagttttcgctactaggtagattcttaaacagaggagataagaaatgacctagtagaacctggcggcagcgcaaaagatg

SEQ ID NO: 50014 - DNA, 103 bp, Artificial Sequence
  Synthetic Polynucleotide
taatacgactcactatagggctcatccacaaccccattaaaaaatggaaaaacagaggagatttccaatgtttaatgggaacctggcggcagcgcaaaagatg

SEQ ID NO: 50015 - DNA, 103 bp, Artificial Sequence
  Synthetic Polynucleotide
taatacgactcactatagggctattacccatacattagtctaaatatgataacagaggagaatcataatgagactaatgaacctggcggcagcgcaaaagatg

SEQ ID NO: 50016 - DNA, 103 bp, Artificial Sequence
  Synthetic Polynucleotide
taatacgactcactatagggcagacatatagttttcgctactaggtagataacagaggagaatctacatggtagcgaaaaacctggcggcagcgcaaaagatg

SEQ ID NO: 50017 - DNA, 103 bp, Artificial Sequence
  Synthetic Polynucleotide
taatacgactcactatagggttctacagacatatagttttcgctactaggaacagaggagacctagtatggaaaactataacctggcggcagcgcaaaagatg

SEQ ID NO: 50018 - DNA, 103 bp, Artificial Sequence
  Synthetic Polynucleotide
taatacgactcactatagggattttttctacagacatatagttttcgctaaacagaggagatagcgaatgctatatgtcaacctggcggcagcgcaaaagatg

SEQ ID NO: 50019 - DNA, 103 bp, Artificial Sequence
  Synthetic Polynucleotide
taatacgactcactatagggcagctattttttctacagacatatagttttaacagaggagaaaaactatgtgtctgtagaacctggcggcagcgcaaaagatg

SEQ ID NO: 50020 - DNA, 103 bp, Artificial Sequence
  Synthetic Polynucleotide
taatacgactcactatagggatcatcagctattttttctacagacatataaacagaggagatatatgatggtagaaaaaaacctggcggcagcgcaaaagatg

SEQ ID NO: 50021 - DNA, 103 bp, Artificial Sequence
  Synthetic Polynucleotide
taatacgactcactatagggattctatcatcagctattttttctacagacaacagaggagagtctgtatgaaaaatagcaacctggcggcagcgcaaaagatg

SEQ ID NO: 50022 - DNA, 103 bp, Artificial Sequence
  Synthetic Polynucleotide
taatacgactcactatagggccactattctatcatcagctattttttctaaacagaggagatagaaaatgtagctgatgaacctggcggcagcgcaaaagatg

SEQ ID NO: 50023 - DNA, 103 bp, Artificial Sequence
  Synthetic Polynucleotide
taatacgactcactatagggatataccactattctatcatcagctattttaacagaggagaaaaataatggatgatagaaacctggcggcagcgcaaaagatg

SEQ ID NO: 50024 - DNA, 103 bp, Artificial Sequence
  Synthetic Polynucleotide
taatacgactcactatagggggattatataccactattctatcatcagctaacagaggagaagctgaatgtagaatagtaacctggcggcagcgcaaaagatg

SEQ ID NO: 50025 - DNA, 103 bp, Artificial Sequence
  Synthetic Polynucleotide
taatacgactcactatagggttgatggattatataccactattctatcataacagaggagaatgataatgtagtggtataacctggcggcagcgcaaaagatg

SEQ ID NO: 50026 - DNA, 103 bp, Artificial Sequence
  Synthetic Polynucleotide
taatacgactcactatagggaaacactattacccatacattagtctaaataacagaggagaatttagatgaatgtatggaacctggcggcagcgcaaaagatg

SEQ ID NO: 50027 - DNA, 103 bp, Artificial Sequence
  Synthetic Polynucleotide
taatacgactcactatagggcattgttgatggattatataccactattctaacagaggagaagaataatggtatataataacctggcggcagcgcaaaagatg

SEQ ID NO: 50028 - DNA, 103 bp, Artificial Sequence
  Synthetic Polynucleotide
taatacgactcactataggggtagacattgttgatggattatataccactaacagaggagaagtggtatgtaatccatcaacctggcggcagcgcaaaagatg

SEQ ID NO: 50029 - DNA, 103 bp, Artificial Sequence
  Synthetic Polynucleotide
taatacgactcactatagggttggagtagacattgttgatggattatataaacagaggagatatataatgcatcaacaaaacctggcggcagcgcaaaagatg

SEQ ID NO: 50030 - DNA, 103 bp, Artificial Sequence
  Synthetic Polynucleotide
taatacgactcactatagggagtcattggagtagacattgttgatggattaacagaggagaaatccaatgacaatgtctaacctggcggcagcgcaaaagatg

SEQ ID NO: 50031 - DNA, 103 bp, Artificial Sequence
  Synthetic Polynucleotide
taatacgactcactatagggtattcagtcattggagtagacattgttgataacagaggagaatcaacatggtctactccaacctggcggcagcgcaaaagatg

SEQ ID NO: 50032 - DNA, 103 bp, Artificial Sequence
  Synthetic Polynucleotide
taatacgactcactatagggtaatgtattcagtcattggagtagacattgaacagaggagacaatgtatgctccaatgaaacctggcggcagcgcaaaagatg

SEQ ID NO: 50033 - DNA, 103 bp, Artificial Sequence
  Synthetic Polynucleotide
taatacgactcactatagggtttgataatgtattcagtcattggagtagaaacagaggagatctactatgatgactgaaaacctggcggcagcgcaaaagatg

SEQ ID NO: 50034 - DNA, 103 bp, Artificial Sequence
  Synthetic Polynucleotide
taatacgactcactatagggttctttttgataatgtattcagtcattggaaacagaggagatccaatatgtgaatacataacctggcggcagcgcaaaagatg

SEQ ID NO: 50035 - DNA, 103 bp, Artificial Sequence
  Synthetic Polynucleotide
taatacgactcactatagggtatcgttctttttgataatgtattcagtcaaacagaggagatgactgatgacattatcaaacctggcggcagcgcaaaagatg

SEQ ID NO: 50036 - DNA, 103 bp, Artificial Sequence
  Synthetic Polynucleotide
taatacgactcactatagggaactatatcgttctttttgataatgtattcaacagaggagagaatacatgatcaaaaagaacctggcggcagcgcaaaagatg

SEQ ID NO: 50037 - DNA, 103 bp, Artificial Sequence
  Synthetic Polynucleotide
taatacgactcactatagggtcttcaaacactattacccatacattagtcaacagaggagagactaaatgatgggtaataacctggcggcagcgcaaaagatg

SEQ ID NO: 50038 - DNA, 103 bp, Artificial Sequence
  Synthetic Polynucleotide
taatacgactcactatagggactctaactatatcgttctttttgataatgaacagaggagacattatatgaaagaacgaaacctggcggcagcgcaaaagatg

SEQ ID NO: 50039 - DNA, 103 bp, Artificial Sequence
  Synthetic Polynucleotide
taatacgactcactatagggtaaacactctaactatatcgttctttttgaaacagaggagatcaaaaatgacgatatagaacctggcggcagcgcaaaagatg

SEQ ID NO: 50040 - DNA, 103 bp, Artificial Sequence
  Synthetic Polynucleotide
taatacgactcactatagggttcgttaaacactctaactatatcgttcttaacagaggagaaagaacatgatagttagaaacctggcggcagcgcaaaagatg

SEQ ID NO: 50041 - DNA, 103 bp, Artificial Sequence
  Synthetic Polynucleotide
taatacgactcactatagggccgtattcgttaaacactctaactatatcgaacagaggagacgatatatgtagagtgttaacctggcggcagcgcaaaagatg

SEQ ID NO: 50042 - DNA, 103 bp, Artificial Sequence
  Synthetic Polynucleotide
taatacgactcactatagggcaaatccgtattcgttaaacactctaactaaacagaggagatagttaatgtgtttaacgaacctggcggcagcgcaaaagatg

SEQ ID NO: 50043 - DNA, 103 bp, Artificial Sequence
  Synthetic Polynucleotide
taatacgactcactatagggaagaacaaatccgtattcgttaaacactctaacagaggagaagagtgatgaacgaatacaacctggcggcagcgcaaaagatg

SEQ ID NO: 50044 - DNA, 103 bp, Artificial Sequence
  Synthetic Polynucleotide
taatacgactcactatagggtctacaagaacaaatccgtattcgttaaacaacagaggagagtttaaatgatacggattaacctggcggcagcgcaaaagatg

SEQ ID NO: 50045 - DNA, 103 bp, Artificial Sequence
  Synthetic Polynucleotide
taatacgactcactatagggcattatctacaagaacaaatccgtattcgtaacagaggagaacgaatatggatttgttcaacctggcggcagcgcaaaagatg

SEQ ID NO: 50046 - DNA, 103 bp, Artificial Sequence
  Synthetic Polynucleotide
taatacgactcactatagggatcaacattatctacaagaacaaatccgtaaacagaggagatacggaatggttcttgtaaacctggcggcagcgcaaaagatg

SEQ ID NO: 50047 - DNA, 103 bp, Artificial Sequence
  Synthetic Polynucleotide
taatacgactcactataggggcgaaatcaacattatctacaagaacaaataacagaggagaatttgtatgtgtagataaaacctggcggcagcgcaaaagatg

SEQ ID NO: 50048 - DNA, 103 bp, Artificial Sequence
  Synthetic Polynucleotide
taatacgactcactatagggcgagctcttcaaacactattacccatacataacagaggagaatgtatatgtaatagtgtaacctggcggcagcgcaaaagatg

SEQ ID NO: 50049 - DNA, 103 bp, Artificial Sequence
  Synthetic Polynucleotide
taatacgactcactatagggttgtagcgaaatcaacattatctacaagaaaacagaggagattcttgatgataatgttgaacctggcggcagcgcaaaagatg

SEQ ID NO: 50050 - DNA, 103 bp, Artificial Sequence
  Synthetic Polynucleotide
taatacgactcactatagggtataattgtagcgaaatcaacattatctacaacagaggagagtagatatggttgatttcaacctggcggcagcgcaaaagatg

SEQ ID NO: 50051 - DNA, 103 bp, Artificial Sequence
  Synthetic Polynucleotide
taatacgactcactatagggcgttctataattgtagcgaaatcaacattaaacagaggagataatgtatgtttcgctacaacctggcggcagcgcaaaagatg

SEQ ID NO: 50052 - DNA, 103 bp, Artificial Sequence
  Synthetic Polynucleotide
taatacgactcactatagggtacttcgttctataattgtagcgaaatcaaaacagaggagattgattatgctacaattaaacctggcggcagcgcaaaagatg

SEQ ID NO: 50053 - DNA, 103 bp, Artificial Sequence
  Synthetic Polynucleotide
taatacgactcactatagggctttttacttcgttctataattgtagcgaaaacagaggagattcgctatgattatagaaaacctggcggcagcgcaaaagatg

SEQ ID NO: 50054 - DNA, 103 bp, Artificial Sequence
  Synthetic Polynucleotide
taatacgactcactatagggataaactttttacttcgttctataattgtaaacagaggagatacaatatgagaacgaagaacctggcggcagcgcaaaagatg

SEQ ID NO: 50055 - DNA, 103 bp, Artificial Sequence
  Synthetic Polynucleotide
taatacgactcactatagggcattaataaactttttacttcgttctataaaacagaggagattatagatggaagtaaaaaacctggcggcagcgcaaaagatg

SEQ ID NO: 50056 - DNA, 103 bp, Artificial Sequence
  Synthetic Polynucleotide
taatacgactcactatagggtgcaccattaataaactttttacttcgttcaacagaggagagaacgaatgaaaaagtttaacctggcggcagcgcaaaagatg

SEQ ID NO: 50057 - DNA, 103 bp, Artificial Sequence
  Synthetic Polynucleotide
taatacgactcactataggggtagatgcaccattaataaactttttacttaacagaggagaaagtaaatggtttattaaaacctggcggcagcgcaaaagatg

SEQ ID NO: 50058 - DNA, 103 bp, Artificial Sequence
  Synthetic Polynucleotide
taatacgactcactatagggccattgtagatgcaccattaataaacttttaacagaggagaaaaagtatgttaatggtgaacctggcggcagcgcaaaagatg

SEQ ID NO: 50059 - DNA, 103 bp, Artificial Sequence
  Synthetic Polynucleotide
taatacgactcactataggggagaacgagctcttcaaacactattacccaaacagaggagatgggtaatggtgtttgaaaacctggcggcagcgcaaaagatg

SEQ ID NO: 50060 - DNA, 103 bp, Artificial Sequence
  Synthetic Polynucleotide
taatacgactcactatagggatcttccattgtagatgcaccattaataaaaacagaggagatttattatgggtgcatctaacctggcggcagcgcaaaagatg

SEQ ID NO: 50061 - DNA, 103 bp, Artificial Sequence
  Synthetic Polynucleotide
taatacgactcactatagggggtctatcttccattgtagatgcaccattaaacagaggagataatggatgatctacaataacctggcggcagcgcaaaagatg

SEQ ID NO: 50062 - DNA, 103 bp, Artificial Sequence
  Synthetic Polynucleotide
taatacgactcactatagggtagacggtctatcttccattgtagatgcacaacagaggagagtgcatatgcaatggaagaacctggcggcagcgcaaaagatg

SEQ ID NO: 50063 - DNA, 103 bp, Artificial Sequence
  Synthetic Polynucleotide
taatacgactcactatagggtcttgtagacggtctatcttccattgtagaaacagaggagatctacaatggaagatagaaacctggcggcagcgcaaaagatg

SEQ ID NO: 50064 - DNA, 103 bp, Artificial Sequence
  Synthetic Polynucleotide
taatacgactcactatagggaagtttcttgtagacggtctatcttccattaacagaggagaaatggaatgtagaccgtcaacctggcggcagcgcaaaagatg

SEQ ID NO: 50065 - DNA, 103 bp, Artificial Sequence
  Synthetic Polynucleotide
taatacgactcactatagggcgaaaaagtttcttgtagacggtctatcttaacagaggagaaagataatgcgtctacaaaacctggcggcagcgcaaaagatg

SEQ ID NO: 50066 - DNA, 103 bp, Artificial Sequence
  Synthetic Polynucleotide
taatacgactcactatagggtagttcgaaaaagtttcttgtagacggtctaacagaggagaagaccgatgacaagaaacaacctggcggcagcgcaaaagatg

SEQ ID NO: 50067 - DNA, 103 bp, Artificial Sequence
  Synthetic Polynucleotide
taatacgactcactatagggctatttagttcgaaaaagtttcttgtagacaacagaggagagtctacatgaaactttttaacctggcggcagcgcaaaagatg

SEQ ID NO: 50068 - DNA, 103 bp, Artificial Sequence
  Synthetic Polynucleotide
taatacgactcactatagggctcctctatttagttcgaaaaagtttcttgaacagaggagacaagaaatgttttcgaacaacctggcggcagcgcaaaagatg

SEQ ID NO: 50069 - DNA, 103 bp, Artificial Sequence
  Synthetic Polynucleotide
taatacgactcactatagggaatggctcctctatttagttcgaaaaagttaacagaggagaaactttatggaactaaataacctggcggcagcgcaaaagatg

SEQ ID NO: 50070 - DNA, 103 bp, Artificial Sequence
  Synthetic Polynucleotide
taatacgactcactatagggatgatgagaacgagctcttcaaacactattaacagaggagaaatagtatgtgaagagctaacctggcggcagcgcaaaagatg

SEQ ID NO: 50071 - DNA, 103 bp, Artificial Sequence
  Synthetic Polynucleotide
taatacgactcactatagggcatttaatggctcctctatttagttcgaaaaacagaggagatttcgaatgaaatagaggaacctggcggcagcgcaaaagatg

SEQ ID NO: 50072 - DNA, 103 bp, Artificial Sequence
  Synthetic Polynucleotide
taatacgactcactatagggcttcacatttaatggctcctctatttagttaacagaggagaaactaaatggaggagccaaacctggcggcagcgcaaaagatg

SEQ ID NO: 50073 - DNA, 103 bp, Artificial Sequence
  Synthetic Polynucleotide
taatacgactcactatagggtaaaccttcacatttaatggctcctctattaacagaggagaaatagaatggccattaaaaacctggcggcagcgcaaaagatg

SEQ ID NO: 50074 - DNA, 103 bp, Artificial Sequence
  Synthetic Polynucleotide
taatacgactcactatagggacatctaaaccttcacatttaatggctcctaacagaggagaaggagcatgtaaatgtgaaacctggcggcagcgcaaaagatg

SEQ ID NO: 50075 - DNA, 103 bp, Artificial Sequence
  Synthetic Polynucleotide
taatacgactcactatagggcttcgacatctaaaccttcacatttaatggaacagaggagaccattaatggtgaaggttaacctggcggcagcgcaaaagatg

SEQ ID NO: 50076 - DNA, 103 bp, Artificial Sequence
  Synthetic Polynucleotide
taatacgactcactatagggtaagtcttcgacatctaaaccttcacatttaacagaggagaaaatgtatgggtttagataacctggcggcagcgcaaaagatg

SEQ ID NO: 50077 - DNA, 103 bp, Artificial Sequence
  Synthetic Polynucleotide
taatacgactcactatagggctaagtaagtcttcgacatctaaaccttcaaacagaggagatgaaggatgagatgtcgaaacctggcggcagcgcaaaagatg

SEQ ID NO: 50078 - DNA, 103 bp, Artificial Sequence
  Synthetic Polynucleotide
taatacgactcactatagggagtaactaagtaagtcttcgacatctaaacaacagaggagagtttagatgtcgaagactaacctggcggcagcgcaaaagatg

SEQ ID NO: 50079 - DNA, 103 bp, Artificial Sequence
  Synthetic Polynucleotide
taatacgactcactatagggaacatagtaactaagtaagtcttcgacatcaacagaggagagatgtcatggacttacttaacctggcggcagcgcaaaagatg

SEQ ID NO: 50080 - DNA, 103 bp, Artificial Sequence
  Synthetic Polynucleotide
taatacgactcactatagggtaaacaacatagtaactaagtaagtcttcgaacagaggagacgaagaatgacttagttaaacctggcggcagcgcaaaagatg

SEQ ID NO: 50081 - DNA, 103 bp, Artificial Sequence
  Synthetic Polynucleotide
taatacgactcactatagggttctgatgatgagaacgagctcttcaaacaaacagaggagatgtttgatgagctcgttcaacctggcggcagcgcaaaagatg

SEQ ID NO: 50082 - DNA, 103 bp, Artificial Sequence
  Synthetic Polynucleotide
taatacgactcactatagggagacataaacaacatagtaactaagtaagtaacagaggagaacttacatggttactatgaacctggcggcagcgcaaaagatg

SEQ ID NO: 50083 - DNA, 103 bp, Artificial Sequence
  Synthetic Polynucleotide
taatacgactcactatagggagaaaagacataaacaacatagtaactaagaacagaggagacttagtatgtatgttgttaacctggcggcagcgcaaaagatg

SEQ ID NO: 50084 - DNA, 103 bp, Artificial Sequence
  Synthetic Polynucleotide
taatacgactcactatagggcgcttagaaaagacataaacaacatagtaaaacagaggagattactaatgtgtttatgtaacctggcggcagcgcaaaagatg

SEQ ID NO: 50085 - DNA, 103 bp, Artificial Sequence
  Synthetic Polynucleotide
taatacgactcactatagggtttaccgcttagaaaagacataaacaacataacagaggagaatgttgatgatgtcttttaacctggcggcagcgcaaaagatg

SEQ ID NO: 50086 - DNA, 103 bp, Artificial Sequence
  Synthetic Polynucleotide
taatacgactcactatagggtattatttaccgcttagaaaagacataaacaacagaggagagtttatatgttttctaagaacctggcggcagcgcaaaagatg

SEQ ID NO: 50087 - DNA, 103 bp, Artificial Sequence
  Synthetic Polynucleotide
taatacgactcactatagggcatattattatttaccgcttagaaaagacaaacagaggagatgtcttatgtaagcggtaaacctggcggcagcgcaaaagatg

SEQ ID NO: 50088 - DNA, 103 bp, Artificial Sequence
  Synthetic Polynucleotide
taatacgactcactatagggcataccatattattatttaccgcttagaaaaacagaggagatttctaatgggtaaataaaacctggcggcagcgcaaaagatg

SEQ ID NO: 50089 - DNA, 103 bp, Artificial Sequence
  Synthetic Polynucleotide
taatacgactcactataggggaacccataccatattattatttaccgcttaacagaggagaaagcggatgataataataaacctggcggcagcgcaaaagatg

SEQ ID NO: 50090 - DNA, 103 bp, Artificial Sequence
  Synthetic Polynucleotide
taatacgactcactatagggtatcagaacccataccatattattatttacaacagaggagagtaaatatgaatatggtaaacctggcggcagcgcaaaagatg

SEQ ID NO: 50091 - DNA, 103 bp, Artificial Sequence
  Synthetic Polynucleotide
taatacgactcactatagggggggatatcagaacccataccatattattaaacagaggagataataaatgggtatgggtaacctggcggcagcgcaaaagatg

SEQ ID NO: 50092 - DNA, 103 bp, Artificial Sequence
  Synthetic Polynucleotide
taatacgactcactatagggatttattctgatgatgagaacgagctcttcaacagaggagagaagagatggttctcatcaacctggcggcagcgcaaaagatg

SEQ ID NO: 50093 - DNA, 103 bp, Artificial Sequence
  Synthetic Polynucleotide
taatacgactcactatagggaaaacggggatatcagaacccataccatataacagaggagaatatggatggggttctgaaacctggcggcagcgcaaaagatg

SEQ ID NO: 50094 - DNA, 103 bp, Artificial Sequence
  Synthetic Polynucleotide
taatacgactcactatagggcatttaaaacggggatatcagaacccatacaacagaggagagtatggatgctgatatccaacctggcggcagcgcaaaagatg

SEQ ID NO: 50095 - DNA, 103 bp, Artificial Sequence
  Synthetic Polynucleotide
taatacgactcactatagggtaatgcatttaaaacggggatatcagaaccaacagaggagaggttctatgatccccgttaacctggcggcagcgcaaaagatg

SEQ ID NO: 50096 - DNA, 103 bp, Artificial Sequence
  Synthetic Polynucleotide
taatacgactcactatagggttatttaatgcatttaaaacggggatatcaaacagaggagatgatatatgcgttttaaaaacctggcggcagcgcaaaagatg

SEQ ID NO: 50097 - DNA, 103 bp, Artificial Sequence
  Synthetic Polynucleotide
taatacgactcactatagggtggaattatttaatgcatttaaaacggggaaacagaggagatccccgatgtaaatgcataacctggcggcagcgcaaaagatg

SEQ ID NO: 50098 - DNA, 103 bp, Artificial Sequence
  Synthetic Polynucleotide
taatacgactcactatagggtctattggaattatttaatgcatttaaaacaacagaggagagttttaatggcattaaataacctggcggcagcgcaaaagatg

SEQ ID NO: 50099 - DNA, 103 bp, Artificial Sequence
  Synthetic Polynucleotide
taatacgactcactatagggatcgctctattggaattatttaatgcatttaacagaggagaaaatgcatgaaataattcaacctggcggcagcgcaaaagatg

SEQ ID NO: 50100 - DNA, 103 bp, Artificial Sequence
  Synthetic Polynucleotide
taatacgactcactatagggcaaaaatcgctctattggaattatttaatgaacagaggagacattaaatgattccaataaacctggcggcagcgcaaaagatg

SEQ ID NO: 50101 - DNA, 103 bp, Artificial Sequence
  Synthetic Polynucleotide
taatacgactcactatagggaggaacaaaaatcgctctattggaattattaacagaggagaaataatatgaatagagcgaacctggcggcagcgcaaaagatg

SEQ ID NO: 50102 - DNA, 103 bp, Artificial Sequence
  Synthetic Polynucleotide
taatacgactcactatagggcctataggaacaaaaatcgctctattggaaaacagaggagattccaaatgagcgattttaacctggcggcagcgcaaaagatg

SEQ ID NO: 50103 - DNA, 103 bp, Artificial Sequence
  Synthetic Polynucleotide
taatacgactcactatagggtattgatttattctgatgatgagaacgagcaacagaggagagctcgtatgcatcatcagaacctggcggcagcgcaaaagatg

SEQ ID NO: 50104 - DNA, 103 bp, Artificial Sequence
  Synthetic Polynucleotide
taatacgactcactatagggaaggtcctataggaacaaaaatcgctctataacagaggagaatagagatgtttttgttcaacctggcggcagcgcaaaagatg

SEQ ID NO: 50105 - DNA, 103 bp, Artificial Sequence
  Synthetic Polynucleotide
taatacgactcactataggggttggaaggtcctataggaacaaaaatcgcaacagaggagagcgattatggttcctataaacctggcggcagcgcaaaagatg

SEQ ID NO: 50106 - DNA, 103 bp, Artificial Sequence
  Synthetic Polynucleotide
taatacgactcactatagggccacagttggaaggtcctataggaacaaaaaacagaggagattttgtatgtataggaccaacctggcggcagcgcaaaagatg

SEQ ID NO: 50107 - DNA, 103 bp, Artificial Sequence
  Synthetic Polynucleotide
taatacgactcactatagggagtatccacagttggaaggtcctataggaaaacagaggagattcctaatggaccttccaaacctggcggcagcgcaaaagatg

SEQ ID NO: 50108 - DNA, 103 bp, Artificial Sequence
  Synthetic Polynucleotide
taatacgactcactatagggtacagagtatccacagttggaaggtcctataacagaggagaataggaatgtccaactgtaacctggcggcagcgcaaaagatg

SEQ ID NO: 50109 - DNA, 103 bp, Artificial Sequence
  Synthetic Polynucleotide
taatacgactcactatagggaacaatacagagtatccacagttggaaggtaacagaggagaaccttcatgctgtggataaacctggcggcagcgcaaaagatg

SEQ ID NO: 50110 - DNA, 103 bp, Artificial Sequence
  Synthetic Polynucleotide
taatacgactcactatagggctattaacaatacagagtatccacagttggaacagaggagaccaactatggatactctgaacctggcggcagcgcaaaagatg

SEQ ID NO: 50111 - DNA, 103 bp, Artificial Sequence
  Synthetic Polynucleotide
taatacgactcactatagggtatatctattaacaatacagagtatccacaaacagaggagatgtggaatgtctgtattgaacctggcggcagcgcaaaagatg

SEQ ID NO: 50112 - DNA, 103 bp, Artificial Sequence
  Synthetic Polynucleotide
taatacgactcactatagggattaatatatctattaacaatacagagtataacagaggagaatactcatgattgttaataacctggcggcagcgcaaaagatg

SEQ ID NO: 50113 - DNA, 103 bp, Artificial Sequence
  Synthetic Polynucleotide
taatacgactcactatagggaaagtattaatatatctattaacaatacagaacagaggagactgtatatgtaatagataaacctggcggcagcgcaaaagatg

SEQ ID NO: 50114 - DNA, 103 bp, Artificial Sequence
  Synthetic Polynucleotide
taatacgactcactatagggagagatattgatttattctgatgatgagaaaacagaggagattctcaatgtcagaataaaacctggcggcagcgcaaaagatg

SEQ ID NO: 50115 - DNA, 103 bp, Artificial Sequence
  Synthetic Polynucleotide
taatacgactcactatagggcgacaaaagtattaatatatctattaacaaaacagaggagattgttaatggatatattaaacctggcggcagcgcaaaagatg

SEQ ID NO: 50116 - DNA, 103 bp, Artificial Sequence
  Synthetic Polynucleotide
taatacgactcactatagggttacccgacaaaagtattaatatatctattaacagaggagaaatagaatgattaatactaacctggcggcagcgcaaaagatg

SEQ ID NO: 50117 - DNA, 103 bp, Artificial Sequence
  Synthetic Polynucleotide
taatacgactcactatagggctttgttacccgacaaaagtattaatatataacagaggagaatatatatgtacttttgtaacctggcggcagcgcaaaagatg

SEQ ID NO: 50118 - DNA, 103 bp, Artificial Sequence
  Synthetic Polynucleotide
taatacgactcactatagggagaacctttgttacccgacaaaagtattaaaacagaggagattaataatgttgtcgggtaacctggcggcagcgcaaaagatg

SEQ ID NO: 50119 - DNA, 103 bp, Artificial Sequence
  Synthetic Polynucleotide
taatacgactcactataggggacgtagaacctttgttacccgacaaaagtaacagaggagaacttttatggggtaacaaaacctggcggcagcgcaaaagatg

SEQ ID NO: 50120 - DNA, 103 bp, Artificial Sequence
  Synthetic Polynucleotide
taatacgactcactatagggtagaagacgtagaacctttgttacccgacaaacagaggagatgtcggatgacaaaggttaacctggcggcagcgcaaaagatg

SEQ ID NO: 50121 - DNA, 103 bp, Artificial Sequence
  Synthetic Polynucleotide
taatacgactcactatagggatttttagaagacgtagaacctttgttaccaacagaggagaggtaacatgggttctacgaacctggcggcagcgcaaaagatg

SEQ ID NO: 50122 - DNA, 103 bp, Artificial Sequence
  Synthetic Polynucleotide
taatacgactcactatagggcttttatttttagaagacgtagaacctttgaacagaggagacaaaggatgtacgtcttcaacctggcggcagcgcaaaagatg

SEQ ID NO: 50123 - DNA, 103 bp, Artificial Sequence
  Synthetic Polynucleotide
taatacgactcactatagggtcaaacttttatttttagaagacgtagaacaacagaggagagttctaatgcttctaaaaaacctggcggcagcgcaaaagatg

SEQ ID NO: 50124 - DNA, 103 bp, Artificial Sequence
  Synthetic Polynucleotide
taatacgactcactatagggtgttatcaaacttttatttttagaagacgtaacagaggagaacgtctatgaaaaataaaaacctggcggcagcgcaaaagatg

SEQ ID NO: 50125 - DNA, 103 bp, Artificial Sequence
  Synthetic Polynucleotide
taatacgactcactatagggcattcctcatccacaaccccattaaaaaataacagaggagaatttttatgtggggttgtaacctggcggcagcgcaaaagatg

SEQ ID NO: 50126 - DNA, 103 bp, Artificial Sequence
  Synthetic Polynucleotide
taatacgactcactatagggaaaacagagatattgatttattctgatgataacagaggagaatcatcatgataaatcaaaacctggcggcagcgcaaaagatg

SEQ ID NO: 50127 - DNA, 103 bp, Artificial Sequence
  Synthetic Polynucleotide
taatacgactcactatagggccagatgttatcaaacttttatttttagaaaacagaggagattctaaatgtaaaagtttaacctggcggcagcgcaaaagatg

SEQ ID NO: 50128 - DNA, 103 bp, Artificial Sequence
  Synthetic Polynucleotide
taatacgactcactatagggacaggccagatgttatcaaacttttattttaacagaggagaaaaataatggtttgataaaacctggcggcagcgcaaaagatg

SEQ ID NO: 50129 - DNA, 103 bp, Artificial Sequence
  Synthetic Polynucleotide
taatacgactcactatagggtatgaacaggccagatgttatcaaacttttaacagaggagaaaaagtatgataacatctaacctggcggcagcgcaaaagatg

SEQ ID NO: 50130 - DNA, 103 bp, Artificial Sequence
  Synthetic Polynucleotide
taatacgactcactatagggttatttatgaacaggccagatgttatcaaaaacagaggagatttgatatgatctggcctaacctggcggcagcgcaaaagatg

SEQ ID NO: 50131 - DNA, 103 bp, Artificial Sequence
  Synthetic Polynucleotide
taatacgactcactatagggagtttttatttatgaacaggccagatgttaaacagaggagataacatatggcctgttcaaacctggcggcagcgcaaaagatg

SEQ ID NO: 50132 - DNA, 103 bp, Artificial Sequence
  Synthetic Polynucleotide
taatacgactcactatagggcgccaagtttttatttatgaacaggccagaaacagaggagatctggcatgttcataaataacctggcggcagcgcaaaagatg

SEQ ID NO: 50133 - DNA, 103 bp, Artificial Sequence
  Synthetic Polynucleotide
taatacgactcactatagggagaatcgccaagtttttatttatgaacaggaacagaggagacctgttatgaaataaaaaaacctggcggcagcgcaaaagatg

SEQ ID NO: 50134 - DNA, 103 bp, Artificial Sequence
  Synthetic Polynucleotide
taatacgactcactatagggtatatagaatcgccaagtttttatttatgaaacagaggagatcataaatgaaaacttggaacctggcggcagcgcaaaagatg

SEQ ID NO: 50135 - DNA, 103 bp, Artificial Sequence
  Synthetic Polynucleotide
taatacgactcactataggggagtatatatagaatcgccaagtttttattaacagaggagaaataaaatgttggcgattaacctggcggcagcgcaaaagatg

SEQ ID NO: 50136 - DNA, 103 bp, Artificial Sequence
  Synthetic Polynucleotide
taatacgactcactatagggaataagagtatatatagaatcgccaagtttaacagaggagaaaacttatggattctataaacctggcggcagcgcaaaagatg

SEQ ID NO: 50137 - DNA, 103 bp, Artificial Sequence
  Synthetic Polynucleotide
taatacgactcactatagggacaaaaaaacagagatattgatttattctgaacagaggagacagaatatgtcaatatctaacctggcggcagcgcaaaagatg

SEQ ID NO: 50138 - DNA, 103 bp, Artificial Sequence
  Synthetic Polynucleotide
taatacgactcactatagggttgataataagagtatatatagaatcgccaaacagaggagatggcgaatgtatatatacaacctggcggcagcgcaaaagatg

SEQ ID NO: 50139 - DNA, 103 bp, Artificial Sequence
  Synthetic Polynucleotide
taatacgactcactatagggtagatttgataataagagtatatatagaataacagaggagaattctaatgatactcttaaacctggcggcagcgcaaaagatg

SEQ ID NO: 50140 - DNA, 103 bp, Artificial Sequence
  Synthetic Polynucleotide
taatacgactcactatagggatggctagatttgataataagagtatatataacagaggagaatatatatgcttattatcaacctggcggcagcgcaaaagatg

SEQ ID NO: 50141 - DNA, 103 bp, Artificial Sequence
  Synthetic Polynucleotide
taatacgactcactatagggagacaatggctagatttgataataagagtaaacagaggagatactctatgtatcaaatcaacctggcggcagcgcaaaagatg

SEQ ID NO: 50142 - DNA, 103 bp, Artificial Sequence
  Synthetic Polynucleotide
taatacgactcactatagggctataagacaatggctagatttgataataaaacagaggagattattaatgaatctagccaacctggcggcagcgcaaaagatg

SEQ ID NO: 50143 - DNA, 103 bp, Artificial Sequence
  Synthetic Polynucleotide
taatacgactcactatagggcacatctataagacaatggctagatttgataacagaggagaatcaaaatgagccattgtaacctggcggcagcgcaaaagatg

SEQ ID NO: 50144 - DNA, 103 bp, Artificial Sequence
  Synthetic Polynucleotide
taatacgactcactatagggtagctcacatctataagacaatggctagataacagaggagaatctagatgttgtcttataacctggcggcagcgcaaaagatg

SEQ ID NO: 50145 - DNA, 103 bp, Artificial Sequence
  Synthetic Polynucleotide
taatacgactcactatagggtacagtagctcacatctataagacaatggcaacagaggagagccattatgttatagatgaacctggcggcagcgcaaaagatg
